United States Patent 10,058,623 (COMPOSITIONS AND METHODS FOR MODULATING UTRN EXPRESSION) - sequence listing, part 5

SEQ ID NO: 114717 - DNA, 15 bp, Homo sapiens
ttgtattgatttttt

SEQ ID NO: 114718 - DNA, 15 bp, Homo sapiens
cttgtattgattttt

SEQ ID NO: 114719 - DNA, 15 bp, Homo sapiens
ctcttgtattgattt

SEQ ID NO: 114720 - DNA, 15 bp, Homo sapiens
actcttgtattgatt

SEQ ID NO: 114721 - DNA, 15 bp, Homo sapiens
aactcttgtattgat

SEQ ID NO: 114722 - DNA, 15 bp, Homo sapiens
aaactcttgtattga

SEQ ID NO: 114723 - DNA, 15 bp, Homo sapiens
aaaactcttgtattg

SEQ ID NO: 114724 - DNA, 15 bp, Homo sapiens
gaaaactcttgtatt

SEQ ID NO: 114725 - DNA, 15 bp, Homo sapiens
agaaaactcttgtat

SEQ ID NO: 114726 - DNA, 15 bp, Homo sapiens
aagaaaactcttgta

SEQ ID NO: 114727 - DNA, 15 bp, Homo sapiens
aaagaaaactcttgt

SEQ ID NO: 114728 - DNA, 15 bp, Homo sapiens
taaagaaaactcttg

SEQ ID NO: 114729 - DNA, 15 bp, Homo sapiens
ttaaagaaaactctt

SEQ ID NO: 114730 - DNA, 15 bp, Homo sapiens
gttaaagaaaactct

SEQ ID NO: 114731 - DNA, 15 bp, Homo sapiens
ggttaaagaaaactc

SEQ ID NO: 114732 - DNA, 15 bp, Homo sapiens
gggttaaagaaaact

SEQ ID NO: 114733 - DNA, 15 bp, Homo sapiens
agggttaaagaaaac

SEQ ID NO: 114734 - DNA, 15 bp, Homo sapiens
cagggttaaagaaaa

SEQ ID NO: 114735 - DNA, 15 bp, Homo sapiens
acagggttaaagaaa

SEQ ID NO: 114736 - DNA, 15 bp, Homo sapiens
tacagggttaaagaa

SEQ ID NO: 114737 - DNA, 15 bp, Homo sapiens
gtacagggttaaaga

SEQ ID NO: 114738 - DNA, 15 bp, Homo sapiens
agtacagggttaaag

SEQ ID NO: 114739 - DNA, 15 bp, Homo sapiens
aagtacagggttaaa

SEQ ID NO: 114740 - DNA, 15 bp, Homo sapiens
aaagtacagggttaa

SEQ ID NO: 114741 - DNA, 15 bp, Homo sapiens
caaagtacagggtta

SEQ ID NO: 114742 - DNA, 15 bp, Homo sapiens
tcaaagtacagggtt

SEQ ID NO: 114743 - DNA, 15 bp, Homo sapiens
ttcaaagtacagggt

SEQ ID NO: 114744 - DNA, 15 bp, Homo sapiens
tttcaaagtacaggg

SEQ ID NO: 114745 - DNA, 15 bp, Homo sapiens
atttcaaagtacagg

SEQ ID NO: 114746 - DNA, 15 bp, Homo sapiens
gatttcaaagtacag

SEQ ID NO: 114747 - DNA, 15 bp, Homo sapiens
tgatttcaaagtaca

SEQ ID NO: 114748 - DNA, 15 bp, Homo sapiens
gtgatttcaaagtac

SEQ ID NO: 114749 - DNA, 15 bp, Homo sapiens
tgtgatttcaaagta

SEQ ID NO: 114750 - DNA, 15 bp, Homo sapiens
ctgtgatttcaaagt

SEQ ID NO: 114751 - DNA, 15 bp, Homo sapiens
tctgtgatttcaaag

SEQ ID NO: 114752 - DNA, 15 bp, Homo sapiens
ctctgtgatttcaaa

SEQ ID NO: 114753 - DNA, 15 bp, Homo sapiens
tctctgtgatttcaa

SEQ ID NO: 114754 - DNA, 15 bp, Homo sapiens
atctctgtgatttca

SEQ ID NO: 114755 - DNA, 15 bp, Homo sapiens
aatctctgtgatttc

SEQ ID NO: 114756 - DNA, 15 bp, Homo sapiens
taatctctgtgattt

SEQ ID NO: 114757 - DNA, 15 bp, Homo sapiens
ctaatctctgtgatt

SEQ ID NO: 114758 - DNA, 15 bp, Homo sapiens
tctaatctctgtgat

SEQ ID NO: 114759 - DNA, 15 bp, Homo sapiens
ttctaatctctgtga

SEQ ID NO: 114760 - DNA, 15 bp, Homo sapiens
tttctaatctctgtg

SEQ ID NO: 114761 - DNA, 15 bp, Homo sapiens
ctttctaatctctgt

SEQ ID NO: 114762 - DNA, 15 bp, Homo sapiens
actttctaatctctg

SEQ ID NO: 114763 - DNA, 15 bp, Homo sapiens
aactttctaatctct

SEQ ID NO: 114764 - DNA, 15 bp, Homo sapiens
caactttctaatctc

SEQ ID NO: 114765 - DNA, 15 bp, Homo sapiens
tcaactttctaatct

SEQ ID NO: 114766 - DNA, 15 bp, Homo sapiens
atcaactttctaatc

SEQ ID NO: 114767 - DNA, 15 bp, Homo sapiens
aatcaactttctaat

SEQ ID NO: 114768 - DNA, 15 bp, Homo sapiens
aaatcaactttctaa

SEQ ID NO: 114769 - DNA, 15 bp, Homo sapiens
caaatcaactttcta

SEQ ID NO: 114770 - DNA, 15 bp, Homo sapiens
gcaaatcaactttct

SEQ ID NO: 114771 - DNA, 15 bp, Homo sapiens
agcaaatcaactttc

SEQ ID NO: 114772 - DNA, 15 bp, Homo sapiens
cagcaaatcaacttt

SEQ ID NO: 114773 - DNA, 15 bp, Homo sapiens
ccagcaaatcaactt

SEQ ID NO: 114774 - DNA, 15 bp, Homo sapiens
accagcaaatcaact

SEQ ID NO: 114775 - DNA, 15 bp, Homo sapiens
aaccagcaaatcaac

SEQ ID NO: 114776 - DNA, 15 bp, Homo sapiens
gaaccagcaaatcaa

SEQ ID NO: 114777 - DNA, 15 bp, Homo sapiens
agaaccagcaaatca

SEQ ID NO: 114778 - DNA, 15 bp, Homo sapiens
cagaaccagcaaatc

SEQ ID NO: 114779 - DNA, 15 bp, Homo sapiens
ccagaaccagcaaat

SEQ ID NO: 114780 - DNA, 15 bp, Homo sapiens
gccagaaccagcaaa

SEQ ID NO: 114781 - DNA, 15 bp, Homo sapiens
agccagaaccagcaa

SEQ ID NO: 114782 - DNA, 15 bp, Homo sapiens
aagccagaaccagca

SEQ ID NO: 114783 - DNA, 15 bp, Homo sapiens
gaagccagaaccagc

SEQ ID NO: 114784 - DNA, 15 bp, Homo sapiens
agaagccagaaccag

SEQ ID NO: 114785 - DNA, 15 bp, Homo sapiens
cagaagccagaacca

SEQ ID NO: 114786 - DNA, 15 bp, Homo sapiens
gcagaagccagaacc

SEQ ID NO: 114787 - DNA, 15 bp, Homo sapiens
tgcagaagccagaac

SEQ ID NO: 114788 - DNA, 15 bp, Homo sapiens
ctgcagaagccagaa

SEQ ID NO: 114789 - DNA, 15 bp, Homo sapiens
actgcagaagccaga

SEQ ID NO: 114790 - DNA, 15 bp, Homo sapiens
tactgcagaagccag

SEQ ID NO: 114791 - DNA, 15 bp, Homo sapiens
ctactgcagaagcca

SEQ ID NO: 114792 - DNA, 15 bp, Homo sapiens
tctactgcagaagcc

SEQ ID NO: 114793 - DNA, 15 bp, Homo sapiens
ctctactgcagaagc

SEQ ID NO: 114794 - DNA, 15 bp, Homo sapiens
tctctactgcagaag

SEQ ID NO: 114795 - DNA, 15 bp, Homo sapiens
ttctctactgcagaa

SEQ ID NO: 114796 - DNA, 15 bp, Homo sapiens
tttctctactgcaga

SEQ ID NO: 114797 - DNA, 15 bp, Homo sapiens
ctttctctactgcag

SEQ ID NO: 114798 - DNA, 15 bp, Homo sapiens
tctttctctactgca

SEQ ID NO: 114799 - DNA, 15 bp, Homo sapiens
ttctttctctactgc

SEQ ID NO: 114800 - DNA, 15 bp, Homo sapiens
attctttctctactg

SEQ ID NO: 114801 - DNA, 15 bp, Homo sapiens
aattctttctctact

SEQ ID NO: 114802 - DNA, 15 bp, Homo sapiens
caattctttctctac

SEQ ID NO: 114803 - DNA, 15 bp, Homo sapiens
tcaattctttctcta

SEQ ID NO: 114804 - DNA, 15 bp, Homo sapiens
ttcaattctttctct

SEQ ID NO: 114805 - DNA, 15 bp, Homo sapiens
attcaattctttctc

SEQ ID NO: 114806 - DNA, 15 bp, Homo sapiens
cattcaattctttct

SEQ ID NO: 114807 - DNA, 15 bp, Homo sapiens
ccattcaattctttc

SEQ ID NO: 114808 - DNA, 15 bp, Homo sapiens
tccattcaattcttt

SEQ ID NO: 114809 - DNA, 15 bp, Homo sapiens
ttccattcaattctt

SEQ ID NO: 114810 - DNA, 15 bp, Homo sapiens
gttccattcaattct

SEQ ID NO: 114811 - DNA, 15 bp, Homo sapiens
tgttccattcaattc

SEQ ID NO: 114812 - DNA, 15 bp, Homo sapiens
atgttccattcaatt

SEQ ID NO: 114813 - DNA, 15 bp, Homo sapiens
catgttccattcaat

SEQ ID NO: 114814 - DNA, 15 bp, Homo sapiens
tcatgttccattcaa

SEQ ID NO: 114815 - DNA, 15 bp, Homo sapiens
ctcatgttccattca

SEQ ID NO: 114816 - DNA, 15 bp, Homo sapiens
actcatgttccattc

SEQ ID NO: 114817 - DNA, 15 bp, Homo sapiens
cactcatgttccatt

SEQ ID NO: 114818 - DNA, 15 bp, Homo sapiens
ccactcatgttccat

SEQ ID NO: 114819 - DNA, 15 bp, Homo sapiens
accactcatgttcca

SEQ ID NO: 114820 - DNA, 15 bp, Homo sapiens
aaccactcatgttcc

SEQ ID NO: 114821 - DNA, 15 bp, Homo sapiens
gaaccactcatgttc

SEQ ID NO: 114822 - DNA, 15 bp, Homo sapiens
agaaccactcatgtt

SEQ ID NO: 114823 - DNA, 15 bp, Homo sapiens
aagaaccactcatgt

SEQ ID NO: 114824 - DNA, 15 bp, Homo sapiens
aaagaaccactcatg

SEQ ID NO: 114825 - DNA, 15 bp, Homo sapiens
aaaagaaccactcat

SEQ ID NO: 114826 - DNA, 15 bp, Homo sapiens
taaaagaaccactca

SEQ ID NO: 114827 - DNA, 15 bp, Homo sapiens
ttaaaagaaccactc

SEQ ID NO: 114828 - DNA, 15 bp, Homo sapiens
gttaaaagaaccact

SEQ ID NO: 114829 - DNA, 15 bp, Homo sapiens
tgttaaaagaaccac

SEQ ID NO: 114830 - DNA, 15 bp, Homo sapiens
ttgttaaaagaacca

SEQ ID NO: 114831 - DNA, 15 bp, Homo sapiens
cttgttaaaagaacc

SEQ ID NO: 114832 - DNA, 15 bp, Homo sapiens
ccttgttaaaagaac

SEQ ID NO: 114833 - DNA, 15 bp, Homo sapiens
gccttgttaaaagaa

SEQ ID NO: 114834 - DNA, 15 bp, Homo sapiens
tgccttgttaaaaga

SEQ ID NO: 114835 - DNA, 15 bp, Homo sapiens
atgccttgttaaaag

SEQ ID NO: 114836 - DNA, 15 bp, Homo sapiens
aatgccttgttaaaa

SEQ ID NO: 114837 - DNA, 15 bp, Homo sapiens
gaatgccttgttaaa

SEQ ID NO: 114838 - DNA, 15 bp, Homo sapiens
agaatgccttgttaa

SEQ ID NO: 114839 - DNA, 15 bp, Homo sapiens
cagaatgccttgtta

SEQ ID NO: 114840 - DNA, 15 bp, Homo sapiens
acagaatgccttgtt

SEQ ID NO: 114841 - DNA, 15 bp, Homo sapiens
aacagaatgccttgt

SEQ ID NO: 114842 - DNA, 15 bp, Homo sapiens
aaacagaatgccttg

SEQ ID NO: 114843 - DNA, 15 bp, Homo sapiens
aaaacagaatgcctt

SEQ ID NO: 114844 - DNA, 15 bp, Homo sapiens
gaaaacagaatgcct

SEQ ID NO: 114845 - DNA, 15 bp, Homo sapiens
ggaaaacagaatgcc

SEQ ID NO: 114846 - DNA, 15 bp, Homo sapiens
aggaaaacagaatgc

SEQ ID NO: 114847 - DNA, 15 bp, Homo sapiens
taggaaaacagaatg

SEQ ID NO: 114848 - DNA, 15 bp, Homo sapiens
ttaggaaaacagaat

SEQ ID NO: 114849 - DNA, 15 bp, Homo sapiens
tttaggaaaacagaa

SEQ ID NO: 114850 - DNA, 15 bp, Homo sapiens
atttaggaaaacaga

SEQ ID NO: 114851 - DNA, 15 bp, Homo sapiens
gatttaggaaaacag

SEQ ID NO: 114852 - DNA, 15 bp, Homo sapiens
agatttaggaaaaca

SEQ ID NO: 114853 - DNA, 15 bp, Homo sapiens
gagatttaggaaaac

SEQ ID NO: 114854 - DNA, 15 bp, Homo sapiens
agagatttaggaaaa

SEQ ID NO: 114855 - DNA, 15 bp, Homo sapiens
aagagatttaggaaa

SEQ ID NO: 114856 - DNA, 15 bp, Homo sapiens
aaagagatttaggaa

SEQ ID NO: 114857 - DNA, 15 bp, Homo sapiens
gaaagagatttagga

SEQ ID NO: 114858 - DNA, 15 bp, Homo sapiens
ggaaagagatttagg

SEQ ID NO: 114859 - DNA, 15 bp, Homo sapiens
aggaaagagatttag

SEQ ID NO: 114860 - DNA, 15 bp, Homo sapiens
caggaaagagattta

SEQ ID NO: 114861 - DNA, 15 bp, Homo sapiens
tcaggaaagagattt

SEQ ID NO: 114862 - DNA, 15 bp, Homo sapiens
ctcaggaaagagatt

SEQ ID NO: 114863 - DNA, 15 bp, Homo sapiens
tctcaggaaagagat

SEQ ID NO: 114864 - DNA, 15 bp, Homo sapiens
ttctcaggaaagaga

SEQ ID NO: 114865 - DNA, 15 bp, Homo sapiens
tttctcaggaaagag

SEQ ID NO: 114866 - DNA, 15 bp, Homo sapiens
ctttctcaggaaaga

SEQ ID NO: 114867 - DNA, 15 bp, Homo sapiens
tctttctcaggaaag

SEQ ID NO: 114868 - DNA, 15 bp, Homo sapiens
ttctttctcaggaaa

SEQ ID NO: 114869 - DNA, 15 bp, Homo sapiens
cttctttctcaggaa

SEQ ID NO: 114870 - DNA, 15 bp, Homo sapiens
gcttctttctcagga

SEQ ID NO: 114871 - DNA, 15 bp, Homo sapiens
cgcttctttctcagg

SEQ ID NO: 114872 - DNA, 15 bp, Homo sapiens
tcgcttctttctcag

SEQ ID NO: 114873 - DNA, 15 bp, Homo sapiens
ctcgcttctttctca

SEQ ID NO: 114874 - DNA, 15 bp, Homo sapiens
actcgcttctttctc

SEQ ID NO: 114875 - DNA, 15 bp, Homo sapiens
tactcgcttctttct

SEQ ID NO: 114876 - DNA, 15 bp, Homo sapiens
atactcgcttctttc

SEQ ID NO: 114877 - DNA, 15 bp, Homo sapiens
tatactcgcttcttt

SEQ ID NO: 114878 - DNA, 15 bp, Homo sapiens
gtatactcgcttctt

SEQ ID NO: 114879 - DNA, 15 bp, Homo sapiens
agtatactcgcttct

SEQ ID NO: 114880 - DNA, 15 bp, Homo sapiens
tagtatactcgcttc

SEQ ID NO: 114881 - DNA, 15 bp, Homo sapiens
ctagtatactcgctt

SEQ ID NO: 114882 - DNA, 15 bp, Homo sapiens
actagtatactcgct

SEQ ID NO: 114883 - DNA, 15 bp, Homo sapiens
cactagtatactcgc

SEQ ID NO: 114884 - DNA, 15 bp, Homo sapiens
ccactagtatactcg

SEQ ID NO: 114885 - DNA, 15 bp, Homo sapiens
cccactagtatactc

SEQ ID NO: 114886 - DNA, 15 bp, Homo sapiens
tcccactagtatact

SEQ ID NO: 114887 - DNA, 15 bp, Homo sapiens
ttcccactagtatac

SEQ ID NO: 114888 - DNA, 15 bp, Homo sapiens
cttcccactagtata

SEQ ID NO: 114889 - DNA, 15 bp, Homo sapiens
acttcccactagtat

SEQ ID NO: 114890 - DNA, 15 bp, Homo sapiens
cacttcccactagta

SEQ ID NO: 114891 - DNA, 15 bp, Homo sapiens
gcacttcccactagt

SEQ ID NO: 114892 - DNA, 15 bp, Homo sapiens
agcacttcccactag

SEQ ID NO: 114893 - DNA, 15 bp, Homo sapiens
cagcacttcccacta

SEQ ID NO: 114894 - DNA, 15 bp, Homo sapiens
tcagcacttcccact

SEQ ID NO: 114895 - DNA, 15 bp, Homo sapiens
ttcagcacttcccac

SEQ ID NO: 114896 - DNA, 15 bp, Homo sapiens
attcagcacttccca

SEQ ID NO: 114897 - DNA, 15 bp, Homo sapiens
tattcagcacttccc

SEQ ID NO: 114898 - DNA, 15 bp, Homo sapiens
atattcagcacttcc

SEQ ID NO: 114899 - DNA, 15 bp, Homo sapiens
tatattcagcacttc

SEQ ID NO: 114900 - DNA, 15 bp, Homo sapiens
ttatattcagcactt

SEQ ID NO: 114901 - DNA, 15 bp, Homo sapiens
tttatattcagcact

SEQ ID NO: 114902 - DNA, 15 bp, Homo sapiens
atttatattcagcac

SEQ ID NO: 114903 - DNA, 15 bp, Homo sapiens
catttatattcagca

SEQ ID NO: 114904 - DNA, 15 bp, Homo sapiens
tcatttatattcagc

SEQ ID NO: 114905 - DNA, 15 bp, Homo sapiens
atcatttatattcag

SEQ ID NO: 114906 - DNA, 15 bp, Homo sapiens
gatcatttatattca

SEQ ID NO: 114907 - DNA, 15 bp, Homo sapiens
tgatcatttatattc

SEQ ID NO: 114908 - DNA, 15 bp, Homo sapiens
ttgatcatttatatt

SEQ ID NO: 114909 - DNA, 15 bp, Homo sapiens
attgatcatttatat

SEQ ID NO: 114910 - DNA, 15 bp, Homo sapiens
tattgatcatttata

SEQ ID NO: 114911 - DNA, 15 bp, Homo sapiens
gtattgatcatttat

SEQ ID NO: 114912 - DNA, 15 bp, Homo sapiens
agtattgatcattta

SEQ ID NO: 114913 - DNA, 15 bp, Homo sapiens
cagtattgatcattt

SEQ ID NO: 114914 - DNA, 15 bp, Homo sapiens
acagtattgatcatt

SEQ ID NO: 114915 - DNA, 15 bp, Homo sapiens
cacagtattgatcat

SEQ ID NO: 114916 - DNA, 15 bp, Homo sapiens
tcacagtattgatca

SEQ ID NO: 114917 - DNA, 15 bp, Homo sapiens
gtcacagtattgatc

SEQ ID NO: 114918 - DNA, 15 bp, Homo sapiens
agtcacagtattgat

SEQ ID NO: 114919 - DNA, 15 bp, Homo sapiens
cagtcacagtattga

SEQ ID NO: 114920 - DNA, 15 bp, Homo sapiens
tcagtcacagtattg

SEQ ID NO: 114921 - DNA, 15 bp, Homo sapiens
atcagtcacagtatt

SEQ ID NO: 114922 - DNA, 15 bp, Homo sapiens
catcagtcacagtat

SEQ ID NO: 114923 - DNA, 15 bp, Homo sapiens
acatcagtcacagta

SEQ ID NO: 114924 - DNA, 15 bp, Homo sapiens
aacatcagtcacagt

SEQ ID NO: 114925 - DNA, 15 bp, Homo sapiens
aaacatcagtcacag

SEQ ID NO: 114926 - DNA, 15 bp, Homo sapiens
taaacatcagtcaca

SEQ ID NO: 114927 - DNA, 15 bp, Homo sapiens
ataaacatcagtcac

SEQ ID NO: 114928 - DNA, 15 bp, Homo sapiens
tataaacatcagtca

SEQ ID NO: 114929 - DNA, 15 bp, Homo sapiens
atataaacatcagtc

SEQ ID NO: 114930 - DNA, 15 bp, Homo sapiens
tatataaacatcagt

SEQ ID NO: 114931 - DNA, 15 bp, Homo sapiens
ttatataaacatcag

SEQ ID NO: 114932 - DNA, 15 bp, Homo sapiens
tttatataaacatca

SEQ ID NO: 114933 - DNA, 15 bp, Homo sapiens
ctttatataaacatc

SEQ ID NO: 114934 - DNA, 15 bp, Homo sapiens
gctttatataaacat

SEQ ID NO: 114935 - DNA, 15 bp, Homo sapiens
ggctttatataaaca

SEQ ID NO: 114936 - DNA, 15 bp, Homo sapiens
tggctttatataaac

SEQ ID NO: 114937 - DNA, 15 bp, Homo sapiens
gtggctttatataaa

SEQ ID NO: 114938 - DNA, 15 bp, Homo sapiens
tgtggctttatataa

SEQ ID NO: 114939 - DNA, 15 bp, Homo sapiens
ttgtggctttatata

SEQ ID NO: 114940 - DNA, 15 bp, Homo sapiens
cttgtggctttatat

SEQ ID NO: 114941 - DNA, 15 bp, Homo sapiens
acttgtggctttata

SEQ ID NO: 114942 - DNA, 15 bp, Homo sapiens
tacttgtggctttat

SEQ ID NO: 114943 - DNA, 15 bp, Homo sapiens
atacttgtggcttta

SEQ ID NO: 114944 - DNA, 15 bp, Homo sapiens
gatacttgtggcttt

SEQ ID NO: 114945 - DNA, 15 bp, Homo sapiens
tgatacttgtggctt

SEQ ID NO: 114946 - DNA, 15 bp, Homo sapiens
ctgatacttgtggct

SEQ ID NO: 114947 - DNA, 15 bp, Homo sapiens
actgatacttgtggc

SEQ ID NO: 114948 - DNA, 15 bp, Homo sapiens
aactgatacttgtgg

SEQ ID NO: 114949 - DNA, 15 bp, Homo sapiens
aaactgatacttgtg

SEQ ID NO: 114950 - DNA, 15 bp, Homo sapiens
caaactgatacttgt

SEQ ID NO: 114951 - DNA, 15 bp, Homo sapiens
tcaaactgatacttg

SEQ ID NO: 114952 - DNA, 15 bp, Homo sapiens
gtcaaactgatactt

SEQ ID NO: 114953 - DNA, 15 bp, Homo sapiens
tgtcaaactgatact

SEQ ID NO: 114954 - DNA, 15 bp, Homo sapiens
gtgtcaaactgatac

SEQ ID NO: 114955 - DNA, 15 bp, Homo sapiens
ggtgtcaaactgata

SEQ ID NO: 114956 - DNA, 15 bp, Homo sapiens
gggtgtcaaactgat

SEQ ID NO: 114957 - DNA, 15 bp, Homo sapiens
agggtgtcaaactga

SEQ ID NO: 114958 - DNA, 15 bp, Homo sapiens
gagggtgtcaaactg

SEQ ID NO: 114959 - DNA, 15 bp, Homo sapiens
agagggtgtcaaact

SEQ ID NO: 114960 - DNA, 15 bp, Homo sapiens
tagagggtgtcaaac

SEQ ID NO: 114961 - DNA, 15 bp, Homo sapiens
gtagagggtgtcaaa

SEQ ID NO: 114962 - DNA, 15 bp, Homo sapiens
tgtagagggtgtcaa

SEQ ID NO: 114963 - DNA, 15 bp, Homo sapiens
ctgtagagggtgtca

SEQ ID NO: 114964 - DNA, 15 bp, Homo sapiens
gctgtagagggtgtc

SEQ ID NO: 114965 - DNA, 15 bp, Homo sapiens
agctgtagagggtgt

SEQ ID NO: 114966 - DNA, 15 bp, Homo sapiens
gagctgtagagggtg

SEQ ID NO: 114967 - DNA, 15 bp, Homo sapiens
agagctgtagagggt

SEQ ID NO: 114968 - DNA, 15 bp, Homo sapiens
tagagctgtagaggg

SEQ ID NO: 114969 - DNA, 15 bp, Homo sapiens
gtagagctgtagagg

SEQ ID NO: 114970 - DNA, 15 bp, Homo sapiens
tgtagagctgtagag

SEQ ID NO: 114971 - DNA, 15 bp, Homo sapiens
gtgtagagctgtaga

SEQ ID NO: 114972 - DNA, 15 bp, Homo sapiens
cgtgtagagctgtag

SEQ ID NO: 114973 - DNA, 15 bp, Homo sapiens
acgtgtagagctgta

SEQ ID NO: 114974 - DNA, 15 bp, Homo sapiens
aacgtgtagagctgt

SEQ ID NO: 114975 - DNA, 15 bp, Homo sapiens
aaacgtgtagagctg

SEQ ID NO: 114976 - DNA, 15 bp, Homo sapiens
caaacgtgtagagct

SEQ ID NO: 114977 - DNA, 15 bp, Homo sapiens
gcaaacgtgtagagc

SEQ ID NO: 114978 - DNA, 15 bp, Homo sapiens
agcaaacgtgtagag

SEQ ID NO: 114979 - DNA, 15 bp, Homo sapiens
cagcaaacgtgtaga

SEQ ID NO: 114980 - DNA, 15 bp, Homo sapiens
acagcaaacgtgtag

SEQ ID NO: 114981 - DNA, 15 bp, Homo sapiens
cacagcaaacgtgta

SEQ ID NO: 114982 - DNA, 15 bp, Homo sapiens
ccacagcaaacgtgt

SEQ ID NO: 114983 - DNA, 15 bp, Homo sapiens
cccacagcaaacgtg

SEQ ID NO: 114984 - DNA, 15 bp, Homo sapiens
gcccacagcaaacgt

SEQ ID NO: 114985 - DNA, 15 bp, Homo sapiens
ggcccacagcaaacg

SEQ ID NO: 114986 - DNA, 15 bp, Homo sapiens
aggcccacagcaaac

SEQ ID NO: 114987 - DNA, 15 bp, Homo sapiens
aaggcccacagcaaa

SEQ ID NO: 114988 - DNA, 15 bp, Homo sapiens
caaggcccacagcaa

SEQ ID NO: 114989 - DNA, 15 bp, Homo sapiens
tcaaggcccacagca

SEQ ID NO: 114990 - DNA, 15 bp, Homo sapiens
ctcaaggcccacagc

SEQ ID NO: 114991 - DNA, 15 bp, Homo sapiens
cctcaaggcccacag

SEQ ID NO: 114992 - DNA, 15 bp, Homo sapiens
tcctcaaggcccaca

SEQ ID NO: 114993 - DNA, 15 bp, Homo sapiens
ctcctcaaggcccac

SEQ ID NO: 114994 - DNA, 15 bp, Homo sapiens
tctcctcaaggccca

SEQ ID NO: 114995 - DNA, 15 bp, Homo sapiens
ttctcctcaaggccc

SEQ ID NO: 114996 - DNA, 15 bp, Homo sapiens
cttctcctcaaggcc

SEQ ID NO: 114997 - DNA, 15 bp, Homo sapiens
ccttctcctcaaggc

SEQ ID NO: 114998 - DNA, 15 bp, Homo sapiens
accttctcctcaagg

SEQ ID NO: 114999 - DNA, 15 bp, Homo sapiens
caccttctcctcaag

SEQ ID NO: 115000 - DNA, 15 bp, Homo sapiens
gcaccttctcctcaa

SEQ ID NO: 115001 - DNA, 15 bp, Homo sapiens
agcaccttctcctca

SEQ ID NO: 115002 - DNA, 15 bp, Homo sapiens
cagcaccttctcctc

SEQ ID NO: 115003 - DNA, 15 bp, Homo sapiens
tcagcaccttctcct

SEQ ID NO: 115004 - DNA, 15 bp, Homo sapiens
ctcagcaccttctcc

SEQ ID NO: 115005 - DNA, 15 bp, Homo sapiens
tctcagcaccttctc

SEQ ID NO: 115006 - DNA, 15 bp, Homo sapiens
ctctcagcaccttct

SEQ ID NO: 115007 - DNA, 15 bp, Homo sapiens
cctctcagcaccttc

SEQ ID NO: 115008 - DNA, 15 bp, Homo sapiens
acctctcagcacctt

SEQ ID NO: 115009 - DNA, 15 bp, Homo sapiens
aacctctcagcacct

SEQ ID NO: 115010 - DNA, 15 bp, Homo sapiens
caacctctcagcacc

SEQ ID NO: 115011 - DNA, 15 bp, Homo sapiens
acaacctctcagcac

SEQ ID NO: 115012 - DNA, 15 bp, Homo sapiens
cacaacctctcagca

SEQ ID NO: 115013 - DNA, 15 bp, Homo sapiens
ccacaacctctcagc

SEQ ID NO: 115014 - DNA, 15 bp, Homo sapiens
cccacaacctctcag

SEQ ID NO: 115015 - DNA, 15 bp, Homo sapiens
ccccacaacctctca

SEQ ID NO: 115016 - DNA, 15 bp, Homo sapiens
accccacaacctctc

SEQ ID NO: 115017 - DNA, 15 bp, Homo sapiens
caccccacaacctct

SEQ ID NO: 115018 - DNA, 15 bp, Homo sapiens
tcaccccacaacctc

SEQ ID NO: 115019 - DNA, 15 bp, Homo sapiens
gtcaccccacaacct

SEQ ID NO: 115020 - DNA, 15 bp, Homo sapiens
tgtcaccccacaacc

SEQ ID NO: 115021 - DNA, 15 bp, Homo sapiens
gtgtcaccccacaac

SEQ ID NO: 115022 - DNA, 15 bp, Homo sapiens
tgtgtcaccccacaa

SEQ ID NO: 115023 - DNA, 15 bp, Homo sapiens
ttgtgtcaccccaca

SEQ ID NO: 115024 - DNA, 15 bp, Homo sapiens
gttgtgtcaccccac

SEQ ID NO: 115025 - DNA, 15 bp, Homo sapiens
agttgtgtcacccca

SEQ ID NO: 115026 - DNA, 15 bp, Homo sapiens
gagttgtgtcacccc

SEQ ID NO: 115027 - DNA, 15 bp, Homo sapiens
ggagttgtgtcaccc

SEQ ID NO: 115028 - DNA, 15 bp, Homo sapiens
aggagttgtgtcacc

SEQ ID NO: 115029 - DNA, 15 bp, Homo sapiens
caggagttgtgtcac

SEQ ID NO: 115030 - DNA, 15 bp, Homo sapiens
gcaggagttgtgtca

SEQ ID NO: 115031 - DNA, 15 bp, Homo sapiens
agcaggagttgtgtc

SEQ ID NO: 115032 - DNA, 15 bp, Homo sapiens
aagcaggagttgtgt

SEQ ID NO: 115033 - DNA, 15 bp, Homo sapiens
taagcaggagttgtg

SEQ ID NO: 115034 - DNA, 15 bp, Homo sapiens
gtaagcaggagttgt

SEQ ID NO: 115035 - DNA, 15 bp, Homo sapiens
agtaagcaggagttg

SEQ ID NO: 115036 - DNA, 15 bp, Homo sapiens
aagtaagcaggagtt

SEQ ID NO: 115037 - DNA, 15 bp, Homo sapiens
aaagtaagcaggagt

SEQ ID NO: 115038 - DNA, 15 bp, Homo sapiens
caaagtaagcaggag

SEQ ID NO: 115039 - DNA, 15 bp, Homo sapiens
tcaaagtaagcagga

SEQ ID NO: 115040 - DNA, 15 bp, Homo sapiens
ttcaaagtaagcagg

SEQ ID NO: 115041 - DNA, 15 bp, Homo sapiens
attcaaagtaagcag

SEQ ID NO: 115042 - DNA, 15 bp, Homo sapiens
cattcaaagtaagca

SEQ ID NO: 115043 - DNA, 15 bp, Homo sapiens
gcattcaaagtaagc

SEQ ID NO: 115044 - DNA, 15 bp, Homo sapiens
agcattcaaagtaag

SEQ ID NO: 115045 - DNA, 15 bp, Homo sapiens
gagcattcaaagtaa

SEQ ID NO: 115046 - DNA, 15 bp, Homo sapiens
agagcattcaaagta

SEQ ID NO: 115047 - DNA, 15 bp, Homo sapiens
cagagcattcaaagt

SEQ ID NO: 115048 - DNA, 15 bp, Homo sapiens
acagagcattcaaag

SEQ ID NO: 115049 - DNA, 15 bp, Homo sapiens
cacagagcattcaaa

SEQ ID NO: 115050 - DNA, 15 bp, Homo sapiens
ccacagagcattcaa

SEQ ID NO: 115051 - DNA, 15 bp, Homo sapiens
tccacagagcattca

SEQ ID NO: 115052 - DNA, 15 bp, Homo sapiens
ctccacagagcattc

SEQ ID NO: 115053 - DNA, 15 bp, Homo sapiens
tctccacagagcatt

SEQ ID NO: 115054 - DNA, 15 bp, Homo sapiens
atctccacagagcat

SEQ ID NO: 115055 - DNA, 15 bp, Homo sapiens
catctccacagagca

SEQ ID NO: 115056 - DNA, 15 bp, Homo sapiens
tcatctccacagagc

SEQ ID NO: 115057 - DNA, 15 bp, Homo sapiens
gtcatctccacagag

SEQ ID NO: 115058 - DNA, 15 bp, Homo sapiens
tgtcatctccacaga

SEQ ID NO: 115059 - DNA, 15 bp, Homo sapiens
ctgtcatctccacag

SEQ ID NO: 115060 - DNA, 15 bp, Homo sapiens
gctgtcatctccaca

SEQ ID NO: 115061 - DNA, 15 bp, Homo sapiens
agctgtcatctccac

SEQ ID NO: 115062 - DNA, 15 bp, Homo sapiens
cagctgtcatctcca

SEQ ID NO: 115063 - DNA, 15 bp, Homo sapiens
ccagctgtcatctcc

SEQ ID NO: 115064 - DNA, 15 bp, Homo sapiens
cccagctgtcatctc

SEQ ID NO: 115065 - DNA, 15 bp, Homo sapiens
tcccagctgtcatct

SEQ ID NO: 115066 - DNA, 15 bp, Homo sapiens
ctcccagctgtcatc

SEQ ID NO: 115067 - DNA, 15 bp, Homo sapiens
tctcccagctgtcat

SEQ ID NO: 115068 - DNA, 15 bp, Homo sapiens
ttctcccagctgtca

SEQ ID NO: 115069 - DNA, 15 bp, Homo sapiens
tttctcccagctgtc

SEQ ID NO: 115070 - DNA, 15 bp, Homo sapiens
ctttctcccagctgt

SEQ ID NO: 115071 - DNA, 15 bp, Homo sapiens
actttctcccagctg

SEQ ID NO: 115072 - DNA, 15 bp, Homo sapiens
aactttctcccagct

SEQ ID NO: 115073 - DNA, 15 bp, Homo sapiens
taactttctcccagc

SEQ ID NO: 115074 - DNA, 15 bp, Homo sapiens
ttaactttctcccag

SEQ ID NO: 115075 - DNA, 15 bp, Homo sapiens
cttaactttctccca

SEQ ID NO: 115076 - DNA, 15 bp, Homo sapiens
tcttaactttctccc

SEQ ID NO: 115077 - DNA, 15 bp, Homo sapiens
atcttaactttctcc

SEQ ID NO: 115078 - DNA, 15 bp, Homo sapiens
tatcttaactttctc

SEQ ID NO: 115079 - DNA, 15 bp, Homo sapiens
ctatcttaactttct

SEQ ID NO: 115080 - DNA, 15 bp, Homo sapiens
actatcttaactttc

SEQ ID NO: 115081 - DNA, 15 bp, Homo sapiens
tactatcttaacttt

SEQ ID NO: 115082 - DNA, 15 bp, Homo sapiens
ctactatcttaactt

SEQ ID NO: 115083 - DNA, 15 bp, Homo sapiens
tctactatcttaact

SEQ ID NO: 115084 - DNA, 15 bp, Homo sapiens
gtctactatcttaac

SEQ ID NO: 115085 - DNA, 15 bp, Homo sapiens
tgtctactatcttaa

SEQ ID NO: 115086 - DNA, 15 bp, Homo sapiens
gtgtctactatctta

SEQ ID NO: 115087 - DNA, 15 bp, Homo sapiens
agtgtctactatctt

SEQ ID NO: 115088 - DNA, 15 bp, Homo sapiens
cagtgtctactatct

SEQ ID NO: 115089 - DNA, 15 bp, Homo sapiens
ccagtgtctactatc

SEQ ID NO: 115090 - DNA, 15 bp, Homo sapiens
tccagtgtctactat

SEQ ID NO: 115091 - DNA, 15 bp, Homo sapiens
ttccagtgtctacta

SEQ ID NO: 115092 - DNA, 15 bp, Homo sapiens
tttccagtgtctact

SEQ ID NO: 115093 - DNA, 15 bp, Homo sapiens
ctttccagtgtctac

SEQ ID NO: 115094 - DNA, 15 bp, Homo sapiens
tctttccagtgtcta

SEQ ID NO: 115095 - DNA, 15 bp, Homo sapiens
gtctttccagtgtct

SEQ ID NO: 115096 - DNA, 15 bp, Homo sapiens
agtctttccagtgtc

SEQ ID NO: 115097 - DNA, 15 bp, Homo sapiens
tagtctttccagtgt

SEQ ID NO: 115098 - DNA, 15 bp, Homo sapiens
atagtctttccagtg

SEQ ID NO: 115099 - DNA, 15 bp, Homo sapiens
aatagtctttccagt

SEQ ID NO: 115100 - DNA, 15 bp, Homo sapiens
gaatagtctttccag

SEQ ID NO: 115101 - DNA, 15 bp, Homo sapiens
agaatagtctttcca

SEQ ID NO: 115102 - DNA, 15 bp, Homo sapiens
gagaatagtctttcc

SEQ ID NO: 115103 - DNA, 15 bp, Homo sapiens
tgagaatagtctttc

SEQ ID NO: 115104 - DNA, 15 bp, Homo sapiens
ctgagaatagtcttt

SEQ ID NO: 115105 - DNA, 15 bp, Homo sapiens
actgagaatagtctt

SEQ ID NO: 115106 - DNA, 15 bp, Homo sapiens
aactgagaatagtct

SEQ ID NO: 115107 - DNA, 15 bp, Homo sapiens
aaactgagaatagtc

SEQ ID NO: 115108 - DNA, 15 bp, Homo sapiens
taaactgagaatagt

SEQ ID NO: 115109 - DNA, 15 bp, Homo sapiens
ctaaactgagaatag

SEQ ID NO: 115110 - DNA, 15 bp, Homo sapiens
tctaaactgagaata

SEQ ID NO: 115111 - DNA, 15 bp, Homo sapiens
ttctaaactgagaat

SEQ ID NO: 115112 - DNA, 15 bp, Homo sapiens
tttctaaactgagaa

SEQ ID NO: 115113 - DNA, 15 bp, Homo sapiens
ttttctaaactgaga

SEQ ID NO: 115114 - DNA, 15 bp, Homo sapiens
tttttctaaactgag

SEQ ID NO: 115115 - DNA, 15 bp, Homo sapiens
ttttttctaaactga

SEQ ID NO: 115116 - DNA, 15 bp, Homo sapiens
cttttttctaaactg

SEQ ID NO: 115117 - DNA, 15 bp, Homo sapiens
gcttttttctaaact

SEQ ID NO: 115118 - DNA, 15 bp, Homo sapiens
agcttttttctaaac

SEQ ID NO: 115119 - DNA, 15 bp, Homo sapiens
gagcttttttctaaa

SEQ ID NO: 115120 - DNA, 15 bp, Homo sapiens
tgagcttttttctaa

SEQ ID NO: 115121 - DNA, 15 bp, Homo sapiens
atgagcttttttcta

SEQ ID NO: 115122 - DNA, 15 bp, Homo sapiens
catgagcttttttct

SEQ ID NO: 115123 - DNA, 15 bp, Homo sapiens
tcatgagcttttttc

SEQ ID NO: 115124 - DNA, 15 bp, Homo sapiens
ttcatgagctttttt

SEQ ID NO: 115125 - DNA, 15 bp, Homo sapiens
tttcatgagcttttt

SEQ ID NO: 115126 - DNA, 15 bp, Homo sapiens
ttttcatgagctttt

SEQ ID NO: 115127 - DNA, 15 bp, Homo sapiens
cttttcatgagcttt

SEQ ID NO: 115128 - DNA, 15 bp, Homo sapiens
gcttttcatgagctt

SEQ ID NO: 115129 - DNA, 15 bp, Homo sapiens
cgcttttcatgagct

SEQ ID NO: 115130 - DNA, 15 bp, Homo sapiens
acgcttttcatgagc

SEQ ID NO: 115131 - DNA, 15 bp, Homo sapiens
cacgcttttcatgag

SEQ ID NO: 115132 - DNA, 15 bp, Homo sapiens
tcacgcttttcatga

SEQ ID NO: 115133 - DNA, 15 bp, Homo sapiens
atcacgcttttcatg

SEQ ID NO: 115134 - DNA, 15 bp, Homo sapiens
gatcacgcttttcat

SEQ ID NO: 115135 - DNA, 15 bp, Homo sapiens
tgatcacgcttttca

SEQ ID NO: 115136 - DNA, 15 bp, Homo sapiens
atgatcacgcttttc

SEQ ID NO: 115137 - DNA, 15 bp, Homo sapiens
catgatcacgctttt

SEQ ID NO: 115138 - DNA, 15 bp, Homo sapiens
gcatgatcacgcttt

SEQ ID NO: 115139 - DNA, 15 bp, Homo sapiens
ggcatgatcacgctt

SEQ ID NO: 115140 - DNA, 15 bp, Homo sapiens
tggcatgatcacgct

SEQ ID NO: 115141 - DNA, 15 bp, Homo sapiens
atggcatgatcacgc

SEQ ID NO: 115142 - DNA, 15 bp, Homo sapiens
catggcatgatcacg

SEQ ID NO: 115143 - DNA, 15 bp, Homo sapiens
tcatggcatgatcac

SEQ ID NO: 115144 - DNA, 15 bp, Homo sapiens
ctcatggcatgatca

SEQ ID NO: 115145 - DNA, 15 bp, Homo sapiens
gctcatggcatgatc

SEQ ID NO: 115146 - DNA, 15 bp, Homo sapiens
tgctcatggcatgat

SEQ ID NO: 115147 - DNA, 15 bp, Homo sapiens
ctgctcatggcatga

SEQ ID NO: 115148 - DNA, 15 bp, Homo sapiens
actgctcatggcatg

SEQ ID NO: 115149 - DNA, 15 bp, Homo sapiens
cactgctcatggcat

SEQ ID NO: 115150 - DNA, 15 bp, Homo sapiens
acactgctcatggca

SEQ ID NO: 115151 - DNA, 15 bp, Homo sapiens
cacactgctcatggc

SEQ ID NO: 115152 - DNA, 15 bp, Homo sapiens
tcacactgctcatgg

SEQ ID NO: 115153 - DNA, 15 bp, Homo sapiens
ctcacactgctcatg

SEQ ID NO: 115154 - DNA, 15 bp, Homo sapiens
actcacactgctcat

SEQ ID NO: 115155 - DNA, 15 bp, Homo sapiens
cactcacactgctca

SEQ ID NO: 115156 - DNA, 15 bp, Homo sapiens
acactcacactgctc

SEQ ID NO: 115157 - DNA, 15 bp, Homo sapiens
tacactcacactgct

SEQ ID NO: 115158 - DNA, 15 bp, Homo sapiens
ttacactcacactgc

SEQ ID NO: 115159 - DNA, 15 bp, Homo sapiens
tttacactcacactg

SEQ ID NO: 115160 - DNA, 15 bp, Homo sapiens
ctttacactcacact

SEQ ID NO: 115161 - DNA, 15 bp, Homo sapiens
cctttacactcacac

SEQ ID NO: 115162 - DNA, 15 bp, Homo sapiens
tcctttacactcaca

SEQ ID NO: 115163 - DNA, 15 bp, Homo sapiens
ttcctttacactcac

SEQ ID NO: 115164 - DNA, 15 bp, Homo sapiens
cttcctttacactca

SEQ ID NO: 115165 - DNA, 15 bp, Homo sapiens
acttcctttacactc

SEQ ID NO: 115166 - DNA, 15 bp, Homo sapiens
cacttcctttacact

SEQ ID NO: 115167 - DNA, 15 bp, Homo sapiens
tcacttcctttacac

SEQ ID NO: 115168 - DNA, 15 bp, Homo sapiens
ttcacttcctttaca

SEQ ID NO: 115169 - DNA, 15 bp, Homo sapiens
cttcacttcctttac

SEQ ID NO: 115170 - DNA, 15 bp, Homo sapiens
tcttcacttccttta

SEQ ID NO: 115171 - DNA, 15 bp, Homo sapiens
ttcttcacttccttt

SEQ ID NO: 115172 - DNA, 15 bp, Homo sapiens
tttcttcacttcctt

SEQ ID NO: 115173 - DNA, 15 bp, Homo sapiens
ctttcttcacttcct

SEQ ID NO: 115174 - DNA, 15 bp, Homo sapiens
cctttcttcacttcc

SEQ ID NO: 115175 - DNA, 15 bp, Homo sapiens
tcctttcttcacttc

SEQ ID NO: 115176 - DNA, 15 bp, Homo sapiens
ttcctttcttcactt

SEQ ID NO: 115177 - DNA, 15 bp, Homo sapiens
attcctttcttcact

SEQ ID NO: 115178 - DNA, 15 bp, Homo sapiens
cattcctttcttcac

SEQ ID NO: 115179 - DNA, 15 bp, Homo sapiens
acattcctttcttca

SEQ ID NO: 115180 - DNA, 15 bp, Homo sapiens
tacattcctttcttc

SEQ ID NO: 115181 - DNA, 15 bp, Homo sapiens
atacattcctttctt

SEQ ID NO: 115182 - DNA, 15 bp, Homo sapiens
catacattcctttct

SEQ ID NO: 115183 - DNA, 15 bp, Homo sapiens
tcatacattcctttc

SEQ ID NO: 115184 - DNA, 15 bp, Homo sapiens
ctcatacattccttt

SEQ ID NO: 115185 - DNA, 15 bp, Homo sapiens
cctcatacattcctt

SEQ ID NO: 115186 - DNA, 15 bp, Homo sapiens
ccctcatacattcct

SEQ ID NO: 115187 - DNA, 15 bp, Homo sapiens
tccctcatacattcc

SEQ ID NO: 115188 - DNA, 15 bp, Homo sapiens
ttccctcatacattc

SEQ ID NO: 115189 - DNA, 15 bp, Homo sapiens
tttccctcatacatt

SEQ ID NO: 115190 - DNA, 15 bp, Homo sapiens
atttccctcatacat

SEQ ID NO: 115191 - DNA, 15 bp, Homo sapiens
catttccctcataca

SEQ ID NO: 115192 - DNA, 15 bp, Homo sapiens
tcatttccctcatac

SEQ ID NO: 115193 - DNA, 15 bp, Homo sapiens
ctcatttccctcata

SEQ ID NO: 115194 - DNA, 15 bp, Homo sapiens
gctcatttccctcat

SEQ ID NO: 115195 - DNA, 15 bp, Homo sapiens
tgctcatttccctca

SEQ ID NO: 115196 - DNA, 15 bp, Homo sapiens
atgctcatttccctc

SEQ ID NO: 115197 - DNA, 15 bp, Homo sapiens
aatgctcatttccct

SEQ ID NO: 115198 - DNA, 15 bp, Homo sapiens
caatgctcatttccc

SEQ ID NO: 115199 - DNA, 15 bp, Homo sapiens
gcaatgctcatttcc

SEQ ID NO: 115200 - DNA, 15 bp, Homo sapiens
tgcaatgctcatttc

SEQ ID NO: 115201 - DNA, 15 bp, Homo sapiens
ttgcaatgctcattt

SEQ ID NO: 115202 - DNA, 15 bp, Homo sapiens
cttgcaatgctcatt

SEQ ID NO: 115203 - DNA, 15 bp, Homo sapiens
acttgcaatgctcat

SEQ ID NO: 115204 - DNA, 15 bp, Homo sapiens
gacttgcaatgctca

SEQ ID NO: 115205 - DNA, 15 bp, Homo sapiens
tgacttgcaatgctc

SEQ ID NO: 115206 - DNA, 15 bp, Homo sapiens
atgacttgcaatgct

SEQ ID NO: 115207 - DNA, 15 bp, Homo sapiens
gatgacttgcaatgc

SEQ ID NO: 115208 - DNA, 15 bp, Homo sapiens
cgatgacttgcaatg

SEQ ID NO: 115209 - DNA, 15 bp, Homo sapiens
ccgatgacttgcaat

SEQ ID NO: 115210 - DNA, 15 bp, Homo sapiens
accgatgacttgcaa

SEQ ID NO: 115211 - DNA, 15 bp, Homo sapiens
caccgatgacttgca

SEQ ID NO: 115212 - DNA, 15 bp, Homo sapiens
acaccgatgacttgc

SEQ ID NO: 115213 - DNA, 15 bp, Homo sapiens
cacaccgatgacttg

SEQ ID NO: 115214 - DNA, 15 bp, Homo sapiens
acacaccgatgactt

SEQ ID NO: 115215 - DNA, 15 bp, Homo sapiens
aacacaccgatgact

SEQ ID NO: 115216 - DNA, 15 bp, Homo sapiens
caacacaccgatgac

SEQ ID NO: 115217 - DNA, 15 bp, Homo sapiens
acaacacaccgatga

SEQ ID NO: 115218 - DNA, 15 bp, Homo sapiens
cacaacacaccgatg

SEQ ID NO: 115219 - DNA, 15 bp, Homo sapiens
ccacaacacaccgat

SEQ ID NO: 115220 - DNA, 15 bp, Homo sapiens
accacaacacaccga

SEQ ID NO: 115221 - DNA, 15 bp, Homo sapiens
aaccacaacacaccg

SEQ ID NO: 115222 - DNA, 15 bp, Homo sapiens
caaccacaacacacc

SEQ ID NO: 115223 - DNA, 15 bp, Homo sapiens
tcaaccacaacacac

SEQ ID NO: 115224 - DNA, 15 bp, Homo sapiens
ttcaaccacaacaca

SEQ ID NO: 115225 - DNA, 15 bp, Homo sapiens
attcaaccacaacac

SEQ ID NO: 115226 - DNA, 15 bp, Homo sapiens
cattcaaccacaaca

SEQ ID NO: 115227 - DNA, 15 bp, Homo sapiens
gcattcaaccacaac

SEQ ID NO: 115228 - DNA, 15 bp, Homo sapiens
tgcattcaaccacaa

SEQ ID NO: 115229 - DNA, 15 bp, Homo sapiens
ttgcattcaaccaca

SEQ ID NO: 115230 - DNA, 15 bp, Homo sapiens
tttgcattcaaccac

SEQ ID NO: 115231 - DNA, 15 bp, Homo sapiens
ttttgcattcaacca

SEQ ID NO: 115232 - DNA, 15 bp, Homo sapiens
gttttgcattcaacc

SEQ ID NO: 115233 - DNA, 15 bp, Homo sapiens
tgttttgcattcaac

SEQ ID NO: 115234 - DNA, 15 bp, Homo sapiens
ttgttttgcattcaa

SEQ ID NO: 115235 - DNA, 15 bp, Homo sapiens
tttgttttgcattca

SEQ ID NO: 115236 - DNA, 15 bp, Homo sapiens
cctttgttttgcatt

SEQ ID NO: 115237 - DNA, 15 bp, Homo sapiens
gcctttgttttgcat

SEQ ID NO: 115238 - DNA, 15 bp, Homo sapiens
tgcctttgttttgca

SEQ ID NO: 115239 - DNA, 15 bp, Homo sapiens
gtgcctttgttttgc

SEQ ID NO: 115240 - DNA, 15 bp, Homo sapiens
ggtgcctttgttttg

SEQ ID NO: 115241 - DNA, 15 bp, Homo sapiens
tggtgcctttgtttt

SEQ ID NO: 115242 - DNA, 15 bp, Homo sapiens
ttggtgcctttgttt

SEQ ID NO: 115243 - DNA, 15 bp, Homo sapiens
tttggtgcctttgtt

SEQ ID NO: 115244 - DNA, 15 bp, Homo sapiens
gtttggtgcctttgt

SEQ ID NO: 115245 - DNA, 15 bp, Homo sapiens
agtttggtgcctttg

SEQ ID NO: 115246 - DNA, 15 bp, Homo sapiens
aagtttggtgccttt

SEQ ID NO: 115247 - DNA, 15 bp, Homo sapiens
aaagtttggtgcctt

SEQ ID NO: 115248 - DNA, 15 bp, Homo sapiens
taaagtttggtgcct

SEQ ID NO: 115249 - DNA, 15 bp, Homo sapiens
ataaagtttggtgcc

SEQ ID NO: 115250 - DNA, 15 bp, Homo sapiens
aataaagtttggtgc

SEQ ID NO: 115251 - DNA, 15 bp, Homo sapiens
caataaagtttggtg

SEQ ID NO: 115252 - DNA, 15 bp, Homo sapiens
acaataaagtttggt

SEQ ID NO: 115253 - DNA, 15 bp, Homo sapiens
aacaataaagtttgg

SEQ ID NO: 115254 - DNA, 15 bp, Homo sapiens
caacaataaagtttg

SEQ ID NO: 115255 - DNA, 15 bp, Homo sapiens
acaacaataaagttt

SEQ ID NO: 115256 - DNA, 15 bp, Homo sapiens
aacaacaataaagtt

SEQ ID NO: 115257 - DNA, 15 bp, Homo sapiens
taacaacaataaagt

SEQ ID NO: 115258 - DNA, 15 bp, Homo sapiens
ttaacaacaataaag

SEQ ID NO: 115259 - DNA, 15 bp, Homo sapiens
tttaacaacaataaa

SEQ ID NO: 115260 - DNA, 15 bp, Homo sapiens
atttaacaacaataa

SEQ ID NO: 115261 - DNA, 15 bp, Homo sapiens
aatttaacaacaata

SEQ ID NO: 115262 - DNA, 15 bp, Homo sapiens
aaatttaacaacaat

SEQ ID NO: 115263 - DNA, 15 bp, Homo sapiens
taaatttaacaacaa

SEQ ID NO: 115264 - DNA, 15 bp, Homo sapiens
ttaaatttaacaaca

SEQ ID NO: 115265 - DNA, 15 bp, Homo sapiens
cttaaatttaacaac

SEQ ID NO: 115266 - DNA, 15 bp, Homo sapiens
acttaaatttaacaa

SEQ ID NO: 115267 - DNA, 15 bp, Homo sapiens
aacttaaatttaaca

SEQ ID NO: 115268 - DNA, 15 bp, Homo sapiens
aaacttaaatttaac

SEQ ID NO: 115269 - DNA, 15 bp, Homo sapiens
aaaacttaaatttaa

SEQ ID NO: 115270 - DNA, 15 bp, Homo sapiens
aaaaacttaaattta

SEQ ID NO: 115271 - DNA, 15 bp, Homo sapiens
gaaaaacttaaattt

SEQ ID NO: 115272 - DNA, 15 bp, Homo sapiens
tgaaaaacttaaatt

SEQ ID NO: 115273 - DNA, 15 bp, Homo sapiens
ttgaaaaacttaaat

SEQ ID NO: 115274 - DNA, 15 bp, Homo sapiens
cttgaaaaacttaaa

SEQ ID NO: 115275 - DNA, 15 bp, Homo sapiens
ccttgaaaaacttaa

SEQ ID NO: 115276 - DNA, 15 bp, Homo sapiens
tccttgaaaaactta

SEQ ID NO: 115277 - DNA, 15 bp, Homo sapiens
gtccttgaaaaactt

SEQ ID NO: 115278 - DNA, 15 bp, Homo sapiens
tgtccttgaaaaact

SEQ ID NO: 115279 - DNA, 15 bp, Homo sapiens
atgtccttgaaaaac

SEQ ID NO: 115280 - DNA, 15 bp, Homo sapiens
tatgtccttgaaaaa

SEQ ID NO: 115281 - DNA, 15 bp, Homo sapiens
atatgtccttgaaaa

SEQ ID NO: 115282 - DNA, 15 bp, Homo sapiens
aatatgtccttgaaa

SEQ ID NO: 115283 - DNA, 15 bp, Homo sapiens
taatatgtccttgaa

SEQ ID NO: 115284 - DNA, 15 bp, Homo sapiens
ataatatgtccttga

SEQ ID NO: 115285 - DNA, 15 bp, Homo sapiens
gataatatgtccttg

SEQ ID NO: 115286 - DNA, 15 bp, Homo sapiens
tgataatatgtcctt

SEQ ID NO: 115287 - DNA, 15 bp, Homo sapiens
atgataatatgtcct

SEQ ID NO: 115288 - DNA, 15 bp, Homo sapiens
gatgataatatgtcc

SEQ ID NO: 115289 - DNA, 15 bp, Homo sapiens
ggatgataatatgtc

SEQ ID NO: 115290 - DNA, 15 bp, Homo sapiens
aggatgataatatgt

SEQ ID NO: 115291 - DNA, 15 bp, Homo sapiens
gaggatgataatatg

SEQ ID NO: 115292 - DNA, 15 bp, Homo sapiens
cgaggatgataatat

SEQ ID NO: 115293 - DNA, 15 bp, Homo sapiens
acgaggatgataata

SEQ ID NO: 115294 - DNA, 15 bp, Homo sapiens
cacgaggatgataat

SEQ ID NO: 115295 - DNA, 15 bp, Homo sapiens
gcacgaggatgataa

SEQ ID NO: 115296 - DNA, 15 bp, Homo sapiens
tgcacgaggatgata

SEQ ID NO: 115297 - DNA, 15 bp, Homo sapiens
ctgcacgaggatgat

SEQ ID NO: 115298 - DNA, 15 bp, Homo sapiens
actgcacgaggatga

SEQ ID NO: 115299 - DNA, 15 bp, Homo sapiens
tactgcacgaggatg

SEQ ID NO: 115300 - DNA, 15 bp, Homo sapiens
atactgcacgaggat

SEQ ID NO: 115301 - DNA, 15 bp, Homo sapiens
tatactgcacgagga

SEQ ID NO: 115302 - DNA, 15 bp, Homo sapiens
gtatactgcacgagg

SEQ ID NO: 115303 - DNA, 15 bp, Homo sapiens
agtatactgcacgag

SEQ ID NO: 115304 - DNA, 15 bp, Homo sapiens
aagtatactgcacga

SEQ ID NO: 115305 - DNA, 15 bp, Homo sapiens
aaagtatactgcacg

SEQ ID NO: 115306 - DNA, 15 bp, Homo sapiens
caaagtatactgcac

SEQ ID NO: 115307 - DNA, 15 bp, Homo sapiens
tcaaagtatactgca

SEQ ID NO: 115308 - DNA, 15 bp, Homo sapiens
ttcaaagtatactgc

SEQ ID NO: 115309 - DNA, 15 bp, Homo sapiens
tttcaaagtatactg

SEQ ID NO: 115310 - DNA, 15 bp, Homo sapiens
ttttcaaagtatact

SEQ ID NO: 115311 - DNA, 15 bp, Homo sapiens
attttcaaagtatac

SEQ ID NO: 115312 - DNA, 15 bp, Homo sapiens
gattttcaaagtata

SEQ ID NO: 115313 - DNA, 15 bp, Homo sapiens
tgattttcaaagtat

SEQ ID NO: 115314 - DNA, 15 bp, Homo sapiens
atgattttcaaagta

SEQ ID NO: 115315 - DNA, 15 bp, Homo sapiens
aatgattttcaaagt

SEQ ID NO: 115316 - DNA, 15 bp, Homo sapiens
taatgattttcaaag

SEQ ID NO: 115317 - DNA, 15 bp, Homo sapiens
gtaatgattttcaaa

SEQ ID NO: 115318 - DNA, 15 bp, Homo sapiens
agtaatgattttcaa

SEQ ID NO: 115319 - DNA, 15 bp, Homo sapiens
aagtaatgattttca

SEQ ID NO: 115320 - DNA, 15 bp, Homo sapiens
aaagtaatgattttc

SEQ ID NO: 115321 - DNA, 15 bp, Homo sapiens
aaaagtaatgatttt

SEQ ID NO: 115322 - DNA, 15 bp, Homo sapiens
aaaaagtaatgattt

SEQ ID NO: 115323 - DNA, 15 bp, Homo sapiens
taaaaagtaatgatt

SEQ ID NO: 115324 - DNA, 15 bp, Homo sapiens
ttaaaaagtaatgat

SEQ ID NO: 115325 - DNA, 15 bp, Homo sapiens
tttaaaaagtaatga

SEQ ID NO: 115326 - DNA, 15 bp, Homo sapiens
atttaaaaagtaatg

SEQ ID NO: 115327 - DNA, 15 bp, Homo sapiens
aatttaaaaagtaat

SEQ ID NO: 115328 - DNA, 15 bp, Homo sapiens
taatttaaaaagtaa

SEQ ID NO: 115329 - DNA, 15 bp, Homo sapiens
ctaatttaaaaagta

SEQ ID NO: 115330 - DNA, 15 bp, Homo sapiens
actaatttaaaaagt

SEQ ID NO: 115331 - DNA, 15 bp, Homo sapiens
tactaatttaaaaag

SEQ ID NO: 115332 - DNA, 15 bp, Homo sapiens
ttactaatttaaaaa

SEQ ID NO: 115333 - DNA, 15 bp, Homo sapiens
gttactaatttaaaa

SEQ ID NO: 115334 - DNA, 15 bp, Homo sapiens
tgttactaatttaaa

SEQ ID NO: 115335 - DNA, 15 bp, Homo sapiens
atgttactaatttaa

SEQ ID NO: 115336 - DNA, 15 bp, Homo sapiens
tatgttactaattta

SEQ ID NO: 115337 - DNA, 15 bp, Homo sapiens
ttatgttactaattt

SEQ ID NO: 115338 - DNA, 15 bp, Homo sapiens
cttatgttactaatt

SEQ ID NO: 115339 - DNA, 15 bp, Homo sapiens
acttatgttactaat

SEQ ID NO: 115340 - DNA, 15 bp, Homo sapiens
tacttatgttactaa

SEQ ID NO: 115341 - DNA, 15 bp, Homo sapiens
ttacttatgttacta

SEQ ID NO: 115342 - DNA, 15 bp, Homo sapiens
attacttatgttact

SEQ ID NO: 115343 - DNA, 15 bp, Homo sapiens
tattacttatgttac

SEQ ID NO: 115344 - DNA, 15 bp, Homo sapiens
ctattacttatgtta

SEQ ID NO: 115345 - DNA, 15 bp, Homo sapiens
tctattacttatgtt

SEQ ID NO: 115346 - DNA, 15 bp, Homo sapiens
ttctattacttatgt

SEQ ID NO: 115347 - DNA, 15 bp, Homo sapiens
cttctattacttatg

SEQ ID NO: 115348 - DNA, 15 bp, Homo sapiens
gcttctattacttat

SEQ ID NO: 115349 - DNA, 15 bp, Homo sapiens
agcttctattactta

SEQ ID NO: 115350 - DNA, 15 bp, Homo sapiens
tagcttctattactt

SEQ ID NO: 115351 - DNA, 15 bp, Homo sapiens
atagcttctattact

SEQ ID NO: 115352 - DNA, 15 bp, Homo sapiens
aatagcttctattac

SEQ ID NO: 115353 - DNA, 15 bp, Homo sapiens
aaatagcttctatta

SEQ ID NO: 115354 - DNA, 15 bp, Homo sapiens
caaatagcttctatt

SEQ ID NO: 115355 - DNA, 15 bp, Homo sapiens
tcaaatagcttctat

SEQ ID NO: 115356 - DNA, 15 bp, Homo sapiens
ttcaaatagcttcta

SEQ ID NO: 115357 - DNA, 15 bp, Homo sapiens
attcaaatagcttct

SEQ ID NO: 115358 - DNA, 15 bp, Homo sapiens
cattcaaatagcttc

SEQ ID NO: 115359 - DNA, 15 bp, Homo sapiens
tcattcaaatagctt

SEQ ID NO: 115360 - DNA, 15 bp, Homo sapiens
ttcattcaaatagct

SEQ ID NO: 115361 - DNA, 15 bp, Homo sapiens
tttcattcaaatagc

SEQ ID NO: 115362 - DNA, 15 bp, Homo sapiens
atttcattcaaatag

SEQ ID NO: 115363 - DNA, 15 bp, Homo sapiens
aatttcattcaaata

SEQ ID NO: 115364 - DNA, 15 bp, Homo sapiens
aaatttcattcaaat

SEQ ID NO: 115365 - DNA, 15 bp, Homo sapiens
caaatttcattcaaa

SEQ ID NO: 115366 - DNA, 15 bp, Homo sapiens
gcaaatttcattcaa

SEQ ID NO: 115367 - DNA, 15 bp, Homo sapiens
ggcaaatttcattca

SEQ ID NO: 115368 - DNA, 15 bp, Homo sapiens
aggcaaatttcattc

SEQ ID NO: 115369 - DNA, 15 bp, Homo sapiens
taggcaaatttcatt

SEQ ID NO: 115370 - DNA, 15 bp, Homo sapiens
ctaggcaaatttcat

SEQ ID NO: 115371 - DNA, 15 bp, Homo sapiens
actaggcaaatttca

SEQ ID NO: 115372 - DNA, 15 bp, Homo sapiens
cactaggcaaatttc

SEQ ID NO: 115373 - DNA, 15 bp, Homo sapiens
acactaggcaaattt

SEQ ID NO: 115374 - DNA, 15 bp, Homo sapiens
tacactaggcaaatt

SEQ ID NO: 115375 - DNA, 15 bp, Homo sapiens
ttacactaggcaaat

SEQ ID NO: 115376 - DNA, 15 bp, Homo sapiens
attacactaggcaaa

SEQ ID NO: 115377 - DNA, 15 bp, Homo sapiens
tattacactaggcaa

SEQ ID NO: 115378 - DNA, 15 bp, Homo sapiens
gtattacactaggca

SEQ ID NO: 115379 - DNA, 15 bp, Homo sapiens
tgtattacactaggc

SEQ ID NO: 115380 - DNA, 15 bp, Homo sapiens
ttgtattacactagg

SEQ ID NO: 115381 - DNA, 15 bp, Homo sapiens
tttgtattacactag

SEQ ID NO: 115382 - DNA, 15 bp, Homo sapiens
ttttgtattacacta

SEQ ID NO: 115383 - DNA, 15 bp, Homo sapiens
tttttgtattacact

SEQ ID NO: 115384 - DNA, 15 bp, Homo sapiens
ttttttgtattacac

SEQ ID NO: 115385 - DNA, 15 bp, Homo sapiens
tttttttgtattaca

SEQ ID NO: 115386 - DNA, 15 bp, Homo sapiens
ataaaaattctaaag

SEQ ID NO: 115387 - DNA, 15 bp, Homo sapiens
aataaaaattctaaa

SEQ ID NO: 115388 - DNA, 15 bp, Homo sapiens
caataaaaattctaa

SEQ ID NO: 115389 - DNA, 15 bp, Homo sapiens
acaataaaaattcta

SEQ ID NO: 115390 - DNA, 15 bp, Homo sapiens
aacaataaaaattct

SEQ ID NO: 115391 - DNA, 15 bp, Homo sapiens
taacaataaaaattc

SEQ ID NO: 115392 - DNA, 15 bp, Homo sapiens
ttaacaataaaaatt

SEQ ID NO: 115393 - DNA, 15 bp, Homo sapiens
tttaacaataaaaat

SEQ ID NO: 115394 - DNA, 15 bp, Homo sapiens
atttaacaataaaaa

SEQ ID NO: 115395 - DNA, 15 bp, Homo sapiens
aatttaacaataaaa

SEQ ID NO: 115396 - DNA, 15 bp, Homo sapiens
gaatttaacaataaa

SEQ ID NO: 115397 - DNA, 15 bp, Homo sapiens
agaatttaacaataa

SEQ ID NO: 115398 - DNA, 15 bp, Homo sapiens
aagaatttaacaata

SEQ ID NO: 115399 - DNA, 15 bp, Homo sapiens
taagaatttaacaat

SEQ ID NO: 115400 - DNA, 15 bp, Homo sapiens
ttaagaatttaacaa

SEQ ID NO: 115401 - DNA, 15 bp, Homo sapiens
tttaagaatttaaca

SEQ ID NO: 115402 - DNA, 15 bp, Homo sapiens
atttaagaatttaac

SEQ ID NO: 115403 - DNA, 15 bp, Homo sapiens
aatttaagaatttaa

SEQ ID NO: 115404 - DNA, 15 bp, Homo sapiens
gaatttaagaattta

SEQ ID NO: 115405 - DNA, 15 bp, Homo sapiens
agaatttaagaattt

SEQ ID NO: 115406 - DNA, 15 bp, Homo sapiens
tagaatttaagaatt

SEQ ID NO: 115407 - DNA, 15 bp, Homo sapiens
atagaatttaagaat

SEQ ID NO: 115408 - DNA, 15 bp, Homo sapiens
aatagaatttaagaa

SEQ ID NO: 115409 - DNA, 15 bp, Homo sapiens
caatagaatttaaga

SEQ ID NO: 115410 - DNA, 15 bp, Homo sapiens
ccaatagaatttaag

SEQ ID NO: 115411 - DNA, 15 bp, Homo sapiens
tccaatagaatttaa

SEQ ID NO: 115412 - DNA, 15 bp, Homo sapiens
ttccaatagaattta

SEQ ID NO: 115413 - DNA, 15 bp, Homo sapiens
tttccaatagaattt

SEQ ID NO: 115414 - DNA, 15 bp, Homo sapiens
atttccaatagaatt

SEQ ID NO: 115415 - DNA, 15 bp, Homo sapiens
aatttccaatagaat

SEQ ID NO: 115416 - DNA, 15 bp, Homo sapiens
aaatttccaatagaa

SEQ ID NO: 115417 - DNA, 15 bp, Homo sapiens
aaaatttccaataga

SEQ ID NO: 115418 - DNA, 15 bp, Homo sapiens
caaaatttccaatag

SEQ ID NO: 115419 - DNA, 15 bp, Homo sapiens
tcaaaatttccaata

SEQ ID NO: 115420 - DNA, 15 bp, Homo sapiens
atcaaaatttccaat

SEQ ID NO: 115421 - DNA, 15 bp, Homo sapiens
aatcaaaatttccaa

SEQ ID NO: 115422 - DNA, 15 bp, Homo sapiens
aaatcaaaatttcca

SEQ ID NO: 115423 - DNA, 15 bp, Homo sapiens
caaatcaaaatttcc

SEQ ID NO: 115424 - DNA, 15 bp, Homo sapiens
tcaaatcaaaatttc

SEQ ID NO: 115425 - DNA, 15 bp, Homo sapiens
ttcaaatcaaaattt

SEQ ID NO: 115426 - DNA, 15 bp, Homo sapiens
attcaaatcaaaatt

SEQ ID NO: 115427 - DNA, 15 bp, Homo sapiens
aattcaaatcaaaat

SEQ ID NO: 115428 - DNA, 15 bp, Homo sapiens
caattcaaatcaaaa

SEQ ID NO: 115429 - DNA, 15 bp, Homo sapiens
gcaattcaaatcaaa

SEQ ID NO: 115430 - DNA, 15 bp, Homo sapiens
ggcaattcaaatcaa

SEQ ID NO: 115431 - DNA, 15 bp, Homo sapiens
aggcaattcaaatca

SEQ ID NO: 115432 - DNA, 15 bp, Homo sapiens
aaggcaattcaaatc

SEQ ID NO: 115433 - DNA, 15 bp, Homo sapiens
caaggcaattcaaat

SEQ ID NO: 115434 - DNA, 15 bp, Homo sapiens
tcaaggcaattcaaa

SEQ ID NO: 115435 - DNA, 15 bp, Homo sapiens
ttcaaggcaattcaa

SEQ ID NO: 115436 - DNA, 15 bp, Homo sapiens
attcaaggcaattca

SEQ ID NO: 115437 - DNA, 15 bp, Homo sapiens
aattcaaggcaattc

SEQ ID NO: 115438 - DNA, 15 bp, Homo sapiens
gaattcaaggcaatt

SEQ ID NO: 115439 - DNA, 15 bp, Homo sapiens
tgaattcaaggcaat

SEQ ID NO: 115440 - DNA, 15 bp, Homo sapiens
atgaattcaaggcaa

SEQ ID NO: 115441 - DNA, 15 bp, Homo sapiens
tatgaattcaaggca

SEQ ID NO: 115442 - DNA, 15 bp, Homo sapiens
gtatgaattcaaggc

SEQ ID NO: 115443 - DNA, 15 bp, Homo sapiens
tgtatgaattcaagg

SEQ ID NO: 115444 - DNA, 15 bp, Homo sapiens
atgtatgaattcaag

SEQ ID NO: 115445 - DNA, 15 bp, Homo sapiens
aatgtatgaattcaa

SEQ ID NO: 115446 - DNA, 15 bp, Homo sapiens
aaatgtatgaattca

SEQ ID NO: 115447 - DNA, 15 bp, Homo sapiens
caaatgtatgaattc

SEQ ID NO: 115448 - DNA, 15 bp, Homo sapiens
acaaatgtatgaatt

SEQ ID NO: 115449 - DNA, 15 bp, Homo sapiens
cacaaatgtatgaat

SEQ ID NO: 115450 - DNA, 15 bp, Homo sapiens
acacaaatgtatgaa

SEQ ID NO: 115451 - DNA, 15 bp, Homo sapiens
tacacaaatgtatga

SEQ ID NO: 115452 - DNA, 15 bp, Homo sapiens
ctacacaaatgtatg

SEQ ID NO: 115453 - DNA, 15 bp, Homo sapiens
actacacaaatgtat

SEQ ID NO: 115454 - DNA, 15 bp, Homo sapiens
cactacacaaatgta

SEQ ID NO: 115455 - DNA, 15 bp, Homo sapiens
gcactacacaaatgt

SEQ ID NO: 115456 - DNA, 15 bp, Homo sapiens
tgcactacacaaatg

SEQ ID NO: 115457 - DNA, 15 bp, Homo sapiens
ctgcactacacaaat

SEQ ID NO: 115458 - DNA, 15 bp, Homo sapiens
tctgcactacacaaa

SEQ ID NO: 115459 - DNA, 15 bp, Homo sapiens
ttctgcactacacaa

SEQ ID NO: 115460 - DNA, 15 bp, Homo sapiens
attctgcactacaca

SEQ ID NO: 115461 - DNA, 15 bp, Homo sapiens
aattctgcactacac

SEQ ID NO: 115462 - DNA, 15 bp, Homo sapiens
caattctgcactaca

SEQ ID NO: 115463 - DNA, 15 bp, Homo sapiens
tcaattctgcactac

SEQ ID NO: 115464 - DNA, 15 bp, Homo sapiens
atcaattctgcacta

SEQ ID NO: 115465 - DNA, 15 bp, Homo sapiens
tatcaattctgcact

SEQ ID NO: 115466 - DNA, 15 bp, Homo sapiens
atatcaattctgcac

SEQ ID NO: 115467 - DNA, 15 bp, Homo sapiens
gatatcaattctgca

SEQ ID NO: 115468 - DNA, 15 bp, Homo sapiens
agatatcaattctgc

SEQ ID NO: 115469 - DNA, 15 bp, Homo sapiens
aagatatcaattctg

SEQ ID NO: 115470 - DNA, 15 bp, Homo sapiens
aaagatatcaattct

SEQ ID NO: 115471 - DNA, 15 bp, Homo sapiens
caaagatatcaattc

SEQ ID NO: 115472 - DNA, 15 bp, Homo sapiens
acaaagatatcaatt

SEQ ID NO: 115473 - DNA, 15 bp, Homo sapiens
aacaaagatatcaat

SEQ ID NO: 115474 - DNA, 15 bp, Homo sapiens
taacaaagatatcaa

SEQ ID NO: 115475 - DNA, 15 bp, Homo sapiens
ataacaaagatatca

SEQ ID NO: 115476 - DNA, 15 bp, Homo sapiens
tataacaaagatatc

SEQ ID NO: 115477 - DNA, 15 bp, Homo sapiens
atataacaaagatat

SEQ ID NO: 115478 - DNA, 15 bp, Homo sapiens
aatataacaaagata

SEQ ID NO: 115479 - DNA, 15 bp, Homo sapiens
taatataacaaagat

SEQ ID NO: 115480 - DNA, 15 bp, Homo sapiens
ttaatataacaaaga

SEQ ID NO: 115481 - DNA, 15 bp, Homo sapiens
attaatataacaaag

SEQ ID NO: 115482 - DNA, 15 bp, Homo sapiens
aattaatataacaaa

SEQ ID NO: 115483 - DNA, 15 bp, Homo sapiens
gaattaatataacaa

SEQ ID NO: 115484 - DNA, 15 bp, Homo sapiens
agaattaatataaca

SEQ ID NO: 115485 - DNA, 15 bp, Homo sapiens
tagaattaatataac

SEQ ID NO: 115486 - DNA, 15 bp, Homo sapiens
atagaattaatataa

SEQ ID NO: 115487 - DNA, 15 bp, Homo sapiens
aatagaattaatata

SEQ ID NO: 115488 - DNA, 15 bp, Homo sapiens
gaatagaattaatat

SEQ ID NO: 115489 - DNA, 15 bp, Homo sapiens
cgaatagaattaata

SEQ ID NO: 115490 - DNA, 15 bp, Homo sapiens
ccgaatagaattaat

SEQ ID NO: 115491 - DNA, 15 bp, Homo sapiens
accgaatagaattaa

SEQ ID NO: 115492 - DNA, 15 bp, Homo sapiens
taccgaatagaatta

SEQ ID NO: 115493 - DNA, 15 bp, Homo sapiens
ttaccgaatagaatt

SEQ ID NO: 115494 - DNA, 15 bp, Homo sapiens
gttaccgaatagaat

SEQ ID NO: 115495 - DNA, 15 bp, Homo sapiens
tgttaccgaatagaa

SEQ ID NO: 115496 - DNA, 15 bp, Homo sapiens
atgttaccgaataga

SEQ ID NO: 115497 - DNA, 15 bp, Homo sapiens
tatgttaccgaatag

SEQ ID NO: 115498 - DNA, 15 bp, Homo sapiens
atatgttaccgaata

SEQ ID NO: 115499 - DNA, 15 bp, Homo sapiens
tatatgttaccgaat

SEQ ID NO: 115500 - DNA, 15 bp, Homo sapiens
atatatgttaccgaa

SEQ ID NO: 115501 - DNA, 15 bp, Homo sapiens
catatatgttaccga

SEQ ID NO: 115502 - DNA, 15 bp, Homo sapiens
acatatatgttaccg

SEQ ID NO: 115503 - DNA, 15 bp, Homo sapiens
gacatatatgttacc

SEQ ID NO: 115504 - DNA, 15 bp, Homo sapiens
agacatatatgttac

SEQ ID NO: 115505 - DNA, 15 bp, Homo sapiens
gagacatatatgtta

SEQ ID NO: 115506 - DNA, 15 bp, Homo sapiens
tgagacatatatgtt

SEQ ID NO: 115507 - DNA, 15 bp, Homo sapiens
atgagacatatatgt

SEQ ID NO: 115508 - DNA, 15 bp, Homo sapiens
aatgagacatatatg

SEQ ID NO: 115509 - DNA, 15 bp, Homo sapiens
aaatgagacatatat

SEQ ID NO: 115510 - DNA, 15 bp, Homo sapiens
aaaatgagacatata

SEQ ID NO: 115511 - DNA, 15 bp, Homo sapiens
aaaaatgagacatat

SEQ ID NO: 115512 - DNA, 15 bp, Homo sapiens
caaaaatgagacata

SEQ ID NO: 115513 - DNA, 15 bp, Homo sapiens
acaaaaatgagacat

SEQ ID NO: 115514 - DNA, 15 bp, Homo sapiens
gacaaaaatgagaca

SEQ ID NO: 115515 - DNA, 15 bp, Homo sapiens
ggacaaaaatgagac

SEQ ID NO: 115516 - DNA, 15 bp, Homo sapiens
aggacaaaaatgaga

SEQ ID NO: 115517 - DNA, 15 bp, Homo sapiens
taggacaaaaatgag

SEQ ID NO: 115518 - DNA, 15 bp, Homo sapiens
ttaggacaaaaatga

SEQ ID NO: 115519 - DNA, 15 bp, Homo sapiens
tttaggacaaaaatg

SEQ ID NO: 115520 - DNA, 15 bp, Homo sapiens
atttaggacaaaaat

SEQ ID NO: 115521 - DNA, 15 bp, Homo sapiens
aatttaggacaaaaa

SEQ ID NO: 115522 - DNA, 15 bp, Homo sapiens
gaatttaggacaaaa

SEQ ID NO: 115523 - DNA, 15 bp, Homo sapiens
agaatttaggacaaa

SEQ ID NO: 115524 - DNA, 15 bp, Homo sapiens
aagaatttaggacaa

SEQ ID NO: 115525 - DNA, 15 bp, Homo sapiens
aaagaatttaggaca

SEQ ID NO: 115526 - DNA, 15 bp, Homo sapiens
gaaagaatttaggac

SEQ ID NO: 115527 - DNA, 15 bp, Homo sapiens
tgaaagaatttagga

SEQ ID NO: 115528 - DNA, 15 bp, Homo sapiens
gtgaaagaatttagg

SEQ ID NO: 115529 - DNA, 15 bp, Homo sapiens
tgtgaaagaatttag

SEQ ID NO: 115530 - DNA, 15 bp, Homo sapiens
atgtgaaagaattta

SEQ ID NO: 115531 - DNA, 15 bp, Homo sapiens
aatgtgaaagaattt

SEQ ID NO: 115532 - DNA, 15 bp, Homo sapiens
gaatgtgaaagaatt

SEQ ID NO: 115533 - DNA, 15 bp, Homo sapiens
ggaatgtgaaagaat

SEQ ID NO: 115534 - DNA, 15 bp, Homo sapiens
aggaatgtgaaagaa

SEQ ID NO: 115535 - DNA, 15 bp, Homo sapiens
taggaatgtgaaaga

SEQ ID NO: 115536 - DNA, 15 bp, Homo sapiens
gtaggaatgtgaaag

SEQ ID NO: 115537 - DNA, 15 bp, Homo sapiens
tgtaggaatgtgaaa

SEQ ID NO: 115538 - DNA, 15 bp, Homo sapiens
atgtaggaatgtgaa

SEQ ID NO: 115539 - DNA, 15 bp, Homo sapiens
tatgtaggaatgtga

SEQ ID NO: 115540 - DNA, 15 bp, Homo sapiens
ttatgtaggaatgtg

SEQ ID NO: 115541 - DNA, 15 bp, Homo sapiens
attatgtaggaatgt

SEQ ID NO: 115542 - DNA, 15 bp, Homo sapiens
cattatgtaggaatg

SEQ ID NO: 115543 - DNA, 15 bp, Homo sapiens
acattatgtaggaat

SEQ ID NO: 115544 - DNA, 15 bp, Homo sapiens
aacattatgtaggaa

SEQ ID NO: 115545 - DNA, 15 bp, Homo sapiens
aaacattatgtagga

SEQ ID NO: 115546 - DNA, 15 bp, Homo sapiens
aaaacattatgtagg

SEQ ID NO: 115547 - DNA, 15 bp, Homo sapiens
caaaacattatgtag

SEQ ID NO: 115548 - DNA, 15 bp, Homo sapiens
tcaaaacattatgta

SEQ ID NO: 115549 - DNA, 15 bp, Homo sapiens
atcaaaacattatgt

SEQ ID NO: 115550 - DNA, 15 bp, Homo sapiens
aatcaaaacattatg

SEQ ID NO: 115551 - DNA, 15 bp, Homo sapiens
aaatcaaaacattat

SEQ ID NO: 115552 - DNA, 15 bp, Homo sapiens
aaaatcaaaacatta

SEQ ID NO: 115553 - DNA, 15 bp, Homo sapiens
aaaaatcaaaacatt

SEQ ID NO: 115554 - DNA, 15 bp, Homo sapiens
aaaaaatcaaaacat

SEQ ID NO: 115555 - DNA, 15 bp, Homo sapiens
aaaaaaatcaaaaca

SEQ ID NO: 115556 - DNA, 15 bp, Homo sapiens
gaaaaaaatcaaaac

SEQ ID NO: 115557 - DNA, 15 bp, Homo sapiens
agaaaaaaatcaaaa

SEQ ID NO: 115558 - DNA, 15 bp, Homo sapiens
aagaaaaaaatcaaa

SEQ ID NO: 115559 - DNA, 15 bp, Homo sapiens
aaagaaaaaaatcaa

SEQ ID NO: 115560 - DNA, 15 bp, Homo sapiens
taaagaaaaaaatca

SEQ ID NO: 115561 - DNA, 15 bp, Homo sapiens
ataaagaaaaaaatc

SEQ ID NO: 115562 - DNA, 15 bp, Homo sapiens
tataaagaaaaaaat

SEQ ID NO: 115563 - DNA, 15 bp, Homo sapiens
ttataaagaaaaaaa

SEQ ID NO: 115564 - DNA, 15 bp, Homo sapiens
tttataaagaaaaaa

SEQ ID NO: 115565 - DNA, 15 bp, Homo sapiens
gtttataaagaaaaa

SEQ ID NO: 115566 - DNA, 15 bp, Homo sapiens
tgtttataaagaaaa

SEQ ID NO: 115567 - DNA, 15 bp, Homo sapiens
atgtttataaagaaa

SEQ ID NO: 115568 - DNA, 15 bp, Homo sapiens
aatgtttataaagaa

SEQ ID NO: 115569 - DNA, 15 bp, Homo sapiens
taatgtttataaaga

SEQ ID NO: 115570 - DNA, 15 bp, Homo sapiens
ataatgtttataaag

SEQ ID NO: 115571 - DNA, 15 bp, Homo sapiens
aataatgtttataaa

SEQ ID NO: 115572 - DNA, 15 bp, Homo sapiens
gaataatgtttataa

SEQ ID NO: 115573 - DNA, 15 bp, Homo sapiens
tgaataatgtttata

SEQ ID NO: 115574 - DNA, 15 bp, Homo sapiens
atgaataatgtttat

SEQ ID NO: 115575 - DNA, 15 bp, Homo sapiens
tatgaataatgttta

SEQ ID NO: 115576 - DNA, 15 bp, Homo sapiens
atatgaataatgttt

SEQ ID NO: 115577 - DNA, 15 bp, Homo sapiens
tatatgaataatgtt

SEQ ID NO: 115578 - DNA, 15 bp, Homo sapiens
atatatgaataatgt

SEQ ID NO: 115579 - DNA, 15 bp, Homo sapiens
catatatgaataatg

SEQ ID NO: 115580 - DNA, 15 bp, Homo sapiens
gcatatatgaataat

SEQ ID NO: 115581 - DNA, 15 bp, Homo sapiens
tgcatatatgaataa

SEQ ID NO: 115582 - DNA, 15 bp, Homo sapiens
gtgcatatatgaata

SEQ ID NO: 115583 - DNA, 15 bp, Homo sapiens
tgtgcatatatgaat

SEQ ID NO: 115584 - DNA, 15 bp, Homo sapiens
ctgtgcatatatgaa

SEQ ID NO: 115585 - DNA, 15 bp, Homo sapiens
cctgtgcatatatga

SEQ ID NO: 115586 - DNA, 15 bp, Homo sapiens
tcctgtgcatatatg

SEQ ID NO: 115587 - DNA, 15 bp, Homo sapiens
ctcctgtgcatatat

SEQ ID NO: 115588 - DNA, 15 bp, Homo sapiens
actcctgtgcatata

SEQ ID NO: 115589 - DNA, 15 bp, Homo sapiens
aactcctgtgcatat

SEQ ID NO: 115590 - DNA, 15 bp, Homo sapiens
aaactcctgtgcata

SEQ ID NO: 115591 - DNA, 15 bp, Homo sapiens
taaactcctgtgcat

SEQ ID NO: 115592 - DNA, 15 bp, Homo sapiens
ataaactcctgtgca

SEQ ID NO: 115593 - DNA, 15 bp, Homo sapiens
aataaactcctgtgc

SEQ ID NO: 115594 - DNA, 15 bp, Homo sapiens
gaataaactcctgtg

SEQ ID NO: 115595 - DNA, 15 bp, Homo sapiens
ggaataaactcctgt

SEQ ID NO: 115596 - DNA, 15 bp, Homo sapiens
aggaataaactcctg

SEQ ID NO: 115597 - DNA, 15 bp, Homo sapiens
taggaataaactcct

SEQ ID NO: 115598 - DNA, 15 bp, Homo sapiens
gtaggaataaactcc

SEQ ID NO: 115599 - DNA, 15 bp, Homo sapiens
tgtaggaataaactc

SEQ ID NO: 115600 - DNA, 15 bp, Homo sapiens
atgtaggaataaact

SEQ ID NO: 115601 - DNA, 15 bp, Homo sapiens
tatgtaggaataaac

SEQ ID NO: 115602 - DNA, 15 bp, Homo sapiens
atatgtaggaataaa

SEQ ID NO: 115603 - DNA, 15 bp, Homo sapiens
gatatgtaggaataa

SEQ ID NO: 115604 - DNA, 15 bp, Homo sapiens
agatatgtaggaata

SEQ ID NO: 115605 - DNA, 15 bp, Homo sapiens
tagatatgtaggaat

SEQ ID NO: 115606 - DNA, 15 bp, Homo sapiens
atagatatgtaggaa

SEQ ID NO: 115607 - DNA, 15 bp, Homo sapiens
aatagatatgtagga

SEQ ID NO: 115608 - DNA, 15 bp, Homo sapiens
aaatagatatgtagg

SEQ ID NO: 115609 - DNA, 15 bp, Homo sapiens
aaaatagatatgtag

SEQ ID NO: 115610 - DNA, 15 bp, Homo sapiens
aaaaatagatatgta

SEQ ID NO: 115611 - DNA, 15 bp, Homo sapiens
taaaaatagatatgt

SEQ ID NO: 115612 - DNA, 15 bp, Homo sapiens
ataaaaatagatatg

SEQ ID NO: 115613 - DNA, 15 bp, Homo sapiens
aataaaaatagatat

SEQ ID NO: 115614 - DNA, 15 bp, Homo sapiens
caataaaaatagata

SEQ ID NO: 115615 - DNA, 15 bp, Homo sapiens
gcaataaaaatagat

SEQ ID NO: 115616 - DNA, 15 bp, Homo sapiens
agcaataaaaataga

SEQ ID NO: 115617 - DNA, 15 bp, Homo sapiens
tagcaataaaaatag

SEQ ID NO: 115618 - DNA, 15 bp, Homo sapiens
atagcaataaaaata

SEQ ID NO: 115619 - DNA, 15 bp, Homo sapiens
catagcaataaaaat

SEQ ID NO: 115620 - DNA, 15 bp, Homo sapiens
acatagcaataaaaa

SEQ ID NO: 115621 - DNA, 15 bp, Homo sapiens
tacatagcaataaaa

SEQ ID NO: 115622 - DNA, 15 bp, Homo sapiens
ttacatagcaataaa

SEQ ID NO: 115623 - DNA, 15 bp, Homo sapiens
tttacatagcaataa

SEQ ID NO: 115624 - DNA, 15 bp, Homo sapiens
ttttacatagcaata

SEQ ID NO: 115625 - DNA, 15 bp, Homo sapiens
tttttacatagcaat

SEQ ID NO: 115626 - DNA, 15 bp, Homo sapiens
atttttacatagcaa

SEQ ID NO: 115627 - DNA, 15 bp, Homo sapiens
tatttttacatagca

SEQ ID NO: 115628 - DNA, 15 bp, Homo sapiens
atatttttacatagc

SEQ ID NO: 115629 - DNA, 15 bp, Homo sapiens
tatatttttacatag

SEQ ID NO: 115630 - DNA, 15 bp, Homo sapiens
gtatatttttacata

SEQ ID NO: 115631 - DNA, 15 bp, Homo sapiens
agtatatttttacat

SEQ ID NO: 115632 - DNA, 15 bp, Homo sapiens
aagtatatttttaca

SEQ ID NO: 115633 - DNA, 15 bp, Homo sapiens
aaagtatatttttac

SEQ ID NO: 115634 - DNA, 15 bp, Homo sapiens
aaaagtatattttta

SEQ ID NO: 115635 - DNA, 15 bp, Homo sapiens
gaaaagtatattttt

SEQ ID NO: 115636 - DNA, 15 bp, Homo sapiens
cgaaaagtatatttt

SEQ ID NO: 115637 - DNA, 15 bp, Homo sapiens
ccgaaaagtatattt

SEQ ID NO: 115638 - DNA, 15 bp, Homo sapiens
accgaaaagtatatt

SEQ ID NO: 115639 - DNA, 15 bp, Homo sapiens
aaccgaaaagtatat

SEQ ID NO: 115640 - DNA, 15 bp, Homo sapiens
aaaccgaaaagtata

SEQ ID NO: 115641 - DNA, 15 bp, Homo sapiens
aaaaccgaaaagtat

SEQ ID NO: 115642 - DNA, 15 bp, Homo sapiens
aaaaaccgaaaagta

SEQ ID NO: 115643 - DNA, 15 bp, Homo sapiens
aaaaaaccgaaaagt

SEQ ID NO: 115644 - DNA, 15 bp, Homo sapiens
aaaaaaaccgaaaag

SEQ ID NO: 115645 - DNA, 15 bp, Homo sapiens
taaaaaaaccgaaaa

SEQ ID NO: 115646 - DNA, 15 bp, Homo sapiens
gtaaaaaaaccgaaa

SEQ ID NO: 115647 - DNA, 15 bp, Homo sapiens
tgtaaaaaaaccgaa

SEQ ID NO: 115648 - DNA, 15 bp, Homo sapiens
ctgtaaaaaaaccga

SEQ ID NO: 115649 - DNA, 15 bp, Homo sapiens
tctgtaaaaaaaccg

SEQ ID NO: 115650 - DNA, 15 bp, Homo sapiens
ctctgtaaaaaaacc

SEQ ID NO: 115651 - DNA, 15 bp, Homo sapiens
actctgtaaaaaaac

SEQ ID NO: 115652 - DNA, 15 bp, Homo sapiens
cactctgtaaaaaaa

SEQ ID NO: 115653 - DNA, 15 bp, Homo sapiens
gcactctgtaaaaaa

SEQ ID NO: 115654 - DNA, 15 bp, Homo sapiens
agcactctgtaaaaa

SEQ ID NO: 115655 - DNA, 15 bp, Homo sapiens
aagcactctgtaaaa

SEQ ID NO: 115656 - DNA, 15 bp, Homo sapiens
taagcactctgtaaa

SEQ ID NO: 115657 - DNA, 15 bp, Homo sapiens
ataagcactctgtaa

SEQ ID NO: 115658 - DNA, 15 bp, Homo sapiens
aataagcactctgta

SEQ ID NO: 115659 - DNA, 15 bp, Homo sapiens
caataagcactctgt

SEQ ID NO: 115660 - DNA, 15 bp, Homo sapiens
acaataagcactctg

SEQ ID NO: 115661 - DNA, 15 bp, Homo sapiens
aacaataagcactct

SEQ ID NO: 115662 - DNA, 15 bp, Homo sapiens
caacaataagcactc

SEQ ID NO: 115663 - DNA, 15 bp, Homo sapiens
ccaacaataagcact

SEQ ID NO: 115664 - DNA, 15 bp, Homo sapiens
accaacaataagcac

SEQ ID NO: 115665 - DNA, 15 bp, Homo sapiens
taccaacaataagca

SEQ ID NO: 115666 - DNA, 15 bp, Homo sapiens
gtaccaacaataagc

SEQ ID NO: 115667 - DNA, 15 bp, Homo sapiens
tgtaccaacaataag

SEQ ID NO: 115668 - DNA, 15 bp, Homo sapiens
atgtaccaacaataa

SEQ ID NO: 115669 - DNA, 15 bp, Homo sapiens
tatgtaccaacaata

SEQ ID NO: 115670 - DNA, 15 bp, Homo sapiens
ctatgtaccaacaat

SEQ ID NO: 115671 - DNA, 15 bp, Homo sapiens
cctatgtaccaacaa

SEQ ID NO: 115672 - DNA, 15 bp, Homo sapiens
acctatgtaccaaca

SEQ ID NO: 115673 - DNA, 15 bp, Homo sapiens
cacctatgtaccaac

SEQ ID NO: 115674 - DNA, 15 bp, Homo sapiens
tcacctatgtaccaa

SEQ ID NO: 115675 - DNA, 15 bp, Homo sapiens
atcacctatgtacca

SEQ ID NO: 115676 - DNA, 15 bp, Homo sapiens
tatcacctatgtacc

SEQ ID NO: 115677 - DNA, 15 bp, Homo sapiens
atatcacctatgtac

SEQ ID NO: 115678 - DNA, 15 bp, Homo sapiens
aatatcacctatgta

SEQ ID NO: 115679 - DNA, 15 bp, Homo sapiens
caatatcacctatgt

SEQ ID NO: 115680 - DNA, 15 bp, Homo sapiens
tcaatatcacctatg

SEQ ID NO: 115681 - DNA, 15 bp, Homo sapiens
atcaatatcacctat

SEQ ID NO: 115682 - DNA, 15 bp, Homo sapiens
aatcaatatcaccta

SEQ ID NO: 115683 - DNA, 15 bp, Homo sapiens
aaatcaatatcacct

SEQ ID NO: 115684 - DNA, 15 bp, Homo sapiens
aaaatcaatatcacc

SEQ ID NO: 115685 - DNA, 15 bp, Homo sapiens
taaaatcaatatcac

SEQ ID NO: 115686 - DNA, 15 bp, Homo sapiens
ataaaatcaatatca

SEQ ID NO: 115687 - DNA, 15 bp, Homo sapiens
tataaaatcaatatc

SEQ ID NO: 115688 - DNA, 15 bp, Homo sapiens
atataaaatcaatat

SEQ ID NO: 115689 - DNA, 15 bp, Homo sapiens
tatataaaatcaata

SEQ ID NO: 115690 - DNA, 15 bp, Homo sapiens
atatataaaatcaat

SEQ ID NO: 115691 - DNA, 15 bp, Homo sapiens
aatatataaaatcaa

SEQ ID NO: 115692 - DNA, 15 bp, Homo sapiens
gaatatataaaatca

SEQ ID NO: 115693 - DNA, 15 bp, Homo sapiens
tgaatatataaaatc

SEQ ID NO: 115694 - DNA, 15 bp, Homo sapiens
attgaatatataaaa

SEQ ID NO: 115695 - DNA, 15 bp, Homo sapiens
aattgaatatataaa

SEQ ID NO: 115696 - DNA, 15 bp, Homo sapiens
aaattgaatatataa

SEQ ID NO: 115697 - DNA, 15 bp, Homo sapiens
aaaattgaatatata

SEQ ID NO: 115698 - DNA, 15 bp, Homo sapiens
aaaaattgaatatat

SEQ ID NO: 115699 - DNA, 15 bp, Homo sapiens
taaaaattgaatata

SEQ ID NO: 115700 - DNA, 15 bp, Homo sapiens
ttaaaaattgaatat

SEQ ID NO: 115701 - DNA, 15 bp, Homo sapiens
tttaaaaattgaata

SEQ ID NO: 115702 - DNA, 15 bp, Homo sapiens
gtttaaaaattgaat

SEQ ID NO: 115703 - DNA, 15 bp, Homo sapiens
tgtttaaaaattgaa

SEQ ID NO: 115704 - DNA, 15 bp, Homo sapiens
atgtttaaaaattga

SEQ ID NO: 115705 - DNA, 15 bp, Homo sapiens
gatgtttaaaaattg

SEQ ID NO: 115706 - DNA, 15 bp, Homo sapiens
ggatgtttaaaaatt

SEQ ID NO: 115707 - DNA, 15 bp, Homo sapiens
tggatgtttaaaaat

SEQ ID NO: 115708 - DNA, 15 bp, Homo sapiens
atggatgtttaaaaa

SEQ ID NO: 115709 - DNA, 15 bp, Homo sapiens
catggatgtttaaaa

SEQ ID NO: 115710 - DNA, 15 bp, Homo sapiens
acatggatgtttaaa

SEQ ID NO: 115711 - DNA, 15 bp, Homo sapiens
aacatggatgtttaa

SEQ ID NO: 115712 - DNA, 15 bp, Homo sapiens
gaacatggatgttta

SEQ ID NO: 115713 - DNA, 15 bp, Homo sapiens
tgaacatggatgttt

SEQ ID NO: 115714 - DNA, 15 bp, Homo sapiens
atgaacatggatgtt

SEQ ID NO: 115715 - DNA, 15 bp, Homo sapiens
tatgaacatggatgt

SEQ ID NO: 115716 - DNA, 15 bp, Homo sapiens
atatgaacatggatg

SEQ ID NO: 115717 - DNA, 15 bp, Homo sapiens
tatatgaacatggat

SEQ ID NO: 115718 - DNA, 15 bp, Homo sapiens
gtatatgaacatgga

SEQ ID NO: 115719 - DNA, 15 bp, Homo sapiens
agtatatgaacatgg

SEQ ID NO: 115720 - DNA, 15 bp, Homo sapiens
gagtatatgaacatg

SEQ ID NO: 115721 - DNA, 15 bp, Homo sapiens
tgagtatatgaacat

SEQ ID NO: 115722 - DNA, 15 bp, Homo sapiens
atgagtatatgaaca

SEQ ID NO: 115723 - DNA, 15 bp, Homo sapiens
tatgagtatatgaac

SEQ ID NO: 115724 - DNA, 15 bp, Homo sapiens
ttatgagtatatgaa

SEQ ID NO: 115725 - DNA, 15 bp, Homo sapiens
tttatgagtatatga

SEQ ID NO: 115726 - DNA, 15 bp, Homo sapiens
atttatgagtatatg

SEQ ID NO: 115727 - DNA, 15 bp, Homo sapiens
aatttatgagtatat

SEQ ID NO: 115728 - DNA, 15 bp, Homo sapiens
gaatttatgagtata

SEQ ID NO: 115729 - DNA, 15 bp, Homo sapiens
tgaatttatgagtat

SEQ ID NO: 115730 - DNA, 15 bp, Homo sapiens
ttgaatttatgagta

SEQ ID NO: 115731 - DNA, 15 bp, Homo sapiens
attgaatttatgagt

SEQ ID NO: 115732 - DNA, 15 bp, Homo sapiens
aattgaatttatgag

SEQ ID NO: 115733 - DNA, 15 bp, Homo sapiens
aaattgaatttatga

SEQ ID NO: 115734 - DNA, 15 bp, Homo sapiens
caaattgaatttatg

SEQ ID NO: 115735 - DNA, 15 bp, Homo sapiens
acaaattgaatttat

SEQ ID NO: 115736 - DNA, 15 bp, Homo sapiens
aacaaattgaattta

SEQ ID NO: 115737 - DNA, 15 bp, Homo sapiens
aaacaaattgaattt

SEQ ID NO: 115738 - DNA, 15 bp, Homo sapiens
aaaacaaattgaatt

SEQ ID NO: 115739 - DNA, 15 bp, Homo sapiens
aaaaacaaattgaat

SEQ ID NO: 115740 - DNA, 15 bp, Homo sapiens
gaaaaacaaattgaa

SEQ ID NO: 115741 - DNA, 15 bp, Homo sapiens
tgaaaaacaaattga

SEQ ID NO: 115742 - DNA, 15 bp, Homo sapiens
ctgaaaaacaaattg

SEQ ID NO: 115743 - DNA, 15 bp, Homo sapiens
gctgaaaaacaaatt

SEQ ID NO: 115744 - DNA, 15 bp, Homo sapiens
agctgaaaaacaaat

SEQ ID NO: 115745 - DNA, 15 bp, Homo sapiens
cagctgaaaaacaaa

SEQ ID NO: 115746 - DNA, 15 bp, Homo sapiens
tcagctgaaaaacaa

SEQ ID NO: 115747 - DNA, 15 bp, Homo sapiens
atcagctgaaaaaca

SEQ ID NO: 115748 - DNA, 15 bp, Homo sapiens
aatcagctgaaaaac

SEQ ID NO: 115749 - DNA, 15 bp, Homo sapiens
gaatcagctgaaaaa

SEQ ID NO: 115750 - DNA, 15 bp, Homo sapiens
agaatcagctgaaaa

SEQ ID NO: 115751 - DNA, 15 bp, Homo sapiens
gagaatcagctgaaa

SEQ ID NO: 115752 - DNA, 15 bp, Homo sapiens
tgagaatcagctgaa

SEQ ID NO: 115753 - DNA, 15 bp, Homo sapiens
atgagaatcagctga

SEQ ID NO: 115754 - DNA, 15 bp, Homo sapiens
tatgagaatcagctg

SEQ ID NO: 115755 - DNA, 15 bp, Homo sapiens
ctatgagaatcagct

SEQ ID NO: 115756 - DNA, 15 bp, Homo sapiens
gctatgagaatcagc

SEQ ID NO: 115757 - DNA, 15 bp, Homo sapiens
agctatgagaatcag

SEQ ID NO: 115758 - DNA, 15 bp, Homo sapiens
aagctatgagaatca

SEQ ID NO: 115759 - DNA, 15 bp, Homo sapiens
aaagctatgagaatc

SEQ ID NO: 115760 - DNA, 15 bp, Homo sapiens
aaaagctatgagaat

SEQ ID NO: 115761 - DNA, 15 bp, Homo sapiens
aaaaagctatgagaa

SEQ ID NO: 115762 - DNA, 15 bp, Homo sapiens
aaaaaagctatgaga

SEQ ID NO: 115763 - DNA, 15 bp, Homo sapiens
taaaaaagctatgag

SEQ ID NO: 115764 - DNA, 15 bp, Homo sapiens
ctaaaaaagctatga

SEQ ID NO: 115765 - DNA, 15 bp, Homo sapiens
cctaaaaaagctatg

SEQ ID NO: 115766 - DNA, 15 bp, Homo sapiens
acctaaaaaagctat

SEQ ID NO: 115767 - DNA, 15 bp, Homo sapiens
tacctaaaaaagcta

SEQ ID NO: 115768 - DNA, 15 bp, Homo sapiens
ttacctaaaaaagct

SEQ ID NO: 115769 - DNA, 15 bp, Homo sapiens
tttacctaaaaaagc

SEQ ID NO: 115770 - DNA, 15 bp, Homo sapiens
ctttacctaaaaaag

SEQ ID NO: 115771 - DNA, 15 bp, Homo sapiens
tctttacctaaaaaa

SEQ ID NO: 115772 - DNA, 15 bp, Homo sapiens
gtctttacctaaaaa

SEQ ID NO: 115773 - DNA, 15 bp, Homo sapiens
agtctttacctaaaa

SEQ ID NO: 115774 - DNA, 15 bp, Homo sapiens
gagtctttacctaaa

SEQ ID NO: 115775 - DNA, 15 bp, Homo sapiens
tgagtctttacctaa

SEQ ID NO: 115776 - DNA, 15 bp, Homo sapiens
ttgagtctttaccta

SEQ ID NO: 115777 - DNA, 15 bp, Homo sapiens
tttgagtctttacct

SEQ ID NO: 115778 - DNA, 15 bp, Homo sapiens
ctttgagtctttacc

SEQ ID NO: 115779 - DNA, 15 bp, Homo sapiens
gctttgagtctttac

SEQ ID NO: 115780 - DNA, 15 bp, Homo sapiens
tgctttgagtcttta

SEQ ID NO: 115781 - DNA, 15 bp, Homo sapiens
ttgctttgagtcttt

SEQ ID NO: 115782 - DNA, 15 bp, Homo sapiens
attgctttgagtctt

SEQ ID NO: 115783 - DNA, 15 bp, Homo sapiens
cattgctttgagtct

SEQ ID NO: 115784 - DNA, 15 bp, Homo sapiens
tcattgctttgagtc

SEQ ID NO: 115785 - DNA, 15 bp, Homo sapiens
ttcattgctttgagt

SEQ ID NO: 115786 - DNA, 15 bp, Homo sapiens
tttcattgctttgag

SEQ ID NO: 115787 - DNA, 15 bp, Homo sapiens
ttttcattgctttga

SEQ ID NO: 115788 - DNA, 15 bp, Homo sapiens
tttttcattgctttg

SEQ ID NO: 115789 - DNA, 15 bp, Homo sapiens
atttttcattgcttt

SEQ ID NO: 115790 - DNA, 15 bp, Homo sapiens
aatttttcattgctt

SEQ ID NO: 115791 - DNA, 15 bp, Homo sapiens
aaatttttcattgct

SEQ ID NO: 115792 - DNA, 15 bp, Homo sapiens
caaatttttcattgc

SEQ ID NO: 115793 - DNA, 15 bp, Homo sapiens
acaaatttttcattg

SEQ ID NO: 115794 - DNA, 15 bp, Homo sapiens
aacaaatttttcatt

SEQ ID NO: 115795 - DNA, 15 bp, Homo sapiens
aaacaaatttttcat

SEQ ID NO: 115796 - DNA, 15 bp, Homo sapiens
gaaacaaatttttca

SEQ ID NO: 115797 - DNA, 15 bp, Homo sapiens
agaaacaaatttttc

SEQ ID NO: 115798 - DNA, 15 bp, Homo sapiens
aagaaacaaattttt

SEQ ID NO: 115799 - DNA, 15 bp, Homo sapiens
aaagaaacaaatttt

SEQ ID NO: 115800 - DNA, 15 bp, Homo sapiens
aaaagaaacaaattt

SEQ ID NO: 115801 - DNA, 15 bp, Homo sapiens
caaaagaaacaaatt

SEQ ID NO: 115802 - DNA, 15 bp, Homo sapiens
ccaaaagaaacaaat

SEQ ID NO: 115803 - DNA, 15 bp, Homo sapiens
tccaaaagaaacaaa

SEQ ID NO: 115804 - DNA, 15 bp, Homo sapiens
ttccaaaagaaacaa

SEQ ID NO: 115805 - DNA, 15 bp, Homo sapiens
gttccaaaagaaaca

SEQ ID NO: 115806 - DNA, 15 bp, Homo sapiens
tgttccaaaagaaac

SEQ ID NO: 115807 - DNA, 15 bp, Homo sapiens
ttgttccaaaagaaa

SEQ ID NO: 115808 - DNA, 15 bp, Homo sapiens
attgttccaaaagaa

SEQ ID NO: 115809 - DNA, 15 bp, Homo sapiens
tattgttccaaaaga

SEQ ID NO: 115810 - DNA, 15 bp, Homo sapiens
atattgttccaaaag

SEQ ID NO: 115811 - DNA, 15 bp, Homo sapiens
catattgttccaaaa

SEQ ID NO: 115812 - DNA, 15 bp, Homo sapiens
gcatattgttccaaa

SEQ ID NO: 115813 - DNA, 15 bp, Homo sapiens
agcatattgttccaa

SEQ ID NO: 115814 - DNA, 15 bp, Homo sapiens
gagcatattgttcca

SEQ ID NO: 115815 - DNA, 15 bp, Homo sapiens
agagcatattgttcc

SEQ ID NO: 115816 - DNA, 15 bp, Homo sapiens
aagagcatattgttc

SEQ ID NO: 115817 - DNA, 15 bp, Homo sapiens
taagagcatattgtt

SEQ ID NO: 115818 - DNA, 15 bp, Homo sapiens
ttaagagcatattgt

SEQ ID NO: 115819 - DNA, 15 bp, Homo sapiens
cttaagagcatattg

SEQ ID NO: 115820 - DNA, 15 bp, Homo sapiens
acttaagagcatatt

SEQ ID NO: 115821 - DNA, 15 bp, Homo sapiens
aacttaagagcatat

SEQ ID NO: 115822 - DNA, 15 bp, Homo sapiens
aaacttaagagcata

SEQ ID NO: 115823 - DNA, 15 bp, Homo sapiens
gaaacttaagagcat

SEQ ID NO: 115824 - DNA, 15 bp, Homo sapiens
ggaaacttaagagca

SEQ ID NO: 115825 - DNA, 15 bp, Homo sapiens
tggaaacttaagagc

SEQ ID NO: 115826 - DNA, 15 bp, Homo sapiens
atggaaacttaagag

SEQ ID NO: 115827 - DNA, 15 bp, Homo sapiens
aatggaaacttaaga

SEQ ID NO: 115828 - DNA, 15 bp, Homo sapiens
aaatggaaacttaag

SEQ ID NO: 115829 - DNA, 15 bp, Homo sapiens
taaatggaaacttaa

SEQ ID NO: 115830 - DNA, 15 bp, Homo sapiens
ttaaatggaaactta

SEQ ID NO: 115831 - DNA, 15 bp, Homo sapiens
attaaatggaaactt

SEQ ID NO: 115832 - DNA, 15 bp, Homo sapiens
gattaaatggaaact

SEQ ID NO: 115833 - DNA, 15 bp, Homo sapiens
agattaaatggaaac

SEQ ID NO: 115834 - DNA, 15 bp, Homo sapiens
aagattaaatggaaa

SEQ ID NO: 115835 - DNA, 15 bp, Homo sapiens
taagattaaatggaa

SEQ ID NO: 115836 - DNA, 15 bp, Homo sapiens
ataagattaaatgga

SEQ ID NO: 115837 - DNA, 15 bp, Homo sapiens
aataagattaaatgg

SEQ ID NO: 115838 - DNA, 15 bp, Homo sapiens
aaataagattaaatg

SEQ ID NO: 115839 - DNA, 15 bp, Homo sapiens
gaaataagattaaat

SEQ ID NO: 115840 - DNA, 15 bp, Homo sapiens
tgaaataagattaaa

SEQ ID NO: 115841 - DNA, 15 bp, Homo sapiens
ctgaaataagattaa

SEQ ID NO: 115842 - DNA, 15 bp, Homo sapiens
tctgaaataagatta

SEQ ID NO: 115843 - DNA, 15 bp, Homo sapiens
ttctgaaataagatt

SEQ ID NO: 115844 - DNA, 15 bp, Homo sapiens
attctgaaataagat

SEQ ID NO: 115845 - DNA, 15 bp, Homo sapiens
aattctgaaataaga

SEQ ID NO: 115846 - DNA, 15 bp, Homo sapiens
caattctgaaataag

SEQ ID NO: 115847 - DNA, 15 bp, Homo sapiens
tcaattctgaaataa

SEQ ID NO: 115848 - DNA, 15 bp, Homo sapiens
ttcaattctgaaata

SEQ ID NO: 115849 - DNA, 15 bp, Homo sapiens
tttcaattctgaaat

SEQ ID NO: 115850 - DNA, 15 bp, Homo sapiens
atttcaattctgaaa

SEQ ID NO: 115851 - DNA, 15 bp, Homo sapiens
catttcaattctgaa

SEQ ID NO: 115852 - DNA, 15 bp, Homo sapiens
tcatttcaattctga

SEQ ID NO: 115853 - DNA, 15 bp, Homo sapiens
atcatttcaattctg

SEQ ID NO: 115854 - DNA, 15 bp, Homo sapiens
tatcatttcaattct

SEQ ID NO: 115855 - DNA, 15 bp, Homo sapiens
ttatcatttcaattc

SEQ ID NO: 115856 - DNA, 15 bp, Homo sapiens
tttatcatttcaatt

SEQ ID NO: 115857 - DNA, 15 bp, Homo sapiens
ctttatcatttcaat

SEQ ID NO: 115858 - DNA, 15 bp, Homo sapiens
tctttatcatttcaa

SEQ ID NO: 115859 - DNA, 15 bp, Homo sapiens
atctttatcatttca

SEQ ID NO: 115860 - DNA, 15 bp, Homo sapiens
catctttatcatttc

SEQ ID NO: 115861 - DNA, 15 bp, Homo sapiens
tcatctttatcattt

SEQ ID NO: 115862 - DNA, 15 bp, Homo sapiens
atcatctttatcatt

SEQ ID NO: 115863 - DNA, 15 bp, Homo sapiens
tatcatctttatcat

SEQ ID NO: 115864 - DNA, 15 bp, Homo sapiens
atatcatctttatca

SEQ ID NO: 115865 - DNA, 15 bp, Homo sapiens
tatatcatctttatc

SEQ ID NO: 115866 - DNA, 15 bp, Homo sapiens
atatatcatctttat

SEQ ID NO: 115867 - DNA, 15 bp, Homo sapiens
tatatatcatcttta

SEQ ID NO: 115868 - DNA, 15 bp, Homo sapiens
gtatatatcatcttt

SEQ ID NO: 115869 - DNA, 15 bp, Homo sapiens
tgtatatatcatctt

SEQ ID NO: 115870 - DNA, 15 bp, Homo sapiens
ttgtatatatcatct

SEQ ID NO: 115871 - DNA, 15 bp, Homo sapiens
cttgtatatatcatc

SEQ ID NO: 115872 - DNA, 15 bp, Homo sapiens
acttgtatatatcat

SEQ ID NO: 115873 - DNA, 15 bp, Homo sapiens
gacttgtatatatca

SEQ ID NO: 115874 - DNA, 15 bp, Homo sapiens
tgacttgtatatatc

SEQ ID NO: 115875 - DNA, 15 bp, Homo sapiens
gtgacttgtatatat

SEQ ID NO: 115876 - DNA, 15 bp, Homo sapiens
tgtgacttgtatata

SEQ ID NO: 115877 - DNA, 15 bp, Homo sapiens
ttgtgacttgtatat

SEQ ID NO: 115878 - DNA, 15 bp, Homo sapiens
tttgtgacttgtata

SEQ ID NO: 115879 - DNA, 15 bp, Homo sapiens
atttgtgacttgtat

SEQ ID NO: 115880 - DNA, 15 bp, Homo sapiens
aatttgtgacttgta

SEQ ID NO: 115881 - DNA, 15 bp, Homo sapiens
gaatttgtgacttgt

SEQ ID NO: 115882 - DNA, 15 bp, Homo sapiens
tgaatttgtgacttg

SEQ ID NO: 115883 - DNA, 15 bp, Homo sapiens
gtgaatttgtgactt

SEQ ID NO: 115884 - DNA, 15 bp, Homo sapiens
tgtgaatttgtgact

SEQ ID NO: 115885 - DNA, 15 bp, Homo sapiens
ctgtgaatttgtgac

SEQ ID NO: 115886 - DNA, 15 bp, Homo sapiens
gctgtgaatttgtga

SEQ ID NO: 115887 - DNA, 15 bp, Homo sapiens
tgctgtgaatttgtg

SEQ ID NO: 115888 - DNA, 15 bp, Homo sapiens
gtgctgtgaatttgt

SEQ ID NO: 115889 - DNA, 15 bp, Homo sapiens
tgtgctgtgaatttg

SEQ ID NO: 115890 - DNA, 15 bp, Homo sapiens
atgtgctgtgaattt

SEQ ID NO: 115891 - DNA, 15 bp, Homo sapiens
aatgtgctgtgaatt

SEQ ID NO: 115892 - DNA, 15 bp, Homo sapiens
gaatgtgctgtgaat

SEQ ID NO: 115893 - DNA, 15 bp, Homo sapiens
agaatgtgctgtgaa

SEQ ID NO: 115894 - DNA, 15 bp, Homo sapiens
gagaatgtgctgtga

SEQ ID NO: 115895 - DNA, 15 bp, Homo sapiens
agagaatgtgctgtg

SEQ ID NO: 115896 - DNA, 15 bp, Homo sapiens
aagagaatgtgctgt

SEQ ID NO: 115897 - DNA, 15 bp, Homo sapiens
gaagagaatgtgctg

SEQ ID NO: 115898 - DNA, 15 bp, Homo sapiens
tgaagagaatgtgct

SEQ ID NO: 115899 - DNA, 15 bp, Homo sapiens
atgaagagaatgtgc

SEQ ID NO: 115900 - DNA, 15 bp, Homo sapiens
aatgaagagaatgtg

SEQ ID NO: 115901 - DNA, 15 bp, Homo sapiens
taatgaagagaatgt

SEQ ID NO: 115902 - DNA, 15 bp, Homo sapiens
ctaatgaagagaatg

SEQ ID NO: 115903 - DNA, 15 bp, Homo sapiens
tctaatgaagagaat

SEQ ID NO: 115904 - DNA, 15 bp, Homo sapiens
ctctaatgaagagaa

SEQ ID NO: 115905 - DNA, 15 bp, Homo sapiens
actctaatgaagaga

SEQ ID NO: 115906 - DNA, 15 bp, Homo sapiens
tactctaatgaagag

SEQ ID NO: 115907 - DNA, 15 bp, Homo sapiens
ttactctaatgaaga

SEQ ID NO: 115908 - DNA, 15 bp, Homo sapiens
tttactctaatgaag

SEQ ID NO: 115909 - DNA, 15 bp, Homo sapiens
atttactctaatgaa

SEQ ID NO: 115910 - DNA, 15 bp, Homo sapiens
gatttactctaatga

SEQ ID NO: 115911 - DNA, 15 bp, Homo sapiens
tgatttactctaatg

SEQ ID NO: 115912 - DNA, 15 bp, Homo sapiens
ttgatttactctaat

SEQ ID NO: 115913 - DNA, 15 bp, Homo sapiens
tttgatttactctaa

SEQ ID NO: 115914 - DNA, 15 bp, Homo sapiens
atttgatttactcta

SEQ ID NO: 115915 - DNA, 15 bp, Homo sapiens
catttgatttactct

SEQ ID NO: 115916 - DNA, 15 bp, Homo sapiens
tcatttgatttactc

SEQ ID NO: 115917 - DNA, 15 bp, Homo sapiens
ttcatttgatttact

SEQ ID NO: 115918 - DNA, 15 bp, Homo sapiens
tttcatttgatttac

SEQ ID NO: 115919 - DNA, 15 bp, Homo sapiens
gtttcatttgattta

SEQ ID NO: 115920 - DNA, 15 bp, Homo sapiens
tgtttcatttgattt

SEQ ID NO: 115921 - DNA, 15 bp, Homo sapiens
atgtttcatttgatt

SEQ ID NO: 115922 - DNA, 15 bp, Homo sapiens
gatgtttcatttgat

SEQ ID NO: 115923 - DNA, 15 bp, Homo sapiens
tgatgtttcatttga

SEQ ID NO: 115924 - DNA, 15 bp, Homo sapiens
ctgatgtttcatttg

SEQ ID NO: 115925 - DNA, 15 bp, Homo sapiens
actgatgtttcattt

SEQ ID NO: 115926 - DNA, 15 bp, Homo sapiens
tactgatgtttcatt

SEQ ID NO: 115927 - DNA, 15 bp, Homo sapiens
atactgatgtttcat

SEQ ID NO: 115928 - DNA, 15 bp, Homo sapiens
tatactgatgtttca

SEQ ID NO: 115929 - DNA, 15 bp, Homo sapiens
atatactgatgtttc

SEQ ID NO: 115930 - DNA, 15 bp, Homo sapiens
tatatactgatgttt

SEQ ID NO: 115931 - DNA, 15 bp, Homo sapiens
atatatactgatgtt

SEQ ID NO: 115932 - DNA, 15 bp, Homo sapiens
aatatatactgatgt

SEQ ID NO: 115933 - DNA, 15 bp, Homo sapiens
taatatatactgatg

SEQ ID NO: 115934 - DNA, 15 bp, Homo sapiens
ttaatatatactgat

SEQ ID NO: 115935 - DNA, 15 bp, Homo sapiens
attaatatatactga

SEQ ID NO: 115936 - DNA, 15 bp, Homo sapiens
tattaatatatactg

SEQ ID NO: 115937 - DNA, 15 bp, Homo sapiens
ttattaatatatact

SEQ ID NO: 115938 - DNA, 15 bp, Homo sapiens
ggttattaatatata

SEQ ID NO: 115939 - DNA, 15 bp, Homo sapiens
tggttattaatatat

SEQ ID NO: 115940 - DNA, 15 bp, Homo sapiens
gtggttattaatata

SEQ ID NO: 115941 - DNA, 15 bp, Homo sapiens
ggtggttattaatat

SEQ ID NO: 115942 - DNA, 15 bp, Homo sapiens
tggtggttattaata

SEQ ID NO: 115943 - DNA, 15 bp, Homo sapiens
atggtggttattaat

SEQ ID NO: 115944 - DNA, 15 bp, Homo sapiens
gatggtggttattaa

SEQ ID NO: 115945 - DNA, 15 bp, Homo sapiens
agatggtggttatta

SEQ ID NO: 115946 - DNA, 15 bp, Homo sapiens
aagatggtggttatt

SEQ ID NO: 115947 - DNA, 15 bp, Homo sapiens
aaagatggtggttat

SEQ ID NO: 115948 - DNA, 15 bp, Homo sapiens
aaaagatggtggtta

SEQ ID NO: 115949 - DNA, 15 bp, Homo sapiens
aaaaagatggtggtt

SEQ ID NO: 115950 - DNA, 15 bp, Homo sapiens
taaaaagatggtggt

SEQ ID NO: 115951 - DNA, 15 bp, Homo sapiens
ataaaaagatggtgg

SEQ ID NO: 115952 - DNA, 15 bp, Homo sapiens
gataaaaagatggtg

SEQ ID NO: 115953 - DNA, 15 bp, Homo sapiens
tgataaaaagatggt

SEQ ID NO: 115954 - DNA, 15 bp, Homo sapiens
gtgataaaaagatgg

SEQ ID NO: 115955 - DNA, 15 bp, Homo sapiens
agtgataaaaagatg

SEQ ID NO: 115956 - DNA, 15 bp, Homo sapiens
cagtgataaaaagat

SEQ ID NO: 115957 - DNA, 15 bp, Homo sapiens
acagtgataaaaaga

SEQ ID NO: 115958 - DNA, 15 bp, Homo sapiens
gacagtgataaaaag

SEQ ID NO: 115959 - DNA, 15 bp, Homo sapiens
agacagtgataaaaa

SEQ ID NO: 115960 - DNA, 15 bp, Homo sapiens
aagacagtgataaaa

SEQ ID NO: 115961 - DNA, 15 bp, Homo sapiens
aaagacagtgataaa

SEQ ID NO: 115962 - DNA, 15 bp, Homo sapiens
aaaagacagtgataa

SEQ ID NO: 115963 - DNA, 15 bp, Homo sapiens
gaaaagacagtgata

SEQ ID NO: 115964 - DNA, 15 bp, Homo sapiens
tgaaaagacagtgat

SEQ ID NO: 115965 - DNA, 15 bp, Homo sapiens
ctgaaaagacagtga

SEQ ID NO: 115966 - DNA, 15 bp, Homo sapiens
tctgaaaagacagtg

SEQ ID NO: 115967 - DNA, 15 bp, Homo sapiens
atctgaaaagacagt

SEQ ID NO: 115968 - DNA, 15 bp, Homo sapiens
aatctgaaaagacag

SEQ ID NO: 115969 - DNA, 15 bp, Homo sapiens
aaatctgaaaagaca

SEQ ID NO: 115970 - DNA, 15 bp, Homo sapiens
taaatctgaaaagac

SEQ ID NO: 115971 - DNA, 15 bp, Homo sapiens
ttaaatctgaaaaga

SEQ ID NO: 115972 - DNA, 15 bp, Homo sapiens
cttaaatctgaaaag

SEQ ID NO: 115973 - DNA, 15 bp, Homo sapiens
ccttaaatctgaaaa

SEQ ID NO: 115974 - DNA, 15 bp, Homo sapiens
tccttaaatctgaaa

SEQ ID NO: 115975 - DNA, 15 bp, Homo sapiens
ttccttaaatctgaa

SEQ ID NO: 115976 - DNA, 15 bp, Homo sapiens
gttccttaaatctga

SEQ ID NO: 115977 - DNA, 15 bp, Homo sapiens
tgttccttaaatctg

SEQ ID NO: 115978 - DNA, 15 bp, Homo sapiens
atgttccttaaatct

SEQ ID NO: 115979 - DNA, 15 bp, Homo sapiens
catgttccttaaatc

SEQ ID NO: 115980 - DNA, 15 bp, Homo sapiens
gcatgttccttaaat

SEQ ID NO: 115981 - DNA, 15 bp, Homo sapiens
tgcatgttccttaaa

SEQ ID NO: 115982 - DNA, 15 bp, Homo sapiens
ctgcatgttccttaa

SEQ ID NO: 115983 - DNA, 15 bp, Homo sapiens
tctgcatgttcctta

SEQ ID NO: 115984 - DNA, 15 bp, Homo sapiens
atctgcatgttcctt

SEQ ID NO: 115985 - DNA, 15 bp, Homo sapiens
aatctgcatgttcct

SEQ ID NO: 115986 - DNA, 15 bp, Homo sapiens
aaatctgcatgttcc

SEQ ID NO: 115987 - DNA, 15 bp, Homo sapiens
gaaatctgcatgttc

SEQ ID NO: 115988 - DNA, 15 bp, Homo sapiens
tgaaatctgcatgtt

SEQ ID NO: 115989 - DNA, 15 bp, Homo sapiens
gtgaaatctgcatgt

SEQ ID NO: 115990 - DNA, 15 bp, Homo sapiens
ggtgaaatctgcatg

SEQ ID NO: 115991 - DNA, 15 bp, Homo sapiens
tggtgaaatctgcat

SEQ ID NO: 115992 - DNA, 15 bp, Homo sapiens
gtggtgaaatctgca

SEQ ID NO: 115993 - DNA, 15 bp, Homo sapiens
tgtggtgaaatctgc

SEQ ID NO: 115994 - DNA, 15 bp, Homo sapiens
atgtggtgaaatctg

SEQ ID NO: 115995 - DNA, 15 bp, Homo sapiens
aatgtggtgaaatct

SEQ ID NO: 115996 - DNA, 15 bp, Homo sapiens
aaatgtggtgaaatc

SEQ ID NO: 115997 - DNA, 15 bp, Homo sapiens
aaaatgtggtgaaat

SEQ ID NO: 115998 - DNA, 15 bp, Homo sapiens
taaaatgtggtgaaa

SEQ ID NO: 115999 - DNA, 15 bp, Homo sapiens
ttaaaatgtggtgaa

SEQ ID NO: 116000 - DNA, 15 bp, Homo sapiens
attaaaatgtggtga

SEQ ID NO: 116001 - DNA, 15 bp, Homo sapiens
cattaaaatgtggtg

SEQ ID NO: 116002 - DNA, 15 bp, Homo sapiens
acattaaaatgtggt

SEQ ID NO: 116003 - DNA, 15 bp, Homo sapiens
tacattaaaatgtgg

SEQ ID NO: 116004 - DNA, 15 bp, Homo sapiens
atacattaaaatgtg

SEQ ID NO: 116005 - DNA, 15 bp, Homo sapiens
aatacattaaaatgt

SEQ ID NO: 116006 - DNA, 15 bp, Homo sapiens
aaatacattaaaatg

SEQ ID NO: 116007 - DNA, 15 bp, Homo sapiens
caaatacattaaaat

SEQ ID NO: 116008 - DNA, 15 bp, Homo sapiens
gcaaatacattaaaa

SEQ ID NO: 116009 - DNA, 15 bp, Homo sapiens
tgcaaatacattaaa

SEQ ID NO: 116010 - DNA, 15 bp, Homo sapiens
gtgcaaatacattaa

SEQ ID NO: 116011 - DNA, 15 bp, Homo sapiens
agtgcaaatacatta

SEQ ID NO: 116012 - DNA, 15 bp, Homo sapiens
aagtgcaaatacatt

SEQ ID NO: 116013 - DNA, 15 bp, Homo sapiens
taagtgcaaatacat

SEQ ID NO: 116014 - DNA, 15 bp, Homo sapiens
ttaagtgcaaataca

SEQ ID NO: 116015 - DNA, 15 bp, Homo sapiens
tttaagtgcaaatac

SEQ ID NO: 116016 - DNA, 15 bp, Homo sapiens
ctttaagtgcaaata

SEQ ID NO: 116017 - DNA, 15 bp, Homo sapiens
tctttaagtgcaaat

SEQ ID NO: 116018 - DNA, 15 bp, Homo sapiens
atctttaagtgcaaa

SEQ ID NO: 116019 - DNA, 15 bp, Homo sapiens
aatctttaagtgcaa

SEQ ID NO: 116020 - DNA, 15 bp, Homo sapiens
taatctttaagtgca

SEQ ID NO: 116021 - DNA, 15 bp, Homo sapiens
ataatctttaagtgc

SEQ ID NO: 116022 - DNA, 15 bp, Homo sapiens
cataatctttaagtg

SEQ ID NO: 116023 - DNA, 15 bp, Homo sapiens
acataatctttaagt

SEQ ID NO: 116024 - DNA, 15 bp, Homo sapiens
tacataatctttaag

SEQ ID NO: 116025 - DNA, 15 bp, Homo sapiens
ttacataatctttaa

SEQ ID NO: 116026 - DNA, 15 bp, Homo sapiens
tttacataatcttta

SEQ ID NO: 116027 - DNA, 15 bp, Homo sapiens
ttttacataatcttt

SEQ ID NO: 116028 - DNA, 15 bp, Homo sapiens
attttacataatctt

SEQ ID NO: 116029 - DNA, 15 bp, Homo sapiens
aattttacataatct

SEQ ID NO: 116030 - DNA, 15 bp, Homo sapiens
taattttacataatc

SEQ ID NO: 116031 - DNA, 15 bp, Homo sapiens
ataattttacataat

SEQ ID NO: 116032 - DNA, 15 bp, Homo sapiens
aataattttacataa

SEQ ID NO: 116033 - DNA, 15 bp, Homo sapiens
aaataattttacata

SEQ ID NO: 116034 - DNA, 15 bp, Homo sapiens
aaaataattttacat

SEQ ID NO: 116035 - DNA, 15 bp, Homo sapiens
gaaaataattttaca

SEQ ID NO: 116036 - DNA, 15 bp, Homo sapiens
tgaaaataattttac

SEQ ID NO: 116037 - DNA, 15 bp, Homo sapiens
ttgaaaataatttta

SEQ ID NO: 116038 - DNA, 15 bp, Homo sapiens
attgaaaataatttt

SEQ ID NO: 116039 - DNA, 15 bp, Homo sapiens
cattgaaaataattt

SEQ ID NO: 116040 - DNA, 15 bp, Homo sapiens
gcattgaaaataatt

SEQ ID NO: 116041 - DNA, 15 bp, Homo sapiens
tgcattgaaaataat

SEQ ID NO: 116042 - DNA, 15 bp, Homo sapiens
ttgcattgaaaataa

SEQ ID NO: 116043 - DNA, 15 bp, Homo sapiens
tttgcattgaaaata

SEQ ID NO: 116044 - DNA, 15 bp, Homo sapiens
ctttgcattgaaaat

SEQ ID NO: 116045 - DNA, 15 bp, Homo sapiens
gctttgcattgaaaa

SEQ ID NO: 116046 - DNA, 15 bp, Homo sapiens
agctttgcattgaaa

SEQ ID NO: 116047 - DNA, 15 bp, Homo sapiens
aagctttgcattgaa

SEQ ID NO: 116048 - DNA, 15 bp, Homo sapiens
taagctttgcattga

SEQ ID NO: 116049 - DNA, 15 bp, Homo sapiens
ttaagctttgcattg

SEQ ID NO: 116050 - DNA, 15 bp, Homo sapiens
tttaagctttgcatt

SEQ ID NO: 116051 - DNA, 15 bp, Homo sapiens
atttaagctttgcat

SEQ ID NO: 116052 - DNA, 15 bp, Homo sapiens
tatttaagctttgca

SEQ ID NO: 116053 - DNA, 15 bp, Homo sapiens
ttatttaagctttgc

SEQ ID NO: 116054 - DNA, 15 bp, Homo sapiens
tttatttaagctttg

SEQ ID NO: 116055 - DNA, 15 bp, Homo sapiens
atttatttaagcttt

SEQ ID NO: 116056 - DNA, 15 bp, Homo sapiens
tatttatttaagctt

SEQ ID NO: 116057 - DNA, 15 bp, Homo sapiens
ttatttatttaagct

SEQ ID NO: 116058 - DNA, 15 bp, Homo sapiens
attatttatttaagc

SEQ ID NO: 116059 - DNA, 15 bp, Homo sapiens
tattatttatttaag

SEQ ID NO: 116060 - DNA, 15 bp, Homo sapiens
atattatttatttaa

SEQ ID NO: 116061 - DNA, 15 bp, Homo sapiens
aatattatttattta

SEQ ID NO: 116062 - DNA, 15 bp, Homo sapiens
aaatattatttattt

SEQ ID NO: 116063 - DNA, 15 bp, Homo sapiens
aaaatattatttatt

SEQ ID NO: 116064 - DNA, 15 bp, Homo sapiens
gaaaatattatttat

SEQ ID NO: 116065 - DNA, 15 bp, Homo sapiens
tgaaaatattattta

SEQ ID NO: 116066 - DNA, 15 bp, Homo sapiens
atgaaaatattattt

SEQ ID NO: 116067 - DNA, 15 bp, Homo sapiens
aatgaaaatattatt

SEQ ID NO: 116068 - DNA, 15 bp, Homo sapiens
aaatgaaaatattat

SEQ ID NO: 116069 - DNA, 15 bp, Homo sapiens
gaaatgaaaatatta

SEQ ID NO: 116070 - DNA, 15 bp, Homo sapiens
agaaatgaaaatatt

SEQ ID NO: 116071 - DNA, 15 bp, Homo sapiens
tcagaaatgaaaata

SEQ ID NO: 116072 - DNA, 15 bp, Homo sapiens
ttcagaaatgaaaat

SEQ ID NO: 116073 - DNA, 15 bp, Homo sapiens
attcagaaatgaaaa

SEQ ID NO: 116074 - DNA, 15 bp, Homo sapiens
tattcagaaatgaaa

SEQ ID NO: 116075 - DNA, 15 bp, Homo sapiens
gtattcagaaatgaa

SEQ ID NO: 116076 - DNA, 15 bp, Homo sapiens
agtattcagaaatga

SEQ ID NO: 116077 - DNA, 15 bp, Homo sapiens
cagtattcagaaatg

SEQ ID NO: 116078 - DNA, 15 bp, Homo sapiens
acagtattcagaaat

SEQ ID NO: 116079 - DNA, 15 bp, Homo sapiens
aacagtattcagaaa

SEQ ID NO: 116080 - DNA, 15 bp, Homo sapiens
aaacagtattcagaa

SEQ ID NO: 116081 - DNA, 15 bp, Homo sapiens
aaaacagtattcaga

SEQ ID NO: 116082 - DNA, 15 bp, Homo sapiens
aaaaacagtattcag

SEQ ID NO: 116083 - DNA, 15 bp, Homo sapiens
taaaaacagtattca

SEQ ID NO: 116084 - DNA, 15 bp, Homo sapiens
ataaaaacagtattc

SEQ ID NO: 116085 - DNA, 15 bp, Homo sapiens
aataaaaacagtatt

SEQ ID NO: 116086 - DNA, 15 bp, Homo sapiens
gaataaaaacagtat

SEQ ID NO: 116087 - DNA, 15 bp, Homo sapiens
ggaataaaaacagta

SEQ ID NO: 116088 - DNA, 15 bp, Homo sapiens
tggaataaaaacagt

SEQ ID NO: 116089 - DNA, 15 bp, Homo sapiens
atggaataaaaacag

SEQ ID NO: 116090 - DNA, 15 bp, Homo sapiens
tatggaataaaaaca

SEQ ID NO: 116091 - DNA, 15 bp, Homo sapiens
ttatggaataaaaac

SEQ ID NO: 116092 - DNA, 15 bp, Homo sapiens
gttatggaataaaaa

SEQ ID NO: 116093 - DNA, 15 bp, Homo sapiens
agttatggaataaaa

SEQ ID NO: 116094 - DNA, 15 bp, Homo sapiens
aagttatggaataaa

SEQ ID NO: 116095 - DNA, 15 bp, Homo sapiens
taagttatggaataa

SEQ ID NO: 116096 - DNA, 15 bp, Homo sapiens
ttaagttatggaata

SEQ ID NO: 116097 - DNA, 15 bp, Homo sapiens
tttaagttatggaat

SEQ ID NO: 116098 - DNA, 15 bp, Homo sapiens
atttaagttatggaa

SEQ ID NO: 116099 - DNA, 15 bp, Homo sapiens
tatttaagttatgga

SEQ ID NO: 116100 - DNA, 15 bp, Homo sapiens
atatttaagttatgg

SEQ ID NO: 116101 - DNA, 15 bp, Homo sapiens
tatatttaagttatg

SEQ ID NO: 116102 - DNA, 15 bp, Homo sapiens
ttatatttaagttat

SEQ ID NO: 116103 - DNA, 15 bp, Homo sapiens
gttatatttaagtta

SEQ ID NO: 116104 - DNA, 15 bp, Homo sapiens
agttatatttaagtt

SEQ ID NO: 116105 - DNA, 15 bp, Homo sapiens
tagttatatttaagt

SEQ ID NO: 116106 - DNA, 15 bp, Homo sapiens
atagttatatttaag

SEQ ID NO: 116107 - DNA, 15 bp, Homo sapiens
aatagttatatttaa

SEQ ID NO: 116108 - DNA, 15 bp, Homo sapiens
aaatagttatattta

SEQ ID NO: 116109 - DNA, 15 bp, Homo sapiens
aaaatagttatattt

SEQ ID NO: 116110 - DNA, 15 bp, Homo sapiens
gaaaatagttatatt

SEQ ID NO: 116111 - DNA, 15 bp, Homo sapiens
tgaaaatagttatat

SEQ ID NO: 116112 - DNA, 15 bp, Homo sapiens
ttgaaaatagttata

SEQ ID NO: 116113 - DNA, 15 bp, Homo sapiens
attgaaaatagttat

SEQ ID NO: 116114 - DNA, 15 bp, Homo sapiens
cattgaaaatagtta

SEQ ID NO: 116115 - DNA, 15 bp, Homo sapiens
acattgaaaatagtt

SEQ ID NO: 116116 - DNA, 15 bp, Homo sapiens
tacattgaaaatagt

SEQ ID NO: 116117 - DNA, 15 bp, Homo sapiens
ttacattgaaaatag

SEQ ID NO: 116118 - DNA, 15 bp, Homo sapiens
attacattgaaaata

SEQ ID NO: 116119 - DNA, 15 bp, Homo sapiens
gattacattgaaaat

SEQ ID NO: 116120 - DNA, 15 bp, Homo sapiens
agattacattgaaaa

SEQ ID NO: 116121 - DNA, 15 bp, Homo sapiens
aagattacattgaaa

SEQ ID NO: 116122 - DNA, 15 bp, Homo sapiens
aaagattacattgaa

SEQ ID NO: 116123 - DNA, 15 bp, Homo sapiens
aaaagattacattga

SEQ ID NO: 116124 - DNA, 15 bp, Homo sapiens
aaaaagattacattg

SEQ ID NO: 116125 - DNA, 15 bp, Homo sapiens
aaaaaagattacatt

SEQ ID NO: 116126 - DNA, 15 bp, Homo sapiens
taaaaaagattacat

SEQ ID NO: 116127 - DNA, 15 bp, Homo sapiens
gtaaaaaagattaca

SEQ ID NO: 116128 - DNA, 15 bp, Homo sapiens
agtaaaaaagattac

SEQ ID NO: 116129 - DNA, 15 bp, Homo sapiens
cagtaaaaaagatta

SEQ ID NO: 116130 - DNA, 15 bp, Homo sapiens
acagtaaaaaagatt

SEQ ID NO: 116131 - DNA, 15 bp, Homo sapiens
tacagtaaaaaagat

SEQ ID NO: 116132 - DNA, 15 bp, Homo sapiens
ttacagtaaaaaaga

SEQ ID NO: 116133 - DNA, 15 bp, Homo sapiens
tttacagtaaaaaag

SEQ ID NO: 116134 - DNA, 15 bp, Homo sapiens
ttttacagtaaaaaa

SEQ ID NO: 116135 - DNA, 15 bp, Homo sapiens
tttttacagtaaaaa

SEQ ID NO: 116136 - DNA, 15 bp, Homo sapiens
ttttttacagtaaaa

SEQ ID NO: 116137 - DNA, 15 bp, Homo sapiens
cttttttacagtaaa

SEQ ID NO: 116138 - DNA, 15 bp, Homo sapiens
acttttttacagtaa

SEQ ID NO: 116139 - DNA, 15 bp, Homo sapiens
tacttttttacagta

SEQ ID NO: 116140 - DNA, 15 bp, Homo sapiens
atacttttttacagt

SEQ ID NO: 116141 - DNA, 15 bp, Homo sapiens
catacttttttacag

SEQ ID NO: 116142 - DNA, 15 bp, Homo sapiens
acatacttttttaca

SEQ ID NO: 116143 - DNA, 15 bp, Homo sapiens
cacatacttttttac

SEQ ID NO: 116144 - DNA, 15 bp, Homo sapiens
acacatactttttta

SEQ ID NO: 116145 - DNA, 15 bp, Homo sapiens
tacacatactttttt

SEQ ID NO: 116146 - DNA, 15 bp, Homo sapiens
gtacacatacttttt

SEQ ID NO: 116147 - DNA, 15 bp, Homo sapiens
agtacacatactttt

SEQ ID NO: 116148 - DNA, 15 bp, Homo sapiens
tagtacacatacttt

SEQ ID NO: 116149 - DNA, 15 bp, Homo sapiens
atagtacacatactt

SEQ ID NO: 116150 - DNA, 15 bp, Homo sapiens
aatagtacacatact

SEQ ID NO: 116151 - DNA, 15 bp, Homo sapiens
aaatagtacacatac

SEQ ID NO: 116152 - DNA, 15 bp, Homo sapiens
taaatagtacacata

SEQ ID NO: 116153 - DNA, 15 bp, Homo sapiens
ctaaatagtacacat

SEQ ID NO: 116154 - DNA, 15 bp, Homo sapiens
tctaaatagtacaca

SEQ ID NO: 116155 - DNA, 15 bp, Homo sapiens
atctaaatagtacac

SEQ ID NO: 116156 - DNA, 15 bp, Homo sapiens
catctaaatagtaca

SEQ ID NO: 116157 - DNA, 15 bp, Homo sapiens
acatctaaatagtac

SEQ ID NO: 116158 - DNA, 15 bp, Homo sapiens
tacatctaaatagta

SEQ ID NO: 116159 - DNA, 15 bp, Homo sapiens
ttacatctaaatagt

SEQ ID NO: 116160 - DNA, 15 bp, Homo sapiens
attacatctaaatag

SEQ ID NO: 116161 - DNA, 15 bp, Homo sapiens
aattacatctaaata

SEQ ID NO: 116162 - DNA, 15 bp, Homo sapiens
taattacatctaaat

SEQ ID NO: 116163 - DNA, 15 bp, Homo sapiens
gtaattacatctaaa

SEQ ID NO: 116164 - DNA, 15 bp, Homo sapiens
agtaattacatctaa

SEQ ID NO: 116165 - DNA, 15 bp, Homo sapiens
aagtaattacatcta

SEQ ID NO: 116166 - DNA, 15 bp, Homo sapiens
caagtaattacatct

SEQ ID NO: 116167 - DNA, 15 bp, Homo sapiens
acaagtaattacatc

SEQ ID NO: 116168 - DNA, 15 bp, Homo sapiens
tacaagtaattacat

SEQ ID NO: 116169 - DNA, 15 bp, Homo sapiens
ctacaagtaattaca

SEQ ID NO: 116170 - DNA, 15 bp, Homo sapiens
actacaagtaattac

SEQ ID NO: 116171 - DNA, 15 bp, Homo sapiens
aactacaagtaatta

SEQ ID NO: 116172 - DNA, 15 bp, Homo sapiens
gaactacaagtaatt

SEQ ID NO: 116173 - DNA, 15 bp, Homo sapiens
tgaactacaagtaat

SEQ ID NO: 116174 - DNA, 15 bp, Homo sapiens
atgaactacaagtaa

SEQ ID NO: 116175 - DNA, 15 bp, Homo sapiens
aatgaactacaagta

SEQ ID NO: 116176 - DNA, 15 bp, Homo sapiens
taatgaactacaagt

SEQ ID NO: 116177 - DNA, 15 bp, Homo sapiens
ataatgaactacaag

SEQ ID NO: 116178 - DNA, 15 bp, Homo sapiens
aataatgaactacaa

SEQ ID NO: 116179 - DNA, 15 bp, Homo sapiens
aaataatgaactaca

SEQ ID NO: 116180 - DNA, 15 bp, Homo sapiens
aaaataatgaactac

SEQ ID NO: 116181 - DNA, 15 bp, Homo sapiens
aaaaataatgaacta

SEQ ID NO: 116182 - DNA, 15 bp, Homo sapiens
aaaaaataatgaact

SEQ ID NO: 116183 - DNA, 15 bp, Homo sapiens
taaaaaataatgaac

SEQ ID NO: 116184 - DNA, 15 bp, Homo sapiens
ataaaaaataatgaa

SEQ ID NO: 116185 - DNA, 15 bp, Homo sapiens
tataaaaaataatga

SEQ ID NO: 116186 - DNA, 15 bp, Homo sapiens
ctataaaaaataatg

SEQ ID NO: 116187 - DNA, 15 bp, Homo sapiens
actataaaaaataat

SEQ ID NO: 116188 - DNA, 15 bp, Homo sapiens
aactataaaaaataa

SEQ ID NO: 116189 - DNA, 15 bp, Homo sapiens
gaactataaaaaata

SEQ ID NO: 116190 - DNA, 15 bp, Homo sapiens
agaactataaaaaat

SEQ ID NO: 116191 - DNA, 15 bp, Homo sapiens
aagaactataaaaaa

SEQ ID NO: 116192 - DNA, 15 bp, Homo sapiens
taagaactataaaaa

SEQ ID NO: 116193 - DNA, 15 bp, Homo sapiens
ttaagaactataaaa

SEQ ID NO: 116194 - DNA, 15 bp, Homo sapiens
tttaagaactataaa

SEQ ID NO: 116195 - DNA, 15 bp, Homo sapiens
atttaagaactataa

SEQ ID NO: 116196 - DNA, 15 bp, Homo sapiens
catttaagaactata

SEQ ID NO: 116197 - DNA, 15 bp, Homo sapiens
gcatttaagaactat

SEQ ID NO: 116198 - DNA, 15 bp, Homo sapiens
agcatttaagaacta

SEQ ID NO: 116199 - DNA, 15 bp, Homo sapiens
tagcatttaagaact

SEQ ID NO: 116200 - DNA, 15 bp, Homo sapiens
atagcatttaagaac

SEQ ID NO: 116201 - DNA, 15 bp, Homo sapiens
aatagcatttaagaa

SEQ ID NO: 116202 - DNA, 15 bp, Homo sapiens
gaatagcatttaaga

SEQ ID NO: 116203 - DNA, 15 bp, Homo sapiens
agaatagcatttaag

SEQ ID NO: 116204 - DNA, 15 bp, Homo sapiens
tagaatagcatttaa

SEQ ID NO: 116205 - DNA, 15 bp, Homo sapiens
ctagaatagcattta

SEQ ID NO: 116206 - DNA, 15 bp, Homo sapiens
actagaatagcattt

SEQ ID NO: 116207 - DNA, 15 bp, Homo sapiens
gactagaatagcatt

SEQ ID NO: 116208 - DNA, 15 bp, Homo sapiens
tgactagaatagcat

SEQ ID NO: 116209 - DNA, 15 bp, Homo sapiens
ttgactagaatagca

SEQ ID NO: 116210 - DNA, 15 bp, Homo sapiens
attgactagaatagc

SEQ ID NO: 116211 - DNA, 15 bp, Homo sapiens
gattgactagaatag

SEQ ID NO: 116212 - DNA, 15 bp, Homo sapiens
tgattgactagaata

SEQ ID NO: 116213 - DNA, 15 bp, Homo sapiens
ctgattgactagaat

SEQ ID NO: 116214 - DNA, 15 bp, Homo sapiens
actgattgactagaa

SEQ ID NO: 116215 - DNA, 15 bp, Homo sapiens
tactgattgactaga

SEQ ID NO: 116216 - DNA, 15 bp, Homo sapiens
gtactgattgactag

SEQ ID NO: 116217 - DNA, 15 bp, Homo sapiens
tgtactgattgacta

SEQ ID NO: 116218 - DNA, 15 bp, Homo sapiens
atgtactgattgact

SEQ ID NO: 116219 - DNA, 15 bp, Homo sapiens
catgtactgattgac

SEQ ID NO: 116220 - DNA, 15 bp, Homo sapiens
gcatgtactgattga

SEQ ID NO: 116221 - DNA, 15 bp, Homo sapiens
ggcatgtactgattg

SEQ ID NO: 116222 - DNA, 15 bp, Homo sapiens
gggcatgtactgatt

SEQ ID NO: 116223 - DNA, 15 bp, Homo sapiens
tgggcatgtactgat

SEQ ID NO: 116224 - DNA, 15 bp, Homo sapiens
gtgggcatgtactga

SEQ ID NO: 116225 - DNA, 15 bp, Homo sapiens
agtgggcatgtactg

SEQ ID NO: 116226 - DNA, 15 bp, Homo sapiens
cagtgggcatgtact

SEQ ID NO: 116227 - DNA, 15 bp, Homo sapiens
tcagtgggcatgtac

SEQ ID NO: 116228 - DNA, 15 bp, Homo sapiens
ttcagtgggcatgta

SEQ ID NO: 116229 - DNA, 15 bp, Homo sapiens
cttcagtgggcatgt

SEQ ID NO: 116230 - DNA, 15 bp, Homo sapiens
tcttcagtgggcatg

SEQ ID NO: 116231 - DNA, 15 bp, Homo sapiens
ttcttcagtgggcat

SEQ ID NO: 116232 - DNA, 15 bp, Homo sapiens
tttcttcagtgggca

SEQ ID NO: 116233 - DNA, 15 bp, Homo sapiens
atttcttcagtgggc

SEQ ID NO: 116234 - DNA, 15 bp, Homo sapiens
catttcttcagtggg

SEQ ID NO: 116235 - DNA, 15 bp, Homo sapiens
tcatttcttcagtgg

SEQ ID NO: 116236 - DNA, 15 bp, Homo sapiens
ttcatttcttcagtg

SEQ ID NO: 116237 - DNA, 15 bp, Homo sapiens
tttcatttcttcagt

SEQ ID NO: 116238 - DNA, 15 bp, Homo sapiens
ctttcatttcttcag

SEQ ID NO: 116239 - DNA, 15 bp, Homo sapiens
tctttcatttcttca

SEQ ID NO: 116240 - DNA, 15 bp, Homo sapiens
atctttcatttcttc

SEQ ID NO: 116241 - DNA, 15 bp, Homo sapiens
aatctttcatttctt

SEQ ID NO: 116242 - DNA, 15 bp, Homo sapiens
gaatctttcatttct

SEQ ID NO: 116243 - DNA, 15 bp, Homo sapiens
agaatctttcatttc

SEQ ID NO: 116244 - DNA, 15 bp, Homo sapiens
aagaatctttcattt

SEQ ID NO: 116245 - DNA, 15 bp, Homo sapiens
taagaatctttcatt

SEQ ID NO: 116246 - DNA, 15 bp, Homo sapiens
ataagaatctttcat

SEQ ID NO: 116247 - DNA, 15 bp, Homo sapiens
aataagaatctttca

SEQ ID NO: 116248 - DNA, 15 bp, Homo sapiens
taataagaatctttc

SEQ ID NO: 116249 - DNA, 15 bp, Homo sapiens
ttaataagaatcttt

SEQ ID NO: 116250 - DNA, 15 bp, Homo sapiens
attaataagaatctt

SEQ ID NO: 116251 - DNA, 15 bp, Homo sapiens
tattaataagaatct

SEQ ID NO: 116252 - DNA, 15 bp, Homo sapiens
ttattaataagaatc

SEQ ID NO: 116253 - DNA, 15 bp, Homo sapiens
attattaataagaat

SEQ ID NO: 116254 - DNA, 15 bp, Homo sapiens
aattattaataagaa

SEQ ID NO: 116255 - DNA, 15 bp, Homo sapiens
caattattaataaga

SEQ ID NO: 116256 - DNA, 15 bp, Homo sapiens
gcaattattaataag

SEQ ID NO: 116257 - DNA, 15 bp, Homo sapiens
agcaattattaataa

SEQ ID NO: 116258 - DNA, 15 bp, Homo sapiens
cagcaattattaata

SEQ ID NO: 116259 - DNA, 15 bp, Homo sapiens
tcagcaattattaat

SEQ ID NO: 116260 - DNA, 15 bp, Homo sapiens
ctcagcaattattaa

SEQ ID NO: 116261 - DNA, 15 bp, Homo sapiens
tctcagcaattatta

SEQ ID NO: 116262 - DNA, 15 bp, Homo sapiens
ctctcagcaattatt

SEQ ID NO: 116263 - DNA, 15 bp, Homo sapiens
gctctcagcaattat

SEQ ID NO: 116264 - DNA, 15 bp, Homo sapiens
tgctctcagcaatta

SEQ ID NO: 116265 - DNA, 15 bp, Homo sapiens
atgctctcagcaatt

SEQ ID NO: 116266 - DNA, 15 bp, Homo sapiens
tatgctctcagcaat

SEQ ID NO: 116267 - DNA, 15 bp, Homo sapiens
ctatgctctcagcaa

SEQ ID NO: 116268 - DNA, 15 bp, Homo sapiens
gctatgctctcagca

SEQ ID NO: 116269 - DNA, 15 bp, Homo sapiens
agctatgctctcagc

SEQ ID NO: 116270 - DNA, 15 bp, Homo sapiens
tagctatgctctcag

SEQ ID NO: 116271 - DNA, 15 bp, Homo sapiens
atagctatgctctca

SEQ ID NO: 116272 - DNA, 15 bp, Homo sapiens
aatagctatgctctc

SEQ ID NO: 116273 - DNA, 15 bp, Homo sapiens
caatagctatgctct

SEQ ID NO: 116274 - DNA, 15 bp, Homo sapiens
ccaatagctatgctc

SEQ ID NO: 116275 - DNA, 15 bp, Homo sapiens
cccaatagctatgct

SEQ ID NO: 116276 - DNA, 15 bp, Homo sapiens
acccaatagctatgc

SEQ ID NO: 116277 - DNA, 15 bp, Homo sapiens
tacccaatagctatg

SEQ ID NO: 116278 - DNA, 15 bp, Homo sapiens
atacccaatagctat

SEQ ID NO: 116279 - DNA, 15 bp, Homo sapiens
gatacccaatagcta

SEQ ID NO: 116280 - DNA, 15 bp, Homo sapiens
ggatacccaatagct

SEQ ID NO: 116281 - DNA, 15 bp, Homo sapiens
aggatacccaatagc

SEQ ID NO: 116282 - DNA, 15 bp, Homo sapiens
aaggatacccaatag

SEQ ID NO: 116283 - DNA, 15 bp, Homo sapiens
aaaggatacccaata

SEQ ID NO: 116284 - DNA, 15 bp, Homo sapiens
taaaggatacccaat

SEQ ID NO: 116285 - DNA, 15 bp, Homo sapiens
ataaaggatacccaa

SEQ ID NO: 116286 - DNA, 15 bp, Homo sapiens
aataaaggataccca

SEQ ID NO: 116287 - DNA, 15 bp, Homo sapiens
aaataaaggataccc

SEQ ID NO: 116288 - DNA, 15 bp, Homo sapiens
aaaataaaggatacc

SEQ ID NO: 116289 - DNA, 15 bp, Homo sapiens
gaaaataaaggatac

SEQ ID NO: 116290 - DNA, 15 bp, Homo sapiens
agaaaataaaggata

SEQ ID NO: 116291 - DNA, 15 bp, Homo sapiens
gagaaaataaaggat

SEQ ID NO: 116292 - DNA, 15 bp, Homo sapiens
ggagaaaataaagga

SEQ ID NO: 116293 - DNA, 15 bp, Homo sapiens
gggagaaaataaagg

SEQ ID NO: 116294 - DNA, 15 bp, Homo sapiens
ggggagaaaataaag

SEQ ID NO: 116295 - DNA, 15 bp, Homo sapiens
gggggagaaaataaa

SEQ ID NO: 116296 - DNA, 15 bp, Homo sapiens
ggggggagaaaataa

SEQ ID NO: 116297 - DNA, 15 bp, Homo sapiens
aggggggagaaaata

SEQ ID NO: 116298 - DNA, 15 bp, Homo sapiens
aaggggggagaaaat

SEQ ID NO: 116299 - DNA, 15 bp, Homo sapiens
caaggggggagaaaa

SEQ ID NO: 116300 - DNA, 15 bp, Homo sapiens
gcaaggggggagaaa

SEQ ID NO: 116301 - DNA, 15 bp, Homo sapiens
agcaaggggggagaa

SEQ ID NO: 116302 - DNA, 15 bp, Homo sapiens
tagcaaggggggaga

SEQ ID NO: 116303 - DNA, 15 bp, Homo sapiens
ctagcaaggggggag

SEQ ID NO: 116304 - DNA, 15 bp, Homo sapiens
tctagcaagggggga

SEQ ID NO: 116305 - DNA, 15 bp, Homo sapiens
ctctagcaagggggg

SEQ ID NO: 116306 - DNA, 15 bp, Homo sapiens
tctctagcaaggggg

SEQ ID NO: 116307 - DNA, 15 bp, Homo sapiens
ttctctagcaagggg

SEQ ID NO: 116308 - DNA, 15 bp, Homo sapiens
attctctagcaaggg

SEQ ID NO: 116309 - DNA, 15 bp, Homo sapiens
tattctctagcaagg

SEQ ID NO: 116310 - DNA, 15 bp, Homo sapiens
ttattctctagcaag

SEQ ID NO: 116311 - DNA, 15 bp, Homo sapiens
attattctctagcaa

SEQ ID NO: 116312 - DNA, 15 bp, Homo sapiens
tattattctctagca

SEQ ID NO: 116313 - DNA, 15 bp, Homo sapiens
atattattctctagc

SEQ ID NO: 116314 - DNA, 15 bp, Homo sapiens
aatattattctctag

SEQ ID NO: 116315 - DNA, 15 bp, Homo sapiens
caatattattctcta

SEQ ID NO: 116316 - DNA, 15 bp, Homo sapiens
ccaatattattctct

SEQ ID NO: 116317 - DNA, 15 bp, Homo sapiens
tccaatattattctc

SEQ ID NO: 116318 - DNA, 15 bp, Homo sapiens
ttccaatattattct

SEQ ID NO: 116319 - DNA, 15 bp, Homo sapiens
tttccaatattattc

SEQ ID NO: 116320 - DNA, 15 bp, Homo sapiens
ctttccaatattatt

SEQ ID NO: 116321 - DNA, 15 bp, Homo sapiens
actttccaatattat

SEQ ID NO: 116322 - DNA, 15 bp, Homo sapiens
tactttccaatatta

SEQ ID NO: 116323 - DNA, 15 bp, Homo sapiens
ctactttccaatatt

SEQ ID NO: 116324 - DNA, 15 bp, Homo sapiens
actactttccaatat

SEQ ID NO: 116325 - DNA, 15 bp, Homo sapiens
tactactttccaata

SEQ ID NO: 116326 - DNA, 15 bp, Homo sapiens
atactactttccaat

SEQ ID NO: 116327 - DNA, 15 bp, Homo sapiens
aatactactttccaa

SEQ ID NO: 116328 - DNA, 15 bp, Homo sapiens
aaatactactttcca

SEQ ID NO: 116329 - DNA, 15 bp, Homo sapiens
gaaatactactttcc

SEQ ID NO: 116330 - DNA, 15 bp, Homo sapiens
tgaaatactactttc

SEQ ID NO: 116331 - DNA, 15 bp, Homo sapiens
ctgaaatactacttt

SEQ ID NO: 116332 - DNA, 15 bp, Homo sapiens
actgaaatactactt

SEQ ID NO: 116333 - DNA, 15 bp, Homo sapiens
aactgaaatactact

SEQ ID NO: 116334 - DNA, 15 bp, Homo sapiens
gaactgaaatactac

SEQ ID NO: 116335 - DNA, 15 bp, Homo sapiens
agaactgaaatacta

SEQ ID NO: 116336 - DNA, 15 bp, Homo sapiens
cagaactgaaatact

SEQ ID NO: 116337 - DNA, 15 bp, Homo sapiens
acagaactgaaatac

SEQ ID NO: 116338 - DNA, 15 bp, Homo sapiens
gacagaactgaaata

SEQ ID NO: 116339 - DNA, 15 bp, Homo sapiens
tgacagaactgaaat

SEQ ID NO: 116340 - DNA, 15 bp, Homo sapiens
atgacagaactgaaa

SEQ ID NO: 116341 - DNA, 15 bp, Homo sapiens
tatgacagaactgaa

SEQ ID NO: 116342 - DNA, 15 bp, Homo sapiens
ttatgacagaactga

SEQ ID NO: 116343 - DNA, 15 bp, Homo sapiens
tttatgacagaactg

SEQ ID NO: 116344 - DNA, 15 bp, Homo sapiens
atttatgacagaact

SEQ ID NO: 116345 - DNA, 15 bp, Homo sapiens
tatttatgacagaac

SEQ ID NO: 116346 - DNA, 15 bp, Homo sapiens
atatttatgacagaa

SEQ ID NO: 116347 - DNA, 15 bp, Homo sapiens
catatttatgacaga

SEQ ID NO: 116348 - DNA, 15 bp, Homo sapiens
gcatatttatgacag

SEQ ID NO: 116349 - DNA, 15 bp, Homo sapiens
ggcatatttatgaca

SEQ ID NO: 116350 - DNA, 15 bp, Homo sapiens
tggcatatttatgac

SEQ ID NO: 116351 - DNA, 15 bp, Homo sapiens
ctggcatatttatga

SEQ ID NO: 116352 - DNA, 15 bp, Homo sapiens
actggcatatttatg

SEQ ID NO: 116353 - DNA, 15 bp, Homo sapiens
tactggcatatttat

SEQ ID NO: 116354 - DNA, 15 bp, Homo sapiens
ttactggcatattta

SEQ ID NO: 116355 - DNA, 15 bp, Homo sapiens
attactggcatattt

SEQ ID NO: 116356 - DNA, 15 bp, Homo sapiens
aattactggcatatt

SEQ ID NO: 116357 - DNA, 15 bp, Homo sapiens
caattactggcatat

SEQ ID NO: 116358 - DNA, 15 bp, Homo sapiens
tcaattactggcata

SEQ ID NO: 116359 - DNA, 15 bp, Homo sapiens
gtcaattactggcat

SEQ ID NO: 116360 - DNA, 15 bp, Homo sapiens
tgtcaattactggca

SEQ ID NO: 116361 - DNA, 15 bp, Homo sapiens
atgtcaattactggc

SEQ ID NO: 116362 - DNA, 15 bp, Homo sapiens
catgtcaattactgg

SEQ ID NO: 116363 - DNA, 15 bp, Homo sapiens
ccatgtcaattactg

SEQ ID NO: 116364 - DNA, 15 bp, Homo sapiens
gccatgtcaattact

SEQ ID NO: 116365 - DNA, 15 bp, Homo sapiens
ggccatgtcaattac

SEQ ID NO: 116366 - DNA, 15 bp, Homo sapiens
tggccatgtcaatta

SEQ ID NO: 116367 - DNA, 15 bp, Homo sapiens
ttggccatgtcaatt

SEQ ID NO: 116368 - DNA, 15 bp, Homo sapiens
cttggccatgtcaat

SEQ ID NO: 116369 - DNA, 15 bp, Homo sapiens
acttggccatgtcaa

SEQ ID NO: 116370 - DNA, 15 bp, Homo sapiens
cacttggccatgtca

SEQ ID NO: 116371 - DNA, 15 bp, Homo sapiens
tcacttggccatgtc

SEQ ID NO: 116372 - DNA, 15 bp, Homo sapiens
ctcacttggccatgt

SEQ ID NO: 116373 - DNA, 15 bp, Homo sapiens
actcacttggccatg

SEQ ID NO: 116374 - DNA, 15 bp, Homo sapiens
cactcacttggccat

SEQ ID NO: 116375 - DNA, 15 bp, Homo sapiens
acactcacttggcca

SEQ ID NO: 116376 - DNA, 15 bp, Homo sapiens
aacactcacttggcc

SEQ ID NO: 116377 - DNA, 15 bp, Homo sapiens
aaacactcacttggc

SEQ ID NO: 116378 - DNA, 15 bp, Homo sapiens
taaacactcacttgg

SEQ ID NO: 116379 - DNA, 15 bp, Homo sapiens
ttaaacactcacttg

SEQ ID NO: 116380 - DNA, 15 bp, Homo sapiens
tttaaacactcactt

SEQ ID NO: 116381 - DNA, 15 bp, Homo sapiens
gtttaaacactcact

SEQ ID NO: 116382 - DNA, 15 bp, Homo sapiens
ggtttaaacactcac

SEQ ID NO: 116383 - DNA, 15 bp, Homo sapiens
aggtttaaacactca

SEQ ID NO: 116384 - DNA, 15 bp, Homo sapiens
caggtttaaacactc

SEQ ID NO: 116385 - DNA, 15 bp, Homo sapiens
ccaggtttaaacact

SEQ ID NO: 116386 - DNA, 15 bp, Homo sapiens
tccaggtttaaacac

SEQ ID NO: 116387 - DNA, 15 bp, Homo sapiens
gtccaggtttaaaca

SEQ ID NO: 116388 - DNA, 15 bp, Homo sapiens
agtccaggtttaaac

SEQ ID NO: 116389 - DNA, 15 bp, Homo sapiens
gagtccaggtttaaa

SEQ ID NO: 116390 - DNA, 15 bp, Homo sapiens
tgagtccaggtttaa

SEQ ID NO: 116391 - DNA, 15 bp, Homo sapiens
atgagtccaggttta

SEQ ID NO: 116392 - DNA, 15 bp, Homo sapiens
aatgagtccaggttt

SEQ ID NO: 116393 - DNA, 15 bp, Homo sapiens
aaatgagtccaggtt

SEQ ID NO: 116394 - DNA, 15 bp, Homo sapiens
caaatgagtccaggt

SEQ ID NO: 116395 - DNA, 15 bp, Homo sapiens
acaaatgagtccagg

SEQ ID NO: 116396 - DNA, 15 bp, Homo sapiens
cacaaatgagtccag

SEQ ID NO: 116397 - DNA, 15 bp, Homo sapiens
tcacaaatgagtcca

SEQ ID NO: 116398 - DNA, 15 bp, Homo sapiens
ttcacaaatgagtcc

SEQ ID NO: 116399 - DNA, 15 bp, Homo sapiens
attcacaaatgagtc

SEQ ID NO: 116400 - DNA, 15 bp, Homo sapiens
aattcacaaatgagt

SEQ ID NO: 116401 - DNA, 15 bp, Homo sapiens
aaattcacaaatgag

SEQ ID NO: 116402 - DNA, 15 bp, Homo sapiens
caaattcacaaatga

SEQ ID NO: 116403 - DNA, 15 bp, Homo sapiens
acaaattcacaaatg

SEQ ID NO: 116404 - DNA, 15 bp, Homo sapiens
tacaaattcacaaat

SEQ ID NO: 116405 - DNA, 15 bp, Homo sapiens
ttacaaattcacaaa

SEQ ID NO: 116406 - DNA, 15 bp, Homo sapiens
attacaaattcacaa

SEQ ID NO: 116407 - DNA, 15 bp, Homo sapiens
aattacaaattcaca

SEQ ID NO: 116408 - DNA, 15 bp, Homo sapiens
caattacaaattcac

SEQ ID NO: 116409 - DNA, 15 bp, Homo sapiens
ccaattacaaattca

SEQ ID NO: 116410 - DNA, 15 bp, Homo sapiens
accaattacaaattc

SEQ ID NO: 116411 - DNA, 15 bp, Homo sapiens
taccaattacaaatt

SEQ ID NO: 116412 - DNA, 15 bp, Homo sapiens
ataccaattacaaat

SEQ ID NO: 116413 - DNA, 15 bp, Homo sapiens
cataccaattacaaa

SEQ ID NO: 116414 - DNA, 15 bp, Homo sapiens
gcataccaattacaa

SEQ ID NO: 116415 - DNA, 15 bp, Homo sapiens
agcataccaattaca

SEQ ID NO: 116416 - DNA, 15 bp, Homo sapiens
aagcataccaattac

SEQ ID NO: 116417 - DNA, 15 bp, Homo sapiens
aaagcataccaatta

SEQ ID NO: 116418 - DNA, 15 bp, Homo sapiens
gaaagcataccaatt

SEQ ID NO: 116419 - DNA, 15 bp, Homo sapiens
ggaaagcataccaat

SEQ ID NO: 116420 - DNA, 15 bp, Homo sapiens
tggaaagcataccaa

SEQ ID NO: 116421 - DNA, 15 bp, Homo sapiens
ttggaaagcatacca

SEQ ID NO: 116422 - DNA, 15 bp, Homo sapiens
cttggaaagcatacc

SEQ ID NO: 116423 - DNA, 15 bp, Homo sapiens
ccttggaaagcatac

SEQ ID NO: 116424 - DNA, 15 bp, Homo sapiens
accttggaaagcata

SEQ ID NO: 116425 - DNA, 15 bp, Homo sapiens
caccttggaaagcat

SEQ ID NO: 116426 - DNA, 15 bp, Homo sapiens
acaccttggaaagca

SEQ ID NO: 116427 - DNA, 15 bp, Homo sapiens
cacaccttggaaagc

SEQ ID NO: 116428 - DNA, 15 bp, Homo sapiens
tcacaccttggaaag

SEQ ID NO: 116429 - DNA, 15 bp, Homo sapiens
atcacaccttggaaa

SEQ ID NO: 116430 - DNA, 15 bp, Homo sapiens
aatcacaccttggaa

SEQ ID NO: 116431 - DNA, 15 bp, Homo sapiens
aaatcacaccttgga

SEQ ID NO: 116432 - DNA, 15 bp, Homo sapiens
taaatcacaccttgg

SEQ ID NO: 116433 - DNA, 15 bp, Homo sapiens
ttaaatcacaccttg

SEQ ID NO: 116434 - DNA, 15 bp, Homo sapiens
attaaatcacacctt

SEQ ID NO: 116435 - DNA, 15 bp, Homo sapiens
cattaaatcacacct

SEQ ID NO: 116436 - DNA, 15 bp, Homo sapiens
acattaaatcacacc

SEQ ID NO: 116437 - DNA, 15 bp, Homo sapiens
tacattaaatcacac

SEQ ID NO: 116438 - DNA, 15 bp, Homo sapiens
ctacattaaatcaca

SEQ ID NO: 116439 - DNA, 15 bp, Homo sapiens
tctacattaaatcac

SEQ ID NO: 116440 - DNA, 15 bp, Homo sapiens
ttctacattaaatca

SEQ ID NO: 116441 - DNA, 15 bp, Homo sapiens
tttctacattaaatc

SEQ ID NO: 116442 - DNA, 15 bp, Homo sapiens
atttctacattaaat

SEQ ID NO: 116443 - DNA, 15 bp, Homo sapiens
tatttctacattaaa

SEQ ID NO: 116444 - DNA, 15 bp, Homo sapiens
atatttctacattaa

SEQ ID NO: 116445 - DNA, 15 bp, Homo sapiens
tatatttctacatta

SEQ ID NO: 116446 - DNA, 15 bp, Homo sapiens
ttatatttctacatt

SEQ ID NO: 116447 - DNA, 15 bp, Homo sapiens
tttatatttctacat

SEQ ID NO: 116448 - DNA, 15 bp, Homo sapiens
gtttatatttctaca

SEQ ID NO: 116449 - DNA, 15 bp, Homo sapiens
agtttatatttctac

SEQ ID NO: 116450 - DNA, 15 bp, Homo sapiens
aagtttatatttcta

SEQ ID NO: 116451 - DNA, 15 bp, Homo sapiens
caagtttatatttct

SEQ ID NO: 116452 - DNA, 15 bp, Homo sapiens
tcaagtttatatttc

SEQ ID NO: 116453 - DNA, 15 bp, Homo sapiens
ctcaagtttatattt

SEQ ID NO: 116454 - DNA, 15 bp, Homo sapiens
gctcaagtttatatt

SEQ ID NO: 116455 - DNA, 15 bp, Homo sapiens
agctcaagtttatat

SEQ ID NO: 116456 - DNA, 15 bp, Homo sapiens
gagctcaagtttata

SEQ ID NO: 116457 - DNA, 15 bp, Homo sapiens
ggagctcaagtttat

SEQ ID NO: 116458 - DNA, 15 bp, Homo sapiens
aggagctcaagttta

SEQ ID NO: 116459 - DNA, 15 bp, Homo sapiens
aaggagctcaagttt

SEQ ID NO: 116460 - DNA, 15 bp, Homo sapiens
taaggagctcaagtt

SEQ ID NO: 116461 - DNA, 15 bp, Homo sapiens
ttaaggagctcaagt

SEQ ID NO: 116462 - DNA, 15 bp, Homo sapiens
tttaaggagctcaag

SEQ ID NO: 116463 - DNA, 15 bp, Homo sapiens
ttttaaggagctcaa

SEQ ID NO: 116464 - DNA, 15 bp, Homo sapiens
attttaaggagctca

SEQ ID NO: 116465 - DNA, 15 bp, Homo sapiens
cattttaaggagctc

SEQ ID NO: 116466 - DNA, 15 bp, Homo sapiens
tcattttaaggagct

SEQ ID NO: 116467 - DNA, 15 bp, Homo sapiens
atcattttaaggagc

SEQ ID NO: 116468 - DNA, 15 bp, Homo sapiens
aatcattttaaggag

SEQ ID NO: 116469 - DNA, 15 bp, Homo sapiens
caatcattttaagga

SEQ ID NO: 116470 - DNA, 15 bp, Homo sapiens
ccaatcattttaagg

SEQ ID NO: 116471 - DNA, 15 bp, Homo sapiens
accaatcattttaag

SEQ ID NO: 116472 - DNA, 15 bp, Homo sapiens
aaccaatcattttaa

SEQ ID NO: 116473 - DNA, 15 bp, Homo sapiens
aaaccaatcatttta

SEQ ID NO: 116474 - DNA, 15 bp, Homo sapiens
taaaccaatcatttt

SEQ ID NO: 116475 - DNA, 15 bp, Homo sapiens
ttaaaccaatcattt

SEQ ID NO: 116476 - DNA, 15 bp, Homo sapiens
tttaaaccaatcatt

SEQ ID NO: 116477 - DNA, 15 bp, Homo sapiens
atttaaaccaatcat

SEQ ID NO: 116478 - DNA, 15 bp, Homo sapiens
catttaaaccaatca

SEQ ID NO: 116479 - DNA, 15 bp, Homo sapiens
acatttaaaccaatc

SEQ ID NO: 116480 - DNA, 15 bp, Homo sapiens
aacatttaaaccaat

SEQ ID NO: 116481 - DNA, 15 bp, Homo sapiens
caacatttaaaccaa

SEQ ID NO: 116482 - DNA, 15 bp, Homo sapiens
tcaacatttaaacca

SEQ ID NO: 116483 - DNA, 15 bp, Homo sapiens
atcaacatttaaacc

SEQ ID NO: 116484 - DNA, 15 bp, Homo sapiens
aatcaacatttaaac

SEQ ID NO: 116485 - DNA, 15 bp, Homo sapiens
aaatcaacatttaaa

SEQ ID NO: 116486 - DNA, 15 bp, Homo sapiens
taaatcaacatttaa

SEQ ID NO: 116487 - DNA, 15 bp, Homo sapiens
ttaaatcaacattta

SEQ ID NO: 116488 - DNA, 15 bp, Homo sapiens
tttaaatcaacattt

SEQ ID NO: 116489 - DNA, 15 bp, Homo sapiens
ttttaaatcaacatt

SEQ ID NO: 116490 - DNA, 15 bp, Homo sapiens
tttttaaatcaacat

SEQ ID NO: 116491 - DNA, 15 bp, Homo sapiens
ttttttaaatcaaca

SEQ ID NO: 116492 - DNA, 15 bp, Homo sapiens
attttttaaatcaac

SEQ ID NO: 116493 - DNA, 15 bp, Homo sapiens
cattttttaaatcaa

SEQ ID NO: 116494 - DNA, 15 bp, Homo sapiens
ccattttttaaatca

SEQ ID NO: 116495 - DNA, 15 bp, Homo sapiens
accattttttaaatc

SEQ ID NO: 116496 - DNA, 15 bp, Homo sapiens
gaccattttttaaat

SEQ ID NO: 116497 - DNA, 15 bp, Homo sapiens
tgaccattttttaaa

SEQ ID NO: 116498 - DNA, 15 bp, Homo sapiens
ttgaccattttttaa

SEQ ID NO: 116499 - DNA, 15 bp, Homo sapiens
attgaccatttttta

SEQ ID NO: 116500 - DNA, 15 bp, Homo sapiens
tattgaccatttttt

SEQ ID NO: 116501 - DNA, 15 bp, Homo sapiens
ttattgaccattttt

SEQ ID NO: 116502 - DNA, 15 bp, Homo sapiens
attattgaccatttt

SEQ ID NO: 116503 - DNA, 15 bp, Homo sapiens
tattattgaccattt

SEQ ID NO: 116504 - DNA, 15 bp, Homo sapiens
ctattattgaccatt

SEQ ID NO: 116505 - DNA, 15 bp, Homo sapiens
actattattgaccat

SEQ ID NO: 116506 - DNA, 15 bp, Homo sapiens
tactattattgacca

SEQ ID NO: 116507 - DNA, 15 bp, Homo sapiens
ctactattattgacc

SEQ ID NO: 116508 - DNA, 15 bp, Homo sapiens
gctactattattgac

SEQ ID NO: 116509 - DNA, 15 bp, Homo sapiens
tgctactattattga

SEQ ID NO: 116510 - DNA, 15 bp, Homo sapiens
ctgctactattattg

SEQ ID NO: 116511 - DNA, 15 bp, Homo sapiens
actgctactattatt

SEQ ID NO: 116512 - DNA, 15 bp, Homo sapiens
tactgctactattat

SEQ ID NO: 116513 - DNA, 15 bp, Homo sapiens
ctactgctactatta

SEQ ID NO: 116514 - DNA, 15 bp, Homo sapiens
cctactgctactatt

SEQ ID NO: 116515 - DNA, 15 bp, Homo sapiens
ccctactgctactat

SEQ ID NO: 116516 - DNA, 15 bp, Homo sapiens
accctactgctacta

SEQ ID NO: 116517 - DNA, 15 bp, Homo sapiens
taccctactgctact

SEQ ID NO: 116518 - DNA, 15 bp, Homo sapiens
ctaccctactgctac

SEQ ID NO: 116519 - DNA, 15 bp, Homo sapiens
tctaccctactgcta

SEQ ID NO: 116520 - DNA, 15 bp, Homo sapiens
atctaccctactgct

SEQ ID NO: 116521 - DNA, 15 bp, Homo sapiens
tatctaccctactgc

SEQ ID NO: 116522 - DNA, 15 bp, Homo sapiens
gtatctaccctactg

SEQ ID NO: 116523 - DNA, 15 bp, Homo sapiens
tgtatctaccctact

SEQ ID NO: 116524 - DNA, 15 bp, Homo sapiens
atgtatctaccctac

SEQ ID NO: 116525 - DNA, 15 bp, Homo sapiens
catgtatctacccta

SEQ ID NO: 116526 - DNA, 15 bp, Homo sapiens
gcatgtatctaccct

SEQ ID NO: 116527 - DNA, 15 bp, Homo sapiens
tgcatgtatctaccc

SEQ ID NO: 116528 - DNA, 15 bp, Homo sapiens
atgcatgtatctacc

SEQ ID NO: 116529 - DNA, 15 bp, Homo sapiens
tatgcatgtatctac

SEQ ID NO: 116530 - DNA, 15 bp, Homo sapiens
atatgcatgtatcta

SEQ ID NO: 116531 - DNA, 15 bp, Homo sapiens
aatatgcatgtatct

SEQ ID NO: 116532 - DNA, 15 bp, Homo sapiens
caatatgcatgtatc

SEQ ID NO: 116533 - DNA, 15 bp, Homo sapiens
gcaatatgcatgtat

SEQ ID NO: 116534 - DNA, 15 bp, Homo sapiens
agcaatatgcatgta

SEQ ID NO: 116535 - DNA, 15 bp, Homo sapiens
aagcaatatgcatgt

SEQ ID NO: 116536 - DNA, 15 bp, Homo sapiens
aaagcaatatgcatg

SEQ ID NO: 116537 - DNA, 15 bp, Homo sapiens
aaaagcaatatgcat

SEQ ID NO: 116538 - DNA, 15 bp, Homo sapiens
aaaaagcaatatgca

SEQ ID NO: 116539 - DNA, 15 bp, Homo sapiens
caaaaagcaatatgc

SEQ ID NO: 116540 - DNA, 15 bp, Homo sapiens
tcaaaaagcaatatg

SEQ ID NO: 116541 - DNA, 15 bp, Homo sapiens
atcaaaaagcaatat

SEQ ID NO: 116542 - DNA, 15 bp, Homo sapiens
aatcaaaaagcaata

SEQ ID NO: 116543 - DNA, 15 bp, Homo sapiens
caatcaaaaagcaat

SEQ ID NO: 116544 - DNA, 15 bp, Homo sapiens
tcaatcaaaaagcaa

SEQ ID NO: 116545 - DNA, 15 bp, Homo sapiens
ttcaatcaaaaagca

SEQ ID NO: 116546 - DNA, 15 bp, Homo sapiens
tttcaatcaaaaagc

SEQ ID NO: 116547 - DNA, 15 bp, Homo sapiens
ctttcaatcaaaaag

SEQ ID NO: 116548 - DNA, 15 bp, Homo sapiens
tctttcaatcaaaaa

SEQ ID NO: 116549 - DNA, 15 bp, Homo sapiens
ctctttcaatcaaaa

SEQ ID NO: 116550 - DNA, 15 bp, Homo sapiens
gctctttcaatcaaa

SEQ ID NO: 116551 - DNA, 15 bp, Homo sapiens
agctctttcaatcaa

SEQ ID NO: 116552 - DNA, 15 bp, Homo sapiens
aagctctttcaatca

SEQ ID NO: 116553 - DNA, 15 bp, Homo sapiens
aaagctctttcaatc

SEQ ID NO: 116554 - DNA, 15 bp, Homo sapiens
caaagctctttcaat

SEQ ID NO: 116555 - DNA, 15 bp, Homo sapiens
acaaagctctttcaa

SEQ ID NO: 116556 - DNA, 15 bp, Homo sapiens
tacaaagctctttca

SEQ ID NO: 116557 - DNA, 15 bp, Homo sapiens
ctacaaagctctttc

SEQ ID NO: 116558 - DNA, 15 bp, Homo sapiens
actacaaagctcttt

SEQ ID NO: 116559 - DNA, 15 bp, Homo sapiens
aactacaaagctctt

SEQ ID NO: 116560 - DNA, 15 bp, Homo sapiens
aaactacaaagctct

SEQ ID NO: 116561 - DNA, 15 bp, Homo sapiens
aaaactacaaagctc

SEQ ID NO: 116562 - DNA, 15 bp, Homo sapiens
taaaactacaaagct

SEQ ID NO: 116563 - DNA, 15 bp, Homo sapiens
ttaaaactacaaagc

SEQ ID NO: 116564 - DNA, 15 bp, Homo sapiens
attaaaactacaaag

SEQ ID NO: 116565 - DNA, 15 bp, Homo sapiens
aattaaaactacaaa

SEQ ID NO: 116566 - DNA, 15 bp, Homo sapiens
caattaaaactacaa

SEQ ID NO: 116567 - DNA, 15 bp, Homo sapiens
acaattaaaactaca

SEQ ID NO: 116568 - DNA, 15 bp, Homo sapiens
cacaattaaaactac

SEQ ID NO: 116569 - DNA, 15 bp, Homo sapiens
ccacaattaaaacta

SEQ ID NO: 116570 - DNA, 15 bp, Homo sapiens
tccacaattaaaact

SEQ ID NO: 116571 - DNA, 15 bp, Homo sapiens
ttccacaattaaaac

SEQ ID NO: 116572 - DNA, 15 bp, Homo sapiens
gttccacaattaaaa

SEQ ID NO: 116573 - DNA, 15 bp, Homo sapiens
agttccacaattaaa

SEQ ID NO: 116574 - DNA, 15 bp, Homo sapiens
gagttccacaattaa

SEQ ID NO: 116575 - DNA, 15 bp, Homo sapiens
tgagttccacaatta

SEQ ID NO: 116576 - DNA, 15 bp, Homo sapiens
atgagttccacaatt

SEQ ID NO: 116577 - DNA, 15 bp, Homo sapiens
catgagttccacaat

SEQ ID NO: 116578 - DNA, 15 bp, Homo sapiens
gcatgagttccacaa

SEQ ID NO: 116579 - DNA, 15 bp, Homo sapiens
agcatgagttccaca

SEQ ID NO: 116580 - DNA, 15 bp, Homo sapiens
gagcatgagttccac

SEQ ID NO: 116581 - DNA, 15 bp, Homo sapiens
agagcatgagttcca

SEQ ID NO: 116582 - DNA, 15 bp, Homo sapiens
gagagcatgagttcc

SEQ ID NO: 116583 - DNA, 15 bp, Homo sapiens
agagagcatgagttc

SEQ ID NO: 116584 - DNA, 15 bp, Homo sapiens
gagagagcatgagtt

SEQ ID NO: 116585 - DNA, 15 bp, Homo sapiens
agagagagcatgagt

SEQ ID NO: 116586 - DNA, 15 bp, Homo sapiens
tagagagagcatgag

SEQ ID NO: 116587 - DNA, 15 bp, Homo sapiens
atagagagagcatga

SEQ ID NO: 116588 - DNA, 15 bp, Homo sapiens
tatagagagagcatg

SEQ ID NO: 116589 - DNA, 15 bp, Homo sapiens
ttatagagagagcat

SEQ ID NO: 116590 - DNA, 15 bp, Homo sapiens
attatagagagagca

SEQ ID NO: 116591 - DNA, 15 bp, Homo sapiens
aattatagagagagc

SEQ ID NO: 116592 - DNA, 15 bp, Homo sapiens
gaattatagagagag

SEQ ID NO: 116593 - DNA, 15 bp, Homo sapiens
agaattatagagaga

SEQ ID NO: 116594 - DNA, 15 bp, Homo sapiens
cagaattatagagag

SEQ ID NO: 116595 - DNA, 15 bp, Homo sapiens
acagaattatagaga

SEQ ID NO: 116596 - DNA, 15 bp, Homo sapiens
cacagaattatagag

SEQ ID NO: 116597 - DNA, 15 bp, Homo sapiens
tcacagaattataga

SEQ ID NO: 116598 - DNA, 15 bp, Homo sapiens
gtcacagaattatag

SEQ ID NO: 116599 - DNA, 15 bp, Homo sapiens
agtcacagaattata

SEQ ID NO: 116600 - DNA, 15 bp, Homo sapiens
tagtcacagaattat

SEQ ID NO: 116601 - DNA, 15 bp, Homo sapiens
atagtcacagaatta

SEQ ID NO: 116602 - DNA, 15 bp, Homo sapiens
tatagtcacagaatt

SEQ ID NO: 116603 - DNA, 15 bp, Homo sapiens
atatagtcacagaat

SEQ ID NO: 116604 - DNA, 15 bp, Homo sapiens
tatatagtcacagaa

SEQ ID NO: 116605 - DNA, 15 bp, Homo sapiens
gtatatagtcacaga

SEQ ID NO: 116606 - DNA, 15 bp, Homo sapiens
agtatatagtcacag

SEQ ID NO: 116607 - DNA, 15 bp, Homo sapiens
aagtatatagtcaca

SEQ ID NO: 116608 - DNA, 15 bp, Homo sapiens
aaagtatatagtcac

SEQ ID NO: 116609 - DNA, 15 bp, Homo sapiens
caaagtatatagtca

SEQ ID NO: 116610 - DNA, 15 bp, Homo sapiens
gcaaagtatatagtc

SEQ ID NO: 116611 - DNA, 15 bp, Homo sapiens
ggcaaagtatatagt

SEQ ID NO: 116612 - DNA, 15 bp, Homo sapiens
aggcaaagtatatag

SEQ ID NO: 116613 - DNA, 15 bp, Homo sapiens
caggcaaagtatata

SEQ ID NO: 116614 - DNA, 15 bp, Homo sapiens
ccaggcaaagtatat

SEQ ID NO: 116615 - DNA, 15 bp, Homo sapiens
accaggcaaagtata

SEQ ID NO: 116616 - DNA, 15 bp, Homo sapiens
caccaggcaaagtat

SEQ ID NO: 116617 - DNA, 15 bp, Homo sapiens
tcaccaggcaaagta

SEQ ID NO: 116618 - DNA, 15 bp, Homo sapiens
ttcaccaggcaaagt

SEQ ID NO: 116619 - DNA, 15 bp, Homo sapiens
tttcaccaggcaaag

SEQ ID NO: 116620 - DNA, 15 bp, Homo sapiens
gtttcaccaggcaaa

SEQ ID NO: 116621 - DNA, 15 bp, Homo sapiens
agtttcaccaggcaa

SEQ ID NO: 116622 - DNA, 15 bp, Homo sapiens
aagtttcaccaggca

SEQ ID NO: 116623 - DNA, 15 bp, Homo sapiens
taagtttcaccaggc

SEQ ID NO: 116624 - DNA, 15 bp, Homo sapiens
gtaagtttcaccagg

SEQ ID NO: 116625 - DNA, 15 bp, Homo sapiens
cgtaagtttcaccag

SEQ ID NO: 116626 - DNA, 15 bp, Homo sapiens
tcgtaagtttcacca

SEQ ID NO: 116627 - DNA, 15 bp, Homo sapiens
ttcgtaagtttcacc

SEQ ID NO: 116628 - DNA, 15 bp, Homo sapiens
attcgtaagtttcac

SEQ ID NO: 116629 - DNA, 15 bp, Homo sapiens
cattcgtaagtttca

SEQ ID NO: 116630 - DNA, 15 bp, Homo sapiens
acattcgtaagtttc

SEQ ID NO: 116631 - DNA, 15 bp, Homo sapiens
cacattcgtaagttt

SEQ ID NO: 116632 - DNA, 15 bp, Homo sapiens
gcacattcgtaagtt

SEQ ID NO: 116633 - DNA, 15 bp, Homo sapiens
ggcacattcgtaagt

SEQ ID NO: 116634 - DNA, 15 bp, Homo sapiens
cggcacattcgtaag

SEQ ID NO: 116635 - DNA, 15 bp, Homo sapiens
tcggcacattcgtaa

SEQ ID NO: 116636 - DNA, 15 bp, Homo sapiens
atcggcacattcgta

SEQ ID NO: 116637 - DNA, 15 bp, Homo sapiens
gatcggcacattcgt

SEQ ID NO: 116638 - DNA, 15 bp, Homo sapiens
tgatcggcacattcg

SEQ ID NO: 116639 - DNA, 15 bp, Homo sapiens
gtgatcggcacattc

SEQ ID NO: 116640 - DNA, 15 bp, Homo sapiens
agtgatcggcacatt

SEQ ID NO: 116641 - DNA, 15 bp, Homo sapiens
aagtgatcggcacat

SEQ ID NO: 116642 - DNA, 15 bp, Homo sapiens
aaagtgatcggcaca

SEQ ID NO: 116643 - DNA, 15 bp, Homo sapiens
taaagtgatcggcac

SEQ ID NO: 116644 - DNA, 15 bp, Homo sapiens
ataaagtgatcggca

SEQ ID NO: 116645 - DNA, 15 bp, Homo sapiens
gataaagtgatcggc

SEQ ID NO: 116646 - DNA, 15 bp, Homo sapiens
tgataaagtgatcgg

SEQ ID NO: 116647 - DNA, 15 bp, Homo sapiens
atgataaagtgatcg

SEQ ID NO: 116648 - DNA, 15 bp, Homo sapiens
gatgataaagtgatc

SEQ ID NO: 116649 - DNA, 15 bp, Homo sapiens
tgatgataaagtgat

SEQ ID NO: 116650 - DNA, 15 bp, Homo sapiens
atgatgataaagtga

SEQ ID NO: 116651 - DNA, 15 bp, Homo sapiens
tatgatgataaagtg

SEQ ID NO: 116652 - DNA, 15 bp, Homo sapiens
gtatgatgataaagt

SEQ ID NO: 116653 - DNA, 15 bp, Homo sapiens
ggtatgatgataaag

SEQ ID NO: 116654 - DNA, 15 bp, Homo sapiens
tggtatgatgataaa

SEQ ID NO: 116655 - DNA, 15 bp, Homo sapiens
atggtatgatgataa

SEQ ID NO: 116656 - DNA, 15 bp, Homo sapiens
gatggtatgatgata

SEQ ID NO: 116657 - DNA, 15 bp, Homo sapiens
ggatggtatgatgat

SEQ ID NO: 116658 - DNA, 15 bp, Homo sapiens
tggatggtatgatga

SEQ ID NO: 116659 - DNA, 15 bp, Homo sapiens
ctggatggtatgatg

SEQ ID NO: 116660 - DNA, 15 bp, Homo sapiens
tctggatggtatgat

SEQ ID NO: 116661 - DNA, 15 bp, Homo sapiens
ctctggatggtatga

SEQ ID NO: 116662 - DNA, 15 bp, Homo sapiens
actctggatggtatg

SEQ ID NO: 116663 - DNA, 15 bp, Homo sapiens
tactctggatggtat

SEQ ID NO: 116664 - DNA, 15 bp, Homo sapiens
atactctggatggta

SEQ ID NO: 116665 - DNA, 15 bp, Homo sapiens
aatactctggatggt

SEQ ID NO: 116666 - DNA, 15 bp, Homo sapiens
taatactctggatgg

SEQ ID NO: 116667 - DNA, 15 bp, Homo sapiens
ataatactctggatg

SEQ ID NO: 116668 - DNA, 15 bp, Homo sapiens
gataatactctggat

SEQ ID NO: 116669 - DNA, 15 bp, Homo sapiens
agataatactctgga

SEQ ID NO: 116670 - DNA, 15 bp, Homo sapiens
aagataatactctgg

SEQ ID NO: 116671 - DNA, 15 bp, Homo sapiens
aaagataatactctg

SEQ ID NO: 116672 - DNA, 15 bp, Homo sapiens
caaagataatactct

SEQ ID NO: 116673 - DNA, 15 bp, Homo sapiens
gcaaagataatactc

SEQ ID NO: 116674 - DNA, 15 bp, Homo sapiens
tgcaaagataatact

SEQ ID NO: 116675 - DNA, 15 bp, Homo sapiens
gtgcaaagataatac

SEQ ID NO: 116676 - DNA, 15 bp, Homo sapiens
agtgcaaagataata

SEQ ID NO: 116677 - DNA, 15 bp, Homo sapiens
aagtgcaaagataat

SEQ ID NO: 116678 - DNA, 15 bp, Homo sapiens
taagtgcaaagataa

SEQ ID NO: 116679 - DNA, 15 bp, Homo sapiens
ataagtgcaaagata

SEQ ID NO: 116680 - DNA, 15 bp, Homo sapiens
cataagtgcaaagat

SEQ ID NO: 116681 - DNA, 15 bp, Homo sapiens
tcataagtgcaaaga

SEQ ID NO: 116682 - DNA, 15 bp, Homo sapiens
gtcataagtgcaaag

SEQ ID NO: 116683 - DNA, 15 bp, Homo sapiens
tgtcataagtgcaaa

SEQ ID NO: 116684 - DNA, 15 bp, Homo sapiens
ctgtcataagtgcaa

SEQ ID NO: 116685 - DNA, 15 bp, Homo sapiens
actgtcataagtgca

SEQ ID NO: 116686 - DNA, 15 bp, Homo sapiens
aactgtcataagtgc

SEQ ID NO: 116687 - DNA, 15 bp, Homo sapiens
caactgtcataagtg

SEQ ID NO: 116688 - DNA, 15 bp, Homo sapiens
acaactgtcataagt

SEQ ID NO: 116689 - DNA, 15 bp, Homo sapiens
tacaactgtcataag

SEQ ID NO: 116690 - DNA, 15 bp, Homo sapiens
ttacaactgtcataa

SEQ ID NO: 116691 - DNA, 15 bp, Homo sapiens
cttacaactgtcata

SEQ ID NO: 116692 - DNA, 15 bp, Homo sapiens
tcttacaactgtcat

SEQ ID NO: 116693 - DNA, 15 bp, Homo sapiens
gtcttacaactgtca

SEQ ID NO: 116694 - DNA, 15 bp, Homo sapiens
ggtcttacaactgtc

SEQ ID NO: 116695 - DNA, 15 bp, Homo sapiens
tggtcttacaactgt

SEQ ID NO: 116696 - DNA, 15 bp, Homo sapiens
ttggtcttacaactg

SEQ ID NO: 116697 - DNA, 15 bp, Homo sapiens
tttggtcttacaact

SEQ ID NO: 116698 - DNA, 15 bp, Homo sapiens
ctttggtcttacaac

SEQ ID NO: 116699 - DNA, 15 bp, Homo sapiens
gctttggtcttacaa

SEQ ID NO: 116700 - DNA, 15 bp, Homo sapiens
agctttggtcttaca

SEQ ID NO: 116701 - DNA, 15 bp, Homo sapiens
aagctttggtcttac

SEQ ID NO: 116702 - DNA, 15 bp, Homo sapiens
taagctttggtctta

SEQ ID NO: 116703 - DNA, 15 bp, Homo sapiens
ctaagctttggtctt

SEQ ID NO: 116704 - DNA, 15 bp, Homo sapiens
tctaagctttggtct

SEQ ID NO: 116705 - DNA, 15 bp, Homo sapiens
gtctaagctttggtc

SEQ ID NO: 116706 - DNA, 15 bp, Homo sapiens
agtctaagctttggt

SEQ ID NO: 116707 - DNA, 15 bp, Homo sapiens
aagtctaagctttgg

SEQ ID NO: 116708 - DNA, 15 bp, Homo sapiens
caagtctaagctttg

SEQ ID NO: 116709 - DNA, 15 bp, Homo sapiens
gcaagtctaagcttt

SEQ ID NO: 116710 - DNA, 15 bp, Homo sapiens
agcaagtctaagctt

SEQ ID NO: 116711 - DNA, 15 bp, Homo sapiens
cagcaagtctaagct

SEQ ID NO: 116712 - DNA, 15 bp, Homo sapiens
gcagcaagtctaagc

SEQ ID NO: 116713 - DNA, 15 bp, Homo sapiens
agcagcaagtctaag

SEQ ID NO: 116714 - DNA, 15 bp, Homo sapiens
gagcagcaagtctaa

SEQ ID NO: 116715 - DNA, 15 bp, Homo sapiens
agagcagcaagtcta

SEQ ID NO: 116716 - DNA, 15 bp, Homo sapiens
gagagcagcaagtct

SEQ ID NO: 116717 - DNA, 15 bp, Homo sapiens
agagagcagcaagtc

SEQ ID NO: 116718 - DNA, 15 bp, Homo sapiens
aagagagcagcaagt

SEQ ID NO: 116719 - DNA, 15 bp, Homo sapiens
caagagagcagcaag

SEQ ID NO: 116720 - DNA, 15 bp, Homo sapiens
acaagagagcagcaa

SEQ ID NO: 116721 - DNA, 15 bp, Homo sapiens
cacaagagagcagca

SEQ ID NO: 116722 - DNA, 15 bp, Homo sapiens
tcacaagagagcagc

SEQ ID NO: 116723 - DNA, 15 bp, Homo sapiens
ctcacaagagagcag

SEQ ID NO: 116724 - DNA, 15 bp, Homo sapiens
actcacaagagagca

SEQ ID NO: 116725 - DNA, 15 bp, Homo sapiens
aactcacaagagagc

SEQ ID NO: 116726 - DNA, 15 bp, Homo sapiens
taactcacaagagag

SEQ ID NO: 116727 - DNA, 15 bp, Homo sapiens
gtaactcacaagaga

SEQ ID NO: 116728 - DNA, 15 bp, Homo sapiens
agtaactcacaagag

SEQ ID NO: 116729 - DNA, 15 bp, Homo sapiens
aagtaactcacaaga

SEQ ID NO: 116730 - DNA, 15 bp, Homo sapiens
taagtaactcacaag

SEQ ID NO: 116731 - DNA, 15 bp, Homo sapiens
gtaagtaactcacaa

SEQ ID NO: 116732 - DNA, 15 bp, Homo sapiens
tgtaagtaactcaca

SEQ ID NO: 116733 - DNA, 15 bp, Homo sapiens
atgtaagtaactcac

SEQ ID NO: 116734 - DNA, 15 bp, Homo sapiens
catgtaagtaactca

SEQ ID NO: 116735 - DNA, 15 bp, Homo sapiens
tcatgtaagtaactc

SEQ ID NO: 116736 - DNA, 15 bp, Homo sapiens
ttcatgtaagtaact

SEQ ID NO: 116737 - DNA, 15 bp, Homo sapiens
tttcatgtaagtaac

SEQ ID NO: 116738 - DNA, 15 bp, Homo sapiens
atttcatgtaagtaa

SEQ ID NO: 116739 - DNA, 15 bp, Homo sapiens
catttcatgtaagta

SEQ ID NO: 116740 - DNA, 15 bp, Homo sapiens
acatttcatgtaagt

SEQ ID NO: 116741 - DNA, 15 bp, Homo sapiens
aacatttcatgtaag

SEQ ID NO: 116742 - DNA, 15 bp, Homo sapiens
aaacatttcatgtaa

SEQ ID NO: 116743 - DNA, 15 bp, Homo sapiens
aaaacatttcatgta

SEQ ID NO: 116744 - DNA, 15 bp, Homo sapiens
aaaaacatttcatgt

SEQ ID NO: 116745 - DNA, 15 bp, Homo sapiens
aaaaaacatttcatg

SEQ ID NO: 116746 - DNA, 15 bp, Homo sapiens
aaaaaaacatttcat

SEQ ID NO: 116747 - DNA, 15 bp, Homo sapiens
caaaaaaacatttca

SEQ ID NO: 116748 - DNA, 15 bp, Homo sapiens
acaaaaaaacatttc

SEQ ID NO: 116749 - DNA, 15 bp, Homo sapiens
tacaaaaaaacattt

SEQ ID NO: 116750 - DNA, 15 bp, Homo sapiens
ttacaaaaaaacatt

SEQ ID NO: 116751 - DNA, 15 bp, Homo sapiens
attacaaaaaaacat

SEQ ID NO: 116752 - DNA, 15 bp, Homo sapiens
cattacaaaaaaaca

SEQ ID NO: 116753 - DNA, 15 bp, Homo sapiens
acattacaaaaaaac

SEQ ID NO: 116754 - DNA, 15 bp, Homo sapiens
aacattacaaaaaaa

SEQ ID NO: 116755 - DNA, 15 bp, Homo sapiens
aaacattacaaaaaa

SEQ ID NO: 116756 - DNA, 15 bp, Homo sapiens
taaacattacaaaaa

SEQ ID NO: 116757 - DNA, 15 bp, Homo sapiens
ataaacattacaaaa

SEQ ID NO: 116758 - DNA, 15 bp, Homo sapiens
aataaacattacaaa

SEQ ID NO: 116759 - DNA, 15 bp, Homo sapiens
gaataaacattacaa

SEQ ID NO: 116760 - DNA, 15 bp, Homo sapiens
tgaataaacattaca

SEQ ID NO: 116761 - DNA, 15 bp, Homo sapiens
ctgaataaacattac

SEQ ID NO: 116762 - DNA, 15 bp, Homo sapiens
actgaataaacatta

SEQ ID NO: 116763 - DNA, 15 bp, Homo sapiens
tactgaataaacatt

SEQ ID NO: 116764 - DNA, 15 bp, Homo sapiens
atactgaataaacat

SEQ ID NO: 116765 - DNA, 15 bp, Homo sapiens
tatactgaataaaca

SEQ ID NO: 116766 - DNA, 15 bp, Homo sapiens
atatactgaataaac

SEQ ID NO: 116767 - DNA, 15 bp, Homo sapiens
aatatactgaataaa

SEQ ID NO: 116768 - DNA, 15 bp, Homo sapiens
taatatactgaataa

SEQ ID NO: 116769 - DNA, 15 bp, Homo sapiens
ataatatactgaata

SEQ ID NO: 116770 - DNA, 15 bp, Homo sapiens
tataatatactgaat

SEQ ID NO: 116771 - DNA, 15 bp, Homo sapiens
atataatatactgaa

SEQ ID NO: 116772 - DNA, 15 bp, Homo sapiens
catataatatactga

SEQ ID NO: 116773 - DNA, 15 bp, Homo sapiens
acatataatatactg

SEQ ID NO: 116774 - DNA, 15 bp, Homo sapiens
cacatataatatact

SEQ ID NO: 116775 - DNA, 15 bp, Homo sapiens
tcacatataatatac

SEQ ID NO: 116776 - DNA, 15 bp, Homo sapiens
ttcacatataatata

SEQ ID NO: 116777 - DNA, 15 bp, Homo sapiens
tttcacatataatat

SEQ ID NO: 116778 - DNA, 15 bp, Homo sapiens
atttcacatataata

SEQ ID NO: 116779 - DNA, 15 bp, Homo sapiens
gatttcacatataat

SEQ ID NO: 116780 - DNA, 15 bp, Homo sapiens
tgatttcacatataa

SEQ ID NO: 116781 - DNA, 15 bp, Homo sapiens
gtgatttcacatata

SEQ ID NO: 116782 - DNA, 15 bp, Homo sapiens
ggtgatttcacatat

SEQ ID NO: 116783 - DNA, 15 bp, Homo sapiens
gggtgatttcacata

SEQ ID NO: 116784 - DNA, 15 bp, Homo sapiens
tgggtgatttcacat

SEQ ID NO: 116785 - DNA, 15 bp, Homo sapiens
ctgggtgatttcaca

SEQ ID NO: 116786 - DNA, 15 bp, Homo sapiens
gctgggtgatttcac

SEQ ID NO: 116787 - DNA, 15 bp, Homo sapiens
agctgggtgatttca

SEQ ID NO: 116788 - DNA, 15 bp, Homo sapiens
cagctgggtgatttc

SEQ ID NO: 116789 - DNA, 15 bp, Homo sapiens
acagctgggtgattt

SEQ ID NO: 116790 - DNA, 15 bp, Homo sapiens
tacagctgggtgatt

SEQ ID NO: 116791 - DNA, 15 bp, Homo sapiens
ttacagctgggtgat

SEQ ID NO: 116792 - DNA, 15 bp, Homo sapiens
cttacagctgggtga

SEQ ID NO: 116793 - DNA, 15 bp, Homo sapiens
tcttacagctgggtg

SEQ ID NO: 116794 - DNA, 15 bp, Homo sapiens
atcttacagctgggt

SEQ ID NO: 116795 - DNA, 15 bp, Homo sapiens
catcttacagctggg

SEQ ID NO: 116796 - DNA, 15 bp, Homo sapiens
acatcttacagctgg

SEQ ID NO: 116797 - DNA, 15 bp, Homo sapiens
aacatcttacagctg

SEQ ID NO: 116798 - DNA, 15 bp, Homo sapiens
taacatcttacagct

SEQ ID NO: 116799 - DNA, 15 bp, Homo sapiens
ataacatcttacagc

SEQ ID NO: 116800 - DNA, 15 bp, Homo sapiens
gataacatcttacag

SEQ ID NO: 116801 - DNA, 15 bp, Homo sapiens
ggataacatcttaca

SEQ ID NO: 116802 - DNA, 15 bp, Homo sapiens
aggataacatcttac

SEQ ID NO: 116803 - DNA, 15 bp, Homo sapiens
aaggataacatctta

SEQ ID NO: 116804 - DNA, 15 bp, Homo sapiens
caaggataacatctt

SEQ ID NO: 116805 - DNA, 15 bp, Homo sapiens
gcaaggataacatct

SEQ ID NO: 116806 - DNA, 15 bp, Homo sapiens
tgcaaggataacatc

SEQ ID NO: 116807 - DNA, 15 bp, Homo sapiens
ttgcaaggataacat

SEQ ID NO: 116808 - DNA, 15 bp, Homo sapiens
cttgcaaggataaca

SEQ ID NO: 116809 - DNA, 15 bp, Homo sapiens
acttgcaaggataac

SEQ ID NO: 116810 - DNA, 15 bp, Homo sapiens
tacttgcaaggataa

SEQ ID NO: 116811 - DNA, 15 bp, Homo sapiens
gtacttgcaaggata

SEQ ID NO: 116812 - DNA, 15 bp, Homo sapiens
ggtacttgcaaggat

SEQ ID NO: 116813 - DNA, 15 bp, Homo sapiens
aggtacttgcaagga

SEQ ID NO: 116814 - DNA, 15 bp, Homo sapiens
taggtacttgcaagg

SEQ ID NO: 116815 - DNA, 15 bp, Homo sapiens
ataggtacttgcaag

SEQ ID NO: 116816 - DNA, 15 bp, Homo sapiens
tataggtacttgcaa

SEQ ID NO: 116817 - DNA, 15 bp, Homo sapiens
ctataggtacttgca

SEQ ID NO: 116818 - DNA, 15 bp, Homo sapiens
actataggtacttgc

SEQ ID NO: 116819 - DNA, 15 bp, Homo sapiens
tactataggtacttg

SEQ ID NO: 116820 - DNA, 15 bp, Homo sapiens
gtactataggtactt

SEQ ID NO: 116821 - DNA, 15 bp, Homo sapiens
tgtactataggtact

SEQ ID NO: 116822 - DNA, 15 bp, Homo sapiens
gtgtactataggtac

SEQ ID NO: 116823 - DNA, 15 bp, Homo sapiens
tgtgtactataggta

SEQ ID NO: 116824 - DNA, 15 bp, Homo sapiens
atgtgtactataggt

SEQ ID NO: 116825 - DNA, 15 bp, Homo sapiens
gatgtgtactatagg

SEQ ID NO: 116826 - DNA, 15 bp, Homo sapiens
cgatgtgtactatag

SEQ ID NO: 116827 - DNA, 15 bp, Homo sapiens
tcgatgtgtactata

SEQ ID NO: 116828 - DNA, 15 bp, Homo sapiens
atcgatgtgtactat

SEQ ID NO: 116829 - DNA, 15 bp, Homo sapiens
tatcgatgtgtacta

SEQ ID NO: 116830 - DNA, 15 bp, Homo sapiens
ctatcgatgtgtact

SEQ ID NO: 116831 - DNA, 15 bp, Homo sapiens
actatcgatgtgtac

SEQ ID NO: 116832 - DNA, 15 bp, Homo sapiens
aactatcgatgtgta

SEQ ID NO: 116833 - DNA, 15 bp, Homo sapiens
aaactatcgatgtgt

SEQ ID NO: 116834 - DNA, 15 bp, Homo sapiens
gaaactatcgatgtg

SEQ ID NO: 116835 - DNA, 15 bp, Homo sapiens
ggaaactatcgatgt

SEQ ID NO: 116836 - DNA, 15 bp, Homo sapiens
aggaaactatcgatg

SEQ ID NO: 116837 - DNA, 15 bp, Homo sapiens
gaggaaactatcgat

SEQ ID NO: 116838 - DNA, 15 bp, Homo sapiens
agaggaaactatcga

SEQ ID NO: 116839 - DNA, 15 bp, Homo sapiens
cagaggaaactatcg

SEQ ID NO: 116840 - DNA, 15 bp, Homo sapiens
ccagaggaaactatc

SEQ ID NO: 116841 - DNA, 15 bp, Homo sapiens
accagaggaaactat

SEQ ID NO: 116842 - DNA, 15 bp, Homo sapiens
taccagaggaaacta

SEQ ID NO: 116843 - DNA, 15 bp, Homo sapiens
ttaccagaggaaact

SEQ ID NO: 116844 - DNA, 15 bp, Homo sapiens
attaccagaggaaac

SEQ ID NO: 116845 - DNA, 15 bp, Homo sapiens
gattaccagaggaaa

SEQ ID NO: 116846 - DNA, 15 bp, Homo sapiens
agattaccagaggaa

SEQ ID NO: 116847 - DNA, 15 bp, Homo sapiens
tagattaccagagga

SEQ ID NO: 116848 - DNA, 15 bp, Homo sapiens
ctagattaccagagg

SEQ ID NO: 116849 - DNA, 15 bp, Homo sapiens
cctagattaccagag

SEQ ID NO: 116850 - DNA, 15 bp, Homo sapiens
tcctagattaccaga

SEQ ID NO: 116851 - DNA, 15 bp, Homo sapiens
ctcctagattaccag

SEQ ID NO: 116852 - DNA, 15 bp, Homo sapiens
tctcctagattacca

SEQ ID NO: 116853 - DNA, 15 bp, Homo sapiens
atctcctagattacc

SEQ ID NO: 116854 - DNA, 15 bp, Homo sapiens
tatctcctagattac

SEQ ID NO: 116855 - DNA, 15 bp, Homo sapiens
ttatctcctagatta

SEQ ID NO: 116856 - DNA, 15 bp, Homo sapiens
tttatctcctagatt

SEQ ID NO: 116857 - DNA, 15 bp, Homo sapiens
atttatctcctagat

SEQ ID NO: 116858 - DNA, 15 bp, Homo sapiens
aatttatctcctaga

SEQ ID NO: 116859 - DNA, 15 bp, Homo sapiens
gaatttatctcctag

SEQ ID NO: 116860 - DNA, 15 bp, Homo sapiens
tgaatttatctccta

SEQ ID NO: 116861 - DNA, 15 bp, Homo sapiens
atgaatttatctcct

SEQ ID NO: 116862 - DNA, 15 bp, Homo sapiens
aatgaatttatctcc

SEQ ID NO: 116863 - DNA, 15 bp, Homo sapiens
caatgaatttatctc

SEQ ID NO: 116864 - DNA, 15 bp, Homo sapiens
acaatgaatttatct

SEQ ID NO: 116865 - DNA, 15 bp, Homo sapiens
cacaatgaatttatc

SEQ ID NO: 116866 - DNA, 15 bp, Homo sapiens
tcacaatgaatttat

SEQ ID NO: 116867 - DNA, 15 bp, Homo sapiens
ttcacaatgaattta

SEQ ID NO: 116868 - DNA, 15 bp, Homo sapiens
attcacaatgaattt

SEQ ID NO: 116869 - DNA, 15 bp, Homo sapiens
aaattcacaatgaat

SEQ ID NO: 116870 - DNA, 15 bp, Homo sapiens
aaaattcacaatgaa

SEQ ID NO: 116871 - DNA, 15 bp, Homo sapiens
aaaaattcacaatga

SEQ ID NO: 116872 - DNA, 15 bp, Homo sapiens
aaaaaattcacaatg

SEQ ID NO: 116873 - DNA, 15 bp, Homo sapiens
aaaaaaattcacaat

SEQ ID NO: 116874 - DNA, 15 bp, Homo sapiens
taaaaaaattcacaa

SEQ ID NO: 116875 - DNA, 15 bp, Homo sapiens
ttaaaaaaattcaca

SEQ ID NO: 116876 - DNA, 15 bp, Homo sapiens
cttaaaaaaattcac

SEQ ID NO: 116877 - DNA, 15 bp, Homo sapiens
acttaaaaaaattca

SEQ ID NO: 116878 - DNA, 15 bp, Homo sapiens
aacttaaaaaaattc

SEQ ID NO: 116879 - DNA, 15 bp, Homo sapiens
caacttaaaaaaatt

SEQ ID NO: 116880 - DNA, 15 bp, Homo sapiens
acaacttaaaaaaat

SEQ ID NO: 116881 - DNA, 15 bp, Homo sapiens
cacaacttaaaaaaa

SEQ ID NO: 116882 - DNA, 15 bp, Homo sapiens
tcacaacttaaaaaa

SEQ ID NO: 116883 - DNA, 15 bp, Homo sapiens
ctcacaacttaaaaa

SEQ ID NO: 116884 - DNA, 15 bp, Homo sapiens
actcacaacttaaaa

SEQ ID NO: 116885 - DNA, 15 bp, Homo sapiens
aactcacaacttaaa

SEQ ID NO: 116886 - DNA, 15 bp, Homo sapiens
gaactcacaacttaa

SEQ ID NO: 116887 - DNA, 15 bp, Homo sapiens
agaactcacaactta

SEQ ID NO: 116888 - DNA, 15 bp, Homo sapiens
tagaactcacaactt

SEQ ID NO: 116889 - DNA, 15 bp, Homo sapiens
ctagaactcacaact

SEQ ID NO: 116890 - DNA, 15 bp, Homo sapiens
cctagaactcacaac

SEQ ID NO: 116891 - DNA, 15 bp, Homo sapiens
tcctagaactcacaa

SEQ ID NO: 116892 - DNA, 15 bp, Homo sapiens
atcctagaactcaca

SEQ ID NO: 116893 - DNA, 15 bp, Homo sapiens
gatcctagaactcac

SEQ ID NO: 116894 - DNA, 15 bp, Homo sapiens
ggatcctagaactca

SEQ ID NO: 116895 - DNA, 15 bp, Homo sapiens
aggatcctagaactc

SEQ ID NO: 116896 - DNA, 15 bp, Homo sapiens
aaggatcctagaact

SEQ ID NO: 116897 - DNA, 15 bp, Homo sapiens
gaaggatcctagaac

SEQ ID NO: 116898 - DNA, 15 bp, Homo sapiens
agaaggatcctagaa

SEQ ID NO: 116899 - DNA, 15 bp, Homo sapiens
cagaaggatcctaga

SEQ ID NO: 116900 - DNA, 15 bp, Homo sapiens
gcagaaggatcctag

SEQ ID NO: 116901 - DNA, 15 bp, Homo sapiens
agcagaaggatccta

SEQ ID NO: 116902 - DNA, 15 bp, Homo sapiens
aagcagaaggatcct

SEQ ID NO: 116903 - DNA, 15 bp, Homo sapiens
aaagcagaaggatcc

SEQ ID NO: 116904 - DNA, 15 bp, Homo sapiens
caaagcagaaggatc

SEQ ID NO: 116905 - DNA, 15 bp, Homo sapiens
gcaaagcagaaggat

SEQ ID NO: 116906 - DNA, 15 bp, Homo sapiens
ggcaaagcagaagga

SEQ ID NO: 116907 - DNA, 15 bp, Homo sapiens
tggcaaagcagaagg

SEQ ID NO: 116908 - DNA, 15 bp, Homo sapiens
ctggcaaagcagaag

SEQ ID NO: 116909 - DNA, 15 bp, Homo sapiens
gctggcaaagcagaa

SEQ ID NO: 116910 - DNA, 15 bp, Homo sapiens
agctggcaaagcaga

SEQ ID NO: 116911 - DNA, 15 bp, Homo sapiens
aagctggcaaagcag

SEQ ID NO: 116912 - DNA, 15 bp, Homo sapiens
caagctggcaaagca

SEQ ID NO: 116913 - DNA, 15 bp, Homo sapiens
acaagctggcaaagc

SEQ ID NO: 116914 - DNA, 15 bp, Homo sapiens
tacaagctggcaaag

SEQ ID NO: 116915 - DNA, 15 bp, Homo sapiens
ctacaagctggcaaa

SEQ ID NO: 116916 - DNA, 15 bp, Homo sapiens
actacaagctggcaa

SEQ ID NO: 116917 - DNA, 15 bp, Homo sapiens
aactacaagctggca

SEQ ID NO: 116918 - DNA, 15 bp, Homo sapiens
taactacaagctggc

SEQ ID NO: 116919 - DNA, 15 bp, Homo sapiens
gtaactacaagctgg

SEQ ID NO: 116920 - DNA, 15 bp, Homo sapiens
agtaactacaagctg

SEQ ID NO: 116921 - DNA, 15 bp, Homo sapiens
cagtaactacaagct

SEQ ID NO: 116922 - DNA, 15 bp, Homo sapiens
tcagtaactacaagc

SEQ ID NO: 116923 - DNA, 15 bp, Homo sapiens
ttcagtaactacaag

SEQ ID NO: 116924 - DNA, 15 bp, Homo sapiens
tttcagtaactacaa

SEQ ID NO: 116925 - DNA, 15 bp, Homo sapiens
ttttcagtaactaca

SEQ ID NO: 116926 - DNA, 15 bp, Homo sapiens
attttcagtaactac

SEQ ID NO: 116927 - DNA, 15 bp, Homo sapiens
cattttcagtaacta

SEQ ID NO: 116928 - DNA, 15 bp, Homo sapiens
tcattttcagtaact

SEQ ID NO: 116929 - DNA, 15 bp, Homo sapiens
ttcattttcagtaac

SEQ ID NO: 116930 - DNA, 15 bp, Homo sapiens
tttcattttcagtaa

SEQ ID NO: 116931 - DNA, 15 bp, Homo sapiens
atttcattttcagta

SEQ ID NO: 116932 - DNA, 15 bp, Homo sapiens
aatttcattttcagt

SEQ ID NO: 116933 - DNA, 15 bp, Homo sapiens
caatttcattttcag

SEQ ID NO: 116934 - DNA, 15 bp, Homo sapiens
tcaatttcattttca

SEQ ID NO: 116935 - DNA, 15 bp, Homo sapiens
ctcaatttcattttc

SEQ ID NO: 116936 - DNA, 15 bp, Homo sapiens
gctcaatttcatttt

SEQ ID NO: 116937 - DNA, 15 bp, Homo sapiens
ggctcaatttcattt

SEQ ID NO: 116938 - DNA, 15 bp, Homo sapiens
aggctcaatttcatt

SEQ ID NO: 116939 - DNA, 15 bp, Homo sapiens
aaggctcaatttcat

SEQ ID NO: 116940 - DNA, 15 bp, Homo sapiens
aaaggctcaatttca

SEQ ID NO: 116941 - DNA, 15 bp, Homo sapiens
taaaggctcaatttc

SEQ ID NO: 116942 - DNA, 15 bp, Homo sapiens
gtaaaggctcaattt

SEQ ID NO: 116943 - DNA, 15 bp, Homo sapiens
tgtaaaggctcaatt

SEQ ID NO: 116944 - DNA, 15 bp, Homo sapiens
atgtaaaggctcaat

SEQ ID NO: 116945 - DNA, 15 bp, Homo sapiens
aatgtaaaggctcaa

SEQ ID NO: 116946 - DNA, 15 bp, Homo sapiens
aaatgtaaaggctca

SEQ ID NO: 116947 - DNA, 15 bp, Homo sapiens
taaatgtaaaggctc

SEQ ID NO: 116948 - DNA, 15 bp, Homo sapiens
ctaaatgtaaaggct

SEQ ID NO: 116949 - DNA, 15 bp, Homo sapiens
tctaaatgtaaaggc

SEQ ID NO: 116950 - DNA, 15 bp, Homo sapiens
ctctaaatgtaaagg

SEQ ID NO: 116951 - DNA, 15 bp, Homo sapiens
actctaaatgtaaag

SEQ ID NO: 116952 - DNA, 15 bp, Homo sapiens
cactctaaatgtaaa

SEQ ID NO: 116953 - DNA, 15 bp, Homo sapiens
tcactctaaatgtaa

SEQ ID NO: 116954 - DNA, 15 bp, Homo sapiens
atcactctaaatgta

SEQ ID NO: 116955 - DNA, 15 bp, Homo sapiens
catcactctaaatgt

SEQ ID NO: 116956 - DNA, 15 bp, Homo sapiens
tcatcactctaaatg

SEQ ID NO: 116957 - DNA, 15 bp, Homo sapiens
atcatcactctaaat

SEQ ID NO: 116958 - DNA, 15 bp, Homo sapiens
catcatcactctaaa

SEQ ID NO: 116959 - DNA, 15 bp, Homo sapiens
tcatcatcactctaa

SEQ ID NO: 116960 - DNA, 15 bp, Homo sapiens
ttcatcatcactcta

SEQ ID NO: 116961 - DNA, 15 bp, Homo sapiens
cttcatcatcactct

SEQ ID NO: 116962 - DNA, 15 bp, Homo sapiens
ccttcatcatcactc

SEQ ID NO: 116963 - DNA, 15 bp, Homo sapiens
accttcatcatcact

SEQ ID NO: 116964 - DNA, 15 bp, Homo sapiens
taccttcatcatcac

SEQ ID NO: 116965 - DNA, 15 bp, Homo sapiens
ttaccttcatcatca

SEQ ID NO: 116966 - DNA, 15 bp, Homo sapiens
attaccttcatcatc

SEQ ID NO: 116967 - DNA, 15 bp, Homo sapiens
aattaccttcatcat

SEQ ID NO: 116968 - DNA, 15 bp, Homo sapiens
caattaccttcatca

SEQ ID NO: 116969 - DNA, 15 bp, Homo sapiens
ccaattaccttcatc

SEQ ID NO: 116970 - DNA, 15 bp, Homo sapiens
gccaattaccttcat

SEQ ID NO: 116971 - DNA, 15 bp, Homo sapiens
tgccaattaccttca

SEQ ID NO: 116972 - DNA, 15 bp, Homo sapiens
atgccaattaccttc

SEQ ID NO: 116973 - DNA, 15 bp, Homo sapiens
aatgccaattacctt

SEQ ID NO: 116974 - DNA, 15 bp, Homo sapiens
gaatgccaattacct

SEQ ID NO: 116975 - DNA, 15 bp, Homo sapiens
tgaatgccaattacc

SEQ ID NO: 116976 - DNA, 15 bp, Homo sapiens
atgaatgccaattac

SEQ ID NO: 116977 - DNA, 15 bp, Homo sapiens
tatgaatgccaatta

SEQ ID NO: 116978 - DNA, 15 bp, Homo sapiens
atatgaatgccaatt

SEQ ID NO: 116979 - DNA, 15 bp, Homo sapiens
catatgaatgccaat

SEQ ID NO: 116980 - DNA, 15 bp, Homo sapiens
acatatgaatgccaa

SEQ ID NO: 116981 - DNA, 15 bp, Homo sapiens
tacatatgaatgcca

SEQ ID NO: 116982 - DNA, 15 bp, Homo sapiens
ttacatatgaatgcc

SEQ ID NO: 116983 - DNA, 15 bp, Homo sapiens
attacatatgaatgc

SEQ ID NO: 116984 - DNA, 15 bp, Homo sapiens
tattacatatgaatg

SEQ ID NO: 116985 - DNA, 15 bp, Homo sapiens
ttattacatatgaat

SEQ ID NO: 116986 - DNA, 15 bp, Homo sapiens
tttattacatatgaa

SEQ ID NO: 116987 - DNA, 15 bp, Homo sapiens
atttattacatatga

SEQ ID NO: 116988 - DNA, 15 bp, Homo sapiens
catttattacatatg

SEQ ID NO: 116989 - DNA, 15 bp, Homo sapiens
ccatttattacatat

SEQ ID NO: 116990 - DNA, 15 bp, Homo sapiens
tccatttattacata

SEQ ID NO: 116991 - DNA, 15 bp, Homo sapiens
atccatttattacat

SEQ ID NO: 116992 - DNA, 15 bp, Homo sapiens
aatccatttattaca

SEQ ID NO: 116993 - DNA, 15 bp, Homo sapiens
aaatccatttattac

SEQ ID NO: 116994 - DNA, 15 bp, Homo sapiens
taaatccatttatta

SEQ ID NO: 116995 - DNA, 15 bp, Homo sapiens
ataaatccatttatt

SEQ ID NO: 116996 - DNA, 15 bp, Homo sapiens
tataaatccatttat

SEQ ID NO: 116997 - DNA, 15 bp, Homo sapiens
atataaatccattta

SEQ ID NO: 116998 - DNA, 15 bp, Homo sapiens
aatataaatccattt

SEQ ID NO: 116999 - DNA, 15 bp, Homo sapiens
aaatataaatccatt

SEQ ID NO: 117000 - DNA, 15 bp, Homo sapiens
taaatataaatccat

SEQ ID NO: 117001 - DNA, 15 bp, Homo sapiens
ttaaatataaatcca

SEQ ID NO: 117002 - DNA, 15 bp, Homo sapiens
tttaaatataaatcc

SEQ ID NO: 117003 - DNA, 15 bp, Homo sapiens
atttaaatataaatc

SEQ ID NO: 117004 - DNA, 15 bp, Homo sapiens
tatttaaatataaat

SEQ ID NO: 117005 - DNA, 15 bp, Homo sapiens
ttatttaaatataaa

SEQ ID NO: 117006 - DNA, 15 bp, Homo sapiens
tttatttaaatataa

SEQ ID NO: 117007 - DNA, 15 bp, Homo sapiens
atttatttaaatata

SEQ ID NO: 117008 - DNA, 15 bp, Homo sapiens
catttatttaaatat

SEQ ID NO: 117009 - DNA, 15 bp, Homo sapiens
tcatttatttaaata

SEQ ID NO: 117010 - DNA, 15 bp, Homo sapiens
ttcatttatttaaat

SEQ ID NO: 117011 - DNA, 15 bp, Homo sapiens
tttcatttatttaaa

SEQ ID NO: 117012 - DNA, 15 bp, Homo sapiens
atttcatttatttaa

SEQ ID NO: 117013 - DNA, 15 bp, Homo sapiens
tatttcatttattta

SEQ ID NO: 117014 - DNA, 15 bp, Homo sapiens
ttatttcatttattt

SEQ ID NO: 117015 - DNA, 15 bp, Homo sapiens
attatttcatttatt

SEQ ID NO: 117016 - DNA, 15 bp, Homo sapiens
aattatttcatttat

SEQ ID NO: 117017 - DNA, 15 bp, Homo sapiens
caattatttcattta

SEQ ID NO: 117018 - DNA, 15 bp, Homo sapiens
gcaattatttcattt

SEQ ID NO: 117019 - DNA, 15 bp, Homo sapiens
agcaattatttcatt

SEQ ID NO: 117020 - DNA, 15 bp, Homo sapiens
aagcaattatttcat

SEQ ID NO: 117021 - DNA, 15 bp, Homo sapiens
aaagcaattatttca

SEQ ID NO: 117022 - DNA, 15 bp, Homo sapiens
gaaagcaattatttc

SEQ ID NO: 117023 - DNA, 15 bp, Homo sapiens
ggaaagcaattattt

SEQ ID NO: 117024 - DNA, 15 bp, Homo sapiens
gggaaagcaattatt

SEQ ID NO: 117025 - DNA, 15 bp, Homo sapiens
tgggaaagcaattat

SEQ ID NO: 117026 - DNA, 15 bp, Homo sapiens
gtgggaaagcaatta

SEQ ID NO: 117027 - DNA, 15 bp, Homo sapiens
tgtgggaaagcaatt

SEQ ID NO: 117028 - DNA, 15 bp, Homo sapiens
ctgtgggaaagcaat

SEQ ID NO: 117029 - DNA, 15 bp, Homo sapiens
gctgtgggaaagcaa

SEQ ID NO: 117030 - DNA, 15 bp, Homo sapiens
agctgtgggaaagca

SEQ ID NO: 117031 - DNA, 15 bp, Homo sapiens
cagctgtgggaaagc

SEQ ID NO: 117032 - DNA, 15 bp, Homo sapiens
tcagctgtgggaaag

SEQ ID NO: 117033 - DNA, 15 bp, Homo sapiens
ctcagctgtgggaaa

SEQ ID NO: 117034 - DNA, 15 bp, Homo sapiens
actcagctgtgggaa

SEQ ID NO: 117035 - DNA, 15 bp, Homo sapiens
cactcagctgtggga

SEQ ID NO: 117036 - DNA, 15 bp, Homo sapiens
acactcagctgtggg

SEQ ID NO: 117037 - DNA, 15 bp, Homo sapiens
cacactcagctgtgg

SEQ ID NO: 117038 - DNA, 15 bp, Homo sapiens
acacactcagctgtg

SEQ ID NO: 117039 - DNA, 15 bp, Homo sapiens
aacacactcagctgt

SEQ ID NO: 117040 - DNA, 15 bp, Homo sapiens
taacacactcagctg

SEQ ID NO: 117041 - DNA, 15 bp, Homo sapiens
gtaacacactcagct

SEQ ID NO: 117042 - DNA, 15 bp, Homo sapiens
tgtaacacactcagc

SEQ ID NO: 117043 - DNA, 15 bp, Homo sapiens
gtgtaacacactcag

SEQ ID NO: 117044 - DNA, 15 bp, Homo sapiens
agtgtaacacactca

SEQ ID NO: 117045 - DNA, 15 bp, Homo sapiens
gagtgtaacacactc

SEQ ID NO: 117046 - DNA, 15 bp, Homo sapiens
tgagtgtaacacact

SEQ ID NO: 117047 - DNA, 15 bp, Homo sapiens
gtgagtgtaacacac

SEQ ID NO: 117048 - DNA, 15 bp, Homo sapiens
agtgagtgtaacaca

SEQ ID NO: 117049 - DNA, 15 bp, Homo sapiens
cagtgagtgtaacac

SEQ ID NO: 117050 - DNA, 15 bp, Homo sapiens
ccagtgagtgtaaca

SEQ ID NO: 117051 - DNA, 15 bp, Homo sapiens
accagtgagtgtaac

SEQ ID NO: 117052 - DNA, 15 bp, Homo sapiens
taccagtgagtgtaa

SEQ ID NO: 117053 - DNA, 15 bp, Homo sapiens
ataccagtgagtgta

SEQ ID NO: 117054 - DNA, 15 bp, Homo sapiens
aataccagtgagtgt

SEQ ID NO: 117055 - DNA, 15 bp, Homo sapiens
aaataccagtgagtg

SEQ ID NO: 117056 - DNA, 15 bp, Homo sapiens
caaataccagtgagt

SEQ ID NO: 117057 - DNA, 15 bp, Homo sapiens
acaaataccagtgag

SEQ ID NO: 117058 - DNA, 15 bp, Homo sapiens
aacaaataccagtga

SEQ ID NO: 117059 - DNA, 15 bp, Homo sapiens
caacaaataccagtg

SEQ ID NO: 117060 - DNA, 15 bp, Homo sapiens
tcaacaaataccagt

SEQ ID NO: 117061 - DNA, 15 bp, Homo sapiens
ttcaacaaataccag

SEQ ID NO: 117062 - DNA, 15 bp, Homo sapiens
attcaacaaatacca

SEQ ID NO: 117063 - DNA, 15 bp, Homo sapiens
aattcaacaaatacc

SEQ ID NO: 117064 - DNA, 15 bp, Homo sapiens
taattcaacaaatac

SEQ ID NO: 117065 - DNA, 15 bp, Homo sapiens
gtaattcaacaaata

SEQ ID NO: 117066 - DNA, 15 bp, Homo sapiens
tgtaattcaacaaat

SEQ ID NO: 117067 - DNA, 15 bp, Homo sapiens
gtgtaattcaacaaa

SEQ ID NO: 117068 - DNA, 15 bp, Homo sapiens
tgtgtaattcaacaa

SEQ ID NO: 117069 - DNA, 15 bp, Homo sapiens
atgtgtaattcaaca

SEQ ID NO: 117070 - DNA, 15 bp, Homo sapiens
aatgtgtaattcaac

SEQ ID NO: 117071 - DNA, 15 bp, Homo sapiens
aaatgtgtaattcaa

SEQ ID NO: 117072 - DNA, 15 bp, Homo sapiens
aaaatgtgtaattca

SEQ ID NO: 117073 - DNA, 15 bp, Homo sapiens
caaaatgtgtaattc

SEQ ID NO: 117074 - DNA, 15 bp, Homo sapiens
acaaaatgtgtaatt

SEQ ID NO: 117075 - DNA, 15 bp, Homo sapiens
aacaaaatgtgtaat

SEQ ID NO: 117076 - DNA, 15 bp, Homo sapiens
aaacaaaatgtgtaa

SEQ ID NO: 117077 - DNA, 15 bp, Homo sapiens
aaaacaaaatgtgta

SEQ ID NO: 117078 - DNA, 15 bp, Homo sapiens
gaaaacaaaatgtgt

SEQ ID NO: 117079 - DNA, 15 bp, Homo sapiens
ggaaaacaaaatgtg

SEQ ID NO: 117080 - DNA, 15 bp, Homo sapiens
tggaaaacaaaatgt

SEQ ID NO: 117081 - DNA, 15 bp, Homo sapiens
atggaaaacaaaatg

SEQ ID NO: 117082 - DNA, 15 bp, Homo sapiens
aatggaaaacaaaat

SEQ ID NO: 117083 - DNA, 15 bp, Homo sapiens
aaatggaaaacaaaa

SEQ ID NO: 117084 - DNA, 15 bp, Homo sapiens
caaatggaaaacaaa

SEQ ID NO: 117085 - DNA, 15 bp, Homo sapiens
ccaaatggaaaacaa

SEQ ID NO: 117086 - DNA, 15 bp, Homo sapiens
tccaaatggaaaaca

SEQ ID NO: 117087 - DNA, 15 bp, Homo sapiens
ttccaaatggaaaac

SEQ ID NO: 117088 - DNA, 15 bp, Homo sapiens
gttccaaatggaaaa

SEQ ID NO: 117089 - DNA, 15 bp, Homo sapiens
agttccaaatggaaa

SEQ ID NO: 117090 - DNA, 15 bp, Homo sapiens
aagttccaaatggaa

SEQ ID NO: 117091 - DNA, 15 bp, Homo sapiens
taagttccaaatgga

SEQ ID NO: 117092 - DNA, 15 bp, Homo sapiens
ttaagttccaaatgg

SEQ ID NO: 117093 - DNA, 15 bp, Homo sapiens
cttaagttccaaatg

SEQ ID NO: 117094 - DNA, 15 bp, Homo sapiens
tcttaagttccaaat

SEQ ID NO: 117095 - DNA, 15 bp, Homo sapiens
ttcttaagttccaaa

SEQ ID NO: 117096 - DNA, 15 bp, Homo sapiens
attcttaagttccaa

SEQ ID NO: 117097 - DNA, 15 bp, Homo sapiens
aattcttaagttcca

SEQ ID NO: 117098 - DNA, 15 bp, Homo sapiens
gaattcttaagttcc

SEQ ID NO: 117099 - DNA, 15 bp, Homo sapiens
agaattcttaagttc

SEQ ID NO: 117100 - DNA, 15 bp, Homo sapiens
gagaattcttaagtt

SEQ ID NO: 117101 - DNA, 15 bp, Homo sapiens
tgagaattcttaagt

SEQ ID NO: 117102 - DNA, 15 bp, Homo sapiens
gtgagaattcttaag

SEQ ID NO: 117103 - DNA, 15 bp, Homo sapiens
agtgagaattcttaa

SEQ ID NO: 117104 - DNA, 15 bp, Homo sapiens
tagtgagaattctta

SEQ ID NO: 117105 - DNA, 15 bp, Homo sapiens
atagtgagaattctt

SEQ ID NO: 117106 - DNA, 15 bp, Homo sapiens
catagtgagaattct

SEQ ID NO: 117107 - DNA, 15 bp, Homo sapiens
acatagtgagaattc

SEQ ID NO: 117108 - DNA, 15 bp, Homo sapiens
aacatagtgagaatt

SEQ ID NO: 117109 - DNA, 15 bp, Homo sapiens
taacatagtgagaat

SEQ ID NO: 117110 - DNA, 15 bp, Homo sapiens
ttaacatagtgagaa

SEQ ID NO: 117111 - DNA, 15 bp, Homo sapiens
attaacatagtgaga

SEQ ID NO: 117112 - DNA, 15 bp, Homo sapiens
tattaacatagtgag

SEQ ID NO: 117113 - DNA, 15 bp, Homo sapiens
ttattaacatagtga

SEQ ID NO: 117114 - DNA, 15 bp, Homo sapiens
cttattaacatagtg

SEQ ID NO: 117115 - DNA, 15 bp, Homo sapiens
acttattaacatagt

SEQ ID NO: 117116 - DNA, 15 bp, Homo sapiens
aacttattaacatag

SEQ ID NO: 117117 - DNA, 15 bp, Homo sapiens
aaacttattaacata

SEQ ID NO: 117118 - DNA, 15 bp, Homo sapiens
caaacttattaacat

SEQ ID NO: 117119 - DNA, 15 bp, Homo sapiens
ccaaacttattaaca

SEQ ID NO: 117120 - DNA, 15 bp, Homo sapiens
cccaaacttattaac

SEQ ID NO: 117121 - DNA, 15 bp, Homo sapiens
tcccaaacttattaa

SEQ ID NO: 117122 - DNA, 15 bp, Homo sapiens
ttcccaaacttatta

SEQ ID NO: 117123 - DNA, 15 bp, Homo sapiens
attcccaaacttatt

SEQ ID NO: 117124 - DNA, 15 bp, Homo sapiens
aattcccaaacttat

SEQ ID NO: 117125 - DNA, 15 bp, Homo sapiens
aaattcccaaactta

SEQ ID NO: 117126 - DNA, 15 bp, Homo sapiens
aaaattcccaaactt

SEQ ID NO: 117127 - DNA, 15 bp, Homo sapiens
caaaattcccaaact

SEQ ID NO: 117128 - DNA, 15 bp, Homo sapiens
acaaaattcccaaac

SEQ ID NO: 117129 - DNA, 15 bp, Homo sapiens
tacaaaattcccaaa

SEQ ID NO: 117130 - DNA, 15 bp, Homo sapiens
ttacaaaattcccaa

SEQ ID NO: 117131 - DNA, 15 bp, Homo sapiens
tttacaaaattccca

SEQ ID NO: 117132 - DNA, 15 bp, Homo sapiens
gtttacaaaattccc

SEQ ID NO: 117133 - DNA, 15 bp, Homo sapiens
agtttacaaaattcc

SEQ ID NO: 117134 - DNA, 15 bp, Homo sapiens
aagtttacaaaattc

SEQ ID NO: 117135 - DNA, 15 bp, Homo sapiens
aaagtttacaaaatt

SEQ ID NO: 117136 - DNA, 15 bp, Homo sapiens
caaagtttacaaaat

SEQ ID NO: 117137 - DNA, 15 bp, Homo sapiens
tcaaagtttacaaaa

SEQ ID NO: 117138 - DNA, 15 bp, Homo sapiens
gtcaaagtttacaaa

SEQ ID NO: 117139 - DNA, 15 bp, Homo sapiens
tgtcaaagtttacaa

SEQ ID NO: 117140 - DNA, 15 bp, Homo sapiens
atgtcaaagtttaca

SEQ ID NO: 117141 - DNA, 15 bp, Homo sapiens
aatgtcaaagtttac

SEQ ID NO: 117142 - DNA, 15 bp, Homo sapiens
caatgtcaaagttta

SEQ ID NO: 117143 - DNA, 15 bp, Homo sapiens
acaatgtcaaagttt

SEQ ID NO: 117144 - DNA, 15 bp, Homo sapiens
tacaatgtcaaagtt

SEQ ID NO: 117145 - DNA, 15 bp, Homo sapiens
ttacaatgtcaaagt

SEQ ID NO: 117146 - DNA, 15 bp, Homo sapiens
tttacaatgtcaaag

SEQ ID NO: 117147 - DNA, 15 bp, Homo sapiens
atttacaatgtcaaa

SEQ ID NO: 117148 - DNA, 15 bp, Homo sapiens
aatttacaatgtcaa

SEQ ID NO: 117149 - DNA, 15 bp, Homo sapiens
taatttacaatgtca

SEQ ID NO: 117150 - DNA, 15 bp, Homo sapiens
ataatttacaatgtc

SEQ ID NO: 117151 - DNA, 15 bp, Homo sapiens
tataatttacaatgt

SEQ ID NO: 117152 - DNA, 15 bp, Homo sapiens
atataatttacaatg

SEQ ID NO: 117153 - DNA, 15 bp, Homo sapiens
tatataatttacaat

SEQ ID NO: 117154 - DNA, 15 bp, Homo sapiens
ctatataatttacaa

SEQ ID NO: 117155 - DNA, 15 bp, Homo sapiens
cctatataatttaca

SEQ ID NO: 117156 - DNA, 15 bp, Homo sapiens
ccctatataatttac

SEQ ID NO: 117157 - DNA, 15 bp, Homo sapiens
tccctatataattta

SEQ ID NO: 117158 - DNA, 15 bp, Homo sapiens
ctccctatataattt

SEQ ID NO: 117159 - DNA, 15 bp, Homo sapiens
actccctatataatt

SEQ ID NO: 117160 - DNA, 15 bp, Homo sapiens
gactccctatataat

SEQ ID NO: 117161 - DNA, 15 bp, Homo sapiens
tgactccctatataa

SEQ ID NO: 117162 - DNA, 15 bp, Homo sapiens
atgactccctatata

SEQ ID NO: 117163 - DNA, 15 bp, Homo sapiens
catgactccctatat

SEQ ID NO: 117164 - DNA, 15 bp, Homo sapiens
ccatgactccctata

SEQ ID NO: 117165 - DNA, 15 bp, Homo sapiens
tccatgactccctat

SEQ ID NO: 117166 - DNA, 15 bp, Homo sapiens
gtccatgactcccta

SEQ ID NO: 117167 - DNA, 15 bp, Homo sapiens
agtccatgactccct

SEQ ID NO: 117168 - DNA, 15 bp, Homo sapiens
tagtccatgactccc

SEQ ID NO: 117169 - DNA, 15 bp, Homo sapiens
gtagtccatgactcc

SEQ ID NO: 117170 - DNA, 15 bp, Homo sapiens
agtagtccatgactc

SEQ ID NO: 117171 - DNA, 15 bp, Homo sapiens
aagtagtccatgact

SEQ ID NO: 117172 - DNA, 15 bp, Homo sapiens
aaagtagtccatgac

SEQ ID NO: 117173 - DNA, 15 bp, Homo sapiens
caaagtagtccatga

SEQ ID NO: 117174 - DNA, 15 bp, Homo sapiens
acaaagtagtccatg

SEQ ID NO: 117175 - DNA, 15 bp, Homo sapiens
tacaaagtagtccat

SEQ ID NO: 117176 - DNA, 15 bp, Homo sapiens
atacaaagtagtcca

SEQ ID NO: 117177 - DNA, 15 bp, Homo sapiens
tatacaaagtagtcc

SEQ ID NO: 117178 - DNA, 15 bp, Homo sapiens
atatacaaagtagtc

SEQ ID NO: 117179 - DNA, 15 bp, Homo sapiens
catatacaaagtagt

SEQ ID NO: 117180 - DNA, 15 bp, Homo sapiens
acatatacaaagtag

SEQ ID NO: 117181 - DNA, 15 bp, Homo sapiens
cacatatacaaagta

SEQ ID NO: 117182 - DNA, 15 bp, Homo sapiens
ccacatatacaaagt

SEQ ID NO: 117183 - DNA, 15 bp, Homo sapiens
gccacatatacaaag

SEQ ID NO: 117184 - DNA, 15 bp, Homo sapiens
tgccacatatacaaa

SEQ ID NO: 117185 - DNA, 15 bp, Homo sapiens
ctgccacatatacaa

SEQ ID NO: 117186 - DNA, 15 bp, Homo sapiens
tctgccacatataca

SEQ ID NO: 117187 - DNA, 15 bp, Homo sapiens
ttctgccacatatac

SEQ ID NO: 117188 - DNA, 15 bp, Homo sapiens
tttctgccacatata

SEQ ID NO: 117189 - DNA, 15 bp, Homo sapiens
ttttctgccacatat

SEQ ID NO: 117190 - DNA, 15 bp, Homo sapiens
cttttctgccacata

SEQ ID NO: 117191 - DNA, 15 bp, Homo sapiens
acttttctgccacat

SEQ ID NO: 117192 - DNA, 15 bp, Homo sapiens
aacttttctgccaca

SEQ ID NO: 117193 - DNA, 15 bp, Homo sapiens
aaacttttctgccac

SEQ ID NO: 117194 - DNA, 15 bp, Homo sapiens
aaaacttttctgcca

SEQ ID NO: 117195 - DNA, 15 bp, Homo sapiens
aaaaacttttctgcc

SEQ ID NO: 117196 - DNA, 15 bp, Homo sapiens
taaaaacttttctgc

SEQ ID NO: 117197 - DNA, 15 bp, Homo sapiens
ttaaaaacttttctg

SEQ ID NO: 117198 - DNA, 15 bp, Homo sapiens
attaaaaacttttct

SEQ ID NO: 117199 - DNA, 15 bp, Homo sapiens
tattaaaaacttttc

SEQ ID NO: 117200 - DNA, 15 bp, Homo sapiens
ttattaaaaactttt

SEQ ID NO: 117201 - DNA, 15 bp, Homo sapiens
attattaaaaacttt

SEQ ID NO: 117202 - DNA, 15 bp, Homo sapiens
aattattaaaaactt

SEQ ID NO: 117203 - DNA, 15 bp, Homo sapiens
aaattattaaaaact

SEQ ID NO: 117204 - DNA, 15 bp, Homo sapiens
taaattattaaaaac

SEQ ID NO: 117205 - DNA, 15 bp, Homo sapiens
ttaaattattaaaaa

SEQ ID NO: 117206 - DNA, 15 bp, Homo sapiens
cttaaattattaaaa

SEQ ID NO: 117207 - DNA, 15 bp, Homo sapiens
ccttaaattattaaa

SEQ ID NO: 117208 - DNA, 15 bp, Homo sapiens
accttaaattattaa

SEQ ID NO: 117209 - DNA, 15 bp, Homo sapiens
aaccttaaattatta

SEQ ID NO: 117210 - DNA, 15 bp, Homo sapiens
caaccttaaattatt

SEQ ID NO: 117211 - DNA, 15 bp, Homo sapiens
acaaccttaaattat

SEQ ID NO: 117212 - DNA, 15 bp, Homo sapiens
tacaaccttaaatta

SEQ ID NO: 117213 - DNA, 15 bp, Homo sapiens
atacaaccttaaatt

SEQ ID NO: 117214 - DNA, 15 bp, Homo sapiens
tatacaaccttaaat

SEQ ID NO: 117215 - DNA, 15 bp, Homo sapiens
atatacaaccttaaa

SEQ ID NO: 117216 - DNA, 15 bp, Homo sapiens
tatatacaaccttaa

SEQ ID NO: 117217 - DNA, 15 bp, Homo sapiens
gtatatacaacctta

SEQ ID NO: 117218 - DNA, 15 bp, Homo sapiens
agtatatacaacctt

SEQ ID NO: 117219 - DNA, 15 bp, Homo sapiens
aagtatatacaacct

SEQ ID NO: 117220 - DNA, 15 bp, Homo sapiens
aaagtatatacaacc

SEQ ID NO: 117221 - DNA, 15 bp, Homo sapiens
aaaagtatatacaac

SEQ ID NO: 117222 - DNA, 15 bp, Homo sapiens
taaaagtatatacaa

SEQ ID NO: 117223 - DNA, 15 bp, Homo sapiens
ataaaagtatataca

SEQ ID NO: 117224 - DNA, 15 bp, Homo sapiens
tataaaagtatatac

SEQ ID NO: 117225 - DNA, 15 bp, Homo sapiens
ttataaaagtatata

SEQ ID NO: 117226 - DNA, 15 bp, Homo sapiens
attataaaagtatat

SEQ ID NO: 117227 - DNA, 15 bp, Homo sapiens
tattataaaagtata

SEQ ID NO: 117228 - DNA, 15 bp, Homo sapiens
atattataaaagtat

SEQ ID NO: 117229 - DNA, 15 bp, Homo sapiens
aatattataaaagta

SEQ ID NO: 117230 - DNA, 15 bp, Homo sapiens
gaatattataaaagt

SEQ ID NO: 117231 - DNA, 15 bp, Homo sapiens
agaatattataaaag

SEQ ID NO: 117232 - DNA, 15 bp, Homo sapiens
cagaatattataaaa

SEQ ID NO: 117233 - DNA, 15 bp, Homo sapiens
tcagaatattataaa

SEQ ID NO: 117234 - DNA, 15 bp, Homo sapiens
ttcagaatattataa

SEQ ID NO: 117235 - DNA, 15 bp, Homo sapiens
cttcagaatattata

SEQ ID NO: 117236 - DNA, 15 bp, Homo sapiens
gcttcagaatattat

SEQ ID NO: 117237 - DNA, 15 bp, Homo sapiens
tgcttcagaatatta

SEQ ID NO: 117238 - DNA, 15 bp, Homo sapiens
atgcttcagaatatt

SEQ ID NO: 117239 - DNA, 15 bp, Homo sapiens
gatgcttcagaatat

SEQ ID NO: 117240 - DNA, 15 bp, Homo sapiens
tgatgcttcagaata

SEQ ID NO: 117241 - DNA, 15 bp, Homo sapiens
ttgatgcttcagaat

SEQ ID NO: 117242 - DNA, 15 bp, Homo sapiens
cttgatgcttcagaa

SEQ ID NO: 117243 - DNA, 15 bp, Homo sapiens
acttgatgcttcaga

SEQ ID NO: 117244 - DNA, 15 bp, Homo sapiens
tacttgatgcttcag

SEQ ID NO: 117245 - DNA, 15 bp, Homo sapiens
ctacttgatgcttca

SEQ ID NO: 117246 - DNA, 15 bp, Homo sapiens
cctacttgatgcttc

SEQ ID NO: 117247 - DNA, 15 bp, Homo sapiens
acctacttgatgctt

SEQ ID NO: 117248 - DNA, 15 bp, Homo sapiens
gacctacttgatgct

SEQ ID NO: 117249 - DNA, 15 bp, Homo sapiens
agacctacttgatgc

SEQ ID NO: 117250 - DNA, 15 bp, Homo sapiens
aagacctacttgatg

SEQ ID NO: 117251 - DNA, 15 bp, Homo sapiens
caagacctacttgat

SEQ ID NO: 117252 - DNA, 15 bp, Homo sapiens
ccaagacctacttga

SEQ ID NO: 117253 - DNA, 15 bp, Homo sapiens
accaagacctacttg

SEQ ID NO: 117254 - DNA, 15 bp, Homo sapiens
caccaagacctactt

SEQ ID NO: 117255 - DNA, 15 bp, Homo sapiens
acaccaagacctact

SEQ ID NO: 117256 - DNA, 15 bp, Homo sapiens
aacaccaagacctac

SEQ ID NO: 117257 - DNA, 15 bp, Homo sapiens
aaacaccaagaccta

SEQ ID NO: 117258 - DNA, 15 bp, Homo sapiens
aaaacaccaagacct

SEQ ID NO: 117259 - DNA, 15 bp, Homo sapiens
aaaaacaccaagacc

SEQ ID NO: 117260 - DNA, 15 bp, Homo sapiens
taaaaacaccaagac

SEQ ID NO: 117261 - DNA, 15 bp, Homo sapiens
ataaaaacaccaaga

SEQ ID NO: 117262 - DNA, 15 bp, Homo sapiens
aataaaaacaccaag

SEQ ID NO: 117263 - DNA, 15 bp, Homo sapiens
aaataaaaacaccaa

SEQ ID NO: 117264 - DNA, 15 bp, Homo sapiens
aaaataaaaacacca

SEQ ID NO: 117265 - DNA, 15 bp, Homo sapiens
gaaaataaaaacacc

SEQ ID NO: 117266 - DNA, 15 bp, Homo sapiens
agaaaataaaaacac

SEQ ID NO: 117267 - DNA, 15 bp, Homo sapiens
tagaaaataaaaaca

SEQ ID NO: 117268 - DNA, 15 bp, Homo sapiens
ctagaaaataaaaac

SEQ ID NO: 117269 - DNA, 15 bp, Homo sapiens
tctagaaaataaaaa

SEQ ID NO: 117270 - DNA, 15 bp, Homo sapiens
ttctagaaaataaaa

SEQ ID NO: 117271 - DNA, 15 bp, Homo sapiens
attctagaaaataaa

SEQ ID NO: 117272 - DNA, 15 bp, Homo sapiens
cattctagaaaataa

SEQ ID NO: 117273 - DNA, 15 bp, Homo sapiens
acattctagaaaata

SEQ ID NO: 117274 - DNA, 15 bp, Homo sapiens
aacattctagaaaat

SEQ ID NO: 117275 - DNA, 15 bp, Homo sapiens
gaacattctagaaaa

SEQ ID NO: 117276 - DNA, 15 bp, Homo sapiens
agaacattctagaaa

SEQ ID NO: 117277 - DNA, 15 bp, Homo sapiens
cagaacattctagaa

SEQ ID NO: 117278 - DNA, 15 bp, Homo sapiens
tcagaacattctaga

SEQ ID NO: 117279 - DNA, 15 bp, Homo sapiens
ttcagaacattctag

SEQ ID NO: 117280 - DNA, 15 bp, Homo sapiens
cttcagaacattcta

SEQ ID NO: 117281 - DNA, 15 bp, Homo sapiens
ccttcagaacattct

SEQ ID NO: 117282 - DNA, 15 bp, Homo sapiens
tccttcagaacattc

SEQ ID NO: 117283 - DNA, 15 bp, Homo sapiens
atccttcagaacatt

SEQ ID NO: 117284 - DNA, 15 bp, Homo sapiens
gatccttcagaacat

SEQ ID NO: 117285 - DNA, 15 bp, Homo sapiens
agatccttcagaaca

SEQ ID NO: 117286 - DNA, 15 bp, Homo sapiens
cagatccttcagaac

SEQ ID NO: 117287 - DNA, 15 bp, Homo sapiens
ccagatccttcagaa

SEQ ID NO: 117288 - DNA, 15 bp, Homo sapiens
tccagatccttcaga

SEQ ID NO: 117289 - DNA, 15 bp, Homo sapiens
ttccagatccttcag

SEQ ID NO: 117290 - DNA, 15 bp, Homo sapiens
tttccagatccttca

SEQ ID NO: 117291 - DNA, 15 bp, Homo sapiens
ttttccagatccttc

SEQ ID NO: 117292 - DNA, 15 bp, Homo sapiens
cttttccagatcctt

SEQ ID NO: 117293 - DNA, 15 bp, Homo sapiens
tcttttccagatcct

SEQ ID NO: 117294 - DNA, 15 bp, Homo sapiens
ctcttttccagatcc

SEQ ID NO: 117295 - DNA, 15 bp, Homo sapiens
tctcttttccagatc

SEQ ID NO: 117296 - DNA, 15 bp, Homo sapiens
ttctcttttccagat

SEQ ID NO: 117297 - DNA, 15 bp, Homo sapiens
tttctcttttccaga

SEQ ID NO: 117298 - DNA, 15 bp, Homo sapiens
ttttctcttttccag

SEQ ID NO: 117299 - DNA, 15 bp, Homo sapiens
cttttctcttttcca

SEQ ID NO: 117300 - DNA, 15 bp, Homo sapiens
gcttttctcttttcc

SEQ ID NO: 117301 - DNA, 15 bp, Homo sapiens
agcttttctcttttc

SEQ ID NO: 117302 - DNA, 15 bp, Homo sapiens
cagcttttctctttt

SEQ ID NO: 117303 - DNA, 15 bp, Homo sapiens
tcagcttttctcttt

SEQ ID NO: 117304 - DNA, 15 bp, Homo sapiens
atcagcttttctctt

SEQ ID NO: 117305 - DNA, 15 bp, Homo sapiens
aatcagcttttctct

SEQ ID NO: 117306 - DNA, 15 bp, Homo sapiens
aaatcagcttttctc

SEQ ID NO: 117307 - DNA, 15 bp, Homo sapiens
taaatcagcttttct

SEQ ID NO: 117308 - DNA, 15 bp, Homo sapiens
ttaaatcagcttttc

SEQ ID NO: 117309 - DNA, 15 bp, Homo sapiens
tttaaatcagctttt

SEQ ID NO: 117310 - DNA, 15 bp, Homo sapiens
atttaaatcagcttt

SEQ ID NO: 117311 - DNA, 15 bp, Homo sapiens
tatttaaatcagctt

SEQ ID NO: 117312 - DNA, 15 bp, Homo sapiens
gtatttaaatcagct

SEQ ID NO: 117313 - DNA, 15 bp, Homo sapiens
ggtatttaaatcagc

SEQ ID NO: 117314 - DNA, 15 bp, Homo sapiens
tggtatttaaatcag

SEQ ID NO: 117315 - DNA, 15 bp, Homo sapiens
atggtatttaaatca

SEQ ID NO: 117316 - DNA, 15 bp, Homo sapiens
gatggtatttaaatc

SEQ ID NO: 117317 - DNA, 15 bp, Homo sapiens
tgatggtatttaaat

SEQ ID NO: 117318 - DNA, 15 bp, Homo sapiens
gtgatggtatttaaa

SEQ ID NO: 117319 - DNA, 15 bp, Homo sapiens
tgtgatggtatttaa

SEQ ID NO: 117320 - DNA, 15 bp, Homo sapiens
ctgtgatggtattta

SEQ ID NO: 117321 - DNA, 15 bp, Homo sapiens
tctgtgatggtattt

SEQ ID NO: 117322 - DNA, 15 bp, Homo sapiens
ctctgtgatggtatt

SEQ ID NO: 117323 - DNA, 15 bp, Homo sapiens
tctctgtgatggtat

SEQ ID NO: 117324 - DNA, 15 bp, Homo sapiens
ctctctgtgatggta

SEQ ID NO: 117325 - DNA, 15 bp, Homo sapiens
actctctgtgatggt

SEQ ID NO: 117326 - DNA, 15 bp, Homo sapiens
tactctctgtgatgg

SEQ ID NO: 117327 - DNA, 15 bp, Homo sapiens
ctactctctgtgatg

SEQ ID NO: 117328 - DNA, 15 bp, Homo sapiens
actactctctgtgat

SEQ ID NO: 117329 - DNA, 15 bp, Homo sapiens
cactactctctgtga

SEQ ID NO: 117330 - DNA, 15 bp, Homo sapiens
gcactactctctgtg

SEQ ID NO: 117331 - DNA, 15 bp, Homo sapiens
agcactactctctgt

SEQ ID NO: 117332 - DNA, 15 bp, Homo sapiens
cagcactactctctg

SEQ ID NO: 117333 - DNA, 15 bp, Homo sapiens
gcagcactactctct

SEQ ID NO: 117334 - DNA, 15 bp, Homo sapiens
ggcagcactactctc

SEQ ID NO: 117335 - DNA, 15 bp, Homo sapiens
gggcagcactactct

SEQ ID NO: 117336 - DNA, 15 bp, Homo sapiens
agggcagcactactc

SEQ ID NO: 117337 - DNA, 15 bp, Homo sapiens
cagggcagcactact

SEQ ID NO: 117338 - DNA, 15 bp, Homo sapiens
gcagggcagcactac

SEQ ID NO: 117339 - DNA, 15 bp, Homo sapiens
tgcagggcagcacta

SEQ ID NO: 117340 - DNA, 15 bp, Homo sapiens
ttgcagggcagcact

SEQ ID NO: 117341 - DNA, 15 bp, Homo sapiens
tttgcagggcagcac

SEQ ID NO: 117342 - DNA, 15 bp, Homo sapiens
ttttgcagggcagca

SEQ ID NO: 117343 - DNA, 15 bp, Homo sapiens
gttttgcagggcagc

SEQ ID NO: 117344 - DNA, 15 bp, Homo sapiens
agttttgcagggcag

SEQ ID NO: 117345 - DNA, 15 bp, Homo sapiens
aagttttgcagggca

SEQ ID NO: 117346 - DNA, 15 bp, Homo sapiens
caagttttgcagggc

SEQ ID NO: 117347 - DNA, 15 bp, Homo sapiens
tcaagttttgcaggg

SEQ ID NO: 117348 - DNA, 15 bp, Homo sapiens
atcaagttttgcagg

SEQ ID NO: 117349 - DNA, 15 bp, Homo sapiens
aatcaagttttgcag

SEQ ID NO: 117350 - DNA, 15 bp, Homo sapiens
caatcaagttttgca

SEQ ID NO: 117351 - DNA, 15 bp, Homo sapiens
tcaatcaagttttgc

SEQ ID NO: 117352 - DNA, 15 bp, Homo sapiens
ctcaatcaagttttg

SEQ ID NO: 117353 - DNA, 15 bp, Homo sapiens
cctcaatcaagtttt

SEQ ID NO: 117354 - DNA, 15 bp, Homo sapiens
ccctcaatcaagttt

SEQ ID NO: 117355 - DNA, 15 bp, Homo sapiens
gccctcaatcaagtt

SEQ ID NO: 117356 - DNA, 15 bp, Homo sapiens
tgccctcaatcaagt

SEQ ID NO: 117357 - DNA, 15 bp, Homo sapiens
ctgccctcaatcaag

SEQ ID NO: 117358 - DNA, 15 bp, Homo sapiens
actgccctcaatcaa

SEQ ID NO: 117359 - DNA, 15 bp, Homo sapiens
cactgccctcaatca

SEQ ID NO: 117360 - DNA, 15 bp, Homo sapiens
tcactgccctcaatc

SEQ ID NO: 117361 - DNA, 15 bp, Homo sapiens
ctcactgccctcaat

SEQ ID NO: 117362 - DNA, 15 bp, Homo sapiens
gctcactgccctcaa

SEQ ID NO: 117363 - DNA, 15 bp, Homo sapiens
ggctcactgccctca

SEQ ID NO: 117364 - DNA, 15 bp, Homo sapiens
aggctcactgccctc

SEQ ID NO: 117365 - DNA, 15 bp, Homo sapiens
taggctcactgccct

SEQ ID NO: 117366 - DNA, 15 bp, Homo sapiens
ataggctcactgccc

SEQ ID NO: 117367 - DNA, 15 bp, Homo sapiens
aataggctcactgcc

SEQ ID NO: 117368 - DNA, 15 bp, Homo sapiens
aaataggctcactgc

SEQ ID NO: 117369 - DNA, 15 bp, Homo sapiens
aaaataggctcactg

SEQ ID NO: 117370 - DNA, 15 bp, Homo sapiens
taaaataggctcact

SEQ ID NO: 117371 - DNA, 15 bp, Homo sapiens
ctaaaataggctcac

SEQ ID NO: 117372 - DNA, 15 bp, Homo sapiens
tctaaaataggctca

SEQ ID NO: 117373 - DNA, 15 bp, Homo sapiens
ttctaaaataggctc

SEQ ID NO: 117374 - DNA, 15 bp, Homo sapiens
cttctaaaataggct

SEQ ID NO: 117375 - DNA, 15 bp, Homo sapiens
tcttctaaaataggc

SEQ ID NO: 117376 - DNA, 15 bp, Homo sapiens
ctcttctaaaatagg

SEQ ID NO: 117377 - DNA, 15 bp, Homo sapiens
tctcttctaaaatag

SEQ ID NO: 117378 - DNA, 15 bp, Homo sapiens
ctctcttctaaaata

SEQ ID NO: 117379 - DNA, 15 bp, Homo sapiens
cctctcttctaaaat

SEQ ID NO: 117380 - DNA, 15 bp, Homo sapiens
gcctctcttctaaaa

SEQ ID NO: 117381 - DNA, 15 bp, Homo sapiens
agcctctcttctaaa

SEQ ID NO: 117382 - DNA, 15 bp, Homo sapiens
gagcctctcttctaa

SEQ ID NO: 117383 - DNA, 15 bp, Homo sapiens
agagcctctcttcta

SEQ ID NO: 117384 - DNA, 15 bp, Homo sapiens
cagagcctctcttct

SEQ ID NO: 117385 - DNA, 15 bp, Homo sapiens
gcagagcctctcttc

SEQ ID NO: 117386 - DNA, 15 bp, Homo sapiens
cgcagagcctctctt

SEQ ID NO: 117387 - DNA, 15 bp, Homo sapiens
acgcagagcctctct

SEQ ID NO: 117388 - DNA, 15 bp, Homo sapiens
gacgcagagcctctc

SEQ ID NO: 117389 - DNA, 15 bp, Homo sapiens
ggacgcagagcctct

SEQ ID NO: 117390 - DNA, 15 bp, Homo sapiens
aggacgcagagcctc

SEQ ID NO: 117391 - DNA, 15 bp, Homo sapiens
aaggacgcagagcct

SEQ ID NO: 117392 - DNA, 15 bp, Homo sapiens
taaggacgcagagcc

SEQ ID NO: 117393 - DNA, 15 bp, Homo sapiens
ttaaggacgcagagc

SEQ ID NO: 117394 - DNA, 15 bp, Homo sapiens
gttaaggacgcagag

SEQ ID NO: 117395 - DNA, 15 bp, Homo sapiens
cgttaaggacgcaga

SEQ ID NO: 117396 - DNA, 15 bp, Homo sapiens
gcgttaaggacgcag

SEQ ID NO: 117397 - DNA, 15 bp, Homo sapiens
agcgttaaggacgca

SEQ ID NO: 117398 - DNA, 15 bp, Homo sapiens
cagcgttaaggacgc

SEQ ID NO: 117399 - DNA, 15 bp, Homo sapiens
ccagcgttaaggacg

SEQ ID NO: 117400 - DNA, 15 bp, Homo sapiens
cccagcgttaaggac

SEQ ID NO: 117401 - DNA, 15 bp, Homo sapiens
acccagcgttaagga

SEQ ID NO: 117402 - DNA, 15 bp, Homo sapiens
cacccagcgttaagg

SEQ ID NO: 117403 - DNA, 15 bp, Homo sapiens
ccacccagcgttaag

SEQ ID NO: 117404 - DNA, 15 bp, Homo sapiens
tccacccagcgttaa

SEQ ID NO: 117405 - DNA, 15 bp, Homo sapiens
ctccacccagcgtta

SEQ ID NO: 117406 - DNA, 15 bp, Homo sapiens
gctccacccagcgtt

SEQ ID NO: 117407 - DNA, 15 bp, Homo sapiens
ggctccacccagcgt

SEQ ID NO: 117408 - DNA, 15 bp, Homo sapiens
cggctccacccagcg

SEQ ID NO: 117409 - DNA, 15 bp, Homo sapiens
tcggctccacccagc

SEQ ID NO: 117410 - DNA, 15 bp, Homo sapiens
ctcggctccacccag

SEQ ID NO: 117411 - DNA, 15 bp, Homo sapiens
actcggctccaccca

SEQ ID NO: 117412 - DNA, 15 bp, Homo sapiens
aactcggctccaccc

SEQ ID NO: 117413 - DNA, 15 bp, Homo sapiens
gaactcggctccacc

SEQ ID NO: 117414 - DNA, 15 bp, Homo sapiens
cgaactcggctccac

SEQ ID NO: 117415 - DNA, 15 bp, Homo sapiens
acgaactcggctcca

SEQ ID NO: 117416 - DNA, 15 bp, Homo sapiens
tacgaactcggctcc

SEQ ID NO: 117417 - DNA, 15 bp, Homo sapiens
gtacgaactcggctc

SEQ ID NO: 117418 - DNA, 15 bp, Homo sapiens
ggtacgaactcggct

SEQ ID NO: 117419 - DNA, 15 bp, Homo sapiens
aggtacgaactcggc

SEQ ID NO: 117420 - DNA, 15 bp, Homo sapiens
caggtacgaactcgg

SEQ ID NO: 117421 - DNA, 15 bp, Homo sapiens
ccaggtacgaactcg

SEQ ID NO: 117422 - DNA, 15 bp, Homo sapiens
tccaggtacgaactc

SEQ ID NO: 117423 - DNA, 15 bp, Homo sapiens
gtccaggtacgaact

SEQ ID NO: 117424 - DNA, 15 bp, Homo sapiens
agtccaggtacgaac

SEQ ID NO: 117425 - DNA, 15 bp, Homo sapiens
cagtccaggtacgaa

SEQ ID NO: 117426 - DNA, 15 bp, Homo sapiens
tcagtccaggtacga

SEQ ID NO: 117427 - DNA, 15 bp, Homo sapiens
ttcagtccaggtacg

SEQ ID NO: 117428 - DNA, 15 bp, Homo sapiens
cttcagtccaggtac

SEQ ID NO: 117429 - DNA, 15 bp, Homo sapiens
tcttcagtccaggta

SEQ ID NO: 117430 - DNA, 15 bp, Homo sapiens
atcttcagtccaggt

SEQ ID NO: 117431 - DNA, 15 bp, Homo sapiens
aatcttcagtccagg

SEQ ID NO: 117432 - DNA, 15 bp, Homo sapiens
caatcttcagtccag

SEQ ID NO: 117433 - DNA, 15 bp, Homo sapiens
ccaatcttcagtcca

SEQ ID NO: 117434 - DNA, 15 bp, Homo sapiens
accaatcttcagtcc

SEQ ID NO: 117435 - DNA, 15 bp, Homo sapiens
caccaatcttcagtc

SEQ ID NO: 117436 - DNA, 15 bp, Homo sapiens
gcaccaatcttcagt

SEQ ID NO: 117437 - DNA, 15 bp, Homo sapiens
tgcaccaatcttcag

SEQ ID NO: 117438 - DNA, 15 bp, Homo sapiens
ttgcaccaatcttca

SEQ ID NO: 117439 - DNA, 15 bp, Homo sapiens
attgcaccaatcttc

SEQ ID NO: 117440 - DNA, 15 bp, Homo sapiens
tattgcaccaatctt

SEQ ID NO: 117441 - DNA, 15 bp, Homo sapiens
gtattgcaccaatct

SEQ ID NO: 117442 - DNA, 15 bp, Homo sapiens
ggtattgcaccaatc

SEQ ID NO: 117443 - DNA, 15 bp, Homo sapiens
aggtattgcaccaat

SEQ ID NO: 117444 - DNA, 15 bp, Homo sapiens
aaggtattgcaccaa

SEQ ID NO: 117445 - DNA, 15 bp, Homo sapiens
caaggtattgcacca

SEQ ID NO: 117446 - DNA, 15 bp, Homo sapiens
tcaaggtattgcacc

SEQ ID NO: 117447 - DNA, 15 bp, Homo sapiens
atcaaggtattgcac

SEQ ID NO: 117448 - DNA, 15 bp, Homo sapiens
catcaaggtattgca

SEQ ID NO: 117449 - DNA, 15 bp, Homo sapiens
ccatcaaggtattgc

SEQ ID NO: 117450 - DNA, 15 bp, Homo sapiens
accatcaaggtattg

SEQ ID NO: 117451 - DNA, 15 bp, Homo sapiens
taccatcaaggtatt

SEQ ID NO: 117452 - DNA, 15 bp, Homo sapiens
ataccatcaaggtat

SEQ ID NO: 117453 - DNA, 15 bp, Homo sapiens
cataccatcaaggta

SEQ ID NO: 117454 - DNA, 15 bp, Homo sapiens
acataccatcaaggt

SEQ ID NO: 117455 - DNA, 15 bp, Homo sapiens
gacataccatcaagg

SEQ ID NO: 117456 - DNA, 15 bp, Homo sapiens
agacataccatcaag

SEQ ID NO: 117457 - DNA, 15 bp, Homo sapiens
gagacataccatcaa

SEQ ID NO: 117458 - DNA, 15 bp, Homo sapiens
tgagacataccatca

SEQ ID NO: 117459 - DNA, 15 bp, Homo sapiens
ctgagacataccatc

SEQ ID NO: 117460 - DNA, 15 bp, Homo sapiens
cctgagacataccat

SEQ ID NO: 117461 - DNA, 15 bp, Homo sapiens
tcctgagacatacca

SEQ ID NO: 117462 - DNA, 15 bp, Homo sapiens
ttcctgagacatacc

SEQ ID NO: 117463 - DNA, 15 bp, Homo sapiens
tttcctgagacatac

SEQ ID NO: 117464 - DNA, 15 bp, Homo sapiens
ttttcctgagacata

SEQ ID NO: 117465 - DNA, 15 bp, Homo sapiens
tttttcctgagacat

SEQ ID NO: 117466 - DNA, 15 bp, Homo sapiens
ctttttcctgagaca

SEQ ID NO: 117467 - DNA, 15 bp, Homo sapiens
actttttcctgagac

SEQ ID NO: 117468 - DNA, 15 bp, Homo sapiens
tactttttcctgaga

SEQ ID NO: 117469 - DNA, 15 bp, Homo sapiens
ttactttttcctgag

SEQ ID NO: 117470 - DNA, 15 bp, Homo sapiens
tttactttttcctga

SEQ ID NO: 117471 - DNA, 15 bp, Homo sapiens
atttactttttcctg

SEQ ID NO: 117472 - DNA, 15 bp, Homo sapiens
catttactttttcct

SEQ ID NO: 117473 - DNA, 15 bp, Homo sapiens
tcatttactttttcc

SEQ ID NO: 117474 - DNA, 15 bp, Homo sapiens
atcatttactttttc

SEQ ID NO: 117475 - DNA, 15 bp, Homo sapiens
catcatttacttttt

SEQ ID NO: 117476 - DNA, 15 bp, Homo sapiens
tcatcatttactttt

SEQ ID NO: 117477 - DNA, 15 bp, Homo sapiens
ttcatcatttacttt

SEQ ID NO: 117478 - DNA, 15 bp, Homo sapiens
tttcatcatttactt

SEQ ID NO: 117479 - DNA, 15 bp, Homo sapiens
atttcatcatttact

SEQ ID NO: 117480 - DNA, 15 bp, Homo sapiens
gatttcatcatttac

SEQ ID NO: 117481 - DNA, 15 bp, Homo sapiens
agatttcatcattta

SEQ ID NO: 117482 - DNA, 15 bp, Homo sapiens
aagatttcatcattt

SEQ ID NO: 117483 - DNA, 15 bp, Homo sapiens
gaagatttcatcatt

SEQ ID NO: 117484 - DNA, 15 bp, Homo sapiens
agaagatttcatcat

SEQ ID NO: 117485 - DNA, 15 bp, Homo sapiens
gagaagatttcatca

SEQ ID NO: 117486 - DNA, 15 bp, Homo sapiens
ggagaagatttcatc

SEQ ID NO: 117487 - DNA, 15 bp, Homo sapiens
aggagaagatttcat

SEQ ID NO: 117488 - DNA, 15 bp, Homo sapiens
gaggagaagatttca

SEQ ID NO: 117489 - DNA, 15 bp, Homo sapiens
agaggagaagatttc

SEQ ID NO: 117490 - DNA, 15 bp, Homo sapiens
gagaggagaagattt

SEQ ID NO: 117491 - DNA, 15 bp, Homo sapiens
agagaggagaagatt

SEQ ID NO: 117492 - DNA, 15 bp, Homo sapiens
aagagaggagaagat

SEQ ID NO: 117493 - DNA, 15 bp, Homo sapiens
gaagagaggagaaga

SEQ ID NO: 117494 - DNA, 15 bp, Homo sapiens
agaagagaggagaag

SEQ ID NO: 117495 - DNA, 15 bp, Homo sapiens
tagaagagaggagaa

SEQ ID NO: 117496 - DNA, 15 bp, Homo sapiens
ctagaagagaggaga

SEQ ID NO: 117497 - DNA, 15 bp, Homo sapiens
actagaagagaggag

SEQ ID NO: 117498 - DNA, 15 bp, Homo sapiens
aactagaagagagga

SEQ ID NO: 117499 - DNA, 15 bp, Homo sapiens
taactagaagagagg

SEQ ID NO: 117500 - DNA, 15 bp, Homo sapiens
ataactagaagagag

SEQ ID NO: 117501 - DNA, 15 bp, Homo sapiens
aataactagaagaga

SEQ ID NO: 117502 - DNA, 15 bp, Homo sapiens
aaataactagaagag

SEQ ID NO: 117503 - DNA, 15 bp, Homo sapiens
aaaataactagaaga

SEQ ID NO: 117504 - DNA, 15 bp, Homo sapiens
aaaaataactagaag

SEQ ID NO: 117505 - DNA, 15 bp, Homo sapiens
aaaaaataactagaa

SEQ ID NO: 117506 - DNA, 15 bp, Homo sapiens
taaaaaataactaga

SEQ ID NO: 117507 - DNA, 15 bp, Homo sapiens
ttaaaaaataactag

SEQ ID NO: 117508 - DNA, 15 bp, Homo sapiens
tttaaaaaataacta

SEQ ID NO: 117509 - DNA, 15 bp, Homo sapiens
atttaaaaaataact

SEQ ID NO: 117510 - DNA, 15 bp, Homo sapiens
catttaaaaaataac

SEQ ID NO: 117511 - DNA, 15 bp, Homo sapiens
tcatttaaaaaataa

SEQ ID NO: 117512 - DNA, 15 bp, Homo sapiens
ttcatttaaaaaata

SEQ ID NO: 117513 - DNA, 15 bp, Homo sapiens
attcatttaaaaaat

SEQ ID NO: 117514 - DNA, 15 bp, Homo sapiens
tattcatttaaaaaa

SEQ ID NO: 117515 - DNA, 15 bp, Homo sapiens
gtattcatttaaaaa

SEQ ID NO: 117516 - DNA, 15 bp, Homo sapiens
tgtattcatttaaaa

SEQ ID NO: 117517 - DNA, 15 bp, Homo sapiens
ttgtattcatttaaa

SEQ ID NO: 117518 - DNA, 15 bp, Homo sapiens
gttgtattcatttaa

SEQ ID NO: 117519 - DNA, 15 bp, Homo sapiens
agttgtattcattta

SEQ ID NO: 117520 - DNA, 15 bp, Homo sapiens
aagttgtattcattt

SEQ ID NO: 117521 - DNA, 15 bp, Homo sapiens
aaagttgtattcatt

SEQ ID NO: 117522 - DNA, 15 bp, Homo sapiens
caaagttgtattcat

SEQ ID NO: 117523 - DNA, 15 bp, Homo sapiens
tcaaagttgtattca

SEQ ID NO: 117524 - DNA, 15 bp, Homo sapiens
atcaaagttgtattc

SEQ ID NO: 117525 - DNA, 15 bp, Homo sapiens
aatcaaagttgtatt

SEQ ID NO: 117526 - DNA, 15 bp, Homo sapiens
taatcaaagttgtat

SEQ ID NO: 117527 - DNA, 15 bp, Homo sapiens
ttaatcaaagttgta

SEQ ID NO: 117528 - DNA, 15 bp, Homo sapiens
tttaatcaaagttgt

SEQ ID NO: 117529 - DNA, 15 bp, Homo sapiens
atttaatcaaagttg

SEQ ID NO: 117530 - DNA, 15 bp, Homo sapiens
aatttaatcaaagtt

SEQ ID NO: 117531 - DNA, 15 bp, Homo sapiens
aaatttaatcaaagt

SEQ ID NO: 117532 - DNA, 15 bp, Homo sapiens
gaaatttaatcaaag

SEQ ID NO: 117533 - DNA, 15 bp, Homo sapiens
tgaaatttaatcaaa

SEQ ID NO: 117534 - DNA, 15 bp, Homo sapiens
ttgaaatttaatcaa

SEQ ID NO: 117535 - DNA, 15 bp, Homo sapiens
tttgaaatttaatca

SEQ ID NO: 117536 - DNA, 15 bp, Homo sapiens
atttgaaatttaatc

SEQ ID NO: 117537 - DNA, 15 bp, Homo sapiens
gatttgaaatttaat

SEQ ID NO: 117538 - DNA, 15 bp, Homo sapiens
ggatttgaaatttaa

SEQ ID NO: 117539 - DNA, 15 bp, Homo sapiens
aggatttgaaattta

SEQ ID NO: 117540 - DNA, 15 bp, Homo sapiens
caggatttgaaattt

SEQ ID NO: 117541 - DNA, 15 bp, Homo sapiens
acaggatttgaaatt

SEQ ID NO: 117542 - DNA, 15 bp, Homo sapiens
aacaggatttgaaat

SEQ ID NO: 117543 - DNA, 15 bp, Homo sapiens
aaacaggatttgaaa

SEQ ID NO: 117544 - DNA, 15 bp, Homo sapiens
taaacaggatttgaa

SEQ ID NO: 117545 - DNA, 15 bp, Homo sapiens
gtaaacaggatttga

SEQ ID NO: 117546 - DNA, 15 bp, Homo sapiens
agtaaacaggatttg

SEQ ID NO: 117547 - DNA, 15 bp, Homo sapiens
cagtaaacaggattt

SEQ ID NO: 117548 - DNA, 15 bp, Homo sapiens
acagtaaacaggatt

SEQ ID NO: 117549 - DNA, 15 bp, Homo sapiens
cacagtaaacaggat

SEQ ID NO: 117550 - DNA, 15 bp, Homo sapiens
acacagtaaacagga

SEQ ID NO: 117551 - DNA, 15 bp, Homo sapiens
cacacagtaaacagg

SEQ ID NO: 117552 - DNA, 15 bp, Homo sapiens
acacacagtaaacag

SEQ ID NO: 117553 - DNA, 15 bp, Homo sapiens
gacacacagtaaaca

SEQ ID NO: 117554 - DNA, 15 bp, Homo sapiens
tgacacacagtaaac

SEQ ID NO: 117555 - DNA, 15 bp, Homo sapiens
gtgacacacagtaaa

SEQ ID NO: 117556 - DNA, 15 bp, Homo sapiens
tgtgacacacagtaa

SEQ ID NO: 117557 - DNA, 15 bp, Homo sapiens
ctgtgacacacagta

SEQ ID NO: 117558 - DNA, 15 bp, Homo sapiens
actgtgacacacagt

SEQ ID NO: 117559 - DNA, 15 bp, Homo sapiens
cactgtgacacacag

SEQ ID NO: 117560 - DNA, 15 bp, Homo sapiens
tcactgtgacacaca

SEQ ID NO: 117561 - DNA, 15 bp, Homo sapiens
atcactgtgacacac

SEQ ID NO: 117562 - DNA, 15 bp, Homo sapiens
catcactgtgacaca

SEQ ID NO: 117563 - DNA, 15 bp, Homo sapiens
acatcactgtgacac

SEQ ID NO: 117564 - DNA, 15 bp, Homo sapiens
aacatcactgtgaca

SEQ ID NO: 117565 - DNA, 15 bp, Homo sapiens
aaacatcactgtgac

SEQ ID NO: 117566 - DNA, 15 bp, Homo sapiens
aaaacatcactgtga

SEQ ID NO: 117567 - DNA, 15 bp, Homo sapiens
caaaacatcactgtg

SEQ ID NO: 117568 - DNA, 15 bp, Homo sapiens
gcaaaacatcactgt

SEQ ID NO: 117569 - DNA, 15 bp, Homo sapiens
agcaaaacatcactg

SEQ ID NO: 117570 - DNA, 15 bp, Homo sapiens
aagcaaaacatcact

SEQ ID NO: 117571 - DNA, 15 bp, Homo sapiens
caagcaaaacatcac

SEQ ID NO: 117572 - DNA, 15 bp, Homo sapiens
acaagcaaaacatca

SEQ ID NO: 117573 - DNA, 15 bp, Homo sapiens
cacaagcaaaacatc

SEQ ID NO: 117574 - DNA, 15 bp, Homo sapiens
tcacaagcaaaacat

SEQ ID NO: 117575 - DNA, 15 bp, Homo sapiens
ttcacaagcaaaaca

SEQ ID NO: 117576 - DNA, 15 bp, Homo sapiens
attcacaagcaaaac

SEQ ID NO: 117577 - DNA, 15 bp, Homo sapiens
aattcacaagcaaaa

SEQ ID NO: 117578 - DNA, 15 bp, Homo sapiens
taattcacaagcaaa

SEQ ID NO: 117579 - DNA, 15 bp, Homo sapiens
ttaattcacaagcaa

SEQ ID NO: 117580 - DNA, 15 bp, Homo sapiens
attaattcacaagca

SEQ ID NO: 117581 - DNA, 15 bp, Homo sapiens
aattaattcacaagc

SEQ ID NO: 117582 - DNA, 15 bp, Homo sapiens
aaattaattcacaag

SEQ ID NO: 117583 - DNA, 15 bp, Homo sapiens
atgaaattaattcac

SEQ ID NO: 117584 - DNA, 15 bp, Homo sapiens
aatgaaattaattca

SEQ ID NO: 117585 - DNA, 15 bp, Homo sapiens
taatgaaattaattc

SEQ ID NO: 117586 - DNA, 15 bp, Homo sapiens
ctaatgaaattaatt

SEQ ID NO: 117587 - DNA, 15 bp, Homo sapiens
tctaatgaaattaat

SEQ ID NO: 117588 - DNA, 15 bp, Homo sapiens
gtctaatgaaattaa

SEQ ID NO: 117589 - DNA, 15 bp, Homo sapiens
agtctaatgaaatta

SEQ ID NO: 117590 - DNA, 15 bp, Homo sapiens
tagtctaatgaaatt

SEQ ID NO: 117591 - DNA, 15 bp, Homo sapiens
ctagtctaatgaaat

SEQ ID NO: 117592 - DNA, 15 bp, Homo sapiens
cctagtctaatgaaa

SEQ ID NO: 117593 - DNA, 15 bp, Homo sapiens
acctagtctaatgaa

SEQ ID NO: 117594 - DNA, 15 bp, Homo sapiens
aacctagtctaatga

SEQ ID NO: 117595 - DNA, 15 bp, Homo sapiens
aaacctagtctaatg

SEQ ID NO: 117596 - DNA, 15 bp, Homo sapiens
aaaacctagtctaat

SEQ ID NO: 117597 - DNA, 15 bp, Homo sapiens
taaaacctagtctaa

SEQ ID NO: 117598 - DNA, 15 bp, Homo sapiens
ataaaacctagtcta

SEQ ID NO: 117599 - DNA, 15 bp, Homo sapiens
aataaaacctagtct

SEQ ID NO: 117600 - DNA, 15 bp, Homo sapiens
aaataaaacctagtc

SEQ ID NO: 117601 - DNA, 15 bp, Homo sapiens
aaaataaaacctagt

SEQ ID NO: 117602 - DNA, 15 bp, Homo sapiens
aaaaataaaacctag

SEQ ID NO: 117603 - DNA, 15 bp, Homo sapiens
aaaaaataaaaccta

SEQ ID NO: 117604 - DNA, 15 bp, Homo sapiens
gaaaaaataaaacct

SEQ ID NO: 117605 - DNA, 15 bp, Homo sapiens
agaaaaaataaaacc

SEQ ID NO: 117606 - DNA, 15 bp, Homo sapiens
aagaaaaaataaaac

SEQ ID NO: 117607 - DNA, 15 bp, Homo sapiens
aaagaaaaaataaaa

SEQ ID NO: 117608 - DNA, 15 bp, Homo sapiens
caaagaaaaaataaa

SEQ ID NO: 117609 - DNA, 15 bp, Homo sapiens
ccaaagaaaaaataa

SEQ ID NO: 117610 - DNA, 15 bp, Homo sapiens
tccaaagaaaaaata

SEQ ID NO: 117611 - DNA, 15 bp, Homo sapiens
ttccaaagaaaaaat

SEQ ID NO: 117612 - DNA, 15 bp, Homo sapiens
tttccaaagaaaaaa

SEQ ID NO: 117613 - DNA, 15 bp, Homo sapiens
ctttccaaagaaaaa

SEQ ID NO: 117614 - DNA, 15 bp, Homo sapiens
cctttccaaagaaaa

SEQ ID NO: 117615 - DNA, 15 bp, Homo sapiens
acctttccaaagaaa

SEQ ID NO: 117616 - DNA, 15 bp, Homo sapiens
tacctttccaaagaa

SEQ ID NO: 117617 - DNA, 15 bp, Homo sapiens
ttacctttccaaaga

SEQ ID NO: 117618 - DNA, 15 bp, Homo sapiens
attacctttccaaag

SEQ ID NO: 117619 - DNA, 15 bp, Homo sapiens
tattacctttccaaa

SEQ ID NO: 117620 - DNA, 15 bp, Homo sapiens
ttattacctttccaa

SEQ ID NO: 117621 - DNA, 15 bp, Homo sapiens
gttattacctttcca

SEQ ID NO: 117622 - DNA, 15 bp, Homo sapiens
agttattacctttcc

SEQ ID NO: 117623 - DNA, 15 bp, Homo sapiens
tagttattacctttc

SEQ ID NO: 117624 - DNA, 15 bp, Homo sapiens
ctagttattaccttt

SEQ ID NO: 117625 - DNA, 15 bp, Homo sapiens
tctagttattacctt

SEQ ID NO: 117626 - DNA, 15 bp, Homo sapiens
ttctagttattacct

SEQ ID NO: 117627 - DNA, 15 bp, Homo sapiens
tttctagttattacc

SEQ ID NO: 117628 - DNA, 15 bp, Homo sapiens
ctttctagttattac

SEQ ID NO: 117629 - DNA, 15 bp, Homo sapiens
tctttctagttatta

SEQ ID NO: 117630 - DNA, 15 bp, Homo sapiens
ttctttctagttatt

SEQ ID NO: 117631 - DNA, 15 bp, Homo sapiens
attctttctagttat

SEQ ID NO: 117632 - DNA, 15 bp, Homo sapiens
aattctttctagtta

SEQ ID NO: 117633 - DNA, 15 bp, Homo sapiens
aaattctttctagtt

SEQ ID NO: 117634 - DNA, 15 bp, Homo sapiens
taaattctttctagt

SEQ ID NO: 117635 - DNA, 15 bp, Homo sapiens
gtaaattctttctag

SEQ ID NO: 117636 - DNA, 15 bp, Homo sapiens
tgtaaattctttcta

SEQ ID NO: 117637 - DNA, 15 bp, Homo sapiens
ctgtaaattctttct

SEQ ID NO: 117638 - DNA, 15 bp, Homo sapiens
actgtaaattctttc

SEQ ID NO: 117639 - DNA, 15 bp, Homo sapiens
cactgtaaattcttt

SEQ ID NO: 117640 - DNA, 15 bp, Homo sapiens
acactgtaaattctt

SEQ ID NO: 117641 - DNA, 15 bp, Homo sapiens
aacactgtaaattct

SEQ ID NO: 117642 - DNA, 15 bp, Homo sapiens
aaacactgtaaattc

SEQ ID NO: 117643 - DNA, 15 bp, Homo sapiens
gaaacactgtaaatt

SEQ ID NO: 117644 - DNA, 15 bp, Homo sapiens
agaaacactgtaaat

SEQ ID NO: 117645 - DNA, 15 bp, Homo sapiens
tagaaacactgtaaa

SEQ ID NO: 117646 - DNA, 15 bp, Homo sapiens
ttagaaacactgtaa

SEQ ID NO: 117647 - DNA, 15 bp, Homo sapiens
tttagaaacactgta

SEQ ID NO: 117648 - DNA, 15 bp, Homo sapiens
atttagaaacactgt

SEQ ID NO: 117649 - DNA, 15 bp, Homo sapiens
tatttagaaacactg

SEQ ID NO: 117650 - DNA, 15 bp, Homo sapiens
atatttagaaacact

SEQ ID NO: 117651 - DNA, 15 bp, Homo sapiens
aatatttagaaacac

SEQ ID NO: 117652 - DNA, 15 bp, Homo sapiens
gaatatttagaaaca

SEQ ID NO: 117653 - DNA, 15 bp, Homo sapiens
tgaatatttagaaac

SEQ ID NO: 117654 - DNA, 15 bp, Homo sapiens
atgaatatttagaaa

SEQ ID NO: 117655 - DNA, 15 bp, Homo sapiens
catgaatatttagaa

SEQ ID NO: 117656 - DNA, 15 bp, Homo sapiens
tcatgaatatttaga

SEQ ID NO: 117657 - DNA, 15 bp, Homo sapiens
atcatgaatatttag

SEQ ID NO: 117658 - DNA, 15 bp, Homo sapiens
gatcatgaatattta

SEQ ID NO: 117659 - DNA, 15 bp, Homo sapiens
agatcatgaatattt

SEQ ID NO: 117660 - DNA, 15 bp, Homo sapiens
cagatcatgaatatt

SEQ ID NO: 117661 - DNA, 15 bp, Homo sapiens
gcagatcatgaatat

SEQ ID NO: 117662 - DNA, 15 bp, Homo sapiens
tgcagatcatgaata

SEQ ID NO: 117663 - DNA, 15 bp, Homo sapiens
atgcagatcatgaat

SEQ ID NO: 117664 - DNA, 15 bp, Homo sapiens
catgcagatcatgaa

SEQ ID NO: 117665 - DNA, 15 bp, Homo sapiens
ccatgcagatcatga

SEQ ID NO: 117666 - DNA, 15 bp, Homo sapiens
tccatgcagatcatg

SEQ ID NO: 117667 - DNA, 15 bp, Homo sapiens
ttccatgcagatcat

SEQ ID NO: 117668 - DNA, 15 bp, Homo sapiens
attccatgcagatca

SEQ ID NO: 117669 - DNA, 15 bp, Homo sapiens
cattccatgcagatc

SEQ ID NO: 117670 - DNA, 15 bp, Homo sapiens
tcattccatgcagat

SEQ ID NO: 117671 - DNA, 15 bp, Homo sapiens
ctcattccatgcaga

SEQ ID NO: 117672 - DNA, 15 bp, Homo sapiens
cctcattccatgcag

SEQ ID NO: 117673 - DNA, 15 bp, Homo sapiens
acctcattccatgca

SEQ ID NO: 117674 - DNA, 15 bp, Homo sapiens
tacctcattccatgc

SEQ ID NO: 117675 - DNA, 15 bp, Homo sapiens
gtacctcattccatg

SEQ ID NO: 117676 - DNA, 15 bp, Homo sapiens
agtacctcattccat

SEQ ID NO: 117677 - DNA, 15 bp, Homo sapiens
aagtacctcattcca

SEQ ID NO: 117678 - DNA, 15 bp, Homo sapiens
aaagtacctcattcc

SEQ ID NO: 117679 - DNA, 15 bp, Homo sapiens
gaaagtacctcattc

SEQ ID NO: 117680 - DNA, 15 bp, Homo sapiens
tgaaagtacctcatt

SEQ ID NO: 117681 - DNA, 15 bp, Homo sapiens
atgaaagtacctcat

SEQ ID NO: 117682 - DNA, 15 bp, Homo sapiens
tatgaaagtacctca

SEQ ID NO: 117683 - DNA, 15 bp, Homo sapiens
atatgaaagtacctc

SEQ ID NO: 117684 - DNA, 15 bp, Homo sapiens
aatatgaaagtacct

SEQ ID NO: 117685 - DNA, 15 bp, Homo sapiens
aaatatgaaagtacc

SEQ ID NO: 117686 - DNA, 15 bp, Homo sapiens
aaaatatgaaagtac

SEQ ID NO: 117687 - DNA, 15 bp, Homo sapiens
taaaatatgaaagta

SEQ ID NO: 117688 - DNA, 15 bp, Homo sapiens
ctaaaatatgaaagt

SEQ ID NO: 117689 - DNA, 15 bp, Homo sapiens
actaaaatatgaaag

SEQ ID NO: 117690 - DNA, 15 bp, Homo sapiens
tactaaaatatgaaa

SEQ ID NO: 117691 - DNA, 15 bp, Homo sapiens
ttactaaaatatgaa

SEQ ID NO: 117692 - DNA, 15 bp, Homo sapiens
tttactaaaatatga

SEQ ID NO: 117693 - DNA, 15 bp, Homo sapiens
atttactaaaatatg

SEQ ID NO: 117694 - DNA, 15 bp, Homo sapiens
catttactaaaatat

SEQ ID NO: 117695 - DNA, 15 bp, Homo sapiens
gcatttactaaaata

SEQ ID NO: 117696 - DNA, 15 bp, Homo sapiens
tgcatttactaaaat

SEQ ID NO: 117697 - DNA, 15 bp, Homo sapiens
gtgcatttactaaaa

SEQ ID NO: 117698 - DNA, 15 bp, Homo sapiens
ggtgcatttactaaa

SEQ ID NO: 117699 - DNA, 15 bp, Homo sapiens
aggtgcatttactaa

SEQ ID NO: 117700 - DNA, 15 bp, Homo sapiens
aaggtgcatttacta

SEQ ID NO: 117701 - DNA, 15 bp, Homo sapiens
taaggtgcatttact

SEQ ID NO: 117702 - DNA, 15 bp, Homo sapiens
ataaggtgcatttac

SEQ ID NO: 117703 - DNA, 15 bp, Homo sapiens
aataaggtgcattta

SEQ ID NO: 117704 - DNA, 15 bp, Homo sapiens
aaataaggtgcattt

SEQ ID NO: 117705 - DNA, 15 bp, Homo sapiens
caaataaggtgcatt

SEQ ID NO: 117706 - DNA, 15 bp, Homo sapiens
acaaataaggtgcat

SEQ ID NO: 117707 - DNA, 15 bp, Homo sapiens
aacaaataaggtgca

SEQ ID NO: 117708 - DNA, 15 bp, Homo sapiens
aaacaaataaggtgc

SEQ ID NO: 117709 - DNA, 15 bp, Homo sapiens
gaaacaaataaggtg

SEQ ID NO: 117710 - DNA, 15 bp, Homo sapiens
tgaaacaaataaggt

SEQ ID NO: 117711 - DNA, 15 bp, Homo sapiens
atgaaacaaataagg

SEQ ID NO: 117712 - DNA, 15 bp, Homo sapiens
aatgaaacaaataag

SEQ ID NO: 117713 - DNA, 15 bp, Homo sapiens
aaatgaaacaaataa

SEQ ID NO: 117714 - DNA, 15 bp, Homo sapiens
taaaatgaaacaaat

SEQ ID NO: 117715 - DNA, 15 bp, Homo sapiens
ttaaaatgaaacaaa

SEQ ID NO: 117716 - DNA, 15 bp, Homo sapiens
attaaaatgaaacaa

SEQ ID NO: 117717 - DNA, 15 bp, Homo sapiens
cattaaaatgaaaca

SEQ ID NO: 117718 - DNA, 15 bp, Homo sapiens
tcattaaaatgaaac

SEQ ID NO: 117719 - DNA, 15 bp, Homo sapiens
atcattaaaatgaaa

SEQ ID NO: 117720 - DNA, 15 bp, Homo sapiens
aatcattaaaatgaa

SEQ ID NO: 117721 - DNA, 15 bp, Homo sapiens
aaatcattaaaatga

SEQ ID NO: 117722 - DNA, 15 bp, Homo sapiens
gaaatcattaaaatg

SEQ ID NO: 117723 - DNA, 15 bp, Homo sapiens
tgaaatcattaaaat

SEQ ID NO: 117724 - DNA, 15 bp, Homo sapiens
atgaaatcattaaaa

SEQ ID NO: 117725 - DNA, 15 bp, Homo sapiens
tatgaaatcattaaa

SEQ ID NO: 117726 - DNA, 15 bp, Homo sapiens
atatgaaatcattaa

SEQ ID NO: 117727 - DNA, 15 bp, Homo sapiens
aatatgaaatcatta

SEQ ID NO: 117728 - DNA, 15 bp, Homo sapiens
caatatgaaatcatt

SEQ ID NO: 117729 - DNA, 15 bp, Homo sapiens
acaatatgaaatcat

SEQ ID NO: 117730 - DNA, 15 bp, Homo sapiens
tacaatatgaaatca

SEQ ID NO: 117731 - DNA, 15 bp, Homo sapiens
atacaatatgaaatc

SEQ ID NO: 117732 - DNA, 15 bp, Homo sapiens
aatacaatatgaaat

SEQ ID NO: 117733 - DNA, 15 bp, Homo sapiens
aaatacaatatgaaa

SEQ ID NO: 117734 - DNA, 15 bp, Homo sapiens
caaatacaatatgaa

SEQ ID NO: 117735 - DNA, 15 bp, Homo sapiens
tcaaatacaatatga

SEQ ID NO: 117736 - DNA, 15 bp, Homo sapiens
aaaatcaaatacaat

SEQ ID NO: 117737 - DNA, 15 bp, Homo sapiens
gaaaatcaaatacaa

SEQ ID NO: 117738 - DNA, 15 bp, Homo sapiens
cgaaaatcaaataca

SEQ ID NO: 117739 - DNA, 15 bp, Homo sapiens
acgaaaatcaaatac

SEQ ID NO: 117740 - DNA, 15 bp, Homo sapiens
tacgaaaatcaaata

SEQ ID NO: 117741 - DNA, 15 bp, Homo sapiens
gtacgaaaatcaaat

SEQ ID NO: 117742 - DNA, 15 bp, Homo sapiens
agtacgaaaatcaaa

SEQ ID NO: 117743 - DNA, 15 bp, Homo sapiens
tagtacgaaaatcaa

SEQ ID NO: 117744 - DNA, 15 bp, Homo sapiens
atagtacgaaaatca

SEQ ID NO: 117745 - DNA, 15 bp, Homo sapiens
gatagtacgaaaatc

SEQ ID NO: 117746 - DNA, 15 bp, Homo sapiens
tgatagtacgaaaat

SEQ ID NO: 117747 - DNA, 15 bp, Homo sapiens
ctgatagtacgaaaa

SEQ ID NO: 117748 - DNA, 15 bp, Homo sapiens
tctgatagtacgaaa

SEQ ID NO: 117749 - DNA, 15 bp, Homo sapiens
ttctgatagtacgaa

SEQ ID NO: 117750 - DNA, 15 bp, Homo sapiens
cttctgatagtacga

SEQ ID NO: 117751 - DNA, 15 bp, Homo sapiens
gcttctgatagtacg

SEQ ID NO: 117752 - DNA, 15 bp, Homo sapiens
agcttctgatagtac

SEQ ID NO: 117753 - DNA, 15 bp, Homo sapiens
tagcttctgatagta

SEQ ID NO: 117754 - DNA, 15 bp, Homo sapiens
atagcttctgatagt

SEQ ID NO: 117755 - DNA, 15 bp, Homo sapiens
aatagcttctgatag

SEQ ID NO: 117756 - DNA, 15 bp, Homo sapiens
aaatagcttctgata

SEQ ID NO: 117757 - DNA, 15 bp, Homo sapiens
aaaatagcttctgat

SEQ ID NO: 117758 - DNA, 15 bp, Homo sapiens
aaaaatagcttctga

SEQ ID NO: 117759 - DNA, 15 bp, Homo sapiens
taaaaatagcttctg

SEQ ID NO: 117760 - DNA, 15 bp, Homo sapiens
ataaaaatagcttct

SEQ ID NO: 117761 - DNA, 15 bp, Homo sapiens
tataaaaatagcttc

SEQ ID NO: 117762 - DNA, 15 bp, Homo sapiens
atataaaaatagctt

SEQ ID NO: 117763 - DNA, 15 bp, Homo sapiens
tatataaaaatagct

SEQ ID NO: 117764 - DNA, 15 bp, Homo sapiens
ttatataaaaatagc

SEQ ID NO: 117765 - DNA, 15 bp, Homo sapiens
tttatataaaaatag

SEQ ID NO: 117766 - DNA, 15 bp, Homo sapiens
ttttatataaaaata

SEQ ID NO: 117767 - DNA, 15 bp, Homo sapiens
attttatataaaaat

SEQ ID NO: 117768 - DNA, 15 bp, Homo sapiens
gattttatataaaaa

SEQ ID NO: 117769 - DNA, 15 bp, Homo sapiens
agattttatataaaa

SEQ ID NO: 117770 - DNA, 15 bp, Homo sapiens
aagattttatataaa

SEQ ID NO: 117771 - DNA, 15 bp, Homo sapiens
gaagattttatataa

SEQ ID NO: 117772 - DNA, 15 bp, Homo sapiens
tgaagattttatata

SEQ ID NO: 117773 - DNA, 15 bp, Homo sapiens
atgaagattttatat

SEQ ID NO: 117774 - DNA, 15 bp, Homo sapiens
tatgaagattttata

SEQ ID NO: 117775 - DNA, 15 bp, Homo sapiens
ctatgaagattttat

SEQ ID NO: 117776 - DNA, 15 bp, Homo sapiens
actatgaagatttta

SEQ ID NO: 117777 - DNA, 15 bp, Homo sapiens
cactatgaagatttt

SEQ ID NO: 117778 - DNA, 15 bp, Homo sapiens
acactatgaagattt

SEQ ID NO: 117779 - DNA, 15 bp, Homo sapiens
aacactatgaagatt

SEQ ID NO: 117780 - DNA, 15 bp, Homo sapiens
aaacactatgaagat

SEQ ID NO: 117781 - DNA, 15 bp, Homo sapiens
caaacactatgaaga

SEQ ID NO: 117782 - DNA, 15 bp, Homo sapiens
tcaaacactatgaag

SEQ ID NO: 117783 - DNA, 15 bp, Homo sapiens
ttcaaacactatgaa

SEQ ID NO: 117784 - DNA, 15 bp, Homo sapiens
attcaaacactatga

SEQ ID NO: 117785 - DNA, 15 bp, Homo sapiens
tattcaaacactatg

SEQ ID NO: 117786 - DNA, 15 bp, Homo sapiens
ttattcaaacactat

SEQ ID NO: 117787 - DNA, 15 bp, Homo sapiens
attattcaaacacta

SEQ ID NO: 117788 - DNA, 15 bp, Homo sapiens
cattattcaaacact

SEQ ID NO: 117789 - DNA, 15 bp, Homo sapiens
ccattattcaaacac

SEQ ID NO: 117790 - DNA, 15 bp, Homo sapiens
gccattattcaaaca

SEQ ID NO: 117791 - DNA, 15 bp, Homo sapiens
tgccattattcaaac

SEQ ID NO: 117792 - DNA, 15 bp, Homo sapiens
atgccattattcaaa

SEQ ID NO: 117793 - DNA, 15 bp, Homo sapiens
tatgccattattcaa

SEQ ID NO: 117794 - DNA, 15 bp, Homo sapiens
gtatgccattattca

SEQ ID NO: 117795 - DNA, 15 bp, Homo sapiens
agtatgccattattc

SEQ ID NO: 117796 - DNA, 15 bp, Homo sapiens
cagtatgccattatt

SEQ ID NO: 117797 - DNA, 15 bp, Homo sapiens
ccagtatgccattat

SEQ ID NO: 117798 - DNA, 15 bp, Homo sapiens
accagtatgccatta

SEQ ID NO: 117799 - DNA, 15 bp, Homo sapiens
aaccagtatgccatt

SEQ ID NO: 117800 - DNA, 15 bp, Homo sapiens
taaccagtatgccat

SEQ ID NO: 117801 - DNA, 15 bp, Homo sapiens
ttaaccagtatgcca

SEQ ID NO: 117802 - DNA, 15 bp, Homo sapiens
cttaaccagtatgcc

SEQ ID NO: 117803 - DNA, 15 bp, Homo sapiens
tcttaaccagtatgc

SEQ ID NO: 117804 - DNA, 15 bp, Homo sapiens
ctcttaaccagtatg

SEQ ID NO: 117805 - DNA, 15 bp, Homo sapiens
gctcttaaccagtat

SEQ ID NO: 117806 - DNA, 15 bp, Homo sapiens
tgctcttaaccagta

SEQ ID NO: 117807 - DNA, 15 bp, Homo sapiens
gtgctcttaaccagt

SEQ ID NO: 117808 - DNA, 15 bp, Homo sapiens
tgtgctcttaaccag

SEQ ID NO: 117809 - DNA, 15 bp, Homo sapiens
ctgtgctcttaacca

SEQ ID NO: 117810 - DNA, 15 bp, Homo sapiens
cctgtgctcttaacc

SEQ ID NO: 117811 - DNA, 15 bp, Homo sapiens
gcctgtgctcttaac

SEQ ID NO: 117812 - DNA, 15 bp, Homo sapiens
agcctgtgctcttaa

SEQ ID NO: 117813 - DNA, 15 bp, Homo sapiens
gagcctgtgctctta

SEQ ID NO: 117814 - DNA, 15 bp, Homo sapiens
agagcctgtgctctt

SEQ ID NO: 117815 - DNA, 15 bp, Homo sapiens
tagagcctgtgctct

SEQ ID NO: 117816 - DNA, 15 bp, Homo sapiens
ctagagcctgtgctc

SEQ ID NO: 117817 - DNA, 15 bp, Homo sapiens
gctagagcctgtgct

SEQ ID NO: 117818 - DNA, 15 bp, Homo sapiens
tgctagagcctgtgc

SEQ ID NO: 117819 - DNA, 15 bp, Homo sapiens
atgctagagcctgtg

SEQ ID NO: 117820 - DNA, 15 bp, Homo sapiens
gatgctagagcctgt

SEQ ID NO: 117821 - DNA, 15 bp, Homo sapiens
agatgctagagcctg

SEQ ID NO: 117822 - DNA, 15 bp, Homo sapiens
cagatgctagagcct

SEQ ID NO: 117823 - DNA, 15 bp, Homo sapiens
tcagatgctagagcc

SEQ ID NO: 117824 - DNA, 15 bp, Homo sapiens
gtcagatgctagagc

SEQ ID NO: 117825 - DNA, 15 bp, Homo sapiens
cgtcagatgctagag

SEQ ID NO: 117826 - DNA, 15 bp, Homo sapiens
ccgtcagatgctaga

SEQ ID NO: 117827 - DNA, 15 bp, Homo sapiens
gccgtcagatgctag

SEQ ID NO: 117828 - DNA, 15 bp, Homo sapiens
ggccgtcagatgcta

SEQ ID NO: 117829 - DNA, 15 bp, Homo sapiens
aggccgtcagatgct

SEQ ID NO: 117830 - DNA, 15 bp, Homo sapiens
taggccgtcagatgc

SEQ ID NO: 117831 - DNA, 15 bp, Homo sapiens
ataggccgtcagatg

SEQ ID NO: 117832 - DNA, 15 bp, Homo sapiens
cataggccgtcagat

SEQ ID NO: 117833 - DNA, 15 bp, Homo sapiens
acataggccgtcaga

SEQ ID NO: 117834 - DNA, 15 bp, Homo sapiens
tacataggccgtcag

SEQ ID NO: 117835 - DNA, 15 bp, Homo sapiens
ttacataggccgtca

SEQ ID NO: 117836 - DNA, 15 bp, Homo sapiens
tttacataggccgtc

SEQ ID NO: 117837 - DNA, 15 bp, Homo sapiens
ttttacataggccgt

SEQ ID NO: 117838 - DNA, 15 bp, Homo sapiens
tttttacataggccg

SEQ ID NO: 117839 - DNA, 15 bp, Homo sapiens
atttttacataggcc

SEQ ID NO: 117840 - DNA, 15 bp, Homo sapiens
aatttttacataggc

SEQ ID NO: 117841 - DNA, 15 bp, Homo sapiens
aaatttttacatagg

SEQ ID NO: 117842 - DNA, 15 bp, Homo sapiens
aaaatttttacatag

SEQ ID NO: 117843 - DNA, 15 bp, Homo sapiens
gaaaatttttacata

SEQ ID NO: 117844 - DNA, 15 bp, Homo sapiens
tgaaaatttttacat

SEQ ID NO: 117845 - DNA, 15 bp, Homo sapiens
atgaaaatttttaca

SEQ ID NO: 117846 - DNA, 15 bp, Homo sapiens
aatgaaaatttttac

SEQ ID NO: 117847 - DNA, 15 bp, Homo sapiens
taatgaaaattttta

SEQ ID NO: 117848 - DNA, 15 bp, Homo sapiens
gtaatgaaaattttt

SEQ ID NO: 117849 - DNA, 15 bp, Homo sapiens
agtaatgaaaatttt

SEQ ID NO: 117850 - DNA, 15 bp, Homo sapiens
tagtaatgaaaattt

SEQ ID NO: 117851 - DNA, 15 bp, Homo sapiens
ctagtaatgaaaatt

SEQ ID NO: 117852 - DNA, 15 bp, Homo sapiens
gctagtaatgaaaat

SEQ ID NO: 117853 - DNA, 15 bp, Homo sapiens
agctagtaatgaaaa

SEQ ID NO: 117854 - DNA, 15 bp, Homo sapiens
aagctagtaatgaaa

SEQ ID NO: 117855 - DNA, 15 bp, Homo sapiens
caagctagtaatgaa

SEQ ID NO: 117856 - DNA, 15 bp, Homo sapiens
ccaagctagtaatga

SEQ ID NO: 117857 - DNA, 15 bp, Homo sapiens
accaagctagtaatg

SEQ ID NO: 117858 - DNA, 15 bp, Homo sapiens
taccaagctagtaat

SEQ ID NO: 117859 - DNA, 15 bp, Homo sapiens
ttaccaagctagtaa

SEQ ID NO: 117860 - DNA, 15 bp, Homo sapiens
gttaccaagctagta

SEQ ID NO: 117861 - DNA, 15 bp, Homo sapiens
tgttaccaagctagt

SEQ ID NO: 117862 - DNA, 15 bp, Homo sapiens
gtgttaccaagctag

SEQ ID NO: 117863 - DNA, 15 bp, Homo sapiens
agtgttaccaagcta

SEQ ID NO: 117864 - DNA, 15 bp, Homo sapiens
cagtgttaccaagct

SEQ ID NO: 117865 - DNA, 15 bp, Homo sapiens
ccagtgttaccaagc

SEQ ID NO: 117866 - DNA, 15 bp, Homo sapiens
accagtgttaccaag

SEQ ID NO: 117867 - DNA, 15 bp, Homo sapiens
taccagtgttaccaa

SEQ ID NO: 117868 - DNA, 15 bp, Homo sapiens
ttaccagtgttacca

SEQ ID NO: 117869 - DNA, 15 bp, Homo sapiens
tttaccagtgttacc

SEQ ID NO: 117870 - DNA, 15 bp, Homo sapiens
ctttaccagtgttac

SEQ ID NO: 117871 - DNA, 15 bp, Homo sapiens
actttaccagtgtta

SEQ ID NO: 117872 - DNA, 15 bp, Homo sapiens
aactttaccagtgtt

SEQ ID NO: 117873 - DNA, 15 bp, Homo sapiens
taactttaccagtgt

SEQ ID NO: 117874 - DNA, 15 bp, Homo sapiens
gtaactttaccagtg

SEQ ID NO: 117875 - DNA, 15 bp, Homo sapiens
agtaactttaccagt

SEQ ID NO: 117876 - DNA, 15 bp, Homo sapiens
aagtaactttaccag

SEQ ID NO: 117877 - DNA, 15 bp, Homo sapiens
taagtaactttacca

SEQ ID NO: 117878 - DNA, 15 bp, Homo sapiens
ttaagtaactttacc

SEQ ID NO: 117879 - DNA, 15 bp, Homo sapiens
tttaagtaactttac

SEQ ID NO: 117880 - DNA, 15 bp, Homo sapiens
gtttaagtaacttta

SEQ ID NO: 117881 - DNA, 15 bp, Homo sapiens
tgtttaagtaacttt

SEQ ID NO: 117882 - DNA, 15 bp, Homo sapiens
atgtttaagtaactt

SEQ ID NO: 117883 - DNA, 15 bp, Homo sapiens
aatgtttaagtaact

SEQ ID NO: 117884 - DNA, 15 bp, Homo sapiens
gaatgtttaagtaac

SEQ ID NO: 117885 - DNA, 15 bp, Homo sapiens
agaatgtttaagtaa

SEQ ID NO: 117886 - DNA, 15 bp, Homo sapiens
gagaatgtttaagta

SEQ ID NO: 117887 - DNA, 15 bp, Homo sapiens
agagaatgtttaagt

SEQ ID NO: 117888 - DNA, 15 bp, Homo sapiens
tagagaatgtttaag

SEQ ID NO: 117889 - DNA, 15 bp, Homo sapiens
ttagagaatgtttaa

SEQ ID NO: 117890 - DNA, 15 bp, Homo sapiens
tttagagaatgttta

SEQ ID NO: 117891 - DNA, 15 bp, Homo sapiens
gtttagagaatgttt

SEQ ID NO: 117892 - DNA, 15 bp, Homo sapiens
ggtttagagaatgtt

SEQ ID NO: 117893 - DNA, 15 bp, Homo sapiens
aggtttagagaatgt

SEQ ID NO: 117894 - DNA, 15 bp, Homo sapiens
gaggtttagagaatg

SEQ ID NO: 117895 - DNA, 15 bp, Homo sapiens
tgaggtttagagaat

SEQ ID NO: 117896 - DNA, 15 bp, Homo sapiens
ctgaggtttagagaa

SEQ ID NO: 117897 - DNA, 15 bp, Homo sapiens
actgaggtttagaga

SEQ ID NO: 117898 - DNA, 15 bp, Homo sapiens
aactgaggtttagag

SEQ ID NO: 117899 - DNA, 15 bp, Homo sapiens
caactgaggtttaga

SEQ ID NO: 117900 - DNA, 15 bp, Homo sapiens
acaactgaggtttag

SEQ ID NO: 117901 - DNA, 15 bp, Homo sapiens
aacaactgaggttta

SEQ ID NO: 117902 - DNA, 15 bp, Homo sapiens
aaacaactgaggttt

SEQ ID NO: 117903 - DNA, 15 bp, Homo sapiens
taaacaactgaggtt

SEQ ID NO: 117904 - DNA, 15 bp, Homo sapiens
ttaaacaactgaggt

SEQ ID NO: 117905 - DNA, 15 bp, Homo sapiens
attaaacaactgagg

SEQ ID NO: 117906 - DNA, 15 bp, Homo sapiens
aattaaacaactgag

SEQ ID NO: 117907 - DNA, 15 bp, Homo sapiens
aaattaaacaactga

SEQ ID NO: 117908 - DNA, 15 bp, Homo sapiens
caaattaaacaactg

SEQ ID NO: 117909 - DNA, 15 bp, Homo sapiens
acaaattaaacaact

SEQ ID NO: 117910 - DNA, 15 bp, Homo sapiens
tacaaattaaacaac

SEQ ID NO: 117911 - DNA, 15 bp, Homo sapiens
ttacaaattaaacaa

SEQ ID NO: 117912 - DNA, 15 bp, Homo sapiens
tttacaaattaaaca

SEQ ID NO: 117913 - DNA, 15 bp, Homo sapiens
ttttacaaattaaac

SEQ ID NO: 117914 - DNA, 15 bp, Homo sapiens
attttacaaattaaa

SEQ ID NO: 117915 - DNA, 15 bp, Homo sapiens
cattttacaaattaa

SEQ ID NO: 117916 - DNA, 15 bp, Homo sapiens
ccattttacaaatta

SEQ ID NO: 117917 - DNA, 15 bp, Homo sapiens
tccattttacaaatt

SEQ ID NO: 117918 - DNA, 15 bp, Homo sapiens
gtccattttacaaat

SEQ ID NO: 117919 - DNA, 15 bp, Homo sapiens
tgtccattttacaaa

SEQ ID NO: 117920 - DNA, 15 bp, Homo sapiens
atgtccattttacaa

SEQ ID NO: 117921 - DNA, 15 bp, Homo sapiens
aatgtccattttaca

SEQ ID NO: 117922 - DNA, 15 bp, Homo sapiens
taatgtccattttac

SEQ ID NO: 117923 - DNA, 15 bp, Homo sapiens
ataatgtccatttta

SEQ ID NO: 117924 - DNA, 15 bp, Homo sapiens
aataatgtccatttt

SEQ ID NO: 117925 - DNA, 15 bp, Homo sapiens
taataatgtccattt

SEQ ID NO: 117926 - DNA, 15 bp, Homo sapiens
ataataatgtccatt

SEQ ID NO: 117927 - DNA, 15 bp, Homo sapiens
tataataatgtccat

SEQ ID NO: 117928 - DNA, 15 bp, Homo sapiens
atataataatgtcca

SEQ ID NO: 117929 - DNA, 15 bp, Homo sapiens
gatataataatgtcc

SEQ ID NO: 117930 - DNA, 15 bp, Homo sapiens
agatataataatgtc

SEQ ID NO: 117931 - DNA, 15 bp, Homo sapiens
tagatataataatgt

SEQ ID NO: 117932 - DNA, 15 bp, Homo sapiens
atagatataataatg

SEQ ID NO: 117933 - DNA, 15 bp, Homo sapiens
gatagatataataat

SEQ ID NO: 117934 - DNA, 15 bp, Homo sapiens
agatagatataataa

SEQ ID NO: 117935 - DNA, 15 bp, Homo sapiens
gagatagatataata

SEQ ID NO: 117936 - DNA, 15 bp, Homo sapiens
tgagatagatataat

SEQ ID NO: 117937 - DNA, 15 bp, Homo sapiens
atgagatagatataa

SEQ ID NO: 117938 - DNA, 15 bp, Homo sapiens
tatgagatagatata

SEQ ID NO: 117939 - DNA, 15 bp, Homo sapiens
gtatgagatagatat

SEQ ID NO: 117940 - DNA, 15 bp, Homo sapiens
tgtatgagatagata

SEQ ID NO: 117941 - DNA, 15 bp, Homo sapiens
ctgtatgagatagat

SEQ ID NO: 117942 - DNA, 15 bp, Homo sapiens
actgtatgagataga

SEQ ID NO: 117943 - DNA, 15 bp, Homo sapiens
aactgtatgagatag

SEQ ID NO: 117944 - DNA, 15 bp, Homo sapiens
aaactgtatgagata

SEQ ID NO: 117945 - DNA, 15 bp, Homo sapiens
aaaactgtatgagat

SEQ ID NO: 117946 - DNA, 15 bp, Homo sapiens
caaaactgtatgaga

SEQ ID NO: 117947 - DNA, 15 bp, Homo sapiens
gcaaaactgtatgag

SEQ ID NO: 117948 - DNA, 15 bp, Homo sapiens
tgcaaaactgtatga

SEQ ID NO: 117949 - DNA, 15 bp, Homo sapiens
ttgcaaaactgtatg

SEQ ID NO: 117950 - DNA, 15 bp, Homo sapiens
attgcaaaactgtat

SEQ ID NO: 117951 - DNA, 15 bp, Homo sapiens
cattgcaaaactgta

SEQ ID NO: 117952 - DNA, 15 bp, Homo sapiens
tcattgcaaaactgt

SEQ ID NO: 117953 - DNA, 15 bp, Homo sapiens
atcattgcaaaactg

SEQ ID NO: 117954 - DNA, 15 bp, Homo sapiens
aatcattgcaaaact

SEQ ID NO: 117955 - DNA, 15 bp, Homo sapiens
caatcattgcaaaac

SEQ ID NO: 117956 - DNA, 15 bp, Homo sapiens
tcaatcattgcaaaa

SEQ ID NO: 117957 - DNA, 15 bp, Homo sapiens
atcaatcattgcaaa

SEQ ID NO: 117958 - DNA, 15 bp, Homo sapiens
aatcaatcattgcaa

SEQ ID NO: 117959 - DNA, 15 bp, Homo sapiens
taatcaatcattgca

SEQ ID NO: 117960 - DNA, 15 bp, Homo sapiens
ataatcaatcattgc

SEQ ID NO: 117961 - DNA, 15 bp, Homo sapiens
cataatcaatcattg

SEQ ID NO: 117962 - DNA, 15 bp, Homo sapiens
tcataatcaatcatt

SEQ ID NO: 117963 - DNA, 15 bp, Homo sapiens
ctcataatcaatcat

SEQ ID NO: 117964 - DNA, 15 bp, Homo sapiens
gctcataatcaatca

SEQ ID NO: 117965 - DNA, 15 bp, Homo sapiens
ggctcataatcaatc

SEQ ID NO: 117966 - DNA, 15 bp, Homo sapiens
aggctcataatcaat

SEQ ID NO: 117967 - DNA, 15 bp, Homo sapiens
aaggctcataatcaa

SEQ ID NO: 117968 - DNA, 15 bp, Homo sapiens
taaggctcataatca

SEQ ID NO: 117969 - DNA, 15 bp, Homo sapiens
ttaaggctcataatc

SEQ ID NO: 117970 - DNA, 15 bp, Homo sapiens
tttaaggctcataat

SEQ ID NO: 117971 - DNA, 15 bp, Homo sapiens
gtttaaggctcataa

SEQ ID NO: 117972 - DNA, 15 bp, Homo sapiens
tgtttaaggctcata

SEQ ID NO: 117973 - DNA, 15 bp, Homo sapiens
atgtttaaggctcat

SEQ ID NO: 117974 - DNA, 15 bp, Homo sapiens
catgtttaaggctca

SEQ ID NO: 117975 - DNA, 15 bp, Homo sapiens
acatgtttaaggctc

SEQ ID NO: 117976 - DNA, 15 bp, Homo sapiens
tacatgtttaaggct

SEQ ID NO: 117977 - DNA, 15 bp, Homo sapiens
ctacatgtttaaggc

SEQ ID NO: 117978 - DNA, 15 bp, Homo sapiens
actacatgtttaagg

SEQ ID NO: 117979 - DNA, 15 bp, Homo sapiens
cactacatgtttaag

SEQ ID NO: 117980 - DNA, 15 bp, Homo sapiens
gcactacatgtttaa

SEQ ID NO: 117981 - DNA, 15 bp, Homo sapiens
agcactacatgttta

SEQ ID NO: 117982 - DNA, 15 bp, Homo sapiens
gagcactacatgttt

SEQ ID NO: 117983 - DNA, 15 bp, Homo sapiens
agagcactacatgtt

SEQ ID NO: 117984 - DNA, 15 bp, Homo sapiens
aagagcactacatgt

SEQ ID NO: 117985 - DNA, 15 bp, Homo sapiens
taagagcactacatg

SEQ ID NO: 117986 - DNA, 15 bp, Homo sapiens
ttaagagcactacat

SEQ ID NO: 117987 - DNA, 15 bp, Homo sapiens
tttaagagcactaca

SEQ ID NO: 117988 - DNA, 15 bp, Homo sapiens
atttaagagcactac

SEQ ID NO: 117989 - DNA, 15 bp, Homo sapiens
tatttaagagcacta

SEQ ID NO: 117990 - DNA, 15 bp, Homo sapiens
ttatttaagagcact

SEQ ID NO: 117991 - DNA, 15 bp, Homo sapiens
gttatttaagagcac

SEQ ID NO: 117992 - DNA, 15 bp, Homo sapiens
agttatttaagagca

SEQ ID NO: 117993 - DNA, 15 bp, Homo sapiens
tagttatttaagagc

SEQ ID NO: 117994 - DNA, 15 bp, Homo sapiens
atagttatttaagag

SEQ ID NO: 117995 - DNA, 15 bp, Homo sapiens
tatagttatttaaga

SEQ ID NO: 117996 - DNA, 15 bp, Homo sapiens
atatagttatttaag

SEQ ID NO: 117997 - DNA, 15 bp, Homo sapiens
catatagttatttaa

SEQ ID NO: 117998 - DNA, 15 bp, Homo sapiens
gcatatagttattta

SEQ ID NO: 117999 - DNA, 15 bp, Homo sapiens
tgcatatagttattt

SEQ ID NO: 118000 - DNA, 15 bp, Homo sapiens
ttgcatatagttatt

SEQ ID NO: 118001 - DNA, 15 bp, Homo sapiens
tttgcatatagttat

SEQ ID NO: 118002 - DNA, 15 bp, Homo sapiens
ttttgcatatagtta

SEQ ID NO: 118003 - DNA, 15 bp, Homo sapiens
gttttgcatatagtt

SEQ ID NO: 118004 - DNA, 15 bp, Homo sapiens
tgttttgcatatagt

SEQ ID NO: 118005 - DNA, 15 bp, Homo sapiens
ttgttttgcatatag

SEQ ID NO: 118006 - DNA, 15 bp, Homo sapiens
gttgttttgcatata

SEQ ID NO: 118007 - DNA, 15 bp, Homo sapiens
ggttgttttgcatat

SEQ ID NO: 118008 - DNA, 15 bp, Homo sapiens
tggttgttttgcata

SEQ ID NO: 118009 - DNA, 15 bp, Homo sapiens
ttggttgttttgcat

SEQ ID NO: 118010 - DNA, 15 bp, Homo sapiens
attggttgttttgca

SEQ ID NO: 118011 - DNA, 15 bp, Homo sapiens
aattggttgttttgc

SEQ ID NO: 118012 - DNA, 15 bp, Homo sapiens
aaattggttgttttg

SEQ ID NO: 118013 - DNA, 15 bp, Homo sapiens
aaaattggttgtttt

SEQ ID NO: 118014 - DNA, 15 bp, Homo sapiens
taaaattggttgttt

SEQ ID NO: 118015 - DNA, 15 bp, Homo sapiens
ctaaaattggttgtt

SEQ ID NO: 118016 - DNA, 15 bp, Homo sapiens
tctaaaattggttgt

SEQ ID NO: 118017 - DNA, 15 bp, Homo sapiens
atctaaaattggttg

SEQ ID NO: 118018 - DNA, 15 bp, Homo sapiens
aatctaaaattggtt

SEQ ID NO: 118019 - DNA, 15 bp, Homo sapiens
aaatctaaaattggt

SEQ ID NO: 118020 - DNA, 15 bp, Homo sapiens
aaaatctaaaattgg

SEQ ID NO: 118021 - DNA, 15 bp, Homo sapiens
caaaatctaaaattg

SEQ ID NO: 118022 - DNA, 15 bp, Homo sapiens
gcaaaatctaaaatt

SEQ ID NO: 118023 - DNA, 15 bp, Homo sapiens
agcaaaatctaaaat

SEQ ID NO: 118024 - DNA, 15 bp, Homo sapiens
tagcaaaatctaaaa

SEQ ID NO: 118025 - DNA, 15 bp, Homo sapiens
atagcaaaatctaaa

SEQ ID NO: 118026 - DNA, 15 bp, Homo sapiens
catagcaaaatctaa

SEQ ID NO: 118027 - DNA, 15 bp, Homo sapiens
tcatagcaaaatcta

SEQ ID NO: 118028 - DNA, 15 bp, Homo sapiens
atcatagcaaaatct

SEQ ID NO: 118029 - DNA, 15 bp, Homo sapiens
aatcatagcaaaatc

SEQ ID NO: 118030 - DNA, 15 bp, Homo sapiens
taatcatagcaaaat

SEQ ID NO: 118031 - DNA, 15 bp, Homo sapiens
ataatcatagcaaaa

SEQ ID NO: 118032 - DNA, 15 bp, Homo sapiens
tataatcatagcaaa

SEQ ID NO: 118033 - DNA, 15 bp, Homo sapiens
ttataatcatagcaa

SEQ ID NO: 118034 - DNA, 15 bp, Homo sapiens
attataatcatagca

SEQ ID NO: 118035 - DNA, 15 bp, Homo sapiens
aattataatcatagc

SEQ ID NO: 118036 - DNA, 15 bp, Homo sapiens
taattataatcatag

SEQ ID NO: 118037 - DNA, 15 bp, Homo sapiens
ataattataatcata

SEQ ID NO: 118038 - DNA, 15 bp, Homo sapiens
aataattataatcat

SEQ ID NO: 118039 - DNA, 15 bp, Homo sapiens
taataattataatca

SEQ ID NO: 118040 - DNA, 15 bp, Homo sapiens
ttaataattataatc

SEQ ID NO: 118041 - DNA, 15 bp, Homo sapiens
tttaataattataat

SEQ ID NO: 118042 - DNA, 15 bp, Homo sapiens
atttaataattataa

SEQ ID NO: 118043 - DNA, 15 bp, Homo sapiens
tatttaataattata

SEQ ID NO: 118044 - DNA, 15 bp, Homo sapiens
atatttaataattat

SEQ ID NO: 118045 - DNA, 15 bp, Homo sapiens
aatatttaataatta

SEQ ID NO: 118046 - DNA, 15 bp, Homo sapiens
caatatttaataatt

SEQ ID NO: 118047 - DNA, 15 bp, Homo sapiens
acaatatttaataat

SEQ ID NO: 118048 - DNA, 15 bp, Homo sapiens
tacaatatttaataa

SEQ ID NO: 118049 - DNA, 15 bp, Homo sapiens
atacaatatttaata

SEQ ID NO: 118050 - DNA, 15 bp, Homo sapiens
tatacaatatttaat

SEQ ID NO: 118051 - DNA, 15 bp, Homo sapiens
atatacaatatttaa

SEQ ID NO: 118052 - DNA, 15 bp, Homo sapiens
catatacaatattta

SEQ ID NO: 118053 - DNA, 15 bp, Homo sapiens
acatatacaatattt

SEQ ID NO: 118054 - DNA, 15 bp, Homo sapiens
cacatatacaatatt

SEQ ID NO: 118055 - DNA, 15 bp, Homo sapiens
acacatatacaatat

SEQ ID NO: 118056 - DNA, 15 bp, Homo sapiens
aacacatatacaata

SEQ ID NO: 118057 - DNA, 15 bp, Homo sapiens
taacacatatacaat

SEQ ID NO: 118058 - DNA, 15 bp, Homo sapiens
ctaacacatatacaa

SEQ ID NO: 118059 - DNA, 15 bp, Homo sapiens
actaacacatataca

SEQ ID NO: 118060 - DNA, 15 bp, Homo sapiens
gactaacacatatac

SEQ ID NO: 118061 - DNA, 15 bp, Homo sapiens
agactaacacatata

SEQ ID NO: 118062 - DNA, 15 bp, Homo sapiens
aagactaacacatat

SEQ ID NO: 118063 - DNA, 15 bp, Homo sapiens
aaagactaacacata

SEQ ID NO: 118064 - DNA, 15 bp, Homo sapiens
caaagactaacacat

SEQ ID NO: 118065 - DNA, 15 bp, Homo sapiens
ccaaagactaacaca

SEQ ID NO: 118066 - DNA, 15 bp, Homo sapiens
accaaagactaacac

SEQ ID NO: 118067 - DNA, 15 bp, Homo sapiens
aaccaaagactaaca

SEQ ID NO: 118068 - DNA, 15 bp, Homo sapiens
taaccaaagactaac

SEQ ID NO: 118069 - DNA, 15 bp, Homo sapiens
ataaccaaagactaa

SEQ ID NO: 118070 - DNA, 15 bp, Homo sapiens
cataaccaaagacta

SEQ ID NO: 118071 - DNA, 15 bp, Homo sapiens
gcataaccaaagact

SEQ ID NO: 118072 - DNA, 15 bp, Homo sapiens
ggcataaccaaagac

SEQ ID NO: 118073 - DNA, 15 bp, Homo sapiens
tggcataaccaaaga

SEQ ID NO: 118074 - DNA, 15 bp, Homo sapiens
gtggcataaccaaag

SEQ ID NO: 118075 - DNA, 15 bp, Homo sapiens
agtggcataaccaaa

SEQ ID NO: 118076 - DNA, 15 bp, Homo sapiens
cagtggcataaccaa

SEQ ID NO: 118077 - DNA, 15 bp, Homo sapiens
gcagtggcataacca

SEQ ID NO: 118078 - DNA, 15 bp, Homo sapiens
agcagtggcataacc

SEQ ID NO: 118079 - DNA, 15 bp, Homo sapiens
gagcagtggcataac

SEQ ID NO: 118080 - DNA, 15 bp, Homo sapiens
agagcagtggcataa

SEQ ID NO: 118081 - DNA, 15 bp, Homo sapiens
cagagcagtggcata

SEQ ID NO: 118082 - DNA, 15 bp, Homo sapiens
acagagcagtggcat

SEQ ID NO: 118083 - DNA, 15 bp, Homo sapiens
tacagagcagtggca

SEQ ID NO: 118084 - DNA, 15 bp, Homo sapiens
ttacagagcagtggc

SEQ ID NO: 118085 - DNA, 15 bp, Homo sapiens
tttacagagcagtgg

SEQ ID NO: 118086 - DNA, 15 bp, Homo sapiens
atttacagagcagtg

SEQ ID NO: 118087 - DNA, 15 bp, Homo sapiens
aatttacagagcagt

SEQ ID NO: 118088 - DNA, 15 bp, Homo sapiens
aaatttacagagcag

SEQ ID NO: 118089 - DNA, 15 bp, Homo sapiens
caaatttacagagca

SEQ ID NO: 118090 - DNA, 15 bp, Homo sapiens
gcaaatttacagagc

SEQ ID NO: 118091 - DNA, 15 bp, Homo sapiens
tgcaaatttacagag

SEQ ID NO: 118092 - DNA, 15 bp, Homo sapiens
atgcaaatttacaga

SEQ ID NO: 118093 - DNA, 15 bp, Homo sapiens
gatgcaaatttacag

SEQ ID NO: 118094 - DNA, 15 bp, Homo sapiens
agatgcaaatttaca

SEQ ID NO: 118095 - DNA, 15 bp, Homo sapiens
gagatgcaaatttac

SEQ ID NO: 118096 - DNA, 15 bp, Homo sapiens
tgagatgcaaattta

SEQ ID NO: 118097 - DNA, 15 bp, Homo sapiens
atgagatgcaaattt

SEQ ID NO: 118098 - DNA, 15 bp, Homo sapiens
catgagatgcaaatt

SEQ ID NO: 118099 - DNA, 15 bp, Homo sapiens
ccatgagatgcaaat

SEQ ID NO: 118100 - DNA, 15 bp, Homo sapiens
tccatgagatgcaaa

SEQ ID NO: 118101 - DNA, 15 bp, Homo sapiens
ttccatgagatgcaa

SEQ ID NO: 118102 - DNA, 15 bp, Homo sapiens
tttccatgagatgca

SEQ ID NO: 118103 - DNA, 15 bp, Homo sapiens
atttccatgagatgc

SEQ ID NO: 118104 - DNA, 15 bp, Homo sapiens
tatttccatgagatg

SEQ ID NO: 118105 - DNA, 15 bp, Homo sapiens
ctatttccatgagat

SEQ ID NO: 118106 - DNA, 15 bp, Homo sapiens
actatttccatgaga

SEQ ID NO: 118107 - DNA, 15 bp, Homo sapiens
aactatttccatgag

SEQ ID NO: 118108 - DNA, 15 bp, Homo sapiens
taactatttccatga

SEQ ID NO: 118109 - DNA, 15 bp, Homo sapiens
gtaactatttccatg

SEQ ID NO: 118110 - DNA, 15 bp, Homo sapiens
ggtaactatttccat

SEQ ID NO: 118111 - DNA, 15 bp, Homo sapiens
tggtaactatttcca

SEQ ID NO: 118112 - DNA, 15 bp, Homo sapiens
atggtaactatttcc

SEQ ID NO: 118113 - DNA, 15 bp, Homo sapiens
aatggtaactatttc

SEQ ID NO: 118114 - DNA, 15 bp, Homo sapiens
aaatggtaactattt

SEQ ID NO: 118115 - DNA, 15 bp, Homo sapiens
taaatggtaactatt

SEQ ID NO: 118116 - DNA, 15 bp, Homo sapiens
ttaaatggtaactat

SEQ ID NO: 118117 - DNA, 15 bp, Homo sapiens
attaaatggtaacta

SEQ ID NO: 118118 - DNA, 15 bp, Homo sapiens
aattaaatggtaact

SEQ ID NO: 118119 - DNA, 15 bp, Homo sapiens
aaattaaatggtaac

SEQ ID NO: 118120 - DNA, 15 bp, Homo sapiens
aaaattaaatggtaa

SEQ ID NO: 118121 - DNA, 15 bp, Homo sapiens
aaaaattaaatggta

SEQ ID NO: 118122 - DNA, 15 bp, Homo sapiens
taaaaattaaatggt

SEQ ID NO: 118123 - DNA, 15 bp, Homo sapiens
ataaaaattaaatgg

SEQ ID NO: 118124 - DNA, 15 bp, Homo sapiens
tataaaaattaaatg

SEQ ID NO: 118125 - DNA, 15 bp, Homo sapiens
atataaaaattaaat

SEQ ID NO: 118126 - DNA, 15 bp, Homo sapiens
catataaaaattaaa

SEQ ID NO: 118127 - DNA, 15 bp, Homo sapiens
ccatataaaaattaa

SEQ ID NO: 118128 - DNA, 15 bp, Homo sapiens
accatataaaaatta

SEQ ID NO: 118129 - DNA, 15 bp, Homo sapiens
aaccatataaaaatt

SEQ ID NO: 118130 - DNA, 15 bp, Homo sapiens
aaaccatataaaaat

SEQ ID NO: 118131 - DNA, 15 bp, Homo sapiens
aaaaccatataaaaa

SEQ ID NO: 118132 - DNA, 15 bp, Homo sapiens
taaaaccatataaaa

SEQ ID NO: 118133 - DNA, 15 bp, Homo sapiens
ataaaaccatataaa

SEQ ID NO: 118134 - DNA, 15 bp, Homo sapiens
cataaaaccatataa

SEQ ID NO: 118135 - DNA, 15 bp, Homo sapiens
acataaaaccatata

SEQ ID NO: 118136 - DNA, 15 bp, Homo sapiens
aacataaaaccatat

SEQ ID NO: 118137 - DNA, 15 bp, Homo sapiens
gaacataaaaccata

SEQ ID NO: 118138 - DNA, 15 bp, Homo sapiens
ggaacataaaaccat

SEQ ID NO: 118139 - DNA, 15 bp, Homo sapiens
aggaacataaaacca

SEQ ID NO: 118140 - DNA, 15 bp, Homo sapiens
taggaacataaaacc

SEQ ID NO: 118141 - DNA, 15 bp, Homo sapiens
ataggaacataaaac

SEQ ID NO: 118142 - DNA, 15 bp, Homo sapiens
cataggaacataaaa

SEQ ID NO: 118143 - DNA, 15 bp, Homo sapiens
tcataggaacataaa

SEQ ID NO: 118144 - DNA, 15 bp, Homo sapiens
atcataggaacataa

SEQ ID NO: 118145 - DNA, 15 bp, Homo sapiens
tatcataggaacata

SEQ ID NO: 118146 - DNA, 15 bp, Homo sapiens
gtatcataggaacat

SEQ ID NO: 118147 - DNA, 15 bp, Homo sapiens
agtatcataggaaca

SEQ ID NO: 118148 - DNA, 15 bp, Homo sapiens
tagtatcataggaac

SEQ ID NO: 118149 - DNA, 15 bp, Homo sapiens
ttagtatcataggaa

SEQ ID NO: 118150 - DNA, 15 bp, Homo sapiens
attagtatcatagga

SEQ ID NO: 118151 - DNA, 15 bp, Homo sapiens
aattagtatcatagg

SEQ ID NO: 118152 - DNA, 15 bp, Homo sapiens
caattagtatcatag

SEQ ID NO: 118153 - DNA, 15 bp, Homo sapiens
acaattagtatcata

SEQ ID NO: 118154 - DNA, 15 bp, Homo sapiens
cacaattagtatcat

SEQ ID NO: 118155 - DNA, 15 bp, Homo sapiens
tcacaattagtatca

SEQ ID NO: 118156 - DNA, 15 bp, Homo sapiens
ttcacaattagtatc

SEQ ID NO: 118157 - DNA, 15 bp, Homo sapiens
attcacaattagtat

SEQ ID NO: 118158 - DNA, 15 bp, Homo sapiens
tattcacaattagta

SEQ ID NO: 118159 - DNA, 15 bp, Homo sapiens
atattcacaattagt

SEQ ID NO: 118160 - DNA, 15 bp, Homo sapiens
tatattcacaattag

SEQ ID NO: 118161 - DNA, 15 bp, Homo sapiens
atatattcacaatta

SEQ ID NO: 118162 - DNA, 15 bp, Homo sapiens
catatattcacaatt

SEQ ID NO: 118163 - DNA, 15 bp, Homo sapiens
ccatatattcacaat

SEQ ID NO: 118164 - DNA, 15 bp, Homo sapiens
gccatatattcacaa

SEQ ID NO: 118165 - DNA, 15 bp, Homo sapiens
ggccatatattcaca

SEQ ID NO: 118166 - DNA, 15 bp, Homo sapiens
tggccatatattcac

SEQ ID NO: 118167 - DNA, 15 bp, Homo sapiens
gtggccatatattca

SEQ ID NO: 118168 - DNA, 15 bp, Homo sapiens
ggtggccatatattc

SEQ ID NO: 118169 - DNA, 15 bp, Homo sapiens
gggtggccatatatt

SEQ ID NO: 118170 - DNA, 15 bp, Homo sapiens
ggggtggccatatat

SEQ ID NO: 118171 - DNA, 15 bp, Homo sapiens
tggggtggccatata

SEQ ID NO: 118172 - DNA, 15 bp, Homo sapiens
gtggggtggccatat

SEQ ID NO: 118173 - DNA, 15 bp, Homo sapiens
ggtggggtggccata

SEQ ID NO: 118174 - DNA, 15 bp, Homo sapiens
gggtggggtggccat

SEQ ID NO: 118175 - DNA, 15 bp, Homo sapiens
agggtggggtggcca

SEQ ID NO: 118176 - DNA, 15 bp, Homo sapiens
gagggtggggtggcc

SEQ ID NO: 118177 - DNA, 15 bp, Homo sapiens
ggagggtggggtggc

SEQ ID NO: 118178 - DNA, 15 bp, Homo sapiens
ggggagggtggggtg

SEQ ID NO: 118179 - DNA, 15 bp, Homo sapiens
aggggagggtggggt

SEQ ID NO: 118180 - DNA, 15 bp, Homo sapiens
caggggagggtgggg

SEQ ID NO: 118181 - DNA, 15 bp, Homo sapiens
gcaggggagggtggg

SEQ ID NO: 118182 - DNA, 15 bp, Homo sapiens
agcaggggagggtgg

SEQ ID NO: 118183 - DNA, 15 bp, Homo sapiens
cagcaggggagggtg

SEQ ID NO: 118184 - DNA, 15 bp, Homo sapiens
tcagcaggggagggt

SEQ ID NO: 118185 - DNA, 15 bp, Homo sapiens
ctcagcaggggaggg

SEQ ID NO: 118186 - DNA, 15 bp, Homo sapiens
cctcagcaggggagg

SEQ ID NO: 118187 - DNA, 15 bp, Homo sapiens
tcctcagcaggggag

SEQ ID NO: 118188 - DNA, 15 bp, Homo sapiens
ttcctcagcagggga

SEQ ID NO: 118189 - DNA, 15 bp, Homo sapiens
cttcctcagcagggg

SEQ ID NO: 118190 - DNA, 15 bp, Homo sapiens
ccttcctcagcaggg

SEQ ID NO: 118191 - DNA, 15 bp, Homo sapiens
gccttcctcagcagg

SEQ ID NO: 118192 - DNA, 15 bp, Homo sapiens
tgccttcctcagcag

SEQ ID NO: 118193 - DNA, 15 bp, Homo sapiens
atgccttcctcagca

SEQ ID NO: 118194 - DNA, 15 bp, Homo sapiens
aatgccttcctcagc

SEQ ID NO: 118195 - DNA, 15 bp, Homo sapiens
caatgccttcctcag

SEQ ID NO: 118196 - DNA, 15 bp, Homo sapiens
acaatgccttcctca

SEQ ID NO: 118197 - DNA, 15 bp, Homo sapiens
gacaatgccttcctc

SEQ ID NO: 118198 - DNA, 15 bp, Homo sapiens
tgacaatgccttcct

SEQ ID NO: 118199 - DNA, 15 bp, Homo sapiens
atgacaatgccttcc

SEQ ID NO: 118200 - DNA, 15 bp, Homo sapiens
aatgacaatgccttc

SEQ ID NO: 118201 - DNA, 15 bp, Homo sapiens
aaatgacaatgcctt

SEQ ID NO: 118202 - DNA, 15 bp, Homo sapiens
taaatgacaatgcct

SEQ ID NO: 118203 - DNA, 15 bp, Homo sapiens
ataaatgacaatgcc

SEQ ID NO: 118204 - DNA, 15 bp, Homo sapiens
tataaatgacaatgc

SEQ ID NO: 118205 - DNA, 15 bp, Homo sapiens
ttataaatgacaatg

SEQ ID NO: 118206 - DNA, 15 bp, Homo sapiens
attataaatgacaat

SEQ ID NO: 118207 - DNA, 15 bp, Homo sapiens
aattataaatgacaa

SEQ ID NO: 118208 - DNA, 15 bp, Homo sapiens
aaattataaatgaca

SEQ ID NO: 118209 - DNA, 15 bp, Homo sapiens
aaaattataaatgac

SEQ ID NO: 118210 - DNA, 15 bp, Homo sapiens
aaaaattataaatga

SEQ ID NO: 118211 - DNA, 15 bp, Homo sapiens
aaaaaattataaatg

SEQ ID NO: 118212 - DNA, 15 bp, Homo sapiens
taaaaaaaattataa

SEQ ID NO: 118213 - DNA, 15 bp, Homo sapiens
ttaaaaaaaattata

SEQ ID NO: 118214 - DNA, 15 bp, Homo sapiens
attaaaaaaaattat

SEQ ID NO: 118215 - DNA, 15 bp, Homo sapiens
aattaaaaaaaatta

SEQ ID NO: 118216 - DNA, 15 bp, Homo sapiens
gaattaaaaaaaatt

SEQ ID NO: 118217 - DNA, 15 bp, Homo sapiens
agaattaaaaaaaat

SEQ ID NO: 118218 - DNA, 15 bp, Homo sapiens
cagaattaaaaaaaa

SEQ ID NO: 118219 - DNA, 15 bp, Homo sapiens
tcagaattaaaaaaa

SEQ ID NO: 118220 - DNA, 15 bp, Homo sapiens
ttcagaattaaaaaa

SEQ ID NO: 118221 - DNA, 15 bp, Homo sapiens
tttcagaattaaaaa

SEQ ID NO: 118222 - DNA, 15 bp, Homo sapiens
atttcagaattaaaa

SEQ ID NO: 118223 - DNA, 15 bp, Homo sapiens
tatttcagaattaaa

SEQ ID NO: 118224 - DNA, 15 bp, Homo sapiens
gtatttcagaattaa

SEQ ID NO: 118225 - DNA, 15 bp, Homo sapiens
ggtatttcagaatta

SEQ ID NO: 118226 - DNA, 15 bp, Homo sapiens
aggtatttcagaatt

SEQ ID NO: 118227 - DNA, 15 bp, Homo sapiens
caggtatttcagaat

SEQ ID NO: 118228 - DNA, 15 bp, Homo sapiens
tcaggtatttcagaa

SEQ ID NO: 118229 - DNA, 15 bp, Homo sapiens
ctcaggtatttcaga

SEQ ID NO: 118230 - DNA, 15 bp, Homo sapiens
tctcaggtatttcag

SEQ ID NO: 118231 - DNA, 15 bp, Homo sapiens
atctcaggtatttca

SEQ ID NO: 118232 - DNA, 15 bp, Homo sapiens
tatctcaggtatttc

SEQ ID NO: 118233 - DNA, 15 bp, Homo sapiens
ctatctcaggtattt

SEQ ID NO: 118234 - DNA, 15 bp, Homo sapiens
cctatctcaggtatt

SEQ ID NO: 118235 - DNA, 15 bp, Homo sapiens
tcctatctcaggtat

SEQ ID NO: 118236 - DNA, 15 bp, Homo sapiens
gtcctatctcaggta

SEQ ID NO: 118237 - DNA, 15 bp, Homo sapiens
agtcctatctcaggt

SEQ ID NO: 118238 - DNA, 15 bp, Homo sapiens
aagtcctatctcagg

SEQ ID NO: 118239 - DNA, 15 bp, Homo sapiens
aaagtcctatctcag

SEQ ID NO: 118240 - DNA, 15 bp, Homo sapiens
aaaagtcctatctca

SEQ ID NO: 118241 - DNA, 15 bp, Homo sapiens
taaaagtcctatctc

SEQ ID NO: 118242 - DNA, 15 bp, Homo sapiens
ataaaagtcctatct

SEQ ID NO: 118243 - DNA, 15 bp, Homo sapiens
gataaaagtcctatc

SEQ ID NO: 118244 - DNA, 15 bp, Homo sapiens
tgataaaagtcctat

SEQ ID NO: 118245 - DNA, 15 bp, Homo sapiens
ttgataaaagtccta

SEQ ID NO: 118246 - DNA, 15 bp, Homo sapiens
tttgataaaagtcct

SEQ ID NO: 118247 - DNA, 15 bp, Homo sapiens
atttgataaaagtcc

SEQ ID NO: 118248 - DNA, 15 bp, Homo sapiens
aatttgataaaagtc

SEQ ID NO: 118249 - DNA, 15 bp, Homo sapiens
aaatttgataaaagt

SEQ ID NO: 118250 - DNA, 15 bp, Homo sapiens
taaatttgataaaag

SEQ ID NO: 118251 - DNA, 15 bp, Homo sapiens
ataaatttgataaaa

SEQ ID NO: 118252 - DNA, 15 bp, Homo sapiens
tataaatttgataaa

SEQ ID NO: 118253 - DNA, 15 bp, Homo sapiens
ctataaatttgataa

SEQ ID NO: 118254 - DNA, 15 bp, Homo sapiens
tctataaatttgata

SEQ ID NO: 118255 - DNA, 15 bp, Homo sapiens
ttctataaatttgat

SEQ ID NO: 118256 - DNA, 15 bp, Homo sapiens
attctataaatttga

SEQ ID NO: 118257 - DNA, 15 bp, Homo sapiens
aattctataaatttg

SEQ ID NO: 118258 - DNA, 15 bp, Homo sapiens
taattctataaattt

SEQ ID NO: 118259 - DNA, 15 bp, Homo sapiens
gtaattctataaatt

SEQ ID NO: 118260 - DNA, 15 bp, Homo sapiens
agtaattctataaat

SEQ ID NO: 118261 - DNA, 15 bp, Homo sapiens
tagtaattctataaa

SEQ ID NO: 118262 - DNA, 15 bp, Homo sapiens
ctagtaattctataa

SEQ ID NO: 118263 - DNA, 15 bp, Homo sapiens
cctagtaattctata

SEQ ID NO: 118264 - DNA, 15 bp, Homo sapiens
acctagtaattctat

SEQ ID NO: 118265 - DNA, 15 bp, Homo sapiens
tacctagtaattcta

SEQ ID NO: 118266 - DNA, 15 bp, Homo sapiens
ttacctagtaattct

SEQ ID NO: 118267 - DNA, 15 bp, Homo sapiens
attacctagtaattc

SEQ ID NO: 118268 - DNA, 15 bp, Homo sapiens
cattacctagtaatt

SEQ ID NO: 118269 - DNA, 15 bp, Homo sapiens
ccattacctagtaat

SEQ ID NO: 118270 - DNA, 15 bp, Homo sapiens
tccattacctagtaa

SEQ ID NO: 118271 - DNA, 15 bp, Homo sapiens
atccattacctagta

SEQ ID NO: 118272 - DNA, 15 bp, Homo sapiens
tatccattacctagt

SEQ ID NO: 118273 - DNA, 15 bp, Homo sapiens
ctatccattacctag

SEQ ID NO: 118274 - DNA, 15 bp, Homo sapiens
tctatccattaccta

SEQ ID NO: 118275 - DNA, 15 bp, Homo sapiens
ctctatccattacct

SEQ ID NO: 118276 - DNA, 15 bp, Homo sapiens
tctctatccattacc

SEQ ID NO: 118277 - DNA, 15 bp, Homo sapiens
gtctctatccattac

SEQ ID NO: 118278 - DNA, 15 bp, Homo sapiens
tgtctctatccatta

SEQ ID NO: 118279 - DNA, 15 bp, Homo sapiens
atgtctctatccatt

SEQ ID NO: 118280 - DNA, 15 bp, Homo sapiens
tatgtctctatccat

SEQ ID NO: 118281 - DNA, 15 bp, Homo sapiens
ttatgtctctatcca

SEQ ID NO: 118282 - DNA, 15 bp, Homo sapiens
tttatgtctctatcc

SEQ ID NO: 118283 - DNA, 15 bp, Homo sapiens
ttttatgtctctatc

SEQ ID NO: 118284 - DNA, 15 bp, Homo sapiens
tttttatgtctctat

SEQ ID NO: 118285 - DNA, 15 bp, Homo sapiens
ttttttatgtctcta

SEQ ID NO: 118286 - DNA, 15 bp, Homo sapiens
attttttatgtctct

SEQ ID NO: 118287 - DNA, 15 bp, Homo sapiens
tattttttatgtctc

SEQ ID NO: 118288 - DNA, 15 bp, Homo sapiens
gtattttttatgtct

SEQ ID NO: 118289 - DNA, 15 bp, Homo sapiens
tgtattttttatgtc

SEQ ID NO: 118290 - DNA, 15 bp, Homo sapiens
atgtattttttatgt

SEQ ID NO: 118291 - DNA, 15 bp, Homo sapiens
aatgtattttttatg

SEQ ID NO: 118292 - DNA, 15 bp, Homo sapiens
taatgtattttttat

SEQ ID NO: 118293 - DNA, 15 bp, Homo sapiens
ataatgtatttttta

SEQ ID NO: 118294 - DNA, 15 bp, Homo sapiens
gataatgtatttttt

SEQ ID NO: 118295 - DNA, 15 bp, Homo sapiens
tgataatgtattttt

SEQ ID NO: 118296 - DNA, 15 bp, Homo sapiens
atgataatgtatttt

SEQ ID NO: 118297 - DNA, 15 bp, Homo sapiens
catgataatgtattt

SEQ ID NO: 118298 - DNA, 15 bp, Homo sapiens
acatgataatgtatt

SEQ ID NO: 118299 - DNA, 15 bp, Homo sapiens
cacatgataatgtat

SEQ ID NO: 118300 - DNA, 15 bp, Homo sapiens
acacatgataatgta

SEQ ID NO: 118301 - DNA, 15 bp, Homo sapiens
aacacatgataatgt

SEQ ID NO: 118302 - DNA, 15 bp, Homo sapiens
aaacacatgataatg

SEQ ID NO: 118303 - DNA, 15 bp, Homo sapiens
caaacacatgataat

SEQ ID NO: 118304 - DNA, 15 bp, Homo sapiens
tcaaacacatgataa

SEQ ID NO: 118305 - DNA, 15 bp, Homo sapiens
ttcaaacacatgata

SEQ ID NO: 118306 - DNA, 15 bp, Homo sapiens
attcaaacacatgat

SEQ ID NO: 118307 - DNA, 15 bp, Homo sapiens
tattcaaacacatga

SEQ ID NO: 118308 - DNA, 15 bp, Homo sapiens
atattcaaacacatg

SEQ ID NO: 118309 - DNA, 15 bp, Homo sapiens
aatattcaaacacat

SEQ ID NO: 118310 - DNA, 15 bp, Homo sapiens
aaatattcaaacaca

SEQ ID NO: 118311 - DNA, 15 bp, Homo sapiens
taaatattcaaacac

SEQ ID NO: 118312 - DNA, 15 bp, Homo sapiens
ataaatattcaaaca

SEQ ID NO: 118313 - DNA, 15 bp, Homo sapiens
aataaatattcaaac

SEQ ID NO: 118314 - DNA, 15 bp, Homo sapiens
aaataaatattcaaa

SEQ ID NO: 118315 - DNA, 15 bp, Homo sapiens
taaataaatattcaa

SEQ ID NO: 118316 - DNA, 15 bp, Homo sapiens
ttaaataaatattca

SEQ ID NO: 118317 - DNA, 15 bp, Homo sapiens
tttaaataaatattc

SEQ ID NO: 118318 - DNA, 15 bp, Homo sapiens
atttaaataaatatt

SEQ ID NO: 118319 - DNA, 15 bp, Homo sapiens
aatttaaataaatat

SEQ ID NO: 118320 - DNA, 15 bp, Homo sapiens
gaatttaaataaata

SEQ ID NO: 118321 - DNA, 15 bp, Homo sapiens
ggaatttaaataaat

SEQ ID NO: 118322 - DNA, 15 bp, Homo sapiens
aggaatttaaataaa

SEQ ID NO: 118323 - DNA, 15 bp, Homo sapiens
gaggaatttaaataa

SEQ ID NO: 118324 - DNA, 15 bp, Homo sapiens
tgaggaatttaaata

SEQ ID NO: 118325 - DNA, 15 bp, Homo sapiens
ctgaggaatttaaat

SEQ ID NO: 118326 - DNA, 15 bp, Homo sapiens
cctgaggaatttaaa

SEQ ID NO: 118327 - DNA, 15 bp, Homo sapiens
tcctgaggaatttaa

SEQ ID NO: 118328 - DNA, 15 bp, Homo sapiens
atcctgaggaattta

SEQ ID NO: 118329 - DNA, 15 bp, Homo sapiens
catcctgaggaattt

SEQ ID NO: 118330 - DNA, 15 bp, Homo sapiens
acatcctgaggaatt

SEQ ID NO: 118331 - DNA, 15 bp, Homo sapiens
cacatcctgaggaat

SEQ ID NO: 118332 - DNA, 15 bp, Homo sapiens
acacatcctgaggaa

SEQ ID NO: 118333 - DNA, 15 bp, Homo sapiens
tacacatcctgagga

SEQ ID NO: 118334 - DNA, 15 bp, Homo sapiens
ctacacatcctgagg

SEQ ID NO: 118335 - DNA, 15 bp, Homo sapiens
cctacacatcctgag

SEQ ID NO: 118336 - DNA, 15 bp, Homo sapiens
ccctacacatcctga

SEQ ID NO: 118337 - DNA, 15 bp, Homo sapiens
gccctacacatcctg

SEQ ID NO: 118338 - DNA, 15 bp, Homo sapiens
tgccctacacatcct

SEQ ID NO: 118339 - DNA, 15 bp, Homo sapiens
ctgccctacacatcc

SEQ ID NO: 118340 - DNA, 15 bp, Homo sapiens
actgccctacacatc

SEQ ID NO: 118341 - DNA, 15 bp, Homo sapiens
cactgccctacacat

SEQ ID NO: 118342 - DNA, 15 bp, Homo sapiens
tcactgccctacaca

SEQ ID NO: 118343 - DNA, 15 bp, Homo sapiens
ttcactgccctacac

SEQ ID NO: 118344 - DNA, 15 bp, Homo sapiens
cttcactgccctaca

SEQ ID NO: 118345 - DNA, 15 bp, Homo sapiens
tcttcactgccctac

SEQ ID NO: 118346 - DNA, 15 bp, Homo sapiens
ctcttcactgcccta

SEQ ID NO: 118347 - DNA, 15 bp, Homo sapiens
gctcttcactgccct

SEQ ID NO: 118348 - DNA, 15 bp, Homo sapiens
tgctcttcactgccc

SEQ ID NO: 118349 - DNA, 15 bp, Homo sapiens
atgctcttcactgcc

SEQ ID NO: 118350 - DNA, 15 bp, Homo sapiens
catgctcttcactgc

SEQ ID NO: 118351 - DNA, 15 bp, Homo sapiens
ccatgctcttcactg

SEQ ID NO: 118352 - DNA, 15 bp, Homo sapiens
cccatgctcttcact

SEQ ID NO: 118353 - DNA, 15 bp, Homo sapiens
gcccatgctcttcac

SEQ ID NO: 118354 - DNA, 15 bp, Homo sapiens
agcccatgctcttca

SEQ ID NO: 118355 - DNA, 15 bp, Homo sapiens
aagcccatgctcttc

SEQ ID NO: 118356 - DNA, 15 bp, Homo sapiens
aaagcccatgctctt

SEQ ID NO: 118357 - DNA, 15 bp, Homo sapiens
caaagcccatgctct

SEQ ID NO: 118358 - DNA, 15 bp, Homo sapiens
gcaaagcccatgctc

SEQ ID NO: 118359 - DNA, 15 bp, Homo sapiens
agcaaagcccatgct

SEQ ID NO: 118360 - DNA, 15 bp, Homo sapiens
gagcaaagcccatgc

SEQ ID NO: 118361 - DNA, 15 bp, Homo sapiens
agagcaaagcccatg

SEQ ID NO: 118362 - DNA, 15 bp, Homo sapiens
aagagcaaagcccat

SEQ ID NO: 118363 - DNA, 15 bp, Homo sapiens
caagagcaaagccca

SEQ ID NO: 118364 - DNA, 15 bp, Homo sapiens
tcaagagcaaagccc

SEQ ID NO: 118365 - DNA, 15 bp, Homo sapiens
atcaagagcaaagcc

SEQ ID NO: 118366 - DNA, 15 bp, Homo sapiens
gatcaagagcaaagc

SEQ ID NO: 118367 - DNA, 15 bp, Homo sapiens
agatcaagagcaaag

SEQ ID NO: 118368 - DNA, 15 bp, Homo sapiens
gagatcaagagcaaa

SEQ ID NO: 118369 - DNA, 15 bp, Homo sapiens
agagatcaagagcaa

SEQ ID NO: 118370 - DNA, 15 bp, Homo sapiens
tagagatcaagagca

SEQ ID NO: 118371 - DNA, 15 bp, Homo sapiens
ttagagatcaagagc

SEQ ID NO: 118372 - DNA, 15 bp, Homo sapiens
gttagagatcaagag

SEQ ID NO: 118373 - DNA, 15 bp, Homo sapiens
tgttagagatcaaga

SEQ ID NO: 118374 - DNA, 15 bp, Homo sapiens
ctgttagagatcaag

SEQ ID NO: 118375 - DNA, 15 bp, Homo sapiens
tctgttagagatcaa

SEQ ID NO: 118376 - DNA, 15 bp, Homo sapiens
atctgttagagatca

SEQ ID NO: 118377 - DNA, 15 bp, Homo sapiens
aatctgttagagatc

SEQ ID NO: 118378 - DNA, 15 bp, Homo sapiens
aaatctgttagagat

SEQ ID NO: 118379 - DNA, 15 bp, Homo sapiens
taaatctgttagaga

SEQ ID NO: 118380 - DNA, 15 bp, Homo sapiens
ataaatctgttagag

SEQ ID NO: 118381 - DNA, 15 bp, Homo sapiens
tataaatctgttaga

SEQ ID NO: 118382 - DNA, 15 bp, Homo sapiens
atataaatctgttag

SEQ ID NO: 118383 - DNA, 15 bp, Homo sapiens
gatataaatctgtta

SEQ ID NO: 118384 - DNA, 15 bp, Homo sapiens
ggatataaatctgtt

SEQ ID NO: 118385 - DNA, 15 bp, Homo sapiens
tggatataaatctgt

SEQ ID NO: 118386 - DNA, 15 bp, Homo sapiens
gtggatataaatctg

SEQ ID NO: 118387 - DNA, 15 bp, Homo sapiens
tgtggatataaatct

SEQ ID NO: 118388 - DNA, 15 bp, Homo sapiens
ctgtggatataaatc

SEQ ID NO: 118389 - DNA, 15 bp, Homo sapiens
actgtggatataaat

SEQ ID NO: 118390 - DNA, 15 bp, Homo sapiens
gactgtggatataaa

SEQ ID NO: 118391 - DNA, 15 bp, Homo sapiens
ggactgtggatataa

SEQ ID NO: 118392 - DNA, 15 bp, Homo sapiens
tggactgtggatata

SEQ ID NO: 118393 - DNA, 15 bp, Homo sapiens
atggactgtggatat

SEQ ID NO: 118394 - DNA, 15 bp, Homo sapiens
catggactgtggata

SEQ ID NO: 118395 - DNA, 15 bp, Homo sapiens
tcatggactgtggat

SEQ ID NO: 118396 - DNA, 15 bp, Homo sapiens
gtcatggactgtgga

SEQ ID NO: 118397 - DNA, 15 bp, Homo sapiens
agtcatggactgtgg

SEQ ID NO: 118398 - DNA, 15 bp, Homo sapiens
aagtcatggactgtg

SEQ ID NO: 118399 - DNA, 15 bp, Homo sapiens
taagtcatggactgt

SEQ ID NO: 118400 - DNA, 15 bp, Homo sapiens
ataagtcatggactg

SEQ ID NO: 118401 - DNA, 15 bp, Homo sapiens
aataagtcatggact

SEQ ID NO: 118402 - DNA, 15 bp, Homo sapiens
taataagtcatggac

SEQ ID NO: 118403 - DNA, 15 bp, Homo sapiens
ataataagtcatgga

SEQ ID NO: 118404 - DNA, 15 bp, Homo sapiens
gataataagtcatgg

SEQ ID NO: 118405 - DNA, 15 bp, Homo sapiens
agataataagtcatg

SEQ ID NO: 118406 - DNA, 15 bp, Homo sapiens
cagataataagtcat

SEQ ID NO: 118407 - DNA, 15 bp, Homo sapiens
acagataataagtca

SEQ ID NO: 118408 - DNA, 15 bp, Homo sapiens
aacagataataagtc

SEQ ID NO: 118409 - DNA, 15 bp, Homo sapiens
aaacagataataagt

SEQ ID NO: 118410 - DNA, 15 bp, Homo sapiens
taaacagataataag

SEQ ID NO: 118411 - DNA, 15 bp, Homo sapiens
ttaaacagataataa

SEQ ID NO: 118412 - DNA, 15 bp, Homo sapiens
gttaaacagataata

SEQ ID NO: 118413 - DNA, 15 bp, Homo sapiens
agttaaacagataat

SEQ ID NO: 118414 - DNA, 15 bp, Homo sapiens
aagttaaacagataa

SEQ ID NO: 118415 - DNA, 15 bp, Homo sapiens
aaagttaaacagata

SEQ ID NO: 118416 - DNA, 15 bp, Homo sapiens
taaagttaaacagat

SEQ ID NO: 118417 - DNA, 15 bp, Homo sapiens
ctaaagttaaacaga

SEQ ID NO: 118418 - DNA, 15 bp, Homo sapiens
gctaaagttaaacag

SEQ ID NO: 118419 - DNA, 15 bp, Homo sapiens
agctaaagttaaaca

SEQ ID NO: 118420 - DNA, 15 bp, Homo sapiens
tagctaaagttaaac

SEQ ID NO: 118421 - DNA, 15 bp, Homo sapiens
ttagctaaagttaaa

SEQ ID NO: 118422 - DNA, 15 bp, Homo sapiens
cttagctaaagttaa

SEQ ID NO: 118423 - DNA, 15 bp, Homo sapiens
acttagctaaagtta

SEQ ID NO: 118424 - DNA, 15 bp, Homo sapiens
aacttagctaaagtt

SEQ ID NO: 118425 - DNA, 15 bp, Homo sapiens
taacttagctaaagt

SEQ ID NO: 118426 - DNA, 15 bp, Homo sapiens
gtaacttagctaaag

SEQ ID NO: 118427 - DNA, 15 bp, Homo sapiens
agtaacttagctaaa

SEQ ID NO: 118428 - DNA, 15 bp, Homo sapiens
aagtaacttagctaa

SEQ ID NO: 118429 - DNA, 15 bp, Homo sapiens
taagtaacttagcta

SEQ ID NO: 118430 - DNA, 15 bp, Homo sapiens
ttaagtaacttagct

SEQ ID NO: 118431 - DNA, 15 bp, Homo sapiens
attaagtaacttagc

SEQ ID NO: 118432 - DNA, 15 bp, Homo sapiens
cattaagtaacttag

SEQ ID NO: 118433 - DNA, 15 bp, Homo sapiens
acattaagtaactta

SEQ ID NO: 118434 - DNA, 15 bp, Homo sapiens
aacattaagtaactt

SEQ ID NO: 118435 - DNA, 15 bp, Homo sapiens
taacattaagtaact

SEQ ID NO: 118436 - DNA, 15 bp, Homo sapiens
gtaacattaagtaac

SEQ ID NO: 118437 - DNA, 15 bp, Homo sapiens
agtaacattaagtaa

SEQ ID NO: 118438 - DNA, 15 bp, Homo sapiens
tagtaacattaagta

SEQ ID NO: 118439 - DNA, 15 bp, Homo sapiens
ttagtaacattaagt

SEQ ID NO: 118440 - DNA, 15 bp, Homo sapiens
cttagtaacattaag

SEQ ID NO: 118441 - DNA, 15 bp, Homo sapiens
gcttagtaacattaa

SEQ ID NO: 118442 - DNA, 15 bp, Homo sapiens
agcttagtaacatta

SEQ ID NO: 118443 - DNA, 15 bp, Homo sapiens
aagcttagtaacatt

SEQ ID NO: 118444 - DNA, 15 bp, Homo sapiens
taagcttagtaacat

SEQ ID NO: 118445 - DNA, 15 bp, Homo sapiens
ttaagcttagtaaca

SEQ ID NO: 118446 - DNA, 15 bp, Homo sapiens
tttaagcttagtaac

SEQ ID NO: 118447 - DNA, 15 bp, Homo sapiens
atttaagcttagtaa

SEQ ID NO: 118448 - DNA, 15 bp, Homo sapiens
aatttaagcttagta

SEQ ID NO: 118449 - DNA, 15 bp, Homo sapiens
aaatttaagcttagt

SEQ ID NO: 118450 - DNA, 15 bp, Homo sapiens
gaaatttaagcttag

SEQ ID NO: 118451 - DNA, 15 bp, Homo sapiens
ggaaatttaagctta

SEQ ID NO: 118452 - DNA, 15 bp, Homo sapiens
tggaaatttaagctt

SEQ ID NO: 118453 - DNA, 15 bp, Homo sapiens
atggaaatttaagct

SEQ ID NO: 118454 - DNA, 15 bp, Homo sapiens
tatggaaatttaagc

SEQ ID NO: 118455 - DNA, 15 bp, Homo sapiens
atatggaaatttaag

SEQ ID NO: 118456 - DNA, 15 bp, Homo sapiens
tatatggaaatttaa

SEQ ID NO: 118457 - DNA, 15 bp, Homo sapiens
atatatggaaattta

SEQ ID NO: 118458 - DNA, 15 bp, Homo sapiens
tatatatggaaattt

SEQ ID NO: 118459 - DNA, 15 bp, Homo sapiens
gtatatatggaaatt

SEQ ID NO: 118460 - DNA, 15 bp, Homo sapiens
tgtatatatggaaat

SEQ ID NO: 118461 - DNA, 15 bp, Homo sapiens
ctgtatatatggaaa

SEQ ID NO: 118462 - DNA, 15 bp, Homo sapiens
tctgtatatatggaa

SEQ ID NO: 118463 - DNA, 15 bp, Homo sapiens
ttctgtatatatgga

SEQ ID NO: 118464 - DNA, 15 bp, Homo sapiens
attctgtatatatgg

SEQ ID NO: 118465 - DNA, 15 bp, Homo sapiens
cattctgtatatatg

SEQ ID NO: 118466 - DNA, 15 bp, Homo sapiens
tcattctgtatatat

SEQ ID NO: 118467 - DNA, 15 bp, Homo sapiens
ctcattctgtatata

SEQ ID NO: 118468 - DNA, 15 bp, Homo sapiens
tctcattctgtatat

SEQ ID NO: 118469 - DNA, 15 bp, Homo sapiens
ttctcattctgtata

SEQ ID NO: 118470 - DNA, 15 bp, Homo sapiens
gttctcattctgtat

SEQ ID NO: 118471 - DNA, 15 bp, Homo sapiens
tgttctcattctgta

SEQ ID NO: 118472 - DNA, 15 bp, Homo sapiens
ttgttctcattctgt

SEQ ID NO: 118473 - DNA, 15 bp, Homo sapiens
tttgttctcattctg

SEQ ID NO: 118474 - DNA, 15 bp, Homo sapiens
ttttgttctcattct

SEQ ID NO: 118475 - DNA, 15 bp, Homo sapiens
cttttgttctcattc

SEQ ID NO: 118476 - DNA, 15 bp, Homo sapiens
acttttgttctcatt

SEQ ID NO: 118477 - DNA, 15 bp, Homo sapiens
tacttttgttctcat

SEQ ID NO: 118478 - DNA, 15 bp, Homo sapiens
atacttttgttctca

SEQ ID NO: 118479 - DNA, 15 bp, Homo sapiens
tatacttttgttctc

SEQ ID NO: 118480 - DNA, 15 bp, Homo sapiens
atatacttttgttct

SEQ ID NO: 118481 - DNA, 15 bp, Homo sapiens
tatatacttttgttc

SEQ ID NO: 118482 - DNA, 15 bp, Homo sapiens
gtatatacttttgtt

SEQ ID NO: 118483 - DNA, 15 bp, Homo sapiens
ggtatatacttttgt

SEQ ID NO: 118484 - DNA, 15 bp, Homo sapiens
aggtatatacttttg

SEQ ID NO: 118485 - DNA, 15 bp, Homo sapiens
taggtatatactttt

SEQ ID NO: 118486 - DNA, 15 bp, Homo sapiens
ttaggtatatacttt

SEQ ID NO: 118487 - DNA, 15 bp, Homo sapiens
gttaggtatatactt

SEQ ID NO: 118488 - DNA, 15 bp, Homo sapiens
tgttaggtatatact

SEQ ID NO: 118489 - DNA, 15 bp, Homo sapiens
ctgttaggtatatac

SEQ ID NO: 118490 - DNA, 15 bp, Homo sapiens
tctgttaggtatata

SEQ ID NO: 118491 - DNA, 15 bp, Homo sapiens
ctctgttaggtatat

SEQ ID NO: 118492 - DNA, 15 bp, Homo sapiens
actctgttaggtata

SEQ ID NO: 118493 - DNA, 15 bp, Homo sapiens
aactctgttaggtat

SEQ ID NO: 118494 - DNA, 15 bp, Homo sapiens
caactctgttaggta

SEQ ID NO: 118495 - DNA, 15 bp, Homo sapiens
acaactctgttaggt

SEQ ID NO: 118496 - DNA, 15 bp, Homo sapiens
aacaactctgttagg

SEQ ID NO: 118497 - DNA, 15 bp, Homo sapiens
taacaactctgttag

SEQ ID NO: 118498 - DNA, 15 bp, Homo sapiens
ttaacaactctgtta

SEQ ID NO: 118499 - DNA, 15 bp, Homo sapiens
tttaacaactctgtt

SEQ ID NO: 118500 - DNA, 15 bp, Homo sapiens
atttaacaactctgt

SEQ ID NO: 118501 - DNA, 15 bp, Homo sapiens
tatttaacaactctg

SEQ ID NO: 118502 - DNA, 15 bp, Homo sapiens
atatttaacaactct

SEQ ID NO: 118503 - DNA, 15 bp, Homo sapiens
aatatttaacaactc

SEQ ID NO: 118504 - DNA, 15 bp, Homo sapiens
caatatttaacaact

SEQ ID NO: 118505 - DNA, 15 bp, Homo sapiens
tcaatatttaacaac

SEQ ID NO: 118506 - DNA, 15 bp, Homo sapiens
ttcaatatttaacaa

SEQ ID NO: 118507 - DNA, 15 bp, Homo sapiens
attcaatatttaaca

SEQ ID NO: 118508 - DNA, 15 bp, Homo sapiens
tattcaatatttaac

SEQ ID NO: 118509 - DNA, 15 bp, Homo sapiens
atattcaatatttaa

SEQ ID NO: 118510 - DNA, 15 bp, Homo sapiens
tatattcaatattta

SEQ ID NO: 118511 - DNA, 15 bp, Homo sapiens
ttatattcaatattt

SEQ ID NO: 118512 - DNA, 15 bp, Homo sapiens
attatattcaatatt

SEQ ID NO: 118513 - DNA, 15 bp, Homo sapiens
tattatattcaatat

SEQ ID NO: 118514 - DNA, 15 bp, Homo sapiens
ctattatattcaata

SEQ ID NO: 118515 - DNA, 15 bp, Homo sapiens
actattatattcaat

SEQ ID NO: 118516 - DNA, 15 bp, Homo sapiens
cactattatattcaa

SEQ ID NO: 118517 - DNA, 15 bp, Homo sapiens
tcactattatattca

SEQ ID NO: 118518 - DNA, 15 bp, Homo sapiens
ttcactattatattc

SEQ ID NO: 118519 - DNA, 15 bp, Homo sapiens
attcactattatatt

SEQ ID NO: 118520 - DNA, 15 bp, Homo sapiens
tattcactattatat

SEQ ID NO: 118521 - DNA, 15 bp, Homo sapiens
atattcactattata

SEQ ID NO: 118522 - DNA, 15 bp, Homo sapiens
catattcactattat

SEQ ID NO: 118523 - DNA, 15 bp, Homo sapiens
tcatattcactatta

SEQ ID NO: 118524 - DNA, 15 bp, Homo sapiens
ctcatattcactatt

SEQ ID NO: 118525 - DNA, 15 bp, Homo sapiens
tctcatattcactat

SEQ ID NO: 118526 - DNA, 15 bp, Homo sapiens
atctcatattcacta

SEQ ID NO: 118527 - DNA, 15 bp, Homo sapiens
aatctcatattcact

SEQ ID NO: 118528 - DNA, 15 bp, Homo sapiens
gaatctcatattcac

SEQ ID NO: 118529 - DNA, 15 bp, Homo sapiens
agaatctcatattca

SEQ ID NO: 118530 - DNA, 15 bp, Homo sapiens
aagaatctcatattc

SEQ ID NO: 118531 - DNA, 15 bp, Homo sapiens
caagaatctcatatt

SEQ ID NO: 118532 - DNA, 15 bp, Homo sapiens
ccaagaatctcatat

SEQ ID NO: 118533 - DNA, 15 bp, Homo sapiens
gccaagaatctcata

SEQ ID NO: 118534 - DNA, 15 bp, Homo sapiens
tgccaagaatctcat

SEQ ID NO: 118535 - DNA, 15 bp, Homo sapiens
gtgccaagaatctca

SEQ ID NO: 118536 - DNA, 15 bp, Homo sapiens
tgtgccaagaatctc

SEQ ID NO: 118537 - DNA, 15 bp, Homo sapiens
atgtgccaagaatct

SEQ ID NO: 118538 - DNA, 15 bp, Homo sapiens
tatgtgccaagaatc

SEQ ID NO: 118539 - DNA, 15 bp, Homo sapiens
ctatgtgccaagaat

SEQ ID NO: 118540 - DNA, 15 bp, Homo sapiens
tctatgtgccaagaa

SEQ ID NO: 118541 - DNA, 15 bp, Homo sapiens
ttctatgtgccaaga

SEQ ID NO: 118542 - DNA, 15 bp, Homo sapiens
attctatgtgccaag

SEQ ID NO: 118543 - DNA, 15 bp, Homo sapiens
tattctatgtgccaa

SEQ ID NO: 118544 - DNA, 15 bp, Homo sapiens
atattctatgtgcca

SEQ ID NO: 118545 - DNA, 15 bp, Homo sapiens
catattctatgtgcc

SEQ ID NO: 118546 - DNA, 15 bp, Homo sapiens
gcatattctatgtgc

SEQ ID NO: 118547 - DNA, 15 bp, Homo sapiens
agcatattctatgtg

SEQ ID NO: 118548 - DNA, 15 bp, Homo sapiens
gagcatattctatgt

SEQ ID NO: 118549 - DNA, 15 bp, Homo sapiens
tgagcatattctatg

SEQ ID NO: 118550 - DNA, 15 bp, Homo sapiens
atgagcatattctat

SEQ ID NO: 118551 - DNA, 15 bp, Homo sapiens
aatgagcatattcta

SEQ ID NO: 118552 - DNA, 15 bp, Homo sapiens
taatgagcatattct

SEQ ID NO: 118553 - DNA, 15 bp, Homo sapiens
ttaatgagcatattc

SEQ ID NO: 118554 - DNA, 15 bp, Homo sapiens
tttaatgagcatatt

SEQ ID NO: 118555 - DNA, 15 bp, Homo sapiens
atttaatgagcatat

SEQ ID NO: 118556 - DNA, 15 bp, Homo sapiens
tatttaatgagcata

SEQ ID NO: 118557 - DNA, 15 bp, Homo sapiens
atatttaatgagcat

SEQ ID NO: 118558 - DNA, 15 bp, Homo sapiens
aatatttaatgagca

SEQ ID NO: 118559 - DNA, 15 bp, Homo sapiens
aaatatttaatgagc

SEQ ID NO: 118560 - DNA, 15 bp, Homo sapiens
aaaatatttaatgag

SEQ ID NO: 118561 - DNA, 15 bp, Homo sapiens
taaaatatttaatga

SEQ ID NO: 118562 - DNA, 15 bp, Homo sapiens
ataaaatatttaatg

SEQ ID NO: 118563 - DNA, 15 bp, Homo sapiens
tataaaatatttaat

SEQ ID NO: 118564 - DNA, 15 bp, Homo sapiens
atataaaatatttaa

SEQ ID NO: 118565 - DNA, 15 bp, Homo sapiens
tatataaaatattta

SEQ ID NO: 118566 - DNA, 15 bp, Homo sapiens
atatataaaatattt

SEQ ID NO: 118567 - DNA, 15 bp, Homo sapiens
aatatataaaatatt

SEQ ID NO: 118568 - DNA, 15 bp, Homo sapiens
taatatataaaatat

SEQ ID NO: 118569 - DNA, 15 bp, Homo sapiens
ttaatatataaaata

SEQ ID NO: 118570 - DNA, 15 bp, Homo sapiens
attaatatataaaat

SEQ ID NO: 118571 - DNA, 15 bp, Homo sapiens
aattaatatataaaa

SEQ ID NO: 118572 - DNA, 15 bp, Homo sapiens
aaattaatatataaa

SEQ ID NO: 118573 - DNA, 15 bp, Homo sapiens
aaaattaatatataa

SEQ ID NO: 118574 - DNA, 15 bp, Homo sapiens
aaaaattaatatata

SEQ ID NO: 118575 - DNA, 15 bp, Homo sapiens
taaaaattaatatat

SEQ ID NO: 118576 - DNA, 15 bp, Homo sapiens
ttaaaaattaatata

SEQ ID NO: 118577 - DNA, 15 bp, Homo sapiens
attaaaaattaatat

SEQ ID NO: 118578 - DNA, 15 bp, Homo sapiens
aattaaaaattaata

SEQ ID NO: 118579 - DNA, 15 bp, Homo sapiens
taattaaaaattaat

SEQ ID NO: 118580 - DNA, 15 bp, Homo sapiens
gtaattaaaaattaa

SEQ ID NO: 118581 - DNA, 15 bp, Homo sapiens
agtaattaaaaatta

SEQ ID NO: 118582 - DNA, 15 bp, Homo sapiens
tagtaattaaaaatt

SEQ ID NO: 118583 - DNA, 15 bp, Homo sapiens
ctagtaattaaaaat

SEQ ID NO: 118584 - DNA, 15 bp, Homo sapiens
gctagtaattaaaaa

SEQ ID NO: 118585 - DNA, 15 bp, Homo sapiens
agctagtaattaaaa

SEQ ID NO: 118586 - DNA, 15 bp, Homo sapiens
aagctagtaattaaa

SEQ ID NO: 118587 - DNA, 15 bp, Homo sapiens
aaagctagtaattaa

SEQ ID NO: 118588 - DNA, 15 bp, Homo sapiens
taaagctagtaatta

SEQ ID NO: 118589 - DNA, 15 bp, Homo sapiens
ataaagctagtaatt

SEQ ID NO: 118590 - DNA, 15 bp, Homo sapiens
aataaagctagtaat

SEQ ID NO: 118591 - DNA, 15 bp, Homo sapiens
aaataaagctagtaa

SEQ ID NO: 118592 - DNA, 15 bp, Homo sapiens
gaaataaagctagta

SEQ ID NO: 118593 - DNA, 15 bp, Homo sapiens
tgaaataaagctagt

SEQ ID NO: 118594 - DNA, 15 bp, Homo sapiens
gtgaaataaagctag

SEQ ID NO: 118595 - DNA, 15 bp, Homo sapiens
tgtgaaataaagcta

SEQ ID NO: 118596 - DNA, 15 bp, Homo sapiens
atgtgaaataaagct

SEQ ID NO: 118597 - DNA, 15 bp, Homo sapiens
aatgtgaaataaagc

SEQ ID NO: 118598 - DNA, 15 bp, Homo sapiens
gaatgtgaaataaag

SEQ ID NO: 118599 - DNA, 15 bp, Homo sapiens
agaatgtgaaataaa

SEQ ID NO: 118600 - DNA, 15 bp, Homo sapiens
aagaatgtgaaataa

SEQ ID NO: 118601 - DNA, 15 bp, Homo sapiens
taagaatgtgaaata

SEQ ID NO: 118602 - DNA, 15 bp, Homo sapiens
ataagaatgtgaaat

SEQ ID NO: 118603 - DNA, 15 bp, Homo sapiens
cataagaatgtgaaa

SEQ ID NO: 118604 - DNA, 15 bp, Homo sapiens
ccataagaatgtgaa

SEQ ID NO: 118605 - DNA, 15 bp, Homo sapiens
gccataagaatgtga

SEQ ID NO: 118606 - DNA, 15 bp, Homo sapiens
ggccataagaatgtg

SEQ ID NO: 118607 - DNA, 15 bp, Homo sapiens
gggccataagaatgt

SEQ ID NO: 118608 - DNA, 15 bp, Homo sapiens
agggccataagaatg

SEQ ID NO: 118609 - DNA, 15 bp, Homo sapiens
aagggccataagaat

SEQ ID NO: 118610 - DNA, 15 bp, Homo sapiens
taagggccataagaa

SEQ ID NO: 118611 - DNA, 15 bp, Homo sapiens
ataagggccataaga

SEQ ID NO: 118612 - DNA, 15 bp, Homo sapiens
aataagggccataag

SEQ ID NO: 118613 - DNA, 15 bp, Homo sapiens
aaataagggccataa

SEQ ID NO: 118614 - DNA, 15 bp, Homo sapiens
gaaataagggccata

SEQ ID NO: 118615 - DNA, 15 bp, Homo sapiens
agaaataagggccat

SEQ ID NO: 118616 - DNA, 15 bp, Homo sapiens
cagaaataagggcca

SEQ ID NO: 118617 - DNA, 15 bp, Homo sapiens
acagaaataagggcc

SEQ ID NO: 118618 - DNA, 15 bp, Homo sapiens
tacagaaataagggc

SEQ ID NO: 118619 - DNA, 15 bp, Homo sapiens
atacagaaataaggg

SEQ ID NO: 118620 - DNA, 15 bp, Homo sapiens
aatacagaaataagg

SEQ ID NO: 118621 - DNA, 15 bp, Homo sapiens
gaatacagaaataag

SEQ ID NO: 118622 - DNA, 15 bp, Homo sapiens
agaatacagaaataa

SEQ ID NO: 118623 - DNA, 15 bp, Homo sapiens
aagaatacagaaata

SEQ ID NO: 118624 - DNA, 15 bp, Homo sapiens
gaagaatacagaaat

SEQ ID NO: 118625 - DNA, 15 bp, Homo sapiens
tgaagaatacagaaa

SEQ ID NO: 118626 - DNA, 15 bp, Homo sapiens
ctgaagaatacagaa

SEQ ID NO: 118627 - DNA, 15 bp, Homo sapiens
actgaagaatacaga

SEQ ID NO: 118628 - DNA, 15 bp, Homo sapiens
gactgaagaatacag

SEQ ID NO: 118629 - DNA, 15 bp, Homo sapiens
agactgaagaataca

SEQ ID NO: 118630 - DNA, 15 bp, Homo sapiens
tagactgaagaatac

SEQ ID NO: 118631 - DNA, 15 bp, Homo sapiens
gtagactgaagaata

SEQ ID NO: 118632 - DNA, 15 bp, Homo sapiens
tgtagactgaagaat

SEQ ID NO: 118633 - DNA, 15 bp, Homo sapiens
gtgtagactgaagaa

SEQ ID NO: 118634 - DNA, 15 bp, Homo sapiens
ggtgtagactgaaga

SEQ ID NO: 118635 - DNA, 15 bp, Homo sapiens
aggtgtagactgaag

SEQ ID NO: 118636 - DNA, 15 bp, Homo sapiens
aaggtgtagactgaa

SEQ ID NO: 118637 - DNA, 15 bp, Homo sapiens
aaaggtgtagactga

SEQ ID NO: 118638 - DNA, 15 bp, Homo sapiens
gaaaggtgtagactg

SEQ ID NO: 118639 - DNA, 15 bp, Homo sapiens
tgaaaggtgtagact

SEQ ID NO: 118640 - DNA, 15 bp, Homo sapiens
ttgaaaggtgtagac

SEQ ID NO: 118641 - DNA, 15 bp, Homo sapiens
tttgaaaggtgtaga

SEQ ID NO: 118642 - DNA, 15 bp, Homo sapiens
gtttgaaaggtgtag

SEQ ID NO: 118643 - DNA, 15 bp, Homo sapiens
agtttgaaaggtgta

SEQ ID NO: 118644 - DNA, 15 bp, Homo sapiens
gagtttgaaaggtgt

SEQ ID NO: 118645 - DNA, 15 bp, Homo sapiens
agagtttgaaaggtg

SEQ ID NO: 118646 - DNA, 15 bp, Homo sapiens
gagagtttgaaaggt

SEQ ID NO: 118647 - DNA, 15 bp, Homo sapiens
ggagagtttgaaagg

SEQ ID NO: 118648 - DNA, 15 bp, Homo sapiens
tggagagtttgaaag

SEQ ID NO: 118649 - DNA, 15 bp, Homo sapiens
atggagagtttgaaa

SEQ ID NO: 118650 - DNA, 15 bp, Homo sapiens
aatggagagtttgaa

SEQ ID NO: 118651 - DNA, 15 bp, Homo sapiens
gaatggagagtttga

SEQ ID NO: 118652 - DNA, 15 bp, Homo sapiens
tgaatggagagtttg

SEQ ID NO: 118653 - DNA, 15 bp, Homo sapiens
ttgaatggagagttt

SEQ ID NO: 118654 - DNA, 15 bp, Homo sapiens
cttgaatggagagtt

SEQ ID NO: 118655 - DNA, 15 bp, Homo sapiens
gcttgaatggagagt

SEQ ID NO: 118656 - DNA, 15 bp, Homo sapiens
tgcttgaatggagag

SEQ ID NO: 118657 - DNA, 15 bp, Homo sapiens
ctgcttgaatggaga

SEQ ID NO: 118658 - DNA, 15 bp, Homo sapiens
actgcttgaatggag

SEQ ID NO: 118659 - DNA, 15 bp, Homo sapiens
tactgcttgaatgga

SEQ ID NO: 118660 - DNA, 15 bp, Homo sapiens
atactgcttgaatgg

SEQ ID NO: 118661 - DNA, 15 bp, Homo sapiens
gatactgcttgaatg

SEQ ID NO: 118662 - DNA, 15 bp, Homo sapiens
agatactgcttgaat

SEQ ID NO: 118663 - DNA, 15 bp, Homo sapiens
aagatactgcttgaa

SEQ ID NO: 118664 - DNA, 15 bp, Homo sapiens
aaagatactgcttga

SEQ ID NO: 118665 - DNA, 15 bp, Homo sapiens
gaaagatactgcttg

SEQ ID NO: 118666 - DNA, 15 bp, Homo sapiens
agaaagatactgctt

SEQ ID NO: 118667 - DNA, 15 bp, Homo sapiens
tagaaagatactgct

SEQ ID NO: 118668 - DNA, 15 bp, Homo sapiens
ctagaaagatactgc

SEQ ID NO: 118669 - DNA, 15 bp, Homo sapiens
actagaaagatactg

SEQ ID NO: 118670 - DNA, 15 bp, Homo sapiens
cactagaaagatact

SEQ ID NO: 118671 - DNA, 15 bp, Homo sapiens
gcactagaaagatac

SEQ ID NO: 118672 - DNA, 15 bp, Homo sapiens
agcactagaaagata

SEQ ID NO: 118673 - DNA, 15 bp, Homo sapiens
cagcactagaaagat

SEQ ID NO: 118674 - DNA, 15 bp, Homo sapiens
acagcactagaaaga

SEQ ID NO: 118675 - DNA, 15 bp, Homo sapiens
aacagcactagaaag

SEQ ID NO: 118676 - DNA, 15 bp, Homo sapiens
taacagcactagaaa

SEQ ID NO: 118677 - DNA, 15 bp, Homo sapiens
ctaacagcactagaa

SEQ ID NO: 118678 - DNA, 15 bp, Homo sapiens
tctaacagcactaga

SEQ ID NO: 118679 - DNA, 15 bp, Homo sapiens
ttctaacagcactag

SEQ ID NO: 118680 - DNA, 15 bp, Homo sapiens
gttctaacagcacta

SEQ ID NO: 118681 - DNA, 15 bp, Homo sapiens
tgttctaacagcact

SEQ ID NO: 118682 - DNA, 15 bp, Homo sapiens
atgttctaacagcac

SEQ ID NO: 118683 - DNA, 15 bp, Homo sapiens
aatgttctaacagca

SEQ ID NO: 118684 - DNA, 15 bp, Homo sapiens
aaatgttctaacagc

SEQ ID NO: 118685 - DNA, 15 bp, Homo sapiens
caaatgttctaacag

SEQ ID NO: 118686 - DNA, 15 bp, Homo sapiens
tcaaatgttctaaca

SEQ ID NO: 118687 - DNA, 15 bp, Homo sapiens
atcaaatgttctaac

SEQ ID NO: 118688 - DNA, 15 bp, Homo sapiens
aatcaaatgttctaa

SEQ ID NO: 118689 - DNA, 15 bp, Homo sapiens
aaatcaaatgttcta

SEQ ID NO: 118690 - DNA, 15 bp, Homo sapiens
taaatcaaatgttct

SEQ ID NO: 118691 - DNA, 15 bp, Homo sapiens
gtaaatcaaatgttc

SEQ ID NO: 118692 - DNA, 15 bp, Homo sapiens
ggtaaatcaaatgtt

SEQ ID NO: 118693 - DNA, 15 bp, Homo sapiens
aggtaaatcaaatgt

SEQ ID NO: 118694 - DNA, 15 bp, Homo sapiens
caggtaaatcaaatg

SEQ ID NO: 118695 - DNA, 15 bp, Homo sapiens
gcaggtaaatcaaat

SEQ ID NO: 118696 - DNA, 15 bp, Homo sapiens
agcaggtaaatcaaa

SEQ ID NO: 118697 - DNA, 15 bp, Homo sapiens
aagcaggtaaatcaa

SEQ ID NO: 118698 - DNA, 15 bp, Homo sapiens
taagcaggtaaatca

SEQ ID NO: 118699 - DNA, 15 bp, Homo sapiens
ttaagcaggtaaatc

SEQ ID NO: 118700 - DNA, 15 bp, Homo sapiens
attaagcaggtaaat

SEQ ID NO: 118701 - DNA, 15 bp, Homo sapiens
tattaagcaggtaaa

SEQ ID NO: 118702 - DNA, 15 bp, Homo sapiens
ctattaagcaggtaa

SEQ ID NO: 118703 - DNA, 15 bp, Homo sapiens
cctattaagcaggta

SEQ ID NO: 118704 - DNA, 15 bp, Homo sapiens
ccctattaagcaggt

SEQ ID NO: 118705 - DNA, 15 bp, Homo sapiens
cccctattaagcagg

SEQ ID NO: 118706 - DNA, 15 bp, Homo sapiens
acccctattaagcag

SEQ ID NO: 118707 - DNA, 15 bp, Homo sapiens
tacccctattaagca

SEQ ID NO: 118708 - DNA, 15 bp, Homo sapiens
ttacccctattaagc

SEQ ID NO: 118709 - DNA, 15 bp, Homo sapiens
tttacccctattaag

SEQ ID NO: 118710 - DNA, 15 bp, Homo sapiens
gtttacccctattaa

SEQ ID NO: 118711 - DNA, 15 bp, Homo sapiens
tgtttacccctatta

SEQ ID NO: 118712 - DNA, 15 bp, Homo sapiens
ttgtttacccctatt

SEQ ID NO: 118713 - DNA, 15 bp, Homo sapiens
cttgtttacccctat

SEQ ID NO: 118714 - DNA, 15 bp, Homo sapiens
acttgtttaccccta

SEQ ID NO: 118715 - DNA, 15 bp, Homo sapiens
gacttgtttacccct

SEQ ID NO: 118716 - DNA, 15 bp, Homo sapiens
agacttgtttacccc

SEQ ID NO: 118717 - DNA, 15 bp, Homo sapiens
cagacttgtttaccc

SEQ ID NO: 118718 - DNA, 15 bp, Homo sapiens
ccagacttgtttacc

SEQ ID NO: 118719 - DNA, 15 bp, Homo sapiens
gccagacttgtttac

SEQ ID NO: 118720 - DNA, 15 bp, Homo sapiens
tgccagacttgttta

SEQ ID NO: 118721 - DNA, 15 bp, Homo sapiens
gtgccagacttgttt

SEQ ID NO: 118722 - DNA, 15 bp, Homo sapiens
agtgccagacttgtt

SEQ ID NO: 118723 - DNA, 15 bp, Homo sapiens
gagtgccagacttgt

SEQ ID NO: 118724 - DNA, 15 bp, Homo sapiens
tgagtgccagacttg

SEQ ID NO: 118725 - DNA, 15 bp, Homo sapiens
atgagtgccagactt

SEQ ID NO: 118726 - DNA, 15 bp, Homo sapiens
gatgagtgccagact

SEQ ID NO: 118727 - DNA, 15 bp, Homo sapiens
tgatgagtgccagac

SEQ ID NO: 118728 - DNA, 15 bp, Homo sapiens
ctgatgagtgccaga

SEQ ID NO: 118729 - DNA, 15 bp, Homo sapiens
actgatgagtgccag

SEQ ID NO: 118730 - DNA, 15 bp, Homo sapiens
aactgatgagtgcca

SEQ ID NO: 118731 - DNA, 15 bp, Homo sapiens
gaactgatgagtgcc

SEQ ID NO: 118732 - DNA, 15 bp, Homo sapiens
agaactgatgagtgc

SEQ ID NO: 118733 - DNA, 15 bp, Homo sapiens
aagaactgatgagtg

SEQ ID NO: 118734 - DNA, 15 bp, Homo sapiens
gaagaactgatgagt

SEQ ID NO: 118735 - DNA, 15 bp, Homo sapiens
ggaagaactgatgag

SEQ ID NO: 118736 - DNA, 15 bp, Homo sapiens
taggaagaactgatg

SEQ ID NO: 118737 - DNA, 15 bp, Homo sapiens
gtaggaagaactgat

SEQ ID NO: 118738 - DNA, 15 bp, Homo sapiens
agtaggaagaactga

SEQ ID NO: 118739 - DNA, 15 bp, Homo sapiens
aagtaggaagaactg

SEQ ID NO: 118740 - DNA, 15 bp, Homo sapiens
taagtaggaagaact

SEQ ID NO: 118741 - DNA, 15 bp, Homo sapiens
ctaagtaggaagaac

SEQ ID NO: 118742 - DNA, 15 bp, Homo sapiens
tctaagtaggaagaa

SEQ ID NO: 118743 - DNA, 15 bp, Homo sapiens
ttctaagtaggaaga

SEQ ID NO: 118744 - DNA, 15 bp, Homo sapiens
attctaagtaggaag

SEQ ID NO: 118745 - DNA, 15 bp, Homo sapiens
gattctaagtaggaa

SEQ ID NO: 118746 - DNA, 15 bp, Homo sapiens
ggattctaagtagga

SEQ ID NO: 118747 - DNA, 15 bp, Homo sapiens
tggattctaagtagg

SEQ ID NO: 118748 - DNA, 15 bp, Homo sapiens
ctggattctaagtag

SEQ ID NO: 118749 - DNA, 15 bp, Homo sapiens
tctggattctaagta

SEQ ID NO: 118750 - DNA, 15 bp, Homo sapiens
atctggattctaagt

SEQ ID NO: 118751 - DNA, 15 bp, Homo sapiens
gatctggattctaag

SEQ ID NO: 118752 - DNA, 15 bp, Homo sapiens
tgatctggattctaa

SEQ ID NO: 118753 - DNA, 15 bp, Homo sapiens
gtgatctggattcta

SEQ ID NO: 118754 - DNA, 15 bp, Homo sapiens
agtgatctggattct

SEQ ID NO: 118755 - DNA, 15 bp, Homo sapiens
cagtgatctggattc

SEQ ID NO: 118756 - DNA, 15 bp, Homo sapiens
acagtgatctggatt

SEQ ID NO: 118757 - DNA, 15 bp, Homo sapiens
aacagtgatctggat

SEQ ID NO: 118758 - DNA, 15 bp, Homo sapiens
caacagtgatctgga

SEQ ID NO: 118759 - DNA, 15 bp, Homo sapiens
tcaacagtgatctgg

SEQ ID NO: 118760 - DNA, 15 bp, Homo sapiens
atcaacagtgatctg

SEQ ID NO: 118761 - DNA, 15 bp, Homo sapiens
tatcaacagtgatct

SEQ ID NO: 118762 - DNA, 15 bp, Homo sapiens
atatcaacagtgatc

SEQ ID NO: 118763 - DNA, 15 bp, Homo sapiens
aatatcaacagtgat

SEQ ID NO: 118764 - DNA, 15 bp, Homo sapiens
aaatatcaacagtga

SEQ ID NO: 118765 - DNA, 15 bp, Homo sapiens
aaaatatcaacagtg

SEQ ID NO: 118766 - DNA, 15 bp, Homo sapiens
gaaaatatcaacagt

SEQ ID NO: 118767 - DNA, 15 bp, Homo sapiens
agaaaatatcaacag

SEQ ID NO: 118768 - DNA, 15 bp, Homo sapiens
gagaaaatatcaaca

SEQ ID NO: 118769 - DNA, 15 bp, Homo sapiens
tgagaaaatatcaac

SEQ ID NO: 118770 - DNA, 15 bp, Homo sapiens
atgagaaaatatcaa

SEQ ID NO: 118771 - DNA, 15 bp, Homo sapiens
tatgagaaaatatca

SEQ ID NO: 118772 - DNA, 15 bp, Homo sapiens
atatgagaaaatatc

SEQ ID NO: 118773 - DNA, 15 bp, Homo sapiens
gatatgagaaaatat

SEQ ID NO: 118774 - DNA, 15 bp, Homo sapiens
tgatatgagaaaata

SEQ ID NO: 118775 - DNA, 15 bp, Homo sapiens
atgatatgagaaaat

SEQ ID NO: 118776 - DNA, 15 bp, Homo sapiens
aatgatatgagaaaa

SEQ ID NO: 118777 - DNA, 15 bp, Homo sapiens
aaatgatatgagaaa

SEQ ID NO: 118778 - DNA, 15 bp, Homo sapiens
taaatgatatgagaa

SEQ ID NO: 118779 - DNA, 15 bp, Homo sapiens
ataaatgatatgaga

SEQ ID NO: 118780 - DNA, 15 bp, Homo sapiens
aataaatgatatgag

SEQ ID NO: 118781 - DNA, 15 bp, Homo sapiens
taataaatgatatga

SEQ ID NO: 118782 - DNA, 15 bp, Homo sapiens
ctaataaatgatatg

SEQ ID NO: 118783 - DNA, 15 bp, Homo sapiens
actaataaatgatat

SEQ ID NO: 118784 - DNA, 15 bp, Homo sapiens
aactaataaatgata

SEQ ID NO: 118785 - DNA, 15 bp, Homo sapiens
gaactaataaatgat

SEQ ID NO: 118786 - DNA, 15 bp, Homo sapiens
tgaactaataaatga

SEQ ID NO: 118787 - DNA, 15 bp, Homo sapiens
gtgaactaataaatg

SEQ ID NO: 118788 - DNA, 15 bp, Homo sapiens
tgtgaactaataaat

SEQ ID NO: 118789 - DNA, 15 bp, Homo sapiens
atgtgaactaataaa

SEQ ID NO: 118790 - DNA, 15 bp, Homo sapiens
aatgtgaactaataa

SEQ ID NO: 118791 - DNA, 15 bp, Homo sapiens
aaatgtgaactaata

SEQ ID NO: 118792 - DNA, 15 bp, Homo sapiens
aaaatgtgaactaat

SEQ ID NO: 118793 - DNA, 15 bp, Homo sapiens
gaaaatgtgaactaa

SEQ ID NO: 118794 - DNA, 15 bp, Homo sapiens
agaaaatgtgaacta

SEQ ID NO: 118795 - DNA, 15 bp, Homo sapiens
aagaaaatgtgaact

SEQ ID NO: 118796 - DNA, 15 bp, Homo sapiens
aaagaaaatgtgaac

SEQ ID NO: 118797 - DNA, 15 bp, Homo sapiens
aaaagaaaatgtgaa

SEQ ID NO: 118798 - DNA, 15 bp, Homo sapiens
aaaaagaaaatgtga

SEQ ID NO: 118799 - DNA, 15 bp, Homo sapiens
aaaaaagaaaatgtg

SEQ ID NO: 118800 - DNA, 15 bp, Homo sapiens
aaaaaaagaaaatgt

SEQ ID NO: 118801 - DNA, 15 bp, Homo sapiens
taaaaaaagaaaatg

SEQ ID NO: 118802 - DNA, 15 bp, Homo sapiens
ttaaaaaaagaaaat

SEQ ID NO: 118803 - DNA, 15 bp, Homo sapiens
tttaaaaaaagaaaa

SEQ ID NO: 118804 - DNA, 15 bp, Homo sapiens
atttttaaaaaaaga

SEQ ID NO: 118805 - DNA, 15 bp, Homo sapiens
catttttaaaaaaag

SEQ ID NO: 118806 - DNA, 15 bp, Homo sapiens
acatttttaaaaaaa

SEQ ID NO: 118807 - DNA, 15 bp, Homo sapiens
aacatttttaaaaaa

SEQ ID NO: 118808 - DNA, 15 bp, Homo sapiens
aaacatttttaaaaa

SEQ ID NO: 118809 - DNA, 15 bp, Homo sapiens
taaacatttttaaaa

SEQ ID NO: 118810 - DNA, 15 bp, Homo sapiens
ataaacatttttaaa

SEQ ID NO: 118811 - DNA, 15 bp, Homo sapiens
aataaacatttttaa

SEQ ID NO: 118812 - DNA, 15 bp, Homo sapiens
aaataaacattttta

SEQ ID NO: 118813 - DNA, 15 bp, Homo sapiens
aaaataaacattttt

SEQ ID NO: 118814 - DNA, 15 bp, Homo sapiens
taaaataaacatttt

SEQ ID NO: 118815 - DNA, 15 bp, Homo sapiens
ttaaaataaacattt

SEQ ID NO: 118816 - DNA, 15 bp, Homo sapiens
cttaaaataaacatt

SEQ ID NO: 118817 - DNA, 15 bp, Homo sapiens
acttaaaataaacat

SEQ ID NO: 118818 - DNA, 15 bp, Homo sapiens
aacttaaaataaaca

SEQ ID NO: 118819 - DNA, 15 bp, Homo sapiens
gaacttaaaataaac

SEQ ID NO: 118820 - DNA, 15 bp, Homo sapiens
tgtacccctgaactt

SEQ ID NO: 118821 - DNA, 15 bp, Homo sapiens
ttgtacccctgaact

SEQ ID NO: 118822 - DNA, 15 bp, Homo sapiens
cttgtacccctgaac

SEQ ID NO: 118823 - DNA, 15 bp, Homo sapiens
ccttgtacccctgaa

SEQ ID NO: 118824 - DNA, 15 bp, Homo sapiens
cccttgtacccctga

SEQ ID NO: 118825 - DNA, 15 bp, Homo sapiens
gcccttgtacccctg

SEQ ID NO: 118826 - DNA, 15 bp, Homo sapiens
tgcccttgtacccct

SEQ ID NO: 118827 - DNA, 15 bp, Homo sapiens
ttgcccttgtacccc

SEQ ID NO: 118828 - DNA, 15 bp, Homo sapiens
cttgcccttgtaccc

SEQ ID NO: 118829 - DNA, 15 bp, Homo sapiens
acttgcccttgtacc

SEQ ID NO: 118830 - DNA, 15 bp, Homo sapiens
aacttgcccttgtac

SEQ ID NO: 118831 - DNA, 15 bp, Homo sapiens
aaacttgcccttgta

SEQ ID NO: 118832 - DNA, 15 bp, Homo sapiens
caaacttgcccttgt

SEQ ID NO: 118833 - DNA, 15 bp, Homo sapiens
acaaacttgcccttg

SEQ ID NO: 118834 - DNA, 15 bp, Homo sapiens
aacaaacttgccctt

SEQ ID NO: 118835 - DNA, 15 bp, Homo sapiens
aaacaaacttgccct

SEQ ID NO: 118836 - DNA, 15 bp, Homo sapiens
aaaacaaacttgccc

SEQ ID NO: 118837 - DNA, 15 bp, Homo sapiens
taaaacaaacttgcc

SEQ ID NO: 118838 - DNA, 15 bp, Homo sapiens
ataaaacaaacttgc

SEQ ID NO: 118839 - DNA, 15 bp, Homo sapiens
aataaaacaaacttg

SEQ ID NO: 118840 - DNA, 15 bp, Homo sapiens
aaataaaacaaactt

SEQ ID NO: 118841 - DNA, 15 bp, Homo sapiens
aaaataaaacaaact

SEQ ID NO: 118842 - DNA, 15 bp, Homo sapiens
taaaaataaaacaaa

SEQ ID NO: 118843 - DNA, 15 bp, Homo sapiens
ataaaaataaaacaa

SEQ ID NO: 118844 - DNA, 15 bp, Homo sapiens
tataaaaataaaaca

SEQ ID NO: 118845 - DNA, 15 bp, Homo sapiens
atataaaaataaaac

SEQ ID NO: 118846 - DNA, 15 bp, Homo sapiens
aatataaaaataaaa

SEQ ID NO: 118847 - DNA, 15 bp, Homo sapiens
caatataaaaataaa

SEQ ID NO: 118848 - DNA, 15 bp, Homo sapiens
acaatataaaaataa

SEQ ID NO: 118849 - DNA, 15 bp, Homo sapiens
aacaatataaaaata

SEQ ID NO: 118850 - DNA, 15 bp, Homo sapiens
aaacaatataaaaat

SEQ ID NO: 118851 - DNA, 15 bp, Homo sapiens
taaacaatataaaaa

SEQ ID NO: 118852 - DNA, 15 bp, Homo sapiens
ataaacaatataaaa

SEQ ID NO: 118853 - DNA, 15 bp, Homo sapiens
aataaacaatataaa

SEQ ID NO: 118854 - DNA, 15 bp, Homo sapiens
aaataaacaatataa

SEQ ID NO: 118855 - DNA, 15 bp, Homo sapiens
caaataaacaatata

SEQ ID NO: 118856 - DNA, 15 bp, Homo sapiens
acaaataaacaatat

SEQ ID NO: 118857 - DNA, 15 bp, Homo sapiens
aacaaataaacaata

SEQ ID NO: 118858 - DNA, 15 bp, Homo sapiens
gaacaaataaacaat

SEQ ID NO: 118859 - DNA, 15 bp, Homo sapiens
tgaacaaataaacaa

SEQ ID NO: 118860 - DNA, 15 bp, Homo sapiens
gtgaacaaataaaca

SEQ ID NO: 118861 - DNA, 15 bp, Homo sapiens
agtgaacaaataaac

SEQ ID NO: 118862 - DNA, 15 bp, Homo sapiens
aagtgaacaaataaa

SEQ ID NO: 118863 - DNA, 15 bp, Homo sapiens
aaagtgaacaaataa

SEQ ID NO: 118864 - DNA, 15 bp, Homo sapiens
aaaagtgaacaaata

SEQ ID NO: 118865 - DNA, 15 bp, Homo sapiens
aaaaagtgaacaaat

SEQ ID NO: 118866 - DNA, 15 bp, Homo sapiens
aaaaaagtgaacaaa

SEQ ID NO: 118867 - DNA, 15 bp, Homo sapiens
aaaaaaagtgaacaa

SEQ ID NO: 118868 - DNA, 15 bp, Homo sapiens
aaaaaaaagtgaaca

SEQ ID NO: 118869 - DNA, 15 bp, Homo sapiens
aaaaaaaaagtgaac

SEQ ID NO: 118870 - DNA, 15 bp, Homo sapiens
aaaaaaaaaagtgaa

SEQ ID NO: 118871 - DNA, 15 bp, Homo sapiens
aaaaaaaaaaagtga

SEQ ID NO: 118872 - DNA, 15 bp, Homo sapiens
ctcagaaaaaaaaaa

SEQ ID NO: 118873 - DNA, 15 bp, Homo sapiens
cctcagaaaaaaaaa

SEQ ID NO: 118874 - DNA, 15 bp, Homo sapiens
gcctcagaaaaaaaa

SEQ ID NO: 118875 - DNA, 15 bp, Homo sapiens
agcctcagaaaaaaa

SEQ ID NO: 118876 - DNA, 15 bp, Homo sapiens
cagcctcagaaaaaa

SEQ ID NO: 118877 - DNA, 15 bp, Homo sapiens
ccagcctcagaaaaa

SEQ ID NO: 118878 - DNA, 15 bp, Homo sapiens
cccagcctcagaaaa

SEQ ID NO: 118879 - DNA, 15 bp, Homo sapiens
acccagcctcagaaa

SEQ ID NO: 118880 - DNA, 15 bp, Homo sapiens
cacccagcctcagaa

SEQ ID NO: 118881 - DNA, 15 bp, Homo sapiens
acacccagcctcaga

SEQ ID NO: 118882 - DNA, 15 bp, Homo sapiens
gacacccagcctcag

SEQ ID NO: 118883 - DNA, 15 bp, Homo sapiens
tgacacccagcctca

SEQ ID NO: 118884 - DNA, 15 bp, Homo sapiens
ctgacacccagcctc

SEQ ID NO: 118885 - DNA, 15 bp, Homo sapiens
actgacacccagcct

SEQ ID NO: 118886 - DNA, 15 bp, Homo sapiens
gactgacacccagcc

SEQ ID NO: 118887 - DNA, 15 bp, Homo sapiens
agactgacacccagc

SEQ ID NO: 118888 - DNA, 15 bp, Homo sapiens
cagactgacacccag

SEQ ID NO: 118889 - DNA, 15 bp, Homo sapiens
acagactgacaccca

SEQ ID NO: 118890 - DNA, 15 bp, Homo sapiens
gacagactgacaccc

SEQ ID NO: 118891 - DNA, 15 bp, Homo sapiens
tgacagactgacacc

SEQ ID NO: 118892 - DNA, 15 bp, Homo sapiens
gtgacagactgacac

SEQ ID NO: 118893 - DNA, 15 bp, Homo sapiens
ggtgacagactgaca

SEQ ID NO: 118894 - DNA, 15 bp, Homo sapiens
gggtgacagactgac

SEQ ID NO: 118895 - DNA, 15 bp, Homo sapiens
tgggtgacagactga

SEQ ID NO: 118896 - DNA, 15 bp, Homo sapiens
atgggtgacagactg

SEQ ID NO: 118897 - DNA, 15 bp, Homo sapiens
catgggtgacagact

SEQ ID NO: 118898 - DNA, 15 bp, Homo sapiens
gcatgggtgacagac

SEQ ID NO: 118899 - DNA, 15 bp, Homo sapiens
agcatgggtgacaga

SEQ ID NO: 118900 - DNA, 15 bp, Homo sapiens
cagcatgggtgacag

SEQ ID NO: 118901 - DNA, 15 bp, Homo sapiens
ccagcatgggtgaca

SEQ ID NO: 118902 - DNA, 15 bp, Homo sapiens
tccagcatgggtgac

SEQ ID NO: 118903 - DNA, 15 bp, Homo sapiens
ctccagcatgggtga

SEQ ID NO: 118904 - DNA, 15 bp, Homo sapiens
actccagcatgggtg

SEQ ID NO: 118905 - DNA, 15 bp, Homo sapiens
cactccagcatgggt

SEQ ID NO: 118906 - DNA, 15 bp, Homo sapiens
gcactccagcatggg

SEQ ID NO: 118907 - DNA, 15 bp, Homo sapiens
tgcactccagcatgg

SEQ ID NO: 118908 - DNA, 15 bp, Homo sapiens
ctgcactccagcatg

SEQ ID NO: 118909 - DNA, 15 bp, Homo sapiens
gcataccactgcact

SEQ ID NO: 118910 - DNA, 15 bp, Homo sapiens
tgcataccactgcac

SEQ ID NO: 118911 - DNA, 15 bp, Homo sapiens
ttgcataccactgca

SEQ ID NO: 118912 - DNA, 15 bp, Homo sapiens
gttgcataccactgc

SEQ ID NO: 118913 - DNA, 15 bp, Homo sapiens
ggttgcataccactg

SEQ ID NO: 118914 - DNA, 15 bp, Homo sapiens
aggttgcataccact

SEQ ID NO: 118915 - DNA, 15 bp, Homo sapiens
gaggttgcataccac

SEQ ID NO: 118916 - DNA, 15 bp, Homo sapiens
cgaggttgcatacca

SEQ ID NO: 118917 - DNA, 15 bp, Homo sapiens
tcgaggttgcatacc

SEQ ID NO: 118918 - DNA, 15 bp, Homo sapiens
gtcgaggttgcatac

SEQ ID NO: 118919 - DNA, 15 bp, Homo sapiens
ggtcgaggttgcata

SEQ ID NO: 118920 - DNA, 15 bp, Homo sapiens
aggtcgaggttgcat

SEQ ID NO: 118921 - DNA, 15 bp, Homo sapiens
gaggtcgaggttgca

SEQ ID NO: 118922 - DNA, 15 bp, Homo sapiens
ggaggtcgaggttgc

SEQ ID NO: 118923 - DNA, 15 bp, Homo sapiens
gggaggtcgaggttg

SEQ ID NO: 118924 - DNA, 15 bp, Homo sapiens
ggggaggtcgaggtt

SEQ ID NO: 118925 - DNA, 15 bp, Homo sapiens
tggggaggtcgaggt

SEQ ID NO: 118926 - DNA, 15 bp, Homo sapiens
ctggggaggtcgagg

SEQ ID NO: 118927 - DNA, 15 bp, Homo sapiens
cctggggaggtcgag

SEQ ID NO: 118928 - DNA, 15 bp, Homo sapiens
gcctggggaggtcga

SEQ ID NO: 118929 - DNA, 15 bp, Homo sapiens
agcctggggaggtcg

SEQ ID NO: 118930 - DNA, 15 bp, Homo sapiens
gagcctggggaggtc

SEQ ID NO: 118931 - DNA, 15 bp, Homo sapiens
tgagcctggggaggt

SEQ ID NO: 118932 - DNA, 15 bp, Homo sapiens
ctgagcctggggagg

SEQ ID NO: 118933 - DNA, 15 bp, Homo sapiens
cctgagcctggggag

SEQ ID NO: 118934 - DNA, 15 bp, Homo sapiens
acctgagcctgggga

SEQ ID NO: 118935 - DNA, 15 bp, Homo sapiens
cacctgagcctgggg

SEQ ID NO: 118936 - DNA, 15 bp, Homo sapiens
tcacctgagcctggg

SEQ ID NO: 118937 - DNA, 15 bp, Homo sapiens
atcacctgagcctgg

SEQ ID NO: 118938 - DNA, 15 bp, Homo sapiens
gatcacctgagcctg

SEQ ID NO: 118939 - DNA, 15 bp, Homo sapiens
ggatcacctgagcct

SEQ ID NO: 118940 - DNA, 15 bp, Homo sapiens
aggatcacctgagcc

SEQ ID NO: 118941 - DNA, 15 bp, Homo sapiens
aaggatcacctgagc

SEQ ID NO: 118942 - DNA, 15 bp, Homo sapiens
gaaggatcacctgag

SEQ ID NO: 118943 - DNA, 15 bp, Homo sapiens
ggaaggatcacctga

SEQ ID NO: 118944 - DNA, 15 bp, Homo sapiens
tggaaggatcacctg

SEQ ID NO: 118945 - DNA, 15 bp, Homo sapiens
gtggaaggatcacct

SEQ ID NO: 118946 - DNA, 15 bp, Homo sapiens
ggtggaaggatcacc

SEQ ID NO: 118947 - DNA, 15 bp, Homo sapiens
aggtggaaggatcac

SEQ ID NO: 118948 - DNA, 15 bp, Homo sapiens
gaggtggaaggatca

SEQ ID NO: 118949 - DNA, 15 bp, Homo sapiens
tgaggtggaaggatc

SEQ ID NO: 118950 - DNA, 15 bp, Homo sapiens
aaggctgaggtggaa

SEQ ID NO: 118951 - DNA, 15 bp, Homo sapiens
caaggctgaggtgga

SEQ ID NO: 118952 - DNA, 15 bp, Homo sapiens
tcaaggctgaggtgg

SEQ ID NO: 118953 - DNA, 15 bp, Homo sapiens
ctcaaggctgaggtg

SEQ ID NO: 118954 - DNA, 15 bp, Homo sapiens
tctcaaggctgaggt

SEQ ID NO: 118955 - DNA, 15 bp, Homo sapiens
ctctcaaggctgagg

SEQ ID NO: 118956 - DNA, 15 bp, Homo sapiens
actctcaaggctgag

SEQ ID NO: 118957 - DNA, 15 bp, Homo sapiens
tactctcaaggctga

SEQ ID NO: 118958 - DNA, 15 bp, Homo sapiens
ctactctcaaggctg

SEQ ID NO: 118959 - DNA, 15 bp, Homo sapiens
gctactctcaaggct

SEQ ID NO: 118960 - DNA, 15 bp, Homo sapiens
agctactctcaaggc

SEQ ID NO: 118961 - DNA, 15 bp, Homo sapiens
cagctactctcaagg

SEQ ID NO: 118962 - DNA, 15 bp, Homo sapiens
ccagctactctcaag

SEQ ID NO: 118963 - DNA, 15 bp, Homo sapiens
cccagctactctcaa

SEQ ID NO: 118964 - DNA, 15 bp, Homo sapiens
tcccagctactctca

SEQ ID NO: 118965 - DNA, 15 bp, Homo sapiens
gtcccagctactctc

SEQ ID NO: 118966 - DNA, 15 bp, Homo sapiens
cgcatgcctgtagtc

SEQ ID NO: 118967 - DNA, 15 bp, Homo sapiens
gcgcatgcctgtagt

SEQ ID NO: 118968 - DNA, 15 bp, Homo sapiens
ggcgcatgcctgtag

SEQ ID NO: 118969 - DNA, 15 bp, Homo sapiens
tggcgcatgcctgta

SEQ ID NO: 118970 - DNA, 15 bp, Homo sapiens
gtggcgcatgcctgt

SEQ ID NO: 118971 - DNA, 15 bp, Homo sapiens
ggtggcgcatgcctg

SEQ ID NO: 118972 - DNA, 15 bp, Homo sapiens
tggtggcgcatgcct

SEQ ID NO: 118973 - DNA, 15 bp, Homo sapiens
gtggtggcgcatgcc

SEQ ID NO: 118974 - DNA, 15 bp, Homo sapiens
tgtggtggcgcatgc

SEQ ID NO: 118975 - DNA, 15 bp, Homo sapiens
gtgtggtggcgcatg

SEQ ID NO: 118976 - DNA, 15 bp, Homo sapiens
ggtgtggtggcgcat

SEQ ID NO: 118977 - DNA, 15 bp, Homo sapiens
gggtgtggtggcgca

SEQ ID NO: 118978 - DNA, 15 bp, Homo sapiens
cgggtgtggtggcgc

SEQ ID NO: 118979 - DNA, 15 bp, Homo sapiens
taaaaaaattagccg

SEQ ID NO: 118980 - DNA, 15 bp, Homo sapiens
ataaaaaaattagcc

SEQ ID NO: 118981 - DNA, 15 bp, Homo sapiens
aataaaaaaattagc

SEQ ID NO: 118982 - DNA, 15 bp, Homo sapiens
aaataaaaaaattag

SEQ ID NO: 118983 - DNA, 15 bp, Homo sapiens
aaaaataaaaaaatt

SEQ ID NO: 118984 - DNA, 15 bp, Homo sapiens
aaaaaataaaaaaat

SEQ ID NO: 118985 - DNA, 15 bp, Homo sapiens
caaaaaataaaaaaa

SEQ ID NO: 118986 - DNA, 15 bp, Homo sapiens
acaaaaaataaaaaa

SEQ ID NO: 118987 - DNA, 15 bp, Homo sapiens
tacaaaaaataaaaa

SEQ ID NO: 118988 - DNA, 15 bp, Homo sapiens
ctacaaaaaataaaa

SEQ ID NO: 118989 - DNA, 15 bp, Homo sapiens
tctacaaaaaataaa

SEQ ID NO: 118990 - DNA, 15 bp, Homo sapiens
ctctacaaaaaataa

SEQ ID NO: 118991 - DNA, 15 bp, Homo sapiens
tctctacaaaaaata

SEQ ID NO: 118992 - DNA, 15 bp, Homo sapiens
ctctctacaaaaaat

SEQ ID NO: 118993 - DNA, 15 bp, Homo sapiens
cctctctacaaaaaa

SEQ ID NO: 118994 - DNA, 15 bp, Homo sapiens
ccctctctacaaaaa

SEQ ID NO: 118995 - DNA, 15 bp, Homo sapiens
cccctctctacaaaa

SEQ ID NO: 118996 - DNA, 15 bp, Homo sapiens
ccccctctctacaaa

SEQ ID NO: 118997 - DNA, 15 bp, Homo sapiens
accccctctctacaa

SEQ ID NO: 118998 - DNA, 15 bp, Homo sapiens
aaccccctctctaca

SEQ ID NO: 118999 - DNA, 15 bp, Homo sapiens
aaaccccctctctac

SEQ ID NO: 119000 - DNA, 15 bp, Homo sapiens
gaaaccccctctcta

SEQ ID NO: 119001 - DNA, 15 bp, Homo sapiens
tgaaaccccctctct

SEQ ID NO: 119002 - DNA, 15 bp, Homo sapiens
gtgaaaccccctctc

SEQ ID NO: 119003 - DNA, 15 bp, Homo sapiens
ggtgaaaccccctct

SEQ ID NO: 119004 - DNA, 15 bp, Homo sapiens
tggtgaaaccccctc

SEQ ID NO: 119005 - DNA, 15 bp, Homo sapiens
acaacatggtgaaac

SEQ ID NO: 119006 - DNA, 15 bp, Homo sapiens
gacaacatggtgaaa

SEQ ID NO: 119007 - DNA, 15 bp, Homo sapiens
ggacaacatggtgaa

SEQ ID NO: 119008 - DNA, 15 bp, Homo sapiens
tggacaacatggtga

SEQ ID NO: 119009 - DNA, 15 bp, Homo sapiens
ctggacaacatggtg

SEQ ID NO: 119010 - DNA, 15 bp, Homo sapiens
cctggacaacatggt

SEQ ID NO: 119011 - DNA, 15 bp, Homo sapiens
gcctggacaacatgg

SEQ ID NO: 119012 - DNA, 15 bp, Homo sapiens
agcctggacaacatg

SEQ ID NO: 119013 - DNA, 15 bp, Homo sapiens
cagcctggacaacat

SEQ ID NO: 119014 - DNA, 15 bp, Homo sapiens
attcaagaccagcct

SEQ ID NO: 119015 - DNA, 15 bp, Homo sapiens
aattcaagaccagcc

SEQ ID NO: 119016 - DNA, 15 bp, Homo sapiens
tcaggaattcaagac

SEQ ID NO: 119017 - DNA, 15 bp, Homo sapiens
ctcaggaattcaaga

SEQ ID NO: 119018 - DNA, 15 bp, Homo sapiens
cctcaggaattcaag

SEQ ID NO: 119019 - DNA, 15 bp, Homo sapiens
acctcaggaattcaa

SEQ ID NO: 119020 - DNA, 15 bp, Homo sapiens
gacctcaggaattca

SEQ ID NO: 119021 - DNA, 15 bp, Homo sapiens
tgacctcaggaattc

SEQ ID NO: 119022 - DNA, 15 bp, Homo sapiens
ttgacctcaggaatt

SEQ ID NO: 119023 - DNA, 15 bp, Homo sapiens
cttgacctcaggaat

SEQ ID NO: 119024 - DNA, 15 bp, Homo sapiens
acttgacctcaggaa

SEQ ID NO: 119025 - DNA, 15 bp, Homo sapiens
cacttgacctcagga

SEQ ID NO: 119026 - DNA, 15 bp, Homo sapiens
tcacttgacctcagg

SEQ ID NO: 119027 - DNA, 15 bp, Homo sapiens
atcacttgacctcag

SEQ ID NO: 119028 - DNA, 15 bp, Homo sapiens
gatcacttgacctca

SEQ ID NO: 119029 - DNA, 15 bp, Homo sapiens
ggatcacttgacctc

SEQ ID NO: 119030 - DNA, 15 bp, Homo sapiens
aggatcacttgacct

SEQ ID NO: 119031 - DNA, 15 bp, Homo sapiens
gaggatcacttgacc

SEQ ID NO: 119032 - DNA, 15 bp, Homo sapiens
ggaggatcacttgac

SEQ ID NO: 119033 - DNA, 15 bp, Homo sapiens
atgggaggatcactt

SEQ ID NO: 119034 - DNA, 15 bp, Homo sapiens
gatgggaggatcact

SEQ ID NO: 119035 - DNA, 15 bp, Homo sapiens
tgatgggaggatcac

SEQ ID NO: 119036 - DNA, 15 bp, Homo sapiens
ctgatgggaggatca

SEQ ID NO: 119037 - DNA, 15 bp, Homo sapiens
cctgatgggaggatc

SEQ ID NO: 119038 - DNA, 15 bp, Homo sapiens
ccctgatgggaggat

SEQ ID NO: 119039 - DNA, 15 bp, Homo sapiens
gccctgatgggagga

SEQ ID NO: 119040 - DNA, 15 bp, Homo sapiens
ggccctgatgggagg

SEQ ID NO: 119041 - DNA, 15 bp, Homo sapiens
aggccctgatgggag

SEQ ID NO: 119042 - DNA, 15 bp, Homo sapiens
gaggccctgatggga

SEQ ID NO: 119043 - DNA, 15 bp, Homo sapiens
ggaggccctgatggg

SEQ ID NO: 119044 - DNA, 15 bp, Homo sapiens
gggaggccctgatgg

SEQ ID NO: 119045 - DNA, 15 bp, Homo sapiens
tgggaggccctgatg

SEQ ID NO: 119046 - DNA, 15 bp, Homo sapiens
ttgggaggccctgat

SEQ ID NO: 119047 - DNA, 15 bp, Homo sapiens
tttgggaggccctga

SEQ ID NO: 119048 - DNA, 15 bp, Homo sapiens
ctttgggaggccctg

SEQ ID NO: 119049 - DNA, 15 bp, Homo sapiens
actttgggaggccct

SEQ ID NO: 119050 - DNA, 15 bp, Homo sapiens
tactttgggaggccc

SEQ ID NO: 119051 - DNA, 15 bp, Homo sapiens
gtactttgggaggcc

SEQ ID NO: 119052 - DNA, 15 bp, Homo sapiens
tccagtactttggga

SEQ ID NO: 119053 - DNA, 15 bp, Homo sapiens
atccagtactttggg

SEQ ID NO: 119054 - DNA, 15 bp, Homo sapiens
aatccagtactttgg

SEQ ID NO: 119055 - DNA, 15 bp, Homo sapiens
taatccagtactttg

SEQ ID NO: 119056 - DNA, 15 bp, Homo sapiens
gtaatccagtacttt

SEQ ID NO: 119057 - DNA, 15 bp, Homo sapiens
tgtaatccagtactt

SEQ ID NO: 119058 - DNA, 15 bp, Homo sapiens
ctgtaatccagtact

SEQ ID NO: 119059 - DNA, 15 bp, Homo sapiens
cctgtaatccagtac

SEQ ID NO: 119060 - DNA, 15 bp, Homo sapiens
taggctgggtgtggt

SEQ ID NO: 119061 - DNA, 15 bp, Homo sapiens
gtaggctgggtgtgg

SEQ ID NO: 119062 - DNA, 15 bp, Homo sapiens
tgtaggctgggtgtg

SEQ ID NO: 119063 - DNA, 15 bp, Homo sapiens
atgtaggctgggtgt

SEQ ID NO: 119064 - DNA, 15 bp, Homo sapiens
aatgtaggctgggtg

SEQ ID NO: 119065 - DNA, 15 bp, Homo sapiens
aaatgtaggctgggt

SEQ ID NO: 119066 - DNA, 15 bp, Homo sapiens
aaaatgtaggctggg

SEQ ID NO: 119067 - DNA, 15 bp, Homo sapiens
gaaaatgtaggctgg

SEQ ID NO: 119068 - DNA, 15 bp, Homo sapiens
agaaaatgtaggctg

SEQ ID NO: 119069 - DNA, 15 bp, Homo sapiens
aagaaaatgtaggct

SEQ ID NO: 119070 - DNA, 15 bp, Homo sapiens
aaagaaaatgtaggc

SEQ ID NO: 119071 - DNA, 15 bp, Homo sapiens
aaaagaaaatgtagg

SEQ ID NO: 119072 - DNA, 15 bp, Homo sapiens
aaaaagaaaatgtag

SEQ ID NO: 119073 - DNA, 15 bp, Homo sapiens
aaaaaagaaaatgta

SEQ ID NO: 119074 - DNA, 15 bp, Homo sapiens
gaaaaaagaaaatgt

SEQ ID NO: 119075 - DNA, 15 bp, Homo sapiens
tgaaaaaagaaaatg

SEQ ID NO: 119076 - DNA, 15 bp, Homo sapiens
ttgaaaaaagaaaat

SEQ ID NO: 119077 - DNA, 15 bp, Homo sapiens
gttgaaaaaagaaaa

SEQ ID NO: 119078 - DNA, 15 bp, Homo sapiens
agttgaaaaaagaaa

SEQ ID NO: 119079 - DNA, 15 bp, Homo sapiens
tagttgaaaaaagaa

SEQ ID NO: 119080 - DNA, 15 bp, Homo sapiens
atagttgaaaaaaga

SEQ ID NO: 119081 - DNA, 15 bp, Homo sapiens
catagttgaaaaaag

SEQ ID NO: 119082 - DNA, 15 bp, Homo sapiens
acatagttgaaaaaa

SEQ ID NO: 119083 - DNA, 15 bp, Homo sapiens
aacatagttgaaaaa

SEQ ID NO: 119084 - DNA, 15 bp, Homo sapiens
aaacatagttgaaaa

SEQ ID NO: 119085 - DNA, 15 bp, Homo sapiens
gaaacatagttgaaa

SEQ ID NO: 119086 - DNA, 15 bp, Homo sapiens
tgaaacatagttgaa

SEQ ID NO: 119087 - DNA, 15 bp, Homo sapiens
atgaaacatagttga

SEQ ID NO: 119088 - DNA, 15 bp, Homo sapiens
tatgaaacatagttg

SEQ ID NO: 119089 - DNA, 15 bp, Homo sapiens
atatgaaacatagtt

SEQ ID NO: 119090 - DNA, 15 bp, Homo sapiens
aatatgaaacatagt

SEQ ID NO: 119091 - DNA, 15 bp, Homo sapiens
taatatgaaacatag

SEQ ID NO: 119092 - DNA, 15 bp, Homo sapiens
ataatatgaaacata

SEQ ID NO: 119093 - DNA, 15 bp, Homo sapiens
tataatatgaaacat

SEQ ID NO: 119094 - DNA, 15 bp, Homo sapiens
ctataatatgaaaca

SEQ ID NO: 119095 - DNA, 15 bp, Homo sapiens
tctataatatgaaac

SEQ ID NO: 119096 - DNA, 15 bp, Homo sapiens
atctataatatgaaa

SEQ ID NO: 119097 - DNA, 15 bp, Homo sapiens
aatctataatatgaa

SEQ ID NO: 119098 - DNA, 15 bp, Homo sapiens
taatctataatatga

SEQ ID NO: 119099 - DNA, 15 bp, Homo sapiens
ttaatctataatatg

SEQ ID NO: 119100 - DNA, 15 bp, Homo sapiens
attaatctataatat

SEQ ID NO: 119101 - DNA, 15 bp, Homo sapiens
cattaatctataata

SEQ ID NO: 119102 - DNA, 15 bp, Homo sapiens
tcattaatctataat

SEQ ID NO: 119103 - DNA, 15 bp, Homo sapiens
atcattaatctataa

SEQ ID NO: 119104 - DNA, 15 bp, Homo sapiens
aatcattaatctata

SEQ ID NO: 119105 - DNA, 15 bp, Homo sapiens
aaatcattaatctat

SEQ ID NO: 119106 - DNA, 15 bp, Homo sapiens
gaaatcattaatcta

SEQ ID NO: 119107 - DNA, 15 bp, Homo sapiens
agaaatcattaatct

SEQ ID NO: 119108 - DNA, 15 bp, Homo sapiens
aagaaatcattaatc

SEQ ID NO: 119109 - DNA, 15 bp, Homo sapiens
aaagaaatcattaat

SEQ ID NO: 119110 - DNA, 15 bp, Homo sapiens
gaaagaaatcattaa

SEQ ID NO: 119111 - DNA, 15 bp, Homo sapiens
agaaagaaatcatta

SEQ ID NO: 119112 - DNA, 15 bp, Homo sapiens
aagaaagaaatcatt

SEQ ID NO: 119113 - DNA, 15 bp, Homo sapiens
aaagaaagaaatcat

SEQ ID NO: 119114 - DNA, 15 bp, Homo sapiens
caaagaaagaaatca

SEQ ID NO: 119115 - DNA, 15 bp, Homo sapiens
acaaagaaagaaatc

SEQ ID NO: 119116 - DNA, 15 bp, Homo sapiens
tacaaagaaagaaat

SEQ ID NO: 119117 - DNA, 15 bp, Homo sapiens
ttacaaagaaagaaa

SEQ ID NO: 119118 - DNA, 15 bp, Homo sapiens
tttacaaagaaagaa

SEQ ID NO: 119119 - DNA, 15 bp, Homo sapiens
ttttacaaagaaaga

SEQ ID NO: 119120 - DNA, 15 bp, Homo sapiens
tttttacaaagaaag

SEQ ID NO: 119121 - DNA, 15 bp, Homo sapiens
gtttttacaaagaaa

SEQ ID NO: 119122 - DNA, 15 bp, Homo sapiens
agtttttacaaagaa

SEQ ID NO: 119123 - DNA, 15 bp, Homo sapiens
aagtttttacaaaga

SEQ ID NO: 119124 - DNA, 15 bp, Homo sapiens
aaagtttttacaaag

SEQ ID NO: 119125 - DNA, 15 bp, Homo sapiens
aaaagtttttacaaa

SEQ ID NO: 119126 - DNA, 15 bp, Homo sapiens
taaaagtttttacaa

SEQ ID NO: 119127 - DNA, 15 bp, Homo sapiens
gtaaaagtttttaca

SEQ ID NO: 119128 - DNA, 15 bp, Homo sapiens
agtaaaagtttttac

SEQ ID NO: 119129 - DNA, 15 bp, Homo sapiens
cagtaaaagttttta

SEQ ID NO: 119130 - DNA, 15 bp, Homo sapiens
acagtaaaagttttt

SEQ ID NO: 119131 - DNA, 15 bp, Homo sapiens
gacagtaaaagtttt

SEQ ID NO: 119132 - DNA, 15 bp, Homo sapiens
agacagtaaaagttt

SEQ ID NO: 119133 - DNA, 15 bp, Homo sapiens
tagacagtaaaagtt

SEQ ID NO: 119134 - DNA, 15 bp, Homo sapiens
ttagacagtaaaagt

SEQ ID NO: 119135 - DNA, 15 bp, Homo sapiens
cttagacagtaaaag

SEQ ID NO: 119136 - DNA, 15 bp, Homo sapiens
gcttagacagtaaaa

SEQ ID NO: 119137 - DNA, 15 bp, Homo sapiens
tgcttagacagtaaa

SEQ ID NO: 119138 - DNA, 15 bp, Homo sapiens
atgcttagacagtaa

SEQ ID NO: 119139 - DNA, 15 bp, Homo sapiens
aatgcttagacagta

SEQ ID NO: 119140 - DNA, 15 bp, Homo sapiens
aaatgcttagacagt

SEQ ID NO: 119141 - DNA, 15 bp, Homo sapiens
aaaatgcttagacag

SEQ ID NO: 119142 - DNA, 15 bp, Homo sapiens
gaaaatgcttagaca

SEQ ID NO: 119143 - DNA, 15 bp, Homo sapiens
ggaaaatgcttagac

SEQ ID NO: 119144 - DNA, 15 bp, Homo sapiens
tggaaaatgcttaga

SEQ ID NO: 119145 - DNA, 15 bp, Homo sapiens
ctggaaaatgcttag

SEQ ID NO: 119146 - DNA, 15 bp, Homo sapiens
actggaaaatgctta

SEQ ID NO: 119147 - DNA, 15 bp, Homo sapiens
aactggaaaatgctt

SEQ ID NO: 119148 - DNA, 15 bp, Homo sapiens
aaactggaaaatgct

SEQ ID NO: 119149 - DNA, 15 bp, Homo sapiens
gaaactggaaaatgc

SEQ ID NO: 119150 - DNA, 15 bp, Homo sapiens
agaaactggaaaatg

SEQ ID NO: 119151 - DNA, 15 bp, Homo sapiens
aagaaactggaaaat

SEQ ID NO: 119152 - DNA, 15 bp, Homo sapiens
aaagaaactggaaaa

SEQ ID NO: 119153 - DNA, 15 bp, Homo sapiens
aaaagaaactggaaa

SEQ ID NO: 119154 - DNA, 15 bp, Homo sapiens
taaaagaaactggaa

SEQ ID NO: 119155 - DNA, 15 bp, Homo sapiens
ataaaagaaactgga

SEQ ID NO: 119156 - DNA, 15 bp, Homo sapiens
gataaaagaaactgg

SEQ ID NO: 119157 - DNA, 15 bp, Homo sapiens
ggataaaagaaactg

SEQ ID NO: 119158 - DNA, 15 bp, Homo sapiens
gggataaaagaaact

SEQ ID NO: 119159 - DNA, 15 bp, Homo sapiens
tgggataaaagaaac

SEQ ID NO: 119160 - DNA, 15 bp, Homo sapiens
gtgggataaaagaaa

SEQ ID NO: 119161 - DNA, 15 bp, Homo sapiens
tgtgggataaaagaa

SEQ ID NO: 119162 - DNA, 15 bp, Homo sapiens
ttgtgggataaaaga

SEQ ID NO: 119163 - DNA, 15 bp, Homo sapiens
tttgtgggataaaag

SEQ ID NO: 119164 - DNA, 15 bp, Homo sapiens
ttttgtgggataaaa

SEQ ID NO: 119165 - DNA, 15 bp, Homo sapiens
attttgtgggataaa

SEQ ID NO: 119166 - DNA, 15 bp, Homo sapiens
tattttgtgggataa

SEQ ID NO: 119167 - DNA, 15 bp, Homo sapiens
atattttgtgggata

SEQ ID NO: 119168 - DNA, 15 bp, Homo sapiens
tatattttgtgggat

SEQ ID NO: 119169 - DNA, 15 bp, Homo sapiens
ttatattttgtggga

SEQ ID NO: 119170 - DNA, 15 bp, Homo sapiens
attatattttgtggg

SEQ ID NO: 119171 - DNA, 15 bp, Homo sapiens
aattatattttgtgg

SEQ ID NO: 119172 - DNA, 15 bp, Homo sapiens
caattatattttgtg

SEQ ID NO: 119173 - DNA, 15 bp, Homo sapiens
gcaattatattttgt

SEQ ID NO: 119174 - DNA, 15 bp, Homo sapiens
agcaattatattttg

SEQ ID NO: 119175 - DNA, 15 bp, Homo sapiens
tagcaattatatttt

SEQ ID NO: 119176 - DNA, 15 bp, Homo sapiens
ttagcaattatattt

SEQ ID NO: 119177 - DNA, 15 bp, Homo sapiens
tttagcaattatatt

SEQ ID NO: 119178 - DNA, 15 bp, Homo sapiens
ctttagcaattatat

SEQ ID NO: 119179 - DNA, 15 bp, Homo sapiens
cctttagcaattata

SEQ ID NO: 119180 - DNA, 15 bp, Homo sapiens
acctttagcaattat

SEQ ID NO: 119181 - DNA, 15 bp, Homo sapiens
aacctttagcaatta

SEQ ID NO: 119182 - DNA, 15 bp, Homo sapiens
taacctttagcaatt

SEQ ID NO: 119183 - DNA, 15 bp, Homo sapiens
ttaacctttagcaat

SEQ ID NO: 119184 - DNA, 15 bp, Homo sapiens
attaacctttagcaa

SEQ ID NO: 119185 - DNA, 15 bp, Homo sapiens
aattaacctttagca

SEQ ID NO: 119186 - DNA, 15 bp, Homo sapiens
aaattaacctttagc

SEQ ID NO: 119187 - DNA, 15 bp, Homo sapiens
gaaattaacctttag

SEQ ID NO: 119188 - DNA, 15 bp, Homo sapiens
tgaaattaaccttta

SEQ ID NO: 119189 - DNA, 15 bp, Homo sapiens
atgaaattaaccttt

SEQ ID NO: 119190 - DNA, 15 bp, Homo sapiens
gatgaaattaacctt

SEQ ID NO: 119191 - DNA, 15 bp, Homo sapiens
tgatgaaattaacct

SEQ ID NO: 119192 - DNA, 15 bp, Homo sapiens
atgatgaaattaacc

SEQ ID NO: 119193 - DNA, 15 bp, Homo sapiens
tatgatgaaattaac

SEQ ID NO: 119194 - DNA, 15 bp, Homo sapiens
ttatgatgaaattaa

SEQ ID NO: 119195 - DNA, 15 bp, Homo sapiens
cttatgatgaaatta

SEQ ID NO: 119196 - DNA, 15 bp, Homo sapiens
acttatgatgaaatt

SEQ ID NO: 119197 - DNA, 15 bp, Homo sapiens
gacttatgatgaaat

SEQ ID NO: 119198 - DNA, 15 bp, Homo sapiens
agacttatgatgaaa

SEQ ID NO: 119199 - DNA, 15 bp, Homo sapiens
gagacttatgatgaa

SEQ ID NO: 119200 - DNA, 15 bp, Homo sapiens
cgagacttatgatga

SEQ ID NO: 119201 - DNA, 15 bp, Homo sapiens
acgagacttatgatg

SEQ ID NO: 119202 - DNA, 15 bp, Homo sapiens
aacgagacttatgat

SEQ ID NO: 119203 - DNA, 15 bp, Homo sapiens
taacgagacttatga

SEQ ID NO: 119204 - DNA, 15 bp, Homo sapiens
gtaacgagacttatg

SEQ ID NO: 119205 - DNA, 15 bp, Homo sapiens
ggtaacgagacttat

SEQ ID NO: 119206 - DNA, 15 bp, Homo sapiens
gggtaacgagactta

SEQ ID NO: 119207 - DNA, 15 bp, Homo sapiens
agggtaacgagactt

SEQ ID NO: 119208 - DNA, 15 bp, Homo sapiens
aagggtaacgagact

SEQ ID NO: 119209 - DNA, 15 bp, Homo sapiens
aaagggtaacgagac

SEQ ID NO: 119210 - DNA, 15 bp, Homo sapiens
aaaagggtaacgaga

SEQ ID NO: 119211 - DNA, 15 bp, Homo sapiens
aaaaagggtaacgag

SEQ ID NO: 119212 - DNA, 15 bp, Homo sapiens
caaaaagggtaacga

SEQ ID NO: 119213 - DNA, 15 bp, Homo sapiens
ccaaaaagggtaacg

SEQ ID NO: 119214 - DNA, 15 bp, Homo sapiens
accaaaaagggtaac

SEQ ID NO: 119215 - DNA, 15 bp, Homo sapiens
gaccaaaaagggtaa

SEQ ID NO: 119216 - DNA, 15 bp, Homo sapiens
tgaccaaaaagggta

SEQ ID NO: 119217 - DNA, 15 bp, Homo sapiens
gtgaccaaaaagggt

SEQ ID NO: 119218 - DNA, 15 bp, Homo sapiens
tgtgaccaaaaaggg

SEQ ID NO: 119219 - DNA, 15 bp, Homo sapiens
gtgtgaccaaaaagg

SEQ ID NO: 119220 - DNA, 15 bp, Homo sapiens
agtgtgaccaaaaag

SEQ ID NO: 119221 - DNA, 15 bp, Homo sapiens
gagtgtgaccaaaaa

SEQ ID NO: 119222 - DNA, 15 bp, Homo sapiens
agagtgtgaccaaaa

SEQ ID NO: 119223 - DNA, 15 bp, Homo sapiens
tagagtgtgaccaaa

SEQ ID NO: 119224 - DNA, 15 bp, Homo sapiens
ttagagtgtgaccaa

SEQ ID NO: 119225 - DNA, 15 bp, Homo sapiens
gttagagtgtgacca

SEQ ID NO: 119226 - DNA, 15 bp, Homo sapiens
agttagagtgtgacc

SEQ ID NO: 119227 - DNA, 15 bp, Homo sapiens
aagttagagtgtgac

SEQ ID NO: 119228 - DNA, 15 bp, Homo sapiens
gaagttagagtgtga

SEQ ID NO: 119229 - DNA, 15 bp, Homo sapiens
agaagttagagtgtg

SEQ ID NO: 119230 - DNA, 15 bp, Homo sapiens
aagaagttagagtgt

SEQ ID NO: 119231 - DNA, 15 bp, Homo sapiens
caagaagttagagtg

SEQ ID NO: 119232 - DNA, 15 bp, Homo sapiens
gcaagaagttagagt

SEQ ID NO: 119233 - DNA, 15 bp, Homo sapiens
ggcaagaagttagag

SEQ ID NO: 119234 - DNA, 15 bp, Homo sapiens
aggcaagaagttaga

SEQ ID NO: 119235 - DNA, 15 bp, Homo sapiens
aaggcaagaagttag

SEQ ID NO: 119236 - DNA, 15 bp, Homo sapiens
taaggcaagaagtta

SEQ ID NO: 119237 - DNA, 15 bp, Homo sapiens
ctaaggcaagaagtt

SEQ ID NO: 119238 - DNA, 15 bp, Homo sapiens
tctaaggcaagaagt

SEQ ID NO: 119239 - DNA, 15 bp, Homo sapiens
atctaaggcaagaag

SEQ ID NO: 119240 - DNA, 15 bp, Homo sapiens
aatctaaggcaagaa

SEQ ID NO: 119241 - DNA, 15 bp, Homo sapiens
taatctaaggcaaga

SEQ ID NO: 119242 - DNA, 15 bp, Homo sapiens
ttaatctaaggcaag

SEQ ID NO: 119243 - DNA, 15 bp, Homo sapiens
gttaatctaaggcaa

SEQ ID NO: 119244 - DNA, 15 bp, Homo sapiens
agttaatctaaggca

SEQ ID NO: 119245 - DNA, 15 bp, Homo sapiens
cagttaatctaaggc

SEQ ID NO: 119246 - DNA, 15 bp, Homo sapiens
acagttaatctaagg

SEQ ID NO: 119247 - DNA, 15 bp, Homo sapiens
aacagttaatctaag

SEQ ID NO: 119248 - DNA, 15 bp, Homo sapiens
aaacagttaatctaa

SEQ ID NO: 119249 - DNA, 15 bp, Homo sapiens
aaaacagttaatcta

SEQ ID NO: 119250 - DNA, 15 bp, Homo sapiens
aaaaacagttaatct

SEQ ID NO: 119251 - DNA, 15 bp, Homo sapiens
gaaaaacagttaatc

SEQ ID NO: 119252 - DNA, 15 bp, Homo sapiens
ggaaaaacagttaat

SEQ ID NO: 119253 - DNA, 15 bp, Homo sapiens
gggaaaaacagttaa

SEQ ID NO: 119254 - DNA, 15 bp, Homo sapiens
tgggaaaaacagtta

SEQ ID NO: 119255 - DNA, 15 bp, Homo sapiens
ctgggaaaaacagtt

SEQ ID NO: 119256 - DNA, 15 bp, Homo sapiens
actgggaaaaacagt

SEQ ID NO: 119257 - DNA, 15 bp, Homo sapiens
gactgggaaaaacag

SEQ ID NO: 119258 - DNA, 15 bp, Homo sapiens
tgactgggaaaaaca

SEQ ID NO: 119259 - DNA, 15 bp, Homo sapiens
atgactgggaaaaac

SEQ ID NO: 119260 - DNA, 15 bp, Homo sapiens
tatgactgggaaaaa

SEQ ID NO: 119261 - DNA, 15 bp, Homo sapiens
ttatgactgggaaaa

SEQ ID NO: 119262 - DNA, 15 bp, Homo sapiens
attatgactgggaaa

SEQ ID NO: 119263 - DNA, 15 bp, Homo sapiens
gattatgactgggaa

SEQ ID NO: 119264 - DNA, 15 bp, Homo sapiens
agattatgactggga

SEQ ID NO: 119265 - DNA, 15 bp, Homo sapiens
cagattatgactggg

SEQ ID NO: 119266 - DNA, 15 bp, Homo sapiens
gcagattatgactgg

SEQ ID NO: 119267 - DNA, 15 bp, Homo sapiens
agcagattatgactg

SEQ ID NO: 119268 - DNA, 15 bp, Homo sapiens
aagcagattatgact

SEQ ID NO: 119269 - DNA, 15 bp, Homo sapiens
taagcagattatgac

SEQ ID NO: 119270 - DNA, 15 bp, Homo sapiens
ttaagcagattatga

SEQ ID NO: 119271 - DNA, 15 bp, Homo sapiens
gttaagcagattatg

SEQ ID NO: 119272 - DNA, 15 bp, Homo sapiens
agttaagcagattat

SEQ ID NO: 119273 - DNA, 15 bp, Homo sapiens
gagttaagcagatta

SEQ ID NO: 119274 - DNA, 15 bp, Homo sapiens
agagttaagcagatt

SEQ ID NO: 119275 - DNA, 15 bp, Homo sapiens
aagagttaagcagat

SEQ ID NO: 119276 - DNA, 15 bp, Homo sapiens
caagagttaagcaga

SEQ ID NO: 119277 - DNA, 15 bp, Homo sapiens
gcaagagttaagcag

SEQ ID NO: 119278 - DNA, 15 bp, Homo sapiens
agcaagagttaagca

SEQ ID NO: 119279 - DNA, 15 bp, Homo sapiens
aagcaagagttaagc

SEQ ID NO: 119280 - DNA, 15 bp, Homo sapiens
gaagcaagagttaag

SEQ ID NO: 119281 - DNA, 15 bp, Homo sapiens
agaagcaagagttaa

SEQ ID NO: 119282 - DNA, 15 bp, Homo sapiens
cagaagcaagagtta

SEQ ID NO: 119283 - DNA, 15 bp, Homo sapiens
acagaagcaagagtt

SEQ ID NO: 119284 - DNA, 15 bp, Homo sapiens
aacagaagcaagagt

SEQ ID NO: 119285 - DNA, 15 bp, Homo sapiens
aaacagaagcaagag

SEQ ID NO: 119286 - DNA, 15 bp, Homo sapiens
aaaacagaagcaaga

SEQ ID NO: 119287 - DNA, 15 bp, Homo sapiens
gaaaacagaagcaag

SEQ ID NO: 119288 - DNA, 15 bp, Homo sapiens
tgaaaacagaagcaa

SEQ ID NO: 119289 - DNA, 15 bp, Homo sapiens
ttgaaaacagaagca

SEQ ID NO: 119290 - DNA, 15 bp, Homo sapiens
tttgaaaacagaagc

SEQ ID NO: 119291 - DNA, 15 bp, Homo sapiens
atttgaaaacagaag

SEQ ID NO: 119292 - DNA, 15 bp, Homo sapiens
gatttgaaaacagaa

SEQ ID NO: 119293 - DNA, 15 bp, Homo sapiens
agatttgaaaacaga

SEQ ID NO: 119294 - DNA, 15 bp, Homo sapiens
cagatttgaaaacag

SEQ ID NO: 119295 - DNA, 15 bp, Homo sapiens
acagatttgaaaaca

SEQ ID NO: 119296 - DNA, 15 bp, Homo sapiens
aacagatttgaaaac

SEQ ID NO: 119297 - DNA, 15 bp, Homo sapiens
cagaacagatttgaa

SEQ ID NO: 119298 - DNA, 15 bp, Homo sapiens
acagaacagatttga

SEQ ID NO: 119299 - DNA, 15 bp, Homo sapiens
gacagaacagatttg

SEQ ID NO: 119300 - DNA, 15 bp, Homo sapiens
ttgacagaacagatt

SEQ ID NO: 119301 - DNA, 15 bp, Homo sapiens
cttgacagaacagat

SEQ ID NO: 119302 - DNA, 15 bp, Homo sapiens
gcttgacagaacaga

SEQ ID NO: 119303 - DNA, 15 bp, Homo sapiens
tgcttgacagaacag

SEQ ID NO: 119304 - DNA, 15 bp, Homo sapiens
gtgcttgacagaaca

SEQ ID NO: 119305 - DNA, 15 bp, Homo sapiens
tgtgcttgacagaac

SEQ ID NO: 119306 - DNA, 15 bp, Homo sapiens
atgtgcttgacagaa

SEQ ID NO: 119307 - DNA, 15 bp, Homo sapiens
aatgtgcttgacaga

SEQ ID NO: 119308 - DNA, 15 bp, Homo sapiens
aaatgtgcttgacag

SEQ ID NO: 119309 - DNA, 15 bp, Homo sapiens
gaaatgtgcttgaca

SEQ ID NO: 119310 - DNA, 15 bp, Homo sapiens
tgaaatgtgcttgac

SEQ ID NO: 119311 - DNA, 15 bp, Homo sapiens
atgaaatgtgcttga

SEQ ID NO: 119312 - DNA, 15 bp, Homo sapiens
catgaaatgtgcttg

SEQ ID NO: 119313 - DNA, 15 bp, Homo sapiens
acatgaaatgtgctt

SEQ ID NO: 119314 - DNA, 15 bp, Homo sapiens
gacatgaaatgtgct

SEQ ID NO: 119315 - DNA, 15 bp, Homo sapiens
ggacatgaaatgtgc

SEQ ID NO: 119316 - DNA, 15 bp, Homo sapiens
aggacatgaaatgtg

SEQ ID NO: 119317 - DNA, 15 bp, Homo sapiens
caggacatgaaatgt

SEQ ID NO: 119318 - DNA, 15 bp, Homo sapiens
gcaggacatgaaatg

SEQ ID NO: 119319 - DNA, 15 bp, Homo sapiens
agcaggacatgaaat

SEQ ID NO: 119320 - DNA, 15 bp, Homo sapiens
aagcaggacatgaaa

SEQ ID NO: 119321 - DNA, 15 bp, Homo sapiens
gaagcaggacatgaa

SEQ ID NO: 119322 - DNA, 15 bp, Homo sapiens
tgaagcaggacatga

SEQ ID NO: 119323 - DNA, 15 bp, Homo sapiens
ctgaagcaggacatg

SEQ ID NO: 119324 - DNA, 15 bp, Homo sapiens
actgaagcaggacat

SEQ ID NO: 119325 - DNA, 15 bp, Homo sapiens
tactgaagcaggaca

SEQ ID NO: 119326 - DNA, 15 bp, Homo sapiens
gtactgaagcaggac

SEQ ID NO: 119327 - DNA, 15 bp, Homo sapiens
tgtactgaagcagga

SEQ ID NO: 119328 - DNA, 15 bp, Homo sapiens
atgtactgaagcagg

SEQ ID NO: 119329 - DNA, 15 bp, Homo sapiens
gatgtactgaagcag

SEQ ID NO: 119330 - DNA, 15 bp, Homo sapiens
agatgtactgaagca

SEQ ID NO: 119331 - DNA, 15 bp, Homo sapiens
aagatgtactgaagc

SEQ ID NO: 119332 - DNA, 15 bp, Homo sapiens
caagatgtactgaag

SEQ ID NO: 119333 - DNA, 15 bp, Homo sapiens
gcaagatgtactgaa

SEQ ID NO: 119334 - DNA, 15 bp, Homo sapiens
agcaagatgtactga

SEQ ID NO: 119335 - DNA, 15 bp, Homo sapiens
cagcaagatgtactg

SEQ ID NO: 119336 - DNA, 15 bp, Homo sapiens
acagcaagatgtact

SEQ ID NO: 119337 - DNA, 15 bp, Homo sapiens
cacagcaagatgtac

SEQ ID NO: 119338 - DNA, 15 bp, Homo sapiens
ccacagcaagatgta

SEQ ID NO: 119339 - DNA, 15 bp, Homo sapiens
accacagcaagatgt

SEQ ID NO: 119340 - DNA, 15 bp, Homo sapiens
gaccacagcaagatg

SEQ ID NO: 119341 - DNA, 15 bp, Homo sapiens
agaccacagcaagat

SEQ ID NO: 119342 - DNA, 15 bp, Homo sapiens
cagaccacagcaaga

SEQ ID NO: 119343 - DNA, 15 bp, Homo sapiens
acagaccacagcaag

SEQ ID NO: 119344 - DNA, 15 bp, Homo sapiens
cacagaccacagcaa

SEQ ID NO: 119345 - DNA, 15 bp, Homo sapiens
gcacagaccacagca

SEQ ID NO: 119346 - DNA, 15 bp, Homo sapiens
ggcacagaccacagc

SEQ ID NO: 119347 - DNA, 15 bp, Homo sapiens
tggcacagaccacag

SEQ ID NO: 119348 - DNA, 15 bp, Homo sapiens
ctggcacagaccaca

SEQ ID NO: 119349 - DNA, 15 bp, Homo sapiens
tctggcacagaccac

SEQ ID NO: 119350 - DNA, 15 bp, Homo sapiens
atctggcacagacca

SEQ ID NO: 119351 - DNA, 15 bp, Homo sapiens
catctggcacagacc

SEQ ID NO: 119352 - DNA, 15 bp, Homo sapiens
acatctggcacagac

SEQ ID NO: 119353 - DNA, 15 bp, Homo sapiens
tacatctggcacaga

SEQ ID NO: 119354 - DNA, 15 bp, Homo sapiens
ttacatctggcacag

SEQ ID NO: 119355 - DNA, 15 bp, Homo sapiens
attacatctggcaca

SEQ ID NO: 119356 - DNA, 15 bp, Homo sapiens
tattacatctggcac

SEQ ID NO: 119357 - DNA, 15 bp, Homo sapiens
atattacatctggca

SEQ ID NO: 119358 - DNA, 15 bp, Homo sapiens
aatattacatctggc

SEQ ID NO: 119359 - DNA, 15 bp, Homo sapiens
taatattacatctgg

SEQ ID NO: 119360 - DNA, 15 bp, Homo sapiens
ttaatattacatctg

SEQ ID NO: 119361 - DNA, 15 bp, Homo sapiens
cttaatattacatct

SEQ ID NO: 119362 - DNA, 15 bp, Homo sapiens
ccttaatattacatc

SEQ ID NO: 119363 - DNA, 15 bp, Homo sapiens
cccttaatattacat

SEQ ID NO: 119364 - DNA, 15 bp, Homo sapiens
gcccttaatattaca

SEQ ID NO: 119365 - DNA, 15 bp, Homo sapiens
agcccttaatattac

SEQ ID NO: 119366 - DNA, 15 bp, Homo sapiens
cagcccttaatatta

SEQ ID NO: 119367 - DNA, 15 bp, Homo sapiens
ccagcccttaatatt

SEQ ID NO: 119368 - DNA, 15 bp, Homo sapiens
accagcccttaatat

SEQ ID NO: 119369 - DNA, 15 bp, Homo sapiens
caccagcccttaata

SEQ ID NO: 119370 - DNA, 15 bp, Homo sapiens
tcaccagcccttaat

SEQ ID NO: 119371 - DNA, 15 bp, Homo sapiens
atcaccagcccttaa

SEQ ID NO: 119372 - DNA, 15 bp, Homo sapiens
tatcaccagccctta

SEQ ID NO: 119373 - DNA, 15 bp, Homo sapiens
gtatcaccagccctt

SEQ ID NO: 119374 - DNA, 15 bp, Homo sapiens
agtatcaccagccct

SEQ ID NO: 119375 - DNA, 15 bp, Homo sapiens
cagtatcaccagccc

SEQ ID NO: 119376 - DNA, 15 bp, Homo sapiens
tcagtatcaccagcc

SEQ ID NO: 119377 - DNA, 15 bp, Homo sapiens
ctcagtatcaccagc

SEQ ID NO: 119378 - DNA, 15 bp, Homo sapiens
cctcagtatcaccag

SEQ ID NO: 119379 - DNA, 15 bp, Homo sapiens
acctcagtatcacca

SEQ ID NO: 119380 - DNA, 15 bp, Homo sapiens
tacctcagtatcacc

SEQ ID NO: 119381 - DNA, 15 bp, Homo sapiens
ttacctcagtatcac

SEQ ID NO: 119382 - DNA, 15 bp, Homo sapiens
cttacctcagtatca

SEQ ID NO: 119383 - DNA, 15 bp, Homo sapiens
ccttacctcagtatc

SEQ ID NO: 119384 - DNA, 15 bp, Homo sapiens
tccttacctcagtat

SEQ ID NO: 119385 - DNA, 15 bp, Homo sapiens
atccttacctcagta

SEQ ID NO: 119386 - DNA, 15 bp, Homo sapiens
tatccttacctcagt

SEQ ID NO: 119387 - DNA, 15 bp, Homo sapiens
gtatccttacctcag

SEQ ID NO: 119388 - DNA, 15 bp, Homo sapiens
tgtatccttacctca

SEQ ID NO: 119389 - DNA, 15 bp, Homo sapiens
ttgtatccttacctc

SEQ ID NO: 119390 - DNA, 15 bp, Homo sapiens
tttgtatccttacct

SEQ ID NO: 119391 - DNA, 15 bp, Homo sapiens
ctttgtatccttacc

SEQ ID NO: 119392 - DNA, 15 bp, Homo sapiens
cctttgtatccttac

SEQ ID NO: 119393 - DNA, 15 bp, Homo sapiens
gcctttgtatcctta

SEQ ID NO: 119394 - DNA, 15 bp, Homo sapiens
tgcctttgtatcctt

SEQ ID NO: 119395 - DNA, 15 bp, Homo sapiens
gtgcctttgtatcct

SEQ ID NO: 119396 - DNA, 15 bp, Homo sapiens
agtgcctttgtatcc

SEQ ID NO: 119397 - DNA, 15 bp, Homo sapiens
cagtgcctttgtatc

SEQ ID NO: 119398 - DNA, 15 bp, Homo sapiens
acagtgcctttgtat

SEQ ID NO: 119399 - DNA, 15 bp, Homo sapiens
gacagtgcctttgta

SEQ ID NO: 119400 - DNA, 15 bp, Homo sapiens
ggacagtgcctttgt

SEQ ID NO: 119401 - DNA, 15 bp, Homo sapiens
aggacagtgcctttg

SEQ ID NO: 119402 - DNA, 15 bp, Homo sapiens
aaggacagtgccttt

SEQ ID NO: 119403 - DNA, 15 bp, Homo sapiens
aaaggacagtgcctt

SEQ ID NO: 119404 - DNA, 15 bp, Homo sapiens
caaaggacagtgcct

SEQ ID NO: 119405 - DNA, 15 bp, Homo sapiens
tcaaaggacagtgcc

SEQ ID NO: 119406 - DNA, 15 bp, Homo sapiens
ctcaaaggacagtgc

SEQ ID NO: 119407 - DNA, 15 bp, Homo sapiens
gctcaaaggacagtg

SEQ ID NO: 119408 - DNA, 15 bp, Homo sapiens
tgctcaaaggacagt

SEQ ID NO: 119409 - DNA, 15 bp, Homo sapiens
ctgctcaaaggacag

SEQ ID NO: 119410 - DNA, 15 bp, Homo sapiens
tctgctcaaaggaca

SEQ ID NO: 119411 - DNA, 15 bp, Homo sapiens
ctctgctcaaaggac

SEQ ID NO: 119412 - DNA, 15 bp, Homo sapiens
gctctgctcaaagga

SEQ ID NO: 119413 - DNA, 15 bp, Homo sapiens
tgctctgctcaaagg

SEQ ID NO: 119414 - DNA, 15 bp, Homo sapiens
atgctctgctcaaag

SEQ ID NO: 119415 - DNA, 15 bp, Homo sapiens
tatgctctgctcaaa

SEQ ID NO: 119416 - DNA, 15 bp, Homo sapiens
gtatgctctgctcaa

SEQ ID NO: 119417 - DNA, 15 bp, Homo sapiens
tgtatgctctgctca

SEQ ID NO: 119418 - DNA, 15 bp, Homo sapiens
ctgtatgctctgctc

SEQ ID NO: 119419 - DNA, 15 bp, Homo sapiens
tctgtatgctctgct

SEQ ID NO: 119420 - DNA, 15 bp, Homo sapiens
ttctgtatgctctgc

SEQ ID NO: 119421 - DNA, 15 bp, Homo sapiens
attctgtatgctctg

SEQ ID NO: 119422 - DNA, 15 bp, Homo sapiens
gattctgtatgctct

SEQ ID NO: 119423 - DNA, 15 bp, Homo sapiens
agattctgtatgctc

SEQ ID NO: 119424 - DNA, 15 bp, Homo sapiens
aagattctgtatgct

SEQ ID NO: 119425 - DNA, 15 bp, Homo sapiens
aaagattctgtatgc

SEQ ID NO: 119426 - DNA, 15 bp, Homo sapiens
aaaagattctgtatg

SEQ ID NO: 119427 - DNA, 15 bp, Homo sapiens
aaaaagattctgtat

SEQ ID NO: 119428 - DNA, 15 bp, Homo sapiens
gaaaaagattctgta

SEQ ID NO: 119429 - DNA, 15 bp, Homo sapiens
tgaaaaagattctgt

SEQ ID NO: 119430 - DNA, 15 bp, Homo sapiens
ttgaaaaagattctg

SEQ ID NO: 119431 - DNA, 15 bp, Homo sapiens
attgaaaaagattct

SEQ ID NO: 119432 - DNA, 15 bp, Homo sapiens
tgaattgaaaaagat

SEQ ID NO: 119433 - DNA, 15 bp, Homo sapiens
atgaattgaaaaaga

SEQ ID NO: 119434 - DNA, 15 bp, Homo sapiens
tatgaattgaaaaag

SEQ ID NO: 119435 - DNA, 15 bp, Homo sapiens
atatgaattgaaaaa

SEQ ID NO: 119436 - DNA, 15 bp, Homo sapiens
aatatgaattgaaaa

SEQ ID NO: 119437 - DNA, 15 bp, Homo sapiens
aaatatgaattgaaa

SEQ ID NO: 119438 - DNA, 15 bp, Homo sapiens
aaaatatgaattgaa

SEQ ID NO: 119439 - DNA, 15 bp, Homo sapiens
gaaaatatgaattga

SEQ ID NO: 119440 - DNA, 15 bp, Homo sapiens
tgaaaatatgaattg

SEQ ID NO: 119441 - DNA, 15 bp, Homo sapiens
atgaaaatatgaatt

SEQ ID NO: 119442 - DNA, 15 bp, Homo sapiens
gatgaaaatatgaat

SEQ ID NO: 119443 - DNA, 15 bp, Homo sapiens
tgatgaaaatatgaa

SEQ ID NO: 119444 - DNA, 15 bp, Homo sapiens
atgatgaaaatatga

SEQ ID NO: 119445 - DNA, 15 bp, Homo sapiens
aatgatgaaaatatg

SEQ ID NO: 119446 - DNA, 15 bp, Homo sapiens
aaatgatgaaaatat

SEQ ID NO: 119447 - DNA, 15 bp, Homo sapiens
aaaatgatgaaaata

SEQ ID NO: 119448 - DNA, 15 bp, Homo sapiens
taaaatgatgaaaat

SEQ ID NO: 119449 - DNA, 15 bp, Homo sapiens
ttaaaatgatgaaaa

SEQ ID NO: 119450 - DNA, 15 bp, Homo sapiens
tttaaaatgatgaaa

SEQ ID NO: 119451 - DNA, 15 bp, Homo sapiens
ttttaaaatgatgaa

SEQ ID NO: 119452 - DNA, 15 bp, Homo sapiens
tttttaaaatgatga

SEQ ID NO: 119453 - DNA, 15 bp, Homo sapiens
ttttttaaaatgatg

SEQ ID NO: 119454 - DNA, 15 bp, Homo sapiens
attttttaaaatgat

SEQ ID NO: 119455 - DNA, 15 bp, Homo sapiens
aattttttaaaatga

SEQ ID NO: 119456 - DNA, 15 bp, Homo sapiens
taattttttaaaatg

SEQ ID NO: 119457 - DNA, 15 bp, Homo sapiens
ataattttttaaaat

SEQ ID NO: 119458 - DNA, 15 bp, Homo sapiens
aataattttttaaaa

SEQ ID NO: 119459 - DNA, 15 bp, Homo sapiens
gaataattttttaaa

SEQ ID NO: 119460 - DNA, 15 bp, Homo sapiens
ggaataattttttaa

SEQ ID NO: 119461 - DNA, 15 bp, Homo sapiens
aggaataatttttta

SEQ ID NO: 119462 - DNA, 15 bp, Homo sapiens
aaggaataatttttt

SEQ ID NO: 119463 - DNA, 15 bp, Homo sapiens
taaggaataattttt

SEQ ID NO: 119464 - DNA, 15 bp, Homo sapiens
ttaaggaataatttt

SEQ ID NO: 119465 - DNA, 15 bp, Homo sapiens
tttaaggaataattt

SEQ ID NO: 119466 - DNA, 15 bp, Homo sapiens
atttaaggaataatt

SEQ ID NO: 119467 - DNA, 15 bp, Homo sapiens
catttaaggaataat

SEQ ID NO: 119468 - DNA, 15 bp, Homo sapiens
tcatttaaggaataa

SEQ ID NO: 119469 - DNA, 15 bp, Homo sapiens
ctcatttaaggaata

SEQ ID NO: 119470 - DNA, 15 bp, Homo sapiens
actcatttaaggaat

SEQ ID NO: 119471 - DNA, 15 bp, Homo sapiens
aactcatttaaggaa

SEQ ID NO: 119472 - DNA, 15 bp, Homo sapiens
aaactcatttaagga

SEQ ID NO: 119473 - DNA, 15 bp, Homo sapiens
aaaactcatttaagg

SEQ ID NO: 119474 - DNA, 15 bp, Homo sapiens
aaaaactcatttaag

SEQ ID NO: 119475 - DNA, 15 bp, Homo sapiens
aaaaaactcatttaa

SEQ ID NO: 119476 - DNA, 15 bp, Homo sapiens
taaaaaactcattta

SEQ ID NO: 119477 - DNA, 15 bp, Homo sapiens
ttaaaaaactcattt

SEQ ID NO: 119478 - DNA, 15 bp, Homo sapiens
tttaaaaaactcatt

SEQ ID NO: 119479 - DNA, 15 bp, Homo sapiens
ttttaaaaaactcat

SEQ ID NO: 119480 - DNA, 15 bp, Homo sapiens
tttttaaaaaactca

SEQ ID NO: 119481 - DNA, 15 bp, Homo sapiens
atttttaaaaaactc

SEQ ID NO: 119482 - DNA, 15 bp, Homo sapiens
tatttttaaaaaact

SEQ ID NO: 119483 - DNA, 15 bp, Homo sapiens
atatttttaaaaaac

SEQ ID NO: 119484 - DNA, 15 bp, Homo sapiens
catatttttaaaaaa

SEQ ID NO: 119485 - DNA, 15 bp, Homo sapiens
ccatatttttaaaaa

SEQ ID NO: 119486 - DNA, 15 bp, Homo sapiens
cccatatttttaaaa

SEQ ID NO: 119487 - DNA, 15 bp, Homo sapiens
gcccatatttttaaa

SEQ ID NO: 119488 - DNA, 15 bp, Homo sapiens
ggcccatatttttaa

SEQ ID NO: 119489 - DNA, 15 bp, Homo sapiens
tggcccatattttta

SEQ ID NO: 119490 - DNA, 15 bp, Homo sapiens
ctggcccatattttt

SEQ ID NO: 119491 - DNA, 15 bp, Homo sapiens
cctggcccatatttt

SEQ ID NO: 119492 - DNA, 15 bp, Homo sapiens
acctggcccatattt

SEQ ID NO: 119493 - DNA, 15 bp, Homo sapiens
cacctggcccatatt

SEQ ID NO: 119494 - DNA, 15 bp, Homo sapiens
acacctggcccatat

SEQ ID NO: 119495 - DNA, 15 bp, Homo sapiens
cacacctggcccata

SEQ ID NO: 119496 - DNA, 15 bp, Homo sapiens
ccacacctggcccat

SEQ ID NO: 119497 - DNA, 15 bp, Homo sapiens
accacacctggccca

SEQ ID NO: 119498 - DNA, 15 bp, Homo sapiens
caccacacctggccc

SEQ ID NO: 119499 - DNA, 15 bp, Homo sapiens
ccaccacacctggcc

SEQ ID NO: 119500 - DNA, 15 bp, Homo sapiens
gccaccacacctggc

SEQ ID NO: 119501 - DNA, 15 bp, Homo sapiens
cgccaccacacctgg

SEQ ID NO: 119502 - DNA, 15 bp, Homo sapiens
gcgccaccacacctg

SEQ ID NO: 119503 - DNA, 15 bp, Homo sapiens
tgcgccaccacacct

SEQ ID NO: 119504 - DNA, 15 bp, Homo sapiens
gtgcgccaccacacc

SEQ ID NO: 119505 - DNA, 15 bp, Homo sapiens
tgtgcgccaccacac

SEQ ID NO: 119506 - DNA, 15 bp, Homo sapiens
gtgtgcgccaccaca

SEQ ID NO: 119507 - DNA, 15 bp, Homo sapiens
ggtgtgcgccaccac

SEQ ID NO: 119508 - DNA, 15 bp, Homo sapiens
aggtgtgcgccacca

SEQ ID NO: 119509 - DNA, 15 bp, Homo sapiens
caggtgtgcgccacc

SEQ ID NO: 119510 - DNA, 15 bp, Homo sapiens
acaggtgtgcgccac

SEQ ID NO: 119511 - DNA, 15 bp, Homo sapiens
tacaggtgtgcgcca

SEQ ID NO: 119512 - DNA, 15 bp, Homo sapiens
ttacaggtgtgcgcc

SEQ ID NO: 119513 - DNA, 15 bp, Homo sapiens
attacaggtgtgcgc

SEQ ID NO: 119514 - DNA, 15 bp, Homo sapiens
gattacaggtgtgcg

SEQ ID NO: 119515 - DNA, 15 bp, Homo sapiens
ggattacaggtgtgc

SEQ ID NO: 119516 - DNA, 15 bp, Homo sapiens
tcctcagcctcccaa

SEQ ID NO: 119517 - DNA, 15 bp, Homo sapiens
ttcctcagcctccca

SEQ ID NO: 119518 - DNA, 15 bp, Homo sapiens
cttcctcagcctccc

SEQ ID NO: 119519 - DNA, 15 bp, Homo sapiens
ccttcctcagcctcc

SEQ ID NO: 119520 - DNA, 15 bp, Homo sapiens
accttcctcagcctc

SEQ ID NO: 119521 - DNA, 15 bp, Homo sapiens
caccttcctcagcct

SEQ ID NO: 119522 - DNA, 15 bp, Homo sapiens
ccaccttcctcagcc

SEQ ID NO: 119523 - DNA, 15 bp, Homo sapiens
tccaccttcctcagc

SEQ ID NO: 119524 - DNA, 15 bp, Homo sapiens
atccaccttcctcag

SEQ ID NO: 119525 - DNA, 15 bp, Homo sapiens
gatccaccttcctca

SEQ ID NO: 119526 - DNA, 15 bp, Homo sapiens
tgatccaccttcctc

SEQ ID NO: 119527 - DNA, 15 bp, Homo sapiens
gtgatccaccttcct

SEQ ID NO: 119528 - DNA, 15 bp, Homo sapiens
tgtgatccaccttcc

SEQ ID NO: 119529 - DNA, 15 bp, Homo sapiens
ttgtgatccaccttc

SEQ ID NO: 119530 - DNA, 15 bp, Homo sapiens
cttgtgatccacctt

SEQ ID NO: 119531 - DNA, 15 bp, Homo sapiens
ccttgtgatccacct

SEQ ID NO: 119532 - DNA, 15 bp, Homo sapiens
accttgtgatccacc

SEQ ID NO: 119533 - DNA, 15 bp, Homo sapiens
gaccttgtgatccac

SEQ ID NO: 119534 - DNA, 15 bp, Homo sapiens
tgaccttgtgatcca

SEQ ID NO: 119535 - DNA, 15 bp, Homo sapiens
tgatctcttgacctt

SEQ ID NO: 119536 - DNA, 15 bp, Homo sapiens
agtcttgatctcttg

SEQ ID NO: 119537 - DNA, 15 bp, Homo sapiens
aagtcttgatctctt

SEQ ID NO: 119538 - DNA, 15 bp, Homo sapiens
gaagtcttgatctct

SEQ ID NO: 119539 - DNA, 15 bp, Homo sapiens
ggaagtcttgatctc

SEQ ID NO: 119540 - DNA, 15 bp, Homo sapiens
aggaagtcttgatct

SEQ ID NO: 119541 - DNA, 15 bp, Homo sapiens
caggaagtcttgatc

SEQ ID NO: 119542 - DNA, 15 bp, Homo sapiens
ccaggaagtcttgat

SEQ ID NO: 119543 - DNA, 15 bp, Homo sapiens
gccaggaagtcttga

SEQ ID NO: 119544 - DNA, 15 bp, Homo sapiens
ggccaggaagtcttg

SEQ ID NO: 119545 - DNA, 15 bp, Homo sapiens
tggccaggaagtctt

SEQ ID NO: 119546 - DNA, 15 bp, Homo sapiens
ttggccaggaagtct

SEQ ID NO: 119547 - DNA, 15 bp, Homo sapiens
gttggccaggaagtc

SEQ ID NO: 119548 - DNA, 15 bp, Homo sapiens
tgttggccaggaagt

SEQ ID NO: 119549 - DNA, 15 bp, Homo sapiens
atgttggccaggaag

SEQ ID NO: 119550 - DNA, 15 bp, Homo sapiens
catgttggccaggaa

SEQ ID NO: 119551 - DNA, 15 bp, Homo sapiens
cggggtttcaccatg

SEQ ID NO: 119552 - DNA, 15 bp, Homo sapiens
atacccagctaattt

SEQ ID NO: 119553 - DNA, 15 bp, Homo sapiens
catacccagctaatt

SEQ ID NO: 119554 - DNA, 15 bp, Homo sapiens
ccatacccagctaat

SEQ ID NO: 119555 - DNA, 15 bp, Homo sapiens
accatacccagctaa

SEQ ID NO: 119556 - DNA, 15 bp, Homo sapiens
caccatacccagcta

SEQ ID NO: 119557 - DNA, 15 bp, Homo sapiens
ccaccatacccagct

SEQ ID NO: 119558 - DNA, 15 bp, Homo sapiens
accaccatacccagc

SEQ ID NO: 119559 - DNA, 15 bp, Homo sapiens
caccaccatacccag

SEQ ID NO: 119560 - DNA, 15 bp, Homo sapiens
gcaccaccataccca

SEQ ID NO: 119561 - DNA, 15 bp, Homo sapiens
tgcaccaccataccc

SEQ ID NO: 119562 - DNA, 15 bp, Homo sapiens
ttgcaccaccatacc

SEQ ID NO: 119563 - DNA, 15 bp, Homo sapiens
cttgcaccaccatac

SEQ ID NO: 119564 - DNA, 15 bp, Homo sapiens
gcttgcaccaccata

SEQ ID NO: 119565 - DNA, 15 bp, Homo sapiens
ggcttgcaccaccat

SEQ ID NO: 119566 - DNA, 15 bp, Homo sapiens
aggcttgcaccacca

SEQ ID NO: 119567 - DNA, 15 bp, Homo sapiens
caggcttgcaccacc

SEQ ID NO: 119568 - DNA, 15 bp, Homo sapiens
gcaggcttgcaccac

SEQ ID NO: 119569 - DNA, 15 bp, Homo sapiens
tgcaggcttgcacca

SEQ ID NO: 119570 - DNA, 15 bp, Homo sapiens
ctgcaggcttgcacc

SEQ ID NO: 119571 - DNA, 15 bp, Homo sapiens
actgcaggcttgcac

SEQ ID NO: 119572 - DNA, 15 bp, Homo sapiens
gactgcaggcttgca

SEQ ID NO: 119573 - DNA, 15 bp, Homo sapiens
ggactgcaggcttgc

SEQ ID NO: 119574 - DNA, 15 bp, Homo sapiens
gggactgcaggcttg

SEQ ID NO: 119575 - DNA, 15 bp, Homo sapiens
tgggactgcaggctt

SEQ ID NO: 119576 - DNA, 15 bp, Homo sapiens
ctgggactgcaggct

SEQ ID NO: 119577 - DNA, 15 bp, Homo sapiens
gctgggactgcaggc

SEQ ID NO: 119578 - DNA, 15 bp, Homo sapiens
agctgggactgcagg

SEQ ID NO: 119579 - DNA, 15 bp, Homo sapiens
tagctgggactgcag

SEQ ID NO: 119580 - DNA, 15 bp, Homo sapiens
tggcacaatctcagc

SEQ ID NO: 119581 - DNA, 15 bp, Homo sapiens
gagtggcacaatctc

SEQ ID NO: 119582 - DNA, 15 bp, Homo sapiens
agagtggcacaatct

SEQ ID NO: 119583 - DNA, 15 bp, Homo sapiens
tagagtggcacaatc

SEQ ID NO: 119584 - DNA, 15 bp, Homo sapiens
gtagagtggcacaat

SEQ ID NO: 119585 - DNA, 15 bp, Homo sapiens
agtagagtggcacaa

SEQ ID NO: 119586 - DNA, 15 bp, Homo sapiens
gagtagagtggcaca

SEQ ID NO: 119587 - DNA, 15 bp, Homo sapiens
ggagtagagtggcac

SEQ ID NO: 119588 - DNA, 15 bp, Homo sapiens
tggagtagagtggca

SEQ ID NO: 119589 - DNA, 15 bp, Homo sapiens
ctggagtagagtggc

SEQ ID NO: 119590 - DNA, 15 bp, Homo sapiens
cctggagtagagtgg

SEQ ID NO: 119591 - DNA, 15 bp, Homo sapiens
gcctggagtagagtg

SEQ ID NO: 119592 - DNA, 15 bp, Homo sapiens
agcctggagtagagt

SEQ ID NO: 119593 - DNA, 15 bp, Homo sapiens
cagcctggagtagag

SEQ ID NO: 119594 - DNA, 15 bp, Homo sapiens
ccagcctggagtaga

SEQ ID NO: 119595 - DNA, 15 bp, Homo sapiens
accagcctggagtag

SEQ ID NO: 119596 - DNA, 15 bp, Homo sapiens
caccagcctggagta

SEQ ID NO: 119597 - DNA, 15 bp, Homo sapiens
tcaccagcctggagt

SEQ ID NO: 119598 - DNA, 15 bp, Homo sapiens
gtcaccagcctggag

SEQ ID NO: 119599 - DNA, 15 bp, Homo sapiens
tgtcaccagcctgga

SEQ ID NO: 119600 - DNA, 15 bp, Homo sapiens
ctgtcaccagcctgg

SEQ ID NO: 119601 - DNA, 15 bp, Homo sapiens
tctgtcaccagcctg

SEQ ID NO: 119602 - DNA, 15 bp, Homo sapiens
ctctgtcaccagcct

SEQ ID NO: 119603 - DNA, 15 bp, Homo sapiens
gctctgtcaccagcc

SEQ ID NO: 119604 - DNA, 15 bp, Homo sapiens
tgctctgtcaccagc

SEQ ID NO: 119605 - DNA, 15 bp, Homo sapiens
cttttgagatggagt

SEQ ID NO: 119606 - DNA, 15 bp, Homo sapiens
tcttttgagatggag

SEQ ID NO: 119607 - DNA, 15 bp, Homo sapiens
ttcttttgagatgga

SEQ ID NO: 119608 - DNA, 15 bp, Homo sapiens
tttcttttgagatgg

SEQ ID NO: 119609 - DNA, 15 bp, Homo sapiens
ttttcttttgagatg

SEQ ID NO: 119610 - DNA, 15 bp, Homo sapiens
tttttcttttgagat

SEQ ID NO: 119611 - DNA, 15 bp, Homo sapiens
ttttttcttttgaga

SEQ ID NO: 119612 - DNA, 15 bp, Homo sapiens
cttttttcttttgag

SEQ ID NO: 119613 - DNA, 15 bp, Homo sapiens
tcttttttcttttga

SEQ ID NO: 119614 - DNA, 15 bp, Homo sapiens
ttcttttttcttttg

SEQ ID NO: 119615 - DNA, 15 bp, Homo sapiens
tttcttttttctttt

SEQ ID NO: 119616 - DNA, 15 bp, Homo sapiens
ttttcttttttcttt

SEQ ID NO: 119617 - DNA, 15 bp, Homo sapiens
tttttcttttttctt

SEQ ID NO: 119618 - DNA, 15 bp, Homo sapiens
ttttttcttttttct

SEQ ID NO: 119619 - DNA, 15 bp, Homo sapiens
tttttttcttttttc

SEQ ID NO: 119620 - DNA, 15 bp, Homo sapiens
ctttttttctttttt

SEQ ID NO: 119621 - DNA, 15 bp, Homo sapiens
tctttttttcttttt

SEQ ID NO: 119622 - DNA, 15 bp, Homo sapiens
atctttttttctttt

SEQ ID NO: 119623 - DNA, 15 bp, Homo sapiens
aatctttttttcttt

SEQ ID NO: 119624 - DNA, 15 bp, Homo sapiens
caatctttttttctt

SEQ ID NO: 119625 - DNA, 15 bp, Homo sapiens
tcaatctttttttct

SEQ ID NO: 119626 - DNA, 15 bp, Homo sapiens
ttcaatctttttttc

SEQ ID NO: 119627 - DNA, 15 bp, Homo sapiens
cttcaatcttttttt

SEQ ID NO: 119628 - DNA, 15 bp, Homo sapiens
tcttcaatctttttt

SEQ ID NO: 119629 - DNA, 15 bp, Homo sapiens
ctcttcaatcttttt

SEQ ID NO: 119630 - DNA, 15 bp, Homo sapiens
cctcttcaatctttt

SEQ ID NO: 119631 - DNA, 15 bp, Homo sapiens
ccctcttcaatcttt

SEQ ID NO: 119632 - DNA, 15 bp, Homo sapiens
gccctcttcaatctt

SEQ ID NO: 119633 - DNA, 15 bp, Homo sapiens
tgccctcttcaatct

SEQ ID NO: 119634 - DNA, 15 bp, Homo sapiens
ttgccctcttcaatc

SEQ ID NO: 119635 - DNA, 15 bp, Homo sapiens
tttgccctcttcaat

SEQ ID NO: 119636 - DNA, 15 bp, Homo sapiens
atttgccctcttcaa

SEQ ID NO: 119637 - DNA, 15 bp, Homo sapiens
gatttgccctcttca

SEQ ID NO: 119638 - DNA, 15 bp, Homo sapiens
tgatttgccctcttc

SEQ ID NO: 119639 - DNA, 15 bp, Homo sapiens
ctgatttgccctctt

SEQ ID NO: 119640 - DNA, 15 bp, Homo sapiens
tctgatttgccctct

SEQ ID NO: 119641 - DNA, 15 bp, Homo sapiens
atctgatttgccctc

SEQ ID NO: 119642 - DNA, 15 bp, Homo sapiens
gatctgatttgccct

SEQ ID NO: 119643 - DNA, 15 bp, Homo sapiens
tgatctgatttgccc

SEQ ID NO: 119644 - DNA, 15 bp, Homo sapiens
ctgatctgatttgcc

SEQ ID NO: 119645 - DNA, 15 bp, Homo sapiens
actgatctgatttgc

SEQ ID NO: 119646 - DNA, 15 bp, Homo sapiens
aactgatctgatttg

SEQ ID NO: 119647 - DNA, 15 bp, Homo sapiens
caactgatctgattt

SEQ ID NO: 119648 - DNA, 15 bp, Homo sapiens
acaactgatctgatt

SEQ ID NO: 119649 - DNA, 15 bp, Homo sapiens
tacaactgatctgat

SEQ ID NO: 119650 - DNA, 15 bp, Homo sapiens
ttacaactgatctga

SEQ ID NO: 119651 - DNA, 15 bp, Homo sapiens
attacaactgatctg

SEQ ID NO: 119652 - DNA, 15 bp, Homo sapiens
tattacaactgatct

SEQ ID NO: 119653 - DNA, 15 bp, Homo sapiens
atattacaactgatc

SEQ ID NO: 119654 - DNA, 15 bp, Homo sapiens
tatattacaactgat

SEQ ID NO: 119655 - DNA, 15 bp, Homo sapiens
ttatattacaactga

SEQ ID NO: 119656 - DNA, 15 bp, Homo sapiens
cttatattacaactg

SEQ ID NO: 119657 - DNA, 15 bp, Homo sapiens
tcttatattacaact

SEQ ID NO: 119658 - DNA, 15 bp, Homo sapiens
ttcttatattacaac

SEQ ID NO: 119659 - DNA, 15 bp, Homo sapiens
attcttatattacaa

SEQ ID NO: 119660 - DNA, 15 bp, Homo sapiens
tattcttatattaca

SEQ ID NO: 119661 - DNA, 15 bp, Homo sapiens
ttattcttatattac

SEQ ID NO: 119662 - DNA, 15 bp, Homo sapiens
cttattcttatatta

SEQ ID NO: 119663 - DNA, 15 bp, Homo sapiens
ccttattcttatatt

SEQ ID NO: 119664 - DNA, 15 bp, Homo sapiens
tccttattcttatat

SEQ ID NO: 119665 - DNA, 15 bp, Homo sapiens
ttccttattcttata

SEQ ID NO: 119666 - DNA, 15 bp, Homo sapiens
attccttattcttat

SEQ ID NO: 119667 - DNA, 15 bp, Homo sapiens
tattccttattctta

SEQ ID NO: 119668 - DNA, 15 bp, Homo sapiens
ttattccttattctt

SEQ ID NO: 119669 - DNA, 15 bp, Homo sapiens
cttattccttattct

SEQ ID NO: 119670 - DNA, 15 bp, Homo sapiens
tcttattccttattc

SEQ ID NO: 119671 - DNA, 15 bp, Homo sapiens
ctcttattccttatt

SEQ ID NO: 119672 - DNA, 15 bp, Homo sapiens
tctcttattccttat

SEQ ID NO: 119673 - DNA, 15 bp, Homo sapiens
atctcttattcctta

SEQ ID NO: 119674 - DNA, 15 bp, Homo sapiens
catctcttattcctt

SEQ ID NO: 119675 - DNA, 15 bp, Homo sapiens
tcatctcttattcct

SEQ ID NO: 119676 - DNA, 15 bp, Homo sapiens
ttcatctcttattcc

SEQ ID NO: 119677 - DNA, 15 bp, Homo sapiens
gttcatctcttattc

SEQ ID NO: 119678 - DNA, 15 bp, Homo sapiens
agttcatctcttatt

SEQ ID NO: 119679 - DNA, 15 bp, Homo sapiens
aagttcatctcttat

SEQ ID NO: 119680 - DNA, 15 bp, Homo sapiens
caagttcatctctta

SEQ ID NO: 119681 - DNA, 15 bp, Homo sapiens
gcaagttcatctctt

SEQ ID NO: 119682 - DNA, 15 bp, Homo sapiens
tgcaagttcatctct

SEQ ID NO: 119683 - DNA, 15 bp, Homo sapiens
atgcaagttcatctc

SEQ ID NO: 119684 - DNA, 15 bp, Homo sapiens
aatgcaagttcatct

SEQ ID NO: 119685 - DNA, 15 bp, Homo sapiens
caatgcaagttcatc

SEQ ID NO: 119686 - DNA, 15 bp, Homo sapiens
tcaatgcaagttcat

SEQ ID NO: 119687 - DNA, 15 bp, Homo sapiens
ttcaatgcaagttca

SEQ ID NO: 119688 - DNA, 15 bp, Homo sapiens
tttcaatgcaagttc

SEQ ID NO: 119689 - DNA, 15 bp, Homo sapiens
atttcaatgcaagtt

SEQ ID NO: 119690 - DNA, 15 bp, Homo sapiens
aatttcaatgcaagt

SEQ ID NO: 119691 - DNA, 15 bp, Homo sapiens
caatttcaatgcaag

SEQ ID NO: 119692 - DNA, 15 bp, Homo sapiens
tcaatttcaatgcaa

SEQ ID NO: 119693 - DNA, 15 bp, Homo sapiens
ttcaatttcaatgca

SEQ ID NO: 119694 - DNA, 15 bp, Homo sapiens
tttcaatttcaatgc

SEQ ID NO: 119695 - DNA, 15 bp, Homo sapiens
ttttcaatttcaatg

SEQ ID NO: 119696 - DNA, 15 bp, Homo sapiens
tttttcaatttcaat

SEQ ID NO: 119697 - DNA, 15 bp, Homo sapiens
ctttttcaatttcaa

SEQ ID NO: 119698 - DNA, 15 bp, Homo sapiens
tctttttcaatttca

SEQ ID NO: 119699 - DNA, 15 bp, Homo sapiens
ttctttttcaatttc

SEQ ID NO: 119700 - DNA, 15 bp, Homo sapiens
tttctttttcaattt

SEQ ID NO: 119701 - DNA, 15 bp, Homo sapiens
gtttctttttcaatt

SEQ ID NO: 119702 - DNA, 15 bp, Homo sapiens
agtttctttttcaat

SEQ ID NO: 119703 - DNA, 15 bp, Homo sapiens
aagtttctttttcaa

SEQ ID NO: 119704 - DNA, 15 bp, Homo sapiens
aaagtttctttttca

SEQ ID NO: 119705 - DNA, 15 bp, Homo sapiens
gaaagtttctttttc

SEQ ID NO: 119706 - DNA, 15 bp, Homo sapiens
tgaaagtttcttttt

SEQ ID NO: 119707 - DNA, 15 bp, Homo sapiens
gtgaaagtttctttt

SEQ ID NO: 119708 - DNA, 15 bp, Homo sapiens
ggtgaaagtttcttt

SEQ ID NO: 119709 - DNA, 15 bp, Homo sapiens
aggtgaaagtttctt

SEQ ID NO: 119710 - DNA, 15 bp, Homo sapiens
aaggtgaaagtttct

SEQ ID NO: 119711 - DNA, 15 bp, Homo sapiens
aaaggtgaaagtttc

SEQ ID NO: 119712 - DNA, 15 bp, Homo sapiens
aaaaggtgaaagttt

SEQ ID NO: 119713 - DNA, 15 bp, Homo sapiens
taaaaggtgaaagtt

SEQ ID NO: 119714 - DNA, 15 bp, Homo sapiens
ataaaaggtgaaagt

SEQ ID NO: 119715 - DNA, 15 bp, Homo sapiens
aataaaaggtgaaag

SEQ ID NO: 119716 - DNA, 15 bp, Homo sapiens
gaataaaaggtgaaa

SEQ ID NO: 119717 - DNA, 15 bp, Homo sapiens
agaataaaaggtgaa

SEQ ID NO: 119718 - DNA, 15 bp, Homo sapiens
tagaataaaaggtga

SEQ ID NO: 119719 - DNA, 15 bp, Homo sapiens
gtagaataaaaggtg

SEQ ID NO: 119720 - DNA, 15 bp, Homo sapiens
agtagaataaaaggt

SEQ ID NO: 119721 - DNA, 15 bp, Homo sapiens
aagtagaataaaagg

SEQ ID NO: 119722 - DNA, 15 bp, Homo sapiens
gaagtagaataaaag

SEQ ID NO: 119723 - DNA, 15 bp, Homo sapiens
tgaagtagaataaaa

SEQ ID NO: 119724 - DNA, 15 bp, Homo sapiens
ttgaagtagaataaa

SEQ ID NO: 119725 - DNA, 15 bp, Homo sapiens
gttgaagtagaataa

SEQ ID NO: 119726 - DNA, 15 bp, Homo sapiens
agttgaagtagaata

SEQ ID NO: 119727 - DNA, 15 bp, Homo sapiens
aagttgaagtagaat

SEQ ID NO: 119728 - DNA, 15 bp, Homo sapiens
aaagttgaagtagaa

SEQ ID NO: 119729 - DNA, 15 bp, Homo sapiens
aaaagttgaagtaga

SEQ ID NO: 119730 - DNA, 15 bp, Homo sapiens
aaaaagttgaagtag

SEQ ID NO: 119731 - DNA, 15 bp, Homo sapiens
taaaaagttgaagta

SEQ ID NO: 119732 - DNA, 15 bp, Homo sapiens
ataaaaagttgaagt

SEQ ID NO: 119733 - DNA, 15 bp, Homo sapiens
aataaaaagttgaag

SEQ ID NO: 119734 - DNA, 15 bp, Homo sapiens
caataaaaagttgaa

SEQ ID NO: 119735 - DNA, 15 bp, Homo sapiens
acaataaaaagttga

SEQ ID NO: 119736 - DNA, 15 bp, Homo sapiens
cacaataaaaagttg

SEQ ID NO: 119737 - DNA, 15 bp, Homo sapiens
gcacaataaaaagtt

SEQ ID NO: 119738 - DNA, 15 bp, Homo sapiens
agcacaataaaaagt

SEQ ID NO: 119739 - DNA, 15 bp, Homo sapiens
cagcacaataaaaag

SEQ ID NO: 119740 - DNA, 15 bp, Homo sapiens
tcagcacaataaaaa

SEQ ID NO: 119741 - DNA, 15 bp, Homo sapiens
ctcagcacaataaaa

SEQ ID NO: 119742 - DNA, 15 bp, Homo sapiens
cctcagcacaataaa

SEQ ID NO: 119743 - DNA, 15 bp, Homo sapiens
acctcagcacaataa

SEQ ID NO: 119744 - DNA, 15 bp, Homo sapiens
gacctcagcacaata

SEQ ID NO: 119745 - DNA, 15 bp, Homo sapiens
agacctcagcacaat

SEQ ID NO: 119746 - DNA, 15 bp, Homo sapiens
tagacctcagcacaa

SEQ ID NO: 119747 - DNA, 15 bp, Homo sapiens
ttagacctcagcaca

SEQ ID NO: 119748 - DNA, 15 bp, Homo sapiens
tttagacctcagcac

SEQ ID NO: 119749 - DNA, 15 bp, Homo sapiens
atttagacctcagca

SEQ ID NO: 119750 - DNA, 15 bp, Homo sapiens
gatttagacctcagc

SEQ ID NO: 119751 - DNA, 15 bp, Homo sapiens
tgatttagacctcag

SEQ ID NO: 119752 - DNA, 15 bp, Homo sapiens
ttgatttagacctca

SEQ ID NO: 119753 - DNA, 15 bp, Homo sapiens
tttgatttagacctc

SEQ ID NO: 119754 - DNA, 15 bp, Homo sapiens
atttgatttagacct

SEQ ID NO: 119755 - DNA, 15 bp, Homo sapiens
tatttgatttagacc

SEQ ID NO: 119756 - DNA, 15 bp, Homo sapiens
ttatttgatttagac

SEQ ID NO: 119757 - DNA, 15 bp, Homo sapiens
tttatttgatttaga

SEQ ID NO: 119758 - DNA, 15 bp, Homo sapiens
atttatttgatttag

SEQ ID NO: 119759 - DNA, 15 bp, Homo sapiens
aatttatttgattta

SEQ ID NO: 119760 - DNA, 15 bp, Homo sapiens
aaatttatttgattt

SEQ ID NO: 119761 - DNA, 15 bp, Homo sapiens
taaatttatttgatt

SEQ ID NO: 119762 - DNA, 15 bp, Homo sapiens
ttaaatttatttgat

SEQ ID NO: 119763 - DNA, 15 bp, Homo sapiens
tttaaatttatttga

SEQ ID NO: 119764 - DNA, 15 bp, Homo sapiens
ttttaaatttatttg

SEQ ID NO: 119765 - DNA, 15 bp, Homo sapiens
tttttaaatttattt

SEQ ID NO: 119766 - DNA, 15 bp, Homo sapiens
ctttttaaatttatt

SEQ ID NO: 119767 - DNA, 15 bp, Homo sapiens
actttttaaatttat

SEQ ID NO: 119768 - DNA, 15 bp, Homo sapiens
cactttttaaattta

SEQ ID NO: 119769 - DNA, 15 bp, Homo sapiens
acactttttaaattt

SEQ ID NO: 119770 - DNA, 15 bp, Homo sapiens
aacactttttaaatt

SEQ ID NO: 119771 - DNA, 15 bp, Homo sapiens
taacactttttaaat

SEQ ID NO: 119772 - DNA, 15 bp, Homo sapiens
ttaacactttttaaa

SEQ ID NO: 119773 - DNA, 15 bp, Homo sapiens
cttaacactttttaa

SEQ ID NO: 119774 - DNA, 15 bp, Homo sapiens
gcttaacacttttta

SEQ ID NO: 119775 - DNA, 15 bp, Homo sapiens
tgcttaacacttttt

SEQ ID NO: 119776 - DNA, 15 bp, Homo sapiens
gtgcttaacactttt

SEQ ID NO: 119777 - DNA, 15 bp, Homo sapiens
ggtgcttaacacttt

SEQ ID NO: 119778 - DNA, 15 bp, Homo sapiens
tggtgcttaacactt

SEQ ID NO: 119779 - DNA, 15 bp, Homo sapiens
atggtgcttaacact

SEQ ID NO: 119780 - DNA, 15 bp, Homo sapiens
tatggtgcttaacac

SEQ ID NO: 119781 - DNA, 15 bp, Homo sapiens
ctatggtgcttaaca

SEQ ID NO: 119782 - DNA, 15 bp, Homo sapiens
tctatggtgcttaac

SEQ ID NO: 119783 - DNA, 15 bp, Homo sapiens
atctatggtgcttaa

SEQ ID NO: 119784 - DNA, 15 bp, Homo sapiens
catctatggtgctta

SEQ ID NO: 119785 - DNA, 15 bp, Homo sapiens
acatctatggtgctt

SEQ ID NO: 119786 - DNA, 15 bp, Homo sapiens
cacatctatggtgct

SEQ ID NO: 119787 - DNA, 15 bp, Homo sapiens
gcacatctatggtgc

SEQ ID NO: 119788 - DNA, 15 bp, Homo sapiens
tgcacatctatggtg

SEQ ID NO: 119789 - DNA, 15 bp, Homo sapiens
atgcacatctatggt

SEQ ID NO: 119790 - DNA, 15 bp, Homo sapiens
aatgcacatctatgg

SEQ ID NO: 119791 - DNA, 15 bp, Homo sapiens
aaatgcacatctatg

SEQ ID NO: 119792 - DNA, 15 bp, Homo sapiens
aaaatgcacatctat

SEQ ID NO: 119793 - DNA, 15 bp, Homo sapiens
aaaaatgcacatcta

SEQ ID NO: 119794 - DNA, 15 bp, Homo sapiens
taaaaatgcacatct

SEQ ID NO: 119795 - DNA, 15 bp, Homo sapiens
ctaaaaatgcacatc

SEQ ID NO: 119796 - DNA, 15 bp, Homo sapiens
cctaaaaatgcacat

SEQ ID NO: 119797 - DNA, 15 bp, Homo sapiens
tcctaaaaatgcaca

SEQ ID NO: 119798 - DNA, 15 bp, Homo sapiens
ttcctaaaaatgcac

SEQ ID NO: 119799 - DNA, 15 bp, Homo sapiens
attcctaaaaatgca

SEQ ID NO: 119800 - DNA, 15 bp, Homo sapiens
tattcctaaaaatgc

SEQ ID NO: 119801 - DNA, 15 bp, Homo sapiens
ttattcctaaaaatg

SEQ ID NO: 119802 - DNA, 15 bp, Homo sapiens
cttattcctaaaaat

SEQ ID NO: 119803 - DNA, 15 bp, Homo sapiens
tcttattcctaaaaa

SEQ ID NO: 119804 - DNA, 15 bp, Homo sapiens
atcttattcctaaaa

SEQ ID NO: 119805 - DNA, 15 bp, Homo sapiens
catcttattcctaaa

SEQ ID NO: 119806 - DNA, 15 bp, Homo sapiens
tcatcttattcctaa

SEQ ID NO: 119807 - DNA, 15 bp, Homo sapiens
ctcatcttattccta

SEQ ID NO: 119808 - DNA, 15 bp, Homo sapiens
actcatcttattcct

SEQ ID NO: 119809 - DNA, 15 bp, Homo sapiens
aactcatcttattcc

SEQ ID NO: 119810 - DNA, 15 bp, Homo sapiens
taactcatcttattc

SEQ ID NO: 119811 - DNA, 15 bp, Homo sapiens
ataactcatcttatt

SEQ ID NO: 119812 - DNA, 15 bp, Homo sapiens
aataactcatcttat

SEQ ID NO: 119813 - DNA, 15 bp, Homo sapiens
gaataactcatctta

SEQ ID NO: 119814 - DNA, 15 bp, Homo sapiens
tgaataactcatctt

SEQ ID NO: 119815 - DNA, 15 bp, Homo sapiens
gtgaataactcatct

SEQ ID NO: 119816 - DNA, 15 bp, Homo sapiens
agtgaataactcatc

SEQ ID NO: 119817 - DNA, 15 bp, Homo sapiens
cagtgaataactcat

SEQ ID NO: 119818 - DNA, 15 bp, Homo sapiens
tcagtgaataactca

SEQ ID NO: 119819 - DNA, 15 bp, Homo sapiens
ttcagtgaataactc

SEQ ID NO: 119820 - DNA, 15 bp, Homo sapiens
cttcagtgaataact

SEQ ID NO: 119821 - DNA, 15 bp, Homo sapiens
tcttcagtgaataac

SEQ ID NO: 119822 - DNA, 15 bp, Homo sapiens
ttcttcagtgaataa

SEQ ID NO: 119823 - DNA, 15 bp, Homo sapiens
cttcttcagtgaata

SEQ ID NO: 119824 - DNA, 15 bp, Homo sapiens
tcttcttcagtgaat

SEQ ID NO: 119825 - DNA, 15 bp, Homo sapiens
ctcttcttcagtgaa

SEQ ID NO: 119826 - DNA, 15 bp, Homo sapiens
gctcttcttcagtga

SEQ ID NO: 119827 - DNA, 15 bp, Homo sapiens
agctcttcttcagtg

SEQ ID NO: 119828 - DNA, 15 bp, Homo sapiens
gagctcttcttcagt

SEQ ID NO: 119829 - DNA, 15 bp, Homo sapiens
agagctcttcttcag

SEQ ID NO: 119830 - DNA, 15 bp, Homo sapiens
cagagctcttcttca

SEQ ID NO: 119831 - DNA, 15 bp, Homo sapiens
gcagagctcttcttc

SEQ ID NO: 119832 - DNA, 15 bp, Homo sapiens
tgcagagctcttctt

SEQ ID NO: 119833 - DNA, 15 bp, Homo sapiens
ctgcagagctcttct

SEQ ID NO: 119834 - DNA, 15 bp, Homo sapiens
cctgcagagctcttc

SEQ ID NO: 119835 - DNA, 15 bp, Homo sapiens
tcctgcagagctctt

SEQ ID NO: 119836 - DNA, 15 bp, Homo sapiens
ttcctgcagagctct

SEQ ID NO: 119837 - DNA, 15 bp, Homo sapiens
cttcctgcagagctc

SEQ ID NO: 119838 - DNA, 15 bp, Homo sapiens
ccttcctgcagagct

SEQ ID NO: 119839 - DNA, 15 bp, Homo sapiens
accttcctgcagagc

SEQ ID NO: 119840 - DNA, 15 bp, Homo sapiens
caccttcctgcagag

SEQ ID NO: 119841 - DNA, 15 bp, Homo sapiens
tcaccttcctgcaga

SEQ ID NO: 119842 - DNA, 15 bp, Homo sapiens
ttcaccttcctgcag

SEQ ID NO: 119843 - DNA, 15 bp, Homo sapiens
tttcaccttcctgca

SEQ ID NO: 119844 - DNA, 15 bp, Homo sapiens
ctttcaccttcctgc

SEQ ID NO: 119845 - DNA, 15 bp, Homo sapiens
gctttcaccttcctg

SEQ ID NO: 119846 - DNA, 15 bp, Homo sapiens
agctttcaccttcct

SEQ ID NO: 119847 - DNA, 15 bp, Homo sapiens
gagctttcaccttcc

SEQ ID NO: 119848 - DNA, 15 bp, Homo sapiens
agagctttcaccttc

SEQ ID NO: 119849 - DNA, 15 bp, Homo sapiens
gagagctttcacctt

SEQ ID NO: 119850 - DNA, 15 bp, Homo sapiens
ggagagctttcacct

SEQ ID NO: 119851 - DNA, 15 bp, Homo sapiens
aggagagctttcacc

SEQ ID NO: 119852 - DNA, 15 bp, Homo sapiens
aaggagagctttcac

SEQ ID NO: 119853 - DNA, 15 bp, Homo sapiens
aaaggagagctttca

SEQ ID NO: 119854 - DNA, 15 bp, Homo sapiens
taaaggagagctttc

SEQ ID NO: 119855 - DNA, 15 bp, Homo sapiens
ttaaaggagagcttt

SEQ ID NO: 119856 - DNA, 15 bp, Homo sapiens
tttaaaggagagctt

SEQ ID NO: 119857 - DNA, 15 bp, Homo sapiens
atttaaaggagagct

SEQ ID NO: 119858 - DNA, 15 bp, Homo sapiens
aatttaaaggagagc

SEQ ID NO: 119859 - DNA, 15 bp, Homo sapiens
gaatttaaaggagag

SEQ ID NO: 119860 - DNA, 15 bp, Homo sapiens
tgaatttaaaggaga

SEQ ID NO: 119861 - DNA, 15 bp, Homo sapiens
atgaatttaaaggag

SEQ ID NO: 119862 - DNA, 15 bp, Homo sapiens
catgaatttaaagga

SEQ ID NO: 119863 - DNA, 15 bp, Homo sapiens
ccatgaatttaaagg

SEQ ID NO: 119864 - DNA, 15 bp, Homo sapiens
accatgaatttaaag

SEQ ID NO: 119865 - DNA, 15 bp, Homo sapiens
taccatgaatttaaa

SEQ ID NO: 119866 - DNA, 15 bp, Homo sapiens
gtaccatgaatttaa

SEQ ID NO: 119867 - DNA, 15 bp, Homo sapiens
tgtaccatgaattta

SEQ ID NO: 119868 - DNA, 15 bp, Homo sapiens
ctgtaccatgaattt

SEQ ID NO: 119869 - DNA, 15 bp, Homo sapiens
actgtaccatgaatt

SEQ ID NO: 119870 - DNA, 15 bp, Homo sapiens
aactgtaccatgaat

SEQ ID NO: 119871 - DNA, 15 bp, Homo sapiens
aaactgtaccatgaa

SEQ ID NO: 119872 - DNA, 15 bp, Homo sapiens
caaactgtaccatga

SEQ ID NO: 119873 - DNA, 15 bp, Homo sapiens
gcaaactgtaccatg

SEQ ID NO: 119874 - DNA, 15 bp, Homo sapiens
agcaaactgtaccat

SEQ ID NO: 119875 - DNA, 15 bp, Homo sapiens
gagcaaactgtacca

SEQ ID NO: 119876 - DNA, 15 bp, Homo sapiens
agagcaaactgtacc

SEQ ID NO: 119877 - DNA, 15 bp, Homo sapiens
aagagcaaactgtac

SEQ ID NO: 119878 - DNA, 15 bp, Homo sapiens
aaagagcaaactgta

SEQ ID NO: 119879 - DNA, 15 bp, Homo sapiens
caaagagcaaactgt

SEQ ID NO: 119880 - DNA, 15 bp, Homo sapiens
tcaaagagcaaactg

SEQ ID NO: 119881 - DNA, 15 bp, Homo sapiens
ttcaaagagcaaact

SEQ ID NO: 119882 - DNA, 15 bp, Homo sapiens
cttcaaagagcaaac

SEQ ID NO: 119883 - DNA, 15 bp, Homo sapiens
ccttcaaagagcaaa

SEQ ID NO: 119884 - DNA, 15 bp, Homo sapiens
accttcaaagagcaa

SEQ ID NO: 119885 - DNA, 15 bp, Homo sapiens
gaccttcaaagagca

SEQ ID NO: 119886 - DNA, 15 bp, Homo sapiens
agaccttcaaagagc

SEQ ID NO: 119887 - DNA, 15 bp, Homo sapiens
aagaccttcaaagag

SEQ ID NO: 119888 - DNA, 15 bp, Homo sapiens
aaagaccttcaaaga

SEQ ID NO: 119889 - DNA, 15 bp, Homo sapiens
aaaagaccttcaaag

SEQ ID NO: 119890 - DNA, 15 bp, Homo sapiens
taaaagaccttcaaa

SEQ ID NO: 119891 - DNA, 15 bp, Homo sapiens
ttaaaagaccttcaa

SEQ ID NO: 119892 - DNA, 15 bp, Homo sapiens
tttaaaagaccttca

SEQ ID NO: 119893 - DNA, 15 bp, Homo sapiens
atttaaaagaccttc

SEQ ID NO: 119894 - DNA, 15 bp, Homo sapiens
gatttaaaagacctt

SEQ ID NO: 119895 - DNA, 15 bp, Homo sapiens
agatttaaaagacct

SEQ ID NO: 119896 - DNA, 15 bp, Homo sapiens
gagatttaaaagacc

SEQ ID NO: 119897 - DNA, 15 bp, Homo sapiens
agagatttaaaagac

SEQ ID NO: 119898 - DNA, 15 bp, Homo sapiens
aagagatttaaaaga

SEQ ID NO: 119899 - DNA, 15 bp, Homo sapiens
aaagagatttaaaag

SEQ ID NO: 119900 - DNA, 15 bp, Homo sapiens
aaaagagatttaaaa

SEQ ID NO: 119901 - DNA, 15 bp, Homo sapiens
taaaagagatttaaa

SEQ ID NO: 119902 - DNA, 15 bp, Homo sapiens
ttaaaagagatttaa

SEQ ID NO: 119903 - DNA, 15 bp, Homo sapiens
cttaaaagagattta

SEQ ID NO: 119904 - DNA, 15 bp, Homo sapiens
tcttaaaagagattt

SEQ ID NO: 119905 - DNA, 15 bp, Homo sapiens
atcttaaaagagatt

SEQ ID NO: 119906 - DNA, 15 bp, Homo sapiens
aatcttaaaagagat

SEQ ID NO: 119907 - DNA, 15 bp, Homo sapiens
taatcttaaaagaga

SEQ ID NO: 119908 - DNA, 15 bp, Homo sapiens
ataatcttaaaagag

SEQ ID NO: 119909 - DNA, 15 bp, Homo sapiens
gataatcttaaaaga

SEQ ID NO: 119910 - DNA, 15 bp, Homo sapiens
tgataatcttaaaag

SEQ ID NO: 119911 - DNA, 15 bp, Homo sapiens
atgataatcttaaaa

SEQ ID NO: 119912 - DNA, 15 bp, Homo sapiens
gatgataatcttaaa

SEQ ID NO: 119913 - DNA, 15 bp, Homo sapiens
agatgataatcttaa

SEQ ID NO: 119914 - DNA, 15 bp, Homo sapiens
aagatgataatctta

SEQ ID NO: 119915 - DNA, 15 bp, Homo sapiens
taagatgataatctt

SEQ ID NO: 119916 - DNA, 15 bp, Homo sapiens
ttaagatgataatct

SEQ ID NO: 119917 - DNA, 15 bp, Homo sapiens
tttaagatgataatc

SEQ ID NO: 119918 - DNA, 15 bp, Homo sapiens
atttaagatgataat

SEQ ID NO: 119919 - DNA, 15 bp, Homo sapiens
tatttaagatgataa

SEQ ID NO: 119920 - DNA, 15 bp, Homo sapiens
atatttaagatgata

SEQ ID NO: 119921 - DNA, 15 bp, Homo sapiens
aatatttaagatgat

SEQ ID NO: 119922 - DNA, 15 bp, Homo sapiens
aaatatttaagatga

SEQ ID NO: 119923 - DNA, 15 bp, Homo sapiens
gaaatatttaagatg

SEQ ID NO: 119924 - DNA, 15 bp, Homo sapiens
tgaaatatttaagat

SEQ ID NO: 119925 - DNA, 15 bp, Homo sapiens
atgaaatatttaaga

SEQ ID NO: 119926 - DNA, 15 bp, Homo sapiens
tatgaaatatttaag

SEQ ID NO: 119927 - DNA, 15 bp, Homo sapiens
atatgaaatatttaa

SEQ ID NO: 119928 - DNA, 15 bp, Homo sapiens
catatgaaatattta

SEQ ID NO: 119929 - DNA, 15 bp, Homo sapiens
ccatatgaaatattt

SEQ ID NO: 119930 - DNA, 15 bp, Homo sapiens
accatatgaaatatt

SEQ ID NO: 119931 - DNA, 15 bp, Homo sapiens
aaccatatgaaatat

SEQ ID NO: 119932 - DNA, 15 bp, Homo sapiens
taaccatatgaaata

SEQ ID NO: 119933 - DNA, 15 bp, Homo sapiens
ataaccatatgaaat

SEQ ID NO: 119934 - DNA, 15 bp, Homo sapiens
cataaccatatgaaa

SEQ ID NO: 119935 - DNA, 15 bp, Homo sapiens
acataaccatatgaa

SEQ ID NO: 119936 - DNA, 15 bp, Homo sapiens
tacataaccatatga

SEQ ID NO: 119937 - DNA, 15 bp, Homo sapiens
ttacataaccatatg

SEQ ID NO: 119938 - DNA, 15 bp, Homo sapiens
cttacataaccatat

SEQ ID NO: 119939 - DNA, 15 bp, Homo sapiens
gcttacataaccata

SEQ ID NO: 119940 - DNA, 15 bp, Homo sapiens
tgcttacataaccat

SEQ ID NO: 119941 - DNA, 15 bp, Homo sapiens
atgcttacataacca

SEQ ID NO: 119942 - DNA, 15 bp, Homo sapiens
aatgcttacataacc

SEQ ID NO: 119943 - DNA, 15 bp, Homo sapiens
aaatgcttacataac

SEQ ID NO: 119944 - DNA, 15 bp, Homo sapiens
aaaatgcttacataa

SEQ ID NO: 119945 - DNA, 15 bp, Homo sapiens
taaaatgcttacata

SEQ ID NO: 119946 - DNA, 15 bp, Homo sapiens
ataaaatgcttacat

SEQ ID NO: 119947 - DNA, 15 bp, Homo sapiens
aataaaatgcttaca

SEQ ID NO: 119948 - DNA, 15 bp, Homo sapiens
taataaaatgcttac

SEQ ID NO: 119949 - DNA, 15 bp, Homo sapiens
ttaataaaatgctta

SEQ ID NO: 119950 - DNA, 15 bp, Homo sapiens
attaataaaatgctt

SEQ ID NO: 119951 - DNA, 15 bp, Homo sapiens
aattaataaaatgct

SEQ ID NO: 119952 - DNA, 15 bp, Homo sapiens
gaattaataaaatgc

SEQ ID NO: 119953 - DNA, 15 bp, Homo sapiens
ggaattaataaaatg

SEQ ID NO: 119954 - DNA, 15 bp, Homo sapiens
aggaattaataaaat

SEQ ID NO: 119955 - DNA, 15 bp, Homo sapiens
aaggaattaataaaa

SEQ ID NO: 119956 - DNA, 15 bp, Homo sapiens
aaaggaattaataaa

SEQ ID NO: 119957 - DNA, 15 bp, Homo sapiens
caaaggaattaataa

SEQ ID NO: 119958 - DNA, 15 bp, Homo sapiens
acaaaggaattaata

SEQ ID NO: 119959 - DNA, 15 bp, Homo sapiens
tacaaaggaattaat

SEQ ID NO: 119960 - DNA, 15 bp, Homo sapiens
ctacaaaggaattaa

SEQ ID NO: 119961 - DNA, 15 bp, Homo sapiens
tctacaaaggaatta

SEQ ID NO: 119962 - DNA, 15 bp, Homo sapiens
ttctacaaaggaatt

SEQ ID NO: 119963 - DNA, 15 bp, Homo sapiens
gttctacaaaggaat

SEQ ID NO: 119964 - DNA, 15 bp, Homo sapiens
ggttctacaaaggaa

SEQ ID NO: 119965 - DNA, 15 bp, Homo sapiens
tggttctacaaagga

SEQ ID NO: 119966 - DNA, 15 bp, Homo sapiens
atggttctacaaagg

SEQ ID NO: 119967 - DNA, 15 bp, Homo sapiens
gatggttctacaaag

SEQ ID NO: 119968 - DNA, 15 bp, Homo sapiens
tgatggttctacaaa

SEQ ID NO: 119969 - DNA, 15 bp, Homo sapiens
ctgatggttctacaa

SEQ ID NO: 119970 - DNA, 15 bp, Homo sapiens
tctgatggttctaca

SEQ ID NO: 119971 - DNA, 15 bp, Homo sapiens
ttctgatggttctac

SEQ ID NO: 119972 - DNA, 15 bp, Homo sapiens
gttctgatggttcta

SEQ ID NO: 119973 - DNA, 15 bp, Homo sapiens
ggttctgatggttct

SEQ ID NO: 119974 - DNA, 15 bp, Homo sapiens
tggttctgatggttc

SEQ ID NO: 119975 - DNA, 15 bp, Homo sapiens
ctggttctgatggtt

SEQ ID NO: 119976 - DNA, 15 bp, Homo sapiens
gctggttctgatggt

SEQ ID NO: 119977 - DNA, 15 bp, Homo sapiens
agctggttctgatgg

SEQ ID NO: 119978 - DNA, 15 bp, Homo sapiens
tagctggttctgatg

SEQ ID NO: 119979 - DNA, 15 bp, Homo sapiens
ctagctggttctgat

SEQ ID NO: 119980 - DNA, 15 bp, Homo sapiens
tctagctggttctga

SEQ ID NO: 119981 - DNA, 15 bp, Homo sapiens
ttctagctggttctg

SEQ ID NO: 119982 - DNA, 15 bp, Homo sapiens
tttctagctggttct

SEQ ID NO: 119983 - DNA, 15 bp, Homo sapiens
atttctagctggttc

SEQ ID NO: 119984 - DNA, 15 bp, Homo sapiens
tatttctagctggtt

SEQ ID NO: 119985 - DNA, 15 bp, Homo sapiens
atatttctagctggt

SEQ ID NO: 119986 - DNA, 15 bp, Homo sapiens
aatatttctagctgg

SEQ ID NO: 119987 - DNA, 15 bp, Homo sapiens
aaatatttctagctg

SEQ ID NO: 119988 - DNA, 15 bp, Homo sapiens
caaatatttctagct

SEQ ID NO: 119989 - DNA, 15 bp, Homo sapiens
tcaaatatttctagc

SEQ ID NO: 119990 - DNA, 15 bp, Homo sapiens
atcaaatatttctag

SEQ ID NO: 119991 - DNA, 15 bp, Homo sapiens
catcaaatatttcta

SEQ ID NO: 119992 - DNA, 15 bp, Homo sapiens
ccatcaaatatttct

SEQ ID NO: 119993 - DNA, 15 bp, Homo sapiens
cccatcaaatatttc

SEQ ID NO: 119994 - DNA, 15 bp, Homo sapiens
tcccatcaaatattt

SEQ ID NO: 119995 - DNA, 15 bp, Homo sapiens
ttcccatcaaatatt

SEQ ID NO: 119996 - DNA, 15 bp, Homo sapiens
gttcccatcaaatat

SEQ ID NO: 119997 - DNA, 15 bp, Homo sapiens
cgttcccatcaaata

SEQ ID NO: 119998 - DNA, 15 bp, Homo sapiens
acgttcccatcaaat

SEQ ID NO: 119999 - DNA, 15 bp, Homo sapiens
cacgttcccatcaaa

SEQ ID NO: 120000 - DNA, 15 bp, Homo sapiens
ccacgttcccatcaa

SEQ ID NO: 120001 - DNA, 15 bp, Homo sapiens
gccacgttcccatca

SEQ ID NO: 120002 - DNA, 15 bp, Homo sapiens
agccacgttcccatc

SEQ ID NO: 120003 - DNA, 15 bp, Homo sapiens
gagccacgttcccat

SEQ ID NO: 120004 - DNA, 15 bp, Homo sapiens
tgagccacgttccca

SEQ ID NO: 120005 - DNA, 15 bp, Homo sapiens
gtgagccacgttccc

SEQ ID NO: 120006 - DNA, 15 bp, Homo sapiens
tgtgagccacgttcc

SEQ ID NO: 120007 - DNA, 15 bp, Homo sapiens
atgtgagccacgttc

SEQ ID NO: 120008 - DNA, 15 bp, Homo sapiens
tatgtgagccacgtt

SEQ ID NO: 120009 - DNA, 15 bp, Homo sapiens
ttatgtgagccacgt

SEQ ID NO: 120010 - DNA, 15 bp, Homo sapiens
cttatgtgagccacg

SEQ ID NO: 120011 - DNA, 15 bp, Homo sapiens
acttatgtgagccac

SEQ ID NO: 120012 - DNA, 15 bp, Homo sapiens
tacttatgtgagcca

SEQ ID NO: 120013 - DNA, 15 bp, Homo sapiens
gtacttatgtgagcc

SEQ ID NO: 120014 - DNA, 15 bp, Homo sapiens
ggtacttatgtgagc

SEQ ID NO: 120015 - DNA, 15 bp, Homo sapiens
aggtacttatgtgag

SEQ ID NO: 120016 - DNA, 15 bp, Homo sapiens
caggtacttatgtga

SEQ ID NO: 120017 - DNA, 15 bp, Homo sapiens
ccaggtacttatgtg

SEQ ID NO: 120018 - DNA, 15 bp, Homo sapiens
gccaggtacttatgt

SEQ ID NO: 120019 - DNA, 15 bp, Homo sapiens
agccaggtacttatg

SEQ ID NO: 120020 - DNA, 15 bp, Homo sapiens
aagccaggtacttat

SEQ ID NO: 120021 - DNA, 15 bp, Homo sapiens
aaagccaggtactta

SEQ ID NO: 120022 - DNA, 15 bp, Homo sapiens
taaagccaggtactt

SEQ ID NO: 120023 - DNA, 15 bp, Homo sapiens
ataaagccaggtact

SEQ ID NO: 120024 - DNA, 15 bp, Homo sapiens
gataaagccaggtac

SEQ ID NO: 120025 - DNA, 15 bp, Homo sapiens
tgataaagccaggta

SEQ ID NO: 120026 - DNA, 15 bp, Homo sapiens
ttgataaagccaggt

SEQ ID NO: 120027 - DNA, 15 bp, Homo sapiens
cttgataaagccagg

SEQ ID NO: 120028 - DNA, 15 bp, Homo sapiens
gcttgataaagccag

SEQ ID NO: 120029 - DNA, 15 bp, Homo sapiens
agcttgataaagcca

SEQ ID NO: 120030 - DNA, 15 bp, Homo sapiens
cagcttgataaagcc

SEQ ID NO: 120031 - DNA, 15 bp, Homo sapiens
tcagcttgataaagc

SEQ ID NO: 120032 - DNA, 15 bp, Homo sapiens
ttcagcttgataaag

SEQ ID NO: 120033 - DNA, 15 bp, Homo sapiens
cttcagcttgataaa

SEQ ID NO: 120034 - DNA, 15 bp, Homo sapiens
gcttcagcttgataa

SEQ ID NO: 120035 - DNA, 15 bp, Homo sapiens
agcttcagcttgata

SEQ ID NO: 120036 - DNA, 15 bp, Homo sapiens
gagcttcagcttgat

SEQ ID NO: 120037 - DNA, 15 bp, Homo sapiens
agagcttcagcttga

SEQ ID NO: 120038 - DNA, 15 bp, Homo sapiens
tagagcttcagcttg

SEQ ID NO: 120039 - DNA, 15 bp, Homo sapiens
atagagcttcagctt

SEQ ID NO: 120040 - DNA, 15 bp, Homo sapiens
aatagagcttcagct

SEQ ID NO: 120041 - DNA, 15 bp, Homo sapiens
caatagagcttcagc

SEQ ID NO: 120042 - DNA, 15 bp, Homo sapiens
ccaatagagcttcag

SEQ ID NO: 120043 - DNA, 15 bp, Homo sapiens
tccaatagagcttca

SEQ ID NO: 120044 - DNA, 15 bp, Homo sapiens
atccaatagagcttc

SEQ ID NO: 120045 - DNA, 15 bp, Homo sapiens
catccaatagagctt

SEQ ID NO: 120046 - DNA, 15 bp, Homo sapiens
tcatccaatagagct

SEQ ID NO: 120047 - DNA, 15 bp, Homo sapiens
ttcatccaatagagc

SEQ ID NO: 120048 - DNA, 15 bp, Homo sapiens
tttcatccaatagag

SEQ ID NO: 120049 - DNA, 15 bp, Homo sapiens
atttcatccaataga

SEQ ID NO: 120050 - DNA, 15 bp, Homo sapiens
aatttcatccaatag

SEQ ID NO: 120051 - DNA, 15 bp, Homo sapiens
caatttcatccaata

SEQ ID NO: 120052 - DNA, 15 bp, Homo sapiens
tcaatttcatccaat

SEQ ID NO: 120053 - DNA, 15 bp, Homo sapiens
ttcaatttcatccaa

SEQ ID NO: 120054 - DNA, 15 bp, Homo sapiens
tttcaatttcatcca

SEQ ID NO: 120055 - DNA, 15 bp, Homo sapiens
ttttcaatttcatcc

SEQ ID NO: 120056 - DNA, 15 bp, Homo sapiens
cttttcaatttcatc

SEQ ID NO: 120057 - DNA, 15 bp, Homo sapiens
tcttttcaatttcat

SEQ ID NO: 120058 - DNA, 15 bp, Homo sapiens
ttcttttcaatttca

SEQ ID NO: 120059 - DNA, 15 bp, Homo sapiens
tttcttttcaatttc

SEQ ID NO: 120060 - DNA, 15 bp, Homo sapiens
gtttcttttcaattt

SEQ ID NO: 120061 - DNA, 15 bp, Homo sapiens
ggtttcttttcaatt

SEQ ID NO: 120062 - DNA, 15 bp, Homo sapiens
tggtttcttttcaat

SEQ ID NO: 120063 - DNA, 15 bp, Homo sapiens
ttggtttcttttcaa

SEQ ID NO: 120064 - DNA, 15 bp, Homo sapiens
gttggtttcttttca

SEQ ID NO: 120065 - DNA, 15 bp, Homo sapiens
tgttggtttcttttc

SEQ ID NO: 120066 - DNA, 15 bp, Homo sapiens
ttgttggtttctttt

SEQ ID NO: 120067 - DNA, 15 bp, Homo sapiens
cttgttggtttcttt

SEQ ID NO: 120068 - DNA, 15 bp, Homo sapiens
acttgttggtttctt

SEQ ID NO: 120069 - DNA, 15 bp, Homo sapiens
tacttgttggtttct

SEQ ID NO: 120070 - DNA, 15 bp, Homo sapiens
ttacttgttggtttc

SEQ ID NO: 120071 - DNA, 15 bp, Homo sapiens
tttacttgttggttt

SEQ ID NO: 120072 - DNA, 15 bp, Homo sapiens
gtttacttgttggtt

SEQ ID NO: 120073 - DNA, 15 bp, Homo sapiens
tgtttacttgttggt

SEQ ID NO: 120074 - DNA, 15 bp, Homo sapiens
ctgtttacttgttgg

SEQ ID NO: 120075 - DNA, 15 bp, Homo sapiens
cctgtttacttgttg

SEQ ID NO: 120076 - DNA, 15 bp, Homo sapiens
tcctgtttacttgtt

SEQ ID NO: 120077 - DNA, 15 bp, Homo sapiens
ttcctgtttacttgt

SEQ ID NO: 120078 - DNA, 15 bp, Homo sapiens
cttcctgtttacttg

SEQ ID NO: 120079 - DNA, 15 bp, Homo sapiens
tcttcctgtttactt

SEQ ID NO: 120080 - DNA, 15 bp, Homo sapiens
ttcttcctgtttact

SEQ ID NO: 120081 - DNA, 15 bp, Homo sapiens
tttcttcctgtttac

SEQ ID NO: 120082 - DNA, 15 bp, Homo sapiens
atttcttcctgttta

SEQ ID NO: 120083 - DNA, 15 bp, Homo sapiens
aatttcttcctgttt

SEQ ID NO: 120084 - DNA, 15 bp, Homo sapiens
caatttcttcctgtt

SEQ ID NO: 120085 - DNA, 15 bp, Homo sapiens
acaatttcttcctgt

SEQ ID NO: 120086 - DNA, 15 bp, Homo sapiens
cacaatttcttcctg

SEQ ID NO: 120087 - DNA, 15 bp, Homo sapiens
tcacaatttcttcct

SEQ ID NO: 120088 - DNA, 15 bp, Homo sapiens
ttcacaatttcttcc

SEQ ID NO: 120089 - DNA, 15 bp, Homo sapiens
cttcacaatttcttc

SEQ ID NO: 120090 - DNA, 15 bp, Homo sapiens
ccttcacaatttctt

SEQ ID NO: 120091 - DNA, 15 bp, Homo sapiens
accttcacaatttct

SEQ ID NO: 120092 - DNA, 15 bp, Homo sapiens
taccttcacaatttc

SEQ ID NO: 120093 - DNA, 15 bp, Homo sapiens
ctaccttcacaattt

SEQ ID NO: 120094 - DNA, 15 bp, Homo sapiens
gctaccttcacaatt

SEQ ID NO: 120095 - DNA, 15 bp, Homo sapiens
tgctaccttcacaat

SEQ ID NO: 120096 - DNA, 15 bp, Homo sapiens
ttgctaccttcacaa

SEQ ID NO: 120097 - DNA, 15 bp, Homo sapiens
tttgctaccttcaca

SEQ ID NO: 120098 - DNA, 15 bp, Homo sapiens
gtttgctaccttcac

SEQ ID NO: 120099 - DNA, 15 bp, Homo sapiens
tgtttgctaccttca

SEQ ID NO: 120100 - DNA, 15 bp, Homo sapiens
gtgtttgctaccttc

SEQ ID NO: 120101 - DNA, 15 bp, Homo sapiens
tgtgtttgctacctt

SEQ ID NO: 120102 - DNA, 15 bp, Homo sapiens
ctgtgtttgctacct

SEQ ID NO: 120103 - DNA, 15 bp, Homo sapiens
tctgtgtttgctacc

SEQ ID NO: 120104 - DNA, 15 bp, Homo sapiens
gtctgtgtttgctac

SEQ ID NO: 120105 - DNA, 15 bp, Homo sapiens
tgtctgtgtttgcta

SEQ ID NO: 120106 - DNA, 15 bp, Homo sapiens
atgtctgtgtttgct

SEQ ID NO: 120107 - DNA, 15 bp, Homo sapiens
gatgtctgtgtttgc

SEQ ID NO: 120108 - DNA, 15 bp, Homo sapiens
tgatgtctgtgtttg

SEQ ID NO: 120109 - DNA, 15 bp, Homo sapiens
ctgatgtctgtgttt

SEQ ID NO: 120110 - DNA, 15 bp, Homo sapiens
actgatgtctgtgtt

SEQ ID NO: 120111 - DNA, 15 bp, Homo sapiens
tactgatgtctgtgt

SEQ ID NO: 120112 - DNA, 15 bp, Homo sapiens
ttactgatgtctgtg

SEQ ID NO: 120113 - DNA, 15 bp, Homo sapiens
gttactgatgtctgt

SEQ ID NO: 120114 - DNA, 15 bp, Homo sapiens
cgttactgatgtctg

SEQ ID NO: 120115 - DNA, 15 bp, Homo sapiens
gcgttactgatgtct

SEQ ID NO: 120116 - DNA, 15 bp, Homo sapiens
agcgttactgatgtc

SEQ ID NO: 120117 - DNA, 15 bp, Homo sapiens
aagcgttactgatgt

SEQ ID NO: 120118 - DNA, 15 bp, Homo sapiens
aaagcgttactgatg

SEQ ID NO: 120119 - DNA, 15 bp, Homo sapiens
aaaagcgttactgat

SEQ ID NO: 120120 - DNA, 15 bp, Homo sapiens
caaaagcgttactga

SEQ ID NO: 120121 - DNA, 15 bp, Homo sapiens
ccaaaagcgttactg

SEQ ID NO: 120122 - DNA, 15 bp, Homo sapiens
cccaaaagcgttact

SEQ ID NO: 120123 - DNA, 15 bp, Homo sapiens
tcccaaaagcgttac

SEQ ID NO: 120124 - DNA, 15 bp, Homo sapiens
ctcccaaaagcgtta

SEQ ID NO: 120125 - DNA, 15 bp, Homo sapiens
actcccaaaagcgtt

SEQ ID NO: 120126 - DNA, 15 bp, Homo sapiens
cactcccaaaagcgt

SEQ ID NO: 120127 - DNA, 15 bp, Homo sapiens
ccactcccaaaagcg

SEQ ID NO: 120128 - DNA, 15 bp, Homo sapiens
gccactcccaaaagc

SEQ ID NO: 120129 - DNA, 15 bp, Homo sapiens
tgccactcccaaaag

SEQ ID NO: 120130 - DNA, 15 bp, Homo sapiens
atgccactcccaaaa

SEQ ID NO: 120131 - DNA, 15 bp, Homo sapiens
catgccactcccaaa

SEQ ID NO: 120132 - DNA, 15 bp, Homo sapiens
acatgccactcccaa

SEQ ID NO: 120133 - DNA, 15 bp, Homo sapiens
aacatgccactccca

SEQ ID NO: 120134 - DNA, 15 bp, Homo sapiens
aaacatgccactccc

SEQ ID NO: 120135 - DNA, 15 bp, Homo sapiens
aaaacatgccactcc

SEQ ID NO: 120136 - DNA, 15 bp, Homo sapiens
caaaacatgccactc

SEQ ID NO: 120137 - DNA, 15 bp, Homo sapiens
acaaaacatgccact

SEQ ID NO: 120138 - DNA, 15 bp, Homo sapiens
aacaaaacatgccac

SEQ ID NO: 120139 - DNA, 15 bp, Homo sapiens
caacaaaacatgcca

SEQ ID NO: 120140 - DNA, 15 bp, Homo sapiens
acaacaaaacatgcc

SEQ ID NO: 120141 - DNA, 15 bp, Homo sapiens
gacaacaaaacatgc

SEQ ID NO: 120142 - DNA, 15 bp, Homo sapiens
tgacaacaaaacatg

SEQ ID NO: 120143 - DNA, 15 bp, Homo sapiens
atgacaacaaaacat

SEQ ID NO: 120144 - DNA, 15 bp, Homo sapiens
catgacaacaaaaca

SEQ ID NO: 120145 - DNA, 15 bp, Homo sapiens
acatgacaacaaaac

SEQ ID NO: 120146 - DNA, 15 bp, Homo sapiens
aacatgacaacaaaa

SEQ ID NO: 120147 - DNA, 15 bp, Homo sapiens
aaacatgacaacaaa

SEQ ID NO: 120148 - DNA, 15 bp, Homo sapiens
aaaacatgacaacaa

SEQ ID NO: 120149 - DNA, 15 bp, Homo sapiens
gaaaacatgacaaca

SEQ ID NO: 120150 - DNA, 15 bp, Homo sapiens
agaaaacatgacaac

SEQ ID NO: 120151 - DNA, 15 bp, Homo sapiens
gagaaaacatgacaa

SEQ ID NO: 120152 - DNA, 15 bp, Homo sapiens
agagaaaacatgaca

SEQ ID NO: 120153 - DNA, 15 bp, Homo sapiens
aagagaaaacatgac

SEQ ID NO: 120154 - DNA, 15 bp, Homo sapiens
gaagagaaaacatga

SEQ ID NO: 120155 - DNA, 15 bp, Homo sapiens
agaagagaaaacatg

SEQ ID NO: 120156 - DNA, 15 bp, Homo sapiens
cagaagagaaaacat

SEQ ID NO: 120157 - DNA, 15 bp, Homo sapiens
ccagaagagaaaaca

SEQ ID NO: 120158 - DNA, 15 bp, Homo sapiens
tccagaagagaaaac

SEQ ID NO: 120159 - DNA, 15 bp, Homo sapiens
ttccagaagagaaaa

SEQ ID NO: 120160 - DNA, 15 bp, Homo sapiens
attccagaagagaaa

SEQ ID NO: 120161 - DNA, 15 bp, Homo sapiens
cattccagaagagaa

SEQ ID NO: 120162 - DNA, 15 bp, Homo sapiens
gcattccagaagaga

SEQ ID NO: 120163 - DNA, 15 bp, Homo sapiens
agcattccagaagag

SEQ ID NO: 120164 - DNA, 15 bp, Homo sapiens
gagcattccagaaga

SEQ ID NO: 120165 - DNA, 15 bp, Homo sapiens
agagcattccagaag

SEQ ID NO: 120166 - DNA, 15 bp, Homo sapiens
tagagcattccagaa

SEQ ID NO: 120167 - DNA, 15 bp, Homo sapiens
ttagagcattccaga

SEQ ID NO: 120168 - DNA, 15 bp, Homo sapiens
cttagagcattccag

SEQ ID NO: 120169 - DNA, 15 bp, Homo sapiens
acttagagcattcca

SEQ ID NO: 120170 - DNA, 15 bp, Homo sapiens
aacttagagcattcc

SEQ ID NO: 120171 - DNA, 15 bp, Homo sapiens
taacttagagcattc

SEQ ID NO: 120172 - DNA, 15 bp, Homo sapiens
gtaacttagagcatt

SEQ ID NO: 120173 - DNA, 15 bp, Homo sapiens
agtaacttagagcat

SEQ ID NO: 120174 - DNA, 15 bp, Homo sapiens
aagtaacttagagca

SEQ ID NO: 120175 - DNA, 15 bp, Homo sapiens
taagtaacttagagc

SEQ ID NO: 120176 - DNA, 15 bp, Homo sapiens
ctaagtaacttagag

SEQ ID NO: 120177 - DNA, 15 bp, Homo sapiens
gctaagtaacttaga

SEQ ID NO: 120178 - DNA, 15 bp, Homo sapiens
agctaagtaacttag

SEQ ID NO: 120179 - DNA, 15 bp, Homo sapiens
gagctaagtaactta

SEQ ID NO: 120180 - DNA, 15 bp, Homo sapiens
agagctaagtaactt

SEQ ID NO: 120181 - DNA, 15 bp, Homo sapiens
gagagctaagtaact

SEQ ID NO: 120182 - DNA, 15 bp, Homo sapiens
tgagagctaagtaac

SEQ ID NO: 120183 - DNA, 15 bp, Homo sapiens
atgagagctaagtaa

SEQ ID NO: 120184 - DNA, 15 bp, Homo sapiens
aatgagagctaagta

SEQ ID NO: 120185 - DNA, 15 bp, Homo sapiens
gaatgagagctaagt

SEQ ID NO: 120186 - DNA, 15 bp, Homo sapiens
ggaatgagagctaag

SEQ ID NO: 120187 - DNA, 15 bp, Homo sapiens
aggaatgagagctaa

SEQ ID NO: 120188 - DNA, 15 bp, Homo sapiens
gaggaatgagagcta

SEQ ID NO: 120189 - DNA, 15 bp, Homo sapiens
ggaggaatgagagct

SEQ ID NO: 120190 - DNA, 15 bp, Homo sapiens
gggaggaatgagagc

SEQ ID NO: 120191 - DNA, 15 bp, Homo sapiens
tgggaggaatgagag

SEQ ID NO: 120192 - DNA, 15 bp, Homo sapiens
ttgggaggaatgaga

SEQ ID NO: 120193 - DNA, 15 bp, Homo sapiens
cttgggaggaatgag

SEQ ID NO: 120194 - DNA, 15 bp, Homo sapiens
gcttgggaggaatga

SEQ ID NO: 120195 - DNA, 15 bp, Homo sapiens
tgcttgggaggaatg

SEQ ID NO: 120196 - DNA, 15 bp, Homo sapiens
atgcttgggaggaat

SEQ ID NO: 120197 - DNA, 15 bp, Homo sapiens
aatgcttgggaggaa

SEQ ID NO: 120198 - DNA, 15 bp, Homo sapiens
taatgcttgggagga

SEQ ID NO: 120199 - DNA, 15 bp, Homo sapiens
ctaatgcttgggagg

SEQ ID NO: 120200 - DNA, 15 bp, Homo sapiens
tctaatgcttgggag

SEQ ID NO: 120201 - DNA, 15 bp, Homo sapiens
atctaatgcttggga

SEQ ID NO: 120202 - DNA, 15 bp, Homo sapiens
aatctaatgcttggg

SEQ ID NO: 120203 - DNA, 15 bp, Homo sapiens
gaatctaatgcttgg

SEQ ID NO: 120204 - DNA, 15 bp, Homo sapiens
tgaatctaatgcttg

SEQ ID NO: 120205 - DNA, 15 bp, Homo sapiens
atgaatctaatgctt

SEQ ID NO: 120206 - DNA, 15 bp, Homo sapiens
aatgaatctaatgct

SEQ ID NO: 120207 - DNA, 15 bp, Homo sapiens
taatgaatctaatgc

SEQ ID NO: 120208 - DNA, 15 bp, Homo sapiens
ttaatgaatctaatg

SEQ ID NO: 120209 - DNA, 15 bp, Homo sapiens
gttaatgaatctaat

SEQ ID NO: 120210 - DNA, 15 bp, Homo sapiens
tgttaatgaatctaa

SEQ ID NO: 120211 - DNA, 15 bp, Homo sapiens
atgttaatgaatcta

SEQ ID NO: 120212 - DNA, 15 bp, Homo sapiens
aatgttaatgaatct

SEQ ID NO: 120213 - DNA, 15 bp, Homo sapiens
aaatgttaatgaatc

SEQ ID NO: 120214 - DNA, 15 bp, Homo sapiens
taaatgttaatgaat

SEQ ID NO: 120215 - DNA, 15 bp, Homo sapiens
ataaatgttaatgaa

SEQ ID NO: 120216 - DNA, 15 bp, Homo sapiens
aataaatgttaatga

SEQ ID NO: 120217 - DNA, 15 bp, Homo sapiens
aaataaatgttaatg

SEQ ID NO: 120218 - DNA, 15 bp, Homo sapiens
aaaataaatgttaat

SEQ ID NO: 120219 - DNA, 15 bp, Homo sapiens
caaaataaatgttaa

SEQ ID NO: 120220 - DNA, 15 bp, Homo sapiens
tcaaaataaatgtta

SEQ ID NO: 120221 - DNA, 15 bp, Homo sapiens
atcaaaataaatgtt

SEQ ID NO: 120222 - DNA, 15 bp, Homo sapiens
catcaaaataaatgt

SEQ ID NO: 120223 - DNA, 15 bp, Homo sapiens
ccatcaaaataaatg

SEQ ID NO: 120224 - DNA, 15 bp, Homo sapiens
cccatcaaaataaat

SEQ ID NO: 120225 - DNA, 15 bp, Homo sapiens
tcccatcaaaataaa

SEQ ID NO: 120226 - DNA, 15 bp, Homo sapiens
ctcccatcaaaataa

SEQ ID NO: 120227 - DNA, 15 bp, Homo sapiens
tctcccatcaaaata

SEQ ID NO: 120228 - DNA, 15 bp, Homo sapiens
ttctcccatcaaaat

SEQ ID NO: 120229 - DNA, 15 bp, Homo sapiens
tttctcccatcaaaa

SEQ ID NO: 120230 - DNA, 15 bp, Homo sapiens
gtttctcccatcaaa

SEQ ID NO: 120231 - DNA, 15 bp, Homo sapiens
agtttctcccatcaa

SEQ ID NO: 120232 - DNA, 15 bp, Homo sapiens
cagtttctcccatca

SEQ ID NO: 120233 - DNA, 15 bp, Homo sapiens
tcagtttctcccatc

SEQ ID NO: 120234 - DNA, 15 bp, Homo sapiens
ctcagtttctcccat

SEQ ID NO: 120235 - DNA, 15 bp, Homo sapiens
tctcagtttctccca

SEQ ID NO: 120236 - DNA, 15 bp, Homo sapiens
gtctcagtttctccc

SEQ ID NO: 120237 - DNA, 15 bp, Homo sapiens
tgtctcagtttctcc

SEQ ID NO: 120238 - DNA, 15 bp, Homo sapiens
ttgtctcagtttctc

SEQ ID NO: 120239 - DNA, 15 bp, Homo sapiens
attgtctcagtttct

SEQ ID NO: 120240 - DNA, 15 bp, Homo sapiens
tattgtctcagtttc

SEQ ID NO: 120241 - DNA, 15 bp, Homo sapiens
ttattgtctcagttt

SEQ ID NO: 120242 - DNA, 15 bp, Homo sapiens
cttattgtctcagtt

SEQ ID NO: 120243 - DNA, 15 bp, Homo sapiens
tcttattgtctcagt

SEQ ID NO: 120244 - DNA, 15 bp, Homo sapiens
ctcttattgtctcag

SEQ ID NO: 120245 - DNA, 15 bp, Homo sapiens
tctcttattgtctca

SEQ ID NO: 120246 - DNA, 15 bp, Homo sapiens
gtctcttattgtctc

SEQ ID NO: 120247 - DNA, 15 bp, Homo sapiens
tgtctcttattgtct

SEQ ID NO: 120248 - DNA, 15 bp, Homo sapiens
ttgtctcttattgtc

SEQ ID NO: 120249 - DNA, 15 bp, Homo sapiens
tttgtctcttattgt

SEQ ID NO: 120250 - DNA, 15 bp, Homo sapiens
ttttgtctcttattg

SEQ ID NO: 120251 - DNA, 15 bp, Homo sapiens
attttgtctcttatt

SEQ ID NO: 120252 - DNA, 15 bp, Homo sapiens
tattttgtctcttat

SEQ ID NO: 120253 - DNA, 15 bp, Homo sapiens
ttattttgtctctta

SEQ ID NO: 120254 - DNA, 15 bp, Homo sapiens
cttattttgtctctt

SEQ ID NO: 120255 - DNA, 15 bp, Homo sapiens
tcttattttgtctct

SEQ ID NO: 120256 - DNA, 15 bp, Homo sapiens
ctcttattttgtctc

SEQ ID NO: 120257 - DNA, 15 bp, Homo sapiens
tctcttattttgtct

SEQ ID NO: 120258 - DNA, 15 bp, Homo sapiens
gtctcttattttgtc

SEQ ID NO: 120259 - DNA, 15 bp, Homo sapiens
cgtctcttattttgt

SEQ ID NO: 120260 - DNA, 15 bp, Homo sapiens
tcgtctcttattttg

SEQ ID NO: 120261 - DNA, 15 bp, Homo sapiens
ttcgtctcttatttt

SEQ ID NO: 120262 - DNA, 15 bp, Homo sapiens
gttcgtctcttattt

SEQ ID NO: 120263 - DNA, 15 bp, Homo sapiens
agttcgtctcttatt

SEQ ID NO: 120264 - DNA, 15 bp, Homo sapiens
aagttcgtctcttat

SEQ ID NO: 120265 - DNA, 15 bp, Homo sapiens
caagttcgtctctta

SEQ ID NO: 120266 - DNA, 15 bp, Homo sapiens
tcaagttcgtctctt

SEQ ID NO: 120267 - DNA, 15 bp, Homo sapiens
ttcaagttcgtctct

SEQ ID NO: 120268 - DNA, 15 bp, Homo sapiens
tttcaagttcgtctc

SEQ ID NO: 120269 - DNA, 15 bp, Homo sapiens
atttcaagttcgtct

SEQ ID NO: 120270 - DNA, 15 bp, Homo sapiens
aatttcaagttcgtc

SEQ ID NO: 120271 - DNA, 15 bp, Homo sapiens
caatttcaagttcgt

SEQ ID NO: 120272 - DNA, 15 bp, Homo sapiens
tcaatttcaagttcg

SEQ ID NO: 120273 - DNA, 15 bp, Homo sapiens
ttcaatttcaagttc

SEQ ID NO: 120274 - DNA, 15 bp, Homo sapiens
tttcaatttcaagtt

SEQ ID NO: 120275 - DNA, 15 bp, Homo sapiens
ctttcaatttcaagt

SEQ ID NO: 120276 - DNA, 15 bp, Homo sapiens
tctttcaatttcaag

SEQ ID NO: 120277 - DNA, 15 bp, Homo sapiens
gtctttcaatttcaa

SEQ ID NO: 120278 - DNA, 15 bp, Homo sapiens
agtctttcaatttca

SEQ ID NO: 120279 - DNA, 15 bp, Homo sapiens
aagtctttcaatttc

SEQ ID NO: 120280 - DNA, 15 bp, Homo sapiens
caagtctttcaattt

SEQ ID NO: 120281 - DNA, 15 bp, Homo sapiens
acaagtctttcaatt

SEQ ID NO: 120282 - DNA, 15 bp, Homo sapiens
tacaagtctttcaat

SEQ ID NO: 120283 - DNA, 15 bp, Homo sapiens
ttacaagtctttcaa

SEQ ID NO: 120284 - DNA, 15 bp, Homo sapiens
cttacaagtctttca

SEQ ID NO: 120285 - DNA, 15 bp, Homo sapiens
tcttacaagtctttc

SEQ ID NO: 120286 - DNA, 15 bp, Homo sapiens
ctcttacaagtcttt

SEQ ID NO: 120287 - DNA, 15 bp, Homo sapiens
tctcttacaagtctt

SEQ ID NO: 120288 - DNA, 15 bp, Homo sapiens
atctcttacaagtct

SEQ ID NO: 120289 - DNA, 15 bp, Homo sapiens
aatctcttacaagtc

SEQ ID NO: 120290 - DNA, 15 bp, Homo sapiens
aaatctcttacaagt

SEQ ID NO: 120291 - DNA, 15 bp, Homo sapiens
gaaatctcttacaag

SEQ ID NO: 120292 - DNA, 15 bp, Homo sapiens
tgaaatctcttacaa

SEQ ID NO: 120293 - DNA, 15 bp, Homo sapiens
ctgaaatctcttaca

SEQ ID NO: 120294 - DNA, 15 bp, Homo sapiens
gctgaaatctcttac

SEQ ID NO: 120295 - DNA, 15 bp, Homo sapiens
tgctgaaatctctta

SEQ ID NO: 120296 - DNA, 15 bp, Homo sapiens
gtgctgaaatctctt

SEQ ID NO: 120297 - DNA, 15 bp, Homo sapiens
tgtgctgaaatctct

SEQ ID NO: 120298 - DNA, 15 bp, Homo sapiens
ttgtgctgaaatctc

SEQ ID NO: 120299 - DNA, 15 bp, Homo sapiens
attgtgctgaaatct

SEQ ID NO: 120300 - DNA, 15 bp, Homo sapiens
gattgtgctgaaatc

SEQ ID NO: 120301 - DNA, 15 bp, Homo sapiens
tgattgtgctgaaat

SEQ ID NO: 120302 - DNA, 15 bp, Homo sapiens
ttgattgtgctgaaa

SEQ ID NO: 120303 - DNA, 15 bp, Homo sapiens
gttgattgtgctgaa

SEQ ID NO: 120304 - DNA, 15 bp, Homo sapiens
ggttgattgtgctga

SEQ ID NO: 120305 - DNA, 15 bp, Homo sapiens
cggttgattgtgctg

SEQ ID NO: 120306 - DNA, 15 bp, Homo sapiens
ccggttgattgtgct

SEQ ID NO: 120307 - DNA, 15 bp, Homo sapiens
tccggttgattgtgc

SEQ ID NO: 120308 - DNA, 15 bp, Homo sapiens
ctccggttgattgtg

SEQ ID NO: 120309 - DNA, 15 bp, Homo sapiens
actccggttgattgt

SEQ ID NO: 120310 - DNA, 15 bp, Homo sapiens
tactccggttgattg

SEQ ID NO: 120311 - DNA, 15 bp, Homo sapiens
ttactccggttgatt

SEQ ID NO: 120312 - DNA, 15 bp, Homo sapiens
cttactccggttgat

SEQ ID NO: 120313 - DNA, 15 bp, Homo sapiens
tcttactccggttga

SEQ ID NO: 120314 - DNA, 15 bp, Homo sapiens
gtcttactccggttg

SEQ ID NO: 120315 - DNA, 15 bp, Homo sapiens
ggtcttactccggtt

SEQ ID NO: 120316 - DNA, 15 bp, Homo sapiens
aggtcttactccggt

SEQ ID NO: 120317 - DNA, 15 bp, Homo sapiens
taggtcttactccgg

SEQ ID NO: 120318 - DNA, 15 bp, Homo sapiens
ataggtcttactccg

SEQ ID NO: 120319 - DNA, 15 bp, Homo sapiens
aataggtcttactcc

SEQ ID NO: 120320 - DNA, 15 bp, Homo sapiens
gaataggtcttactc

SEQ ID NO: 120321 - DNA, 15 bp, Homo sapiens
tgaataggtcttact

SEQ ID NO: 120322 - DNA, 15 bp, Homo sapiens
gtgaataggtcttac

SEQ ID NO: 120323 - DNA, 15 bp, Homo sapiens
tgtgaataggtctta

SEQ ID NO: 120324 - DNA, 15 bp, Homo sapiens
atgtgaataggtctt

SEQ ID NO: 120325 - DNA, 15 bp, Homo sapiens
tatgtgaataggtct

SEQ ID NO: 120326 - DNA, 15 bp, Homo sapiens
ttatgtgaataggtc

SEQ ID NO: 120327 - DNA, 15 bp, Homo sapiens
cttatgtgaataggt

SEQ ID NO: 120328 - DNA, 15 bp, Homo sapiens
tcttatgtgaatagg

SEQ ID NO: 120329 - DNA, 15 bp, Homo sapiens
atcttatgtgaatag

SEQ ID NO: 120330 - DNA, 15 bp, Homo sapiens
catcttatgtgaata

SEQ ID NO: 120331 - DNA, 15 bp, Homo sapiens
gcatcttatgtgaat

SEQ ID NO: 120332 - DNA, 15 bp, Homo sapiens
ggcatcttatgtgaa

SEQ ID NO: 120333 - DNA, 15 bp, Homo sapiens
tggcatcttatgtga

SEQ ID NO: 120334 - DNA, 15 bp, Homo sapiens
ttggcatcttatgtg

SEQ ID NO: 120335 - DNA, 15 bp, Homo sapiens
attggcatcttatgt

SEQ ID NO: 120336 - DNA, 15 bp, Homo sapiens
cattggcatcttatg

SEQ ID NO: 120337 - DNA, 15 bp, Homo sapiens
tcattggcatcttat

SEQ ID NO: 120338 - DNA, 15 bp, Homo sapiens
ctcattggcatctta

SEQ ID NO: 120339 - DNA, 15 bp, Homo sapiens
actcattggcatctt

SEQ ID NO: 120340 - DNA, 15 bp, Homo sapiens
gactcattggcatct

SEQ ID NO: 120341 - DNA, 15 bp, Homo sapiens
agactcattggcatc

SEQ ID NO: 120342 - DNA, 15 bp, Homo sapiens
aagactcattggcat

SEQ ID NO: 120343 - DNA, 15 bp, Homo sapiens
caagactcattggca

SEQ ID NO: 120344 - DNA, 15 bp, Homo sapiens
gcaagactcattggc

SEQ ID NO: 120345 - DNA, 15 bp, Homo sapiens
agcaagactcattgg

SEQ ID NO: 120346 - DNA, 15 bp, Homo sapiens
cagcaagactcattg

SEQ ID NO: 120347 - DNA, 15 bp, Homo sapiens
tcagcaagactcatt

SEQ ID NO: 120348 - DNA, 15 bp, Homo sapiens
atcagcaagactcat

SEQ ID NO: 120349 - DNA, 15 bp, Homo sapiens
aatcagcaagactca

SEQ ID NO: 120350 - DNA, 15 bp, Homo sapiens
caatcagcaagactc

SEQ ID NO: 120351 - DNA, 15 bp, Homo sapiens
gcaatcagcaagact

SEQ ID NO: 120352 - DNA, 15 bp, Homo sapiens
agcaatcagcaagac

SEQ ID NO: 120353 - DNA, 15 bp, Homo sapiens
cagcaatcagcaaga

SEQ ID NO: 120354 - DNA, 15 bp, Homo sapiens
tcagcaatcagcaag

SEQ ID NO: 120355 - DNA, 15 bp, Homo sapiens
gtcagcaatcagcaa

SEQ ID NO: 120356 - DNA, 15 bp, Homo sapiens
agtcagcaatcagca

SEQ ID NO: 120357 - DNA, 15 bp, Homo sapiens
aagtcagcaatcagc

SEQ ID NO: 120358 - DNA, 15 bp, Homo sapiens
aaagtcagcaatcag

SEQ ID NO: 120359 - DNA, 15 bp, Homo sapiens
aaaagtcagcaatca

SEQ ID NO: 120360 - DNA, 15 bp, Homo sapiens
caaaagtcagcaatc

SEQ ID NO: 120361 - DNA, 15 bp, Homo sapiens
acaaaagtcagcaat

SEQ ID NO: 120362 - DNA, 15 bp, Homo sapiens
tacaaaagtcagcaa

SEQ ID NO: 120363 - DNA, 15 bp, Homo sapiens
atacaaaagtcagca

SEQ ID NO: 120364 - DNA, 15 bp, Homo sapiens
aatacaaaagtcagc

SEQ ID NO: 120365 - DNA, 15 bp, Homo sapiens
gaatacaaaagtcag

SEQ ID NO: 120366 - DNA, 15 bp, Homo sapiens
agaatacaaaagtca

SEQ ID NO: 120367 - DNA, 15 bp, Homo sapiens
gagaatacaaaagtc

SEQ ID NO: 120368 - DNA, 15 bp, Homo sapiens
ggagaatacaaaagt

SEQ ID NO: 120369 - DNA, 15 bp, Homo sapiens
tggagaatacaaaag

SEQ ID NO: 120370 - DNA, 15 bp, Homo sapiens
aatggagaatacaaa

SEQ ID NO: 120371 - DNA, 15 bp, Homo sapiens
caatggagaatacaa

SEQ ID NO: 120372 - DNA, 15 bp, Homo sapiens
tcaatggagaataca

SEQ ID NO: 120373 - DNA, 15 bp, Homo sapiens
ctcaatggagaatac

SEQ ID NO: 120374 - DNA, 15 bp, Homo sapiens
actcaatggagaata

SEQ ID NO: 120375 - DNA, 15 bp, Homo sapiens
cactcaatggagaat

SEQ ID NO: 120376 - DNA, 15 bp, Homo sapiens
gcactcaatggagaa

SEQ ID NO: 120377 - DNA, 15 bp, Homo sapiens
agcactcaatggaga

SEQ ID NO: 120378 - DNA, 15 bp, Homo sapiens
cagcactcaatggag

SEQ ID NO: 120379 - DNA, 15 bp, Homo sapiens
gcagcactcaatgga

SEQ ID NO: 120380 - DNA, 15 bp, Homo sapiens
agcagcactcaatgg

SEQ ID NO: 120381 - DNA, 15 bp, Homo sapiens
aagcagcactcaatg

SEQ ID NO: 120382 - DNA, 15 bp, Homo sapiens
taagcagcactcaat

SEQ ID NO: 120383 - DNA, 15 bp, Homo sapiens
gtaagcagcactcaa

SEQ ID NO: 120384 - DNA, 15 bp, Homo sapiens
agtaagcagcactca

SEQ ID NO: 120385 - DNA, 15 bp, Homo sapiens
aagtaagcagcactc

SEQ ID NO: 120386 - DNA, 15 bp, Homo sapiens
gaagtaagcagcact

SEQ ID NO: 120387 - DNA, 15 bp, Homo sapiens
agaagtaagcagcac

SEQ ID NO: 120388 - DNA, 15 bp, Homo sapiens
cagaagtaagcagca

SEQ ID NO: 120389 - DNA, 15 bp, Homo sapiens
acagaagtaagcagc

SEQ ID NO: 120390 - DNA, 15 bp, Homo sapiens
tacagaagtaagcag

SEQ ID NO: 120391 - DNA, 15 bp, Homo sapiens
atacagaagtaagca

SEQ ID NO: 120392 - DNA, 15 bp, Homo sapiens
aatacagaagtaagc

SEQ ID NO: 120393 - DNA, 15 bp, Homo sapiens
gaatacagaagtaag

SEQ ID NO: 120394 - DNA, 15 bp, Homo sapiens
agaatacagaagtaa

SEQ ID NO: 120395 - DNA, 15 bp, Homo sapiens
gagaatacagaagta

SEQ ID NO: 120396 - DNA, 15 bp, Homo sapiens
ggagaatacagaagt

SEQ ID NO: 120397 - DNA, 15 bp, Homo sapiens
tggagaatacagaag

SEQ ID NO: 120398 - DNA, 15 bp, Homo sapiens
ctggagaatacagaa

SEQ ID NO: 120399 - DNA, 15 bp, Homo sapiens
actggagaatacaga

SEQ ID NO: 120400 - DNA, 15 bp, Homo sapiens
cactggagaatacag

SEQ ID NO: 120401 - DNA, 15 bp, Homo sapiens
tcactggagaataca

SEQ ID NO: 120402 - DNA, 15 bp, Homo sapiens
ctcactggagaatac

SEQ ID NO: 120403 - DNA, 15 bp, Homo sapiens
actcactggagaata

SEQ ID NO: 120404 - DNA, 15 bp, Homo sapiens
gactcactggagaat

SEQ ID NO: 120405 - DNA, 15 bp, Homo sapiens
agactcactggagaa

SEQ ID NO: 120406 - DNA, 15 bp, Homo sapiens
aagactcactggaga

SEQ ID NO: 120407 - DNA, 15 bp, Homo sapiens
taagactcactggag

SEQ ID NO: 120408 - DNA, 15 bp, Homo sapiens
gtaagactcactgga

SEQ ID NO: 120409 - DNA, 15 bp, Homo sapiens
agtaagactcactgg

SEQ ID NO: 120410 - DNA, 15 bp, Homo sapiens
aagtaagactcactg

SEQ ID NO: 120411 - DNA, 15 bp, Homo sapiens
taagtaagactcact

SEQ ID NO: 120412 - DNA, 15 bp, Homo sapiens
gtaagtaagactcac

SEQ ID NO: 120413 - DNA, 15 bp, Homo sapiens
agtaagtaagactca

SEQ ID NO: 120414 - DNA, 15 bp, Homo sapiens
aagtaagtaagactc

SEQ ID NO: 120415 - DNA, 15 bp, Homo sapiens
aaagtaagtaagact

SEQ ID NO: 120416 - DNA, 15 bp, Homo sapiens
aaaagtaagtaagac

SEQ ID NO: 120417 - DNA, 15 bp, Homo sapiens
caaaagtaagtaaga

SEQ ID NO: 120418 - DNA, 15 bp, Homo sapiens
acaaaagtaagtaag

SEQ ID NO: 120419 - DNA, 15 bp, Homo sapiens
tacaaaagtaagtaa

SEQ ID NO: 120420 - DNA, 15 bp, Homo sapiens
atacaaaagtaagta

SEQ ID NO: 120421 - DNA, 15 bp, Homo sapiens
aatacaaaagtaagt

SEQ ID NO: 120422 - DNA, 15 bp, Homo sapiens
gaatacaaaagtaag

SEQ ID NO: 120423 - DNA, 15 bp, Homo sapiens
agaatacaaaagtaa

SEQ ID NO: 120424 - DNA, 15 bp, Homo sapiens
gagaatacaaaagta

SEQ ID NO: 120425 - DNA, 15 bp, Homo sapiens
ttggagaatacaaaa

SEQ ID NO: 120426 - DNA, 15 bp, Homo sapiens
attggagaatacaaa

SEQ ID NO: 120427 - DNA, 15 bp, Homo sapiens
cattggagaatacaa

SEQ ID NO: 120428 - DNA, 15 bp, Homo sapiens
tcattggagaataca

SEQ ID NO: 120429 - DNA, 15 bp, Homo sapiens
ctcattggagaatac

SEQ ID NO: 120430 - DNA, 15 bp, Homo sapiens
actcattggagaata

SEQ ID NO: 120431 - DNA, 15 bp, Homo sapiens
gactcattggagaat

SEQ ID NO: 120432 - DNA, 15 bp, Homo sapiens
agactcattggagaa

SEQ ID NO: 120433 - DNA, 15 bp, Homo sapiens
cagactcattggaga

SEQ ID NO: 120434 - DNA, 15 bp, Homo sapiens
acagactcattggag

SEQ ID NO: 120435 - DNA, 15 bp, Homo sapiens
gacagactcattgga

SEQ ID NO: 120436 - DNA, 15 bp, Homo sapiens
agacagactcattgg

SEQ ID NO: 120437 - DNA, 15 bp, Homo sapiens
aagacagactcattg

SEQ ID NO: 120438 - DNA, 15 bp, Homo sapiens
taagacagactcatt

SEQ ID NO: 120439 - DNA, 15 bp, Homo sapiens
gtaagacagactcat

SEQ ID NO: 120440 - DNA, 15 bp, Homo sapiens
agtaagacagactca

SEQ ID NO: 120441 - DNA, 15 bp, Homo sapiens
aagtaagacagactc

SEQ ID NO: 120442 - DNA, 15 bp, Homo sapiens
gaagtaagacagact

SEQ ID NO: 120443 - DNA, 15 bp, Homo sapiens
agaagtaagacagac

SEQ ID NO: 120444 - DNA, 15 bp, Homo sapiens
cagaagtaagacaga

SEQ ID NO: 120445 - DNA, 15 bp, Homo sapiens
acagaagtaagacag

SEQ ID NO: 120446 - DNA, 15 bp, Homo sapiens
tacagaagtaagaca

SEQ ID NO: 120447 - DNA, 15 bp, Homo sapiens
gtacagaagtaagac

SEQ ID NO: 120448 - DNA, 15 bp, Homo sapiens
agtacagaagtaaga

SEQ ID NO: 120449 - DNA, 15 bp, Homo sapiens
gagtacagaagtaag

SEQ ID NO: 120450 - DNA, 15 bp, Homo sapiens
agagtacagaagtaa

SEQ ID NO: 120451 - DNA, 15 bp, Homo sapiens
gagagtacagaagta

SEQ ID NO: 120452 - DNA, 15 bp, Homo sapiens
ggagagtacagaagt

SEQ ID NO: 120453 - DNA, 15 bp, Homo sapiens
tggagagtacagaag

SEQ ID NO: 120454 - DNA, 15 bp, Homo sapiens
ttggagagtacagaa

SEQ ID NO: 120455 - DNA, 15 bp, Homo sapiens
attggagagtacaga

SEQ ID NO: 120456 - DNA, 15 bp, Homo sapiens
cattggagagtacag

SEQ ID NO: 120457 - DNA, 15 bp, Homo sapiens
tcattggagagtaca

SEQ ID NO: 120458 - DNA, 15 bp, Homo sapiens
ctcattggagagtac

SEQ ID NO: 120459 - DNA, 15 bp, Homo sapiens
actcattggagagta

SEQ ID NO: 120460 - DNA, 15 bp, Homo sapiens
gactcattggagagt

SEQ ID NO: 120461 - DNA, 15 bp, Homo sapiens
agactcattggagag

SEQ ID NO: 120462 - DNA, 15 bp, Homo sapiens
aagactcattggaga

SEQ ID NO: 120463 - DNA, 15 bp, Homo sapiens
taagactcattggag

SEQ ID NO: 120464 - DNA, 15 bp, Homo sapiens
gtaagactcattgga

SEQ ID NO: 120465 - DNA, 15 bp, Homo sapiens
tgtaagactcattgg

SEQ ID NO: 120466 - DNA, 15 bp, Homo sapiens
atgtaagactcattg

SEQ ID NO: 120467 - DNA, 15 bp, Homo sapiens
tatgtaagactcatt

SEQ ID NO: 120468 - DNA, 15 bp, Homo sapiens
gtatgtaagactcat

SEQ ID NO: 120469 - DNA, 15 bp, Homo sapiens
agtatgtaagactca

SEQ ID NO: 120470 - DNA, 15 bp, Homo sapiens
aagtatgtaagactc

SEQ ID NO: 120471 - DNA, 15 bp, Homo sapiens
aaagtatgtaagact

SEQ ID NO: 120472 - DNA, 15 bp, Homo sapiens
aaaagtatgtaagac

SEQ ID NO: 120473 - DNA, 15 bp, Homo sapiens
caaaagtatgtaaga

SEQ ID NO: 120474 - DNA, 15 bp, Homo sapiens
acaaaagtatgtaag

SEQ ID NO: 120475 - DNA, 15 bp, Homo sapiens
tacaaaagtatgtaa

SEQ ID NO: 120476 - DNA, 15 bp, Homo sapiens
atacaaaagtatgta

SEQ ID NO: 120477 - DNA, 15 bp, Homo sapiens
aatacaaaagtatgt

SEQ ID NO: 120478 - DNA, 15 bp, Homo sapiens
gaatacaaaagtatg

SEQ ID NO: 120479 - DNA, 15 bp, Homo sapiens
agaatacaaaagtat

SEQ ID NO: 120480 - DNA, 15 bp, Homo sapiens
ctggagaatacaaaa

SEQ ID NO: 120481 - DNA, 15 bp, Homo sapiens
gctggagaatacaaa

SEQ ID NO: 120482 - DNA, 15 bp, Homo sapiens
cgctggagaatacaa

SEQ ID NO: 120483 - DNA, 15 bp, Homo sapiens
tcgctggagaataca

SEQ ID NO: 120484 - DNA, 15 bp, Homo sapiens
ctcgctggagaatac

SEQ ID NO: 120485 - DNA, 15 bp, Homo sapiens
actcgctggagaata

SEQ ID NO: 120486 - DNA, 15 bp, Homo sapiens
gactcgctggagaat

SEQ ID NO: 120487 - DNA, 15 bp, Homo sapiens
agactcgctggagaa

SEQ ID NO: 120488 - DNA, 15 bp, Homo sapiens
aagactcgctggaga

SEQ ID NO: 120489 - DNA, 15 bp, Homo sapiens
taagactcgctggag

SEQ ID NO: 120490 - DNA, 15 bp, Homo sapiens
gtaagactcgctgga

SEQ ID NO: 120491 - DNA, 15 bp, Homo sapiens
agtaagactcgctgg

SEQ ID NO: 120492 - DNA, 15 bp, Homo sapiens
aagtaagactcgctg

SEQ ID NO: 120493 - DNA, 15 bp, Homo sapiens
gaagtaagactcgct

SEQ ID NO: 120494 - DNA, 15 bp, Homo sapiens
agaagtaagactcgc

SEQ ID NO: 120495 - DNA, 15 bp, Homo sapiens
cagaagtaagactcg

SEQ ID NO: 120496 - DNA, 15 bp, Homo sapiens
acagaagtaagactc

SEQ ID NO: 120497 - DNA, 15 bp, Homo sapiens
tacagaagtaagact

SEQ ID NO: 120498 - DNA, 15 bp, Homo sapiens
atacagaagtaagac

SEQ ID NO: 120499 - DNA, 15 bp, Homo sapiens
aatacagaagtaaga

SEQ ID NO: 120500 - DNA, 15 bp, Homo sapiens
aaatacagaagtaag

SEQ ID NO: 120501 - DNA, 15 bp, Homo sapiens
aaaatacagaagtaa

SEQ ID NO: 120502 - DNA, 15 bp, Homo sapiens
gaaaatacagaagta

SEQ ID NO: 120503 - DNA, 15 bp, Homo sapiens
ggaaaatacagaagt

SEQ ID NO: 120504 - DNA, 15 bp, Homo sapiens
tggaaaatacagaag

SEQ ID NO: 120505 - DNA, 15 bp, Homo sapiens
ttggaaaatacagaa

SEQ ID NO: 120506 - DNA, 15 bp, Homo sapiens
attggaaaatacaga

SEQ ID NO: 120507 - DNA, 15 bp, Homo sapiens
cattggaaaatacag

SEQ ID NO: 120508 - DNA, 15 bp, Homo sapiens
tcattggaaaataca

SEQ ID NO: 120509 - DNA, 15 bp, Homo sapiens
ctcattggaaaatac

SEQ ID NO: 120510 - DNA, 15 bp, Homo sapiens
tctcattggaaaata

SEQ ID NO: 120511 - DNA, 15 bp, Homo sapiens
ttctcattggaaaat

SEQ ID NO: 120512 - DNA, 15 bp, Homo sapiens
attctcattggaaaa

SEQ ID NO: 120513 - DNA, 15 bp, Homo sapiens
aattctcattggaaa

SEQ ID NO: 120514 - DNA, 15 bp, Homo sapiens
taattctcattggaa

SEQ ID NO: 120515 - DNA, 15 bp, Homo sapiens
gtaattctcattgga

SEQ ID NO: 120516 - DNA, 15 bp, Homo sapiens
agtaattctcattgg

SEQ ID NO: 120517 - DNA, 15 bp, Homo sapiens
aagtaattctcattg

SEQ ID NO: 120518 - DNA, 15 bp, Homo sapiens
taagtaattctcatt

SEQ ID NO: 120519 - DNA, 15 bp, Homo sapiens
gtaagtaattctcat

SEQ ID NO: 120520 - DNA, 15 bp, Homo sapiens
ggtaagtaattctca

SEQ ID NO: 120521 - DNA, 15 bp, Homo sapiens
aggtaagtaattctc

SEQ ID NO: 120522 - DNA, 15 bp, Homo sapiens
gaggtaagtaattct

SEQ ID NO: 120523 - DNA, 15 bp, Homo sapiens
agaggtaagtaattc

SEQ ID NO: 120524 - DNA, 15 bp, Homo sapiens
cagaggtaagtaatt

SEQ ID NO: 120525 - DNA, 15 bp, Homo sapiens
acagaggtaagtaat

SEQ ID NO: 120526 - DNA, 15 bp, Homo sapiens
cacagaggtaagtaa

SEQ ID NO: 120527 - DNA, 15 bp, Homo sapiens
acacagaggtaagta

SEQ ID NO: 120528 - DNA, 15 bp, Homo sapiens
aacacagaggtaagt

SEQ ID NO: 120529 - DNA, 15 bp, Homo sapiens
gaacacagaggtaag

SEQ ID NO: 120530 - DNA, 15 bp, Homo sapiens
agaacacagaggtaa

SEQ ID NO: 120531 - DNA, 15 bp, Homo sapiens
gagaacacagaggta

SEQ ID NO: 120532 - DNA, 15 bp, Homo sapiens
ggagaacacagaggt

SEQ ID NO: 120533 - DNA, 15 bp, Homo sapiens
tggagaacacagagg

SEQ ID NO: 120534 - DNA, 15 bp, Homo sapiens
ttggagaacacagag

SEQ ID NO: 120535 - DNA, 15 bp, Homo sapiens
attggagaacacaga

SEQ ID NO: 120536 - DNA, 15 bp, Homo sapiens
cattggagaacacag

SEQ ID NO: 120537 - DNA, 15 bp, Homo sapiens
tcattggagaacaca

SEQ ID NO: 120538 - DNA, 15 bp, Homo sapiens
ctcattggagaacac

SEQ ID NO: 120539 - DNA, 15 bp, Homo sapiens
actcattggagaaca

SEQ ID NO: 120540 - DNA, 15 bp, Homo sapiens
gactcattggagaac

SEQ ID NO: 120541 - DNA, 15 bp, Homo sapiens
ggactcattggagaa

SEQ ID NO: 120542 - DNA, 15 bp, Homo sapiens
aggactcattggaga

SEQ ID NO: 120543 - DNA, 15 bp, Homo sapiens
taggactcattggag

SEQ ID NO: 120544 - DNA, 15 bp, Homo sapiens
ataggactcattgga

SEQ ID NO: 120545 - DNA, 15 bp, Homo sapiens
cataggactcattgg

SEQ ID NO: 120546 - DNA, 15 bp, Homo sapiens
acataggactcattg

SEQ ID NO: 120547 - DNA, 15 bp, Homo sapiens
cacataggactcatt

SEQ ID NO: 120548 - DNA, 15 bp, Homo sapiens
tcacataggactcat

SEQ ID NO: 120549 - DNA, 15 bp, Homo sapiens
ttcacataggactca

SEQ ID NO: 120550 - DNA, 15 bp, Homo sapiens
gttcacataggactc

SEQ ID NO: 120551 - DNA, 15 bp, Homo sapiens
tgttcacataggact

SEQ ID NO: 120552 - DNA, 15 bp, Homo sapiens
ctgttcacataggac

SEQ ID NO: 120553 - DNA, 15 bp, Homo sapiens
gctgttcacatagga

SEQ ID NO: 120554 - DNA, 15 bp, Homo sapiens
agctgttcacatagg

SEQ ID NO: 120555 - DNA, 15 bp, Homo sapiens
gagctgttcacatag

SEQ ID NO: 120556 - DNA, 15 bp, Homo sapiens
agagctgttcacata

SEQ ID NO: 120557 - DNA, 15 bp, Homo sapiens
gagagctgttcacat

SEQ ID NO: 120558 - DNA, 15 bp, Homo sapiens
tgagagctgttcaca

SEQ ID NO: 120559 - DNA, 15 bp, Homo sapiens
gtgagagctgttcac

SEQ ID NO: 120560 - DNA, 15 bp, Homo sapiens
ggtgagagctgttca

SEQ ID NO: 120561 - DNA, 15 bp, Homo sapiens
aggtgagagctgttc

SEQ ID NO: 120562 - DNA, 15 bp, Homo sapiens
caggtgagagctgtt

SEQ ID NO: 120563 - DNA, 15 bp, Homo sapiens
ccaggtgagagctgt

SEQ ID NO: 120564 - DNA, 15 bp, Homo sapiens
accaggtgagagctg

SEQ ID NO: 120565 - DNA, 15 bp, Homo sapiens
aaccaggtgagagct

SEQ ID NO: 120566 - DNA, 15 bp, Homo sapiens
caaccaggtgagagc

SEQ ID NO: 120567 - DNA, 15 bp, Homo sapiens
tcaaccaggtgagag

SEQ ID NO: 120568 - DNA, 15 bp, Homo sapiens
atcaaccaggtgaga

SEQ ID NO: 120569 - DNA, 15 bp, Homo sapiens
aatcaaccaggtgag

SEQ ID NO: 120570 - DNA, 15 bp, Homo sapiens
taatcaaccaggtga

SEQ ID NO: 120571 - DNA, 15 bp, Homo sapiens
ataatcaaccaggtg

SEQ ID NO: 120572 - DNA, 15 bp, Homo sapiens
cataatcaaccaggt

SEQ ID NO: 120573 - DNA, 15 bp, Homo sapiens
gcataatcaaccagg

SEQ ID NO: 120574 - DNA, 15 bp, Homo sapiens
agcataatcaaccag

SEQ ID NO: 120575 - DNA, 15 bp, Homo sapiens
cagcataatcaacca

SEQ ID NO: 120576 - DNA, 15 bp, Homo sapiens
tcagcataatcaacc

SEQ ID NO: 120577 - DNA, 15 bp, Homo sapiens
ttcagcataatcaac

SEQ ID NO: 120578 - DNA, 15 bp, Homo sapiens
gatttcagcataatc

SEQ ID NO: 120579 - DNA, 15 bp, Homo sapiens
agatttcagcataat

SEQ ID NO: 120580 - DNA, 15 bp, Homo sapiens
gagatttcagcataa

SEQ ID NO: 120581 - DNA, 15 bp, Homo sapiens
agagatttcagcata

SEQ ID NO: 120582 - DNA, 15 bp, Homo sapiens
aagagatttcagcat

SEQ ID NO: 120583 - DNA, 15 bp, Homo sapiens
taagagatttcagca

SEQ ID NO: 120584 - DNA, 15 bp, Homo sapiens
gtaagagatttcagc

SEQ ID NO: 120585 - DNA, 15 bp, Homo sapiens
agtaagagatttcag

SEQ ID NO: 120586 - DNA, 15 bp, Homo sapiens
cagtaagagatttca

SEQ ID NO: 120587 - DNA, 15 bp, Homo sapiens
ccagtaagagatttc

SEQ ID NO: 120588 - DNA, 15 bp, Homo sapiens
cccagtaagagattt

SEQ ID NO: 120589 - DNA, 15 bp, Homo sapiens
ccccagtaagagatt

SEQ ID NO: 120590 - DNA, 15 bp, Homo sapiens
tccccagtaagagat

SEQ ID NO: 120591 - DNA, 15 bp, Homo sapiens
atccccagtaagaga

SEQ ID NO: 120592 - DNA, 15 bp, Homo sapiens
gatccccagtaagag

SEQ ID NO: 120593 - DNA, 15 bp, Homo sapiens
ggatccccagtaaga

SEQ ID NO: 120594 - DNA, 15 bp, Homo sapiens
gggatccccagtaag

SEQ ID NO: 120595 - DNA, 15 bp, Homo sapiens
tgggatccccagtaa

SEQ ID NO: 120596 - DNA, 15 bp, Homo sapiens
ctgggatccccagta

SEQ ID NO: 120597 - DNA, 15 bp, Homo sapiens
tctgggatccccagt

SEQ ID NO: 120598 - DNA, 15 bp, Homo sapiens
atctgggatccccag

SEQ ID NO: 120599 - DNA, 15 bp, Homo sapiens
tatctgggatcccca

SEQ ID NO: 120600 - DNA, 15 bp, Homo sapiens
atatctgggatcccc

SEQ ID NO: 120601 - DNA, 15 bp, Homo sapiens
aatatctgggatccc

SEQ ID NO: 120602 - DNA, 15 bp, Homo sapiens
aaatatctgggatcc

SEQ ID NO: 120603 - DNA, 15 bp, Homo sapiens
taaatatctgggatc

SEQ ID NO: 120604 - DNA, 15 bp, Homo sapiens
ataaatatctgggat

SEQ ID NO: 120605 - DNA, 15 bp, Homo sapiens
aataaatatctggga

SEQ ID NO: 120606 - DNA, 15 bp, Homo sapiens
aaataaatatctggg

SEQ ID NO: 120607 - DNA, 15 bp, Homo sapiens
taaataaatatctgg

SEQ ID NO: 120608 - DNA, 15 bp, Homo sapiens
ttaaataaatatctg

SEQ ID NO: 120609 - DNA, 15 bp, Homo sapiens
tttaaataaatatct

SEQ ID NO: 120610 - DNA, 15 bp, Homo sapiens
gtttaaataaatatc

SEQ ID NO: 120611 - DNA, 15 bp, Homo sapiens
agtttaaataaatat

SEQ ID NO: 120612 - DNA, 15 bp, Homo sapiens
tagtttaaataaata

SEQ ID NO: 120613 - DNA, 15 bp, Homo sapiens
gtagtttaaataaat

SEQ ID NO: 120614 - DNA, 15 bp, Homo sapiens
ggtagtttaaataaa

SEQ ID NO: 120615 - DNA, 15 bp, Homo sapiens
aggtagtttaaataa

SEQ ID NO: 120616 - DNA, 15 bp, Homo sapiens
aaggtagtttaaata

SEQ ID NO: 120617 - DNA, 15 bp, Homo sapiens
aaaggtagtttaaat

SEQ ID NO: 120618 - DNA, 15 bp, Homo sapiens
gaaaggtagtttaaa

SEQ ID NO: 120619 - DNA, 15 bp, Homo sapiens
ggaaaggtagtttaa

SEQ ID NO: 120620 - DNA, 15 bp, Homo sapiens
aggaaaggtagttta

SEQ ID NO: 120621 - DNA, 15 bp, Homo sapiens
aaggaaaggtagttt

SEQ ID NO: 120622 - DNA, 15 bp, Homo sapiens
gaaggaaaggtagtt

SEQ ID NO: 120623 - DNA, 15 bp, Homo sapiens
agaaggaaaggtagt

SEQ ID NO: 120624 - DNA, 15 bp, Homo sapiens
cagaaggaaaggtag

SEQ ID NO: 120625 - DNA, 15 bp, Homo sapiens
acagaaggaaaggta

SEQ ID NO: 120626 - DNA, 15 bp, Homo sapiens
tacagaaggaaaggt

SEQ ID NO: 120627 - DNA, 15 bp, Homo sapiens
atacagaaggaaagg

SEQ ID NO: 120628 - DNA, 15 bp, Homo sapiens
tatacagaaggaaag

SEQ ID NO: 120629 - DNA, 15 bp, Homo sapiens
ttatacagaaggaaa

SEQ ID NO: 120630 - DNA, 15 bp, Homo sapiens
cttatacagaaggaa

SEQ ID NO: 120631 - DNA, 15 bp, Homo sapiens
gcttatacagaagga

SEQ ID NO: 120632 - DNA, 15 bp, Homo sapiens
tgcttatacagaagg

SEQ ID NO: 120633 - DNA, 15 bp, Homo sapiens
atgcttatacagaag

SEQ ID NO: 120634 - DNA, 15 bp, Homo sapiens
gatgcttatacagaa

SEQ ID NO: 120635 - DNA, 15 bp, Homo sapiens
tgatgcttatacaga

SEQ ID NO: 120636 - DNA, 15 bp, Homo sapiens
gtgatgcttatacag

SEQ ID NO: 120637 - DNA, 15 bp, Homo sapiens
tgtgatgcttataca

SEQ ID NO: 120638 - DNA, 15 bp, Homo sapiens
gtgtgatgcttatac

SEQ ID NO: 120639 - DNA, 15 bp, Homo sapiens
agtgtgatgcttata

SEQ ID NO: 120640 - DNA, 15 bp, Homo sapiens
gagtgtgatgcttat

SEQ ID NO: 120641 - DNA, 15 bp, Homo sapiens
tgagtgtgatgctta

SEQ ID NO: 120642 - DNA, 15 bp, Homo sapiens
atgagtgtgatgctt

SEQ ID NO: 120643 - DNA, 15 bp, Homo sapiens
catgagtgtgatgct

SEQ ID NO: 120644 - DNA, 15 bp, Homo sapiens
acatgagtgtgatgc

SEQ ID NO: 120645 - DNA, 15 bp, Homo sapiens
aacatgagtgtgatg

SEQ ID NO: 120646 - DNA, 15 bp, Homo sapiens
aaacatgagtgtgat

SEQ ID NO: 120647 - DNA, 15 bp, Homo sapiens
caaacatgagtgtga

SEQ ID NO: 120648 - DNA, 15 bp, Homo sapiens
ccaaacatgagtgtg

SEQ ID NO: 120649 - DNA, 15 bp, Homo sapiens
cccaaacatgagtgt

SEQ ID NO: 120650 - DNA, 15 bp, Homo sapiens
acccaaacatgagtg

SEQ ID NO: 120651 - DNA, 15 bp, Homo sapiens
aacccaaacatgagt

SEQ ID NO: 120652 - DNA, 15 bp, Homo sapiens
aaacccaaacatgag

SEQ ID NO: 120653 - DNA, 15 bp, Homo sapiens
caaacccaaacatga

SEQ ID NO: 120654 - DNA, 15 bp, Homo sapiens
tcaaacccaaacatg

SEQ ID NO: 120655 - DNA, 15 bp, Homo sapiens
atcaaacccaaacat

SEQ ID NO: 120656 - DNA, 15 bp, Homo sapiens
aatcaaacccaaaca

SEQ ID NO: 120657 - DNA, 15 bp, Homo sapiens
aaatcaaacccaaac

SEQ ID NO: 120658 - DNA, 15 bp, Homo sapiens
aaaatcaaacccaaa

SEQ ID NO: 120659 - DNA, 15 bp, Homo sapiens
aaaaatcaaacccaa

SEQ ID NO: 120660 - DNA, 15 bp, Homo sapiens
gaaaaatcaaaccca

SEQ ID NO: 120661 - DNA, 15 bp, Homo sapiens
ggaaaaatcaaaccc

SEQ ID NO: 120662 - DNA, 15 bp, Homo sapiens
gggaaaaatcaaacc

SEQ ID NO: 120663 - DNA, 15 bp, Homo sapiens
tgggaaaaatcaaac

SEQ ID NO: 120664 - DNA, 15 bp, Homo sapiens
atgggaaaaatcaaa

SEQ ID NO: 120665 - DNA, 15 bp, Homo sapiens
catgggaaaaatcaa

SEQ ID NO: 120666 - DNA, 15 bp, Homo sapiens
tcatgggaaaaatca

SEQ ID NO: 120667 - DNA, 15 bp, Homo sapiens
ctcatgggaaaaatc

SEQ ID NO: 120668 - DNA, 15 bp, Homo sapiens
tctcatgggaaaaat

SEQ ID NO: 120669 - DNA, 15 bp, Homo sapiens
atctcatgggaaaaa

SEQ ID NO: 120670 - DNA, 15 bp, Homo sapiens
tatctcatgggaaaa

SEQ ID NO: 120671 - DNA, 15 bp, Homo sapiens
ttatctcatgggaaa

SEQ ID NO: 120672 - DNA, 15 bp, Homo sapiens
attatctcatgggaa

SEQ ID NO: 120673 - DNA, 15 bp, Homo sapiens
aattatctcatggga

SEQ ID NO: 120674 - DNA, 15 bp, Homo sapiens
aaattatctcatggg

SEQ ID NO: 120675 - DNA, 15 bp, Homo sapiens
aaaattatctcatgg

SEQ ID NO: 120676 - DNA, 15 bp, Homo sapiens
caaaattatctcatg

SEQ ID NO: 120677 - DNA, 15 bp, Homo sapiens
acaaaattatctcat

SEQ ID NO: 120678 - DNA, 15 bp, Homo sapiens
cacaaaattatctca

SEQ ID NO: 120679 - DNA, 15 bp, Homo sapiens
acacaaaattatctc

SEQ ID NO: 120680 - DNA, 15 bp, Homo sapiens
aacacaaaattatct

SEQ ID NO: 120681 - DNA, 15 bp, Homo sapiens
aaacacaaaattatc

SEQ ID NO: 120682 - DNA, 15 bp, Homo sapiens
aaaacacaaaattat

SEQ ID NO: 120683 - DNA, 15 bp, Homo sapiens
gaaaacacaaaatta

SEQ ID NO: 120684 - DNA, 15 bp, Homo sapiens
agaaaacacaaaatt

SEQ ID NO: 120685 - DNA, 15 bp, Homo sapiens
aagaaaacacaaaat

SEQ ID NO: 120686 - DNA, 15 bp, Homo sapiens
taagaaaacacaaaa

SEQ ID NO: 120687 - DNA, 15 bp, Homo sapiens
ataagaaaacacaaa

SEQ ID NO: 120688 - DNA, 15 bp, Homo sapiens
tataagaaaacacaa

SEQ ID NO: 120689 - DNA, 15 bp, Homo sapiens
ttataagaaaacaca

SEQ ID NO: 120690 - DNA, 15 bp, Homo sapiens
attataagaaaacac

SEQ ID NO: 120691 - DNA, 15 bp, Homo sapiens
aattataagaaaaca

SEQ ID NO: 120692 - DNA, 15 bp, Homo sapiens
taattataagaaaac

SEQ ID NO: 120693 - DNA, 15 bp, Homo sapiens
ctaattataagaaaa

SEQ ID NO: 120694 - DNA, 15 bp, Homo sapiens
gctaattataagaaa

SEQ ID NO: 120695 - DNA, 15 bp, Homo sapiens
cgctaattataagaa

SEQ ID NO: 120696 - DNA, 15 bp, Homo sapiens
acgctaattataaga

SEQ ID NO: 120697 - DNA, 15 bp, Homo sapiens
aacgctaattataag

SEQ ID NO: 120698 - DNA, 15 bp, Homo sapiens
aaacgctaattataa

SEQ ID NO: 120699 - DNA, 15 bp, Homo sapiens
taaacgctaattata

SEQ ID NO: 120700 - DNA, 15 bp, Homo sapiens
ctaaacgctaattat

SEQ ID NO: 120701 - DNA, 15 bp, Homo sapiens
actaaacgctaatta

SEQ ID NO: 120702 - DNA, 15 bp, Homo sapiens
tactaaacgctaatt

SEQ ID NO: 120703 - DNA, 15 bp, Homo sapiens
atactaaacgctaat

SEQ ID NO: 120704 - DNA, 15 bp, Homo sapiens
gatactaaacgctaa

SEQ ID NO: 120705 - DNA, 15 bp, Homo sapiens
agatactaaacgcta

SEQ ID NO: 120706 - DNA, 15 bp, Homo sapiens
cagatactaaacgct

SEQ ID NO: 120707 - DNA, 15 bp, Homo sapiens
tcagatactaaacgc

SEQ ID NO: 120708 - DNA, 15 bp, Homo sapiens
ctcagatactaaacg

SEQ ID NO: 120709 - DNA, 15 bp, Homo sapiens
gctcagatactaaac

SEQ ID NO: 120710 - DNA, 15 bp, Homo sapiens
agctcagatactaaa

SEQ ID NO: 120711 - DNA, 15 bp, Homo sapiens
cagctcagatactaa

SEQ ID NO: 120712 - DNA, 15 bp, Homo sapiens
ccagctcagatacta

SEQ ID NO: 120713 - DNA, 15 bp, Homo sapiens
tccagctcagatact

SEQ ID NO: 120714 - DNA, 15 bp, Homo sapiens
atccagctcagatac

SEQ ID NO: 120715 - DNA, 15 bp, Homo sapiens
catccagctcagata

SEQ ID NO: 120716 - DNA, 15 bp, Homo sapiens
tcatccagctcagat

SEQ ID NO: 120717 - DNA, 15 bp, Homo sapiens
atcatccagctcaga

SEQ ID NO: 120718 - DNA, 15 bp, Homo sapiens
catcatccagctcag

SEQ ID NO: 120719 - DNA, 15 bp, Homo sapiens
gcatcatccagctca

SEQ ID NO: 120720 - DNA, 15 bp, Homo sapiens
ggcatcatccagctc

SEQ ID NO: 120721 - DNA, 15 bp, Homo sapiens
tggcatcatccagct

SEQ ID NO: 120722 - DNA, 15 bp, Homo sapiens
ttggcatcatccagc

SEQ ID NO: 120723 - DNA, 15 bp, Homo sapiens
gttggcatcatccag

SEQ ID NO: 120724 - DNA, 15 bp, Homo sapiens
ggttggcatcatcca

SEQ ID NO: 120725 - DNA, 15 bp, Homo sapiens
aggttggcatcatcc

SEQ ID NO: 120726 - DNA, 15 bp, Homo sapiens
gaggttggcatcatc

SEQ ID NO: 120727 - DNA, 15 bp, Homo sapiens
ggaggttggcatcat

SEQ ID NO: 120728 - DNA, 15 bp, Homo sapiens
tggaggttggcatca

SEQ ID NO: 120729 - DNA, 15 bp, Homo sapiens
ctggaggttggcatc

SEQ ID NO: 120730 - DNA, 15 bp, Homo sapiens
cctggaggttggcat

SEQ ID NO: 120731 - DNA, 15 bp, Homo sapiens
acctggaggttggca

SEQ ID NO: 120732 - DNA, 15 bp, Homo sapiens
aacctggaggttggc

SEQ ID NO: 120733 - DNA, 15 bp, Homo sapiens
caacctggaggttgg

SEQ ID NO: 120734 - DNA, 15 bp, Homo sapiens
tcaacctggaggttg

SEQ ID NO: 120735 - DNA, 15 bp, Homo sapiens
ttcaacctggaggtt

SEQ ID NO: 120736 - DNA, 15 bp, Homo sapiens
tttcaacctggaggt

SEQ ID NO: 120737 - DNA, 15 bp, Homo sapiens
ttttcaacctggagg

SEQ ID NO: 120738 - DNA, 15 bp, Homo sapiens
attttcaacctggag

SEQ ID NO: 120739 - DNA, 15 bp, Homo sapiens
cattttcaacctgga

SEQ ID NO: 120740 - DNA, 15 bp, Homo sapiens
acattttcaacctgg

SEQ ID NO: 120741 - DNA, 15 bp, Homo sapiens
gacattttcaacctg

SEQ ID NO: 120742 - DNA, 15 bp, Homo sapiens
ggacattttcaacct

SEQ ID NO: 120743 - DNA, 15 bp, Homo sapiens
cggacattttcaacc

SEQ ID NO: 120744 - DNA, 15 bp, Homo sapiens
gcggacattttcaac

SEQ ID NO: 120745 - DNA, 15 bp, Homo sapiens
cgcggacattttcaa

SEQ ID NO: 120746 - DNA, 15 bp, Homo sapiens
tcgcggacattttca

SEQ ID NO: 120747 - DNA, 15 bp, Homo sapiens
atcgcggacattttc

SEQ ID NO: 120748 - DNA, 15 bp, Homo sapiens
gatcgcggacatttt

SEQ ID NO: 120749 - DNA, 15 bp, Homo sapiens
tgatcgcggacattt

SEQ ID NO: 120750 - DNA, 15 bp, Homo sapiens
ttgatcgcggacatt

SEQ ID NO: 120751 - DNA, 15 bp, Homo sapiens
cttgatcgcggacat

SEQ ID NO: 120752 - DNA, 15 bp, Homo sapiens
gcttgatcgcggaca

SEQ ID NO: 120753 - DNA, 15 bp, Homo sapiens
ggcttgatcgcggac

SEQ ID NO: 120754 - DNA, 15 bp, Homo sapiens
gggcttgatcgcgga

SEQ ID NO: 120755 - DNA, 15 bp, Homo sapiens
agggcttgatcgcgg

SEQ ID NO: 120756 - DNA, 15 bp, Homo sapiens
aagggcttgatcgcg

SEQ ID NO: 120757 - DNA, 15 bp, Homo sapiens
taagggcttgatcgc

SEQ ID NO: 120758 - DNA, 15 bp, Homo sapiens
ataagggcttgatcg

SEQ ID NO: 120759 - DNA, 15 bp, Homo sapiens
aataagggcttgatc

SEQ ID NO: 120760 - DNA, 15 bp, Homo sapiens
aaataagggcttgat

SEQ ID NO: 120761 - DNA, 15 bp, Homo sapiens
aaaataagggcttga

SEQ ID NO: 120762 - DNA, 15 bp, Homo sapiens
caaaataagggcttg

SEQ ID NO: 120763 - DNA, 15 bp, Homo sapiens
tcaaaataagggctt

SEQ ID NO: 120764 - DNA, 15 bp, Homo sapiens
atcaaaataagggct

SEQ ID NO: 120765 - DNA, 15 bp, Homo sapiens
catcaaaataagggc

SEQ ID NO: 120766 - DNA, 15 bp, Homo sapiens
tcatcaaaataaggg

SEQ ID NO: 120767 - DNA, 15 bp, Homo sapiens
ttcatcaaaataagg

SEQ ID NO: 120768 - DNA, 15 bp, Homo sapiens
attcatcaaaataag

SEQ ID NO: 120769 - DNA, 15 bp, Homo sapiens
cattcatcaaaataa

SEQ ID NO: 120770 - DNA, 15 bp, Homo sapiens
gcattcatcaaaata

SEQ ID NO: 120771 - DNA, 15 bp, Homo sapiens
ggcattcatcaaaat

SEQ ID NO: 120772 - DNA, 15 bp, Homo sapiens
gggcattcatcaaaa

SEQ ID NO: 120773 - DNA, 15 bp, Homo sapiens
cgggcattcatcaaa

SEQ ID NO: 120774 - DNA, 15 bp, Homo sapiens
acgggcattcatcaa

SEQ ID NO: 120775 - DNA, 15 bp, Homo sapiens
cacgggcattcatca

SEQ ID NO: 120776 - DNA, 15 bp, Homo sapiens
ccacgggcattcatc

SEQ ID NO: 120777 - DNA, 15 bp, Homo sapiens
tccacgggcattcat

SEQ ID NO: 120778 - DNA, 15 bp, Homo sapiens
ttccacgggcattca

SEQ ID NO: 120779 - DNA, 15 bp, Homo sapiens
cttccacgggcattc

SEQ ID NO: 120780 - DNA, 15 bp, Homo sapiens
gcttccacgggcatt

SEQ ID NO: 120781 - DNA, 15 bp, Homo sapiens
agcttccacgggcat

SEQ ID NO: 120782 - DNA, 15 bp, Homo sapiens
gagcttccacgggca

SEQ ID NO: 120783 - DNA, 15 bp, Homo sapiens
tgagcttccacgggc

SEQ ID NO: 120784 - DNA, 15 bp, Homo sapiens
ttgagcttccacggg

SEQ ID NO: 120785 - DNA, 15 bp, Homo sapiens
cttgagcttccacgg

SEQ ID NO: 120786 - DNA, 15 bp, Homo sapiens
gcttgagcttccacg

SEQ ID NO: 120787 - DNA, 15 bp, Homo sapiens
tgcttgagcttccac

SEQ ID NO: 120788 - DNA, 15 bp, Homo sapiens
ctgcttgagcttcca

SEQ ID NO: 120789 - DNA, 15 bp, Homo sapiens
cctgcttgagcttcc

SEQ ID NO: 120790 - DNA, 15 bp, Homo sapiens
ccctgcttgagcttc

SEQ ID NO: 120791 - DNA, 15 bp, Homo sapiens
tccctgcttgagctt

SEQ ID NO: 120792 - DNA, 15 bp, Homo sapiens
ctccctgcttgagct

SEQ ID NO: 120793 - DNA, 15 bp, Homo sapiens
gctccctgcttgagc

SEQ ID NO: 120794 - DNA, 15 bp, Homo sapiens
agctccctgcttgag

SEQ ID NO: 120795 - DNA, 15 bp, Homo sapiens
aagctccctgcttga

SEQ ID NO: 120796 - DNA, 15 bp, Homo sapiens
caagctccctgcttg

SEQ ID NO: 120797 - DNA, 15 bp, Homo sapiens
acaagctccctgctt

SEQ ID NO: 120798 - DNA, 15 bp, Homo sapiens
tacaagctccctgct

SEQ ID NO: 120799 - DNA, 15 bp, Homo sapiens
ctacaagctccctgc

SEQ ID NO: 120800 - DNA, 15 bp, Homo sapiens
tctacaagctccctg

SEQ ID NO: 120801 - DNA, 15 bp, Homo sapiens
ttctacaagctccct

SEQ ID NO: 120802 - DNA, 15 bp, Homo sapiens
gttctacaagctccc

SEQ ID NO: 120803 - DNA, 15 bp, Homo sapiens
ggttctacaagctcc

SEQ ID NO: 120804 - DNA, 15 bp, Homo sapiens
tggttctacaagctc

SEQ ID NO: 120805 - DNA, 15 bp, Homo sapiens
ttggttctacaagct

SEQ ID NO: 120806 - DNA, 15 bp, Homo sapiens
tttggttctacaagc

SEQ ID NO: 120807 - DNA, 15 bp, Homo sapiens
ctttggttctacaag

SEQ ID NO: 120808 - DNA, 15 bp, Homo sapiens
actttggttctacaa

SEQ ID NO: 120809 - DNA, 15 bp, Homo sapiens
aactttggttctaca

SEQ ID NO: 120810 - DNA, 15 bp, Homo sapiens
taactttggttctac

SEQ ID NO: 120811 - DNA, 15 bp, Homo sapiens
ctaactttggttcta

SEQ ID NO: 120812 - DNA, 15 bp, Homo sapiens
gctaactttggttct

SEQ ID NO: 120813 - DNA, 15 bp, Homo sapiens
agctaactttggttc

SEQ ID NO: 120814 - DNA, 15 bp, Homo sapiens
cagctaactttggtt

SEQ ID NO: 120815 - DNA, 15 bp, Homo sapiens
tcagctaactttggt

SEQ ID NO: 120816 - DNA, 15 bp, Homo sapiens
ctcagctaactttgg

SEQ ID NO: 120817 - DNA, 15 bp, Homo sapiens
gctcagctaactttg

SEQ ID NO: 120818 - DNA, 15 bp, Homo sapiens
agctcagctaacttt

SEQ ID NO: 120819 - DNA, 15 bp, Homo sapiens
cagctcagctaactt

SEQ ID NO: 120820 - DNA, 15 bp, Homo sapiens
tcagctcagctaact

SEQ ID NO: 120821 - DNA, 15 bp, Homo sapiens
ttcagctcagctaac

SEQ ID NO: 120822 - DNA, 15 bp, Homo sapiens
attcagctcagctaa

SEQ ID NO: 120823 - DNA, 15 bp, Homo sapiens
tattcagctcagcta

SEQ ID NO: 120824 - DNA, 15 bp, Homo sapiens
ctattcagctcagct

SEQ ID NO: 120825 - DNA, 15 bp, Homo sapiens
cctattcagctcagc

SEQ ID NO: 120826 - DNA, 15 bp, Homo sapiens
tcctattcagctcag

SEQ ID NO: 120827 - DNA, 15 bp, Homo sapiens
ttcctattcagctca

SEQ ID NO: 120828 - DNA, 15 bp, Homo sapiens
gttcctattcagctc

SEQ ID NO: 120829 - DNA, 15 bp, Homo sapiens
agttcctattcagct

SEQ ID NO: 120830 - DNA, 15 bp, Homo sapiens
aagttcctattcagc

SEQ ID NO: 120831 - DNA, 15 bp, Homo sapiens
aaagttcctattcag

SEQ ID NO: 120832 - DNA, 15 bp, Homo sapiens
caaagttcctattca

SEQ ID NO: 120833 - DNA, 15 bp, Homo sapiens
tcaaagttcctattc

SEQ ID NO: 120834 - DNA, 15 bp, Homo sapiens
ttcaaagttcctatt

SEQ ID NO: 120835 - DNA, 15 bp, Homo sapiens
tttcaaagttcctat

SEQ ID NO: 120836 - DNA, 15 bp, Homo sapiens
ttttcaaagttccta

SEQ ID NO: 120837 - DNA, 15 bp, Homo sapiens
cttttcaaagttcct

SEQ ID NO: 120838 - DNA, 15 bp, Homo sapiens
ccttttcaaagttcc

SEQ ID NO: 120839 - DNA, 15 bp, Homo sapiens
caccttttcaaagtt

SEQ ID NO: 120840 - DNA, 15 bp, Homo sapiens
acaccttttcaaagt

SEQ ID NO: 120841 - DNA, 15 bp, Homo sapiens
gacaccttttcaaag

SEQ ID NO: 120842 - DNA, 15 bp, Homo sapiens
agacaccttttcaaa

SEQ ID NO: 120843 - DNA, 15 bp, Homo sapiens
gagacaccttttcaa

SEQ ID NO: 120844 - DNA, 15 bp, Homo sapiens
tgagacaccttttca

SEQ ID NO: 120845 - DNA, 15 bp, Homo sapiens
ttgagacaccttttc

SEQ ID NO: 120846 - DNA, 15 bp, Homo sapiens
gttgagacacctttt

SEQ ID NO: 120847 - DNA, 15 bp, Homo sapiens
tgttgagacaccttt

SEQ ID NO: 120848 - DNA, 15 bp, Homo sapiens
atgttgagacacctt

SEQ ID NO: 120849 - DNA, 15 bp, Homo sapiens
tatgttgagacacct

SEQ ID NO: 120850 - DNA, 15 bp, Homo sapiens
atatgttgagacacc

SEQ ID NO: 120851 - DNA, 15 bp, Homo sapiens
gatatgttgagacac

SEQ ID NO: 120852 - DNA, 15 bp, Homo sapiens
tgatatgttgagaca

SEQ ID NO: 120853 - DNA, 15 bp, Homo sapiens
ttgatatgttgagac

SEQ ID NO: 120854 - DNA, 15 bp, Homo sapiens
tttgatatgttgaga

SEQ ID NO: 120855 - DNA, 15 bp, Homo sapiens
ttttgatatgttgag

SEQ ID NO: 120856 - DNA, 15 bp, Homo sapiens
cttttgatatgttga

SEQ ID NO: 120857 - DNA, 15 bp, Homo sapiens
acttttgatatgttg

SEQ ID NO: 120858 - DNA, 15 bp, Homo sapiens
cacttttgatatgtt

SEQ ID NO: 120859 - DNA, 15 bp, Homo sapiens
gcacttttgatatgt

SEQ ID NO: 120860 - DNA, 15 bp, Homo sapiens
ggcacttttgatatg

SEQ ID NO: 120861 - DNA, 15 bp, Homo sapiens
tggcacttttgatat

SEQ ID NO: 120862 - DNA, 15 bp, Homo sapiens
ttggcacttttgata

SEQ ID NO: 120863 - DNA, 15 bp, Homo sapiens
tttggcacttttgat

SEQ ID NO: 120864 - DNA, 15 bp, Homo sapiens
ctttggcacttttga

SEQ ID NO: 120865 - DNA, 15 bp, Homo sapiens
actttggcacttttg

SEQ ID NO: 120866 - DNA, 15 bp, Homo sapiens
cactttggcactttt

SEQ ID NO: 120867 - DNA, 15 bp, Homo sapiens
tcactttggcacttt

SEQ ID NO: 120868 - DNA, 15 bp, Homo sapiens
ctcactttggcactt

SEQ ID NO: 120869 - DNA, 15 bp, Homo sapiens
actcactttggcact

SEQ ID NO: 120870 - DNA, 15 bp, Homo sapiens
tactcactttggcac

SEQ ID NO: 120871 - DNA, 15 bp, Homo sapiens
ttactcactttggca

SEQ ID NO: 120872 - DNA, 15 bp, Homo sapiens
attactcactttggc

SEQ ID NO: 120873 - DNA, 15 bp, Homo sapiens
aattactcactttgg

SEQ ID NO: 120874 - DNA, 15 bp, Homo sapiens
taattactcactttg

SEQ ID NO: 120875 - DNA, 15 bp, Homo sapiens
ataattactcacttt

SEQ ID NO: 120876 - DNA, 15 bp, Homo sapiens
cataattactcactt

SEQ ID NO: 120877 - DNA, 15 bp, Homo sapiens
gcataattactcact

SEQ ID NO: 120878 - DNA, 15 bp, Homo sapiens
agcataattactcac

SEQ ID NO: 120879 - DNA, 15 bp, Homo sapiens
aagcataattactca

SEQ ID NO: 120880 - DNA, 15 bp, Homo sapiens
aaagcataattactc

SEQ ID NO: 120881 - DNA, 15 bp, Homo sapiens
aaaagcataattact

SEQ ID NO: 120882 - DNA, 15 bp, Homo sapiens
taaaagcataattac

SEQ ID NO: 120883 - DNA, 15 bp, Homo sapiens
ctaaaagcataatta

SEQ ID NO: 120884 - DNA, 15 bp, Homo sapiens
tctaaaagcataatt

SEQ ID NO: 120885 - DNA, 15 bp, Homo sapiens
ctctaaaagcataat

SEQ ID NO: 120886 - DNA, 15 bp, Homo sapiens
actctaaaagcataa

SEQ ID NO: 120887 - DNA, 15 bp, Homo sapiens
tactctaaaagcata

SEQ ID NO: 120888 - DNA, 15 bp, Homo sapiens
ttactctaaaagcat

SEQ ID NO: 120889 - DNA, 15 bp, Homo sapiens
tttactctaaaagca

SEQ ID NO: 120890 - DNA, 15 bp, Homo sapiens
gtttactctaaaagc

SEQ ID NO: 120891 - DNA, 15 bp, Homo sapiens
ggtttactctaaaag

SEQ ID NO: 120892 - DNA, 15 bp, Homo sapiens
tggtttactctaaaa

SEQ ID NO: 120893 - DNA, 15 bp, Homo sapiens
atggtttactctaaa

SEQ ID NO: 120894 - DNA, 15 bp, Homo sapiens
aatggtttactctaa

SEQ ID NO: 120895 - DNA, 15 bp, Homo sapiens
aaatggtttactcta

SEQ ID NO: 120896 - DNA, 15 bp, Homo sapiens
aaaatggtttactct

SEQ ID NO: 120897 - DNA, 15 bp, Homo sapiens
aaaaatggtttactc

SEQ ID NO: 120898 - DNA, 15 bp, Homo sapiens
gaaaaatggtttact

SEQ ID NO: 120899 - DNA, 15 bp, Homo sapiens
ggaaaaatggtttac

SEQ ID NO: 120900 - DNA, 15 bp, Homo sapiens
aggaaaaatggttta

SEQ ID NO: 120901 - DNA, 15 bp, Homo sapiens
taggaaaaatggttt

SEQ ID NO: 120902 - DNA, 15 bp, Homo sapiens
ataggaaaaatggtt

SEQ ID NO: 120903 - DNA, 15 bp, Homo sapiens
cataggaaaaatggt

SEQ ID NO: 120904 - DNA, 15 bp, Homo sapiens
ccataggaaaaatgg

SEQ ID NO: 120905 - DNA, 15 bp, Homo sapiens
cccataggaaaaatg

SEQ ID NO: 120906 - DNA, 15 bp, Homo sapiens
acccataggaaaaat

SEQ ID NO: 120907 - DNA, 15 bp, Homo sapiens
tacccataggaaaaa

SEQ ID NO: 120908 - DNA, 15 bp, Homo sapiens
atacccataggaaaa

SEQ ID NO: 120909 - DNA, 15 bp, Homo sapiens
catacccataggaaa

SEQ ID NO: 120910 - DNA, 15 bp, Homo sapiens
acatacccataggaa

SEQ ID NO: 120911 - DNA, 15 bp, Homo sapiens
tacatacccatagga

SEQ ID NO: 120912 - DNA, 15 bp, Homo sapiens
atacatacccatagg

SEQ ID NO: 120913 - DNA, 15 bp, Homo sapiens
gatacatacccatag

SEQ ID NO: 120914 - DNA, 15 bp, Homo sapiens
agatacatacccata

SEQ ID NO: 120915 - DNA, 15 bp, Homo sapiens
tagatacatacccat

SEQ ID NO: 120916 - DNA, 15 bp, Homo sapiens
ttagatacataccca

SEQ ID NO: 120917 - DNA, 15 bp, Homo sapiens
tttagatacataccc

SEQ ID NO: 120918 - DNA, 15 bp, Homo sapiens
atttagatacatacc

SEQ ID NO: 120919 - DNA, 15 bp, Homo sapiens
catttagatacatac

SEQ ID NO: 120920 - DNA, 15 bp, Homo sapiens
tcatttagatacata

SEQ ID NO: 120921 - DNA, 15 bp, Homo sapiens
atcatttagatacat

SEQ ID NO: 120922 - DNA, 15 bp, Homo sapiens
tatcatttagataca

SEQ ID NO: 120923 - DNA, 15 bp, Homo sapiens
ctatcatttagatac

SEQ ID NO: 120924 - DNA, 15 bp, Homo sapiens
actatcatttagata

SEQ ID NO: 120925 - DNA, 15 bp, Homo sapiens
gactatcatttagat

SEQ ID NO: 120926 - DNA, 15 bp, Homo sapiens
tgactatcatttaga

SEQ ID NO: 120927 - DNA, 15 bp, Homo sapiens
atgactatcatttag

SEQ ID NO: 120928 - DNA, 15 bp, Homo sapiens
tatgactatcattta

SEQ ID NO: 120929 - DNA, 15 bp, Homo sapiens
gtatgactatcattt

SEQ ID NO: 120930 - DNA, 15 bp, Homo sapiens
tgtatgactatcatt

SEQ ID NO: 120931 - DNA, 15 bp, Homo sapiens
ctgtatgactatcat

SEQ ID NO: 120932 - DNA, 15 bp, Homo sapiens
actgtatgactatca

SEQ ID NO: 120933 - DNA, 15 bp, Homo sapiens
tactgtatgactatc

SEQ ID NO: 120934 - DNA, 15 bp, Homo sapiens
gtactgtatgactat

SEQ ID NO: 120935 - DNA, 15 bp, Homo sapiens
tgtactgtatgacta

SEQ ID NO: 120936 - DNA, 15 bp, Homo sapiens
atgtactgtatgact

SEQ ID NO: 120937 - DNA, 15 bp, Homo sapiens
tatgtactgtatgac

SEQ ID NO: 120938 - DNA, 15 bp, Homo sapiens
gtatgtactgtatga

SEQ ID NO: 120939 - DNA, 15 bp, Homo sapiens
tgtatgtactgtatg

SEQ ID NO: 120940 - DNA, 15 bp, Homo sapiens
atgtatgtactgtat

SEQ ID NO: 120941 - DNA, 15 bp, Homo sapiens
gatgtatgtactgta

SEQ ID NO: 120942 - DNA, 15 bp, Homo sapiens
tgatgtatgtactgt

SEQ ID NO: 120943 - DNA, 15 bp, Homo sapiens
ttgatgtatgtactg

SEQ ID NO: 120944 - DNA, 15 bp, Homo sapiens
gttgatgtatgtact

SEQ ID NO: 120945 - DNA, 15 bp, Homo sapiens
tgttgatgtatgtac

SEQ ID NO: 120946 - DNA, 15 bp, Homo sapiens
ttgttgatgtatgta

SEQ ID NO: 120947 - DNA, 15 bp, Homo sapiens
attgttgatgtatgt

SEQ ID NO: 120948 - DNA, 15 bp, Homo sapiens
aattgttgatgtatg

SEQ ID NO: 120949 - DNA, 15 bp, Homo sapiens
aaattgttgatgtat

SEQ ID NO: 120950 - DNA, 15 bp, Homo sapiens
aaaattgttgatgta

SEQ ID NO: 120951 - DNA, 15 bp, Homo sapiens
caaaattgttgatgt

SEQ ID NO: 120952 - DNA, 15 bp, Homo sapiens
acaaaattgttgatg

SEQ ID NO: 120953 - DNA, 15 bp, Homo sapiens
aacaaaattgttgat

SEQ ID NO: 120954 - DNA, 15 bp, Homo sapiens
aaacaaaattgttga

SEQ ID NO: 120955 - DNA, 15 bp, Homo sapiens
aaaacaaaattgttg

SEQ ID NO: 120956 - DNA, 15 bp, Homo sapiens
taaaacaaaattgtt

SEQ ID NO: 120957 - DNA, 15 bp, Homo sapiens
ataaaacaaaattgt

SEQ ID NO: 120958 - DNA, 15 bp, Homo sapiens
aataaaacaaaattg

SEQ ID NO: 120959 - DNA, 15 bp, Homo sapiens
taataaaacaaaatt

SEQ ID NO: 120960 - DNA, 15 bp, Homo sapiens
ataataaaacaaaat

SEQ ID NO: 120961 - DNA, 15 bp, Homo sapiens
aataataaaacaaaa

SEQ ID NO: 120962 - DNA, 15 bp, Homo sapiens
aaataataaaacaaa

SEQ ID NO: 120963 - DNA, 15 bp, Homo sapiens
aaaataataaaacaa

SEQ ID NO: 120964 - DNA, 15 bp, Homo sapiens
taaaataataaaaca

SEQ ID NO: 120965 - DNA, 15 bp, Homo sapiens
ttaaaataataaaac

SEQ ID NO: 120966 - DNA, 15 bp, Homo sapiens
attaaaataataaaa

SEQ ID NO: 120967 - DNA, 15 bp, Homo sapiens
aattaaaataataaa

SEQ ID NO: 120968 - DNA, 15 bp, Homo sapiens
aaattaaaataataa

SEQ ID NO: 120969 - DNA, 15 bp, Homo sapiens
aaaattaaaataata

SEQ ID NO: 120970 - DNA, 15 bp, Homo sapiens
taaaattaaaataat

SEQ ID NO: 120971 - DNA, 15 bp, Homo sapiens
ataaaattaaaataa

SEQ ID NO: 120972 - DNA, 15 bp, Homo sapiens
aataaaattaaaata

SEQ ID NO: 120973 - DNA, 15 bp, Homo sapiens
caataaaattaaaat

SEQ ID NO: 120974 - DNA, 15 bp, Homo sapiens
acaataaaattaaaa

SEQ ID NO: 120975 - DNA, 15 bp, Homo sapiens
aacaataaaattaaa

SEQ ID NO: 120976 - DNA, 15 bp, Homo sapiens
aaacaataaaattaa

SEQ ID NO: 120977 - DNA, 15 bp, Homo sapiens
aaaacaataaaatta

SEQ ID NO: 120978 - DNA, 15 bp, Homo sapiens
gaaaacaataaaatt

SEQ ID NO: 120979 - DNA, 15 bp, Homo sapiens
agaaaacaataaaat

SEQ ID NO: 120980 - DNA, 15 bp, Homo sapiens
gagaaaacaataaaa

SEQ ID NO: 120981 - DNA, 15 bp, Homo sapiens
agagaaaacaataaa

SEQ ID NO: 120982 - DNA, 15 bp, Homo sapiens
gagagaaaacaataa

SEQ ID NO: 120983 - DNA, 15 bp, Homo sapiens
agagagaaaacaata

SEQ ID NO: 120984 - DNA, 15 bp, Homo sapiens
gagagagaaaacaat

SEQ ID NO: 120985 - DNA, 15 bp, Homo sapiens
agagagagaaaacaa

SEQ ID NO: 120986 - DNA, 15 bp, Homo sapiens
cagagagagaaaaca

SEQ ID NO: 120987 - DNA, 15 bp, Homo sapiens
acagagagagaaaac

SEQ ID NO: 120988 - DNA, 15 bp, Homo sapiens
gacagagagagaaaa

SEQ ID NO: 120989 - DNA, 15 bp, Homo sapiens
tgacagagagagaaa

SEQ ID NO: 120990 - DNA, 15 bp, Homo sapiens
gtgacagagagagaa

SEQ ID NO: 120991 - DNA, 15 bp, Homo sapiens
ggtgacagagagaga

SEQ ID NO: 120992 - DNA, 15 bp, Homo sapiens
cggtgacagagagag

SEQ ID NO: 120993 - DNA, 15 bp, Homo sapiens
tcggtgacagagaga

SEQ ID NO: 120994 - DNA, 15 bp, Homo sapiens
ctcggtgacagagag

SEQ ID NO: 120995 - DNA, 15 bp, Homo sapiens
cctcggtgacagaga

SEQ ID NO: 120996 - DNA, 15 bp, Homo sapiens
gcctcggtgacagag

SEQ ID NO: 120997 - DNA, 15 bp, Homo sapiens
agcctcggtgacaga

SEQ ID NO: 120998 - DNA, 15 bp, Homo sapiens
cagcctcggtgacag

SEQ ID NO: 120999 - DNA, 15 bp, Homo sapiens
ccagcctcggtgaca

SEQ ID NO: 121000 - DNA, 15 bp, Homo sapiens
tccagcctcggtgac

SEQ ID NO: 121001 - DNA, 15 bp, Homo sapiens
ctccagcctcggtga

SEQ ID NO: 121002 - DNA, 15 bp, Homo sapiens
actccagcctcggtg

SEQ ID NO: 121003 - DNA, 15 bp, Homo sapiens
cactccagcctcggt

SEQ ID NO: 121004 - DNA, 15 bp, Homo sapiens
gcactccagcctcgg

SEQ ID NO: 121005 - DNA, 15 bp, Homo sapiens
tgcactccagcctcg

SEQ ID NO: 121006 - DNA, 15 bp, Homo sapiens
ctgcactccagcctc

SEQ ID NO: 121007 - DNA, 15 bp, Homo sapiens
ctcatgccactgcac

SEQ ID NO: 121008 - DNA, 15 bp, Homo sapiens
gctcatgccactgca

SEQ ID NO: 121009 - DNA, 15 bp, Homo sapiens
agctcatgccactgc

SEQ ID NO: 121010 - DNA, 15 bp, Homo sapiens
gagctcatgccactg

SEQ ID NO: 121011 - DNA, 15 bp, Homo sapiens
tgagctcatgccact

SEQ ID NO: 121012 - DNA, 15 bp, Homo sapiens
gtgagctcatgccac

SEQ ID NO: 121013 - DNA, 15 bp, Homo sapiens
agtgagctcatgcca

SEQ ID NO: 121014 - DNA, 15 bp, Homo sapiens
cagtgagctcatgcc

SEQ ID NO: 121015 - DNA, 15 bp, Homo sapiens
gcagtgagctcatgc

SEQ ID NO: 121016 - DNA, 15 bp, Homo sapiens
tgcagtgagctcatg

SEQ ID NO: 121017 - DNA, 15 bp, Homo sapiens
ttgcagtgagctcat

SEQ ID NO: 121018 - DNA, 15 bp, Homo sapiens
gttgcagtgagctca

SEQ ID NO: 121019 - DNA, 15 bp, Homo sapiens
ggttgcagtgagctc

SEQ ID NO: 121020 - DNA, 15 bp, Homo sapiens
aaggcggaggttgca

SEQ ID NO: 121021 - DNA, 15 bp, Homo sapiens
gaaggcggaggttgc

SEQ ID NO: 121022 - DNA, 15 bp, Homo sapiens
agaaggcggaggttg

SEQ ID NO: 121023 - DNA, 15 bp, Homo sapiens
cagaaggcggaggtt

SEQ ID NO: 121024 - DNA, 15 bp, Homo sapiens
ccagaaggcggaggt

SEQ ID NO: 121025 - DNA, 15 bp, Homo sapiens
cccagaaggcggagg

SEQ ID NO: 121026 - DNA, 15 bp, Homo sapiens
acccagaaggcggag

SEQ ID NO: 121027 - DNA, 15 bp, Homo sapiens
cacccagaaggcgga

SEQ ID NO: 121028 - DNA, 15 bp, Homo sapiens
gcacccagaaggcgg

SEQ ID NO: 121029 - DNA, 15 bp, Homo sapiens
tgcacccagaaggcg

SEQ ID NO: 121030 - DNA, 15 bp, Homo sapiens
ttgcacccagaaggc

SEQ ID NO: 121031 - DNA, 15 bp, Homo sapiens
cttgcacccagaagg

SEQ ID NO: 121032 - DNA, 15 bp, Homo sapiens
gcttgcacccagaag

SEQ ID NO: 121033 - DNA, 15 bp, Homo sapiens
agcttgcacccagaa

SEQ ID NO: 121034 - DNA, 15 bp, Homo sapiens
tagcttgcacccaga

SEQ ID NO: 121035 - DNA, 15 bp, Homo sapiens
atagcttgcacccag

SEQ ID NO: 121036 - DNA, 15 bp, Homo sapiens
aatagcttgcaccca

SEQ ID NO: 121037 - DNA, 15 bp, Homo sapiens
gaatagcttgcaccc

SEQ ID NO: 121038 - DNA, 15 bp, Homo sapiens
agaatagcttgcacc

SEQ ID NO: 121039 - DNA, 15 bp, Homo sapiens
gagaatagcttgcac

SEQ ID NO: 121040 - DNA, 15 bp, Homo sapiens
ggagaatagcttgca

SEQ ID NO: 121041 - DNA, 15 bp, Homo sapiens
aggagaatagcttgc

SEQ ID NO: 121042 - DNA, 15 bp, Homo sapiens
gaggcaggagaatag

SEQ ID NO: 121043 - DNA, 15 bp, Homo sapiens
tgaggcaggagaata

SEQ ID NO: 121044 - DNA, 15 bp, Homo sapiens
tggctgaggcaggag

SEQ ID NO: 121045 - DNA, 15 bp, Homo sapiens
gtggctgaggcagga

SEQ ID NO: 121046 - DNA, 15 bp, Homo sapiens
ggtggctgaggcagg

SEQ ID NO: 121047 - DNA, 15 bp, Homo sapiens
gggtggctgaggcag

SEQ ID NO: 121048 - DNA, 15 bp, Homo sapiens
tgggtggctgaggca

SEQ ID NO: 121049 - DNA, 15 bp, Homo sapiens
ttgggtggctgaggc

SEQ ID NO: 121050 - DNA, 15 bp, Homo sapiens
cttgggtggctgagg

SEQ ID NO: 121051 - DNA, 15 bp, Homo sapiens
acttgggtggctgag

SEQ ID NO: 121052 - DNA, 15 bp, Homo sapiens
tacttgggtggctga

SEQ ID NO: 121053 - DNA, 15 bp, Homo sapiens
ctacttgggtggctg

SEQ ID NO: 121054 - DNA, 15 bp, Homo sapiens
gctacttgggtggct

SEQ ID NO: 121055 - DNA, 15 bp, Homo sapiens
agctacttgggtggc

SEQ ID NO: 121056 - DNA, 15 bp, Homo sapiens
cagctacttgggtgg

SEQ ID NO: 121057 - DNA, 15 bp, Homo sapiens
ccagctacttgggtg

SEQ ID NO: 121058 - DNA, 15 bp, Homo sapiens
cccagctacttgggt

SEQ ID NO: 121059 - DNA, 15 bp, Homo sapiens
aaatcccagctactt

SEQ ID NO: 121060 - DNA, 15 bp, Homo sapiens
gaaatcccagctact

SEQ ID NO: 121061 - DNA, 15 bp, Homo sapiens
ggaaatcccagctac

SEQ ID NO: 121062 - DNA, 15 bp, Homo sapiens
cggaaatcccagcta

SEQ ID NO: 121063 - DNA, 15 bp, Homo sapiens
ccggaaatcccagct

SEQ ID NO: 121064 - DNA, 15 bp, Homo sapiens
gccggaaatcccagc

SEQ ID NO: 121065 - DNA, 15 bp, Homo sapiens
tgccggaaatcccag

SEQ ID NO: 121066 - DNA, 15 bp, Homo sapiens
ttgccggaaatccca

SEQ ID NO: 121067 - DNA, 15 bp, Homo sapiens
gttgccggaaatccc

SEQ ID NO: 121068 - DNA, 15 bp, Homo sapiens
agttgccggaaatcc

SEQ ID NO: 121069 - DNA, 15 bp, Homo sapiens
cagttgccggaaatc

SEQ ID NO: 121070 - DNA, 15 bp, Homo sapiens
gcagttgccggaaat

SEQ ID NO: 121071 - DNA, 15 bp, Homo sapiens
ggcagttgccggaaa

SEQ ID NO: 121072 - DNA, 15 bp, Homo sapiens
tggcagttgccggaa

SEQ ID NO: 121073 - DNA, 15 bp, Homo sapiens
gtggcagttgccgga

SEQ ID NO: 121074 - DNA, 15 bp, Homo sapiens
ggtggcagttgccgg

SEQ ID NO: 121075 - DNA, 15 bp, Homo sapiens
tggtggcagttgccg

SEQ ID NO: 121076 - DNA, 15 bp, Homo sapiens
gtggtggcagttgcc

SEQ ID NO: 121077 - DNA, 15 bp, Homo sapiens
tgtggtggcagttgc

SEQ ID NO: 121078 - DNA, 15 bp, Homo sapiens
gtgtggtggcagttg

SEQ ID NO: 121079 - DNA, 15 bp, Homo sapiens
ggtgtggtggcagtt

SEQ ID NO: 121080 - DNA, 15 bp, Homo sapiens
gggtgtggtggcagt

SEQ ID NO: 121081 - DNA, 15 bp, Homo sapiens
cacaaaaattagctg

SEQ ID NO: 121082 - DNA, 15 bp, Homo sapiens
acacaaaaattagct

SEQ ID NO: 121083 - DNA, 15 bp, Homo sapiens
aacacaaaaattagc

SEQ ID NO: 121084 - DNA, 15 bp, Homo sapiens
aaacacaaaaattag

SEQ ID NO: 121085 - DNA, 15 bp, Homo sapiens
aaaacacaaaaatta

SEQ ID NO: 121086 - DNA, 15 bp, Homo sapiens
aaaaacacaaaaatt

SEQ ID NO: 121087 - DNA, 15 bp, Homo sapiens
aaaaaacacaaaaat

SEQ ID NO: 121088 - DNA, 15 bp, Homo sapiens
aaaaaaacacaaaaa

SEQ ID NO: 121089 - DNA, 15 bp, Homo sapiens
taaaaaaaacacaaa

SEQ ID NO: 121090 - DNA, 15 bp, Homo sapiens
ctaaaaaaaacacaa

SEQ ID NO: 121091 - DNA, 15 bp, Homo sapiens
cctaaaaaaaacaca

SEQ ID NO: 121092 - DNA, 15 bp, Homo sapiens
tcctaaaaaaaacac

SEQ ID NO: 121093 - DNA, 15 bp, Homo sapiens
ctcctaaaaaaaaca

SEQ ID NO: 121094 - DNA, 15 bp, Homo sapiens
tctcctaaaaaaaac

SEQ ID NO: 121095 - DNA, 15 bp, Homo sapiens
ctctcctaaaaaaaa

SEQ ID NO: 121096 - DNA, 15 bp, Homo sapiens
tctctcctaaaaaaa

SEQ ID NO: 121097 - DNA, 15 bp, Homo sapiens
atctctcctaaaaaa

SEQ ID NO: 121098 - DNA, 15 bp, Homo sapiens
tatctctcctaaaaa

SEQ ID NO: 121099 - DNA, 15 bp, Homo sapiens
ctatctctcctaaaa

SEQ ID NO: 121100 - DNA, 15 bp, Homo sapiens
cctatctctcctaaa

SEQ ID NO: 121101 - DNA, 15 bp, Homo sapiens
ccctatctctcctaa

SEQ ID NO: 121102 - DNA, 15 bp, Homo sapiens
accctatctctccta

SEQ ID NO: 121103 - DNA, 15 bp, Homo sapiens
aaccctatctctcct

SEQ ID NO: 121104 - DNA, 15 bp, Homo sapiens
aaaccctatctctcc

SEQ ID NO: 121105 - DNA, 15 bp, Homo sapiens
gaaaccctatctctc

SEQ ID NO: 121106 - DNA, 15 bp, Homo sapiens
tgaaaccctatctct

SEQ ID NO: 121107 - DNA, 15 bp, Homo sapiens
gtgaaaccctatctc

SEQ ID NO: 121108 - DNA, 15 bp, Homo sapiens
ggtgaaaccctatct

SEQ ID NO: 121109 - DNA, 15 bp, Homo sapiens
tggtgaaaccctatc

SEQ ID NO: 121110 - DNA, 15 bp, Homo sapiens
atggtgaaaccctat

SEQ ID NO: 121111 - DNA, 15 bp, Homo sapiens
gatggtgaaacccta

SEQ ID NO: 121112 - DNA, 15 bp, Homo sapiens
agatggtgaaaccct

SEQ ID NO: 121113 - DNA, 15 bp, Homo sapiens
ctcaagaccagcctg

SEQ ID NO: 121114 - DNA, 15 bp, Homo sapiens
gctcaagaccagcct

SEQ ID NO: 121115 - DNA, 15 bp, Homo sapiens
agctcaagaccagcc

SEQ ID NO: 121116 - DNA, 15 bp, Homo sapiens
cagctcaagaccagc

SEQ ID NO: 121117 - DNA, 15 bp, Homo sapiens
gcagctcaagaccag

SEQ ID NO: 121118 - DNA, 15 bp, Homo sapiens
agcagctcaagacca

SEQ ID NO: 121119 - DNA, 15 bp, Homo sapiens
cagcagctcaagacc

SEQ ID NO: 121120 - DNA, 15 bp, Homo sapiens
tcagcagctcaagac

SEQ ID NO: 121121 - DNA, 15 bp, Homo sapiens
gtcagcagctcaaga

SEQ ID NO: 121122 - DNA, 15 bp, Homo sapiens
ggtcagcagctcaag

SEQ ID NO: 121123 - DNA, 15 bp, Homo sapiens
aggtcagcagctcaa

SEQ ID NO: 121124 - DNA, 15 bp, Homo sapiens
gaggtcagcagctca

SEQ ID NO: 121125 - DNA, 15 bp, Homo sapiens
tgaggtcagcagctc

SEQ ID NO: 121126 - DNA, 15 bp, Homo sapiens
ttgaggtcagcagct

SEQ ID NO: 121127 - DNA, 15 bp, Homo sapiens
aggcgggcagatcac

SEQ ID NO: 121128 - DNA, 15 bp, Homo sapiens
tccagcactttggga

SEQ ID NO: 121129 - DNA, 15 bp, Homo sapiens
ttccagcactttggg

SEQ ID NO: 121130 - DNA, 15 bp, Homo sapiens
attccagcactttgg

SEQ ID NO: 121131 - DNA, 15 bp, Homo sapiens
aattccagcactttg

SEQ ID NO: 121132 - DNA, 15 bp, Homo sapiens
taattccagcacttt

SEQ ID NO: 121133 - DNA, 15 bp, Homo sapiens
acctgtaattccagc

SEQ ID NO: 121134 - DNA, 15 bp, Homo sapiens
tcacacctgtaattc

SEQ ID NO: 121135 - DNA, 15 bp, Homo sapiens
ctcacacctgtaatt

SEQ ID NO: 121136 - DNA, 15 bp, Homo sapiens
agctcacacctgtaa

SEQ ID NO: 121137 - DNA, 15 bp, Homo sapiens
cagctcacacctgta

SEQ ID NO: 121138 - DNA, 15 bp, Homo sapiens
gcagctcacacctgt

SEQ ID NO: 121139 - DNA, 15 bp, Homo sapiens
agcagctcacacctg

SEQ ID NO: 121140 - DNA, 15 bp, Homo sapiens
cagcagctcacacct

SEQ ID NO: 121141 - DNA, 15 bp, Homo sapiens
gcagcagctcacacc

SEQ ID NO: 121142 - DNA, 15 bp, Homo sapiens
tgcagcagctcacac

SEQ ID NO: 121143 - DNA, 15 bp, Homo sapiens
gtgcagcagctcaca

SEQ ID NO: 121144 - DNA, 15 bp, Homo sapiens
ggtgcagcagctcac

SEQ ID NO: 121145 - DNA, 15 bp, Homo sapiens
gggtgcagcagctca

SEQ ID NO: 121146 - DNA, 15 bp, Homo sapiens
cgggtgcagcagctc

SEQ ID NO: 121147 - DNA, 15 bp, Homo sapiens
ccgggtgcagcagct

SEQ ID NO: 121148 - DNA, 15 bp, Homo sapiens
gccgggtgcagcagc

SEQ ID NO: 121149 - DNA, 15 bp, Homo sapiens
ggccgggtgcagcag

SEQ ID NO: 121150 - DNA, 15 bp, Homo sapiens
tggccgggtgcagca

SEQ ID NO: 121151 - DNA, 15 bp, Homo sapiens
ttggccgggtgcagc

SEQ ID NO: 121152 - DNA, 15 bp, Homo sapiens
gttggccgggtgcag

SEQ ID NO: 121153 - DNA, 15 bp, Homo sapiens
tgttggccgggtgca

SEQ ID NO: 121154 - DNA, 15 bp, Homo sapiens
ttgttggccgggtgc

SEQ ID NO: 121155 - DNA, 15 bp, Homo sapiens
attgttggccgggtg

SEQ ID NO: 121156 - DNA, 15 bp, Homo sapiens
aattgttggccgggt

SEQ ID NO: 121157 - DNA, 15 bp, Homo sapiens
aaattgttggccggg

SEQ ID NO: 121158 - DNA, 15 bp, Homo sapiens
aaaattgttggccgg

SEQ ID NO: 121159 - DNA, 15 bp, Homo sapiens
aaaaattgttggccg

SEQ ID NO: 121160 - DNA, 15 bp, Homo sapiens
taaaaattgttggcc

SEQ ID NO: 121161 - DNA, 15 bp, Homo sapiens
ttaaaaattgttggc

SEQ ID NO: 121162 - DNA, 15 bp, Homo sapiens
tttaaaaattgttgg

SEQ ID NO: 121163 - DNA, 15 bp, Homo sapiens
atttaaaaattgttg

SEQ ID NO: 121164 - DNA, 15 bp, Homo sapiens
aatttaaaaattgtt

SEQ ID NO: 121165 - DNA, 15 bp, Homo sapiens
taatttaaaaattgt

SEQ ID NO: 121166 - DNA, 15 bp, Homo sapiens
ttaatttaaaaattg

SEQ ID NO: 121167 - DNA, 15 bp, Homo sapiens
tttaatttaaaaatt

SEQ ID NO: 121168 - DNA, 15 bp, Homo sapiens
ttttaatttaaaaat

SEQ ID NO: 121169 - DNA, 15 bp, Homo sapiens
attttaatttaaaaa

SEQ ID NO: 121170 - DNA, 15 bp, Homo sapiens
cattttaatttaaaa

SEQ ID NO: 121171 - DNA, 15 bp, Homo sapiens
acattttaatttaaa

SEQ ID NO: 121172 - DNA, 15 bp, Homo sapiens
aacattttaatttaa

SEQ ID NO: 121173 - DNA, 15 bp, Homo sapiens
aaacattttaattta

SEQ ID NO: 121174 - DNA, 15 bp, Homo sapiens
aaaacattttaattt

SEQ ID NO: 121175 - DNA, 15 bp, Homo sapiens
aaaaacattttaatt

SEQ ID NO: 121176 - DNA, 15 bp, Homo sapiens
taaaaacattttaat

SEQ ID NO: 121177 - DNA, 15 bp, Homo sapiens
ttaaaaacattttaa

SEQ ID NO: 121178 - DNA, 15 bp, Homo sapiens
attaaaaacatttta

SEQ ID NO: 121179 - DNA, 15 bp, Homo sapiens
gattaaaaacatttt

SEQ ID NO: 121180 - DNA, 15 bp, Homo sapiens
tgattaaaaacattt

SEQ ID NO: 121181 - DNA, 15 bp, Homo sapiens
gtgattaaaaacatt

SEQ ID NO: 121182 - DNA, 15 bp, Homo sapiens
agtgattaaaaacat

SEQ ID NO: 121183 - DNA, 15 bp, Homo sapiens
aagtgattaaaaaca

SEQ ID NO: 121184 - DNA, 15 bp, Homo sapiens
aaagtgattaaaaac

SEQ ID NO: 121185 - DNA, 15 bp, Homo sapiens
aaaagtgattaaaaa

SEQ ID NO: 121186 - DNA, 15 bp, Homo sapiens
aaaaagtgattaaaa

SEQ ID NO: 121187 - DNA, 15 bp, Homo sapiens
gaaaaagtgattaaa

SEQ ID NO: 121188 - DNA, 15 bp, Homo sapiens
agaaaaagtgattaa

SEQ ID NO: 121189 - DNA, 15 bp, Homo sapiens
aagaaaaagtgatta

SEQ ID NO: 121190 - DNA, 15 bp, Homo sapiens
aaagaaaaagtgatt

SEQ ID NO: 121191 - DNA, 15 bp, Homo sapiens
caaagaaaaagtgat

SEQ ID NO: 121192 - DNA, 15 bp, Homo sapiens
tcaaagaaaaagtga

SEQ ID NO: 121193 - DNA, 15 bp, Homo sapiens
ttcaaagaaaaagtg

SEQ ID NO: 121194 - DNA, 15 bp, Homo sapiens
attcaaagaaaaagt

SEQ ID NO: 121195 - DNA, 15 bp, Homo sapiens
cattcaaagaaaaag

SEQ ID NO: 121196 - DNA, 15 bp, Homo sapiens
ccattcaaagaaaaa

SEQ ID NO: 121197 - DNA, 15 bp, Homo sapiens
tccattcaaagaaaa

SEQ ID NO: 121198 - DNA, 15 bp, Homo sapiens
ctccattcaaagaaa

SEQ ID NO: 121199 - DNA, 15 bp, Homo sapiens
gctccattcaaagaa

SEQ ID NO: 121200 - DNA, 15 bp, Homo sapiens
tgctccattcaaaga

SEQ ID NO: 121201 - DNA, 15 bp, Homo sapiens
atgctccattcaaag

SEQ ID NO: 121202 - DNA, 15 bp, Homo sapiens
aatgctccattcaaa

SEQ ID NO: 121203 - DNA, 15 bp, Homo sapiens
aaatgctccattcaa

SEQ ID NO: 121204 - DNA, 15 bp, Homo sapiens
caaatgctccattca

SEQ ID NO: 121205 - DNA, 15 bp, Homo sapiens
acaaatgctccattc

SEQ ID NO: 121206 - DNA, 15 bp, Homo sapiens
gacaaatgctccatt

SEQ ID NO: 121207 - DNA, 15 bp, Homo sapiens
ggacaaatgctccat

SEQ ID NO: 121208 - DNA, 15 bp, Homo sapiens
cggacaaatgctcca

SEQ ID NO: 121209 - DNA, 15 bp, Homo sapiens
acggacaaatgctcc

SEQ ID NO: 121210 - DNA, 15 bp, Homo sapiens
tacggacaaatgctc

SEQ ID NO: 121211 - DNA, 15 bp, Homo sapiens
atacggacaaatgct

SEQ ID NO: 121212 - DNA, 15 bp, Homo sapiens
aatacggacaaatgc

SEQ ID NO: 121213 - DNA, 15 bp, Homo sapiens
aaatacggacaaatg

SEQ ID NO: 121214 - DNA, 15 bp, Homo sapiens
taaatacggacaaat

SEQ ID NO: 121215 - DNA, 15 bp, Homo sapiens
ataaatacggacaaa

SEQ ID NO: 121216 - DNA, 15 bp, Homo sapiens
aataaatacggacaa

SEQ ID NO: 121217 - DNA, 15 bp, Homo sapiens
aaataaatacggaca

SEQ ID NO: 121218 - DNA, 15 bp, Homo sapiens
caaataaatacggac

SEQ ID NO: 121219 - DNA, 15 bp, Homo sapiens
acaaataaatacgga

SEQ ID NO: 121220 - DNA, 15 bp, Homo sapiens
cacaaataaatacgg

SEQ ID NO: 121221 - DNA, 15 bp, Homo sapiens
tcacaaataaatacg

SEQ ID NO: 121222 - DNA, 15 bp, Homo sapiens
atcacaaataaatac

SEQ ID NO: 121223 - DNA, 15 bp, Homo sapiens
aatcacaaataaata

SEQ ID NO: 121224 - DNA, 15 bp, Homo sapiens
caatcacaaataaat

SEQ ID NO: 121225 - DNA, 15 bp, Homo sapiens
acaatcacaaataaa

SEQ ID NO: 121226 - DNA, 15 bp, Homo sapiens
cacaatcacaaataa

SEQ ID NO: 121227 - DNA, 15 bp, Homo sapiens
gcacaatcacaaata

SEQ ID NO: 121228 - DNA, 15 bp, Homo sapiens
tgcacaatcacaaat

SEQ ID NO: 121229 - DNA, 15 bp, Homo sapiens
atgcacaatcacaaa

SEQ ID NO: 121230 - DNA, 15 bp, Homo sapiens
tatgcacaatcacaa

SEQ ID NO: 121231 - DNA, 15 bp, Homo sapiens
atatgcacaatcaca

SEQ ID NO: 121232 - DNA, 15 bp, Homo sapiens
catatgcacaatcac

SEQ ID NO: 121233 - DNA, 15 bp, Homo sapiens
tcatatgcacaatca

SEQ ID NO: 121234 - DNA, 15 bp, Homo sapiens
ttcatatgcacaatc

SEQ ID NO: 121235 - DNA, 15 bp, Homo sapiens
cttcatatgcacaat

SEQ ID NO: 121236 - DNA, 15 bp, Homo sapiens
ccttcatatgcacaa

SEQ ID NO: 121237 - DNA, 15 bp, Homo sapiens
tccttcatatgcaca

SEQ ID NO: 121238 - DNA, 15 bp, Homo sapiens
ctccttcatatgcac

SEQ ID NO: 121239 - DNA, 15 bp, Homo sapiens
tctccttcatatgca

SEQ ID NO: 121240 - DNA, 15 bp, Homo sapiens
ctctccttcatatgc

SEQ ID NO: 121241 - DNA, 15 bp, Homo sapiens
tctctccttcatatg

SEQ ID NO: 121242 - DNA, 15 bp, Homo sapiens
ttctctccttcatat

SEQ ID NO: 121243 - DNA, 15 bp, Homo sapiens
tttctctccttcata

SEQ ID NO: 121244 - DNA, 15 bp, Homo sapiens
ttttctctccttcat

SEQ ID NO: 121245 - DNA, 15 bp, Homo sapiens
gttttctctccttca

SEQ ID NO: 121246 - DNA, 15 bp, Homo sapiens
tgttttctctccttc

SEQ ID NO: 121247 - DNA, 15 bp, Homo sapiens
ttgttttctctcctt

SEQ ID NO: 121248 - DNA, 15 bp, Homo sapiens
cttgttttctctcct

SEQ ID NO: 121249 - DNA, 15 bp, Homo sapiens
gcttgttttctctcc

SEQ ID NO: 121250 - DNA, 15 bp, Homo sapiens
tgcttgttttctctc

SEQ ID NO: 121251 - DNA, 15 bp, Homo sapiens
ttgcttgttttctct

SEQ ID NO: 121252 - DNA, 15 bp, Homo sapiens
attgcttgttttctc

SEQ ID NO: 121253 - DNA, 15 bp, Homo sapiens
aattgcttgttttct

SEQ ID NO: 121254 - DNA, 15 bp, Homo sapiens
taattgcttgttttc

SEQ ID NO: 121255 - DNA, 15 bp, Homo sapiens
ctaattgcttgtttt

SEQ ID NO: 121256 - DNA, 15 bp, Homo sapiens
actaattgcttgttt

SEQ ID NO: 121257 - DNA, 15 bp, Homo sapiens
tactaattgcttgtt

SEQ ID NO: 121258 - DNA, 15 bp, Homo sapiens
atactaattgcttgt

SEQ ID NO: 121259 - DNA, 15 bp, Homo sapiens
aatactaattgcttg

SEQ ID NO: 121260 - DNA, 15 bp, Homo sapiens
caatactaattgctt

SEQ ID NO: 121261 - DNA, 15 bp, Homo sapiens
tcaatactaattgct

SEQ ID NO: 121262 - DNA, 15 bp, Homo sapiens
ttcaatactaattgc

SEQ ID NO: 121263 - DNA, 15 bp, Homo sapiens
cttcaatactaattg

SEQ ID NO: 121264 - DNA, 15 bp, Homo sapiens
tcttcaatactaatt

SEQ ID NO: 121265 - DNA, 15 bp, Homo sapiens
ttcttcaatactaat

SEQ ID NO: 121266 - DNA, 15 bp, Homo sapiens
tttcttcaatactaa

SEQ ID NO: 121267 - DNA, 15 bp, Homo sapiens
ttttcttcaatacta

SEQ ID NO: 121268 - DNA, 15 bp, Homo sapiens
attttcttcaatact

SEQ ID NO: 121269 - DNA, 15 bp, Homo sapiens
tattttcttcaatac

SEQ ID NO: 121270 - DNA, 15 bp, Homo sapiens
ttattttcttcaata

SEQ ID NO: 121271 - DNA, 15 bp, Homo sapiens
gttattttcttcaat

SEQ ID NO: 121272 - DNA, 15 bp, Homo sapiens
ggttattttcttcaa

SEQ ID NO: 121273 - DNA, 15 bp, Homo sapiens
aggttattttcttca

SEQ ID NO: 121274 - DNA, 15 bp, Homo sapiens
taggttattttcttc

SEQ ID NO: 121275 - DNA, 15 bp, Homo sapiens
ataggttattttctt

SEQ ID NO: 121276 - DNA, 15 bp, Homo sapiens
aataggttattttct

SEQ ID NO: 121277 - DNA, 15 bp, Homo sapiens
aaataggttattttc

SEQ ID NO: 121278 - DNA, 15 bp, Homo sapiens
caaataggttatttt

SEQ ID NO: 121279 - DNA, 15 bp, Homo sapiens
tcaaataggttattt

SEQ ID NO: 121280 - DNA, 15 bp, Homo sapiens
ctcaaataggttatt

SEQ ID NO: 121281 - DNA, 15 bp, Homo sapiens
tctcaaataggttat

SEQ ID NO: 121282 - DNA, 15 bp, Homo sapiens
ttctcaaataggtta

SEQ ID NO: 121283 - DNA, 15 bp, Homo sapiens
tttctcaaataggtt

SEQ ID NO: 121284 - DNA, 15 bp, Homo sapiens
ttttctcaaataggt

SEQ ID NO: 121285 - DNA, 15 bp, Homo sapiens
cttttctcaaatagg

SEQ ID NO: 121286 - DNA, 15 bp, Homo sapiens
ccttttctcaaatag

SEQ ID NO: 121287 - DNA, 15 bp, Homo sapiens
accttttctcaaata

SEQ ID NO: 121288 - DNA, 15 bp, Homo sapiens
aaccttttctcaaat

SEQ ID NO: 121289 - DNA, 15 bp, Homo sapiens
aaaccttttctcaaa

SEQ ID NO: 121290 - DNA, 15 bp, Homo sapiens
gaaaccttttctcaa

SEQ ID NO: 121291 - DNA, 15 bp, Homo sapiens
tgaaaccttttctca

SEQ ID NO: 121292 - DNA, 15 bp, Homo sapiens
ttgaaaccttttctc

SEQ ID NO: 121293 - DNA, 15 bp, Homo sapiens
tttgaaaccttttct

SEQ ID NO: 121294 - DNA, 15 bp, Homo sapiens
ctttgaaaccttttc

SEQ ID NO: 121295 - DNA, 15 bp, Homo sapiens
tctttgaaacctttt

SEQ ID NO: 121296 - DNA, 15 bp, Homo sapiens
gtctttgaaaccttt

SEQ ID NO: 121297 - DNA, 15 bp, Homo sapiens
agtctttgaaacctt

SEQ ID NO: 121298 - DNA, 15 bp, Homo sapiens
gagtctttgaaacct

SEQ ID NO: 121299 - DNA, 15 bp, Homo sapiens
tgagtctttgaaacc

SEQ ID NO: 121300 - DNA, 15 bp, Homo sapiens
ctgagtctttgaaac

SEQ ID NO: 121301 - DNA, 15 bp, Homo sapiens
actgagtctttgaaa

SEQ ID NO: 121302 - DNA, 15 bp, Homo sapiens
gactgagtctttgaa

SEQ ID NO: 121303 - DNA, 15 bp, Homo sapiens
tgactgagtctttga

SEQ ID NO: 121304 - DNA, 15 bp, Homo sapiens
ttgactgagtctttg

SEQ ID NO: 121305 - DNA, 15 bp, Homo sapiens
tttgactgagtcttt

SEQ ID NO: 121306 - DNA, 15 bp, Homo sapiens
ctttgactgagtctt

SEQ ID NO: 121307 - DNA, 15 bp, Homo sapiens
cctttgactgagtct

SEQ ID NO: 121308 - DNA, 15 bp, Homo sapiens
acctttgactgagtc

SEQ ID NO: 121309 - DNA, 15 bp, Homo sapiens
aacctttgactgagt

SEQ ID NO: 121310 - DNA, 15 bp, Homo sapiens
taacctttgactgag

SEQ ID NO: 121311 - DNA, 15 bp, Homo sapiens
ctaacctttgactga

SEQ ID NO: 121312 - DNA, 15 bp, Homo sapiens
tctaacctttgactg

SEQ ID NO: 121313 - DNA, 15 bp, Homo sapiens
ttctaacctttgact

SEQ ID NO: 121314 - DNA, 15 bp, Homo sapiens
attctaacctttgac

SEQ ID NO: 121315 - DNA, 15 bp, Homo sapiens
aattctaacctttga

SEQ ID NO: 121316 - DNA, 15 bp, Homo sapiens
caattctaacctttg

SEQ ID NO: 121317 - DNA, 15 bp, Homo sapiens
ccaattctaaccttt

SEQ ID NO: 121318 - DNA, 15 bp, Homo sapiens
accaattctaacctt

SEQ ID NO: 121319 - DNA, 15 bp, Homo sapiens
aaccaattctaacct

SEQ ID NO: 121320 - DNA, 15 bp, Homo sapiens
taaccaattctaacc

SEQ ID NO: 121321 - DNA, 15 bp, Homo sapiens
ataaccaattctaac

SEQ ID NO: 121322 - DNA, 15 bp, Homo sapiens
cataaccaattctaa

SEQ ID NO: 121323 - DNA, 15 bp, Homo sapiens
tcataaccaattcta

SEQ ID NO: 121324 - DNA, 15 bp, Homo sapiens
ttcataaccaattct

SEQ ID NO: 121325 - DNA, 15 bp, Homo sapiens
tttcataaccaattc

SEQ ID NO: 121326 - DNA, 15 bp, Homo sapiens
atttcataaccaatt

SEQ ID NO: 121327 - DNA, 15 bp, Homo sapiens
catttcataaccaat

SEQ ID NO: 121328 - DNA, 15 bp, Homo sapiens
tcatttcataaccaa

SEQ ID NO: 121329 - DNA, 15 bp, Homo sapiens
atcatttcataacca

SEQ ID NO: 121330 - DNA, 15 bp, Homo sapiens
catcatttcataacc

SEQ ID NO: 121331 - DNA, 15 bp, Homo sapiens
tcatcatttcataac

SEQ ID NO: 121332 - DNA, 15 bp, Homo sapiens
ttcatcatttcataa

SEQ ID NO: 121333 - DNA, 15 bp, Homo sapiens
tttcatcatttcata

SEQ ID NO: 121334 - DNA, 15 bp, Homo sapiens
gtttcatcatttcat

SEQ ID NO: 121335 - DNA, 15 bp, Homo sapiens
agtttcatcatttca

SEQ ID NO: 121336 - DNA, 15 bp, Homo sapiens
tagtttcatcatttc

SEQ ID NO: 121337 - DNA, 15 bp, Homo sapiens
ttagtttcatcattt

SEQ ID NO: 121338 - DNA, 15 bp, Homo sapiens
attagtttcatcatt

SEQ ID NO: 121339 - DNA, 15 bp, Homo sapiens
aattagtttcatcat

SEQ ID NO: 121340 - DNA, 15 bp, Homo sapiens
gaattagtttcatca

SEQ ID NO: 121341 - DNA, 15 bp, Homo sapiens
ggaattagtttcatc

SEQ ID NO: 121342 - DNA, 15 bp, Homo sapiens
gggaattagtttcat

SEQ ID NO: 121343 - DNA, 15 bp, Homo sapiens
tgggaattagtttca

SEQ ID NO: 121344 - DNA, 15 bp, Homo sapiens
ttgggaattagtttc

SEQ ID NO: 121345 - DNA, 15 bp, Homo sapiens
cttgggaattagttt

SEQ ID NO: 121346 - DNA, 15 bp, Homo sapiens
gcttgggaattagtt

SEQ ID NO: 121347 - DNA, 15 bp, Homo sapiens
agcttgggaattagt

SEQ ID NO: 121348 - DNA, 15 bp, Homo sapiens
tagcttgggaattag

SEQ ID NO: 121349 - DNA, 15 bp, Homo sapiens
ctagcttgggaatta

SEQ ID NO: 121350 - DNA, 15 bp, Homo sapiens
cctagcttgggaatt

SEQ ID NO: 121351 - DNA, 15 bp, Homo sapiens
ccctagcttgggaat

SEQ ID NO: 121352 - DNA, 15 bp, Homo sapiens
tccctagcttgggaa

SEQ ID NO: 121353 - DNA, 15 bp, Homo sapiens
atccctagcttggga

SEQ ID NO: 121354 - DNA, 15 bp, Homo sapiens
catccctagcttggg

SEQ ID NO: 121355 - DNA, 15 bp, Homo sapiens
tcatccctagcttgg

SEQ ID NO: 121356 - DNA, 15 bp, Homo sapiens
ttcatccctagcttg

SEQ ID NO: 121357 - DNA, 15 bp, Homo sapiens
attcatccctagctt

SEQ ID NO: 121358 - DNA, 15 bp, Homo sapiens
tattcatccctagct

SEQ ID NO: 121359 - DNA, 15 bp, Homo sapiens
atattcatccctagc

SEQ ID NO: 121360 - DNA, 15 bp, Homo sapiens
aatattcatccctag

SEQ ID NO: 121361 - DNA, 15 bp, Homo sapiens
taatattcatcccta

SEQ ID NO: 121362 - DNA, 15 bp, Homo sapiens
ttaatattcatccct

SEQ ID NO: 121363 - DNA, 15 bp, Homo sapiens
tttaatattcatccc

SEQ ID NO: 121364 - DNA, 15 bp, Homo sapiens
gtttaatattcatcc

SEQ ID NO: 121365 - DNA, 15 bp, Homo sapiens
ggtttaatattcatc

SEQ ID NO: 121366 - DNA, 15 bp, Homo sapiens
gggtttaatattcat

SEQ ID NO: 121367 - DNA, 15 bp, Homo sapiens
agggtttaatattca

SEQ ID NO: 121368 - DNA, 15 bp, Homo sapiens
aagggtttaatattc

SEQ ID NO: 121369 - DNA, 15 bp, Homo sapiens
aaagggtttaatatt

SEQ ID NO: 121370 - DNA, 15 bp, Homo sapiens
taaagggtttaatat

SEQ ID NO: 121371 - DNA, 15 bp, Homo sapiens
ataaagggtttaata

SEQ ID NO: 121372 - DNA, 15 bp, Homo sapiens
aataaagggtttaat

SEQ ID NO: 121373 - DNA, 15 bp, Homo sapiens
aaataaagggtttaa

SEQ ID NO: 121374 - DNA, 15 bp, Homo sapiens
aaaataaagggttta

SEQ ID NO: 121375 - DNA, 15 bp, Homo sapiens
taaaataaagggttt

SEQ ID NO: 121376 - DNA, 15 bp, Homo sapiens
ataaaataaagggtt

SEQ ID NO: 121377 - DNA, 15 bp, Homo sapiens
cataaaataaagggt

SEQ ID NO: 121378 - DNA, 15 bp, Homo sapiens
ccataaaataaaggg

SEQ ID NO: 121379 - DNA, 15 bp, Homo sapiens
accataaaataaagg

SEQ ID NO: 121380 - DNA, 15 bp, Homo sapiens
gaccataaaataaag

SEQ ID NO: 121381 - DNA, 15 bp, Homo sapiens
tgaccataaaataaa

SEQ ID NO: 121382 - DNA, 15 bp, Homo sapiens
gtgaccataaaataa

SEQ ID NO: 121383 - DNA, 15 bp, Homo sapiens
tgtgaccataaaata

SEQ ID NO: 121384 - DNA, 15 bp, Homo sapiens
gtgtgaccataaaat

SEQ ID NO: 121385 - DNA, 15 bp, Homo sapiens
agtgtgaccataaaa

SEQ ID NO: 121386 - DNA, 15 bp, Homo sapiens
gagtgtgaccataaa

SEQ ID NO: 121387 - DNA, 15 bp, Homo sapiens
agagtgtgaccataa

SEQ ID NO: 121388 - DNA, 15 bp, Homo sapiens
tagagtgtgaccata

SEQ ID NO: 121389 - DNA, 15 bp, Homo sapiens
atagagtgtgaccat

SEQ ID NO: 121390 - DNA, 15 bp, Homo sapiens
tatagagtgtgacca

SEQ ID NO: 121391 - DNA, 15 bp, Homo sapiens
atatagagtgtgacc

SEQ ID NO: 121392 - DNA, 15 bp, Homo sapiens
tatatagagtgtgac

SEQ ID NO: 121393 - DNA, 15 bp, Homo sapiens
atatatagagtgtga

SEQ ID NO: 121394 - DNA, 15 bp, Homo sapiens
catatatagagtgtg

SEQ ID NO: 121395 - DNA, 15 bp, Homo sapiens
acatatatagagtgt

SEQ ID NO: 121396 - DNA, 15 bp, Homo sapiens
gacatatatagagtg

SEQ ID NO: 121397 - DNA, 15 bp, Homo sapiens
agacatatatagagt

SEQ ID NO: 121398 - DNA, 15 bp, Homo sapiens
aagacatatatagag

SEQ ID NO: 121399 - DNA, 15 bp, Homo sapiens
gaagacatatataga

SEQ ID NO: 121400 - DNA, 15 bp, Homo sapiens
tgaagacatatatag

SEQ ID NO: 121401 - DNA, 15 bp, Homo sapiens
gtgaagacatatata

SEQ ID NO: 121402 - DNA, 15 bp, Homo sapiens
tgtgaagacatatat

SEQ ID NO: 121403 - DNA, 15 bp, Homo sapiens
atgtgaagacatata

SEQ ID NO: 121404 - DNA, 15 bp, Homo sapiens
aatgtgaagacatat

SEQ ID NO: 121405 - DNA, 15 bp, Homo sapiens
caatgtgaagacata

SEQ ID NO: 121406 - DNA, 15 bp, Homo sapiens
gcaatgtgaagacat

SEQ ID NO: 121407 - DNA, 15 bp, Homo sapiens
tgcaatgtgaagaca

SEQ ID NO: 121408 - DNA, 15 bp, Homo sapiens
gtgcaatgtgaagac

SEQ ID NO: 121409 - DNA, 15 bp, Homo sapiens
tgtgcaatgtgaaga

SEQ ID NO: 121410 - DNA, 15 bp, Homo sapiens
gtgtgcaatgtgaag

SEQ ID NO: 121411 - DNA, 15 bp, Homo sapiens
tgtgtgcaatgtgaa

SEQ ID NO: 121412 - DNA, 15 bp, Homo sapiens
gtgtgtgcaatgtga

SEQ ID NO: 121413 - DNA, 15 bp, Homo sapiens
ggtgtgtgcaatgtg

SEQ ID NO: 121414 - DNA, 15 bp, Homo sapiens
tggtgtgtgcaatgt

SEQ ID NO: 121415 - DNA, 15 bp, Homo sapiens
gtggtgtgtgcaatg

SEQ ID NO: 121416 - DNA, 15 bp, Homo sapiens
tgtggtgtgtgcaat

SEQ ID NO: 121417 - DNA, 15 bp, Homo sapiens
ctgtggtgtgtgcaa

SEQ ID NO: 121418 - DNA, 15 bp, Homo sapiens
tctgtggtgtgtgca

SEQ ID NO: 121419 - DNA, 15 bp, Homo sapiens
ttctgtggtgtgtgc

SEQ ID NO: 121420 - DNA, 15 bp, Homo sapiens
gttctgtggtgtgtg

SEQ ID NO: 121421 - DNA, 15 bp, Homo sapiens
agttctgtggtgtgt

SEQ ID NO: 121422 - DNA, 15 bp, Homo sapiens
aagttctgtggtgtg

SEQ ID NO: 121423 - DNA, 15 bp, Homo sapiens
caagttctgtggtgt

SEQ ID NO: 121424 - DNA, 15 bp, Homo sapiens
acaagttctgtggtg

SEQ ID NO: 121425 - DNA, 15 bp, Homo sapiens
aacaagttctgtggt

SEQ ID NO: 121426 - DNA, 15 bp, Homo sapiens
aaacaagttctgtgg

SEQ ID NO: 121427 - DNA, 15 bp, Homo sapiens
aaaacaagttctgtg

SEQ ID NO: 121428 - DNA, 15 bp, Homo sapiens
aaaaacaagttctgt

SEQ ID NO: 121429 - DNA, 15 bp, Homo sapiens
aaaaaacaagttctg

SEQ ID NO: 121430 - DNA, 15 bp, Homo sapiens
aaaaaaacaagttct

SEQ ID NO: 121431 - DNA, 15 bp, Homo sapiens
aaaaaaaacaagttc

SEQ ID NO: 121432 - DNA, 15 bp, Homo sapiens
aaaaaaaaacaagtt

SEQ ID NO: 121433 - DNA, 15 bp, Homo sapiens
aaaaaaaaaacaagt

SEQ ID NO: 121434 - DNA, 15 bp, Homo sapiens
aaaaaaaaaaacaag

SEQ ID NO: 121435 - DNA, 15 bp, Homo sapiens
acaaaaaaaaaaaca

SEQ ID NO: 121436 - DNA, 15 bp, Homo sapiens
aacaaaaaaaaaaac

SEQ ID NO: 121437 - DNA, 15 bp, Homo sapiens
taaaacaaaaaaaaa

SEQ ID NO: 121438 - DNA, 15 bp, Homo sapiens
ataaaacaaaaaaaa

SEQ ID NO: 121439 - DNA, 15 bp, Homo sapiens
tataaaacaaaaaaa

SEQ ID NO: 121440 - DNA, 15 bp, Homo sapiens
atataaaacaaaaaa

SEQ ID NO: 121441 - DNA, 15 bp, Homo sapiens
catataaaacaaaaa

SEQ ID NO: 121442 - DNA, 15 bp, Homo sapiens
tcatataaaacaaaa

SEQ ID NO: 121443 - DNA, 15 bp, Homo sapiens
gtcatataaaacaaa

SEQ ID NO: 121444 - DNA, 15 bp, Homo sapiens
cgtcatataaaacaa

SEQ ID NO: 121445 - DNA, 15 bp, Homo sapiens
tcgtcatataaaaca

SEQ ID NO: 121446 - DNA, 15 bp, Homo sapiens
gtcgtcatataaaac

SEQ ID NO: 121447 - DNA, 15 bp, Homo sapiens
tgtcgtcatataaaa

SEQ ID NO: 121448 - DNA, 15 bp, Homo sapiens
ttgtcgtcatataaa

SEQ ID NO: 121449 - DNA, 15 bp, Homo sapiens
tttgtcgtcatataa

SEQ ID NO: 121450 - DNA, 15 bp, Homo sapiens
atttgtcgtcatata

SEQ ID NO: 121451 - DNA, 15 bp, Homo sapiens
gatttgtcgtcatat

SEQ ID NO: 121452 - DNA, 15 bp, Homo sapiens
agatttgtcgtcata

SEQ ID NO: 121453 - DNA, 15 bp, Homo sapiens
tagatttgtcgtcat

SEQ ID NO: 121454 - DNA, 15 bp, Homo sapiens
ttagatttgtcgtca

SEQ ID NO: 121455 - DNA, 15 bp, Homo sapiens
tttagatttgtcgtc

SEQ ID NO: 121456 - DNA, 15 bp, Homo sapiens
ttttagatttgtcgt

SEQ ID NO: 121457 - DNA, 15 bp, Homo sapiens
cttttagatttgtcg

SEQ ID NO: 121458 - DNA, 15 bp, Homo sapiens
acttttagatttgtc

SEQ ID NO: 121459 - DNA, 15 bp, Homo sapiens
aacttttagatttgt

SEQ ID NO: 121460 - DNA, 15 bp, Homo sapiens
taacttttagatttg

SEQ ID NO: 121461 - DNA, 15 bp, Homo sapiens
gtaacttttagattt

SEQ ID NO: 121462 - DNA, 15 bp, Homo sapiens
tgtaacttttagatt

SEQ ID NO: 121463 - DNA, 15 bp, Homo sapiens
ctgtaacttttagat

SEQ ID NO: 121464 - DNA, 15 bp, Homo sapiens
tctgtaacttttaga

SEQ ID NO: 121465 - DNA, 15 bp, Homo sapiens
atctgtaacttttag

SEQ ID NO: 121466 - DNA, 15 bp, Homo sapiens
tatctgtaactttta

SEQ ID NO: 121467 - DNA, 15 bp, Homo sapiens
ttatctgtaactttt

SEQ ID NO: 121468 - DNA, 15 bp, Homo sapiens
attatctgtaacttt

SEQ ID NO: 121469 - DNA, 15 bp, Homo sapiens
aattatctgtaactt

SEQ ID NO: 121470 - DNA, 15 bp, Homo sapiens
aaattatctgtaact

SEQ ID NO: 121471 - DNA, 15 bp, Homo sapiens
gaaattatctgtaac

SEQ ID NO: 121472 - DNA, 15 bp, Homo sapiens
tgaaattatctgtaa

SEQ ID NO: 121473 - DNA, 15 bp, Homo sapiens
gtgaaattatctgta

SEQ ID NO: 121474 - DNA, 15 bp, Homo sapiens
tgtgaaattatctgt

SEQ ID NO: 121475 - DNA, 15 bp, Homo sapiens
ctgtgaaattatctg

SEQ ID NO: 121476 - DNA, 15 bp, Homo sapiens
actgtgaaattatct

SEQ ID NO: 121477 - DNA, 15 bp, Homo sapiens
aactgtgaaattatc

SEQ ID NO: 121478 - DNA, 15 bp, Homo sapiens
aaactgtgaaattat

SEQ ID NO: 121479 - DNA, 15 bp, Homo sapiens
taaactgtgaaatta

SEQ ID NO: 121480 - DNA, 15 bp, Homo sapiens
ttaaactgtgaaatt

SEQ ID NO: 121481 - DNA, 15 bp, Homo sapiens
attaaactgtgaaat

SEQ ID NO: 121482 - DNA, 15 bp, Homo sapiens
gattaaactgtgaaa

SEQ ID NO: 121483 - DNA, 15 bp, Homo sapiens
ggattaaactgtgaa

SEQ ID NO: 121484 - DNA, 15 bp, Homo sapiens
aggattaaactgtga

SEQ ID NO: 121485 - DNA, 15 bp, Homo sapiens
taggattaaactgtg

SEQ ID NO: 121486 - DNA, 15 bp, Homo sapiens
ttaggattaaactgt

SEQ ID NO: 121487 - DNA, 15 bp, Homo sapiens
attaggattaaactg

SEQ ID NO: 121488 - DNA, 15 bp, Homo sapiens
cattaggattaaact

SEQ ID NO: 121489 - DNA, 15 bp, Homo sapiens
acattaggattaaac

SEQ ID NO: 121490 - DNA, 15 bp, Homo sapiens
tacattaggattaaa

SEQ ID NO: 121491 - DNA, 15 bp, Homo sapiens
ctacattaggattaa

SEQ ID NO: 121492 - DNA, 15 bp, Homo sapiens
cctacattaggatta

SEQ ID NO: 121493 - DNA, 15 bp, Homo sapiens
tcctacattaggatt

SEQ ID NO: 121494 - DNA, 15 bp, Homo sapiens
ttcctacattaggat

SEQ ID NO: 121495 - DNA, 15 bp, Homo sapiens
tttcctacattagga

SEQ ID NO: 121496 - DNA, 15 bp, Homo sapiens
ctttcctacattagg

SEQ ID NO: 121497 - DNA, 15 bp, Homo sapiens
actttcctacattag

SEQ ID NO: 121498 - DNA, 15 bp, Homo sapiens
tactttcctacatta

SEQ ID NO: 121499 - DNA, 15 bp, Homo sapiens
gtactttcctacatt

SEQ ID NO: 121500 - DNA, 15 bp, Homo sapiens
agtactttcctacat

SEQ ID NO: 121501 - DNA, 15 bp, Homo sapiens
tagtactttcctaca

SEQ ID NO: 121502 - DNA, 15 bp, Homo sapiens
gtagtactttcctac

SEQ ID NO: 121503 - DNA, 15 bp, Homo sapiens
ggtagtactttccta

SEQ ID NO: 121504 - DNA, 15 bp, Homo sapiens
aggtagtactttcct

SEQ ID NO: 121505 - DNA, 15 bp, Homo sapiens
caggtagtactttcc

SEQ ID NO: 121506 - DNA, 15 bp, Homo sapiens
tcaggtagtactttc

SEQ ID NO: 121507 - DNA, 15 bp, Homo sapiens
atcaggtagtacttt

SEQ ID NO: 121508 - DNA, 15 bp, Homo sapiens
aatcaggtagtactt

SEQ ID NO: 121509 - DNA, 15 bp, Homo sapiens
aaatcaggtagtact

SEQ ID NO: 121510 - DNA, 15 bp, Homo sapiens
aaaatcaggtagtac

SEQ ID NO: 121511 - DNA, 15 bp, Homo sapiens
taaaatcaggtagta

SEQ ID NO: 121512 - DNA, 15 bp, Homo sapiens
ataaaatcaggtagt

SEQ ID NO: 121513 - DNA, 15 bp, Homo sapiens
tataaaatcaggtag

SEQ ID NO: 121514 - DNA, 15 bp, Homo sapiens
ttataaaatcaggta

SEQ ID NO: 121515 - DNA, 15 bp, Homo sapiens
tttataaaatcaggt

SEQ ID NO: 121516 - DNA, 15 bp, Homo sapiens
atttataaaatcagg

SEQ ID NO: 121517 - DNA, 15 bp, Homo sapiens
aatttataaaatcag

SEQ ID NO: 121518 - DNA, 15 bp, Homo sapiens
aaatttataaaatca

SEQ ID NO: 121519 - DNA, 15 bp, Homo sapiens
taaatttataaaatc

SEQ ID NO: 121520 - DNA, 15 bp, Homo sapiens
ttaaatttataaaat

SEQ ID NO: 121521 - DNA, 15 bp, Homo sapiens
attaaatttataaaa

SEQ ID NO: 121522 - DNA, 15 bp, Homo sapiens
tattaaatttataaa

SEQ ID NO: 121523 - DNA, 15 bp, Homo sapiens
ttattaaatttataa

SEQ ID NO: 121524 - DNA, 15 bp, Homo sapiens
tttattaaatttata

SEQ ID NO: 121525 - DNA, 15 bp, Homo sapiens
ctttattaaatttat

SEQ ID NO: 121526 - DNA, 15 bp, Homo sapiens
tctttattaaattta

SEQ ID NO: 121527 - DNA, 15 bp, Homo sapiens
ctctttattaaattt

SEQ ID NO: 121528 - DNA, 15 bp, Homo sapiens
gctctttattaaatt

SEQ ID NO: 121529 - DNA, 15 bp, Homo sapiens
agctctttattaaat

SEQ ID NO: 121530 - DNA, 15 bp, Homo sapiens
aagctctttattaaa

SEQ ID NO: 121531 - DNA, 15 bp, Homo sapiens
aaagctctttattaa

SEQ ID NO: 121532 - DNA, 15 bp, Homo sapiens
taaagctctttatta

SEQ ID NO: 121533 - DNA, 15 bp, Homo sapiens
ctaaagctctttatt

SEQ ID NO: 121534 - DNA, 15 bp, Homo sapiens
tctaaagctctttat

SEQ ID NO: 121535 - DNA, 15 bp, Homo sapiens
gtctaaagctcttta

SEQ ID NO: 121536 - DNA, 15 bp, Homo sapiens
tgtctaaagctcttt

SEQ ID NO: 121537 - DNA, 15 bp, Homo sapiens
atgtctaaagctctt

SEQ ID NO: 121538 - DNA, 15 bp, Homo sapiens
aatgtctaaagctct

SEQ ID NO: 121539 - DNA, 15 bp, Homo sapiens
aaatgtctaaagctc

SEQ ID NO: 121540 - DNA, 15 bp, Homo sapiens
taaatgtctaaagct

SEQ ID NO: 121541 - DNA, 15 bp, Homo sapiens
ttaaatgtctaaagc

SEQ ID NO: 121542 - DNA, 15 bp, Homo sapiens
attaaatgtctaaag

SEQ ID NO: 121543 - DNA, 15 bp, Homo sapiens
aattaaatgtctaaa

SEQ ID NO: 121544 - DNA, 15 bp, Homo sapiens
taattaaatgtctaa

SEQ ID NO: 121545 - DNA, 15 bp, Homo sapiens
ttaattaaatgtcta

SEQ ID NO: 121546 - DNA, 15 bp, Homo sapiens
gttaattaaatgtct

SEQ ID NO: 121547 - DNA, 15 bp, Homo sapiens
tgttaattaaatgtc

SEQ ID NO: 121548 - DNA, 15 bp, Homo sapiens
ctgttaattaaatgt

SEQ ID NO: 121549 - DNA, 15 bp, Homo sapiens
cctgttaattaaatg

SEQ ID NO: 121550 - DNA, 15 bp, Homo sapiens
ccctgttaattaaat

SEQ ID NO: 121551 - DNA, 15 bp, Homo sapiens
accctgttaattaaa

SEQ ID NO: 121552 - DNA, 15 bp, Homo sapiens
taccctgttaattaa

SEQ ID NO: 121553 - DNA, 15 bp, Homo sapiens
ttaccctgttaatta

SEQ ID NO: 121554 - DNA, 15 bp, Homo sapiens
attaccctgttaatt

SEQ ID NO: 121555 - DNA, 15 bp, Homo sapiens
tattaccctgttaat

SEQ ID NO: 121556 - DNA, 15 bp, Homo sapiens
ttattaccctgttaa

SEQ ID NO: 121557 - DNA, 15 bp, Homo sapiens
tttattaccctgtta

SEQ ID NO: 121558 - DNA, 15 bp, Homo sapiens
atttattaccctgtt

SEQ ID NO: 121559 - DNA, 15 bp, Homo sapiens
tatttattaccctgt

SEQ ID NO: 121560 - DNA, 15 bp, Homo sapiens
ctatttattaccctg

SEQ ID NO: 121561 - DNA, 15 bp, Homo sapiens
cctatttattaccct

SEQ ID NO: 121562 - DNA, 15 bp, Homo sapiens
tcctatttattaccc

SEQ ID NO: 121563 - DNA, 15 bp, Homo sapiens
gtcctatttattacc

SEQ ID NO: 121564 - DNA, 15 bp, Homo sapiens
ggtcctatttattac

SEQ ID NO: 121565 - DNA, 15 bp, Homo sapiens
aggtcctatttatta

SEQ ID NO: 121566 - DNA, 15 bp, Homo sapiens
aaggtcctatttatt

SEQ ID NO: 121567 - DNA, 15 bp, Homo sapiens
aaaggtcctatttat

SEQ ID NO: 121568 - DNA, 15 bp, Homo sapiens
taaaggtcctattta

SEQ ID NO: 121569 - DNA, 15 bp, Homo sapiens
ataaaggtcctattt

SEQ ID NO: 121570 - DNA, 15 bp, Homo sapiens
cataaaggtcctatt

SEQ ID NO: 121571 - DNA, 15 bp, Homo sapiens
tcataaaggtcctat

SEQ ID NO: 121572 - DNA, 15 bp, Homo sapiens
ctcataaaggtccta

SEQ ID NO: 121573 - DNA, 15 bp, Homo sapiens
tctcataaaggtcct

SEQ ID NO: 121574 - DNA, 15 bp, Homo sapiens
ctctcataaaggtcc

SEQ ID NO: 121575 - DNA, 15 bp, Homo sapiens
actctcataaaggtc

SEQ ID NO: 121576 - DNA, 15 bp, Homo sapiens
cactctcataaaggt

SEQ ID NO: 121577 - DNA, 15 bp, Homo sapiens
gcactctcataaagg

SEQ ID NO: 121578 - DNA, 15 bp, Homo sapiens
agcactctcataaag

SEQ ID NO: 121579 - DNA, 15 bp, Homo sapiens
tagcactctcataaa

SEQ ID NO: 121580 - DNA, 15 bp, Homo sapiens
ctagcactctcataa

SEQ ID NO: 121581 - DNA, 15 bp, Homo sapiens
actagcactctcata

SEQ ID NO: 121582 - DNA, 15 bp, Homo sapiens
aactagcactctcat

SEQ ID NO: 121583 - DNA, 15 bp, Homo sapiens
aaactagcactctca

SEQ ID NO: 121584 - DNA, 15 bp, Homo sapiens
aaaactagcactctc

SEQ ID NO: 121585 - DNA, 15 bp, Homo sapiens
gaaaactagcactct

SEQ ID NO: 121586 - DNA, 15 bp, Homo sapiens
ggaaaactagcactc

SEQ ID NO: 121587 - DNA, 15 bp, Homo sapiens
gggaaaactagcact

SEQ ID NO: 121588 - DNA, 15 bp, Homo sapiens
tgggaaaactagcac

SEQ ID NO: 121589 - DNA, 15 bp, Homo sapiens
gtgggaaaactagca

SEQ ID NO: 121590 - DNA, 15 bp, Homo sapiens
tgtgggaaaactagc

SEQ ID NO: 121591 - DNA, 15 bp, Homo sapiens
gtgtgggaaaactag

SEQ ID NO: 121592 - DNA, 15 bp, Homo sapiens
agtgtgggaaaacta

SEQ ID NO: 121593 - DNA, 15 bp, Homo sapiens
aagtgtgggaaaact

SEQ ID NO: 121594 - DNA, 15 bp, Homo sapiens
taagtgtgggaaaac

SEQ ID NO: 121595 - DNA, 15 bp, Homo sapiens
ctaagtgtgggaaaa

SEQ ID NO: 121596 - DNA, 15 bp, Homo sapiens
gctaagtgtgggaaa

SEQ ID NO: 121597 - DNA, 15 bp, Homo sapiens
ggctaagtgtgggaa

SEQ ID NO: 121598 - DNA, 15 bp, Homo sapiens
tggctaagtgtggga

SEQ ID NO: 121599 - DNA, 15 bp, Homo sapiens
ttggctaagtgtggg

SEQ ID NO: 121600 - DNA, 15 bp, Homo sapiens
gttggctaagtgtgg

SEQ ID NO: 121601 - DNA, 15 bp, Homo sapiens
ggttggctaagtgtg

SEQ ID NO: 121602 - DNA, 15 bp, Homo sapiens
gggttggctaagtgt

SEQ ID NO: 121603 - DNA, 15 bp, Homo sapiens
ggggttggctaagtg

SEQ ID NO: 121604 - DNA, 15 bp, Homo sapiens
tggggttggctaagt

SEQ ID NO: 121605 - DNA, 15 bp, Homo sapiens
ctggggttggctaag

SEQ ID NO: 121606 - DNA, 15 bp, Homo sapiens
tctggggttggctaa

SEQ ID NO: 121607 - DNA, 15 bp, Homo sapiens
atctggggttggcta

SEQ ID NO: 121608 - DNA, 15 bp, Homo sapiens
catctggggttggct

SEQ ID NO: 121609 - DNA, 15 bp, Homo sapiens
ccatctggggttggc

SEQ ID NO: 121610 - DNA, 15 bp, Homo sapiens
accatctggggttgg

SEQ ID NO: 121611 - DNA, 15 bp, Homo sapiens
taccatctggggttg

SEQ ID NO: 121612 - DNA, 15 bp, Homo sapiens
ataccatctggggtt

SEQ ID NO: 121613 - DNA, 15 bp, Homo sapiens
aataccatctggggt

SEQ ID NO: 121614 - DNA, 15 bp, Homo sapiens
aaataccatctgggg

SEQ ID NO: 121615 - DNA, 15 bp, Homo sapiens
taaataccatctggg

SEQ ID NO: 121616 - DNA, 15 bp, Homo sapiens
ataaataccatctgg

SEQ ID NO: 121617 - DNA, 15 bp, Homo sapiens
gataaataccatctg

SEQ ID NO: 121618 - DNA, 15 bp, Homo sapiens
agataaataccatct

SEQ ID NO: 121619 - DNA, 15 bp, Homo sapiens
cagataaataccatc

SEQ ID NO: 121620 - DNA, 15 bp, Homo sapiens
gcagataaataccat

SEQ ID NO: 121621 - DNA, 15 bp, Homo sapiens
tgcagataaatacca

SEQ ID NO: 121622 - DNA, 15 bp, Homo sapiens
atgcagataaatacc

SEQ ID NO: 121623 - DNA, 15 bp, Homo sapiens
aatgcagataaatac

SEQ ID NO: 121624 - DNA, 15 bp, Homo sapiens
aaatgcagataaata

SEQ ID NO: 121625 - DNA, 15 bp, Homo sapiens
taaatgcagataaat

SEQ ID NO: 121626 - DNA, 15 bp, Homo sapiens
ctaaatgcagataaa

SEQ ID NO: 121627 - DNA, 15 bp, Homo sapiens
actaaatgcagataa

SEQ ID NO: 121628 - DNA, 15 bp, Homo sapiens
aactaaatgcagata

SEQ ID NO: 121629 - DNA, 15 bp, Homo sapiens
aaactaaatgcagat

SEQ ID NO: 121630 - DNA, 15 bp, Homo sapiens
aaaactaaatgcaga

SEQ ID NO: 121631 - DNA, 15 bp, Homo sapiens
taaaactaaatgcag

SEQ ID NO: 121632 - DNA, 15 bp, Homo sapiens
ataaaactaaatgca

SEQ ID NO: 121633 - DNA, 15 bp, Homo sapiens
aataaaactaaatgc

SEQ ID NO: 121634 - DNA, 15 bp, Homo sapiens
taataaaactaaatg

SEQ ID NO: 121635 - DNA, 15 bp, Homo sapiens
ttaataaaactaaat

SEQ ID NO: 121636 - DNA, 15 bp, Homo sapiens
tttaataaaactaaa

SEQ ID NO: 121637 - DNA, 15 bp, Homo sapiens
ttttaataaaactaa

SEQ ID NO: 121638 - DNA, 15 bp, Homo sapiens
attttaataaaacta

SEQ ID NO: 121639 - DNA, 15 bp, Homo sapiens
aattttaataaaact

SEQ ID NO: 121640 - DNA, 15 bp, Homo sapiens
caattttaataaaac

SEQ ID NO: 121641 - DNA, 15 bp, Homo sapiens
acaattttaataaaa

SEQ ID NO: 121642 - DNA, 15 bp, Homo sapiens
aacaattttaataaa

SEQ ID NO: 121643 - DNA, 15 bp, Homo sapiens
aaacaattttaataa

SEQ ID NO: 121644 - DNA, 15 bp, Homo sapiens
aaaacaattttaata

SEQ ID NO: 121645 - DNA, 15 bp, Homo sapiens
taaaacaattttaat

SEQ ID NO: 121646 - DNA, 15 bp, Homo sapiens
ataaaacaattttaa

SEQ ID NO: 121647 - DNA, 15 bp, Homo sapiens
aataaaacaatttta

SEQ ID NO: 121648 - DNA, 15 bp, Homo sapiens
caataaaacaatttt

SEQ ID NO: 121649 - DNA, 15 bp, Homo sapiens
tcaataaaacaattt

SEQ ID NO: 121650 - DNA, 15 bp, Homo sapiens
ctcaataaaacaatt

SEQ ID NO: 121651 - DNA, 15 bp, Homo sapiens
actcaataaaacaat

SEQ ID NO: 121652 - DNA, 15 bp, Homo sapiens
aactcaataaaacaa

SEQ ID NO: 121653 - DNA, 15 bp, Homo sapiens
aaactcaataaaaca

SEQ ID NO: 121654 - DNA, 15 bp, Homo sapiens
aaaactcaataaaac

SEQ ID NO: 121655 - DNA, 15 bp, Homo sapiens
taaaactcaataaaa

SEQ ID NO: 121656 - DNA, 15 bp, Homo sapiens
ataaaactcaataaa

SEQ ID NO: 121657 - DNA, 15 bp, Homo sapiens
aataaaactcaataa

SEQ ID NO: 121658 - DNA, 15 bp, Homo sapiens
aaataaaactcaata

SEQ ID NO: 121659 - DNA, 15 bp, Homo sapiens
taaataaaactcaat

SEQ ID NO: 121660 - DNA, 15 bp, Homo sapiens
ttaaataaaactcaa

SEQ ID NO: 121661 - DNA, 15 bp, Homo sapiens
tttaaataaaactca

SEQ ID NO: 121662 - DNA, 15 bp, Homo sapiens
gtttaaataaaactc

SEQ ID NO: 121663 - DNA, 15 bp, Homo sapiens
tgtttaaataaaact

SEQ ID NO: 121664 - DNA, 15 bp, Homo sapiens
ttgtttaaataaaac

SEQ ID NO: 121665 - DNA, 15 bp, Homo sapiens
tttgtttaaataaaa

SEQ ID NO: 121666 - DNA, 15 bp, Homo sapiens
atttgtttaaataaa

SEQ ID NO: 121667 - DNA, 15 bp, Homo sapiens
tatttgtttaaataa

SEQ ID NO: 121668 - DNA, 15 bp, Homo sapiens
atatttgtttaaata

SEQ ID NO: 121669 - DNA, 15 bp, Homo sapiens
tatatttgtttaaat

SEQ ID NO: 121670 - DNA, 15 bp, Homo sapiens
ttatatttgtttaaa

SEQ ID NO: 121671 - DNA, 15 bp, Homo sapiens
tttatatttgtttaa

SEQ ID NO: 121672 - DNA, 15 bp, Homo sapiens
ttttatatttgttta

SEQ ID NO: 121673 - DNA, 15 bp, Homo sapiens
attttatatttgttt

SEQ ID NO: 121674 - DNA, 15 bp, Homo sapiens
aattttatatttgtt

SEQ ID NO: 121675 - DNA, 15 bp, Homo sapiens
aaattttatatttgt

SEQ ID NO: 121676 - DNA, 15 bp, Homo sapiens
aaaattttatatttg

SEQ ID NO: 121677 - DNA, 15 bp, Homo sapiens
aaaaattttatattt

SEQ ID NO: 121678 - DNA, 15 bp, Homo sapiens
gaaaaattttatatt

SEQ ID NO: 121679 - DNA, 15 bp, Homo sapiens
agaaaaattttatat

SEQ ID NO: 121680 - DNA, 15 bp, Homo sapiens
tagaaaaattttata

SEQ ID NO: 121681 - DNA, 15 bp, Homo sapiens
gtagaaaaattttat

SEQ ID NO: 121682 - DNA, 15 bp, Homo sapiens
cgtagaaaaatttta

SEQ ID NO: 121683 - DNA, 15 bp, Homo sapiens
acgtagaaaaatttt

SEQ ID NO: 121684 - DNA, 15 bp, Homo sapiens
tacgtagaaaaattt

SEQ ID NO: 121685 - DNA, 15 bp, Homo sapiens
ctacgtagaaaaatt

SEQ ID NO: 121686 - DNA, 15 bp, Homo sapiens
tctacgtagaaaaat

SEQ ID NO: 121687 - DNA, 15 bp, Homo sapiens
atctacgtagaaaaa

SEQ ID NO: 121688 - DNA, 15 bp, Homo sapiens
catctacgtagaaaa

SEQ ID NO: 121689 - DNA, 15 bp, Homo sapiens
acatctacgtagaaa

SEQ ID NO: 121690 - DNA, 15 bp, Homo sapiens
aacatctacgtagaa

SEQ ID NO: 121691 - DNA, 15 bp, Homo sapiens
taacatctacgtaga

SEQ ID NO: 121692 - DNA, 15 bp, Homo sapiens
ataacatctacgtag

SEQ ID NO: 121693 - DNA, 15 bp, Homo sapiens
gataacatctacgta

SEQ ID NO: 121694 - DNA, 15 bp, Homo sapiens
agataacatctacgt

SEQ ID NO: 121695 - DNA, 15 bp, Homo sapiens
cagataacatctacg

SEQ ID NO: 121696 - DNA, 15 bp, Homo sapiens
tcagataacatctac

SEQ ID NO: 121697 - DNA, 15 bp, Homo sapiens
ttcagataacatcta

SEQ ID NO: 121698 - DNA, 15 bp, Homo sapiens
tttcagataacatct

SEQ ID NO: 121699 - DNA, 15 bp, Homo sapiens
ttttcagataacatc

SEQ ID NO: 121700 - DNA, 15 bp, Homo sapiens
cttttcagataacat

SEQ ID NO: 121701 - DNA, 15 bp, Homo sapiens
tcttttcagataaca

SEQ ID NO: 121702 - DNA, 15 bp, Homo sapiens
atcttttcagataac

SEQ ID NO: 121703 - DNA, 15 bp, Homo sapiens
catcttttcagataa

SEQ ID NO: 121704 - DNA, 15 bp, Homo sapiens
tcatcttttcagata

SEQ ID NO: 121705 - DNA, 15 bp, Homo sapiens
gtcatcttttcagat

SEQ ID NO: 121706 - DNA, 15 bp, Homo sapiens
tgtcatcttttcaga

SEQ ID NO: 121707 - DNA, 15 bp, Homo sapiens
atgtcatcttttcag

SEQ ID NO: 121708 - DNA, 15 bp, Homo sapiens
aatgtcatcttttca

SEQ ID NO: 121709 - DNA, 15 bp, Homo sapiens
caatgtcatcttttc

SEQ ID NO: 121710 - DNA, 15 bp, Homo sapiens
tcaatgtcatctttt

SEQ ID NO: 121711 - DNA, 15 bp, Homo sapiens
ctcaatgtcatcttt

SEQ ID NO: 121712 - DNA, 15 bp, Homo sapiens
tctcaatgtcatctt

SEQ ID NO: 121713 - DNA, 15 bp, Homo sapiens
ttctcaatgtcatct

SEQ ID NO: 121714 - DNA, 15 bp, Homo sapiens
tttctcaatgtcatc

SEQ ID NO: 121715 - DNA, 15 bp, Homo sapiens
atttctcaatgtcat

SEQ ID NO: 121716 - DNA, 15 bp, Homo sapiens
tatttctcaatgtca

SEQ ID NO: 121717 - DNA, 15 bp, Homo sapiens
atatttctcaatgtc

SEQ ID NO: 121718 - DNA, 15 bp, Homo sapiens
catatttctcaatgt

SEQ ID NO: 121719 - DNA, 15 bp, Homo sapiens
gcatatttctcaatg

SEQ ID NO: 121720 - DNA, 15 bp, Homo sapiens
tgcatatttctcaat

SEQ ID NO: 121721 - DNA, 15 bp, Homo sapiens
gtgcatatttctcaa

SEQ ID NO: 121722 - DNA, 15 bp, Homo sapiens
agtgcatatttctca

SEQ ID NO: 121723 - DNA, 15 bp, Homo sapiens
aagtgcatatttctc

SEQ ID NO: 121724 - DNA, 15 bp, Homo sapiens
gaagtgcatatttct

SEQ ID NO: 121725 - DNA, 15 bp, Homo sapiens
agaagtgcatatttc

SEQ ID NO: 121726 - DNA, 15 bp, Homo sapiens
aagaagtgcatattt

SEQ ID NO: 121727 - DNA, 15 bp, Homo sapiens
aaagaagtgcatatt

SEQ ID NO: 121728 - DNA, 15 bp, Homo sapiens
caaagaagtgcatat

SEQ ID NO: 121729 - DNA, 15 bp, Homo sapiens
tcaaagaagtgcata

SEQ ID NO: 121730 - DNA, 15 bp, Homo sapiens
gtcaaagaagtgcat

SEQ ID NO: 121731 - DNA, 15 bp, Homo sapiens
cgtcaaagaagtgca

SEQ ID NO: 121732 - DNA, 15 bp, Homo sapiens
acgtcaaagaagtgc

SEQ ID NO: 121733 - DNA, 15 bp, Homo sapiens
aacgtcaaagaagtg

SEQ ID NO: 121734 - DNA, 15 bp, Homo sapiens
aaacgtcaaagaagt

SEQ ID NO: 121735 - DNA, 15 bp, Homo sapiens
caaacgtcaaagaag

SEQ ID NO: 121736 - DNA, 15 bp, Homo sapiens
acaaacgtcaaagaa

SEQ ID NO: 121737 - DNA, 15 bp, Homo sapiens
cacaaacgtcaaaga

SEQ ID NO: 121738 - DNA, 15 bp, Homo sapiens
acacaaacgtcaaag

SEQ ID NO: 121739 - DNA, 15 bp, Homo sapiens
tacacaaacgtcaaa

SEQ ID NO: 121740 - DNA, 15 bp, Homo sapiens
atacacaaacgtcaa

SEQ ID NO: 121741 - DNA, 15 bp, Homo sapiens
catacacaaacgtca

SEQ ID NO: 121742 - DNA, 15 bp, Homo sapiens
tcatacacaaacgtc

SEQ ID NO: 121743 - DNA, 15 bp, Homo sapiens
ttcatacacaaacgt

SEQ ID NO: 121744 - DNA, 15 bp, Homo sapiens
tttcatacacaaacg

SEQ ID NO: 121745 - DNA, 15 bp, Homo sapiens
ttttcatacacaaac

SEQ ID NO: 121746 - DNA, 15 bp, Homo sapiens
attttcatacacaaa

SEQ ID NO: 121747 - DNA, 15 bp, Homo sapiens
gattttcatacacaa

SEQ ID NO: 121748 - DNA, 15 bp, Homo sapiens
ggattttcatacaca

SEQ ID NO: 121749 - DNA, 15 bp, Homo sapiens
tggattttcatacac

SEQ ID NO: 121750 - DNA, 15 bp, Homo sapiens
ttggattttcataca

SEQ ID NO: 121751 - DNA, 15 bp, Homo sapiens
cttggattttcatac

SEQ ID NO: 121752 - DNA, 15 bp, Homo sapiens
ccttggattttcata

SEQ ID NO: 121753 - DNA, 15 bp, Homo sapiens
cccttggattttcat

SEQ ID NO: 121754 - DNA, 15 bp, Homo sapiens
ccccttggattttca

SEQ ID NO: 121755 - DNA, 15 bp, Homo sapiens
tccccttggattttc

SEQ ID NO: 121756 - DNA, 15 bp, Homo sapiens
ttccccttggatttt

SEQ ID NO: 121757 - DNA, 15 bp, Homo sapiens
attccccttggattt

SEQ ID NO: 121758 - DNA, 15 bp, Homo sapiens
aattccccttggatt

SEQ ID NO: 121759 - DNA, 15 bp, Homo sapiens
gaattccccttggat

SEQ ID NO: 121760 - DNA, 15 bp, Homo sapiens
agaattccccttgga

SEQ ID NO: 121761 - DNA, 15 bp, Homo sapiens
tagaattccccttgg

SEQ ID NO: 121762 - DNA, 15 bp, Homo sapiens
gtagaattccccttg

SEQ ID NO: 121763 - DNA, 15 bp, Homo sapiens
agtagaattcccctt

SEQ ID NO: 121764 - DNA, 15 bp, Homo sapiens
cagtagaattcccct

SEQ ID NO: 121765 - DNA, 15 bp, Homo sapiens
tcagtagaattcccc

SEQ ID NO: 121766 - DNA, 15 bp, Homo sapiens
ctcagtagaattccc

SEQ ID NO: 121767 - DNA, 15 bp, Homo sapiens
cctcagtagaattcc

SEQ ID NO: 121768 - DNA, 15 bp, Homo sapiens
tcctcagtagaattc

SEQ ID NO: 121769 - DNA, 15 bp, Homo sapiens
ttcctcagtagaatt

SEQ ID NO: 121770 - DNA, 15 bp, Homo sapiens
tttcctcagtagaat

SEQ ID NO: 121771 - DNA, 15 bp, Homo sapiens
gtttcctcagtagaa

SEQ ID NO: 121772 - DNA, 15 bp, Homo sapiens
agtttcctcagtaga

SEQ ID NO: 121773 - DNA, 15 bp, Homo sapiens
aagtttcctcagtag

SEQ ID NO: 121774 - DNA, 15 bp, Homo sapiens
taagtttcctcagta

SEQ ID NO: 121775 - DNA, 15 bp, Homo sapiens
ttaagtttcctcagt

SEQ ID NO: 121776 - DNA, 15 bp, Homo sapiens
gttaagtttcctcag

SEQ ID NO: 121777 - DNA, 15 bp, Homo sapiens
agttaagtttcctca

SEQ ID NO: 121778 - DNA, 15 bp, Homo sapiens
cagttaagtttcctc

SEQ ID NO: 121779 - DNA, 15 bp, Homo sapiens
ccagttaagtttcct

SEQ ID NO: 121780 - DNA, 15 bp, Homo sapiens
cccagttaagtttcc

SEQ ID NO: 121781 - DNA, 15 bp, Homo sapiens
tcccagttaagtttc

SEQ ID NO: 121782 - DNA, 15 bp, Homo sapiens
ctcccagttaagttt

SEQ ID NO: 121783 - DNA, 15 bp, Homo sapiens
tctcccagttaagtt

SEQ ID NO: 121784 - DNA, 15 bp, Homo sapiens
gtctcccagttaagt

SEQ ID NO: 121785 - DNA, 15 bp, Homo sapiens
tgtctcccagttaag

SEQ ID NO: 121786 - DNA, 15 bp, Homo sapiens
atgtctcccagttaa

SEQ ID NO: 121787 - DNA, 15 bp, Homo sapiens
aatgtctcccagtta

SEQ ID NO: 121788 - DNA, 15 bp, Homo sapiens
gaatgtctcccagtt

SEQ ID NO: 121789 - DNA, 15 bp, Homo sapiens
agaatgtctcccagt

SEQ ID NO: 121790 - DNA, 15 bp, Homo sapiens
cagaatgtctcccag

SEQ ID NO: 121791 - DNA, 15 bp, Homo sapiens
acagaatgtctccca

SEQ ID NO: 121792 - DNA, 15 bp, Homo sapiens
cacagaatgtctccc

SEQ ID NO: 121793 - DNA, 15 bp, Homo sapiens
tcacagaatgtctcc

SEQ ID NO: 121794 - DNA, 15 bp, Homo sapiens
ctcacagaatgtctc

SEQ ID NO: 121795 - DNA, 15 bp, Homo sapiens
cctcacagaatgtct

SEQ ID NO: 121796 - DNA, 15 bp, Homo sapiens
acctcacagaatgtc

SEQ ID NO: 121797 - DNA, 15 bp, Homo sapiens
cacctcacagaatgt

SEQ ID NO: 121798 - DNA, 15 bp, Homo sapiens
acacctcacagaatg

SEQ ID NO: 121799 - DNA, 15 bp, Homo sapiens
gacacctcacagaat

SEQ ID NO: 121800 - DNA, 15 bp, Homo sapiens
ggacacctcacagaa

SEQ ID NO: 121801 - DNA, 15 bp, Homo sapiens
gggacacctcacaga

SEQ ID NO: 121802 - DNA, 15 bp, Homo sapiens
agggacacctcacag

SEQ ID NO: 121803 - DNA, 15 bp, Homo sapiens
cagggacacctcaca

SEQ ID NO: 121804 - DNA, 15 bp, Homo sapiens
gcagggacacctcac

SEQ ID NO: 121805 - DNA, 15 bp, Homo sapiens
ggcagggacacctca

SEQ ID NO: 121806 - DNA, 15 bp, Homo sapiens
gggcagggacacctc

SEQ ID NO: 121807 - DNA, 15 bp, Homo sapiens
agggcagggacacct

SEQ ID NO: 121808 - DNA, 15 bp, Homo sapiens
cagggcagggacacc

SEQ ID NO: 121809 - DNA, 15 bp, Homo sapiens
ccagggcagggacac

SEQ ID NO: 121810 - DNA, 15 bp, Homo sapiens
cccagggcagggaca

SEQ ID NO: 121811 - DNA, 15 bp, Homo sapiens
ccccagggcagggac

SEQ ID NO: 121812 - DNA, 15 bp, Homo sapiens
cccccagggcaggga

SEQ ID NO: 121813 - DNA, 15 bp, Homo sapiens
gcccccagggcaggg

SEQ ID NO: 121814 - DNA, 15 bp, Homo sapiens
agcccccagggcagg

SEQ ID NO: 121815 - DNA, 15 bp, Homo sapiens
cagcccccagggcag

SEQ ID NO: 121816 - DNA, 15 bp, Homo sapiens
ccagcccccagggca

SEQ ID NO: 121817 - DNA, 15 bp, Homo sapiens
cccagcccccagggc

SEQ ID NO: 121818 - DNA, 15 bp, Homo sapiens
acccagcccccaggg

SEQ ID NO: 121819 - DNA, 15 bp, Homo sapiens
cacccagcccccagg

SEQ ID NO: 121820 - DNA, 15 bp, Homo sapiens
ccacccagcccccag

SEQ ID NO: 121821 - DNA, 15 bp, Homo sapiens
gccacccagccccca

SEQ ID NO: 121822 - DNA, 15 bp, Homo sapiens
agccacccagccccc

SEQ ID NO: 121823 - DNA, 15 bp, Homo sapiens
cagccacccagcccc

SEQ ID NO: 121824 - DNA, 15 bp, Homo sapiens
acagccacccagccc

SEQ ID NO: 121825 - DNA, 15 bp, Homo sapiens
aacagccacccagcc

SEQ ID NO: 121826 - DNA, 15 bp, Homo sapiens
gaacagccacccagc

SEQ ID NO: 121827 - DNA, 15 bp, Homo sapiens
agaacagccacccag

SEQ ID NO: 121828 - DNA, 15 bp, Homo sapiens
aagaacagccaccca

SEQ ID NO: 121829 - DNA, 15 bp, Homo sapiens
gaagaacagccaccc

SEQ ID NO: 121830 - DNA, 15 bp, Homo sapiens
ggaagaacagccacc

SEQ ID NO: 121831 - DNA, 15 bp, Homo sapiens
aggaagaacagccac

SEQ ID NO: 121832 - DNA, 15 bp, Homo sapiens
aaggaagaacagcca

SEQ ID NO: 121833 - DNA, 15 bp, Homo sapiens
aaaggaagaacagcc

SEQ ID NO: 121834 - DNA, 15 bp, Homo sapiens
gaaaggaagaacagc

SEQ ID NO: 121835 - DNA, 15 bp, Homo sapiens
agaaaggaagaacag

SEQ ID NO: 121836 - DNA, 15 bp, Homo sapiens
cagaaaggaagaaca

SEQ ID NO: 121837 - DNA, 15 bp, Homo sapiens
acagaaaggaagaac

SEQ ID NO: 121838 - DNA, 15 bp, Homo sapiens
cacagaaaggaagaa

SEQ ID NO: 121839 - DNA, 15 bp, Homo sapiens
ccacagaaaggaaga

SEQ ID NO: 121840 - DNA, 15 bp, Homo sapiens
gccacagaaaggaag

SEQ ID NO: 121841 - DNA, 15 bp, Homo sapiens
ggccacagaaaggaa

SEQ ID NO: 121842 - DNA, 15 bp, Homo sapiens
tggccacagaaagga

SEQ ID NO: 121843 - DNA, 15 bp, Homo sapiens
atggccacagaaagg

SEQ ID NO: 121844 - DNA, 15 bp, Homo sapiens
catggccacagaaag

SEQ ID NO: 121845 - DNA, 15 bp, Homo sapiens
ccatggccacagaaa

SEQ ID NO: 121846 - DNA, 15 bp, Homo sapiens
accatggccacagaa

SEQ ID NO: 121847 - DNA, 15 bp, Homo sapiens
taccatggccacaga

SEQ ID NO: 121848 - DNA, 15 bp, Homo sapiens
ttaccatggccacag

SEQ ID NO: 121849 - DNA, 15 bp, Homo sapiens
cttaccatggccaca

SEQ ID NO: 121850 - DNA, 15 bp, Homo sapiens
ccttaccatggccac

SEQ ID NO: 121851 - DNA, 15 bp, Homo sapiens
tccttaccatggcca

SEQ ID NO: 121852 - DNA, 15 bp, Homo sapiens
atccttaccatggcc

SEQ ID NO: 121853 - DNA, 15 bp, Homo sapiens
tatccttaccatggc

SEQ ID NO: 121854 - DNA, 15 bp, Homo sapiens
ctatccttaccatgg

SEQ ID NO: 121855 - DNA, 15 bp, Homo sapiens
actatccttaccatg

SEQ ID NO: 121856 - DNA, 15 bp, Homo sapiens
aactatccttaccat

SEQ ID NO: 121857 - DNA, 15 bp, Homo sapiens
aaactatccttacca

SEQ ID NO: 121858 - DNA, 15 bp, Homo sapiens
gaaactatccttacc

SEQ ID NO: 121859 - DNA, 15 bp, Homo sapiens
agaaactatccttac

SEQ ID NO: 121860 - DNA, 15 bp, Homo sapiens
cagaaactatcctta

SEQ ID NO: 121861 - DNA, 15 bp, Homo sapiens
ccagaaactatcctt

SEQ ID NO: 121862 - DNA, 15 bp, Homo sapiens
tccagaaactatcct

SEQ ID NO: 121863 - DNA, 15 bp, Homo sapiens
atccagaaactatcc

SEQ ID NO: 121864 - DNA, 15 bp, Homo sapiens
gatccagaaactatc

SEQ ID NO: 121865 - DNA, 15 bp, Homo sapiens
tgatccagaaactat

SEQ ID NO: 121866 - DNA, 15 bp, Homo sapiens
atgatccagaaacta

SEQ ID NO: 121867 - DNA, 15 bp, Homo sapiens
catgatccagaaact

SEQ ID NO: 121868 - DNA, 15 bp, Homo sapiens
ccatgatccagaaac

SEQ ID NO: 121869 - DNA, 15 bp, Homo sapiens
gccatgatccagaaa

SEQ ID NO: 121870 - DNA, 15 bp, Homo sapiens
ggccatgatccagaa

SEQ ID NO: 121871 - DNA, 15 bp, Homo sapiens
tggccatgatccaga

SEQ ID NO: 121872 - DNA, 15 bp, Homo sapiens
atggccatgatccag

SEQ ID NO: 121873 - DNA, 15 bp, Homo sapiens
tatggccatgatcca

SEQ ID NO: 121874 - DNA, 15 bp, Homo sapiens
ctatggccatgatcc

SEQ ID NO: 121875 - DNA, 15 bp, Homo sapiens
actatggccatgatc

SEQ ID NO: 121876 - DNA, 15 bp, Homo sapiens
aactatggccatgat

SEQ ID NO: 121877 - DNA, 15 bp, Homo sapiens
aaactatggccatga

SEQ ID NO: 121878 - DNA, 15 bp, Homo sapiens
gaaactatggccatg

SEQ ID NO: 121879 - DNA, 15 bp, Homo sapiens
ggaaactatggccat

SEQ ID NO: 121880 - DNA, 15 bp, Homo sapiens
aggaaactatggcca

SEQ ID NO: 121881 - DNA, 15 bp, Homo sapiens
caggaaactatggcc

SEQ ID NO: 121882 - DNA, 15 bp, Homo sapiens
gcaggaaactatggc

SEQ ID NO: 121883 - DNA, 15 bp, Homo sapiens
agcaggaaactatgg

SEQ ID NO: 121884 - DNA, 15 bp, Homo sapiens
tagcaggaaactatg

SEQ ID NO: 121885 - DNA, 15 bp, Homo sapiens
atagcaggaaactat

SEQ ID NO: 121886 - DNA, 15 bp, Homo sapiens
catagcaggaaacta

SEQ ID NO: 121887 - DNA, 15 bp, Homo sapiens
gcatagcaggaaact

SEQ ID NO: 121888 - DNA, 15 bp, Homo sapiens
agcatagcaggaaac

SEQ ID NO: 121889 - DNA, 15 bp, Homo sapiens
gagcatagcaggaaa

SEQ ID NO: 121890 - DNA, 15 bp, Homo sapiens
cgagcatagcaggaa

SEQ ID NO: 121891 - DNA, 15 bp, Homo sapiens
gcgagcatagcagga

SEQ ID NO: 121892 - DNA, 15 bp, Homo sapiens
tgcgagcatagcagg

SEQ ID NO: 121893 - DNA, 15 bp, Homo sapiens
atgcgagcatagcag

SEQ ID NO: 121894 - DNA, 15 bp, Homo sapiens
catgcgagcatagca

SEQ ID NO: 121895 - DNA, 15 bp, Homo sapiens
acatgcgagcatagc

SEQ ID NO: 121896 - DNA, 15 bp, Homo sapiens
cacatgcgagcatag

SEQ ID NO: 121897 - DNA, 15 bp, Homo sapiens
ccacatgcgagcata

SEQ ID NO: 121898 - DNA, 15 bp, Homo sapiens
accacatgcgagcat

SEQ ID NO: 121899 - DNA, 15 bp, Homo sapiens
gaccacatgcgagca

SEQ ID NO: 121900 - DNA, 15 bp, Homo sapiens
agaccacatgcgagc

SEQ ID NO: 121901 - DNA, 15 bp, Homo sapiens
gagaccacatgcgag

SEQ ID NO: 121902 - DNA, 15 bp, Homo sapiens
ggagaccacatgcga

SEQ ID NO: 121903 - DNA, 15 bp, Homo sapiens
tggagaccacatgcg

SEQ ID NO: 121904 - DNA, 15 bp, Homo sapiens
ttggagaccacatgc

SEQ ID NO: 121905 - DNA, 15 bp, Homo sapiens
tttggagaccacatg

SEQ ID NO: 121906 - DNA, 15 bp, Homo sapiens
atttggagaccacat

SEQ ID NO: 121907 - DNA, 15 bp, Homo sapiens
gatttggagaccaca

SEQ ID NO: 121908 - DNA, 15 bp, Homo sapiens
ggatttggagaccac

SEQ ID NO: 121909 - DNA, 15 bp, Homo sapiens
tggatttggagacca

SEQ ID NO: 121910 - DNA, 15 bp, Homo sapiens
gtggatttggagacc

SEQ ID NO: 121911 - DNA, 15 bp, Homo sapiens
cgtggatttggagac

SEQ ID NO: 121912 - DNA, 15 bp, Homo sapiens
gcgtggatttggaga

SEQ ID NO: 121913 - DNA, 15 bp, Homo sapiens
ggcgtggatttggag

SEQ ID NO: 121914 - DNA, 15 bp, Homo sapiens
tggcgtggatttgga

SEQ ID NO: 121915 - DNA, 15 bp, Homo sapiens
gtggcgtggatttgg

SEQ ID NO: 121916 - DNA, 15 bp, Homo sapiens
tgtggcgtggatttg

SEQ ID NO: 121917 - DNA, 15 bp, Homo sapiens
ttgtggcgtggattt

SEQ ID NO: 121918 - DNA, 15 bp, Homo sapiens
gttgtggcgtggatt

SEQ ID NO: 121919 - DNA, 15 bp, Homo sapiens
tgttgtggcgtggat

SEQ ID NO: 121920 - DNA, 15 bp, Homo sapiens
gtgttgtggcgtgga

SEQ ID NO: 121921 - DNA, 15 bp, Homo sapiens
agtgttgtggcgtgg

SEQ ID NO: 121922 - DNA, 15 bp, Homo sapiens
gagtgttgtggcgtg

SEQ ID NO: 121923 - DNA, 15 bp, Homo sapiens
agagtgttgtggcgt

SEQ ID NO: 121924 - DNA, 15 bp, Homo sapiens
cagagtgttgtggcg

SEQ ID NO: 121925 - DNA, 15 bp, Homo sapiens
ccagagtgttgtggc

SEQ ID NO: 121926 - DNA, 15 bp, Homo sapiens
cccagagtgttgtgg

SEQ ID NO: 121927 - DNA, 15 bp, Homo sapiens
gcccagagtgttgtg

SEQ ID NO: 121928 - DNA, 15 bp, Homo sapiens
tgcccagagtgttgt

SEQ ID NO: 121929 - DNA, 15 bp, Homo sapiens
ctgcccagagtgttg

SEQ ID NO: 121930 - DNA, 15 bp, Homo sapiens
gctgcccagagtgtt

SEQ ID NO: 121931 - DNA, 15 bp, Homo sapiens
ggctgcccagagtgt

SEQ ID NO: 121932 - DNA, 15 bp, Homo sapiens
tggctgcccagagtg

SEQ ID NO: 121933 - DNA, 15 bp, Homo sapiens
gtggctgcccagagt

SEQ ID NO: 121934 - DNA, 15 bp, Homo sapiens
tgtggctgcccagag

SEQ ID NO: 121935 - DNA, 15 bp, Homo sapiens
ttgtggctgcccaga

SEQ ID NO: 121936 - DNA, 15 bp, Homo sapiens
attgtggctgcccag

SEQ ID NO: 121937 - DNA, 15 bp, Homo sapiens
cattgtggctgccca

SEQ ID NO: 121938 - DNA, 15 bp, Homo sapiens
tcattgtggctgccc

SEQ ID NO: 121939 - DNA, 15 bp, Homo sapiens
ttcattgtggctgcc

SEQ ID NO: 121940 - DNA, 15 bp, Homo sapiens
attcattgtggctgc

SEQ ID NO: 121941 - DNA, 15 bp, Homo sapiens
aattcattgtggctg

SEQ ID NO: 121942 - DNA, 15 bp, Homo sapiens
caattcattgtggct

SEQ ID NO: 121943 - DNA, 15 bp, Homo sapiens
gcaattcattgtggc

SEQ ID NO: 121944 - DNA, 15 bp, Homo sapiens
tgcaattcattgtgg

SEQ ID NO: 121945 - DNA, 15 bp, Homo sapiens
ttgcaattcattgtg

SEQ ID NO: 121946 - DNA, 15 bp, Homo sapiens
attgcaattcattgt

SEQ ID NO: 121947 - DNA, 15 bp, Homo sapiens
tattgcaattcattg

SEQ ID NO: 121948 - DNA, 15 bp, Homo sapiens
gtattgcaattcatt

SEQ ID NO: 121949 - DNA, 15 bp, Homo sapiens
agtattgcaattcat

SEQ ID NO: 121950 - DNA, 15 bp, Homo sapiens
tagtattgcaattca

SEQ ID NO: 121951 - DNA, 15 bp, Homo sapiens
gtagtattgcaattc

SEQ ID NO: 121952 - DNA, 15 bp, Homo sapiens
cgtagtattgcaatt

SEQ ID NO: 121953 - DNA, 15 bp, Homo sapiens
acgtagtattgcaat

SEQ ID NO: 121954 - DNA, 15 bp, Homo sapiens
gacgtagtattgcaa

SEQ ID NO: 121955 - DNA, 15 bp, Homo sapiens
tgacgtagtattgca

SEQ ID NO: 121956 - DNA, 15 bp, Homo sapiens
gtgacgtagtattgc

SEQ ID NO: 121957 - DNA, 15 bp, Homo sapiens
tgtgacgtagtattg

SEQ ID NO: 121958 - DNA, 15 bp, Homo sapiens
atgtgacgtagtatt

SEQ ID NO: 121959 - DNA, 15 bp, Homo sapiens
gatgtgacgtagtat

SEQ ID NO: 121960 - DNA, 15 bp, Homo sapiens
ggatgtgacgtagta

SEQ ID NO: 121961 - DNA, 15 bp, Homo sapiens
gggatgtgacgtagt

SEQ ID NO: 121962 - DNA, 15 bp, Homo sapiens
agggatgtgacgtag

SEQ ID NO: 121963 - DNA, 15 bp, Homo sapiens
cagggatgtgacgta

SEQ ID NO: 121964 - DNA, 15 bp, Homo sapiens
ccagggatgtgacgt

SEQ ID NO: 121965 - DNA, 15 bp, Homo sapiens
gccagggatgtgacg

SEQ ID NO: 121966 - DNA, 15 bp, Homo sapiens
agccagggatgtgac

SEQ ID NO: 121967 - DNA, 15 bp, Homo sapiens
tagccagggatgtga

SEQ ID NO: 121968 - DNA, 15 bp, Homo sapiens
ctagccagggatgtg

SEQ ID NO: 121969 - DNA, 15 bp, Homo sapiens
tctagccagggatgt

SEQ ID NO: 121970 - DNA, 15 bp, Homo sapiens
ctctagccagggatg

SEQ ID NO: 121971 - DNA, 15 bp, Homo sapiens
actctagccagggat

SEQ ID NO: 121972 - DNA, 15 bp, Homo sapiens
aactctagccaggga

SEQ ID NO: 121973 - DNA, 15 bp, Homo sapiens
aaactctagccaggg

SEQ ID NO: 121974 - DNA, 15 bp, Homo sapiens
caaactctagccagg

SEQ ID NO: 121975 - DNA, 15 bp, Homo sapiens
ccaaactctagccag

SEQ ID NO: 121976 - DNA, 15 bp, Homo sapiens
tccaaactctagcca

SEQ ID NO: 121977 - DNA, 15 bp, Homo sapiens
ctccaaactctagcc

SEQ ID NO: 121978 - DNA, 15 bp, Homo sapiens
tctccaaactctagc

SEQ ID NO: 121979 - DNA, 15 bp, Homo sapiens
ttctccaaactctag

SEQ ID NO: 121980 - DNA, 15 bp, Homo sapiens
tttctccaaactcta

SEQ ID NO: 121981 - DNA, 15 bp, Homo sapiens
ttttctccaaactct

SEQ ID NO: 121982 - DNA, 15 bp, Homo sapiens
gttttctccaaactc

SEQ ID NO: 121983 - DNA, 15 bp, Homo sapiens
cgttttctccaaact

SEQ ID NO: 121984 - DNA, 15 bp, Homo sapiens
ccgttttctccaaac

SEQ ID NO: 121985 - DNA, 15 bp, Homo sapiens
cccgttttctccaaa

SEQ ID NO: 121986 - DNA, 15 bp, Homo sapiens
acccgttttctccaa

SEQ ID NO: 121987 - DNA, 15 bp, Homo sapiens
gacccgttttctcca

SEQ ID NO: 121988 - DNA, 15 bp, Homo sapiens
tgacccgttttctcc

SEQ ID NO: 121989 - DNA, 15 bp, Homo sapiens
atgacccgttttctc

SEQ ID NO: 121990 - DNA, 15 bp, Homo sapiens
aatgacccgttttct

SEQ ID NO: 121991 - DNA, 15 bp, Homo sapiens
gaatgacccgttttc

SEQ ID NO: 121992 - DNA, 15 bp, Homo sapiens
tgaatgacccgtttt

SEQ ID NO: 121993 - DNA, 15 bp, Homo sapiens
ctgaatgacccgttt

SEQ ID NO: 121994 - DNA, 15 bp, Homo sapiens
tctgaatgacccgtt

SEQ ID NO: 121995 - DNA, 15 bp, Homo sapiens
ctctgaatgacccgt

SEQ ID NO: 121996 - DNA, 15 bp, Homo sapiens
tctctgaatgacccg

SEQ ID NO: 121997 - DNA, 15 bp, Homo sapiens
ttctctgaatgaccc

SEQ ID NO: 121998 - DNA, 15 bp, Homo sapiens
cttctctgaatgacc

SEQ ID NO: 121999 - DNA, 15 bp, Homo sapiens
acttctctgaatgac

SEQ ID NO: 122000 - DNA, 15 bp, Homo sapiens
gacttctctgaatga

SEQ ID NO: 122001 - DNA, 15 bp, Homo sapiens
agacttctctgaatg

SEQ ID NO: 122002 - DNA, 15 bp, Homo sapiens
cagacttctctgaat

SEQ ID NO: 122003 - DNA, 15 bp, Homo sapiens
tcagacttctctgaa

SEQ ID NO: 122004 - DNA, 15 bp, Homo sapiens
ttcagacttctctga

SEQ ID NO: 122005 - DNA, 15 bp, Homo sapiens
attcagacttctctg

SEQ ID NO: 122006 - DNA, 15 bp, Homo sapiens
aattcagacttctct

SEQ ID NO: 122007 - DNA, 15 bp, Homo sapiens
caattcagacttctc

SEQ ID NO: 122008 - DNA, 15 bp, Homo sapiens
ccaattcagacttct

SEQ ID NO: 122009 - DNA, 15 bp, Homo sapiens
accaattcagacttc

SEQ ID NO: 122010 - DNA, 15 bp, Homo sapiens
taccaattcagactt

SEQ ID NO: 122011 - DNA, 15 bp, Homo sapiens
ttaccaattcagact

SEQ ID NO: 122012 - DNA, 15 bp, Homo sapiens
tttaccaattcagac

SEQ ID NO: 122013 - DNA, 15 bp, Homo sapiens
ttttaccaattcaga

SEQ ID NO: 122014 - DNA, 15 bp, Homo sapiens
attttaccaattcag

SEQ ID NO: 122015 - DNA, 15 bp, Homo sapiens
gattttaccaattca

SEQ ID NO: 122016 - DNA, 15 bp, Homo sapiens
tgattttaccaattc

SEQ ID NO: 122017 - DNA, 15 bp, Homo sapiens
atgattttaccaatt

SEQ ID NO: 122018 - DNA, 15 bp, Homo sapiens
aatgattttaccaat

SEQ ID NO: 122019 - DNA, 15 bp, Homo sapiens
caatgattttaccaa

SEQ ID NO: 122020 - DNA, 15 bp, Homo sapiens
gcaatgattttacca

SEQ ID NO: 122021 - DNA, 15 bp, Homo sapiens
ggcaatgattttacc

SEQ ID NO: 122022 - DNA, 15 bp, Homo sapiens
tggcaatgattttac

SEQ ID NO: 122023 - DNA, 15 bp, Homo sapiens
atggcaatgatttta

SEQ ID NO: 122024 - DNA, 15 bp, Homo sapiens
tatggcaatgatttt

SEQ ID NO: 122025 - DNA, 15 bp, Homo sapiens
atatggcaatgattt

SEQ ID NO: 122026 - DNA, 15 bp, Homo sapiens
tatatggcaatgatt

SEQ ID NO: 122027 - DNA, 15 bp, Homo sapiens
ttatatggcaatgat

SEQ ID NO: 122028 - DNA, 15 bp, Homo sapiens
tttatatggcaatga

SEQ ID NO: 122029 - DNA, 15 bp, Homo sapiens
atttatatggcaatg

SEQ ID NO: 122030 - DNA, 15 bp, Homo sapiens
catttatatggcaat

SEQ ID NO: 122031 - DNA, 15 bp, Homo sapiens
tcatttatatggcaa

SEQ ID NO: 122032 - DNA, 15 bp, Homo sapiens
ttcatttatatggca

SEQ ID NO: 122033 - DNA, 15 bp, Homo sapiens
attcatttatatggc

SEQ ID NO: 122034 - DNA, 15 bp, Homo sapiens
cattcatttatatgg

SEQ ID NO: 122035 - DNA, 15 bp, Homo sapiens
tcattcatttatatg

SEQ ID NO: 122036 - DNA, 15 bp, Homo sapiens
ttcattcatttatat

SEQ ID NO: 122037 - DNA, 15 bp, Homo sapiens
tttcattcatttata

SEQ ID NO: 122038 - DNA, 15 bp, Homo sapiens
gtttcattcatttat

SEQ ID NO: 122039 - DNA, 15 bp, Homo sapiens
tgtttcattcattta

SEQ ID NO: 122040 - DNA, 15 bp, Homo sapiens
ttgtttcattcattt

SEQ ID NO: 122041 - DNA, 15 bp, Homo sapiens
tttgtttcattcatt

SEQ ID NO: 122042 - DNA, 15 bp, Homo sapiens
ttttgtttcattcat

SEQ ID NO: 122043 - DNA, 15 bp, Homo sapiens
cttttgtttcattca

SEQ ID NO: 122044 - DNA, 15 bp, Homo sapiens
acttttgtttcattc

SEQ ID NO: 122045 - DNA, 15 bp, Homo sapiens
aacttttgtttcatt

SEQ ID NO: 122046 - DNA, 15 bp, Homo sapiens
taacttttgtttcat

SEQ ID NO: 122047 - DNA, 15 bp, Homo sapiens
ctaacttttgtttca

SEQ ID NO: 122048 - DNA, 15 bp, Homo sapiens
gctaacttttgtttc

SEQ ID NO: 122049 - DNA, 15 bp, Homo sapiens
agctaacttttgttt

SEQ ID NO: 122050 - DNA, 15 bp, Homo sapiens
cagctaacttttgtt

SEQ ID NO: 122051 - DNA, 15 bp, Homo sapiens
tcagctaacttttgt

SEQ ID NO: 122052 - DNA, 15 bp, Homo sapiens
ctcagctaacttttg

SEQ ID NO: 122053 - DNA, 15 bp, Homo sapiens
gctcagctaactttt

SEQ ID NO: 122054 - DNA, 15 bp, Homo sapiens
tctattcagctcagc

SEQ ID NO: 122055 - DNA, 15 bp, Homo sapiens
ttctattcagctcag

SEQ ID NO: 122056 - DNA, 15 bp, Homo sapiens
tttctattcagctca

SEQ ID NO: 122057 - DNA, 15 bp, Homo sapiens
ttttctattcagctc

SEQ ID NO: 122058 - DNA, 15 bp, Homo sapiens
cttttctattcagct

SEQ ID NO: 122059 - DNA, 15 bp, Homo sapiens
acttttctattcagc

SEQ ID NO: 122060 - DNA, 15 bp, Homo sapiens
gacttttctattcag

SEQ ID NO: 122061 - DNA, 15 bp, Homo sapiens
tgacttttctattca

SEQ ID NO: 122062 - DNA, 15 bp, Homo sapiens
ctgacttttctattc

SEQ ID NO: 122063 - DNA, 15 bp, Homo sapiens
actgacttttctatt

SEQ ID NO: 122064 - DNA, 15 bp, Homo sapiens
aactgacttttctat

SEQ ID NO: 122065 - DNA, 15 bp, Homo sapiens
taactgacttttcta

SEQ ID NO: 122066 - DNA, 15 bp, Homo sapiens
ttaactgacttttct

SEQ ID NO: 122067 - DNA, 15 bp, Homo sapiens
tttaactgacttttc

SEQ ID NO: 122068 - DNA, 15 bp, Homo sapiens
ttttaactgactttt

SEQ ID NO: 122069 - DNA, 15 bp, Homo sapiens
tttttaactgacttt

SEQ ID NO: 122070 - DNA, 15 bp, Homo sapiens
ttttttaactgactt

SEQ ID NO: 122071 - DNA, 15 bp, Homo sapiens
cttttttaactgact

SEQ ID NO: 122072 - DNA, 15 bp, Homo sapiens
acttttttaactgac

SEQ ID NO: 122073 - DNA, 15 bp, Homo sapiens
cacttttttaactga

SEQ ID NO: 122074 - DNA, 15 bp, Homo sapiens
acacttttttaactg

SEQ ID NO: 122075 - DNA, 15 bp, Homo sapiens
aacacttttttaact

SEQ ID NO: 122076 - DNA, 15 bp, Homo sapiens
taacacttttttaac

SEQ ID NO: 122077 - DNA, 15 bp, Homo sapiens
ctaacacttttttaa

SEQ ID NO: 122078 - DNA, 15 bp, Homo sapiens
actaacactttttta

SEQ ID NO: 122079 - DNA, 15 bp, Homo sapiens
aactaacactttttt

SEQ ID NO: 122080 - DNA, 15 bp, Homo sapiens
aaactaacacttttt

SEQ ID NO: 122081 - DNA, 15 bp, Homo sapiens
gaaactaacactttt

SEQ ID NO: 122082 - DNA, 15 bp, Homo sapiens
agaaactaacacttt

SEQ ID NO: 122083 - DNA, 15 bp, Homo sapiens
gagaaactaacactt

SEQ ID NO: 122084 - DNA, 15 bp, Homo sapiens
agagaaactaacact

SEQ ID NO: 122085 - DNA, 15 bp, Homo sapiens
gagagaaactaacac

SEQ ID NO: 122086 - DNA, 15 bp, Homo sapiens
agagagaaactaaca

SEQ ID NO: 122087 - DNA, 15 bp, Homo sapiens
aagagagaaactaac

SEQ ID NO: 122088 - DNA, 15 bp, Homo sapiens
caagagagaaactaa

SEQ ID NO: 122089 - DNA, 15 bp, Homo sapiens
tcaagagagaaacta

SEQ ID NO: 122090 - DNA, 15 bp, Homo sapiens
gtcaagagagaaact

SEQ ID NO: 122091 - DNA, 15 bp, Homo sapiens
tgtcaagagagaaac

SEQ ID NO: 122092 - DNA, 15 bp, Homo sapiens
gtgtcaagagagaaa

SEQ ID NO: 122093 - DNA, 15 bp, Homo sapiens
ggtgtcaagagagaa

SEQ ID NO: 122094 - DNA, 15 bp, Homo sapiens
gggtgtcaagagaga

SEQ ID NO: 122095 - DNA, 15 bp, Homo sapiens
ggggtgtcaagagag

SEQ ID NO: 122096 - DNA, 15 bp, Homo sapiens
tggggtgtcaagaga

SEQ ID NO: 122097 - DNA, 15 bp, Homo sapiens
atggggtgtcaagag

SEQ ID NO: 122098 - DNA, 15 bp, Homo sapiens
gatggggtgtcaaga

SEQ ID NO: 122099 - DNA, 15 bp, Homo sapiens
agatggggtgtcaag

SEQ ID NO: 122100 - DNA, 15 bp, Homo sapiens
gagatggggtgtcaa

SEQ ID NO: 122101 - DNA, 15 bp, Homo sapiens
agagatggggtgtca

SEQ ID NO: 122102 - DNA, 15 bp, Homo sapiens
gagagatggggtgtc

SEQ ID NO: 122103 - DNA, 15 bp, Homo sapiens
agagagatggggtgt

SEQ ID NO: 122104 - DNA, 15 bp, Homo sapiens
cagagagatggggtg

SEQ ID NO: 122105 - DNA, 15 bp, Homo sapiens
tcagagagatggggt

SEQ ID NO: 122106 - DNA, 15 bp, Homo sapiens
atcagagagatgggg

SEQ ID NO: 122107 - DNA, 15 bp, Homo sapiens
aatcagagagatggg

SEQ ID NO: 122108 - DNA, 15 bp, Homo sapiens
taatcagagagatgg

SEQ ID NO: 122109 - DNA, 15 bp, Homo sapiens
ttaatcagagagatg

SEQ ID NO: 122110 - DNA, 15 bp, Homo sapiens
attaatcagagagat

SEQ ID NO: 122111 - DNA, 15 bp, Homo sapiens
cattaatcagagaga

SEQ ID NO: 122112 - DNA, 15 bp, Homo sapiens
tcattaatcagagag

SEQ ID NO: 122113 - DNA, 15 bp, Homo sapiens
atcattaatcagaga

SEQ ID NO: 122114 - DNA, 15 bp, Homo sapiens
catcattaatcagag

SEQ ID NO: 122115 - DNA, 15 bp, Homo sapiens
ccatcattaatcaga

SEQ ID NO: 122116 - DNA, 15 bp, Homo sapiens
tccatcattaatcag

SEQ ID NO: 122117 - DNA, 15 bp, Homo sapiens
ttccatcattaatca

SEQ ID NO: 122118 - DNA, 15 bp, Homo sapiens
tttccatcattaatc

SEQ ID NO: 122119 - DNA, 15 bp, Homo sapiens
ctttccatcattaat

SEQ ID NO: 122120 - DNA, 15 bp, Homo sapiens
actttccatcattaa

SEQ ID NO: 122121 - DNA, 15 bp, Homo sapiens
gactttccatcatta

SEQ ID NO: 122122 - DNA, 15 bp, Homo sapiens
tgactttccatcatt

SEQ ID NO: 122123 - DNA, 15 bp, Homo sapiens
ttgactttccatcat

SEQ ID NO: 122124 - DNA, 15 bp, Homo sapiens
tttgactttccatca

SEQ ID NO: 122125 - DNA, 15 bp, Homo sapiens
atttgactttccatc

SEQ ID NO: 122126 - DNA, 15 bp, Homo sapiens
aatttgactttccat

SEQ ID NO: 122127 - DNA, 15 bp, Homo sapiens
taatttgactttcca

SEQ ID NO: 122128 - DNA, 15 bp, Homo sapiens
ttaatttgactttcc

SEQ ID NO: 122129 - DNA, 15 bp, Homo sapiens
tttaatttgactttc

SEQ ID NO: 122130 - DNA, 15 bp, Homo sapiens
ttttaatttgacttt

SEQ ID NO: 122131 - DNA, 15 bp, Homo sapiens
tttttaatttgactt

SEQ ID NO: 122132 - DNA, 15 bp, Homo sapiens
atttttaatttgact

SEQ ID NO: 122133 - DNA, 15 bp, Homo sapiens
gatttttaatttgac

SEQ ID NO: 122134 - DNA, 15 bp, Homo sapiens
agatttttaatttga

SEQ ID NO: 122135 - DNA, 15 bp, Homo sapiens
tagatttttaatttg

SEQ ID NO: 122136 - DNA, 15 bp, Homo sapiens
atagatttttaattt

SEQ ID NO: 122137 - DNA, 15 bp, Homo sapiens
aatagatttttaatt

SEQ ID NO: 122138 - DNA, 15 bp, Homo sapiens
aaatagatttttaat

SEQ ID NO: 122139 - DNA, 15 bp, Homo sapiens
aaaatagatttttaa

SEQ ID NO: 122140 - DNA, 15 bp, Homo sapiens
gaaaatagattttta

SEQ ID NO: 122141 - DNA, 15 bp, Homo sapiens
tgaaaatagattttt

SEQ ID NO: 122142 - DNA, 15 bp, Homo sapiens
ctgaaaatagatttt

SEQ ID NO: 122143 - DNA, 15 bp, Homo sapiens
tctgaaaatagattt

SEQ ID NO: 122144 - DNA, 15 bp, Homo sapiens
ctctgaaaatagatt

SEQ ID NO: 122145 - DNA, 15 bp, Homo sapiens
tctctgaaaatagat

SEQ ID NO: 122146 - DNA, 15 bp, Homo sapiens
ttctctgaaaataga

SEQ ID NO: 122147 - DNA, 15 bp, Homo sapiens
attctctgaaaatag

SEQ ID NO: 122148 - DNA, 15 bp, Homo sapiens
aattctctgaaaata

SEQ ID NO: 122149 - DNA, 15 bp, Homo sapiens
gaattctctgaaaat

SEQ ID NO: 122150 - DNA, 15 bp, Homo sapiens
agaattctctgaaaa

SEQ ID NO: 122151 - DNA, 15 bp, Homo sapiens
aagaattctctgaaa

SEQ ID NO: 122152 - DNA, 15 bp, Homo sapiens
aaagaattctctgaa

SEQ ID NO: 122153 - DNA, 15 bp, Homo sapiens
aaaagaattctctga

SEQ ID NO: 122154 - DNA, 15 bp, Homo sapiens
gaaaagaattctctg

SEQ ID NO: 122155 - DNA, 15 bp, Homo sapiens
ggaaaagaattctct

SEQ ID NO: 122156 - DNA, 15 bp, Homo sapiens
aggaaaagaattctc

SEQ ID NO: 122157 - DNA, 15 bp, Homo sapiens
aaggaaaagaattct

SEQ ID NO: 122158 - DNA, 15 bp, Homo sapiens
gaaggaaaagaattc

SEQ ID NO: 122159 - DNA, 15 bp, Homo sapiens
agaaggaaaagaatt

SEQ ID NO: 122160 - DNA, 15 bp, Homo sapiens
tagaaggaaaagaat

SEQ ID NO: 122161 - DNA, 15 bp, Homo sapiens
gtagaaggaaaagaa

SEQ ID NO: 122162 - DNA, 15 bp, Homo sapiens
tgtagaaggaaaaga

SEQ ID NO: 122163 - DNA, 15 bp, Homo sapiens
ctgtagaaggaaaag

SEQ ID NO: 122164 - DNA, 15 bp, Homo sapiens
actgtagaaggaaaa

SEQ ID NO: 122165 - DNA, 15 bp, Homo sapiens
aactgtagaaggaaa

SEQ ID NO: 122166 - DNA, 15 bp, Homo sapiens
caactgtagaaggaa

SEQ ID NO: 122167 - DNA, 15 bp, Homo sapiens
gcaactgtagaagga

SEQ ID NO: 122168 - DNA, 15 bp, Homo sapiens
agcaactgtagaagg

SEQ ID NO: 122169 - DNA, 15 bp, Homo sapiens
tagcaactgtagaag

SEQ ID NO: 122170 - DNA, 15 bp, Homo sapiens
ttagcaactgtagaa

SEQ ID NO: 122171 - DNA, 15 bp, Homo sapiens
attagcaactgtaga

SEQ ID NO: 122172 - DNA, 15 bp, Homo sapiens
aattagcaactgtag

SEQ ID NO: 122173 - DNA, 15 bp, Homo sapiens
caattagcaactgta

SEQ ID NO: 122174 - DNA, 15 bp, Homo sapiens
gcaattagcaactgt

SEQ ID NO: 122175 - DNA, 15 bp, Homo sapiens
agcaattagcaactg

SEQ ID NO: 122176 - DNA, 15 bp, Homo sapiens
gagcaattagcaact

SEQ ID NO: 122177 - DNA, 15 bp, Homo sapiens
tgagcaattagcaac

SEQ ID NO: 122178 - DNA, 15 bp, Homo sapiens
ctgagcaattagcaa

SEQ ID NO: 122179 - DNA, 15 bp, Homo sapiens
cctgagcaattagca

SEQ ID NO: 122180 - DNA, 15 bp, Homo sapiens
tcctgagcaattagc

SEQ ID NO: 122181 - DNA, 15 bp, Homo sapiens
ttcctgagcaattag

SEQ ID NO: 122182 - DNA, 15 bp, Homo sapiens
gttcctgagcaatta

SEQ ID NO: 122183 - DNA, 15 bp, Homo sapiens
ggttcctgagcaatt

SEQ ID NO: 122184 - DNA, 15 bp, Homo sapiens
tggttcctgagcaat

SEQ ID NO: 122185 - DNA, 15 bp, Homo sapiens
atggttcctgagcaa

SEQ ID NO: 122186 - DNA, 15 bp, Homo sapiens
aatggttcctgagca

SEQ ID NO: 122187 - DNA, 15 bp, Homo sapiens
taatggttcctgagc

SEQ ID NO: 122188 - DNA, 15 bp, Homo sapiens
ataatggttcctgag

SEQ ID NO: 122189 - DNA, 15 bp, Homo sapiens
tataatggttcctga

SEQ ID NO: 122190 - DNA, 15 bp, Homo sapiens
gtataatggttcctg

SEQ ID NO: 122191 - DNA, 15 bp, Homo sapiens
ggtataatggttcct

SEQ ID NO: 122192 - DNA, 15 bp, Homo sapiens
tggtataatggttcc

SEQ ID NO: 122193 - DNA, 15 bp, Homo sapiens
ttggtataatggttc

SEQ ID NO: 122194 - DNA, 15 bp, Homo sapiens
attggtataatggtt

SEQ ID NO: 122195 - DNA, 15 bp, Homo sapiens
cattggtataatggt

SEQ ID NO: 122196 - DNA, 15 bp, Homo sapiens
acattggtataatgg

SEQ ID NO: 122197 - DNA, 15 bp, Homo sapiens
aacattggtataatg

SEQ ID NO: 122198 - DNA, 15 bp, Homo sapiens
aaacattggtataat

SEQ ID NO: 122199 - DNA, 15 bp, Homo sapiens
caaacattggtataa

SEQ ID NO: 122200 - DNA, 15 bp, Homo sapiens
ccaaacattggtata

SEQ ID NO: 122201 - DNA, 15 bp, Homo sapiens
accaaacattggtat

SEQ ID NO: 122202 - DNA, 15 bp, Homo sapiens
gaccaaacattggta

SEQ ID NO: 122203 - DNA, 15 bp, Homo sapiens
tgaccaaacattggt

SEQ ID NO: 122204 - DNA, 15 bp, Homo sapiens
gtgaccaaacattgg

SEQ ID NO: 122205 - DNA, 15 bp, Homo sapiens
ggtgaccaaacattg

SEQ ID NO: 122206 - DNA, 15 bp, Homo sapiens
tggtgaccaaacatt

SEQ ID NO: 122207 - DNA, 15 bp, Homo sapiens
gtggtgaccaaacat

SEQ ID NO: 122208 - DNA, 15 bp, Homo sapiens
agtggtgaccaaaca

SEQ ID NO: 122209 - DNA, 15 bp, Homo sapiens
cagtggtgaccaaac

SEQ ID NO: 122210 - DNA, 15 bp, Homo sapiens
tcagtggtgaccaaa

SEQ ID NO: 122211 - DNA, 15 bp, Homo sapiens
ttcagtggtgaccaa

SEQ ID NO: 122212 - DNA, 15 bp, Homo sapiens
tttcagtggtgacca

SEQ ID NO: 122213 - DNA, 15 bp, Homo sapiens
gtttcagtggtgacc

SEQ ID NO: 122214 - DNA, 15 bp, Homo sapiens
tgtttcagtggtgac

SEQ ID NO: 122215 - DNA, 15 bp, Homo sapiens
atgtttcagtggtga

SEQ ID NO: 122216 - DNA, 15 bp, Homo sapiens
aatgtttcagtggtg

SEQ ID NO: 122217 - DNA, 15 bp, Homo sapiens
aaatgtttcagtggt

SEQ ID NO: 122218 - DNA, 15 bp, Homo sapiens
caaatgtttcagtgg

SEQ ID NO: 122219 - DNA, 15 bp, Homo sapiens
tcaaatgtttcagtg

SEQ ID NO: 122220 - DNA, 15 bp, Homo sapiens
ttcaaatgtttcagt

SEQ ID NO: 122221 - DNA, 15 bp, Homo sapiens
tttcaaatgtttcag

SEQ ID NO: 122222 - DNA, 15 bp, Homo sapiens
gtttcaaatgtttca

SEQ ID NO: 122223 - DNA, 15 bp, Homo sapiens
agtttcaaatgtttc

SEQ ID NO: 122224 - DNA, 15 bp, Homo sapiens
cagtttcaaatgttt

SEQ ID NO: 122225 - DNA, 15 bp, Homo sapiens
ccagtttcaaatgtt

SEQ ID NO: 122226 - DNA, 15 bp, Homo sapiens
accagtttcaaatgt

SEQ ID NO: 122227 - DNA, 15 bp, Homo sapiens
caccagtttcaaatg

SEQ ID NO: 122228 - DNA, 15 bp, Homo sapiens
acaccagtttcaaat

SEQ ID NO: 122229 - DNA, 15 bp, Homo sapiens
cacaccagtttcaaa

SEQ ID NO: 122230 - DNA, 15 bp, Homo sapiens
gcacaccagtttcaa

SEQ ID NO: 122231 - DNA, 15 bp, Homo sapiens
ggcacaccagtttca

SEQ ID NO: 122232 - DNA, 15 bp, Homo sapiens
aggcacaccagtttc

SEQ ID NO: 122233 - DNA, 15 bp, Homo sapiens
aaggcacaccagttt

SEQ ID NO: 122234 - DNA, 15 bp, Homo sapiens
aaaggcacaccagtt

SEQ ID NO: 122235 - DNA, 15 bp, Homo sapiens
gaaaggcacaccagt

SEQ ID NO: 122236 - DNA, 15 bp, Homo sapiens
agaaaggcacaccag

SEQ ID NO: 122237 - DNA, 15 bp, Homo sapiens
gagaaaggcacacca

SEQ ID NO: 122238 - DNA, 15 bp, Homo sapiens
agagaaaggcacacc

SEQ ID NO: 122239 - DNA, 15 bp, Homo sapiens
cagagaaaggcacac

SEQ ID NO: 122240 - DNA, 15 bp, Homo sapiens
tcagagaaaggcaca

SEQ ID NO: 122241 - DNA, 15 bp, Homo sapiens
gtcagagaaaggcac

SEQ ID NO: 122242 - DNA, 15 bp, Homo sapiens
agtcagagaaaggca

SEQ ID NO: 122243 - DNA, 15 bp, Homo sapiens
aagtcagagaaaggc

SEQ ID NO: 122244 - DNA, 15 bp, Homo sapiens
caagtcagagaaagg

SEQ ID NO: 122245 - DNA, 15 bp, Homo sapiens
ccaagtcagagaaag

SEQ ID NO: 122246 - DNA, 15 bp, Homo sapiens
tccaagtcagagaaa

SEQ ID NO: 122247 - DNA, 15 bp, Homo sapiens
ttccaagtcagagaa

SEQ ID NO: 122248 - DNA, 15 bp, Homo sapiens
tttccaagtcagaga

SEQ ID NO: 122249 - DNA, 15 bp, Homo sapiens
ttttccaagtcagag

SEQ ID NO: 122250 - DNA, 15 bp, Homo sapiens
tttttccaagtcaga

SEQ ID NO: 122251 - DNA, 15 bp, Homo sapiens
atttttccaagtcag

SEQ ID NO: 122252 - DNA, 15 bp, Homo sapiens
aatttttccaagtca

SEQ ID NO: 122253 - DNA, 15 bp, Homo sapiens
taatttttccaagtc

SEQ ID NO: 122254 - DNA, 15 bp, Homo sapiens
ctaatttttccaagt

SEQ ID NO: 122255 - DNA, 15 bp, Homo sapiens
tctaatttttccaag

SEQ ID NO: 122256 - DNA, 15 bp, Homo sapiens
ttctaatttttccaa

SEQ ID NO: 122257 - DNA, 15 bp, Homo sapiens
tttctaatttttcca

SEQ ID NO: 122258 - DNA, 15 bp, Homo sapiens
ttttctaatttttcc

SEQ ID NO: 122259 - DNA, 15 bp, Homo sapiens
attttctaatttttc

SEQ ID NO: 122260 - DNA, 15 bp, Homo sapiens
cattttctaattttt

SEQ ID NO: 122261 - DNA, 15 bp, Homo sapiens
tcattttctaatttt

SEQ ID NO: 122262 - DNA, 15 bp, Homo sapiens
gtcattttctaattt

SEQ ID NO: 122263 - DNA, 15 bp, Homo sapiens
tgtcattttctaatt

SEQ ID NO: 122264 - DNA, 15 bp, Homo sapiens
atgtcattttctaat

SEQ ID NO: 122265 - DNA, 15 bp, Homo sapiens
tatgtcattttctaa

SEQ ID NO: 122266 - DNA, 15 bp, Homo sapiens
ctatgtcattttcta

SEQ ID NO: 122267 - DNA, 15 bp, Homo sapiens
tctatgtcattttct

SEQ ID NO: 122268 - DNA, 15 bp, Homo sapiens
ttctatgtcattttc

SEQ ID NO: 122269 - DNA, 15 bp, Homo sapiens
tttctatgtcatttt

SEQ ID NO: 122270 - DNA, 15 bp, Homo sapiens
ttttctatgtcattt

SEQ ID NO: 122271 - DNA, 15 bp, Homo sapiens
attttctatgtcatt

SEQ ID NO: 122272 - DNA, 15 bp, Homo sapiens
tattttctatgtcat

SEQ ID NO: 122273 - DNA, 15 bp, Homo sapiens
atattttctatgtca

SEQ ID NO: 122274 - DNA, 15 bp, Homo sapiens
catattttctatgtc

SEQ ID NO: 122275 - DNA, 15 bp, Homo sapiens
acatattttctatgt

SEQ ID NO: 122276 - DNA, 15 bp, Homo sapiens
aacatattttctatg

SEQ ID NO: 122277 - DNA, 15 bp, Homo sapiens
taacatattttctat

SEQ ID NO: 122278 - DNA, 15 bp, Homo sapiens
ttaacatattttcta

SEQ ID NO: 122279 - DNA, 15 bp, Homo sapiens
tttaacatattttct

SEQ ID NO: 122280 - DNA, 15 bp, Homo sapiens
ttttaacatattttc

SEQ ID NO: 122281 - DNA, 15 bp, Homo sapiens
attttaacatatttt

SEQ ID NO: 122282 - DNA, 15 bp, Homo sapiens
aattttaacatattt

SEQ ID NO: 122283 - DNA, 15 bp, Homo sapiens
aaattttaacatatt

SEQ ID NO: 122284 - DNA, 15 bp, Homo sapiens
caaattttaacatat

SEQ ID NO: 122285 - DNA, 15 bp, Homo sapiens
acaaattttaacata

SEQ ID NO: 122286 - DNA, 15 bp, Homo sapiens
cacaaattttaacat

SEQ ID NO: 122287 - DNA, 15 bp, Homo sapiens
ccacaaattttaaca

SEQ ID NO: 122288 - DNA, 15 bp, Homo sapiens
tccacaaattttaac

SEQ ID NO: 122289 - DNA, 15 bp, Homo sapiens
ttccacaaattttaa

SEQ ID NO: 122290 - DNA, 15 bp, Homo sapiens
tttccacaaatttta

SEQ ID NO: 122291 - DNA, 15 bp, Homo sapiens
ttttccacaaatttt

SEQ ID NO: 122292 - DNA, 15 bp, Homo sapiens
tttttccacaaattt

SEQ ID NO: 122293 - DNA, 15 bp, Homo sapiens
gtttttccacaaatt

SEQ ID NO: 122294 - DNA, 15 bp, Homo sapiens
tgtttttccacaaat

SEQ ID NO: 122295 - DNA, 15 bp, Homo sapiens
gtgtttttccacaaa

SEQ ID NO: 122296 - DNA, 15 bp, Homo sapiens
agtgtttttccacaa

SEQ ID NO: 122297 - DNA, 15 bp, Homo sapiens
aagtgtttttccaca

SEQ ID NO: 122298 - DNA, 15 bp, Homo sapiens
caagtgtttttccac

SEQ ID NO: 122299 - DNA, 15 bp, Homo sapiens
ccaagtgtttttcca

SEQ ID NO: 122300 - DNA, 15 bp, Homo sapiens
tccaagtgtttttcc

SEQ ID NO: 122301 - DNA, 15 bp, Homo sapiens
ttccaagtgtttttc

SEQ ID NO: 122302 - DNA, 15 bp, Homo sapiens
attccaagtgttttt

SEQ ID NO: 122303 - DNA, 15 bp, Homo sapiens
gattccaagtgtttt

SEQ ID NO: 122304 - DNA, 15 bp, Homo sapiens
ggattccaagtgttt

SEQ ID NO: 122305 - DNA, 15 bp, Homo sapiens
tggattccaagtgtt

SEQ ID NO: 122306 - DNA, 15 bp, Homo sapiens
ctggattccaagtgt

SEQ ID NO: 122307 - DNA, 15 bp, Homo sapiens
actggattccaagtg

SEQ ID NO: 122308 - DNA, 15 bp, Homo sapiens
cactggattccaagt

SEQ ID NO: 122309 - DNA, 15 bp, Homo sapiens
tcactggattccaag

SEQ ID NO: 122310 - DNA, 15 bp, Homo sapiens
atcactggattccaa

SEQ ID NO: 122311 - DNA, 15 bp, Homo sapiens
catcactggattcca

SEQ ID NO: 122312 - DNA, 15 bp, Homo sapiens
tcatcactggattcc

SEQ ID NO: 122313 - DNA, 15 bp, Homo sapiens
ttcatcactggattc

SEQ ID NO: 122314 - DNA, 15 bp, Homo sapiens
cttcatcactggatt

SEQ ID NO: 122315 - DNA, 15 bp, Homo sapiens
tcttcatcactggat

SEQ ID NO: 122316 - DNA, 15 bp, Homo sapiens
atcttcatcactgga

SEQ ID NO: 122317 - DNA, 15 bp, Homo sapiens
catcttcatcactgg

SEQ ID NO: 122318 - DNA, 15 bp, Homo sapiens
tcatcttcatcactg

SEQ ID NO: 122319 - DNA, 15 bp, Homo sapiens
ttcatcttcatcact

SEQ ID NO: 122320 - DNA, 15 bp, Homo sapiens
tttcatcttcatcac

SEQ ID NO: 122321 - DNA, 15 bp, Homo sapiens
ttttcatcttcatca

SEQ ID NO: 122322 - DNA, 15 bp, Homo sapiens
cttttcatcttcatc

SEQ ID NO: 122323 - DNA, 15 bp, Homo sapiens
ccttttcatcttcat

SEQ ID NO: 122324 - DNA, 15 bp, Homo sapiens
accttttcatcttca

SEQ ID NO: 122325 - DNA, 15 bp, Homo sapiens
aaccttttcatcttc

SEQ ID NO: 122326 - DNA, 15 bp, Homo sapiens
caaccttttcatctt

SEQ ID NO: 122327 - DNA, 15 bp, Homo sapiens
ccaaccttttcatct

SEQ ID NO: 122328 - DNA, 15 bp, Homo sapiens
accaaccttttcatc

SEQ ID NO: 122329 - DNA, 15 bp, Homo sapiens
aaccaaccttttcat

SEQ ID NO: 122330 - DNA, 15 bp, Homo sapiens
gaaccaaccttttca

SEQ ID NO: 122331 - DNA, 15 bp, Homo sapiens
tgaaccaaccttttc

SEQ ID NO: 122332 - DNA, 15 bp, Homo sapiens
ttgaaccaacctttt

SEQ ID NO: 122333 - DNA, 15 bp, Homo sapiens
cttgaaccaaccttt

SEQ ID NO: 122334 - DNA, 15 bp, Homo sapiens
ccttgaaccaacctt

SEQ ID NO: 122335 - DNA, 15 bp, Homo sapiens
tccttgaaccaacct

SEQ ID NO: 122336 - DNA, 15 bp, Homo sapiens
ctccttgaaccaacc

SEQ ID NO: 122337 - DNA, 15 bp, Homo sapiens
tctccttgaaccaac

SEQ ID NO: 122338 - DNA, 15 bp, Homo sapiens
atctccttgaaccaa

SEQ ID NO: 122339 - DNA, 15 bp, Homo sapiens
aatctccttgaacca

SEQ ID NO: 122340 - DNA, 15 bp, Homo sapiens
aaatctccttgaacc

SEQ ID NO: 122341 - DNA, 15 bp, Homo sapiens
gaaatctccttgaac

SEQ ID NO: 122342 - DNA, 15 bp, Homo sapiens
tgaaatctccttgaa

SEQ ID NO: 122343 - DNA, 15 bp, Homo sapiens
ttgaaatctccttga

SEQ ID NO: 122344 - DNA, 15 bp, Homo sapiens
tttgaaatctccttg

SEQ ID NO: 122345 - DNA, 15 bp, Homo sapiens
ttttgaaatctcctt

SEQ ID NO: 122346 - DNA, 15 bp, Homo sapiens
gttttgaaatctcct

SEQ ID NO: 122347 - DNA, 15 bp, Homo sapiens
ggttttgaaatctcc

SEQ ID NO: 122348 - DNA, 15 bp, Homo sapiens
tggttttgaaatctc

SEQ ID NO: 122349 - DNA, 15 bp, Homo sapiens
atggttttgaaatct

SEQ ID NO: 122350 - DNA, 15 bp, Homo sapiens
catggttttgaaatc

SEQ ID NO: 122351 - DNA, 15 bp, Homo sapiens
ccatggttttgaaat

SEQ ID NO: 122352 - DNA, 15 bp, Homo sapiens
accatggttttgaaa

SEQ ID NO: 122353 - DNA, 15 bp, Homo sapiens
caccatggttttgaa

SEQ ID NO: 122354 - DNA, 15 bp, Homo sapiens
ccaccatggttttga

SEQ ID NO: 122355 - DNA, 15 bp, Homo sapiens
accaccatggttttg

SEQ ID NO: 122356 - DNA, 15 bp, Homo sapiens
gaccaccatggtttt

SEQ ID NO: 122357 - DNA, 15 bp, Homo sapiens
agaccaccatggttt

SEQ ID NO: 122358 - DNA, 15 bp, Homo sapiens
gagaccaccatggtt

SEQ ID NO: 122359 - DNA, 15 bp, Homo sapiens
tgagaccaccatggt

SEQ ID NO: 122360 - DNA, 15 bp, Homo sapiens
atgagaccaccatgg

SEQ ID NO: 122361 - DNA, 15 bp, Homo sapiens
aatgagaccaccatg

SEQ ID NO: 122362 - DNA, 15 bp, Homo sapiens
aaatgagaccaccat

SEQ ID NO: 122363 - DNA, 15 bp, Homo sapiens
aaaatgagaccacca

SEQ ID NO: 122364 - DNA, 15 bp, Homo sapiens
aaaaatgagaccacc

SEQ ID NO: 122365 - DNA, 15 bp, Homo sapiens
gaaaaatgagaccac

SEQ ID NO: 122366 - DNA, 15 bp, Homo sapiens
agaaaaatgagacca

SEQ ID NO: 122367 - DNA, 15 bp, Homo sapiens
aagaaaaatgagacc

SEQ ID NO: 122368 - DNA, 15 bp, Homo sapiens
gaagaaaaatgagac

SEQ ID NO: 122369 - DNA, 15 bp, Homo sapiens
agaagaaaaatgaga

SEQ ID NO: 122370 - DNA, 15 bp, Homo sapiens
gagaagaaaaatgag

SEQ ID NO: 122371 - DNA, 15 bp, Homo sapiens
agagaagaaaaatga

SEQ ID NO: 122372 - DNA, 15 bp, Homo sapiens
tagagaagaaaaatg

SEQ ID NO: 122373 - DNA, 15 bp, Homo sapiens
atagagaagaaaaat

SEQ ID NO: 122374 - DNA, 15 bp, Homo sapiens
aatagagaagaaaaa

SEQ ID NO: 122375 - DNA, 15 bp, Homo sapiens
taatagagaagaaaa

SEQ ID NO: 122376 - DNA, 15 bp, Homo sapiens
ttaatagagaagaaa

SEQ ID NO: 122377 - DNA, 15 bp, Homo sapiens
attaatagagaagaa

SEQ ID NO: 122378 - DNA, 15 bp, Homo sapiens
aattaatagagaaga

SEQ ID NO: 122379 - DNA, 15 bp, Homo sapiens
aaattaatagagaag

SEQ ID NO: 122380 - DNA, 15 bp, Homo sapiens
gaaattaatagagaa

SEQ ID NO: 122381 - DNA, 15 bp, Homo sapiens
tgaaattaatagaga

SEQ ID NO: 122382 - DNA, 15 bp, Homo sapiens
atgaaattaatagag

SEQ ID NO: 122383 - DNA, 15 bp, Homo sapiens
aatgaaattaataga

SEQ ID NO: 122384 - DNA, 15 bp, Homo sapiens
aaatgaaattaatag

SEQ ID NO: 122385 - DNA, 15 bp, Homo sapiens
aaaatgaaattaata

SEQ ID NO: 122386 - DNA, 15 bp, Homo sapiens
aaaaatgaaattaat

SEQ ID NO: 122387 - DNA, 15 bp, Homo sapiens
taaaaatgaaattaa

SEQ ID NO: 122388 - DNA, 15 bp, Homo sapiens
gtaaaaatgaaatta

SEQ ID NO: 122389 - DNA, 15 bp, Homo sapiens
tgtaaaaatgaaatt

SEQ ID NO: 122390 - DNA, 15 bp, Homo sapiens
atgtaaaaatgaaat

SEQ ID NO: 122391 - DNA, 15 bp, Homo sapiens
gatgtaaaaatgaaa

SEQ ID NO: 122392 - DNA, 15 bp, Homo sapiens
tgatgtaaaaatgaa

SEQ ID NO: 122393 - DNA, 15 bp, Homo sapiens
ttgatgtaaaaatga

SEQ ID NO: 122394 - DNA, 15 bp, Homo sapiens
cttgatgtaaaaatg

SEQ ID NO: 122395 - DNA, 15 bp, Homo sapiens
tcttgatgtaaaaat

SEQ ID NO: 122396 - DNA, 15 bp, Homo sapiens
atcttgatgtaaaaa

SEQ ID NO: 122397 - DNA, 15 bp, Homo sapiens
catcttgatgtaaaa

SEQ ID NO: 122398 - DNA, 15 bp, Homo sapiens
acatcttgatgtaaa

SEQ ID NO: 122399 - DNA, 15 bp, Homo sapiens
aacatcttgatgtaa

SEQ ID NO: 122400 - DNA, 15 bp, Homo sapiens
aaacatcttgatgta

SEQ ID NO: 122401 - DNA, 15 bp, Homo sapiens
caaacatcttgatgt

SEQ ID NO: 122402 - DNA, 15 bp, Homo sapiens
gcaaacatcttgatg

SEQ ID NO: 122403 - DNA, 15 bp, Homo sapiens
ggcaaacatcttgat

SEQ ID NO: 122404 - DNA, 15 bp, Homo sapiens
gggcaaacatcttga

SEQ ID NO: 122405 - DNA, 15 bp, Homo sapiens
tgggcaaacatcttg

SEQ ID NO: 122406 - DNA, 15 bp, Homo sapiens
atgggcaaacatctt

SEQ ID NO: 122407 - DNA, 15 bp, Homo sapiens
tatgggcaaacatct

SEQ ID NO: 122408 - DNA, 15 bp, Homo sapiens
atatgggcaaacatc

SEQ ID NO: 122409 - DNA, 15 bp, Homo sapiens
tatatgggcaaacat

SEQ ID NO: 122410 - DNA, 15 bp, Homo sapiens
ttatatgggcaaaca

SEQ ID NO: 122411 - DNA, 15 bp, Homo sapiens
attatatgggcaaac

SEQ ID NO: 122412 - DNA, 15 bp, Homo sapiens
gattatatgggcaaa

SEQ ID NO: 122413 - DNA, 15 bp, Homo sapiens
agattatatgggcaa

SEQ ID NO: 122414 - DNA, 15 bp, Homo sapiens
cagattatatgggca

SEQ ID NO: 122415 - DNA, 15 bp, Homo sapiens
acagattatatgggc

SEQ ID NO: 122416 - DNA, 15 bp, Homo sapiens
gacagattatatggg

SEQ ID NO: 122417 - DNA, 15 bp, Homo sapiens
tgacagattatatgg

SEQ ID NO: 122418 - DNA, 15 bp, Homo sapiens
ttgacagattatatg

SEQ ID NO: 122419 - DNA, 15 bp, Homo sapiens
tttgacagattatat

SEQ ID NO: 122420 - DNA, 15 bp, Homo sapiens
gtttgacagattata

SEQ ID NO: 122421 - DNA, 15 bp, Homo sapiens
tgtttgacagattat

SEQ ID NO: 122422 - DNA, 15 bp, Homo sapiens
atgtttgacagatta

SEQ ID NO: 122423 - DNA, 15 bp, Homo sapiens
catgtttgacagatt

SEQ ID NO: 122424 - DNA, 15 bp, Homo sapiens
tcatgtttgacagat

SEQ ID NO: 122425 - DNA, 15 bp, Homo sapiens
atcatgtttgacaga

SEQ ID NO: 122426 - DNA, 15 bp, Homo sapiens
catcatgtttgacag

SEQ ID NO: 122427 - DNA, 15 bp, Homo sapiens
tcatcatgtttgaca

SEQ ID NO: 122428 - DNA, 15 bp, Homo sapiens
ttcatcatgtttgac

SEQ ID NO: 122429 - DNA, 15 bp, Homo sapiens
tttcatcatgtttga

SEQ ID NO: 122430 - DNA, 15 bp, Homo sapiens
gtttcatcatgtttg

SEQ ID NO: 122431 - DNA, 15 bp, Homo sapiens
tgtttcatcatgttt

SEQ ID NO: 122432 - DNA, 15 bp, Homo sapiens
ctgtttcatcatgtt

SEQ ID NO: 122433 - DNA, 15 bp, Homo sapiens
tctgtttcatcatgt

SEQ ID NO: 122434 - DNA, 15 bp, Homo sapiens
atctgtttcatcatg

SEQ ID NO: 122435 - DNA, 15 bp, Homo sapiens
aatctgtttcatcat

SEQ ID NO: 122436 - DNA, 15 bp, Homo sapiens
gaatctgtttcatca

SEQ ID NO: 122437 - DNA, 15 bp, Homo sapiens
tgaatctgtttcatc

SEQ ID NO: 122438 - DNA, 15 bp, Homo sapiens
ttgaatctgtttcat

SEQ ID NO: 122439 - DNA, 15 bp, Homo sapiens
tttgaatctgtttca

SEQ ID NO: 122440 - DNA, 15 bp, Homo sapiens
atttgaatctgtttc

SEQ ID NO: 122441 - DNA, 15 bp, Homo sapiens
catttgaatctgttt

SEQ ID NO: 122442 - DNA, 15 bp, Homo sapiens
acatttgaatctgtt

SEQ ID NO: 122443 - DNA, 15 bp, Homo sapiens
cacatttgaatctgt

SEQ ID NO: 122444 - DNA, 15 bp, Homo sapiens
tcacatttgaatctg

SEQ ID NO: 122445 - DNA, 15 bp, Homo sapiens
atcacatttgaatct

SEQ ID NO: 122446 - DNA, 15 bp, Homo sapiens
aatcacatttgaatc

SEQ ID NO: 122447 - DNA, 15 bp, Homo sapiens
aaatcacatttgaat

SEQ ID NO: 122448 - DNA, 15 bp, Homo sapiens
aaaatcacatttgaa

SEQ ID NO: 122449 - DNA, 15 bp, Homo sapiens
aaaaatcacatttga

SEQ ID NO: 122450 - DNA, 15 bp, Homo sapiens
aaaaaatcacatttg

SEQ ID NO: 122451 - DNA, 15 bp, Homo sapiens
caaaaaatcacattt

SEQ ID NO: 122452 - DNA, 15 bp, Homo sapiens
tcaaaaaatcacatt

SEQ ID NO: 122453 - DNA, 15 bp, Homo sapiens
atcaaaaaatcacat

SEQ ID NO: 122454 - DNA, 15 bp, Homo sapiens
catcaaaaaatcaca

SEQ ID NO: 122455 - DNA, 15 bp, Homo sapiens
acatcaaaaaatcac

SEQ ID NO: 122456 - DNA, 15 bp, Homo sapiens
cacatcaaaaaatca

SEQ ID NO: 122457 - DNA, 15 bp, Homo sapiens
acacatcaaaaaatc

SEQ ID NO: 122458 - DNA, 15 bp, Homo sapiens
cacacatcaaaaaat

SEQ ID NO: 122459 - DNA, 15 bp, Homo sapiens
acacacatcaaaaaa

SEQ ID NO: 122460 - DNA, 15 bp, Homo sapiens
gacacacatcaaaaa

SEQ ID NO: 122461 - DNA, 15 bp, Homo sapiens
tgacacacatcaaaa

SEQ ID NO: 122462 - DNA, 15 bp, Homo sapiens
ttgacacacatcaaa

SEQ ID NO: 122463 - DNA, 15 bp, Homo sapiens
attgacacacatcaa

SEQ ID NO: 122464 - DNA, 15 bp, Homo sapiens
cattgacacacatca

SEQ ID NO: 122465 - DNA, 15 bp, Homo sapiens
acattgacacacatc

SEQ ID NO: 122466 - DNA, 15 bp, Homo sapiens
tacattgacacacat

SEQ ID NO: 122467 - DNA, 15 bp, Homo sapiens
ttacattgacacaca

SEQ ID NO: 122468 - DNA, 15 bp, Homo sapiens
cttacattgacacac

SEQ ID NO: 122469 - DNA, 15 bp, Homo sapiens
tcttacattgacaca

SEQ ID NO: 122470 - DNA, 15 bp, Homo sapiens
ctcttacattgacac

SEQ ID NO: 122471 - DNA, 15 bp, Homo sapiens
actcttacattgaca

SEQ ID NO: 122472 - DNA, 15 bp, Homo sapiens
gactcttacattgac

SEQ ID NO: 122473 - DNA, 15 bp, Homo sapiens
tgactcttacattga

SEQ ID NO: 122474 - DNA, 15 bp, Homo sapiens
gtgactcttacattg

SEQ ID NO: 122475 - DNA, 15 bp, Homo sapiens
tgtgactcttacatt

SEQ ID NO: 122476 - DNA, 15 bp, Homo sapiens
atgtgactcttacat

SEQ ID NO: 122477 - DNA, 15 bp, Homo sapiens
catgtgactcttaca

SEQ ID NO: 122478 - DNA, 15 bp, Homo sapiens
tcatgtgactcttac

SEQ ID NO: 122479 - DNA, 15 bp, Homo sapiens
atcatgtgactctta

SEQ ID NO: 122480 - DNA, 15 bp, Homo sapiens
aatcatgtgactctt

SEQ ID NO: 122481 - DNA, 15 bp, Homo sapiens
gaatcatgtgactct

SEQ ID NO: 122482 - DNA, 15 bp, Homo sapiens
tgaatcatgtgactc

SEQ ID NO: 122483 - DNA, 15 bp, Homo sapiens
atgaatcatgtgact

SEQ ID NO: 122484 - DNA, 15 bp, Homo sapiens
catgaatcatgtgac

SEQ ID NO: 122485 - DNA, 15 bp, Homo sapiens
acatgaatcatgtga

SEQ ID NO: 122486 - DNA, 15 bp, Homo sapiens
cacatgaatcatgtg

SEQ ID NO: 122487 - DNA, 15 bp, Homo sapiens
gcacatgaatcatgt

SEQ ID NO: 122488 - DNA, 15 bp, Homo sapiens
agcacatgaatcatg

SEQ ID NO: 122489 - DNA, 15 bp, Homo sapiens
aagcacatgaatcat

SEQ ID NO: 122490 - DNA, 15 bp, Homo sapiens
taagcacatgaatca

SEQ ID NO: 122491 - DNA, 15 bp, Homo sapiens
ttaagcacatgaatc

SEQ ID NO: 122492 - DNA, 15 bp, Homo sapiens
tttaagcacatgaat

SEQ ID NO: 122493 - DNA, 15 bp, Homo sapiens
ttttaagcacatgaa

SEQ ID NO: 122494 - DNA, 15 bp, Homo sapiens
tttttaagcacatga

SEQ ID NO: 122495 - DNA, 15 bp, Homo sapiens
ctttttaagcacatg

SEQ ID NO: 122496 - DNA, 15 bp, Homo sapiens
tctttttaagcacat

SEQ ID NO: 122497 - DNA, 15 bp, Homo sapiens
ttctttttaagcaca

SEQ ID NO: 122498 - DNA, 15 bp, Homo sapiens
tttctttttaagcac

SEQ ID NO: 122499 - DNA, 15 bp, Homo sapiens
ttttctttttaagca

SEQ ID NO: 122500 - DNA, 15 bp, Homo sapiens
attttctttttaagc

SEQ ID NO: 122501 - DNA, 15 bp, Homo sapiens
tattttctttttaag

SEQ ID NO: 122502 - DNA, 15 bp, Homo sapiens
ctattttctttttaa

SEQ ID NO: 122503 - DNA, 15 bp, Homo sapiens
tctattttcttttta

SEQ ID NO: 122504 - DNA, 15 bp, Homo sapiens
gtctattttcttttt

SEQ ID NO: 122505 - DNA, 15 bp, Homo sapiens
agtctattttctttt

SEQ ID NO: 122506 - DNA, 15 bp, Homo sapiens
gagtctattttcttt

SEQ ID NO: 122507 - DNA, 15 bp, Homo sapiens
tgagtctattttctt

SEQ ID NO: 122508 - DNA, 15 bp, Homo sapiens
ctgagtctattttct

SEQ ID NO: 122509 - DNA, 15 bp, Homo sapiens
actgagtctattttc

SEQ ID NO: 122510 - DNA, 15 bp, Homo sapiens
aactgagtctatttt

SEQ ID NO: 122511 - DNA, 15 bp, Homo sapiens
aaactgagtctattt

SEQ ID NO: 122512 - DNA, 15 bp, Homo sapiens
gaaactgagtctatt

SEQ ID NO: 122513 - DNA, 15 bp, Homo sapiens
agaaactgagtctat

SEQ ID NO: 122514 - DNA, 15 bp, Homo sapiens
cagaaactgagtcta

SEQ ID NO: 122515 - DNA, 15 bp, Homo sapiens
tcagaaactgagtct

SEQ ID NO: 122516 - DNA, 15 bp, Homo sapiens
ttcagaaactgagtc

SEQ ID NO: 122517 - DNA, 15 bp, Homo sapiens
gttcagaaactgagt

SEQ ID NO: 122518 - DNA, 15 bp, Homo sapiens
agttcagaaactgag

SEQ ID NO: 122519 - DNA, 15 bp, Homo sapiens
tagttcagaaactga

SEQ ID NO: 122520 - DNA, 15 bp, Homo sapiens
ctagttcagaaactg

SEQ ID NO: 122521 - DNA, 15 bp, Homo sapiens
tctagttcagaaact

SEQ ID NO: 122522 - DNA, 15 bp, Homo sapiens
gtctagttcagaaac

SEQ ID NO: 122523 - DNA, 15 bp, Homo sapiens
tgtctagttcagaaa

SEQ ID NO: 122524 - DNA, 15 bp, Homo sapiens
atgtctagttcagaa

SEQ ID NO: 122525 - DNA, 15 bp, Homo sapiens
tatgtctagttcaga

SEQ ID NO: 122526 - DNA, 15 bp, Homo sapiens
ttatgtctagttcag

SEQ ID NO: 122527 - DNA, 15 bp, Homo sapiens
attatgtctagttca

SEQ ID NO: 122528 - DNA, 15 bp, Homo sapiens
gattatgtctagttc

SEQ ID NO: 122529 - DNA, 15 bp, Homo sapiens
ggattatgtctagtt

SEQ ID NO: 122530 - DNA, 15 bp, Homo sapiens
aggattatgtctagt

SEQ ID NO: 122531 - DNA, 15 bp, Homo sapiens
aaggattatgtctag

SEQ ID NO: 122532 - DNA, 15 bp, Homo sapiens
taaggattatgtcta

SEQ ID NO: 122533 - DNA, 15 bp, Homo sapiens
ctaaggattatgtct

SEQ ID NO: 122534 - DNA, 15 bp, Homo sapiens
actaaggattatgtc

SEQ ID NO: 122535 - DNA, 15 bp, Homo sapiens
tactaaggattatgt

SEQ ID NO: 122536 - DNA, 15 bp, Homo sapiens
atactaaggattatg

SEQ ID NO: 122537 - DNA, 15 bp, Homo sapiens
aatactaaggattat

SEQ ID NO: 122538 - DNA, 15 bp, Homo sapiens
taatactaaggatta

SEQ ID NO: 122539 - DNA, 15 bp, Homo sapiens
ataatactaaggatt

SEQ ID NO: 122540 - DNA, 15 bp, Homo sapiens
gataatactaaggat

SEQ ID NO: 122541 - DNA, 15 bp, Homo sapiens
agataatactaagga

SEQ ID NO: 122542 - DNA, 15 bp, Homo sapiens
tagataatactaagg

SEQ ID NO: 122543 - DNA, 15 bp, Homo sapiens
ttagataatactaag

SEQ ID NO: 122544 - DNA, 15 bp, Homo sapiens
attagataatactaa

SEQ ID NO: 122545 - DNA, 15 bp, Homo sapiens
cattagataatacta

SEQ ID NO: 122546 - DNA, 15 bp, Homo sapiens
acattagataatact

SEQ ID NO: 122547 - DNA, 15 bp, Homo sapiens
aacattagataatac

SEQ ID NO: 122548 - DNA, 15 bp, Homo sapiens
aaacattagataata

SEQ ID NO: 122549 - DNA, 15 bp, Homo sapiens
caaacattagataat

SEQ ID NO: 122550 - DNA, 15 bp, Homo sapiens
gcaaacattagataa

SEQ ID NO: 122551 - DNA, 15 bp, Homo sapiens
agcaaacattagata

SEQ ID NO: 122552 - DNA, 15 bp, Homo sapiens
tagcaaacattagat

SEQ ID NO: 122553 - DNA, 15 bp, Homo sapiens
ttagcaaacattaga

SEQ ID NO: 122554 - DNA, 15 bp, Homo sapiens
tttagcaaacattag

SEQ ID NO: 122555 - DNA, 15 bp, Homo sapiens
gtttagcaaacatta

SEQ ID NO: 122556 - DNA, 15 bp, Homo sapiens
agtttagcaaacatt

SEQ ID NO: 122557 - DNA, 15 bp, Homo sapiens
gagtttagcaaacat

SEQ ID NO: 122558 - DNA, 15 bp, Homo sapiens
agagtttagcaaaca

SEQ ID NO: 122559 - DNA, 15 bp, Homo sapiens
gagagtttagcaaac

SEQ ID NO: 122560 - DNA, 15 bp, Homo sapiens
agagagtttagcaaa

SEQ ID NO: 122561 - DNA, 15 bp, Homo sapiens
aagagagtttagcaa

SEQ ID NO: 122562 - DNA, 15 bp, Homo sapiens
aaagagagtttagca

SEQ ID NO: 122563 - DNA, 15 bp, Homo sapiens
caaagagagtttagc

SEQ ID NO: 122564 - DNA, 15 bp, Homo sapiens
tcaaagagagtttag

SEQ ID NO: 122565 - DNA, 15 bp, Homo sapiens
ctcaaagagagttta

SEQ ID NO: 122566 - DNA, 15 bp, Homo sapiens
tctcaaagagagttt

SEQ ID NO: 122567 - DNA, 15 bp, Homo sapiens
gtctcaaagagagtt

SEQ ID NO: 122568 - DNA, 15 bp, Homo sapiens
tgtctcaaagagagt

SEQ ID NO: 122569 - DNA, 15 bp, Homo sapiens
atgtctcaaagagag

SEQ ID NO: 122570 - DNA, 15 bp, Homo sapiens
aatgtctcaaagaga

SEQ ID NO: 122571 - DNA, 15 bp, Homo sapiens
aaatgtctcaaagag

SEQ ID NO: 122572 - DNA, 15 bp, Homo sapiens
aaaatgtctcaaaga

SEQ ID NO: 122573 - DNA, 15 bp, Homo sapiens
taaaatgtctcaaag

SEQ ID NO: 122574 - DNA, 15 bp, Homo sapiens
ataaaatgtctcaaa

SEQ ID NO: 122575 - DNA, 15 bp, Homo sapiens
gataaaatgtctcaa

SEQ ID NO: 122576 - DNA, 15 bp, Homo sapiens
agataaaatgtctca

SEQ ID NO: 122577 - DNA, 15 bp, Homo sapiens
aagataaaatgtctc

SEQ ID NO: 122578 - DNA, 15 bp, Homo sapiens
gaagataaaatgtct

SEQ ID NO: 122579 - DNA, 15 bp, Homo sapiens
tgaagataaaatgtc

SEQ ID NO: 122580 - DNA, 15 bp, Homo sapiens
ttgaagataaaatgt

SEQ ID NO: 122581 - DNA, 15 bp, Homo sapiens
tttgaagataaaatg

SEQ ID NO: 122582 - DNA, 15 bp, Homo sapiens
atttgaagataaaat

SEQ ID NO: 122583 - DNA, 15 bp, Homo sapiens
tatttgaagataaaa

SEQ ID NO: 122584 - DNA, 15 bp, Homo sapiens
atatttgaagataaa

SEQ ID NO: 122585 - DNA, 15 bp, Homo sapiens
tatatttgaagataa

SEQ ID NO: 122586 - DNA, 15 bp, Homo sapiens
ttatatttgaagata

SEQ ID NO: 122587 - DNA, 15 bp, Homo sapiens
tttatatttgaagat

SEQ ID NO: 122588 - DNA, 15 bp, Homo sapiens
ttttatatttgaaga

SEQ ID NO: 122589 - DNA, 15 bp, Homo sapiens
attttatatttgaag

SEQ ID NO: 122590 - DNA, 15 bp, Homo sapiens
tattttatatttgaa

SEQ ID NO: 122591 - DNA, 15 bp, Homo sapiens
atattttatatttga

SEQ ID NO: 122592 - DNA, 15 bp, Homo sapiens
tatattttatatttg

SEQ ID NO: 122593 - DNA, 15 bp, Homo sapiens
atatattttatattt

SEQ ID NO: 122594 - DNA, 15 bp, Homo sapiens
aatatattttatatt

SEQ ID NO: 122595 - DNA, 15 bp, Homo sapiens
aaatatattttatat

SEQ ID NO: 122596 - DNA, 15 bp, Homo sapiens
taaatatattttata

SEQ ID NO: 122597 - DNA, 15 bp, Homo sapiens
ttaaatatattttat

SEQ ID NO: 122598 - DNA, 15 bp, Homo sapiens
tttaaatatatttta

SEQ ID NO: 122599 - DNA, 15 bp, Homo sapiens
ttttaaatatatttt

SEQ ID NO: 122600 - DNA, 15 bp, Homo sapiens
tttttaaatatattt

SEQ ID NO: 122601 - DNA, 15 bp, Homo sapiens
ttttttaaatatatt

SEQ ID NO: 122602 - DNA, 15 bp, Homo sapiens
gttttttttaaatat

SEQ ID NO: 122603 - DNA, 15 bp, Homo sapiens
tgttttttttaaata

SEQ ID NO: 122604 - DNA, 15 bp, Homo sapiens
atgttttttttaaat

SEQ ID NO: 122605 - DNA, 15 bp, Homo sapiens
tatgttttttttaaa

SEQ ID NO: 122606 - DNA, 15 bp, Homo sapiens
ttatgttttttttaa

SEQ ID NO: 122607 - DNA, 15 bp, Homo sapiens
tttatgtttttttta

SEQ ID NO: 122608 - DNA, 15 bp, Homo sapiens
atttatgtttttttt

SEQ ID NO: 122609 - DNA, 15 bp, Homo sapiens
aatttatgttttttt

SEQ ID NO: 122610 - DNA, 15 bp, Homo sapiens
aaatttatgtttttt

SEQ ID NO: 122611 - DNA, 15 bp, Homo sapiens
aaaatttatgttttt

SEQ ID NO: 122612 - DNA, 15 bp, Homo sapiens
aaaaatttatgtttt

SEQ ID NO: 122613 - DNA, 15 bp, Homo sapiens
aaaaaatttatgttt

SEQ ID NO: 122614 - DNA, 15 bp, Homo sapiens
caaaaaatttatgtt

SEQ ID NO: 122615 - DNA, 15 bp, Homo sapiens
tcaaaaaatttatgt

SEQ ID NO: 122616 - DNA, 15 bp, Homo sapiens
atcaaaaaatttatg

SEQ ID NO: 122617 - DNA, 15 bp, Homo sapiens
gatcaaaaaatttat

SEQ ID NO: 122618 - DNA, 15 bp, Homo sapiens
cgatcaaaaaattta

SEQ ID NO: 122619 - DNA, 15 bp, Homo sapiens
acgatcaaaaaattt

SEQ ID NO: 122620 - DNA, 15 bp, Homo sapiens
aacgatcaaaaaatt

SEQ ID NO: 122621 - DNA, 15 bp, Homo sapiens
gaacgatcaaaaaat

SEQ ID NO: 122622 - DNA, 15 bp, Homo sapiens
tgaacgatcaaaaaa

SEQ ID NO: 122623 - DNA, 15 bp, Homo sapiens
ctgaacgatcaaaaa

SEQ ID NO: 122624 - DNA, 15 bp, Homo sapiens
cctgaacgatcaaaa

SEQ ID NO: 122625 - DNA, 15 bp, Homo sapiens
acctgaacgatcaaa

SEQ ID NO: 122626 - DNA, 15 bp, Homo sapiens
aacctgaacgatcaa

SEQ ID NO: 122627 - DNA, 15 bp, Homo sapiens
taacctgaacgatca

SEQ ID NO: 122628 - DNA, 15 bp, Homo sapiens
ttaacctgaacgatc

SEQ ID NO: 122629 - DNA, 15 bp, Homo sapiens
gttaacctgaacgat

SEQ ID NO: 122630 - DNA, 15 bp, Homo sapiens
tgttaacctgaacga

SEQ ID NO: 122631 - DNA, 15 bp, Homo sapiens
atgttaacctgaacg

SEQ ID NO: 122632 - DNA, 15 bp, Homo sapiens
tatgttaacctgaac

SEQ ID NO: 122633 - DNA, 15 bp, Homo sapiens
atatgttaacctgaa

SEQ ID NO: 122634 - DNA, 15 bp, Homo sapiens
gatatgttaacctga

SEQ ID NO: 122635 - DNA, 15 bp, Homo sapiens
agatatgttaacctg

SEQ ID NO: 122636 - DNA, 15 bp, Homo sapiens
aagatatgttaacct

SEQ ID NO: 122637 - DNA, 15 bp, Homo sapiens
caagatatgttaacc

SEQ ID NO: 122638 - DNA, 15 bp, Homo sapiens
tcaagatatgttaac

SEQ ID NO: 122639 - DNA, 15 bp, Homo sapiens
gtcaagatatgttaa

SEQ ID NO: 122640 - DNA, 15 bp, Homo sapiens
cgtcaagatatgtta

SEQ ID NO: 122641 - DNA, 15 bp, Homo sapiens
acgtcaagatatgtt

SEQ ID NO: 122642 - DNA, 15 bp, Homo sapiens
tacgtcaagatatgt

SEQ ID NO: 122643 - DNA, 15 bp, Homo sapiens
atacgtcaagatatg

SEQ ID NO: 122644 - DNA, 15 bp, Homo sapiens
tatacgtcaagatat

SEQ ID NO: 122645 - DNA, 15 bp, Homo sapiens
gtatacgtcaagata

SEQ ID NO: 122646 - DNA, 15 bp, Homo sapiens
agtatacgtcaagat

SEQ ID NO: 122647 - DNA, 15 bp, Homo sapiens
tagtatacgtcaaga

SEQ ID NO: 122648 - DNA, 15 bp, Homo sapiens
atagtatacgtcaag

SEQ ID NO: 122649 - DNA, 15 bp, Homo sapiens
tatagtatacgtcaa

SEQ ID NO: 122650 - DNA, 15 bp, Homo sapiens
gtatagtatacgtca

SEQ ID NO: 122651 - DNA, 15 bp, Homo sapiens
agtatagtatacgtc

SEQ ID NO: 122652 - DNA, 15 bp, Homo sapiens
tagtatagtatacgt

SEQ ID NO: 122653 - DNA, 15 bp, Homo sapiens
ttagtatagtatacg

SEQ ID NO: 122654 - DNA, 15 bp, Homo sapiens
cttagtatagtatac

SEQ ID NO: 122655 - DNA, 15 bp, Homo sapiens
acttagtatagtata

SEQ ID NO: 122656 - DNA, 15 bp, Homo sapiens
tacttagtatagtat

SEQ ID NO: 122657 - DNA, 15 bp, Homo sapiens
ctacttagtatagta

SEQ ID NO: 122658 - DNA, 15 bp, Homo sapiens
cctacttagtatagt

SEQ ID NO: 122659 - DNA, 15 bp, Homo sapiens
acctacttagtatag

SEQ ID NO: 122660 - DNA, 15 bp, Homo sapiens
aacctacttagtata

SEQ ID NO: 122661 - DNA, 15 bp, Homo sapiens
taacctacttagtat

SEQ ID NO: 122662 - DNA, 15 bp, Homo sapiens
ctaacctacttagta

SEQ ID NO: 122663 - DNA, 15 bp, Homo sapiens
actaacctacttagt

SEQ ID NO: 122664 - DNA, 15 bp, Homo sapiens
aactaacctacttag

SEQ ID NO: 122665 - DNA, 15 bp, Homo sapiens
aaactaacctactta

SEQ ID NO: 122666 - DNA, 15 bp, Homo sapiens
aaaactaacctactt

SEQ ID NO: 122667 - DNA, 15 bp, Homo sapiens
gaaaactaacctact

SEQ ID NO: 122668 - DNA, 15 bp, Homo sapiens
ggaaaactaacctac

SEQ ID NO: 122669 - DNA, 15 bp, Homo sapiens
aggaaaactaaccta

SEQ ID NO: 122670 - DNA, 15 bp, Homo sapiens
gaggaaaactaacct

SEQ ID NO: 122671 - DNA, 15 bp, Homo sapiens
ggaggaaaactaacc

SEQ ID NO: 122672 - DNA, 15 bp, Homo sapiens
aggaggaaaactaac

SEQ ID NO: 122673 - DNA, 15 bp, Homo sapiens
aaggaggaaaactaa

SEQ ID NO: 122674 - DNA, 15 bp, Homo sapiens
taaggaggaaaacta

SEQ ID NO: 122675 - DNA, 15 bp, Homo sapiens
ctaaggaggaaaact

SEQ ID NO: 122676 - DNA, 15 bp, Homo sapiens
cctaaggaggaaaac

SEQ ID NO: 122677 - DNA, 15 bp, Homo sapiens
tcctaaggaggaaaa

SEQ ID NO: 122678 - DNA, 15 bp, Homo sapiens
ctcctaaggaggaaa

SEQ ID NO: 122679 - DNA, 15 bp, Homo sapiens
actcctaaggaggaa

SEQ ID NO: 122680 - DNA, 15 bp, Homo sapiens
aactcctaaggagga

SEQ ID NO: 122681 - DNA, 15 bp, Homo sapiens
caactcctaaggagg

SEQ ID NO: 122682 - DNA, 15 bp, Homo sapiens
tcaactcctaaggag

SEQ ID NO: 122683 - DNA, 15 bp, Homo sapiens
atcaactcctaagga

SEQ ID NO: 122684 - DNA, 15 bp, Homo sapiens
tatcaactcctaagg

SEQ ID NO: 122685 - DNA, 15 bp, Homo sapiens
ctatcaactcctaag

SEQ ID NO: 122686 - DNA, 15 bp, Homo sapiens
cctatcaactcctaa

SEQ ID NO: 122687 - DNA, 15 bp, Homo sapiens
tcctatcaactccta

SEQ ID NO: 122688 - DNA, 15 bp, Homo sapiens
ttcctatcaactcct

SEQ ID NO: 122689 - DNA, 15 bp, Homo sapiens
cttcctatcaactcc

SEQ ID NO: 122690 - DNA, 15 bp, Homo sapiens
acttcctatcaactc

SEQ ID NO: 122691 - DNA, 15 bp, Homo sapiens
cacttcctatcaact

SEQ ID NO: 122692 - DNA, 15 bp, Homo sapiens
tcacttcctatcaac

SEQ ID NO: 122693 - DNA, 15 bp, Homo sapiens
gtcacttcctatcaa

SEQ ID NO: 122694 - DNA, 15 bp, Homo sapiens
ggtcacttcctatca

SEQ ID NO: 122695 - DNA, 15 bp, Homo sapiens
aggtcacttcctatc

SEQ ID NO: 122696 - DNA, 15 bp, Homo sapiens
aaggtcacttcctat

SEQ ID NO: 122697 - DNA, 15 bp, Homo sapiens
taaggtcacttccta

SEQ ID NO: 122698 - DNA, 15 bp, Homo sapiens
ataaggtcacttcct

SEQ ID NO: 122699 - DNA, 15 bp, Homo sapiens
cataaggtcacttcc

SEQ ID NO: 122700 - DNA, 15 bp, Homo sapiens
gcataaggtcacttc

SEQ ID NO: 122701 - DNA, 15 bp, Homo sapiens
tgcataaggtcactt

SEQ ID NO: 122702 - DNA, 15 bp, Homo sapiens
atgcataaggtcact

SEQ ID NO: 122703 - DNA, 15 bp, Homo sapiens
aatgcataaggtcac

SEQ ID NO: 122704 - DNA, 15 bp, Homo sapiens
aaatgcataaggtca

SEQ ID NO: 122705 - DNA, 15 bp, Homo sapiens
aaaatgcataaggtc

SEQ ID NO: 122706 - DNA, 15 bp, Homo sapiens
aaaaatgcataaggt

SEQ ID NO: 122707 - DNA, 15 bp, Homo sapiens
gaaaaatgcataagg

SEQ ID NO: 122708 - DNA, 15 bp, Homo sapiens
agaaaaatgcataag

SEQ ID NO: 122709 - DNA, 15 bp, Homo sapiens
aagaaaaatgcataa

SEQ ID NO: 122710 - DNA, 15 bp, Homo sapiens
aaagaaaaatgcata

SEQ ID NO: 122711 - DNA, 15 bp, Homo sapiens
aaaagaaaaatgcat

SEQ ID NO: 122712 - DNA, 15 bp, Homo sapiens
caaaagaaaaatgca

SEQ ID NO: 122713 - DNA, 15 bp, Homo sapiens
tcaaaagaaaaatgc

SEQ ID NO: 122714 - DNA, 15 bp, Homo sapiens
ctcaaaagaaaaatg

SEQ ID NO: 122715 - DNA, 15 bp, Homo sapiens
actcaaaagaaaaat

SEQ ID NO: 122716 - DNA, 15 bp, Homo sapiens
gactcaaaagaaaaa

SEQ ID NO: 122717 - DNA, 15 bp, Homo sapiens
tgactcaaaagaaaa

SEQ ID NO: 122718 - DNA, 15 bp, Homo sapiens
atgactcaaaagaaa

SEQ ID NO: 122719 - DNA, 15 bp, Homo sapiens
aatgactcaaaagaa

SEQ ID NO: 122720 - DNA, 15 bp, Homo sapiens
aaatgactcaaaaga

SEQ ID NO: 122721 - DNA, 15 bp, Homo sapiens
aaaatgactcaaaag

SEQ ID NO: 122722 - DNA, 15 bp, Homo sapiens
aaaaatgactcaaaa

SEQ ID NO: 122723 - DNA, 15 bp, Homo sapiens
aaaaaaatgactcaa

SEQ ID NO: 122724 - DNA, 15 bp, Homo sapiens
aaaaaaaatgactca

SEQ ID NO: 122725 - DNA, 15 bp, Homo sapiens
aaaaaaaaatgactc

SEQ ID NO: 122726 - DNA, 15 bp, Homo sapiens
ggaaaaaaaaaatga

SEQ ID NO: 122727 - DNA, 15 bp, Homo sapiens
aaggaaaaaaaaaat

SEQ ID NO: 122728 - DNA, 15 bp, Homo sapiens
aaaggaaaaaaaaaa

SEQ ID NO: 122729 - DNA, 15 bp, Homo sapiens
taaaaggaaaaaaaa

SEQ ID NO: 122730 - DNA, 15 bp, Homo sapiens
ttaaaaggaaaaaaa

SEQ ID NO: 122731 - DNA, 15 bp, Homo sapiens
tttaaaaggaaaaaa

SEQ ID NO: 122732 - DNA, 15 bp, Homo sapiens
ttttaaaaggaaaaa

SEQ ID NO: 122733 - DNA, 15 bp, Homo sapiens
tttttaaaaggaaaa

SEQ ID NO: 122734 - DNA, 15 bp, Homo sapiens
atttttaaaaggaaa

SEQ ID NO: 122735 - DNA, 15 bp, Homo sapiens
aatttttaaaaggaa

SEQ ID NO: 122736 - DNA, 15 bp, Homo sapiens
aaatttttaaaagga

SEQ ID NO: 122737 - DNA, 15 bp, Homo sapiens
taaatttttaaaagg

SEQ ID NO: 122738 - DNA, 15 bp, Homo sapiens
ctaaatttttaaaag

SEQ ID NO: 122739 - DNA, 15 bp, Homo sapiens
tctaaatttttaaaa

SEQ ID NO: 122740 - DNA, 15 bp, Homo sapiens
atctaaatttttaaa

SEQ ID NO: 122741 - DNA, 15 bp, Homo sapiens
catctaaatttttaa

SEQ ID NO: 122742 - DNA, 15 bp, Homo sapiens
ccatctaaattttta

SEQ ID NO: 122743 - DNA, 15 bp, Homo sapiens
tccatctaaattttt

SEQ ID NO: 122744 - DNA, 15 bp, Homo sapiens
atccatctaaatttt

SEQ ID NO: 122745 - DNA, 15 bp, Homo sapiens
catccatctaaattt

SEQ ID NO: 122746 - DNA, 15 bp, Homo sapiens
tcatccatctaaatt

SEQ ID NO: 122747 - DNA, 15 bp, Homo sapiens
ctcatccatctaaat

SEQ ID NO: 122748 - DNA, 15 bp, Homo sapiens
cctcatccatctaaa

SEQ ID NO: 122749 - DNA, 15 bp, Homo sapiens
tcctcatccatctaa

SEQ ID NO: 122750 - DNA, 15 bp, Homo sapiens
ctcctcatccatcta

SEQ ID NO: 122751 - DNA, 15 bp, Homo sapiens
tctcctcatccatct

SEQ ID NO: 122752 - DNA, 15 bp, Homo sapiens
ctctcctcatccatc

SEQ ID NO: 122753 - DNA, 15 bp, Homo sapiens
actctcctcatccat

SEQ ID NO: 122754 - DNA, 15 bp, Homo sapiens
cactctcctcatcca

SEQ ID NO: 122755 - DNA, 15 bp, Homo sapiens
gcactctcctcatcc

SEQ ID NO: 122756 - DNA, 15 bp, Homo sapiens
ggcactctcctcatc

SEQ ID NO: 122757 - DNA, 15 bp, Homo sapiens
gggcactctcctcat

SEQ ID NO: 122758 - DNA, 15 bp, Homo sapiens
tgggcactctcctca

SEQ ID NO: 122759 - DNA, 15 bp, Homo sapiens
ctgggcactctcctc

SEQ ID NO: 122760 - DNA, 15 bp, Homo sapiens
tctgggcactctcct

SEQ ID NO: 122761 - DNA, 15 bp, Homo sapiens
atctgggcactctcc

SEQ ID NO: 122762 - DNA, 15 bp, Homo sapiens
aatctgggcactctc

SEQ ID NO: 122763 - DNA, 15 bp, Homo sapiens
caatctgggcactct

SEQ ID NO: 122764 - DNA, 15 bp, Homo sapiens
tcaatctgggcactc

SEQ ID NO: 122765 - DNA, 15 bp, Homo sapiens
ctcaatctgggcact

SEQ ID NO: 122766 - DNA, 15 bp, Homo sapiens
cctcaatctgggcac

SEQ ID NO: 122767 - DNA, 15 bp, Homo sapiens
tcctcaatctgggca

SEQ ID NO: 122768 - DNA, 15 bp, Homo sapiens
ttcctcaatctgggc

SEQ ID NO: 122769 - DNA, 15 bp, Homo sapiens
cttcctcaatctggg

SEQ ID NO: 122770 - DNA, 15 bp, Homo sapiens
acttcctcaatctgg

SEQ ID NO: 122771 - DNA, 15 bp, Homo sapiens
aacttcctcaatctg

SEQ ID NO: 122772 - DNA, 15 bp, Homo sapiens
gaacttcctcaatct

SEQ ID NO: 122773 - DNA, 15 bp, Homo sapiens
agaacttcctcaatc

SEQ ID NO: 122774 - DNA, 15 bp, Homo sapiens
tagaacttcctcaat

SEQ ID NO: 122775 - DNA, 15 bp, Homo sapiens
gtagaacttcctcaa

SEQ ID NO: 122776 - DNA, 15 bp, Homo sapiens
tgtagaacttcctca

SEQ ID NO: 122777 - DNA, 15 bp, Homo sapiens
ttgtagaacttcctc

SEQ ID NO: 122778 - DNA, 15 bp, Homo sapiens
tttgtagaacttcct

SEQ ID NO: 122779 - DNA, 15 bp, Homo sapiens
ctttgtagaacttcc

SEQ ID NO: 122780 - DNA, 15 bp, Homo sapiens
tctttgtagaacttc

SEQ ID NO: 122781 - DNA, 15 bp, Homo sapiens
ctctttgtagaactt

SEQ ID NO: 122782 - DNA, 15 bp, Homo sapiens
cctctttgtagaact

SEQ ID NO: 122783 - DNA, 15 bp, Homo sapiens
tcctctttgtagaac

SEQ ID NO: 122784 - DNA, 15 bp, Homo sapiens
ctcctctttgtagaa

SEQ ID NO: 122785 - DNA, 15 bp, Homo sapiens
tctcctctttgtaga

SEQ ID NO: 122786 - DNA, 15 bp, Homo sapiens
ttctcctctttgtag

SEQ ID NO: 122787 - DNA, 15 bp, Homo sapiens
cttctcctctttgta

SEQ ID NO: 122788 - DNA, 15 bp, Homo sapiens
tcttctcctctttgt

SEQ ID NO: 122789 - DNA, 15 bp, Homo sapiens
ttcttctcctctttg

SEQ ID NO: 122790 - DNA, 15 bp, Homo sapiens
tttcttctcctcttt

SEQ ID NO: 122791 - DNA, 15 bp, Homo sapiens
atttcttctcctctt

SEQ ID NO: 122792 - DNA, 15 bp, Homo sapiens
catttcttctcctct

SEQ ID NO: 122793 - DNA, 15 bp, Homo sapiens
acatttcttctcctc

SEQ ID NO: 122794 - DNA, 15 bp, Homo sapiens
aacatttcttctcct

SEQ ID NO: 122795 - DNA, 15 bp, Homo sapiens
taacatttcttctcc

SEQ ID NO: 122796 - DNA, 15 bp, Homo sapiens
gtaacatttcttctc

SEQ ID NO: 122797 - DNA, 15 bp, Homo sapiens
tgtaacatttcttct

SEQ ID NO: 122798 - DNA, 15 bp, Homo sapiens
atgtaacatttcttc

SEQ ID NO: 122799 - DNA, 15 bp, Homo sapiens
gatgtaacatttctt

SEQ ID NO: 122800 - DNA, 15 bp, Homo sapiens
tgatgtaacatttct

SEQ ID NO: 122801 - DNA, 15 bp, Homo sapiens
ttgatgtaacatttc

SEQ ID NO: 122802 - DNA, 15 bp, Homo sapiens
gttgatgtaacattt

SEQ ID NO: 122803 - DNA, 15 bp, Homo sapiens
ggttgatgtaacatt

SEQ ID NO: 122804 - DNA, 15 bp, Homo sapiens
aggttgatgtaacat

SEQ ID NO: 122805 - DNA, 15 bp, Homo sapiens
taggttgatgtaaca

SEQ ID NO: 122806 - DNA, 15 bp, Homo sapiens
ataggttgatgtaac

SEQ ID NO: 122807 - DNA, 15 bp, Homo sapiens
cataggttgatgtaa

SEQ ID NO: 122808 - DNA, 15 bp, Homo sapiens
ccataggttgatgta

SEQ ID NO: 122809 - DNA, 15 bp, Homo sapiens
tccataggttgatgt

SEQ ID NO: 122810 - DNA, 15 bp, Homo sapiens
ttccataggttgatg

SEQ ID NO: 122811 - DNA, 15 bp, Homo sapiens
cttccataggttgat

SEQ ID NO: 122812 - DNA, 15 bp, Homo sapiens
tcttccataggttga

SEQ ID NO: 122813 - DNA, 15 bp, Homo sapiens
atcttccataggttg

SEQ ID NO: 122814 - DNA, 15 bp, Homo sapiens
tatcttccataggtt

SEQ ID NO: 122815 - DNA, 15 bp, Homo sapiens
ttatcttccataggt

SEQ ID NO: 122816 - DNA, 15 bp, Homo sapiens
attatcttccatagg

SEQ ID NO: 122817 - DNA, 15 bp, Homo sapiens
tattatcttccatag

SEQ ID NO: 122818 - DNA, 15 bp, Homo sapiens
ttattatcttccata

SEQ ID NO: 122819 - DNA, 15 bp, Homo sapiens
tttattatcttccat

SEQ ID NO: 122820 - DNA, 15 bp, Homo sapiens
ttttattatcttcca

SEQ ID NO: 122821 - DNA, 15 bp, Homo sapiens
tttttattatcttcc

SEQ ID NO: 122822 - DNA, 15 bp, Homo sapiens
ttttttattatcttc

SEQ ID NO: 122823 - DNA, 15 bp, Homo sapiens
cttttttattatctt

SEQ ID NO: 122824 - DNA, 15 bp, Homo sapiens
tcttttttattatct

SEQ ID NO: 122825 - DNA, 15 bp, Homo sapiens
ttcttttttattatc

SEQ ID NO: 122826 - DNA, 15 bp, Homo sapiens
tttcttttttattat

SEQ ID NO: 122827 - DNA, 15 bp, Homo sapiens
ttttcttttttatta

SEQ ID NO: 122828 - DNA, 15 bp, Homo sapiens
cttttcttttttatt

SEQ ID NO: 122829 - DNA, 15 bp, Homo sapiens
tcttttcttttttat

SEQ ID NO: 122830 - DNA, 15 bp, Homo sapiens
atcttttctttttta

SEQ ID NO: 122831 - DNA, 15 bp, Homo sapiens
gatcttttctttttt

SEQ ID NO: 122832 - DNA, 15 bp, Homo sapiens
ggatcttttcttttt

SEQ ID NO: 122833 - DNA, 15 bp, Homo sapiens
cggatcttttctttt

SEQ ID NO: 122834 - DNA, 15 bp, Homo sapiens
acggatcttttcttt

SEQ ID NO: 122835 - DNA, 15 bp, Homo sapiens
aacggatcttttctt

SEQ ID NO: 122836 - DNA, 15 bp, Homo sapiens
aaacggatcttttct

SEQ ID NO: 122837 - DNA, 15 bp, Homo sapiens
caaacggatcttttc

SEQ ID NO: 122838 - DNA, 15 bp, Homo sapiens
gcaaacggatctttt

SEQ ID NO: 122839 - DNA, 15 bp, Homo sapiens
tgcaaacggatcttt

SEQ ID NO: 122840 - DNA, 15 bp, Homo sapiens
ttgcaaacggatctt

SEQ ID NO: 122841 - DNA, 15 bp, Homo sapiens
attgcaaacggatct

SEQ ID NO: 122842 - DNA, 15 bp, Homo sapiens
aattgcaaacggatc

SEQ ID NO: 122843 - DNA, 15 bp, Homo sapiens
taattgcaaacggat

SEQ ID NO: 122844 - DNA, 15 bp, Homo sapiens
ataattgcaaacgga

SEQ ID NO: 122845 - DNA, 15 bp, Homo sapiens
aataattgcaaacgg

SEQ ID NO: 122846 - DNA, 15 bp, Homo sapiens
taataattgcaaacg

SEQ ID NO: 122847 - DNA, 15 bp, Homo sapiens
gtaataattgcaaac

SEQ ID NO: 122848 - DNA, 15 bp, Homo sapiens
agtaataattgcaaa

SEQ ID NO: 122849 - DNA, 15 bp, Homo sapiens
aagtaataattgcaa

SEQ ID NO: 122850 - DNA, 15 bp, Homo sapiens
aaagtaataattgca

SEQ ID NO: 122851 - DNA, 15 bp, Homo sapiens
aaaagtaataattgc

SEQ ID NO: 122852 - DNA, 15 bp, Homo sapiens
caaaagtaataattg

SEQ ID NO: 122853 - DNA, 15 bp, Homo sapiens
gcaaaagtaataatt

SEQ ID NO: 122854 - DNA, 15 bp, Homo sapiens
tgcaaaagtaataat

SEQ ID NO: 122855 - DNA, 15 bp, Homo sapiens
atgcaaaagtaataa

SEQ ID NO: 122856 - DNA, 15 bp, Homo sapiens
tatgcaaaagtaata

SEQ ID NO: 122857 - DNA, 15 bp, Homo sapiens
gtatgcaaaagtaat

SEQ ID NO: 122858 - DNA, 15 bp, Homo sapiens
agtatgcaaaagtaa

SEQ ID NO: 122859 - DNA, 15 bp, Homo sapiens
tagtatgcaaaagta

SEQ ID NO: 122860 - DNA, 15 bp, Homo sapiens
ctagtatgcaaaagt

SEQ ID NO: 122861 - DNA, 15 bp, Homo sapiens
tctagtatgcaaaag

SEQ ID NO: 122862 - DNA, 15 bp, Homo sapiens
atctagtatgcaaaa

SEQ ID NO: 122863 - DNA, 15 bp, Homo sapiens
tatctagtatgcaaa

SEQ ID NO: 122864 - DNA, 15 bp, Homo sapiens
gtatctagtatgcaa

SEQ ID NO: 122865 - DNA, 15 bp, Homo sapiens
tgtatctagtatgca

SEQ ID NO: 122866 - DNA, 15 bp, Homo sapiens
ttgtatctagtatgc

SEQ ID NO: 122867 - DNA, 15 bp, Homo sapiens
gttgtatctagtatg

SEQ ID NO: 122868 - DNA, 15 bp, Homo sapiens
tgttgtatctagtat

SEQ ID NO: 122869 - DNA, 15 bp, Homo sapiens
ttgttgtatctagta

SEQ ID NO: 122870 - DNA, 15 bp, Homo sapiens
tttgttgtatctagt

SEQ ID NO: 122871 - DNA, 15 bp, Homo sapiens
ttttgttgtatctag

SEQ ID NO: 122872 - DNA, 15 bp, Homo sapiens
attttgttgtatcta

SEQ ID NO: 122873 - DNA, 15 bp, Homo sapiens
aattttgttgtatct

SEQ ID NO: 122874 - DNA, 15 bp, Homo sapiens
taattttgttgtatc

SEQ ID NO: 122875 - DNA, 15 bp, Homo sapiens
ttaattttgttgtat

SEQ ID NO: 122876 - DNA, 15 bp, Homo sapiens
cttaattttgttgta

SEQ ID NO: 122877 - DNA, 15 bp, Homo sapiens
ccttaattttgttgt

SEQ ID NO: 122878 - DNA, 15 bp, Homo sapiens
accttaattttgttg

SEQ ID NO: 122879 - DNA, 15 bp, Homo sapiens
taccttaattttgtt

SEQ ID NO: 122880 - DNA, 15 bp, Homo sapiens
ataccttaattttgt

SEQ ID NO: 122881 - DNA, 15 bp, Homo sapiens
aataccttaattttg

SEQ ID NO: 122882 - DNA, 15 bp, Homo sapiens
taataccttaatttt

SEQ ID NO: 122883 - DNA, 15 bp, Homo sapiens
ataataccttaattt

SEQ ID NO: 122884 - DNA, 15 bp, Homo sapiens
cataataccttaatt

SEQ ID NO: 122885 - DNA, 15 bp, Homo sapiens
tcataataccttaat

SEQ ID NO: 122886 - DNA, 15 bp, Homo sapiens
atcataataccttaa

SEQ ID NO: 122887 - DNA, 15 bp, Homo sapiens
aatcataatacctta

SEQ ID NO: 122888 - DNA, 15 bp, Homo sapiens
caatcataatacctt

SEQ ID NO: 122889 - DNA, 15 bp, Homo sapiens
ccaatcataatacct

SEQ ID NO: 122890 - DNA, 15 bp, Homo sapiens
tccaatcataatacc

SEQ ID NO: 122891 - DNA, 15 bp, Homo sapiens
ctccaatcataatac

SEQ ID NO: 122892 - DNA, 15 bp, Homo sapiens
tctccaatcataata

SEQ ID NO: 122893 - DNA, 15 bp, Homo sapiens
ctctccaatcataat

SEQ ID NO: 122894 - DNA, 15 bp, Homo sapiens
actctccaatcataa

SEQ ID NO: 122895 - DNA, 15 bp, Homo sapiens
gactctccaatcata

SEQ ID NO: 122896 - DNA, 15 bp, Homo sapiens
agactctccaatcat

SEQ ID NO: 122897 - DNA, 15 bp, Homo sapiens
gagactctccaatca

SEQ ID NO: 122898 - DNA, 15 bp, Homo sapiens
agagactctccaatc

SEQ ID NO: 122899 - DNA, 15 bp, Homo sapiens
cagagactctccaat

SEQ ID NO: 122900 - DNA, 15 bp, Homo sapiens
acagagactctccaa

SEQ ID NO: 122901 - DNA, 15 bp, Homo sapiens
aacagagactctcca

SEQ ID NO: 122902 - DNA, 15 bp, Homo sapiens
caacagagactctcc

SEQ ID NO: 122903 - DNA, 15 bp, Homo sapiens
gcaacagagactctc

SEQ ID NO: 122904 - DNA, 15 bp, Homo sapiens
tgcaacagagactct

SEQ ID NO: 122905 - DNA, 15 bp, Homo sapiens
atgcaacagagactc

SEQ ID NO: 122906 - DNA, 15 bp, Homo sapiens
aatgcaacagagact

SEQ ID NO: 122907 - DNA, 15 bp, Homo sapiens
aaatgcaacagagac

SEQ ID NO: 122908 - DNA, 15 bp, Homo sapiens
taaatgcaacagaga

SEQ ID NO: 122909 - DNA, 15 bp, Homo sapiens
ttaaatgcaacagag

SEQ ID NO: 122910 - DNA, 15 bp, Homo sapiens
tttaaatgcaacaga

SEQ ID NO: 122911 - DNA, 15 bp, Homo sapiens
atttaaatgcaacag

SEQ ID NO: 122912 - DNA, 15 bp, Homo sapiens
tatttaaatgcaaca

SEQ ID NO: 122913 - DNA, 15 bp, Homo sapiens
gtatttaaatgcaac

SEQ ID NO: 122914 - DNA, 15 bp, Homo sapiens
ggtatttaaatgcaa

SEQ ID NO: 122915 - DNA, 15 bp, Homo sapiens
aggtatttaaatgca

SEQ ID NO: 122916 - DNA, 15 bp, Homo sapiens
aaggtatttaaatgc

SEQ ID NO: 122917 - DNA, 15 bp, Homo sapiens
taaggtatttaaatg

SEQ ID NO: 122918 - DNA, 15 bp, Homo sapiens
gtaaggtatttaaat

SEQ ID NO: 122919 - DNA, 15 bp, Homo sapiens
agtaaggtatttaaa

SEQ ID NO: 122920 - DNA, 15 bp, Homo sapiens
aagtaaggtatttaa

SEQ ID NO: 122921 - DNA, 15 bp, Homo sapiens
taagtaaggtattta

SEQ ID NO: 122922 - DNA, 15 bp, Homo sapiens
ttaagtaaggtattt

SEQ ID NO: 122923 - DNA, 15 bp, Homo sapiens
gttaagtaaggtatt

SEQ ID NO: 122924 - DNA, 15 bp, Homo sapiens
agttaagtaaggtat

SEQ ID NO: 122925 - DNA, 15 bp, Homo sapiens
gagttaagtaaggta

SEQ ID NO: 122926 - DNA, 15 bp, Homo sapiens
agagttaagtaaggt

SEQ ID NO: 122927 - DNA, 15 bp, Homo sapiens
aagagttaagtaagg

SEQ ID NO: 122928 - DNA, 15 bp, Homo sapiens
caagagttaagtaag

SEQ ID NO: 122929 - DNA, 15 bp, Homo sapiens
gcaagagttaagtaa

SEQ ID NO: 122930 - DNA, 15 bp, Homo sapiens
ggcaagagttaagta

SEQ ID NO: 122931 - DNA, 15 bp, Homo sapiens
tggcaagagttaagt

SEQ ID NO: 122932 - DNA, 15 bp, Homo sapiens
atggcaagagttaag

SEQ ID NO: 122933 - DNA, 15 bp, Homo sapiens
aatggcaagagttaa

SEQ ID NO: 122934 - DNA, 15 bp, Homo sapiens
gaatggcaagagtta

SEQ ID NO: 122935 - DNA, 15 bp, Homo sapiens
tgaatggcaagagtt

SEQ ID NO: 122936 - DNA, 15 bp, Homo sapiens
ctgaatggcaagagt

SEQ ID NO: 122937 - DNA, 15 bp, Homo sapiens
tctgaatggcaagag

SEQ ID NO: 122938 - DNA, 15 bp, Homo sapiens
atctgaatggcaaga

SEQ ID NO: 122939 - DNA, 15 bp, Homo sapiens
catctgaatggcaag

SEQ ID NO: 122940 - DNA, 15 bp, Homo sapiens
acatctgaatggcaa

SEQ ID NO: 122941 - DNA, 15 bp, Homo sapiens
cacatctgaatggca

SEQ ID NO: 122942 - DNA, 15 bp, Homo sapiens
acacatctgaatggc

SEQ ID NO: 122943 - DNA, 15 bp, Homo sapiens
cacacatctgaatgg

SEQ ID NO: 122944 - DNA, 15 bp, Homo sapiens
tcacacatctgaatg

SEQ ID NO: 122945 - DNA, 15 bp, Homo sapiens
atcacacatctgaat

SEQ ID NO: 122946 - DNA, 15 bp, Homo sapiens
catcacacatctgaa

SEQ ID NO: 122947 - DNA, 15 bp, Homo sapiens
gcatcacacatctga

SEQ ID NO: 122948 - DNA, 15 bp, Homo sapiens
agcatcacacatctg

SEQ ID NO: 122949 - DNA, 15 bp, Homo sapiens
cagcatcacacatct

SEQ ID NO: 122950 - DNA, 15 bp, Homo sapiens
gcagcatcacacatc

SEQ ID NO: 122951 - DNA, 15 bp, Homo sapiens
tgcagcatcacacat

SEQ ID NO: 122952 - DNA, 15 bp, Homo sapiens
atgcagcatcacaca

SEQ ID NO: 122953 - DNA, 15 bp, Homo sapiens
gatgcagcatcacac

SEQ ID NO: 122954 - DNA, 15 bp, Homo sapiens
tgatgcagcatcaca

SEQ ID NO: 122955 - DNA, 15 bp, Homo sapiens
gtgatgcagcatcac

SEQ ID NO: 122956 - DNA, 15 bp, Homo sapiens
tgtgatgcagcatca

SEQ ID NO: 122957 - DNA, 15 bp, Homo sapiens
ctgtgatgcagcatc

SEQ ID NO: 122958 - DNA, 15 bp, Homo sapiens
tctgtgatgcagcat

SEQ ID NO: 122959 - DNA, 15 bp, Homo sapiens
atctgtgatgcagca

SEQ ID NO: 122960 - DNA, 15 bp, Homo sapiens
catctgtgatgcagc

SEQ ID NO: 122961 - DNA, 15 bp, Homo sapiens
gcatctgtgatgcag

SEQ ID NO: 122962 - DNA, 15 bp, Homo sapiens
agcatctgtgatgca

SEQ ID NO: 122963 - DNA, 15 bp, Homo sapiens
aagcatctgtgatgc

SEQ ID NO: 122964 - DNA, 15 bp, Homo sapiens
aaagcatctgtgatg

SEQ ID NO: 122965 - DNA, 15 bp, Homo sapiens
taaagcatctgtgat

SEQ ID NO: 122966 - DNA, 15 bp, Homo sapiens
ttaaagcatctgtga

SEQ ID NO: 122967 - DNA, 15 bp, Homo sapiens
tttaaagcatctgtg

SEQ ID NO: 122968 - DNA, 15 bp, Homo sapiens
ttttaaagcatctgt

SEQ ID NO: 122969 - DNA, 15 bp, Homo sapiens
gttttaaagcatctg

SEQ ID NO: 122970 - DNA, 15 bp, Homo sapiens
tgttttaaagcatct

SEQ ID NO: 122971 - DNA, 15 bp, Homo sapiens
gtgttttaaagcatc

SEQ ID NO: 122972 - DNA, 15 bp, Homo sapiens
tgtgttttaaagcat

SEQ ID NO: 122973 - DNA, 15 bp, Homo sapiens
gtgtgttttaaagca

SEQ ID NO: 122974 - DNA, 15 bp, Homo sapiens
ggtgtgttttaaagc

SEQ ID NO: 122975 - DNA, 15 bp, Homo sapiens
tggtgtgttttaaag

SEQ ID NO: 122976 - DNA, 15 bp, Homo sapiens
ctggtgtgttttaaa

SEQ ID NO: 122977 - DNA, 15 bp, Homo sapiens
actggtgtgttttaa

SEQ ID NO: 122978 - DNA, 15 bp, Homo sapiens
aactggtgtgtttta

SEQ ID NO: 122979 - DNA, 15 bp, Homo sapiens
caactggtgtgtttt

SEQ ID NO: 122980 - DNA, 15 bp, Homo sapiens
ccaactggtgtgttt

SEQ ID NO: 122981 - DNA, 15 bp, Homo sapiens
tccaactggtgtgtt

SEQ ID NO: 122982 - DNA, 15 bp, Homo sapiens
ttccaactggtgtgt

SEQ ID NO: 122983 - DNA, 15 bp, Homo sapiens
attccaactggtgtg

SEQ ID NO: 122984 - DNA, 15 bp, Homo sapiens
tattccaactggtgt

SEQ ID NO: 122985 - DNA, 15 bp, Homo sapiens
atattccaactggtg

SEQ ID NO: 122986 - DNA, 15 bp, Homo sapiens
gatattccaactggt

SEQ ID NO: 122987 - DNA, 15 bp, Homo sapiens
tgatattccaactgg

SEQ ID NO: 122988 - DNA, 15 bp, Homo sapiens
atgatattccaactg

SEQ ID NO: 122989 - DNA, 15 bp, Homo sapiens
gatgatattccaact

SEQ ID NO: 122990 - DNA, 15 bp, Homo sapiens
agatgatattccaac

SEQ ID NO: 122991 - DNA, 15 bp, Homo sapiens
gagatgatattccaa

SEQ ID NO: 122992 - DNA, 15 bp, Homo sapiens
ggagatgatattcca

SEQ ID NO: 122993 - DNA, 15 bp, Homo sapiens
aggagatgatattcc

SEQ ID NO: 122994 - DNA, 15 bp, Homo sapiens
gaggagatgatattc

SEQ ID NO: 122995 - DNA, 15 bp, Homo sapiens
ggaggagatgatatt

SEQ ID NO: 122996 - DNA, 15 bp, Homo sapiens
aggaggagatgatat

SEQ ID NO: 122997 - DNA, 15 bp, Homo sapiens
aaggaggagatgata

SEQ ID NO: 122998 - DNA, 15 bp, Homo sapiens
aaaggaggagatgat

SEQ ID NO: 122999 - DNA, 15 bp, Homo sapiens
gaaaggaggagatga

SEQ ID NO: 123000 - DNA, 15 bp, Homo sapiens
agaaaggaggagatg

SEQ ID NO: 123001 - DNA, 15 bp, Homo sapiens
tagaaaggaggagat

SEQ ID NO: 123002 - DNA, 15 bp, Homo sapiens
ctagaaaggaggaga

SEQ ID NO: 123003 - DNA, 15 bp, Homo sapiens
actagaaaggaggag

SEQ ID NO: 123004 - DNA, 15 bp, Homo sapiens
cactagaaaggagga

SEQ ID NO: 123005 - DNA, 15 bp, Homo sapiens
acactagaaaggagg

SEQ ID NO: 123006 - DNA, 15 bp, Homo sapiens
cacactagaaaggag

SEQ ID NO: 123007 - DNA, 15 bp, Homo sapiens
acacactagaaagga

SEQ ID NO: 123008 - DNA, 15 bp, Homo sapiens
cacacactagaaagg

SEQ ID NO: 123009 - DNA, 15 bp, Homo sapiens
acacacactagaaag

SEQ ID NO: 123010 - DNA, 15 bp, Homo sapiens
aacacacactagaaa

SEQ ID NO: 123011 - DNA, 15 bp, Homo sapiens
taacacacactagaa

SEQ ID NO: 123012 - DNA, 15 bp, Homo sapiens
gtaacacacactaga

SEQ ID NO: 123013 - DNA, 15 bp, Homo sapiens
agtaacacacactag

SEQ ID NO: 123014 - DNA, 15 bp, Homo sapiens
tagtaacacacacta

SEQ ID NO: 123015 - DNA, 15 bp, Homo sapiens
ctagtaacacacact

SEQ ID NO: 123016 - DNA, 15 bp, Homo sapiens
tctagtaacacacac

SEQ ID NO: 123017 - DNA, 15 bp, Homo sapiens
atctagtaacacaca

SEQ ID NO: 123018 - DNA, 15 bp, Homo sapiens
catctagtaacacac

SEQ ID NO: 123019 - DNA, 15 bp, Homo sapiens
acatctagtaacaca

SEQ ID NO: 123020 - DNA, 15 bp, Homo sapiens
cacatctagtaacac

SEQ ID NO: 123021 - DNA, 15 bp, Homo sapiens
acacatctagtaaca

SEQ ID NO: 123022 - DNA, 15 bp, Homo sapiens
aacacatctagtaac

SEQ ID NO: 123023 - DNA, 15 bp, Homo sapiens
gaacacatctagtaa

SEQ ID NO: 123024 - DNA, 15 bp, Homo sapiens
tgaacacatctagta

SEQ ID NO: 123025 - DNA, 15 bp, Homo sapiens
atgaacacatctagt

SEQ ID NO: 123026 - DNA, 15 bp, Homo sapiens
tatgaacacatctag

SEQ ID NO: 123027 - DNA, 15 bp, Homo sapiens
atatgaacacatcta

SEQ ID NO: 123028 - DNA, 15 bp, Homo sapiens
aatatgaacacatct

SEQ ID NO: 123029 - DNA, 15 bp, Homo sapiens
aaatatgaacacatc

SEQ ID NO: 123030 - DNA, 15 bp, Homo sapiens
aaaatatgaacacat

SEQ ID NO: 123031 - DNA, 15 bp, Homo sapiens
aaaaatatgaacaca

SEQ ID NO: 123032 - DNA, 15 bp, Homo sapiens
caaaaatatgaacac

SEQ ID NO: 123033 - DNA, 15 bp, Homo sapiens
ccaaaaatatgaaca

SEQ ID NO: 123034 - DNA, 15 bp, Homo sapiens
tccaaaaatatgaac

SEQ ID NO: 123035 - DNA, 15 bp, Homo sapiens
atccaaaaatatgaa

SEQ ID NO: 123036 - DNA, 15 bp, Homo sapiens
catccaaaaatatga

SEQ ID NO: 123037 - DNA, 15 bp, Homo sapiens
ccatccaaaaatatg

SEQ ID NO: 123038 - DNA, 15 bp, Homo sapiens
accatccaaaaatat

SEQ ID NO: 123039 - DNA, 15 bp, Homo sapiens
caccatccaaaaata

SEQ ID NO: 123040 - DNA, 15 bp, Homo sapiens
gcaccatccaaaaat

SEQ ID NO: 123041 - DNA, 15 bp, Homo sapiens
tgcaccatccaaaaa

SEQ ID NO: 123042 - DNA, 15 bp, Homo sapiens
ctgcaccatccaaaa

SEQ ID NO: 123043 - DNA, 15 bp, Homo sapiens
tctgcaccatccaaa

SEQ ID NO: 123044 - DNA, 15 bp, Homo sapiens
ttctgcaccatccaa

SEQ ID NO: 123045 - DNA, 15 bp, Homo sapiens
gttctgcaccatcca

SEQ ID NO: 123046 - DNA, 15 bp, Homo sapiens
agttctgcaccatcc

SEQ ID NO: 123047 - DNA, 15 bp, Homo sapiens
gagttctgcaccatc

SEQ ID NO: 123048 - DNA, 15 bp, Homo sapiens
tgagttctgcaccat

SEQ ID NO: 123049 - DNA, 15 bp, Homo sapiens
ttgagttctgcacca

SEQ ID NO: 123050 - DNA, 15 bp, Homo sapiens
tttgagttctgcacc

SEQ ID NO: 123051 - DNA, 15 bp, Homo sapiens
ttttgagttctgcac

SEQ ID NO: 123052 - DNA, 15 bp, Homo sapiens
attttgagttctgca

SEQ ID NO: 123053 - DNA, 15 bp, Homo sapiens
cattttgagttctgc

SEQ ID NO: 123054 - DNA, 15 bp, Homo sapiens
ccattttgagttctg

SEQ ID NO: 123055 - DNA, 15 bp, Homo sapiens
tccattttgagttct

SEQ ID NO: 123056 - DNA, 15 bp, Homo sapiens
ttccattttgagttc

SEQ ID NO: 123057 - DNA, 15 bp, Homo sapiens
tttccattttgagtt

SEQ ID NO: 123058 - DNA, 15 bp, Homo sapiens
atttccattttgagt

SEQ ID NO: 123059 - DNA, 15 bp, Homo sapiens
catttccattttgag

SEQ ID NO: 123060 - DNA, 15 bp, Homo sapiens
acatttccattttga

SEQ ID NO: 123061 - DNA, 15 bp, Homo sapiens
tacatttccattttg

SEQ ID NO: 123062 - DNA, 15 bp, Homo sapiens
ttacatttccatttt

SEQ ID NO: 123063 - DNA, 15 bp, Homo sapiens
tttacatttccattt

SEQ ID NO: 123064 - DNA, 15 bp, Homo sapiens
ttttacatttccatt

SEQ ID NO: 123065 - DNA, 15 bp, Homo sapiens
gttttacatttccat

SEQ ID NO: 123066 - DNA, 15 bp, Homo sapiens
ggttttacatttcca

SEQ ID NO: 123067 - DNA, 15 bp, Homo sapiens
aggttttacatttcc

SEQ ID NO: 123068 - DNA, 15 bp, Homo sapiens
aaggttttacatttc

SEQ ID NO: 123069 - DNA, 15 bp, Homo sapiens
taaggttttacattt

SEQ ID NO: 123070 - DNA, 15 bp, Homo sapiens
ataaggttttacatt

SEQ ID NO: 123071 - DNA, 15 bp, Homo sapiens
aataaggttttacat

SEQ ID NO: 123072 - DNA, 15 bp, Homo sapiens
taataaggttttaca

SEQ ID NO: 123073 - DNA, 15 bp, Homo sapiens
ataataaggttttac

SEQ ID NO: 123074 - DNA, 15 bp, Homo sapiens
aataataaggtttta

SEQ ID NO: 123075 - DNA, 15 bp, Homo sapiens
caataataaggtttt

SEQ ID NO: 123076 - DNA, 15 bp, Homo sapiens
ccaataataaggttt

SEQ ID NO: 123077 - DNA, 15 bp, Homo sapiens
gccaataataaggtt

SEQ ID NO: 123078 - DNA, 15 bp, Homo sapiens
ggccaataataaggt

SEQ ID NO: 123079 - DNA, 15 bp, Homo sapiens
tggccaataataagg

SEQ ID NO: 123080 - DNA, 15 bp, Homo sapiens
atggccaataataag

SEQ ID NO: 123081 - DNA, 15 bp, Homo sapiens
gatggccaataataa

SEQ ID NO: 123082 - DNA, 15 bp, Homo sapiens
agatggccaataata

SEQ ID NO: 123083 - DNA, 15 bp, Homo sapiens
gagatggccaataat

SEQ ID NO: 123084 - DNA, 15 bp, Homo sapiens
agagatggccaataa

SEQ ID NO: 123085 - DNA, 15 bp, Homo sapiens
aagagatggccaata

SEQ ID NO: 123086 - DNA, 15 bp, Homo sapiens
aaagagatggccaat

SEQ ID NO: 123087 - DNA, 15 bp, Homo sapiens
aaaagagatggccaa

SEQ ID NO: 123088 - DNA, 15 bp, Homo sapiens
caaaagagatggcca

SEQ ID NO: 123089 - DNA, 15 bp, Homo sapiens
ccaaaagagatggcc

SEQ ID NO: 123090 - DNA, 15 bp, Homo sapiens
tccaaaagagatggc

SEQ ID NO: 123091 - DNA, 15 bp, Homo sapiens
atccaaaagagatgg

SEQ ID NO: 123092 - DNA, 15 bp, Homo sapiens
aatccaaaagagatg

SEQ ID NO: 123093 - DNA, 15 bp, Homo sapiens
aaatccaaaagagat

SEQ ID NO: 123094 - DNA, 15 bp, Homo sapiens
gaaatccaaaagaga

SEQ ID NO: 123095 - DNA, 15 bp, Homo sapiens
agaaatccaaaagag

SEQ ID NO: 123096 - DNA, 15 bp, Homo sapiens
cagaaatccaaaaga

SEQ ID NO: 123097 - DNA, 15 bp, Homo sapiens
tcagaaatccaaaag

SEQ ID NO: 123098 - DNA, 15 bp, Homo sapiens
atcagaaatccaaaa

SEQ ID NO: 123099 - DNA, 15 bp, Homo sapiens
aatcagaaatccaaa

SEQ ID NO: 123100 - DNA, 15 bp, Homo sapiens
taatcagaaatccaa

SEQ ID NO: 123101 - DNA, 15 bp, Homo sapiens
ataatcagaaatcca

SEQ ID NO: 123102 - DNA, 15 bp, Homo sapiens
cataatcagaaatcc

SEQ ID NO: 123103 - DNA, 15 bp, Homo sapiens
acataatcagaaatc

SEQ ID NO: 123104 - DNA, 15 bp, Homo sapiens
aacataatcagaaat

SEQ ID NO: 123105 - DNA, 15 bp, Homo sapiens
taacataatcagaaa

SEQ ID NO: 123106 - DNA, 15 bp, Homo sapiens
ataacataatcagaa

SEQ ID NO: 123107 - DNA, 15 bp, Homo sapiens
gataacataatcaga

SEQ ID NO: 123108 - DNA, 15 bp, Homo sapiens
tgataacataatcag

SEQ ID NO: 123109 - DNA, 15 bp, Homo sapiens
ttgataacataatca

SEQ ID NO: 123110 - DNA, 15 bp, Homo sapiens
tttgataacataatc

SEQ ID NO: 123111 - DNA, 15 bp, Homo sapiens
gtttgataacataat

SEQ ID NO: 123112 - DNA, 15 bp, Homo sapiens
ggtttgataacataa

SEQ ID NO: 123113 - DNA, 15 bp, Homo sapiens
aggtttgataacata

SEQ ID NO: 123114 - DNA, 15 bp, Homo sapiens
taggtttgataacat

SEQ ID NO: 123115 - DNA, 15 bp, Homo sapiens
ttaggtttgataaca

SEQ ID NO: 123116 - DNA, 15 bp, Homo sapiens
tttaggtttgataac

SEQ ID NO: 123117 - DNA, 15 bp, Homo sapiens
ttttaggtttgataa

SEQ ID NO: 123118 - DNA, 15 bp, Homo sapiens
cttttaggtttgata

SEQ ID NO: 123119 - DNA, 15 bp, Homo sapiens
tcttttaggtttgat

SEQ ID NO: 123120 - DNA, 15 bp, Homo sapiens
ctcttttaggtttga

SEQ ID NO: 123121 - DNA, 15 bp, Homo sapiens
tctcttttaggtttg

SEQ ID NO: 123122 - DNA, 15 bp, Homo sapiens
atctcttttaggttt

SEQ ID NO: 123123 - DNA, 15 bp, Homo sapiens
gatctcttttaggtt

SEQ ID NO: 123124 - DNA, 15 bp, Homo sapiens
agatctcttttaggt

SEQ ID NO: 123125 - DNA, 15 bp, Homo sapiens
tagatctcttttagg

SEQ ID NO: 123126 - DNA, 15 bp, Homo sapiens
atagatctcttttag

SEQ ID NO: 123127 - DNA, 15 bp, Homo sapiens
gatagatctctttta

SEQ ID NO: 123128 - DNA, 15 bp, Homo sapiens
agatagatctctttt

SEQ ID NO: 123129 - DNA, 15 bp, Homo sapiens
tagatagatctcttt

SEQ ID NO: 123130 - DNA, 15 bp, Homo sapiens
atagatagatctctt

SEQ ID NO: 123131 - DNA, 15 bp, Homo sapiens
aatagatagatctct

SEQ ID NO: 123132 - DNA, 15 bp, Homo sapiens
aaatagatagatctc

SEQ ID NO: 123133 - DNA, 15 bp, Homo sapiens
gaaatagatagatct

SEQ ID NO: 123134 - DNA, 15 bp, Homo sapiens
tgaaatagatagatc

SEQ ID NO: 123135 - DNA, 15 bp, Homo sapiens
ctgaaatagatagat

SEQ ID NO: 123136 - DNA, 15 bp, Homo sapiens
tctgaaatagataga

SEQ ID NO: 123137 - DNA, 15 bp, Homo sapiens
ttctgaaatagatag

SEQ ID NO: 123138 - DNA, 15 bp, Homo sapiens
cttctgaaatagata

SEQ ID NO: 123139 - DNA, 15 bp, Homo sapiens
acttctgaaatagat

SEQ ID NO: 123140 - DNA, 15 bp, Homo sapiens
cacttctgaaataga

SEQ ID NO: 123141 - DNA, 15 bp, Homo sapiens
ccacttctgaaatag

SEQ ID NO: 123142 - DNA, 15 bp, Homo sapiens
gccacttctgaaata

SEQ ID NO: 123143 - DNA, 15 bp, Homo sapiens
agccacttctgaaat

SEQ ID NO: 123144 - DNA, 15 bp, Homo sapiens
aagccacttctgaaa

SEQ ID NO: 123145 - DNA, 15 bp, Homo sapiens
gaagccacttctgaa

SEQ ID NO: 123146 - DNA, 15 bp, Homo sapiens
ggaagccacttctga

SEQ ID NO: 123147 - DNA, 15 bp, Homo sapiens
aggaagccacttctg

SEQ ID NO: 123148 - DNA, 15 bp, Homo sapiens
gaggaagccacttct

SEQ ID NO: 123149 - DNA, 15 bp, Homo sapiens
ggaggaagccacttc

SEQ ID NO: 123150 - DNA, 15 bp, Homo sapiens
tggaggaagccactt

SEQ ID NO: 123151 - DNA, 15 bp, Homo sapiens
ttggaggaagccact

SEQ ID NO: 123152 - DNA, 15 bp, Homo sapiens
attggaggaagccac

SEQ ID NO: 123153 - DNA, 15 bp, Homo sapiens
aattggaggaagcca

SEQ ID NO: 123154 - DNA, 15 bp, Homo sapiens
gaattggaggaagcc

SEQ ID NO: 123155 - DNA, 15 bp, Homo sapiens
ggaattggaggaagc

SEQ ID NO: 123156 - DNA, 15 bp, Homo sapiens
tggaattggaggaag

SEQ ID NO: 123157 - DNA, 15 bp, Homo sapiens
atggaattggaggaa

SEQ ID NO: 123158 - DNA, 15 bp, Homo sapiens
tatggaattggagga

SEQ ID NO: 123159 - DNA, 15 bp, Homo sapiens
atatggaattggagg

SEQ ID NO: 123160 - DNA, 15 bp, Homo sapiens
aatatggaattggag

SEQ ID NO: 123161 - DNA, 15 bp, Homo sapiens
aaatatggaattgga

SEQ ID NO: 123162 - DNA, 15 bp, Homo sapiens
aaaatatggaattgg

SEQ ID NO: 123163 - DNA, 15 bp, Homo sapiens
taaaatatggaattg

SEQ ID NO: 123164 - DNA, 15 bp, Homo sapiens
ataaaatatggaatt

SEQ ID NO: 123165 - DNA, 15 bp, Homo sapiens
aataaaatatggaat

SEQ ID NO: 123166 - DNA, 15 bp, Homo sapiens
aaataaaatatggaa

SEQ ID NO: 123167 - DNA, 15 bp, Homo sapiens
caaataaaatatgga

SEQ ID NO: 123168 - DNA, 15 bp, Homo sapiens
tcacaaataaaatat

SEQ ID NO: 123169 - DNA, 15 bp, Homo sapiens
ttcacaaataaaata

SEQ ID NO: 123170 - DNA, 15 bp, Homo sapiens
cttcacaaataaaat

SEQ ID NO: 123171 - DNA, 15 bp, Homo sapiens
ccttcacaaataaaa

SEQ ID NO: 123172 - DNA, 15 bp, Homo sapiens
accttcacaaataaa

SEQ ID NO: 123173 - DNA, 15 bp, Homo sapiens
gaccttcacaaataa

SEQ ID NO: 123174 - DNA, 15 bp, Homo sapiens
agaccttcacaaata

SEQ ID NO: 123175 - DNA, 15 bp, Homo sapiens
aagaccttcacaaat

SEQ ID NO: 123176 - DNA, 15 bp, Homo sapiens
caagaccttcacaaa

SEQ ID NO: 123177 - DNA, 15 bp, Homo sapiens
acaagaccttcacaa

SEQ ID NO: 123178 - DNA, 15 bp, Homo sapiens
gacaagaccttcaca

SEQ ID NO: 123179 - DNA, 15 bp, Homo sapiens
agacaagaccttcac

SEQ ID NO: 123180 - DNA, 15 bp, Homo sapiens
tagacaagaccttca

SEQ ID NO: 123181 - DNA, 15 bp, Homo sapiens
atagacaagaccttc

SEQ ID NO: 123182 - DNA, 15 bp, Homo sapiens
catagacaagacctt

SEQ ID NO: 123183 - DNA, 15 bp, Homo sapiens
acatagacaagacct

SEQ ID NO: 123184 - DNA, 15 bp, Homo sapiens
gacatagacaagacc

SEQ ID NO: 123185 - DNA, 15 bp, Homo sapiens
tgacatagacaagac

SEQ ID NO: 123186 - DNA, 15 bp, Homo sapiens
ttgacatagacaaga

SEQ ID NO: 123187 - DNA, 15 bp, Homo sapiens
tttgacatagacaag

SEQ ID NO: 123188 - DNA, 15 bp, Homo sapiens
ttttgacatagacaa

SEQ ID NO: 123189 - DNA, 15 bp, Homo sapiens
tttttgacatagaca

SEQ ID NO: 123190 - DNA, 15 bp, Homo sapiens
ttttttgacatagac

SEQ ID NO: 123191 - DNA, 15 bp, Homo sapiens
tttttttgacataga

SEQ ID NO: 123192 - DNA, 15 bp, Homo sapiens
ttttttttgacatag

SEQ ID NO: 123193 - DNA, 15 bp, Homo sapiens
attttttttgacata

SEQ ID NO: 123194 - DNA, 15 bp, Homo sapiens
aattttttttgacat

SEQ ID NO: 123195 - DNA, 15 bp, Homo sapiens
aaattttttttgaca

SEQ ID NO: 123196 - DNA, 15 bp, Homo sapiens
gaaattttttttgac

SEQ ID NO: 123197 - DNA, 15 bp, Homo sapiens
agaaattttttttga

SEQ ID NO: 123198 - DNA, 15 bp, Homo sapiens
tagaaattttttttg

SEQ ID NO: 123199 - DNA, 15 bp, Homo sapiens
ctagaaatttttttt

SEQ ID NO: 123200 - DNA, 15 bp, Homo sapiens
actagaaattttttt

SEQ ID NO: 123201 - DNA, 15 bp, Homo sapiens
aactagaaatttttt

SEQ ID NO: 123202 - DNA, 15 bp, Homo sapiens
aaactagaaattttt

SEQ ID NO: 123203 - DNA, 15 bp, Homo sapiens
taaactagaaatttt

SEQ ID NO: 123204 - DNA, 15 bp, Homo sapiens
ttaaactagaaattt

SEQ ID NO: 123205 - DNA, 15 bp, Homo sapiens
tttaaactagaaatt

SEQ ID NO: 123206 - DNA, 15 bp, Homo sapiens
ttttaaactagaaat

SEQ ID NO: 123207 - DNA, 15 bp, Homo sapiens
tttttaaactagaaa

SEQ ID NO: 123208 - DNA, 15 bp, Homo sapiens
atttttaaactagaa

SEQ ID NO: 123209 - DNA, 15 bp, Homo sapiens
tatttttaaactaga

SEQ ID NO: 123210 - DNA, 15 bp, Homo sapiens
ttatttttaaactag

SEQ ID NO: 123211 - DNA, 15 bp, Homo sapiens
gttatttttaaacta

SEQ ID NO: 123212 - DNA, 15 bp, Homo sapiens
agttatttttaaact

SEQ ID NO: 123213 - DNA, 15 bp, Homo sapiens
gagttatttttaaac

SEQ ID NO: 123214 - DNA, 15 bp, Homo sapiens
tgagttatttttaaa

SEQ ID NO: 123215 - DNA, 15 bp, Homo sapiens
ctgagttatttttaa

SEQ ID NO: 123216 - DNA, 15 bp, Homo sapiens
actgagttattttta

SEQ ID NO: 123217 - DNA, 15 bp, Homo sapiens
aactgagttattttt

SEQ ID NO: 123218 - DNA, 15 bp, Homo sapiens
aaactgagttatttt

SEQ ID NO: 123219 - DNA, 15 bp, Homo sapiens
caaactgagttattt

SEQ ID NO: 123220 - DNA, 15 bp, Homo sapiens
acaaactgagttatt

SEQ ID NO: 123221 - DNA, 15 bp, Homo sapiens
cacaaactgagttat

SEQ ID NO: 123222 - DNA, 15 bp, Homo sapiens
tcacaaactgagtta

SEQ ID NO: 123223 - DNA, 15 bp, Homo sapiens
ttcacaaactgagtt

SEQ ID NO: 123224 - DNA, 15 bp, Homo sapiens
tttcacaaactgagt

SEQ ID NO: 123225 - DNA, 15 bp, Homo sapiens
ctttcacaaactgag

SEQ ID NO: 123226 - DNA, 15 bp, Homo sapiens
actttcacaaactga

SEQ ID NO: 123227 - DNA, 15 bp, Homo sapiens
cactttcacaaactg

SEQ ID NO: 123228 - DNA, 15 bp, Homo sapiens
tcactttcacaaact

SEQ ID NO: 123229 - DNA, 15 bp, Homo sapiens
atcactttcacaaac

SEQ ID NO: 123230 - DNA, 15 bp, Homo sapiens
catcactttcacaaa

SEQ ID NO: 123231 - DNA, 15 bp, Homo sapiens
acatcactttcacaa

SEQ ID NO: 123232 - DNA, 15 bp, Homo sapiens
tacatcactttcaca

SEQ ID NO: 123233 - DNA, 15 bp, Homo sapiens
ttacatcactttcac

SEQ ID NO: 123234 - DNA, 15 bp, Homo sapiens
attacatcactttca

SEQ ID NO: 123235 - DNA, 15 bp, Homo sapiens
tattacatcactttc

SEQ ID NO: 123236 - DNA, 15 bp, Homo sapiens
atattacatcacttt

SEQ ID NO: 123237 - DNA, 15 bp, Homo sapiens
catattacatcactt

SEQ ID NO: 123238 - DNA, 15 bp, Homo sapiens
tcatattacatcact

SEQ ID NO: 123239 - DNA, 15 bp, Homo sapiens
atcatattacatcac

SEQ ID NO: 123240 - DNA, 15 bp, Homo sapiens
aatcatattacatca

SEQ ID NO: 123241 - DNA, 15 bp, Homo sapiens
aaatcatattacatc

SEQ ID NO: 123242 - DNA, 15 bp, Homo sapiens
taaatcatattacat

SEQ ID NO: 123243 - DNA, 15 bp, Homo sapiens
ataaatcatattaca

SEQ ID NO: 123244 - DNA, 15 bp, Homo sapiens
tataaatcatattac

SEQ ID NO: 123245 - DNA, 15 bp, Homo sapiens
atataaatcatatta

SEQ ID NO: 123246 - DNA, 15 bp, Homo sapiens
aatataaatcatatt

SEQ ID NO: 123247 - DNA, 15 bp, Homo sapiens
gaatataaatcatat

SEQ ID NO: 123248 - DNA, 15 bp, Homo sapiens
agaatataaatcata

SEQ ID NO: 123249 - DNA, 15 bp, Homo sapiens
tagaatataaatcat

SEQ ID NO: 123250 - DNA, 15 bp, Homo sapiens
ctagaatataaatca

SEQ ID NO: 123251 - DNA, 15 bp, Homo sapiens
actagaatataaatc

SEQ ID NO: 123252 - DNA, 15 bp, Homo sapiens
tactagaatataaat

SEQ ID NO: 123253 - DNA, 15 bp, Homo sapiens
ttactagaatataaa

SEQ ID NO: 123254 - DNA, 15 bp, Homo sapiens
tttactagaatataa

SEQ ID NO: 123255 - DNA, 15 bp, Homo sapiens
ctttactagaatata

SEQ ID NO: 123256 - DNA, 15 bp, Homo sapiens
tctttactagaatat

SEQ ID NO: 123257 - DNA, 15 bp, Homo sapiens
atctttactagaata

SEQ ID NO: 123258 - DNA, 15 bp, Homo sapiens
aatctttactagaat

SEQ ID NO: 123259 - DNA, 15 bp, Homo sapiens
gaatctttactagaa

SEQ ID NO: 123260 - DNA, 15 bp, Homo sapiens
tgaatctttactaga

SEQ ID NO: 123261 - DNA, 15 bp, Homo sapiens
gtgaatctttactag

SEQ ID NO: 123262 - DNA, 15 bp, Homo sapiens
agtgaatctttacta

SEQ ID NO: 123263 - DNA, 15 bp, Homo sapiens
tagtgaatctttact

SEQ ID NO: 123264 - DNA, 15 bp, Homo sapiens
gtagtgaatctttac

SEQ ID NO: 123265 - DNA, 15 bp, Homo sapiens
ggtagtgaatcttta

SEQ ID NO: 123266 - DNA, 15 bp, Homo sapiens
tggtagtgaatcttt

SEQ ID NO: 123267 - DNA, 15 bp, Homo sapiens
ctggtagtgaatctt

SEQ ID NO: 123268 - DNA, 15 bp, Homo sapiens
gctggtagtgaatct

SEQ ID NO: 123269 - DNA, 15 bp, Homo sapiens
agctggtagtgaatc

SEQ ID NO: 123270 - DNA, 15 bp, Homo sapiens
gagctggtagtgaat

SEQ ID NO: 123271 - DNA, 15 bp, Homo sapiens
ggagctggtagtgaa

SEQ ID NO: 123272 - DNA, 15 bp, Homo sapiens
gggagctggtagtga

SEQ ID NO: 123273 - DNA, 15 bp, Homo sapiens
agggagctggtagtg

SEQ ID NO: 123274 - DNA, 15 bp, Homo sapiens
aagggagctggtagt

SEQ ID NO: 123275 - DNA, 15 bp, Homo sapiens
aaagggagctggtag

SEQ ID NO: 123276 - DNA, 15 bp, Homo sapiens
aaaagggagctggta

SEQ ID NO: 123277 - DNA, 15 bp, Homo sapiens
aaaaagggagctggt

SEQ ID NO: 123278 - DNA, 15 bp, Homo sapiens
taaaaagggagctgg

SEQ ID NO: 123279 - DNA, 15 bp, Homo sapiens
ataaaaagggagctg

SEQ ID NO: 123280 - DNA, 15 bp, Homo sapiens
aataaaaagggagct

SEQ ID NO: 123281 - DNA, 15 bp, Homo sapiens
aaataaaaagggagc

SEQ ID NO: 123282 - DNA, 15 bp, Homo sapiens
gaaataaaaagggag

SEQ ID NO: 123283 - DNA, 15 bp, Homo sapiens
agaaataaaaaggga

SEQ ID NO: 123284 - DNA, 15 bp, Homo sapiens
aagaaataaaaaggg

SEQ ID NO: 123285 - DNA, 15 bp, Homo sapiens
aaagaaataaaaagg

SEQ ID NO: 123286 - DNA, 15 bp, Homo sapiens
taaagaaataaaaag

SEQ ID NO: 123287 - DNA, 15 bp, Homo sapiens
ataaagaaataaaaa

SEQ ID NO: 123288 - DNA, 15 bp, Homo sapiens
tataaagaaataaaa

SEQ ID NO: 123289 - DNA, 15 bp, Homo sapiens
atataaagaaataaa

SEQ ID NO: 123290 - DNA, 15 bp, Homo sapiens
aatataaagaaataa

SEQ ID NO: 123291 - DNA, 15 bp, Homo sapiens
aaatataaagaaata

SEQ ID NO: 123292 - DNA, 15 bp, Homo sapiens
aaaatataaagaaat

SEQ ID NO: 123293 - DNA, 15 bp, Homo sapiens
aaaaatataaagaaa

SEQ ID NO: 123294 - DNA, 15 bp, Homo sapiens
gaaaaatataaagaa

SEQ ID NO: 123295 - DNA, 15 bp, Homo sapiens
agaaaaatataaaga

SEQ ID NO: 123296 - DNA, 15 bp, Homo sapiens
aagaaaaatataaag

SEQ ID NO: 123297 - DNA, 15 bp, Homo sapiens
aaagaaaaatataaa

SEQ ID NO: 123298 - DNA, 15 bp, Homo sapiens
aaaagaaaaatataa

SEQ ID NO: 123299 - DNA, 15 bp, Homo sapiens
aaaaagaaaaatata

SEQ ID NO: 123300 - DNA, 15 bp, Homo sapiens
aaaaaagaaaaatat

SEQ ID NO: 123301 - DNA, 15 bp, Homo sapiens
aaaaaaagaaaaata

SEQ ID NO: 123302 - DNA, 15 bp, Homo sapiens
aaaaaaaagaaaaat

SEQ ID NO: 123303 - DNA, 15 bp, Homo sapiens
aaaaaaaaagaaaaa

SEQ ID NO: 123304 - DNA, 15 bp, Homo sapiens
ctttaaaaaaaaaaa

SEQ ID NO: 123305 - DNA, 15 bp, Homo sapiens
tctttaaaaaaaaaa

SEQ ID NO: 123306 - DNA, 15 bp, Homo sapiens
atctttaaaaaaaaa

SEQ ID NO: 123307 - DNA, 15 bp, Homo sapiens
catctttaaaaaaaa

SEQ ID NO: 123308 - DNA, 15 bp, Homo sapiens
ccatctttaaaaaaa

SEQ ID NO: 123309 - DNA, 15 bp, Homo sapiens
cccatctttaaaaaa

SEQ ID NO: 123310 - DNA, 15 bp, Homo sapiens
ccccatctttaaaaa

SEQ ID NO: 123311 - DNA, 15 bp, Homo sapiens
accccatctttaaaa

SEQ ID NO: 123312 - DNA, 15 bp, Homo sapiens
taccccatctttaaa

SEQ ID NO: 123313 - DNA, 15 bp, Homo sapiens
ataccccatctttaa

SEQ ID NO: 123314 - DNA, 15 bp, Homo sapiens
gataccccatcttta

SEQ ID NO: 123315 - DNA, 15 bp, Homo sapiens
agataccccatcttt

SEQ ID NO: 123316 - DNA, 15 bp, Homo sapiens
gagataccccatctt

SEQ ID NO: 123317 - DNA, 15 bp, Homo sapiens
agagataccccatct

SEQ ID NO: 123318 - DNA, 15 bp, Homo sapiens
tagagataccccatc

SEQ ID NO: 123319 - DNA, 15 bp, Homo sapiens
atagagataccccat

SEQ ID NO: 123320 - DNA, 15 bp, Homo sapiens
catagagatacccca

SEQ ID NO: 123321 - DNA, 15 bp, Homo sapiens
acatagagatacccc

SEQ ID NO: 123322 - DNA, 15 bp, Homo sapiens
aacatagagataccc

SEQ ID NO: 123323 - DNA, 15 bp, Homo sapiens
caacatagagatacc

SEQ ID NO: 123324 - DNA, 15 bp, Homo sapiens
gcaacatagagatac

SEQ ID NO: 123325 - DNA, 15 bp, Homo sapiens
ggcaacatagagata

SEQ ID NO: 123326 - DNA, 15 bp, Homo sapiens
gggcaacatagagat

SEQ ID NO: 123327 - DNA, 15 bp, Homo sapiens
tgggcaacatagaga

SEQ ID NO: 123328 - DNA, 15 bp, Homo sapiens
ctgggcaacatagag

SEQ ID NO: 123329 - DNA, 15 bp, Homo sapiens
cctgggcaacataga

SEQ ID NO: 123330 - DNA, 15 bp, Homo sapiens
taggagttcaagatc

SEQ ID NO: 123331 - DNA, 15 bp, Homo sapiens
ctaggagttcaagat

SEQ ID NO: 123332 - DNA, 15 bp, Homo sapiens
cctaggagttcaaga

SEQ ID NO: 123333 - DNA, 15 bp, Homo sapiens
gcctaggagttcaag

SEQ ID NO: 123334 - DNA, 15 bp, Homo sapiens
agcctaggagttcaa

SEQ ID NO: 123335 - DNA, 15 bp, Homo sapiens
gagcctaggagttca

SEQ ID NO: 123336 - DNA, 15 bp, Homo sapiens
tgagcctaggagttc

SEQ ID NO: 123337 - DNA, 15 bp, Homo sapiens
ttgagcctaggagtt

SEQ ID NO: 123338 - DNA, 15 bp, Homo sapiens
cttgagcctaggagt

SEQ ID NO: 123339 - DNA, 15 bp, Homo sapiens
acttgagcctaggag

SEQ ID NO: 123340 - DNA, 15 bp, Homo sapiens
cacttgagcctagga

SEQ ID NO: 123341 - DNA, 15 bp, Homo sapiens
tcacttgagcctagg

SEQ ID NO: 123342 - DNA, 15 bp, Homo sapiens
atcacttgagcctag

SEQ ID NO: 123343 - DNA, 15 bp, Homo sapiens
gatcacttgagccta

SEQ ID NO: 123344 - DNA, 15 bp, Homo sapiens
taggaggatcacttg

SEQ ID NO: 123345 - DNA, 15 bp, Homo sapiens
ataggaggatcactt

SEQ ID NO: 123346 - DNA, 15 bp, Homo sapiens
cataggaggatcact

SEQ ID NO: 123347 - DNA, 15 bp, Homo sapiens
acataggaggatcac

SEQ ID NO: 123348 - DNA, 15 bp, Homo sapiens
gacataggaggatca

SEQ ID NO: 123349 - DNA, 15 bp, Homo sapiens
tgacataggaggatc

SEQ ID NO: 123350 - DNA, 15 bp, Homo sapiens
ctgacataggaggat

SEQ ID NO: 123351 - DNA, 15 bp, Homo sapiens
actgacataggagga

SEQ ID NO: 123352 - DNA, 15 bp, Homo sapiens
gactgacataggagg

SEQ ID NO: 123353 - DNA, 15 bp, Homo sapiens
agactgacataggag

SEQ ID NO: 123354 - DNA, 15 bp, Homo sapiens
gagactgacatagga

SEQ ID NO: 123355 - DNA, 15 bp, Homo sapiens
ggagactgacatagg

SEQ ID NO: 123356 - DNA, 15 bp, Homo sapiens
gggagactgacatag

SEQ ID NO: 123357 - DNA, 15 bp, Homo sapiens
tgggagactgacata

SEQ ID NO: 123358 - DNA, 15 bp, Homo sapiens
ttgggagactgacat

SEQ ID NO: 123359 - DNA, 15 bp, Homo sapiens
cttgggagactgaca

SEQ ID NO: 123360 - DNA, 15 bp, Homo sapiens
acttgggagactgac

SEQ ID NO: 123361 - DNA, 15 bp, Homo sapiens
aacttgggagactga

SEQ ID NO: 123362 - DNA, 15 bp, Homo sapiens
caacttgggagactg

SEQ ID NO: 123363 - DNA, 15 bp, Homo sapiens
gcaacttgggagact

SEQ ID NO: 123364 - DNA, 15 bp, Homo sapiens
agcaacttgggagac

SEQ ID NO: 123365 - DNA, 15 bp, Homo sapiens
tagcaacttgggaga

SEQ ID NO: 123366 - DNA, 15 bp, Homo sapiens
ctagcaacttgggag

SEQ ID NO: 123367 - DNA, 15 bp, Homo sapiens
cctagcaacttggga

SEQ ID NO: 123368 - DNA, 15 bp, Homo sapiens
tcctagcaacttggg

SEQ ID NO: 123369 - DNA, 15 bp, Homo sapiens
gtcctagcaacttgg

SEQ ID NO: 123370 - DNA, 15 bp, Homo sapiens
agtcctagcaacttg

SEQ ID NO: 123371 - DNA, 15 bp, Homo sapiens
tagtcctagcaactt

SEQ ID NO: 123372 - DNA, 15 bp, Homo sapiens
gtagtcctagcaact

SEQ ID NO: 123373 - DNA, 15 bp, Homo sapiens
tgtagtcctagcaac

SEQ ID NO: 123374 - DNA, 15 bp, Homo sapiens
ctgtagtcctagcaa

SEQ ID NO: 123375 - DNA, 15 bp, Homo sapiens
cctgtagtcctagca

SEQ ID NO: 123376 - DNA, 15 bp, Homo sapiens
acctgtagtcctagc

SEQ ID NO: 123377 - DNA, 15 bp, Homo sapiens
cacctgtagtcctag

SEQ ID NO: 123378 - DNA, 15 bp, Homo sapiens
acacctgtagtccta

SEQ ID NO: 123379 - DNA, 15 bp, Homo sapiens
cacacctgtagtcct

SEQ ID NO: 123380 - DNA, 15 bp, Homo sapiens
ccacacacctgtagt

SEQ ID NO: 123381 - DNA, 15 bp, Homo sapiens
cccacacacctgtag

SEQ ID NO: 123382 - DNA, 15 bp, Homo sapiens
gcccacacacctgta

SEQ ID NO: 123383 - DNA, 15 bp, Homo sapiens
ggcccacacacctgt

SEQ ID NO: 123384 - DNA, 15 bp, Homo sapiens
tggcccacacacctg

SEQ ID NO: 123385 - DNA, 15 bp, Homo sapiens
gtggcccacacacct

SEQ ID NO: 123386 - DNA, 15 bp, Homo sapiens
ggtggcccacacacc

SEQ ID NO: 123387 - DNA, 15 bp, Homo sapiens
tggtggcccacacac

SEQ ID NO: 123388 - DNA, 15 bp, Homo sapiens
atggtggcccacaca

SEQ ID NO: 123389 - DNA, 15 bp, Homo sapiens
tatggtggcccacac

SEQ ID NO: 123390 - DNA, 15 bp, Homo sapiens
atatggtggcccaca

SEQ ID NO: 123391 - DNA, 15 bp, Homo sapiens
gatatggtggcccac

SEQ ID NO: 123392 - DNA, 15 bp, Homo sapiens
ggatatggtggccca

SEQ ID NO: 123393 - DNA, 15 bp, Homo sapiens
tggatatggtggccc

SEQ ID NO: 123394 - DNA, 15 bp, Homo sapiens
ctggatatggtggcc

SEQ ID NO: 123395 - DNA, 15 bp, Homo sapiens
gctggatatggtggc

SEQ ID NO: 123396 - DNA, 15 bp, Homo sapiens
agctggatatggtgg

SEQ ID NO: 123397 - DNA, 15 bp, Homo sapiens
gagctggatatggtg

SEQ ID NO: 123398 - DNA, 15 bp, Homo sapiens
ggagctggatatggt

SEQ ID NO: 123399 - DNA, 15 bp, Homo sapiens
tggagctggatatgg

SEQ ID NO: 123400 - DNA, 15 bp, Homo sapiens
ctggagctggatatg

SEQ ID NO: 123401 - DNA, 15 bp, Homo sapiens
gctggagctggatat

SEQ ID NO: 123402 - DNA, 15 bp, Homo sapiens
agctggagctggata

SEQ ID NO: 123403 - DNA, 15 bp, Homo sapiens
gagctggagctggat

SEQ ID NO: 123404 - DNA, 15 bp, Homo sapiens
agagctggagctgga

SEQ ID NO: 123405 - DNA, 15 bp, Homo sapiens
aagagctggagctgg

SEQ ID NO: 123406 - DNA, 15 bp, Homo sapiens
aaagagctggagctg

SEQ ID NO: 123407 - DNA, 15 bp, Homo sapiens
aaaagagctggagct

SEQ ID NO: 123408 - DNA, 15 bp, Homo sapiens
aaaaagagctggagc

SEQ ID NO: 123409 - DNA, 15 bp, Homo sapiens
aaaaaagagctggag

SEQ ID NO: 123410 - DNA, 15 bp, Homo sapiens
taaaaaagagctgga

SEQ ID NO: 123411 - DNA, 15 bp, Homo sapiens
ttaaaaaagagctgg

SEQ ID NO: 123412 - DNA, 15 bp, Homo sapiens
tttaaaaaagagctg

SEQ ID NO: 123413 - DNA, 15 bp, Homo sapiens
gtttaaaaaagagct

SEQ ID NO: 123414 - DNA, 15 bp, Homo sapiens
cgtttaaaaaagagc

SEQ ID NO: 123415 - DNA, 15 bp, Homo sapiens
ccgtttaaaaaagag

SEQ ID NO: 123416 - DNA, 15 bp, Homo sapiens
gccgtttaaaaaaga

SEQ ID NO: 123417 - DNA, 15 bp, Homo sapiens
tgccgtttaaaaaag

SEQ ID NO: 123418 - DNA, 15 bp, Homo sapiens
ttgccgtttaaaaaa

SEQ ID NO: 123419 - DNA, 15 bp, Homo sapiens
attgccgtttaaaaa

SEQ ID NO: 123420 - DNA, 15 bp, Homo sapiens
gattgccgtttaaaa

SEQ ID NO: 123421 - DNA, 15 bp, Homo sapiens
agattgccgtttaaa

SEQ ID NO: 123422 - DNA, 15 bp, Homo sapiens
aagattgccgtttaa

SEQ ID NO: 123423 - DNA, 15 bp, Homo sapiens
aaagattgccgttta

SEQ ID NO: 123424 - DNA, 15 bp, Homo sapiens
gaaagattgccgttt

SEQ ID NO: 123425 - DNA, 15 bp, Homo sapiens
agaaagattgccgtt

SEQ ID NO: 123426 - DNA, 15 bp, Homo sapiens
tagaaagattgccgt

SEQ ID NO: 123427 - DNA, 15 bp, Homo sapiens
ctagaaagattgccg

SEQ ID NO: 123428 - DNA, 15 bp, Homo sapiens
gctagaaagattgcc

SEQ ID NO: 123429 - DNA, 15 bp, Homo sapiens
agctagaaagattgc

SEQ ID NO: 123430 - DNA, 15 bp, Homo sapiens
cagctagaaagattg

SEQ ID NO: 123431 - DNA, 15 bp, Homo sapiens
gcagctagaaagatt

SEQ ID NO: 123432 - DNA, 15 bp, Homo sapiens
tgcagctagaaagat

SEQ ID NO: 123433 - DNA, 15 bp, Homo sapiens
atgcagctagaaaga

SEQ ID NO: 123434 - DNA, 15 bp, Homo sapiens
aatgcagctagaaag

SEQ ID NO: 123435 - DNA, 15 bp, Homo sapiens
aaatgcagctagaaa

SEQ ID NO: 123436 - DNA, 15 bp, Homo sapiens
aaaatgcagctagaa

SEQ ID NO: 123437 - DNA, 15 bp, Homo sapiens
taaaatgcagctaga

SEQ ID NO: 123438 - DNA, 15 bp, Homo sapiens
ttaaaatgcagctag

SEQ ID NO: 123439 - DNA, 15 bp, Homo sapiens
cttaaaatgcagcta

SEQ ID NO: 123440 - DNA, 15 bp, Homo sapiens
acttaaaatgcagct

SEQ ID NO: 123441 - DNA, 15 bp, Homo sapiens
cacttaaaatgcagc

SEQ ID NO: 123442 - DNA, 15 bp, Homo sapiens
acacttaaaatgcag

SEQ ID NO: 123443 - DNA, 15 bp, Homo sapiens
cacacttaaaatgca

SEQ ID NO: 123444 - DNA, 15 bp, Homo sapiens
gcacacttaaaatgc

SEQ ID NO: 123445 - DNA, 15 bp, Homo sapiens
agcacacttaaaatg

SEQ ID NO: 123446 - DNA, 15 bp, Homo sapiens
cagcacacttaaaat

SEQ ID NO: 123447 - DNA, 15 bp, Homo sapiens
acagcacacttaaaa

SEQ ID NO: 123448 - DNA, 15 bp, Homo sapiens
aacagcacacttaaa

SEQ ID NO: 123449 - DNA, 15 bp, Homo sapiens
caacagcacacttaa

SEQ ID NO: 123450 - DNA, 15 bp, Homo sapiens
acaacagcacactta

SEQ ID NO: 123451 - DNA, 15 bp, Homo sapiens
aacaacagcacactt

SEQ ID NO: 123452 - DNA, 15 bp, Homo sapiens
gaacaacagcacact

SEQ ID NO: 123453 - DNA, 15 bp, Homo sapiens
ggaacaacagcacac

SEQ ID NO: 123454 - DNA, 15 bp, Homo sapiens
gggaacaacagcaca

SEQ ID NO: 123455 - DNA, 15 bp, Homo sapiens
agggaacaacagcac

SEQ ID NO: 123456 - DNA, 15 bp, Homo sapiens
cagggaacaacagca

SEQ ID NO: 123457 - DNA, 15 bp, Homo sapiens
ccagggaacaacagc

SEQ ID NO: 123458 - DNA, 15 bp, Homo sapiens
cccagggaacaacag

SEQ ID NO: 123459 - DNA, 15 bp, Homo sapiens
ccccagggaacaaca

SEQ ID NO: 123460 - DNA, 15 bp, Homo sapiens
accccagggaacaac

SEQ ID NO: 123461 - DNA, 15 bp, Homo sapiens
gaccccagggaacaa

SEQ ID NO: 123462 - DNA, 15 bp, Homo sapiens
ggaccccagggaaca

SEQ ID NO: 123463 - DNA, 15 bp, Homo sapiens
cggaccccagggaac

SEQ ID NO: 123464 - DNA, 15 bp, Homo sapiens
acggaccccagggaa

SEQ ID NO: 123465 - DNA, 15 bp, Homo sapiens
aacggaccccaggga

SEQ ID NO: 123466 - DNA, 15 bp, Homo sapiens
gaacggaccccaggg

SEQ ID NO: 123467 - DNA, 15 bp, Homo sapiens
agaacggaccccagg

SEQ ID NO: 123468 - DNA, 15 bp, Homo sapiens
aagaacggaccccag

SEQ ID NO: 123469 - DNA, 15 bp, Homo sapiens
aaagaacggacccca

SEQ ID NO: 123470 - DNA, 15 bp, Homo sapiens
caaagaacggacccc

SEQ ID NO: 123471 - DNA, 15 bp, Homo sapiens
ccaaagaacggaccc

SEQ ID NO: 123472 - DNA, 15 bp, Homo sapiens
accaaagaacggacc

SEQ ID NO: 123473 - DNA, 15 bp, Homo sapiens
taccaaagaacggac

SEQ ID NO: 123474 - DNA, 15 bp, Homo sapiens
ctaccaaagaacgga

SEQ ID NO: 123475 - DNA, 15 bp, Homo sapiens
actaccaaagaacgg

SEQ ID NO: 123476 - DNA, 15 bp, Homo sapiens
aactaccaaagaacg

SEQ ID NO: 123477 - DNA, 15 bp, Homo sapiens
gaactaccaaagaac

SEQ ID NO: 123478 - DNA, 15 bp, Homo sapiens
ggaactaccaaagaa

SEQ ID NO: 123479 - DNA, 15 bp, Homo sapiens
aggaactaccaaaga

SEQ ID NO: 123480 - DNA, 15 bp, Homo sapiens
aaggaactaccaaag

SEQ ID NO: 123481 - DNA, 15 bp, Homo sapiens
gaaggaactaccaaa

SEQ ID NO: 123482 - DNA, 15 bp, Homo sapiens
agaaggaactaccaa

SEQ ID NO: 123483 - DNA, 15 bp, Homo sapiens
tagaaggaactacca

SEQ ID NO: 123484 - DNA, 15 bp, Homo sapiens
ctagaaggaactacc

SEQ ID NO: 123485 - DNA, 15 bp, Homo sapiens
tctagaaggaactac

SEQ ID NO: 123486 - DNA, 15 bp, Homo sapiens
ttctagaaggaacta

SEQ ID NO: 123487 - DNA, 15 bp, Homo sapiens
gttctagaaggaact

SEQ ID NO: 123488 - DNA, 15 bp, Homo sapiens
cgttctagaaggaac

SEQ ID NO: 123489 - DNA, 15 bp, Homo sapiens
tcgttctagaaggaa

SEQ ID NO: 123490 - DNA, 15 bp, Homo sapiens
atcgttctagaagga

SEQ ID NO: 123491 - DNA, 15 bp, Homo sapiens
aatcgttctagaagg

SEQ ID NO: 123492 - DNA, 15 bp, Homo sapiens
aaatcgttctagaag

SEQ ID NO: 123493 - DNA, 15 bp, Homo sapiens
aaaatcgttctagaa

SEQ ID NO: 123494 - DNA, 15 bp, Homo sapiens
aaaaatcgttctaga

SEQ ID NO: 123495 - DNA, 15 bp, Homo sapiens
taaaaatcgttctag

SEQ ID NO: 123496 - DNA, 15 bp, Homo sapiens
ataaaaatcgttcta

SEQ ID NO: 123497 - DNA, 15 bp, Homo sapiens
aataaaaatcgttct

SEQ ID NO: 123498 - DNA, 15 bp, Homo sapiens
aaataaaaatcgttc

SEQ ID NO: 123499 - DNA, 15 bp, Homo sapiens
caaataaaaatcgtt

SEQ ID NO: 123500 - DNA, 15 bp, Homo sapiens
tcaaataaaaatcgt

SEQ ID NO: 123501 - DNA, 15 bp, Homo sapiens
atcaaataaaaatcg

SEQ ID NO: 123502 - DNA, 15 bp, Homo sapiens
catcaaataaaaatc

SEQ ID NO: 123503 - DNA, 15 bp, Homo sapiens
tcatcaaataaaaat

SEQ ID NO: 123504 - DNA, 15 bp, Homo sapiens
gtcatcaaataaaaa

SEQ ID NO: 123505 - DNA, 15 bp, Homo sapiens
agtcatcaaataaaa

SEQ ID NO: 123506 - DNA, 15 bp, Homo sapiens
aagtcatcaaataaa

SEQ ID NO: 123507 - DNA, 15 bp, Homo sapiens
aaagtcatcaaataa

SEQ ID NO: 123508 - DNA, 15 bp, Homo sapiens
caaagtcatcaaata

SEQ ID NO: 123509 - DNA, 15 bp, Homo sapiens
ccaaagtcatcaaat

SEQ ID NO: 123510 - DNA, 15 bp, Homo sapiens
tccaaagtcatcaaa

SEQ ID NO: 123511 - DNA, 15 bp, Homo sapiens
ttccaaagtcatcaa

SEQ ID NO: 123512 - DNA, 15 bp, Homo sapiens
tttccaaagtcatca

SEQ ID NO: 123513 - DNA, 15 bp, Homo sapiens
atttccaaagtcatc

SEQ ID NO: 123514 - DNA, 15 bp, Homo sapiens
aatttccaaagtcat

SEQ ID NO: 123515 - DNA, 15 bp, Homo sapiens
taatttccaaagtca

SEQ ID NO: 123516 - DNA, 15 bp, Homo sapiens
ttaatttccaaagtc

SEQ ID NO: 123517 - DNA, 15 bp, Homo sapiens
cttaatttccaaagt

SEQ ID NO: 123518 - DNA, 15 bp, Homo sapiens
acttaatttccaaag

SEQ ID NO: 123519 - DNA, 15 bp, Homo sapiens
tacttaatttccaaa

SEQ ID NO: 123520 - DNA, 15 bp, Homo sapiens
ctacttaatttccaa

SEQ ID NO: 123521 - DNA, 15 bp, Homo sapiens
tctacttaatttcca

SEQ ID NO: 123522 - DNA, 15 bp, Homo sapiens
atctacttaatttcc

SEQ ID NO: 123523 - DNA, 15 bp, Homo sapiens
gatctacttaatttc

SEQ ID NO: 123524 - DNA, 15 bp, Homo sapiens
cgatctacttaattt

SEQ ID NO: 123525 - DNA, 15 bp, Homo sapiens
tcgatctacttaatt

SEQ ID NO: 123526 - DNA, 15 bp, Homo sapiens
atcgatctacttaat

SEQ ID NO: 123527 - DNA, 15 bp, Homo sapiens
aatcgatctacttaa

SEQ ID NO: 123528 - DNA, 15 bp, Homo sapiens
taatcgatctactta

SEQ ID NO: 123529 - DNA, 15 bp, Homo sapiens
ataatcgatctactt

SEQ ID NO: 123530 - DNA, 15 bp, Homo sapiens
cataatcgatctact

SEQ ID NO: 123531 - DNA, 15 bp, Homo sapiens
ccataatcgatctac

SEQ ID NO: 123532 - DNA, 15 bp, Homo sapiens
accataatcgatcta

SEQ ID NO: 123533 - DNA, 15 bp, Homo sapiens
taccataatcgatct

SEQ ID NO: 123534 - DNA, 15 bp, Homo sapiens
gtaccataatcgatc

SEQ ID NO: 123535 - DNA, 15 bp, Homo sapiens
agtaccataatcgat

SEQ ID NO: 123536 - DNA, 15 bp, Homo sapiens
cagtaccataatcga

SEQ ID NO: 123537 - DNA, 15 bp, Homo sapiens
acagtaccataatcg

SEQ ID NO: 123538 - DNA, 15 bp, Homo sapiens
tacagtaccataatc

SEQ ID NO: 123539 - DNA, 15 bp, Homo sapiens
atacagtaccataat

SEQ ID NO: 123540 - DNA, 15 bp, Homo sapiens
aatacagtaccataa

SEQ ID NO: 123541 - DNA, 15 bp, Homo sapiens
aaatacagtaccata

SEQ ID NO: 123542 - DNA, 15 bp, Homo sapiens
aaaatacagtaccat

SEQ ID NO: 123543 - DNA, 15 bp, Homo sapiens
aaaaatacagtacca

SEQ ID NO: 123544 - DNA, 15 bp, Homo sapiens
taaaaatacagtacc

SEQ ID NO: 123545 - DNA, 15 bp, Homo sapiens
gtaaaaatacagtac

SEQ ID NO: 123546 - DNA, 15 bp, Homo sapiens
agtaaaaatacagta

SEQ ID NO: 123547 - DNA, 15 bp, Homo sapiens
cagtaaaaatacagt

SEQ ID NO: 123548 - DNA, 15 bp, Homo sapiens
acagtaaaaatacag

SEQ ID NO: 123549 - DNA, 15 bp, Homo sapiens
tacagtaaaaataca

SEQ ID NO: 123550 - DNA, 15 bp, Homo sapiens
gtacagtaaaaatac

SEQ ID NO: 123551 - DNA, 15 bp, Homo sapiens
ggtacagtaaaaata

SEQ ID NO: 123552 - DNA, 15 bp, Homo sapiens
aggtacagtaaaaat

SEQ ID NO: 123553 - DNA, 15 bp, Homo sapiens
aaggtacagtaaaaa

SEQ ID NO: 123554 - DNA, 15 bp, Homo sapiens
aaaggtacagtaaaa

SEQ ID NO: 123555 - DNA, 15 bp, Homo sapiens
aaaaggtacagtaaa

SEQ ID NO: 123556 - DNA, 15 bp, Homo sapiens
gaaaaggtacagtaa

SEQ ID NO: 123557 - DNA, 15 bp, Homo sapiens
agaaaaggtacagta

SEQ ID NO: 123558 - DNA, 15 bp, Homo sapiens
tagaaaaggtacagt

SEQ ID NO: 123559 - DNA, 15 bp, Homo sapiens
atagaaaaggtacag

SEQ ID NO: 123560 - DNA, 15 bp, Homo sapiens
catagaaaaggtaca

SEQ ID NO: 123561 - DNA, 15 bp, Homo sapiens
acatagaaaaggtac

SEQ ID NO: 123562 - DNA, 15 bp, Homo sapiens
aacatagaaaaggta

SEQ ID NO: 123563 - DNA, 15 bp, Homo sapiens
aaacatagaaaaggt

SEQ ID NO: 123564 - DNA, 15 bp, Homo sapiens
taaacatagaaaagg

SEQ ID NO: 123565 - DNA, 15 bp, Homo sapiens
ctaaacatagaaaag

SEQ ID NO: 123566 - DNA, 15 bp, Homo sapiens
tctaaacatagaaaa

SEQ ID NO: 123567 - DNA, 15 bp, Homo sapiens
atctaaacatagaaa

SEQ ID NO: 123568 - DNA, 15 bp, Homo sapiens
tatctaaacatagaa

SEQ ID NO: 123569 - DNA, 15 bp, Homo sapiens
atatctaaacataga

SEQ ID NO: 123570 - DNA, 15 bp, Homo sapiens
catatctaaacatag

SEQ ID NO: 123571 - DNA, 15 bp, Homo sapiens
acatatctaaacata

SEQ ID NO: 123572 - DNA, 15 bp, Homo sapiens
aacatatctaaacat

SEQ ID NO: 123573 - DNA, 15 bp, Homo sapiens
aaacatatctaaaca

SEQ ID NO: 123574 - DNA, 15 bp, Homo sapiens
taaacatatctaaac

SEQ ID NO: 123575 - DNA, 15 bp, Homo sapiens
ctaaacatatctaaa

SEQ ID NO: 123576 - DNA, 15 bp, Homo sapiens
tctaaacatatctaa

SEQ ID NO: 123577 - DNA, 15 bp, Homo sapiens
atctaaacatatcta

SEQ ID NO: 123578 - DNA, 15 bp, Homo sapiens
tatctaaacatatct

SEQ ID NO: 123579 - DNA, 15 bp, Homo sapiens
gtatctaaacatatc

SEQ ID NO: 123580 - DNA, 15 bp, Homo sapiens
tgtatctaaacatat

SEQ ID NO: 123581 - DNA, 15 bp, Homo sapiens
atgtatctaaacata

SEQ ID NO: 123582 - DNA, 15 bp, Homo sapiens
tatgtatctaaacat

SEQ ID NO: 123583 - DNA, 15 bp, Homo sapiens
gaagtatttatgtat

SEQ ID NO: 123584 - DNA, 15 bp, Homo sapiens
ggaagtatttatgta

SEQ ID NO: 123585 - DNA, 15 bp, Homo sapiens
tggaagtatttatgt

SEQ ID NO: 123586 - DNA, 15 bp, Homo sapiens
ttggaagtatttatg

SEQ ID NO: 123587 - DNA, 15 bp, Homo sapiens
gttggaagtatttat

SEQ ID NO: 123588 - DNA, 15 bp, Homo sapiens
agttggaagtattta

SEQ ID NO: 123589 - DNA, 15 bp, Homo sapiens
cagttggaagtattt

SEQ ID NO: 123590 - DNA, 15 bp, Homo sapiens
acagttggaagtatt

SEQ ID NO: 123591 - DNA, 15 bp, Homo sapiens
cacagttggaagtat

SEQ ID NO: 123592 - DNA, 15 bp, Homo sapiens
acacagttggaagta

SEQ ID NO: 123593 - DNA, 15 bp, Homo sapiens
aacacagttggaagt

SEQ ID NO: 123594 - DNA, 15 bp, Homo sapiens
aaacacagttggaag

SEQ ID NO: 123595 - DNA, 15 bp, Homo sapiens
gaaacacagttggaa

SEQ ID NO: 123596 - DNA, 15 bp, Homo sapiens
tgaaacacagttgga

SEQ ID NO: 123597 - DNA, 15 bp, Homo sapiens
ctgaaacacagttgg

SEQ ID NO: 123598 - DNA, 15 bp, Homo sapiens
tctgaaacacagttg

SEQ ID NO: 123599 - DNA, 15 bp, Homo sapiens
ttctgaaacacagtt

SEQ ID NO: 123600 - DNA, 15 bp, Homo sapiens
attctgaaacacagt

SEQ ID NO: 123601 - DNA, 15 bp, Homo sapiens
aattctgaaacacag

SEQ ID NO: 123602 - DNA, 15 bp, Homo sapiens
caattctgaaacaca

SEQ ID NO: 123603 - DNA, 15 bp, Homo sapiens
gcaattctgaaacac

SEQ ID NO: 123604 - DNA, 15 bp, Homo sapiens
ggcaattctgaaaca

SEQ ID NO: 123605 - DNA, 15 bp, Homo sapiens
aggcaattctgaaac

SEQ ID NO: 123606 - DNA, 15 bp, Homo sapiens
taggcaattctgaaa

SEQ ID NO: 123607 - DNA, 15 bp, Homo sapiens
ataggcaattctgaa

SEQ ID NO: 123608 - DNA, 15 bp, Homo sapiens
tataggcaattctga

SEQ ID NO: 123609 - DNA, 15 bp, Homo sapiens
ctataggcaattctg

SEQ ID NO: 123610 - DNA, 15 bp, Homo sapiens
actataggcaattct

SEQ ID NO: 123611 - DNA, 15 bp, Homo sapiens
tactataggcaattc

SEQ ID NO: 123612 - DNA, 15 bp, Homo sapiens
atactataggcaatt

SEQ ID NO: 123613 - DNA, 15 bp, Homo sapiens
aatactataggcaat

SEQ ID NO: 123614 - DNA, 15 bp, Homo sapiens
gaatactataggcaa

SEQ ID NO: 123615 - DNA, 15 bp, Homo sapiens
tgaatactataggca

SEQ ID NO: 123616 - DNA, 15 bp, Homo sapiens
ctgaatactataggc

SEQ ID NO: 123617 - DNA, 15 bp, Homo sapiens
actgaatactatagg

SEQ ID NO: 123618 - DNA, 15 bp, Homo sapiens
tactgaatactatag

SEQ ID NO: 123619 - DNA, 15 bp, Homo sapiens
gtactgaatactata

SEQ ID NO: 123620 - DNA, 15 bp, Homo sapiens
tgtactgaatactat

SEQ ID NO: 123621 - DNA, 15 bp, Homo sapiens
ttgtactgaatacta

SEQ ID NO: 123622 - DNA, 15 bp, Homo sapiens
attgtactgaatact

SEQ ID NO: 123623 - DNA, 15 bp, Homo sapiens
tattgtactgaatac

SEQ ID NO: 123624 - DNA, 15 bp, Homo sapiens
ttattgtactgaata

SEQ ID NO: 123625 - DNA, 15 bp, Homo sapiens
gttattgtactgaat

SEQ ID NO: 123626 - DNA, 15 bp, Homo sapiens
cgttattgtactgaa

SEQ ID NO: 123627 - DNA, 15 bp, Homo sapiens
acgttattgtactga

SEQ ID NO: 123628 - DNA, 15 bp, Homo sapiens
cacgttattgtactg

SEQ ID NO: 123629 - DNA, 15 bp, Homo sapiens
gcacgttattgtact

SEQ ID NO: 123630 - DNA, 15 bp, Homo sapiens
agcacgttattgtac

SEQ ID NO: 123631 - DNA, 15 bp, Homo sapiens
cagcacgttattgta

SEQ ID NO: 123632 - DNA, 15 bp, Homo sapiens
acagcacgttattgt

SEQ ID NO: 123633 - DNA, 15 bp, Homo sapiens
tacagcacgttattg

SEQ ID NO: 123634 - DNA, 15 bp, Homo sapiens
ttacagcacgttatt

SEQ ID NO: 123635 - DNA, 15 bp, Homo sapiens
tttacagcacgttat

SEQ ID NO: 123636 - DNA, 15 bp, Homo sapiens
ctttacagcacgtta

SEQ ID NO: 123637 - DNA, 15 bp, Homo sapiens
actttacagcacgtt

SEQ ID NO: 123638 - DNA, 15 bp, Homo sapiens
aactttacagcacgt

SEQ ID NO: 123639 - DNA, 15 bp, Homo sapiens
aaactttacagcacg

SEQ ID NO: 123640 - DNA, 15 bp, Homo sapiens
aaaactttacagcac

SEQ ID NO: 123641 - DNA, 15 bp, Homo sapiens
taaaactttacagca

SEQ ID NO: 123642 - DNA, 15 bp, Homo sapiens
ctaaaactttacagc

SEQ ID NO: 123643 - DNA, 15 bp, Homo sapiens
gctaaaactttacag

SEQ ID NO: 123644 - DNA, 15 bp, Homo sapiens
ggctaaaactttaca

SEQ ID NO: 123645 - DNA, 15 bp, Homo sapiens
aggctaaaactttac

SEQ ID NO: 123646 - DNA, 15 bp, Homo sapiens
taggctaaaacttta

SEQ ID NO: 123647 - DNA, 15 bp, Homo sapiens
ctaggctaaaacttt

SEQ ID NO: 123648 - DNA, 15 bp, Homo sapiens
cctaggctaaaactt

SEQ ID NO: 123649 - DNA, 15 bp, Homo sapiens
tcctaggctaaaact

SEQ ID NO: 123650 - DNA, 15 bp, Homo sapiens
ctcctaggctaaaac

SEQ ID NO: 123651 - DNA, 15 bp, Homo sapiens
gctcctaggctaaaa

SEQ ID NO: 123652 - DNA, 15 bp, Homo sapiens
tgctcctaggctaaa

SEQ ID NO: 123653 - DNA, 15 bp, Homo sapiens
ttgctcctaggctaa

SEQ ID NO: 123654 - DNA, 15 bp, Homo sapiens
attgctcctaggcta

SEQ ID NO: 123655 - DNA, 15 bp, Homo sapiens
aattgctcctaggct

SEQ ID NO: 123656 - DNA, 15 bp, Homo sapiens
caattgctcctaggc

SEQ ID NO: 123657 - DNA, 15 bp, Homo sapiens
tcaattgctcctagg

SEQ ID NO: 123658 - DNA, 15 bp, Homo sapiens
gtcaattgctcctag

SEQ ID NO: 123659 - DNA, 15 bp, Homo sapiens
agtcaattgctccta

SEQ ID NO: 123660 - DNA, 15 bp, Homo sapiens
tagtcaattgctcct

SEQ ID NO: 123661 - DNA, 15 bp, Homo sapiens
atagtcaattgctcc

SEQ ID NO: 123662 - DNA, 15 bp, Homo sapiens
tatagtcaattgctc

SEQ ID NO: 123663 - DNA, 15 bp, Homo sapiens
gtatagtcaattgct

SEQ ID NO: 123664 - DNA, 15 bp, Homo sapiens
ggtatagtcaattgc

SEQ ID NO: 123665 - DNA, 15 bp, Homo sapiens
tggtatagtcaattg

SEQ ID NO: 123666 - DNA, 15 bp, Homo sapiens
gtggtatagtcaatt

SEQ ID NO: 123667 - DNA, 15 bp, Homo sapiens
tgtggtatagtcaat

SEQ ID NO: 123668 - DNA, 15 bp, Homo sapiens
gtgtggtatagtcaa

SEQ ID NO: 123669 - DNA, 15 bp, Homo sapiens
tgtgtggtatagtca

SEQ ID NO: 123670 - DNA, 15 bp, Homo sapiens
ctgtgtggtatagtc

SEQ ID NO: 123671 - DNA, 15 bp, Homo sapiens
gctgtgtggtatagt

SEQ ID NO: 123672 - DNA, 15 bp, Homo sapiens
ggctgtgtggtatag

SEQ ID NO: 123673 - DNA, 15 bp, Homo sapiens
aggctgtgtggtata

SEQ ID NO: 123674 - DNA, 15 bp, Homo sapiens
taggctgtgtggtat

SEQ ID NO: 123675 - DNA, 15 bp, Homo sapiens
ttaggctgtgtggta

SEQ ID NO: 123676 - DNA, 15 bp, Homo sapiens
cttaggctgtgtggt

SEQ ID NO: 123677 - DNA, 15 bp, Homo sapiens
acttaggctgtgtgg

SEQ ID NO: 123678 - DNA, 15 bp, Homo sapiens
cacttaggctgtgtg

SEQ ID NO: 123679 - DNA, 15 bp, Homo sapiens
acacttaggctgtgt

SEQ ID NO: 123680 - DNA, 15 bp, Homo sapiens
cacacttaggctgtg

SEQ ID NO: 123681 - DNA, 15 bp, Homo sapiens
gcacacttaggctgt

SEQ ID NO: 123682 - DNA, 15 bp, Homo sapiens
tgcacacttaggctg

SEQ ID NO: 123683 - DNA, 15 bp, Homo sapiens
ctgcacacttaggct

SEQ ID NO: 123684 - DNA, 15 bp, Homo sapiens
cctgcacacttaggc

SEQ ID NO: 123685 - DNA, 15 bp, Homo sapiens
tcctgcacacttagg

SEQ ID NO: 123686 - DNA, 15 bp, Homo sapiens
ctcctgcacacttag

SEQ ID NO: 123687 - DNA, 15 bp, Homo sapiens
cctcctgcacactta

SEQ ID NO: 123688 - DNA, 15 bp, Homo sapiens
gcctcctgcacactt

SEQ ID NO: 123689 - DNA, 15 bp, Homo sapiens
agcctcctgcacact

SEQ ID NO: 123690 - DNA, 15 bp, Homo sapiens
cagcctcctgcacac

SEQ ID NO: 123691 - DNA, 15 bp, Homo sapiens
acagcctcctgcaca

SEQ ID NO: 123692 - DNA, 15 bp, Homo sapiens
tacagcctcctgcac

SEQ ID NO: 123693 - DNA, 15 bp, Homo sapiens
gtacagcctcctgca

SEQ ID NO: 123694 - DNA, 15 bp, Homo sapiens
ggtacagcctcctgc

SEQ ID NO: 123695 - DNA, 15 bp, Homo sapiens
tggtacagcctcctg

SEQ ID NO: 123696 - DNA, 15 bp, Homo sapiens
atggtacagcctcct

SEQ ID NO: 123697 - DNA, 15 bp, Homo sapiens
gatggtacagcctcc

SEQ ID NO: 123698 - DNA, 15 bp, Homo sapiens
agatggtacagcctc

SEQ ID NO: 123699 - DNA, 15 bp, Homo sapiens
tagatggtacagcct

SEQ ID NO: 123700 - DNA, 15 bp, Homo sapiens
ctagatggtacagcc

SEQ ID NO: 123701 - DNA, 15 bp, Homo sapiens
cctagatggtacagc

SEQ ID NO: 123702 - DNA, 15 bp, Homo sapiens
acctagatggtacag

SEQ ID NO: 123703 - DNA, 15 bp, Homo sapiens
aacctagatggtaca

SEQ ID NO: 123704 - DNA, 15 bp, Homo sapiens
aaacctagatggtac

SEQ ID NO: 123705 - DNA, 15 bp, Homo sapiens
caaacctagatggta

SEQ ID NO: 123706 - DNA, 15 bp, Homo sapiens
acaaacctagatggt

SEQ ID NO: 123707 - DNA, 15 bp, Homo sapiens
cacaaacctagatgg

SEQ ID NO: 123708 - DNA, 15 bp, Homo sapiens
acacaaacctagatg

SEQ ID NO: 123709 - DNA, 15 bp, Homo sapiens
tacacaaacctagat

SEQ ID NO: 123710 - DNA, 15 bp, Homo sapiens
ttacacaaacctaga

SEQ ID NO: 123711 - DNA, 15 bp, Homo sapiens
cttacacaaacctag

SEQ ID NO: 123712 - DNA, 15 bp, Homo sapiens
ccttacacaaaccta

SEQ ID NO: 123713 - DNA, 15 bp, Homo sapiens
cccttacacaaacct

SEQ ID NO: 123714 - DNA, 15 bp, Homo sapiens
gcccttacacaaacc

SEQ ID NO: 123715 - DNA, 15 bp, Homo sapiens
tgcccttacacaaac

SEQ ID NO: 123716 - DNA, 15 bp, Homo sapiens
gtgcccttacacaaa

SEQ ID NO: 123717 - DNA, 15 bp, Homo sapiens
agtgcccttacacaa

SEQ ID NO: 123718 - DNA, 15 bp, Homo sapiens
gagtgcccttacaca

SEQ ID NO: 123719 - DNA, 15 bp, Homo sapiens
agagtgcccttacac

SEQ ID NO: 123720 - DNA, 15 bp, Homo sapiens
tagagtgcccttaca

SEQ ID NO: 123721 - DNA, 15 bp, Homo sapiens
atagagtgcccttac

SEQ ID NO: 123722 - DNA, 15 bp, Homo sapiens
catagagtgccctta

SEQ ID NO: 123723 - DNA, 15 bp, Homo sapiens
tcatagagtgccctt

SEQ ID NO: 123724 - DNA, 15 bp, Homo sapiens
atcatagagtgccct

SEQ ID NO: 123725 - DNA, 15 bp, Homo sapiens
catcatagagtgccc

SEQ ID NO: 123726 - DNA, 15 bp, Homo sapiens
acatcatagagtgcc

SEQ ID NO: 123727 - DNA, 15 bp, Homo sapiens
aacatcatagagtgc

SEQ ID NO: 123728 - DNA, 15 bp, Homo sapiens
aaacatcatagagtg

SEQ ID NO: 123729 - DNA, 15 bp, Homo sapiens
acaaacatcatagag

SEQ ID NO: 123730 - DNA, 15 bp, Homo sapiens
tacaaacatcataga

SEQ ID NO: 123731 - DNA, 15 bp, Homo sapiens
atacaaacatcatag

SEQ ID NO: 123732 - DNA, 15 bp, Homo sapiens
catacaaacatcata

SEQ ID NO: 123733 - DNA, 15 bp, Homo sapiens
tcatacaaacatcat

SEQ ID NO: 123734 - DNA, 15 bp, Homo sapiens
gtcatacaaacatca

SEQ ID NO: 123735 - DNA, 15 bp, Homo sapiens
tgtcatacaaacatc

SEQ ID NO: 123736 - DNA, 15 bp, Homo sapiens
ttgtcatacaaacat

SEQ ID NO: 123737 - DNA, 15 bp, Homo sapiens
attgtcatacaaaca

SEQ ID NO: 123738 - DNA, 15 bp, Homo sapiens
cattgtcatacaaac

SEQ ID NO: 123739 - DNA, 15 bp, Homo sapiens
tcattgtcatacaaa

SEQ ID NO: 123740 - DNA, 15 bp, Homo sapiens
ttcattgtcatacaa

SEQ ID NO: 123741 - DNA, 15 bp, Homo sapiens
tttcattgtcataca

SEQ ID NO: 123742 - DNA, 15 bp, Homo sapiens
atttcattgtcatac

SEQ ID NO: 123743 - DNA, 15 bp, Homo sapiens
tatttcattgtcata

SEQ ID NO: 123744 - DNA, 15 bp, Homo sapiens
ttatttcattgtcat

SEQ ID NO: 123745 - DNA, 15 bp, Homo sapiens
gttatttcattgtca

SEQ ID NO: 123746 - DNA, 15 bp, Homo sapiens
ggttatttcattgtc

SEQ ID NO: 123747 - DNA, 15 bp, Homo sapiens
aggttatttcattgt

SEQ ID NO: 123748 - DNA, 15 bp, Homo sapiens
taggttatttcattg

SEQ ID NO: 123749 - DNA, 15 bp, Homo sapiens
ctaggttatttcatt

SEQ ID NO: 123750 - DNA, 15 bp, Homo sapiens
tctaggttatttcat

SEQ ID NO: 123751 - DNA, 15 bp, Homo sapiens
ctctaggttatttca

SEQ ID NO: 123752 - DNA, 15 bp, Homo sapiens
tctctaggttatttc

SEQ ID NO: 123753 - DNA, 15 bp, Homo sapiens
gtctctaggttattt

SEQ ID NO: 123754 - DNA, 15 bp, Homo sapiens
tgtctctaggttatt

SEQ ID NO: 123755 - DNA, 15 bp, Homo sapiens
gtgtctctaggttat

SEQ ID NO: 123756 - DNA, 15 bp, Homo sapiens
tgtgtctctaggtta

SEQ ID NO: 123757 - DNA, 15 bp, Homo sapiens
atgtgtctctaggtt

SEQ ID NO: 123758 - DNA, 15 bp, Homo sapiens
aatgtgtctctaggt

SEQ ID NO: 123759 - DNA, 15 bp, Homo sapiens
aaatgtgtctctagg

SEQ ID NO: 123760 - DNA, 15 bp, Homo sapiens
gaaatgtgtctctag

SEQ ID NO: 123761 - DNA, 15 bp, Homo sapiens
agaaatgtgtctcta

SEQ ID NO: 123762 - DNA, 15 bp, Homo sapiens
gagaaatgtgtctct

SEQ ID NO: 123763 - DNA, 15 bp, Homo sapiens
tgagaaatgtgtctc

SEQ ID NO: 123764 - DNA, 15 bp, Homo sapiens
ctgagaaatgtgtct

SEQ ID NO: 123765 - DNA, 15 bp, Homo sapiens
tctgagaaatgtgtc

SEQ ID NO: 123766 - DNA, 15 bp, Homo sapiens
ttctgagaaatgtgt

SEQ ID NO: 123767 - DNA, 15 bp, Homo sapiens
gttctgagaaatgtg

SEQ ID NO: 123768 - DNA, 15 bp, Homo sapiens
tgttctgagaaatgt

SEQ ID NO: 123769 - DNA, 15 bp, Homo sapiens
atgttctgagaaatg

SEQ ID NO: 123770 - DNA, 15 bp, Homo sapiens
catgttctgagaaat

SEQ ID NO: 123771 - DNA, 15 bp, Homo sapiens
acatgttctgagaaa

SEQ ID NO: 123772 - DNA, 15 bp, Homo sapiens
gacatgttctgagaa

SEQ ID NO: 123773 - DNA, 15 bp, Homo sapiens
ggacatgttctgaga

SEQ ID NO: 123774 - DNA, 15 bp, Homo sapiens
gggacatgttctgag

SEQ ID NO: 123775 - DNA, 15 bp, Homo sapiens
agggacatgttctga

SEQ ID NO: 123776 - DNA, 15 bp, Homo sapiens
cagggacatgttctg

SEQ ID NO: 123777 - DNA, 15 bp, Homo sapiens
acagggacatgttct

SEQ ID NO: 123778 - DNA, 15 bp, Homo sapiens
aacagggacatgttc

SEQ ID NO: 123779 - DNA, 15 bp, Homo sapiens
taacagggacatgtt

SEQ ID NO: 123780 - DNA, 15 bp, Homo sapiens
ataacagggacatgt

SEQ ID NO: 123781 - DNA, 15 bp, Homo sapiens
aataacagggacatg

SEQ ID NO: 123782 - DNA, 15 bp, Homo sapiens
taataacagggacat

SEQ ID NO: 123783 - DNA, 15 bp, Homo sapiens
ttaataacagggaca

SEQ ID NO: 123784 - DNA, 15 bp, Homo sapiens
cttaataacagggac

SEQ ID NO: 123785 - DNA, 15 bp, Homo sapiens
gcttaataacaggga

SEQ ID NO: 123786 - DNA, 15 bp, Homo sapiens
tgcttaataacaggg

SEQ ID NO: 123787 - DNA, 15 bp, Homo sapiens
ttgcttaataacagg

SEQ ID NO: 123788 - DNA, 15 bp, Homo sapiens
attgcttaataacag

SEQ ID NO: 123789 - DNA, 15 bp, Homo sapiens
cattgcttaataaca

SEQ ID NO: 123790 - DNA, 15 bp, Homo sapiens
gcattgcttaataac

SEQ ID NO: 123791 - DNA, 15 bp, Homo sapiens
tgcattgcttaataa

SEQ ID NO: 123792 - DNA, 15 bp, Homo sapiens
atgcattgcttaata

SEQ ID NO: 123793 - DNA, 15 bp, Homo sapiens
catgcattgcttaat

SEQ ID NO: 123794 - DNA, 15 bp, Homo sapiens
tcatgcattgcttaa

SEQ ID NO: 123795 - DNA, 15 bp, Homo sapiens
gtcatgcattgctta

SEQ ID NO: 123796 - DNA, 15 bp, Homo sapiens
agtcatgcattgctt

SEQ ID NO: 123797 - DNA, 15 bp, Homo sapiens
tagtcatgcattgct

SEQ ID NO: 123798 - DNA, 15 bp, Homo sapiens
atagtcatgcattgc

SEQ ID NO: 123799 - DNA, 15 bp, Homo sapiens
tatagtcatgcattg

SEQ ID NO: 123800 - DNA, 15 bp, Homo sapiens
gtatagtcatgcatt

SEQ ID NO: 123801 - DNA, 15 bp, Homo sapiens
agtatagtcatgcat

SEQ ID NO: 123802 - DNA, 15 bp, Homo sapiens
aagtatagtcatgca

SEQ ID NO: 123803 - DNA, 15 bp, Homo sapiens
aaagtatagtcatgc

SEQ ID NO: 123804 - DNA, 15 bp, Homo sapiens
taaagtatagtcatg

SEQ ID NO: 123805 - DNA, 15 bp, Homo sapiens
ttaaagtatagtcat

SEQ ID NO: 123806 - DNA, 15 bp, Homo sapiens
tttaaagtatagtca

SEQ ID NO: 123807 - DNA, 15 bp, Homo sapiens
ttttaaagtatagtc

SEQ ID NO: 123808 - DNA, 15 bp, Homo sapiens
tttttaaagtatagt

SEQ ID NO: 123809 - DNA, 15 bp, Homo sapiens
gtttttaaagtatag

SEQ ID NO: 123810 - DNA, 15 bp, Homo sapiens
agtttttaaagtata

SEQ ID NO: 123811 - DNA, 15 bp, Homo sapiens
tagtttttaaagtat

SEQ ID NO: 123812 - DNA, 15 bp, Homo sapiens
ctagtttttaaagta

SEQ ID NO: 123813 - DNA, 15 bp, Homo sapiens
gctagtttttaaagt

SEQ ID NO: 123814 - DNA, 15 bp, Homo sapiens
ggctagtttttaaag

SEQ ID NO: 123815 - DNA, 15 bp, Homo sapiens
tggctagtttttaaa

SEQ ID NO: 123816 - DNA, 15 bp, Homo sapiens
atggctagtttttaa

SEQ ID NO: 123817 - DNA, 15 bp, Homo sapiens
aatggctagttttta

SEQ ID NO: 123818 - DNA, 15 bp, Homo sapiens
gaatggctagttttt

SEQ ID NO: 123819 - DNA, 15 bp, Homo sapiens
agaatggctagtttt

SEQ ID NO: 123820 - DNA, 15 bp, Homo sapiens
gagaatggctagttt

SEQ ID NO: 123821 - DNA, 15 bp, Homo sapiens
agagaatggctagtt

SEQ ID NO: 123822 - DNA, 15 bp, Homo sapiens
gagagaatggctagt

SEQ ID NO: 123823 - DNA, 15 bp, Homo sapiens
tgagagaatggctag

SEQ ID NO: 123824 - DNA, 15 bp, Homo sapiens
ttgagagaatggcta

SEQ ID NO: 123825 - DNA, 15 bp, Homo sapiens
cttgagagaatggct

SEQ ID NO: 123826 - DNA, 15 bp, Homo sapiens
ccttgagagaatggc

SEQ ID NO: 123827 - DNA, 15 bp, Homo sapiens
gccttgagagaatgg

SEQ ID NO: 123828 - DNA, 15 bp, Homo sapiens
agccttgagagaatg

SEQ ID NO: 123829 - DNA, 15 bp, Homo sapiens
cagccttgagagaat

SEQ ID NO: 123830 - DNA, 15 bp, Homo sapiens
tcagccttgagagaa

SEQ ID NO: 123831 - DNA, 15 bp, Homo sapiens
ttcagccttgagaga

SEQ ID NO: 123832 - DNA, 15 bp, Homo sapiens
cttcagccttgagag

SEQ ID NO: 123833 - DNA, 15 bp, Homo sapiens
gcttcagccttgaga

SEQ ID NO: 123834 - DNA, 15 bp, Homo sapiens
ggcttcagccttgag

SEQ ID NO: 123835 - DNA, 15 bp, Homo sapiens
aggcttcagccttga

SEQ ID NO: 123836 - DNA, 15 bp, Homo sapiens
gaggcttcagccttg

SEQ ID NO: 123837 - DNA, 15 bp, Homo sapiens
tgaggcttcagcctt

SEQ ID NO: 123838 - DNA, 15 bp, Homo sapiens
ttgaggcttcagcct

SEQ ID NO: 123839 - DNA, 15 bp, Homo sapiens
gttgaggcttcagcc

SEQ ID NO: 123840 - DNA, 15 bp, Homo sapiens
tgttgaggcttcagc

SEQ ID NO: 123841 - DNA, 15 bp, Homo sapiens
atgttgaggcttcag

SEQ ID NO: 123842 - DNA, 15 bp, Homo sapiens
gatgttgaggcttca

SEQ ID NO: 123843 - DNA, 15 bp, Homo sapiens
ggatgttgaggcttc

SEQ ID NO: 123844 - DNA, 15 bp, Homo sapiens
aggatgttgaggctt

SEQ ID NO: 123845 - DNA, 15 bp, Homo sapiens
aaggatgttgaggct

SEQ ID NO: 123846 - DNA, 15 bp, Homo sapiens
gaaggatgttgaggc

SEQ ID NO: 123847 - DNA, 15 bp, Homo sapiens
agaaggatgttgagg

SEQ ID NO: 123848 - DNA, 15 bp, Homo sapiens
aagaaggatgttgag

SEQ ID NO: 123849 - DNA, 15 bp, Homo sapiens
taagaaggatgttga

SEQ ID NO: 123850 - DNA, 15 bp, Homo sapiens
ttaagaaggatgttg

SEQ ID NO: 123851 - DNA, 15 bp, Homo sapiens
gttaagaaggatgtt

SEQ ID NO: 123852 - DNA, 15 bp, Homo sapiens
agttaagaaggatgt

SEQ ID NO: 123853 - DNA, 15 bp, Homo sapiens
tagttaagaaggatg

SEQ ID NO: 123854 - DNA, 15 bp, Homo sapiens
atagttaagaaggat

SEQ ID NO: 123855 - DNA, 15 bp, Homo sapiens
aatagttaagaagga

SEQ ID NO: 123856 - DNA, 15 bp, Homo sapiens
aaatagttaagaagg

SEQ ID NO: 123857 - DNA, 15 bp, Homo sapiens
gaaatagttaagaag

SEQ ID NO: 123858 - DNA, 15 bp, Homo sapiens
agaaatagttaagaa

SEQ ID NO: 123859 - DNA, 15 bp, Homo sapiens
aagaaatagttaaga

SEQ ID NO: 123860 - DNA, 15 bp, Homo sapiens
caagaaatagttaag

SEQ ID NO: 123861 - DNA, 15 bp, Homo sapiens
acaagaaatagttaa

SEQ ID NO: 123862 - DNA, 15 bp, Homo sapiens
aacaagaaatagtta

SEQ ID NO: 123863 - DNA, 15 bp, Homo sapiens
gaacaagaaatagtt

SEQ ID NO: 123864 - DNA, 15 bp, Homo sapiens
ggaacaagaaatagt

SEQ ID NO: 123865 - DNA, 15 bp, Homo sapiens
aggaacaagaaatag

SEQ ID NO: 123866 - DNA, 15 bp, Homo sapiens
gaggaacaagaaata

SEQ ID NO: 123867 - DNA, 15 bp, Homo sapiens
tgaggaacaagaaat

SEQ ID NO: 123868 - DNA, 15 bp, Homo sapiens
gtgaggaacaagaaa

SEQ ID NO: 123869 - DNA, 15 bp, Homo sapiens
tgtgaggaacaagaa

SEQ ID NO: 123870 - DNA, 15 bp, Homo sapiens
atgtgaggaacaaga

SEQ ID NO: 123871 - DNA, 15 bp, Homo sapiens
tatgtgaggaacaag

SEQ ID NO: 123872 - DNA, 15 bp, Homo sapiens
atatgtgaggaacaa

SEQ ID NO: 123873 - DNA, 15 bp, Homo sapiens
gatatgtgaggaaca

SEQ ID NO: 123874 - DNA, 15 bp, Homo sapiens
agatatgtgaggaac

SEQ ID NO: 123875 - DNA, 15 bp, Homo sapiens
aagatatgtgaggaa

SEQ ID NO: 123876 - DNA, 15 bp, Homo sapiens
gaagatatgtgagga

SEQ ID NO: 123877 - DNA, 15 bp, Homo sapiens
agaagatatgtgagg

SEQ ID NO: 123878 - DNA, 15 bp, Homo sapiens
gagaagatatgtgag

SEQ ID NO: 123879 - DNA, 15 bp, Homo sapiens
tgagaagatatgtga

SEQ ID NO: 123880 - DNA, 15 bp, Homo sapiens
gtgagaagatatgtg

SEQ ID NO: 123881 - DNA, 15 bp, Homo sapiens
tgtgagaagatatgt

SEQ ID NO: 123882 - DNA, 15 bp, Homo sapiens
atgtgagaagatatg

SEQ ID NO: 123883 - DNA, 15 bp, Homo sapiens
gatgtgagaagatat

SEQ ID NO: 123884 - DNA, 15 bp, Homo sapiens
tgatgtgagaagata

SEQ ID NO: 123885 - DNA, 15 bp, Homo sapiens
gtgatgtgagaagat

SEQ ID NO: 123886 - DNA, 15 bp, Homo sapiens
tgtgatgtgagaaga

SEQ ID NO: 123887 - DNA, 15 bp, Homo sapiens
gtgtgatgtgagaag

SEQ ID NO: 123888 - DNA, 15 bp, Homo sapiens
agtgtgatgtgagaa

SEQ ID NO: 123889 - DNA, 15 bp, Homo sapiens
cagtgtgatgtgaga

SEQ ID NO: 123890 - DNA, 15 bp, Homo sapiens
tcagtgtgatgtgag

SEQ ID NO: 123891 - DNA, 15 bp, Homo sapiens
ctcagtgtgatgtga

SEQ ID NO: 123892 - DNA, 15 bp, Homo sapiens
actcagtgtgatgtg

SEQ ID NO: 123893 - DNA, 15 bp, Homo sapiens
tactcagtgtgatgt

SEQ ID NO: 123894 - DNA, 15 bp, Homo sapiens
ctactcagtgtgatg

SEQ ID NO: 123895 - DNA, 15 bp, Homo sapiens
cctactcagtgtgat

SEQ ID NO: 123896 - DNA, 15 bp, Homo sapiens
gcctactcagtgtga

SEQ ID NO: 123897 - DNA, 15 bp, Homo sapiens
tgcctactcagtgtg

SEQ ID NO: 123898 - DNA, 15 bp, Homo sapiens
atgcctactcagtgt

SEQ ID NO: 123899 - DNA, 15 bp, Homo sapiens
aatgcctactcagtg

SEQ ID NO: 123900 - DNA, 15 bp, Homo sapiens
taatgcctactcagt

SEQ ID NO: 123901 - DNA, 15 bp, Homo sapiens
ttaatgcctactcag

SEQ ID NO: 123902 - DNA, 15 bp, Homo sapiens
tttaatgcctactca

SEQ ID NO: 123903 - DNA, 15 bp, Homo sapiens
ttttaatgcctactc

SEQ ID NO: 123904 - DNA, 15 bp, Homo sapiens
gttttaatgcctact

SEQ ID NO: 123905 - DNA, 15 bp, Homo sapiens
agttttaatgcctac

SEQ ID NO: 123906 - DNA, 15 bp, Homo sapiens
cagttttaatgccta

SEQ ID NO: 123907 - DNA, 15 bp, Homo sapiens
acagttttaatgcct

SEQ ID NO: 123908 - DNA, 15 bp, Homo sapiens
aacagttttaatgcc

SEQ ID NO: 123909 - DNA, 15 bp, Homo sapiens
caacagttttaatgc

SEQ ID NO: 123910 - DNA, 15 bp, Homo sapiens
tcaacagttttaatg

SEQ ID NO: 123911 - DNA, 15 bp, Homo sapiens
ctcaacagttttaat

SEQ ID NO: 123912 - DNA, 15 bp, Homo sapiens
tctcaacagttttaa

SEQ ID NO: 123913 - DNA, 15 bp, Homo sapiens
gtctcaacagtttta

SEQ ID NO: 123914 - DNA, 15 bp, Homo sapiens
agtctcaacagtttt

SEQ ID NO: 123915 - DNA, 15 bp, Homo sapiens
cagtctcaacagttt

SEQ ID NO: 123916 - DNA, 15 bp, Homo sapiens
gcagtctcaacagtt

SEQ ID NO: 123917 - DNA, 15 bp, Homo sapiens
agcagtctcaacagt

SEQ ID NO: 123918 - DNA, 15 bp, Homo sapiens
aagcagtctcaacag

SEQ ID NO: 123919 - DNA, 15 bp, Homo sapiens
caagcagtctcaaca

SEQ ID NO: 123920 - DNA, 15 bp, Homo sapiens
tcaagcagtctcaac

SEQ ID NO: 123921 - DNA, 15 bp, Homo sapiens
ttcaagcagtctcaa

SEQ ID NO: 123922 - DNA, 15 bp, Homo sapiens
cttcaagcagtctca

SEQ ID NO: 123923 - DNA, 15 bp, Homo sapiens
gcttcaagcagtctc

SEQ ID NO: 123924 - DNA, 15 bp, Homo sapiens
tgcttcaagcagtct

SEQ ID NO: 123925 - DNA, 15 bp, Homo sapiens
ttgcttcaagcagtc

SEQ ID NO: 123926 - DNA, 15 bp, Homo sapiens
gttgcttcaagcagt

SEQ ID NO: 123927 - DNA, 15 bp, Homo sapiens
tgttgcttcaagcag

SEQ ID NO: 123928 - DNA, 15 bp, Homo sapiens
atgttgcttcaagca

SEQ ID NO: 123929 - DNA, 15 bp, Homo sapiens
tatgttgcttcaagc

SEQ ID NO: 123930 - DNA, 15 bp, Homo sapiens
gtatgttgcttcaag

SEQ ID NO: 123931 - DNA, 15 bp, Homo sapiens
tgtatgttgcttcaa

SEQ ID NO: 123932 - DNA, 15 bp, Homo sapiens
ctgtatgttgcttca

SEQ ID NO: 123933 - DNA, 15 bp, Homo sapiens
cctgtatgttgcttc

SEQ ID NO: 123934 - DNA, 15 bp, Homo sapiens
acctgtatgttgctt

SEQ ID NO: 123935 - DNA, 15 bp, Homo sapiens
aacctgtatgttgct

SEQ ID NO: 123936 - DNA, 15 bp, Homo sapiens
aaacctgtatgttgc

SEQ ID NO: 123937 - DNA, 15 bp, Homo sapiens
caaacctgtatgttg

SEQ ID NO: 123938 - DNA, 15 bp, Homo sapiens
tcaaacctgtatgtt

SEQ ID NO: 123939 - DNA, 15 bp, Homo sapiens
ttcaaacctgtatgt

SEQ ID NO: 123940 - DNA, 15 bp, Homo sapiens
gttcaaacctgtatg

SEQ ID NO: 123941 - DNA, 15 bp, Homo sapiens
cgttcaaacctgtat

SEQ ID NO: 123942 - DNA, 15 bp, Homo sapiens
acgttcaaacctgta

SEQ ID NO: 123943 - DNA, 15 bp, Homo sapiens
cacgttcaaacctgt

SEQ ID NO: 123944 - DNA, 15 bp, Homo sapiens
tcacgttcaaacctg

SEQ ID NO: 123945 - DNA, 15 bp, Homo sapiens
ttcacgttcaaacct

SEQ ID NO: 123946 - DNA, 15 bp, Homo sapiens
cttcacgttcaaacc

SEQ ID NO: 123947 - DNA, 15 bp, Homo sapiens
acttcacgttcaaac

SEQ ID NO: 123948 - DNA, 15 bp, Homo sapiens
aacttcacgttcaaa

SEQ ID NO: 123949 - DNA, 15 bp, Homo sapiens
taacttcacgttcaa

SEQ ID NO: 123950 - DNA, 15 bp, Homo sapiens
ctaacttcacgttca

SEQ ID NO: 123951 - DNA, 15 bp, Homo sapiens
tctaacttcacgttc

SEQ ID NO: 123952 - DNA, 15 bp, Homo sapiens
atctaacttcacgtt

SEQ ID NO: 123953 - DNA, 15 bp, Homo sapiens
tatctaacttcacgt

SEQ ID NO: 123954 - DNA, 15 bp, Homo sapiens
atatctaacttcacg

SEQ ID NO: 123955 - DNA, 15 bp, Homo sapiens
aatatctaacttcac

SEQ ID NO: 123956 - DNA, 15 bp, Homo sapiens
caatatctaacttca

SEQ ID NO: 123957 - DNA, 15 bp, Homo sapiens
gcaatatctaacttc

SEQ ID NO: 123958 - DNA, 15 bp, Homo sapiens
agcaatatctaactt

SEQ ID NO: 123959 - DNA, 15 bp, Homo sapiens
gagcaatatctaact

SEQ ID NO: 123960 - DNA, 15 bp, Homo sapiens
agagcaatatctaac

SEQ ID NO: 123961 - DNA, 15 bp, Homo sapiens
tagagcaatatctaa

SEQ ID NO: 123962 - DNA, 15 bp, Homo sapiens
gtagagcaatatcta

SEQ ID NO: 123963 - DNA, 15 bp, Homo sapiens
ggtagagcaatatct

SEQ ID NO: 123964 - DNA, 15 bp, Homo sapiens
tggtagagcaatatc

SEQ ID NO: 123965 - DNA, 15 bp, Homo sapiens
ctggtagagcaatat

SEQ ID NO: 123966 - DNA, 15 bp, Homo sapiens
gctggtagagcaata

SEQ ID NO: 123967 - DNA, 15 bp, Homo sapiens
agctggtagagcaat

SEQ ID NO: 123968 - DNA, 15 bp, Homo sapiens
cagctggtagagcaa

SEQ ID NO: 123969 - DNA, 15 bp, Homo sapiens
gcagctggtagagca

SEQ ID NO: 123970 - DNA, 15 bp, Homo sapiens
agcagctggtagagc

SEQ ID NO: 123971 - DNA, 15 bp, Homo sapiens
aagcagctggtagag

SEQ ID NO: 123972 - DNA, 15 bp, Homo sapiens
caagcagctggtaga

SEQ ID NO: 123973 - DNA, 15 bp, Homo sapiens
acaagcagctggtag

SEQ ID NO: 123974 - DNA, 15 bp, Homo sapiens
aacaagcagctggta

SEQ ID NO: 123975 - DNA, 15 bp, Homo sapiens
aaacaagcagctggt

SEQ ID NO: 123976 - DNA, 15 bp, Homo sapiens
aaaacaagcagctgg

SEQ ID NO: 123977 - DNA, 15 bp, Homo sapiens
taaaacaagcagctg

SEQ ID NO: 123978 - DNA, 15 bp, Homo sapiens
ataaaacaagcagct

SEQ ID NO: 123979 - DNA, 15 bp, Homo sapiens
cataaaacaagcagc

SEQ ID NO: 123980 - DNA, 15 bp, Homo sapiens
tcataaaacaagcag

SEQ ID NO: 123981 - DNA, 15 bp, Homo sapiens
gtcataaaacaagca

SEQ ID NO: 123982 - DNA, 15 bp, Homo sapiens
ggtcataaaacaagc

SEQ ID NO: 123983 - DNA, 15 bp, Homo sapiens
tggtcataaaacaag

SEQ ID NO: 123984 - DNA, 15 bp, Homo sapiens
atggtcataaaacaa

SEQ ID NO: 123985 - DNA, 15 bp, Homo sapiens
gatggtcataaaaca

SEQ ID NO: 123986 - DNA, 15 bp, Homo sapiens
tgatggtcataaaac

SEQ ID NO: 123987 - DNA, 15 bp, Homo sapiens
ctgatggtcataaaa

SEQ ID NO: 123988 - DNA, 15 bp, Homo sapiens
tctgatggtcataaa

SEQ ID NO: 123989 - DNA, 15 bp, Homo sapiens
ttctgatggtcataa

SEQ ID NO: 123990 - DNA, 15 bp, Homo sapiens
tttctgatggtcata

SEQ ID NO: 123991 - DNA, 15 bp, Homo sapiens
ctttctgatggtcat

SEQ ID NO: 123992 - DNA, 15 bp, Homo sapiens
actttctgatggtca

SEQ ID NO: 123993 - DNA, 15 bp, Homo sapiens
cactttctgatggtc

SEQ ID NO: 123994 - DNA, 15 bp, Homo sapiens
gcactttctgatggt

SEQ ID NO: 123995 - DNA, 15 bp, Homo sapiens
ggcactttctgatgg

SEQ ID NO: 123996 - DNA, 15 bp, Homo sapiens
aggcactttctgatg

SEQ ID NO: 123997 - DNA, 15 bp, Homo sapiens
aaggcactttctgat

SEQ ID NO: 123998 - DNA, 15 bp, Homo sapiens
taaggcactttctga

SEQ ID NO: 123999 - DNA, 15 bp, Homo sapiens
ctaaggcactttctg

SEQ ID NO: 124000 - DNA, 15 bp, Homo sapiens
gctaaggcactttct

SEQ ID NO: 124001 - DNA, 15 bp, Homo sapiens
agctaaggcactttc

SEQ ID NO: 124002 - DNA, 15 bp, Homo sapiens
aagctaaggcacttt

SEQ ID NO: 124003 - DNA, 15 bp, Homo sapiens
taagctaaggcactt

SEQ ID NO: 124004 - DNA, 15 bp, Homo sapiens
ataagctaaggcact

SEQ ID NO: 124005 - DNA, 15 bp, Homo sapiens
aataagctaaggcac

SEQ ID NO: 124006 - DNA, 15 bp, Homo sapiens
aaataagctaaggca

SEQ ID NO: 124007 - DNA, 15 bp, Homo sapiens
aaaataagctaaggc

SEQ ID NO: 124008 - DNA, 15 bp, Homo sapiens
taaaataagctaagg

SEQ ID NO: 124009 - DNA, 15 bp, Homo sapiens
gtaaaataagctaag

SEQ ID NO: 124010 - DNA, 15 bp, Homo sapiens
agtaaaataagctaa

SEQ ID NO: 124011 - DNA, 15 bp, Homo sapiens
aagtaaaataagcta

SEQ ID NO: 124012 - DNA, 15 bp, Homo sapiens
gaagtaaaataagct

SEQ ID NO: 124013 - DNA, 15 bp, Homo sapiens
tgaagtaaaataagc

SEQ ID NO: 124014 - DNA, 15 bp, Homo sapiens
gtgaagtaaaataag

SEQ ID NO: 124015 - DNA, 15 bp, Homo sapiens
agtgaagtaaaataa

SEQ ID NO: 124016 - DNA, 15 bp, Homo sapiens
tagtgaagtaaaata

SEQ ID NO: 124017 - DNA, 15 bp, Homo sapiens
atagtgaagtaaaat

SEQ ID NO: 124018 - DNA, 15 bp, Homo sapiens
gatagtgaagtaaaa

SEQ ID NO: 124019 - DNA, 15 bp, Homo sapiens
ggatagtgaagtaaa

SEQ ID NO: 124020 - DNA, 15 bp, Homo sapiens
aggatagtgaagtaa

SEQ ID NO: 124021 - DNA, 15 bp, Homo sapiens
aaggatagtgaagta

SEQ ID NO: 124022 - DNA, 15 bp, Homo sapiens
aaaggatagtgaagt

SEQ ID NO: 124023 - DNA, 15 bp, Homo sapiens
gaaaggatagtgaag

SEQ ID NO: 124024 - DNA, 15 bp, Homo sapiens
ggaaaggatagtgaa

SEQ ID NO: 124025 - DNA, 15 bp, Homo sapiens
tggaaaggatagtga

SEQ ID NO: 124026 - DNA, 15 bp, Homo sapiens
atggaaaggatagtg

SEQ ID NO: 124027 - DNA, 15 bp, Homo sapiens
tatggaaaggatagt

SEQ ID NO: 124028 - DNA, 15 bp, Homo sapiens
ttatggaaaggatag

SEQ ID NO: 124029 - DNA, 15 bp, Homo sapiens
attatggaaaggata

SEQ ID NO: 124030 - DNA, 15 bp, Homo sapiens
aattatggaaaggat

SEQ ID NO: 124031 - DNA, 15 bp, Homo sapiens
aaattatggaaagga

SEQ ID NO: 124032 - DNA, 15 bp, Homo sapiens
taaattatggaaagg

SEQ ID NO: 124033 - DNA, 15 bp, Homo sapiens
ctaaattatggaaag

SEQ ID NO: 124034 - DNA, 15 bp, Homo sapiens
tctaaattatggaaa

SEQ ID NO: 124035 - DNA, 15 bp, Homo sapiens
gtctaaattatggaa

SEQ ID NO: 124036 - DNA, 15 bp, Homo sapiens
agtctaaattatgga

SEQ ID NO: 124037 - DNA, 15 bp, Homo sapiens
tagtctaaattatgg

SEQ ID NO: 124038 - DNA, 15 bp, Homo sapiens
ttagtctaaattatg

SEQ ID NO: 124039 - DNA, 15 bp, Homo sapiens
attagtctaaattat

SEQ ID NO: 124040 - DNA, 15 bp, Homo sapiens
cattagtctaaatta

SEQ ID NO: 124041 - DNA, 15 bp, Homo sapiens
tcattagtctaaatt

SEQ ID NO: 124042 - DNA, 15 bp, Homo sapiens
atcattagtctaaat

SEQ ID NO: 124043 - DNA, 15 bp, Homo sapiens
aatcattagtctaaa

SEQ ID NO: 124044 - DNA, 15 bp, Homo sapiens
aaatcattagtctaa

SEQ ID NO: 124045 - DNA, 15 bp, Homo sapiens
aaaatcattagtcta

SEQ ID NO: 124046 - DNA, 15 bp, Homo sapiens
gaaaatcattagtct

SEQ ID NO: 124047 - DNA, 15 bp, Homo sapiens
agaaaatcattagtc

SEQ ID NO: 124048 - DNA, 15 bp, Homo sapiens
gagaaaatcattagt

SEQ ID NO: 124049 - DNA, 15 bp, Homo sapiens
ggagaaaatcattag

SEQ ID NO: 124050 - DNA, 15 bp, Homo sapiens
gggagaaaatcatta

SEQ ID NO: 124051 - DNA, 15 bp, Homo sapiens
tgggagaaaatcatt

SEQ ID NO: 124052 - DNA, 15 bp, Homo sapiens
atgggagaaaatcat

SEQ ID NO: 124053 - DNA, 15 bp, Homo sapiens
catgggagaaaatca

SEQ ID NO: 124054 - DNA, 15 bp, Homo sapiens
tcatgggagaaaatc

SEQ ID NO: 124055 - DNA, 15 bp, Homo sapiens
atcatgggagaaaat

SEQ ID NO: 124056 - DNA, 15 bp, Homo sapiens
tatcatgggagaaaa

SEQ ID NO: 124057 - DNA, 15 bp, Homo sapiens
atatcatgggagaaa

SEQ ID NO: 124058 - DNA, 15 bp, Homo sapiens
aatatcatgggagaa

SEQ ID NO: 124059 - DNA, 15 bp, Homo sapiens
taatatcatgggaga

SEQ ID NO: 124060 - DNA, 15 bp, Homo sapiens
ataatatcatgggag

SEQ ID NO: 124061 - DNA, 15 bp, Homo sapiens
tataatatcatggga

SEQ ID NO: 124062 - DNA, 15 bp, Homo sapiens
atataatatcatggg

SEQ ID NO: 124063 - DNA, 15 bp, Homo sapiens
gatataatatcatgg

SEQ ID NO: 124064 - DNA, 15 bp, Homo sapiens
ggatataatatcatg

SEQ ID NO: 124065 - DNA, 15 bp, Homo sapiens
gggatataatatcat

SEQ ID NO: 124066 - DNA, 15 bp, Homo sapiens
tgggatataatatca

SEQ ID NO: 124067 - DNA, 15 bp, Homo sapiens
atgggatataatatc

SEQ ID NO: 124068 - DNA, 15 bp, Homo sapiens
catgggatataatat

SEQ ID NO: 124069 - DNA, 15 bp, Homo sapiens
ccatgggatataata

SEQ ID NO: 124070 - DNA, 15 bp, Homo sapiens
tccatgggatataat

SEQ ID NO: 124071 - DNA, 15 bp, Homo sapiens
gtccatgggatataa

SEQ ID NO: 124072 - DNA, 15 bp, Homo sapiens
tgtccatgggatata

SEQ ID NO: 124073 - DNA, 15 bp, Homo sapiens
atgtccatgggatat

SEQ ID NO: 124074 - DNA, 15 bp, Homo sapiens
tatgtccatgggata

SEQ ID NO: 124075 - DNA, 15 bp, Homo sapiens
atatgtccatgggat

SEQ ID NO: 124076 - DNA, 15 bp, Homo sapiens
aatatgtccatggga

SEQ ID NO: 124077 - DNA, 15 bp, Homo sapiens
gaatatgtccatggg

SEQ ID NO: 124078 - DNA, 15 bp, Homo sapiens
agaatatgtccatgg

SEQ ID NO: 124079 - DNA, 15 bp, Homo sapiens
aagaatatgtccatg

SEQ ID NO: 124080 - DNA, 15 bp, Homo sapiens
taagaatatgtccat

SEQ ID NO: 124081 - DNA, 15 bp, Homo sapiens
ataagaatatgtcca

SEQ ID NO: 124082 - DNA, 15 bp, Homo sapiens
cataagaatatgtcc

SEQ ID NO: 124083 - DNA, 15 bp, Homo sapiens
acataagaatatgtc

SEQ ID NO: 124084 - DNA, 15 bp, Homo sapiens
gacataagaatatgt

SEQ ID NO: 124085 - DNA, 15 bp, Homo sapiens
agacataagaatatg

SEQ ID NO: 124086 - DNA, 15 bp, Homo sapiens
cagacataagaatat

SEQ ID NO: 124087 - DNA, 15 bp, Homo sapiens
acagacataagaata

SEQ ID NO: 124088 - DNA, 15 bp, Homo sapiens
aacagacataagaat

SEQ ID NO: 124089 - DNA, 15 bp, Homo sapiens
aaacagacataagaa

SEQ ID NO: 124090 - DNA, 15 bp, Homo sapiens
aaaacagacataaga

SEQ ID NO: 124091 - DNA, 15 bp, Homo sapiens
aaaaacagacataag

SEQ ID NO: 124092 - DNA, 15 bp, Homo sapiens
aaaaaacagacataa

SEQ ID NO: 124093 - DNA, 15 bp, Homo sapiens
gaaaaaacagacata

SEQ ID NO: 124094 - DNA, 15 bp, Homo sapiens
agaaaaaacagacat

SEQ ID NO: 124095 - DNA, 15 bp, Homo sapiens
gagaaaaaacagaca

SEQ ID NO: 124096 - DNA, 15 bp, Homo sapiens
tgagaaaaaacagac

SEQ ID NO: 124097 - DNA, 15 bp, Homo sapiens
gtgagaaaaaacaga

SEQ ID NO: 124098 - DNA, 15 bp, Homo sapiens
agtgagaaaaaacag

SEQ ID NO: 124099 - DNA, 15 bp, Homo sapiens
gagtgagaaaaaaca

SEQ ID NO: 124100 - DNA, 15 bp, Homo sapiens
agagtgagaaaaaac

SEQ ID NO: 124101 - DNA, 15 bp, Homo sapiens
tagagtgagaaaaaa

SEQ ID NO: 124102 - DNA, 15 bp, Homo sapiens
ctagagtgagaaaaa

SEQ ID NO: 124103 - DNA, 15 bp, Homo sapiens
gctagagtgagaaaa

SEQ ID NO: 124104 - DNA, 15 bp, Homo sapiens
tgctagagtgagaaa

SEQ ID NO: 124105 - DNA, 15 bp, Homo sapiens
atgctagagtgagaa

SEQ ID NO: 124106 - DNA, 15 bp, Homo sapiens
catgctagagtgaga

SEQ ID NO: 124107 - DNA, 15 bp, Homo sapiens
acatgctagagtgag

SEQ ID NO: 124108 - DNA, 15 bp, Homo sapiens
gacatgctagagtga

SEQ ID NO: 124109 - DNA, 15 bp, Homo sapiens
ggacatgctagagtg

SEQ ID NO: 124110 - DNA, 15 bp, Homo sapiens
aggacatgctagagt

SEQ ID NO: 124111 - DNA, 15 bp, Homo sapiens
aaggacatgctagag

SEQ ID NO: 124112 - DNA, 15 bp, Homo sapiens
aaaggacatgctaga

SEQ ID NO: 124113 - DNA, 15 bp, Homo sapiens
caaaggacatgctag

SEQ ID NO: 124114 - DNA, 15 bp, Homo sapiens
acaaaggacatgcta

SEQ ID NO: 124115 - DNA, 15 bp, Homo sapiens
gacaaaggacatgct

SEQ ID NO: 124116 - DNA, 15 bp, Homo sapiens
agacaaaggacatgc

SEQ ID NO: 124117 - DNA, 15 bp, Homo sapiens
gagacaaaggacatg

SEQ ID NO: 124118 - DNA, 15 bp, Homo sapiens
agagacaaaggacat

SEQ ID NO: 124119 - DNA, 15 bp, Homo sapiens
aagagacaaaggaca

SEQ ID NO: 124120 - DNA, 15 bp, Homo sapiens
gaagagacaaaggac

SEQ ID NO: 124121 - DNA, 15 bp, Homo sapiens
ggaagagacaaagga

SEQ ID NO: 124122 - DNA, 15 bp, Homo sapiens
aggaagagacaaagg

SEQ ID NO: 124123 - DNA, 15 bp, Homo sapiens
gaggaagagacaaag

SEQ ID NO: 124124 - DNA, 15 bp, Homo sapiens
tgaggaagagacaaa

SEQ ID NO: 124125 - DNA, 15 bp, Homo sapiens
gtgaggaagagacaa

SEQ ID NO: 124126 - DNA, 15 bp, Homo sapiens
tgtgaggaagagaca

SEQ ID NO: 124127 - DNA, 15 bp, Homo sapiens
ctgtgaggaagagac

SEQ ID NO: 124128 - DNA, 15 bp, Homo sapiens
actgtgaggaagaga

SEQ ID NO: 124129 - DNA, 15 bp, Homo sapiens
aactgtgaggaagag

SEQ ID NO: 124130 - DNA, 15 bp, Homo sapiens
taactgtgaggaaga

SEQ ID NO: 124131 - DNA, 15 bp, Homo sapiens
ataactgtgaggaag

SEQ ID NO: 124132 - DNA, 15 bp, Homo sapiens
aataactgtgaggaa

SEQ ID NO: 124133 - DNA, 15 bp, Homo sapiens
gaataactgtgagga

SEQ ID NO: 124134 - DNA, 15 bp, Homo sapiens
agaataactgtgagg

SEQ ID NO: 124135 - DNA, 15 bp, Homo sapiens
gagaataactgtgag

SEQ ID NO: 124136 - DNA, 15 bp, Homo sapiens
ggagaataactgtga

SEQ ID NO: 124137 - DNA, 15 bp, Homo sapiens
gggagaataactgtg

SEQ ID NO: 124138 - DNA, 15 bp, Homo sapiens
ggggagaataactgt

SEQ ID NO: 124139 - DNA, 15 bp, Homo sapiens
tggggagaataactg

SEQ ID NO: 124140 - DNA, 15 bp, Homo sapiens
ttggggagaataact

SEQ ID NO: 124141 - DNA, 15 bp, Homo sapiens
tttggggagaataac

SEQ ID NO: 124142 - DNA, 15 bp, Homo sapiens
ctttggggagaataa

SEQ ID NO: 124143 - DNA, 15 bp, Homo sapiens
actttggggagaata

SEQ ID NO: 124144 - DNA, 15 bp, Homo sapiens
gactttggggagaat

SEQ ID NO: 124145 - DNA, 15 bp, Homo sapiens
tgactttggggagaa

SEQ ID NO: 124146 - DNA, 15 bp, Homo sapiens
atgactttggggaga

SEQ ID NO: 124147 - DNA, 15 bp, Homo sapiens
catgactttggggag

SEQ ID NO: 124148 - DNA, 15 bp, Homo sapiens
ccatgactttgggga

SEQ ID NO: 124149 - DNA, 15 bp, Homo sapiens
gccatgactttgggg

SEQ ID NO: 124150 - DNA, 15 bp, Homo sapiens
agccatgactttggg

SEQ ID NO: 124151 - DNA, 15 bp, Homo sapiens
cagccatgactttgg

SEQ ID NO: 124152 - DNA, 15 bp, Homo sapiens
tcagccatgactttg

SEQ ID NO: 124153 - DNA, 15 bp, Homo sapiens
atcagccatgacttt

SEQ ID NO: 124154 - DNA, 15 bp, Homo sapiens
gatcagccatgactt

SEQ ID NO: 124155 - DNA, 15 bp, Homo sapiens
tgatcagccatgact

SEQ ID NO: 124156 - DNA, 15 bp, Homo sapiens
atgatcagccatgac

SEQ ID NO: 124157 - DNA, 15 bp, Homo sapiens
catgatcagccatga

SEQ ID NO: 124158 - DNA, 15 bp, Homo sapiens
acatgatcagccatg

SEQ ID NO: 124159 - DNA, 15 bp, Homo sapiens
gacatgatcagccat

SEQ ID NO: 124160 - DNA, 15 bp, Homo sapiens
tgacatgatcagcca

SEQ ID NO: 124161 - DNA, 15 bp, Homo sapiens
atgacatgatcagcc

SEQ ID NO: 124162 - DNA, 15 bp, Homo sapiens
aatgacatgatcagc

SEQ ID NO: 124163 - DNA, 15 bp, Homo sapiens
gaatgacatgatcag

SEQ ID NO: 124164 - DNA, 15 bp, Homo sapiens
ggaatgacatgatca

SEQ ID NO: 124165 - DNA, 15 bp, Homo sapiens
aggaatgacatgatc

SEQ ID NO: 124166 - DNA, 15 bp, Homo sapiens
aaggaatgacatgat

SEQ ID NO: 124167 - DNA, 15 bp, Homo sapiens
gaaggaatgacatga

SEQ ID NO: 124168 - DNA, 15 bp, Homo sapiens
tgaaggaatgacatg

SEQ ID NO: 124169 - DNA, 15 bp, Homo sapiens
atgaaggaatgacat

SEQ ID NO: 124170 - DNA, 15 bp, Homo sapiens
gatgaaggaatgaca

SEQ ID NO: 124171 - DNA, 15 bp, Homo sapiens
cgatgaaggaatgac

SEQ ID NO: 124172 - DNA, 15 bp, Homo sapiens
tcgatgaaggaatga

SEQ ID NO: 124173 - DNA, 15 bp, Homo sapiens
ttcgatgaaggaatg

SEQ ID NO: 124174 - DNA, 15 bp, Homo sapiens
cttcgatgaaggaat

SEQ ID NO: 124175 - DNA, 15 bp, Homo sapiens
tcttcgatgaaggaa

SEQ ID NO: 124176 - DNA, 15 bp, Homo sapiens
ttcttcgatgaagga

SEQ ID NO: 124177 - DNA, 15 bp, Homo sapiens
tttcttcgatgaagg

SEQ ID NO: 124178 - DNA, 15 bp, Homo sapiens
gtttcttcgatgaag

SEQ ID NO: 124179 - DNA, 15 bp, Homo sapiens
agtttcttcgatgaa

SEQ ID NO: 124180 - DNA, 15 bp, Homo sapiens
cagtttcttcgatga

SEQ ID NO: 124181 - DNA, 15 bp, Homo sapiens
acagtttcttcgatg

SEQ ID NO: 124182 - DNA, 15 bp, Homo sapiens
aacagtttcttcgat

SEQ ID NO: 124183 - DNA, 15 bp, Homo sapiens
aaacagtttcttcga

SEQ ID NO: 124184 - DNA, 15 bp, Homo sapiens
taaacagtttcttcg

SEQ ID NO: 124185 - DNA, 15 bp, Homo sapiens
ctaaacagtttcttc

SEQ ID NO: 124186 - DNA, 15 bp, Homo sapiens
cctaaacagtttctt

SEQ ID NO: 124187 - DNA, 15 bp, Homo sapiens
tcctaaacagtttct

SEQ ID NO: 124188 - DNA, 15 bp, Homo sapiens
ttcctaaacagtttc

SEQ ID NO: 124189 - DNA, 15 bp, Homo sapiens
tttcctaaacagttt

SEQ ID NO: 124190 - DNA, 15 bp, Homo sapiens
ttttcctaaacagtt

SEQ ID NO: 124191 - DNA, 15 bp, Homo sapiens
attttcctaaacagt

SEQ ID NO: 124192 - DNA, 15 bp, Homo sapiens
tattttcctaaacag

SEQ ID NO: 124193 - DNA, 15 bp, Homo sapiens
atattttcctaaaca

SEQ ID NO: 124194 - DNA, 15 bp, Homo sapiens
aatattttcctaaac

SEQ ID NO: 124195 - DNA, 15 bp, Homo sapiens
caatattttcctaaa

SEQ ID NO: 124196 - DNA, 15 bp, Homo sapiens
gcaatattttcctaa

SEQ ID NO: 124197 - DNA, 15 bp, Homo sapiens
tgcaatattttccta

SEQ ID NO: 124198 - DNA, 15 bp, Homo sapiens
ttgcaatattttcct

SEQ ID NO: 124199 - DNA, 15 bp, Homo sapiens
tttgcaatattttcc

SEQ ID NO: 124200 - DNA, 15 bp, Homo sapiens
ttttgcaatattttc

SEQ ID NO: 124201 - DNA, 15 bp, Homo sapiens
attttgcaatatttt

SEQ ID NO: 124202 - DNA, 15 bp, Homo sapiens
tattttgcaatattt

SEQ ID NO: 124203 - DNA, 15 bp, Homo sapiens
gtattttgcaatatt

SEQ ID NO: 124204 - DNA, 15 bp, Homo sapiens
tgtattttgcaatat

SEQ ID NO: 124205 - DNA, 15 bp, Homo sapiens
ctgtattttgcaata

SEQ ID NO: 124206 - DNA, 15 bp, Homo sapiens
tctgtattttgcaat

SEQ ID NO: 124207 - DNA, 15 bp, Homo sapiens
ttctgtattttgcaa

SEQ ID NO: 124208 - DNA, 15 bp, Homo sapiens
tttctgtattttgca

SEQ ID NO: 124209 - DNA, 15 bp, Homo sapiens
ttttctgtattttgc

SEQ ID NO: 124210 - DNA, 15 bp, Homo sapiens
tttttctgtattttg

SEQ ID NO: 124211 - DNA, 15 bp, Homo sapiens
ctttttctgtatttt

SEQ ID NO: 124212 - DNA, 15 bp, Homo sapiens
gctttttctgtattt

SEQ ID NO: 124213 - DNA, 15 bp, Homo sapiens
agctttttctgtatt

SEQ ID NO: 124214 - DNA, 15 bp, Homo sapiens
aagctttttctgtat

SEQ ID NO: 124215 - DNA, 15 bp, Homo sapiens
aaagctttttctgta

SEQ ID NO: 124216 - DNA, 15 bp, Homo sapiens
taaagctttttctgt

SEQ ID NO: 124217 - DNA, 15 bp, Homo sapiens
ttaaagctttttctg

SEQ ID NO: 124218 - DNA, 15 bp, Homo sapiens
tttaaagctttttct

SEQ ID NO: 124219 - DNA, 15 bp, Homo sapiens
atttaaagctttttc

SEQ ID NO: 124220 - DNA, 15 bp, Homo sapiens
catttaaagcttttt

SEQ ID NO: 124221 - DNA, 15 bp, Homo sapiens
gcatttaaagctttt

SEQ ID NO: 124222 - DNA, 15 bp, Homo sapiens
tgcatttaaagcttt

SEQ ID NO: 124223 - DNA, 15 bp, Homo sapiens
ttgcatttaaagctt

SEQ ID NO: 124224 - DNA, 15 bp, Homo sapiens
cttgcatttaaagct

SEQ ID NO: 124225 - DNA, 15 bp, Homo sapiens
ccttgcatttaaagc

SEQ ID NO: 124226 - DNA, 15 bp, Homo sapiens
accttgcatttaaag

SEQ ID NO: 124227 - DNA, 15 bp, Homo sapiens
gaccttgcatttaaa

SEQ ID NO: 124228 - DNA, 15 bp, Homo sapiens
agaccttgcatttaa

SEQ ID NO: 124229 - DNA, 15 bp, Homo sapiens
cagaccttgcattta

SEQ ID NO: 124230 - DNA, 15 bp, Homo sapiens
acagaccttgcattt

SEQ ID NO: 124231 - DNA, 15 bp, Homo sapiens
gacagaccttgcatt

SEQ ID NO: 124232 - DNA, 15 bp, Homo sapiens
tgacagaccttgcat

SEQ ID NO: 124233 - DNA, 15 bp, Homo sapiens
ttgacagaccttgca

SEQ ID NO: 124234 - DNA, 15 bp, Homo sapiens
attgacagaccttgc

SEQ ID NO: 124235 - DNA, 15 bp, Homo sapiens
tattgacagaccttg

SEQ ID NO: 124236 - DNA, 15 bp, Homo sapiens
atattgacagacctt

SEQ ID NO: 124237 - DNA, 15 bp, Homo sapiens
tatattgacagacct

SEQ ID NO: 124238 - DNA, 15 bp, Homo sapiens
ttatattgacagacc

SEQ ID NO: 124239 - DNA, 15 bp, Homo sapiens
gttatattgacagac

SEQ ID NO: 124240 - DNA, 15 bp, Homo sapiens
cgttatattgacaga

SEQ ID NO: 124241 - DNA, 15 bp, Homo sapiens
tcgttatattgacag

SEQ ID NO: 124242 - DNA, 15 bp, Homo sapiens
gtcgttatattgaca

SEQ ID NO: 124243 - DNA, 15 bp, Homo sapiens
tgtcgttatattgac

SEQ ID NO: 124244 - DNA, 15 bp, Homo sapiens
atgtcgttatattga

SEQ ID NO: 124245 - DNA, 15 bp, Homo sapiens
tatgtcgttatattg

SEQ ID NO: 124246 - DNA, 15 bp, Homo sapiens
gtatgtcgttatatt

SEQ ID NO: 124247 - DNA, 15 bp, Homo sapiens
tgtatgtcgttatat

SEQ ID NO: 124248 - DNA, 15 bp, Homo sapiens
ttgtatgtcgttata

SEQ ID NO: 124249 - DNA, 15 bp, Homo sapiens
tttgtatgtcgttat

SEQ ID NO: 124250 - DNA, 15 bp, Homo sapiens
ctttgtatgtcgtta

SEQ ID NO: 124251 - DNA, 15 bp, Homo sapiens
actttgtatgtcgtt

SEQ ID NO: 124252 - DNA, 15 bp, Homo sapiens
gactttgtatgtcgt

SEQ ID NO: 124253 - DNA, 15 bp, Homo sapiens
agactttgtatgtcg

SEQ ID NO: 124254 - DNA, 15 bp, Homo sapiens
aagactttgtatgtc

SEQ ID NO: 124255 - DNA, 15 bp, Homo sapiens
gaagactttgtatgt

SEQ ID NO: 124256 - DNA, 15 bp, Homo sapiens
tgaagactttgtatg

SEQ ID NO: 124257 - DNA, 15 bp, Homo sapiens
ctgaagactttgtat

SEQ ID NO: 124258 - DNA, 15 bp, Homo sapiens
actgaagactttgta

SEQ ID NO: 124259 - DNA, 15 bp, Homo sapiens
gactgaagactttgt

SEQ ID NO: 124260 - DNA, 15 bp, Homo sapiens
agactgaagactttg

SEQ ID NO: 124261 - DNA, 15 bp, Homo sapiens
cagactgaagacttt

SEQ ID NO: 124262 - DNA, 15 bp, Homo sapiens
tcagactgaagactt

SEQ ID NO: 124263 - DNA, 15 bp, Homo sapiens
gtcagactgaagact

SEQ ID NO: 124264 - DNA, 15 bp, Homo sapiens
ggtcagactgaagac

SEQ ID NO: 124265 - DNA, 15 bp, Homo sapiens
gggtcagactgaaga

SEQ ID NO: 124266 - DNA, 15 bp, Homo sapiens
ggggtcagactgaag

SEQ ID NO: 124267 - DNA, 15 bp, Homo sapiens
aggggtcagactgaa

SEQ ID NO: 124268 - DNA, 15 bp, Homo sapiens
caggggtcagactga

SEQ ID NO: 124269 - DNA, 15 bp, Homo sapiens
ccaggggtcagactg

SEQ ID NO: 124270 - DNA, 15 bp, Homo sapiens
gccaggggtcagact

SEQ ID NO: 124271 - DNA, 15 bp, Homo sapiens
agccaggggtcagac

SEQ ID NO: 124272 - DNA, 15 bp, Homo sapiens
gagccaggggtcaga

SEQ ID NO: 124273 - DNA, 15 bp, Homo sapiens
ggagccaggggtcag

SEQ ID NO: 124274 - DNA, 15 bp, Homo sapiens
aggagccaggggtca

SEQ ID NO: 124275 - DNA, 15 bp, Homo sapiens
aaggagccaggggtc

SEQ ID NO: 124276 - DNA, 15 bp, Homo sapiens
taaggagccaggggt

SEQ ID NO: 124277 - DNA, 15 bp, Homo sapiens
ataaggagccagggg

SEQ ID NO: 124278 - DNA, 15 bp, Homo sapiens
cataaggagccaggg

SEQ ID NO: 124279 - DNA, 15 bp, Homo sapiens
acataaggagccagg

SEQ ID NO: 124280 - DNA, 15 bp, Homo sapiens
gacataaggagccag

SEQ ID NO: 124281 - DNA, 15 bp, Homo sapiens
agacataaggagcca

SEQ ID NO: 124282 - DNA, 15 bp, Homo sapiens
aagacataaggagcc

SEQ ID NO: 124283 - DNA, 15 bp, Homo sapiens
aaagacataaggagc

SEQ ID NO: 124284 - DNA, 15 bp, Homo sapiens
caaagacataaggag

SEQ ID NO: 124285 - DNA, 15 bp, Homo sapiens
tcaaagacataagga

SEQ ID NO: 124286 - DNA, 15 bp, Homo sapiens
atcaaagacataagg

SEQ ID NO: 124287 - DNA, 15 bp, Homo sapiens
catcaaagacataag

SEQ ID NO: 124288 - DNA, 15 bp, Homo sapiens
acatcaaagacataa

SEQ ID NO: 124289 - DNA, 15 bp, Homo sapiens
cacatcaaagacata

SEQ ID NO: 124290 - DNA, 15 bp, Homo sapiens
gcacatcaaagacat

SEQ ID NO: 124291 - DNA, 15 bp, Homo sapiens
agcacatcaaagaca

SEQ ID NO: 124292 - DNA, 15 bp, Homo sapiens
cagcacatcaaagac

SEQ ID NO: 124293 - DNA, 15 bp, Homo sapiens
acagcacatcaaaga

SEQ ID NO: 124294 - DNA, 15 bp, Homo sapiens
gacagcacatcaaag

SEQ ID NO: 124295 - DNA, 15 bp, Homo sapiens
tgacagcacatcaaa

SEQ ID NO: 124296 - DNA, 15 bp, Homo sapiens
gtgacagcacatcaa

SEQ ID NO: 124297 - DNA, 15 bp, Homo sapiens
agtgacagcacatca

SEQ ID NO: 124298 - DNA, 15 bp, Homo sapiens
aagtgacagcacatc

SEQ ID NO: 124299 - DNA, 15 bp, Homo sapiens
gaagtgacagcacat

SEQ ID NO: 124300 - DNA, 15 bp, Homo sapiens
ggaagtgacagcaca

SEQ ID NO: 124301 - DNA, 15 bp, Homo sapiens
gggaagtgacagcac

SEQ ID NO: 124302 - DNA, 15 bp, Homo sapiens
tgggaagtgacagca

SEQ ID NO: 124303 - DNA, 15 bp, Homo sapiens
atgggaagtgacagc

SEQ ID NO: 124304 - DNA, 15 bp, Homo sapiens
catgggaagtgacag

SEQ ID NO: 124305 - DNA, 15 bp, Homo sapiens
acatgggaagtgaca

SEQ ID NO: 124306 - DNA, 15 bp, Homo sapiens
tacatgggaagtgac

SEQ ID NO: 124307 - DNA, 15 bp, Homo sapiens
ctacatgggaagtga

SEQ ID NO: 124308 - DNA, 15 bp, Homo sapiens
actacatgggaagtg

SEQ ID NO: 124309 - DNA, 15 bp, Homo sapiens
tactacatgggaagt

SEQ ID NO: 124310 - DNA, 15 bp, Homo sapiens
gtactacatgggaag

SEQ ID NO: 124311 - DNA, 15 bp, Homo sapiens
tgtactacatgggaa

SEQ ID NO: 124312 - DNA, 15 bp, Homo sapiens
ctgtactacatggga

SEQ ID NO: 124313 - DNA, 15 bp, Homo sapiens
gctgtactacatggg

SEQ ID NO: 124314 - DNA, 15 bp, Homo sapiens
agctgtactacatgg

SEQ ID NO: 124315 - DNA, 15 bp, Homo sapiens
tagctgtactacatg

SEQ ID NO: 124316 - DNA, 15 bp, Homo sapiens
atagctgtactacat

SEQ ID NO: 124317 - DNA, 15 bp, Homo sapiens
catagctgtactaca

SEQ ID NO: 124318 - DNA, 15 bp, Homo sapiens
gcatagctgtactac

SEQ ID NO: 124319 - DNA, 15 bp, Homo sapiens
agcatagctgtacta

SEQ ID NO: 124320 - DNA, 15 bp, Homo sapiens
cagcatagctgtact

SEQ ID NO: 124321 - DNA, 15 bp, Homo sapiens
ccagcatagctgtac

SEQ ID NO: 124322 - DNA, 15 bp, Homo sapiens
accagcatagctgta

SEQ ID NO: 124323 - DNA, 15 bp, Homo sapiens
aaccagcatagctgt

SEQ ID NO: 124324 - DNA, 15 bp, Homo sapiens
aaaccagcatagctg

SEQ ID NO: 124325 - DNA, 15 bp, Homo sapiens
aaaaccagcatagct

SEQ ID NO: 124326 - DNA, 15 bp, Homo sapiens
aaaaaccagcatagc

SEQ ID NO: 124327 - DNA, 15 bp, Homo sapiens
gaaaaaccagcatag

SEQ ID NO: 124328 - DNA, 15 bp, Homo sapiens
agaaaaaccagcata

SEQ ID NO: 124329 - DNA, 15 bp, Homo sapiens
aagaaaaaccagcat

SEQ ID NO: 124330 - DNA, 15 bp, Homo sapiens
aaagaaaaaccagca

SEQ ID NO: 124331 - DNA, 15 bp, Homo sapiens
taaagaaaaaccagc

SEQ ID NO: 124332 - DNA, 15 bp, Homo sapiens
gtaaagaaaaaccag

SEQ ID NO: 124333 - DNA, 15 bp, Homo sapiens
tgtaaagaaaaacca

SEQ ID NO: 124334 - DNA, 15 bp, Homo sapiens
atgtaaagaaaaacc

SEQ ID NO: 124335 - DNA, 15 bp, Homo sapiens
aatgtaaagaaaaac

SEQ ID NO: 124336 - DNA, 15 bp, Homo sapiens
aaatgtaaagaaaaa

SEQ ID NO: 124337 - DNA, 15 bp, Homo sapiens
aaaatgtaaagaaaa

SEQ ID NO: 124338 - DNA, 15 bp, Homo sapiens
gaaaatgtaaagaaa

SEQ ID NO: 124339 - DNA, 15 bp, Homo sapiens
ggaaaatgtaaagaa

SEQ ID NO: 124340 - DNA, 15 bp, Homo sapiens
aggaaaatgtaaaga

SEQ ID NO: 124341 - DNA, 15 bp, Homo sapiens
taggaaaatgtaaag

SEQ ID NO: 124342 - DNA, 15 bp, Homo sapiens
ttaggaaaatgtaaa

SEQ ID NO: 124343 - DNA, 15 bp, Homo sapiens
tttaggaaaatgtaa

SEQ ID NO: 124344 - DNA, 15 bp, Homo sapiens
gtttaggaaaatgta

SEQ ID NO: 124345 - DNA, 15 bp, Homo sapiens
tgtttaggaaaatgt

SEQ ID NO: 124346 - DNA, 15 bp, Homo sapiens
gtgtttaggaaaatg

SEQ ID NO: 124347 - DNA, 15 bp, Homo sapiens
tgtgtttaggaaaat

SEQ ID NO: 124348 - DNA, 15 bp, Homo sapiens
atgtgtttaggaaaa

SEQ ID NO: 124349 - DNA, 15 bp, Homo sapiens
gatgtgtttaggaaa

SEQ ID NO: 124350 - DNA, 15 bp, Homo sapiens
tgatgtgtttaggaa

SEQ ID NO: 124351 - DNA, 15 bp, Homo sapiens
atgatgtgtttagga

SEQ ID NO: 124352 - DNA, 15 bp, Homo sapiens
catgatgtgtttagg

SEQ ID NO: 124353 - DNA, 15 bp, Homo sapiens
acatgatgtgtttag

SEQ ID NO: 124354 - DNA, 15 bp, Homo sapiens
cacatgatgtgttta

SEQ ID NO: 124355 - DNA, 15 bp, Homo sapiens
gcacatgatgtgttt

SEQ ID NO: 124356 - DNA, 15 bp, Homo sapiens
ggcacatgatgtgtt

SEQ ID NO: 124357 - DNA, 15 bp, Homo sapiens
aggcacatgatgtgt

SEQ ID NO: 124358 - DNA, 15 bp, Homo sapiens
aaggcacatgatgtg

SEQ ID NO: 124359 - DNA, 15 bp, Homo sapiens
taaggcacatgatgt

SEQ ID NO: 124360 - DNA, 15 bp, Homo sapiens
ctaaggcacatgatg

SEQ ID NO: 124361 - DNA, 15 bp, Homo sapiens
gctaaggcacatgat

SEQ ID NO: 124362 - DNA, 15 bp, Homo sapiens
tgctaaggcacatga

SEQ ID NO: 124363 - DNA, 15 bp, Homo sapiens
gtgctaaggcacatg

SEQ ID NO: 124364 - DNA, 15 bp, Homo sapiens
tgtgctaaggcacat

SEQ ID NO: 124365 - DNA, 15 bp, Homo sapiens
atgtgctaaggcaca

SEQ ID NO: 124366 - DNA, 15 bp, Homo sapiens
gatgtgctaaggcac

SEQ ID NO: 124367 - DNA, 15 bp, Homo sapiens
agatgtgctaaggca

SEQ ID NO: 124368 - DNA, 15 bp, Homo sapiens
cagatgtgctaaggc

SEQ ID NO: 124369 - DNA, 15 bp, Homo sapiens
ccagatgtgctaagg

SEQ ID NO: 124370 - DNA, 15 bp, Homo sapiens
cccagatgtgctaag

SEQ ID NO: 124371 - DNA, 15 bp, Homo sapiens
tcccagatgtgctaa

SEQ ID NO: 124372 - DNA, 15 bp, Homo sapiens
ttcccagatgtgcta

SEQ ID NO: 124373 - DNA, 15 bp, Homo sapiens
gttcccagatgtgct

SEQ ID NO: 124374 - DNA, 15 bp, Homo sapiens
agttcccagatgtgc

SEQ ID NO: 124375 - DNA, 15 bp, Homo sapiens
aagttcccagatgtg

SEQ ID NO: 124376 - DNA, 15 bp, Homo sapiens
taagttcccagatgt

SEQ ID NO: 124377 - DNA, 15 bp, Homo sapiens
ataagttcccagatg

SEQ ID NO: 124378 - DNA, 15 bp, Homo sapiens
aataagttcccagat

SEQ ID NO: 124379 - DNA, 15 bp, Homo sapiens
taataagttcccaga

SEQ ID NO: 124380 - DNA, 15 bp, Homo sapiens
ttaataagttcccag

SEQ ID NO: 124381 - DNA, 15 bp, Homo sapiens
attaataagttccca

SEQ ID NO: 124382 - DNA, 15 bp, Homo sapiens
aattaataagttccc

SEQ ID NO: 124383 - DNA, 15 bp, Homo sapiens
aaattaataagttcc

SEQ ID NO: 124384 - DNA, 15 bp, Homo sapiens
aaaattaataagttc

SEQ ID NO: 124385 - DNA, 15 bp, Homo sapiens
taaaattaataagtt

SEQ ID NO: 124386 - DNA, 15 bp, Homo sapiens
ataaaattaataagt

SEQ ID NO: 124387 - DNA, 15 bp, Homo sapiens
aataaaattaataag

SEQ ID NO: 124388 - DNA, 15 bp, Homo sapiens
gaataaaattaataa

SEQ ID NO: 124389 - DNA, 15 bp, Homo sapiens
ggaataaaattaata

SEQ ID NO: 124390 - DNA, 15 bp, Homo sapiens
cggaataaaattaat

SEQ ID NO: 124391 - DNA, 15 bp, Homo sapiens
tcggaataaaattaa

SEQ ID NO: 124392 - DNA, 15 bp, Homo sapiens
atcggaataaaatta

SEQ ID NO: 124393 - DNA, 15 bp, Homo sapiens
aatcggaataaaatt

SEQ ID NO: 124394 - DNA, 15 bp, Homo sapiens
gaatcggaataaaat

SEQ ID NO: 124395 - DNA, 15 bp, Homo sapiens
ggaatcggaataaaa

SEQ ID NO: 124396 - DNA, 15 bp, Homo sapiens
gggaatcggaataaa

SEQ ID NO: 124397 - DNA, 15 bp, Homo sapiens
agggaatcggaataa

SEQ ID NO: 124398 - DNA, 15 bp, Homo sapiens
tagggaatcggaata

SEQ ID NO: 124399 - DNA, 15 bp, Homo sapiens
ctagggaatcggaat

SEQ ID NO: 124400 - DNA, 15 bp, Homo sapiens
tctagggaatcggaa

SEQ ID NO: 124401 - DNA, 15 bp, Homo sapiens
ctctagggaatcgga

SEQ ID NO: 124402 - DNA, 15 bp, Homo sapiens
actctagggaatcgg

SEQ ID NO: 124403 - DNA, 15 bp, Homo sapiens
cactctagggaatcg

SEQ ID NO: 124404 - DNA, 15 bp, Homo sapiens
tcactctagggaatc

SEQ ID NO: 124405 - DNA, 15 bp, Homo sapiens
ctcactctagggaat

SEQ ID NO: 124406 - DNA, 15 bp, Homo sapiens
actcactctagggaa

SEQ ID NO: 124407 - DNA, 15 bp, Homo sapiens
aactcactctaggga

SEQ ID NO: 124408 - DNA, 15 bp, Homo sapiens
aaactcactctaggg

SEQ ID NO: 124409 - DNA, 15 bp, Homo sapiens
aaaactcactctagg

SEQ ID NO: 124410 - DNA, 15 bp, Homo sapiens
caaaactcactctag

SEQ ID NO: 124411 - DNA, 15 bp, Homo sapiens
acaaaactcactcta

SEQ ID NO: 124412 - DNA, 15 bp, Homo sapiens
gacaaaactcactct

SEQ ID NO: 124413 - DNA, 15 bp, Homo sapiens
agacaaaactcactc

SEQ ID NO: 124414 - DNA, 15 bp, Homo sapiens
aagacaaaactcact

SEQ ID NO: 124415 - DNA, 15 bp, Homo sapiens
aaagacaaaactcac

SEQ ID NO: 124416 - DNA, 15 bp, Homo sapiens
aaaagacaaaactca

SEQ ID NO: 124417 - DNA, 15 bp, Homo sapiens
aaaaagacaaaactc

SEQ ID NO: 124418 - DNA, 15 bp, Homo sapiens
taaaaagacaaaact

SEQ ID NO: 124419 - DNA, 15 bp, Homo sapiens
ctaaaaagacaaaac

SEQ ID NO: 124420 - DNA, 15 bp, Homo sapiens
cctaaaaagacaaaa

SEQ ID NO: 124421 - DNA, 15 bp, Homo sapiens
acctaaaaagacaaa

SEQ ID NO: 124422 - DNA, 15 bp, Homo sapiens
aacctaaaaagacaa

SEQ ID NO: 124423 - DNA, 15 bp, Homo sapiens
taacctaaaaagaca

SEQ ID NO: 124424 - DNA, 15 bp, Homo sapiens
ctaacctaaaaagac

SEQ ID NO: 124425 - DNA, 15 bp, Homo sapiens
gctaacctaaaaaga

SEQ ID NO: 124426 - DNA, 15 bp, Homo sapiens
agctaacctaaaaag

SEQ ID NO: 124427 - DNA, 15 bp, Homo sapiens
cagctaacctaaaaa

SEQ ID NO: 124428 - DNA, 15 bp, Homo sapiens
tcagctaacctaaaa

SEQ ID NO: 124429 - DNA, 15 bp, Homo sapiens
ttcagctaacctaaa

SEQ ID NO: 124430 - DNA, 15 bp, Homo sapiens
tttcagctaacctaa

SEQ ID NO: 124431 - DNA, 15 bp, Homo sapiens
ttttcagctaaccta

SEQ ID NO: 124432 - DNA, 15 bp, Homo sapiens
tttttcagctaacct

SEQ ID NO: 124433 - DNA, 15 bp, Homo sapiens
atttttcagctaacc

SEQ ID NO: 124434 - DNA, 15 bp, Homo sapiens
catttttcagctaac

SEQ ID NO: 124435 - DNA, 15 bp, Homo sapiens
gcatttttcagctaa

SEQ ID NO: 124436 - DNA, 15 bp, Homo sapiens
cgcatttttcagcta

SEQ ID NO: 124437 - DNA, 15 bp, Homo sapiens
acgcatttttcagct

SEQ ID NO: 124438 - DNA, 15 bp, Homo sapiens
aacgcatttttcagc

SEQ ID NO: 124439 - DNA, 15 bp, Homo sapiens
taacgcatttttcag

SEQ ID NO: 124440 - DNA, 15 bp, Homo sapiens
ataacgcatttttca

SEQ ID NO: 124441 - DNA, 15 bp, Homo sapiens
gataacgcatttttc

SEQ ID NO: 124442 - DNA, 15 bp, Homo sapiens
agataacgcattttt

SEQ ID NO: 124443 - DNA, 15 bp, Homo sapiens
aagataacgcatttt

SEQ ID NO: 124444 - DNA, 15 bp, Homo sapiens
aaagataacgcattt

SEQ ID NO: 124445 - DNA, 15 bp, Homo sapiens
aaaagataacgcatt

SEQ ID NO: 124446 - DNA, 15 bp, Homo sapiens
taaaagataacgcat

SEQ ID NO: 124447 - DNA, 15 bp, Homo sapiens
ttaaaagataacgca

SEQ ID NO: 124448 - DNA, 15 bp, Homo sapiens
tttaaaagataacgc

SEQ ID NO: 124449 - DNA, 15 bp, Homo sapiens
ttttaaaagataacg

SEQ ID NO: 124450 - DNA, 15 bp, Homo sapiens
gttttaaaagataac

SEQ ID NO: 124451 - DNA, 15 bp, Homo sapiens
agttttaaaagataa

SEQ ID NO: 124452 - DNA, 15 bp, Homo sapiens
gagttttaaaagata

SEQ ID NO: 124453 - DNA, 15 bp, Homo sapiens
tgagttttaaaagat

SEQ ID NO: 124454 - DNA, 15 bp, Homo sapiens
ctgagttttaaaaga

SEQ ID NO: 124455 - DNA, 15 bp, Homo sapiens
gctgagttttaaaag

SEQ ID NO: 124456 - DNA, 15 bp, Homo sapiens
agctgagttttaaaa

SEQ ID NO: 124457 - DNA, 15 bp, Homo sapiens
gagctgagttttaaa

SEQ ID NO: 124458 - DNA, 15 bp, Homo sapiens
ggagctgagttttaa

SEQ ID NO: 124459 - DNA, 15 bp, Homo sapiens
tggagctgagtttta

SEQ ID NO: 124460 - DNA, 15 bp, Homo sapiens
atggagctgagtttt

SEQ ID NO: 124461 - DNA, 15 bp, Homo sapiens
aatggagctgagttt

SEQ ID NO: 124462 - DNA, 15 bp, Homo sapiens
aaatggagctgagtt

SEQ ID NO: 124463 - DNA, 15 bp, Homo sapiens
aaaatggagctgagt

SEQ ID NO: 124464 - DNA, 15 bp, Homo sapiens
aaaaatggagctgag

SEQ ID NO: 124465 - DNA, 15 bp, Homo sapiens
taaaaatggagctga

SEQ ID NO: 124466 - DNA, 15 bp, Homo sapiens
ataaaaatggagctg

SEQ ID NO: 124467 - DNA, 15 bp, Homo sapiens
aataaaaatggagct

SEQ ID NO: 124468 - DNA, 15 bp, Homo sapiens
aaataaaaatggagc

SEQ ID NO: 124469 - DNA, 15 bp, Homo sapiens
gaaataaaaatggag

SEQ ID NO: 124470 - DNA, 15 bp, Homo sapiens
agaaataaaaatgga

SEQ ID NO: 124471 - DNA, 15 bp, Homo sapiens
tagaaataaaaatgg

SEQ ID NO: 124472 - DNA, 15 bp, Homo sapiens
ttagaaataaaaatg

SEQ ID NO: 124473 - DNA, 15 bp, Homo sapiens
gttagaaataaaaat

SEQ ID NO: 124474 - DNA, 15 bp, Homo sapiens
agttagaaataaaaa

SEQ ID NO: 124475 - DNA, 15 bp, Homo sapiens
aagttagaaataaaa

SEQ ID NO: 124476 - DNA, 15 bp, Homo sapiens
gaagttagaaataaa

SEQ ID NO: 124477 - DNA, 15 bp, Homo sapiens
agaagttagaaataa

SEQ ID NO: 124478 - DNA, 15 bp, Homo sapiens
cagaagttagaaata

SEQ ID NO: 124479 - DNA, 15 bp, Homo sapiens
acagaagttagaaat

SEQ ID NO: 124480 - DNA, 15 bp, Homo sapiens
gacagaagttagaaa

SEQ ID NO: 124481 - DNA, 15 bp, Homo sapiens
tgacagaagttagaa

SEQ ID NO: 124482 - DNA, 15 bp, Homo sapiens
ctgacagaagttaga

SEQ ID NO: 124483 - DNA, 15 bp, Homo sapiens
tctgacagaagttag

SEQ ID NO: 124484 - DNA, 15 bp, Homo sapiens
atctgacagaagtta

SEQ ID NO: 124485 - DNA, 15 bp, Homo sapiens
aatctgacagaagtt

SEQ ID NO: 124486 - DNA, 15 bp, Homo sapiens
taatctgacagaagt

SEQ ID NO: 124487 - DNA, 15 bp, Homo sapiens
ataatctgacagaag

SEQ ID NO: 124488 - DNA, 15 bp, Homo sapiens
tataatctgacagaa

SEQ ID NO: 124489 - DNA, 15 bp, Homo sapiens
atataatctgacaga

SEQ ID NO: 124490 - DNA, 15 bp, Homo sapiens
aatataatctgacag

SEQ ID NO: 124491 - DNA, 15 bp, Homo sapiens
taatataatctgaca

SEQ ID NO: 124492 - DNA, 15 bp, Homo sapiens
ataatataatctgac

SEQ ID NO: 124493 - DNA, 15 bp, Homo sapiens
tataatataatctga

SEQ ID NO: 124494 - DNA, 15 bp, Homo sapiens
ctataatataatctg

SEQ ID NO: 124495 - DNA, 15 bp, Homo sapiens
actataatataatct

SEQ ID NO: 124496 - DNA, 15 bp, Homo sapiens
aactataatataatc

SEQ ID NO: 124497 - DNA, 15 bp, Homo sapiens
gaactataatataat

SEQ ID NO: 124498 - DNA, 15 bp, Homo sapiens
agaactataatataa

SEQ ID NO: 124499 - DNA, 15 bp, Homo sapiens
gagaactataatata

SEQ ID NO: 124500 - DNA, 15 bp, Homo sapiens
agagaactataatat

SEQ ID NO: 124501 - DNA, 15 bp, Homo sapiens
cagagaactataata

SEQ ID NO: 124502 - DNA, 15 bp, Homo sapiens
gcagagaactataat

SEQ ID NO: 124503 - DNA, 15 bp, Homo sapiens
agcagagaactataa

SEQ ID NO: 124504 - DNA, 15 bp, Homo sapiens
aagcagagaactata

SEQ ID NO: 124505 - DNA, 15 bp, Homo sapiens
aaagcagagaactat

SEQ ID NO: 124506 - DNA, 15 bp, Homo sapiens
taaagcagagaacta

SEQ ID NO: 124507 - DNA, 15 bp, Homo sapiens
ataaagcagagaact

SEQ ID NO: 124508 - DNA, 15 bp, Homo sapiens
aataaagcagagaac

SEQ ID NO: 124509 - DNA, 15 bp, Homo sapiens
caataaagcagagaa

SEQ ID NO: 124510 - DNA, 15 bp, Homo sapiens
acaataaagcagaga

SEQ ID NO: 124511 - DNA, 15 bp, Homo sapiens
cacaataaagcagag

SEQ ID NO: 124512 - DNA, 15 bp, Homo sapiens
tcacaataaagcaga

SEQ ID NO: 124513 - DNA, 15 bp, Homo sapiens
gtcacaataaagcag

SEQ ID NO: 124514 - DNA, 15 bp, Homo sapiens
agtcacaataaagca

SEQ ID NO: 124515 - DNA, 15 bp, Homo sapiens
aagtcacaataaagc

SEQ ID NO: 124516 - DNA, 15 bp, Homo sapiens
aaagtcacaataaag

SEQ ID NO: 124517 - DNA, 15 bp, Homo sapiens
aaaagtcacaataaa

SEQ ID NO: 124518 - DNA, 15 bp, Homo sapiens
aaaaagtcacaataa

SEQ ID NO: 124519 - DNA, 15 bp, Homo sapiens
taaaaagtcacaata

SEQ ID NO: 124520 - DNA, 15 bp, Homo sapiens
ttaaaaagtcacaat

SEQ ID NO: 124521 - DNA, 15 bp, Homo sapiens
tttaaaaagtcacaa

SEQ ID NO: 124522 - DNA, 15 bp, Homo sapiens
ctttaaaaagtcaca

SEQ ID NO: 124523 - DNA, 15 bp, Homo sapiens
actttaaaaagtcac

SEQ ID NO: 124524 - DNA, 15 bp, Homo sapiens
atactttaaaaagtc

SEQ ID NO: 124525 - DNA, 15 bp, Homo sapiens
gatactttaaaaagt

SEQ ID NO: 124526 - DNA, 15 bp, Homo sapiens
agatactttaaaaag

SEQ ID NO: 124527 - DNA, 15 bp, Homo sapiens
aagatactttaaaaa

SEQ ID NO: 124528 - DNA, 15 bp, Homo sapiens
aaagatactttaaaa

SEQ ID NO: 124529 - DNA, 15 bp, Homo sapiens
gaaagatactttaaa

SEQ ID NO: 124530 - DNA, 15 bp, Homo sapiens
agaaagatactttaa

SEQ ID NO: 124531 - DNA, 15 bp, Homo sapiens
aagaaagatacttta

SEQ ID NO: 124532 - DNA, 15 bp, Homo sapiens
gaagaaagatacttt

SEQ ID NO: 124533 - DNA, 15 bp, Homo sapiens
ggaagaaagatactt

SEQ ID NO: 124534 - DNA, 15 bp, Homo sapiens
gggaagaaagatact

SEQ ID NO: 124535 - DNA, 15 bp, Homo sapiens
agggaagaaagatac

SEQ ID NO: 124536 - DNA, 15 bp, Homo sapiens
tagggaagaaagata

SEQ ID NO: 124537 - DNA, 15 bp, Homo sapiens
ttagggaagaaagat

SEQ ID NO: 124538 - DNA, 15 bp, Homo sapiens
attagggaagaaaga

SEQ ID NO: 124539 - DNA, 15 bp, Homo sapiens
cattagggaagaaag

SEQ ID NO: 124540 - DNA, 15 bp, Homo sapiens
gcattagggaagaaa

SEQ ID NO: 124541 - DNA, 15 bp, Homo sapiens
agcattagggaagaa

SEQ ID NO: 124542 - DNA, 15 bp, Homo sapiens
aagcattagggaaga

SEQ ID NO: 124543 - DNA, 15 bp, Homo sapiens
gaagcattagggaag

SEQ ID NO: 124544 - DNA, 15 bp, Homo sapiens
agaagcattagggaa

SEQ ID NO: 124545 - DNA, 15 bp, Homo sapiens
gagaagcattaggga

SEQ ID NO: 124546 - DNA, 15 bp, Homo sapiens
ggagaagcattaggg

SEQ ID NO: 124547 - DNA, 15 bp, Homo sapiens
tggagaagcattagg

SEQ ID NO: 124548 - DNA, 15 bp, Homo sapiens
ttggagaagcattag

SEQ ID NO: 124549 - DNA, 15 bp, Homo sapiens
cttggagaagcatta

SEQ ID NO: 124550 - DNA, 15 bp, Homo sapiens
acttggagaagcatt

SEQ ID NO: 124551 - DNA, 15 bp, Homo sapiens
aacttggagaagcat

SEQ ID NO: 124552 - DNA, 15 bp, Homo sapiens
gaacttggagaagca

SEQ ID NO: 124553 - DNA, 15 bp, Homo sapiens
tgaacttggagaagc

SEQ ID NO: 124554 - DNA, 15 bp, Homo sapiens
ctgaacttggagaag

SEQ ID NO: 124555 - DNA, 15 bp, Homo sapiens
cctgaacttggagaa

SEQ ID NO: 124556 - DNA, 15 bp, Homo sapiens
gcctgaacttggaga

SEQ ID NO: 124557 - DNA, 15 bp, Homo sapiens
tgcctgaacttggag

SEQ ID NO: 124558 - DNA, 15 bp, Homo sapiens
ttgcctgaacttgga

SEQ ID NO: 124559 - DNA, 15 bp, Homo sapiens
attgcctgaacttgg

SEQ ID NO: 124560 - DNA, 15 bp, Homo sapiens
tattgcctgaacttg

SEQ ID NO: 124561 - DNA, 15 bp, Homo sapiens
atattgcctgaactt

SEQ ID NO: 124562 - DNA, 15 bp, Homo sapiens
gatattgcctgaact

SEQ ID NO: 124563 - DNA, 15 bp, Homo sapiens
agatattgcctgaac

SEQ ID NO: 124564 - DNA, 15 bp, Homo sapiens
aagatattgcctgaa

SEQ ID NO: 124565 - DNA, 15 bp, Homo sapiens
aaagatattgcctga

SEQ ID NO: 124566 - DNA, 15 bp, Homo sapiens
aaaagatattgcctg

SEQ ID NO: 124567 - DNA, 15 bp, Homo sapiens
aaaaagatattgcct

SEQ ID NO: 124568 - DNA, 15 bp, Homo sapiens
gaaaaagatattgcc

SEQ ID NO: 124569 - DNA, 15 bp, Homo sapiens
tgaaaaagatattgc

SEQ ID NO: 124570 - DNA, 15 bp, Homo sapiens
atgaaaaagatattg

SEQ ID NO: 124571 - DNA, 15 bp, Homo sapiens
gatgaaaaagatatt

SEQ ID NO: 124572 - DNA, 15 bp, Homo sapiens
agatgaaaaagatat

SEQ ID NO: 124573 - DNA, 15 bp, Homo sapiens
aagatgaaaaagata

SEQ ID NO: 124574 - DNA, 15 bp, Homo sapiens
aaagatgaaaaagat

SEQ ID NO: 124575 - DNA, 15 bp, Homo sapiens
caaagatgaaaaaga

SEQ ID NO: 124576 - DNA, 15 bp, Homo sapiens
ccaaagatgaaaaag

SEQ ID NO: 124577 - DNA, 15 bp, Homo sapiens
cccaaagatgaaaaa

SEQ ID NO: 124578 - DNA, 15 bp, Homo sapiens
acccaaagatgaaaa

SEQ ID NO: 124579 - DNA, 15 bp, Homo sapiens
gacccaaagatgaaa

SEQ ID NO: 124580 - DNA, 15 bp, Homo sapiens
ggacccaaagatgaa

SEQ ID NO: 124581 - DNA, 15 bp, Homo sapiens
cggacccaaagatga

SEQ ID NO: 124582 - DNA, 15 bp, Homo sapiens
tcggacccaaagatg

SEQ ID NO: 124583 - DNA, 15 bp, Homo sapiens
ttcggacccaaagat

SEQ ID NO: 124584 - DNA, 15 bp, Homo sapiens
tttcggacccaaaga

SEQ ID NO: 124585 - DNA, 15 bp, Homo sapiens
atttcggacccaaag

SEQ ID NO: 124586 - DNA, 15 bp, Homo sapiens
gatttcggacccaaa

SEQ ID NO: 124587 - DNA, 15 bp, Homo sapiens
tgatttcggacccaa

SEQ ID NO: 124588 - DNA, 15 bp, Homo sapiens
ctgatttcggaccca

SEQ ID NO: 124589 - DNA, 15 bp, Homo sapiens
tctgatttcggaccc

SEQ ID NO: 124590 - DNA, 15 bp, Homo sapiens
ttctgatttcggacc

SEQ ID NO: 124591 - DNA, 15 bp, Homo sapiens
tttctgatttcggac

SEQ ID NO: 124592 - DNA, 15 bp, Homo sapiens
atttctgatttcgga

SEQ ID NO: 124593 - DNA, 15 bp, Homo sapiens
aatttctgatttcgg

SEQ ID NO: 124594 - DNA, 15 bp, Homo sapiens
taatttctgatttcg

SEQ ID NO: 124595 - DNA, 15 bp, Homo sapiens
ataatttctgatttc

SEQ ID NO: 124596 - DNA, 15 bp, Homo sapiens
aataatttctgattt

SEQ ID NO: 124597 - DNA, 15 bp, Homo sapiens
taataatttctgatt

SEQ ID NO: 124598 - DNA, 15 bp, Homo sapiens
gtaataatttctgat

SEQ ID NO: 124599 - DNA, 15 bp, Homo sapiens
agtaataatttctga

SEQ ID NO: 124600 - DNA, 15 bp, Homo sapiens
cagtaataatttctg

SEQ ID NO: 124601 - DNA, 15 bp, Homo sapiens
ccagtaataatttct

SEQ ID NO: 124602 - DNA, 15 bp, Homo sapiens
gccagtaataatttc

SEQ ID NO: 124603 - DNA, 15 bp, Homo sapiens
tgccagtaataattt

SEQ ID NO: 124604 - DNA, 15 bp, Homo sapiens
gtgccagtaataatt

SEQ ID NO: 124605 - DNA, 15 bp, Homo sapiens
tgtgccagtaataat

SEQ ID NO: 124606 - DNA, 15 bp, Homo sapiens
ttgtgccagtaataa

SEQ ID NO: 124607 - DNA, 15 bp, Homo sapiens
tttgtgccagtaata

SEQ ID NO: 124608 - DNA, 15 bp, Homo sapiens
ttttgtgccagtaat

SEQ ID NO: 124609 - DNA, 15 bp, Homo sapiens
attttgtgccagtaa

SEQ ID NO: 124610 - DNA, 15 bp, Homo sapiens
tattttgtgccagta

SEQ ID NO: 124611 - DNA, 15 bp, Homo sapiens
ctattttgtgccagt

SEQ ID NO: 124612 - DNA, 15 bp, Homo sapiens
tctattttgtgccag

SEQ ID NO: 124613 - DNA, 15 bp, Homo sapiens
ttctattttgtgcca

SEQ ID NO: 124614 - DNA, 15 bp, Homo sapiens
tttctattttgtgcc

SEQ ID NO: 124615 - DNA, 15 bp, Homo sapiens
atttctattttgtgc

SEQ ID NO: 124616 - DNA, 15 bp, Homo sapiens
tatttctattttgtg

SEQ ID NO: 124617 - DNA, 15 bp, Homo sapiens
ttatttctattttgt

SEQ ID NO: 124618 - DNA, 15 bp, Homo sapiens
cttatttctattttg

SEQ ID NO: 124619 - DNA, 15 bp, Homo sapiens
acttatttctatttt

SEQ ID NO: 124620 - DNA, 15 bp, Homo sapiens
aacttatttctattt

SEQ ID NO: 124621 - DNA, 15 bp, Homo sapiens
aaacttatttctatt

SEQ ID NO: 124622 - DNA, 15 bp, Homo sapiens
aaaacttatttctat

SEQ ID NO: 124623 - DNA, 15 bp, Homo sapiens
taaaacttatttcta

SEQ ID NO: 124624 - DNA, 15 bp, Homo sapiens
ttaaaacttatttct

SEQ ID NO: 124625 - DNA, 15 bp, Homo sapiens
cttaaaacttatttc

SEQ ID NO: 124626 - DNA, 15 bp, Homo sapiens
gcttaaaacttattt

SEQ ID NO: 124627 - DNA, 15 bp, Homo sapiens
agcttaaaacttatt

SEQ ID NO: 124628 - DNA, 15 bp, Homo sapiens
aagcttaaaacttat

SEQ ID NO: 124629 - DNA, 15 bp, Homo sapiens
aaagcttaaaactta

SEQ ID NO: 124630 - DNA, 15 bp, Homo sapiens
aaaagcttaaaactt

SEQ ID NO: 124631 - DNA, 15 bp, Homo sapiens
taaaagcttaaaact

SEQ ID NO: 124632 - DNA, 15 bp, Homo sapiens
ttaaaagcttaaaac

SEQ ID NO: 124633 - DNA, 15 bp, Homo sapiens
attaaaagcttaaaa

SEQ ID NO: 124634 - DNA, 15 bp, Homo sapiens
tattaaaagcttaaa

SEQ ID NO: 124635 - DNA, 15 bp, Homo sapiens
gtattaaaagcttaa

SEQ ID NO: 124636 - DNA, 15 bp, Homo sapiens
tgtattaaaagctta

SEQ ID NO: 124637 - DNA, 15 bp, Homo sapiens
atgtattaaaagctt

SEQ ID NO: 124638 - DNA, 15 bp, Homo sapiens
tatgtattaaaagct

SEQ ID NO: 124639 - DNA, 15 bp, Homo sapiens
ttatgtattaaaagc

SEQ ID NO: 124640 - DNA, 15 bp, Homo sapiens
tttatgtattaaaag

SEQ ID NO: 124641 - DNA, 15 bp, Homo sapiens
atttatgtattaaaa

SEQ ID NO: 124642 - DNA, 15 bp, Homo sapiens
tatttatgtattaaa

SEQ ID NO: 124643 - DNA, 15 bp, Homo sapiens
ttatttatgtattaa

SEQ ID NO: 124644 - DNA, 15 bp, Homo sapiens
tttatttatgtatta

SEQ ID NO: 124645 - DNA, 15 bp, Homo sapiens
atttatttatgtatt

SEQ ID NO: 124646 - DNA, 15 bp, Homo sapiens
aatttatttatgtat

SEQ ID NO: 124647 - DNA, 15 bp, Homo sapiens
aaatttatttatgta

SEQ ID NO: 124648 - DNA, 15 bp, Homo sapiens
caaatttatttatgt

SEQ ID NO: 124649 - DNA, 15 bp, Homo sapiens
acaaatttatttatg

SEQ ID NO: 124650 - DNA, 15 bp, Homo sapiens
aacaaatttatttat

SEQ ID NO: 124651 - DNA, 15 bp, Homo sapiens
aaacaaatttattta

SEQ ID NO: 124652 - DNA, 15 bp, Homo sapiens
caaacaaatttattt

SEQ ID NO: 124653 - DNA, 15 bp, Homo sapiens
acaaacaaatttatt

SEQ ID NO: 124654 - DNA, 15 bp, Homo sapiens
aacaaacaaatttat

SEQ ID NO: 124655 - DNA, 15 bp, Homo sapiens
taacaaacaaattta

SEQ ID NO: 124656 - DNA, 15 bp, Homo sapiens
ttaacaaacaaattt

SEQ ID NO: 124657 - DNA, 15 bp, Homo sapiens
tttaacaaacaaatt

SEQ ID NO: 124658 - DNA, 15 bp, Homo sapiens
ttttaacaaacaaat

SEQ ID NO: 124659 - DNA, 15 bp, Homo sapiens
cttttaacaaacaaa

SEQ ID NO: 124660 - DNA, 15 bp, Homo sapiens
acttttaacaaacaa

SEQ ID NO: 124661 - DNA, 15 bp, Homo sapiens
tacttttaacaaaca

SEQ ID NO: 124662 - DNA, 15 bp, Homo sapiens
gtacttttaacaaac

SEQ ID NO: 124663 - DNA, 15 bp, Homo sapiens
agtacttttaacaaa

SEQ ID NO: 124664 - DNA, 15 bp, Homo sapiens
tagtacttttaacaa

SEQ ID NO: 124665 - DNA, 15 bp, Homo sapiens
ttagtacttttaaca

SEQ ID NO: 124666 - DNA, 15 bp, Homo sapiens
attagtacttttaac

SEQ ID NO: 124667 - DNA, 15 bp, Homo sapiens
tattagtacttttaa

SEQ ID NO: 124668 - DNA, 15 bp, Homo sapiens
atattagtactttta

SEQ ID NO: 124669 - DNA, 15 bp, Homo sapiens
tatattagtactttt

SEQ ID NO: 124670 - DNA, 15 bp, Homo sapiens
atatattagtacttt

SEQ ID NO: 124671 - DNA, 15 bp, Homo sapiens
tatatattagtactt

SEQ ID NO: 124672 - DNA, 15 bp, Homo sapiens
gtatatattagtact

SEQ ID NO: 124673 - DNA, 15 bp, Homo sapiens
agtatatattagtac

SEQ ID NO: 124674 - DNA, 15 bp, Homo sapiens
tagtatatattagta

SEQ ID NO: 124675 - DNA, 15 bp, Homo sapiens
atagtatatattagt

SEQ ID NO: 124676 - DNA, 15 bp, Homo sapiens
tatagtatatattag

SEQ ID NO: 124677 - DNA, 15 bp, Homo sapiens
gtatagtatatatta

SEQ ID NO: 124678 - DNA, 15 bp, Homo sapiens
tgtatagtatatatt

SEQ ID NO: 124679 - DNA, 15 bp, Homo sapiens
ttgtatagtatatat

SEQ ID NO: 124680 - DNA, 15 bp, Homo sapiens
cttgtatagtatata

SEQ ID NO: 124681 - DNA, 15 bp, Homo sapiens
gcttgtatagtatat

SEQ ID NO: 124682 - DNA, 15 bp, Homo sapiens
agcttgtatagtata

SEQ ID NO: 124683 - DNA, 15 bp, Homo sapiens
tagcttgtatagtat

SEQ ID NO: 124684 - DNA, 15 bp, Homo sapiens
ttagcttgtatagta

SEQ ID NO: 124685 - DNA, 15 bp, Homo sapiens
attagcttgtatagt

SEQ ID NO: 124686 - DNA, 15 bp, Homo sapiens
aattagcttgtatag

SEQ ID NO: 124687 - DNA, 15 bp, Homo sapiens
aaattagcttgtata

SEQ ID NO: 124688 - DNA, 15 bp, Homo sapiens
gaaattagcttgtat

SEQ ID NO: 124689 - DNA, 15 bp, Homo sapiens
tgaaattagcttgta

SEQ ID NO: 124690 - DNA, 15 bp, Homo sapiens
atgaaattagcttgt

SEQ ID NO: 124691 - DNA, 15 bp, Homo sapiens
aatgaaattagcttg

SEQ ID NO: 124692 - DNA, 15 bp, Homo sapiens
gaatgaaattagctt

SEQ ID NO: 124693 - DNA, 15 bp, Homo sapiens
agaatgaaattagct

SEQ ID NO: 124694 - DNA, 15 bp, Homo sapiens
cagaatgaaattagc

SEQ ID NO: 124695 - DNA, 15 bp, Homo sapiens
ccagaatgaaattag

SEQ ID NO: 124696 - DNA, 15 bp, Homo sapiens
gccagaatgaaatta

SEQ ID NO: 124697 - DNA, 15 bp, Homo sapiens
agccagaatgaaatt

SEQ ID NO: 124698 - DNA, 15 bp, Homo sapiens
aagccagaatgaaat

SEQ ID NO: 124699 - DNA, 15 bp, Homo sapiens
aaagccagaatgaaa

SEQ ID NO: 124700 - DNA, 15 bp, Homo sapiens
taaagccagaatgaa

SEQ ID NO: 124701 - DNA, 15 bp, Homo sapiens
gtaaagccagaatga

SEQ ID NO: 124702 - DNA, 15 bp, Homo sapiens
agtaaagccagaatg

SEQ ID NO: 124703 - DNA, 15 bp, Homo sapiens
tagtaaagccagaat

SEQ ID NO: 124704 - DNA, 15 bp, Homo sapiens
ttagtaaagccagaa

SEQ ID NO: 124705 - DNA, 15 bp, Homo sapiens
gttagtaaagccaga

SEQ ID NO: 124706 - DNA, 15 bp, Homo sapiens
tgttagtaaagccag

SEQ ID NO: 124707 - DNA, 15 bp, Homo sapiens
atgttagtaaagcca

SEQ ID NO: 124708 - DNA, 15 bp, Homo sapiens
aatgttagtaaagcc

SEQ ID NO: 124709 - DNA, 15 bp, Homo sapiens
caatgttagtaaagc

SEQ ID NO: 124710 - DNA, 15 bp, Homo sapiens
ccaatgttagtaaag

SEQ ID NO: 124711 - DNA, 15 bp, Homo sapiens
accaatgttagtaaa

SEQ ID NO: 124712 - DNA, 15 bp, Homo sapiens
taccaatgttagtaa

SEQ ID NO: 124713 - DNA, 15 bp, Homo sapiens
ctaccaatgttagta

SEQ ID NO: 124714 - DNA, 15 bp, Homo sapiens
cctaccaatgttagt

SEQ ID NO: 124715 - DNA, 15 bp, Homo sapiens
gcctaccaatgttag

SEQ ID NO: 124716 - DNA, 15 bp, Homo sapiens
cgcctaccaatgtta

SEQ ID NO: 124717 - DNA, 15 bp, Homo sapiens
tcgcctaccaatgtt

SEQ ID NO: 124718 - DNA, 15 bp, Homo sapiens
ttcgcctaccaatgt

SEQ ID NO: 124719 - DNA, 15 bp, Homo sapiens
gttcgcctaccaatg

SEQ ID NO: 124720 - DNA, 15 bp, Homo sapiens
agttcgcctaccaat

SEQ ID NO: 124721 - DNA, 15 bp, Homo sapiens
tagttcgcctaccaa

SEQ ID NO: 124722 - DNA, 15 bp, Homo sapiens
atagttcgcctacca

SEQ ID NO: 124723 - DNA, 15 bp, Homo sapiens
catagttcgcctacc

SEQ ID NO: 124724 - DNA, 15 bp, Homo sapiens
acatagttcgcctac

SEQ ID NO: 124725 - DNA, 15 bp, Homo sapiens
aacatagttcgccta

SEQ ID NO: 124726 - DNA, 15 bp, Homo sapiens
taacatagttcgcct

SEQ ID NO: 124727 - DNA, 15 bp, Homo sapiens
gtaacatagttcgcc

SEQ ID NO: 124728 - DNA, 15 bp, Homo sapiens
tgtaacatagttcgc

SEQ ID NO: 124729 - DNA, 15 bp, Homo sapiens
ttgtaacatagttcg

SEQ ID NO: 124730 - DNA, 15 bp, Homo sapiens
tttgtaacatagttc

SEQ ID NO: 124731 - DNA, 15 bp, Homo sapiens
gtttgtaacatagtt

SEQ ID NO: 124732 - DNA, 15 bp, Homo sapiens
agtttgtaacatagt

SEQ ID NO: 124733 - DNA, 15 bp, Homo sapiens
aagtttgtaacatag

SEQ ID NO: 124734 - DNA, 15 bp, Homo sapiens
gaagtttgtaacata

SEQ ID NO: 124735 - DNA, 15 bp, Homo sapiens
tgaagtttgtaacat

SEQ ID NO: 124736 - DNA, 15 bp, Homo sapiens
ttgaagtttgtaaca

SEQ ID NO: 124737 - DNA, 15 bp, Homo sapiens
tttgaagtttgtaac

SEQ ID NO: 124738 - DNA, 15 bp, Homo sapiens
atttgaagtttgtaa

SEQ ID NO: 124739 - DNA, 15 bp, Homo sapiens
gatttgaagtttgta

SEQ ID NO: 124740 - DNA, 15 bp, Homo sapiens
agatttgaagtttgt

SEQ ID NO: 124741 - DNA, 15 bp, Homo sapiens
tagatttgaagtttg

SEQ ID NO: 124742 - DNA, 15 bp, Homo sapiens
atagatttgaagttt

SEQ ID NO: 124743 - DNA, 15 bp, Homo sapiens
tatagatttgaagtt

SEQ ID NO: 124744 - DNA, 15 bp, Homo sapiens
ctatagatttgaagt

SEQ ID NO: 124745 - DNA, 15 bp, Homo sapiens
actatagatttgaag

SEQ ID NO: 124746 - DNA, 15 bp, Homo sapiens
aactatagatttgaa

SEQ ID NO: 124747 - DNA, 15 bp, Homo sapiens
aaactatagatttga

SEQ ID NO: 124748 - DNA, 15 bp, Homo sapiens
aaaactatagatttg

SEQ ID NO: 124749 - DNA, 15 bp, Homo sapiens
gaaaactatagattt

SEQ ID NO: 124750 - DNA, 15 bp, Homo sapiens
tgaaaactatagatt

SEQ ID NO: 124751 - DNA, 15 bp, Homo sapiens
ttgaaaactatagat

SEQ ID NO: 124752 - DNA, 15 bp, Homo sapiens
tttgaaaactataga

SEQ ID NO: 124753 - DNA, 15 bp, Homo sapiens
gtttgaaaactatag

SEQ ID NO: 124754 - DNA, 15 bp, Homo sapiens
agtttgaaaactata

SEQ ID NO: 124755 - DNA, 15 bp, Homo sapiens
aagtttgaaaactat

SEQ ID NO: 124756 - DNA, 15 bp, Homo sapiens
atttagtagagatgg

SEQ ID NO: 124757 - DNA, 15 bp, Homo sapiens
tatttagtagagatg

SEQ ID NO: 124758 - DNA, 15 bp, Homo sapiens
atatttagtagagat

SEQ ID NO: 124759 - DNA, 15 bp, Homo sapiens
tatatttagtagaga

SEQ ID NO: 124760 - DNA, 15 bp, Homo sapiens
atatatttagtagag

SEQ ID NO: 124761 - DNA, 15 bp, Homo sapiens
tatatatttagtaga

SEQ ID NO: 124762 - DNA, 15 bp, Homo sapiens
ttatatatttagtag

SEQ ID NO: 124763 - DNA, 15 bp, Homo sapiens
tttatatatttagta

SEQ ID NO: 124764 - DNA, 15 bp, Homo sapiens
ttttatatatttagt

SEQ ID NO: 124765 - DNA, 15 bp, Homo sapiens
cttttatatatttag

SEQ ID NO: 124766 - DNA, 15 bp, Homo sapiens
acttttatatattta

SEQ ID NO: 124767 - DNA, 15 bp, Homo sapiens
aacttttatatattt

SEQ ID NO: 124768 - DNA, 15 bp, Homo sapiens
taacttttatatatt

SEQ ID NO: 124769 - DNA, 15 bp, Homo sapiens
ctaacttttatatat

SEQ ID NO: 124770 - DNA, 15 bp, Homo sapiens
gctaacttttatata

SEQ ID NO: 124771 - DNA, 15 bp, Homo sapiens
agctaacttttatat

SEQ ID NO: 124772 - DNA, 15 bp, Homo sapiens
cagctaacttttata

SEQ ID NO: 124773 - DNA, 15 bp, Homo sapiens
ccagctaacttttat

SEQ ID NO: 124774 - DNA, 15 bp, Homo sapiens
cccagctaactttta

SEQ ID NO: 124775 - DNA, 15 bp, Homo sapiens
gcccagctaactttt

SEQ ID NO: 124776 - DNA, 15 bp, Homo sapiens
tgcccagctaacttt

SEQ ID NO: 124777 - DNA, 15 bp, Homo sapiens
atgcccagctaactt

SEQ ID NO: 124778 - DNA, 15 bp, Homo sapiens
catgcccagctaact

SEQ ID NO: 124779 - DNA, 15 bp, Homo sapiens
tcatgcccagctaac

SEQ ID NO: 124780 - DNA, 15 bp, Homo sapiens
atcatgcccagctaa

SEQ ID NO: 124781 - DNA, 15 bp, Homo sapiens
catcatgcccagcta

SEQ ID NO: 124782 - DNA, 15 bp, Homo sapiens
ccatcatgcccagct

SEQ ID NO: 124783 - DNA, 15 bp, Homo sapiens
accatcatgcccagc

SEQ ID NO: 124784 - DNA, 15 bp, Homo sapiens
caccatcatgcccag

SEQ ID NO: 124785 - DNA, 15 bp, Homo sapiens
gcaccatcatgccca

SEQ ID NO: 124786 - DNA, 15 bp, Homo sapiens
tgcaccatcatgccc

SEQ ID NO: 124787 - DNA, 15 bp, Homo sapiens
atgcaccatcatgcc

SEQ ID NO: 124788 - DNA, 15 bp, Homo sapiens
catgcaccatcatgc

SEQ ID NO: 124789 - DNA, 15 bp, Homo sapiens
gcatgcaccatcatg

SEQ ID NO: 124790 - DNA, 15 bp, Homo sapiens
agcatgcaccatcat

SEQ ID NO: 124791 - DNA, 15 bp, Homo sapiens
aagcatgcaccatca

SEQ ID NO: 124792 - DNA, 15 bp, Homo sapiens
caagcatgcaccatc

SEQ ID NO: 124793 - DNA, 15 bp, Homo sapiens
acaagcatgcaccat

SEQ ID NO: 124794 - DNA, 15 bp, Homo sapiens
agctgggattacaag

SEQ ID NO: 124795 - DNA, 15 bp, Homo sapiens
tagctgggattacaa

SEQ ID NO: 124796 - DNA, 15 bp, Homo sapiens
tctgcctcagcctcc

SEQ ID NO: 124797 - DNA, 15 bp, Homo sapiens
ttctgcctcagcctc

SEQ ID NO: 124798 - DNA, 15 bp, Homo sapiens
cttctgcctcagcct

SEQ ID NO: 124799 - DNA, 15 bp, Homo sapiens
tcttctgcctcagcc

SEQ ID NO: 124800 - DNA, 15 bp, Homo sapiens
ttcttctgcctcagc

SEQ ID NO: 124801 - DNA, 15 bp, Homo sapiens
attcttctgcctcag

SEQ ID NO: 124802 - DNA, 15 bp, Homo sapiens
gattcttctgcctca

SEQ ID NO: 124803 - DNA, 15 bp, Homo sapiens
cgattcttctgcctc

SEQ ID NO: 124804 - DNA, 15 bp, Homo sapiens
gcgattcttctgcct

SEQ ID NO: 124805 - DNA, 15 bp, Homo sapiens
agcgattcttctgcc

SEQ ID NO: 124806 - DNA, 15 bp, Homo sapiens
aagcgattcttctgc

SEQ ID NO: 124807 - DNA, 15 bp, Homo sapiens
caagcgattcttctg

SEQ ID NO: 124808 - DNA, 15 bp, Homo sapiens
tcaagcgattcttct

SEQ ID NO: 124809 - DNA, 15 bp, Homo sapiens
ttcaagcgattcttc

SEQ ID NO: 124810 - DNA, 15 bp, Homo sapiens
gtctgcctcccaggt

SEQ ID NO: 124811 - DNA, 15 bp, Homo sapiens
cgtctgcctcccagg

SEQ ID NO: 124812 - DNA, 15 bp, Homo sapiens
ccgtctgcctcccag

SEQ ID NO: 124813 - DNA, 15 bp, Homo sapiens
accgtctgcctccca

SEQ ID NO: 124814 - DNA, 15 bp, Homo sapiens
caccgtctgcctccc

SEQ ID NO: 124815 - DNA, 15 bp, Homo sapiens
gcaccgtctgcctcc

SEQ ID NO: 124816 - DNA, 15 bp, Homo sapiens
tgcaccgtctgcctc

SEQ ID NO: 124817 - DNA, 15 bp, Homo sapiens
ctgcaccgtctgcct

SEQ ID NO: 124818 - DNA, 15 bp, Homo sapiens
actgcaccgtctgcc

SEQ ID NO: 124819 - DNA, 15 bp, Homo sapiens
cactgcaccgtctgc

SEQ ID NO: 124820 - DNA, 15 bp, Homo sapiens
tcactgcaccgtctg

SEQ ID NO: 124821 - DNA, 15 bp, Homo sapiens
ctcactgcaccgtct

SEQ ID NO: 124822 - DNA, 15 bp, Homo sapiens
gctcactgcaccgtc

SEQ ID NO: 124823 - DNA, 15 bp, Homo sapiens
ggctcactgcaccgt

SEQ ID NO: 124824 - DNA, 15 bp, Homo sapiens
cggctcactgcaccg

SEQ ID NO: 124825 - DNA, 15 bp, Homo sapiens
tcggctcactgcacc

SEQ ID NO: 124826 - DNA, 15 bp, Homo sapiens
ctcggctcactgcac

SEQ ID NO: 124827 - DNA, 15 bp, Homo sapiens
ctgtgatctcggctc

SEQ ID NO: 124828 - DNA, 15 bp, Homo sapiens
gctgtgatctcggct

SEQ ID NO: 124829 - DNA, 15 bp, Homo sapiens
tgctgtgatctcggc

SEQ ID NO: 124830 - DNA, 15 bp, Homo sapiens
gtgctgtgatctcgg

SEQ ID NO: 124831 - DNA, 15 bp, Homo sapiens
agtgctgtgatctcg

SEQ ID NO: 124832 - DNA, 15 bp, Homo sapiens
cagtgctgtgatctc

SEQ ID NO: 124833 - DNA, 15 bp, Homo sapiens
gcagtgctgtgatct

SEQ ID NO: 124834 - DNA, 15 bp, Homo sapiens
tgcagtgctgtgatc

SEQ ID NO: 124835 - DNA, 15 bp, Homo sapiens
gtgcagtgctgtgat

SEQ ID NO: 124836 - DNA, 15 bp, Homo sapiens
agtgcagtgctgtga

SEQ ID NO: 124837 - DNA, 15 bp, Homo sapiens
gagtgcagtgctgtg

SEQ ID NO: 124838 - DNA, 15 bp, Homo sapiens
ggagtgcagtgctgt

SEQ ID NO: 124839 - DNA, 15 bp, Homo sapiens
tggagtgcagtgctg

SEQ ID NO: 124840 - DNA, 15 bp, Homo sapiens
ctggagtgcagtgct

SEQ ID NO: 124841 - DNA, 15 bp, Homo sapiens
gctggagtgcagtgc

SEQ ID NO: 124842 - DNA, 15 bp, Homo sapiens
cctcccaggctggag

SEQ ID NO: 124843 - DNA, 15 bp, Homo sapiens
gcctcccaggctgga

SEQ ID NO: 124844 - DNA, 15 bp, Homo sapiens
tgcctcccaggctgg

SEQ ID NO: 124845 - DNA, 15 bp, Homo sapiens
ctgcctcccaggctg

SEQ ID NO: 124846 - DNA, 15 bp, Homo sapiens
tctgcctcccaggct

SEQ ID NO: 124847 - DNA, 15 bp, Homo sapiens
ctctgcctcccaggc

SEQ ID NO: 124848 - DNA, 15 bp, Homo sapiens
gctctgcctcccagg

SEQ ID NO: 124849 - DNA, 15 bp, Homo sapiens
tgctctgcctcccag

SEQ ID NO: 124850 - DNA, 15 bp, Homo sapiens
ttgctctgcctccca

SEQ ID NO: 124851 - DNA, 15 bp, Homo sapiens
gttgctctgcctccc

SEQ ID NO: 124852 - DNA, 15 bp, Homo sapiens
tgttgctctgcctcc

SEQ ID NO: 124853 - DNA, 15 bp, Homo sapiens
gtgttgctctgcctc

SEQ ID NO: 124854 - DNA, 15 bp, Homo sapiens
agtgttgctctgcct

SEQ ID NO: 124855 - DNA, 15 bp, Homo sapiens
gagtgttgctctgcc

SEQ ID NO: 124856 - DNA, 15 bp, Homo sapiens
agagtgttgctctgc

SEQ ID NO: 124857 - DNA, 15 bp, Homo sapiens
cagagtgttgctctg

SEQ ID NO: 124858 - DNA, 15 bp, Homo sapiens
acagagtgttgctct

SEQ ID NO: 124859 - DNA, 15 bp, Homo sapiens
gacagagtgttgctc

SEQ ID NO: 124860 - DNA, 15 bp, Homo sapiens
ggacagagtgttgct

SEQ ID NO: 124861 - DNA, 15 bp, Homo sapiens
aggacagagtgttgc

SEQ ID NO: 124862 - DNA, 15 bp, Homo sapiens
caggacagagtgttg

SEQ ID NO: 124863 - DNA, 15 bp, Homo sapiens
gcaggacagagtgtt

SEQ ID NO: 124864 - DNA, 15 bp, Homo sapiens
tgcaggacagagtgt

SEQ ID NO: 124865 - DNA, 15 bp, Homo sapiens
gtgcaggacagagtg

SEQ ID NO: 124866 - DNA, 15 bp, Homo sapiens
ggtgcaggacagagt

SEQ ID NO: 124867 - DNA, 15 bp, Homo sapiens
gggtgcaggacagag

SEQ ID NO: 124868 - DNA, 15 bp, Homo sapiens
ggggtgcaggacaga

SEQ ID NO: 124869 - DNA, 15 bp, Homo sapiens
gggggtgcaggacag

SEQ ID NO: 124870 - DNA, 15 bp, Homo sapiens
ggggggtgcaggaca

SEQ ID NO: 124871 - DNA, 15 bp, Homo sapiens
gggggggtgcaggac

SEQ ID NO: 124872 - DNA, 15 bp, Homo sapiens
tgggggggtgcagga

SEQ ID NO: 124873 - DNA, 15 bp, Homo sapiens
ttgggggggtgcagg

SEQ ID NO: 124874 - DNA, 15 bp, Homo sapiens
tttgggggggtgcag

SEQ ID NO: 124875 - DNA, 15 bp, Homo sapiens
ttttgggggggtgca

SEQ ID NO: 124876 - DNA, 15 bp, Homo sapiens
tttttgggggggtgc

SEQ ID NO: 124877 - DNA, 15 bp, Homo sapiens
ttttttgggggggtg

SEQ ID NO: 124878 - DNA, 15 bp, Homo sapiens
tttttttgggggggt

SEQ ID NO: 124879 - DNA, 15 bp, Homo sapiens
atttttttggggggg

SEQ ID NO: 124880 - DNA, 15 bp, Homo sapiens
tatttttttgggggg

SEQ ID NO: 124881 - DNA, 15 bp, Homo sapiens
ttatttttttggggg

SEQ ID NO: 124882 - DNA, 15 bp, Homo sapiens
tttatttttttgggg

SEQ ID NO: 124883 - DNA, 15 bp, Homo sapiens
ttttatttttttggg

SEQ ID NO: 124884 - DNA, 15 bp, Homo sapiens
tttttatttttttgg

SEQ ID NO: 124885 - DNA, 15 bp, Homo sapiens
atttttatttttttg

SEQ ID NO: 124886 - DNA, 15 bp, Homo sapiens
catttttattttttt

SEQ ID NO: 124887 - DNA, 15 bp, Homo sapiens
tttcatttttatttt

SEQ ID NO: 124888 - DNA, 15 bp, Homo sapiens
ttttcatttttattt

SEQ ID NO: 124889 - DNA, 15 bp, Homo sapiens
tttttcatttttatt

SEQ ID NO: 124890 - DNA, 15 bp, Homo sapiens
ctttttcatttttat

SEQ ID NO: 124891 - DNA, 15 bp, Homo sapiens
tctttttcattttta

SEQ ID NO: 124892 - DNA, 15 bp, Homo sapiens
ttctttttcattttt

SEQ ID NO: 124893 - DNA, 15 bp, Homo sapiens
ctttctttttcattt

SEQ ID NO: 124894 - DNA, 15 bp, Homo sapiens
gctttctttttcatt

SEQ ID NO: 124895 - DNA, 15 bp, Homo sapiens
agctttctttttcat

SEQ ID NO: 124896 - DNA, 15 bp, Homo sapiens
gagctttctttttca

SEQ ID NO: 124897 - DNA, 15 bp, Homo sapiens
agagctttctttttc

SEQ ID NO: 124898 - DNA, 15 bp, Homo sapiens
cagagctttcttttt

SEQ ID NO: 124899 - DNA, 15 bp, Homo sapiens
tcagagctttctttt

SEQ ID NO: 124900 - DNA, 15 bp, Homo sapiens
ctcagagctttcttt

SEQ ID NO: 124901 - DNA, 15 bp, Homo sapiens
tctcagagctttctt

SEQ ID NO: 124902 - DNA, 15 bp, Homo sapiens
tcctcttctcagagc

SEQ ID NO: 124903 - DNA, 15 bp, Homo sapiens
atcctcttctcagag

SEQ ID NO: 124904 - DNA, 15 bp, Homo sapiens
gatcctcttctcaga

SEQ ID NO: 124905 - DNA, 15 bp, Homo sapiens
ggatcctcttctcag

SEQ ID NO: 124906 - DNA, 15 bp, Homo sapiens
tggatcctcttctca

SEQ ID NO: 124907 - DNA, 15 bp, Homo sapiens
ctggatcctcttctc

SEQ ID NO: 124908 - DNA, 15 bp, Homo sapiens
tctggatcctcttct

SEQ ID NO: 124909 - DNA, 15 bp, Homo sapiens
ttctggatcctcttc

SEQ ID NO: 124910 - DNA, 15 bp, Homo sapiens
tttctggatcctctt

SEQ ID NO: 124911 - DNA, 15 bp, Homo sapiens
ttttctggatcctct

SEQ ID NO: 124912 - DNA, 15 bp, Homo sapiens
attttctggatcctc

SEQ ID NO: 124913 - DNA, 15 bp, Homo sapiens
gattttctggatcct

SEQ ID NO: 124914 - DNA, 15 bp, Homo sapiens
agattttctggatcc

SEQ ID NO: 124915 - DNA, 15 bp, Homo sapiens
tagattttctggatc

SEQ ID NO: 124916 - DNA, 15 bp, Homo sapiens
atagattttctggat

SEQ ID NO: 124917 - DNA, 15 bp, Homo sapiens
tatagattttctgga

SEQ ID NO: 124918 - DNA, 15 bp, Homo sapiens
atatagattttctgg

SEQ ID NO: 124919 - DNA, 15 bp, Homo sapiens
aatatagattttctg

SEQ ID NO: 124920 - DNA, 15 bp, Homo sapiens
taatatagattttct

SEQ ID NO: 124921 - DNA, 15 bp, Homo sapiens
ctaatatagattttc

SEQ ID NO: 124922 - DNA, 15 bp, Homo sapiens
cctaatatagatttt

SEQ ID NO: 124923 - DNA, 15 bp, Homo sapiens
ccctaatatagattt

SEQ ID NO: 124924 - DNA, 15 bp, Homo sapiens
gccctaatatagatt

SEQ ID NO: 124925 - DNA, 15 bp, Homo sapiens
tgccctaatatagat

SEQ ID NO: 124926 - DNA, 15 bp, Homo sapiens
ctgccctaatataga

SEQ ID NO: 124927 - DNA, 15 bp, Homo sapiens
tctgccctaatatag

SEQ ID NO: 124928 - DNA, 15 bp, Homo sapiens
atctgccctaatata

SEQ ID NO: 124929 - DNA, 15 bp, Homo sapiens
catctgccctaatat

SEQ ID NO: 124930 - DNA, 15 bp, Homo sapiens
tcatctgccctaata

SEQ ID NO: 124931 - DNA, 15 bp, Homo sapiens
ctcatctgccctaat

SEQ ID NO: 124932 - DNA, 15 bp, Homo sapiens
actcatctgccctaa

SEQ ID NO: 124933 - DNA, 15 bp, Homo sapiens
tactcatctgcccta

SEQ ID NO: 124934 - DNA, 15 bp, Homo sapiens
ctactcatctgccct

SEQ ID NO: 124935 - DNA, 15 bp, Homo sapiens
actactcatctgccc

SEQ ID NO: 124936 - DNA, 15 bp, Homo sapiens
gactactcatctgcc

SEQ ID NO: 124937 - DNA, 15 bp, Homo sapiens
ggactactcatctgc

SEQ ID NO: 124938 - DNA, 15 bp, Homo sapiens
tggactactcatctg

SEQ ID NO: 124939 - DNA, 15 bp, Homo sapiens
atggactactcatct

SEQ ID NO: 124940 - DNA, 15 bp, Homo sapiens
tatggactactcatc

SEQ ID NO: 124941 - DNA, 15 bp, Homo sapiens
ctatggactactcat

SEQ ID NO: 124942 - DNA, 15 bp, Homo sapiens
tctatggactactca

SEQ ID NO: 124943 - DNA, 15 bp, Homo sapiens
ctctatggactactc

SEQ ID NO: 124944 - DNA, 15 bp, Homo sapiens
gctctatggactact

SEQ ID NO: 124945 - DNA, 15 bp, Homo sapiens
ggctctatggactac

SEQ ID NO: 124946 - DNA, 15 bp, Homo sapiens
aggctctatggacta

SEQ ID NO: 124947 - DNA, 15 bp, Homo sapiens
gaggctctatggact

SEQ ID NO: 124948 - DNA, 15 bp, Homo sapiens
tgaggctctatggac

SEQ ID NO: 124949 - DNA, 15 bp, Homo sapiens
ttgaggctctatgga

SEQ ID NO: 124950 - DNA, 15 bp, Homo sapiens
cttgaggctctatgg

SEQ ID NO: 124951 - DNA, 15 bp, Homo sapiens
acttgaggctctatg

SEQ ID NO: 124952 - DNA, 15 bp, Homo sapiens
gacttgaggctctat

SEQ ID NO: 124953 - DNA, 15 bp, Homo sapiens
agacttgaggctcta

SEQ ID NO: 124954 - DNA, 15 bp, Homo sapiens
cagacttgaggctct

SEQ ID NO: 124955 - DNA, 15 bp, Homo sapiens
acagacttgaggctc

SEQ ID NO: 124956 - DNA, 15 bp, Homo sapiens
gacagacttgaggct

SEQ ID NO: 124957 - DNA, 15 bp, Homo sapiens
agacagacttgaggc

SEQ ID NO: 124958 - DNA, 15 bp, Homo sapiens
tagacagacttgagg

SEQ ID NO: 124959 - DNA, 15 bp, Homo sapiens
ttagacagacttgag

SEQ ID NO: 124960 - DNA, 15 bp, Homo sapiens
tttagacagacttga

SEQ ID NO: 124961 - DNA, 15 bp, Homo sapiens
atttagacagacttg

SEQ ID NO: 124962 - DNA, 15 bp, Homo sapiens
tatttagacagactt

SEQ ID NO: 124963 - DNA, 15 bp, Homo sapiens
atatttagacagact

SEQ ID NO: 124964 - DNA, 15 bp, Homo sapiens
catatttagacagac

SEQ ID NO: 124965 - DNA, 15 bp, Homo sapiens
tcatatttagacaga

SEQ ID NO: 124966 - DNA, 15 bp, Homo sapiens
gtcatatttagacag

SEQ ID NO: 124967 - DNA, 15 bp, Homo sapiens
tgtcatatttagaca

SEQ ID NO: 124968 - DNA, 15 bp, Homo sapiens
gtgtcatatttagac

SEQ ID NO: 124969 - DNA, 15 bp, Homo sapiens
agtgtcatatttaga

SEQ ID NO: 124970 - DNA, 15 bp, Homo sapiens
aagtgtcatatttag

SEQ ID NO: 124971 - DNA, 15 bp, Homo sapiens
gaagtgtcatattta

SEQ ID NO: 124972 - DNA, 15 bp, Homo sapiens
tgaagtgtcatattt

SEQ ID NO: 124973 - DNA, 15 bp, Homo sapiens
atgaagtgtcatatt

SEQ ID NO: 124974 - DNA, 15 bp, Homo sapiens
catgaagtgtcatat

SEQ ID NO: 124975 - DNA, 15 bp, Homo sapiens
tcatgaagtgtcata

SEQ ID NO: 124976 - DNA, 15 bp, Homo sapiens
atcatgaagtgtcat

SEQ ID NO: 124977 - DNA, 15 bp, Homo sapiens
gatcatgaagtgtca

SEQ ID NO: 124978 - DNA, 15 bp, Homo sapiens
agatcatgaagtgtc

SEQ ID NO: 124979 - DNA, 15 bp, Homo sapiens
tagatcatgaagtgt

SEQ ID NO: 124980 - DNA, 15 bp, Homo sapiens
atagatcatgaagtg

SEQ ID NO: 124981 - DNA, 15 bp, Homo sapiens
aatagatcatgaagt

SEQ ID NO: 124982 - DNA, 15 bp, Homo sapiens
aaatagatcatgaag

SEQ ID NO: 124983 - DNA, 15 bp, Homo sapiens
aaaatagatcatgaa

SEQ ID NO: 124984 - DNA, 15 bp, Homo sapiens
gaaaatagatcatga

SEQ ID NO: 124985 - DNA, 15 bp, Homo sapiens
agaaaatagatcatg

SEQ ID NO: 124986 - DNA, 15 bp, Homo sapiens
tagaaaatagatcat

SEQ ID NO: 124987 - DNA, 15 bp, Homo sapiens
ttagaaaatagatca

SEQ ID NO: 124988 - DNA, 15 bp, Homo sapiens
attagaaaatagatc

SEQ ID NO: 124989 - DNA, 15 bp, Homo sapiens
cattagaaaatagat

SEQ ID NO: 124990 - DNA, 15 bp, Homo sapiens
acattagaaaataga

SEQ ID NO: 124991 - DNA, 15 bp, Homo sapiens
tacattagaaaatag

SEQ ID NO: 124992 - DNA, 15 bp, Homo sapiens
ctacattagaaaata

SEQ ID NO: 124993 - DNA, 15 bp, Homo sapiens
cctacattagaaaat

SEQ ID NO: 124994 - DNA, 15 bp, Homo sapiens
tcctacattagaaaa

SEQ ID NO: 124995 - DNA, 15 bp, Homo sapiens
atcctacattagaaa

SEQ ID NO: 124996 - DNA, 15 bp, Homo sapiens
tatcctacattagaa

SEQ ID NO: 124997 - DNA, 15 bp, Homo sapiens
atatcctacattaga

SEQ ID NO: 124998 - DNA, 15 bp, Homo sapiens
aatatcctacattag

SEQ ID NO: 124999 - DNA, 15 bp, Homo sapiens
gaatatcctacatta

SEQ ID NO: 125000 - DNA, 15 bp, Homo sapiens
ggaatatcctacatt

SEQ ID NO: 125001 - DNA, 15 bp, Homo sapiens
aggaatatcctacat

SEQ ID NO: 125002 - DNA, 15 bp, Homo sapiens
caggaatatcctaca

SEQ ID NO: 125003 - DNA, 15 bp, Homo sapiens
gcaggaatatcctac

SEQ ID NO: 125004 - DNA, 15 bp, Homo sapiens
agcaggaatatccta

SEQ ID NO: 125005 - DNA, 15 bp, Homo sapiens
gagcaggaatatcct

SEQ ID NO: 125006 - DNA, 15 bp, Homo sapiens
agagcaggaatatcc

SEQ ID NO: 125007 - DNA, 15 bp, Homo sapiens
tagagcaggaatatc

SEQ ID NO: 125008 - DNA, 15 bp, Homo sapiens
atagagcaggaatat

SEQ ID NO: 125009 - DNA, 15 bp, Homo sapiens
tatagagcaggaata

SEQ ID NO: 125010 - DNA, 15 bp, Homo sapiens
ttatagagcaggaat

SEQ ID NO: 125011 - DNA, 15 bp, Homo sapiens
attatagagcaggaa

SEQ ID NO: 125012 - DNA, 15 bp, Homo sapiens
tattatagagcagga

SEQ ID NO: 125013 - DNA, 15 bp, Homo sapiens
atattatagagcagg

SEQ ID NO: 125014 - DNA, 15 bp, Homo sapiens
aatattatagagcag

SEQ ID NO: 125015 - DNA, 15 bp, Homo sapiens
taatattatagagca

SEQ ID NO: 125016 - DNA, 15 bp, Homo sapiens
ataatattatagagc

SEQ ID NO: 125017 - DNA, 15 bp, Homo sapiens
aataatattatagag

SEQ ID NO: 125018 - DNA, 15 bp, Homo sapiens
gaataatattataga

SEQ ID NO: 125019 - DNA, 15 bp, Homo sapiens
agaataatattatag

SEQ ID NO: 125020 - DNA, 15 bp, Homo sapiens
gagaataatattata

SEQ ID NO: 125021 - DNA, 15 bp, Homo sapiens
tgagaataatattat

SEQ ID NO: 125022 - DNA, 15 bp, Homo sapiens
ctgagaataatatta

SEQ ID NO: 125023 - DNA, 15 bp, Homo sapiens
tctgagaataatatt

SEQ ID NO: 125024 - DNA, 15 bp, Homo sapiens
ctctgagaataatat

SEQ ID NO: 125025 - DNA, 15 bp, Homo sapiens
tctctgagaataata

SEQ ID NO: 125026 - DNA, 15 bp, Homo sapiens
atctctgagaataat

SEQ ID NO: 125027 - DNA, 15 bp, Homo sapiens
aatctctgagaataa

SEQ ID NO: 125028 - DNA, 15 bp, Homo sapiens
taatctctgagaata

SEQ ID NO: 125029 - DNA, 15 bp, Homo sapiens
ttaatctctgagaat

SEQ ID NO: 125030 - DNA, 15 bp, Homo sapiens
cttaatctctgagaa

SEQ ID NO: 125031 - DNA, 15 bp, Homo sapiens
tcttaatctctgaga

SEQ ID NO: 125032 - DNA, 15 bp, Homo sapiens
atcttaatctctgag

SEQ ID NO: 125033 - DNA, 15 bp, Homo sapiens
aatcttaatctctga

SEQ ID NO: 125034 - DNA, 15 bp, Homo sapiens
taatcttaatctctg

SEQ ID NO: 125035 - DNA, 15 bp, Homo sapiens
gtaatcttaatctct

SEQ ID NO: 125036 - DNA, 15 bp, Homo sapiens
tgtaatcttaatctc

SEQ ID NO: 125037 - DNA, 15 bp, Homo sapiens
atgtaatcttaatct

SEQ ID NO: 125038 - DNA, 15 bp, Homo sapiens
tatgtaatcttaatc

SEQ ID NO: 125039 - DNA, 15 bp, Homo sapiens
gtatgtaatcttaat

SEQ ID NO: 125040 - DNA, 15 bp, Homo sapiens
agtatgtaatcttaa

SEQ ID NO: 125041 - DNA, 15 bp, Homo sapiens
cagtatgtaatctta

SEQ ID NO: 125042 - DNA, 15 bp, Homo sapiens
tcagtatgtaatctt

SEQ ID NO: 125043 - DNA, 15 bp, Homo sapiens
ttcagtatgtaatct

SEQ ID NO: 125044 - DNA, 15 bp, Homo sapiens
attcagtatgtaatc

SEQ ID NO: 125045 - DNA, 15 bp, Homo sapiens
aattcagtatgtaat

SEQ ID NO: 125046 - DNA, 15 bp, Homo sapiens
taattcagtatgtaa

SEQ ID NO: 125047 - DNA, 15 bp, Homo sapiens
gtaattcagtatgta

SEQ ID NO: 125048 - DNA, 15 bp, Homo sapiens
ggtaattcagtatgt

SEQ ID NO: 125049 - DNA, 15 bp, Homo sapiens
aggtaattcagtatg

SEQ ID NO: 125050 - DNA, 15 bp, Homo sapiens
caggtaattcagtat

SEQ ID NO: 125051 - DNA, 15 bp, Homo sapiens
ccaggtaattcagta

SEQ ID NO: 125052 - DNA, 15 bp, Homo sapiens
tccaggtaattcagt

SEQ ID NO: 125053 - DNA, 15 bp, Homo sapiens
atccaggtaattcag

SEQ ID NO: 125054 - DNA, 15 bp, Homo sapiens
tatccaggtaattca

SEQ ID NO: 125055 - DNA, 15 bp, Homo sapiens
atatccaggtaattc

SEQ ID NO: 125056 - DNA, 15 bp, Homo sapiens
aatatccaggtaatt

SEQ ID NO: 125057 - DNA, 15 bp, Homo sapiens
taatatccaggtaat

SEQ ID NO: 125058 - DNA, 15 bp, Homo sapiens
gtaatatccaggtaa

SEQ ID NO: 125059 - DNA, 15 bp, Homo sapiens
agtaatatccaggta

SEQ ID NO: 125060 - DNA, 15 bp, Homo sapiens
aagtaatatccaggt

SEQ ID NO: 125061 - DNA, 15 bp, Homo sapiens
aaagtaatatccagg

SEQ ID NO: 125062 - DNA, 15 bp, Homo sapiens
taaagtaatatccag

SEQ ID NO: 125063 - DNA, 15 bp, Homo sapiens
ttaaagtaatatcca

SEQ ID NO: 125064 - DNA, 15 bp, Homo sapiens
attaaagtaatatcc

SEQ ID NO: 125065 - DNA, 15 bp, Homo sapiens
gattaaagtaatatc

SEQ ID NO: 125066 - DNA, 15 bp, Homo sapiens
tgattaaagtaatat

SEQ ID NO: 125067 - DNA, 15 bp, Homo sapiens
ttgattaaagtaata

SEQ ID NO: 125068 - DNA, 15 bp, Homo sapiens
tttgattaaagtaat

SEQ ID NO: 125069 - DNA, 15 bp, Homo sapiens
ttttgattaaagtaa

SEQ ID NO: 125070 - DNA, 15 bp, Homo sapiens
gttttgattaaagta

SEQ ID NO: 125071 - DNA, 15 bp, Homo sapiens
ggttttgattaaagt

SEQ ID NO: 125072 - DNA, 15 bp, Homo sapiens
gggttttgattaaag

SEQ ID NO: 125073 - DNA, 15 bp, Homo sapiens
agggttttgattaaa

SEQ ID NO: 125074 - DNA, 15 bp, Homo sapiens
aagggttttgattaa

SEQ ID NO: 125075 - DNA, 15 bp, Homo sapiens
aaagggttttgatta

SEQ ID NO: 125076 - DNA, 15 bp, Homo sapiens
caaagggttttgatt

SEQ ID NO: 125077 - DNA, 15 bp, Homo sapiens
acaaagggttttgat

SEQ ID NO: 125078 - DNA, 15 bp, Homo sapiens
cacaaagggttttga

SEQ ID NO: 125079 - DNA, 15 bp, Homo sapiens
gcacaaagggttttg

SEQ ID NO: 125080 - DNA, 15 bp, Homo sapiens
tgcacaaagggtttt

SEQ ID NO: 125081 - DNA, 15 bp, Homo sapiens
atgcacaaagggttt

SEQ ID NO: 125082 - DNA, 15 bp, Homo sapiens
aatgcacaaagggtt

SEQ ID NO: 125083 - DNA, 15 bp, Homo sapiens
aaatgcacaaagggt

SEQ ID NO: 125084 - DNA, 15 bp, Homo sapiens
gaaatgcacaaaggg

SEQ ID NO: 125085 - DNA, 15 bp, Homo sapiens
tgaaatgcacaaagg

SEQ ID NO: 125086 - DNA, 15 bp, Homo sapiens
atgaaatgcacaaag

SEQ ID NO: 125087 - DNA, 15 bp, Homo sapiens
catgaaatgcacaaa

SEQ ID NO: 125088 - DNA, 15 bp, Homo sapiens
acatgaaatgcacaa

SEQ ID NO: 125089 - DNA, 15 bp, Homo sapiens
aacatgaaatgcaca

SEQ ID NO: 125090 - DNA, 15 bp, Homo sapiens
caacatgaaatgcac

SEQ ID NO: 125091 - DNA, 15 bp, Homo sapiens
acaacatgaaatgca

SEQ ID NO: 125092 - DNA, 15 bp, Homo sapiens
cacaacatgaaatgc

SEQ ID NO: 125093 - DNA, 15 bp, Homo sapiens
acacaacatgaaatg

SEQ ID NO: 125094 - DNA, 15 bp, Homo sapiens
aacacaacatgaaat

SEQ ID NO: 125095 - DNA, 15 bp, Homo sapiens
taacacaacatgaaa

SEQ ID NO: 125096 - DNA, 15 bp, Homo sapiens
ataacacaacatgaa

SEQ ID NO: 125097 - DNA, 15 bp, Homo sapiens
cataacacaacatga

SEQ ID NO: 125098 - DNA, 15 bp, Homo sapiens
ccataacacaacatg

SEQ ID NO: 125099 - DNA, 15 bp, Homo sapiens
tccataacacaacat

SEQ ID NO: 125100 - DNA, 15 bp, Homo sapiens
ttccataacacaaca

SEQ ID NO: 125101 - DNA, 15 bp, Homo sapiens
tttccataacacaac

SEQ ID NO: 125102 - DNA, 15 bp, Homo sapiens
gtttccataacacaa

SEQ ID NO: 125103 - DNA, 15 bp, Homo sapiens
tgtttccataacaca

SEQ ID NO: 125104 - DNA, 15 bp, Homo sapiens
atgtttccataacac

SEQ ID NO: 125105 - DNA, 15 bp, Homo sapiens
catgtttccataaca

SEQ ID NO: 125106 - DNA, 15 bp, Homo sapiens
acatgtttccataac

SEQ ID NO: 125107 - DNA, 15 bp, Homo sapiens
aacatgtttccataa

SEQ ID NO: 125108 - DNA, 15 bp, Homo sapiens
aaacatgtttccata

SEQ ID NO: 125109 - DNA, 15 bp, Homo sapiens
taaacatgtttccat

SEQ ID NO: 125110 - DNA, 15 bp, Homo sapiens
ttaaacatgtttcca

SEQ ID NO: 125111 - DNA, 15 bp, Homo sapiens
gttaaacatgtttcc

SEQ ID NO: 125112 - DNA, 15 bp, Homo sapiens
agttaaacatgtttc

SEQ ID NO: 125113 - DNA, 15 bp, Homo sapiens
aagttaaacatgttt

SEQ ID NO: 125114 - DNA, 15 bp, Homo sapiens
caagttaaacatgtt

SEQ ID NO: 125115 - DNA, 15 bp, Homo sapiens
gcaagttaaacatgt

SEQ ID NO: 125116 - DNA, 15 bp, Homo sapiens
agcaagttaaacatg

SEQ ID NO: 125117 - DNA, 15 bp, Homo sapiens
aagcaagttaaacat

SEQ ID NO: 125118 - DNA, 15 bp, Homo sapiens
taagcaagttaaaca

SEQ ID NO: 125119 - DNA, 15 bp, Homo sapiens
ataagcaagttaaac

SEQ ID NO: 125120 - DNA, 15 bp, Homo sapiens
tataagcaagttaaa

SEQ ID NO: 125121 - DNA, 15 bp, Homo sapiens
atataagcaagttaa

SEQ ID NO: 125122 - DNA, 15 bp, Homo sapiens
aatataagcaagtta

SEQ ID NO: 125123 - DNA, 15 bp, Homo sapiens
aaatataagcaagtt

SEQ ID NO: 125124 - DNA, 15 bp, Homo sapiens
aaaatataagcaagt

SEQ ID NO: 125125 - DNA, 15 bp, Homo sapiens
aaaaatataagcaag

SEQ ID NO: 125126 - DNA, 15 bp, Homo sapiens
taaaaatataagcaa

SEQ ID NO: 125127 - DNA, 15 bp, Homo sapiens
ctaaaaatataagca

SEQ ID NO: 125128 - DNA, 15 bp, Homo sapiens
gctaaaaatataagc

SEQ ID NO: 125129 - DNA, 15 bp, Homo sapiens
tgctaaaaatataag

SEQ ID NO: 125130 - DNA, 15 bp, Homo sapiens
ttgctaaaaatataa

SEQ ID NO: 125131 - DNA, 15 bp, Homo sapiens
attgctaaaaatata

SEQ ID NO: 125132 - DNA, 15 bp, Homo sapiens
cattgctaaaaatat

SEQ ID NO: 125133 - DNA, 15 bp, Homo sapiens
tcattgctaaaaata

SEQ ID NO: 125134 - DNA, 15 bp, Homo sapiens
ctcattgctaaaaat

SEQ ID NO: 125135 - DNA, 15 bp, Homo sapiens
cctcattgctaaaaa

SEQ ID NO: 125136 - DNA, 15 bp, Homo sapiens
acctcattgctaaaa

SEQ ID NO: 125137 - DNA, 15 bp, Homo sapiens
gacctcattgctaaa

SEQ ID NO: 125138 - DNA, 15 bp, Homo sapiens
ggacctcattgctaa

SEQ ID NO: 125139 - DNA, 15 bp, Homo sapiens
tggacctcattgcta

SEQ ID NO: 125140 - DNA, 15 bp, Homo sapiens
ttggacctcattgct

SEQ ID NO: 125141 - DNA, 15 bp, Homo sapiens
attggacctcattgc

SEQ ID NO: 125142 - DNA, 15 bp, Homo sapiens
aattggacctcattg

SEQ ID NO: 125143 - DNA, 15 bp, Homo sapiens
aaattggacctcatt

SEQ ID NO: 125144 - DNA, 15 bp, Homo sapiens
aaaattggacctcat

SEQ ID NO: 125145 - DNA, 15 bp, Homo sapiens
taaaattggacctca

SEQ ID NO: 125146 - DNA, 15 bp, Homo sapiens
ttaaaattggacctc

SEQ ID NO: 125147 - DNA, 15 bp, Homo sapiens
tttaaaattggacct

SEQ ID NO: 125148 - DNA, 15 bp, Homo sapiens
ttttaaaattggacc

SEQ ID NO: 125149 - DNA, 15 bp, Homo sapiens
attttaaaattggac

SEQ ID NO: 125150 - DNA, 15 bp, Homo sapiens
aattttaaaattgga

SEQ ID NO: 125151 - DNA, 15 bp, Homo sapiens
caattttaaaattgg

SEQ ID NO: 125152 - DNA, 15 bp, Homo sapiens
acaattttaaaattg

SEQ ID NO: 125153 - DNA, 15 bp, Homo sapiens
cacaattttaaaatt

SEQ ID NO: 125154 - DNA, 15 bp, Homo sapiens
tcacaattttaaaat

SEQ ID NO: 125155 - DNA, 15 bp, Homo sapiens
atcacaattttaaaa

SEQ ID NO: 125156 - DNA, 15 bp, Homo sapiens
tatcacaattttaaa

SEQ ID NO: 125157 - DNA, 15 bp, Homo sapiens
atatcacaattttaa

SEQ ID NO: 125158 - DNA, 15 bp, Homo sapiens
aatatcacaatttta

SEQ ID NO: 125159 - DNA, 15 bp, Homo sapiens
aaatatcacaatttt

SEQ ID NO: 125160 - DNA, 15 bp, Homo sapiens
aaaatatcacaattt

SEQ ID NO: 125161 - DNA, 15 bp, Homo sapiens
aaaaatatcacaatt

SEQ ID NO: 125162 - DNA, 15 bp, Homo sapiens
taaaaatatcacaat

SEQ ID NO: 125163 - DNA, 15 bp, Homo sapiens
ttaaaaatatcacaa

SEQ ID NO: 125164 - DNA, 15 bp, Homo sapiens
tttaaaaatatcaca

SEQ ID NO: 125165 - DNA, 15 bp, Homo sapiens
ttttaaaaatatcac

SEQ ID NO: 125166 - DNA, 15 bp, Homo sapiens
cttttaaaaatatca

SEQ ID NO: 125167 - DNA, 15 bp, Homo sapiens
tcttttaaaaatatc

SEQ ID NO: 125168 - DNA, 15 bp, Homo sapiens
ctcttttaaaaatat

SEQ ID NO: 125169 - DNA, 15 bp, Homo sapiens
actcttttaaaaata

SEQ ID NO: 125170 - DNA, 15 bp, Homo sapiens
cactcttttaaaaat

SEQ ID NO: 125171 - DNA, 15 bp, Homo sapiens
tcactcttttaaaaa

SEQ ID NO: 125172 - DNA, 15 bp, Homo sapiens
ttcactcttttaaaa

SEQ ID NO: 125173 - DNA, 15 bp, Homo sapiens
tttcactcttttaaa

SEQ ID NO: 125174 - DNA, 15 bp, Homo sapiens
atttcactcttttaa

SEQ ID NO: 125175 - DNA, 15 bp, Homo sapiens
tatttcactctttta

SEQ ID NO: 125176 - DNA, 15 bp, Homo sapiens
ttatttcactctttt

SEQ ID NO: 125177 - DNA, 15 bp, Homo sapiens
attatttcactcttt

SEQ ID NO: 125178 - DNA, 15 bp, Homo sapiens
cattatttcactctt

SEQ ID NO: 125179 - DNA, 15 bp, Homo sapiens
acattatttcactct

SEQ ID NO: 125180 - DNA, 15 bp, Homo sapiens
tacattatttcactc

SEQ ID NO: 125181 - DNA, 15 bp, Homo sapiens
atacattatttcact

SEQ ID NO: 125182 - DNA, 15 bp, Homo sapiens
gatacattatttcac

SEQ ID NO: 125183 - DNA, 15 bp, Homo sapiens
tgatacattatttca

SEQ ID NO: 125184 - DNA, 15 bp, Homo sapiens
ttgatacattatttc

SEQ ID NO: 125185 - DNA, 15 bp, Homo sapiens
tttgatacattattt

SEQ ID NO: 125186 - DNA, 15 bp, Homo sapiens
ttttgatacattatt

SEQ ID NO: 125187 - DNA, 15 bp, Homo sapiens
attttgatacattat

SEQ ID NO: 125188 - DNA, 15 bp, Homo sapiens
cattttgatacatta

SEQ ID NO: 125189 - DNA, 15 bp, Homo sapiens
acattttgatacatt

SEQ ID NO: 125190 - DNA, 15 bp, Homo sapiens
aacattttgatacat

SEQ ID NO: 125191 - DNA, 15 bp, Homo sapiens
aaacattttgataca

SEQ ID NO: 125192 - DNA, 15 bp, Homo sapiens
aaaacattttgatac

SEQ ID NO: 125193 - DNA, 15 bp, Homo sapiens
taaaacattttgata

SEQ ID NO: 125194 - DNA, 15 bp, Homo sapiens
ataaaacattttgat

SEQ ID NO: 125195 - DNA, 15 bp, Homo sapiens
aataaaacattttga

SEQ ID NO: 125196 - DNA, 15 bp, Homo sapiens
aaataaaacattttg

SEQ ID NO: 125197 - DNA, 15 bp, Homo sapiens
gaaataaaacatttt

SEQ ID NO: 125198 - DNA, 15 bp, Homo sapiens
tgaaataaaacattt

SEQ ID NO: 125199 - DNA, 15 bp, Homo sapiens
atgaaataaaacatt

SEQ ID NO: 125200 - DNA, 15 bp, Homo sapiens
tatgaaataaaacat

SEQ ID NO: 125201 - DNA, 15 bp, Homo sapiens
gtatgaaataaaaca

SEQ ID NO: 125202 - DNA, 15 bp, Homo sapiens
tgtatgaaataaaac

SEQ ID NO: 125203 - DNA, 15 bp, Homo sapiens
ttgtatgaaataaaa

SEQ ID NO: 125204 - DNA, 15 bp, Homo sapiens
ttttgtatgaaataa

SEQ ID NO: 125205 - DNA, 15 bp, Homo sapiens
gttttgtatgaaata

SEQ ID NO: 125206 - DNA, 15 bp, Homo sapiens
agttttgtatgaaat

SEQ ID NO: 125207 - DNA, 15 bp, Homo sapiens
aagttttgtatgaaa

SEQ ID NO: 125208 - DNA, 15 bp, Homo sapiens
aaagttttgtatgaa

SEQ ID NO: 125209 - DNA, 15 bp, Homo sapiens
caaagttttgtatga

SEQ ID NO: 125210 - DNA, 15 bp, Homo sapiens
acaaagttttgtatg

SEQ ID NO: 125211 - DNA, 15 bp, Homo sapiens
cacaaagttttgtat

SEQ ID NO: 125212 - DNA, 15 bp, Homo sapiens
tcacaaagttttgta

SEQ ID NO: 125213 - DNA, 15 bp, Homo sapiens
atcacaaagttttgt

SEQ ID NO: 125214 - DNA, 15 bp, Homo sapiens
aatcacaaagttttg

SEQ ID NO: 125215 - DNA, 15 bp, Homo sapiens
caatcacaaagtttt

SEQ ID NO: 125216 - DNA, 15 bp, Homo sapiens
ccaatcacaaagttt

SEQ ID NO: 125217 - DNA, 15 bp, Homo sapiens
gccaatcacaaagtt

SEQ ID NO: 125218 - DNA, 15 bp, Homo sapiens
tgccaatcacaaagt

SEQ ID NO: 125219 - DNA, 15 bp, Homo sapiens
ctgccaatcacaaag

SEQ ID NO: 125220 - DNA, 15 bp, Homo sapiens
cctgccaatcacaaa

SEQ ID NO: 125221 - DNA, 15 bp, Homo sapiens
tcctgccaatcacaa

SEQ ID NO: 125222 - DNA, 15 bp, Homo sapiens
atcctgccaatcaca

SEQ ID NO: 125223 - DNA, 15 bp, Homo sapiens
tatcctgccaatcac

SEQ ID NO: 125224 - DNA, 15 bp, Homo sapiens
atatcctgccaatca

SEQ ID NO: 125225 - DNA, 15 bp, Homo sapiens
aatatcctgccaatc

SEQ ID NO: 125226 - DNA, 15 bp, Homo sapiens
gaatatcctgccaat

SEQ ID NO: 125227 - DNA, 15 bp, Homo sapiens
agaatatcctgccaa

SEQ ID NO: 125228 - DNA, 15 bp, Homo sapiens
gagaatatcctgcca

SEQ ID NO: 125229 - DNA, 15 bp, Homo sapiens
tgagaatatcctgcc

SEQ ID NO: 125230 - DNA, 15 bp, Homo sapiens
atgagaatatcctgc

SEQ ID NO: 125231 - DNA, 15 bp, Homo sapiens
aatgagaatatcctg

SEQ ID NO: 125232 - DNA, 15 bp, Homo sapiens
gaatgagaatatcct

SEQ ID NO: 125233 - DNA, 15 bp, Homo sapiens
agaatgagaatatcc

SEQ ID NO: 125234 - DNA, 15 bp, Homo sapiens
aagaatgagaatatc

SEQ ID NO: 125235 - DNA, 15 bp, Homo sapiens
aaagaatgagaatat

SEQ ID NO: 125236 - DNA, 15 bp, Homo sapiens
gaaagaatgagaata

SEQ ID NO: 125237 - DNA, 15 bp, Homo sapiens
tgaaagaatgagaat

SEQ ID NO: 125238 - DNA, 15 bp, Homo sapiens
ttgaaagaatgagaa

SEQ ID NO: 125239 - DNA, 15 bp, Homo sapiens
gttgaaagaatgaga

SEQ ID NO: 125240 - DNA, 15 bp, Homo sapiens
tgttgaaagaatgag

SEQ ID NO: 125241 - DNA, 15 bp, Homo sapiens
ttgttgaaagaatga

SEQ ID NO: 125242 - DNA, 15 bp, Homo sapiens
gttgttgaaagaatg

SEQ ID NO: 125243 - DNA, 15 bp, Homo sapiens
agttgttgaaagaat

SEQ ID NO: 125244 - DNA, 15 bp, Homo sapiens
gagttgttgaaagaa

SEQ ID NO: 125245 - DNA, 15 bp, Homo sapiens
tgagttgttgaaaga

SEQ ID NO: 125246 - DNA, 15 bp, Homo sapiens
ttgagttgttgaaag

SEQ ID NO: 125247 - DNA, 15 bp, Homo sapiens
cttgagttgttgaaa

SEQ ID NO: 125248 - DNA, 15 bp, Homo sapiens
tcttgagttgttgaa

SEQ ID NO: 125249 - DNA, 15 bp, Homo sapiens
ttcttgagttgttga

SEQ ID NO: 125250 - DNA, 15 bp, Homo sapiens
tttcttgagttgttg

SEQ ID NO: 125251 - DNA, 15 bp, Homo sapiens
ctttcttgagttgtt

SEQ ID NO: 125252 - DNA, 15 bp, Homo sapiens
cctttcttgagttgt

SEQ ID NO: 125253 - DNA, 15 bp, Homo sapiens
tcctttcttgagttg

SEQ ID NO: 125254 - DNA, 15 bp, Homo sapiens
ttcctttcttgagtt

SEQ ID NO: 125255 - DNA, 15 bp, Homo sapiens
attcctttcttgagt

SEQ ID NO: 125256 - DNA, 15 bp, Homo sapiens
aattcctttcttgag

SEQ ID NO: 125257 - DNA, 15 bp, Homo sapiens
caattcctttcttga

SEQ ID NO: 125258 - DNA, 15 bp, Homo sapiens
acaattcctttcttg

SEQ ID NO: 125259 - DNA, 15 bp, Homo sapiens
aacaattcctttctt

SEQ ID NO: 125260 - DNA, 15 bp, Homo sapiens
caacaattcctttct

SEQ ID NO: 125261 - DNA, 15 bp, Homo sapiens
acaacaattcctttc

SEQ ID NO: 125262 - DNA, 15 bp, Homo sapiens
aacaacaattccttt

SEQ ID NO: 125263 - DNA, 15 bp, Homo sapiens
aaacaacaattcctt

SEQ ID NO: 125264 - DNA, 15 bp, Homo sapiens
aaaacaacaattcct

SEQ ID NO: 125265 - DNA, 15 bp, Homo sapiens
aaaaacaacaattcc

SEQ ID NO: 125266 - DNA, 15 bp, Homo sapiens
aaaaaacaacaattc

SEQ ID NO: 125267 - DNA, 15 bp, Homo sapiens
caaaaaacaacaatt

SEQ ID NO: 125268 - DNA, 15 bp, Homo sapiens
acaaaaaacaacaat

SEQ ID NO: 125269 - DNA, 15 bp, Homo sapiens
aacaaaaaacaacaa

SEQ ID NO: 125270 - DNA, 15 bp, Homo sapiens
aaacaaaaaacaaca

SEQ ID NO: 125271 - DNA, 15 bp, Homo sapiens
caaacaaaaaacaac

SEQ ID NO: 125272 - DNA, 15 bp, Homo sapiens
gcaaacaaaaaacaa

SEQ ID NO: 125273 - DNA, 15 bp, Homo sapiens
agcaaacaaaaaaca

SEQ ID NO: 125274 - DNA, 15 bp, Homo sapiens
tagcaaacaaaaaac

SEQ ID NO: 125275 - DNA, 15 bp, Homo sapiens
ttagcaaacaaaaaa

SEQ ID NO: 125276 - DNA, 15 bp, Homo sapiens
gttagcaaacaaaaa

SEQ ID NO: 125277 - DNA, 15 bp, Homo sapiens
agttagcaaacaaaa

SEQ ID NO: 125278 - DNA, 15 bp, Homo sapiens
cagttagcaaacaaa

SEQ ID NO: 125279 - DNA, 15 bp, Homo sapiens
tcagttagcaaacaa

SEQ ID NO: 125280 - DNA, 15 bp, Homo sapiens
ctcagttagcaaaca

SEQ ID NO: 125281 - DNA, 15 bp, Homo sapiens
actcagttagcaaac

SEQ ID NO: 125282 - DNA, 15 bp, Homo sapiens
aactcagttagcaaa

SEQ ID NO: 125283 - DNA, 15 bp, Homo sapiens
aaactcagttagcaa

SEQ ID NO: 125284 - DNA, 15 bp, Homo sapiens
taaactcagttagca

SEQ ID NO: 125285 - DNA, 15 bp, Homo sapiens
ctaaactcagttagc

SEQ ID NO: 125286 - DNA, 15 bp, Homo sapiens
tctaaactcagttag

SEQ ID NO: 125287 - DNA, 15 bp, Homo sapiens
atctaaactcagtta

SEQ ID NO: 125288 - DNA, 15 bp, Homo sapiens
catctaaactcagtt

SEQ ID NO: 125289 - DNA, 15 bp, Homo sapiens
ccatctaaactcagt

SEQ ID NO: 125290 - DNA, 15 bp, Homo sapiens
gccatctaaactcag

SEQ ID NO: 125291 - DNA, 15 bp, Homo sapiens
tgccatctaaactca

SEQ ID NO: 125292 - DNA, 15 bp, Homo sapiens
atgccatctaaactc

SEQ ID NO: 125293 - DNA, 15 bp, Homo sapiens
tatgccatctaaact

SEQ ID NO: 125294 - DNA, 15 bp, Homo sapiens
ctatgccatctaaac

SEQ ID NO: 125295 - DNA, 15 bp, Homo sapiens
tctatgccatctaaa

SEQ ID NO: 125296 - DNA, 15 bp, Homo sapiens
atctatgccatctaa

SEQ ID NO: 125297 - DNA, 15 bp, Homo sapiens
gatctatgccatcta

SEQ ID NO: 125298 - DNA, 15 bp, Homo sapiens
agatctatgccatct

SEQ ID NO: 125299 - DNA, 15 bp, Homo sapiens
aagatctatgccatc

SEQ ID NO: 125300 - DNA, 15 bp, Homo sapiens
taagatctatgccat

SEQ ID NO: 125301 - DNA, 15 bp, Homo sapiens
ttaagatctatgcca

SEQ ID NO: 125302 - DNA, 15 bp, Homo sapiens
tttaagatctatgcc

SEQ ID NO: 125303 - DNA, 15 bp, Homo sapiens
ctttaagatctatgc

SEQ ID NO: 125304 - DNA, 15 bp, Homo sapiens
gctttaagatctatg

SEQ ID NO: 125305 - DNA, 15 bp, Homo sapiens
ggctttaagatctat

SEQ ID NO: 125306 - DNA, 15 bp, Homo sapiens
aggctttaagatcta

SEQ ID NO: 125307 - DNA, 15 bp, Homo sapiens
caggctttaagatct

SEQ ID NO: 125308 - DNA, 15 bp, Homo sapiens
acaggctttaagatc

SEQ ID NO: 125309 - DNA, 15 bp, Homo sapiens
gacaggctttaagat

SEQ ID NO: 125310 - DNA, 15 bp, Homo sapiens
tgacaggctttaaga

SEQ ID NO: 125311 - DNA, 15 bp, Homo sapiens
ttgacaggctttaag

SEQ ID NO: 125312 - DNA, 15 bp, Homo sapiens
tttgacaggctttaa

SEQ ID NO: 125313 - DNA, 15 bp, Homo sapiens
atttgacaggcttta

SEQ ID NO: 125314 - DNA, 15 bp, Homo sapiens
aatttgacaggcttt

SEQ ID NO: 125315 - DNA, 15 bp, Homo sapiens
taatttgacaggctt

SEQ ID NO: 125316 - DNA, 15 bp, Homo sapiens
ttaatttgacaggct

SEQ ID NO: 125317 - DNA, 15 bp, Homo sapiens
attaatttgacaggc

SEQ ID NO: 125318 - DNA, 15 bp, Homo sapiens
tattaatttgacagg

SEQ ID NO: 125319 - DNA, 15 bp, Homo sapiens
ttattaatttgacag

SEQ ID NO: 125320 - DNA, 15 bp, Homo sapiens
gttattaatttgaca

SEQ ID NO: 125321 - DNA, 15 bp, Homo sapiens
tgttattaatttgac

SEQ ID NO: 125322 - DNA, 15 bp, Homo sapiens
atgttattaatttga

SEQ ID NO: 125323 - DNA, 15 bp, Homo sapiens
tatgttattaatttg

SEQ ID NO: 125324 - DNA, 15 bp, Homo sapiens
gtatgttattaattt

SEQ ID NO: 125325 - DNA, 15 bp, Homo sapiens
agtatgttattaatt

SEQ ID NO: 125326 - DNA, 15 bp, Homo sapiens
aagtatgttattaat

SEQ ID NO: 125327 - DNA, 15 bp, Homo sapiens
taagtatgttattaa

SEQ ID NO: 125328 - DNA, 15 bp, Homo sapiens
ataagtatgttatta

SEQ ID NO: 125329 - DNA, 15 bp, Homo sapiens
tataagtatgttatt

SEQ ID NO: 125330 - DNA, 15 bp, Homo sapiens
gtataagtatgttat

SEQ ID NO: 125331 - DNA, 15 bp, Homo sapiens
agtataagtatgtta

SEQ ID NO: 125332 - DNA, 15 bp, Homo sapiens
cagtataagtatgtt

SEQ ID NO: 125333 - DNA, 15 bp, Homo sapiens
acagtataagtatgt

SEQ ID NO: 125334 - DNA, 15 bp, Homo sapiens
aacagtataagtatg

SEQ ID NO: 125335 - DNA, 15 bp, Homo sapiens
aaacagtataagtat

SEQ ID NO: 125336 - DNA, 15 bp, Homo sapiens
taaacagtataagta

SEQ ID NO: 125337 - DNA, 15 bp, Homo sapiens
ttaaacagtataagt

SEQ ID NO: 125338 - DNA, 15 bp, Homo sapiens
attaaacagtataag

SEQ ID NO: 125339 - DNA, 15 bp, Homo sapiens
tattaaacagtataa

SEQ ID NO: 125340 - DNA, 15 bp, Homo sapiens
atattaaacagtata

SEQ ID NO: 125341 - DNA, 15 bp, Homo sapiens
gatattaaacagtat

SEQ ID NO: 125342 - DNA, 15 bp, Homo sapiens
tgatattaaacagta

SEQ ID NO: 125343 - DNA, 15 bp, Homo sapiens
atgatattaaacagt

SEQ ID NO: 125344 - DNA, 15 bp, Homo sapiens
catgatattaaacag

SEQ ID NO: 125345 - DNA, 15 bp, Homo sapiens
gcatgatattaaaca

SEQ ID NO: 125346 - DNA, 15 bp, Homo sapiens
agcatgatattaaac

SEQ ID NO: 125347 - DNA, 15 bp, Homo sapiens
cagcatgatattaaa

SEQ ID NO: 125348 - DNA, 15 bp, Homo sapiens
gcagcatgatattaa

SEQ ID NO: 125349 - DNA, 15 bp, Homo sapiens
tgcagcatgatatta

SEQ ID NO: 125350 - DNA, 15 bp, Homo sapiens
ctgcagcatgatatt

SEQ ID NO: 125351 - DNA, 15 bp, Homo sapiens
tctgcagcatgatat

SEQ ID NO: 125352 - DNA, 15 bp, Homo sapiens
atctgcagcatgata

SEQ ID NO: 125353 - DNA, 15 bp, Homo sapiens
catctgcagcatgat

SEQ ID NO: 125354 - DNA, 15 bp, Homo sapiens
tcatctgcagcatga

SEQ ID NO: 125355 - DNA, 15 bp, Homo sapiens
ttcatctgcagcatg

SEQ ID NO: 125356 - DNA, 15 bp, Homo sapiens
tttcatctgcagcat

SEQ ID NO: 125357 - DNA, 15 bp, Homo sapiens
ttttcatctgcagca

SEQ ID NO: 125358 - DNA, 15 bp, Homo sapiens
attttcatctgcagc

SEQ ID NO: 125359 - DNA, 15 bp, Homo sapiens
aattttcatctgcag

SEQ ID NO: 125360 - DNA, 15 bp, Homo sapiens
taattttcatctgca

SEQ ID NO: 125361 - DNA, 15 bp, Homo sapiens
ctaattttcatctgc

SEQ ID NO: 125362 - DNA, 15 bp, Homo sapiens
cctaattttcatctg

SEQ ID NO: 125363 - DNA, 15 bp, Homo sapiens
tcctaattttcatct

SEQ ID NO: 125364 - DNA, 15 bp, Homo sapiens
atcctaattttcatc

SEQ ID NO: 125365 - DNA, 15 bp, Homo sapiens
tatcctaattttcat

SEQ ID NO: 125366 - DNA, 15 bp, Homo sapiens
gtatcctaattttca

SEQ ID NO: 125367 - DNA, 15 bp, Homo sapiens
tgtatcctaattttc

SEQ ID NO: 125368 - DNA, 15 bp, Homo sapiens
ctgtatcctaatttt

SEQ ID NO: 125369 - DNA, 15 bp, Homo sapiens
tctgtatcctaattt

SEQ ID NO: 125370 - DNA, 15 bp, Homo sapiens
atctgtatcctaatt

SEQ ID NO: 125371 - DNA, 15 bp, Homo sapiens
aatctgtatcctaat

SEQ ID NO: 125372 - DNA, 15 bp, Homo sapiens
caatctgtatcctaa

SEQ ID NO: 125373 - DNA, 15 bp, Homo sapiens
acaatctgtatccta

SEQ ID NO: 125374 - DNA, 15 bp, Homo sapiens
aacaatctgtatcct

SEQ ID NO: 125375 - DNA, 15 bp, Homo sapiens
taacaatctgtatcc

SEQ ID NO: 125376 - DNA, 15 bp, Homo sapiens
ttaacaatctgtatc

SEQ ID NO: 125377 - DNA, 15 bp, Homo sapiens
cttaacaatctgtat

SEQ ID NO: 125378 - DNA, 15 bp, Homo sapiens
ccttaacaatctgta

SEQ ID NO: 125379 - DNA, 15 bp, Homo sapiens
accttaacaatctgt

SEQ ID NO: 125380 - DNA, 15 bp, Homo sapiens
aaccttaacaatctg

SEQ ID NO: 125381 - DNA, 15 bp, Homo sapiens
aaaccttaacaatct

SEQ ID NO: 125382 - DNA, 15 bp, Homo sapiens
aaaaccttaacaatc

SEQ ID NO: 125383 - DNA, 15 bp, Homo sapiens
gaaaaccttaacaat

SEQ ID NO: 125384 - DNA, 15 bp, Homo sapiens
agaaaaccttaacaa

SEQ ID NO: 125385 - DNA, 15 bp, Homo sapiens
cagaaaaccttaaca

SEQ ID NO: 125386 - DNA, 15 bp, Homo sapiens
acagaaaaccttaac

SEQ ID NO: 125387 - DNA, 15 bp, Homo sapiens
aacagaaaaccttaa

SEQ ID NO: 125388 - DNA, 15 bp, Homo sapiens
caacagaaaacctta

SEQ ID NO: 125389 - DNA, 15 bp, Homo sapiens
gcaacagaaaacctt

SEQ ID NO: 125390 - DNA, 15 bp, Homo sapiens
tgcaacagaaaacct

SEQ ID NO: 125391 - DNA, 15 bp, Homo sapiens
ttgcaacagaaaacc

SEQ ID NO: 125392 - DNA, 15 bp, Homo sapiens
cttgcaacagaaaac

SEQ ID NO: 125393 - DNA, 15 bp, Homo sapiens
ccttgcaacagaaaa

SEQ ID NO: 125394 - DNA, 15 bp, Homo sapiens
accttgcaacagaaa

SEQ ID NO: 125395 - DNA, 15 bp, Homo sapiens
taccttgcaacagaa

SEQ ID NO: 125396 - DNA, 15 bp, Homo sapiens
ctaccttgcaacaga

SEQ ID NO: 125397 - DNA, 15 bp, Homo sapiens
cctaccttgcaacag

SEQ ID NO: 125398 - DNA, 15 bp, Homo sapiens
acctaccttgcaaca

SEQ ID NO: 125399 - DNA, 15 bp, Homo sapiens
aacctaccttgcaac

SEQ ID NO: 125400 - DNA, 15 bp, Homo sapiens
aaacctaccttgcaa

SEQ ID NO: 125401 - DNA, 15 bp, Homo sapiens
taaacctaccttgca

SEQ ID NO: 125402 - DNA, 15 bp, Homo sapiens
ataaacctaccttgc

SEQ ID NO: 125403 - DNA, 15 bp, Homo sapiens
tataaacctaccttg

SEQ ID NO: 125404 - DNA, 15 bp, Homo sapiens
ttataaacctacctt

SEQ ID NO: 125405 - DNA, 15 bp, Homo sapiens
attataaacctacct

SEQ ID NO: 125406 - DNA, 15 bp, Homo sapiens
tattataaacctacc

SEQ ID NO: 125407 - DNA, 15 bp, Homo sapiens
atattataaacctac

SEQ ID NO: 125408 - DNA, 15 bp, Homo sapiens
tatattataaaccta

SEQ ID NO: 125409 - DNA, 15 bp, Homo sapiens
ttatattataaacct

SEQ ID NO: 125410 - DNA, 15 bp, Homo sapiens
tttatattataaacc

SEQ ID NO: 125411 - DNA, 15 bp, Homo sapiens
ttttatattataaac

SEQ ID NO: 125412 - DNA, 15 bp, Homo sapiens
attttatattataaa

SEQ ID NO: 125413 - DNA, 15 bp, Homo sapiens
tattttatattataa

SEQ ID NO: 125414 - DNA, 15 bp, Homo sapiens
atattttatattata

SEQ ID NO: 125415 - DNA, 15 bp, Homo sapiens
aatattttatattat

SEQ ID NO: 125416 - DNA, 15 bp, Homo sapiens
taatattttatatta

SEQ ID NO: 125417 - DNA, 15 bp, Homo sapiens
ttaatattttatatt

SEQ ID NO: 125418 - DNA, 15 bp, Homo sapiens
tttaatattttatat

SEQ ID NO: 125419 - DNA, 15 bp, Homo sapiens
ttttaatattttata

SEQ ID NO: 125420 - DNA, 15 bp, Homo sapiens
gttttaatattttat

SEQ ID NO: 125421 - DNA, 15 bp, Homo sapiens
agttttaatatttta

SEQ ID NO: 125422 - DNA, 15 bp, Homo sapiens
tagttttaatatttt

SEQ ID NO: 125423 - DNA, 15 bp, Homo sapiens
ttagttttaatattt

SEQ ID NO: 125424 - DNA, 15 bp, Homo sapiens
cttagttttaatatt

SEQ ID NO: 125425 - DNA, 15 bp, Homo sapiens
acttagttttaatat

SEQ ID NO: 125426 - DNA, 15 bp, Homo sapiens
aacttagttttaata

SEQ ID NO: 125427 - DNA, 15 bp, Homo sapiens
aaacttagttttaat

SEQ ID NO: 125428 - DNA, 15 bp, Homo sapiens
aaaacttagttttaa

SEQ ID NO: 125429 - DNA, 15 bp, Homo sapiens
taaaacttagtttta

SEQ ID NO: 125430 - DNA, 15 bp, Homo sapiens
ttaaaacttagtttt

SEQ ID NO: 125431 - DNA, 15 bp, Homo sapiens
tttaaaacttagttt

SEQ ID NO: 125432 - DNA, 15 bp, Homo sapiens
ttttaaaacttagtt

SEQ ID NO: 125433 - DNA, 15 bp, Homo sapiens
tttttaaaacttagt

SEQ ID NO: 125434 - DNA, 15 bp, Homo sapiens
atttttaaaacttag

SEQ ID NO: 125435 - DNA, 15 bp, Homo sapiens
aatttttaaaactta

SEQ ID NO: 125436 - DNA, 15 bp, Homo sapiens
caaatttttaaaact

SEQ ID NO: 125437 - DNA, 15 bp, Homo sapiens
ccaaatttttaaaac

SEQ ID NO: 125438 - DNA, 15 bp, Homo sapiens
accaaatttttaaaa

SEQ ID NO: 125439 - DNA, 15 bp, Homo sapiens
aaccaaatttttaaa

SEQ ID NO: 125440 - DNA, 15 bp, Homo sapiens
gaaccaaatttttaa

SEQ ID NO: 125441 - DNA, 15 bp, Homo sapiens
tgaaccaaattttta

SEQ ID NO: 125442 - DNA, 15 bp, Homo sapiens
atgaaccaaattttt

SEQ ID NO: 125443 - DNA, 15 bp, Homo sapiens
catgaaccaaatttt

SEQ ID NO: 125444 - DNA, 15 bp, Homo sapiens
tcatgaaccaaattt

SEQ ID NO: 125445 - DNA, 15 bp, Homo sapiens
atcatgaaccaaatt

SEQ ID NO: 125446 - DNA, 15 bp, Homo sapiens
tatcatgaaccaaat

SEQ ID NO: 125447 - DNA, 15 bp, Homo sapiens
atatcatgaaccaaa

SEQ ID NO: 125448 - DNA, 15 bp, Homo sapiens
aatatcatgaaccaa

SEQ ID NO: 125449 - DNA, 15 bp, Homo sapiens
caatatcatgaacca

SEQ ID NO: 125450 - DNA, 15 bp, Homo sapiens
gcaatatcatgaacc

SEQ ID NO: 125451 - DNA, 15 bp, Homo sapiens
tgcaatatcatgaac

SEQ ID NO: 125452 - DNA, 15 bp, Homo sapiens
atgcaatatcatgaa

SEQ ID NO: 125453 - DNA, 15 bp, Homo sapiens
aatgcaatatcatga

SEQ ID NO: 125454 - DNA, 15 bp, Homo sapiens
gaatgcaatatcatg

SEQ ID NO: 125455 - DNA, 15 bp, Homo sapiens
ggaatgcaatatcat

SEQ ID NO: 125456 - DNA, 15 bp, Homo sapiens
aggaatgcaatatca

SEQ ID NO: 125457 - DNA, 15 bp, Homo sapiens
aaggaatgcaatatc

SEQ ID NO: 125458 - DNA, 15 bp, Homo sapiens
gaaggaatgcaatat

SEQ ID NO: 125459 - DNA, 15 bp, Homo sapiens
tgaaggaatgcaata

SEQ ID NO: 125460 - DNA, 15 bp, Homo sapiens
gtgaaggaatgcaat

SEQ ID NO: 125461 - DNA, 15 bp, Homo sapiens
tgtgaaggaatgcaa

SEQ ID NO: 125462 - DNA, 15 bp, Homo sapiens
gtgtgaaggaatgca

SEQ ID NO: 125463 - DNA, 15 bp, Homo sapiens
tgtgtgaaggaatgc

SEQ ID NO: 125464 - DNA, 15 bp, Homo sapiens
ttgtgtgaaggaatg

SEQ ID NO: 125465 - DNA, 15 bp, Homo sapiens
attgtgtgaaggaat

SEQ ID NO: 125466 - DNA, 15 bp, Homo sapiens
tattgtgtgaaggaa

SEQ ID NO: 125467 - DNA, 15 bp, Homo sapiens
ctattgtgtgaagga

SEQ ID NO: 125468 - DNA, 15 bp, Homo sapiens
actattgtgtgaagg

SEQ ID NO: 125469 - DNA, 15 bp, Homo sapiens
gactattgtgtgaag

SEQ ID NO: 125470 - DNA, 15 bp, Homo sapiens
agactattgtgtgaa

SEQ ID NO: 125471 - DNA, 15 bp, Homo sapiens
aagactattgtgtga

SEQ ID NO: 125472 - DNA, 15 bp, Homo sapiens
caagactattgtgtg

SEQ ID NO: 125473 - DNA, 15 bp, Homo sapiens
acaagactattgtgt

SEQ ID NO: 125474 - DNA, 15 bp, Homo sapiens
aacaagactattgtg

SEQ ID NO: 125475 - DNA, 15 bp, Homo sapiens
taacaagactattgt

SEQ ID NO: 125476 - DNA, 15 bp, Homo sapiens
ataacaagactattg

SEQ ID NO: 125477 - DNA, 15 bp, Homo sapiens
aataacaagactatt

SEQ ID NO: 125478 - DNA, 15 bp, Homo sapiens
taataacaagactat

SEQ ID NO: 125479 - DNA, 15 bp, Homo sapiens
ataataacaagacta

SEQ ID NO: 125480 - DNA, 15 bp, Homo sapiens
aataataacaagact

SEQ ID NO: 125481 - DNA, 15 bp, Homo sapiens
gaataataacaagac

SEQ ID NO: 125482 - DNA, 15 bp, Homo sapiens
tgaataataacaaga

SEQ ID NO: 125483 - DNA, 15 bp, Homo sapiens
atgaataataacaag

SEQ ID NO: 125484 - DNA, 15 bp, Homo sapiens
aatgaataataacaa

SEQ ID NO: 125485 - DNA, 15 bp, Homo sapiens
caatgaataataaca

SEQ ID NO: 125486 - DNA, 15 bp, Homo sapiens
acaatgaataataac

SEQ ID NO: 125487 - DNA, 15 bp, Homo sapiens
cacaatgaataataa

SEQ ID NO: 125488 - DNA, 15 bp, Homo sapiens
ccacaatgaataata

SEQ ID NO: 125489 - DNA, 15 bp, Homo sapiens
cccacaatgaataat

SEQ ID NO: 125490 - DNA, 15 bp, Homo sapiens
ccccacaatgaataa

SEQ ID NO: 125491 - DNA, 15 bp, Homo sapiens
cccccacaatgaata

SEQ ID NO: 125492 - DNA, 15 bp, Homo sapiens
acccccacaatgaat

SEQ ID NO: 125493 - DNA, 15 bp, Homo sapiens
tacccccacaatgaa

SEQ ID NO: 125494 - DNA, 15 bp, Homo sapiens
atacccccacaatga

SEQ ID NO: 125495 - DNA, 15 bp, Homo sapiens
aatacccccacaatg

SEQ ID NO: 125496 - DNA, 15 bp, Homo sapiens
aaatacccccacaat

SEQ ID NO: 125497 - DNA, 15 bp, Homo sapiens
aaaatacccccacaa

SEQ ID NO: 125498 - DNA, 15 bp, Homo sapiens
taaaatacccccaca

SEQ ID NO: 125499 - DNA, 15 bp, Homo sapiens
ttaaaatacccccac

SEQ ID NO: 125500 - DNA, 15 bp, Homo sapiens
cttaaaataccccca

SEQ ID NO: 125501 - DNA, 15 bp, Homo sapiens
tcttaaaataccccc

SEQ ID NO: 125502 - DNA, 15 bp, Homo sapiens
ctcttaaaatacccc

SEQ ID NO: 125503 - DNA, 15 bp, Homo sapiens
tctcttaaaataccc

SEQ ID NO: 125504 - DNA, 15 bp, Homo sapiens
atctcttaaaatacc

SEQ ID NO: 125505 - DNA, 15 bp, Homo sapiens
tatctcttaaaatac

SEQ ID NO: 125506 - DNA, 15 bp, Homo sapiens
atatctcttaaaata

SEQ ID NO: 125507 - DNA, 15 bp, Homo sapiens
tatatctcttaaaat

SEQ ID NO: 125508 - DNA, 15 bp, Homo sapiens
atatatctcttaaaa

SEQ ID NO: 125509 - DNA, 15 bp, Homo sapiens
tatatatctcttaaa

SEQ ID NO: 125510 - DNA, 15 bp, Homo sapiens
atatatatctcttaa

SEQ ID NO: 125511 - DNA, 15 bp, Homo sapiens
tatatatatctctta

SEQ ID NO: 125512 - DNA, 15 bp, Homo sapiens
atatatatatctctt

SEQ ID NO: 125513 - DNA, 15 bp, Homo sapiens
tatatatatatctct

SEQ ID NO: 125514 - DNA, 15 bp, Homo sapiens
atatatatatatctc

SEQ ID NO: 125515 - DNA, 15 bp, Homo sapiens
tatatatatatatct

SEQ ID NO: 125516 - DNA, 15 bp, Homo sapiens
atatatatatatatc

SEQ ID NO: 125517 - DNA, 15 bp, Homo sapiens
aaaaaaatatatata

SEQ ID NO: 125518 - DNA, 15 bp, Homo sapiens
aaaaaaaatatatat

SEQ ID NO: 125519 - DNA, 15 bp, Homo sapiens
aaaaaaaaatatata

SEQ ID NO: 125520 - DNA, 15 bp, Homo sapiens
aaaaaaaaaatatat

SEQ ID NO: 125521 - DNA, 15 bp, Homo sapiens
aaaaaaaaaaatata

SEQ ID NO: 125522 - DNA, 15 bp, Homo sapiens
caaaaaaaaaaatat

SEQ ID NO: 125523 - DNA, 15 bp, Homo sapiens
gcaaaaaaaaaaata

SEQ ID NO: 125524 - DNA, 15 bp, Homo sapiens
agcaaaaaaaaaaat

SEQ ID NO: 125525 - DNA, 15 bp, Homo sapiens
cagcaaaaaaaaaaa

SEQ ID NO: 125526 - DNA, 15 bp, Homo sapiens
aacagcaaaaaaaaa

SEQ ID NO: 125527 - DNA, 15 bp, Homo sapiens
aaacagcaaaaaaaa

SEQ ID NO: 125528 - DNA, 15 bp, Homo sapiens
aaaacagcaaaaaaa

SEQ ID NO: 125529 - DNA, 15 bp, Homo sapiens
aaaaacagcaaaaaa

SEQ ID NO: 125530 - DNA, 15 bp, Homo sapiens
caaaaacagcaaaaa

SEQ ID NO: 125531 - DNA, 15 bp, Homo sapiens
acaaaaacagcaaaa

SEQ ID NO: 125532 - DNA, 15 bp, Homo sapiens
tacaaaaacagcaaa

SEQ ID NO: 125533 - DNA, 15 bp, Homo sapiens
ctacaaaaacagcaa

SEQ ID NO: 125534 - DNA, 15 bp, Homo sapiens
cctacaaaaacagca

SEQ ID NO: 125535 - DNA, 15 bp, Homo sapiens
gcctacaaaaacagc

SEQ ID NO: 125536 - DNA, 15 bp, Homo sapiens
tgcctacaaaaacag

SEQ ID NO: 125537 - DNA, 15 bp, Homo sapiens
ttgcctacaaaaaca

SEQ ID NO: 125538 - DNA, 15 bp, Homo sapiens
attgcctacaaaaac

SEQ ID NO: 125539 - DNA, 15 bp, Homo sapiens
gattgcctacaaaaa

SEQ ID NO: 125540 - DNA, 15 bp, Homo sapiens
ggattgcctacaaaa

SEQ ID NO: 125541 - DNA, 15 bp, Homo sapiens
gggattgcctacaaa

SEQ ID NO: 125542 - DNA, 15 bp, Homo sapiens
agggattgcctacaa

SEQ ID NO: 125543 - DNA, 15 bp, Homo sapiens
tagggattgcctaca

SEQ ID NO: 125544 - DNA, 15 bp, Homo sapiens
atagggattgcctac

SEQ ID NO: 125545 - DNA, 15 bp, Homo sapiens
aatagggattgccta

SEQ ID NO: 125546 - DNA, 15 bp, Homo sapiens
gaatagggattgcct

SEQ ID NO: 125547 - DNA, 15 bp, Homo sapiens
tgaatagggattgcc

SEQ ID NO: 125548 - DNA, 15 bp, Homo sapiens
ttgaatagggattgc

SEQ ID NO: 125549 - DNA, 15 bp, Homo sapiens
gttgaatagggattg

SEQ ID NO: 125550 - DNA, 15 bp, Homo sapiens
tgttgaatagggatt

SEQ ID NO: 125551 - DNA, 15 bp, Homo sapiens
ctgttgaatagggat

SEQ ID NO: 125552 - DNA, 15 bp, Homo sapiens
tctgttgaataggga

SEQ ID NO: 125553 - DNA, 15 bp, Homo sapiens
ctctgttgaataggg

SEQ ID NO: 125554 - DNA, 15 bp, Homo sapiens
cctctgttgaatagg

SEQ ID NO: 125555 - DNA, 15 bp, Homo sapiens
tcctctgttgaatag

SEQ ID NO: 125556 - DNA, 15 bp, Homo sapiens
ttcctctgttgaata

SEQ ID NO: 125557 - DNA, 15 bp, Homo sapiens
tttcctctgttgaat

SEQ ID NO: 125558 - DNA, 15 bp, Homo sapiens
ttttcctctgttgaa

SEQ ID NO: 125559 - DNA, 15 bp, Homo sapiens
attttcctctgttga

SEQ ID NO: 125560 - DNA, 15 bp, Homo sapiens
cattttcctctgttg

SEQ ID NO: 125561 - DNA, 15 bp, Homo sapiens
acccattttcctctg

SEQ ID NO: 125562 - DNA, 15 bp, Homo sapiens
gacccattttcctct

SEQ ID NO: 125563 - DNA, 15 bp, Homo sapiens
tgacccattttcctc

SEQ ID NO: 125564 - DNA, 15 bp, Homo sapiens
ttgacccattttcct

SEQ ID NO: 125565 - DNA, 15 bp, Homo sapiens
gttgacccattttcc

SEQ ID NO: 125566 - DNA, 15 bp, Homo sapiens
agttgacccattttc

SEQ ID NO: 125567 - DNA, 15 bp, Homo sapiens
aagttgacccatttt

SEQ ID NO: 125568 - DNA, 15 bp, Homo sapiens
caagttgacccattt

SEQ ID NO: 125569 - DNA, 15 bp, Homo sapiens
gcaagttgacccatt

SEQ ID NO: 125570 - DNA, 15 bp, Homo sapiens
agcaagttgacccat

SEQ ID NO: 125571 - DNA, 15 bp, Homo sapiens
aagcaagttgaccca

SEQ ID NO: 125572 - DNA, 15 bp, Homo sapiens
gaagcaagttgaccc

SEQ ID NO: 125573 - DNA, 15 bp, Homo sapiens
agaagcaagttgacc

SEQ ID NO: 125574 - DNA, 15 bp, Homo sapiens
cagaagcaagttgac

SEQ ID NO: 125575 - DNA, 15 bp, Homo sapiens
ccagaagcaagttga

SEQ ID NO: 125576 - DNA, 15 bp, Homo sapiens
tccagaagcaagttg

SEQ ID NO: 125577 - DNA, 15 bp, Homo sapiens
ttccagaagcaagtt

SEQ ID NO: 125578 - DNA, 15 bp, Homo sapiens
attccagaagcaagt

SEQ ID NO: 125579 - DNA, 15 bp, Homo sapiens
aattccagaagcaag

SEQ ID NO: 125580 - DNA, 15 bp, Homo sapiens
taattccagaagcaa

SEQ ID NO: 125581 - DNA, 15 bp, Homo sapiens
ctaattccagaagca

SEQ ID NO: 125582 - DNA, 15 bp, Homo sapiens
tctaattccagaagc

SEQ ID NO: 125583 - DNA, 15 bp, Homo sapiens
atctaattccagaag

SEQ ID NO: 125584 - DNA, 15 bp, Homo sapiens
gatctaattccagaa

SEQ ID NO: 125585 - DNA, 15 bp, Homo sapiens
tgatctaattccaga

SEQ ID NO: 125586 - DNA, 15 bp, Homo sapiens
atgatctaattccag

SEQ ID NO: 125587 - DNA, 15 bp, Homo sapiens
gatgatctaattcca

SEQ ID NO: 125588 - DNA, 15 bp, Homo sapiens
tgatgatctaattcc

SEQ ID NO: 125589 - DNA, 15 bp, Homo sapiens
gtgatgatctaattc

SEQ ID NO: 125590 - DNA, 15 bp, Homo sapiens
agtgatgatctaatt

SEQ ID NO: 125591 - DNA, 15 bp, Homo sapiens
aagtgatgatctaat

SEQ ID NO: 125592 - DNA, 15 bp, Homo sapiens
gaagtgatgatctaa

SEQ ID NO: 125593 - DNA, 15 bp, Homo sapiens
agaagtgatgatcta

SEQ ID NO: 125594 - DNA, 15 bp, Homo sapiens
aagaagtgatgatct

SEQ ID NO: 125595 - DNA, 15 bp, Homo sapiens
gaagaagtgatgatc

SEQ ID NO: 125596 - DNA, 15 bp, Homo sapiens
ggaagaagtgatgat

SEQ ID NO: 125597 - DNA, 15 bp, Homo sapiens
aggaagaagtgatga

SEQ ID NO: 125598 - DNA, 15 bp, Homo sapiens
taggaagaagtgatg

SEQ ID NO: 125599 - DNA, 15 bp, Homo sapiens
gtaggaagaagtgat

SEQ ID NO: 125600 - DNA, 15 bp, Homo sapiens
tgtaggaagaagtga

SEQ ID NO: 125601 - DNA, 15 bp, Homo sapiens
ctgtaggaagaagtg

SEQ ID NO: 125602 - DNA, 15 bp, Homo sapiens
tctgtaggaagaagt

SEQ ID NO: 125603 - DNA, 15 bp, Homo sapiens
atctgtaggaagaag

SEQ ID NO: 125604 - DNA, 15 bp, Homo sapiens
aatctgtaggaagaa

SEQ ID NO: 125605 - DNA, 15 bp, Homo sapiens
taatctgtaggaaga

SEQ ID NO: 125606 - DNA, 15 bp, Homo sapiens
ataatctgtaggaag

SEQ ID NO: 125607 - DNA, 15 bp, Homo sapiens
gataatctgtaggaa

SEQ ID NO: 125608 - DNA, 15 bp, Homo sapiens
agataatctgtagga

SEQ ID NO: 125609 - DNA, 15 bp, Homo sapiens
cagataatctgtagg

SEQ ID NO: 125610 - DNA, 15 bp, Homo sapiens
ccagataatctgtag

SEQ ID NO: 125611 - DNA, 15 bp, Homo sapiens
accagataatctgta

SEQ ID NO: 125612 - DNA, 15 bp, Homo sapiens
aaccagataatctgt

SEQ ID NO: 125613 - DNA, 15 bp, Homo sapiens
caaccagataatctg

SEQ ID NO: 125614 - DNA, 15 bp, Homo sapiens
tcaaccagataatct

SEQ ID NO: 125615 - DNA, 15 bp, Homo sapiens
ttcaaccagataatc

SEQ ID NO: 125616 - DNA, 15 bp, Homo sapiens
tttcaaccagataat

SEQ ID NO: 125617 - DNA, 15 bp, Homo sapiens
atttcaaccagataa

SEQ ID NO: 125618 - DNA, 15 bp, Homo sapiens
aatttcaaccagata

SEQ ID NO: 125619 - DNA, 15 bp, Homo sapiens
taatttcaaccagat

SEQ ID NO: 125620 - DNA, 15 bp, Homo sapiens
ttaatttcaaccaga

SEQ ID NO: 125621 - DNA, 15 bp, Homo sapiens
gttaatttcaaccag

SEQ ID NO: 125622 - DNA, 15 bp, Homo sapiens
tgttaatttcaacca

SEQ ID NO: 125623 - DNA, 15 bp, Homo sapiens
ttgttaatttcaacc

SEQ ID NO: 125624 - DNA, 15 bp, Homo sapiens
tttgttaatttcaac

SEQ ID NO: 125625 - DNA, 15 bp, Homo sapiens
ttttgttaatttcaa

SEQ ID NO: 125626 - DNA, 15 bp, Homo sapiens
attttgttaatttca

SEQ ID NO: 125627 - DNA, 15 bp, Homo sapiens
aattttgttaatttc

SEQ ID NO: 125628 - DNA, 15 bp, Homo sapiens
aaattttgttaattt

SEQ ID NO: 125629 - DNA, 15 bp, Homo sapiens
aaaattttgttaatt

SEQ ID NO: 125630 - DNA, 15 bp, Homo sapiens
taaaattttgttaat

SEQ ID NO: 125631 - DNA, 15 bp, Homo sapiens
gtaaaattttgttaa

SEQ ID NO: 125632 - DNA, 15 bp, Homo sapiens
agtaaaattttgtta

SEQ ID NO: 125633 - DNA, 15 bp, Homo sapiens
aagtaaaattttgtt

SEQ ID NO: 125634 - DNA, 15 bp, Homo sapiens
aaagtaaaattttgt

SEQ ID NO: 125635 - DNA, 15 bp, Homo sapiens
caaagtaaaattttg

SEQ ID NO: 125636 - DNA, 15 bp, Homo sapiens
gcaaagtaaaatttt

SEQ ID NO: 125637 - DNA, 15 bp, Homo sapiens
tgcaaagtaaaattt

SEQ ID NO: 125638 - DNA, 15 bp, Homo sapiens
atgcaaagtaaaatt

SEQ ID NO: 125639 - DNA, 15 bp, Homo sapiens
catgcaaagtaaaat

SEQ ID NO: 125640 - DNA, 15 bp, Homo sapiens
ccatgcaaagtaaaa

SEQ ID NO: 125641 - DNA, 15 bp, Homo sapiens
tccatgcaaagtaaa

SEQ ID NO: 125642 - DNA, 15 bp, Homo sapiens
atccatgcaaagtaa

SEQ ID NO: 125643 - DNA, 15 bp, Homo sapiens
catccatgcaaagta

SEQ ID NO: 125644 - DNA, 15 bp, Homo sapiens
tcatccatgcaaagt

SEQ ID NO: 125645 - DNA, 15 bp, Homo sapiens
atcatccatgcaaag

SEQ ID NO: 125646 - DNA, 15 bp, Homo sapiens
catcatccatgcaaa

SEQ ID NO: 125647 - DNA, 15 bp, Homo sapiens
acatcatccatgcaa

SEQ ID NO: 125648 - DNA, 15 bp, Homo sapiens
aacatcatccatgca

SEQ ID NO: 125649 - DNA, 15 bp, Homo sapiens
caacatcatccatgc

SEQ ID NO: 125650 - DNA, 15 bp, Homo sapiens
tcaacatcatccatg

SEQ ID NO: 125651 - DNA, 15 bp, Homo sapiens
ttcaacatcatccat

SEQ ID NO: 125652 - DNA, 15 bp, Homo sapiens
attcaacatcatcca

SEQ ID NO: 125653 - DNA, 15 bp, Homo sapiens
aattcaacatcatcc

SEQ ID NO: 125654 - DNA, 15 bp, Homo sapiens
taattcaacatcatc

SEQ ID NO: 125655 - DNA, 15 bp, Homo sapiens
ataattcaacatcat

SEQ ID NO: 125656 - DNA, 15 bp, Homo sapiens
gataattcaacatca

SEQ ID NO: 125657 - DNA, 15 bp, Homo sapiens
cgataattcaacatc

SEQ ID NO: 125658 - DNA, 15 bp, Homo sapiens
gcgataattcaacat

SEQ ID NO: 125659 - DNA, 15 bp, Homo sapiens
agcgataattcaaca

SEQ ID NO: 125660 - DNA, 15 bp, Homo sapiens
aagcgataattcaac

SEQ ID NO: 125661 - DNA, 15 bp, Homo sapiens
taagcgataattcaa

SEQ ID NO: 125662 - DNA, 15 bp, Homo sapiens
ttaagcgataattca

SEQ ID NO: 125663 - DNA, 15 bp, Homo sapiens
attaagcgataattc

SEQ ID NO: 125664 - DNA, 15 bp, Homo sapiens
cattaagcgataatt

SEQ ID NO: 125665 - DNA, 15 bp, Homo sapiens
acattaagcgataat

SEQ ID NO: 125666 - DNA, 15 bp, Homo sapiens
aacattaagcgataa

SEQ ID NO: 125667 - DNA, 15 bp, Homo sapiens
gaacattaagcgata

SEQ ID NO: 125668 - DNA, 15 bp, Homo sapiens
ggaacattaagcgat

SEQ ID NO: 125669 - DNA, 15 bp, Homo sapiens
tggaacattaagcga

SEQ ID NO: 125670 - DNA, 15 bp, Homo sapiens
ctggaacattaagcg

SEQ ID NO: 125671 - DNA, 15 bp, Homo sapiens
tctggaacattaagc

SEQ ID NO: 125672 - DNA, 15 bp, Homo sapiens
ctctggaacattaag

SEQ ID NO: 125673 - DNA, 15 bp, Homo sapiens
gctctggaacattaa

SEQ ID NO: 125674 - DNA, 15 bp, Homo sapiens
agctctggaacatta

SEQ ID NO: 125675 - DNA, 15 bp, Homo sapiens
gagctctggaacatt

SEQ ID NO: 125676 - DNA, 15 bp, Homo sapiens
tgagctctggaacat

SEQ ID NO: 125677 - DNA, 15 bp, Homo sapiens
ttgagctctggaaca

SEQ ID NO: 125678 - DNA, 15 bp, Homo sapiens
gttgagctctggaac

SEQ ID NO: 125679 - DNA, 15 bp, Homo sapiens
tgttgagctctggaa

SEQ ID NO: 125680 - DNA, 15 bp, Homo sapiens
gtgttgagctctgga

SEQ ID NO: 125681 - DNA, 15 bp, Homo sapiens
agtgttgagctctgg

SEQ ID NO: 125682 - DNA, 15 bp, Homo sapiens
cagtgttgagctctg

SEQ ID NO: 125683 - DNA, 15 bp, Homo sapiens
gcagtgttgagctct

SEQ ID NO: 125684 - DNA, 15 bp, Homo sapiens
agcagtgttgagctc

SEQ ID NO: 125685 - DNA, 15 bp, Homo sapiens
tagcagtgttgagct

SEQ ID NO: 125686 - DNA, 15 bp, Homo sapiens
atagcagtgttgagc

SEQ ID NO: 125687 - DNA, 15 bp, Homo sapiens
aatagcagtgttgag

SEQ ID NO: 125688 - DNA, 15 bp, Homo sapiens
aaatagcagtgttga

SEQ ID NO: 125689 - DNA, 15 bp, Homo sapiens
taaatagcagtgttg

SEQ ID NO: 125690 - DNA, 15 bp, Homo sapiens
gtaaatagcagtgtt

SEQ ID NO: 125691 - DNA, 15 bp, Homo sapiens
cgtaaatagcagtgt

SEQ ID NO: 125692 - DNA, 15 bp, Homo sapiens
tcgtaaatagcagtg

SEQ ID NO: 125693 - DNA, 15 bp, Homo sapiens
ttcgtaaatagcagt

SEQ ID NO: 125694 - DNA, 15 bp, Homo sapiens
cttcgtaaatagcag

SEQ ID NO: 125695 - DNA, 15 bp, Homo sapiens
tcttcgtaaatagca

SEQ ID NO: 125696 - DNA, 15 bp, Homo sapiens
gtcttcgtaaatagc

SEQ ID NO: 125697 - DNA, 15 bp, Homo sapiens
agtcttcgtaaatag

SEQ ID NO: 125698 - DNA, 15 bp, Homo sapiens
aagtcttcgtaaata

SEQ ID NO: 125699 - DNA, 15 bp, Homo sapiens
gaagtcttcgtaaat

SEQ ID NO: 125700 - DNA, 15 bp, Homo sapiens
agaagtcttcgtaaa

SEQ ID NO: 125701 - DNA, 15 bp, Homo sapiens
gagaagtcttcgtaa

SEQ ID NO: 125702 - DNA, 15 bp, Homo sapiens
agagaagtcttcgta

SEQ ID NO: 125703 - DNA, 15 bp, Homo sapiens
aagagaagtcttcgt

SEQ ID NO: 125704 - DNA, 15 bp, Homo sapiens
aaagagaagtcttcg

SEQ ID NO: 125705 - DNA, 15 bp, Homo sapiens
aaaagagaagtcttc

SEQ ID NO: 125706 - DNA, 15 bp, Homo sapiens
gaaaagagaagtctt

SEQ ID NO: 125707 - DNA, 15 bp, Homo sapiens
tgaaaagagaagtct

SEQ ID NO: 125708 - DNA, 15 bp, Homo sapiens
ctgaaaagagaagtc

SEQ ID NO: 125709 - DNA, 15 bp, Homo sapiens
cctgaaaagagaagt

SEQ ID NO: 125710 - DNA, 15 bp, Homo sapiens
tcctgaaaagagaag

SEQ ID NO: 125711 - DNA, 15 bp, Homo sapiens
ttcctgaaaagagaa

SEQ ID NO: 125712 - DNA, 15 bp, Homo sapiens
cttcctgaaaagaga

SEQ ID NO: 125713 - DNA, 15 bp, Homo sapiens
tcttcctgaaaagag

SEQ ID NO: 125714 - DNA, 15 bp, Homo sapiens
gtcttcctgaaaaga

SEQ ID NO: 125715 - DNA, 15 bp, Homo sapiens
agtcttcctgaaaag

SEQ ID NO: 125716 - DNA, 15 bp, Homo sapiens
gagtcttcctgaaaa

SEQ ID NO: 125717 - DNA, 15 bp, Homo sapiens
agagtcttcctgaaa

SEQ ID NO: 125718 - DNA, 15 bp, Homo sapiens
gagagtcttcctgaa

SEQ ID NO: 125719 - DNA, 15 bp, Homo sapiens
agagagtcttcctga

SEQ ID NO: 125720 - DNA, 15 bp, Homo sapiens
cagagagtcttcctg

SEQ ID NO: 125721 - DNA, 15 bp, Homo sapiens
tcagagagtcttcct

SEQ ID NO: 125722 - DNA, 15 bp, Homo sapiens
ttcagagagtcttcc

SEQ ID NO: 125723 - DNA, 15 bp, Homo sapiens
cttcagagagtcttc

SEQ ID NO: 125724 - DNA, 15 bp, Homo sapiens
ccttcagagagtctt

SEQ ID NO: 125725 - DNA, 15 bp, Homo sapiens
accttcagagagtct

SEQ ID NO: 125726 - DNA, 15 bp, Homo sapiens
taccttcagagagtc

SEQ ID NO: 125727 - DNA, 15 bp, Homo sapiens
ctaccttcagagagt

SEQ ID NO: 125728 - DNA, 15 bp, Homo sapiens
tctaccttcagagag

SEQ ID NO: 125729 - DNA, 15 bp, Homo sapiens
gtctaccttcagaga

SEQ ID NO: 125730 - DNA, 15 bp, Homo sapiens
ggtctaccttcagag

SEQ ID NO: 125731 - DNA, 15 bp, Homo sapiens
aggtctaccttcaga

SEQ ID NO: 125732 - DNA, 15 bp, Homo sapiens
gaggtctaccttcag

SEQ ID NO: 125733 - DNA, 15 bp, Homo sapiens
agaggtctaccttca

SEQ ID NO: 125734 - DNA, 15 bp, Homo sapiens
cagaggtctaccttc

SEQ ID NO: 125735 - DNA, 15 bp, Homo sapiens
ccagaggtctacctt

SEQ ID NO: 125736 - DNA, 15 bp, Homo sapiens
cccagaggtctacct

SEQ ID NO: 125737 - DNA, 15 bp, Homo sapiens
gcccagaggtctacc

SEQ ID NO: 125738 - DNA, 15 bp, Homo sapiens
tgcccagaggtctac

SEQ ID NO: 125739 - DNA, 15 bp, Homo sapiens
gtgcccagaggtcta

SEQ ID NO: 125740 - DNA, 15 bp, Homo sapiens
agtgcccagaggtct

SEQ ID NO: 125741 - DNA, 15 bp, Homo sapiens
cagtgcccagaggtc

SEQ ID NO: 125742 - DNA, 15 bp, Homo sapiens
acagtgcccagaggt

SEQ ID NO: 125743 - DNA, 15 bp, Homo sapiens
cacagtgcccagagg

SEQ ID NO: 125744 - DNA, 15 bp, Homo sapiens
acacagtgcccagag

SEQ ID NO: 125745 - DNA, 15 bp, Homo sapiens
aacacagtgcccaga

SEQ ID NO: 125746 - DNA, 15 bp, Homo sapiens
aaacacagtgcccag

SEQ ID NO: 125747 - DNA, 15 bp, Homo sapiens
caaacacagtgccca

SEQ ID NO: 125748 - DNA, 15 bp, Homo sapiens
tcaaacacagtgccc

SEQ ID NO: 125749 - DNA, 15 bp, Homo sapiens
ttcaaacacagtgcc

SEQ ID NO: 125750 - DNA, 15 bp, Homo sapiens
attcaaacacagtgc

SEQ ID NO: 125751 - DNA, 15 bp, Homo sapiens
cattcaaacacagtg

SEQ ID NO: 125752 - DNA, 15 bp, Homo sapiens
ccattcaaacacagt

SEQ ID NO: 125753 - DNA, 15 bp, Homo sapiens
gccattcaaacacag

SEQ ID NO: 125754 - DNA, 15 bp, Homo sapiens
ggccattcaaacaca

SEQ ID NO: 125755 - DNA, 15 bp, Homo sapiens
tggccattcaaacac

SEQ ID NO: 125756 - DNA, 15 bp, Homo sapiens
gtggccattcaaaca

SEQ ID NO: 125757 - DNA, 15 bp, Homo sapiens
tgtggccattcaaac

SEQ ID NO: 125758 - DNA, 15 bp, Homo sapiens
ctgtggccattcaaa

SEQ ID NO: 125759 - DNA, 15 bp, Homo sapiens
actgtggccattcaa

SEQ ID NO: 125760 - DNA, 15 bp, Homo sapiens
aactgtggccattca

SEQ ID NO: 125761 - DNA, 15 bp, Homo sapiens
taactgtggccattc

SEQ ID NO: 125762 - DNA, 15 bp, Homo sapiens
ttaactgtggccatt

SEQ ID NO: 125763 - DNA, 15 bp, Homo sapiens
attaactgtggccat

SEQ ID NO: 125764 - DNA, 15 bp, Homo sapiens
cattaactgtggcca

SEQ ID NO: 125765 - DNA, 15 bp, Homo sapiens
acattaactgtggcc

SEQ ID NO: 125766 - DNA, 15 bp, Homo sapiens
tacattaactgtggc

SEQ ID NO: 125767 - DNA, 15 bp, Homo sapiens
ctacattaactgtgg

SEQ ID NO: 125768 - DNA, 15 bp, Homo sapiens
tctacattaactgtg

SEQ ID NO: 125769 - DNA, 15 bp, Homo sapiens
ttctacattaactgt

SEQ ID NO: 125770 - DNA, 15 bp, Homo sapiens
cttctacattaactg

SEQ ID NO: 125771 - DNA, 15 bp, Homo sapiens
acttctacattaact

SEQ ID NO: 125772 - DNA, 15 bp, Homo sapiens
tacttctacattaac

SEQ ID NO: 125773 - DNA, 15 bp, Homo sapiens
ctacttctacattaa

SEQ ID NO: 125774 - DNA, 15 bp, Homo sapiens
tctacttctacatta

SEQ ID NO: 125775 - DNA, 15 bp, Homo sapiens
ctctacttctacatt

SEQ ID NO: 125776 - DNA, 15 bp, Homo sapiens
cctctacttctacat

SEQ ID NO: 125777 - DNA, 15 bp, Homo sapiens
tcctctacttctaca

SEQ ID NO: 125778 - DNA, 15 bp, Homo sapiens
ttcctctacttctac

SEQ ID NO: 125779 - DNA, 15 bp, Homo sapiens
cttcctctacttcta

SEQ ID NO: 125780 - DNA, 15 bp, Homo sapiens
tcttcctctacttct

SEQ ID NO: 125781 - DNA, 15 bp, Homo sapiens
ttcttcctctacttc

SEQ ID NO: 125782 - DNA, 15 bp, Homo sapiens
tttcttcctctactt

SEQ ID NO: 125783 - DNA, 15 bp, Homo sapiens
atttcttcctctact

SEQ ID NO: 125784 - DNA, 15 bp, Homo sapiens
aatttcttcctctac

SEQ ID NO: 125785 - DNA, 15 bp, Homo sapiens
aaatttcttcctcta

SEQ ID NO: 125786 - DNA, 15 bp, Homo sapiens
caaatttcttcctct

SEQ ID NO: 125787 - DNA, 15 bp, Homo sapiens
acaaatttcttcctc

SEQ ID NO: 125788 - DNA, 15 bp, Homo sapiens
aacaaatttcttcct

SEQ ID NO: 125789 - DNA, 15 bp, Homo sapiens
gaacaaatttcttcc

SEQ ID NO: 125790 - DNA, 15 bp, Homo sapiens
agaacaaatttcttc

SEQ ID NO: 125791 - DNA, 15 bp, Homo sapiens
aagaacaaatttctt

SEQ ID NO: 125792 - DNA, 15 bp, Homo sapiens
caagaacaaatttct

SEQ ID NO: 125793 - DNA, 15 bp, Homo sapiens
acaagaacaaatttc

SEQ ID NO: 125794 - DNA, 15 bp, Homo sapiens
cacaagaacaaattt

SEQ ID NO: 125795 - DNA, 15 bp, Homo sapiens
gcacaagaacaaatt

SEQ ID NO: 125796 - DNA, 15 bp, Homo sapiens
ggcacaagaacaaat

SEQ ID NO: 125797 - DNA, 15 bp, Homo sapiens
aggcacaagaacaaa

SEQ ID NO: 125798 - DNA, 15 bp, Homo sapiens
taggcacaagaacaa

SEQ ID NO: 125799 - DNA, 15 bp, Homo sapiens
gtaggcacaagaaca

SEQ ID NO: 125800 - DNA, 15 bp, Homo sapiens
agtaggcacaagaac

SEQ ID NO: 125801 - DNA, 15 bp, Homo sapiens
aagtaggcacaagaa

SEQ ID NO: 125802 - DNA, 15 bp, Homo sapiens
taagtaggcacaaga

SEQ ID NO: 125803 - DNA, 15 bp, Homo sapiens
ctaagtaggcacaag

SEQ ID NO: 125804 - DNA, 15 bp, Homo sapiens
tctaagtaggcacaa

SEQ ID NO: 125805 - DNA, 15 bp, Homo sapiens
atctaagtaggcaca

SEQ ID NO: 125806 - DNA, 15 bp, Homo sapiens
catctaagtaggcac

SEQ ID NO: 125807 - DNA, 15 bp, Homo sapiens
ccatctaagtaggca

SEQ ID NO: 125808 - DNA, 15 bp, Homo sapiens
accatctaagtaggc

SEQ ID NO: 125809 - DNA, 15 bp, Homo sapiens
gaccatctaagtagg

SEQ ID NO: 125810 - DNA, 15 bp, Homo sapiens
agaccatctaagtag

SEQ ID NO: 125811 - DNA, 15 bp, Homo sapiens
tagaccatctaagta

SEQ ID NO: 125812 - DNA, 15 bp, Homo sapiens
atagaccatctaagt

SEQ ID NO: 125813 - DNA, 15 bp, Homo sapiens
tatagaccatctaag

SEQ ID NO: 125814 - DNA, 15 bp, Homo sapiens
atatagaccatctaa

SEQ ID NO: 125815 - DNA, 15 bp, Homo sapiens
gatatagaccatcta

SEQ ID NO: 125816 - DNA, 15 bp, Homo sapiens
agatatagaccatct

SEQ ID NO: 125817 - DNA, 15 bp, Homo sapiens
aagatatagaccatc

SEQ ID NO: 125818 - DNA, 15 bp, Homo sapiens
aaagatatagaccat

SEQ ID NO: 125819 - DNA, 15 bp, Homo sapiens
aaaagatatagacca

SEQ ID NO: 125820 - DNA, 15 bp, Homo sapiens
taaaagatatagacc

SEQ ID NO: 125821 - DNA, 15 bp, Homo sapiens
gtaaaagatatagac

SEQ ID NO: 125822 - DNA, 15 bp, Homo sapiens
tgtaaaagatataga

SEQ ID NO: 125823 - DNA, 15 bp, Homo sapiens
ttgtaaaagatatag

SEQ ID NO: 125824 - DNA, 15 bp, Homo sapiens
attgtaaaagatata

SEQ ID NO: 125825 - DNA, 15 bp, Homo sapiens
aattgtaaaagatat

SEQ ID NO: 125826 - DNA, 15 bp, Homo sapiens
aaattgtaaaagata

SEQ ID NO: 125827 - DNA, 15 bp, Homo sapiens
caaattgtaaaagat

SEQ ID NO: 125828 - DNA, 15 bp, Homo sapiens
acaaattgtaaaaga

SEQ ID NO: 125829 - DNA, 15 bp, Homo sapiens
cacaaattgtaaaag

SEQ ID NO: 125830 - DNA, 15 bp, Homo sapiens
gcacaaattgtaaaa

SEQ ID NO: 125831 - DNA, 15 bp, Homo sapiens
ggcacaaattgtaaa

SEQ ID NO: 125832 - DNA, 15 bp, Homo sapiens
tggcacaaattgtaa

SEQ ID NO: 125833 - DNA, 15 bp, Homo sapiens
ctggcacaaattgta

SEQ ID NO: 125834 - DNA, 15 bp, Homo sapiens
cctggcacaaattgt

SEQ ID NO: 125835 - DNA, 15 bp, Homo sapiens
ccctggcacaaattg

SEQ ID NO: 125836 - DNA, 15 bp, Homo sapiens
cccctggcacaaatt

SEQ ID NO: 125837 - DNA, 15 bp, Homo sapiens
tcccctggcacaaat

SEQ ID NO: 125838 - DNA, 15 bp, Homo sapiens
atcccctggcacaaa

SEQ ID NO: 125839 - DNA, 15 bp, Homo sapiens
aatcccctggcacaa

SEQ ID NO: 125840 - DNA, 15 bp, Homo sapiens
taatcccctggcaca

SEQ ID NO: 125841 - DNA, 15 bp, Homo sapiens
ttaatcccctggcac

SEQ ID NO: 125842 - DNA, 15 bp, Homo sapiens
tattaatcccctggc

SEQ ID NO: 125843 - DNA, 15 bp, Homo sapiens
ttattaatcccctgg

SEQ ID NO: 125844 - DNA, 15 bp, Homo sapiens
attattaatcccctg

SEQ ID NO: 125845 - DNA, 15 bp, Homo sapiens
tattattaatcccct

SEQ ID NO: 125846 - DNA, 15 bp, Homo sapiens
atattattaatcccc

SEQ ID NO: 125847 - DNA, 15 bp, Homo sapiens
catattattaatccc

SEQ ID NO: 125848 - DNA, 15 bp, Homo sapiens
acatattattaatcc

SEQ ID NO: 125849 - DNA, 15 bp, Homo sapiens
tacatattattaatc

SEQ ID NO: 125850 - DNA, 15 bp, Homo sapiens
atacatattattaat

SEQ ID NO: 125851 - DNA, 15 bp, Homo sapiens
catacatattattaa

SEQ ID NO: 125852 - DNA, 15 bp, Homo sapiens
tcatacatattatta

SEQ ID NO: 125853 - DNA, 15 bp, Homo sapiens
gtcatacatattatt

SEQ ID NO: 125854 - DNA, 15 bp, Homo sapiens
agtcatacatattat

SEQ ID NO: 125855 - DNA, 15 bp, Homo sapiens
tagtcatacatatta

SEQ ID NO: 125856 - DNA, 15 bp, Homo sapiens
ctagtcatacatatt

SEQ ID NO: 125857 - DNA, 15 bp, Homo sapiens
actagtcatacatat

SEQ ID NO: 125858 - DNA, 15 bp, Homo sapiens
tactagtcatacata

SEQ ID NO: 125859 - DNA, 15 bp, Homo sapiens
ttactagtcatacat

SEQ ID NO: 125860 - DNA, 15 bp, Homo sapiens
tttactagtcataca

SEQ ID NO: 125861 - DNA, 15 bp, Homo sapiens
ctttactagtcatac

SEQ ID NO: 125862 - DNA, 15 bp, Homo sapiens
gctttactagtcata

SEQ ID NO: 125863 - DNA, 15 bp, Homo sapiens
agctttactagtcat

SEQ ID NO: 125864 - DNA, 15 bp, Homo sapiens
aagctttactagtca

SEQ ID NO: 125865 - DNA, 15 bp, Homo sapiens
aaagctttactagtc

SEQ ID NO: 125866 - DNA, 15 bp, Homo sapiens
gaaagctttactagt

SEQ ID NO: 125867 - DNA, 15 bp, Homo sapiens
ggaaagctttactag

SEQ ID NO: 125868 - DNA, 15 bp, Homo sapiens
aggaaagctttacta

SEQ ID NO: 125869 - DNA, 15 bp, Homo sapiens
taggaaagctttact

SEQ ID NO: 125870 - DNA, 15 bp, Homo sapiens
ataggaaagctttac

SEQ ID NO: 125871 - DNA, 15 bp, Homo sapiens
tataggaaagcttta

SEQ ID NO: 125872 - DNA, 15 bp, Homo sapiens
atataggaaagcttt

SEQ ID NO: 125873 - DNA, 15 bp, Homo sapiens
aatataggaaagctt

SEQ ID NO: 125874 - DNA, 15 bp, Homo sapiens
caatataggaaagct

SEQ ID NO: 125875 - DNA, 15 bp, Homo sapiens
acaatataggaaagc

SEQ ID NO: 125876 - DNA, 15 bp, Homo sapiens
gacaatataggaaag

SEQ ID NO: 125877 - DNA, 15 bp, Homo sapiens
tgacaatataggaaa

SEQ ID NO: 125878 - DNA, 15 bp, Homo sapiens
ttgacaatataggaa

SEQ ID NO: 125879 - DNA, 15 bp, Homo sapiens
tttgacaatatagga

SEQ ID NO: 125880 - DNA, 15 bp, Homo sapiens
ctttgacaatatagg

SEQ ID NO: 125881 - DNA, 15 bp, Homo sapiens
tctttgacaatatag

SEQ ID NO: 125882 - DNA, 15 bp, Homo sapiens
ttctttgacaatata

SEQ ID NO: 125883 - DNA, 15 bp, Homo sapiens
tttctttgacaatat

SEQ ID NO: 125884 - DNA, 15 bp, Homo sapiens
ttttctttgacaata

SEQ ID NO: 125885 - DNA, 15 bp, Homo sapiens
attttctttgacaat

SEQ ID NO: 125886 - DNA, 15 bp, Homo sapiens
tattttctttgacaa

SEQ ID NO: 125887 - DNA, 15 bp, Homo sapiens
atattttctttgaca

SEQ ID NO: 125888 - DNA, 15 bp, Homo sapiens
tatattttctttgac

SEQ ID NO: 125889 - DNA, 15 bp, Homo sapiens
atatattttctttga

SEQ ID NO: 125890 - DNA, 15 bp, Homo sapiens
aatatattttctttg

SEQ ID NO: 125891 - DNA, 15 bp, Homo sapiens
taatatattttcttt

SEQ ID NO: 125892 - DNA, 15 bp, Homo sapiens
ttaatatattttctt

SEQ ID NO: 125893 - DNA, 15 bp, Homo sapiens
tttaatatattttct

SEQ ID NO: 125894 - DNA, 15 bp, Homo sapiens
atttaatatattttc

SEQ ID NO: 125895 - DNA, 15 bp, Homo sapiens
aatttaatatatttt

SEQ ID NO: 125896 - DNA, 15 bp, Homo sapiens
aaatttaatatattt

SEQ ID NO: 125897 - DNA, 15 bp, Homo sapiens
aaaatttaatatatt

SEQ ID NO: 125898 - DNA, 15 bp, Homo sapiens
caaaatttaatatat

SEQ ID NO: 125899 - DNA, 15 bp, Homo sapiens
tcaaaatttaatata

SEQ ID NO: 125900 - DNA, 15 bp, Homo sapiens
ttcaaaatttaatat

SEQ ID NO: 125901 - DNA, 15 bp, Homo sapiens
attcaaaatttaata

SEQ ID NO: 125902 - DNA, 15 bp, Homo sapiens
aattcaaaatttaat

SEQ ID NO: 125903 - DNA, 15 bp, Homo sapiens
aaattcaaaatttaa

SEQ ID NO: 125904 - DNA, 15 bp, Homo sapiens
aaaattcaaaattta

SEQ ID NO: 125905 - DNA, 15 bp, Homo sapiens
aaaaattcaaaattt

SEQ ID NO: 125906 - DNA, 15 bp, Homo sapiens
taaaaattcaaaatt

SEQ ID NO: 125907 - DNA, 15 bp, Homo sapiens
ttaaaaattcaaaat

SEQ ID NO: 125908 - DNA, 15 bp, Homo sapiens
tttttaaaaattcaa

SEQ ID NO: 125909 - DNA, 15 bp, Homo sapiens
ctttttaaaaattca

SEQ ID NO: 125910 - DNA, 15 bp, Homo sapiens
ccactttttaaaaat

SEQ ID NO: 125911 - DNA, 15 bp, Homo sapiens
cccactttttaaaaa

SEQ ID NO: 125912 - DNA, 15 bp, Homo sapiens
acccactttttaaaa

SEQ ID NO: 125913 - DNA, 15 bp, Homo sapiens
tacccactttttaaa

SEQ ID NO: 125914 - DNA, 15 bp, Homo sapiens
atacccactttttaa

SEQ ID NO: 125915 - DNA, 15 bp, Homo sapiens
catacccacttttta

SEQ ID NO: 125916 - DNA, 15 bp, Homo sapiens
ccatacccacttttt

SEQ ID NO: 125917 - DNA, 15 bp, Homo sapiens
tccatacccactttt

SEQ ID NO: 125918 - DNA, 15 bp, Homo sapiens
atccatacccacttt

SEQ ID NO: 125919 - DNA, 15 bp, Homo sapiens
aatccatacccactt

SEQ ID NO: 125920 - DNA, 15 bp, Homo sapiens
caatccatacccact

SEQ ID NO: 125921 - DNA, 15 bp, Homo sapiens
acaatccatacccac

SEQ ID NO: 125922 - DNA, 15 bp, Homo sapiens
aacaatccataccca

SEQ ID NO: 125923 - DNA, 15 bp, Homo sapiens
taacaatccataccc

SEQ ID NO: 125924 - DNA, 15 bp, Homo sapiens
ttaacaatccatacc

SEQ ID NO: 125925 - DNA, 15 bp, Homo sapiens
tttaacaatccatac

SEQ ID NO: 125926 - DNA, 15 bp, Homo sapiens
atttaacaatccata

SEQ ID NO: 125927 - DNA, 15 bp, Homo sapiens
catttaacaatccat

SEQ ID NO: 125928 - DNA, 15 bp, Homo sapiens
acatttaacaatcca

SEQ ID NO: 125929 - DNA, 15 bp, Homo sapiens
cacatttaacaatcc

SEQ ID NO: 125930 - DNA, 15 bp, Homo sapiens
gcacatttaacaatc

SEQ ID NO: 125931 - DNA, 15 bp, Homo sapiens
tgcacatttaacaat

SEQ ID NO: 125932 - DNA, 15 bp, Homo sapiens
gtgcacatttaacaa

SEQ ID NO: 125933 - DNA, 15 bp, Homo sapiens
tgtgcacatttaaca

SEQ ID NO: 125934 - DNA, 15 bp, Homo sapiens
ctgtgcacatttaac

SEQ ID NO: 125935 - DNA, 15 bp, Homo sapiens
actgtgcacatttaa

SEQ ID NO: 125936 - DNA, 15 bp, Homo sapiens
aactgtgcacattta

SEQ ID NO: 125937 - DNA, 15 bp, Homo sapiens
taactgtgcacattt

SEQ ID NO: 125938 - DNA, 15 bp, Homo sapiens
ataactgtgcacatt

SEQ ID NO: 125939 - DNA, 15 bp, Homo sapiens
tataactgtgcacat

SEQ ID NO: 125940 - DNA, 15 bp, Homo sapiens
ttataactgtgcaca

SEQ ID NO: 125941 - DNA, 15 bp, Homo sapiens
tttataactgtgcac

SEQ ID NO: 125942 - DNA, 15 bp, Homo sapiens
atttataactgtgca

SEQ ID NO: 125943 - DNA, 15 bp, Homo sapiens
aatttataactgtgc

SEQ ID NO: 125944 - DNA, 15 bp, Homo sapiens
taatttataactgtg

SEQ ID NO: 125945 - DNA, 15 bp, Homo sapiens
ataatttataactgt

SEQ ID NO: 125946 - DNA, 15 bp, Homo sapiens
aataatttataactg

SEQ ID NO: 125947 - DNA, 15 bp, Homo sapiens
aaataatttataact

SEQ ID NO: 125948 - DNA, 15 bp, Homo sapiens
caaataatttataac

SEQ ID NO: 125949 - DNA, 15 bp, Homo sapiens
gcaaataatttataa

SEQ ID NO: 125950 - DNA, 15 bp, Homo sapiens
tgcaaataatttata

SEQ ID NO: 125951 - DNA, 15 bp, Homo sapiens
ttgcaaataatttat

SEQ ID NO: 125952 - DNA, 15 bp, Homo sapiens
gttgcaaataattta

SEQ ID NO: 125953 - DNA, 15 bp, Homo sapiens
tgttgcaaataattt

SEQ ID NO: 125954 - DNA, 15 bp, Homo sapiens
atgttgcaaataatt

SEQ ID NO: 125955 - DNA, 15 bp, Homo sapiens
gatgttgcaaataat

SEQ ID NO: 125956 - DNA, 15 bp, Homo sapiens
tgatgttgcaaataa

SEQ ID NO: 125957 - DNA, 15 bp, Homo sapiens
ctgatgttgcaaata

SEQ ID NO: 125958 - DNA, 15 bp, Homo sapiens
tctgatgttgcaaat

SEQ ID NO: 125959 - DNA, 15 bp, Homo sapiens
ctctgatgttgcaaa

SEQ ID NO: 125960 - DNA, 15 bp, Homo sapiens
gctctgatgttgcaa

SEQ ID NO: 125961 - DNA, 15 bp, Homo sapiens
ggctctgatgttgca

SEQ ID NO: 125962 - DNA, 15 bp, Homo sapiens
aggctctgatgttgc

SEQ ID NO: 125963 - DNA, 15 bp, Homo sapiens
aaggctctgatgttg

SEQ ID NO: 125964 - DNA, 15 bp, Homo sapiens
caaggctctgatgtt

SEQ ID NO: 125965 - DNA, 15 bp, Homo sapiens
acaaggctctgatgt

SEQ ID NO: 125966 - DNA, 15 bp, Homo sapiens
aacaaggctctgatg

SEQ ID NO: 125967 - DNA, 15 bp, Homo sapiens
aaacaaggctctgat

SEQ ID NO: 125968 - DNA, 15 bp, Homo sapiens
taaacaaggctctga

SEQ ID NO: 125969 - DNA, 15 bp, Homo sapiens
ttaaacaaggctctg

SEQ ID NO: 125970 - DNA, 15 bp, Homo sapiens
tttaaacaaggctct

SEQ ID NO: 125971 - DNA, 15 bp, Homo sapiens
ttttaaacaaggctc

SEQ ID NO: 125972 - DNA, 15 bp, Homo sapiens
attttaaacaaggct

SEQ ID NO: 125973 - DNA, 15 bp, Homo sapiens
aattttaaacaaggc

SEQ ID NO: 125974 - DNA, 15 bp, Homo sapiens
taattttaaacaagg

SEQ ID NO: 125975 - DNA, 15 bp, Homo sapiens
ttaattttaaacaag

SEQ ID NO: 125976 - DNA, 15 bp, Homo sapiens
tttaattttaaacaa

SEQ ID NO: 125977 - DNA, 15 bp, Homo sapiens
tgtttaattttaaac

SEQ ID NO: 125978 - DNA, 15 bp, Homo sapiens
ctgtttaattttaaa

SEQ ID NO: 125979 - DNA, 15 bp, Homo sapiens
tctgtttaattttaa

SEQ ID NO: 125980 - DNA, 15 bp, Homo sapiens
ctctgtttaatttta

SEQ ID NO: 125981 - DNA, 15 bp, Homo sapiens
tctctgtttaatttt

SEQ ID NO: 125982 - DNA, 15 bp, Homo sapiens
gtctctgtttaattt

SEQ ID NO: 125983 - DNA, 15 bp, Homo sapiens
tgtctctgtttaatt

SEQ ID NO: 125984 - DNA, 15 bp, Homo sapiens
atgtctctgtttaat

SEQ ID NO: 125985 - DNA, 15 bp, Homo sapiens
tatgtctctgtttaa

SEQ ID NO: 125986 - DNA, 15 bp, Homo sapiens
ctatgtctctgttta

SEQ ID NO: 125987 - DNA, 15 bp, Homo sapiens
tctatgtctctgttt

SEQ ID NO: 125988 - DNA, 15 bp, Homo sapiens
gtctatgtctctgtt

SEQ ID NO: 125989 - DNA, 15 bp, Homo sapiens
ggtctatgtctctgt

SEQ ID NO: 125990 - DNA, 15 bp, Homo sapiens
tggtctatgtctctg

SEQ ID NO: 125991 - DNA, 15 bp, Homo sapiens
gtggtctatgtctct

SEQ ID NO: 125992 - DNA, 15 bp, Homo sapiens
ggtggtctatgtctc

SEQ ID NO: 125993 - DNA, 15 bp, Homo sapiens
aggtggtctatgtct

SEQ ID NO: 125994 - DNA, 15 bp, Homo sapiens
aaggtggtctatgtc

SEQ ID NO: 125995 - DNA, 15 bp, Homo sapiens
gaaggtggtctatgt

SEQ ID NO: 125996 - DNA, 15 bp, Homo sapiens
ggaaggtggtctatg

SEQ ID NO: 125997 - DNA, 15 bp, Homo sapiens
aggaaggtggtctat

SEQ ID NO: 125998 - DNA, 15 bp, Homo sapiens
caggaaggtggtcta

SEQ ID NO: 125999 - DNA, 15 bp, Homo sapiens
acaggaaggtggtct

SEQ ID NO: 126000 - DNA, 15 bp, Homo sapiens
gacaggaaggtggtc

SEQ ID NO: 126001 - DNA, 15 bp, Homo sapiens
agacaggaaggtggt

SEQ ID NO: 126002 - DNA, 15 bp, Homo sapiens
aagacaggaaggtgg

SEQ ID NO: 126003 - DNA, 15 bp, Homo sapiens
taagacaggaaggtg

SEQ ID NO: 126004 - DNA, 15 bp, Homo sapiens
ataagacaggaaggt

SEQ ID NO: 126005 - DNA, 15 bp, Homo sapiens
tataagacaggaagg

SEQ ID NO: 126006 - DNA, 15 bp, Homo sapiens
ttataagacaggaag

SEQ ID NO: 126007 - DNA, 15 bp, Homo sapiens
tttataagacaggaa

SEQ ID NO: 126008 - DNA, 15 bp, Homo sapiens
gtttataagacagga

SEQ ID NO: 126009 - DNA, 15 bp, Homo sapiens
agtttataagacagg

SEQ ID NO: 126010 - DNA, 15 bp, Homo sapiens
tagtttataagacag

SEQ ID NO: 126011 - DNA, 15 bp, Homo sapiens
ctagtttataagaca

SEQ ID NO: 126012 - DNA, 15 bp, Homo sapiens
tctagtttataagac

SEQ ID NO: 126013 - DNA, 15 bp, Homo sapiens
atctagtttataaga

SEQ ID NO: 126014 - DNA, 15 bp, Homo sapiens
aatctagtttataag

SEQ ID NO: 126015 - DNA, 15 bp, Homo sapiens
caatctagtttataa

SEQ ID NO: 126016 - DNA, 15 bp, Homo sapiens
acaatctagtttata

SEQ ID NO: 126017 - DNA, 15 bp, Homo sapiens
gacaatctagtttat

SEQ ID NO: 126018 - DNA, 15 bp, Homo sapiens
tgacaatctagttta

SEQ ID NO: 126019 - DNA, 15 bp, Homo sapiens
ctgacaatctagttt

SEQ ID NO: 126020 - DNA, 15 bp, Homo sapiens
actgacaatctagtt

SEQ ID NO: 126021 - DNA, 15 bp, Homo sapiens
aactgacaatctagt

SEQ ID NO: 126022 - DNA, 15 bp, Homo sapiens
caactgacaatctag

SEQ ID NO: 126023 - DNA, 15 bp, Homo sapiens
tcaactgacaatcta

SEQ ID NO: 126024 - DNA, 15 bp, Homo sapiens
atcaactgacaatct

SEQ ID NO: 126025 - DNA, 15 bp, Homo sapiens
catcaactgacaatc

SEQ ID NO: 126026 - DNA, 15 bp, Homo sapiens
acatcaactgacaat

SEQ ID NO: 126027 - DNA, 15 bp, Homo sapiens
aacatcaactgacaa

SEQ ID NO: 126028 - DNA, 15 bp, Homo sapiens
taacatcaactgaca

SEQ ID NO: 126029 - DNA, 15 bp, Homo sapiens
ttaacatcaactgac

SEQ ID NO: 126030 - DNA, 15 bp, Homo sapiens
attaacatcaactga

SEQ ID NO: 126031 - DNA, 15 bp, Homo sapiens
aattaacatcaactg

SEQ ID NO: 126032 - DNA, 15 bp, Homo sapiens
caattaacatcaact

SEQ ID NO: 126033 - DNA, 15 bp, Homo sapiens
acaattaacatcaac

SEQ ID NO: 126034 - DNA, 15 bp, Homo sapiens
gacaattaacatcaa

SEQ ID NO: 126035 - DNA, 15 bp, Homo sapiens
tgacaattaacatca

SEQ ID NO: 126036 - DNA, 15 bp, Homo sapiens
ctgacaattaacatc

SEQ ID NO: 126037 - DNA, 15 bp, Homo sapiens
gctgacaattaacat

SEQ ID NO: 126038 - DNA, 15 bp, Homo sapiens
tgctgacaattaaca

SEQ ID NO: 126039 - DNA, 15 bp, Homo sapiens
atgctgacaattaac

SEQ ID NO: 126040 - DNA, 15 bp, Homo sapiens
aatgctgacaattaa

SEQ ID NO: 126041 - DNA, 15 bp, Homo sapiens
aaatgctgacaatta

SEQ ID NO: 126042 - DNA, 15 bp, Homo sapiens
taaatgctgacaatt

SEQ ID NO: 126043 - DNA, 15 bp, Homo sapiens
ataaatgctgacaat

SEQ ID NO: 126044 - DNA, 15 bp, Homo sapiens
gataaatgctgacaa

SEQ ID NO: 126045 - DNA, 15 bp, Homo sapiens
tgataaatgctgaca

SEQ ID NO: 126046 - DNA, 15 bp, Homo sapiens
ctgataaatgctgac

SEQ ID NO: 126047 - DNA, 15 bp, Homo sapiens
cctgataaatgctga

SEQ ID NO: 126048 - DNA, 15 bp, Homo sapiens
gcctgataaatgctg

SEQ ID NO: 126049 - DNA, 15 bp, Homo sapiens
tgcctgataaatgct

SEQ ID NO: 126050 - DNA, 15 bp, Homo sapiens
ttgcctgataaatgc

SEQ ID NO: 126051 - DNA, 15 bp, Homo sapiens
attgcctgataaatg

SEQ ID NO: 126052 - DNA, 15 bp, Homo sapiens
gattgcctgataaat

SEQ ID NO: 126053 - DNA, 15 bp, Homo sapiens
agattgcctgataaa

SEQ ID NO: 126054 - DNA, 15 bp, Homo sapiens
tagattgcctgataa

SEQ ID NO: 126055 - DNA, 15 bp, Homo sapiens
atagattgcctgata

SEQ ID NO: 126056 - DNA, 15 bp, Homo sapiens
tatagattgcctgat

SEQ ID NO: 126057 - DNA, 15 bp, Homo sapiens
ttatagattgcctga

SEQ ID NO: 126058 - DNA, 15 bp, Homo sapiens
attatagattgcctg

SEQ ID NO: 126059 - DNA, 15 bp, Homo sapiens
cattatagattgcct

SEQ ID NO: 126060 - DNA, 15 bp, Homo sapiens
ccattatagattgcc

SEQ ID NO: 126061 - DNA, 15 bp, Homo sapiens
accattatagattgc

SEQ ID NO: 126062 - DNA, 15 bp, Homo sapiens
aaccattatagattg

SEQ ID NO: 126063 - DNA, 15 bp, Homo sapiens
aaaccattatagatt

SEQ ID NO: 126064 - DNA, 15 bp, Homo sapiens
taaaccattatagat

SEQ ID NO: 126065 - DNA, 15 bp, Homo sapiens
ttaaaccattataga

SEQ ID NO: 126066 - DNA, 15 bp, Homo sapiens
tttaaaccattatag

SEQ ID NO: 126067 - DNA, 15 bp, Homo sapiens
attttaaaccattat

SEQ ID NO: 126068 - DNA, 15 bp, Homo sapiens
aattttaaaccatta

SEQ ID NO: 126069 - DNA, 15 bp, Homo sapiens
caattttaaaccatt

SEQ ID NO: 126070 - DNA, 15 bp, Homo sapiens
ccaattttaaaccat

SEQ ID NO: 126071 - DNA, 15 bp, Homo sapiens
gccaattttaaacca

SEQ ID NO: 126072 - DNA, 15 bp, Homo sapiens
ggccaattttaaacc

SEQ ID NO: 126073 - DNA, 15 bp, Homo sapiens
tggccaattttaaac

SEQ ID NO: 126074 - DNA, 15 bp, Homo sapiens
ctggccaattttaaa

SEQ ID NO: 126075 - DNA, 15 bp, Homo sapiens
actggccaattttaa

SEQ ID NO: 126076 - DNA, 15 bp, Homo sapiens
aactggccaatttta

SEQ ID NO: 126077 - DNA, 15 bp, Homo sapiens
caactggccaatttt

SEQ ID NO: 126078 - DNA, 15 bp, Homo sapiens
tcaactggccaattt

SEQ ID NO: 126079 - DNA, 15 bp, Homo sapiens
ctcaactggccaatt

SEQ ID NO: 126080 - DNA, 15 bp, Homo sapiens
cctcaactggccaat

SEQ ID NO: 126081 - DNA, 15 bp, Homo sapiens
acctcaactggccaa

SEQ ID NO: 126082 - DNA, 15 bp, Homo sapiens
tacctcaactggcca

SEQ ID NO: 126083 - DNA, 15 bp, Homo sapiens
atacctcaactggcc

SEQ ID NO: 126084 - DNA, 15 bp, Homo sapiens
catacctcaactggc

SEQ ID NO: 126085 - DNA, 15 bp, Homo sapiens
ccatacctcaactgg

SEQ ID NO: 126086 - DNA, 15 bp, Homo sapiens
tccatacctcaactg

SEQ ID NO: 126087 - DNA, 15 bp, Homo sapiens
ttccatacctcaact

SEQ ID NO: 126088 - DNA, 15 bp, Homo sapiens
attccatacctcaac

SEQ ID NO: 126089 - DNA, 15 bp, Homo sapiens
cattccatacctcaa

SEQ ID NO: 126090 - DNA, 15 bp, Homo sapiens
ccattccatacctca

SEQ ID NO: 126091 - DNA, 15 bp, Homo sapiens
gccattccatacctc

SEQ ID NO: 126092 - DNA, 15 bp, Homo sapiens
tgccattccatacct

SEQ ID NO: 126093 - DNA, 15 bp, Homo sapiens
atgccattccatacc

SEQ ID NO: 126094 - DNA, 15 bp, Homo sapiens
gatgccattccatac

SEQ ID NO: 126095 - DNA, 15 bp, Homo sapiens
agatgccattccata

SEQ ID NO: 126096 - DNA, 15 bp, Homo sapiens
aagatgccattccat

SEQ ID NO: 126097 - DNA, 15 bp, Homo sapiens
caagatgccattcca

SEQ ID NO: 126098 - DNA, 15 bp, Homo sapiens
tcaagatgccattcc

SEQ ID NO: 126099 - DNA, 15 bp, Homo sapiens
atcaagatgccattc

SEQ ID NO: 126100 - DNA, 15 bp, Homo sapiens
aatcaagatgccatt

SEQ ID NO: 126101 - DNA, 15 bp, Homo sapiens
caatcaagatgccat

SEQ ID NO: 126102 - DNA, 15 bp, Homo sapiens
acaatcaagatgcca

SEQ ID NO: 126103 - DNA, 15 bp, Homo sapiens
tacaatcaagatgcc

SEQ ID NO: 126104 - DNA, 15 bp, Homo sapiens
ttacaatcaagatgc

SEQ ID NO: 126105 - DNA, 15 bp, Homo sapiens
cttacaatcaagatg

SEQ ID NO: 126106 - DNA, 15 bp, Homo sapiens
acttacaatcaagat

SEQ ID NO: 126107 - DNA, 15 bp, Homo sapiens
aacttacaatcaaga

SEQ ID NO: 126108 - DNA, 15 bp, Homo sapiens
taacttacaatcaag

SEQ ID NO: 126109 - DNA, 15 bp, Homo sapiens
ttaacttacaatcaa

SEQ ID NO: 126110 - DNA, 15 bp, Homo sapiens
attaacttacaatca

SEQ ID NO: 126111 - DNA, 15 bp, Homo sapiens
aattaacttacaatc

SEQ ID NO: 126112 - DNA, 15 bp, Homo sapiens
taattaacttacaat

SEQ ID NO: 126113 - DNA, 15 bp, Homo sapiens
ttaattaacttacaa

SEQ ID NO: 126114 - DNA, 15 bp, Homo sapiens
tttaattaacttaca

SEQ ID NO: 126115 - DNA, 15 bp, Homo sapiens
gtttaattaacttac

SEQ ID NO: 126116 - DNA, 15 bp, Homo sapiens
agtttaattaactta

SEQ ID NO: 126117 - DNA, 15 bp, Homo sapiens
aagtttaattaactt

SEQ ID NO: 126118 - DNA, 15 bp, Homo sapiens
taagtttaattaact

SEQ ID NO: 126119 - DNA, 15 bp, Homo sapiens
ttaagtttaattaac

SEQ ID NO: 126120 - DNA, 15 bp, Homo sapiens
tttaagtttaattaa

SEQ ID NO: 126121 - DNA, 15 bp, Homo sapiens
atttaagtttaatta

SEQ ID NO: 126122 - DNA, 15 bp, Homo sapiens
aatttaagtttaatt

SEQ ID NO: 126123 - DNA, 15 bp, Homo sapiens
gaatttaagtttaat

SEQ ID NO: 126124 - DNA, 15 bp, Homo sapiens
agaatttaagtttaa

SEQ ID NO: 126125 - DNA, 15 bp, Homo sapiens
tagaatttaagttta

SEQ ID NO: 126126 - DNA, 15 bp, Homo sapiens
ctagaatttaagttt

SEQ ID NO: 126127 - DNA, 15 bp, Homo sapiens
gctagaatttaagtt

SEQ ID NO: 126128 - DNA, 15 bp, Homo sapiens
tgctagaatttaagt

SEQ ID NO: 126129 - DNA, 15 bp, Homo sapiens
ttgctagaatttaag

SEQ ID NO: 126130 - DNA, 15 bp, Homo sapiens
cttgctagaatttaa

SEQ ID NO: 126131 - DNA, 15 bp, Homo sapiens
ccttgctagaattta

SEQ ID NO: 126132 - DNA, 15 bp, Homo sapiens
gccttgctagaattt

SEQ ID NO: 126133 - DNA, 15 bp, Homo sapiens
tgccttgctagaatt

SEQ ID NO: 126134 - DNA, 15 bp, Homo sapiens
atgccttgctagaat

SEQ ID NO: 126135 - DNA, 15 bp, Homo sapiens
aatgccttgctagaa

SEQ ID NO: 126136 - DNA, 15 bp, Homo sapiens
aaatgccttgctaga

SEQ ID NO: 126137 - DNA, 15 bp, Homo sapiens
aaaatgccttgctag

SEQ ID NO: 126138 - DNA, 15 bp, Homo sapiens
gaaaatgccttgcta

SEQ ID NO: 126139 - DNA, 15 bp, Homo sapiens
tgaaaatgccttgct

SEQ ID NO: 126140 - DNA, 15 bp, Homo sapiens
atgaaaatgccttgc

SEQ ID NO: 126141 - DNA, 15 bp, Homo sapiens
catgaaaatgccttg

SEQ ID NO: 126142 - DNA, 15 bp, Homo sapiens
acatgaaaatgcctt

SEQ ID NO: 126143 - DNA, 15 bp, Homo sapiens
tacatgaaaatgcct

SEQ ID NO: 126144 - DNA, 15 bp, Homo sapiens
ttacatgaaaatgcc

SEQ ID NO: 126145 - DNA, 15 bp, Homo sapiens
gttacatgaaaatgc

SEQ ID NO: 126146 - DNA, 15 bp, Homo sapiens
agttacatgaaaatg

SEQ ID NO: 126147 - DNA, 15 bp, Homo sapiens
aagttacatgaaaat

SEQ ID NO: 126148 - DNA, 15 bp, Homo sapiens
caagttacatgaaaa

SEQ ID NO: 126149 - DNA, 15 bp, Homo sapiens
tcaagttacatgaaa

SEQ ID NO: 126150 - DNA, 15 bp, Homo sapiens
atcaagttacatgaa

SEQ ID NO: 126151 - DNA, 15 bp, Homo sapiens
aatcaagttacatga

SEQ ID NO: 126152 - DNA, 15 bp, Homo sapiens
caatcaagttacatg

SEQ ID NO: 126153 - DNA, 15 bp, Homo sapiens
gcaatcaagttacat

SEQ ID NO: 126154 - DNA, 15 bp, Homo sapiens
tgcaatcaagttaca

SEQ ID NO: 126155 - DNA, 15 bp, Homo sapiens
atgcaatcaagttac

SEQ ID NO: 126156 - DNA, 15 bp, Homo sapiens
aatgcaatcaagtta

SEQ ID NO: 126157 - DNA, 15 bp, Homo sapiens
aaatgcaatcaagtt

SEQ ID NO: 126158 - DNA, 15 bp, Homo sapiens
taaatgcaatcaagt

SEQ ID NO: 126159 - DNA, 15 bp, Homo sapiens
ataaatgcaatcaag

SEQ ID NO: 126160 - DNA, 15 bp, Homo sapiens
tataaatgcaatcaa

SEQ ID NO: 126161 - DNA, 15 bp, Homo sapiens
atataaatgcaatca

SEQ ID NO: 126162 - DNA, 15 bp, Homo sapiens
catataaatgcaatc

SEQ ID NO: 126163 - DNA, 15 bp, Homo sapiens
acatataaatgcaat

SEQ ID NO: 126164 - DNA, 15 bp, Homo sapiens
tacatataaatgcaa

SEQ ID NO: 126165 - DNA, 15 bp, Homo sapiens
ttacatataaatgca

SEQ ID NO: 126166 - DNA, 15 bp, Homo sapiens
tttacatataaatgc

SEQ ID NO: 126167 - DNA, 15 bp, Homo sapiens
ttttacatataaatg

SEQ ID NO: 126168 - DNA, 15 bp, Homo sapiens
attttacatataaat

SEQ ID NO: 126169 - DNA, 15 bp, Homo sapiens
gattttacatataaa

SEQ ID NO: 126170 - DNA, 15 bp, Homo sapiens
tgattttacatataa

SEQ ID NO: 126171 - DNA, 15 bp, Homo sapiens
gtgattttacatata

SEQ ID NO: 126172 - DNA, 15 bp, Homo sapiens
tgtgattttacatat

SEQ ID NO: 126173 - DNA, 15 bp, Homo sapiens
ttgtgattttacata

SEQ ID NO: 126174 - DNA, 15 bp, Homo sapiens
attgtgattttacat

SEQ ID NO: 126175 - DNA, 15 bp, Homo sapiens
tattgtgattttaca

SEQ ID NO: 126176 - DNA, 15 bp, Homo sapiens
ttattgtgattttac

SEQ ID NO: 126177 - DNA, 15 bp, Homo sapiens
tttattgtgatttta

SEQ ID NO: 126178 - DNA, 15 bp, Homo sapiens
atttattgtgatttt

SEQ ID NO: 126179 - DNA, 15 bp, Homo sapiens
aatttattgtgattt

SEQ ID NO: 126180 - DNA, 15 bp, Homo sapiens
gaatttattgtgatt

SEQ ID NO: 126181 - DNA, 15 bp, Homo sapiens
tgaatttattgtgat

SEQ ID NO: 126182 - DNA, 15 bp, Homo sapiens
gtgaatttattgtga

SEQ ID NO: 126183 - DNA, 15 bp, Homo sapiens
agtgaatttattgtg

SEQ ID NO: 126184 - DNA, 15 bp, Homo sapiens
cagtgaatttattgt

SEQ ID NO: 126185 - DNA, 15 bp, Homo sapiens
tcagtgaatttattg

SEQ ID NO: 126186 - DNA, 15 bp, Homo sapiens
atcagtgaatttatt

SEQ ID NO: 126187 - DNA, 15 bp, Homo sapiens
tatcagtgaatttat

SEQ ID NO: 126188 - DNA, 15 bp, Homo sapiens
ttatcagtgaattta

SEQ ID NO: 126189 - DNA, 15 bp, Homo sapiens
attatcagtgaattt

SEQ ID NO: 126190 - DNA, 15 bp, Homo sapiens
tattatcagtgaatt

SEQ ID NO: 126191 - DNA, 15 bp, Homo sapiens
atattatcagtgaat

SEQ ID NO: 126192 - DNA, 15 bp, Homo sapiens
catattatcagtgaa

SEQ ID NO: 126193 - DNA, 15 bp, Homo sapiens
ccatattatcagtga

SEQ ID NO: 126194 - DNA, 15 bp, Homo sapiens
tccatattatcagtg

SEQ ID NO: 126195 - DNA, 15 bp, Homo sapiens
atccatattatcagt

SEQ ID NO: 126196 - DNA, 15 bp, Homo sapiens
aatccatattatcag

SEQ ID NO: 126197 - DNA, 15 bp, Homo sapiens
aaatccatattatca

SEQ ID NO: 126198 - DNA, 15 bp, Homo sapiens
caaatccatattatc

SEQ ID NO: 126199 - DNA, 15 bp, Homo sapiens
tcaaatccatattat

SEQ ID NO: 126200 - DNA, 15 bp, Homo sapiens
atcaaatccatatta

SEQ ID NO: 126201 - DNA, 15 bp, Homo sapiens
tatcaaatccatatt

SEQ ID NO: 126202 - DNA, 15 bp, Homo sapiens
ctatcaaatccatat

SEQ ID NO: 126203 - DNA, 15 bp, Homo sapiens
actatcaaatccata

SEQ ID NO: 126204 - DNA, 15 bp, Homo sapiens
cactatcaaatccat

SEQ ID NO: 126205 - DNA, 15 bp, Homo sapiens
gcactatcaaatcca

SEQ ID NO: 126206 - DNA, 15 bp, Homo sapiens
tgcactatcaaatcc

SEQ ID NO: 126207 - DNA, 15 bp, Homo sapiens
atgcactatcaaatc

SEQ ID NO: 126208 - DNA, 15 bp, Homo sapiens
aatgcactatcaaat

SEQ ID NO: 126209 - DNA, 15 bp, Homo sapiens
gaatgcactatcaaa

SEQ ID NO: 126210 - DNA, 15 bp, Homo sapiens
ggaatgcactatcaa

SEQ ID NO: 126211 - DNA, 15 bp, Homo sapiens
aggaatgcactatca

SEQ ID NO: 126212 - DNA, 15 bp, Homo sapiens
gaggaatgcactatc

SEQ ID NO: 126213 - DNA, 15 bp, Homo sapiens
agaggaatgcactat

SEQ ID NO: 126214 - DNA, 15 bp, Homo sapiens
gagaggaatgcacta

SEQ ID NO: 126215 - DNA, 15 bp, Homo sapiens
tgagaggaatgcact

SEQ ID NO: 126216 - DNA, 15 bp, Homo sapiens
atgagaggaatgcac

SEQ ID NO: 126217 - DNA, 15 bp, Homo sapiens
aatgagaggaatgca

SEQ ID NO: 126218 - DNA, 15 bp, Homo sapiens
aaatgagaggaatgc

SEQ ID NO: 126219 - DNA, 15 bp, Homo sapiens
taaatgagaggaatg

SEQ ID NO: 126220 - DNA, 15 bp, Homo sapiens
ttaaatgagaggaat

SEQ ID NO: 126221 - DNA, 15 bp, Homo sapiens
tttaaatgagaggaa

SEQ ID NO: 126222 - DNA, 15 bp, Homo sapiens
gtttaaatgagagga

SEQ ID NO: 126223 - DNA, 15 bp, Homo sapiens
agtttaaatgagagg

SEQ ID NO: 126224 - DNA, 15 bp, Homo sapiens
tagtttaaatgagag

SEQ ID NO: 126225 - DNA, 15 bp, Homo sapiens
ttagtttaaatgaga

SEQ ID NO: 126226 - DNA, 15 bp, Homo sapiens
gttagtttaaatgag

SEQ ID NO: 126227 - DNA, 15 bp, Homo sapiens
tgttagtttaaatga

SEQ ID NO: 126228 - DNA, 15 bp, Homo sapiens
atgttagtttaaatg

SEQ ID NO: 126229 - DNA, 15 bp, Homo sapiens
aatgttagtttaaat

SEQ ID NO: 126230 - DNA, 15 bp, Homo sapiens
taatgttagtttaaa

SEQ ID NO: 126231 - DNA, 15 bp, Homo sapiens
ataatgttagtttaa

SEQ ID NO: 126232 - DNA, 15 bp, Homo sapiens
aataatgttagttta

SEQ ID NO: 126233 - DNA, 15 bp, Homo sapiens
taataatgttagttt

SEQ ID NO: 126234 - DNA, 15 bp, Homo sapiens
ctaataatgttagtt

SEQ ID NO: 126235 - DNA, 15 bp, Homo sapiens
tctaataatgttagt

SEQ ID NO: 126236 - DNA, 15 bp, Homo sapiens
atctaataatgttag

SEQ ID NO: 126237 - DNA, 15 bp, Homo sapiens
tatctaataatgtta

SEQ ID NO: 126238 - DNA, 15 bp, Homo sapiens
atatctaataatgtt

SEQ ID NO: 126239 - DNA, 15 bp, Homo sapiens
aatatctaataatgt

SEQ ID NO: 126240 - DNA, 15 bp, Homo sapiens
aaatatctaataatg

SEQ ID NO: 126241 - DNA, 15 bp, Homo sapiens
caaatatctaataat

SEQ ID NO: 126242 - DNA, 15 bp, Homo sapiens
tcaaatatctaataa

SEQ ID NO: 126243 - DNA, 15 bp, Homo sapiens
ttcaaatatctaata

SEQ ID NO: 126244 - DNA, 15 bp, Homo sapiens
tttcaaatatctaat

SEQ ID NO: 126245 - DNA, 15 bp, Homo sapiens
ttttcaaatatctaa

SEQ ID NO: 126246 - DNA, 15 bp, Homo sapiens
attttcaaatatcta

SEQ ID NO: 126247 - DNA, 15 bp, Homo sapiens
tattttcaaatatct

SEQ ID NO: 126248 - DNA, 15 bp, Homo sapiens
atattttcaaatatc

SEQ ID NO: 126249 - DNA, 15 bp, Homo sapiens
gatattttcaaatat

SEQ ID NO: 126250 - DNA, 15 bp, Homo sapiens
tgatattttcaaata

SEQ ID NO: 126251 - DNA, 15 bp, Homo sapiens
gtgatattttcaaat

SEQ ID NO: 126252 - DNA, 15 bp, Homo sapiens
agtgatattttcaaa

SEQ ID NO: 126253 - DNA, 15 bp, Homo sapiens
tagtgatattttcaa

SEQ ID NO: 126254 - DNA, 15 bp, Homo sapiens
atagtgatattttca

SEQ ID NO: 126255 - DNA, 15 bp, Homo sapiens
aatagtgatattttc

SEQ ID NO: 126256 - DNA, 15 bp, Homo sapiens
aaatagtgatatttt

SEQ ID NO: 126257 - DNA, 15 bp, Homo sapiens
gaaatagtgatattt

SEQ ID NO: 126258 - DNA, 15 bp, Homo sapiens
ggaaatagtgatatt

SEQ ID NO: 126259 - DNA, 15 bp, Homo sapiens
tggaaatagtgatat

SEQ ID NO: 126260 - DNA, 15 bp, Homo sapiens
ctggaaatagtgata

SEQ ID NO: 126261 - DNA, 15 bp, Homo sapiens
gctggaaatagtgat

SEQ ID NO: 126262 - DNA, 15 bp, Homo sapiens
agctggaaatagtga

SEQ ID NO: 126263 - DNA, 15 bp, Homo sapiens
aagctggaaatagtg

SEQ ID NO: 126264 - DNA, 15 bp, Homo sapiens
gaagctggaaatagt

SEQ ID NO: 126265 - DNA, 15 bp, Homo sapiens
tgaagctggaaatag

SEQ ID NO: 126266 - DNA, 15 bp, Homo sapiens
ttgaagctggaaata

SEQ ID NO: 126267 - DNA, 15 bp, Homo sapiens
tttgaagctggaaat

SEQ ID NO: 126268 - DNA, 15 bp, Homo sapiens
atttgaagctggaaa

SEQ ID NO: 126269 - DNA, 15 bp, Homo sapiens
catttgaagctggaa

SEQ ID NO: 126270 - DNA, 15 bp, Homo sapiens
gcatttgaagctgga

SEQ ID NO: 126271 - DNA, 15 bp, Homo sapiens
ggcatttgaagctgg

SEQ ID NO: 126272 - DNA, 15 bp, Homo sapiens
aggcatttgaagctg

SEQ ID NO: 126273 - DNA, 15 bp, Homo sapiens
gaggcatttgaagct

SEQ ID NO: 126274 - DNA, 15 bp, Homo sapiens
tgaggcatttgaagc

SEQ ID NO: 126275 - DNA, 15 bp, Homo sapiens
atgaggcatttgaag

SEQ ID NO: 126276 - DNA, 15 bp, Homo sapiens
aatgaggcatttgaa

SEQ ID NO: 126277 - DNA, 15 bp, Homo sapiens
taatgaggcatttga

SEQ ID NO: 126278 - DNA, 15 bp, Homo sapiens
gtaatgaggcatttg

SEQ ID NO: 126279 - DNA, 15 bp, Homo sapiens
ggtaatgaggcattt

SEQ ID NO: 126280 - DNA, 15 bp, Homo sapiens
aggtaatgaggcatt

SEQ ID NO: 126281 - DNA, 15 bp, Homo sapiens
taggtaatgaggcat

SEQ ID NO: 126282 - DNA, 15 bp, Homo sapiens
ataggtaatgaggca

SEQ ID NO: 126283 - DNA, 15 bp, Homo sapiens
tataggtaatgaggc

SEQ ID NO: 126284 - DNA, 15 bp, Homo sapiens
ctataggtaatgagg

SEQ ID NO: 126285 - DNA, 15 bp, Homo sapiens
tctataggtaatgag

SEQ ID NO: 126286 - DNA, 15 bp, Homo sapiens
ctctataggtaatga

SEQ ID NO: 126287 - DNA, 15 bp, Homo sapiens
tctctataggtaatg

SEQ ID NO: 126288 - DNA, 15 bp, Homo sapiens
ttctctataggtaat

SEQ ID NO: 126289 - DNA, 15 bp, Homo sapiens
attctctataggtaa

SEQ ID NO: 126290 - DNA, 15 bp, Homo sapiens
cattctctataggta

SEQ ID NO: 126291 - DNA, 15 bp, Homo sapiens
acattctctataggt

SEQ ID NO: 126292 - DNA, 15 bp, Homo sapiens
aacattctctatagg

SEQ ID NO: 126293 - DNA, 15 bp, Homo sapiens
taacattctctatag

SEQ ID NO: 126294 - DNA, 15 bp, Homo sapiens
gtaacattctctata

SEQ ID NO: 126295 - DNA, 15 bp, Homo sapiens
agtaacattctctat

SEQ ID NO: 126296 - DNA, 15 bp, Homo sapiens
cagtaacattctcta

SEQ ID NO: 126297 - DNA, 15 bp, Homo sapiens
tcagtaacattctct

SEQ ID NO: 126298 - DNA, 15 bp, Homo sapiens
ttcagtaacattctc

SEQ ID NO: 126299 - DNA, 15 bp, Homo sapiens
cttcagtaacattct

SEQ ID NO: 126300 - DNA, 15 bp, Homo sapiens
gcttcagtaacattc

SEQ ID NO: 126301 - DNA, 15 bp, Homo sapiens
ggcttcagtaacatt

SEQ ID NO: 126302 - DNA, 15 bp, Homo sapiens
aggcttcagtaacat

SEQ ID NO: 126303 - DNA, 15 bp, Homo sapiens
aaggcttcagtaaca

SEQ ID NO: 126304 - DNA, 15 bp, Homo sapiens
aaaggcttcagtaac

SEQ ID NO: 126305 - DNA, 15 bp, Homo sapiens
gaaaggcttcagtaa

SEQ ID NO: 126306 - DNA, 15 bp, Homo sapiens
tgaaaggcttcagta

SEQ ID NO: 126307 - DNA, 15 bp, Homo sapiens
atgaaaggcttcagt

SEQ ID NO: 126308 - DNA, 15 bp, Homo sapiens
catgaaaggcttcag

SEQ ID NO: 126309 - DNA, 15 bp, Homo sapiens
acatgaaaggcttca

SEQ ID NO: 126310 - DNA, 15 bp, Homo sapiens
cacatgaaaggcttc

SEQ ID NO: 126311 - DNA, 15 bp, Homo sapiens
acacatgaaaggctt

SEQ ID NO: 126312 - DNA, 15 bp, Homo sapiens
aacacatgaaaggct

SEQ ID NO: 126313 - DNA, 15 bp, Homo sapiens
gaacacatgaaaggc

SEQ ID NO: 126314 - DNA, 15 bp, Homo sapiens
agaacacatgaaagg

SEQ ID NO: 126315 - DNA, 15 bp, Homo sapiens
cagaacacatgaaag

SEQ ID NO: 126316 - DNA, 15 bp, Homo sapiens
acagaacacatgaaa

SEQ ID NO: 126317 - DNA, 15 bp, Homo sapiens
tacagaacacatgaa

SEQ ID NO: 126318 - DNA, 15 bp, Homo sapiens
gtacagaacacatga

SEQ ID NO: 126319 - DNA, 15 bp, Homo sapiens
tgtacagaacacatg

SEQ ID NO: 126320 - DNA, 15 bp, Homo sapiens
ttgtacagaacacat

SEQ ID NO: 126321 - DNA, 15 bp, Homo sapiens
tttgtacagaacaca

SEQ ID NO: 126322 - DNA, 15 bp, Homo sapiens
atttgtacagaacac

SEQ ID NO: 126323 - DNA, 15 bp, Homo sapiens
catttgtacagaaca

SEQ ID NO: 126324 - DNA, 15 bp, Homo sapiens
gcatttgtacagaac

SEQ ID NO: 126325 - DNA, 15 bp, Homo sapiens
agcatttgtacagaa

SEQ ID NO: 126326 - DNA, 15 bp, Homo sapiens
tagcatttgtacaga

SEQ ID NO: 126327 - DNA, 15 bp, Homo sapiens
gtagcatttgtacag

SEQ ID NO: 126328 - DNA, 15 bp, Homo sapiens
agtagcatttgtaca

SEQ ID NO: 126329 - DNA, 15 bp, Homo sapiens
tagtagcatttgtac

SEQ ID NO: 126330 - DNA, 15 bp, Homo sapiens
atagtagcatttgta

SEQ ID NO: 126331 - DNA, 15 bp, Homo sapiens
aatagtagcatttgt

SEQ ID NO: 126332 - DNA, 15 bp, Homo sapiens
caatagtagcatttg

SEQ ID NO: 126333 - DNA, 15 bp, Homo sapiens
acaatagtagcattt

SEQ ID NO: 126334 - DNA, 15 bp, Homo sapiens
cacaatagtagcatt

SEQ ID NO: 126335 - DNA, 15 bp, Homo sapiens
tcacaatagtagcat

SEQ ID NO: 126336 - DNA, 15 bp, Homo sapiens
ctcacaatagtagca

SEQ ID NO: 126337 - DNA, 15 bp, Homo sapiens
cctcacaatagtagc

SEQ ID NO: 126338 - DNA, 15 bp, Homo sapiens
tcctcacaatagtag

SEQ ID NO: 126339 - DNA, 15 bp, Homo sapiens
gtcctcacaatagta

SEQ ID NO: 126340 - DNA, 15 bp, Homo sapiens
agtcctcacaatagt

SEQ ID NO: 126341 - DNA, 15 bp, Homo sapiens
aagtcctcacaatag

SEQ ID NO: 126342 - DNA, 15 bp, Homo sapiens
aaagtcctcacaata

SEQ ID NO: 126343 - DNA, 15 bp, Homo sapiens
aaaagtcctcacaat

SEQ ID NO: 126344 - DNA, 15 bp, Homo sapiens
aaaaagtcctcacaa

SEQ ID NO: 126345 - DNA, 15 bp, Homo sapiens
aaaaaagtcctcaca

SEQ ID NO: 126346 - DNA, 15 bp, Homo sapiens
aaaaaaagtcctcac

SEQ ID NO: 126347 - DNA, 15 bp, Homo sapiens
gaaaaaaagtcctca

SEQ ID NO: 126348 - DNA, 15 bp, Homo sapiens
ggaaaaaaagtcctc

SEQ ID NO: 126349 - DNA, 15 bp, Homo sapiens
aggaaaaaaagtcct

SEQ ID NO: 126350 - DNA, 15 bp, Homo sapiens
caggaaaaaaagtcc

SEQ ID NO: 126351 - DNA, 15 bp, Homo sapiens
gcaggaaaaaaagtc

SEQ ID NO: 126352 - DNA, 15 bp, Homo sapiens
ggcaggaaaaaaagt

SEQ ID NO: 126353 - DNA, 15 bp, Homo sapiens
aggcaggaaaaaaag

SEQ ID NO: 126354 - DNA, 15 bp, Homo sapiens
aaggcaggaaaaaaa

SEQ ID NO: 126355 - DNA, 15 bp, Homo sapiens
caaggcaggaaaaaa

SEQ ID NO: 126356 - DNA, 15 bp, Homo sapiens
tcaaggcaggaaaaa

SEQ ID NO: 126357 - DNA, 15 bp, Homo sapiens
ctcaaggcaggaaaa

SEQ ID NO: 126358 - DNA, 15 bp, Homo sapiens
actcaaggcaggaaa

SEQ ID NO: 126359 - DNA, 15 bp, Homo sapiens
tactcaaggcaggaa

SEQ ID NO: 126360 - DNA, 15 bp, Homo sapiens
atactcaaggcagga

SEQ ID NO: 126361 - DNA, 15 bp, Homo sapiens
tatactcaaggcagg

SEQ ID NO: 126362 - DNA, 15 bp, Homo sapiens
atatactcaaggcag

SEQ ID NO: 126363 - DNA, 15 bp, Homo sapiens
aatatactcaaggca

SEQ ID NO: 126364 - DNA, 15 bp, Homo sapiens
taatatactcaaggc

SEQ ID NO: 126365 - DNA, 15 bp, Homo sapiens
ataatatactcaagg

SEQ ID NO: 126366 - DNA, 15 bp, Homo sapiens
cataatatactcaag

SEQ ID NO: 126367 - DNA, 15 bp, Homo sapiens
acataatatactcaa

SEQ ID NO: 126368 - DNA, 15 bp, Homo sapiens
tacataatatactca

SEQ ID NO: 126369 - DNA, 15 bp, Homo sapiens
ctacataatatactc

SEQ ID NO: 126370 - DNA, 15 bp, Homo sapiens
gctacataatatact

SEQ ID NO: 126371 - DNA, 15 bp, Homo sapiens
tgctacataatatac

SEQ ID NO: 126372 - DNA, 15 bp, Homo sapiens
atgctacataatata

SEQ ID NO: 126373 - DNA, 15 bp, Homo sapiens
tatgctacataatat

SEQ ID NO: 126374 - DNA, 15 bp, Homo sapiens
atatgctacataata

SEQ ID NO: 126375 - DNA, 15 bp, Homo sapiens
aatatgctacataat

SEQ ID NO: 126376 - DNA, 15 bp, Homo sapiens
gaatatgctacataa

SEQ ID NO: 126377 - DNA, 15 bp, Homo sapiens
ggaatatgctacata

SEQ ID NO: 126378 - DNA, 15 bp, Homo sapiens
tggaatatgctacat

SEQ ID NO: 126379 - DNA, 15 bp, Homo sapiens
gtggaatatgctaca

SEQ ID NO: 126380 - DNA, 15 bp, Homo sapiens
tgtggaatatgctac

SEQ ID NO: 126381 - DNA, 15 bp, Homo sapiens
gtgtggaatatgcta

SEQ ID NO: 126382 - DNA, 15 bp, Homo sapiens
tgtgtggaatatgct

SEQ ID NO: 126383 - DNA, 15 bp, Homo sapiens
gtgtgtggaatatgc

SEQ ID NO: 126384 - DNA, 15 bp, Homo sapiens
agtgtgtggaatatg

SEQ ID NO: 126385 - DNA, 15 bp, Homo sapiens
aagtgtgtggaatat

SEQ ID NO: 126386 - DNA, 15 bp, Homo sapiens
aaagtgtgtggaata

SEQ ID NO: 126387 - DNA, 15 bp, Homo sapiens
caaagtgtgtggaat

SEQ ID NO: 126388 - DNA, 15 bp, Homo sapiens
ccaaagtgtgtggaa

SEQ ID NO: 126389 - DNA, 15 bp, Homo sapiens
accaaagtgtgtgga

SEQ ID NO: 126390 - DNA, 15 bp, Homo sapiens
aaccaaagtgtgtgg

SEQ ID NO: 126391 - DNA, 15 bp, Homo sapiens
taaccaaagtgtgtg

SEQ ID NO: 126392 - DNA, 15 bp, Homo sapiens
ttaaccaaagtgtgt

SEQ ID NO: 126393 - DNA, 15 bp, Homo sapiens
tttaaccaaagtgtg

SEQ ID NO: 126394 - DNA, 15 bp, Homo sapiens
ttttaaccaaagtgt

SEQ ID NO: 126395 - DNA, 15 bp, Homo sapiens
gttttaaccaaagtg

SEQ ID NO: 126396 - DNA, 15 bp, Homo sapiens
tgttttaaccaaagt

SEQ ID NO: 126397 - DNA, 15 bp, Homo sapiens
ctgttttaaccaaag

SEQ ID NO: 126398 - DNA, 15 bp, Homo sapiens
tctgttttaaccaaa

SEQ ID NO: 126399 - DNA, 15 bp, Homo sapiens
ctctgttttaaccaa

SEQ ID NO: 126400 - DNA, 15 bp, Homo sapiens
actctgttttaacca

SEQ ID NO: 126401 - DNA, 15 bp, Homo sapiens
tactctgttttaacc

SEQ ID NO: 126402 - DNA, 15 bp, Homo sapiens
atactctgttttaac

SEQ ID NO: 126403 - DNA, 15 bp, Homo sapiens
gatactctgttttaa

SEQ ID NO: 126404 - DNA, 15 bp, Homo sapiens
tgatactctgtttta

SEQ ID NO: 126405 - DNA, 15 bp, Homo sapiens
atgatactctgtttt

SEQ ID NO: 126406 - DNA, 15 bp, Homo sapiens
aatgatactctgttt

SEQ ID NO: 126407 - DNA, 15 bp, Homo sapiens
aaatgatactctgtt

SEQ ID NO: 126408 - DNA, 15 bp, Homo sapiens
taaatgatactctgt

SEQ ID NO: 126409 - DNA, 15 bp, Homo sapiens
ttaaatgatactctg

SEQ ID NO: 126410 - DNA, 15 bp, Homo sapiens
tttaaatgatactct

SEQ ID NO: 126411 - DNA, 15 bp, Homo sapiens
ttttaaatgatactc

SEQ ID NO: 126412 - DNA, 15 bp, Homo sapiens
tttttaaatgatact

SEQ ID NO: 126413 - DNA, 15 bp, Homo sapiens
ttttttaaatgatac

SEQ ID NO: 126414 - DNA, 15 bp, Homo sapiens
tttttttaaatgata

SEQ ID NO: 126415 - DNA, 15 bp, Homo sapiens
ttttttttaaatgat

SEQ ID NO: 126416 - DNA, 15 bp, Homo sapiens
tttttttttaaatga

SEQ ID NO: 126417 - DNA, 15 bp, Homo sapiens
ttttttttttaaatg

SEQ ID NO: 126418 - DNA, 15 bp, Homo sapiens
ctttttttttttaaa

SEQ ID NO: 126419 - DNA, 15 bp, Homo sapiens
actttttttttttaa

SEQ ID NO: 126420 - DNA, 15 bp, Homo sapiens
aacttttttttttta

SEQ ID NO: 126421 - DNA, 15 bp, Homo sapiens
gaaaacttttttttt

SEQ ID NO: 126422 - DNA, 15 bp, Homo sapiens
tgaaaactttttttt

SEQ ID NO: 126423 - DNA, 15 bp, Homo sapiens
ctgaaaacttttttt

SEQ ID NO: 126424 - DNA, 15 bp, Homo sapiens
actgaaaactttttt

SEQ ID NO: 126425 - DNA, 15 bp, Homo sapiens
aactgaaaacttttt

SEQ ID NO: 126426 - DNA, 15 bp, Homo sapiens
aaactgaaaactttt

SEQ ID NO: 126427 - DNA, 15 bp, Homo sapiens
aaaactgaaaacttt

SEQ ID NO: 126428 - DNA, 15 bp, Homo sapiens
gaaaactgaaaactt

SEQ ID NO: 126429 - DNA, 15 bp, Homo sapiens
tgaaaactgaaaact

SEQ ID NO: 126430 - DNA, 15 bp, Homo sapiens
atgaaaactgaaaac

SEQ ID NO: 126431 - DNA, 15 bp, Homo sapiens
catgaaaactgaaaa

SEQ ID NO: 126432 - DNA, 15 bp, Homo sapiens
tcatgaaaactgaaa

SEQ ID NO: 126433 - DNA, 15 bp, Homo sapiens
atcatgaaaactgaa

SEQ ID NO: 126434 - DNA, 15 bp, Homo sapiens
aatcatgaaaactga

SEQ ID NO: 126435 - DNA, 15 bp, Homo sapiens
taatcatgaaaactg

SEQ ID NO: 126436 - DNA, 15 bp, Homo sapiens
ttaatcatgaaaact

SEQ ID NO: 126437 - DNA, 15 bp, Homo sapiens
gttaatcatgaaaac

SEQ ID NO: 126438 - DNA, 15 bp, Homo sapiens
tgttaatcatgaaaa

SEQ ID NO: 126439 - DNA, 15 bp, Homo sapiens
ttgttaatcatgaaa

SEQ ID NO: 126440 - DNA, 15 bp, Homo sapiens
attgttaatcatgaa

SEQ ID NO: 126441 - DNA, 15 bp, Homo sapiens
cattgttaatcatga

SEQ ID NO: 126442 - DNA, 15 bp, Homo sapiens
tcattgttaatcatg

SEQ ID NO: 126443 - DNA, 15 bp, Homo sapiens
atcattgttaatcat

SEQ ID NO: 126444 - DNA, 15 bp, Homo sapiens
aatcattgttaatca

SEQ ID NO: 126445 - DNA, 15 bp, Homo sapiens
taatcattgttaatc

SEQ ID NO: 126446 - DNA, 15 bp, Homo sapiens
ataatcattgttaat

SEQ ID NO: 126447 - DNA, 15 bp, Homo sapiens
cataatcattgttaa

SEQ ID NO: 126448 - DNA, 15 bp, Homo sapiens
acataatcattgtta

SEQ ID NO: 126449 - DNA, 15 bp, Homo sapiens
gacataatcattgtt

SEQ ID NO: 126450 - DNA, 15 bp, Homo sapiens
agacataatcattgt

SEQ ID NO: 126451 - DNA, 15 bp, Homo sapiens
gagacataatcattg

SEQ ID NO: 126452 - DNA, 15 bp, Homo sapiens
tgagacataatcatt

SEQ ID NO: 126453 - DNA, 15 bp, Homo sapiens
taatgagacataatc

SEQ ID NO: 126454 - DNA, 15 bp, Homo sapiens
ataatgagacataat

SEQ ID NO: 126455 - DNA, 15 bp, Homo sapiens
aataatgagacataa

SEQ ID NO: 126456 - DNA, 15 bp, Homo sapiens
taataatgagacata

SEQ ID NO: 126457 - DNA, 15 bp, Homo sapiens
ataataatgagacat

SEQ ID NO: 126458 - DNA, 15 bp, Homo sapiens
aataataatgagaca

SEQ ID NO: 126459 - DNA, 15 bp, Homo sapiens
aaataataatgagac

SEQ ID NO: 126460 - DNA, 15 bp, Homo sapiens
gaaataataatgaga

SEQ ID NO: 126461 - DNA, 15 bp, Homo sapiens
tgaaataataatgag

SEQ ID NO: 126462 - DNA, 15 bp, Homo sapiens
ttgaaataataatga

SEQ ID NO: 126463 - DNA, 15 bp, Homo sapiens
tttgaaataataatg

SEQ ID NO: 126464 - DNA, 15 bp, Homo sapiens
atttgaaataataat

SEQ ID NO: 126465 - DNA, 15 bp, Homo sapiens
catttgaaataataa

SEQ ID NO: 126466 - DNA, 15 bp, Homo sapiens
tcatttgaaataata

SEQ ID NO: 126467 - DNA, 15 bp, Homo sapiens
ctcatttgaaataat

SEQ ID NO: 126468 - DNA, 15 bp, Homo sapiens
actcatttgaaataa

SEQ ID NO: 126469 - DNA, 15 bp, Homo sapiens
cactcatttgaaata

SEQ ID NO: 126470 - DNA, 15 bp, Homo sapiens
acactcatttgaaat

SEQ ID NO: 126471 - DNA, 15 bp, Homo sapiens
aacactcatttgaaa

SEQ ID NO: 126472 - DNA, 15 bp, Homo sapiens
gaacactcatttgaa

SEQ ID NO: 126473 - DNA, 15 bp, Homo sapiens
agaacactcatttga

SEQ ID NO: 126474 - DNA, 15 bp, Homo sapiens
tagaacactcatttg

SEQ ID NO: 126475 - DNA, 15 bp, Homo sapiens
gtagaacactcattt

SEQ ID NO: 126476 - DNA, 15 bp, Homo sapiens
tgtagaacactcatt

SEQ ID NO: 126477 - DNA, 15 bp, Homo sapiens
ttgtagaacactcat

SEQ ID NO: 126478 - DNA, 15 bp, Homo sapiens
attgtagaacactca

SEQ ID NO: 126479 - DNA, 15 bp, Homo sapiens
tattgtagaacactc

SEQ ID NO: 126480 - DNA, 15 bp, Homo sapiens
atattgtagaacact

SEQ ID NO: 126481 - DNA, 15 bp, Homo sapiens
tatattgtagaacac

SEQ ID NO: 126482 - DNA, 15 bp, Homo sapiens
ttatattgtagaaca

SEQ ID NO: 126483 - DNA, 15 bp, Homo sapiens
tttatattgtagaac

SEQ ID NO: 126484 - DNA, 15 bp, Homo sapiens
atttatattgtagaa

SEQ ID NO: 126485 - DNA, 15 bp, Homo sapiens
tatttatattgtaga

SEQ ID NO: 126486 - DNA, 15 bp, Homo sapiens
atatttatattgtag

SEQ ID NO: 126487 - DNA, 15 bp, Homo sapiens
gatatttatattgta

SEQ ID NO: 126488 - DNA, 15 bp, Homo sapiens
agatatttatattgt

SEQ ID NO: 126489 - DNA, 15 bp, Homo sapiens
cagatatttatattg

SEQ ID NO: 126490 - DNA, 15 bp, Homo sapiens
ccagatatttatatt

SEQ ID NO: 126491 - DNA, 15 bp, Homo sapiens
accagatatttatat

SEQ ID NO: 126492 - DNA, 15 bp, Homo sapiens
gaccagatatttata

SEQ ID NO: 126493 - DNA, 15 bp, Homo sapiens
tgaccagatatttat

SEQ ID NO: 126494 - DNA, 15 bp, Homo sapiens
atgaccagatattta

SEQ ID NO: 126495 - DNA, 15 bp, Homo sapiens
gatgaccagatattt

SEQ ID NO: 126496 - DNA, 15 bp, Homo sapiens
agatgaccagatatt

SEQ ID NO: 126497 - DNA, 15 bp, Homo sapiens
cagatgaccagatat

SEQ ID NO: 126498 - DNA, 15 bp, Homo sapiens
acagatgaccagata

SEQ ID NO: 126499 - DNA, 15 bp, Homo sapiens
cacagatgaccagat

SEQ ID NO: 126500 - DNA, 15 bp, Homo sapiens
tcacagatgaccaga

SEQ ID NO: 126501 - DNA, 15 bp, Homo sapiens
atcacagatgaccag

SEQ ID NO: 126502 - DNA, 15 bp, Homo sapiens
aatcacagatgacca

SEQ ID NO: 126503 - DNA, 15 bp, Homo sapiens
gaatcacagatgacc

SEQ ID NO: 126504 - DNA, 15 bp, Homo sapiens
ggaatcacagatgac

SEQ ID NO: 126505 - DNA, 15 bp, Homo sapiens
aggaatcacagatga

SEQ ID NO: 126506 - DNA, 15 bp, Homo sapiens
aaggaatcacagatg

SEQ ID NO: 126507 - DNA, 15 bp, Homo sapiens
aaaggaatcacagat

SEQ ID NO: 126508 - DNA, 15 bp, Homo sapiens
aaaaggaatcacaga

SEQ ID NO: 126509 - DNA, 15 bp, Homo sapiens
aaaaaggaatcacag

SEQ ID NO: 126510 - DNA, 15 bp, Homo sapiens
aaaaaaggaatcaca

SEQ ID NO: 126511 - DNA, 15 bp, Homo sapiens
aaaaaaaggaatcac

SEQ ID NO: 126512 - DNA, 15 bp, Homo sapiens
caaaaaaaggaatca

SEQ ID NO: 126513 - DNA, 15 bp, Homo sapiens
acaaaaaaaggaatc

SEQ ID NO: 126514 - DNA, 15 bp, Homo sapiens
aacaaaaaaaggaat

SEQ ID NO: 126515 - DNA, 15 bp, Homo sapiens
taacaaaaaaaggaa

SEQ ID NO: 126516 - DNA, 15 bp, Homo sapiens
gtaacaaaaaaagga

SEQ ID NO: 126517 - DNA, 15 bp, Homo sapiens
agtaacaaaaaaagg

SEQ ID NO: 126518 - DNA, 15 bp, Homo sapiens
aagtaacaaaaaaag

SEQ ID NO: 126519 - DNA, 15 bp, Homo sapiens
aaagtaacaaaaaaa

SEQ ID NO: 126520 - DNA, 15 bp, Homo sapiens
caaagtaacaaaaaa

SEQ ID NO: 126521 - DNA, 15 bp, Homo sapiens
gcaaagtaacaaaaa

SEQ ID NO: 126522 - DNA, 15 bp, Homo sapiens
agcaaagtaacaaaa

SEQ ID NO: 126523 - DNA, 15 bp, Homo sapiens
cagcaaagtaacaaa

SEQ ID NO: 126524 - DNA, 15 bp, Homo sapiens
ccagcaaagtaacaa

SEQ ID NO: 126525 - DNA, 15 bp, Homo sapiens
tccagcaaagtaaca

SEQ ID NO: 126526 - DNA, 15 bp, Homo sapiens
atccagcaaagtaac

SEQ ID NO: 126527 - DNA, 15 bp, Homo sapiens
aatccagcaaagtaa

SEQ ID NO: 126528 - DNA, 15 bp, Homo sapiens
aaatccagcaaagta

SEQ ID NO: 126529 - DNA, 15 bp, Homo sapiens
aaaatccagcaaagt

SEQ ID NO: 126530 - DNA, 15 bp, Homo sapiens
caaaatccagcaaag

SEQ ID NO: 126531 - DNA, 15 bp, Homo sapiens
acaaaatccagcaaa

SEQ ID NO: 126532 - DNA, 15 bp, Homo sapiens
aacaaaatccagcaa

SEQ ID NO: 126533 - DNA, 15 bp, Homo sapiens
taacaaaatccagca

SEQ ID NO: 126534 - DNA, 15 bp, Homo sapiens
ttaacaaaatccagc

SEQ ID NO: 126535 - DNA, 15 bp, Homo sapiens
attaacaaaatccag

SEQ ID NO: 126536 - DNA, 15 bp, Homo sapiens
gattaacaaaatcca

SEQ ID NO: 126537 - DNA, 15 bp, Homo sapiens
agattaacaaaatcc

SEQ ID NO: 126538 - DNA, 15 bp, Homo sapiens
tagattaacaaaatc

SEQ ID NO: 126539 - DNA, 15 bp, Homo sapiens
atagattaacaaaat

SEQ ID NO: 126540 - DNA, 15 bp, Homo sapiens
catagattaacaaaa

SEQ ID NO: 126541 - DNA, 15 bp, Homo sapiens
tcatagattaacaaa

SEQ ID NO: 126542 - DNA, 15 bp, Homo sapiens
gtcatagattaacaa

SEQ ID NO: 126543 - DNA, 15 bp, Homo sapiens
tgtcatagattaaca

SEQ ID NO: 126544 - DNA, 15 bp, Homo sapiens
ttgtcatagattaac

SEQ ID NO: 126545 - DNA, 15 bp, Homo sapiens
attgtcatagattaa

SEQ ID NO: 126546 - DNA, 15 bp, Homo sapiens
tattgtcatagatta

SEQ ID NO: 126547 - DNA, 15 bp, Homo sapiens
atattgtcatagatt

SEQ ID NO: 126548 - DNA, 15 bp, Homo sapiens
tatattgtcatagat

SEQ ID NO: 126549 - DNA, 15 bp, Homo sapiens
atatattgtcataga

SEQ ID NO: 126550 - DNA, 15 bp, Homo sapiens
aatatattgtcatag

SEQ ID NO: 126551 - DNA, 15 bp, Homo sapiens
aaatatattgtcata

SEQ ID NO: 126552 - DNA, 15 bp, Homo sapiens
aaaatatattgtcat

SEQ ID NO: 126553 - DNA, 15 bp, Homo sapiens
aaaaatatattgtca

SEQ ID NO: 126554 - DNA, 15 bp, Homo sapiens
taaaaatatattgtc

SEQ ID NO: 126555 - DNA, 15 bp, Homo sapiens
ctaaaaatatattgt

SEQ ID NO: 126556 - DNA, 15 bp, Homo sapiens
tctaaaaatatattg

SEQ ID NO: 126557 - DNA, 15 bp, Homo sapiens
ttctaaaaatatatt

SEQ ID NO: 126558 - DNA, 15 bp, Homo sapiens
attctaaaaatatat

SEQ ID NO: 126559 - DNA, 15 bp, Homo sapiens
tattctaaaaatata

SEQ ID NO: 126560 - DNA, 15 bp, Homo sapiens
atattctaaaaatat

SEQ ID NO: 126561 - DNA, 15 bp, Homo sapiens
gatattctaaaaata

SEQ ID NO: 126562 - DNA, 15 bp, Homo sapiens
tgatattctaaaaat

SEQ ID NO: 126563 - DNA, 15 bp, Homo sapiens
ttgatattctaaaaa

SEQ ID NO: 126564 - DNA, 15 bp, Homo sapiens
tttgatattctaaaa

SEQ ID NO: 126565 - DNA, 15 bp, Homo sapiens
ctttgatattctaaa

SEQ ID NO: 126566 - DNA, 15 bp, Homo sapiens
tctttgatattctaa

SEQ ID NO: 126567 - DNA, 15 bp, Homo sapiens
gtctttgatattcta

SEQ ID NO: 126568 - DNA, 15 bp, Homo sapiens
ggtctttgatattct

SEQ ID NO: 126569 - DNA, 15 bp, Homo sapiens
tggtctttgatattc

SEQ ID NO: 126570 - DNA, 15 bp, Homo sapiens
ttggtctttgatatt

SEQ ID NO: 126571 - DNA, 15 bp, Homo sapiens
gttggtctttgatat

SEQ ID NO: 126572 - DNA, 15 bp, Homo sapiens
agttggtctttgata

SEQ ID NO: 126573 - DNA, 15 bp, Homo sapiens
cagttggtctttgat

SEQ ID NO: 126574 - DNA, 15 bp, Homo sapiens
ccagttggtctttga

SEQ ID NO: 126575 - DNA, 15 bp, Homo sapiens
tccagttggtctttg

SEQ ID NO: 126576 - DNA, 15 bp, Homo sapiens
gtccagttggtcttt

SEQ ID NO: 126577 - DNA, 15 bp, Homo sapiens
tgtccagttggtctt

SEQ ID NO: 126578 - DNA, 15 bp, Homo sapiens
ttgtccagttggtct

SEQ ID NO: 126579 - DNA, 15 bp, Homo sapiens
tttgtccagttggtc

SEQ ID NO: 126580 - DNA, 15 bp, Homo sapiens
gtttgtccagttggt

SEQ ID NO: 126581 - DNA, 15 bp, Homo sapiens
agtttgtccagttgg

SEQ ID NO: 126582 - DNA, 15 bp, Homo sapiens
aagtttgtccagttg

SEQ ID NO: 126583 - DNA, 15 bp, Homo sapiens
caagtttgtccagtt

SEQ ID NO: 126584 - DNA, 15 bp, Homo sapiens
ccaagtttgtccagt

SEQ ID NO: 126585 - DNA, 15 bp, Homo sapiens
tccaagtttgtccag

SEQ ID NO: 126586 - DNA, 15 bp, Homo sapiens
ctccaagtttgtcca

SEQ ID NO: 126587 - DNA, 15 bp, Homo sapiens
tctccaagtttgtcc

SEQ ID NO: 126588 - DNA, 15 bp, Homo sapiens
ctctccaagtttgtc

SEQ ID NO: 126589 - DNA, 15 bp, Homo sapiens
gctctccaagtttgt

SEQ ID NO: 126590 - DNA, 15 bp, Homo sapiens
tgctctccaagtttg

SEQ ID NO: 126591 - DNA, 15 bp, Homo sapiens
ctgctctccaagttt

SEQ ID NO: 126592 - DNA, 15 bp, Homo sapiens
tctgctctccaagtt

SEQ ID NO: 126593 - DNA, 15 bp, Homo sapiens
atctgctctccaagt

SEQ ID NO: 126594 - DNA, 15 bp, Homo sapiens
aatctgctctccaag

SEQ ID NO: 126595 - DNA, 15 bp, Homo sapiens
caatctgctctccaa

SEQ ID NO: 126596 - DNA, 15 bp, Homo sapiens
gcaatctgctctcca

SEQ ID NO: 126597 - DNA, 15 bp, Homo sapiens
tgcaatctgctctcc

SEQ ID NO: 126598 - DNA, 15 bp, Homo sapiens
ctgcaatctgctctc

SEQ ID NO: 126599 - DNA, 15 bp, Homo sapiens
actgcaatctgctct

SEQ ID NO: 126600 - DNA, 15 bp, Homo sapiens
gactgcaatctgctc

SEQ ID NO: 126601 - DNA, 15 bp, Homo sapiens
tgactgcaatctgct

SEQ ID NO: 126602 - DNA, 15 bp, Homo sapiens
atgactgcaatctgc

SEQ ID NO: 126603 - DNA, 15 bp, Homo sapiens
aatgactgcaatctg

SEQ ID NO: 126604 - DNA, 15 bp, Homo sapiens
gaatgactgcaatct

SEQ ID NO: 126605 - DNA, 15 bp, Homo sapiens
tgaatgactgcaatc

SEQ ID NO: 126606 - DNA, 15 bp, Homo sapiens
atgaatgactgcaat

SEQ ID NO: 126607 - DNA, 15 bp, Homo sapiens
catgaatgactgcaa

SEQ ID NO: 126608 - DNA, 15 bp, Homo sapiens
tcatgaatgactgca

SEQ ID NO: 126609 - DNA, 15 bp, Homo sapiens
ttcatgaatgactgc

SEQ ID NO: 126610 - DNA, 15 bp, Homo sapiens
tttcatgaatgactg

SEQ ID NO: 126611 - DNA, 15 bp, Homo sapiens
ttttcatgaatgact

SEQ ID NO: 126612 - DNA, 15 bp, Homo sapiens
tttttcatgaatgac

SEQ ID NO: 126613 - DNA, 15 bp, Homo sapiens
gtttttcatgaatga

SEQ ID NO: 126614 - DNA, 15 bp, Homo sapiens
tgtttttcatgaatg

SEQ ID NO: 126615 - DNA, 15 bp, Homo sapiens
ctgtttttcatgaat

SEQ ID NO: 126616 - DNA, 15 bp, Homo sapiens
gctgtttttcatgaa

SEQ ID NO: 126617 - DNA, 15 bp, Homo sapiens
ggctgtttttcatga

SEQ ID NO: 126618 - DNA, 15 bp, Homo sapiens
tggctgtttttcatg

SEQ ID NO: 126619 - DNA, 15 bp, Homo sapiens
ctggctgtttttcat

SEQ ID NO: 126620 - DNA, 15 bp, Homo sapiens
tctggctgtttttca

SEQ ID NO: 126621 - DNA, 15 bp, Homo sapiens
atctggctgtttttc

SEQ ID NO: 126622 - DNA, 15 bp, Homo sapiens
catctggctgttttt

SEQ ID NO: 126623 - DNA, 15 bp, Homo sapiens
acatctggctgtttt

SEQ ID NO: 126624 - DNA, 15 bp, Homo sapiens
gacatctggctgttt

SEQ ID NO: 126625 - DNA, 15 bp, Homo sapiens
tgacatctggctgtt

SEQ ID NO: 126626 - DNA, 15 bp, Homo sapiens
atgacatctggctgt

SEQ ID NO: 126627 - DNA, 15 bp, Homo sapiens
gatgacatctggctg

SEQ ID NO: 126628 - DNA, 15 bp, Homo sapiens
ggatgacatctggct

SEQ ID NO: 126629 - DNA, 15 bp, Homo sapiens
aggatgacatctggc

SEQ ID NO: 126630 - DNA, 15 bp, Homo sapiens
aaggatgacatctgg

SEQ ID NO: 126631 - DNA, 15 bp, Homo sapiens
caaggatgacatctg

SEQ ID NO: 126632 - DNA, 15 bp, Homo sapiens
tcaaggatgacatct

SEQ ID NO: 126633 - DNA, 15 bp, Homo sapiens
ttcaaggatgacatc

SEQ ID NO: 126634 - DNA, 15 bp, Homo sapiens
cttcaaggatgacat

SEQ ID NO: 126635 - DNA, 15 bp, Homo sapiens
gcttcaaggatgaca

SEQ ID NO: 126636 - DNA, 15 bp, Homo sapiens
ggcttcaaggatgac

SEQ ID NO: 126637 - DNA, 15 bp, Homo sapiens
aggcttcaaggatga

SEQ ID NO: 126638 - DNA, 15 bp, Homo sapiens
gaggcttcaaggatg

SEQ ID NO: 126639 - DNA, 15 bp, Homo sapiens
agaggcttcaaggat

SEQ ID NO: 126640 - DNA, 15 bp, Homo sapiens
cagaggcttcaagga

SEQ ID NO: 126641 - DNA, 15 bp, Homo sapiens
ccagaggcttcaagg

SEQ ID NO: 126642 - DNA, 15 bp, Homo sapiens
tccagaggcttcaag

SEQ ID NO: 126643 - DNA, 15 bp, Homo sapiens
gtccagaggcttcaa

SEQ ID NO: 126644 - DNA, 15 bp, Homo sapiens
ggtccagaggcttca

SEQ ID NO: 126645 - DNA, 15 bp, Homo sapiens
aggtccagaggcttc

SEQ ID NO: 126646 - DNA, 15 bp, Homo sapiens
caggtccagaggctt

SEQ ID NO: 126647 - DNA, 15 bp, Homo sapiens
tcaggtccagaggct

SEQ ID NO: 126648 - DNA, 15 bp, Homo sapiens
ttcaggtccagaggc

SEQ ID NO: 126649 - DNA, 15 bp, Homo sapiens
cttcaggtccagagg

SEQ ID NO: 126650 - DNA, 15 bp, Homo sapiens
gcttcaggtccagag

SEQ ID NO: 126651 - DNA, 15 bp, Homo sapiens
ggcttcaggtccaga

SEQ ID NO: 126652 - DNA, 15 bp, Homo sapiens
tggcttcaggtccag

SEQ ID NO: 126653 - DNA, 15 bp, Homo sapiens
atggcttcaggtcca

SEQ ID NO: 126654 - DNA, 15 bp, Homo sapiens
aatggcttcaggtcc

SEQ ID NO: 126655 - DNA, 15 bp, Homo sapiens
gaatggcttcaggtc

SEQ ID NO: 126656 - DNA, 15 bp, Homo sapiens
tgaatggcttcaggt

SEQ ID NO: 126657 - DNA, 15 bp, Homo sapiens
ctgaatggcttcagg

SEQ ID NO: 126658 - DNA, 15 bp, Homo sapiens
tctgaatggcttcag

SEQ ID NO: 126659 - DNA, 15 bp, Homo sapiens
atctgaatggcttca

SEQ ID NO: 126660 - DNA, 15 bp, Homo sapiens
gatctgaatggcttc

SEQ ID NO: 126661 - DNA, 15 bp, Homo sapiens
tgatctgaatggctt

SEQ ID NO: 126662 - DNA, 15 bp, Homo sapiens
ctgatctgaatggct

SEQ ID NO: 126663 - DNA, 15 bp, Homo sapiens
tctgatctgaatggc

SEQ ID NO: 126664 - DNA, 15 bp, Homo sapiens
ctctgatctgaatgg

SEQ ID NO: 126665 - DNA, 15 bp, Homo sapiens
tctctgatctgaatg

SEQ ID NO: 126666 - DNA, 15 bp, Homo sapiens
atctctgatctgaat

SEQ ID NO: 126667 - DNA, 15 bp, Homo sapiens
tatctctgatctgaa

SEQ ID NO: 126668 - DNA, 15 bp, Homo sapiens
gtatctctgatctga

SEQ ID NO: 126669 - DNA, 15 bp, Homo sapiens
tgtatctctgatctg

SEQ ID NO: 126670 - DNA, 15 bp, Homo sapiens
gtgtatctctgatct

SEQ ID NO: 126671 - DNA, 15 bp, Homo sapiens
agtgtatctctgatc

SEQ ID NO: 126672 - DNA, 15 bp, Homo sapiens
aagtgtatctctgat

SEQ ID NO: 126673 - DNA, 15 bp, Homo sapiens
taagtgtatctctga

SEQ ID NO: 126674 - DNA, 15 bp, Homo sapiens
gtaagtgtatctctg

SEQ ID NO: 126675 - DNA, 15 bp, Homo sapiens
agtaagtgtatctct

SEQ ID NO: 126676 - DNA, 15 bp, Homo sapiens
gagtaagtgtatctc

SEQ ID NO: 126677 - DNA, 15 bp, Homo sapiens
tgagtaagtgtatct

SEQ ID NO: 126678 - DNA, 15 bp, Homo sapiens
ctgagtaagtgtatc

SEQ ID NO: 126679 - DNA, 15 bp, Homo sapiens
gctgagtaagtgtat

SEQ ID NO: 126680 - DNA, 15 bp, Homo sapiens
agctgagtaagtgta

SEQ ID NO: 126681 - DNA, 15 bp, Homo sapiens
cagctgagtaagtgt

SEQ ID NO: 126682 - DNA, 15 bp, Homo sapiens
tcagctgagtaagtg

SEQ ID NO: 126683 - DNA, 15 bp, Homo sapiens
ttcagctgagtaagt

SEQ ID NO: 126684 - DNA, 15 bp, Homo sapiens
attcagctgagtaag

SEQ ID NO: 126685 - DNA, 15 bp, Homo sapiens
cattcagctgagtaa

SEQ ID NO: 126686 - DNA, 15 bp, Homo sapiens
gcattcagctgagta

SEQ ID NO: 126687 - DNA, 15 bp, Homo sapiens
tgcattcagctgagt

SEQ ID NO: 126688 - DNA, 15 bp, Homo sapiens
ttgcattcagctgag

SEQ ID NO: 126689 - DNA, 15 bp, Homo sapiens
tttgcattcagctga

SEQ ID NO: 126690 - DNA, 15 bp, Homo sapiens
ttttgcattcagctg

SEQ ID NO: 126691 - DNA, 15 bp, Homo sapiens
attttgcattcagct

SEQ ID NO: 126692 - DNA, 15 bp, Homo sapiens
cattttgcattcagc

SEQ ID NO: 126693 - DNA, 15 bp, Homo sapiens
ccattttgcattcag

SEQ ID NO: 126694 - DNA, 15 bp, Homo sapiens
cccattttgcattca

SEQ ID NO: 126695 - DNA, 15 bp, Homo sapiens
tcccattttgcattc

SEQ ID NO: 126696 - DNA, 15 bp, Homo sapiens
gtcccattttgcatt

SEQ ID NO: 126697 - DNA, 15 bp, Homo sapiens
tgtcccattttgcat

SEQ ID NO: 126698 - DNA, 15 bp, Homo sapiens
ctgtcccattttgca

SEQ ID NO: 126699 - DNA, 15 bp, Homo sapiens
tctgtcccattttgc

SEQ ID NO: 126700 - DNA, 15 bp, Homo sapiens
ttctgtcccattttg

SEQ ID NO: 126701 - DNA, 15 bp, Homo sapiens
attctgtcccatttt

SEQ ID NO: 126702 - DNA, 15 bp, Homo sapiens
aattctgtcccattt

SEQ ID NO: 126703 - DNA, 15 bp, Homo sapiens
taattctgtcccatt

SEQ ID NO: 126704 - DNA, 15 bp, Homo sapiens
ttaattctgtcccat

SEQ ID NO: 126705 - DNA, 15 bp, Homo sapiens
attaattctgtccca

SEQ ID NO: 126706 - DNA, 15 bp, Homo sapiens
tattaattctgtccc

SEQ ID NO: 126707 - DNA, 15 bp, Homo sapiens
ctattaattctgtcc

SEQ ID NO: 126708 - DNA, 15 bp, Homo sapiens
tctattaattctgtc

SEQ ID NO: 126709 - DNA, 15 bp, Homo sapiens
ttctattaattctgt

SEQ ID NO: 126710 - DNA, 15 bp, Homo sapiens
attctattaattctg

SEQ ID NO: 126711 - DNA, 15 bp, Homo sapiens
cattctattaattct

SEQ ID NO: 126712 - DNA, 15 bp, Homo sapiens
acattctattaattc

SEQ ID NO: 126713 - DNA, 15 bp, Homo sapiens
tacattctattaatt

SEQ ID NO: 126714 - DNA, 15 bp, Homo sapiens
gtacattctattaat

SEQ ID NO: 126715 - DNA, 15 bp, Homo sapiens
tgtacattctattaa

SEQ ID NO: 126716 - DNA, 15 bp, Homo sapiens
ctgtacattctatta

SEQ ID NO: 126717 - DNA, 15 bp, Homo sapiens
actgtacattctatt

SEQ ID NO: 126718 - DNA, 15 bp, Homo sapiens
cactgtacattctat

SEQ ID NO: 126719 - DNA, 15 bp, Homo sapiens
tcactgtacattcta

SEQ ID NO: 126720 - DNA, 15 bp, Homo sapiens
atcactgtacattct

SEQ ID NO: 126721 - DNA, 15 bp, Homo sapiens
gatcactgtacattc

SEQ ID NO: 126722 - DNA, 15 bp, Homo sapiens
cgatcactgtacatt

SEQ ID NO: 126723 - DNA, 15 bp, Homo sapiens
ccgatcactgtacat

SEQ ID NO: 126724 - DNA, 15 bp, Homo sapiens
tccgatcactgtaca

SEQ ID NO: 126725 - DNA, 15 bp, Homo sapiens
ttccgatcactgtac

SEQ ID NO: 126726 - DNA, 15 bp, Homo sapiens
tttccgatcactgta

SEQ ID NO: 126727 - DNA, 15 bp, Homo sapiens
ctttccgatcactgt

SEQ ID NO: 126728 - DNA, 15 bp, Homo sapiens
cctttccgatcactg

SEQ ID NO: 126729 - DNA, 15 bp, Homo sapiens
ccctttccgatcact

SEQ ID NO: 126730 - DNA, 15 bp, Homo sapiens
accctttccgatcac

SEQ ID NO: 126731 - DNA, 15 bp, Homo sapiens
taccctttccgatca

SEQ ID NO: 126732 - DNA, 15 bp, Homo sapiens
ataccctttccgatc

SEQ ID NO: 126733 - DNA, 15 bp, Homo sapiens
cataccctttccgat

SEQ ID NO: 126734 - DNA, 15 bp, Homo sapiens
acataccctttccga

SEQ ID NO: 126735 - DNA, 15 bp, Homo sapiens
cacataccctttccg

SEQ ID NO: 126736 - DNA, 15 bp, Homo sapiens
acacataccctttcc

SEQ ID NO: 126737 - DNA, 15 bp, Homo sapiens
tacacataccctttc

SEQ ID NO: 126738 - DNA, 15 bp, Homo sapiens
ttacacatacccttt

SEQ ID NO: 126739 - DNA, 15 bp, Homo sapiens
tttacacataccctt

SEQ ID NO: 126740 - DNA, 15 bp, Homo sapiens
atttacacataccct

SEQ ID NO: 126741 - DNA, 15 bp, Homo sapiens
catttacacataccc

SEQ ID NO: 126742 - DNA, 15 bp, Homo sapiens
tcatttacacatacc

SEQ ID NO: 126743 - DNA, 15 bp, Homo sapiens
ttcatttacacatac

SEQ ID NO: 126744 - DNA, 15 bp, Homo sapiens
tttcatttacacata

SEQ ID NO: 126745 - DNA, 15 bp, Homo sapiens
atttcatttacacat

SEQ ID NO: 126746 - DNA, 15 bp, Homo sapiens
aatttcatttacaca

SEQ ID NO: 126747 - DNA, 15 bp, Homo sapiens
taatttcatttacac

SEQ ID NO: 126748 - DNA, 15 bp, Homo sapiens
ttaatttcatttaca

SEQ ID NO: 126749 - DNA, 15 bp, Homo sapiens
attaatttcatttac

SEQ ID NO: 126750 - DNA, 15 bp, Homo sapiens
tattaatttcattta

SEQ ID NO: 126751 - DNA, 15 bp, Homo sapiens
atattaatttcattt

SEQ ID NO: 126752 - DNA, 15 bp, Homo sapiens
aatattaatttcatt

SEQ ID NO: 126753 - DNA, 15 bp, Homo sapiens
aaatattaatttcat

SEQ ID NO: 126754 - DNA, 15 bp, Homo sapiens
taaatattaatttca

SEQ ID NO: 126755 - DNA, 15 bp, Homo sapiens
ttaaatattaatttc

SEQ ID NO: 126756 - DNA, 15 bp, Homo sapiens
attaaatattaattt

SEQ ID NO: 126757 - DNA, 15 bp, Homo sapiens
aattaaatattaatt

SEQ ID NO: 126758 - DNA, 15 bp, Homo sapiens
aaattaaatattaat

SEQ ID NO: 126759 - DNA, 15 bp, Homo sapiens
taaattaaatattaa

SEQ ID NO: 126760 - DNA, 15 bp, Homo sapiens
ttaaattaaatatta

SEQ ID NO: 126761 - DNA, 15 bp, Homo sapiens
tttaaattaaatatt

SEQ ID NO: 126762 - DNA, 15 bp, Homo sapiens
ttttaaattaaatat

SEQ ID NO: 126763 - DNA, 15 bp, Homo sapiens
tttttaaattaaata

SEQ ID NO: 126764 - DNA, 15 bp, Homo sapiens
ttttttaaattaaat

SEQ ID NO: 126765 - DNA, 15 bp, Homo sapiens
tttttttaaattaaa

SEQ ID NO: 126766 - DNA, 15 bp, Homo sapiens
atttttttaaattaa

SEQ ID NO: 126767 - DNA, 15 bp, Homo sapiens
catttttttaaatta

SEQ ID NO: 126768 - DNA, 15 bp, Homo sapiens
gcatttttttaaatt

SEQ ID NO: 126769 - DNA, 15 bp, Homo sapiens
ggcatttttttaaat

SEQ ID NO: 126770 - DNA, 15 bp, Homo sapiens
aggcatttttttaaa

SEQ ID NO: 126771 - DNA, 15 bp, Homo sapiens
caggcatttttttaa

SEQ ID NO: 126772 - DNA, 15 bp, Homo sapiens
gcaggcattttttta

SEQ ID NO: 126773 - DNA, 15 bp, Homo sapiens
tgcaggcattttttt

SEQ ID NO: 126774 - DNA, 15 bp, Homo sapiens
ttgcaggcatttttt

SEQ ID NO: 126775 - DNA, 15 bp, Homo sapiens
cttgcaggcattttt

SEQ ID NO: 126776 - DNA, 15 bp, Homo sapiens
acttgcaggcatttt

SEQ ID NO: 126777 - DNA, 15 bp, Homo sapiens
aacttgcaggcattt

SEQ ID NO: 126778 - DNA, 15 bp, Homo sapiens
gaacttgcaggcatt

SEQ ID NO: 126779 - DNA, 15 bp, Homo sapiens
tgaacttgcaggcat

SEQ ID NO: 126780 - DNA, 15 bp, Homo sapiens
atgaacttgcaggca

SEQ ID NO: 126781 - DNA, 15 bp, Homo sapiens
catgaacttgcaggc

SEQ ID NO: 126782 - DNA, 15 bp, Homo sapiens
ccatgaacttgcagg

SEQ ID NO: 126783 - DNA, 15 bp, Homo sapiens
cccatgaacttgcag

SEQ ID NO: 126784 - DNA, 15 bp, Homo sapiens
gcccatgaacttgca

SEQ ID NO: 126785 - DNA, 15 bp, Homo sapiens
cgcccatgaacttgc

SEQ ID NO: 126786 - DNA, 15 bp, Homo sapiens
acgcccatgaacttg

SEQ ID NO: 126787 - DNA, 15 bp, Homo sapiens
cacgcccatgaactt

SEQ ID NO: 126788 - DNA, 15 bp, Homo sapiens
tcacgcccatgaact

SEQ ID NO: 126789 - DNA, 15 bp, Homo sapiens
ttcacgcccatgaac

SEQ ID NO: 126790 - DNA, 15 bp, Homo sapiens
cttcacgcccatgaa

SEQ ID NO: 126791 - DNA, 15 bp, Homo sapiens
tcttcacgcccatga

SEQ ID NO: 126792 - DNA, 15 bp, Homo sapiens
ttcttcacgcccatg

SEQ ID NO: 126793 - DNA, 15 bp, Homo sapiens
cttcttcacgcccat

SEQ ID NO: 126794 - DNA, 15 bp, Homo sapiens
tcttcttcacgccca

SEQ ID NO: 126795 - DNA, 15 bp, Homo sapiens
atcttcttcacgccc

SEQ ID NO: 126796 - DNA, 15 bp, Homo sapiens
gatcttcttcacgcc

SEQ ID NO: 126797 - DNA, 15 bp, Homo sapiens
tgatcttcttcacgc

SEQ ID NO: 126798 - DNA, 15 bp, Homo sapiens
atgatcttcttcacg

SEQ ID NO: 126799 - DNA, 15 bp, Homo sapiens
catgatcttcttcac

SEQ ID NO: 126800 - DNA, 15 bp, Homo sapiens
acatgatcttcttca

SEQ ID NO: 126801 - DNA, 15 bp, Homo sapiens
cacatgatcttcttc

SEQ ID NO: 126802 - DNA, 15 bp, Homo sapiens
ccacatgatcttctt

SEQ ID NO: 126803 - DNA, 15 bp, Homo sapiens
tccacatgatcttct

SEQ ID NO: 126804 - DNA, 15 bp, Homo sapiens
gtccacatgatcttc

SEQ ID NO: 126805 - DNA, 15 bp, Homo sapiens
tgtccacatgatctt

SEQ ID NO: 126806 - DNA, 15 bp, Homo sapiens
gtgtccacatgatct

SEQ ID NO: 126807 - DNA, 15 bp, Homo sapiens
agtgtccacatgatc

SEQ ID NO: 126808 - DNA, 15 bp, Homo sapiens
cagtgtccacatgat

SEQ ID NO: 126809 - DNA, 15 bp, Homo sapiens
tcagtgtccacatga

SEQ ID NO: 126810 - DNA, 15 bp, Homo sapiens
ctcagtgtccacatg

SEQ ID NO: 126811 - DNA, 15 bp, Homo sapiens
tctcagtgtccacat

SEQ ID NO: 126812 - DNA, 15 bp, Homo sapiens
atctcagtgtccaca

SEQ ID NO: 126813 - DNA, 15 bp, Homo sapiens
aatctcagtgtccac

SEQ ID NO: 126814 - DNA, 15 bp, Homo sapiens
taatctcagtgtcca

SEQ ID NO: 126815 - DNA, 15 bp, Homo sapiens
ttaatctcagtgtcc

SEQ ID NO: 126816 - DNA, 15 bp, Homo sapiens
attaatctcagtgtc

SEQ ID NO: 126817 - DNA, 15 bp, Homo sapiens
cattaatctcagtgt

SEQ ID NO: 126818 - DNA, 15 bp, Homo sapiens
tcattaatctcagtg

SEQ ID NO: 126819 - DNA, 15 bp, Homo sapiens
ctcattaatctcagt

SEQ ID NO: 126820 - DNA, 15 bp, Homo sapiens
tctcattaatctcag

SEQ ID NO: 126821 - DNA, 15 bp, Homo sapiens
ttctcattaatctca

SEQ ID NO: 126822 - DNA, 15 bp, Homo sapiens
gttctcattaatctc

SEQ ID NO: 126823 - DNA, 15 bp, Homo sapiens
tgttctcattaatct

SEQ ID NO: 126824 - DNA, 15 bp, Homo sapiens
atgttctcattaatc

SEQ ID NO: 126825 - DNA, 15 bp, Homo sapiens
catgttctcattaat

SEQ ID NO: 126826 - DNA, 15 bp, Homo sapiens
acatgttctcattaa

SEQ ID NO: 126827 - DNA, 15 bp, Homo sapiens
aacatgttctcatta

SEQ ID NO: 126828 - DNA, 15 bp, Homo sapiens
aaacatgttctcatt

SEQ ID NO: 126829 - DNA, 15 bp, Homo sapiens
gaaacatgttctcat

SEQ ID NO: 126830 - DNA, 15 bp, Homo sapiens
tgaaacatgttctca

SEQ ID NO: 126831 - DNA, 15 bp, Homo sapiens
atgaaacatgttctc

SEQ ID NO: 126832 - DNA, 15 bp, Homo sapiens
tatgaaacatgttct

SEQ ID NO: 126833 - DNA, 15 bp, Homo sapiens
atatgaaacatgttc

SEQ ID NO: 126834 - DNA, 15 bp, Homo sapiens
gatatgaaacatgtt

SEQ ID NO: 126835 - DNA, 15 bp, Homo sapiens
ggatatgaaacatgt

SEQ ID NO: 126836 - DNA, 15 bp, Homo sapiens
aggatatgaaacatg

SEQ ID NO: 126837 - DNA, 15 bp, Homo sapiens
aaggatatgaaacat

SEQ ID NO: 126838 - DNA, 15 bp, Homo sapiens
caaggatatgaaaca

SEQ ID NO: 126839 - DNA, 15 bp, Homo sapiens
acaaggatatgaaac

SEQ ID NO: 126840 - DNA, 15 bp, Homo sapiens
tacaaggatatgaaa

SEQ ID NO: 126841 - DNA, 15 bp, Homo sapiens
ctacaaggatatgaa

SEQ ID NO: 126842 - DNA, 15 bp, Homo sapiens
cctacaaggatatga

SEQ ID NO: 126843 - DNA, 15 bp, Homo sapiens
tcctacaaggatatg

SEQ ID NO: 126844 - DNA, 15 bp, Homo sapiens
atcctacaaggatat

SEQ ID NO: 126845 - DNA, 15 bp, Homo sapiens
catcctacaaggata

SEQ ID NO: 126846 - DNA, 15 bp, Homo sapiens
gcatcctacaaggat

SEQ ID NO: 126847 - DNA, 15 bp, Homo sapiens
ggcatcctacaagga

SEQ ID NO: 126848 - DNA, 15 bp, Homo sapiens
gggcatcctacaagg

SEQ ID NO: 126849 - DNA, 15 bp, Homo sapiens
agggcatcctacaag

SEQ ID NO: 126850 - DNA, 15 bp, Homo sapiens
tagggcatcctacaa

SEQ ID NO: 126851 - DNA, 15 bp, Homo sapiens
atagggcatcctaca

SEQ ID NO: 126852 - DNA, 15 bp, Homo sapiens
aatagggcatcctac

SEQ ID NO: 126853 - DNA, 15 bp, Homo sapiens
taatagggcatccta

SEQ ID NO: 126854 - DNA, 15 bp, Homo sapiens
ataatagggcatcct

SEQ ID NO: 126855 - DNA, 15 bp, Homo sapiens
aataatagggcatcc

SEQ ID NO: 126856 - DNA, 15 bp, Homo sapiens
aaataatagggcatc

SEQ ID NO: 126857 - DNA, 15 bp, Homo sapiens
aaaataatagggcat

SEQ ID NO: 126858 - DNA, 15 bp, Homo sapiens
aaaaataatagggca

SEQ ID NO: 126859 - DNA, 15 bp, Homo sapiens
aaaaaataatagggc

SEQ ID NO: 126860 - DNA, 15 bp, Homo sapiens
aaaaaaataataggg

SEQ ID NO: 126861 - DNA, 15 bp, Homo sapiens
aaaaaaaataatagg

SEQ ID NO: 126862 - DNA, 15 bp, Homo sapiens
aaaaaaaaataatag

SEQ ID NO: 126863 - DNA, 15 bp, Homo sapiens
agaaaaaaaaataat

SEQ ID NO: 126864 - DNA, 15 bp, Homo sapiens
aagaaaaaaaaataa

SEQ ID NO: 126865 - DNA, 15 bp, Homo sapiens
aaagaaaaaaaaata

SEQ ID NO: 126866 - DNA, 15 bp, Homo sapiens
aaaagaaaaaaaaat

SEQ ID NO: 126867 - DNA, 15 bp, Homo sapiens
taaaagaaaaaaaaa

SEQ ID NO: 126868 - DNA, 15 bp, Homo sapiens
ttaaaagaaaaaaaa

SEQ ID NO: 126869 - DNA, 15 bp, Homo sapiens
cttaaaagaaaaaaa

SEQ ID NO: 126870 - DNA, 15 bp, Homo sapiens
tcttaaaagaaaaaa

SEQ ID NO: 126871 - DNA, 15 bp, Homo sapiens
ttcttaaaagaaaaa

SEQ ID NO: 126872 - DNA, 15 bp, Homo sapiens
cttcttaaaagaaaa

SEQ ID NO: 126873 - DNA, 15 bp, Homo sapiens
ccttcttaaaagaaa

SEQ ID NO: 126874 - DNA, 15 bp, Homo sapiens
tccttcttaaaagaa

SEQ ID NO: 126875 - DNA, 15 bp, Homo sapiens
ctccttcttaaaaga

SEQ ID NO: 126876 - DNA, 15 bp, Homo sapiens
actccttcttaaaag

SEQ ID NO: 126877 - DNA, 15 bp, Homo sapiens
gactccttcttaaaa

SEQ ID NO: 126878 - DNA, 15 bp, Homo sapiens
agactccttcttaaa

SEQ ID NO: 126879 - DNA, 15 bp, Homo sapiens
aagactccttcttaa

SEQ ID NO: 126880 - DNA, 15 bp, Homo sapiens
caagactccttctta

SEQ ID NO: 126881 - DNA, 15 bp, Homo sapiens
gcaagactccttctt

SEQ ID NO: 126882 - DNA, 15 bp, Homo sapiens
agcaagactccttct

SEQ ID NO: 126883 - DNA, 15 bp, Homo sapiens
gagcaagactccttc

SEQ ID NO: 126884 - DNA, 15 bp, Homo sapiens
agagcaagactcctt

SEQ ID NO: 126885 - DNA, 15 bp, Homo sapiens
cagagcaagactcct

SEQ ID NO: 126886 - DNA, 15 bp, Homo sapiens
cccagcctgggtgac

SEQ ID NO: 126887 - DNA, 15 bp, Homo sapiens
ccccagcctgggtga

SEQ ID NO: 126888 - DNA, 15 bp, Homo sapiens
accccagcctgggtg

SEQ ID NO: 126889 - DNA, 15 bp, Homo sapiens
caccccagcctgggt

SEQ ID NO: 126890 - DNA, 15 bp, Homo sapiens
gcaccccagcctggg

SEQ ID NO: 126891 - DNA, 15 bp, Homo sapiens
tgcaccccagcctgg

SEQ ID NO: 126892 - DNA, 15 bp, Homo sapiens
ctgcaccccagcctg

SEQ ID NO: 126893 - DNA, 15 bp, Homo sapiens
actgcaccccagcct

SEQ ID NO: 126894 - DNA, 15 bp, Homo sapiens
cactgcaccccagcc

SEQ ID NO: 126895 - DNA, 15 bp, Homo sapiens
ccactgcaccccagc

SEQ ID NO: 126896 - DNA, 15 bp, Homo sapiens
gccactgcaccccag

SEQ ID NO: 126897 - DNA, 15 bp, Homo sapiens
tgccactgcacccca

SEQ ID NO: 126898 - DNA, 15 bp, Homo sapiens
atgccactgcacccc

SEQ ID NO: 126899 - DNA, 15 bp, Homo sapiens
catgccactgcaccc

SEQ ID NO: 126900 - DNA, 15 bp, Homo sapiens
tcatgccactgcacc

SEQ ID NO: 126901 - DNA, 15 bp, Homo sapiens
gctgagatcatgcca

SEQ ID NO: 126902 - DNA, 15 bp, Homo sapiens
agctgagatcatgcc

SEQ ID NO: 126903 - DNA, 15 bp, Homo sapiens
gagctgagatcatgc

SEQ ID NO: 126904 - DNA, 15 bp, Homo sapiens
tgagctgagatcatg

SEQ ID NO: 126905 - DNA, 15 bp, Homo sapiens
gtgagctgagatcat

SEQ ID NO: 126906 - DNA, 15 bp, Homo sapiens
tgttgcagtgagctg

SEQ ID NO: 126907 - DNA, 15 bp, Homo sapiens
atgttgcagtgagct

SEQ ID NO: 126908 - DNA, 15 bp, Homo sapiens
aatgttgcagtgagc

SEQ ID NO: 126909 - DNA, 15 bp, Homo sapiens
aaatgttgcagtgag

SEQ ID NO: 126910 - DNA, 15 bp, Homo sapiens
caaatgttgcagtga

SEQ ID NO: 126911 - DNA, 15 bp, Homo sapiens
gcaaatgttgcagtg

SEQ ID NO: 126912 - DNA, 15 bp, Homo sapiens
ggcaaatgttgcagt

SEQ ID NO: 126913 - DNA, 15 bp, Homo sapiens
aggcaaatgttgcag

SEQ ID NO: 126914 - DNA, 15 bp, Homo sapiens
gaggcaaatgttgca

SEQ ID NO: 126915 - DNA, 15 bp, Homo sapiens
ggaggcaaatgttgc

SEQ ID NO: 126916 - DNA, 15 bp, Homo sapiens
gggaggcaaatgttg

SEQ ID NO: 126917 - DNA, 15 bp, Homo sapiens
tgggaggcaaatgtt

SEQ ID NO: 126918 - DNA, 15 bp, Homo sapiens
ctgggaggcaaatgt

SEQ ID NO: 126919 - DNA, 15 bp, Homo sapiens
cctgggaggcaaatg

SEQ ID NO: 126920 - DNA, 15 bp, Homo sapiens
acctgggaggcaaat

SEQ ID NO: 126921 - DNA, 15 bp, Homo sapiens
aacctgggaggcaaa

SEQ ID NO: 126922 - DNA, 15 bp, Homo sapiens
gaacctgggaggcaa

SEQ ID NO: 126923 - DNA, 15 bp, Homo sapiens
gtgcgcctgtaatcc

SEQ ID NO: 126924 - DNA, 15 bp, Homo sapiens
tgtgcgcctgtaatc

SEQ ID NO: 126925 - DNA, 15 bp, Homo sapiens
gtgtgcgcctgtaat

SEQ ID NO: 126926 - DNA, 15 bp, Homo sapiens
ggtgtgcgcctgtaa

SEQ ID NO: 126927 - DNA, 15 bp, Homo sapiens
tggtgtgcgcctgta

SEQ ID NO: 126928 - DNA, 15 bp, Homo sapiens
gtggtgtgcgcctgt

SEQ ID NO: 126929 - DNA, 15 bp, Homo sapiens
ggtggtgtgcgcctg

SEQ ID NO: 126930 - DNA, 15 bp, Homo sapiens
gtggtggtgtgcgcc

SEQ ID NO: 126931 - DNA, 15 bp, Homo sapiens
cgtggtggtgtgcgc

SEQ ID NO: 126932 - DNA, 15 bp, Homo sapiens
gcgtggtggtgtgcg

SEQ ID NO: 126933 - DNA, 15 bp, Homo sapiens
ggcgtggtggtgtgc

SEQ ID NO: 126934 - DNA, 15 bp, Homo sapiens
aggcgtggtggtgtg

SEQ ID NO: 126935 - DNA, 15 bp, Homo sapiens
caggcgtggtggtgt

SEQ ID NO: 126936 - DNA, 15 bp, Homo sapiens
aataccagcctggcc

SEQ ID NO: 126937 - DNA, 15 bp, Homo sapiens
caataccagcctggc

SEQ ID NO: 126938 - DNA, 15 bp, Homo sapiens
tcaataccagcctgg

SEQ ID NO: 126939 - DNA, 15 bp, Homo sapiens
ttcaataccagcctg

SEQ ID NO: 126940 - DNA, 15 bp, Homo sapiens
gttcaataccagcct

SEQ ID NO: 126941 - DNA, 15 bp, Homo sapiens
agttcaataccagcc

SEQ ID NO: 126942 - DNA, 15 bp, Homo sapiens
gagttcaataccagc

SEQ ID NO: 126943 - DNA, 15 bp, Homo sapiens
ggagttcaataccag

SEQ ID NO: 126944 - DNA, 15 bp, Homo sapiens
cggagttcaatacca

SEQ ID NO: 126945 - DNA, 15 bp, Homo sapiens
ccggagttcaatacc

SEQ ID NO: 126946 - DNA, 15 bp, Homo sapiens
tccggagttcaatac

SEQ ID NO: 126947 - DNA, 15 bp, Homo sapiens
gtccggagttcaata

SEQ ID NO: 126948 - DNA, 15 bp, Homo sapiens
ggtccggagttcaat

SEQ ID NO: 126949 - DNA, 15 bp, Homo sapiens
aggtccggagttcaa

SEQ ID NO: 126950 - DNA, 15 bp, Homo sapiens
gaggtccggagttca

SEQ ID NO: 126951 - DNA, 15 bp, Homo sapiens
tgaggtccggagttc

SEQ ID NO: 126952 - DNA, 15 bp, Homo sapiens
ctgaggtccggagtt

SEQ ID NO: 126953 - DNA, 15 bp, Homo sapiens
cctgaggtccggagt

SEQ ID NO: 126954 - DNA, 15 bp, Homo sapiens
gcctgaggtccggag

SEQ ID NO: 126955 - DNA, 15 bp, Homo sapiens
tgcctgaggtccgga

SEQ ID NO: 126956 - DNA, 15 bp, Homo sapiens
ctgcctgaggtccgg

SEQ ID NO: 126957 - DNA, 15 bp, Homo sapiens
actgcctgaggtccg

SEQ ID NO: 126958 - DNA, 15 bp, Homo sapiens
gactgcctgaggtcc

SEQ ID NO: 126959 - DNA, 15 bp, Homo sapiens
ggactgcctgaggtc

SEQ ID NO: 126960 - DNA, 15 bp, Homo sapiens
cggactgcctgaggt

SEQ ID NO: 126961 - DNA, 15 bp, Homo sapiens
gcggactgcctgagg

SEQ ID NO: 126962 - DNA, 15 bp, Homo sapiens
ggcggactgcctgag

SEQ ID NO: 126963 - DNA, 15 bp, Homo sapiens
aggcggactgcctga

SEQ ID NO: 126964 - DNA, 15 bp, Homo sapiens
aaggcggactgcctg

SEQ ID NO: 126965 - DNA, 15 bp, Homo sapiens
caaggcggactgcct

SEQ ID NO: 126966 - DNA, 15 bp, Homo sapiens
gcaaggcggactgcc

SEQ ID NO: 126967 - DNA, 15 bp, Homo sapiens
ggcaaggcggactgc

SEQ ID NO: 126968 - DNA, 15 bp, Homo sapiens
aggcaaggcggactg

SEQ ID NO: 126969 - DNA, 15 bp, Homo sapiens
aaggcaaggcggact

SEQ ID NO: 126970 - DNA, 15 bp, Homo sapiens
caaggcaaggcggac

SEQ ID NO: 126971 - DNA, 15 bp, Homo sapiens
ccaaggcaaggcgga

SEQ ID NO: 126972 - DNA, 15 bp, Homo sapiens
gccaaggcaaggcgg

SEQ ID NO: 126973 - DNA, 15 bp, Homo sapiens
ggccaaggcaaggcg

SEQ ID NO: 126974 - DNA, 15 bp, Homo sapiens
aggccaaggcaaggc

SEQ ID NO: 126975 - DNA, 15 bp, Homo sapiens
gaggccaaggcaagg

SEQ ID NO: 126976 - DNA, 15 bp, Homo sapiens
ggaggccaaggcaag

SEQ ID NO: 126977 - DNA, 15 bp, Homo sapiens
gggaggccaaggcaa

SEQ ID NO: 126978 - DNA, 15 bp, Homo sapiens
cgggtgcagtggctc

SEQ ID NO: 126979 - DNA, 15 bp, Homo sapiens
gccgggtgcagtggc

SEQ ID NO: 126980 - DNA, 15 bp, Homo sapiens
ggccgggtgcagtgg

SEQ ID NO: 126981 - DNA, 15 bp, Homo sapiens
aggccgggtgcagtg

SEQ ID NO: 126982 - DNA, 15 bp, Homo sapiens
aaggccgggtgcagt

SEQ ID NO: 126983 - DNA, 15 bp, Homo sapiens
taaggccgggtgcag

SEQ ID NO: 126984 - DNA, 15 bp, Homo sapiens
ataaggccgggtgca

SEQ ID NO: 126985 - DNA, 15 bp, Homo sapiens
cataaggccgggtgc

SEQ ID NO: 126986 - DNA, 15 bp, Homo sapiens
gcataaggccgggtg

SEQ ID NO: 126987 - DNA, 15 bp, Homo sapiens
ggcataaggccgggt

SEQ ID NO: 126988 - DNA, 15 bp, Homo sapiens
gggcataaggccggg

SEQ ID NO: 126989 - DNA, 15 bp, Homo sapiens
agggcataaggccgg

SEQ ID NO: 126990 - DNA, 15 bp, Homo sapiens
cagggcataaggccg

SEQ ID NO: 126991 - DNA, 15 bp, Homo sapiens
acagggcataaggcc

SEQ ID NO: 126992 - DNA, 15 bp, Homo sapiens
aacagggcataaggc

SEQ ID NO: 126993 - DNA, 15 bp, Homo sapiens
aaacagggcataagg

SEQ ID NO: 126994 - DNA, 15 bp, Homo sapiens
taaacagggcataag

SEQ ID NO: 126995 - DNA, 15 bp, Homo sapiens
ttaaacagggcataa

SEQ ID NO: 126996 - DNA, 15 bp, Homo sapiens
attaaacagggcata

SEQ ID NO: 126997 - DNA, 15 bp, Homo sapiens
tattaaacagggcat

SEQ ID NO: 126998 - DNA, 15 bp, Homo sapiens
ttattaaacagggca

SEQ ID NO: 126999 - DNA, 15 bp, Homo sapiens
tttattaaacagggc

SEQ ID NO: 127000 - DNA, 15 bp, Homo sapiens
atttattaaacaggg

SEQ ID NO: 127001 - DNA, 15 bp, Homo sapiens
aatttattaaacagg

SEQ ID NO: 127002 - DNA, 15 bp, Homo sapiens
caatttattaaacag

SEQ ID NO: 127003 - DNA, 15 bp, Homo sapiens
acaatttattaaaca

SEQ ID NO: 127004 - DNA, 15 bp, Homo sapiens
cacaatttattaaac

SEQ ID NO: 127005 - DNA, 15 bp, Homo sapiens
tcacaatttattaaa

SEQ ID NO: 127006 - DNA, 15 bp, Homo sapiens
atcacaatttattaa

SEQ ID NO: 127007 - DNA, 15 bp, Homo sapiens
catcacaatttatta

SEQ ID NO: 127008 - DNA, 15 bp, Homo sapiens
tcatcacaatttatt

SEQ ID NO: 127009 - DNA, 15 bp, Homo sapiens
ctcatcacaatttat

SEQ ID NO: 127010 - DNA, 15 bp, Homo sapiens
actcatcacaattta

SEQ ID NO: 127011 - DNA, 15 bp, Homo sapiens
tactcatcacaattt

SEQ ID NO: 127012 - DNA, 15 bp, Homo sapiens
atactcatcacaatt

SEQ ID NO: 127013 - DNA, 15 bp, Homo sapiens
tatactcatcacaat

SEQ ID NO: 127014 - DNA, 15 bp, Homo sapiens
ctatactcatcacaa

SEQ ID NO: 127015 - DNA, 15 bp, Homo sapiens
actatactcatcaca

SEQ ID NO: 127016 - DNA, 15 bp, Homo sapiens
aactatactcatcac

SEQ ID NO: 127017 - DNA, 15 bp, Homo sapiens
gaactatactcatca

SEQ ID NO: 127018 - DNA, 15 bp, Homo sapiens
ggaactatactcatc

SEQ ID NO: 127019 - DNA, 15 bp, Homo sapiens
aggaactatactcat

SEQ ID NO: 127020 - DNA, 15 bp, Homo sapiens
aaggaactatactca

SEQ ID NO: 127021 - DNA, 15 bp, Homo sapiens
taaggaactatactc

SEQ ID NO: 127022 - DNA, 15 bp, Homo sapiens
ttaaggaactatact

SEQ ID NO: 127023 - DNA, 15 bp, Homo sapiens
tttaaggaactatac

SEQ ID NO: 127024 - DNA, 15 bp, Homo sapiens
ctttaaggaactata

SEQ ID NO: 127025 - DNA, 15 bp, Homo sapiens
cctttaaggaactat

SEQ ID NO: 127026 - DNA, 15 bp, Homo sapiens
tcctttaaggaacta

SEQ ID NO: 127027 - DNA, 15 bp, Homo sapiens
ctcctttaaggaact

SEQ ID NO: 127028 - DNA, 15 bp, Homo sapiens
cctcctttaaggaac

SEQ ID NO: 127029 - DNA, 15 bp, Homo sapiens
tcctcctttaaggaa

SEQ ID NO: 127030 - DNA, 15 bp, Homo sapiens
ttcctcctttaagga

SEQ ID NO: 127031 - DNA, 15 bp, Homo sapiens
attcctcctttaagg

SEQ ID NO: 127032 - DNA, 15 bp, Homo sapiens
cattcctcctttaag

SEQ ID NO: 127033 - DNA, 15 bp, Homo sapiens
acattcctcctttaa

SEQ ID NO: 127034 - DNA, 15 bp, Homo sapiens
cacattcctccttta

SEQ ID NO: 127035 - DNA, 15 bp, Homo sapiens
tcacattcctccttt

SEQ ID NO: 127036 - DNA, 15 bp, Homo sapiens
atcacattcctcctt

SEQ ID NO: 127037 - DNA, 15 bp, Homo sapiens
gatcacattcctcct

SEQ ID NO: 127038 - DNA, 15 bp, Homo sapiens
tgatcacattcctcc

SEQ ID NO: 127039 - DNA, 15 bp, Homo sapiens
atgatcacattcctc

SEQ ID NO: 127040 - DNA, 15 bp, Homo sapiens
catgatcacattcct

SEQ ID NO: 127041 - DNA, 15 bp, Homo sapiens
acatgatcacattcc

SEQ ID NO: 127042 - DNA, 15 bp, Homo sapiens
tacatgatcacattc

SEQ ID NO: 127043 - DNA, 15 bp, Homo sapiens
atacatgatcacatt

SEQ ID NO: 127044 - DNA, 15 bp, Homo sapiens
tatacatgatcacat

SEQ ID NO: 127045 - DNA, 15 bp, Homo sapiens
ctatacatgatcaca

SEQ ID NO: 127046 - DNA, 15 bp, Homo sapiens
tctatacatgatcac

SEQ ID NO: 127047 - DNA, 15 bp, Homo sapiens
atctatacatgatca

SEQ ID NO: 127048 - DNA, 15 bp, Homo sapiens
catctatacatgatc

SEQ ID NO: 127049 - DNA, 15 bp, Homo sapiens
tcatctatacatgat

SEQ ID NO: 127050 - DNA, 15 bp, Homo sapiens
gtcatctatacatga

SEQ ID NO: 127051 - DNA, 15 bp, Homo sapiens
ggtcatctatacatg

SEQ ID NO: 127052 - DNA, 15 bp, Homo sapiens
tggtcatctatacat

SEQ ID NO: 127053 - DNA, 15 bp, Homo sapiens
atggtcatctataca

SEQ ID NO: 127054 - DNA, 15 bp, Homo sapiens
aatggtcatctatac

SEQ ID NO: 127055 - DNA, 15 bp, Homo sapiens
aaatggtcatctata

SEQ ID NO: 127056 - DNA, 15 bp, Homo sapiens
taaatggtcatctat

SEQ ID NO: 127057 - DNA, 15 bp, Homo sapiens
ataaatggtcatcta

SEQ ID NO: 127058 - DNA, 15 bp, Homo sapiens
tataaatggtcatct

SEQ ID NO: 127059 - DNA, 15 bp, Homo sapiens
ttataaatggtcatc

SEQ ID NO: 127060 - DNA, 15 bp, Homo sapiens
gttataaatggtcat

SEQ ID NO: 127061 - DNA, 15 bp, Homo sapiens
tgttataaatggtca

SEQ ID NO: 127062 - DNA, 15 bp, Homo sapiens
atgttataaatggtc

SEQ ID NO: 127063 - DNA, 15 bp, Homo sapiens
tatgttataaatggt

SEQ ID NO: 127064 - DNA, 15 bp, Homo sapiens
ttatgttataaatgg

SEQ ID NO: 127065 - DNA, 15 bp, Homo sapiens
attatgttataaatg

SEQ ID NO: 127066 - DNA, 15 bp, Homo sapiens
tattatgttataaat

SEQ ID NO: 127067 - DNA, 15 bp, Homo sapiens
atattatgttataaa

SEQ ID NO: 127068 - DNA, 15 bp, Homo sapiens
gatattatgttataa

SEQ ID NO: 127069 - DNA, 15 bp, Homo sapiens
agatattatgttata

SEQ ID NO: 127070 - DNA, 15 bp, Homo sapiens
aagatattatgttat

SEQ ID NO: 127071 - DNA, 15 bp, Homo sapiens
taagatattatgtta

SEQ ID NO: 127072 - DNA, 15 bp, Homo sapiens
ttaagatattatgtt

SEQ ID NO: 127073 - DNA, 15 bp, Homo sapiens
attaagatattatgt

SEQ ID NO: 127074 - DNA, 15 bp, Homo sapiens
cattaagatattatg

SEQ ID NO: 127075 - DNA, 15 bp, Homo sapiens
tcattaagatattat

SEQ ID NO: 127076 - DNA, 15 bp, Homo sapiens
atcattaagatatta

SEQ ID NO: 127077 - DNA, 15 bp, Homo sapiens
tatcattaagatatt

SEQ ID NO: 127078 - DNA, 15 bp, Homo sapiens
atatcattaagatat

SEQ ID NO: 127079 - DNA, 15 bp, Homo sapiens
catatcattaagata

SEQ ID NO: 127080 - DNA, 15 bp, Homo sapiens
ccatatcattaagat

SEQ ID NO: 127081 - DNA, 15 bp, Homo sapiens
tccatatcattaaga

SEQ ID NO: 127082 - DNA, 15 bp, Homo sapiens
ttccatatcattaag

SEQ ID NO: 127083 - DNA, 15 bp, Homo sapiens
cttccatatcattaa

SEQ ID NO: 127084 - DNA, 15 bp, Homo sapiens
gcttccatatcatta

SEQ ID NO: 127085 - DNA, 15 bp, Homo sapiens
tgcttccatatcatt

SEQ ID NO: 127086 - DNA, 15 bp, Homo sapiens
gtgcttccatatcat

SEQ ID NO: 127087 - DNA, 15 bp, Homo sapiens
agtgcttccatatca

SEQ ID NO: 127088 - DNA, 15 bp, Homo sapiens
aagtgcttccatatc

SEQ ID NO: 127089 - DNA, 15 bp, Homo sapiens
gaagtgcttccatat

SEQ ID NO: 127090 - DNA, 15 bp, Homo sapiens
agaagtgcttccata

SEQ ID NO: 127091 - DNA, 15 bp, Homo sapiens
tagaagtgcttccat

SEQ ID NO: 127092 - DNA, 15 bp, Homo sapiens
ttagaagtgcttcca

SEQ ID NO: 127093 - DNA, 15 bp, Homo sapiens
attagaagtgcttcc

SEQ ID NO: 127094 - DNA, 15 bp, Homo sapiens
aattagaagtgcttc

SEQ ID NO: 127095 - DNA, 15 bp, Homo sapiens
aaattagaagtgctt

SEQ ID NO: 127096 - DNA, 15 bp, Homo sapiens
aaaattagaagtgct

SEQ ID NO: 127097 - DNA, 15 bp, Homo sapiens
aaaaattagaagtgc

SEQ ID NO: 127098 - DNA, 15 bp, Homo sapiens
taaaaattagaagtg

SEQ ID NO: 127099 - DNA, 15 bp, Homo sapiens
ctaaaaattagaagt

SEQ ID NO: 127100 - DNA, 15 bp, Homo sapiens
actaaaaattagaag

SEQ ID NO: 127101 - DNA, 15 bp, Homo sapiens
cactaaaaattagaa

SEQ ID NO: 127102 - DNA, 15 bp, Homo sapiens
acactaaaaattaga

SEQ ID NO: 127103 - DNA, 15 bp, Homo sapiens
gacactaaaaattag

SEQ ID NO: 127104 - DNA, 15 bp, Homo sapiens
agacactaaaaatta

SEQ ID NO: 127105 - DNA, 15 bp, Homo sapiens
tagacactaaaaatt

SEQ ID NO: 127106 - DNA, 15 bp, Homo sapiens
ttagacactaaaaat

SEQ ID NO: 127107 - DNA, 15 bp, Homo sapiens
tttagacactaaaaa

SEQ ID NO: 127108 - DNA, 15 bp, Homo sapiens
atttagacactaaaa

SEQ ID NO: 127109 - DNA, 15 bp, Homo sapiens
tatttagacactaaa

SEQ ID NO: 127110 - DNA, 15 bp, Homo sapiens
ctatttagacactaa

SEQ ID NO: 127111 - DNA, 15 bp, Homo sapiens
actatttagacacta

SEQ ID NO: 127112 - DNA, 15 bp, Homo sapiens
cactatttagacact

SEQ ID NO: 127113 - DNA, 15 bp, Homo sapiens
acactatttagacac

SEQ ID NO: 127114 - DNA, 15 bp, Homo sapiens
gacactatttagaca

SEQ ID NO: 127115 - DNA, 15 bp, Homo sapiens
ggacactatttagac

SEQ ID NO: 127116 - DNA, 15 bp, Homo sapiens
tggacactatttaga

SEQ ID NO: 127117 - DNA, 15 bp, Homo sapiens
atggacactatttag

SEQ ID NO: 127118 - DNA, 15 bp, Homo sapiens
aatggacactattta

SEQ ID NO: 127119 - DNA, 15 bp, Homo sapiens
gaatggacactattt

SEQ ID NO: 127120 - DNA, 15 bp, Homo sapiens
agaatggacactatt

SEQ ID NO: 127121 - DNA, 15 bp, Homo sapiens
gagaatggacactat

SEQ ID NO: 127122 - DNA, 15 bp, Homo sapiens
agagaatggacacta

SEQ ID NO: 127123 - DNA, 15 bp, Homo sapiens
aagagaatggacact

SEQ ID NO: 127124 - DNA, 15 bp, Homo sapiens
aaagagaatggacac

SEQ ID NO: 127125 - DNA, 15 bp, Homo sapiens
taaagagaatggaca

SEQ ID NO: 127126 - DNA, 15 bp, Homo sapiens
ttaaagagaatggac

SEQ ID NO: 127127 - DNA, 15 bp, Homo sapiens
tttaaagagaatgga

SEQ ID NO: 127128 - DNA, 15 bp, Homo sapiens
ttttaaagagaatgg

SEQ ID NO: 127129 - DNA, 15 bp, Homo sapiens
tttttaaagagaatg

SEQ ID NO: 127130 - DNA, 15 bp, Homo sapiens
ttttttaaagagaat

SEQ ID NO: 127131 - DNA, 15 bp, Homo sapiens
tttttttaaagagaa

SEQ ID NO: 127132 - DNA, 15 bp, Homo sapiens
gtttttttaaagaga

SEQ ID NO: 127133 - DNA, 15 bp, Homo sapiens
agtttttttaaagag

SEQ ID NO: 127134 - DNA, 15 bp, Homo sapiens
tagtttttttaaaga

SEQ ID NO: 127135 - DNA, 15 bp, Homo sapiens
ttagtttttttaaag

SEQ ID NO: 127136 - DNA, 15 bp, Homo sapiens
tttagtttttttaaa

SEQ ID NO: 127137 - DNA, 15 bp, Homo sapiens
ctttagtttttttaa

SEQ ID NO: 127138 - DNA, 15 bp, Homo sapiens
tctttagttttttta

SEQ ID NO: 127139 - DNA, 15 bp, Homo sapiens
ttctttagttttttt

SEQ ID NO: 127140 - DNA, 15 bp, Homo sapiens
tttctttagtttttt

SEQ ID NO: 127141 - DNA, 15 bp, Homo sapiens
atttctttagttttt

SEQ ID NO: 127142 - DNA, 15 bp, Homo sapiens
aatttctttagtttt

SEQ ID NO: 127143 - DNA, 15 bp, Homo sapiens
aaatttctttagttt

SEQ ID NO: 127144 - DNA, 15 bp, Homo sapiens
aaaatttctttagtt

SEQ ID NO: 127145 - DNA, 15 bp, Homo sapiens
aaaaatttctttagt

SEQ ID NO: 127146 - DNA, 15 bp, Homo sapiens
gaaaaatttctttag

SEQ ID NO: 127147 - DNA, 15 bp, Homo sapiens
tgaaaaatttcttta

SEQ ID NO: 127148 - DNA, 15 bp, Homo sapiens
atgaaaaatttcttt

SEQ ID NO: 127149 - DNA, 15 bp, Homo sapiens
aatgaaaaatttctt

SEQ ID NO: 127150 - DNA, 15 bp, Homo sapiens
taatgaaaaatttct

SEQ ID NO: 127151 - DNA, 15 bp, Homo sapiens
ttaatgaaaaatttc

SEQ ID NO: 127152 - DNA, 15 bp, Homo sapiens
attaatgaaaaattt

SEQ ID NO: 127153 - DNA, 15 bp, Homo sapiens
cattaatgaaaaatt

SEQ ID NO: 127154 - DNA, 15 bp, Homo sapiens
acattaatgaaaaat

SEQ ID NO: 127155 - DNA, 15 bp, Homo sapiens
aacattaatgaaaaa

SEQ ID NO: 127156 - DNA, 15 bp, Homo sapiens
gaacattaatgaaaa

SEQ ID NO: 127157 - DNA, 15 bp, Homo sapiens
tgaacattaatgaaa

SEQ ID NO: 127158 - DNA, 15 bp, Homo sapiens
gtgaacattaatgaa

SEQ ID NO: 127159 - DNA, 15 bp, Homo sapiens
agtgaacattaatga

SEQ ID NO: 127160 - DNA, 15 bp, Homo sapiens
aagtgaacattaatg

SEQ ID NO: 127161 - DNA, 15 bp, Homo sapiens
aaagtgaacattaat

SEQ ID NO: 127162 - DNA, 15 bp, Homo sapiens
gaaagtgaacattaa

SEQ ID NO: 127163 - DNA, 15 bp, Homo sapiens
agaaagtgaacatta

SEQ ID NO: 127164 - DNA, 15 bp, Homo sapiens
gagaaagtgaacatt

SEQ ID NO: 127165 - DNA, 15 bp, Homo sapiens
tgagaaagtgaacat

SEQ ID NO: 127166 - DNA, 15 bp, Homo sapiens
ctgagaaagtgaaca

SEQ ID NO: 127167 - DNA, 15 bp, Homo sapiens
gctgagaaagtgaac

SEQ ID NO: 127168 - DNA, 15 bp, Homo sapiens
tgctgagaaagtgaa

SEQ ID NO: 127169 - DNA, 15 bp, Homo sapiens
gtgctgagaaagtga

SEQ ID NO: 127170 - DNA, 15 bp, Homo sapiens
tgtgctgagaaagtg

SEQ ID NO: 127171 - DNA, 15 bp, Homo sapiens
gtgtgctgagaaagt

SEQ ID NO: 127172 - DNA, 15 bp, Homo sapiens
agtgtgctgagaaag

SEQ ID NO: 127173 - DNA, 15 bp, Homo sapiens
aagtgtgctgagaaa

SEQ ID NO: 127174 - DNA, 15 bp, Homo sapiens
caagtgtgctgagaa

SEQ ID NO: 127175 - DNA, 15 bp, Homo sapiens
tcaagtgtgctgaga

SEQ ID NO: 127176 - DNA, 15 bp, Homo sapiens
atcaagtgtgctgag

SEQ ID NO: 127177 - DNA, 15 bp, Homo sapiens
catcaagtgtgctga

SEQ ID NO: 127178 - DNA, 15 bp, Homo sapiens
tcatcaagtgtgctg

SEQ ID NO: 127179 - DNA, 15 bp, Homo sapiens
atcatcaagtgtgct

SEQ ID NO: 127180 - DNA, 15 bp, Homo sapiens
aatcatcaagtgtgc

SEQ ID NO: 127181 - DNA, 15 bp, Homo sapiens
taatcatcaagtgtg

SEQ ID NO: 127182 - DNA, 15 bp, Homo sapiens
ttaatcatcaagtgt

SEQ ID NO: 127183 - DNA, 15 bp, Homo sapiens
attaatcatcaagtg

SEQ ID NO: 127184 - DNA, 15 bp, Homo sapiens
cattaatcatcaagt

SEQ ID NO: 127185 - DNA, 15 bp, Homo sapiens
acattaatcatcaag

SEQ ID NO: 127186 - DNA, 15 bp, Homo sapiens
cacattaatcatcaa

SEQ ID NO: 127187 - DNA, 15 bp, Homo sapiens
tcacattaatcatca

SEQ ID NO: 127188 - DNA, 15 bp, Homo sapiens
ctcacattaatcatc

SEQ ID NO: 127189 - DNA, 15 bp, Homo sapiens
actcacattaatcat

SEQ ID NO: 127190 - DNA, 15 bp, Homo sapiens
cactcacattaatca

SEQ ID NO: 127191 - DNA, 15 bp, Homo sapiens
tcactcacattaatc

SEQ ID NO: 127192 - DNA, 15 bp, Homo sapiens
ttcactcacattaat

SEQ ID NO: 127193 - DNA, 15 bp, Homo sapiens
cttcactcacattaa

SEQ ID NO: 127194 - DNA, 15 bp, Homo sapiens
tcttcactcacatta

SEQ ID NO: 127195 - DNA, 15 bp, Homo sapiens
ttcttcactcacatt

SEQ ID NO: 127196 - DNA, 15 bp, Homo sapiens
gttcttcactcacat

SEQ ID NO: 127197 - DNA, 15 bp, Homo sapiens
tgttcttcactcaca

SEQ ID NO: 127198 - DNA, 15 bp, Homo sapiens
ctgttcttcactcac

SEQ ID NO: 127199 - DNA, 15 bp, Homo sapiens
tctgttcttcactca

SEQ ID NO: 127200 - DNA, 15 bp, Homo sapiens
ctctgttcttcactc

SEQ ID NO: 127201 - DNA, 15 bp, Homo sapiens
cctctgttcttcact

SEQ ID NO: 127202 - DNA, 15 bp, Homo sapiens
gcctctgttcttcac

SEQ ID NO: 127203 - DNA, 15 bp, Homo sapiens
tgcctctgttcttca

SEQ ID NO: 127204 - DNA, 15 bp, Homo sapiens
ctgcctctgttcttc

SEQ ID NO: 127205 - DNA, 15 bp, Homo sapiens
gctgcctctgttctt

SEQ ID NO: 127206 - DNA, 15 bp, Homo sapiens
agctgcctctgttct

SEQ ID NO: 127207 - DNA, 15 bp, Homo sapiens
tagctgcctctgttc

SEQ ID NO: 127208 - DNA, 15 bp, Homo sapiens
gtagctgcctctgtt

SEQ ID NO: 127209 - DNA, 15 bp, Homo sapiens
tgtagctgcctctgt

SEQ ID NO: 127210 - DNA, 15 bp, Homo sapiens
ctgtagctgcctctg

SEQ ID NO: 127211 - DNA, 15 bp, Homo sapiens
tctgtagctgcctct

SEQ ID NO: 127212 - DNA, 15 bp, Homo sapiens
atctgtagctgcctc

SEQ ID NO: 127213 - DNA, 15 bp, Homo sapiens
tatctgtagctgcct

SEQ ID NO: 127214 - DNA, 15 bp, Homo sapiens
ttatctgtagctgcc

SEQ ID NO: 127215 - DNA, 15 bp, Homo sapiens
attatctgtagctgc

SEQ ID NO: 127216 - DNA, 15 bp, Homo sapiens
aattatctgtagctg

SEQ ID NO: 127217 - DNA, 15 bp, Homo sapiens
taattatctgtagct

SEQ ID NO: 127218 - DNA, 15 bp, Homo sapiens
ctaattatctgtagc

SEQ ID NO: 127219 - DNA, 15 bp, Homo sapiens
tctaattatctgtag

SEQ ID NO: 127220 - DNA, 15 bp, Homo sapiens
ttctaattatctgta

SEQ ID NO: 127221 - DNA, 15 bp, Homo sapiens
attctaattatctgt

SEQ ID NO: 127222 - DNA, 15 bp, Homo sapiens
gattctaattatctg

SEQ ID NO: 127223 - DNA, 15 bp, Homo sapiens
ggattctaattatct

SEQ ID NO: 127224 - DNA, 15 bp, Homo sapiens
tggattctaattatc

SEQ ID NO: 127225 - DNA, 15 bp, Homo sapiens
atggattctaattat

SEQ ID NO: 127226 - DNA, 15 bp, Homo sapiens
tatggattctaatta

SEQ ID NO: 127227 - DNA, 15 bp, Homo sapiens
atatggattctaatt

SEQ ID NO: 127228 - DNA, 15 bp, Homo sapiens
tatatggattctaat

SEQ ID NO: 127229 - DNA, 15 bp, Homo sapiens
atatatggattctaa

SEQ ID NO: 127230 - DNA, 15 bp, Homo sapiens
tatatatggattcta

SEQ ID NO: 127231 - DNA, 15 bp, Homo sapiens
ctatatatggattct

SEQ ID NO: 127232 - DNA, 15 bp, Homo sapiens
actatatatggattc

SEQ ID NO: 127233 - DNA, 15 bp, Homo sapiens
tactatatatggatt

SEQ ID NO: 127234 - DNA, 15 bp, Homo sapiens
gtactatatatggat

SEQ ID NO: 127235 - DNA, 15 bp, Homo sapiens
ggtactatatatgga

SEQ ID NO: 127236 - DNA, 15 bp, Homo sapiens
tggtactatatatgg

SEQ ID NO: 127237 - DNA, 15 bp, Homo sapiens
ttggtactatatatg

SEQ ID NO: 127238 - DNA, 15 bp, Homo sapiens
tttggtactatatat

SEQ ID NO: 127239 - DNA, 15 bp, Homo sapiens
gtttggtactatata

SEQ ID NO: 127240 - DNA, 15 bp, Homo sapiens
agtttggtactatat

SEQ ID NO: 127241 - DNA, 15 bp, Homo sapiens
gagtttggtactata

SEQ ID NO: 127242 - DNA, 15 bp, Homo sapiens
agagtttggtactat

SEQ ID NO: 127243 - DNA, 15 bp, Homo sapiens
aagagtttggtacta

SEQ ID NO: 127244 - DNA, 15 bp, Homo sapiens
aaagagtttggtact

SEQ ID NO: 127245 - DNA, 15 bp, Homo sapiens
aaaagagtttggtac

SEQ ID NO: 127246 - DNA, 15 bp, Homo sapiens
aaaaagagtttggta

SEQ ID NO: 127247 - DNA, 15 bp, Homo sapiens
aaaaaagagtttggt

SEQ ID NO: 127248 - DNA, 15 bp, Homo sapiens
taaaaaagagtttgg

SEQ ID NO: 127249 - DNA, 15 bp, Homo sapiens
ataaaaaagagtttg

SEQ ID NO: 127250 - DNA, 15 bp, Homo sapiens
tataaaaaagagttt

SEQ ID NO: 127251 - DNA, 15 bp, Homo sapiens
ctataaaaaagagtt

SEQ ID NO: 127252 - DNA, 15 bp, Homo sapiens
gctataaaaaagagt

SEQ ID NO: 127253 - DNA, 15 bp, Homo sapiens
ggctataaaaaagag

SEQ ID NO: 127254 - DNA, 15 bp, Homo sapiens
aggctataaaaaaga

SEQ ID NO: 127255 - DNA, 15 bp, Homo sapiens
aaggctataaaaaag

SEQ ID NO: 127256 - DNA, 15 bp, Homo sapiens
gaaggctataaaaaa

SEQ ID NO: 127257 - DNA, 15 bp, Homo sapiens
agaaggctataaaaa

SEQ ID NO: 127258 - DNA, 15 bp, Homo sapiens
cagaaggctataaaa

SEQ ID NO: 127259 - DNA, 15 bp, Homo sapiens
acagaaggctataaa

SEQ ID NO: 127260 - DNA, 15 bp, Homo sapiens
aacagaaggctataa

SEQ ID NO: 127261 - DNA, 15 bp, Homo sapiens
aaacagaaggctata

SEQ ID NO: 127262 - DNA, 15 bp, Homo sapiens
taaacagaaggctat

SEQ ID NO: 127263 - DNA, 15 bp, Homo sapiens
ttaaacagaaggcta

SEQ ID NO: 127264 - DNA, 15 bp, Homo sapiens
tttaaacagaaggct

SEQ ID NO: 127265 - DNA, 15 bp, Homo sapiens
atttaaacagaaggc

SEQ ID NO: 127266 - DNA, 15 bp, Homo sapiens
catttaaacagaagg

SEQ ID NO: 127267 - DNA, 15 bp, Homo sapiens
tcatttaaacagaag

SEQ ID NO: 127268 - DNA, 15 bp, Homo sapiens
ttcatttaaacagaa

SEQ ID NO: 127269 - DNA, 15 bp, Homo sapiens
attcatttaaacaga

SEQ ID NO: 127270 - DNA, 15 bp, Homo sapiens
cattcatttaaacag

SEQ ID NO: 127271 - DNA, 15 bp, Homo sapiens
gcattcatttaaaca

SEQ ID NO: 127272 - DNA, 15 bp, Homo sapiens
agcattcatttaaac

SEQ ID NO: 127273 - DNA, 15 bp, Homo sapiens
aagcattcatttaaa

SEQ ID NO: 127274 - DNA, 15 bp, Homo sapiens
aaagcattcatttaa

SEQ ID NO: 127275 - DNA, 15 bp, Homo sapiens
aaaagcattcattta

SEQ ID NO: 127276 - DNA, 15 bp, Homo sapiens
caaaagcattcattt

SEQ ID NO: 127277 - DNA, 15 bp, Homo sapiens
tcaaaagcattcatt

SEQ ID NO: 127278 - DNA, 15 bp, Homo sapiens
ctcaaaagcattcat

SEQ ID NO: 127279 - DNA, 15 bp, Homo sapiens
gctcaaaagcattca

SEQ ID NO: 127280 - DNA, 15 bp, Homo sapiens
ggctcaaaagcattc

SEQ ID NO: 127281 - DNA, 15 bp, Homo sapiens
aggctcaaaagcatt

SEQ ID NO: 127282 - DNA, 15 bp, Homo sapiens
aaggctcaaaagcat

SEQ ID NO: 127283 - DNA, 15 bp, Homo sapiens
gaaggctcaaaagca

SEQ ID NO: 127284 - DNA, 15 bp, Homo sapiens
agaaggctcaaaagc

SEQ ID NO: 127285 - DNA, 15 bp, Homo sapiens
aagaaggctcaaaag

SEQ ID NO: 127286 - DNA, 15 bp, Homo sapiens
taagaaggctcaaaa

SEQ ID NO: 127287 - DNA, 15 bp, Homo sapiens
gtaagaaggctcaaa

SEQ ID NO: 127288 - DNA, 15 bp, Homo sapiens
agtaagaaggctcaa

SEQ ID NO: 127289 - DNA, 15 bp, Homo sapiens
tagtaagaaggctca

SEQ ID NO: 127290 - DNA, 15 bp, Homo sapiens
ctagtaagaaggctc

SEQ ID NO: 127291 - DNA, 15 bp, Homo sapiens
tctagtaagaaggct

SEQ ID NO: 127292 - DNA, 15 bp, Homo sapiens
atctagtaagaaggc

SEQ ID NO: 127293 - DNA, 15 bp, Homo sapiens
aatctagtaagaagg

SEQ ID NO: 127294 - DNA, 15 bp, Homo sapiens
aaatctagtaagaag

SEQ ID NO: 127295 - DNA, 15 bp, Homo sapiens
aaaatctagtaagaa

SEQ ID NO: 127296 - DNA, 15 bp, Homo sapiens
caaaatctagtaaga

SEQ ID NO: 127297 - DNA, 15 bp, Homo sapiens
tcaaaatctagtaag

SEQ ID NO: 127298 - DNA, 15 bp, Homo sapiens
gtcaaaatctagtaa

SEQ ID NO: 127299 - DNA, 15 bp, Homo sapiens
ggtcaaaatctagta

SEQ ID NO: 127300 - DNA, 15 bp, Homo sapiens
tggtcaaaatctagt

SEQ ID NO: 127301 - DNA, 15 bp, Homo sapiens
ctggtcaaaatctag

SEQ ID NO: 127302 - DNA, 15 bp, Homo sapiens
cctggtcaaaatcta

SEQ ID NO: 127303 - DNA, 15 bp, Homo sapiens
tcctggtcaaaatct

SEQ ID NO: 127304 - DNA, 15 bp, Homo sapiens
gtcctggtcaaaatc

SEQ ID NO: 127305 - DNA, 15 bp, Homo sapiens
agtcctggtcaaaat

SEQ ID NO: 127306 - DNA, 15 bp, Homo sapiens
tagtcctggtcaaaa

SEQ ID NO: 127307 - DNA, 15 bp, Homo sapiens
atagtcctggtcaaa

SEQ ID NO: 127308 - DNA, 15 bp, Homo sapiens
aatagtcctggtcaa

SEQ ID NO: 127309 - DNA, 15 bp, Homo sapiens
taatagtcctggtca

SEQ ID NO: 127310 - DNA, 15 bp, Homo sapiens
ttaatagtcctggtc

SEQ ID NO: 127311 - DNA, 15 bp, Homo sapiens
attaatagtcctggt

SEQ ID NO: 127312 - DNA, 15 bp, Homo sapiens
tattaatagtcctgg

SEQ ID NO: 127313 - DNA, 15 bp, Homo sapiens
ctattaatagtcctg

SEQ ID NO: 127314 - DNA, 15 bp, Homo sapiens
cctattaatagtcct

SEQ ID NO: 127315 - DNA, 15 bp, Homo sapiens
acctattaatagtcc

SEQ ID NO: 127316 - DNA, 15 bp, Homo sapiens
tacctattaatagtc

SEQ ID NO: 127317 - DNA, 15 bp, Homo sapiens
ctacctattaatagt

SEQ ID NO: 127318 - DNA, 15 bp, Homo sapiens
tctacctattaatag

SEQ ID NO: 127319 - DNA, 15 bp, Homo sapiens
ttctacctattaata

SEQ ID NO: 127320 - DNA, 15 bp, Homo sapiens
tttctacctattaat

SEQ ID NO: 127321 - DNA, 15 bp, Homo sapiens
atttctacctattaa

SEQ ID NO: 127322 - DNA, 15 bp, Homo sapiens
catttctacctatta

SEQ ID NO: 127323 - DNA, 15 bp, Homo sapiens
tcatttctacctatt

SEQ ID NO: 127324 - DNA, 15 bp, Homo sapiens
ttcatttctacctat

SEQ ID NO: 127325 - DNA, 15 bp, Homo sapiens
tttcatttctaccta

SEQ ID NO: 127326 - DNA, 15 bp, Homo sapiens
ttttcatttctacct

SEQ ID NO: 127327 - DNA, 15 bp, Homo sapiens
gttttcatttctacc

SEQ ID NO: 127328 - DNA, 15 bp, Homo sapiens
tgttttcatttctac

SEQ ID NO: 127329 - DNA, 15 bp, Homo sapiens
ctgttttcatttcta

SEQ ID NO: 127330 - DNA, 15 bp, Homo sapiens
cctgttttcatttct

SEQ ID NO: 127331 - DNA, 15 bp, Homo sapiens
gcctgttttcatttc

SEQ ID NO: 127332 - DNA, 15 bp, Homo sapiens
tgcctgttttcattt

SEQ ID NO: 127333 - DNA, 15 bp, Homo sapiens
ttgcctgttttcatt

SEQ ID NO: 127334 - DNA, 15 bp, Homo sapiens
cttgcctgttttcat

SEQ ID NO: 127335 - DNA, 15 bp, Homo sapiens
tcttgcctgttttca

SEQ ID NO: 127336 - DNA, 15 bp, Homo sapiens
atcttgcctgttttc

SEQ ID NO: 127337 - DNA, 15 bp, Homo sapiens
aatcttgcctgtttt

SEQ ID NO: 127338 - DNA, 15 bp, Homo sapiens
aaatcttgcctgttt

SEQ ID NO: 127339 - DNA, 15 bp, Homo sapiens
aaaatcttgcctgtt

SEQ ID NO: 127340 - DNA, 15 bp, Homo sapiens
aaaaatcttgcctgt

SEQ ID NO: 127341 - DNA, 15 bp, Homo sapiens
caaaaatcttgcctg

SEQ ID NO: 127342 - DNA, 15 bp, Homo sapiens
gcaaaaatcttgcct

SEQ ID NO: 127343 - DNA, 15 bp, Homo sapiens
ggcaaaaatcttgcc

SEQ ID NO: 127344 - DNA, 15 bp, Homo sapiens
tggcaaaaatcttgc

SEQ ID NO: 127345 - DNA, 15 bp, Homo sapiens
ctggcaaaaatcttg

SEQ ID NO: 127346 - DNA, 15 bp, Homo sapiens
actggcaaaaatctt

SEQ ID NO: 127347 - DNA, 15 bp, Homo sapiens
tactggcaaaaatct

SEQ ID NO: 127348 - DNA, 15 bp, Homo sapiens
ctactggcaaaaatc

SEQ ID NO: 127349 - DNA, 15 bp, Homo sapiens
gctactggcaaaaat

SEQ ID NO: 127350 - DNA, 15 bp, Homo sapiens
agctactggcaaaaa

SEQ ID NO: 127351 - DNA, 15 bp, Homo sapiens
cagctactggcaaaa

SEQ ID NO: 127352 - DNA, 15 bp, Homo sapiens
acagctactggcaaa

SEQ ID NO: 127353 - DNA, 15 bp, Homo sapiens
cacagctactggcaa

SEQ ID NO: 127354 - DNA, 15 bp, Homo sapiens
ccacagctactggca

SEQ ID NO: 127355 - DNA, 15 bp, Homo sapiens
tccacagctactggc

SEQ ID NO: 127356 - DNA, 15 bp, Homo sapiens
atccacagctactgg

SEQ ID NO: 127357 - DNA, 15 bp, Homo sapiens
catccacagctactg

SEQ ID NO: 127358 - DNA, 15 bp, Homo sapiens
acatccacagctact

SEQ ID NO: 127359 - DNA, 15 bp, Homo sapiens
cacatccacagctac

SEQ ID NO: 127360 - DNA, 15 bp, Homo sapiens
tcacatccacagcta

SEQ ID NO: 127361 - DNA, 15 bp, Homo sapiens
atcacatccacagct

SEQ ID NO: 127362 - DNA, 15 bp, Homo sapiens
catcacatccacagc

SEQ ID NO: 127363 - DNA, 15 bp, Homo sapiens
ccatcacatccacag

SEQ ID NO: 127364 - DNA, 15 bp, Homo sapiens
tccatcacatccaca

SEQ ID NO: 127365 - DNA, 15 bp, Homo sapiens
ttccatcacatccac

SEQ ID NO: 127366 - DNA, 15 bp, Homo sapiens
tttccatcacatcca

SEQ ID NO: 127367 - DNA, 15 bp, Homo sapiens
ctttccatcacatcc

SEQ ID NO: 127368 - DNA, 15 bp, Homo sapiens
cctttccatcacatc

SEQ ID NO: 127369 - DNA, 15 bp, Homo sapiens
gcctttccatcacat

SEQ ID NO: 127370 - DNA, 15 bp, Homo sapiens
tgcctttccatcaca

SEQ ID NO: 127371 - DNA, 15 bp, Homo sapiens
ttgcctttccatcac

SEQ ID NO: 127372 - DNA, 15 bp, Homo sapiens
tttgcctttccatca

SEQ ID NO: 127373 - DNA, 15 bp, Homo sapiens
atttgcctttccatc

SEQ ID NO: 127374 - DNA, 15 bp, Homo sapiens
tatttgcctttccat

SEQ ID NO: 127375 - DNA, 15 bp, Homo sapiens
ttatttgcctttcca

SEQ ID NO: 127376 - DNA, 15 bp, Homo sapiens
cttatttgcctttcc

SEQ ID NO: 127377 - DNA, 15 bp, Homo sapiens
acttatttgcctttc

SEQ ID NO: 127378 - DNA, 15 bp, Homo sapiens
aacttatttgccttt

SEQ ID NO: 127379 - DNA, 15 bp, Homo sapiens
taacttatttgcctt

SEQ ID NO: 127380 - DNA, 15 bp, Homo sapiens
ataacttatttgcct

SEQ ID NO: 127381 - DNA, 15 bp, Homo sapiens
cataacttatttgcc

SEQ ID NO: 127382 - DNA, 15 bp, Homo sapiens
tcataacttatttgc

SEQ ID NO: 127383 - DNA, 15 bp, Homo sapiens
ttcataacttatttg

SEQ ID NO: 127384 - DNA, 15 bp, Homo sapiens
tttcataacttattt

SEQ ID NO: 127385 - DNA, 15 bp, Homo sapiens
atttcataacttatt

SEQ ID NO: 127386 - DNA, 15 bp, Homo sapiens
tatttcataacttat

SEQ ID NO: 127387 - DNA, 15 bp, Homo sapiens
ttatttcataactta

SEQ ID NO: 127388 - DNA, 15 bp, Homo sapiens
gttatttcataactt

SEQ ID NO: 127389 - DNA, 15 bp, Homo sapiens
ggttatttcataact

SEQ ID NO: 127390 - DNA, 15 bp, Homo sapiens
gggttatttcataac

SEQ ID NO: 127391 - DNA, 15 bp, Homo sapiens
tgggttatttcataa

SEQ ID NO: 127392 - DNA, 15 bp, Homo sapiens
ctgggttatttcata

SEQ ID NO: 127393 - DNA, 15 bp, Homo sapiens
actgggttatttcat

SEQ ID NO: 127394 - DNA, 15 bp, Homo sapiens
cactgggttatttca

SEQ ID NO: 127395 - DNA, 15 bp, Homo sapiens
ccactgggttatttc

SEQ ID NO: 127396 - DNA, 15 bp, Homo sapiens
tccactgggttattt

SEQ ID NO: 127397 - DNA, 15 bp, Homo sapiens
ttccactgggttatt

SEQ ID NO: 127398 - DNA, 15 bp, Homo sapiens
tttccactgggttat

SEQ ID NO: 127399 - DNA, 15 bp, Homo sapiens
ctttccactgggtta

SEQ ID NO: 127400 - DNA, 15 bp, Homo sapiens
gctttccactgggtt

SEQ ID NO: 127401 - DNA, 15 bp, Homo sapiens
cgctttccactgggt

SEQ ID NO: 127402 - DNA, 15 bp, Homo sapiens
gcgctttccactggg

SEQ ID NO: 127403 - DNA, 15 bp, Homo sapiens
agcgctttccactgg

SEQ ID NO: 127404 - DNA, 15 bp, Homo sapiens
cagcgctttccactg

SEQ ID NO: 127405 - DNA, 15 bp, Homo sapiens
acagcgctttccact

SEQ ID NO: 127406 - DNA, 15 bp, Homo sapiens
tacagcgctttccac

SEQ ID NO: 127407 - DNA, 15 bp, Homo sapiens
atacagcgctttcca

SEQ ID NO: 127408 - DNA, 15 bp, Homo sapiens
tatacagcgctttcc

SEQ ID NO: 127409 - DNA, 15 bp, Homo sapiens
ttatacagcgctttc

SEQ ID NO: 127410 - DNA, 15 bp, Homo sapiens
cttatacagcgcttt

SEQ ID NO: 127411 - DNA, 15 bp, Homo sapiens
tcttatacagcgctt

SEQ ID NO: 127412 - DNA, 15 bp, Homo sapiens
ctcttatacagcgct

SEQ ID NO: 127413 - DNA, 15 bp, Homo sapiens
cctcttatacagcgc

SEQ ID NO: 127414 - DNA, 15 bp, Homo sapiens
tcctcttatacagcg

SEQ ID NO: 127415 - DNA, 15 bp, Homo sapiens
ttcctcttatacagc

SEQ ID NO: 127416 - DNA, 15 bp, Homo sapiens
tttcctcttatacag

SEQ ID NO: 127417 - DNA, 15 bp, Homo sapiens
ctttcctcttataca

SEQ ID NO: 127418 - DNA, 15 bp, Homo sapiens
cctttcctcttatac

SEQ ID NO: 127419 - DNA, 15 bp, Homo sapiens
ccctttcctcttata

SEQ ID NO: 127420 - DNA, 15 bp, Homo sapiens
tccctttcctcttat

SEQ ID NO: 127421 - DNA, 15 bp, Homo sapiens
ctccctttcctctta

SEQ ID NO: 127422 - DNA, 15 bp, Homo sapiens
gctccctttcctctt

SEQ ID NO: 127423 - DNA, 15 bp, Homo sapiens
tgctccctttcctct

SEQ ID NO: 127424 - DNA, 15 bp, Homo sapiens
gtgctccctttcctc

SEQ ID NO: 127425 - DNA, 15 bp, Homo sapiens
tgtgctccctttcct

SEQ ID NO: 127426 - DNA, 15 bp, Homo sapiens
ctgtgctccctttcc

SEQ ID NO: 127427 - DNA, 15 bp, Homo sapiens
tctgtgctccctttc

SEQ ID NO: 127428 - DNA, 15 bp, Homo sapiens
ttctgtgctcccttt

SEQ ID NO: 127429 - DNA, 15 bp, Homo sapiens
attctgtgctccctt

SEQ ID NO: 127430 - DNA, 15 bp, Homo sapiens
tattctgtgctccct

SEQ ID NO: 127431 - DNA, 15 bp, Homo sapiens
ttattctgtgctccc

SEQ ID NO: 127432 - DNA, 15 bp, Homo sapiens
attattctgtgctcc

SEQ ID NO: 127433 - DNA, 15 bp, Homo sapiens
tattattctgtgctc

SEQ ID NO: 127434 - DNA, 15 bp, Homo sapiens
gtattattctgtgct

SEQ ID NO: 127435 - DNA, 15 bp, Homo sapiens
tgtattattctgtgc

SEQ ID NO: 127436 - DNA, 15 bp, Homo sapiens
atgtattattctgtg

SEQ ID NO: 127437 - DNA, 15 bp, Homo sapiens
aatgtattattctgt

SEQ ID NO: 127438 - DNA, 15 bp, Homo sapiens
caatgtattattctg

SEQ ID NO: 127439 - DNA, 15 bp, Homo sapiens
ccaatgtattattct

SEQ ID NO: 127440 - DNA, 15 bp, Homo sapiens
cccaatgtattattc

SEQ ID NO: 127441 - DNA, 15 bp, Homo sapiens
acccaatgtattatt

SEQ ID NO: 127442 - DNA, 15 bp, Homo sapiens
tacccaatgtattat

SEQ ID NO: 127443 - DNA, 15 bp, Homo sapiens
ttacccaatgtatta

SEQ ID NO: 127444 - DNA, 15 bp, Homo sapiens
gttacccaatgtatt

SEQ ID NO: 127445 - DNA, 15 bp, Homo sapiens
agttacccaatgtat

SEQ ID NO: 127446 - DNA, 15 bp, Homo sapiens
aagttacccaatgta

SEQ ID NO: 127447 - DNA, 15 bp, Homo sapiens
caagttacccaatgt

SEQ ID NO: 127448 - DNA, 15 bp, Homo sapiens
tcaagttacccaatg

SEQ ID NO: 127449 - DNA, 15 bp, Homo sapiens
ctcaagttacccaat

SEQ ID NO: 127450 - DNA, 15 bp, Homo sapiens
tctcaagttacccaa

SEQ ID NO: 127451 - DNA, 15 bp, Homo sapiens
ctctcaagttaccca

SEQ ID NO: 127452 - DNA, 15 bp, Homo sapiens
tctctcaagttaccc

SEQ ID NO: 127453 - DNA, 15 bp, Homo sapiens
gtctctcaagttacc

SEQ ID NO: 127454 - DNA, 15 bp, Homo sapiens
tgtctctcaagttac

SEQ ID NO: 127455 - DNA, 15 bp, Homo sapiens
atgtctctcaagtta

SEQ ID NO: 127456 - DNA, 15 bp, Homo sapiens
tatgtctctcaagtt

SEQ ID NO: 127457 - DNA, 15 bp, Homo sapiens
gtatgtctctcaagt

SEQ ID NO: 127458 - DNA, 15 bp, Homo sapiens
cgtatgtctctcaag

SEQ ID NO: 127459 - DNA, 15 bp, Homo sapiens
gcgtatgtctctcaa

SEQ ID NO: 127460 - DNA, 15 bp, Homo sapiens
tgcgtatgtctctca

SEQ ID NO: 127461 - DNA, 15 bp, Homo sapiens
gtgcgtatgtctctc

SEQ ID NO: 127462 - DNA, 15 bp, Homo sapiens
tgtgcgtatgtctct

SEQ ID NO: 127463 - DNA, 15 bp, Homo sapiens
ttgtgcgtatgtctc

SEQ ID NO: 127464 - DNA, 15 bp, Homo sapiens
tttgtgcgtatgtct

SEQ ID NO: 127465 - DNA, 15 bp, Homo sapiens
ttttgtgcgtatgtc

SEQ ID NO: 127466 - DNA, 15 bp, Homo sapiens
tttttgtgcgtatgt

SEQ ID NO: 127467 - DNA, 15 bp, Homo sapiens
gtttttgtgcgtatg

SEQ ID NO: 127468 - DNA, 15 bp, Homo sapiens
agtttttgtgcgtat

SEQ ID NO: 127469 - DNA, 15 bp, Homo sapiens
tagtttttgtgcgta

SEQ ID NO: 127470 - DNA, 15 bp, Homo sapiens
ctagtttttgtgcgt

SEQ ID NO: 127471 - DNA, 15 bp, Homo sapiens
cctagtttttgtgcg

SEQ ID NO: 127472 - DNA, 15 bp, Homo sapiens
gcctagtttttgtgc

SEQ ID NO: 127473 - DNA, 15 bp, Homo sapiens
tgcctagtttttgtg

SEQ ID NO: 127474 - DNA, 15 bp, Homo sapiens
atgcctagtttttgt

SEQ ID NO: 127475 - DNA, 15 bp, Homo sapiens
gatgcctagtttttg

SEQ ID NO: 127476 - DNA, 15 bp, Homo sapiens
tgatgcctagttttt

SEQ ID NO: 127477 - DNA, 15 bp, Homo sapiens
atgatgcctagtttt

SEQ ID NO: 127478 - DNA, 15 bp, Homo sapiens
catgatgcctagttt

SEQ ID NO: 127479 - DNA, 15 bp, Homo sapiens
acatgatgcctagtt

SEQ ID NO: 127480 - DNA, 15 bp, Homo sapiens
aacatgatgcctagt

SEQ ID NO: 127481 - DNA, 15 bp, Homo sapiens
gaacatgatgcctag

SEQ ID NO: 127482 - DNA, 15 bp, Homo sapiens
ggaacatgatgccta

SEQ ID NO: 127483 - DNA, 15 bp, Homo sapiens
aggaacatgatgcct

SEQ ID NO: 127484 - DNA, 15 bp, Homo sapiens
aaggaacatgatgcc

SEQ ID NO: 127485 - DNA, 15 bp, Homo sapiens
gaaggaacatgatgc

SEQ ID NO: 127486 - DNA, 15 bp, Homo sapiens
agaaggaacatgatg

SEQ ID NO: 127487 - DNA, 15 bp, Homo sapiens
gagaaggaacatgat

SEQ ID NO: 127488 - DNA, 15 bp, Homo sapiens
agagaaggaacatga

SEQ ID NO: 127489 - DNA, 15 bp, Homo sapiens
aagagaaggaacatg

SEQ ID NO: 127490 - DNA, 15 bp, Homo sapiens
aaagagaaggaacat

SEQ ID NO: 127491 - DNA, 15 bp, Homo sapiens
aaaagagaaggaaca

SEQ ID NO: 127492 - DNA, 15 bp, Homo sapiens
aaaaagagaaggaac

SEQ ID NO: 127493 - DNA, 15 bp, Homo sapiens
aaaaaagagaaggaa

SEQ ID NO: 127494 - DNA, 15 bp, Homo sapiens
aaaaaaagagaagga

SEQ ID NO: 127495 - DNA, 15 bp, Homo sapiens
gaaaaaaagagaagg

SEQ ID NO: 127496 - DNA, 15 bp, Homo sapiens
agaaaaaaagagaag

SEQ ID NO: 127497 - DNA, 15 bp, Homo sapiens
tagaaaaaaagagaa

SEQ ID NO: 127498 - DNA, 15 bp, Homo sapiens
atagaaaaaaagaga

SEQ ID NO: 127499 - DNA, 15 bp, Homo sapiens
aatagaaaaaaagag

SEQ ID NO: 127500 - DNA, 15 bp, Homo sapiens
aaatagaaaaaaaga

SEQ ID NO: 127501 - DNA, 15 bp, Homo sapiens
aaaatagaaaaaaag

SEQ ID NO: 127502 - DNA, 15 bp, Homo sapiens
taaaatagaaaaaaa

SEQ ID NO: 127503 - DNA, 15 bp, Homo sapiens
ctaaaatagaaaaaa

SEQ ID NO: 127504 - DNA, 15 bp, Homo sapiens
gctaaaatagaaaaa

SEQ ID NO: 127505 - DNA, 15 bp, Homo sapiens
ggctaaaatagaaaa

SEQ ID NO: 127506 - DNA, 15 bp, Homo sapiens
aggctaaaatagaaa

SEQ ID NO: 127507 - DNA, 15 bp, Homo sapiens
taggctaaaatagaa

SEQ ID NO: 127508 - DNA, 15 bp, Homo sapiens
gtaggctaaaataga

SEQ ID NO: 127509 - DNA, 15 bp, Homo sapiens
tgtaggctaaaatag

SEQ ID NO: 127510 - DNA, 15 bp, Homo sapiens
atgtaggctaaaata

SEQ ID NO: 127511 - DNA, 15 bp, Homo sapiens
tatgtaggctaaaat

SEQ ID NO: 127512 - DNA, 15 bp, Homo sapiens
atatgtaggctaaaa

SEQ ID NO: 127513 - DNA, 15 bp, Homo sapiens
aatatgtaggctaaa

SEQ ID NO: 127514 - DNA, 15 bp, Homo sapiens
aaatatgtaggctaa

SEQ ID NO: 127515 - DNA, 15 bp, Homo sapiens
gaaatatgtaggcta

SEQ ID NO: 127516 - DNA, 15 bp, Homo sapiens
tgaaatatgtaggct

SEQ ID NO: 127517 - DNA, 15 bp, Homo sapiens
ttgaaatatgtaggc

SEQ ID NO: 127518 - DNA, 15 bp, Homo sapiens
attgaaatatgtagg

SEQ ID NO: 127519 - DNA, 15 bp, Homo sapiens
cattgaaatatgtag

SEQ ID NO: 127520 - DNA, 15 bp, Homo sapiens
acattgaaatatgta

SEQ ID NO: 127521 - DNA, 15 bp, Homo sapiens
cacattgaaatatgt

SEQ ID NO: 127522 - DNA, 15 bp, Homo sapiens
tcacattgaaatatg

SEQ ID NO: 127523 - DNA, 15 bp, Homo sapiens
gtcacattgaaatat

SEQ ID NO: 127524 - DNA, 15 bp, Homo sapiens
agtcacattgaaata

SEQ ID NO: 127525 - DNA, 15 bp, Homo sapiens
tagtcacattgaaat

SEQ ID NO: 127526 - DNA, 15 bp, Homo sapiens
ttagtcacattgaaa

SEQ ID NO: 127527 - DNA, 15 bp, Homo sapiens
attagtcacattgaa

SEQ ID NO: 127528 - DNA, 15 bp, Homo sapiens
gattagtcacattga

SEQ ID NO: 127529 - DNA, 15 bp, Homo sapiens
ggattagtcacattg

SEQ ID NO: 127530 - DNA, 15 bp, Homo sapiens
aggattagtcacatt

SEQ ID NO: 127531 - DNA, 15 bp, Homo sapiens
aaggattagtcacat

SEQ ID NO: 127532 - DNA, 15 bp, Homo sapiens
caaggattagtcaca

SEQ ID NO: 127533 - DNA, 15 bp, Homo sapiens
tcaaggattagtcac

SEQ ID NO: 127534 - DNA, 15 bp, Homo sapiens
ttcaaggattagtca

SEQ ID NO: 127535 - DNA, 15 bp, Homo sapiens
tttcaaggattagtc

SEQ ID NO: 127536 - DNA, 15 bp, Homo sapiens
ttttcaaggattagt

SEQ ID NO: 127537 - DNA, 15 bp, Homo sapiens
cttttcaaggattag

SEQ ID NO: 127538 - DNA, 15 bp, Homo sapiens
tcttttcaaggatta

SEQ ID NO: 127539 - DNA, 15 bp, Homo sapiens
atcttttcaaggatt

SEQ ID NO: 127540 - DNA, 15 bp, Homo sapiens
tatcttttcaaggat

SEQ ID NO: 127541 - DNA, 15 bp, Homo sapiens
ctatcttttcaagga

SEQ ID NO: 127542 - DNA, 15 bp, Homo sapiens
gctatcttttcaagg

SEQ ID NO: 127543 - DNA, 15 bp, Homo sapiens
agctatcttttcaag

SEQ ID NO: 127544 - DNA, 15 bp, Homo sapiens
aagctatcttttcaa

SEQ ID NO: 127545 - DNA, 15 bp, Homo sapiens
aaagctatcttttca

SEQ ID NO: 127546 - DNA, 15 bp, Homo sapiens
aaaagctatcttttc

SEQ ID NO: 127547 - DNA, 15 bp, Homo sapiens
taaaagctatctttt

SEQ ID NO: 127548 - DNA, 15 bp, Homo sapiens
ctaaaagctatcttt

SEQ ID NO: 127549 - DNA, 15 bp, Homo sapiens
actaaaagctatctt

SEQ ID NO: 127550 - DNA, 15 bp, Homo sapiens
cactaaaagctatct

SEQ ID NO: 127551 - DNA, 15 bp, Homo sapiens
ccactaaaagctatc

SEQ ID NO: 127552 - DNA, 15 bp, Homo sapiens
gccactaaaagctat

SEQ ID NO: 127553 - DNA, 15 bp, Homo sapiens
ggccactaaaagcta

SEQ ID NO: 127554 - DNA, 15 bp, Homo sapiens
aggccactaaaagct

SEQ ID NO: 127555 - DNA, 15 bp, Homo sapiens
aaggccactaaaagc

SEQ ID NO: 127556 - DNA, 15 bp, Homo sapiens
aaaggccactaaaag

SEQ ID NO: 127557 - DNA, 15 bp, Homo sapiens
caaaggccactaaaa

SEQ ID NO: 127558 - DNA, 15 bp, Homo sapiens
ccaaaggccactaaa

SEQ ID NO: 127559 - DNA, 15 bp, Homo sapiens
accaaaggccactaa

SEQ ID NO: 127560 - DNA, 15 bp, Homo sapiens
taccaaaggccacta

SEQ ID NO: 127561 - DNA, 15 bp, Homo sapiens
ataccaaaggccact

SEQ ID NO: 127562 - DNA, 15 bp, Homo sapiens
tataccaaaggccac

SEQ ID NO: 127563 - DNA, 15 bp, Homo sapiens
atataccaaaggcca

SEQ ID NO: 127564 - DNA, 15 bp, Homo sapiens
aatataccaaaggcc

SEQ ID NO: 127565 - DNA, 15 bp, Homo sapiens
gaatataccaaaggc

SEQ ID NO: 127566 - DNA, 15 bp, Homo sapiens
ggaatataccaaagg

SEQ ID NO: 127567 - DNA, 15 bp, Homo sapiens
aggaatataccaaag

SEQ ID NO: 127568 - DNA, 15 bp, Homo sapiens
aaggaatataccaaa

SEQ ID NO: 127569 - DNA, 15 bp, Homo sapiens
aaaggaatataccaa

SEQ ID NO: 127570 - DNA, 15 bp, Homo sapiens
caaaggaatatacca

SEQ ID NO: 127571 - DNA, 15 bp, Homo sapiens
acaaaggaatatacc

SEQ ID NO: 127572 - DNA, 15 bp, Homo sapiens
aacaaaggaatatac

SEQ ID NO: 127573 - DNA, 15 bp, Homo sapiens
aaacaaaggaatata

SEQ ID NO: 127574 - DNA, 15 bp, Homo sapiens
caaacaaaggaatat

SEQ ID NO: 127575 - DNA, 15 bp, Homo sapiens
ccaaacaaaggaata

SEQ ID NO: 127576 - DNA, 15 bp, Homo sapiens
tccaaacaaaggaat

SEQ ID NO: 127577 - DNA, 15 bp, Homo sapiens
atccaaacaaaggaa

SEQ ID NO: 127578 - DNA, 15 bp, Homo sapiens
aatccaaacaaagga

SEQ ID NO: 127579 - DNA, 15 bp, Homo sapiens
aaatccaaacaaagg

SEQ ID NO: 127580 - DNA, 15 bp, Homo sapiens
aaaatccaaacaaag

SEQ ID NO: 127581 - DNA, 15 bp, Homo sapiens
taaaatccaaacaaa

SEQ ID NO: 127582 - DNA, 15 bp, Homo sapiens
gtaaaatccaaacaa

SEQ ID NO: 127583 - DNA, 15 bp, Homo sapiens
tgtaaaatccaaaca

SEQ ID NO: 127584 - DNA, 15 bp, Homo sapiens
ttgtaaaatccaaac

SEQ ID NO: 127585 - DNA, 15 bp, Homo sapiens
tttgtaaaatccaaa

SEQ ID NO: 127586 - DNA, 15 bp, Homo sapiens
atttgtaaaatccaa

SEQ ID NO: 127587 - DNA, 15 bp, Homo sapiens
aatttgtaaaatcca

SEQ ID NO: 127588 - DNA, 15 bp, Homo sapiens
aaatttgtaaaatcc

SEQ ID NO: 127589 - DNA, 15 bp, Homo sapiens
aaaatttgtaaaatc

SEQ ID NO: 127590 - DNA, 15 bp, Homo sapiens
gaaaatttgtaaaat

SEQ ID NO: 127591 - DNA, 15 bp, Homo sapiens
agaaaatttgtaaaa

SEQ ID NO: 127592 - DNA, 15 bp, Homo sapiens
gagaaaatttgtaaa

SEQ ID NO: 127593 - DNA, 15 bp, Homo sapiens
agagaaaatttgtaa

SEQ ID NO: 127594 - DNA, 15 bp, Homo sapiens
aagagaaaatttgta

SEQ ID NO: 127595 - DNA, 15 bp, Homo sapiens
aaagagaaaatttgt

SEQ ID NO: 127596 - DNA, 15 bp, Homo sapiens
caaagagaaaatttg

SEQ ID NO: 127597 - DNA, 15 bp, Homo sapiens
acaaagagaaaattt

SEQ ID NO: 127598 - DNA, 15 bp, Homo sapiens
tacaaagagaaaatt

SEQ ID NO: 127599 - DNA, 15 bp, Homo sapiens
gtacaaagagaaaat

SEQ ID NO: 127600 - DNA, 15 bp, Homo sapiens
ggtacaaagagaaaa

SEQ ID NO: 127601 - DNA, 15 bp, Homo sapiens
aggtacaaagagaaa

SEQ ID NO: 127602 - DNA, 15 bp, Homo sapiens
aaggtacaaagagaa

SEQ ID NO: 127603 - DNA, 15 bp, Homo sapiens
aaaggtacaaagaga

SEQ ID NO: 127604 - DNA, 15 bp, Homo sapiens
caaaggtacaaagag

SEQ ID NO: 127605 - DNA, 15 bp, Homo sapiens
ccaaaggtacaaaga

SEQ ID NO: 127606 - DNA, 15 bp, Homo sapiens
tccaaaggtacaaag

SEQ ID NO: 127607 - DNA, 15 bp, Homo sapiens
ctccaaaggtacaaa

SEQ ID NO: 127608 - DNA, 15 bp, Homo sapiens
tctccaaaggtacaa

SEQ ID NO: 127609 - DNA, 15 bp, Homo sapiens
ttctccaaaggtaca

SEQ ID NO: 127610 - DNA, 15 bp, Homo sapiens
gttctccaaaggtac

SEQ ID NO: 127611 - DNA, 15 bp, Homo sapiens
tgttctccaaaggta

SEQ ID NO: 127612 - DNA, 15 bp, Homo sapiens
atgttctccaaaggt

SEQ ID NO: 127613 - DNA, 15 bp, Homo sapiens
aatgttctccaaagg

SEQ ID NO: 127614 - DNA, 15 bp, Homo sapiens
gaatgttctccaaag

SEQ ID NO: 127615 - DNA, 15 bp, Homo sapiens
agaatgttctccaaa

SEQ ID NO: 127616 - DNA, 15 bp, Homo sapiens
aagaatgttctccaa

SEQ ID NO: 127617 - DNA, 15 bp, Homo sapiens
aaagaatgttctcca

SEQ ID NO: 127618 - DNA, 15 bp, Homo sapiens
aaaagaatgttctcc

SEQ ID NO: 127619 - DNA, 15 bp, Homo sapiens
taaaagaatgttctc

SEQ ID NO: 127620 - DNA, 15 bp, Homo sapiens
gtaaaagaatgttct

SEQ ID NO: 127621 - DNA, 15 bp, Homo sapiens
tgtaaaagaatgttc

SEQ ID NO: 127622 - DNA, 15 bp, Homo sapiens
atgtaaaagaatgtt

SEQ ID NO: 127623 - DNA, 15 bp, Homo sapiens
tatgtaaaagaatgt

SEQ ID NO: 127624 - DNA, 15 bp, Homo sapiens
gtatgtaaaagaatg

SEQ ID NO: 127625 - DNA, 15 bp, Homo sapiens
tgtatgtaaaagaat

SEQ ID NO: 127626 - DNA, 15 bp, Homo sapiens
atgtatgtaaaagaa

SEQ ID NO: 127627 - DNA, 15 bp, Homo sapiens
gatgtatgtaaaaga

SEQ ID NO: 127628 - DNA, 15 bp, Homo sapiens
agatgtatgtaaaag

SEQ ID NO: 127629 - DNA, 15 bp, Homo sapiens
aagatgtatgtaaaa

SEQ ID NO: 127630 - DNA, 15 bp, Homo sapiens
aaagatgtatgtaaa

SEQ ID NO: 127631 - DNA, 15 bp, Homo sapiens
taaagatgtatgtaa

SEQ ID NO: 127632 - DNA, 15 bp, Homo sapiens
ataaagatgtatgta

SEQ ID NO: 127633 - DNA, 15 bp, Homo sapiens
gataaagatgtatgt

SEQ ID NO: 127634 - DNA, 15 bp, Homo sapiens
ggataaagatgtatg

SEQ ID NO: 127635 - DNA, 15 bp, Homo sapiens
tggataaagatgtat

SEQ ID NO: 127636 - DNA, 15 bp, Homo sapiens
atggataaagatgta

SEQ ID NO: 127637 - DNA, 15 bp, Homo sapiens
tatggataaagatgt

SEQ ID NO: 127638 - DNA, 15 bp, Homo sapiens
gtatggataaagatg

SEQ ID NO: 127639 - DNA, 15 bp, Homo sapiens
agtatggataaagat

SEQ ID NO: 127640 - DNA, 15 bp, Homo sapiens
aagtatggataaaga

SEQ ID NO: 127641 - DNA, 15 bp, Homo sapiens
taagtatggataaag

SEQ ID NO: 127642 - DNA, 15 bp, Homo sapiens
ataagtatggataaa

SEQ ID NO: 127643 - DNA, 15 bp, Homo sapiens
tataagtatggataa

SEQ ID NO: 127644 - DNA, 15 bp, Homo sapiens
atataagtatggata

SEQ ID NO: 127645 - DNA, 15 bp, Homo sapiens
aatataagtatggat

SEQ ID NO: 127646 - DNA, 15 bp, Homo sapiens
aaatataagtatgga

SEQ ID NO: 127647 - DNA, 15 bp, Homo sapiens
gaaatataagtatgg

SEQ ID NO: 127648 - DNA, 15 bp, Homo sapiens
tgaaatataagtatg

SEQ ID NO: 127649 - DNA, 15 bp, Homo sapiens
atgaaatataagtat

SEQ ID NO: 127650 - DNA, 15 bp, Homo sapiens
aatgaaatataagta

SEQ ID NO: 127651 - DNA, 15 bp, Homo sapiens
taatgaaatataagt

SEQ ID NO: 127652 - DNA, 15 bp, Homo sapiens
ctaatgaaatataag

SEQ ID NO: 127653 - DNA, 15 bp, Homo sapiens
cctaatgaaatataa

SEQ ID NO: 127654 - DNA, 15 bp, Homo sapiens
gcctaatgaaatata

SEQ ID NO: 127655 - DNA, 15 bp, Homo sapiens
agcctaatgaaatat

SEQ ID NO: 127656 - DNA, 15 bp, Homo sapiens
aagcctaatgaaata

SEQ ID NO: 127657 - DNA, 15 bp, Homo sapiens
caagcctaatgaaat

SEQ ID NO: 127658 - DNA, 15 bp, Homo sapiens
tcaagcctaatgaaa

SEQ ID NO: 127659 - DNA, 15 bp, Homo sapiens
atcaagcctaatgaa

SEQ ID NO: 127660 - DNA, 15 bp, Homo sapiens
gatcaagcctaatga

SEQ ID NO: 127661 - DNA, 15 bp, Homo sapiens
tgatcaagcctaatg

SEQ ID NO: 127662 - DNA, 15 bp, Homo sapiens
atgatcaagcctaat

SEQ ID NO: 127663 - DNA, 15 bp, Homo sapiens
aatgatcaagcctaa

SEQ ID NO: 127664 - DNA, 15 bp, Homo sapiens
taatgatcaagccta

SEQ ID NO: 127665 - DNA, 15 bp, Homo sapiens
ctaatgatcaagcct

SEQ ID NO: 127666 - DNA, 15 bp, Homo sapiens
tctaatgatcaagcc

SEQ ID NO: 127667 - DNA, 15 bp, Homo sapiens
atctaatgatcaagc

SEQ ID NO: 127668 - DNA, 15 bp, Homo sapiens
catctaatgatcaag

SEQ ID NO: 127669 - DNA, 15 bp, Homo sapiens
tcatctaatgatcaa

SEQ ID NO: 127670 - DNA, 15 bp, Homo sapiens
ttcatctaatgatca

SEQ ID NO: 127671 - DNA, 15 bp, Homo sapiens
cttcatctaatgatc

SEQ ID NO: 127672 - DNA, 15 bp, Homo sapiens
tcttcatctaatgat

SEQ ID NO: 127673 - DNA, 15 bp, Homo sapiens
gtcttcatctaatga

SEQ ID NO: 127674 - DNA, 15 bp, Homo sapiens
tgtcttcatctaatg

SEQ ID NO: 127675 - DNA, 15 bp, Homo sapiens
ttgtcttcatctaat

SEQ ID NO: 127676 - DNA, 15 bp, Homo sapiens
tttgtcttcatctaa

SEQ ID NO: 127677 - DNA, 15 bp, Homo sapiens
atttgtcttcatcta

SEQ ID NO: 127678 - DNA, 15 bp, Homo sapiens
aatttgtcttcatct

SEQ ID NO: 127679 - DNA, 15 bp, Homo sapiens
aaatttgtcttcatc

SEQ ID NO: 127680 - DNA, 15 bp, Homo sapiens
gaaatttgtcttcat

SEQ ID NO: 127681 - DNA, 15 bp, Homo sapiens
agaaatttgtcttca

SEQ ID NO: 127682 - DNA, 15 bp, Homo sapiens
aagaaatttgtcttc

SEQ ID NO: 127683 - DNA, 15 bp, Homo sapiens
aaagaaatttgtctt

SEQ ID NO: 127684 - DNA, 15 bp, Homo sapiens
taaagaaatttgtct

SEQ ID NO: 127685 - DNA, 15 bp, Homo sapiens
ttaaagaaatttgtc

SEQ ID NO: 127686 - DNA, 15 bp, Homo sapiens
tttaaagaaatttgt

SEQ ID NO: 127687 - DNA, 15 bp, Homo sapiens
ttttaaagaaatttg

SEQ ID NO: 127688 - DNA, 15 bp, Homo sapiens
tttttaaagaaattt

SEQ ID NO: 127689 - DNA, 15 bp, Homo sapiens
atttttaaagaaatt

SEQ ID NO: 127690 - DNA, 15 bp, Homo sapiens
tatttttaaagaaat

SEQ ID NO: 127691 - DNA, 15 bp, Homo sapiens
ttatttttaaagaaa

SEQ ID NO: 127692 - DNA, 15 bp, Homo sapiens
attatttttaaagaa

SEQ ID NO: 127693 - DNA, 15 bp, Homo sapiens
cattatttttaaaga

SEQ ID NO: 127694 - DNA, 15 bp, Homo sapiens
tcattatttttaaag

SEQ ID NO: 127695 - DNA, 15 bp, Homo sapiens
gtcattatttttaaa

SEQ ID NO: 127696 - DNA, 15 bp, Homo sapiens
tgtcattatttttaa

SEQ ID NO: 127697 - DNA, 15 bp, Homo sapiens
atgtcattattttta

SEQ ID NO: 127698 - DNA, 15 bp, Homo sapiens
aatgtcattattttt

SEQ ID NO: 127699 - DNA, 15 bp, Homo sapiens
aaatgtcattatttt

SEQ ID NO: 127700 - DNA, 15 bp, Homo sapiens
aaaatgtcattattt

SEQ ID NO: 127701 - DNA, 15 bp, Homo sapiens
taaaatgtcattatt

SEQ ID NO: 127702 - DNA, 15 bp, Homo sapiens
ttaaaatgtcattat

SEQ ID NO: 127703 - DNA, 15 bp, Homo sapiens
tttaaaatgtcatta

SEQ ID NO: 127704 - DNA, 15 bp, Homo sapiens
gtttaaaatgtcatt

SEQ ID NO: 127705 - DNA, 15 bp, Homo sapiens
ggtttaaaatgtcat

SEQ ID NO: 127706 - DNA, 15 bp, Homo sapiens
gggtttaaaatgtca

SEQ ID NO: 127707 - DNA, 15 bp, Homo sapiens
ggggtttaaaatgtc

SEQ ID NO: 127708 - DNA, 15 bp, Homo sapiens
aggggtttaaaatgt

SEQ ID NO: 127709 - DNA, 15 bp, Homo sapiens
caggggtttaaaatg

SEQ ID NO: 127710 - DNA, 15 bp, Homo sapiens
acaggggtttaaaat

SEQ ID NO: 127711 - DNA, 15 bp, Homo sapiens
tacaggggtttaaaa

SEQ ID NO: 127712 - DNA, 15 bp, Homo sapiens
atacaggggtttaaa

SEQ ID NO: 127713 - DNA, 15 bp, Homo sapiens
aatacaggggtttaa

SEQ ID NO: 127714 - DNA, 15 bp, Homo sapiens
taatacaggggttta

SEQ ID NO: 127715 - DNA, 15 bp, Homo sapiens
ataatacaggggttt

SEQ ID NO: 127716 - DNA, 15 bp, Homo sapiens
tataatacaggggtt

SEQ ID NO: 127717 - DNA, 15 bp, Homo sapiens
atataatacaggggt

SEQ ID NO: 127718 - DNA, 15 bp, Homo sapiens
gatataatacagggg

SEQ ID NO: 127719 - DNA, 15 bp, Homo sapiens
tgatataatacaggg

SEQ ID NO: 127720 - DNA, 15 bp, Homo sapiens
atgatataatacagg

SEQ ID NO: 127721 - DNA, 15 bp, Homo sapiens
catgatataatacag

SEQ ID NO: 127722 - DNA, 15 bp, Homo sapiens
tcatgatataataca

SEQ ID NO: 127723 - DNA, 15 bp, Homo sapiens
ttcatgatataatac

SEQ ID NO: 127724 - DNA, 15 bp, Homo sapiens
tttcatgatataata

SEQ ID NO: 127725 - DNA, 15 bp, Homo sapiens
atttcatgatataat

SEQ ID NO: 127726 - DNA, 15 bp, Homo sapiens
aatttcatgatataa

SEQ ID NO: 127727 - DNA, 15 bp, Homo sapiens
caatttcatgatata

SEQ ID NO: 127728 - DNA, 15 bp, Homo sapiens
ccaatttcatgatat

SEQ ID NO: 127729 - DNA, 15 bp, Homo sapiens
accaatttcatgata

SEQ ID NO: 127730 - DNA, 15 bp, Homo sapiens
aaccaatttcatgat

SEQ ID NO: 127731 - DNA, 15 bp, Homo sapiens
taaccaatttcatga

SEQ ID NO: 127732 - DNA, 15 bp, Homo sapiens
gtaaccaatttcatg

SEQ ID NO: 127733 - DNA, 15 bp, Homo sapiens
agtaaccaatttcat

SEQ ID NO: 127734 - DNA, 15 bp, Homo sapiens
tagtaaccaatttca

SEQ ID NO: 127735 - DNA, 15 bp, Homo sapiens
atagtaaccaatttc

SEQ ID NO: 127736 - DNA, 15 bp, Homo sapiens
tatagtaaccaattt

SEQ ID NO: 127737 - DNA, 15 bp, Homo sapiens
gtatagtaaccaatt

SEQ ID NO: 127738 - DNA, 15 bp, Homo sapiens
ggtatagtaaccaat

SEQ ID NO: 127739 - DNA, 15 bp, Homo sapiens
gggtatagtaaccaa

SEQ ID NO: 127740 - DNA, 15 bp, Homo sapiens
ggggtatagtaacca

SEQ ID NO: 127741 - DNA, 15 bp, Homo sapiens
aggggtatagtaacc

SEQ ID NO: 127742 - DNA, 15 bp, Homo sapiens
caggggtatagtaac

SEQ ID NO: 127743 - DNA, 15 bp, Homo sapiens
gcaggggtatagtaa

SEQ ID NO: 127744 - DNA, 15 bp, Homo sapiens
ggcaggggtatagta

SEQ ID NO: 127745 - DNA, 15 bp, Homo sapiens
tggcaggggtatagt

SEQ ID NO: 127746 - DNA, 15 bp, Homo sapiens
ttggcaggggtatag

SEQ ID NO: 127747 - DNA, 15 bp, Homo sapiens
gttggcaggggtata

SEQ ID NO: 127748 - DNA, 15 bp, Homo sapiens
tgttggcaggggtat

SEQ ID NO: 127749 - DNA, 15 bp, Homo sapiens
ctgttggcaggggta

SEQ ID NO: 127750 - DNA, 15 bp, Homo sapiens
actgttggcaggggt

SEQ ID NO: 127751 - DNA, 15 bp, Homo sapiens
tactgttggcagggg

SEQ ID NO: 127752 - DNA, 15 bp, Homo sapiens
atactgttggcaggg

SEQ ID NO: 127753 - DNA, 15 bp, Homo sapiens
aatactgttggcagg

SEQ ID NO: 127754 - DNA, 15 bp, Homo sapiens
aaatactgttggcag

SEQ ID NO: 127755 - DNA, 15 bp, Homo sapiens
caaatactgttggca

SEQ ID NO: 127756 - DNA, 15 bp, Homo sapiens
acaaatactgttggc

SEQ ID NO: 127757 - DNA, 15 bp, Homo sapiens
tacaaatactgttgg

SEQ ID NO: 127758 - DNA, 15 bp, Homo sapiens
ttacaaatactgttg

SEQ ID NO: 127759 - DNA, 15 bp, Homo sapiens
tttacaaatactgtt

SEQ ID NO: 127760 - DNA, 15 bp, Homo sapiens
ttttacaaatactgt

SEQ ID NO: 127761 - DNA, 15 bp, Homo sapiens
tttttacaaatactg

SEQ ID NO: 127762 - DNA, 15 bp, Homo sapiens
atttttacaaatact

SEQ ID NO: 127763 - DNA, 15 bp, Homo sapiens
tatttttacaaatac

SEQ ID NO: 127764 - DNA, 15 bp, Homo sapiens
atatttttacaaata

SEQ ID NO: 127765 - DNA, 15 bp, Homo sapiens
gatatttttacaaat

SEQ ID NO: 127766 - DNA, 15 bp, Homo sapiens
ggatatttttacaaa

SEQ ID NO: 127767 - DNA, 15 bp, Homo sapiens
aggatatttttacaa

SEQ ID NO: 127768 - DNA, 15 bp, Homo sapiens
aaggatatttttaca

SEQ ID NO: 127769 - DNA, 15 bp, Homo sapiens
gaaggatatttttac

SEQ ID NO: 127770 - DNA, 15 bp, Homo sapiens
agaaggatattttta

SEQ ID NO: 127771 - DNA, 15 bp, Homo sapiens
aagaaggatattttt

SEQ ID NO: 127772 - DNA, 15 bp, Homo sapiens
aaagaaggatatttt

SEQ ID NO: 127773 - DNA, 15 bp, Homo sapiens
aaaagaaggatattt

SEQ ID NO: 127774 - DNA, 15 bp, Homo sapiens
aaaaagaaggatatt

SEQ ID NO: 127775 - DNA, 15 bp, Homo sapiens
caaaaagaaggatat

SEQ ID NO: 127776 - DNA, 15 bp, Homo sapiens
tcaaaaagaaggata

SEQ ID NO: 127777 - DNA, 15 bp, Homo sapiens
ctcaaaaagaaggat

SEQ ID NO: 127778 - DNA, 15 bp, Homo sapiens
gctcaaaaagaagga

SEQ ID NO: 127779 - DNA, 15 bp, Homo sapiens
ggctcaaaaagaagg

SEQ ID NO: 127780 - DNA, 15 bp, Homo sapiens
gggctcaaaaagaag

SEQ ID NO: 127781 - DNA, 15 bp, Homo sapiens
agggctcaaaaagaa

SEQ ID NO: 127782 - DNA, 15 bp, Homo sapiens
aagggctcaaaaaga

SEQ ID NO: 127783 - DNA, 15 bp, Homo sapiens
taagggctcaaaaag

SEQ ID NO: 127784 - DNA, 15 bp, Homo sapiens
gtaagggctcaaaaa

SEQ ID NO: 127785 - DNA, 15 bp, Homo sapiens
agtaagggctcaaaa

SEQ ID NO: 127786 - DNA, 15 bp, Homo sapiens
tagtaagggctcaaa

SEQ ID NO: 127787 - DNA, 15 bp, Homo sapiens
ttagtaagggctcaa

SEQ ID NO: 127788 - DNA, 15 bp, Homo sapiens
gttagtaagggctca

SEQ ID NO: 127789 - DNA, 15 bp, Homo sapiens
tgttagtaagggctc

SEQ ID NO: 127790 - DNA, 15 bp, Homo sapiens
atgttagtaagggct

SEQ ID NO: 127791 - DNA, 15 bp, Homo sapiens
aatgttagtaagggc

SEQ ID NO: 127792 - DNA, 15 bp, Homo sapiens
caatgttagtaaggg

SEQ ID NO: 127793 - DNA, 15 bp, Homo sapiens
tcaatgttagtaagg

SEQ ID NO: 127794 - DNA, 15 bp, Homo sapiens
gtcaatgttagtaag

SEQ ID NO: 127795 - DNA, 15 bp, Homo sapiens
tgtcaatgttagtaa

SEQ ID NO: 127796 - DNA, 15 bp, Homo sapiens
ctgtcaatgttagta

SEQ ID NO: 127797 - DNA, 15 bp, Homo sapiens
cctgtcaatgttagt

SEQ ID NO: 127798 - DNA, 15 bp, Homo sapiens
acctgtcaatgttag

SEQ ID NO: 127799 - DNA, 15 bp, Homo sapiens
aacctgtcaatgtta

SEQ ID NO: 127800 - DNA, 15 bp, Homo sapiens
aaacctgtcaatgtt

SEQ ID NO: 127801 - DNA, 15 bp, Homo sapiens
aaaacctgtcaatgt

SEQ ID NO: 127802 - DNA, 15 bp, Homo sapiens
aaaaacctgtcaatg

SEQ ID NO: 127803 - DNA, 15 bp, Homo sapiens
aaaaaacctgtcaat

SEQ ID NO: 127804 - DNA, 15 bp, Homo sapiens
aaaaaaacctgtcaa

SEQ ID NO: 127805 - DNA, 15 bp, Homo sapiens
aaaaaaaacctgtca

SEQ ID NO: 127806 - DNA, 15 bp, Homo sapiens
aaaaaaaaacctgtc

SEQ ID NO: 127807 - DNA, 15 bp, Homo sapiens
aaaaaaaaaacctgt

SEQ ID NO: 127808 - DNA, 15 bp, Homo sapiens
taaaaaaaaaacctg

SEQ ID NO: 127809 - DNA, 15 bp, Homo sapiens
ataaaaaaaaaacct

SEQ ID NO: 127810 - DNA, 15 bp, Homo sapiens
aataaaaaaaaaacc

SEQ ID NO: 127811 - DNA, 15 bp, Homo sapiens
taataaaaaaaaaac

SEQ ID NO: 127812 - DNA, 15 bp, Homo sapiens
aataataaaaaaaaa

SEQ ID NO: 127813 - DNA, 15 bp, Homo sapiens
aaataataaaaaaaa

SEQ ID NO: 127814 - DNA, 15 bp, Homo sapiens
taaataataaaaaaa

SEQ ID NO: 127815 - DNA, 15 bp, Homo sapiens
ttaaataataaaaaa

SEQ ID NO: 127816 - DNA, 15 bp, Homo sapiens
tttaaataataaaaa

SEQ ID NO: 127817 - DNA, 15 bp, Homo sapiens
tttttaaataataaa

SEQ ID NO: 127818 - DNA, 15 bp, Homo sapiens
ttttttaaataataa

SEQ ID NO: 127819 - DNA, 15 bp, Homo sapiens
tttttttaaataata

SEQ ID NO: 127820 - DNA, 15 bp, Homo sapiens
gtttttttaaataat

SEQ ID NO: 127821 - DNA, 15 bp, Homo sapiens
agtttttttaaataa

SEQ ID NO: 127822 - DNA, 15 bp, Homo sapiens
aagtttttttaaata

SEQ ID NO: 127823 - DNA, 15 bp, Homo sapiens
aaagtttttttaaat

SEQ ID NO: 127824 - DNA, 15 bp, Homo sapiens
caaagtttttttaaa

SEQ ID NO: 127825 - DNA, 15 bp, Homo sapiens
gcaaagtttttttaa

SEQ ID NO: 127826 - DNA, 15 bp, Homo sapiens
ggcaaagttttttta

SEQ ID NO: 127827 - DNA, 15 bp, Homo sapiens
tggcaaagttttttt

SEQ ID NO: 127828 - DNA, 15 bp, Homo sapiens
ctggcaaagtttttt

SEQ ID NO: 127829 - DNA, 15 bp, Homo sapiens
actggcaaagttttt

SEQ ID NO: 127830 - DNA, 15 bp, Homo sapiens
aactggcaaagtttt

SEQ ID NO: 127831 - DNA, 15 bp, Homo sapiens
aaactggcaaagttt

SEQ ID NO: 127832 - DNA, 15 bp, Homo sapiens
taaactggcaaagtt

SEQ ID NO: 127833 - DNA, 15 bp, Homo sapiens
ttaaactggcaaagt

SEQ ID NO: 127834 - DNA, 15 bp, Homo sapiens
attaaactggcaaag

SEQ ID NO: 127835 - DNA, 15 bp, Homo sapiens
tattaaactggcaaa

SEQ ID NO: 127836 - DNA, 15 bp, Homo sapiens
ctattaaactggcaa

SEQ ID NO: 127837 - DNA, 15 bp, Homo sapiens
actattaaactggca

SEQ ID NO: 127838 - DNA, 15 bp, Homo sapiens
cactattaaactggc

SEQ ID NO: 127839 - DNA, 15 bp, Homo sapiens
tcactattaaactgg

SEQ ID NO: 127840 - DNA, 15 bp, Homo sapiens
atcactattaaactg

SEQ ID NO: 127841 - DNA, 15 bp, Homo sapiens
tatcactattaaact

SEQ ID NO: 127842 - DNA, 15 bp, Homo sapiens
ctatcactattaaac

SEQ ID NO: 127843 - DNA, 15 bp, Homo sapiens
tctatcactattaaa

SEQ ID NO: 127844 - DNA, 15 bp, Homo sapiens
atctatcactattaa

SEQ ID NO: 127845 - DNA, 15 bp, Homo sapiens
aatctatcactatta

SEQ ID NO: 127846 - DNA, 15 bp, Homo sapiens
taatctatcactatt

SEQ ID NO: 127847 - DNA, 15 bp, Homo sapiens
gtaatctatcactat

SEQ ID NO: 127848 - DNA, 15 bp, Homo sapiens
tgtaatctatcacta

SEQ ID NO: 127849 - DNA, 15 bp, Homo sapiens
atgtaatctatcact

SEQ ID NO: 127850 - DNA, 15 bp, Homo sapiens
gatgtaatctatcac

SEQ ID NO: 127851 - DNA, 15 bp, Homo sapiens
agatgtaatctatca

SEQ ID NO: 127852 - DNA, 15 bp, Homo sapiens
gagatgtaatctatc

SEQ ID NO: 127853 - DNA, 15 bp, Homo sapiens
tgagatgtaatctat

SEQ ID NO: 127854 - DNA, 15 bp, Homo sapiens
ttgagatgtaatcta

SEQ ID NO: 127855 - DNA, 15 bp, Homo sapiens
attgagatgtaatct

SEQ ID NO: 127856 - DNA, 15 bp, Homo sapiens
aattgagatgtaatc

SEQ ID NO: 127857 - DNA, 15 bp, Homo sapiens
aaattgagatgtaat

SEQ ID NO: 127858 - DNA, 15 bp, Homo sapiens
aaaattgagatgtaa

SEQ ID NO: 127859 - DNA, 15 bp, Homo sapiens
taaaattgagatgta

SEQ ID NO: 127860 - DNA, 15 bp, Homo sapiens
ataaaattgagatgt

SEQ ID NO: 127861 - DNA, 15 bp, Homo sapiens
aataaaattgagatg

SEQ ID NO: 127862 - DNA, 15 bp, Homo sapiens
aaataaaattgagat

SEQ ID NO: 127863 - DNA, 15 bp, Homo sapiens
aaaataaaattgaga

SEQ ID NO: 127864 - DNA, 15 bp, Homo sapiens
gaaaataaaattgag

SEQ ID NO: 127865 - DNA, 15 bp, Homo sapiens
tgaaaataaaattga

SEQ ID NO: 127866 - DNA, 15 bp, Homo sapiens
atgaaaataaaattg

SEQ ID NO: 127867 - DNA, 15 bp, Homo sapiens
aatgaaaataaaatt

SEQ ID NO: 127868 - DNA, 15 bp, Homo sapiens
aaaaatgaaaataaa

SEQ ID NO: 127869 - DNA, 15 bp, Homo sapiens
taaaaatgaaaataa

SEQ ID NO: 127870 - DNA, 15 bp, Homo sapiens
ttaaaaatgaaaata

SEQ ID NO: 127871 - DNA, 15 bp, Homo sapiens
tttaaaaatgaaaat

SEQ ID NO: 127872 - DNA, 15 bp, Homo sapiens
atttaaaaatgaaaa

SEQ ID NO: 127873 - DNA, 15 bp, Homo sapiens
aatttaaaaatgaaa

SEQ ID NO: 127874 - DNA, 15 bp, Homo sapiens
aaatttaaaaatgaa

SEQ ID NO: 127875 - DNA, 15 bp, Homo sapiens
aaaatttaaaaatga

SEQ ID NO: 127876 - DNA, 15 bp, Homo sapiens
aaaaatttaaaaatg

SEQ ID NO: 127877 - DNA, 15 bp, Homo sapiens
taaaaatttaaaaat

SEQ ID NO: 127878 - DNA, 15 bp, Homo sapiens
ctaaaaatttaaaaa

SEQ ID NO: 127879 - DNA, 15 bp, Homo sapiens
actaaaaatttaaaa

SEQ ID NO: 127880 - DNA, 15 bp, Homo sapiens
cactaaaaatttaaa

SEQ ID NO: 127881 - DNA, 15 bp, Homo sapiens
gcactaaaaatttaa

SEQ ID NO: 127882 - DNA, 15 bp, Homo sapiens
agcactaaaaattta

SEQ ID NO: 127883 - DNA, 15 bp, Homo sapiens
tagcactaaaaattt

SEQ ID NO: 127884 - DNA, 15 bp, Homo sapiens
gtagcactaaaaatt

SEQ ID NO: 127885 - DNA, 15 bp, Homo sapiens
agtagcactaaaaat

SEQ ID NO: 127886 - DNA, 15 bp, Homo sapiens
tagtagcactaaaaa

SEQ ID NO: 127887 - DNA, 15 bp, Homo sapiens
ttagtagcactaaaa

SEQ ID NO: 127888 - DNA, 15 bp, Homo sapiens
attagtagcactaaa

SEQ ID NO: 127889 - DNA, 15 bp, Homo sapiens
aattagtagcactaa

SEQ ID NO: 127890 - DNA, 15 bp, Homo sapiens
aaattagtagcacta

SEQ ID NO: 127891 - DNA, 15 bp, Homo sapiens
aaaattagtagcact

SEQ ID NO: 127892 - DNA, 15 bp, Homo sapiens
aaaaattagtagcac

SEQ ID NO: 127893 - DNA, 15 bp, Homo sapiens
caaaaattagtagca

SEQ ID NO: 127894 - DNA, 15 bp, Homo sapiens
acaaaaattagtagc

SEQ ID NO: 127895 - DNA, 15 bp, Homo sapiens
tacaaaaattagtag

SEQ ID NO: 127896 - DNA, 15 bp, Homo sapiens
gtacaaaaattagta

SEQ ID NO: 127897 - DNA, 15 bp, Homo sapiens
cgtacaaaaattagt

SEQ ID NO: 127898 - DNA, 15 bp, Homo sapiens
acgtacaaaaattag

SEQ ID NO: 127899 - DNA, 15 bp, Homo sapiens
gacgtacaaaaatta

SEQ ID NO: 127900 - DNA, 15 bp, Homo sapiens
tgacgtacaaaaatt

SEQ ID NO: 127901 - DNA, 15 bp, Homo sapiens
ttgacgtacaaaaat

SEQ ID NO: 127902 - DNA, 15 bp, Homo sapiens
attgacgtacaaaaa

SEQ ID NO: 127903 - DNA, 15 bp, Homo sapiens
aattgacgtacaaaa

SEQ ID NO: 127904 - DNA, 15 bp, Homo sapiens
aaattgacgtacaaa

SEQ ID NO: 127905 - DNA, 15 bp, Homo sapiens
aaaattgacgtacaa

SEQ ID NO: 127906 - DNA, 15 bp, Homo sapiens
caaaattgacgtaca

SEQ ID NO: 127907 - DNA, 15 bp, Homo sapiens
acaaaattgacgtac

SEQ ID NO: 127908 - DNA, 15 bp, Homo sapiens
tacaaaattgacgta

SEQ ID NO: 127909 - DNA, 15 bp, Homo sapiens
atacaaaattgacgt

SEQ ID NO: 127910 - DNA, 15 bp, Homo sapiens
gatacaaaattgacg

SEQ ID NO: 127911 - DNA, 15 bp, Homo sapiens
ggatacaaaattgac

SEQ ID NO: 127912 - DNA, 15 bp, Homo sapiens
aggatacaaaattga

SEQ ID NO: 127913 - DNA, 15 bp, Homo sapiens
caggatacaaaattg

SEQ ID NO: 127914 - DNA, 15 bp, Homo sapiens
tcaggatacaaaatt

SEQ ID NO: 127915 - DNA, 15 bp, Homo sapiens
ttcaggatacaaaat

SEQ ID NO: 127916 - DNA, 15 bp, Homo sapiens
tttcaggatacaaaa

SEQ ID NO: 127917 - DNA, 15 bp, Homo sapiens
gtttcaggatacaaa

SEQ ID NO: 127918 - DNA, 15 bp, Homo sapiens
agtttcaggatacaa

SEQ ID NO: 127919 - DNA, 15 bp, Homo sapiens
aagtttcaggataca

SEQ ID NO: 127920 - DNA, 15 bp, Homo sapiens
aaagtttcaggatac

SEQ ID NO: 127921 - DNA, 15 bp, Homo sapiens
caaagtttcaggata

SEQ ID NO: 127922 - DNA, 15 bp, Homo sapiens
gcaaagtttcaggat

SEQ ID NO: 127923 - DNA, 15 bp, Homo sapiens
agcaaagtttcagga

SEQ ID NO: 127924 - DNA, 15 bp, Homo sapiens
cagcaaagtttcagg

SEQ ID NO: 127925 - DNA, 15 bp, Homo sapiens
tcagcaaagtttcag

SEQ ID NO: 127926 - DNA, 15 bp, Homo sapiens
ttcagcaaagtttca

SEQ ID NO: 127927 - DNA, 15 bp, Homo sapiens
attcagcaaagtttc

SEQ ID NO: 127928 - DNA, 15 bp, Homo sapiens
aattcagcaaagttt

SEQ ID NO: 127929 - DNA, 15 bp, Homo sapiens
aaattcagcaaagtt

SEQ ID NO: 127930 - DNA, 15 bp, Homo sapiens
taaattcagcaaagt

SEQ ID NO: 127931 - DNA, 15 bp, Homo sapiens
ataaattcagcaaag

SEQ ID NO: 127932 - DNA, 15 bp, Homo sapiens
aataaattcagcaaa

SEQ ID NO: 127933 - DNA, 15 bp, Homo sapiens
aaataaattcagcaa

SEQ ID NO: 127934 - DNA, 15 bp, Homo sapiens
taaataaattcagca

SEQ ID NO: 127935 - DNA, 15 bp, Homo sapiens
gtaaataaattcagc

SEQ ID NO: 127936 - DNA, 15 bp, Homo sapiens
ggtaaataaattcag

SEQ ID NO: 127937 - DNA, 15 bp, Homo sapiens
tggtaaataaattca

SEQ ID NO: 127938 - DNA, 15 bp, Homo sapiens
ctggtaaataaattc

SEQ ID NO: 127939 - DNA, 15 bp, Homo sapiens
actggtaaataaatt

SEQ ID NO: 127940 - DNA, 15 bp, Homo sapiens
aactggtaaataaat

SEQ ID NO: 127941 - DNA, 15 bp, Homo sapiens
gaactggtaaataaa

SEQ ID NO: 127942 - DNA, 15 bp, Homo sapiens
agaactggtaaataa

SEQ ID NO: 127943 - DNA, 15 bp, Homo sapiens
tagaactggtaaata

SEQ ID NO: 127944 - DNA, 15 bp, Homo sapiens
ctagaactggtaaat

SEQ ID NO: 127945 - DNA, 15 bp, Homo sapiens
cctagaactggtaaa

SEQ ID NO: 127946 - DNA, 15 bp, Homo sapiens
tcctagaactggtaa

SEQ ID NO: 127947 - DNA, 15 bp, Homo sapiens
ctcctagaactggta

SEQ ID NO: 127948 - DNA, 15 bp, Homo sapiens
gctcctagaactggt

SEQ ID NO: 127949 - DNA, 15 bp, Homo sapiens
agctcctagaactgg

SEQ ID NO: 127950 - DNA, 15 bp, Homo sapiens
aagctcctagaactg

SEQ ID NO: 127951 - DNA, 15 bp, Homo sapiens
aaagctcctagaact

SEQ ID NO: 127952 - DNA, 15 bp, Homo sapiens
aaaagctcctagaac

SEQ ID NO: 127953 - DNA, 15 bp, Homo sapiens
aaaaagctcctagaa

SEQ ID NO: 127954 - DNA, 15 bp, Homo sapiens
caaaaagctcctaga

SEQ ID NO: 127955 - DNA, 15 bp, Homo sapiens
ccaaaaagctcctag

SEQ ID NO: 127956 - DNA, 15 bp, Homo sapiens
tccaaaaagctccta

SEQ ID NO: 127957 - DNA, 15 bp, Homo sapiens
atccaaaaagctcct

SEQ ID NO: 127958 - DNA, 15 bp, Homo sapiens
catccaaaaagctcc

SEQ ID NO: 127959 - DNA, 15 bp, Homo sapiens
tcatccaaaaagctc

SEQ ID NO: 127960 - DNA, 15 bp, Homo sapiens
ctcatccaaaaagct

SEQ ID NO: 127961 - DNA, 15 bp, Homo sapiens
actcatccaaaaagc

SEQ ID NO: 127962 - DNA, 15 bp, Homo sapiens
gactcatccaaaaag

SEQ ID NO: 127963 - DNA, 15 bp, Homo sapiens
agactcatccaaaaa

SEQ ID NO: 127964 - DNA, 15 bp, Homo sapiens
aagactcatccaaaa

SEQ ID NO: 127965 - DNA, 15 bp, Homo sapiens
aaagactcatccaaa

SEQ ID NO: 127966 - DNA, 15 bp, Homo sapiens
taaagactcatccaa

SEQ ID NO: 127967 - DNA, 15 bp, Homo sapiens
ctaaagactcatcca

SEQ ID NO: 127968 - DNA, 15 bp, Homo sapiens
cctaaagactcatcc

SEQ ID NO: 127969 - DNA, 15 bp, Homo sapiens
ccctaaagactcatc

SEQ ID NO: 127970 - DNA, 15 bp, Homo sapiens
accctaaagactcat

SEQ ID NO: 127971 - DNA, 15 bp, Homo sapiens
aaccctaaagactca

SEQ ID NO: 127972 - DNA, 15 bp, Homo sapiens
aaaccctaaagactc

SEQ ID NO: 127973 - DNA, 15 bp, Homo sapiens
aaaaccctaaagact

SEQ ID NO: 127974 - DNA, 15 bp, Homo sapiens
gaaaaccctaaagac

SEQ ID NO: 127975 - DNA, 15 bp, Homo sapiens
agaaaaccctaaaga

SEQ ID NO: 127976 - DNA, 15 bp, Homo sapiens
tagaaaaccctaaag

SEQ ID NO: 127977 - DNA, 15 bp, Homo sapiens
ctagaaaaccctaaa

SEQ ID NO: 127978 - DNA, 15 bp, Homo sapiens
cctagaaaaccctaa

SEQ ID NO: 127979 - DNA, 15 bp, Homo sapiens
acctagaaaacccta

SEQ ID NO: 127980 - DNA, 15 bp, Homo sapiens
tacctagaaaaccct

SEQ ID NO: 127981 - DNA, 15 bp, Homo sapiens
atacctagaaaaccc

SEQ ID NO: 127982 - DNA, 15 bp, Homo sapiens
tatacctagaaaacc

SEQ ID NO: 127983 - DNA, 15 bp, Homo sapiens
atatacctagaaaac

SEQ ID NO: 127984 - DNA, 15 bp, Homo sapiens
catatacctagaaaa

SEQ ID NO: 127985 - DNA, 15 bp, Homo sapiens
tcatatacctagaaa

SEQ ID NO: 127986 - DNA, 15 bp, Homo sapiens
atcatatacctagaa

SEQ ID NO: 127987 - DNA, 15 bp, Homo sapiens
gatcatatacctaga

SEQ ID NO: 127988 - DNA, 15 bp, Homo sapiens
tgatcatatacctag

SEQ ID NO: 127989 - DNA, 15 bp, Homo sapiens
atgatcatataccta

SEQ ID NO: 127990 - DNA, 15 bp, Homo sapiens
catgatcatatacct

SEQ ID NO: 127991 - DNA, 15 bp, Homo sapiens
acatgatcatatacc

SEQ ID NO: 127992 - DNA, 15 bp, Homo sapiens
aacatgatcatatac

SEQ ID NO: 127993 - DNA, 15 bp, Homo sapiens
taacatgatcatata

SEQ ID NO: 127994 - DNA, 15 bp, Homo sapiens
gtaacatgatcatat

SEQ ID NO: 127995 - DNA, 15 bp, Homo sapiens
ggtaacatgatcata

SEQ ID NO: 127996 - DNA, 15 bp, Homo sapiens
tggtaacatgatcat

SEQ ID NO: 127997 - DNA, 15 bp, Homo sapiens
ctggtaacatgatca

SEQ ID NO: 127998 - DNA, 15 bp, Homo sapiens
gctggtaacatgatc

SEQ ID NO: 127999 - DNA, 15 bp, Homo sapiens
tgctggtaacatgat

SEQ ID NO: 128000 - DNA, 15 bp, Homo sapiens
ttgctggtaacatga

SEQ ID NO: 128001 - DNA, 15 bp, Homo sapiens
tttgctggtaacatg

SEQ ID NO: 128002 - DNA, 15 bp, Homo sapiens
gtttgctggtaacat

SEQ ID NO: 128003 - DNA, 15 bp, Homo sapiens
tgtttgctggtaaca

SEQ ID NO: 128004 - DNA, 15 bp, Homo sapiens
ctgtttgctggtaac

SEQ ID NO: 128005 - DNA, 15 bp, Homo sapiens
actgtttgctggtaa

SEQ ID NO: 128006 - DNA, 15 bp, Homo sapiens
tactgtttgctggta

SEQ ID NO: 128007 - DNA, 15 bp, Homo sapiens
ttactgtttgctggt

SEQ ID NO: 128008 - DNA, 15 bp, Homo sapiens
gttactgtttgctgg

SEQ ID NO: 128009 - DNA, 15 bp, Homo sapiens
tgttactgtttgctg

SEQ ID NO: 128010 - DNA, 15 bp, Homo sapiens
ctgttactgtttgct

SEQ ID NO: 128011 - DNA, 15 bp, Homo sapiens
actgttactgtttgc

SEQ ID NO: 128012 - DNA, 15 bp, Homo sapiens
aactgttactgtttg

SEQ ID NO: 128013 - DNA, 15 bp, Homo sapiens
aaactgttactgttt

SEQ ID NO: 128014 - DNA, 15 bp, Homo sapiens
caaactgttactgtt

SEQ ID NO: 128015 - DNA, 15 bp, Homo sapiens
tcaaactgttactgt

SEQ ID NO: 128016 - DNA, 15 bp, Homo sapiens
ctcaaactgttactg

SEQ ID NO: 128017 - DNA, 15 bp, Homo sapiens
actcaaactgttact

SEQ ID NO: 128018 - DNA, 15 bp, Homo sapiens
aactcaaactgttac

SEQ ID NO: 128019 - DNA, 15 bp, Homo sapiens
gaactcaaactgtta

SEQ ID NO: 128020 - DNA, 15 bp, Homo sapiens
ggaactcaaactgtt

SEQ ID NO: 128021 - DNA, 15 bp, Homo sapiens
aggaactcaaactgt

SEQ ID NO: 128022 - DNA, 15 bp, Homo sapiens
aaggaactcaaactg

SEQ ID NO: 128023 - DNA, 15 bp, Homo sapiens
aaaggaactcaaact

SEQ ID NO: 128024 - DNA, 15 bp, Homo sapiens
aaaaggaactcaaac

SEQ ID NO: 128025 - DNA, 15 bp, Homo sapiens
taaaaggaactcaaa

SEQ ID NO: 128026 - DNA, 15 bp, Homo sapiens
ttaaaaggaactcaa

SEQ ID NO: 128027 - DNA, 15 bp, Homo sapiens
gttaaaaggaactca

SEQ ID NO: 128028 - DNA, 15 bp, Homo sapiens
ggttaaaaggaactc

SEQ ID NO: 128029 - DNA, 15 bp, Homo sapiens
tggttaaaaggaact

SEQ ID NO: 128030 - DNA, 15 bp, Homo sapiens
ttggttaaaaggaac

SEQ ID NO: 128031 - DNA, 15 bp, Homo sapiens
attggttaaaaggaa

SEQ ID NO: 128032 - DNA, 15 bp, Homo sapiens
aattggttaaaagga

SEQ ID NO: 128033 - DNA, 15 bp, Homo sapiens
gaattggttaaaagg

SEQ ID NO: 128034 - DNA, 15 bp, Homo sapiens
cgaattggttaaaag

SEQ ID NO: 128035 - DNA, 15 bp, Homo sapiens
ccgaattggttaaaa

SEQ ID NO: 128036 - DNA, 15 bp, Homo sapiens
tccgaattggttaaa

SEQ ID NO: 128037 - DNA, 15 bp, Homo sapiens
atccgaattggttaa

SEQ ID NO: 128038 - DNA, 15 bp, Homo sapiens
catccgaattggtta

SEQ ID NO: 128039 - DNA, 15 bp, Homo sapiens
gcatccgaattggtt

SEQ ID NO: 128040 - DNA, 15 bp, Homo sapiens
ggcatccgaattggt

SEQ ID NO: 128041 - DNA, 15 bp, Homo sapiens
gggcatccgaattgg

SEQ ID NO: 128042 - DNA, 15 bp, Homo sapiens
agggcatccgaattg

SEQ ID NO: 128043 - DNA, 15 bp, Homo sapiens
aagggcatccgaatt

SEQ ID NO: 128044 - DNA, 15 bp, Homo sapiens
aaagggcatccgaat

SEQ ID NO: 128045 - DNA, 15 bp, Homo sapiens
taaagggcatccgaa

SEQ ID NO: 128046 - DNA, 15 bp, Homo sapiens
ataaagggcatccga

SEQ ID NO: 128047 - DNA, 15 bp, Homo sapiens
aataaagggcatccg

SEQ ID NO: 128048 - DNA, 15 bp, Homo sapiens
aaataaagggcatcc

SEQ ID NO: 128049 - DNA, 15 bp, Homo sapiens
gaaataaagggcatc

SEQ ID NO: 128050 - DNA, 15 bp, Homo sapiens
agaaataaagggcat

SEQ ID NO: 128051 - DNA, 15 bp, Homo sapiens
aagaaataaagggca

SEQ ID NO: 128052 - DNA, 15 bp, Homo sapiens
aaagaaataaagggc

SEQ ID NO: 128053 - DNA, 15 bp, Homo sapiens
gaaagaaataaaggg

SEQ ID NO: 128054 - DNA, 15 bp, Homo sapiens
agaaagaaataaagg

SEQ ID NO: 128055 - DNA, 15 bp, Homo sapiens
caagagaaagaaata

SEQ ID NO: 128056 - DNA, 15 bp, Homo sapiens
acaagagaaagaaat

SEQ ID NO: 128057 - DNA, 15 bp, Homo sapiens
gacaagagaaagaaa

SEQ ID NO: 128058 - DNA, 15 bp, Homo sapiens
agacaagagaaagaa

SEQ ID NO: 128059 - DNA, 15 bp, Homo sapiens
cagacaagagaaaga

SEQ ID NO: 128060 - DNA, 15 bp, Homo sapiens
tcagacaagagaaag

SEQ ID NO: 128061 - DNA, 15 bp, Homo sapiens
atcagacaagagaaa

SEQ ID NO: 128062 - DNA, 15 bp, Homo sapiens
aatcagacaagagaa

SEQ ID NO: 128063 - DNA, 15 bp, Homo sapiens
caatcagacaagaga

SEQ ID NO: 128064 - DNA, 15 bp, Homo sapiens
gcaatcagacaagag

SEQ ID NO: 128065 - DNA, 15 bp, Homo sapiens
agcaatcagacaaga

SEQ ID NO: 128066 - DNA, 15 bp, Homo sapiens
gagcaatcagacaag

SEQ ID NO: 128067 - DNA, 15 bp, Homo sapiens
agagcaatcagacaa

SEQ ID NO: 128068 - DNA, 15 bp, Homo sapiens
cagagcaatcagaca

SEQ ID NO: 128069 - DNA, 15 bp, Homo sapiens
acagagcaatcagac

SEQ ID NO: 128070 - DNA, 15 bp, Homo sapiens
gacagagcaatcaga

SEQ ID NO: 128071 - DNA, 15 bp, Homo sapiens
agacagagcaatcag

SEQ ID NO: 128072 - DNA, 15 bp, Homo sapiens
tagacagagcaatca

SEQ ID NO: 128073 - DNA, 15 bp, Homo sapiens
ctagacagagcaatc

SEQ ID NO: 128074 - DNA, 15 bp, Homo sapiens
cctagacagagcaat

SEQ ID NO: 128075 - DNA, 15 bp, Homo sapiens
tcctagacagagcaa

SEQ ID NO: 128076 - DNA, 15 bp, Homo sapiens
gtcctagacagagca

SEQ ID NO: 128077 - DNA, 15 bp, Homo sapiens
agtcctagacagagc

SEQ ID NO: 128078 - DNA, 15 bp, Homo sapiens
aagtcctagacagag

SEQ ID NO: 128079 - DNA, 15 bp, Homo sapiens
gaagtcctagacaga

SEQ ID NO: 128080 - DNA, 15 bp, Homo sapiens
ggaagtcctagacag

SEQ ID NO: 128081 - DNA, 15 bp, Homo sapiens
cggaagtcctagaca

SEQ ID NO: 128082 - DNA, 15 bp, Homo sapiens
ccggaagtcctagac

SEQ ID NO: 128083 - DNA, 15 bp, Homo sapiens
accggaagtcctaga

SEQ ID NO: 128084 - DNA, 15 bp, Homo sapiens
taccggaagtcctag

SEQ ID NO: 128085 - DNA, 15 bp, Homo sapiens
gtaccggaagtccta

SEQ ID NO: 128086 - DNA, 15 bp, Homo sapiens
agtaccggaagtcct

SEQ ID NO: 128087 - DNA, 15 bp, Homo sapiens
tagtaccggaagtcc

SEQ ID NO: 128088 - DNA, 15 bp, Homo sapiens
atagtaccggaagtc

SEQ ID NO: 128089 - DNA, 15 bp, Homo sapiens
catagtaccggaagt

SEQ ID NO: 128090 - DNA, 15 bp, Homo sapiens
acatagtaccggaag

SEQ ID NO: 128091 - DNA, 15 bp, Homo sapiens
aacatagtaccggaa

SEQ ID NO: 128092 - DNA, 15 bp, Homo sapiens
caacatagtaccgga

SEQ ID NO: 128093 - DNA, 15 bp, Homo sapiens
tcaacatagtaccgg

SEQ ID NO: 128094 - DNA, 15 bp, Homo sapiens
ttcaacatagtaccg

SEQ ID NO: 128095 - DNA, 15 bp, Homo sapiens
attcaacatagtacc

SEQ ID NO: 128096 - DNA, 15 bp, Homo sapiens
cattcaacatagtac

SEQ ID NO: 128097 - DNA, 15 bp, Homo sapiens
gcattcaacatagta

SEQ ID NO: 128098 - DNA, 15 bp, Homo sapiens
tgcattcaacatagt

SEQ ID NO: 128099 - DNA, 15 bp, Homo sapiens
ttgcattcaacatag

SEQ ID NO: 128100 - DNA, 15 bp, Homo sapiens
cttgcattcaacata

SEQ ID NO: 128101 - DNA, 15 bp, Homo sapiens
acttgcattcaacat

SEQ ID NO: 128102 - DNA, 15 bp, Homo sapiens
cacttgcattcaaca

SEQ ID NO: 128103 - DNA, 15 bp, Homo sapiens
ccacttgcattcaac

SEQ ID NO: 128104 - DNA, 15 bp, Homo sapiens
accacttgcattcaa

SEQ ID NO: 128105 - DNA, 15 bp, Homo sapiens
caccacttgcattca

SEQ ID NO: 128106 - DNA, 15 bp, Homo sapiens
tcaccacttgcattc

SEQ ID NO: 128107 - DNA, 15 bp, Homo sapiens
ttcaccacttgcatt

SEQ ID NO: 128108 - DNA, 15 bp, Homo sapiens
tttcaccacttgcat

SEQ ID NO: 128109 - DNA, 15 bp, Homo sapiens
ctttcaccacttgca

SEQ ID NO: 128110 - DNA, 15 bp, Homo sapiens
actttcaccacttgc

SEQ ID NO: 128111 - DNA, 15 bp, Homo sapiens
cactttcaccacttg

SEQ ID NO: 128112 - DNA, 15 bp, Homo sapiens
ccactttcaccactt

SEQ ID NO: 128113 - DNA, 15 bp, Homo sapiens
cccactttcaccact

SEQ ID NO: 128114 - DNA, 15 bp, Homo sapiens
gcccactttcaccac

SEQ ID NO: 128115 - DNA, 15 bp, Homo sapiens
tgcccactttcacca

SEQ ID NO: 128116 - DNA, 15 bp, Homo sapiens
atgcccactttcacc

SEQ ID NO: 128117 - DNA, 15 bp, Homo sapiens
gatgcccactttcac

SEQ ID NO: 128118 - DNA, 15 bp, Homo sapiens
ggatgcccactttca

SEQ ID NO: 128119 - DNA, 15 bp, Homo sapiens
aggatgcccactttc

SEQ ID NO: 128120 - DNA, 15 bp, Homo sapiens
aaggatgcccacttt

SEQ ID NO: 128121 - DNA, 15 bp, Homo sapiens
aaaggatgcccactt

SEQ ID NO: 128122 - DNA, 15 bp, Homo sapiens
aaaaggatgcccact

SEQ ID NO: 128123 - DNA, 15 bp, Homo sapiens
gaaaaggatgcccac

SEQ ID NO: 128124 - DNA, 15 bp, Homo sapiens
agaaaaggatgccca

SEQ ID NO: 128125 - DNA, 15 bp, Homo sapiens
aagaaaaggatgccc

SEQ ID NO: 128126 - DNA, 15 bp, Homo sapiens
caagaaaaggatgcc

SEQ ID NO: 128127 - DNA, 15 bp, Homo sapiens
acaagaaaaggatgc

SEQ ID NO: 128128 - DNA, 15 bp, Homo sapiens
aacaagaaaaggatg

SEQ ID NO: 128129 - DNA, 15 bp, Homo sapiens
gaacaagaaaaggat

SEQ ID NO: 128130 - DNA, 15 bp, Homo sapiens
ggaacaagaaaagga

SEQ ID NO: 128131 - DNA, 15 bp, Homo sapiens
tggaacaagaaaagg

SEQ ID NO: 128132 - DNA, 15 bp, Homo sapiens
ctggaacaagaaaag

SEQ ID NO: 128133 - DNA, 15 bp, Homo sapiens
actggaacaagaaaa

SEQ ID NO: 128134 - DNA, 15 bp, Homo sapiens
aactggaacaagaaa

SEQ ID NO: 128135 - DNA, 15 bp, Homo sapiens
gaactggaacaagaa

SEQ ID NO: 128136 - DNA, 15 bp, Homo sapiens
agaactggaacaaga

SEQ ID NO: 128137 - DNA, 15 bp, Homo sapiens
gagaactggaacaag

SEQ ID NO: 128138 - DNA, 15 bp, Homo sapiens
tgagaactggaacaa

SEQ ID NO: 128139 - DNA, 15 bp, Homo sapiens
ctgagaactggaaca

SEQ ID NO: 128140 - DNA, 15 bp, Homo sapiens
cctgagaactggaac

SEQ ID NO: 128141 - DNA, 15 bp, Homo sapiens
ccctgagaactggaa

SEQ ID NO: 128142 - DNA, 15 bp, Homo sapiens
cccctgagaactgga

SEQ ID NO: 128143 - DNA, 15 bp, Homo sapiens
ccccctgagaactgg

SEQ ID NO: 128144 - DNA, 15 bp, Homo sapiens
tccccctgagaactg

SEQ ID NO: 128145 - DNA, 15 bp, Homo sapiens
ttccccctgagaact

SEQ ID NO: 128146 - DNA, 15 bp, Homo sapiens
attccccctgagaac

SEQ ID NO: 128147 - DNA, 15 bp, Homo sapiens
cattccccctgagaa

SEQ ID NO: 128148 - DNA, 15 bp, Homo sapiens
gcattccccctgaga

SEQ ID NO: 128149 - DNA, 15 bp, Homo sapiens
agcattccccctgag

SEQ ID NO: 128150 - DNA, 15 bp, Homo sapiens
aagcattccccctga

SEQ ID NO: 128151 - DNA, 15 bp, Homo sapiens
aaagcattccccctg

SEQ ID NO: 128152 - DNA, 15 bp, Homo sapiens
gaaagcattccccct

SEQ ID NO: 128153 - DNA, 15 bp, Homo sapiens
tgaaagcattccccc

SEQ ID NO: 128154 - DNA, 15 bp, Homo sapiens
ttgaaagcattcccc

SEQ ID NO: 128155 - DNA, 15 bp, Homo sapiens
attgaaagcattccc

SEQ ID NO: 128156 - DNA, 15 bp, Homo sapiens
aattgaaagcattcc

SEQ ID NO: 128157 - DNA, 15 bp, Homo sapiens
aaattgaaagcattc

SEQ ID NO: 128158 - DNA, 15 bp, Homo sapiens
aaaattgaaagcatt

SEQ ID NO: 128159 - DNA, 15 bp, Homo sapiens
aaaaattgaaagcat

SEQ ID NO: 128160 - DNA, 15 bp, Homo sapiens
gaaaaattgaaagca

SEQ ID NO: 128161 - DNA, 15 bp, Homo sapiens
ggaaaaattgaaagc

SEQ ID NO: 128162 - DNA, 15 bp, Homo sapiens
aggaaaaattgaaag

SEQ ID NO: 128163 - DNA, 15 bp, Homo sapiens
gaggaaaaattgaaa

SEQ ID NO: 128164 - DNA, 15 bp, Homo sapiens
tgaggaaaaattgaa

SEQ ID NO: 128165 - DNA, 15 bp, Homo sapiens
atgaggaaaaattga

SEQ ID NO: 128166 - DNA, 15 bp, Homo sapiens
aatgaggaaaaattg

SEQ ID NO: 128167 - DNA, 15 bp, Homo sapiens
gaatgaggaaaaatt

SEQ ID NO: 128168 - DNA, 15 bp, Homo sapiens
tgaatgaggaaaaat

SEQ ID NO: 128169 - DNA, 15 bp, Homo sapiens
ctgaatgaggaaaaa

SEQ ID NO: 128170 - DNA, 15 bp, Homo sapiens
actgaatgaggaaaa

SEQ ID NO: 128171 - DNA, 15 bp, Homo sapiens
tactgaatgaggaaa

SEQ ID NO: 128172 - DNA, 15 bp, Homo sapiens
atactgaatgaggaa

SEQ ID NO: 128173 - DNA, 15 bp, Homo sapiens
tatactgaatgagga

SEQ ID NO: 128174 - DNA, 15 bp, Homo sapiens
ttatactgaatgagg

SEQ ID NO: 128175 - DNA, 15 bp, Homo sapiens
attatactgaatgag

SEQ ID NO: 128176 - DNA, 15 bp, Homo sapiens
cattatactgaatga

SEQ ID NO: 128177 - DNA, 15 bp, Homo sapiens
acattatactgaatg

SEQ ID NO: 128178 - DNA, 15 bp, Homo sapiens
aacattatactgaat

SEQ ID NO: 128179 - DNA, 15 bp, Homo sapiens
caacattatactgaa

SEQ ID NO: 128180 - DNA, 15 bp, Homo sapiens
ccaacattatactga

SEQ ID NO: 128181 - DNA, 15 bp, Homo sapiens
gccaacattatactg

SEQ ID NO: 128182 - DNA, 15 bp, Homo sapiens
agccaacattatact

SEQ ID NO: 128183 - DNA, 15 bp, Homo sapiens
tagccaacattatac

SEQ ID NO: 128184 - DNA, 15 bp, Homo sapiens
atagccaacattata

SEQ ID NO: 128185 - DNA, 15 bp, Homo sapiens
catagccaacattat

SEQ ID NO: 128186 - DNA, 15 bp, Homo sapiens
ccatagccaacatta

SEQ ID NO: 128187 - DNA, 15 bp, Homo sapiens
cccatagccaacatt

SEQ ID NO: 128188 - DNA, 15 bp, Homo sapiens
gcccatagccaacat

SEQ ID NO: 128189 - DNA, 15 bp, Homo sapiens
agcccatagccaaca

SEQ ID NO: 128190 - DNA, 15 bp, Homo sapiens
tagcccatagccaac

SEQ ID NO: 128191 - DNA, 15 bp, Homo sapiens
ttagcccatagccaa

SEQ ID NO: 128192 - DNA, 15 bp, Homo sapiens
tttagcccatagcca

SEQ ID NO: 128193 - DNA, 15 bp, Homo sapiens
ttttagcccatagcc

SEQ ID NO: 128194 - DNA, 15 bp, Homo sapiens
cttttagcccatagc

SEQ ID NO: 128195 - DNA, 15 bp, Homo sapiens
acttttagcccatag

SEQ ID NO: 128196 - DNA, 15 bp, Homo sapiens
gacttttagcccata

SEQ ID NO: 128197 - DNA, 15 bp, Homo sapiens
tgacttttagcccat

SEQ ID NO: 128198 - DNA, 15 bp, Homo sapiens
atgacttttagccca

SEQ ID NO: 128199 - DNA, 15 bp, Homo sapiens
tatgacttttagccc

SEQ ID NO: 128200 - DNA, 15 bp, Homo sapiens
ctatgacttttagcc

SEQ ID NO: 128201 - DNA, 15 bp, Homo sapiens
tctatgacttttagc

SEQ ID NO: 128202 - DNA, 15 bp, Homo sapiens
atctatgacttttag

SEQ ID NO: 128203 - DNA, 15 bp, Homo sapiens
catctatgactttta

SEQ ID NO: 128204 - DNA, 15 bp, Homo sapiens
ccatctatgactttt

SEQ ID NO: 128205 - DNA, 15 bp, Homo sapiens
gccatctatgacttt

SEQ ID NO: 128206 - DNA, 15 bp, Homo sapiens
agccatctatgactt

SEQ ID NO: 128207 - DNA, 15 bp, Homo sapiens
aagccatctatgact

SEQ ID NO: 128208 - DNA, 15 bp, Homo sapiens
aaagccatctatgac

SEQ ID NO: 128209 - DNA, 15 bp, Homo sapiens
aaaagccatctatga

SEQ ID NO: 128210 - DNA, 15 bp, Homo sapiens
taaaagccatctatg

SEQ ID NO: 128211 - DNA, 15 bp, Homo sapiens
ataaaagccatctat

SEQ ID NO: 128212 - DNA, 15 bp, Homo sapiens
aataaaagccatcta

SEQ ID NO: 128213 - DNA, 15 bp, Homo sapiens
taataaaagccatct

SEQ ID NO: 128214 - DNA, 15 bp, Homo sapiens
gtaataaaagccatc

SEQ ID NO: 128215 - DNA, 15 bp, Homo sapiens
ggtaataaaagccat

SEQ ID NO: 128216 - DNA, 15 bp, Homo sapiens
aggtaataaaagcca

SEQ ID NO: 128217 - DNA, 15 bp, Homo sapiens
caggtaataaaagcc

SEQ ID NO: 128218 - DNA, 15 bp, Homo sapiens
tcaggtaataaaagc

SEQ ID NO: 128219 - DNA, 15 bp, Homo sapiens
ttcaggtaataaaag

SEQ ID NO: 128220 - DNA, 15 bp, Homo sapiens
cttcaggtaataaaa

SEQ ID NO: 128221 - DNA, 15 bp, Homo sapiens
ccttcaggtaataaa

SEQ ID NO: 128222 - DNA, 15 bp, Homo sapiens
accttcaggtaataa

SEQ ID NO: 128223 - DNA, 15 bp, Homo sapiens
taccttcaggtaata

SEQ ID NO: 128224 - DNA, 15 bp, Homo sapiens
ataccttcaggtaat

SEQ ID NO: 128225 - DNA, 15 bp, Homo sapiens
cataccttcaggtaa

SEQ ID NO: 128226 - DNA, 15 bp, Homo sapiens
acataccttcaggta

SEQ ID NO: 128227 - DNA, 15 bp, Homo sapiens
aacataccttcaggt

SEQ ID NO: 128228 - DNA, 15 bp, Homo sapiens
gaacataccttcagg

SEQ ID NO: 128229 - DNA, 15 bp, Homo sapiens
ggaacataccttcag

SEQ ID NO: 128230 - DNA, 15 bp, Homo sapiens
aggaacataccttca

SEQ ID NO: 128231 - DNA, 15 bp, Homo sapiens
aaggaacataccttc

SEQ ID NO: 128232 - DNA, 15 bp, Homo sapiens
gaaggaacatacctt

SEQ ID NO: 128233 - DNA, 15 bp, Homo sapiens
agaaggaacatacct

SEQ ID NO: 128234 - DNA, 15 bp, Homo sapiens
tagaaggaacatacc

SEQ ID NO: 128235 - DNA, 15 bp, Homo sapiens
atagaaggaacatac

SEQ ID NO: 128236 - DNA, 15 bp, Homo sapiens
catagaaggaacata

SEQ ID NO: 128237 - DNA, 15 bp, Homo sapiens
gcatagaaggaacat

SEQ ID NO: 128238 - DNA, 15 bp, Homo sapiens
ggcatagaaggaaca

SEQ ID NO: 128239 - DNA, 15 bp, Homo sapiens
tggcatagaaggaac

SEQ ID NO: 128240 - DNA, 15 bp, Homo sapiens
ttggcatagaaggaa

SEQ ID NO: 128241 - DNA, 15 bp, Homo sapiens
attggcatagaagga

SEQ ID NO: 128242 - DNA, 15 bp, Homo sapiens
aattggcatagaagg

SEQ ID NO: 128243 - DNA, 15 bp, Homo sapiens
aaattggcatagaag

SEQ ID NO: 128244 - DNA, 15 bp, Homo sapiens
aaaattggcatagaa

SEQ ID NO: 128245 - DNA, 15 bp, Homo sapiens
caaaattggcataga

SEQ ID NO: 128246 - DNA, 15 bp, Homo sapiens
gcaaaattggcatag

SEQ ID NO: 128247 - DNA, 15 bp, Homo sapiens
agcaaaattggcata

SEQ ID NO: 128248 - DNA, 15 bp, Homo sapiens
cagcaaaattggcat

SEQ ID NO: 128249 - DNA, 15 bp, Homo sapiens
tcagcaaaattggca

SEQ ID NO: 128250 - DNA, 15 bp, Homo sapiens
ctcagcaaaattggc

SEQ ID NO: 128251 - DNA, 15 bp, Homo sapiens
tctcagcaaaattgg

SEQ ID NO: 128252 - DNA, 15 bp, Homo sapiens
ttctcagcaaaattg

SEQ ID NO: 128253 - DNA, 15 bp, Homo sapiens
attctcagcaaaatt

SEQ ID NO: 128254 - DNA, 15 bp, Homo sapiens
aattctcagcaaaat

SEQ ID NO: 128255 - DNA, 15 bp, Homo sapiens
aaattctcagcaaaa

SEQ ID NO: 128256 - DNA, 15 bp, Homo sapiens
aaaattctcagcaaa

SEQ ID NO: 128257 - DNA, 15 bp, Homo sapiens
taaaattctcagcaa

SEQ ID NO: 128258 - DNA, 15 bp, Homo sapiens
ttaaaattctcagca

SEQ ID NO: 128259 - DNA, 15 bp, Homo sapiens
attaaaattctcagc

SEQ ID NO: 128260 - DNA, 15 bp, Homo sapiens
gattaaaattctcag

SEQ ID NO: 128261 - DNA, 15 bp, Homo sapiens
tgattaaaattctca

SEQ ID NO: 128262 - DNA, 15 bp, Homo sapiens
atgattaaaattctc

SEQ ID NO: 128263 - DNA, 15 bp, Homo sapiens
tatgattaaaattct

SEQ ID NO: 128264 - DNA, 15 bp, Homo sapiens
ttatgattaaaattc

SEQ ID NO: 128265 - DNA, 15 bp, Homo sapiens
tttatgattaaaatt

SEQ ID NO: 128266 - DNA, 15 bp, Homo sapiens
ctttatgattaaaat

SEQ ID NO: 128267 - DNA, 15 bp, Homo sapiens
cctttatgattaaaa

SEQ ID NO: 128268 - DNA, 15 bp, Homo sapiens
ccctttatgattaaa

SEQ ID NO: 128269 - DNA, 15 bp, Homo sapiens
tccctttatgattaa

SEQ ID NO: 128270 - DNA, 15 bp, Homo sapiens
atccctttatgatta

SEQ ID NO: 128271 - DNA, 15 bp, Homo sapiens
catccctttatgatt

SEQ ID NO: 128272 - DNA, 15 bp, Homo sapiens
gcatccctttatgat

SEQ ID NO: 128273 - DNA, 15 bp, Homo sapiens
agcatccctttatga

SEQ ID NO: 128274 - DNA, 15 bp, Homo sapiens
tagcatccctttatg

SEQ ID NO: 128275 - DNA, 15 bp, Homo sapiens
ctagcatccctttat

SEQ ID NO: 128276 - DNA, 15 bp, Homo sapiens
tctagcatcccttta

SEQ ID NO: 128277 - DNA, 15 bp, Homo sapiens
atctagcatcccttt

SEQ ID NO: 128278 - DNA, 15 bp, Homo sapiens
aatctagcatccctt

SEQ ID NO: 128279 - DNA, 15 bp, Homo sapiens
aaatctagcatccct

SEQ ID NO: 128280 - DNA, 15 bp, Homo sapiens
aaaatctagcatccc

SEQ ID NO: 128281 - DNA, 15 bp, Homo sapiens
caaaatctagcatcc

SEQ ID NO: 128282 - DNA, 15 bp, Homo sapiens
acaaaatctagcatc

SEQ ID NO: 128283 - DNA, 15 bp, Homo sapiens
gacaaaatctagcat

SEQ ID NO: 128284 - DNA, 15 bp, Homo sapiens
tgacaaaatctagca

SEQ ID NO: 128285 - DNA, 15 bp, Homo sapiens
ctgacaaaatctagc

SEQ ID NO: 128286 - DNA, 15 bp, Homo sapiens
tctgacaaaatctag

SEQ ID NO: 128287 - DNA, 15 bp, Homo sapiens
ctctgacaaaatcta

SEQ ID NO: 128288 - DNA, 15 bp, Homo sapiens
cctctgacaaaatct

SEQ ID NO: 128289 - DNA, 15 bp, Homo sapiens
gcctctgacaaaatc

SEQ ID NO: 128290 - DNA, 15 bp, Homo sapiens
agcctctgacaaaat

SEQ ID NO: 128291 - DNA, 15 bp, Homo sapiens
aagcctctgacaaaa

SEQ ID NO: 128292 - DNA, 15 bp, Homo sapiens
aaagcctctgacaaa

SEQ ID NO: 128293 - DNA, 15 bp, Homo sapiens
aaaagcctctgacaa

SEQ ID NO: 128294 - DNA, 15 bp, Homo sapiens
aaaaagcctctgaca

SEQ ID NO: 128295 - DNA, 15 bp, Homo sapiens
gaaaaagcctctgac

SEQ ID NO: 128296 - DNA, 15 bp, Homo sapiens
agaaaaagcctctga

SEQ ID NO: 128297 - DNA, 15 bp, Homo sapiens
cagaaaaagcctctg

SEQ ID NO: 128298 - DNA, 15 bp, Homo sapiens
tcagaaaaagcctct

SEQ ID NO: 128299 - DNA, 15 bp, Homo sapiens
ctcagaaaaagcctc

SEQ ID NO: 128300 - DNA, 15 bp, Homo sapiens
actcagaaaaagcct

SEQ ID NO: 128301 - DNA, 15 bp, Homo sapiens
gactcagaaaaagcc

SEQ ID NO: 128302 - DNA, 15 bp, Homo sapiens
agactcagaaaaagc

SEQ ID NO: 128303 - DNA, 15 bp, Homo sapiens
cagactcagaaaaag

SEQ ID NO: 128304 - DNA, 15 bp, Homo sapiens
acagactcagaaaaa

SEQ ID NO: 128305 - DNA, 15 bp, Homo sapiens
aacagactcagaaaa

SEQ ID NO: 128306 - DNA, 15 bp, Homo sapiens
caacagactcagaaa

SEQ ID NO: 128307 - DNA, 15 bp, Homo sapiens
tcaacagactcagaa

SEQ ID NO: 128308 - DNA, 15 bp, Homo sapiens
ctcaacagactcaga

SEQ ID NO: 128309 - DNA, 15 bp, Homo sapiens
cctcaacagactcag

SEQ ID NO: 128310 - DNA, 15 bp, Homo sapiens
acctcaacagactca

SEQ ID NO: 128311 - DNA, 15 bp, Homo sapiens
cacctcaacagactc

SEQ ID NO: 128312 - DNA, 15 bp, Homo sapiens
tcacctcaacagact

SEQ ID NO: 128313 - DNA, 15 bp, Homo sapiens
atcacctcaacagac

SEQ ID NO: 128314 - DNA, 15 bp, Homo sapiens
gatcacctcaacaga

SEQ ID NO: 128315 - DNA, 15 bp, Homo sapiens
tgatcacctcaacag

SEQ ID NO: 128316 - DNA, 15 bp, Homo sapiens
atgatcacctcaaca

SEQ ID NO: 128317 - DNA, 15 bp, Homo sapiens
catgatcacctcaac

SEQ ID NO: 128318 - DNA, 15 bp, Homo sapiens
acatgatcacctcaa

SEQ ID NO: 128319 - DNA, 15 bp, Homo sapiens
cacatgatcacctca

SEQ ID NO: 128320 - DNA, 15 bp, Homo sapiens
tcacatgatcacctc

SEQ ID NO: 128321 - DNA, 15 bp, Homo sapiens
atcacatgatcacct

SEQ ID NO: 128322 - DNA, 15 bp, Homo sapiens
aatcacatgatcacc

SEQ ID NO: 128323 - DNA, 15 bp, Homo sapiens
aaatcacatgatcac

SEQ ID NO: 128324 - DNA, 15 bp, Homo sapiens
aaaatcacatgatca

SEQ ID NO: 128325 - DNA, 15 bp, Homo sapiens
aaaaatcacatgatc

SEQ ID NO: 128326 - DNA, 15 bp, Homo sapiens
caaaaatcacatgat

SEQ ID NO: 128327 - DNA, 15 bp, Homo sapiens
acaaaaatcacatga

SEQ ID NO: 128328 - DNA, 15 bp, Homo sapiens
aacaaaaatcacatg

SEQ ID NO: 128329 - DNA, 15 bp, Homo sapiens
aaacaaaaatcacat

SEQ ID NO: 128330 - DNA, 15 bp, Homo sapiens
aaaacaaaaatcaca

SEQ ID NO: 128331 - DNA, 15 bp, Homo sapiens
taaaacaaaaatcac

SEQ ID NO: 128332 - DNA, 15 bp, Homo sapiens
ttaaaacaaaaatca

SEQ ID NO: 128333 - DNA, 15 bp, Homo sapiens
attaaaacaaaaatc

SEQ ID NO: 128334 - DNA, 15 bp, Homo sapiens
aattaaaacaaaaat

SEQ ID NO: 128335 - DNA, 15 bp, Homo sapiens
gaattaaaacaaaaa

SEQ ID NO: 128336 - DNA, 15 bp, Homo sapiens
agaattaaaacaaaa

SEQ ID NO: 128337 - DNA, 15 bp, Homo sapiens
cagaattaaaacaaa

SEQ ID NO: 128338 - DNA, 15 bp, Homo sapiens
acagaattaaaacaa

SEQ ID NO: 128339 - DNA, 15 bp, Homo sapiens
aacagaattaaaaca

SEQ ID NO: 128340 - DNA, 15 bp, Homo sapiens
aaacagaattaaaac

SEQ ID NO: 128341 - DNA, 15 bp, Homo sapiens
taaacagaattaaaa

SEQ ID NO: 128342 - DNA, 15 bp, Homo sapiens
ataaacagaattaaa

SEQ ID NO: 128343 - DNA, 15 bp, Homo sapiens
cataaacagaattaa

SEQ ID NO: 128344 - DNA, 15 bp, Homo sapiens
acataaacagaatta

SEQ ID NO: 128345 - DNA, 15 bp, Homo sapiens
cacataaacagaatt

SEQ ID NO: 128346 - DNA, 15 bp, Homo sapiens
ccacataaacagaat

SEQ ID NO: 128347 - DNA, 15 bp, Homo sapiens
accacataaacagaa

SEQ ID NO: 128348 - DNA, 15 bp, Homo sapiens
caccacataaacaga

SEQ ID NO: 128349 - DNA, 15 bp, Homo sapiens
acaccacataaacag

SEQ ID NO: 128350 - DNA, 15 bp, Homo sapiens
tacaccacataaaca

SEQ ID NO: 128351 - DNA, 15 bp, Homo sapiens
atacaccacataaac

SEQ ID NO: 128352 - DNA, 15 bp, Homo sapiens
gatacaccacataaa

SEQ ID NO: 128353 - DNA, 15 bp, Homo sapiens
tgatacaccacataa

SEQ ID NO: 128354 - DNA, 15 bp, Homo sapiens
gtgatacaccacata

SEQ ID NO: 128355 - DNA, 15 bp, Homo sapiens
tgtgatacaccacat

SEQ ID NO: 128356 - DNA, 15 bp, Homo sapiens
atgtgatacaccaca

SEQ ID NO: 128357 - DNA, 15 bp, Homo sapiens
aatgtgatacaccac

SEQ ID NO: 128358 - DNA, 15 bp, Homo sapiens
aaatgtgatacacca

SEQ ID NO: 128359 - DNA, 15 bp, Homo sapiens
taaatgtgatacacc

SEQ ID NO: 128360 - DNA, 15 bp, Homo sapiens
ataaatgtgatacac

SEQ ID NO: 128361 - DNA, 15 bp, Homo sapiens
aataaatgtgataca

SEQ ID NO: 128362 - DNA, 15 bp, Homo sapiens
caataaatgtgatac

SEQ ID NO: 128363 - DNA, 15 bp, Homo sapiens
tcaataaatgtgata

SEQ ID NO: 128364 - DNA, 15 bp, Homo sapiens
gtcaataaatgtgat

SEQ ID NO: 128365 - DNA, 15 bp, Homo sapiens
agtcaataaatgtga

SEQ ID NO: 128366 - DNA, 15 bp, Homo sapiens
aagtcaataaatgtg

SEQ ID NO: 128367 - DNA, 15 bp, Homo sapiens
caagtcaataaatgt

SEQ ID NO: 128368 - DNA, 15 bp, Homo sapiens
acaagtcaataaatg

SEQ ID NO: 128369 - DNA, 15 bp, Homo sapiens
cacaagtcaataaat

SEQ ID NO: 128370 - DNA, 15 bp, Homo sapiens
acacaagtcaataaa

SEQ ID NO: 128371 - DNA, 15 bp, Homo sapiens
tacacaagtcaataa

SEQ ID NO: 128372 - DNA, 15 bp, Homo sapiens
atacacaagtcaata

SEQ ID NO: 128373 - DNA, 15 bp, Homo sapiens
catacacaagtcaat

SEQ ID NO: 128374 - DNA, 15 bp, Homo sapiens
acatacacaagtcaa

SEQ ID NO: 128375 - DNA, 15 bp, Homo sapiens
aacatacacaagtca

SEQ ID NO: 128376 - DNA, 15 bp, Homo sapiens
taacatacacaagtc

SEQ ID NO: 128377 - DNA, 15 bp, Homo sapiens
ttaacatacacaagt

SEQ ID NO: 128378 - DNA, 15 bp, Homo sapiens
tttaacatacacaag

SEQ ID NO: 128379 - DNA, 15 bp, Homo sapiens
gtttaacatacacaa

SEQ ID NO: 128380 - DNA, 15 bp, Homo sapiens
ggtttaacatacaca

SEQ ID NO: 128381 - DNA, 15 bp, Homo sapiens
tggtttaacatacac

SEQ ID NO: 128382 - DNA, 15 bp, Homo sapiens
atggtttaacataca

SEQ ID NO: 128383 - DNA, 15 bp, Homo sapiens
gatggtttaacatac

SEQ ID NO: 128384 - DNA, 15 bp, Homo sapiens
ggatggtttaacata

SEQ ID NO: 128385 - DNA, 15 bp, Homo sapiens
gggatggtttaacat

SEQ ID NO: 128386 - DNA, 15 bp, Homo sapiens
agggatggtttaaca

SEQ ID NO: 128387 - DNA, 15 bp, Homo sapiens
cagggatggtttaac

SEQ ID NO: 128388 - DNA, 15 bp, Homo sapiens
gcagggatggtttaa

SEQ ID NO: 128389 - DNA, 15 bp, Homo sapiens
tgcagggatggttta

SEQ ID NO: 128390 - DNA, 15 bp, Homo sapiens
atgcagggatggttt

SEQ ID NO: 128391 - DNA, 15 bp, Homo sapiens
gatgcagggatggtt

SEQ ID NO: 128392 - DNA, 15 bp, Homo sapiens
ggatgcagggatggt

SEQ ID NO: 128393 - DNA, 15 bp, Homo sapiens
gggatgcagggatgg

SEQ ID NO: 128394 - DNA, 15 bp, Homo sapiens
agggatgcagggatg

SEQ ID NO: 128395 - DNA, 15 bp, Homo sapiens
tagggatgcagggat

SEQ ID NO: 128396 - DNA, 15 bp, Homo sapiens
ctagggatgcaggga

SEQ ID NO: 128397 - DNA, 15 bp, Homo sapiens
actagggatgcaggg

SEQ ID NO: 128398 - DNA, 15 bp, Homo sapiens
tactagggatgcagg

SEQ ID NO: 128399 - DNA, 15 bp, Homo sapiens
atactagggatgcag

SEQ ID NO: 128400 - DNA, 15 bp, Homo sapiens
catactagggatgca

SEQ ID NO: 128401 - DNA, 15 bp, Homo sapiens
tcatactagggatgc

SEQ ID NO: 128402 - DNA, 15 bp, Homo sapiens
ttcatactagggatg

SEQ ID NO: 128403 - DNA, 15 bp, Homo sapiens
tttcatactagggat

SEQ ID NO: 128404 - DNA, 15 bp, Homo sapiens
gtttcatactaggga

SEQ ID NO: 128405 - DNA, 15 bp, Homo sapiens
ggtttcatactaggg

SEQ ID NO: 128406 - DNA, 15 bp, Homo sapiens
gggtttcatactagg

SEQ ID NO: 128407 - DNA, 15 bp, Homo sapiens
tgggtttcatactag

SEQ ID NO: 128408 - DNA, 15 bp, Homo sapiens
gtgggtttcatacta

SEQ ID NO: 128409 - DNA, 15 bp, Homo sapiens
agtgggtttcatact

SEQ ID NO: 128410 - DNA, 15 bp, Homo sapiens
aagtgggtttcatac

SEQ ID NO: 128411 - DNA, 15 bp, Homo sapiens
caagtgggtttcata

SEQ ID NO: 128412 - DNA, 15 bp, Homo sapiens
tcaagtgggtttcat

SEQ ID NO: 128413 - DNA, 15 bp, Homo sapiens
atcaagtgggtttca

SEQ ID NO: 128414 - DNA, 15 bp, Homo sapiens
gatcaagtgggtttc

SEQ ID NO: 128415 - DNA, 15 bp, Homo sapiens
tgatcaagtgggttt

SEQ ID NO: 128416 - DNA, 15 bp, Homo sapiens
atgatcaagtgggtt

SEQ ID NO: 128417 - DNA, 15 bp, Homo sapiens
catgatcaagtgggt

SEQ ID NO: 128418 - DNA, 15 bp, Homo sapiens
ccatgatcaagtggg

SEQ ID NO: 128419 - DNA, 15 bp, Homo sapiens
accatgatcaagtgg

SEQ ID NO: 128420 - DNA, 15 bp, Homo sapiens
aaccatgatcaagtg

SEQ ID NO: 128421 - DNA, 15 bp, Homo sapiens
aaaccatgatcaagt

SEQ ID NO: 128422 - DNA, 15 bp, Homo sapiens
taaaccatgatcaag

SEQ ID NO: 128423 - DNA, 15 bp, Homo sapiens
ataaaccatgatcaa

SEQ ID NO: 128424 - DNA, 15 bp, Homo sapiens
aataaaccatgatca

SEQ ID NO: 128425 - DNA, 15 bp, Homo sapiens
caataaaccatgatc

SEQ ID NO: 128426 - DNA, 15 bp, Homo sapiens
acaataaaccatgat

SEQ ID NO: 128427 - DNA, 15 bp, Homo sapiens
gacaataaaccatga

SEQ ID NO: 128428 - DNA, 15 bp, Homo sapiens
agacaataaaccatg

SEQ ID NO: 128429 - DNA, 15 bp, Homo sapiens
aagacaataaaccat

SEQ ID NO: 128430 - DNA, 15 bp, Homo sapiens
aaagacaataaacca

SEQ ID NO: 128431 - DNA, 15 bp, Homo sapiens
aaaagacaataaacc

SEQ ID NO: 128432 - DNA, 15 bp, Homo sapiens
aaaaagacaataaac

SEQ ID NO: 128433 - DNA, 15 bp, Homo sapiens
caaaaagacaataaa

SEQ ID NO: 128434 - DNA, 15 bp, Homo sapiens
tcaaaaagacaataa

SEQ ID NO: 128435 - DNA, 15 bp, Homo sapiens
atcaaaaagacaata

SEQ ID NO: 128436 - DNA, 15 bp, Homo sapiens
tatcaaaaagacaat

SEQ ID NO: 128437 - DNA, 15 bp, Homo sapiens
atatcaaaaagacaa

SEQ ID NO: 128438 - DNA, 15 bp, Homo sapiens
tatatcaaaaagaca

SEQ ID NO: 128439 - DNA, 15 bp, Homo sapiens
gtatatcaaaaagac

SEQ ID NO: 128440 - DNA, 15 bp, Homo sapiens
agtatatcaaaaaga

SEQ ID NO: 128441 - DNA, 15 bp, Homo sapiens
tagtatatcaaaaag

SEQ ID NO: 128442 - DNA, 15 bp, Homo sapiens
atagtatatcaaaaa

SEQ ID NO: 128443 - DNA, 15 bp, Homo sapiens
aatagtatatcaaaa

SEQ ID NO: 128444 - DNA, 15 bp, Homo sapiens
caatagtatatcaaa

SEQ ID NO: 128445 - DNA, 15 bp, Homo sapiens
ccaatagtatatcaa

SEQ ID NO: 128446 - DNA, 15 bp, Homo sapiens
tccaatagtatatca

SEQ ID NO: 128447 - DNA, 15 bp, Homo sapiens
atccaatagtatatc

SEQ ID NO: 128448 - DNA, 15 bp, Homo sapiens
aatccaatagtatat

SEQ ID NO: 128449 - DNA, 15 bp, Homo sapiens
gaatccaatagtata

SEQ ID NO: 128450 - DNA, 15 bp, Homo sapiens
tgaatccaatagtat

SEQ ID NO: 128451 - DNA, 15 bp, Homo sapiens
ctgaatccaatagta

SEQ ID NO: 128452 - DNA, 15 bp, Homo sapiens
actgaatccaatagt

SEQ ID NO: 128453 - DNA, 15 bp, Homo sapiens
aactgaatccaatag

SEQ ID NO: 128454 - DNA, 15 bp, Homo sapiens
taactgaatccaata

SEQ ID NO: 128455 - DNA, 15 bp, Homo sapiens
ctaactgaatccaat

SEQ ID NO: 128456 - DNA, 15 bp, Homo sapiens
gctaactgaatccaa

SEQ ID NO: 128457 - DNA, 15 bp, Homo sapiens
agctaactgaatcca

SEQ ID NO: 128458 - DNA, 15 bp, Homo sapiens
tagctaactgaatcc

SEQ ID NO: 128459 - DNA, 15 bp, Homo sapiens
ctagctaactgaatc

SEQ ID NO: 128460 - DNA, 15 bp, Homo sapiens
actagctaactgaat

SEQ ID NO: 128461 - DNA, 15 bp, Homo sapiens
tactagctaactgaa

SEQ ID NO: 128462 - DNA, 15 bp, Homo sapiens
atactagctaactga

SEQ ID NO: 128463 - DNA, 15 bp, Homo sapiens
aatactagctaactg

SEQ ID NO: 128464 - DNA, 15 bp, Homo sapiens
aaatactagctaact

SEQ ID NO: 128465 - DNA, 15 bp, Homo sapiens
aaaatactagctaac

SEQ ID NO: 128466 - DNA, 15 bp, Homo sapiens
caaaatactagctaa

SEQ ID NO: 128467 - DNA, 15 bp, Homo sapiens
acaaaatactagcta

SEQ ID NO: 128468 - DNA, 15 bp, Homo sapiens
aacaaaatactagct

SEQ ID NO: 128469 - DNA, 15 bp, Homo sapiens
caacaaaatactagc

SEQ ID NO: 128470 - DNA, 15 bp, Homo sapiens
tcaacaaaatactag

SEQ ID NO: 128471 - DNA, 15 bp, Homo sapiens
ctcaacaaaatacta

SEQ ID NO: 128472 - DNA, 15 bp, Homo sapiens
cctcaacaaaatact

SEQ ID NO: 128473 - DNA, 15 bp, Homo sapiens
tcctcaacaaaatac

SEQ ID NO: 128474 - DNA, 15 bp, Homo sapiens
atcctcaacaaaata

SEQ ID NO: 128475 - DNA, 15 bp, Homo sapiens
aatcctcaacaaaat

SEQ ID NO: 128476 - DNA, 15 bp, Homo sapiens
aaatcctcaacaaaa

SEQ ID NO: 128477 - DNA, 15 bp, Homo sapiens
aaaatcctcaacaaa

SEQ ID NO: 128478 - DNA, 15 bp, Homo sapiens
aaaaatcctcaacaa

SEQ ID NO: 128479 - DNA, 15 bp, Homo sapiens
caaaaatcctcaaca

SEQ ID NO: 128480 - DNA, 15 bp, Homo sapiens
gcaaaaatcctcaac

SEQ ID NO: 128481 - DNA, 15 bp, Homo sapiens
tgcaaaaatcctcaa

SEQ ID NO: 128482 - DNA, 15 bp, Homo sapiens
atgcaaaaatcctca

SEQ ID NO: 128483 - DNA, 15 bp, Homo sapiens
gatgcaaaaatcctc

SEQ ID NO: 128484 - DNA, 15 bp, Homo sapiens
agatgcaaaaatcct

SEQ ID NO: 128485 - DNA, 15 bp, Homo sapiens
tagatgcaaaaatcc

SEQ ID NO: 128486 - DNA, 15 bp, Homo sapiens
atagatgcaaaaatc

SEQ ID NO: 128487 - DNA, 15 bp, Homo sapiens
tatagatgcaaaaat

SEQ ID NO: 128488 - DNA, 15 bp, Homo sapiens
atatagatgcaaaaa

SEQ ID NO: 128489 - DNA, 15 bp, Homo sapiens
gatatagatgcaaaa

SEQ ID NO: 128490 - DNA, 15 bp, Homo sapiens
tgatatagatgcaaa

SEQ ID NO: 128491 - DNA, 15 bp, Homo sapiens
ctgatatagatgcaa

SEQ ID NO: 128492 - DNA, 15 bp, Homo sapiens
cctgatatagatgca

SEQ ID NO: 128493 - DNA, 15 bp, Homo sapiens
ccctgatatagatgc

SEQ ID NO: 128494 - DNA, 15 bp, Homo sapiens
tccctgatatagatg

SEQ ID NO: 128495 - DNA, 15 bp, Homo sapiens
atccctgatatagat

SEQ ID NO: 128496 - DNA, 15 bp, Homo sapiens
aatccctgatataga

SEQ ID NO: 128497 - DNA, 15 bp, Homo sapiens
aaatccctgatatag

SEQ ID NO: 128498 - DNA, 15 bp, Homo sapiens
caaatccctgatata

SEQ ID NO: 128499 - DNA, 15 bp, Homo sapiens
ccaaatccctgatat

SEQ ID NO: 128500 - DNA, 15 bp, Homo sapiens
accaaatccctgata

SEQ ID NO: 128501 - DNA, 15 bp, Homo sapiens
gaccaaatccctgat

SEQ ID NO: 128502 - DNA, 15 bp, Homo sapiens
agaccaaatccctga

SEQ ID NO: 128503 - DNA, 15 bp, Homo sapiens
cagaccaaatccctg

SEQ ID NO: 128504 - DNA, 15 bp, Homo sapiens
acagaccaaatccct

SEQ ID NO: 128505 - DNA, 15 bp, Homo sapiens
tacagaccaaatccc

SEQ ID NO: 128506 - DNA, 15 bp, Homo sapiens
ctacagaccaaatcc

SEQ ID NO: 128507 - DNA, 15 bp, Homo sapiens
actacagaccaaatc

SEQ ID NO: 128508 - DNA, 15 bp, Homo sapiens
aactacagaccaaat

SEQ ID NO: 128509 - DNA, 15 bp, Homo sapiens
aaactacagaccaaa

SEQ ID NO: 128510 - DNA, 15 bp, Homo sapiens
aaaactacagaccaa

SEQ ID NO: 128511 - DNA, 15 bp, Homo sapiens
gaaaactacagacca

SEQ ID NO: 128512 - DNA, 15 bp, Homo sapiens
agaaaactacagacc

SEQ ID NO: 128513 - DNA, 15 bp, Homo sapiens
aagaaaactacagac

SEQ ID NO: 128514 - DNA, 15 bp, Homo sapiens
aaagaaaactacaga

SEQ ID NO: 128515 - DNA, 15 bp, Homo sapiens
aaaagaaaactacag

SEQ ID NO: 128516 - DNA, 15 bp, Homo sapiens
aaaaagaaaactaca

SEQ ID NO: 128517 - DNA, 15 bp, Homo sapiens
aaaaaagaaaactac

SEQ ID NO: 128518 - DNA, 15 bp, Homo sapiens
caaaaaagaaaacta

SEQ ID NO: 128519 - DNA, 15 bp, Homo sapiens
acaaaaaagaaaact

SEQ ID NO: 128520 - DNA, 15 bp, Homo sapiens
ataacaaaaaagaaa

SEQ ID NO: 128521 - DNA, 15 bp, Homo sapiens
cataacaaaaaagaa

SEQ ID NO: 128522 - DNA, 15 bp, Homo sapiens
acataacaaaaaaga

SEQ ID NO: 128523 - DNA, 15 bp, Homo sapiens
gacataacaaaaaag

SEQ ID NO: 128524 - DNA, 15 bp, Homo sapiens
ggacataacaaaaaa

SEQ ID NO: 128525 - DNA, 15 bp, Homo sapiens
aggacataacaaaaa

SEQ ID NO: 128526 - DNA, 15 bp, Homo sapiens
aaggacataacaaaa

SEQ ID NO: 128527 - DNA, 15 bp, Homo sapiens
aaaggacataacaaa

SEQ ID NO: 128528 - DNA, 15 bp, Homo sapiens
gaaaggacataacaa

SEQ ID NO: 128529 - DNA, 15 bp, Homo sapiens
ggaaaggacataaca

SEQ ID NO: 128530 - DNA, 15 bp, Homo sapiens
aggaaaggacataac

SEQ ID NO: 128531 - DNA, 15 bp, Homo sapiens
caggaaaggacataa

SEQ ID NO: 128532 - DNA, 15 bp, Homo sapiens
ccaggaaaggacata

SEQ ID NO: 128533 - DNA, 15 bp, Homo sapiens
accaggaaaggacat

SEQ ID NO: 128534 - DNA, 15 bp, Homo sapiens
aaccaggaaaggaca

SEQ ID NO: 128535 - DNA, 15 bp, Homo sapiens
aaaccaggaaaggac

SEQ ID NO: 128536 - DNA, 15 bp, Homo sapiens
aaaaccaggaaagga

SEQ ID NO: 128537 - DNA, 15 bp, Homo sapiens
caaaaccaggaaagg

SEQ ID NO: 128538 - DNA, 15 bp, Homo sapiens
ccaaaaccaggaaag

SEQ ID NO: 128539 - DNA, 15 bp, Homo sapiens
accaaaaccaggaaa

SEQ ID NO: 128540 - DNA, 15 bp, Homo sapiens
taccaaaaccaggaa

SEQ ID NO: 128541 - DNA, 15 bp, Homo sapiens
ataccaaaaccagga

SEQ ID NO: 128542 - DNA, 15 bp, Homo sapiens
aataccaaaaccagg

SEQ ID NO: 128543 - DNA, 15 bp, Homo sapiens
taataccaaaaccag

SEQ ID NO: 128544 - DNA, 15 bp, Homo sapiens
agtcaaaatataagc

SEQ ID NO: 128545 - DNA, 15 bp, Homo sapiens
tagtcaaaatataag

SEQ ID NO: 128546 - DNA, 15 bp, Homo sapiens
ttagtcaaaatataa

SEQ ID NO: 128547 - DNA, 15 bp, Homo sapiens
tttagtcaaaatata

SEQ ID NO: 128548 - DNA, 15 bp, Homo sapiens
ttttagtcaaaatat

SEQ ID NO: 128549 - DNA, 15 bp, Homo sapiens
gttttagtcaaaata

SEQ ID NO: 128550 - DNA, 15 bp, Homo sapiens
tgttttagtcaaaat

SEQ ID NO: 128551 - DNA, 15 bp, Homo sapiens
ttgttttagtcaaaa

SEQ ID NO: 128552 - DNA, 15 bp, Homo sapiens
attgttttagtcaaa

SEQ ID NO: 128553 - DNA, 15 bp, Homo sapiens
tattgttttagtcaa

SEQ ID NO: 128554 - DNA, 15 bp, Homo sapiens
atattgttttagtca

SEQ ID NO: 128555 - DNA, 15 bp, Homo sapiens
aatattgttttagtc

SEQ ID NO: 128556 - DNA, 15 bp, Homo sapiens
aaatattgttttagt

SEQ ID NO: 128557 - DNA, 15 bp, Homo sapiens
caaatattgttttag

SEQ ID NO: 128558 - DNA, 15 bp, Homo sapiens
acaaatattgtttta

SEQ ID NO: 128559 - DNA, 15 bp, Homo sapiens
gacaaatattgtttt

SEQ ID NO: 128560 - DNA, 15 bp, Homo sapiens
agacaaatattgttt

SEQ ID NO: 128561 - DNA, 15 bp, Homo sapiens
aagacaaatattgtt

SEQ ID NO: 128562 - DNA, 15 bp, Homo sapiens
aaagacaaatattgt

SEQ ID NO: 128563 - DNA, 15 bp, Homo sapiens
caaagacaaatattg

SEQ ID NO: 128564 - DNA, 15 bp, Homo sapiens
acaaagacaaatatt

SEQ ID NO: 128565 - DNA, 15 bp, Homo sapiens
tacaaagacaaatat

SEQ ID NO: 128566 - DNA, 15 bp, Homo sapiens
ttacaaagacaaata

SEQ ID NO: 128567 - DNA, 15 bp, Homo sapiens
tttacaaagacaaat

SEQ ID NO: 128568 - DNA, 15 bp, Homo sapiens
atttacaaagacaaa

SEQ ID NO: 128569 - DNA, 15 bp, Homo sapiens
aatttacaaagacaa

SEQ ID NO: 128570 - DNA, 15 bp, Homo sapiens
taatttacaaagaca

SEQ ID NO: 128571 - DNA, 15 bp, Homo sapiens
ttaatttacaaagac

SEQ ID NO: 128572 - DNA, 15 bp, Homo sapiens
gttaatttacaaaga

SEQ ID NO: 128573 - DNA, 15 bp, Homo sapiens
cgttaatttacaaag

SEQ ID NO: 128574 - DNA, 15 bp, Homo sapiens
gcgttaatttacaaa

SEQ ID NO: 128575 - DNA, 15 bp, Homo sapiens
agcgttaatttacaa

SEQ ID NO: 128576 - DNA, 15 bp, Homo sapiens
tagcgttaatttaca

SEQ ID NO: 128577 - DNA, 15 bp, Homo sapiens
ttagcgttaatttac

SEQ ID NO: 128578 - DNA, 15 bp, Homo sapiens
tttagcgttaattta

SEQ ID NO: 128579 - DNA, 15 bp, Homo sapiens
gtttagcgttaattt

SEQ ID NO: 128580 - DNA, 15 bp, Homo sapiens
agtttagcgttaatt

SEQ ID NO: 128581 - DNA, 15 bp, Homo sapiens
aagtttagcgttaat

SEQ ID NO: 128582 - DNA, 15 bp, Homo sapiens
gaagtttagcgttaa

SEQ ID NO: 128583 - DNA, 15 bp, Homo sapiens
tgaagtttagcgtta

SEQ ID NO: 128584 - DNA, 15 bp, Homo sapiens
gtgaagtttagcgtt

SEQ ID NO: 128585 - DNA, 15 bp, Homo sapiens
ggtgaagtttagcgt

SEQ ID NO: 128586 - DNA, 15 bp, Homo sapiens
aggtgaagtttagcg

SEQ ID NO: 128587 - DNA, 15 bp, Homo sapiens
aaggtgaagtttagc

SEQ ID NO: 128588 - DNA, 15 bp, Homo sapiens
taaggtgaagtttag

SEQ ID NO: 128589 - DNA, 15 bp, Homo sapiens
ctaaggtgaagttta

SEQ ID NO: 128590 - DNA, 15 bp, Homo sapiens
cctaaggtgaagttt

SEQ ID NO: 128591 - DNA, 15 bp, Homo sapiens
acctaaggtgaagtt

SEQ ID NO: 128592 - DNA, 15 bp, Homo sapiens
aacctaaggtgaagt

SEQ ID NO: 128593 - DNA, 15 bp, Homo sapiens
caacctaaggtgaag

SEQ ID NO: 128594 - DNA, 15 bp, Homo sapiens
ccaacctaaggtgaa

SEQ ID NO: 128595 - DNA, 15 bp, Homo sapiens
accaacctaaggtga

SEQ ID NO: 128596 - DNA, 15 bp, Homo sapiens
taccaacctaaggtg

SEQ ID NO: 128597 - DNA, 15 bp, Homo sapiens
ctaccaacctaaggt

SEQ ID NO: 128598 - DNA, 15 bp, Homo sapiens
actaccaacctaagg

SEQ ID NO: 128599 - DNA, 15 bp, Homo sapiens
gactaccaacctaag

SEQ ID NO: 128600 - DNA, 15 bp, Homo sapiens
agactaccaacctaa

SEQ ID NO: 128601 - DNA, 15 bp, Homo sapiens
tagactaccaaccta

SEQ ID NO: 128602 - DNA, 15 bp, Homo sapiens
atagactaccaacct

SEQ ID NO: 128603 - DNA, 15 bp, Homo sapiens
tatagactaccaacc

SEQ ID NO: 128604 - DNA, 15 bp, Homo sapiens
atatagactaccaac

SEQ ID NO: 128605 - DNA, 15 bp, Homo sapiens
aatatagactaccaa

SEQ ID NO: 128606 - DNA, 15 bp, Homo sapiens
taatatagactacca

SEQ ID NO: 128607 - DNA, 15 bp, Homo sapiens
ttaatatagactacc

SEQ ID NO: 128608 - DNA, 15 bp, Homo sapiens
tttaatatagactac

SEQ ID NO: 128609 - DNA, 15 bp, Homo sapiens
atttaatatagacta

SEQ ID NO: 128610 - DNA, 15 bp, Homo sapiens
aatttaatatagact

SEQ ID NO: 128611 - DNA, 15 bp, Homo sapiens
caatttaatatagac

SEQ ID NO: 128612 - DNA, 15 bp, Homo sapiens
ccaatttaatataga

SEQ ID NO: 128613 - DNA, 15 bp, Homo sapiens
cccaatttaatatag

SEQ ID NO: 128614 - DNA, 15 bp, Homo sapiens
tcccaatttaatata

SEQ ID NO: 128615 - DNA, 15 bp, Homo sapiens
gtcccaatttaatat

SEQ ID NO: 128616 - DNA, 15 bp, Homo sapiens
ggtcccaatttaata

SEQ ID NO: 128617 - DNA, 15 bp, Homo sapiens
tggtcccaatttaat

SEQ ID NO: 128618 - DNA, 15 bp, Homo sapiens
atggtcccaatttaa

SEQ ID NO: 128619 - DNA, 15 bp, Homo sapiens
aatggtcccaattta

SEQ ID NO: 128620 - DNA, 15 bp, Homo sapiens
aaatggtcccaattt

SEQ ID NO: 128621 - DNA, 15 bp, Homo sapiens
aaaatggtcccaatt

SEQ ID NO: 128622 - DNA, 15 bp, Homo sapiens
caaaatggtcccaat

SEQ ID NO: 128623 - DNA, 15 bp, Homo sapiens
ccaaaatggtcccaa

SEQ ID NO: 128624 - DNA, 15 bp, Homo sapiens
cccaaaatggtccca

SEQ ID NO: 128625 - DNA, 15 bp, Homo sapiens
acccaaaatggtccc

SEQ ID NO: 128626 - DNA, 15 bp, Homo sapiens
tacccaaaatggtcc

SEQ ID NO: 128627 - DNA, 15 bp, Homo sapiens
ctacccaaaatggtc

SEQ ID NO: 128628 - DNA, 15 bp, Homo sapiens
tctacccaaaatggt

SEQ ID NO: 128629 - DNA, 15 bp, Homo sapiens
atctacccaaaatgg

SEQ ID NO: 128630 - DNA, 15 bp, Homo sapiens
aatctacccaaaatg

SEQ ID NO: 128631 - DNA, 15 bp, Homo sapiens
caatctacccaaaat

SEQ ID NO: 128632 - DNA, 15 bp, Homo sapiens
acaatctacccaaaa

SEQ ID NO: 128633 - DNA, 15 bp, Homo sapiens
tacaatctacccaaa

SEQ ID NO: 128634 - DNA, 15 bp, Homo sapiens
atacaatctacccaa

SEQ ID NO: 128635 - DNA, 15 bp, Homo sapiens
tatacaatctaccca

SEQ ID NO: 128636 - DNA, 15 bp, Homo sapiens
atatacaatctaccc

SEQ ID NO: 128637 - DNA, 15 bp, Homo sapiens
tatatacaatctacc

SEQ ID NO: 128638 - DNA, 15 bp, Homo sapiens
atatatacaatctac

SEQ ID NO: 128639 - DNA, 15 bp, Homo sapiens
catatatacaatcta

SEQ ID NO: 128640 - DNA, 15 bp, Homo sapiens
acatatatacaatct

SEQ ID NO: 128641 - DNA, 15 bp, Homo sapiens
aacatatatacaatc

SEQ ID NO: 128642 - DNA, 15 bp, Homo sapiens
caacatatatacaat

SEQ ID NO: 128643 - DNA, 15 bp, Homo sapiens
acaacatatatacaa

SEQ ID NO: 128644 - DNA, 15 bp, Homo sapiens
aacaacatatataca

SEQ ID NO: 128645 - DNA, 15 bp, Homo sapiens
taacaacatatatac

SEQ ID NO: 128646 - DNA, 15 bp, Homo sapiens
ttaacaacatatata

SEQ ID NO: 128647 - DNA, 15 bp, Homo sapiens
gttaacaacatatat

SEQ ID NO: 128648 - DNA, 15 bp, Homo sapiens
tgttaacaacatata

SEQ ID NO: 128649 - DNA, 15 bp, Homo sapiens
ttgttaacaacatat

SEQ ID NO: 128650 - DNA, 15 bp, Homo sapiens
tttgttaacaacata

SEQ ID NO: 128651 - DNA, 15 bp, Homo sapiens
ctttgttaacaacat

SEQ ID NO: 128652 - DNA, 15 bp, Homo sapiens
actttgttaacaaca

SEQ ID NO: 128653 - DNA, 15 bp, Homo sapiens
tactttgttaacaac

SEQ ID NO: 128654 - DNA, 15 bp, Homo sapiens
ttactttgttaacaa

SEQ ID NO: 128655 - DNA, 15 bp, Homo sapiens
attactttgttaaca

SEQ ID NO: 128656 - DNA, 15 bp, Homo sapiens
aattactttgttaac

SEQ ID NO: 128657 - DNA, 15 bp, Homo sapiens
caattactttgttaa

SEQ ID NO: 128658 - DNA, 15 bp, Homo sapiens
tcaattactttgtta

SEQ ID NO: 128659 - DNA, 15 bp, Homo sapiens
ctcaattactttgtt

SEQ ID NO: 128660 - DNA, 15 bp, Homo sapiens
tctcaattactttgt

SEQ ID NO: 128661 - DNA, 15 bp, Homo sapiens
ttctcaattactttg

SEQ ID NO: 128662 - DNA, 15 bp, Homo sapiens
attctcaattacttt

SEQ ID NO: 128663 - DNA, 15 bp, Homo sapiens
aattctcaattactt

SEQ ID NO: 128664 - DNA, 15 bp, Homo sapiens
taattctcaattact

SEQ ID NO: 128665 - DNA, 15 bp, Homo sapiens
ataattctcaattac

SEQ ID NO: 128666 - DNA, 15 bp, Homo sapiens
gataattctcaatta

SEQ ID NO: 128667 - DNA, 15 bp, Homo sapiens
tgataattctcaatt

SEQ ID NO: 128668 - DNA, 15 bp, Homo sapiens
gtgataattctcaat

SEQ ID NO: 128669 - DNA, 15 bp, Homo sapiens
tgtgataattctcaa

SEQ ID NO: 128670 - DNA, 15 bp, Homo sapiens
gtgtgataattctca

SEQ ID NO: 128671 - DNA, 15 bp, Homo sapiens
tgtgtgataattctc

SEQ ID NO: 128672 - DNA, 15 bp, Homo sapiens
ctgtgtgataattct

SEQ ID NO: 128673 - DNA, 15 bp, Homo sapiens
actgtgtgataattc

SEQ ID NO: 128674 - DNA, 15 bp, Homo sapiens
aactgtgtgataatt

SEQ ID NO: 128675 - DNA, 15 bp, Homo sapiens
gaactgtgtgataat

SEQ ID NO: 128676 - DNA, 15 bp, Homo sapiens
tgaactgtgtgataa

SEQ ID NO: 128677 - DNA, 15 bp, Homo sapiens
ttgaactgtgtgata

SEQ ID NO: 128678 - DNA, 15 bp, Homo sapiens
attgaactgtgtgat

SEQ ID NO: 128679 - DNA, 15 bp, Homo sapiens
aattgaactgtgtga

SEQ ID NO: 128680 - DNA, 15 bp, Homo sapiens
aaattgaactgtgtg

SEQ ID NO: 128681 - DNA, 15 bp, Homo sapiens
caaattgaactgtgt

SEQ ID NO: 128682 - DNA, 15 bp, Homo sapiens
acaaattgaactgtg

SEQ ID NO: 128683 - DNA, 15 bp, Homo sapiens
aacaaattgaactgt

SEQ ID NO: 128684 - DNA, 15 bp, Homo sapiens
aaacaaattgaactg

SEQ ID NO: 128685 - DNA, 15 bp, Homo sapiens
aaaacaaattgaact

SEQ ID NO: 128686 - DNA, 15 bp, Homo sapiens
aaaaacaaattgaac

SEQ ID NO: 128687 - DNA, 15 bp, Homo sapiens
caaaaacaaattgaa

SEQ ID NO: 128688 - DNA, 15 bp, Homo sapiens
acaaaaacaaattga

SEQ ID NO: 128689 - DNA, 15 bp, Homo sapiens
tacaaaaacaaattg

SEQ ID NO: 128690 - DNA, 15 bp, Homo sapiens
atacaaaaacaaatt

SEQ ID NO: 128691 - DNA, 15 bp, Homo sapiens
aatacaaaaacaaat

SEQ ID NO: 128692 - DNA, 15 bp, Homo sapiens
caatacaaaaacaaa

SEQ ID NO: 128693 - DNA, 15 bp, Homo sapiens
tcaatacaaaaacaa

SEQ ID NO: 128694 - DNA, 15 bp, Homo sapiens
ctcaatacaaaaaca

SEQ ID NO: 128695 - DNA, 15 bp, Homo sapiens
actcaatacaaaaac

SEQ ID NO: 128696 - DNA, 15 bp, Homo sapiens
cactcaatacaaaaa

SEQ ID NO: 128697 - DNA, 15 bp, Homo sapiens
gcactcaatacaaaa

SEQ ID NO: 128698 - DNA, 15 bp, Homo sapiens
ggcactcaatacaaa

SEQ ID NO: 128699 - DNA, 15 bp, Homo sapiens
aggcactcaatacaa

SEQ ID NO: 128700 - DNA, 15 bp, Homo sapiens
caggcactcaataca

SEQ ID NO: 128701 - DNA, 15 bp, Homo sapiens
acaggcactcaatac

SEQ ID NO: 128702 - DNA, 15 bp, Homo sapiens
tacaggcactcaata

SEQ ID NO: 128703 - DNA, 15 bp, Homo sapiens
ctacaggcactcaat

SEQ ID NO: 128704 - DNA, 15 bp, Homo sapiens
actacaggcactcaa

SEQ ID NO: 128705 - DNA, 15 bp, Homo sapiens
aactacaggcactca

SEQ ID NO: 128706 - DNA, 15 bp, Homo sapiens
taactacaggcactc

SEQ ID NO: 128707 - DNA, 15 bp, Homo sapiens
ttaactacaggcact

SEQ ID NO: 128708 - DNA, 15 bp, Homo sapiens
cttaactacaggcac

SEQ ID NO: 128709 - DNA, 15 bp, Homo sapiens
acttaactacaggca

SEQ ID NO: 128710 - DNA, 15 bp, Homo sapiens
tacttaactacaggc

SEQ ID NO: 128711 - DNA, 15 bp, Homo sapiens
atacttaactacagg

SEQ ID NO: 128712 - DNA, 15 bp, Homo sapiens
aatacttaactacag

SEQ ID NO: 128713 - DNA, 15 bp, Homo sapiens
aaatacttaactaca

SEQ ID NO: 128714 - DNA, 15 bp, Homo sapiens
caaatacttaactac

SEQ ID NO: 128715 - DNA, 15 bp, Homo sapiens
gcaaatacttaacta

SEQ ID NO: 128716 - DNA, 15 bp, Homo sapiens
tgcaaatacttaact

SEQ ID NO: 128717 - DNA, 15 bp, Homo sapiens
atgcaaatacttaac

SEQ ID NO: 128718 - DNA, 15 bp, Homo sapiens
tatgcaaatacttaa

SEQ ID NO: 128719 - DNA, 15 bp, Homo sapiens
ctatgcaaatactta

SEQ ID NO: 128720 - DNA, 15 bp, Homo sapiens
actatgcaaatactt

SEQ ID NO: 128721 - DNA, 15 bp, Homo sapiens
aactatgcaaatact

SEQ ID NO: 128722 - DNA, 15 bp, Homo sapiens
gaactatgcaaatac

SEQ ID NO: 128723 - DNA, 15 bp, Homo sapiens
tgaactatgcaaata

SEQ ID NO: 128724 - DNA, 15 bp, Homo sapiens
ctgaactatgcaaat

SEQ ID NO: 128725 - DNA, 15 bp, Homo sapiens
gctgaactatgcaaa

SEQ ID NO: 128726 - DNA, 15 bp, Homo sapiens
tgctgaactatgcaa

SEQ ID NO: 128727 - DNA, 15 bp, Homo sapiens
ttgctgaactatgca

SEQ ID NO: 128728 - DNA, 15 bp, Homo sapiens
gttgctgaactatgc

SEQ ID NO: 128729 - DNA, 15 bp, Homo sapiens
ggttgctgaactatg

SEQ ID NO: 128730 - DNA, 15 bp, Homo sapiens
aggttgctgaactat

SEQ ID NO: 128731 - DNA, 15 bp, Homo sapiens
caggttgctgaacta

SEQ ID NO: 128732 - DNA, 15 bp, Homo sapiens
gcaggttgctgaact

SEQ ID NO: 128733 - DNA, 15 bp, Homo sapiens
tgcaggttgctgaac

SEQ ID NO: 128734 - DNA, 15 bp, Homo sapiens
ctgcaggttgctgaa

SEQ ID NO: 128735 - DNA, 15 bp, Homo sapiens
tctgcaggttgctga

SEQ ID NO: 128736 - DNA, 15 bp, Homo sapiens
ctctgcaggttgctg

SEQ ID NO: 128737 - DNA, 15 bp, Homo sapiens
actctgcaggttgct

SEQ ID NO: 128738 - DNA, 15 bp, Homo sapiens
aactctgcaggttgc

SEQ ID NO: 128739 - DNA, 15 bp, Homo sapiens
taactctgcaggttg

SEQ ID NO: 128740 - DNA, 15 bp, Homo sapiens
ataactctgcaggtt

SEQ ID NO: 128741 - DNA, 15 bp, Homo sapiens
aataactctgcaggt

SEQ ID NO: 128742 - DNA, 15 bp, Homo sapiens
aaataactctgcagg

SEQ ID NO: 128743 - DNA, 15 bp, Homo sapiens
gaaataactctgcag

SEQ ID NO: 128744 - DNA, 15 bp, Homo sapiens
agaaataactctgca

SEQ ID NO: 128745 - DNA, 15 bp, Homo sapiens
aagaaataactctgc

SEQ ID NO: 128746 - DNA, 15 bp, Homo sapiens
gaagaaataactctg

SEQ ID NO: 128747 - DNA, 15 bp, Homo sapiens
ggaagaaataactct

SEQ ID NO: 128748 - DNA, 15 bp, Homo sapiens
gggaagaaataactc

SEQ ID NO: 128749 - DNA, 15 bp, Homo sapiens
agggaagaaataact

SEQ ID NO: 128750 - DNA, 15 bp, Homo sapiens
aagggaagaaataac

SEQ ID NO: 128751 - DNA, 15 bp, Homo sapiens
aaagggaagaaataa

SEQ ID NO: 128752 - DNA, 15 bp, Homo sapiens
aaaagggaagaaata

SEQ ID NO: 128753 - DNA, 15 bp, Homo sapiens
aaaaagggaagaaat

SEQ ID NO: 128754 - DNA, 15 bp, Homo sapiens
aaaaaagggaagaaa

SEQ ID NO: 128755 - DNA, 15 bp, Homo sapiens
caaaaaagggaagaa

SEQ ID NO: 128756 - DNA, 15 bp, Homo sapiens
ccaaaaaagggaaga

SEQ ID NO: 128757 - DNA, 15 bp, Homo sapiens
tccaaaaaagggaag

SEQ ID NO: 128758 - DNA, 15 bp, Homo sapiens
ctccaaaaaagggaa

SEQ ID NO: 128759 - DNA, 15 bp, Homo sapiens
tctccaaaaaaggga

SEQ ID NO: 128760 - DNA, 15 bp, Homo sapiens
gtctccaaaaaaggg

SEQ ID NO: 128761 - DNA, 15 bp, Homo sapiens
tgtctccaaaaaagg

SEQ ID NO: 128762 - DNA, 15 bp, Homo sapiens
ttgtctccaaaaaag

SEQ ID NO: 128763 - DNA, 15 bp, Homo sapiens
cttgtctccaaaaaa

SEQ ID NO: 128764 - DNA, 15 bp, Homo sapiens
ccttgtctccaaaaa

SEQ ID NO: 128765 - DNA, 15 bp, Homo sapiens
accttgtctccaaaa

SEQ ID NO: 128766 - DNA, 15 bp, Homo sapiens
gaccttgtctccaaa

SEQ ID NO: 128767 - DNA, 15 bp, Homo sapiens
agaccttgtctccaa

SEQ ID NO: 128768 - DNA, 15 bp, Homo sapiens
aagaccttgtctcca

SEQ ID NO: 128769 - DNA, 15 bp, Homo sapiens
caagaccttgtctcc

SEQ ID NO: 128770 - DNA, 15 bp, Homo sapiens
acaagaccttgtctc

SEQ ID NO: 128771 - DNA, 15 bp, Homo sapiens
aacaagaccttgtct

SEQ ID NO: 128772 - DNA, 15 bp, Homo sapiens
gaacaagaccttgtc

SEQ ID NO: 128773 - DNA, 15 bp, Homo sapiens
agaacaagaccttgt

SEQ ID NO: 128774 - DNA, 15 bp, Homo sapiens
cagaacaagaccttg

SEQ ID NO: 128775 - DNA, 15 bp, Homo sapiens
tcagaacaagacctt

SEQ ID NO: 128776 - DNA, 15 bp, Homo sapiens
atcagaacaagacct

SEQ ID NO: 128777 - DNA, 15 bp, Homo sapiens
tatcagaacaagacc

SEQ ID NO: 128778 - DNA, 15 bp, Homo sapiens
gtatcagaacaagac

SEQ ID NO: 128779 - DNA, 15 bp, Homo sapiens
ggtatcagaacaaga

SEQ ID NO: 128780 - DNA, 15 bp, Homo sapiens
gggtatcagaacaag

SEQ ID NO: 128781 - DNA, 15 bp, Homo sapiens
tgggtatcagaacaa

SEQ ID NO: 128782 - DNA, 15 bp, Homo sapiens
ctgggtatcagaaca

SEQ ID NO: 128783 - DNA, 15 bp, Homo sapiens
cctgggtatcagaac

SEQ ID NO: 128784 - DNA, 15 bp, Homo sapiens
gcctgggtatcagaa

SEQ ID NO: 128785 - DNA, 15 bp, Homo sapiens
agcctgggtatcaga

SEQ ID NO: 128786 - DNA, 15 bp, Homo sapiens
cagcctgggtatcag

SEQ ID NO: 128787 - DNA, 15 bp, Homo sapiens
ccagcctgggtatca

SEQ ID NO: 128788 - DNA, 15 bp, Homo sapiens
tccagcctgggtatc

SEQ ID NO: 128789 - DNA, 15 bp, Homo sapiens
ctccagcctgggtat

SEQ ID NO: 128790 - DNA, 15 bp, Homo sapiens
gcaccattgcactcc

SEQ ID NO: 128791 - DNA, 15 bp, Homo sapiens
tgcaccattgcactc

SEQ ID NO: 128792 - DNA, 15 bp, Homo sapiens
ttgcaccattgcact

SEQ ID NO: 128793 - DNA, 15 bp, Homo sapiens
attgcaccattgcac

SEQ ID NO: 128794 - DNA, 15 bp, Homo sapiens
gattgcaccattgca

SEQ ID NO: 128795 - DNA, 15 bp, Homo sapiens
cgattgcaccattgc

SEQ ID NO: 128796 - DNA, 15 bp, Homo sapiens
acgattgcaccattg

SEQ ID NO: 128797 - DNA, 15 bp, Homo sapiens
tacgattgcaccatt

SEQ ID NO: 128798 - DNA, 15 bp, Homo sapiens
ctacgattgcaccat

SEQ ID NO: 128799 - DNA, 15 bp, Homo sapiens
gctacgattgcacca

SEQ ID NO: 128800 - DNA, 15 bp, Homo sapiens
agctacgattgcacc

SEQ ID NO: 128801 - DNA, 15 bp, Homo sapiens
gagctacgattgcac

SEQ ID NO: 128802 - DNA, 15 bp, Homo sapiens
tgagctacgattgca

SEQ ID NO: 128803 - DNA, 15 bp, Homo sapiens
gtgagctacgattgc

SEQ ID NO: 128804 - DNA, 15 bp, Homo sapiens
agtgagctacgattg

SEQ ID NO: 128805 - DNA, 15 bp, Homo sapiens
cagtgagctacgatt

SEQ ID NO: 128806 - DNA, 15 bp, Homo sapiens
gcagtgagctacgat

SEQ ID NO: 128807 - DNA, 15 bp, Homo sapiens
tgcagtgagctacga

SEQ ID NO: 128808 - DNA, 15 bp, Homo sapiens
atgcagtgagctacg

SEQ ID NO: 128809 - DNA, 15 bp, Homo sapiens
gatgcagtgagctac

SEQ ID NO: 128810 - DNA, 15 bp, Homo sapiens
ggatgcagtgagcta

SEQ ID NO: 128811 - DNA, 15 bp, Homo sapiens
aggatgcagtgagct

SEQ ID NO: 128812 - DNA, 15 bp, Homo sapiens
aaggatgcagtgagc

SEQ ID NO: 128813 - DNA, 15 bp, Homo sapiens
caaggatgcagtgag

SEQ ID NO: 128814 - DNA, 15 bp, Homo sapiens
tcaaggatgcagtga

SEQ ID NO: 128815 - DNA, 15 bp, Homo sapiens
ctcaaggatgcagtg

SEQ ID NO: 128816 - DNA, 15 bp, Homo sapiens
gctcaaggatgcagt

SEQ ID NO: 128817 - DNA, 15 bp, Homo sapiens
ggctcaaggatgcag

SEQ ID NO: 128818 - DNA, 15 bp, Homo sapiens
gggctcaaggatgca

SEQ ID NO: 128819 - DNA, 15 bp, Homo sapiens
ggggctcaaggatgc

SEQ ID NO: 128820 - DNA, 15 bp, Homo sapiens
aggggctcaaggatg

SEQ ID NO: 128821 - DNA, 15 bp, Homo sapiens
caggggctcaaggat

SEQ ID NO: 128822 - DNA, 15 bp, Homo sapiens
ccaggggctcaagga

SEQ ID NO: 128823 - DNA, 15 bp, Homo sapiens
cccaggggctcaagg

SEQ ID NO: 128824 - DNA, 15 bp, Homo sapiens
gcccaggggctcaag

SEQ ID NO: 128825 - DNA, 15 bp, Homo sapiens
agcccaggggctcaa

SEQ ID NO: 128826 - DNA, 15 bp, Homo sapiens
gagcccaggggctca

SEQ ID NO: 128827 - DNA, 15 bp, Homo sapiens
tgagcccaggggctc

SEQ ID NO: 128828 - DNA, 15 bp, Homo sapiens
ttgagcccaggggct

SEQ ID NO: 128829 - DNA, 15 bp, Homo sapiens
cttgagcccaggggc

SEQ ID NO: 128830 - DNA, 15 bp, Homo sapiens
tgcttgagcccaggg

SEQ ID NO: 128831 - DNA, 15 bp, Homo sapiens
gaggattgcttgagc

SEQ ID NO: 128832 - DNA, 15 bp, Homo sapiens
agaggattgcttgag

SEQ ID NO: 128833 - DNA, 15 bp, Homo sapiens
gagaggattgcttga

SEQ ID NO: 128834 - DNA, 15 bp, Homo sapiens
tgagaggattgcttg

SEQ ID NO: 128835 - DNA, 15 bp, Homo sapiens
gtgagaggattgctt

SEQ ID NO: 128836 - DNA, 15 bp, Homo sapiens
ggtgagaggattgct

SEQ ID NO: 128837 - DNA, 15 bp, Homo sapiens
gggtgagaggattgc

SEQ ID NO: 128838 - DNA, 15 bp, Homo sapiens
agggtgagaggattg

SEQ ID NO: 128839 - DNA, 15 bp, Homo sapiens
tagggtgagaggatt

SEQ ID NO: 128840 - DNA, 15 bp, Homo sapiens
ctagggtgagaggat

SEQ ID NO: 128841 - DNA, 15 bp, Homo sapiens
actagggtgagagga

SEQ ID NO: 128842 - DNA, 15 bp, Homo sapiens
gactagggtgagagg

SEQ ID NO: 128843 - DNA, 15 bp, Homo sapiens
agactagggtgagag

SEQ ID NO: 128844 - DNA, 15 bp, Homo sapiens
aagactagggtgaga

SEQ ID NO: 128845 - DNA, 15 bp, Homo sapiens
gaagactagggtgag

SEQ ID NO: 128846 - DNA, 15 bp, Homo sapiens
agaagactagggtga

SEQ ID NO: 128847 - DNA, 15 bp, Homo sapiens
cagaagactagggtg

SEQ ID NO: 128848 - DNA, 15 bp, Homo sapiens
tcagaagactagggt

SEQ ID NO: 128849 - DNA, 15 bp, Homo sapiens
ctcagaagactaggg

SEQ ID NO: 128850 - DNA, 15 bp, Homo sapiens
actcagaagactagg

SEQ ID NO: 128851 - DNA, 15 bp, Homo sapiens
tactcagaagactag

SEQ ID NO: 128852 - DNA, 15 bp, Homo sapiens
ctactcagaagacta

SEQ ID NO: 128853 - DNA, 15 bp, Homo sapiens
actactcagaagact

SEQ ID NO: 128854 - DNA, 15 bp, Homo sapiens
aactactcagaagac

SEQ ID NO: 128855 - DNA, 15 bp, Homo sapiens
caactactcagaaga

SEQ ID NO: 128856 - DNA, 15 bp, Homo sapiens
ccaactactcagaag

SEQ ID NO: 128857 - DNA, 15 bp, Homo sapiens
cccaactactcagaa

SEQ ID NO: 128858 - DNA, 15 bp, Homo sapiens
ccccaactactcaga

SEQ ID NO: 128859 - DNA, 15 bp, Homo sapiens
gccccaactactcag

SEQ ID NO: 128860 - DNA, 15 bp, Homo sapiens
agccccaactactca

SEQ ID NO: 128861 - DNA, 15 bp, Homo sapiens
cagccccaactactc

SEQ ID NO: 128862 - DNA, 15 bp, Homo sapiens
gcagccccaactact

SEQ ID NO: 128863 - DNA, 15 bp, Homo sapiens
tgcagccccaactac

SEQ ID NO: 128864 - DNA, 15 bp, Homo sapiens
ttgcagccccaacta

SEQ ID NO: 128865 - DNA, 15 bp, Homo sapiens
cttgcagccccaact

SEQ ID NO: 128866 - DNA, 15 bp, Homo sapiens
acttgcagccccaac

SEQ ID NO: 128867 - DNA, 15 bp, Homo sapiens
cacttgcagccccaa

SEQ ID NO: 128868 - DNA, 15 bp, Homo sapiens
acacttgcagcccca

SEQ ID NO: 128869 - DNA, 15 bp, Homo sapiens
cacacttgcagcccc

SEQ ID NO: 128870 - DNA, 15 bp, Homo sapiens
acacacttgcagccc

SEQ ID NO: 128871 - DNA, 15 bp, Homo sapiens
cacacacttgcagcc

SEQ ID NO: 128872 - DNA, 15 bp, Homo sapiens
gcacacacttgcagc

SEQ ID NO: 128873 - DNA, 15 bp, Homo sapiens
agcacacacttgcag

SEQ ID NO: 128874 - DNA, 15 bp, Homo sapiens
tagcacacacttgca

SEQ ID NO: 128875 - DNA, 15 bp, Homo sapiens
gtagcacacacttgc

SEQ ID NO: 128876 - DNA, 15 bp, Homo sapiens
ggtagcacacacttg

SEQ ID NO: 128877 - DNA, 15 bp, Homo sapiens
tggtagcacacactt

SEQ ID NO: 128878 - DNA, 15 bp, Homo sapiens
gtggtagcacacact

SEQ ID NO: 128879 - DNA, 15 bp, Homo sapiens
tgtggtagcacacac

SEQ ID NO: 128880 - DNA, 15 bp, Homo sapiens
gtgtggtagcacaca

SEQ ID NO: 128881 - DNA, 15 bp, Homo sapiens
ggtgtggtagcacac

SEQ ID NO: 128882 - DNA, 15 bp, Homo sapiens
gggtgtggtagcaca

SEQ ID NO: 128883 - DNA, 15 bp, Homo sapiens
tgggtgtggtagcac

SEQ ID NO: 128884 - DNA, 15 bp, Homo sapiens
ctgggtgtggtagca

SEQ ID NO: 128885 - DNA, 15 bp, Homo sapiens
gctgggtgtggtagc

SEQ ID NO: 128886 - DNA, 15 bp, Homo sapiens
agctgggtgtggtag

SEQ ID NO: 128887 - DNA, 15 bp, Homo sapiens
cagctgggtgtggta

SEQ ID NO: 128888 - DNA, 15 bp, Homo sapiens
tcagctgggtgtggt

SEQ ID NO: 128889 - DNA, 15 bp, Homo sapiens
atcagctgggtgtgg

SEQ ID NO: 128890 - DNA, 15 bp, Homo sapiens
aatcagctgggtgtg

SEQ ID NO: 128891 - DNA, 15 bp, Homo sapiens
aaatcagctgggtgt

SEQ ID NO: 128892 - DNA, 15 bp, Homo sapiens
aaaatcagctgggtg

SEQ ID NO: 128893 - DNA, 15 bp, Homo sapiens
aaaaatcagctgggt

SEQ ID NO: 128894 - DNA, 15 bp, Homo sapiens
taaaaatcagctggg

SEQ ID NO: 128895 - DNA, 15 bp, Homo sapiens
ttaaaaatcagctgg

SEQ ID NO: 128896 - DNA, 15 bp, Homo sapiens
tttaaaaatcagctg

SEQ ID NO: 128897 - DNA, 15 bp, Homo sapiens
atttaaaaatcagct

SEQ ID NO: 128898 - DNA, 15 bp, Homo sapiens
aatttaaaaatcagc

SEQ ID NO: 128899 - DNA, 15 bp, Homo sapiens
caatttaaaaatcag

SEQ ID NO: 128900 - DNA, 15 bp, Homo sapiens
acaatttaaaaatca

SEQ ID NO: 128901 - DNA, 15 bp, Homo sapiens
aacaatttaaaaatc

SEQ ID NO: 128902 - DNA, 15 bp, Homo sapiens
aaacaatttaaaaat

SEQ ID NO: 128903 - DNA, 15 bp, Homo sapiens
caaacaatttaaaaa

SEQ ID NO: 128904 - DNA, 15 bp, Homo sapiens
acaaacaatttaaaa

SEQ ID NO: 128905 - DNA, 15 bp, Homo sapiens
tacaaacaatttaaa

SEQ ID NO: 128906 - DNA, 15 bp, Homo sapiens
ttacaaacaatttaa

SEQ ID NO: 128907 - DNA, 15 bp, Homo sapiens
tttacaaacaattta

SEQ ID NO: 128908 - DNA, 15 bp, Homo sapiens
tttttacaaacaatt

SEQ ID NO: 128909 - DNA, 15 bp, Homo sapiens
atttttacaaacaat

SEQ ID NO: 128910 - DNA, 15 bp, Homo sapiens
tatttttacaaacaa

SEQ ID NO: 128911 - DNA, 15 bp, Homo sapiens
ttatttttacaaaca

SEQ ID NO: 128912 - DNA, 15 bp, Homo sapiens
cttatttttacaaac

SEQ ID NO: 128913 - DNA, 15 bp, Homo sapiens
ccttatttttacaaa

SEQ ID NO: 128914 - DNA, 15 bp, Homo sapiens
accttatttttacaa

SEQ ID NO: 128915 - DNA, 15 bp, Homo sapiens
gaccttatttttaca

SEQ ID NO: 128916 - DNA, 15 bp, Homo sapiens
agaccttatttttac

SEQ ID NO: 128917 - DNA, 15 bp, Homo sapiens
aagaccttattttta

SEQ ID NO: 128918 - DNA, 15 bp, Homo sapiens
caagaccttattttt

SEQ ID NO: 128919 - DNA, 15 bp, Homo sapiens
gcaagaccttatttt

SEQ ID NO: 128920 - DNA, 15 bp, Homo sapiens
ggcaagaccttattt

SEQ ID NO: 128921 - DNA, 15 bp, Homo sapiens
tggcaagaccttatt

SEQ ID NO: 128922 - DNA, 15 bp, Homo sapiens
atggcaagaccttat

SEQ ID NO: 128923 - DNA, 15 bp, Homo sapiens
catggcaagacctta

SEQ ID NO: 128924 - DNA, 15 bp, Homo sapiens
acatggcaagacctt

SEQ ID NO: 128925 - DNA, 15 bp, Homo sapiens
aacatggcaagacct

SEQ ID NO: 128926 - DNA, 15 bp, Homo sapiens
caacatggcaagacc

SEQ ID NO: 128927 - DNA, 15 bp, Homo sapiens
acaacatggcaagac

SEQ ID NO: 128928 - DNA, 15 bp, Homo sapiens
gacaacatggcaaga

SEQ ID NO: 128929 - DNA, 15 bp, Homo sapiens
ggacaacatggcaag

SEQ ID NO: 128930 - DNA, 15 bp, Homo sapiens
tggacaacatggcaa

SEQ ID NO: 128931 - DNA, 15 bp, Homo sapiens
ctggacaacatggca

SEQ ID NO: 128932 - DNA, 15 bp, Homo sapiens
cctggacaacatggc

SEQ ID NO: 128933 - DNA, 15 bp, Homo sapiens
gagaccagcctggac

SEQ ID NO: 128934 - DNA, 15 bp, Homo sapiens
cgagaccagcctgga

SEQ ID NO: 128935 - DNA, 15 bp, Homo sapiens
taggagttcgagacc

SEQ ID NO: 128936 - DNA, 15 bp, Homo sapiens
ctaggagttcgagac

SEQ ID NO: 128937 - DNA, 15 bp, Homo sapiens
cctaggagttcgaga

SEQ ID NO: 128938 - DNA, 15 bp, Homo sapiens
gcctaggagttcgag

SEQ ID NO: 128939 - DNA, 15 bp, Homo sapiens
agcctaggagttcga

SEQ ID NO: 128940 - DNA, 15 bp, Homo sapiens
gagcctaggagttcg

SEQ ID NO: 128941 - DNA, 15 bp, Homo sapiens
actgaggcaggagga

SEQ ID NO: 128942 - DNA, 15 bp, Homo sapiens
gactgaggcaggagg

SEQ ID NO: 128943 - DNA, 15 bp, Homo sapiens
agactgaggcaggag

SEQ ID NO: 128944 - DNA, 15 bp, Homo sapiens
agagactgaggcagg

SEQ ID NO: 128945 - DNA, 15 bp, Homo sapiens
gagagactgaggcag

SEQ ID NO: 128946 - DNA, 15 bp, Homo sapiens
tgagagactgaggca

SEQ ID NO: 128947 - DNA, 15 bp, Homo sapiens
ttgagagactgaggc

SEQ ID NO: 128948 - DNA, 15 bp, Homo sapiens
tttgagagactgagg

SEQ ID NO: 128949 - DNA, 15 bp, Homo sapiens
ctttgagagactgag

SEQ ID NO: 128950 - DNA, 15 bp, Homo sapiens
actttgagagactga

SEQ ID NO: 128951 - DNA, 15 bp, Homo sapiens
cactttgagagactg

SEQ ID NO: 128952 - DNA, 15 bp, Homo sapiens
gcactttgagagact

SEQ ID NO: 128953 - DNA, 15 bp, Homo sapiens
agcactttgagagac

SEQ ID NO: 128954 - DNA, 15 bp, Homo sapiens
cagcactttgagaga

SEQ ID NO: 128955 - DNA, 15 bp, Homo sapiens
cccagcactttgaga

SEQ ID NO: 128956 - DNA, 15 bp, Homo sapiens
tcccagcactttgag

SEQ ID NO: 128957 - DNA, 15 bp, Homo sapiens
ggtggctcacggctg

SEQ ID NO: 128958 - DNA, 15 bp, Homo sapiens
tggtggctcacggct

SEQ ID NO: 128959 - DNA, 15 bp, Homo sapiens
atggtggctcacggc

SEQ ID NO: 128960 - DNA, 15 bp, Homo sapiens
catggtggctcacgg

SEQ ID NO: 128961 - DNA, 15 bp, Homo sapiens
gcatggtggctcacg

SEQ ID NO: 128962 - DNA, 15 bp, Homo sapiens
cactgggcatggtgg

SEQ ID NO: 128963 - DNA, 15 bp, Homo sapiens
ccactgggcatggtg

SEQ ID NO: 128964 - DNA, 15 bp, Homo sapiens
cccactgggcatggt

SEQ ID NO: 128965 - DNA, 15 bp, Homo sapiens
acccactgggcatgg

SEQ ID NO: 128966 - DNA, 15 bp, Homo sapiens
aacccactgggcatg

SEQ ID NO: 128967 - DNA, 15 bp, Homo sapiens
taacccactgggcat

SEQ ID NO: 128968 - DNA, 15 bp, Homo sapiens
ataacccactgggca

SEQ ID NO: 128969 - DNA, 15 bp, Homo sapiens
aataacccactgggc

SEQ ID NO: 128970 - DNA, 15 bp, Homo sapiens
gaataacccactggg

SEQ ID NO: 128971 - DNA, 15 bp, Homo sapiens
ggaataacccactgg

SEQ ID NO: 128972 - DNA, 15 bp, Homo sapiens
aggaataacccactg

SEQ ID NO: 128973 - DNA, 15 bp, Homo sapiens
aaggaataacccact

SEQ ID NO: 128974 - DNA, 15 bp, Homo sapiens
taaggaataacccac

SEQ ID NO: 128975 - DNA, 15 bp, Homo sapiens
ctaaggaataaccca

SEQ ID NO: 128976 - DNA, 15 bp, Homo sapiens
actaaggaataaccc

SEQ ID NO: 128977 - DNA, 15 bp, Homo sapiens
cactaaggaataacc

SEQ ID NO: 128978 - DNA, 15 bp, Homo sapiens
tcactaaggaataac

SEQ ID NO: 128979 - DNA, 15 bp, Homo sapiens
ctcactaaggaataa

SEQ ID NO: 128980 - DNA, 15 bp, Homo sapiens
gctcactaaggaata

SEQ ID NO: 128981 - DNA, 15 bp, Homo sapiens
tgctcactaaggaat

SEQ ID NO: 128982 - DNA, 15 bp, Homo sapiens
ttgctcactaaggaa

SEQ ID NO: 128983 - DNA, 15 bp, Homo sapiens
attgctcactaagga

SEQ ID NO: 128984 - DNA, 15 bp, Homo sapiens
aattgctcactaagg

SEQ ID NO: 128985 - DNA, 15 bp, Homo sapiens
caattgctcactaag

SEQ ID NO: 128986 - DNA, 15 bp, Homo sapiens
acaattgctcactaa

SEQ ID NO: 128987 - DNA, 15 bp, Homo sapiens
aacaattgctcacta

SEQ ID NO: 128988 - DNA, 15 bp, Homo sapiens
aaacaattgctcact

SEQ ID NO: 128989 - DNA, 15 bp, Homo sapiens
gaaacaattgctcac

SEQ ID NO: 128990 - DNA, 15 bp, Homo sapiens
agaaacaattgctca

SEQ ID NO: 128991 - DNA, 15 bp, Homo sapiens
aagaaacaattgctc

SEQ ID NO: 128992 - DNA, 15 bp, Homo sapiens
gaagaaacaattgct

SEQ ID NO: 128993 - DNA, 15 bp, Homo sapiens
agaagaaacaattgc

SEQ ID NO: 128994 - DNA, 15 bp, Homo sapiens
cagaagaaacaattg

SEQ ID NO: 128995 - DNA, 15 bp, Homo sapiens
acagaagaaacaatt

SEQ ID NO: 128996 - DNA, 15 bp, Homo sapiens
aacagaagaaacaat

SEQ ID NO: 128997 - DNA, 15 bp, Homo sapiens
taacagaagaaacaa

SEQ ID NO: 128998 - DNA, 15 bp, Homo sapiens
ctaacagaagaaaca

SEQ ID NO: 128999 - DNA, 15 bp, Homo sapiens
tctaacagaagaaac

SEQ ID NO: 129000 - DNA, 15 bp, Homo sapiens
ttctaacagaagaaa

SEQ ID NO: 129001 - DNA, 15 bp, Homo sapiens
gttctaacagaagaa

SEQ ID NO: 129002 - DNA, 15 bp, Homo sapiens
tgttctaacagaaga

SEQ ID NO: 129003 - DNA, 15 bp, Homo sapiens
atgttctaacagaag

SEQ ID NO: 129004 - DNA, 15 bp, Homo sapiens
catgttctaacagaa

SEQ ID NO: 129005 - DNA, 15 bp, Homo sapiens
tcatgttctaacaga

SEQ ID NO: 129006 - DNA, 15 bp, Homo sapiens
ttcatgttctaacag

SEQ ID NO: 129007 - DNA, 15 bp, Homo sapiens
attcatgttctaaca

SEQ ID NO: 129008 - DNA, 15 bp, Homo sapiens
aattcatgttctaac

SEQ ID NO: 129009 - DNA, 15 bp, Homo sapiens
aaattcatgttctaa

SEQ ID NO: 129010 - DNA, 15 bp, Homo sapiens
taaattcatgttcta

SEQ ID NO: 129011 - DNA, 15 bp, Homo sapiens
ataaattcatgttct

SEQ ID NO: 129012 - DNA, 15 bp, Homo sapiens
tataaattcatgttc

SEQ ID NO: 129013 - DNA, 15 bp, Homo sapiens
ttataaattcatgtt

SEQ ID NO: 129014 - DNA, 15 bp, Homo sapiens
attataaattcatgt

SEQ ID NO: 129015 - DNA, 15 bp, Homo sapiens
aattataaattcatg

SEQ ID NO: 129016 - DNA, 15 bp, Homo sapiens
aaattataaattcat

SEQ ID NO: 129017 - DNA, 15 bp, Homo sapiens
caaattataaattca

SEQ ID NO: 129018 - DNA, 15 bp, Homo sapiens
acaaattataaattc

SEQ ID NO: 129019 - DNA, 15 bp, Homo sapiens
aacaaattataaatt

SEQ ID NO: 129020 - DNA, 15 bp, Homo sapiens
aaacaaattataaat

SEQ ID NO: 129021 - DNA, 15 bp, Homo sapiens
aaaacaaattataaa

SEQ ID NO: 129022 - DNA, 15 bp, Homo sapiens
aaaaacaaattataa

SEQ ID NO: 129023 - DNA, 15 bp, Homo sapiens
taaaaacaaattata

SEQ ID NO: 129024 - DNA, 15 bp, Homo sapiens
gtaaaaacaaattat

SEQ ID NO: 129025 - DNA, 15 bp, Homo sapiens
agtaaaaacaaatta

SEQ ID NO: 129026 - DNA, 15 bp, Homo sapiens
gagtaaaaacaaatt

SEQ ID NO: 129027 - DNA, 15 bp, Homo sapiens
agagtaaaaacaaat

SEQ ID NO: 129028 - DNA, 15 bp, Homo sapiens
aagagtaaaaacaaa

SEQ ID NO: 129029 - DNA, 15 bp, Homo sapiens
caagagtaaaaacaa

SEQ ID NO: 129030 - DNA, 15 bp, Homo sapiens
ccaagagtaaaaaca

SEQ ID NO: 129031 - DNA, 15 bp, Homo sapiens
cccaagagtaaaaac

SEQ ID NO: 129032 - DNA, 15 bp, Homo sapiens
ccccaagagtaaaaa

SEQ ID NO: 129033 - DNA, 15 bp, Homo sapiens
tccccaagagtaaaa

SEQ ID NO: 129034 - DNA, 15 bp, Homo sapiens
atccccaagagtaaa

SEQ ID NO: 129035 - DNA, 15 bp, Homo sapiens
tatccccaagagtaa

SEQ ID NO: 129036 - DNA, 15 bp, Homo sapiens
ttatccccaagagta

SEQ ID NO: 129037 - DNA, 15 bp, Homo sapiens
attatccccaagagt

SEQ ID NO: 129038 - DNA, 15 bp, Homo sapiens
tattatccccaagag

SEQ ID NO: 129039 - DNA, 15 bp, Homo sapiens
atattatccccaaga

SEQ ID NO: 129040 - DNA, 15 bp, Homo sapiens
aatattatccccaag

SEQ ID NO: 129041 - DNA, 15 bp, Homo sapiens
aaatattatccccaa

SEQ ID NO: 129042 - DNA, 15 bp, Homo sapiens
taaatattatcccca

SEQ ID NO: 129043 - DNA, 15 bp, Homo sapiens
ttaaatattatcccc

SEQ ID NO: 129044 - DNA, 15 bp, Homo sapiens
tttaaatattatccc

SEQ ID NO: 129045 - DNA, 15 bp, Homo sapiens
ttttaaatattatcc

SEQ ID NO: 129046 - DNA, 15 bp, Homo sapiens
attttaaatattatc

SEQ ID NO: 129047 - DNA, 15 bp, Homo sapiens
cattttaaatattat

SEQ ID NO: 129048 - DNA, 15 bp, Homo sapiens
acattttaaatatta

SEQ ID NO: 129049 - DNA, 15 bp, Homo sapiens
tacattttaaatatt

SEQ ID NO: 129050 - DNA, 15 bp, Homo sapiens
ctacattttaaatat

SEQ ID NO: 129051 - DNA, 15 bp, Homo sapiens
tctacattttaaata

SEQ ID NO: 129052 - DNA, 15 bp, Homo sapiens
atctacattttaaat

SEQ ID NO: 129053 - DNA, 15 bp, Homo sapiens
aatctacattttaaa

SEQ ID NO: 129054 - DNA, 15 bp, Homo sapiens
taatctacattttaa

SEQ ID NO: 129055 - DNA, 15 bp, Homo sapiens
ataatctacatttta

SEQ ID NO: 129056 - DNA, 15 bp, Homo sapiens
tataatctacatttt

SEQ ID NO: 129057 - DNA, 15 bp, Homo sapiens
atataatctacattt

SEQ ID NO: 129058 - DNA, 15 bp, Homo sapiens
aatataatctacatt

SEQ ID NO: 129059 - DNA, 15 bp, Homo sapiens
aaatataatctacat

SEQ ID NO: 129060 - DNA, 15 bp, Homo sapiens
taaatataatctaca

SEQ ID NO: 129061 - DNA, 15 bp, Homo sapiens
ctaaatataatctac

SEQ ID NO: 129062 - DNA, 15 bp, Homo sapiens
gctaaatataatcta

SEQ ID NO: 129063 - DNA, 15 bp, Homo sapiens
agctaaatataatct

SEQ ID NO: 129064 - DNA, 15 bp, Homo sapiens
tagctaaatataatc

SEQ ID NO: 129065 - DNA, 15 bp, Homo sapiens
ttagctaaatataat

SEQ ID NO: 129066 - DNA, 15 bp, Homo sapiens
attagctaaatataa

SEQ ID NO: 129067 - DNA, 15 bp, Homo sapiens
aattagctaaatata

SEQ ID NO: 129068 - DNA, 15 bp, Homo sapiens
aaattagctaaatat

SEQ ID NO: 129069 - DNA, 15 bp, Homo sapiens
caaattagctaaata

SEQ ID NO: 129070 - DNA, 15 bp, Homo sapiens
gcaaattagctaaat

SEQ ID NO: 129071 - DNA, 15 bp, Homo sapiens
tgcaaattagctaaa

SEQ ID NO: 129072 - DNA, 15 bp, Homo sapiens
ctgcaaattagctaa

SEQ ID NO: 129073 - DNA, 15 bp, Homo sapiens
tctgcaaattagcta

SEQ ID NO: 129074 - DNA, 15 bp, Homo sapiens
atctgcaaattagct

SEQ ID NO: 129075 - DNA, 15 bp, Homo sapiens
catctgcaaattagc

SEQ ID NO: 129076 - DNA, 15 bp, Homo sapiens
tcatctgcaaattag

SEQ ID NO: 129077 - DNA, 15 bp, Homo sapiens
ttcatctgcaaatta

SEQ ID NO: 129078 - DNA, 15 bp, Homo sapiens
tttcatctgcaaatt

SEQ ID NO: 129079 - DNA, 15 bp, Homo sapiens
ttttcatctgcaaat

SEQ ID NO: 129080 - DNA, 15 bp, Homo sapiens
attttcatctgcaaa

SEQ ID NO: 129081 - DNA, 15 bp, Homo sapiens
tattttcatctgcaa

SEQ ID NO: 129082 - DNA, 15 bp, Homo sapiens
atattttcatctgca

SEQ ID NO: 129083 - DNA, 15 bp, Homo sapiens
aatattttcatctgc

SEQ ID NO: 129084 - DNA, 15 bp, Homo sapiens
caatattttcatctg

SEQ ID NO: 129085 - DNA, 15 bp, Homo sapiens
ccaatattttcatct

SEQ ID NO: 129086 - DNA, 15 bp, Homo sapiens
cccaatattttcatc

SEQ ID NO: 129087 - DNA, 15 bp, Homo sapiens
acccaatattttcat

SEQ ID NO: 129088 - DNA, 15 bp, Homo sapiens
cacccaatattttca

SEQ ID NO: 129089 - DNA, 15 bp, Homo sapiens
tcacccaatattttc

SEQ ID NO: 129090 - DNA, 15 bp, Homo sapiens
gtcacccaatatttt

SEQ ID NO: 129091 - DNA, 15 bp, Homo sapiens
agtcacccaatattt

SEQ ID NO: 129092 - DNA, 15 bp, Homo sapiens
gagtcacccaatatt

SEQ ID NO: 129093 - DNA, 15 bp, Homo sapiens
tgagtcacccaatat

SEQ ID NO: 129094 - DNA, 15 bp, Homo sapiens
ttgagtcacccaata

SEQ ID NO: 129095 - DNA, 15 bp, Homo sapiens
tttgagtcacccaat

SEQ ID NO: 129096 - DNA, 15 bp, Homo sapiens
atttgagtcacccaa

SEQ ID NO: 129097 - DNA, 15 bp, Homo sapiens
tatttgagtcaccca

SEQ ID NO: 129098 - DNA, 15 bp, Homo sapiens
atatttgagtcaccc

SEQ ID NO: 129099 - DNA, 15 bp, Homo sapiens
tatatttgagtcacc

SEQ ID NO: 129100 - DNA, 15 bp, Homo sapiens
atatatttgagtcac

SEQ ID NO: 129101 - DNA, 15 bp, Homo sapiens
gatatatttgagtca

SEQ ID NO: 129102 - DNA, 15 bp, Homo sapiens
agatatatttgagtc

SEQ ID NO: 129103 - DNA, 15 bp, Homo sapiens
aagatatatttgagt

SEQ ID NO: 129104 - DNA, 15 bp, Homo sapiens
taagatatatttgag

SEQ ID NO: 129105 - DNA, 15 bp, Homo sapiens
ataagatatatttga

SEQ ID NO: 129106 - DNA, 15 bp, Homo sapiens
aataagatatatttg

SEQ ID NO: 129107 - DNA, 15 bp, Homo sapiens
caataagatatattt

SEQ ID NO: 129108 - DNA, 15 bp, Homo sapiens
tcaataagatatatt

SEQ ID NO: 129109 - DNA, 15 bp, Homo sapiens
ttcaataagatatat

SEQ ID NO: 129110 - DNA, 15 bp, Homo sapiens
tttcaataagatata

SEQ ID NO: 129111 - DNA, 15 bp, Homo sapiens
atttcaataagatat

SEQ ID NO: 129112 - DNA, 15 bp, Homo sapiens
gatttcaataagata

SEQ ID NO: 129113 - DNA, 15 bp, Homo sapiens
tgatttcaataagat

SEQ ID NO: 129114 - DNA, 15 bp, Homo sapiens
gtgatttcaataaga

SEQ ID NO: 129115 - DNA, 15 bp, Homo sapiens
agtgatttcaataag

SEQ ID NO: 129116 - DNA, 15 bp, Homo sapiens
aagtgatttcaataa

SEQ ID NO: 129117 - DNA, 15 bp, Homo sapiens
aaagtgatttcaata

SEQ ID NO: 129118 - DNA, 15 bp, Homo sapiens
taaagtgatttcaat

SEQ ID NO: 129119 - DNA, 15 bp, Homo sapiens
ataaagtgatttcaa

SEQ ID NO: 129120 - DNA, 15 bp, Homo sapiens
tataaagtgatttca

SEQ ID NO: 129121 - DNA, 15 bp, Homo sapiens
ttataaagtgatttc

SEQ ID NO: 129122 - DNA, 15 bp, Homo sapiens
attataaagtgattt

SEQ ID NO: 129123 - DNA, 15 bp, Homo sapiens
cattataaagtgatt

SEQ ID NO: 129124 - DNA, 15 bp, Homo sapiens
gcattataaagtgat

SEQ ID NO: 129125 - DNA, 15 bp, Homo sapiens
agcattataaagtga

SEQ ID NO: 129126 - DNA, 15 bp, Homo sapiens
tagcattataaagtg

SEQ ID NO: 129127 - DNA, 15 bp, Homo sapiens
ctagcattataaagt

SEQ ID NO: 129128 - DNA, 15 bp, Homo sapiens
actagcattataaag

SEQ ID NO: 129129 - DNA, 15 bp, Homo sapiens
aactagcattataaa

SEQ ID NO: 129130 - DNA, 15 bp, Homo sapiens
aaactagcattataa

SEQ ID NO: 129131 - DNA, 15 bp, Homo sapiens
aaaactagcattata

SEQ ID NO: 129132 - DNA, 15 bp, Homo sapiens
gaaaactagcattat

SEQ ID NO: 129133 - DNA, 15 bp, Homo sapiens
agaaaactagcatta

SEQ ID NO: 129134 - DNA, 15 bp, Homo sapiens
aagaaaactagcatt

SEQ ID NO: 129135 - DNA, 15 bp, Homo sapiens
gaagaaaactagcat

SEQ ID NO: 129136 - DNA, 15 bp, Homo sapiens
tgaagaaaactagca

SEQ ID NO: 129137 - DNA, 15 bp, Homo sapiens
atgaagaaaactagc

SEQ ID NO: 129138 - DNA, 15 bp, Homo sapiens
tatgaagaaaactag

SEQ ID NO: 129139 - DNA, 15 bp, Homo sapiens
ctatgaagaaaacta

SEQ ID NO: 129140 - DNA, 15 bp, Homo sapiens
actatgaagaaaact

SEQ ID NO: 129141 - DNA, 15 bp, Homo sapiens
aactatgaagaaaac

SEQ ID NO: 129142 - DNA, 15 bp, Homo sapiens
gaactatgaagaaaa

SEQ ID NO: 129143 - DNA, 15 bp, Homo sapiens
agaactatgaagaaa

SEQ ID NO: 129144 - DNA, 15 bp, Homo sapiens
cagaactatgaagaa

SEQ ID NO: 129145 - DNA, 15 bp, Homo sapiens
acagaactatgaaga

SEQ ID NO: 129146 - DNA, 15 bp, Homo sapiens
aacagaactatgaag

SEQ ID NO: 129147 - DNA, 15 bp, Homo sapiens
aaacagaactatgaa

SEQ ID NO: 129148 - DNA, 15 bp, Homo sapiens
aaaacagaactatga

SEQ ID NO: 129149 - DNA, 15 bp, Homo sapiens
caaaacagaactatg

SEQ ID NO: 129150 - DNA, 15 bp, Homo sapiens
tcaaaacagaactat

SEQ ID NO: 129151 - DNA, 15 bp, Homo sapiens
ttcaaaacagaacta

SEQ ID NO: 129152 - DNA, 15 bp, Homo sapiens
tttcaaaacagaact

SEQ ID NO: 129153 - DNA, 15 bp, Homo sapiens
ctttcaaaacagaac

SEQ ID NO: 129154 - DNA, 15 bp, Homo sapiens
actttcaaaacagaa

SEQ ID NO: 129155 - DNA, 15 bp, Homo sapiens
tactttcaaaacaga

SEQ ID NO: 129156 - DNA, 15 bp, Homo sapiens
gtactttcaaaacag

SEQ ID NO: 129157 - DNA, 15 bp, Homo sapiens
agtactttcaaaaca

SEQ ID NO: 129158 - DNA, 15 bp, Homo sapiens
tagtactttcaaaac

SEQ ID NO: 129159 - DNA, 15 bp, Homo sapiens
ttagtactttcaaaa

SEQ ID NO: 129160 - DNA, 15 bp, Homo sapiens
tttagtactttcaaa

SEQ ID NO: 129161 - DNA, 15 bp, Homo sapiens
atttagtactttcaa

SEQ ID NO: 129162 - DNA, 15 bp, Homo sapiens
aatttagtactttca

SEQ ID NO: 129163 - DNA, 15 bp, Homo sapiens
taatttagtactttc

SEQ ID NO: 129164 - DNA, 15 bp, Homo sapiens
ctaatttagtacttt

SEQ ID NO: 129165 - DNA, 15 bp, Homo sapiens
actaatttagtactt

SEQ ID NO: 129166 - DNA, 15 bp, Homo sapiens
gactaatttagtact

SEQ ID NO: 129167 - DNA, 15 bp, Homo sapiens
tgactaatttagtac

SEQ ID NO: 129168 - DNA, 15 bp, Homo sapiens
atgactaatttagta

SEQ ID NO: 129169 - DNA, 15 bp, Homo sapiens
catgactaatttagt

SEQ ID NO: 129170 - DNA, 15 bp, Homo sapiens
tcatgactaatttag

SEQ ID NO: 129171 - DNA, 15 bp, Homo sapiens
atcatgactaattta

SEQ ID NO: 129172 - DNA, 15 bp, Homo sapiens
gatcatgactaattt

SEQ ID NO: 129173 - DNA, 15 bp, Homo sapiens
agatcatgactaatt

SEQ ID NO: 129174 - DNA, 15 bp, Homo sapiens
aagatcatgactaat

SEQ ID NO: 129175 - DNA, 15 bp, Homo sapiens
caagatcatgactaa

SEQ ID NO: 129176 - DNA, 15 bp, Homo sapiens
tcaagatcatgacta

SEQ ID NO: 129177 - DNA, 15 bp, Homo sapiens
ttcaagatcatgact

SEQ ID NO: 129178 - DNA, 15 bp, Homo sapiens
tttcaagatcatgac

SEQ ID NO: 129179 - DNA, 15 bp, Homo sapiens
gtttcaagatcatga

SEQ ID NO: 129180 - DNA, 15 bp, Homo sapiens
tgtttcaagatcatg

SEQ ID NO: 129181 - DNA, 15 bp, Homo sapiens
atgtttcaagatcat

SEQ ID NO: 129182 - DNA, 15 bp, Homo sapiens
aatgtttcaagatca

SEQ ID NO: 129183 - DNA, 15 bp, Homo sapiens
caatgtttcaagatc

SEQ ID NO: 129184 - DNA, 15 bp, Homo sapiens
ccaatgtttcaagat

SEQ ID NO: 129185 - DNA, 15 bp, Homo sapiens
tccaatgtttcaaga

SEQ ID NO: 129186 - DNA, 15 bp, Homo sapiens
gtccaatgtttcaag

SEQ ID NO: 129187 - DNA, 15 bp, Homo sapiens
cgtccaatgtttcaa

SEQ ID NO: 129188 - DNA, 15 bp, Homo sapiens
acgtccaatgtttca

SEQ ID NO: 129189 - DNA, 15 bp, Homo sapiens
cacgtccaatgtttc

SEQ ID NO: 129190 - DNA, 15 bp, Homo sapiens
tcacgtccaatgttt

SEQ ID NO: 129191 - DNA, 15 bp, Homo sapiens
ttcacgtccaatgtt

SEQ ID NO: 129192 - DNA, 15 bp, Homo sapiens
tttcacgtccaatgt

SEQ ID NO: 129193 - DNA, 15 bp, Homo sapiens
atttcacgtccaatg

SEQ ID NO: 129194 - DNA, 15 bp, Homo sapiens
aatttcacgtccaat

SEQ ID NO: 129195 - DNA, 15 bp, Homo sapiens
aaatttcacgtccaa

SEQ ID NO: 129196 - DNA, 15 bp, Homo sapiens
gaaatttcacgtcca

SEQ ID NO: 129197 - DNA, 15 bp, Homo sapiens
tgaaatttcacgtcc

SEQ ID NO: 129198 - DNA, 15 bp, Homo sapiens
ttgaaatttcacgtc

SEQ ID NO: 129199 - DNA, 15 bp, Homo sapiens
gttgaaatttcacgt

SEQ ID NO: 129200 - DNA, 15 bp, Homo sapiens
agttgaaatttcacg

SEQ ID NO: 129201 - DNA, 15 bp, Homo sapiens
gagttgaaatttcac

SEQ ID NO: 129202 - DNA, 15 bp, Homo sapiens
agagttgaaatttca

SEQ ID NO: 129203 - DNA, 15 bp, Homo sapiens
aagagttgaaatttc

SEQ ID NO: 129204 - DNA, 15 bp, Homo sapiens
aaagagttgaaattt

SEQ ID NO: 129205 - DNA, 15 bp, Homo sapiens
aaaagagttgaaatt

SEQ ID NO: 129206 - DNA, 15 bp, Homo sapiens
aaaaagagttgaaat

SEQ ID NO: 129207 - DNA, 15 bp, Homo sapiens
aaaaaagagttgaaa

SEQ ID NO: 129208 - DNA, 15 bp, Homo sapiens
taaaaaagagttgaa

SEQ ID NO: 129209 - DNA, 15 bp, Homo sapiens
ctaaaaaagagttga

SEQ ID NO: 129210 - DNA, 15 bp, Homo sapiens
tctaaaaaagagttg

SEQ ID NO: 129211 - DNA, 15 bp, Homo sapiens
ttctaaaaaagagtt

SEQ ID NO: 129212 - DNA, 15 bp, Homo sapiens
tttctaaaaaagagt

SEQ ID NO: 129213 - DNA, 15 bp, Homo sapiens
gtttctaaaaaagag

SEQ ID NO: 129214 - DNA, 15 bp, Homo sapiens
tgtttctaaaaaaga

SEQ ID NO: 129215 - DNA, 15 bp, Homo sapiens
ttgtttctaaaaaag

SEQ ID NO: 129216 - DNA, 15 bp, Homo sapiens
cctttgtttctaaaa

SEQ ID NO: 129217 - DNA, 15 bp, Homo sapiens
gcctttgtttctaaa

SEQ ID NO: 129218 - DNA, 15 bp, Homo sapiens
ggcctttgtttctaa

SEQ ID NO: 129219 - DNA, 15 bp, Homo sapiens
aggcctttgtttcta

SEQ ID NO: 129220 - DNA, 15 bp, Homo sapiens
taggcctttgtttct

SEQ ID NO: 129221 - DNA, 15 bp, Homo sapiens
ataggcctttgtttc

SEQ ID NO: 129222 - DNA, 15 bp, Homo sapiens
tataggcctttgttt

SEQ ID NO: 129223 - DNA, 15 bp, Homo sapiens
ttataggcctttgtt

SEQ ID NO: 129224 - DNA, 15 bp, Homo sapiens
attataggcctttgt

SEQ ID NO: 129225 - DNA, 15 bp, Homo sapiens
tattataggcctttg

SEQ ID NO: 129226 - DNA, 15 bp, Homo sapiens
ctattataggccttt

SEQ ID NO: 129227 - DNA, 15 bp, Homo sapiens
actattataggcctt

SEQ ID NO: 129228 - DNA, 15 bp, Homo sapiens
tactattataggcct

SEQ ID NO: 129229 - DNA, 15 bp, Homo sapiens
atactattataggcc

SEQ ID NO: 129230 - DNA, 15 bp, Homo sapiens
aatactattataggc

SEQ ID NO: 129231 - DNA, 15 bp, Homo sapiens
aaatactattatagg

SEQ ID NO: 129232 - DNA, 15 bp, Homo sapiens
aaaatactattatag

SEQ ID NO: 129233 - DNA, 15 bp, Homo sapiens
caaaatactattata

SEQ ID NO: 129234 - DNA, 15 bp, Homo sapiens
ccaaaatactattat

SEQ ID NO: 129235 - DNA, 15 bp, Homo sapiens
cccaaaatactatta

SEQ ID NO: 129236 - DNA, 15 bp, Homo sapiens
acccaaaatactatt

SEQ ID NO: 129237 - DNA, 15 bp, Homo sapiens
cacccaaaatactat

SEQ ID NO: 129238 - DNA, 15 bp, Homo sapiens
acacccaaaatacta

SEQ ID NO: 129239 - DNA, 15 bp, Homo sapiens
aacacccaaaatact

SEQ ID NO: 129240 - DNA, 15 bp, Homo sapiens
aaacacccaaaatac

SEQ ID NO: 129241 - DNA, 15 bp, Homo sapiens
gaaacacccaaaata

SEQ ID NO: 129242 - DNA, 15 bp, Homo sapiens
ggaaacacccaaaat

SEQ ID NO: 129243 - DNA, 15 bp, Homo sapiens
tggaaacacccaaaa

SEQ ID NO: 129244 - DNA, 15 bp, Homo sapiens
ttggaaacacccaaa

SEQ ID NO: 129245 - DNA, 15 bp, Homo sapiens
tttggaaacacccaa

SEQ ID NO: 129246 - DNA, 15 bp, Homo sapiens
ctttggaaacaccca

SEQ ID NO: 129247 - DNA, 15 bp, Homo sapiens
actttggaaacaccc

SEQ ID NO: 129248 - DNA, 15 bp, Homo sapiens
aactttggaaacacc

SEQ ID NO: 129249 - DNA, 15 bp, Homo sapiens
caactttggaaacac

SEQ ID NO: 129250 - DNA, 15 bp, Homo sapiens
acaactttggaaaca

SEQ ID NO: 129251 - DNA, 15 bp, Homo sapiens
gacaactttggaaac

SEQ ID NO: 129252 - DNA, 15 bp, Homo sapiens
tgacaactttggaaa

SEQ ID NO: 129253 - DNA, 15 bp, Homo sapiens
atgacaactttggaa

SEQ ID NO: 129254 - DNA, 15 bp, Homo sapiens
aatgacaactttgga

SEQ ID NO: 129255 - DNA, 15 bp, Homo sapiens
aaatgacaactttgg

SEQ ID NO: 129256 - DNA, 15 bp, Homo sapiens
taaatgacaactttg

SEQ ID NO: 129257 - DNA, 15 bp, Homo sapiens
ttaaatgacaacttt

SEQ ID NO: 129258 - DNA, 15 bp, Homo sapiens
cttaaatgacaactt

SEQ ID NO: 129259 - DNA, 15 bp, Homo sapiens
acttaaatgacaact

SEQ ID NO: 129260 - DNA, 15 bp, Homo sapiens
aacttaaatgacaac

SEQ ID NO: 129261 - DNA, 15 bp, Homo sapiens
taacttaaatgacaa

SEQ ID NO: 129262 - DNA, 15 bp, Homo sapiens
ttaacttaaatgaca

SEQ ID NO: 129263 - DNA, 15 bp, Homo sapiens
tttaacttaaatgac

SEQ ID NO: 129264 - DNA, 15 bp, Homo sapiens
atttaacttaaatga

SEQ ID NO: 129265 - DNA, 15 bp, Homo sapiens
tatttaacttaaatg

SEQ ID NO: 129266 - DNA, 15 bp, Homo sapiens
gtatttaacttaaat

SEQ ID NO: 129267 - DNA, 15 bp, Homo sapiens
agtatttaacttaaa

SEQ ID NO: 129268 - DNA, 15 bp, Homo sapiens
aagtatttaacttaa

SEQ ID NO: 129269 - DNA, 15 bp, Homo sapiens
aaagtatttaactta

SEQ ID NO: 129270 - DNA, 15 bp, Homo sapiens
aaaagtatttaactt

SEQ ID NO: 129271 - DNA, 15 bp, Homo sapiens
gaaaagtatttaact

SEQ ID NO: 129272 - DNA, 15 bp, Homo sapiens
tgaaaagtatttaac

SEQ ID NO: 129273 - DNA, 15 bp, Homo sapiens
gtgaaaagtatttaa

SEQ ID NO: 129274 - DNA, 15 bp, Homo sapiens
agtgaaaagtattta

SEQ ID NO: 129275 - DNA, 15 bp, Homo sapiens
tagtgaaaagtattt

SEQ ID NO: 129276 - DNA, 15 bp, Homo sapiens
atagtgaaaagtatt

SEQ ID NO: 129277 - DNA, 15 bp, Homo sapiens
catagtgaaaagtat

SEQ ID NO: 129278 - DNA, 15 bp, Homo sapiens
ccatagtgaaaagta

SEQ ID NO: 129279 - DNA, 15 bp, Homo sapiens
tccatagtgaaaagt

SEQ ID NO: 129280 - DNA, 15 bp, Homo sapiens
ctccatagtgaaaag

SEQ ID NO: 129281 - DNA, 15 bp, Homo sapiens
cctccatagtgaaaa

SEQ ID NO: 129282 - DNA, 15 bp, Homo sapiens
ccctccatagtgaaa

SEQ ID NO: 129283 - DNA, 15 bp, Homo sapiens
accctccatagtgaa

SEQ ID NO: 129284 - DNA, 15 bp, Homo sapiens
taccctccatagtga

SEQ ID NO: 129285 - DNA, 15 bp, Homo sapiens
ctaccctccatagtg

SEQ ID NO: 129286 - DNA, 15 bp, Homo sapiens
tctaccctccatagt

SEQ ID NO: 129287 - DNA, 15 bp, Homo sapiens
atctaccctccatag

SEQ ID NO: 129288 - DNA, 15 bp, Homo sapiens
aatctaccctccata

SEQ ID NO: 129289 - DNA, 15 bp, Homo sapiens
taatctaccctccat

SEQ ID NO: 129290 - DNA, 15 bp, Homo sapiens
gtaatctaccctcca

SEQ ID NO: 129291 - DNA, 15 bp, Homo sapiens
agtaatctaccctcc

SEQ ID NO: 129292 - DNA, 15 bp, Homo sapiens
aagtaatctaccctc

SEQ ID NO: 129293 - DNA, 15 bp, Homo sapiens
caagtaatctaccct

SEQ ID NO: 129294 - DNA, 15 bp, Homo sapiens
acaagtaatctaccc

SEQ ID NO: 129295 - DNA, 15 bp, Homo sapiens
aacaagtaatctacc

SEQ ID NO: 129296 - DNA, 15 bp, Homo sapiens
aaacaagtaatctac

SEQ ID NO: 129297 - DNA, 15 bp, Homo sapiens
aaaacaagtaatcta

SEQ ID NO: 129298 - DNA, 15 bp, Homo sapiens
taaaacaagtaatct

SEQ ID NO: 129299 - DNA, 15 bp, Homo sapiens
ctaaaacaagtaatc

SEQ ID NO: 129300 - DNA, 15 bp, Homo sapiens
actaaaacaagtaat

SEQ ID NO: 129301 - DNA, 15 bp, Homo sapiens
gactaaaacaagtaa

SEQ ID NO: 129302 - DNA, 15 bp, Homo sapiens
agactaaaacaagta

SEQ ID NO: 129303 - DNA, 15 bp, Homo sapiens
aagactaaaacaagt

SEQ ID NO: 129304 - DNA, 15 bp, Homo sapiens
taagactaaaacaag

SEQ ID NO: 129305 - DNA, 15 bp, Homo sapiens
ctaagactaaaacaa

SEQ ID NO: 129306 - DNA, 15 bp, Homo sapiens
actaagactaaaaca

SEQ ID NO: 129307 - DNA, 15 bp, Homo sapiens
tactaagactaaaac

SEQ ID NO: 129308 - DNA, 15 bp, Homo sapiens
ttactaagactaaaa

SEQ ID NO: 129309 - DNA, 15 bp, Homo sapiens
attactaagactaaa

SEQ ID NO: 129310 - DNA, 15 bp, Homo sapiens
aattactaagactaa

SEQ ID NO: 129311 - DNA, 15 bp, Homo sapiens
taattactaagacta

SEQ ID NO: 129312 - DNA, 15 bp, Homo sapiens
ctaattactaagact

SEQ ID NO: 129313 - DNA, 15 bp, Homo sapiens
actaattactaagac

SEQ ID NO: 129314 - DNA, 15 bp, Homo sapiens
cactaattactaaga

SEQ ID NO: 129315 - DNA, 15 bp, Homo sapiens
gcactaattactaag

SEQ ID NO: 129316 - DNA, 15 bp, Homo sapiens
agcactaattactaa

SEQ ID NO: 129317 - DNA, 15 bp, Homo sapiens
cagcactaattacta

SEQ ID NO: 129318 - DNA, 15 bp, Homo sapiens
acagcactaattact

SEQ ID NO: 129319 - DNA, 15 bp, Homo sapiens
aacagcactaattac

SEQ ID NO: 129320 - DNA, 15 bp, Homo sapiens
caacagcactaatta

SEQ ID NO: 129321 - DNA, 15 bp, Homo sapiens
gcaacagcactaatt

SEQ ID NO: 129322 - DNA, 15 bp, Homo sapiens
agcaacagcactaat

SEQ ID NO: 129323 - DNA, 15 bp, Homo sapiens
cagcaacagcactaa

SEQ ID NO: 129324 - DNA, 15 bp, Homo sapiens
acagcaacagcacta

SEQ ID NO: 129325 - DNA, 15 bp, Homo sapiens
tacagcaacagcact

SEQ ID NO: 129326 - DNA, 15 bp, Homo sapiens
atacagcaacagcac

SEQ ID NO: 129327 - DNA, 15 bp, Homo sapiens
aatacagcaacagca

SEQ ID NO: 129328 - DNA, 15 bp, Homo sapiens
aaatacagcaacagc

SEQ ID NO: 129329 - DNA, 15 bp, Homo sapiens
taaatacagcaacag

SEQ ID NO: 129330 - DNA, 15 bp, Homo sapiens
ataaatacagcaaca

SEQ ID NO: 129331 - DNA, 15 bp, Homo sapiens
aataaatacagcaac

SEQ ID NO: 129332 - DNA, 15 bp, Homo sapiens
aaataaatacagcaa

SEQ ID NO: 129333 - DNA, 15 bp, Homo sapiens
taaataaatacagca

SEQ ID NO: 129334 - DNA, 15 bp, Homo sapiens
ataaataaatacagc

SEQ ID NO: 129335 - DNA, 15 bp, Homo sapiens
aataaataaatacag

SEQ ID NO: 129336 - DNA, 15 bp, Homo sapiens
aaataaataaataca

SEQ ID NO: 129337 - DNA, 15 bp, Homo sapiens
aaaataaataaatac

SEQ ID NO: 129338 - DNA, 15 bp, Homo sapiens
taaaaataaataaat

SEQ ID NO: 129339 - DNA, 15 bp, Homo sapiens
ttaaaaataaataaa

SEQ ID NO: 129340 - DNA, 15 bp, Homo sapiens
gattaaaaataaata

SEQ ID NO: 129341 - DNA, 15 bp, Homo sapiens
agattaaaaataaat

SEQ ID NO: 129342 - DNA, 15 bp, Homo sapiens
aagattaaaaataaa

SEQ ID NO: 129343 - DNA, 15 bp, Homo sapiens
taagattaaaaataa

SEQ ID NO: 129344 - DNA, 15 bp, Homo sapiens
ttaagattaaaaata

SEQ ID NO: 129345 - DNA, 15 bp, Homo sapiens
tttaagattaaaaat

SEQ ID NO: 129346 - DNA, 15 bp, Homo sapiens
ctttaagattaaaaa

SEQ ID NO: 129347 - DNA, 15 bp, Homo sapiens
cctttaagattaaaa

SEQ ID NO: 129348 - DNA, 15 bp, Homo sapiens
tcctttaagattaaa

SEQ ID NO: 129349 - DNA, 15 bp, Homo sapiens
ctcctttaagattaa

SEQ ID NO: 129350 - DNA, 15 bp, Homo sapiens
gctcctttaagatta

SEQ ID NO: 129351 - DNA, 15 bp, Homo sapiens
tgctcctttaagatt

SEQ ID NO: 129352 - DNA, 15 bp, Homo sapiens
atgctcctttaagat

SEQ ID NO: 129353 - DNA, 15 bp, Homo sapiens
aatgctcctttaaga

SEQ ID NO: 129354 - DNA, 15 bp, Homo sapiens
gaatgctcctttaag

SEQ ID NO: 129355 - DNA, 15 bp, Homo sapiens
agaatgctcctttaa

SEQ ID NO: 129356 - DNA, 15 bp, Homo sapiens
aagaatgctccttta

SEQ ID NO: 129357 - DNA, 15 bp, Homo sapiens
aaagaatgctccttt

SEQ ID NO: 129358 - DNA, 15 bp, Homo sapiens
gaaagaatgctcctt

SEQ ID NO: 129359 - DNA, 15 bp, Homo sapiens
agaaagaatgctcct

SEQ ID NO: 129360 - DNA, 15 bp, Homo sapiens
aagaaagaatgctcc

SEQ ID NO: 129361 - DNA, 15 bp, Homo sapiens
caagaaagaatgctc

SEQ ID NO: 129362 - DNA, 15 bp, Homo sapiens
tcaagaaagaatgct

SEQ ID NO: 129363 - DNA, 15 bp, Homo sapiens
atcaagaaagaatgc

SEQ ID NO: 129364 - DNA, 15 bp, Homo sapiens
catcaagaaagaatg

SEQ ID NO: 129365 - DNA, 15 bp, Homo sapiens
ccatcaagaaagaat

SEQ ID NO: 129366 - DNA, 15 bp, Homo sapiens
tccatcaagaaagaa

SEQ ID NO: 129367 - DNA, 15 bp, Homo sapiens
atccatcaagaaaga

SEQ ID NO: 129368 - DNA, 15 bp, Homo sapiens
tatccatcaagaaag

SEQ ID NO: 129369 - DNA, 15 bp, Homo sapiens
gtatccatcaagaaa

SEQ ID NO: 129370 - DNA, 15 bp, Homo sapiens
agtatccatcaagaa

SEQ ID NO: 129371 - DNA, 15 bp, Homo sapiens
aagtatccatcaaga

SEQ ID NO: 129372 - DNA, 15 bp, Homo sapiens
taagtatccatcaag

SEQ ID NO: 129373 - DNA, 15 bp, Homo sapiens
ttaagtatccatcaa

SEQ ID NO: 129374 - DNA, 15 bp, Homo sapiens
tttaagtatccatca

SEQ ID NO: 129375 - DNA, 15 bp, Homo sapiens
ttttaagtatccatc

SEQ ID NO: 129376 - DNA, 15 bp, Homo sapiens
tttttaagtatccat

SEQ ID NO: 129377 - DNA, 15 bp, Homo sapiens
atttttaagtatcca

SEQ ID NO: 129378 - DNA, 15 bp, Homo sapiens
aatttttaagtatcc

SEQ ID NO: 129379 - DNA, 15 bp, Homo sapiens
taatttttaagtatc

SEQ ID NO: 129380 - DNA, 15 bp, Homo sapiens
ataatttttaagtat

SEQ ID NO: 129381 - DNA, 15 bp, Homo sapiens
cataatttttaagta

SEQ ID NO: 129382 - DNA, 15 bp, Homo sapiens
tcataatttttaagt

SEQ ID NO: 129383 - DNA, 15 bp, Homo sapiens
atcataatttttaag

SEQ ID NO: 129384 - DNA, 15 bp, Homo sapiens
aatcataatttttaa

SEQ ID NO: 129385 - DNA, 15 bp, Homo sapiens
aaatcataattttta

SEQ ID NO: 129386 - DNA, 15 bp, Homo sapiens
aaaatcataattttt

SEQ ID NO: 129387 - DNA, 15 bp, Homo sapiens
caaaatcataatttt

SEQ ID NO: 129388 - DNA, 15 bp, Homo sapiens
acaaaatcataattt

SEQ ID NO: 129389 - DNA, 15 bp, Homo sapiens
tacaaaatcataatt

SEQ ID NO: 129390 - DNA, 15 bp, Homo sapiens
ctacaaaatcataat

SEQ ID NO: 129391 - DNA, 15 bp, Homo sapiens
actacaaaatcataa

SEQ ID NO: 129392 - DNA, 15 bp, Homo sapiens
cactacaaaatcata

SEQ ID NO: 129393 - DNA, 15 bp, Homo sapiens
tcactacaaaatcat

SEQ ID NO: 129394 - DNA, 15 bp, Homo sapiens
atcactacaaaatca

SEQ ID NO: 129395 - DNA, 15 bp, Homo sapiens
aatcactacaaaatc

SEQ ID NO: 129396 - DNA, 15 bp, Homo sapiens
aaatcactacaaaat

SEQ ID NO: 129397 - DNA, 15 bp, Homo sapiens
aaaatcactacaaaa

SEQ ID NO: 129398 - DNA, 15 bp, Homo sapiens
gaaaatcactacaaa

SEQ ID NO: 129399 - DNA, 15 bp, Homo sapiens
tgaaaatcactacaa

SEQ ID NO: 129400 - DNA, 15 bp, Homo sapiens
atgaaaatcactaca

SEQ ID NO: 129401 - DNA, 15 bp, Homo sapiens
aatgaaaatcactac

SEQ ID NO: 129402 - DNA, 15 bp, Homo sapiens
aaatgaaaatcacta

SEQ ID NO: 129403 - DNA, 15 bp, Homo sapiens
aaaatgaaaatcact

SEQ ID NO: 129404 - DNA, 15 bp, Homo sapiens
aaaaatgaaaatcac

SEQ ID NO: 129405 - DNA, 15 bp, Homo sapiens
aaaaaatgaaaatca

SEQ ID NO: 129406 - DNA, 15 bp, Homo sapiens
aaaaaaatgaaaatc

SEQ ID NO: 129407 - DNA, 15 bp, Homo sapiens
taaaaaaatgaaaat

SEQ ID NO: 129408 - DNA, 15 bp, Homo sapiens
ttaaaaaaatgaaaa

SEQ ID NO: 129409 - DNA, 15 bp, Homo sapiens
tttaaaaaaatgaaa

SEQ ID NO: 129410 - DNA, 15 bp, Homo sapiens
gtttaaaaaaatgaa

SEQ ID NO: 129411 - DNA, 15 bp, Homo sapiens
tgtttaaaaaaatga

SEQ ID NO: 129412 - DNA, 15 bp, Homo sapiens
atgtttaaaaaaatg

SEQ ID NO: 129413 - DNA, 15 bp, Homo sapiens
aatgtttaaaaaaat

SEQ ID NO: 129414 - DNA, 15 bp, Homo sapiens
taatgtttaaaaaaa

SEQ ID NO: 129415 - DNA, 15 bp, Homo sapiens
ataatgtttaaaaaa

SEQ ID NO: 129416 - DNA, 15 bp, Homo sapiens
tataatgtttaaaaa

SEQ ID NO: 129417 - DNA, 15 bp, Homo sapiens
gtataatgtttaaaa

SEQ ID NO: 129418 - DNA, 15 bp, Homo sapiens
tgtataatgtttaaa

SEQ ID NO: 129419 - DNA, 15 bp, Homo sapiens
atgtataatgtttaa

SEQ ID NO: 129420 - DNA, 15 bp, Homo sapiens
gatgtataatgttta

SEQ ID NO: 129421 - DNA, 15 bp, Homo sapiens
tgatgtataatgttt

SEQ ID NO: 129422 - DNA, 15 bp, Homo sapiens
ttgatgtataatgtt

SEQ ID NO: 129423 - DNA, 15 bp, Homo sapiens
tttgatgtataatgt

SEQ ID NO: 129424 - DNA, 15 bp, Homo sapiens
atttgatgtataatg

SEQ ID NO: 129425 - DNA, 15 bp, Homo sapiens
tatttgatgtataat

SEQ ID NO: 129426 - DNA, 15 bp, Homo sapiens
atatttgatgtataa

SEQ ID NO: 129427 - DNA, 15 bp, Homo sapiens
aatatttgatgtata

SEQ ID NO: 129428 - DNA, 15 bp, Homo sapiens
caatatttgatgtat

SEQ ID NO: 129429 - DNA, 15 bp, Homo sapiens
tcaatatttgatgta

SEQ ID NO: 129430 - DNA, 15 bp, Homo sapiens
gtcaatatttgatgt

SEQ ID NO: 129431 - DNA, 15 bp, Homo sapiens
agtcaatatttgatg

SEQ ID NO: 129432 - DNA, 15 bp, Homo sapiens
cagtcaatatttgat

SEQ ID NO: 129433 - DNA, 15 bp, Homo sapiens
acagtcaatatttga

SEQ ID NO: 129434 - DNA, 15 bp, Homo sapiens
aacagtcaatatttg

SEQ ID NO: 129435 - DNA, 15 bp, Homo sapiens
aaacagtcaatattt

SEQ ID NO: 129436 - DNA, 15 bp, Homo sapiens
taaacagtcaatatt

SEQ ID NO: 129437 - DNA, 15 bp, Homo sapiens
ataaacagtcaatat

SEQ ID NO: 129438 - DNA, 15 bp, Homo sapiens
aataaacagtcaata

SEQ ID NO: 129439 - DNA, 15 bp, Homo sapiens
taataaacagtcaat

SEQ ID NO: 129440 - DNA, 15 bp, Homo sapiens
ttaataaacagtcaa

SEQ ID NO: 129441 - DNA, 15 bp, Homo sapiens
tttaataaacagtca

SEQ ID NO: 129442 - DNA, 15 bp, Homo sapiens
atttaataaacagtc

SEQ ID NO: 129443 - DNA, 15 bp, Homo sapiens
tatttaataaacagt

SEQ ID NO: 129444 - DNA, 15 bp, Homo sapiens
atatttaataaacag

SEQ ID NO: 129445 - DNA, 15 bp, Homo sapiens
tatatttaataaaca

SEQ ID NO: 129446 - DNA, 15 bp, Homo sapiens
ctatatttaataaac

SEQ ID NO: 129447 - DNA, 15 bp, Homo sapiens
tctatatttaataaa

SEQ ID NO: 129448 - DNA, 15 bp, Homo sapiens
ttctatatttaataa

SEQ ID NO: 129449 - DNA, 15 bp, Homo sapiens
cttctatatttaata

SEQ ID NO: 129450 - DNA, 15 bp, Homo sapiens
acttctatatttaat

SEQ ID NO: 129451 - DNA, 15 bp, Homo sapiens
tacttctatatttaa

SEQ ID NO: 129452 - DNA, 15 bp, Homo sapiens
atacttctatattta

SEQ ID NO: 129453 - DNA, 15 bp, Homo sapiens
aatacttctatattt

SEQ ID NO: 129454 - DNA, 15 bp, Homo sapiens
taatacttctatatt

SEQ ID NO: 129455 - DNA, 15 bp, Homo sapiens
ataatacttctatat

SEQ ID NO: 129456 - DNA, 15 bp, Homo sapiens
gataatacttctata

SEQ ID NO: 129457 - DNA, 15 bp, Homo sapiens
agataatacttctat

SEQ ID NO: 129458 - DNA, 15 bp, Homo sapiens
tagataatacttcta

SEQ ID NO: 129459 - DNA, 15 bp, Homo sapiens
ttagataatacttct

SEQ ID NO: 129460 - DNA, 15 bp, Homo sapiens
attagataatacttc

SEQ ID NO: 129461 - DNA, 15 bp, Homo sapiens
tattagataatactt

SEQ ID NO: 129462 - DNA, 15 bp, Homo sapiens
atattagataatact

SEQ ID NO: 129463 - DNA, 15 bp, Homo sapiens
aatattagataatac

SEQ ID NO: 129464 - DNA, 15 bp, Homo sapiens
aaatattagataata

SEQ ID NO: 129465 - DNA, 15 bp, Homo sapiens
aaaatattagataat

SEQ ID NO: 129466 - DNA, 15 bp, Homo sapiens
taaaatattagataa

SEQ ID NO: 129467 - DNA, 15 bp, Homo sapiens
ataaaatattagata

SEQ ID NO: 129468 - DNA, 15 bp, Homo sapiens
aataaaatattagat

SEQ ID NO: 129469 - DNA, 15 bp, Homo sapiens
taataaaatattaga

SEQ ID NO: 129470 - DNA, 15 bp, Homo sapiens
gtaataaaatattag

SEQ ID NO: 129471 - DNA, 15 bp, Homo sapiens
tgtaataaaatatta

SEQ ID NO: 129472 - DNA, 15 bp, Homo sapiens
atgtaataaaatatt

SEQ ID NO: 129473 - DNA, 15 bp, Homo sapiens
catgtaataaaatat

SEQ ID NO: 129474 - DNA, 15 bp, Homo sapiens
acatgtaataaaata

SEQ ID NO: 129475 - DNA, 15 bp, Homo sapiens
tacatgtaataaaat

SEQ ID NO: 129476 - DNA, 15 bp, Homo sapiens
atacatgtaataaaa

SEQ ID NO: 129477 - DNA, 15 bp, Homo sapiens
aatacatgtaataaa

SEQ ID NO: 129478 - DNA, 15 bp, Homo sapiens
caatacatgtaataa

SEQ ID NO: 129479 - DNA, 15 bp, Homo sapiens
gcaatacatgtaata

SEQ ID NO: 129480 - DNA, 15 bp, Homo sapiens
tgcaatacatgtaat

SEQ ID NO: 129481 - DNA, 15 bp, Homo sapiens
gtgcaatacatgtaa

SEQ ID NO: 129482 - DNA, 15 bp, Homo sapiens
cgtgcaatacatgta

SEQ ID NO: 129483 - DNA, 15 bp, Homo sapiens
tcgtgcaatacatgt

SEQ ID NO: 129484 - DNA, 15 bp, Homo sapiens
atcgtgcaatacatg

SEQ ID NO: 129485 - DNA, 15 bp, Homo sapiens
aatcgtgcaatacat

SEQ ID NO: 129486 - DNA, 15 bp, Homo sapiens
taatcgtgcaataca

SEQ ID NO: 129487 - DNA, 15 bp, Homo sapiens
ataatcgtgcaatac

SEQ ID NO: 129488 - DNA, 15 bp, Homo sapiens
cataatcgtgcaata

SEQ ID NO: 129489 - DNA, 15 bp, Homo sapiens
acataatcgtgcaat

SEQ ID NO: 129490 - DNA, 15 bp, Homo sapiens
cacataatcgtgcaa

SEQ ID NO: 129491 - DNA, 15 bp, Homo sapiens
tcacataatcgtgca

SEQ ID NO: 129492 - DNA, 15 bp, Homo sapiens
ctcacataatcgtgc

SEQ ID NO: 129493 - DNA, 15 bp, Homo sapiens
tctcacataatcgtg

SEQ ID NO: 129494 - DNA, 15 bp, Homo sapiens
ttctcacataatcgt

SEQ ID NO: 129495 - DNA, 15 bp, Homo sapiens
gttctcacataatcg

SEQ ID NO: 129496 - DNA, 15 bp, Homo sapiens
agttctcacataatc

SEQ ID NO: 129497 - DNA, 15 bp, Homo sapiens
aagttctcacataat

SEQ ID NO: 129498 - DNA, 15 bp, Homo sapiens
aaagttctcacataa

SEQ ID NO: 129499 - DNA, 15 bp, Homo sapiens
aaaagttctcacata

SEQ ID NO: 129500 - DNA, 15 bp, Homo sapiens
caaaagttctcacat

SEQ ID NO: 129501 - DNA, 15 bp, Homo sapiens
acaaaagttctcaca

SEQ ID NO: 129502 - DNA, 15 bp, Homo sapiens
cacaaaagttctcac

SEQ ID NO: 129503 - DNA, 15 bp, Homo sapiens
tcacaaaagttctca

SEQ ID NO: 129504 - DNA, 15 bp, Homo sapiens
atcacaaaagttctc

SEQ ID NO: 129505 - DNA, 15 bp, Homo sapiens
aatcacaaaagttct

SEQ ID NO: 129506 - DNA, 15 bp, Homo sapiens
taatcacaaaagttc

SEQ ID NO: 129507 - DNA, 15 bp, Homo sapiens
ttaatcacaaaagtt

SEQ ID NO: 129508 - DNA, 15 bp, Homo sapiens
tttaatcacaaaagt

SEQ ID NO: 129509 - DNA, 15 bp, Homo sapiens
ttttaatcacaaaag

SEQ ID NO: 129510 - DNA, 15 bp, Homo sapiens
tttttaatcacaaaa

SEQ ID NO: 129511 - DNA, 15 bp, Homo sapiens
atttttaatcacaaa

SEQ ID NO: 129512 - DNA, 15 bp, Homo sapiens
catttttaatcacaa

SEQ ID NO: 129513 - DNA, 15 bp, Homo sapiens
tcatttttaatcaca

SEQ ID NO: 129514 - DNA, 15 bp, Homo sapiens
ttcatttttaatcac

SEQ ID NO: 129515 - DNA, 15 bp, Homo sapiens
tttcatttttaatca

SEQ ID NO: 129516 - DNA, 15 bp, Homo sapiens
ttttcatttttaatc

SEQ ID NO: 129517 - DNA, 15 bp, Homo sapiens
gttttcatttttaat

SEQ ID NO: 129518 - DNA, 15 bp, Homo sapiens
agttttcatttttaa

SEQ ID NO: 129519 - DNA, 15 bp, Homo sapiens
gagttttcattttta

SEQ ID NO: 129520 - DNA, 15 bp, Homo sapiens
ggagttttcattttt

SEQ ID NO: 129521 - DNA, 15 bp, Homo sapiens
aggagttttcatttt

SEQ ID NO: 129522 - DNA, 15 bp, Homo sapiens
taggagttttcattt

SEQ ID NO: 129523 - DNA, 15 bp, Homo sapiens
ctaggagttttcatt

SEQ ID NO: 129524 - DNA, 15 bp, Homo sapiens
gctaggagttttcat

SEQ ID NO: 129525 - DNA, 15 bp, Homo sapiens
agctaggagttttca

SEQ ID NO: 129526 - DNA, 15 bp, Homo sapiens
cagctaggagttttc

SEQ ID NO: 129527 - DNA, 15 bp, Homo sapiens
gcagctaggagtttt

SEQ ID NO: 129528 - DNA, 15 bp, Homo sapiens
tgcagctaggagttt

SEQ ID NO: 129529 - DNA, 15 bp, Homo sapiens
ttgcagctaggagtt

SEQ ID NO: 129530 - DNA, 15 bp, Homo sapiens
tttgcagctaggagt

SEQ ID NO: 129531 - DNA, 15 bp, Homo sapiens
ttttgcagctaggag

SEQ ID NO: 129532 - DNA, 15 bp, Homo sapiens
tttttgcagctagga

SEQ ID NO: 129533 - DNA, 15 bp, Homo sapiens
gtttttgcagctagg

SEQ ID NO: 129534 - DNA, 15 bp, Homo sapiens
tgtttttgcagctag

SEQ ID NO: 129535 - DNA, 15 bp, Homo sapiens
atgtttttgcagcta

SEQ ID NO: 129536 - DNA, 15 bp, Homo sapiens
tatgtttttgcagct

SEQ ID NO: 129537 - DNA, 15 bp, Homo sapiens
ttatgtttttgcagc

SEQ ID NO: 129538 - DNA, 15 bp, Homo sapiens
tttatgtttttgcag

SEQ ID NO: 129539 - DNA, 15 bp, Homo sapiens
atttatgtttttgca

SEQ ID NO: 129540 - DNA, 15 bp, Homo sapiens
aatttatgtttttgc

SEQ ID NO: 129541 - DNA, 15 bp, Homo sapiens
gaatttatgtttttg

SEQ ID NO: 129542 - DNA, 15 bp, Homo sapiens
agaatttatgttttt

SEQ ID NO: 129543 - DNA, 15 bp, Homo sapiens
aagaatttatgtttt

SEQ ID NO: 129544 - DNA, 15 bp, Homo sapiens
taagaatttatgttt

SEQ ID NO: 129545 - DNA, 15 bp, Homo sapiens
ataagaatttatgtt

SEQ ID NO: 129546 - DNA, 15 bp, Homo sapiens
aataagaatttatgt

SEQ ID NO: 129547 - DNA, 15 bp, Homo sapiens
taataagaatttatg

SEQ ID NO: 129548 - DNA, 15 bp, Homo sapiens
ctaataagaatttat

SEQ ID NO: 129549 - DNA, 15 bp, Homo sapiens
cctaataagaattta

SEQ ID NO: 129550 - DNA, 15 bp, Homo sapiens
tcctaataagaattt

SEQ ID NO: 129551 - DNA, 15 bp, Homo sapiens
ttcctaataagaatt

SEQ ID NO: 129552 - DNA, 15 bp, Homo sapiens
attcctaataagaat

SEQ ID NO: 129553 - DNA, 15 bp, Homo sapiens
cattcctaataagaa

SEQ ID NO: 129554 - DNA, 15 bp, Homo sapiens
tcattcctaataaga

SEQ ID NO: 129555 - DNA, 15 bp, Homo sapiens
atcattcctaataag

SEQ ID NO: 129556 - DNA, 15 bp, Homo sapiens
tatcattcctaataa

SEQ ID NO: 129557 - DNA, 15 bp, Homo sapiens
gtatcattcctaata

SEQ ID NO: 129558 - DNA, 15 bp, Homo sapiens
tgtatcattcctaat

SEQ ID NO: 129559 - DNA, 15 bp, Homo sapiens
ttgtatcattcctaa

SEQ ID NO: 129560 - DNA, 15 bp, Homo sapiens
attgtatcattccta

SEQ ID NO: 129561 - DNA, 15 bp, Homo sapiens
tattgtatcattcct

SEQ ID NO: 129562 - DNA, 15 bp, Homo sapiens
gtattgtatcattcc

SEQ ID NO: 129563 - DNA, 15 bp, Homo sapiens
tgtattgtatcattc

SEQ ID NO: 129564 - DNA, 15 bp, Homo sapiens
ttgtattgtatcatt

SEQ ID NO: 129565 - DNA, 15 bp, Homo sapiens
attgtattgtatcat

SEQ ID NO: 129566 - DNA, 15 bp, Homo sapiens
aattgtattgtatca

SEQ ID NO: 129567 - DNA, 15 bp, Homo sapiens
aaattgtattgtatc

SEQ ID NO: 129568 - DNA, 15 bp, Homo sapiens
taaattgtattgtat

SEQ ID NO: 129569 - DNA, 15 bp, Homo sapiens
ataaattgtattgta

SEQ ID NO: 129570 - DNA, 15 bp, Homo sapiens
aataaattgtattgt

SEQ ID NO: 129571 - DNA, 15 bp, Homo sapiens
aaataaattgtattg

SEQ ID NO: 129572 - DNA, 15 bp, Homo sapiens
taaataaattgtatt

SEQ ID NO: 129573 - DNA, 15 bp, Homo sapiens
ttaaataaattgtat

SEQ ID NO: 129574 - DNA, 15 bp, Homo sapiens
tttaaataaattgta

SEQ ID NO: 129575 - DNA, 15 bp, Homo sapiens
ttttaaataaattgt

SEQ ID NO: 129576 - DNA, 15 bp, Homo sapiens
tttttaaataaattg

SEQ ID NO: 129577 - DNA, 15 bp, Homo sapiens
atttttaaataaatt

SEQ ID NO: 129578 - DNA, 15 bp, Homo sapiens
aatttttaaataaat

SEQ ID NO: 129579 - DNA, 15 bp, Homo sapiens
caatttttaaataaa

SEQ ID NO: 129580 - DNA, 15 bp, Homo sapiens
gcaatttttaaataa

SEQ ID NO: 129581 - DNA, 15 bp, Homo sapiens
tgcaatttttaaata

SEQ ID NO: 129582 - DNA, 15 bp, Homo sapiens
atgcaatttttaaat

SEQ ID NO: 129583 - DNA, 15 bp, Homo sapiens
aatgcaatttttaaa

SEQ ID NO: 129584 - DNA, 15 bp, Homo sapiens
gaatgcaatttttaa

SEQ ID NO: 129585 - DNA, 15 bp, Homo sapiens
tgaatgcaattttta

SEQ ID NO: 129586 - DNA, 15 bp, Homo sapiens
ctgaatgcaattttt

SEQ ID NO: 129587 - DNA, 15 bp, Homo sapiens
actgaatgcaatttt

SEQ ID NO: 129588 - DNA, 15 bp, Homo sapiens
aactgaatgcaattt

SEQ ID NO: 129589 - DNA, 15 bp, Homo sapiens
aaactgaatgcaatt

SEQ ID NO: 129590 - DNA, 15 bp, Homo sapiens
aaaactgaatgcaat

SEQ ID NO: 129591 - DNA, 15 bp, Homo sapiens
aaaaactgaatgcaa

SEQ ID NO: 129592 - DNA, 15 bp, Homo sapiens
taaaaactgaatgca

SEQ ID NO: 129593 - DNA, 15 bp, Homo sapiens
ttaaaaactgaatgc

SEQ ID NO: 129594 - DNA, 15 bp, Homo sapiens
tttaaaaactgaatg

SEQ ID NO: 129595 - DNA, 15 bp, Homo sapiens
gtttaaaaactgaat

SEQ ID NO: 129596 - DNA, 15 bp, Homo sapiens
ggtttaaaaactgaa

SEQ ID NO: 129597 - DNA, 15 bp, Homo sapiens
tggtttaaaaactga

SEQ ID NO: 129598 - DNA, 15 bp, Homo sapiens
ctggtttaaaaactg

SEQ ID NO: 129599 - DNA, 15 bp, Homo sapiens
gctggtttaaaaact

SEQ ID NO: 129600 - DNA, 15 bp, Homo sapiens
tgctggtttaaaaac

SEQ ID NO: 129601 - DNA, 15 bp, Homo sapiens
ctgctggtttaaaaa

SEQ ID NO: 129602 - DNA, 15 bp, Homo sapiens
actgctggtttaaaa

SEQ ID NO: 129603 - DNA, 15 bp, Homo sapiens
aactgctggtttaaa

SEQ ID NO: 129604 - DNA, 15 bp, Homo sapiens
taactgctggtttaa

SEQ ID NO: 129605 - DNA, 15 bp, Homo sapiens
ttaactgctggttta

SEQ ID NO: 129606 - DNA, 15 bp, Homo sapiens
attaactgctggttt

SEQ ID NO: 129607 - DNA, 15 bp, Homo sapiens
aattaactgctggtt

SEQ ID NO: 129608 - DNA, 15 bp, Homo sapiens
taattaactgctggt

SEQ ID NO: 129609 - DNA, 15 bp, Homo sapiens
ataattaactgctgg

SEQ ID NO: 129610 - DNA, 15 bp, Homo sapiens
tataattaactgctg

SEQ ID NO: 129611 - DNA, 15 bp, Homo sapiens
ctataattaactgct

SEQ ID NO: 129612 - DNA, 15 bp, Homo sapiens
gctataattaactgc

SEQ ID NO: 129613 - DNA, 15 bp, Homo sapiens
tgctataattaactg

SEQ ID NO: 129614 - DNA, 15 bp, Homo sapiens
ctgctataattaact

SEQ ID NO: 129615 - DNA, 15 bp, Homo sapiens
gctgctataattaac

SEQ ID NO: 129616 - DNA, 15 bp, Homo sapiens
agctgctataattaa

SEQ ID NO: 129617 - DNA, 15 bp, Homo sapiens
tagctgctataatta

SEQ ID NO: 129618 - DNA, 15 bp, Homo sapiens
atagctgctataatt

SEQ ID NO: 129619 - DNA, 15 bp, Homo sapiens
tatagctgctataat

SEQ ID NO: 129620 - DNA, 15 bp, Homo sapiens
ttatagctgctataa

SEQ ID NO: 129621 - DNA, 15 bp, Homo sapiens
tttatagctgctata

SEQ ID NO: 129622 - DNA, 15 bp, Homo sapiens
ttttatagctgctat

SEQ ID NO: 129623 - DNA, 15 bp, Homo sapiens
tttttatagctgcta

SEQ ID NO: 129624 - DNA, 15 bp, Homo sapiens
atttttatagctgct

SEQ ID NO: 129625 - DNA, 15 bp, Homo sapiens
tatttttatagctgc

SEQ ID NO: 129626 - DNA, 15 bp, Homo sapiens
ttatttttatagctg

SEQ ID NO: 129627 - DNA, 15 bp, Homo sapiens
tttatttttatagct

SEQ ID NO: 129628 - DNA, 15 bp, Homo sapiens
ctttatttttatagc

SEQ ID NO: 129629 - DNA, 15 bp, Homo sapiens
tctttatttttatag

SEQ ID NO: 129630 - DNA, 15 bp, Homo sapiens
atctttatttttata

SEQ ID NO: 129631 - DNA, 15 bp, Homo sapiens
tatctttatttttat

SEQ ID NO: 129632 - DNA, 15 bp, Homo sapiens
gtatctttattttta

SEQ ID NO: 129633 - DNA, 15 bp, Homo sapiens
ggtatctttattttt

SEQ ID NO: 129634 - DNA, 15 bp, Homo sapiens
tggtatctttatttt

SEQ ID NO: 129635 - DNA, 15 bp, Homo sapiens
gtggtatctttattt

SEQ ID NO: 129636 - DNA, 15 bp, Homo sapiens
ggtggtatctttatt

SEQ ID NO: 129637 - DNA, 15 bp, Homo sapiens
tggtggtatctttat

SEQ ID NO: 129638 - DNA, 15 bp, Homo sapiens
ctggtggtatcttta

SEQ ID NO: 129639 - DNA, 15 bp, Homo sapiens
cctggtggtatcttt

SEQ ID NO: 129640 - DNA, 15 bp, Homo sapiens
gcctggtggtatctt

SEQ ID NO: 129641 - DNA, 15 bp, Homo sapiens
agcctggtggtatct

SEQ ID NO: 129642 - DNA, 15 bp, Homo sapiens
aagcctggtggtatc

SEQ ID NO: 129643 - DNA, 15 bp, Homo sapiens
aaagcctggtggtat

SEQ ID NO: 129644 - DNA, 15 bp, Homo sapiens
aaaagcctggtggta

SEQ ID NO: 129645 - DNA, 15 bp, Homo sapiens
taaaagcctggtggt

SEQ ID NO: 129646 - DNA, 15 bp, Homo sapiens
ttaaaagcctggtgg

SEQ ID NO: 129647 - DNA, 15 bp, Homo sapiens
attaaaagcctggtg

SEQ ID NO: 129648 - DNA, 15 bp, Homo sapiens
tattaaaagcctggt

SEQ ID NO: 129649 - DNA, 15 bp, Homo sapiens
ctattaaaagcctgg

SEQ ID NO: 129650 - DNA, 15 bp, Homo sapiens
gctattaaaagcctg

SEQ ID NO: 129651 - DNA, 15 bp, Homo sapiens
agctattaaaagcct

SEQ ID NO: 129652 - DNA, 15 bp, Homo sapiens
aagctattaaaagcc

SEQ ID NO: 129653 - DNA, 15 bp, Homo sapiens
aaagctattaaaagc

SEQ ID NO: 129654 - DNA, 15 bp, Homo sapiens
gaaagctattaaaag

SEQ ID NO: 129655 - DNA, 15 bp, Homo sapiens
tgaaagctattaaaa

SEQ ID NO: 129656 - DNA, 15 bp, Homo sapiens
ttgaaagctattaaa

SEQ ID NO: 129657 - DNA, 15 bp, Homo sapiens
tttgaaagctattaa

SEQ ID NO: 129658 - DNA, 15 bp, Homo sapiens
atttgaaagctatta

SEQ ID NO: 129659 - DNA, 15 bp, Homo sapiens
gatttgaaagctatt

SEQ ID NO: 129660 - DNA, 15 bp, Homo sapiens
ggatttgaaagctat

SEQ ID NO: 129661 - DNA, 15 bp, Homo sapiens
aggatttgaaagcta

SEQ ID NO: 129662 - DNA, 15 bp, Homo sapiens
aaggatttgaaagct

SEQ ID NO: 129663 - DNA, 15 bp, Homo sapiens
aaaggatttgaaagc

SEQ ID NO: 129664 - DNA, 15 bp, Homo sapiens
aaaaggatttgaaag

SEQ ID NO: 129665 - DNA, 15 bp, Homo sapiens
taaaaggatttgaaa

SEQ ID NO: 129666 - DNA, 15 bp, Homo sapiens
ttaaaaggatttgaa

SEQ ID NO: 129667 - DNA, 15 bp, Homo sapiens
tttaaaaggatttga

SEQ ID NO: 129668 - DNA, 15 bp, Homo sapiens
ttttaaaaggatttg

SEQ ID NO: 129669 - DNA, 15 bp, Homo sapiens
tttttaaaaggattt

SEQ ID NO: 129670 - DNA, 15 bp, Homo sapiens
ttttttaaaaggatt

SEQ ID NO: 129671 - DNA, 15 bp, Homo sapiens
gttttttaaaaggat

SEQ ID NO: 129672 - DNA, 15 bp, Homo sapiens
tgttttttaaaagga

SEQ ID NO: 129673 - DNA, 15 bp, Homo sapiens
gtgttttttaaaagg

SEQ ID NO: 129674 - DNA, 15 bp, Homo sapiens
tgtgttttttaaaag

SEQ ID NO: 129675 - DNA, 15 bp, Homo sapiens
atgtgttttttaaaa

SEQ ID NO: 129676 - DNA, 15 bp, Homo sapiens
tatgtgttttttaaa

SEQ ID NO: 129677 - DNA, 15 bp, Homo sapiens
ttatgtgttttttaa

SEQ ID NO: 129678 - DNA, 15 bp, Homo sapiens
attatgtgtttttta

SEQ ID NO: 129679 - DNA, 15 bp, Homo sapiens
gattatgtgtttttt

SEQ ID NO: 129680 - DNA, 15 bp, Homo sapiens
agattatgtgttttt

SEQ ID NO: 129681 - DNA, 15 bp, Homo sapiens
aagattatgtgtttt

SEQ ID NO: 129682 - DNA, 15 bp, Homo sapiens
taagattatgtgttt

SEQ ID NO: 129683 - DNA, 15 bp, Homo sapiens
ataagattatgtgtt

SEQ ID NO: 129684 - DNA, 15 bp, Homo sapiens
aataagattatgtgt

SEQ ID NO: 129685 - DNA, 15 bp, Homo sapiens
aaataagattatgtg

SEQ ID NO: 129686 - DNA, 15 bp, Homo sapiens
caaataagattatgt

SEQ ID NO: 129687 - DNA, 15 bp, Homo sapiens
acaaataagattatg

SEQ ID NO: 129688 - DNA, 15 bp, Homo sapiens
gacaaataagattat

SEQ ID NO: 129689 - DNA, 15 bp, Homo sapiens
tgacaaataagatta

SEQ ID NO: 129690 - DNA, 15 bp, Homo sapiens
atgacaaataagatt

SEQ ID NO: 129691 - DNA, 15 bp, Homo sapiens
tatgacaaataagat

SEQ ID NO: 129692 - DNA, 15 bp, Homo sapiens
atatgacaaataaga

SEQ ID NO: 129693 - DNA, 15 bp, Homo sapiens
catatgacaaataag

SEQ ID NO: 129694 - DNA, 15 bp, Homo sapiens
tcatatgacaaataa

SEQ ID NO: 129695 - DNA, 15 bp, Homo sapiens
ctcatatgacaaata

SEQ ID NO: 129696 - DNA, 15 bp, Homo sapiens
actcatatgacaaat

SEQ ID NO: 129697 - DNA, 15 bp, Homo sapiens
aactcatatgacaaa

SEQ ID NO: 129698 - DNA, 15 bp, Homo sapiens
gaactcatatgacaa

SEQ ID NO: 129699 - DNA, 15 bp, Homo sapiens
agaactcatatgaca

SEQ ID NO: 129700 - DNA, 15 bp, Homo sapiens
tagaactcatatgac

SEQ ID NO: 129701 - DNA, 15 bp, Homo sapiens
ttagaactcatatga

SEQ ID NO: 129702 - DNA, 15 bp, Homo sapiens
attagaactcatatg

SEQ ID NO: 129703 - DNA, 15 bp, Homo sapiens
gattagaactcatat

SEQ ID NO: 129704 - DNA, 15 bp, Homo sapiens
tgattagaactcata

SEQ ID NO: 129705 - DNA, 15 bp, Homo sapiens
atgattagaactcat

SEQ ID NO: 129706 - DNA, 15 bp, Homo sapiens
tatgattagaactca

SEQ ID NO: 129707 - DNA, 15 bp, Homo sapiens
atatgattagaactc

SEQ ID NO: 129708 - DNA, 15 bp, Homo sapiens
aatatgattagaact

SEQ ID NO: 129709 - DNA, 15 bp, Homo sapiens
gaatatgattagaac

SEQ ID NO: 129710 - DNA, 15 bp, Homo sapiens
ggaatatgattagaa

SEQ ID NO: 129711 - DNA, 15 bp, Homo sapiens
aggaatatgattaga

SEQ ID NO: 129712 - DNA, 15 bp, Homo sapiens
gaggaatatgattag

SEQ ID NO: 129713 - DNA, 15 bp, Homo sapiens
agaggaatatgatta

SEQ ID NO: 129714 - DNA, 15 bp, Homo sapiens
gagaggaatatgatt

SEQ ID NO: 129715 - DNA, 15 bp, Homo sapiens
agagaggaatatgat

SEQ ID NO: 129716 - DNA, 15 bp, Homo sapiens
aagagaggaatatga

SEQ ID NO: 129717 - DNA, 15 bp, Homo sapiens
gaagagaggaatatg

SEQ ID NO: 129718 - DNA, 15 bp, Homo sapiens
agaagagaggaatat

SEQ ID NO: 129719 - DNA, 15 bp, Homo sapiens
cagaagagaggaata

SEQ ID NO: 129720 - DNA, 15 bp, Homo sapiens
tcagaagagaggaat

SEQ ID NO: 129721 - DNA, 15 bp, Homo sapiens
gtcagaagagaggaa

SEQ ID NO: 129722 - DNA, 15 bp, Homo sapiens
tgtcagaagagagga

SEQ ID NO: 129723 - DNA, 15 bp, Homo sapiens
ctgtcagaagagagg

SEQ ID NO: 129724 - DNA, 15 bp, Homo sapiens
tctgtcagaagagag

SEQ ID NO: 129725 - DNA, 15 bp, Homo sapiens
atctgtcagaagaga

SEQ ID NO: 129726 - DNA, 15 bp, Homo sapiens
catctgtcagaagag

SEQ ID NO: 129727 - DNA, 15 bp, Homo sapiens
ccatctgtcagaaga

SEQ ID NO: 129728 - DNA, 15 bp, Homo sapiens
accatctgtcagaag

SEQ ID NO: 129729 - DNA, 15 bp, Homo sapiens
aaccatctgtcagaa

SEQ ID NO: 129730 - DNA, 15 bp, Homo sapiens
aaaccatctgtcaga

SEQ ID NO: 129731 - DNA, 15 bp, Homo sapiens
taaaccatctgtcag

SEQ ID NO: 129732 - DNA, 15 bp, Homo sapiens
ataaaccatctgtca

SEQ ID NO: 129733 - DNA, 15 bp, Homo sapiens
tataaaccatctgtc

SEQ ID NO: 129734 - DNA, 15 bp, Homo sapiens
atataaaccatctgt

SEQ ID NO: 129735 - DNA, 15 bp, Homo sapiens
aatataaaccatctg

SEQ ID NO: 129736 - DNA, 15 bp, Homo sapiens
gaatataaaccatct

SEQ ID NO: 129737 - DNA, 15 bp, Homo sapiens
agaatataaaccatc

SEQ ID NO: 129738 - DNA, 15 bp, Homo sapiens
aagaatataaaccat

SEQ ID NO: 129739 - DNA, 15 bp, Homo sapiens
taagaatataaacca

SEQ ID NO: 129740 - DNA, 15 bp, Homo sapiens
ataagaatataaacc

SEQ ID NO: 129741 - DNA, 15 bp, Homo sapiens
tataagaatataaac

SEQ ID NO: 129742 - DNA, 15 bp, Homo sapiens
ttataagaatataaa

SEQ ID NO: 129743 - DNA, 15 bp, Homo sapiens
tttataagaatataa

SEQ ID NO: 129744 - DNA, 15 bp, Homo sapiens
atttataagaatata

SEQ ID NO: 129745 - DNA, 15 bp, Homo sapiens
catttataagaatat

SEQ ID NO: 129746 - DNA, 15 bp, Homo sapiens
acatttataagaata

SEQ ID NO: 129747 - DNA, 15 bp, Homo sapiens
aacatttataagaat

SEQ ID NO: 129748 - DNA, 15 bp, Homo sapiens
taacatttataagaa

SEQ ID NO: 129749 - DNA, 15 bp, Homo sapiens
ataacatttataaga

SEQ ID NO: 129750 - DNA, 15 bp, Homo sapiens
aataacatttataag

SEQ ID NO: 129751 - DNA, 15 bp, Homo sapiens
gaataacatttataa

SEQ ID NO: 129752 - DNA, 15 bp, Homo sapiens
agaataacatttata

SEQ ID NO: 129753 - DNA, 15 bp, Homo sapiens
aagaataacatttat

SEQ ID NO: 129754 - DNA, 15 bp, Homo sapiens
taagaataacattta

SEQ ID NO: 129755 - DNA, 15 bp, Homo sapiens
ataagaataacattt

SEQ ID NO: 129756 - DNA, 15 bp, Homo sapiens
tataagaataacatt

SEQ ID NO: 129757 - DNA, 15 bp, Homo sapiens
ttataagaataacat

SEQ ID NO: 129758 - DNA, 15 bp, Homo sapiens
gttataagaataaca

SEQ ID NO: 129759 - DNA, 15 bp, Homo sapiens
tgttataagaataac

SEQ ID NO: 129760 - DNA, 15 bp, Homo sapiens
gtgttataagaataa

SEQ ID NO: 129761 - DNA, 15 bp, Homo sapiens
agtgttataagaata

SEQ ID NO: 129762 - DNA, 15 bp, Homo sapiens
tagtgttataagaat

SEQ ID NO: 129763 - DNA, 15 bp, Homo sapiens
atagtgttataagaa

SEQ ID NO: 129764 - DNA, 15 bp, Homo sapiens
tatagtgttataaga

SEQ ID NO: 129765 - DNA, 15 bp, Homo sapiens
ttatagtgttataag

SEQ ID NO: 129766 - DNA, 15 bp, Homo sapiens
tttatagtgttataa

SEQ ID NO: 129767 - DNA, 15 bp, Homo sapiens
ctttatagtgttata

SEQ ID NO: 129768 - DNA, 15 bp, Homo sapiens
tctttatagtgttat

SEQ ID NO: 129769 - DNA, 15 bp, Homo sapiens
atctttatagtgtta

SEQ ID NO: 129770 - DNA, 15 bp, Homo sapiens
gatctttatagtgtt

SEQ ID NO: 129771 - DNA, 15 bp, Homo sapiens
agatctttatagtgt

SEQ ID NO: 129772 - DNA, 15 bp, Homo sapiens
tagatctttatagtg

SEQ ID NO: 129773 - DNA, 15 bp, Homo sapiens
ttagatctttatagt

SEQ ID NO: 129774 - DNA, 15 bp, Homo sapiens
attagatctttatag

SEQ ID NO: 129775 - DNA, 15 bp, Homo sapiens
aattagatctttata

SEQ ID NO: 129776 - DNA, 15 bp, Homo sapiens
caattagatctttat

SEQ ID NO: 129777 - DNA, 15 bp, Homo sapiens
tcaattagatcttta

SEQ ID NO: 129778 - DNA, 15 bp, Homo sapiens
ctcaattagatcttt

SEQ ID NO: 129779 - DNA, 15 bp, Homo sapiens
cctcaattagatctt

SEQ ID NO: 129780 - DNA, 15 bp, Homo sapiens
gcctcaattagatct

SEQ ID NO: 129781 - DNA, 15 bp, Homo sapiens
tgcctcaattagatc

SEQ ID NO: 129782 - DNA, 15 bp, Homo sapiens
ctgcctcaattagat

SEQ ID NO: 129783 - DNA, 15 bp, Homo sapiens
actgcctcaattaga

SEQ ID NO: 129784 - DNA, 15 bp, Homo sapiens
aactgcctcaattag

SEQ ID NO: 129785 - DNA, 15 bp, Homo sapiens
gaactgcctcaatta

SEQ ID NO: 129786 - DNA, 15 bp, Homo sapiens
ggaactgcctcaatt

SEQ ID NO: 129787 - DNA, 15 bp, Homo sapiens
aggaactgcctcaat

SEQ ID NO: 129788 - DNA, 15 bp, Homo sapiens
aaggaactgcctcaa

SEQ ID NO: 129789 - DNA, 15 bp, Homo sapiens
aaaggaactgcctca

SEQ ID NO: 129790 - DNA, 15 bp, Homo sapiens
aaaaggaactgcctc

SEQ ID NO: 129791 - DNA, 15 bp, Homo sapiens
aaaaaggaactgcct

SEQ ID NO: 129792 - DNA, 15 bp, Homo sapiens
aaaaaaggaactgcc

SEQ ID NO: 129793 - DNA, 15 bp, Homo sapiens
taaaaaaggaactgc

SEQ ID NO: 129794 - DNA, 15 bp, Homo sapiens
ataaaaaaggaactg

SEQ ID NO: 129795 - DNA, 15 bp, Homo sapiens
tataaaaaaggaact

SEQ ID NO: 129796 - DNA, 15 bp, Homo sapiens
atataaaaaaggaac

SEQ ID NO: 129797 - DNA, 15 bp, Homo sapiens
aatataaaaaaggaa

SEQ ID NO: 129798 - DNA, 15 bp, Homo sapiens
gaatataaaaaagga

SEQ ID NO: 129799 - DNA, 15 bp, Homo sapiens
tgaatataaaaaagg

SEQ ID NO: 129800 - DNA, 15 bp, Homo sapiens
atgaatataaaaaag

SEQ ID NO: 129801 - DNA, 15 bp, Homo sapiens
aatgaatataaaaaa

SEQ ID NO: 129802 - DNA, 15 bp, Homo sapiens
aaatgaatataaaaa

SEQ ID NO: 129803 - DNA, 15 bp, Homo sapiens
gtcaaatgaatataa

SEQ ID NO: 129804 - DNA, 15 bp, Homo sapiens
agtcaaatgaatata

SEQ ID NO: 129805 - DNA, 15 bp, Homo sapiens
cagtcaaatgaatat

SEQ ID NO: 129806 - DNA, 15 bp, Homo sapiens
acagtcaaatgaata

SEQ ID NO: 129807 - DNA, 15 bp, Homo sapiens
aacagtcaaatgaat

SEQ ID NO: 129808 - DNA, 15 bp, Homo sapiens
aaacagtcaaatgaa

SEQ ID NO: 129809 - DNA, 15 bp, Homo sapiens
aaaacagtcaaatga

SEQ ID NO: 129810 - DNA, 15 bp, Homo sapiens
gaaaacagtcaaatg

SEQ ID NO: 129811 - DNA, 15 bp, Homo sapiens
ggaaaacagtcaaat

SEQ ID NO: 129812 - DNA, 15 bp, Homo sapiens
aggaaaacagtcaaa

SEQ ID NO: 129813 - DNA, 15 bp, Homo sapiens
aaggaaaacagtcaa

SEQ ID NO: 129814 - DNA, 15 bp, Homo sapiens
caaggaaaacagtca

SEQ ID NO: 129815 - DNA, 15 bp, Homo sapiens
gcaaggaaaacagtc

SEQ ID NO: 129816 - DNA, 15 bp, Homo sapiens
tgcaaggaaaacagt

SEQ ID NO: 129817 - DNA, 15 bp, Homo sapiens
atgcaaggaaaacag

SEQ ID NO: 129818 - DNA, 15 bp, Homo sapiens
gatgcaaggaaaaca

SEQ ID NO: 129819 - DNA, 15 bp, Homo sapiens
tgatgcaaggaaaac

SEQ ID NO: 129820 - DNA, 15 bp, Homo sapiens
atgatgcaaggaaaa

SEQ ID NO: 129821 - DNA, 15 bp, Homo sapiens
aatgatgcaaggaaa

SEQ ID NO: 129822 - DNA, 15 bp, Homo sapiens
aaatgatgcaaggaa

SEQ ID NO: 129823 - DNA, 15 bp, Homo sapiens
taaatgatgcaagga

SEQ ID NO: 129824 - DNA, 15 bp, Homo sapiens
ttaaatgatgcaagg

SEQ ID NO: 129825 - DNA, 15 bp, Homo sapiens
tttaaatgatgcaag

SEQ ID NO: 129826 - DNA, 15 bp, Homo sapiens
ttttaaatgatgcaa

SEQ ID NO: 129827 - DNA, 15 bp, Homo sapiens
attttaaatgatgca

SEQ ID NO: 129828 - DNA, 15 bp, Homo sapiens
aattttaaatgatgc

SEQ ID NO: 129829 - DNA, 15 bp, Homo sapiens
aaattttaaatgatg

SEQ ID NO: 129830 - DNA, 15 bp, Homo sapiens
aaaattttaaatgat

SEQ ID NO: 129831 - DNA, 15 bp, Homo sapiens
aaaaattttaaatga

SEQ ID NO: 129832 - DNA, 15 bp, Homo sapiens
gcaaaaattttaaat

SEQ ID NO: 129833 - DNA, 15 bp, Homo sapiens
agcaaaaattttaaa

SEQ ID NO: 129834 - DNA, 15 bp, Homo sapiens
aagcaaaaattttaa

SEQ ID NO: 129835 - DNA, 15 bp, Homo sapiens
aaagcaaaaatttta

SEQ ID NO: 129836 - DNA, 15 bp, Homo sapiens
caaagcaaaaatttt

SEQ ID NO: 129837 - DNA, 15 bp, Homo sapiens
acaaagcaaaaattt

SEQ ID NO: 129838 - DNA, 15 bp, Homo sapiens
aacaaagcaaaaatt

SEQ ID NO: 129839 - DNA, 15 bp, Homo sapiens
aaacaaagcaaaaat

SEQ ID NO: 129840 - DNA, 15 bp, Homo sapiens
aaaacaaagcaaaaa

SEQ ID NO: 129841 - DNA, 15 bp, Homo sapiens
aaaaacaaagcaaaa

SEQ ID NO: 129842 - DNA, 15 bp, Homo sapiens
aaaaaacaaagcaaa

SEQ ID NO: 129843 - DNA, 15 bp, Homo sapiens
aaaaaaacaaagcaa

SEQ ID NO: 129844 - DNA, 15 bp, Homo sapiens
gaaaaaaacaaagca

SEQ ID NO: 129845 - DNA, 15 bp, Homo sapiens
agaaaaaaacaaagc

SEQ ID NO: 129846 - DNA, 15 bp, Homo sapiens
tagaaaaaaacaaag

SEQ ID NO: 129847 - DNA, 15 bp, Homo sapiens
atagaaaaaaacaaa

SEQ ID NO: 129848 - DNA, 15 bp, Homo sapiens
tatagaaaaaaacaa

SEQ ID NO: 129849 - DNA, 15 bp, Homo sapiens
atatagaaaaaaaca

SEQ ID NO: 129850 - DNA, 15 bp, Homo sapiens
gatatagaaaaaaac

SEQ ID NO: 129851 - DNA, 15 bp, Homo sapiens
agatatagaaaaaaa

SEQ ID NO: 129852 - DNA, 15 bp, Homo sapiens
gagatatagaaaaaa

SEQ ID NO: 129853 - DNA, 15 bp, Homo sapiens
agagatatagaaaaa

SEQ ID NO: 129854 - DNA, 15 bp, Homo sapiens
aagagatatagaaaa

SEQ ID NO: 129855 - DNA, 15 bp, Homo sapiens
aaagagatatagaaa

SEQ ID NO: 129856 - DNA, 15 bp, Homo sapiens
aaaagagatatagaa

SEQ ID NO: 129857 - DNA, 15 bp, Homo sapiens
aaaaagagatataga

SEQ ID NO: 129858 - DNA, 15 bp, Homo sapiens
caaaaagagatatag

SEQ ID NO: 129859 - DNA, 15 bp, Homo sapiens
acaaaaagagatata

SEQ ID NO: 129860 - DNA, 15 bp, Homo sapiens
tacaaaaagagatat

SEQ ID NO: 129861 - DNA, 15 bp, Homo sapiens
ttacaaaaagagata

SEQ ID NO: 129862 - DNA, 15 bp, Homo sapiens
gttacaaaaagagat

SEQ ID NO: 129863 - DNA, 15 bp, Homo sapiens
tgttacaaaaagaga

SEQ ID NO: 129864 - DNA, 15 bp, Homo sapiens
ctgttacaaaaagag

SEQ ID NO: 129865 - DNA, 15 bp, Homo sapiens
actgttacaaaaaga

SEQ ID NO: 129866 - DNA, 15 bp, Homo sapiens
cactgttacaaaaag

SEQ ID NO: 129867 - DNA, 15 bp, Homo sapiens
gcactgttacaaaaa

SEQ ID NO: 129868 - DNA, 15 bp, Homo sapiens
agcactgttacaaaa

SEQ ID NO: 129869 - DNA, 15 bp, Homo sapiens
gagcactgttacaaa

SEQ ID NO: 129870 - DNA, 15 bp, Homo sapiens
agagcactgttacaa

SEQ ID NO: 129871 - DNA, 15 bp, Homo sapiens
tagagcactgttaca

SEQ ID NO: 129872 - DNA, 15 bp, Homo sapiens
atagagcactgttac

SEQ ID NO: 129873 - DNA, 15 bp, Homo sapiens
aatagagcactgtta

SEQ ID NO: 129874 - DNA, 15 bp, Homo sapiens
gaatagagcactgtt

SEQ ID NO: 129875 - DNA, 15 bp, Homo sapiens
tgaatagagcactgt

SEQ ID NO: 129876 - DNA, 15 bp, Homo sapiens
ttgaatagagcactg

SEQ ID NO: 129877 - DNA, 15 bp, Homo sapiens
tttgaatagagcact

SEQ ID NO: 129878 - DNA, 15 bp, Homo sapiens
atttgaatagagcac

SEQ ID NO: 129879 - DNA, 15 bp, Homo sapiens
tatttgaatagagca

SEQ ID NO: 129880 - DNA, 15 bp, Homo sapiens
atatttgaatagagc

SEQ ID NO: 129881 - DNA, 15 bp, Homo sapiens
tatatttgaatagag

SEQ ID NO: 129882 - DNA, 15 bp, Homo sapiens
ttatatttgaataga

SEQ ID NO: 129883 - DNA, 15 bp, Homo sapiens
attatatttgaatag

SEQ ID NO: 129884 - DNA, 15 bp, Homo sapiens
tattatatttgaata

SEQ ID NO: 129885 - DNA, 15 bp, Homo sapiens
ctattatatttgaat

SEQ ID NO: 129886 - DNA, 15 bp, Homo sapiens
actattatatttgaa

SEQ ID NO: 129887 - DNA, 15 bp, Homo sapiens
aactattatatttga

SEQ ID NO: 129888 - DNA, 15 bp, Homo sapiens
taactattatatttg

SEQ ID NO: 129889 - DNA, 15 bp, Homo sapiens
ataactattatattt

SEQ ID NO: 129890 - DNA, 15 bp, Homo sapiens
aataactattatatt

SEQ ID NO: 129891 - DNA, 15 bp, Homo sapiens
aaataactattatat

SEQ ID NO: 129892 - DNA, 15 bp, Homo sapiens
aaaataactattata

SEQ ID NO: 129893 - DNA, 15 bp, Homo sapiens
taaaataactattat

SEQ ID NO: 129894 - DNA, 15 bp, Homo sapiens
ttaaaataactatta

SEQ ID NO: 129895 - DNA, 15 bp, Homo sapiens
attaaaataactatt

SEQ ID NO: 129896 - DNA, 15 bp, Homo sapiens
tattaaaataactat

SEQ ID NO: 129897 - DNA, 15 bp, Homo sapiens
ttattaaaataacta

SEQ ID NO: 129898 - DNA, 15 bp, Homo sapiens
tttattaaaataact

SEQ ID NO: 129899 - DNA, 15 bp, Homo sapiens
gtttattaaaataac

SEQ ID NO: 129900 - DNA, 15 bp, Homo sapiens
tgtttattaaaataa

SEQ ID NO: 129901 - DNA, 15 bp, Homo sapiens
ttgtttattaaaata

SEQ ID NO: 129902 - DNA, 15 bp, Homo sapiens
cttgtttattaaaat

SEQ ID NO: 129903 - DNA, 15 bp, Homo sapiens
gcttgtttattaaaa

SEQ ID NO: 129904 - DNA, 15 bp, Homo sapiens
ggcttgtttattaaa

SEQ ID NO: 129905 - DNA, 15 bp, Homo sapiens
tggcttgtttattaa

SEQ ID NO: 129906 - DNA, 15 bp, Homo sapiens
ttggcttgtttatta

SEQ ID NO: 129907 - DNA, 15 bp, Homo sapiens
tttggcttgtttatt

SEQ ID NO: 129908 - DNA, 15 bp, Homo sapiens
atttggcttgtttat

SEQ ID NO: 129909 - DNA, 15 bp, Homo sapiens
aatttggcttgttta

SEQ ID NO: 129910 - DNA, 15 bp, Homo sapiens
gaatttggcttgttt

SEQ ID NO: 129911 - DNA, 15 bp, Homo sapiens
tgaatttggcttgtt

SEQ ID NO: 129912 - DNA, 15 bp, Homo sapiens
gtgaatttggcttgt

SEQ ID NO: 129913 - DNA, 15 bp, Homo sapiens
tgtgaatttggcttg

SEQ ID NO: 129914 - DNA, 15 bp, Homo sapiens
atgtgaatttggctt

SEQ ID NO: 129915 - DNA, 15 bp, Homo sapiens
catgtgaatttggct

SEQ ID NO: 129916 - DNA, 15 bp, Homo sapiens
acatgtgaatttggc

SEQ ID NO: 129917 - DNA, 15 bp, Homo sapiens
aacatgtgaatttgg

SEQ ID NO: 129918 - DNA, 15 bp, Homo sapiens
aaacatgtgaatttg

SEQ ID NO: 129919 - DNA, 15 bp, Homo sapiens
gaaacatgtgaattt

SEQ ID NO: 129920 - DNA, 15 bp, Homo sapiens
agaaacatgtgaatt

SEQ ID NO: 129921 - DNA, 15 bp, Homo sapiens
aagaaacatgtgaat

SEQ ID NO: 129922 - DNA, 15 bp, Homo sapiens
caagaaacatgtgaa

SEQ ID NO: 129923 - DNA, 15 bp, Homo sapiens
acaagaaacatgtga

SEQ ID NO: 129924 - DNA, 15 bp, Homo sapiens
gacaagaaacatgtg

SEQ ID NO: 129925 - DNA, 15 bp, Homo sapiens
agacaagaaacatgt

SEQ ID NO: 129926 - DNA, 15 bp, Homo sapiens
aagacaagaaacatg

SEQ ID NO: 129927 - DNA, 15 bp, Homo sapiens
gaagacaagaaacat

SEQ ID NO: 129928 - DNA, 15 bp, Homo sapiens
ggaagacaagaaaca

SEQ ID NO: 129929 - DNA, 15 bp, Homo sapiens
gggaagacaagaaac

SEQ ID NO: 129930 - DNA, 15 bp, Homo sapiens
agggaagacaagaaa

SEQ ID NO: 129931 - DNA, 15 bp, Homo sapiens
tagggaagacaagaa

SEQ ID NO: 129932 - DNA, 15 bp, Homo sapiens
ttagggaagacaaga

SEQ ID NO: 129933 - DNA, 15 bp, Homo sapiens
attagggaagacaag

SEQ ID NO: 129934 - DNA, 15 bp, Homo sapiens
tattagggaagacaa

SEQ ID NO: 129935 - DNA, 15 bp, Homo sapiens
gtattagggaagaca

SEQ ID NO: 129936 - DNA, 15 bp, Homo sapiens
agtattagggaagac

SEQ ID NO: 129937 - DNA, 15 bp, Homo sapiens
aagtattagggaaga

SEQ ID NO: 129938 - DNA, 15 bp, Homo sapiens
caagtattagggaag

SEQ ID NO: 129939 - DNA, 15 bp, Homo sapiens
acaagtattagggaa

SEQ ID NO: 129940 - DNA, 15 bp, Homo sapiens
tacaagtattaggga

SEQ ID NO: 129941 - DNA, 15 bp, Homo sapiens
ttacaagtattaggg

SEQ ID NO: 129942 - DNA, 15 bp, Homo sapiens
cttacaagtattagg

SEQ ID NO: 129943 - DNA, 15 bp, Homo sapiens
tcttacaagtattag

SEQ ID NO: 129944 - DNA, 15 bp, Homo sapiens
atcttacaagtatta

SEQ ID NO: 129945 - DNA, 15 bp, Homo sapiens
aatcttacaagtatt

SEQ ID NO: 129946 - DNA, 15 bp, Homo sapiens
gaatcttacaagtat

SEQ ID NO: 129947 - DNA, 15 bp, Homo sapiens
agaatcttacaagta

SEQ ID NO: 129948 - DNA, 15 bp, Homo sapiens
gagaatcttacaagt

SEQ ID NO: 129949 - DNA, 15 bp, Homo sapiens
ggagaatcttacaag

SEQ ID NO: 129950 - DNA, 15 bp, Homo sapiens
gggagaatcttacaa

SEQ ID NO: 129951 - DNA, 15 bp, Homo sapiens
tgggagaatcttaca

SEQ ID NO: 129952 - DNA, 15 bp, Homo sapiens
atgggagaatcttac

SEQ ID NO: 129953 - DNA, 15 bp, Homo sapiens
aatgggagaatctta

SEQ ID NO: 129954 - DNA, 15 bp, Homo sapiens
gaatgggagaatctt

SEQ ID NO: 129955 - DNA, 15 bp, Homo sapiens
agaatgggagaatct

SEQ ID NO: 129956 - DNA, 15 bp, Homo sapiens
aagaatgggagaatc

SEQ ID NO: 129957 - DNA, 15 bp, Homo sapiens
caagaatgggagaat

SEQ ID NO: 129958 - DNA, 15 bp, Homo sapiens
tcaagaatgggagaa

SEQ ID NO: 129959 - DNA, 15 bp, Homo sapiens
atcaagaatgggaga

SEQ ID NO: 129960 - DNA, 15 bp, Homo sapiens
tatcaagaatgggag

SEQ ID NO: 129961 - DNA, 15 bp, Homo sapiens
gtatcaagaatggga

SEQ ID NO: 129962 - DNA, 15 bp, Homo sapiens
ggtatcaagaatggg

SEQ ID NO: 129963 - DNA, 15 bp, Homo sapiens
aggtatcaagaatgg

SEQ ID NO: 129964 - DNA, 15 bp, Homo sapiens
aaggtatcaagaatg

SEQ ID NO: 129965 - DNA, 15 bp, Homo sapiens
caaggtatcaagaat

SEQ ID NO: 129966 - DNA, 15 bp, Homo sapiens
gcaaggtatcaagaa

SEQ ID NO: 129967 - DNA, 15 bp, Homo sapiens
agcaaggtatcaaga

SEQ ID NO: 129968 - DNA, 15 bp, Homo sapiens
aagcaaggtatcaag

SEQ ID NO: 129969 - DNA, 15 bp, Homo sapiens
aaagcaaggtatcaa

SEQ ID NO: 129970 - DNA, 15 bp, Homo sapiens
caaagcaaggtatca

SEQ ID NO: 129971 - DNA, 15 bp, Homo sapiens
acaaagcaaggtatc

SEQ ID NO: 129972 - DNA, 15 bp, Homo sapiens
aacaaagcaaggtat

SEQ ID NO: 129973 - DNA, 15 bp, Homo sapiens
gaacaaagcaaggta

SEQ ID NO: 129974 - DNA, 15 bp, Homo sapiens
agaacaaagcaaggt

SEQ ID NO: 129975 - DNA, 15 bp, Homo sapiens
aagaacaaagcaagg

SEQ ID NO: 129976 - DNA, 15 bp, Homo sapiens
taagaacaaagcaag

SEQ ID NO: 129977 - DNA, 15 bp, Homo sapiens
ataagaacaaagcaa

SEQ ID NO: 129978 - DNA, 15 bp, Homo sapiens
aataagaacaaagca

SEQ ID NO: 129979 - DNA, 15 bp, Homo sapiens
gaataagaacaaagc

SEQ ID NO: 129980 - DNA, 15 bp, Homo sapiens
agaataagaacaaag

SEQ ID NO: 129981 - DNA, 15 bp, Homo sapiens
aagaataagaacaaa

SEQ ID NO: 129982 - DNA, 15 bp, Homo sapiens
aaagaataagaacaa

SEQ ID NO: 129983 - DNA, 15 bp, Homo sapiens
gaaagaataagaaca

SEQ ID NO: 129984 - DNA, 15 bp, Homo sapiens
agaaagaataagaac

SEQ ID NO: 129985 - DNA, 15 bp, Homo sapiens
cagaaagaataagaa

SEQ ID NO: 129986 - DNA, 15 bp, Homo sapiens
acagaaagaataaga

SEQ ID NO: 129987 - DNA, 15 bp, Homo sapiens
aacagaaagaataag

SEQ ID NO: 129988 - DNA, 15 bp, Homo sapiens
gaacagaaagaataa

SEQ ID NO: 129989 - DNA, 15 bp, Homo sapiens
agaacagaaagaata

SEQ ID NO: 129990 - DNA, 15 bp, Homo sapiens
tagaacagaaagaat

SEQ ID NO: 129991 - DNA, 15 bp, Homo sapiens
atagaacagaaagaa

SEQ ID NO: 129992 - DNA, 15 bp, Homo sapiens
catagaacagaaaga

SEQ ID NO: 129993 - DNA, 15 bp, Homo sapiens
tcatagaacagaaag

SEQ ID NO: 129994 - DNA, 15 bp, Homo sapiens
ttcatagaacagaaa

SEQ ID NO: 129995 - DNA, 15 bp, Homo sapiens
attcatagaacagaa

SEQ ID NO: 129996 - DNA, 15 bp, Homo sapiens
tattcatagaacaga

SEQ ID NO: 129997 - DNA, 15 bp, Homo sapiens
ttattcatagaacag

SEQ ID NO: 129998 - DNA, 15 bp, Homo sapiens
tttattcatagaaca

SEQ ID NO: 129999 - DNA, 15 bp, Homo sapiens
ctttattcatagaac

SEQ ID NO: 130000 - DNA, 15 bp, Homo sapiens
gctttattcatagaa

SEQ ID NO: 130001 - DNA, 15 bp, Homo sapiens
tgctttattcataga

SEQ ID NO: 130002 - DNA, 15 bp, Homo sapiens
ctgctttattcatag

SEQ ID NO: 130003 - DNA, 15 bp, Homo sapiens
tctgctttattcata

SEQ ID NO: 130004 - DNA, 15 bp, Homo sapiens
ctctgctttattcat

SEQ ID NO: 130005 - DNA, 15 bp, Homo sapiens
actctgctttattca

SEQ ID NO: 130006 - DNA, 15 bp, Homo sapiens
tactctgctttattc

SEQ ID NO: 130007 - DNA, 15 bp, Homo sapiens
ttactctgctttatt

SEQ ID NO: 130008 - DNA, 15 bp, Homo sapiens
attactctgctttat

SEQ ID NO: 130009 - DNA, 15 bp, Homo sapiens
tattactctgcttta

SEQ ID NO: 130010 - DNA, 15 bp, Homo sapiens
ctattactctgcttt

SEQ ID NO: 130011 - DNA, 15 bp, Homo sapiens
actattactctgctt

SEQ ID NO: 130012 - DNA, 15 bp, Homo sapiens
aactattactctgct

SEQ ID NO: 130013 - DNA, 15 bp, Homo sapiens
taactattactctgc

SEQ ID NO: 130014 - DNA, 15 bp, Homo sapiens
gtaactattactctg

SEQ ID NO: 130015 - DNA, 15 bp, Homo sapiens
ggtaactattactct

SEQ ID NO: 130016 - DNA, 15 bp, Homo sapiens
tggtaactattactc

SEQ ID NO: 130017 - DNA, 15 bp, Homo sapiens
gtggtaactattact

SEQ ID NO: 130018 - DNA, 15 bp, Homo sapiens
ggtggtaactattac

SEQ ID NO: 130019 - DNA, 15 bp, Homo sapiens
aggtggtaactatta

SEQ ID NO: 130020 - DNA, 15 bp, Homo sapiens
taggtggtaactatt

SEQ ID NO: 130021 - DNA, 15 bp, Homo sapiens
ttaggtggtaactat

SEQ ID NO: 130022 - DNA, 15 bp, Homo sapiens
attaggtggtaacta

SEQ ID NO: 130023 - DNA, 15 bp, Homo sapiens
cattaggtggtaact

SEQ ID NO: 130024 - DNA, 15 bp, Homo sapiens
acattaggtggtaac

SEQ ID NO: 130025 - DNA, 15 bp, Homo sapiens
cacattaggtggtaa

SEQ ID NO: 130026 - DNA, 15 bp, Homo sapiens
tcacattaggtggta

SEQ ID NO: 130027 - DNA, 15 bp, Homo sapiens
atcacattaggtggt

SEQ ID NO: 130028 - DNA, 15 bp, Homo sapiens
tatcacattaggtgg

SEQ ID NO: 130029 - DNA, 15 bp, Homo sapiens
ttatcacattaggtg

SEQ ID NO: 130030 - DNA, 15 bp, Homo sapiens
gttatcacattaggt

SEQ ID NO: 130031 - DNA, 15 bp, Homo sapiens
tgttatcacattagg

SEQ ID NO: 130032 - DNA, 15 bp, Homo sapiens
atgttatcacattag

SEQ ID NO: 130033 - DNA, 15 bp, Homo sapiens
catgttatcacatta

SEQ ID NO: 130034 - DNA, 15 bp, Homo sapiens
acatgttatcacatt

SEQ ID NO: 130035 - DNA, 15 bp, Homo sapiens
gacatgttatcacat

SEQ ID NO: 130036 - DNA, 15 bp, Homo sapiens
tgacatgttatcaca

SEQ ID NO: 130037 - DNA, 15 bp, Homo sapiens
atgacatgttatcac

SEQ ID NO: 130038 - DNA, 15 bp, Homo sapiens
tatgacatgttatca

SEQ ID NO: 130039 - DNA, 15 bp, Homo sapiens
atatgacatgttatc

SEQ ID NO: 130040 - DNA, 15 bp, Homo sapiens
tatatgacatgttat

SEQ ID NO: 130041 - DNA, 15 bp, Homo sapiens
ttatatgacatgtta

SEQ ID NO: 130042 - DNA, 15 bp, Homo sapiens
attatatgacatgtt

SEQ ID NO: 130043 - DNA, 15 bp, Homo sapiens
cattatatgacatgt

SEQ ID NO: 130044 - DNA, 15 bp, Homo sapiens
tcattatatgacatg

SEQ ID NO: 130045 - DNA, 15 bp, Homo sapiens
atcattatatgacat

SEQ ID NO: 130046 - DNA, 15 bp, Homo sapiens
aatcattatatgaca

SEQ ID NO: 130047 - DNA, 15 bp, Homo sapiens
gaatcattatatgac

SEQ ID NO: 130048 - DNA, 15 bp, Homo sapiens
ggaatcattatatga

SEQ ID NO: 130049 - DNA, 15 bp, Homo sapiens
aggaatcattatatg

SEQ ID NO: 130050 - DNA, 15 bp, Homo sapiens
aaggaatcattatat

SEQ ID NO: 130051 - DNA, 15 bp, Homo sapiens
aaaggaatcattata

SEQ ID NO: 130052 - DNA, 15 bp, Homo sapiens
gaaaggaatcattat

SEQ ID NO: 130053 - DNA, 15 bp, Homo sapiens
tgaaaggaatcatta

SEQ ID NO: 130054 - DNA, 15 bp, Homo sapiens
ttgaaaggaatcatt

SEQ ID NO: 130055 - DNA, 15 bp, Homo sapiens
attgaaaggaatcat

SEQ ID NO: 130056 - DNA, 15 bp, Homo sapiens
tattgaaaggaatca

SEQ ID NO: 130057 - DNA, 15 bp, Homo sapiens
atattgaaaggaatc

SEQ ID NO: 130058 - DNA, 15 bp, Homo sapiens
aatattgaaaggaat

SEQ ID NO: 130059 - DNA, 15 bp, Homo sapiens
gaatattgaaaggaa

SEQ ID NO: 130060 - DNA, 15 bp, Homo sapiens
cgaatattgaaagga

SEQ ID NO: 130061 - DNA, 15 bp, Homo sapiens
acgaatattgaaagg

SEQ ID NO: 130062 - DNA, 15 bp, Homo sapiens
cacgaatattgaaag

SEQ ID NO: 130063 - DNA, 15 bp, Homo sapiens
tcacgaatattgaaa

SEQ ID NO: 130064 - DNA, 15 bp, Homo sapiens
ttcacgaatattgaa

SEQ ID NO: 130065 - DNA, 15 bp, Homo sapiens
tttcacgaatattga

SEQ ID NO: 130066 - DNA, 15 bp, Homo sapiens
gtttcacgaatattg

SEQ ID NO: 130067 - DNA, 15 bp, Homo sapiens
tgtttcacgaatatt

SEQ ID NO: 130068 - DNA, 15 bp, Homo sapiens
gtgtttcacgaatat

SEQ ID NO: 130069 - DNA, 15 bp, Homo sapiens
agtgtttcacgaata

SEQ ID NO: 130070 - DNA, 15 bp, Homo sapiens
gagtgtttcacgaat

SEQ ID NO: 130071 - DNA, 15 bp, Homo sapiens
tgagtgtttcacgaa

SEQ ID NO: 130072 - DNA, 15 bp, Homo sapiens
ttgagtgtttcacga

SEQ ID NO: 130073 - DNA, 15 bp, Homo sapiens
tttgagtgtttcacg

SEQ ID NO: 130074 - DNA, 15 bp, Homo sapiens
ctttgagtgtttcac

SEQ ID NO: 130075 - DNA, 15 bp, Homo sapiens
tctttgagtgtttca

SEQ ID NO: 130076 - DNA, 15 bp, Homo sapiens
ctctttgagtgtttc

SEQ ID NO: 130077 - DNA, 15 bp, Homo sapiens
tctctttgagtgttt

SEQ ID NO: 130078 - DNA, 15 bp, Homo sapiens
ttctctttgagtgtt

SEQ ID NO: 130079 - DNA, 15 bp, Homo sapiens
attctctttgagtgt

SEQ ID NO: 130080 - DNA, 15 bp, Homo sapiens
aattctctttgagtg

SEQ ID NO: 130081 - DNA, 15 bp, Homo sapiens
taattctctttgagt

SEQ ID NO: 130082 - DNA, 15 bp, Homo sapiens
ataattctctttgag

SEQ ID NO: 130083 - DNA, 15 bp, Homo sapiens
cataattctctttga

SEQ ID NO: 130084 - DNA, 15 bp, Homo sapiens
gcataattctctttg

SEQ ID NO: 130085 - DNA, 15 bp, Homo sapiens
agcataattctcttt

SEQ ID NO: 130086 - DNA, 15 bp, Homo sapiens
aagcataattctctt

SEQ ID NO: 130087 - DNA, 15 bp, Homo sapiens
aaagcataattctct

SEQ ID NO: 130088 - DNA, 15 bp, Homo sapiens
aaaagcataattctc

SEQ ID NO: 130089 - DNA, 15 bp, Homo sapiens
aaaaagcataattct

SEQ ID NO: 130090 - DNA, 15 bp, Homo sapiens
gaaaaagcataattc

SEQ ID NO: 130091 - DNA, 15 bp, Homo sapiens
ggaaaaagcataatt

SEQ ID NO: 130092 - DNA, 15 bp, Homo sapiens
gggaaaaagcataat

SEQ ID NO: 130093 - DNA, 15 bp, Homo sapiens
agggaaaaagcataa

SEQ ID NO: 130094 - DNA, 15 bp, Homo sapiens
tagggaaaaagcata

SEQ ID NO: 130095 - DNA, 15 bp, Homo sapiens
atagggaaaaagcat

SEQ ID NO: 130096 - DNA, 15 bp, Homo sapiens
aatagggaaaaagca

SEQ ID NO: 130097 - DNA, 15 bp, Homo sapiens
taatagggaaaaagc

SEQ ID NO: 130098 - DNA, 15 bp, Homo sapiens
ataatagggaaaaag

SEQ ID NO: 130099 - DNA, 15 bp, Homo sapiens
aataatagggaaaaa

SEQ ID NO: 130100 - DNA, 15 bp, Homo sapiens
aaataatagggaaaa

SEQ ID NO: 130101 - DNA, 15 bp, Homo sapiens
aaaataatagggaaa

SEQ ID NO: 130102 - DNA, 15 bp, Homo sapiens
taaaataatagggaa

SEQ ID NO: 130103 - DNA, 15 bp, Homo sapiens
ctaaaataataggga

SEQ ID NO: 130104 - DNA, 15 bp, Homo sapiens
tctaaaataataggg

SEQ ID NO: 130105 - DNA, 15 bp, Homo sapiens
atctaaaataatagg

SEQ ID NO: 130106 - DNA, 15 bp, Homo sapiens
tatctaaaataatag

SEQ ID NO: 130107 - DNA, 15 bp, Homo sapiens
ttatctaaaataata

SEQ ID NO: 130108 - DNA, 15 bp, Homo sapiens
tttatctaaaataat

SEQ ID NO: 130109 - DNA, 15 bp, Homo sapiens
ctttatctaaaataa

SEQ ID NO: 130110 - DNA, 15 bp, Homo sapiens
tctttatctaaaata

SEQ ID NO: 130111 - DNA, 15 bp, Homo sapiens
gtctttatctaaaat

SEQ ID NO: 130112 - DNA, 15 bp, Homo sapiens
tgtctttatctaaaa

SEQ ID NO: 130113 - DNA, 15 bp, Homo sapiens
atgtctttatctaaa

SEQ ID NO: 130114 - DNA, 15 bp, Homo sapiens
aatgtctttatctaa

SEQ ID NO: 130115 - DNA, 15 bp, Homo sapiens
aaatgtctttatcta

SEQ ID NO: 130116 - DNA, 15 bp, Homo sapiens
aaaatgtctttatct

SEQ ID NO: 130117 - DNA, 15 bp, Homo sapiens
aaaaatgtctttatc

SEQ ID NO: 130118 - DNA, 15 bp, Homo sapiens
gaaaaatgtctttat

SEQ ID NO: 130119 - DNA, 15 bp, Homo sapiens
tgaaaaatgtcttta

SEQ ID NO: 130120 - DNA, 15 bp, Homo sapiens
atgaaaaatgtcttt

SEQ ID NO: 130121 - DNA, 15 bp, Homo sapiens
catgaaaaatgtctt

SEQ ID NO: 130122 - DNA, 15 bp, Homo sapiens
acatgaaaaatgtct

SEQ ID NO: 130123 - DNA, 15 bp, Homo sapiens
aacatgaaaaatgtc

SEQ ID NO: 130124 - DNA, 15 bp, Homo sapiens
aaacatgaaaaatgt

SEQ ID NO: 130125 - DNA, 15 bp, Homo sapiens
aaaacatgaaaaatg

SEQ ID NO: 130126 - DNA, 15 bp, Homo sapiens
taaaacatgaaaaat

SEQ ID NO: 130127 - DNA, 15 bp, Homo sapiens
ttaaaacatgaaaaa

SEQ ID NO: 130128 - DNA, 15 bp, Homo sapiens
tttaaaacatgaaaa

SEQ ID NO: 130129 - DNA, 15 bp, Homo sapiens
ttttaaaacatgaaa

SEQ ID NO: 130130 - DNA, 15 bp, Homo sapiens
tttttaaaacatgaa

SEQ ID NO: 130131 - DNA, 15 bp, Homo sapiens
ttttttaaaacatga

SEQ ID NO: 130132 - DNA, 15 bp, Homo sapiens
attttttaaaacatg

SEQ ID NO: 130133 - DNA, 15 bp, Homo sapiens
aattttttaaaacat

SEQ ID NO: 130134 - DNA, 15 bp, Homo sapiens
aaattttttaaaaca

SEQ ID NO: 130135 - DNA, 15 bp, Homo sapiens
gaaattttttaaaac

SEQ ID NO: 130136 - DNA, 15 bp, Homo sapiens
ggaaattttttaaaa

SEQ ID NO: 130137 - DNA, 15 bp, Homo sapiens
tggaaattttttaaa

SEQ ID NO: 130138 - DNA, 15 bp, Homo sapiens
atggaaattttttaa

SEQ ID NO: 130139 - DNA, 15 bp, Homo sapiens
aatggaaatttttta

SEQ ID NO: 130140 - DNA, 15 bp, Homo sapiens
taatggaaatttttt

SEQ ID NO: 130141 - DNA, 15 bp, Homo sapiens
ataatggaaattttt

SEQ ID NO: 130142 - DNA, 15 bp, Homo sapiens
cataatggaaatttt

SEQ ID NO: 130143 - DNA, 15 bp, Homo sapiens
acataatggaaattt

SEQ ID NO: 130144 - DNA, 15 bp, Homo sapiens
aacataatggaaatt

SEQ ID NO: 130145 - DNA, 15 bp, Homo sapiens
caacataatggaaat

SEQ ID NO: 130146 - DNA, 15 bp, Homo sapiens
gcaacataatggaaa

SEQ ID NO: 130147 - DNA, 15 bp, Homo sapiens
cgcaacataatggaa

SEQ ID NO: 130148 - DNA, 15 bp, Homo sapiens
ccgcaacataatgga

SEQ ID NO: 130149 - DNA, 15 bp, Homo sapiens
tccgcaacataatgg

SEQ ID NO: 130150 - DNA, 15 bp, Homo sapiens
ctccgcaacataatg

SEQ ID NO: 130151 - DNA, 15 bp, Homo sapiens
actccgcaacataat

SEQ ID NO: 130152 - DNA, 15 bp, Homo sapiens
cactccgcaacataa

SEQ ID NO: 130153 - DNA, 15 bp, Homo sapiens
ccactccgcaacata

SEQ ID NO: 130154 - DNA, 15 bp, Homo sapiens
accactccgcaacat

SEQ ID NO: 130155 - DNA, 15 bp, Homo sapiens
taccactccgcaaca

SEQ ID NO: 130156 - DNA, 15 bp, Homo sapiens
ataccactccgcaac

SEQ ID NO: 130157 - DNA, 15 bp, Homo sapiens
gataccactccgcaa

SEQ ID NO: 130158 - DNA, 15 bp, Homo sapiens
agataccactccgca

SEQ ID NO: 130159 - DNA, 15 bp, Homo sapiens
tagataccactccgc

SEQ ID NO: 130160 - DNA, 15 bp, Homo sapiens
ttagataccactccg

SEQ ID NO: 130161 - DNA, 15 bp, Homo sapiens
gttagataccactcc

SEQ ID NO: 130162 - DNA, 15 bp, Homo sapiens
agttagataccactc

SEQ ID NO: 130163 - DNA, 15 bp, Homo sapiens
cagttagataccact

SEQ ID NO: 130164 - DNA, 15 bp, Homo sapiens
acagttagataccac

SEQ ID NO: 130165 - DNA, 15 bp, Homo sapiens
tacagttagatacca

SEQ ID NO: 130166 - DNA, 15 bp, Homo sapiens
ttacagttagatacc

SEQ ID NO: 130167 - DNA, 15 bp, Homo sapiens
tttacagttagatac

SEQ ID NO: 130168 - DNA, 15 bp, Homo sapiens
ttttacagttagata

SEQ ID NO: 130169 - DNA, 15 bp, Homo sapiens
tttttacagttagat

SEQ ID NO: 130170 - DNA, 15 bp, Homo sapiens
ttttttacagttaga

SEQ ID NO: 130171 - DNA, 15 bp, Homo sapiens
cttttttacagttag

SEQ ID NO: 130172 - DNA, 15 bp, Homo sapiens
ccttttttacagtta

SEQ ID NO: 130173 - DNA, 15 bp, Homo sapiens
gccttttttacagtt

SEQ ID NO: 130174 - DNA, 15 bp, Homo sapiens
agccttttttacagt

SEQ ID NO: 130175 - DNA, 15 bp, Homo sapiens
aagccttttttacag

SEQ ID NO: 130176 - DNA, 15 bp, Homo sapiens
aaagccttttttaca

SEQ ID NO: 130177 - DNA, 15 bp, Homo sapiens
aaaagccttttttac

SEQ ID NO: 130178 - DNA, 15 bp, Homo sapiens
caaaagcctttttta

SEQ ID NO: 130179 - DNA, 15 bp, Homo sapiens
acaaaagcctttttt

SEQ ID NO: 130180 - DNA, 15 bp, Homo sapiens
tacaaaagccttttt

SEQ ID NO: 130181 - DNA, 15 bp, Homo sapiens
atacaaaagcctttt

SEQ ID NO: 130182 - DNA, 15 bp, Homo sapiens
aatacaaaagccttt

SEQ ID NO: 130183 - DNA, 15 bp, Homo sapiens
gaatacaaaagcctt

SEQ ID NO: 130184 - DNA, 15 bp, Homo sapiens
tgaatacaaaagcct

SEQ ID NO: 130185 - DNA, 15 bp, Homo sapiens
ttgaatacaaaagcc

SEQ ID NO: 130186 - DNA, 15 bp, Homo sapiens
attgaatacaaaagc

SEQ ID NO: 130187 - DNA, 15 bp, Homo sapiens
aattgaatacaaaag

SEQ ID NO: 130188 - DNA, 15 bp, Homo sapiens
aaattgaatacaaaa

SEQ ID NO: 130189 - DNA, 15 bp, Homo sapiens
gaaattgaatacaaa

SEQ ID NO: 130190 - DNA, 15 bp, Homo sapiens
agaaattgaatacaa

SEQ ID NO: 130191 - DNA, 15 bp, Homo sapiens
tagaaattgaataca

SEQ ID NO: 130192 - DNA, 15 bp, Homo sapiens
gtagaaattgaatac

SEQ ID NO: 130193 - DNA, 15 bp, Homo sapiens
tgtagaaattgaata

SEQ ID NO: 130194 - DNA, 15 bp, Homo sapiens
atgtagaaattgaat

SEQ ID NO: 130195 - DNA, 15 bp, Homo sapiens
tatgtagaaattgaa

SEQ ID NO: 130196 - DNA, 15 bp, Homo sapiens
ttatgtagaaattga

SEQ ID NO: 130197 - DNA, 15 bp, Homo sapiens
gttatgtagaaattg

SEQ ID NO: 130198 - DNA, 15 bp, Homo sapiens
agttatgtagaaatt

SEQ ID NO: 130199 - DNA, 15 bp, Homo sapiens
aagttatgtagaaat

SEQ ID NO: 130200 - DNA, 15 bp, Homo sapiens
aaagttatgtagaaa

SEQ ID NO: 130201 - DNA, 15 bp, Homo sapiens
aaaagttatgtagaa

SEQ ID NO: 130202 - DNA, 15 bp, Homo sapiens
aaaaagttatgtaga

SEQ ID NO: 130203 - DNA, 15 bp, Homo sapiens
taaaaagttatgtag

SEQ ID NO: 130204 - DNA, 15 bp, Homo sapiens
ataaaaagttatgta

SEQ ID NO: 130205 - DNA, 15 bp, Homo sapiens
cataaaaagttatgt

SEQ ID NO: 130206 - DNA, 15 bp, Homo sapiens
tcataaaaagttatg

SEQ ID NO: 130207 - DNA, 15 bp, Homo sapiens
atcataaaaagttat

SEQ ID NO: 130208 - DNA, 15 bp, Homo sapiens
catcataaaaagtta

SEQ ID NO: 130209 - DNA, 15 bp, Homo sapiens
tcatcataaaaagtt

SEQ ID NO: 130210 - DNA, 15 bp, Homo sapiens
ctcatcataaaaagt

SEQ ID NO: 130211 - DNA, 15 bp, Homo sapiens
cctcatcataaaaag

SEQ ID NO: 130212 - DNA, 15 bp, Homo sapiens
ccctcatcataaaaa

SEQ ID NO: 130213 - DNA, 15 bp, Homo sapiens
tccctcatcataaaa

SEQ ID NO: 130214 - DNA, 15 bp, Homo sapiens
ttccctcatcataaa

SEQ ID NO: 130215 - DNA, 15 bp, Homo sapiens
cttccctcatcataa

SEQ ID NO: 130216 - DNA, 15 bp, Homo sapiens
tcttccctcatcata

SEQ ID NO: 130217 - DNA, 15 bp, Homo sapiens
atcttccctcatcat

SEQ ID NO: 130218 - DNA, 15 bp, Homo sapiens
tatcttccctcatca

SEQ ID NO: 130219 - DNA, 15 bp, Homo sapiens
ttatcttccctcatc

SEQ ID NO: 130220 - DNA, 15 bp, Homo sapiens
attatcttccctcat

SEQ ID NO: 130221 - DNA, 15 bp, Homo sapiens
tattatcttccctca

SEQ ID NO: 130222 - DNA, 15 bp, Homo sapiens
atattatcttccctc

SEQ ID NO: 130223 - DNA, 15 bp, Homo sapiens
aatattatcttccct

SEQ ID NO: 130224 - DNA, 15 bp, Homo sapiens
gaatattatcttccc

SEQ ID NO: 130225 - DNA, 15 bp, Homo sapiens
agaatattatcttcc

SEQ ID NO: 130226 - DNA, 15 bp, Homo sapiens
aagaatattatcttc

SEQ ID NO: 130227 - DNA, 15 bp, Homo sapiens
aaagaatattatctt

SEQ ID NO: 130228 - DNA, 15 bp, Homo sapiens
taaagaatattatct

SEQ ID NO: 130229 - DNA, 15 bp, Homo sapiens
ctaaagaatattatc

SEQ ID NO: 130230 - DNA, 15 bp, Homo sapiens
actaaagaatattat

SEQ ID NO: 130231 - DNA, 15 bp, Homo sapiens
aactaaagaatatta

SEQ ID NO: 130232 - DNA, 15 bp, Homo sapiens
aaactaaagaatatt

SEQ ID NO: 130233 - DNA, 15 bp, Homo sapiens
gaaactaaagaatat

SEQ ID NO: 130234 - DNA, 15 bp, Homo sapiens
tgaaactaaagaata

SEQ ID NO: 130235 - DNA, 15 bp, Homo sapiens
ttgaaactaaagaat

SEQ ID NO: 130236 - DNA, 15 bp, Homo sapiens
attgaaactaaagaa

SEQ ID NO: 130237 - DNA, 15 bp, Homo sapiens
cattgaaactaaaga

SEQ ID NO: 130238 - DNA, 15 bp, Homo sapiens
acattgaaactaaag

SEQ ID NO: 130239 - DNA, 15 bp, Homo sapiens
aacattgaaactaaa

SEQ ID NO: 130240 - DNA, 15 bp, Homo sapiens
aaacattgaaactaa

SEQ ID NO: 130241 - DNA, 15 bp, Homo sapiens
aaaacattgaaacta

SEQ ID NO: 130242 - DNA, 15 bp, Homo sapiens
aaaaacattgaaact

SEQ ID NO: 130243 - DNA, 15 bp, Homo sapiens
caaaaacattgaaac

SEQ ID NO: 130244 - DNA, 15 bp, Homo sapiens
tcaaaaacattgaaa

SEQ ID NO: 130245 - DNA, 15 bp, Homo sapiens
ttcaaaaacattgaa

SEQ ID NO: 130246 - DNA, 15 bp, Homo sapiens
attcaaaaacattga

SEQ ID NO: 130247 - DNA, 15 bp, Homo sapiens
aattcaaaaacattg

SEQ ID NO: 130248 - DNA, 15 bp, Homo sapiens
aaattcaaaaacatt

SEQ ID NO: 130249 - DNA, 15 bp, Homo sapiens
taaattcaaaaacat

SEQ ID NO: 130250 - DNA, 15 bp, Homo sapiens
ttaaattcaaaaaca

SEQ ID NO: 130251 - DNA, 15 bp, Homo sapiens
gttaaattcaaaaac

SEQ ID NO: 130252 - DNA, 15 bp, Homo sapiens
agttaaattcaaaaa

SEQ ID NO: 130253 - DNA, 15 bp, Homo sapiens
tagttaaattcaaaa

SEQ ID NO: 130254 - DNA, 15 bp, Homo sapiens
ttagttaaattcaaa

SEQ ID NO: 130255 - DNA, 15 bp, Homo sapiens
cttagttaaattcaa

SEQ ID NO: 130256 - DNA, 15 bp, Homo sapiens
ccttagttaaattca

SEQ ID NO: 130257 - DNA, 15 bp, Homo sapiens
tccttagttaaattc

SEQ ID NO: 130258 - DNA, 15 bp, Homo sapiens
ttccttagttaaatt

SEQ ID NO: 130259 - DNA, 15 bp, Homo sapiens
tttccttagttaaat

SEQ ID NO: 130260 - DNA, 15 bp, Homo sapiens
ttttccttagttaaa

SEQ ID NO: 130261 - DNA, 15 bp, Homo sapiens
tttttccttagttaa

SEQ ID NO: 130262 - DNA, 15 bp, Homo sapiens
ttttttccttagtta

SEQ ID NO: 130263 - DNA, 15 bp, Homo sapiens
cttttttccttagtt

SEQ ID NO: 130264 - DNA, 15 bp, Homo sapiens
gcttttttccttagt

SEQ ID NO: 130265 - DNA, 15 bp, Homo sapiens
agcttttttccttag

SEQ ID NO: 130266 - DNA, 15 bp, Homo sapiens
aagcttttttcctta

SEQ ID NO: 130267 - DNA, 15 bp, Homo sapiens
gaagcttttttcctt

SEQ ID NO: 130268 - DNA, 15 bp, Homo sapiens
agaagcttttttcct

SEQ ID NO: 130269 - DNA, 15 bp, Homo sapiens
aagaagcttttttcc

SEQ ID NO: 130270 - DNA, 15 bp, Homo sapiens
caagaagcttttttc

SEQ ID NO: 130271 - DNA, 15 bp, Homo sapiens
ccaagaagctttttt

SEQ ID NO: 130272 - DNA, 15 bp, Homo sapiens
accaagaagcttttt

SEQ ID NO: 130273 - DNA, 15 bp, Homo sapiens
gaccaagaagctttt

SEQ ID NO: 130274 - DNA, 15 bp, Homo sapiens
agaccaagaagcttt

SEQ ID NO: 130275 - DNA, 15 bp, Homo sapiens
tagaccaagaagctt

SEQ ID NO: 130276 - DNA, 15 bp, Homo sapiens
atagaccaagaagct

SEQ ID NO: 130277 - DNA, 15 bp, Homo sapiens
aatagaccaagaagc

SEQ ID NO: 130278 - DNA, 15 bp, Homo sapiens
taatagaccaagaag

SEQ ID NO: 130279 - DNA, 15 bp, Homo sapiens
ataatagaccaagaa

SEQ ID NO: 130280 - DNA, 15 bp, Homo sapiens
aataatagaccaaga

SEQ ID NO: 130281 - DNA, 15 bp, Homo sapiens
taataatagaccaag

SEQ ID NO: 130282 - DNA, 15 bp, Homo sapiens
ttaataatagaccaa

SEQ ID NO: 130283 - DNA, 15 bp, Homo sapiens
cttaataatagacca

SEQ ID NO: 130284 - DNA, 15 bp, Homo sapiens
gcttaataatagacc

SEQ ID NO: 130285 - DNA, 15 bp, Homo sapiens
tgcttaataatagac

SEQ ID NO: 130286 - DNA, 15 bp, Homo sapiens
ttgcttaataataga

SEQ ID NO: 130287 - DNA, 15 bp, Homo sapiens
attgcttaataatag

SEQ ID NO: 130288 - DNA, 15 bp, Homo sapiens
gattgcttaataata

SEQ ID NO: 130289 - DNA, 15 bp, Homo sapiens
agattgcttaataat

SEQ ID NO: 130290 - DNA, 15 bp, Homo sapiens
aagattgcttaataa

SEQ ID NO: 130291 - DNA, 15 bp, Homo sapiens
aaagattgcttaata

SEQ ID NO: 130292 - DNA, 15 bp, Homo sapiens
taaagattgcttaat

SEQ ID NO: 130293 - DNA, 15 bp, Homo sapiens
ataaagattgcttaa

SEQ ID NO: 130294 - DNA, 15 bp, Homo sapiens
tataaagattgctta

SEQ ID NO: 130295 - DNA, 15 bp, Homo sapiens
atataaagattgctt

SEQ ID NO: 130296 - DNA, 15 bp, Homo sapiens
aatataaagattgct

SEQ ID NO: 130297 - DNA, 15 bp, Homo sapiens
caatataaagattgc

SEQ ID NO: 130298 - DNA, 15 bp, Homo sapiens
acaatataaagattg

SEQ ID NO: 130299 - DNA, 15 bp, Homo sapiens
tacaatataaagatt

SEQ ID NO: 130300 - DNA, 15 bp, Homo sapiens
ctacaatataaagat

SEQ ID NO: 130301 - DNA, 15 bp, Homo sapiens
tctacaatataaaga

SEQ ID NO: 130302 - DNA, 15 bp, Homo sapiens
ttctacaatataaag

SEQ ID NO: 130303 - DNA, 15 bp, Homo sapiens
attctacaatataaa

SEQ ID NO: 130304 - DNA, 15 bp, Homo sapiens
tattctacaatataa

SEQ ID NO: 130305 - DNA, 15 bp, Homo sapiens
atattctacaatata

SEQ ID NO: 130306 - DNA, 15 bp, Homo sapiens
tatattctacaatat

SEQ ID NO: 130307 - DNA, 15 bp, Homo sapiens
atatattctacaata

SEQ ID NO: 130308 - DNA, 15 bp, Homo sapiens
tatatattctacaat

SEQ ID NO: 130309 - DNA, 15 bp, Homo sapiens
gtatatattctacaa

SEQ ID NO: 130310 - DNA, 15 bp, Homo sapiens
tgtatatattctaca

SEQ ID NO: 130311 - DNA, 15 bp, Homo sapiens
atgtatatattctac

SEQ ID NO: 130312 - DNA, 15 bp, Homo sapiens
aatgtatatattcta

SEQ ID NO: 130313 - DNA, 15 bp, Homo sapiens
caatgtatatattct

SEQ ID NO: 130314 - DNA, 15 bp, Homo sapiens
acaatgtatatattc

SEQ ID NO: 130315 - DNA, 15 bp, Homo sapiens
aacaatgtatatatt

SEQ ID NO: 130316 - DNA, 15 bp, Homo sapiens
aaacaatgtatatat

SEQ ID NO: 130317 - DNA, 15 bp, Homo sapiens
gaaacaatgtatata

SEQ ID NO: 130318 - DNA, 15 bp, Homo sapiens
tgaaacaatgtatat

SEQ ID NO: 130319 - DNA, 15 bp, Homo sapiens
gtgaaacaatgtata

SEQ ID NO: 130320 - DNA, 15 bp, Homo sapiens
agtgaaacaatgtat

SEQ ID NO: 130321 - DNA, 15 bp, Homo sapiens
aagtgaaacaatgta

SEQ ID NO: 130322 - DNA, 15 bp, Homo sapiens
taagtgaaacaatgt

SEQ ID NO: 130323 - DNA, 15 bp, Homo sapiens
ttaagtgaaacaatg

SEQ ID NO: 130324 - DNA, 15 bp, Homo sapiens
tttaagtgaaacaat

SEQ ID NO: 130325 - DNA, 15 bp, Homo sapiens
ttttaagtgaaacaa

SEQ ID NO: 130326 - DNA, 15 bp, Homo sapiens
attttaagtgaaaca

SEQ ID NO: 130327 - DNA, 15 bp, Homo sapiens
tattttaagtgaaac

SEQ ID NO: 130328 - DNA, 15 bp, Homo sapiens
atattttaagtgaaa

SEQ ID NO: 130329 - DNA, 15 bp, Homo sapiens
tatattttaagtgaa

SEQ ID NO: 130330 - DNA, 15 bp, Homo sapiens
atatattttaagtga

SEQ ID NO: 130331 - DNA, 15 bp, Homo sapiens
tatatattttaagtg

SEQ ID NO: 130332 - DNA, 15 bp, Homo sapiens
atatatattttaagt

SEQ ID NO: 130333 - DNA, 15 bp, Homo sapiens
aatatatattttaag

SEQ ID NO: 130334 - DNA, 15 bp, Homo sapiens
taatatatattttaa

SEQ ID NO: 130335 - DNA, 15 bp, Homo sapiens
ttaatatatatttta

SEQ ID NO: 130336 - DNA, 15 bp, Homo sapiens
tttaatatatatttt

SEQ ID NO: 130337 - DNA, 15 bp, Homo sapiens
ttttaatatatattt

SEQ ID NO: 130338 - DNA, 15 bp, Homo sapiens
attttaatatatatt

SEQ ID NO: 130339 - DNA, 15 bp, Homo sapiens
tattttaatatatat

SEQ ID NO: 130340 - DNA, 15 bp, Homo sapiens
ttattttaatatata

SEQ ID NO: 130341 - DNA, 15 bp, Homo sapiens
attattttaatatat

SEQ ID NO: 130342 - DNA, 15 bp, Homo sapiens
aattattttaatata

SEQ ID NO: 130343 - DNA, 15 bp, Homo sapiens
taattattttaatat

SEQ ID NO: 130344 - DNA, 15 bp, Homo sapiens
ataattattttaata

SEQ ID NO: 130345 - DNA, 15 bp, Homo sapiens
aataattattttaat

SEQ ID NO: 130346 - DNA, 15 bp, Homo sapiens
ctaataattatttta

SEQ ID NO: 130347 - DNA, 15 bp, Homo sapiens
tctaataattatttt

SEQ ID NO: 130348 - DNA, 15 bp, Homo sapiens
ttctaataattattt

SEQ ID NO: 130349 - DNA, 15 bp, Homo sapiens
tttctaataattatt

SEQ ID NO: 130350 - DNA, 15 bp, Homo sapiens
atttctaataattat

SEQ ID NO: 130351 - DNA, 15 bp, Homo sapiens
aatttctaataatta

SEQ ID NO: 130352 - DNA, 15 bp, Homo sapiens
taatttctaataatt

SEQ ID NO: 130353 - DNA, 15 bp, Homo sapiens
ataatttctaataat

SEQ ID NO: 130354 - DNA, 15 bp, Homo sapiens
aataatttctaataa

SEQ ID NO: 130355 - DNA, 15 bp, Homo sapiens
aaataatttctaata

SEQ ID NO: 130356 - DNA, 15 bp, Homo sapiens
taaataatttctaat

SEQ ID NO: 130357 - DNA, 15 bp, Homo sapiens
ataaataatttctaa

SEQ ID NO: 130358 - DNA, 15 bp, Homo sapiens
aataaataatttcta

SEQ ID NO: 130359 - DNA, 15 bp, Homo sapiens
aaataaataatttct

SEQ ID NO: 130360 - DNA, 15 bp, Homo sapiens
aaaataaataatttc

SEQ ID NO: 130361 - DNA, 15 bp, Homo sapiens
caaaataaataattt

SEQ ID NO: 130362 - DNA, 15 bp, Homo sapiens
ccaaaataaataatt

SEQ ID NO: 130363 - DNA, 15 bp, Homo sapiens
cccaaaataaataat

SEQ ID NO: 130364 - DNA, 15 bp, Homo sapiens
tcccaaaataaataa

SEQ ID NO: 130365 - DNA, 15 bp, Homo sapiens
ttcccaaaataaata

SEQ ID NO: 130366 - DNA, 15 bp, Homo sapiens
tttcccaaaataaat

SEQ ID NO: 130367 - DNA, 15 bp, Homo sapiens
atttcccaaaataaa

SEQ ID NO: 130368 - DNA, 15 bp, Homo sapiens
tatttcccaaaataa

SEQ ID NO: 130369 - DNA, 15 bp, Homo sapiens
atatttcccaaaata

SEQ ID NO: 130370 - DNA, 15 bp, Homo sapiens
aatatttcccaaaat

SEQ ID NO: 130371 - DNA, 15 bp, Homo sapiens
aaatatttcccaaaa

SEQ ID NO: 130372 - DNA, 15 bp, Homo sapiens
taaatatttcccaaa

SEQ ID NO: 130373 - DNA, 15 bp, Homo sapiens
ctaaatatttcccaa

SEQ ID NO: 130374 - DNA, 15 bp, Homo sapiens
actaaatatttccca

SEQ ID NO: 130375 - DNA, 15 bp, Homo sapiens
gactaaatatttccc

SEQ ID NO: 130376 - DNA, 15 bp, Homo sapiens
tgactaaatatttcc

SEQ ID NO: 130377 - DNA, 15 bp, Homo sapiens
ctgactaaatatttc

SEQ ID NO: 130378 - DNA, 15 bp, Homo sapiens
cctgactaaatattt

SEQ ID NO: 130379 - DNA, 15 bp, Homo sapiens
tcctgactaaatatt

SEQ ID NO: 130380 - DNA, 15 bp, Homo sapiens
atcctgactaaatat

SEQ ID NO: 130381 - DNA, 15 bp, Homo sapiens
tatcctgactaaata

SEQ ID NO: 130382 - DNA, 15 bp, Homo sapiens
atatcctgactaaat

SEQ ID NO: 130383 - DNA, 15 bp, Homo sapiens
aatatcctgactaaa

SEQ ID NO: 130384 - DNA, 15 bp, Homo sapiens
gaatatcctgactaa

SEQ ID NO: 130385 - DNA, 15 bp, Homo sapiens
tgaatatcctgacta

SEQ ID NO: 130386 - DNA, 15 bp, Homo sapiens
ttgaatatcctgact

SEQ ID NO: 130387 - DNA, 15 bp, Homo sapiens
tttgaatatcctgac

SEQ ID NO: 130388 - DNA, 15 bp, Homo sapiens
ctttgaatatcctga

SEQ ID NO: 130389 - DNA, 15 bp, Homo sapiens
gctttgaatatcctg

SEQ ID NO: 130390 - DNA, 15 bp, Homo sapiens
tgctttgaatatcct

SEQ ID NO: 130391 - DNA, 15 bp, Homo sapiens
ttgctttgaatatcc

SEQ ID NO: 130392 - DNA, 15 bp, Homo sapiens
tttgctttgaatatc

SEQ ID NO: 130393 - DNA, 15 bp, Homo sapiens
atttgctttgaatat

SEQ ID NO: 130394 - DNA, 15 bp, Homo sapiens
tatttgctttgaata

SEQ ID NO: 130395 - DNA, 15 bp, Homo sapiens
atatttgctttgaat

SEQ ID NO: 130396 - DNA, 15 bp, Homo sapiens
catatttgctttgaa

SEQ ID NO: 130397 - DNA, 15 bp, Homo sapiens
acatatttgctttga

SEQ ID NO: 130398 - DNA, 15 bp, Homo sapiens
tacatatttgctttg

SEQ ID NO: 130399 - DNA, 15 bp, Homo sapiens
ttacatatttgcttt

SEQ ID NO: 130400 - DNA, 15 bp, Homo sapiens
cttacatatttgctt

SEQ ID NO: 130401 - DNA, 15 bp, Homo sapiens
ccttacatatttgct

SEQ ID NO: 130402 - DNA, 15 bp, Homo sapiens
accttacatatttgc

SEQ ID NO: 130403 - DNA, 15 bp, Homo sapiens
aaccttacatatttg

SEQ ID NO: 130404 - DNA, 15 bp, Homo sapiens
gaaccttacatattt

SEQ ID NO: 130405 - DNA, 15 bp, Homo sapiens
agaaccttacatatt

SEQ ID NO: 130406 - DNA, 15 bp, Homo sapiens
cagaaccttacatat

SEQ ID NO: 130407 - DNA, 15 bp, Homo sapiens
gcagaaccttacata

SEQ ID NO: 130408 - DNA, 15 bp, Homo sapiens
agcagaaccttacat

SEQ ID NO: 130409 - DNA, 15 bp, Homo sapiens
aagcagaaccttaca

SEQ ID NO: 130410 - DNA, 15 bp, Homo sapiens
taagcagaaccttac

SEQ ID NO: 130411 - DNA, 15 bp, Homo sapiens
ttaagcagaacctta

SEQ ID NO: 130412 - DNA, 15 bp, Homo sapiens
attaagcagaacctt

SEQ ID NO: 130413 - DNA, 15 bp, Homo sapiens
aattaagcagaacct

SEQ ID NO: 130414 - DNA, 15 bp, Homo sapiens
caattaagcagaacc

SEQ ID NO: 130415 - DNA, 15 bp, Homo sapiens
ccaattaagcagaac

SEQ ID NO: 130416 - DNA, 15 bp, Homo sapiens
tccaattaagcagaa

SEQ ID NO: 130417 - DNA, 15 bp, Homo sapiens
gtccaattaagcaga

SEQ ID NO: 130418 - DNA, 15 bp, Homo sapiens
tgtccaattaagcag

SEQ ID NO: 130419 - DNA, 15 bp, Homo sapiens
ctgtccaattaagca

SEQ ID NO: 130420 - DNA, 15 bp, Homo sapiens
actgtccaattaagc

SEQ ID NO: 130421 - DNA, 15 bp, Homo sapiens
aactgtccaattaag

SEQ ID NO: 130422 - DNA, 15 bp, Homo sapiens
aaactgtccaattaa

SEQ ID NO: 130423 - DNA, 15 bp, Homo sapiens
aaaactgtccaatta

SEQ ID NO: 130424 - DNA, 15 bp, Homo sapiens
aaaaactgtccaatt

SEQ ID NO: 130425 - DNA, 15 bp, Homo sapiens
gaaaaactgtccaat

SEQ ID NO: 130426 - DNA, 15 bp, Homo sapiens
ggaaaaactgtccaa

SEQ ID NO: 130427 - DNA, 15 bp, Homo sapiens
aggaaaaactgtcca

SEQ ID NO: 130428 - DNA, 15 bp, Homo sapiens
gaggaaaaactgtcc

SEQ ID NO: 130429 - DNA, 15 bp, Homo sapiens
tgaggaaaaactgtc

SEQ ID NO: 130430 - DNA, 15 bp, Homo sapiens
ttgaggaaaaactgt

SEQ ID NO: 130431 - DNA, 15 bp, Homo sapiens
attgaggaaaaactg

SEQ ID NO: 130432 - DNA, 15 bp, Homo sapiens
tattgaggaaaaact

SEQ ID NO: 130433 - DNA, 15 bp, Homo sapiens
atattgaggaaaaac

SEQ ID NO: 130434 - DNA, 15 bp, Homo sapiens
aatattgaggaaaaa

SEQ ID NO: 130435 - DNA, 15 bp, Homo sapiens
aaatattgaggaaaa

SEQ ID NO: 130436 - DNA, 15 bp, Homo sapiens
aaaatattgaggaaa

SEQ ID NO: 130437 - DNA, 15 bp, Homo sapiens
aaaaatattgaggaa

SEQ ID NO: 130438 - DNA, 15 bp, Homo sapiens
taaaaatattgagga

SEQ ID NO: 130439 - DNA, 15 bp, Homo sapiens
ttaaaaatattgagg

SEQ ID NO: 130440 - DNA, 15 bp, Homo sapiens
tttaaaaatattgag

SEQ ID NO: 130441 - DNA, 15 bp, Homo sapiens
atttaaaaatattga

SEQ ID NO: 130442 - DNA, 15 bp, Homo sapiens
tatttaaaaatattg

SEQ ID NO: 130443 - DNA, 15 bp, Homo sapiens
attatttaaaaatat

SEQ ID NO: 130444 - DNA, 15 bp, Homo sapiens
tattatttaaaaata

SEQ ID NO: 130445 - DNA, 15 bp, Homo sapiens
atattatttaaaaat

SEQ ID NO: 130446 - DNA, 15 bp, Homo sapiens
tatattatttaaaaa

SEQ ID NO: 130447 - DNA, 15 bp, Homo sapiens
atatattatttaaaa

SEQ ID NO: 130448 - DNA, 15 bp, Homo sapiens
aatatattatttaaa

SEQ ID NO: 130449 - DNA, 15 bp, Homo sapiens
gaatatattatttaa

SEQ ID NO: 130450 - DNA, 15 bp, Homo sapiens
agaatatattattta

SEQ ID NO: 130451 - DNA, 15 bp, Homo sapiens
aagaatatattattt

SEQ ID NO: 130452 - DNA, 15 bp, Homo sapiens
aaagaatatattatt

SEQ ID NO: 130453 - DNA, 15 bp, Homo sapiens
aaaagaatatattat

SEQ ID NO: 130454 - DNA, 15 bp, Homo sapiens
taaaagaatatatta

SEQ ID NO: 130455 - DNA, 15 bp, Homo sapiens
ctaaaagaatatatt

SEQ ID NO: 130456 - DNA, 15 bp, Homo sapiens
cctaaaagaatatat

SEQ ID NO: 130457 - DNA, 15 bp, Homo sapiens
gcctaaaagaatata

SEQ ID NO: 130458 - DNA, 15 bp, Homo sapiens
agcctaaaagaatat

SEQ ID NO: 130459 - DNA, 15 bp, Homo sapiens
tagcctaaaagaata

SEQ ID NO: 130460 - DNA, 15 bp, Homo sapiens
ttagcctaaaagaat

SEQ ID NO: 130461 - DNA, 15 bp, Homo sapiens
tttagcctaaaagaa

SEQ ID NO: 130462 - DNA, 15 bp, Homo sapiens
ttttagcctaaaaga

SEQ ID NO: 130463 - DNA, 15 bp, Homo sapiens
cttttagcctaaaag

SEQ ID NO: 130464 - DNA, 15 bp, Homo sapiens
ccttttagcctaaaa

SEQ ID NO: 130465 - DNA, 15 bp, Homo sapiens
tccttttagcctaaa

SEQ ID NO: 130466 - DNA, 15 bp, Homo sapiens
ctccttttagcctaa

SEQ ID NO: 130467 - DNA, 15 bp, Homo sapiens
tctccttttagccta

SEQ ID NO: 130468 - DNA, 15 bp, Homo sapiens
ttctccttttagcct

SEQ ID NO: 130469 - DNA, 15 bp, Homo sapiens
tttctccttttagcc

SEQ ID NO: 130470 - DNA, 15 bp, Homo sapiens
ctttctccttttagc

SEQ ID NO: 130471 - DNA, 15 bp, Homo sapiens
actttctccttttag

SEQ ID NO: 130472 - DNA, 15 bp, Homo sapiens
tactttctcctttta

SEQ ID NO: 130473 - DNA, 15 bp, Homo sapiens
ttactttctcctttt

SEQ ID NO: 130474 - DNA, 15 bp, Homo sapiens
cttactttctccttt

SEQ ID NO: 130475 - DNA, 15 bp, Homo sapiens
gcttactttctcctt

SEQ ID NO: 130476 - DNA, 15 bp, Homo sapiens
tgcttactttctcct

SEQ ID NO: 130477 - DNA, 15 bp, Homo sapiens
ctgcttactttctcc

SEQ ID NO: 130478 - DNA, 15 bp, Homo sapiens
cctgcttactttctc

SEQ ID NO: 130479 - DNA, 15 bp, Homo sapiens
acctgcttactttct

SEQ ID NO: 130480 - DNA, 15 bp, Homo sapiens
cacctgcttactttc

SEQ ID NO: 130481 - DNA, 15 bp, Homo sapiens
tcacctgcttacttt

SEQ ID NO: 130482 - DNA, 15 bp, Homo sapiens
atcacctgcttactt

SEQ ID NO: 130483 - DNA, 15 bp, Homo sapiens
catcacctgcttact

SEQ ID NO: 130484 - DNA, 15 bp, Homo sapiens
tcatcacctgcttac

SEQ ID NO: 130485 - DNA, 15 bp, Homo sapiens
ttcatcacctgctta

SEQ ID NO: 130486 - DNA, 15 bp, Homo sapiens
cttcatcacctgctt

SEQ ID NO: 130487 - DNA, 15 bp, Homo sapiens
acttcatcacctgct

SEQ ID NO: 130488 - DNA, 15 bp, Homo sapiens
tacttcatcacctgc

SEQ ID NO: 130489 - DNA, 15 bp, Homo sapiens
gtacttcatcacctg

SEQ ID NO: 130490 - DNA, 15 bp, Homo sapiens
tgtacttcatcacct

SEQ ID NO: 130491 - DNA, 15 bp, Homo sapiens
ctgtacttcatcacc

SEQ ID NO: 130492 - DNA, 15 bp, Homo sapiens
cctgtacttcatcac

SEQ ID NO: 130493 - DNA, 15 bp, Homo sapiens
gcctgtacttcatca

SEQ ID NO: 130494 - DNA, 15 bp, Homo sapiens
tgcctgtacttcatc

SEQ ID NO: 130495 - DNA, 15 bp, Homo sapiens
atgcctgtacttcat

SEQ ID NO: 130496 - DNA, 15 bp, Homo sapiens
gatgcctgtacttca

SEQ ID NO: 130497 - DNA, 15 bp, Homo sapiens
tgatgcctgtacttc

SEQ ID NO: 130498 - DNA, 15 bp, Homo sapiens
ctgatgcctgtactt

SEQ ID NO: 130499 - DNA, 15 bp, Homo sapiens
gctgatgcctgtact

SEQ ID NO: 130500 - DNA, 15 bp, Homo sapiens
agctgatgcctgtac

SEQ ID NO: 130501 - DNA, 15 bp, Homo sapiens
tagctgatgcctgta

SEQ ID NO: 130502 - DNA, 15 bp, Homo sapiens
ctagctgatgcctgt

SEQ ID NO: 130503 - DNA, 15 bp, Homo sapiens
tctagctgatgcctg

SEQ ID NO: 130504 - DNA, 15 bp, Homo sapiens
atctagctgatgcct

SEQ ID NO: 130505 - DNA, 15 bp, Homo sapiens
catctagctgatgcc

SEQ ID NO: 130506 - DNA, 15 bp, Homo sapiens
tcatctagctgatgc

SEQ ID NO: 130507 - DNA, 15 bp, Homo sapiens
ctcatctagctgatg

SEQ ID NO: 130508 - DNA, 15 bp, Homo sapiens
tctcatctagctgat

SEQ ID NO: 130509 - DNA, 15 bp, Homo sapiens
atctcatctagctga

SEQ ID NO: 130510 - DNA, 15 bp, Homo sapiens
aatctcatctagctg

SEQ ID NO: 130511 - DNA, 15 bp, Homo sapiens
taatctcatctagct

SEQ ID NO: 130512 - DNA, 15 bp, Homo sapiens
ataatctcatctagc

SEQ ID NO: 130513 - DNA, 15 bp, Homo sapiens
gataatctcatctag

SEQ ID NO: 130514 - DNA, 15 bp, Homo sapiens
agataatctcatcta

SEQ ID NO: 130515 - DNA, 15 bp, Homo sapiens
cagataatctcatct

SEQ ID NO: 130516 - DNA, 15 bp, Homo sapiens
acagataatctcatc

SEQ ID NO: 130517 - DNA, 15 bp, Homo sapiens
aacagataatctcat

SEQ ID NO: 130518 - DNA, 15 bp, Homo sapiens
caacagataatctca

SEQ ID NO: 130519 - DNA, 15 bp, Homo sapiens
ccaacagataatctc

SEQ ID NO: 130520 - DNA, 15 bp, Homo sapiens
accaacagataatct

SEQ ID NO: 130521 - DNA, 15 bp, Homo sapiens
aaccaacagataatc

SEQ ID NO: 130522 - DNA, 15 bp, Homo sapiens
taaccaacagataat

SEQ ID NO: 130523 - DNA, 15 bp, Homo sapiens
ttaaccaacagataa

SEQ ID NO: 130524 - DNA, 15 bp, Homo sapiens
gttaaccaacagata

SEQ ID NO: 130525 - DNA, 15 bp, Homo sapiens
tgttaaccaacagat

SEQ ID NO: 130526 - DNA, 15 bp, Homo sapiens
ttgttaaccaacaga

SEQ ID NO: 130527 - DNA, 15 bp, Homo sapiens
tttgttaaccaacag

SEQ ID NO: 130528 - DNA, 15 bp, Homo sapiens
ctttgttaaccaaca

SEQ ID NO: 130529 - DNA, 15 bp, Homo sapiens
cctttgttaaccaac

SEQ ID NO: 130530 - DNA, 15 bp, Homo sapiens
gcctttgttaaccaa

SEQ ID NO: 130531 - DNA, 15 bp, Homo sapiens
agcctttgttaacca

SEQ ID NO: 130532 - DNA, 15 bp, Homo sapiens
cagcctttgttaacc

SEQ ID NO: 130533 - DNA, 15 bp, Homo sapiens
tcagcctttgttaac

SEQ ID NO: 130534 - DNA, 15 bp, Homo sapiens
ctcagcctttgttaa

SEQ ID NO: 130535 - DNA, 15 bp, Homo sapiens
gctcagcctttgtta

SEQ ID NO: 130536 - DNA, 15 bp, Homo sapiens
tgctcagcctttgtt

SEQ ID NO: 130537 - DNA, 15 bp, Homo sapiens
atgctcagcctttgt

SEQ ID NO: 130538 - DNA, 15 bp, Homo sapiens
catgctcagcctttg

SEQ ID NO: 130539 - DNA, 15 bp, Homo sapiens
gcatgctcagccttt

SEQ ID NO: 130540 - DNA, 15 bp, Homo sapiens
agcatgctcagcctt

SEQ ID NO: 130541 - DNA, 15 bp, Homo sapiens
tagcatgctcagcct

SEQ ID NO: 130542 - DNA, 15 bp, Homo sapiens
atagcatgctcagcc

SEQ ID NO: 130543 - DNA, 15 bp, Homo sapiens
catagcatgctcagc

SEQ ID NO: 130544 - DNA, 15 bp, Homo sapiens
gcatagcatgctcag

SEQ ID NO: 130545 - DNA, 15 bp, Homo sapiens
tgcatagcatgctca

SEQ ID NO: 130546 - DNA, 15 bp, Homo sapiens
ttgcatagcatgctc

SEQ ID NO: 130547 - DNA, 15 bp, Homo sapiens
tttgcatagcatgct

SEQ ID NO: 130548 - DNA, 15 bp, Homo sapiens
ttttgcatagcatgc

SEQ ID NO: 130549 - DNA, 15 bp, Homo sapiens
cttttgcatagcatg

SEQ ID NO: 130550 - DNA, 15 bp, Homo sapiens
tcttttgcatagcat

SEQ ID NO: 130551 - DNA, 15 bp, Homo sapiens
ctcttttgcatagca

SEQ ID NO: 130552 - DNA, 15 bp, Homo sapiens
tctcttttgcatagc

SEQ ID NO: 130553 - DNA, 15 bp, Homo sapiens
atctcttttgcatag

SEQ ID NO: 130554 - DNA, 15 bp, Homo sapiens
gatctcttttgcata

SEQ ID NO: 130555 - DNA, 15 bp, Homo sapiens
tgatctcttttgcat

SEQ ID NO: 130556 - DNA, 15 bp, Homo sapiens
ttgatctcttttgca

SEQ ID NO: 130557 - DNA, 15 bp, Homo sapiens
gttgatctcttttgc

SEQ ID NO: 130558 - DNA, 15 bp, Homo sapiens
ggttgatctcttttg

SEQ ID NO: 130559 - DNA, 15 bp, Homo sapiens
tggttgatctctttt

SEQ ID NO: 130560 - DNA, 15 bp, Homo sapiens
gtggttgatctcttt

SEQ ID NO: 130561 - DNA, 15 bp, Homo sapiens
ggtggttgatctctt

SEQ ID NO: 130562 - DNA, 15 bp, Homo sapiens
cggtggttgatctct

SEQ ID NO: 130563 - DNA, 15 bp, Homo sapiens
tcggtggttgatctc

SEQ ID NO: 130564 - DNA, 15 bp, Homo sapiens
ttcggtggttgatct

SEQ ID NO: 130565 - DNA, 15 bp, Homo sapiens
attcggtggttgatc

SEQ ID NO: 130566 - DNA, 15 bp, Homo sapiens
aattcggtggttgat

SEQ ID NO: 130567 - DNA, 15 bp, Homo sapiens
caattcggtggttga

SEQ ID NO: 130568 - DNA, 15 bp, Homo sapiens
ccaattcggtggttg

SEQ ID NO: 130569 - DNA, 15 bp, Homo sapiens
cccaattcggtggtt

SEQ ID NO: 130570 - DNA, 15 bp, Homo sapiens
tcccaattcggtggt

SEQ ID NO: 130571 - DNA, 15 bp, Homo sapiens
ctcccaattcggtgg

SEQ ID NO: 130572 - DNA, 15 bp, Homo sapiens
tctcccaattcggtg

SEQ ID NO: 130573 - DNA, 15 bp, Homo sapiens
ttctcccaattcggt

SEQ ID NO: 130574 - DNA, 15 bp, Homo sapiens
tttctcccaattcgg

SEQ ID NO: 130575 - DNA, 15 bp, Homo sapiens
ttttctcccaattcg

SEQ ID NO: 130576 - DNA, 15 bp, Homo sapiens
gttttctcccaattc

SEQ ID NO: 130577 - DNA, 15 bp, Homo sapiens
ggttttctcccaatt

SEQ ID NO: 130578 - DNA, 15 bp, Homo sapiens
aggttttctcccaat

SEQ ID NO: 130579 - DNA, 15 bp, Homo sapiens
caggttttctcccaa

SEQ ID NO: 130580 - DNA, 15 bp, Homo sapiens
gcaggttttctccca

SEQ ID NO: 130581 - DNA, 15 bp, Homo sapiens
tgcaggttttctccc

SEQ ID NO: 130582 - DNA, 15 bp, Homo sapiens
ttgcaggttttctcc

SEQ ID NO: 130583 - DNA, 15 bp, Homo sapiens
cttgcaggttttctc

SEQ ID NO: 130584 - DNA, 15 bp, Homo sapiens
tcttgcaggttttct

SEQ ID NO: 130585 - DNA, 15 bp, Homo sapiens
ttcttgcaggttttc

SEQ ID NO: 130586 - DNA, 15 bp, Homo sapiens
attcttgcaggtttt

SEQ ID NO: 130587 - DNA, 15 bp, Homo sapiens
aattcttgcaggttt

SEQ ID NO: 130588 - DNA, 15 bp, Homo sapiens
taattcttgcaggtt

SEQ ID NO: 130589 - DNA, 15 bp, Homo sapiens
ttaattcttgcaggt

SEQ ID NO: 130590 - DNA, 15 bp, Homo sapiens
cttaattcttgcagg

SEQ ID NO: 130591 - DNA, 15 bp, Homo sapiens
tcttaattcttgcag

SEQ ID NO: 130592 - DNA, 15 bp, Homo sapiens
ctcttaattcttgca

SEQ ID NO: 130593 - DNA, 15 bp, Homo sapiens
actcttaattcttgc

SEQ ID NO: 130594 - DNA, 15 bp, Homo sapiens
tactcttaattcttg

SEQ ID NO: 130595 - DNA, 15 bp, Homo sapiens
ttactcttaattctt

SEQ ID NO: 130596 - DNA, 15 bp, Homo sapiens
cttactcttaattct

SEQ ID NO: 130597 - DNA, 15 bp, Homo sapiens
acttactcttaattc

SEQ ID NO: 130598 - DNA, 15 bp, Homo sapiens
aacttactcttaatt

SEQ ID NO: 130599 - DNA, 15 bp, Homo sapiens
caacttactcttaat

SEQ ID NO: 130600 - DNA, 15 bp, Homo sapiens
acaacttactcttaa

SEQ ID NO: 130601 - DNA, 15 bp, Homo sapiens
aacaacttactctta

SEQ ID NO: 130602 - DNA, 15 bp, Homo sapiens
aaacaacttactctt

SEQ ID NO: 130603 - DNA, 15 bp, Homo sapiens
taaacaacttactct

SEQ ID NO: 130604 - DNA, 15 bp, Homo sapiens
ataaacaacttactc

SEQ ID NO: 130605 - DNA, 15 bp, Homo sapiens
aataaacaacttact

SEQ ID NO: 130606 - DNA, 15 bp, Homo sapiens
aaataaacaacttac

SEQ ID NO: 130607 - DNA, 15 bp, Homo sapiens
gaaataaacaactta

SEQ ID NO: 130608 - DNA, 15 bp, Homo sapiens
agaaataaacaactt

SEQ ID NO: 130609 - DNA, 15 bp, Homo sapiens
cagaaataaacaact

SEQ ID NO: 130610 - DNA, 15 bp, Homo sapiens
acagaaataaacaac

SEQ ID NO: 130611 - DNA, 15 bp, Homo sapiens
gacagaaataaacaa

SEQ ID NO: 130612 - DNA, 15 bp, Homo sapiens
agacagaaataaaca

SEQ ID NO: 130613 - DNA, 15 bp, Homo sapiens
tagacagaaataaac

SEQ ID NO: 130614 - DNA, 15 bp, Homo sapiens
atagacagaaataaa

SEQ ID NO: 130615 - DNA, 15 bp, Homo sapiens
tatagacagaaataa

SEQ ID NO: 130616 - DNA, 15 bp, Homo sapiens
atatagacagaaata

SEQ ID NO: 130617 - DNA, 15 bp, Homo sapiens
catatagacagaaat

SEQ ID NO: 130618 - DNA, 15 bp, Homo sapiens
gcatatagacagaaa

SEQ ID NO: 130619 - DNA, 15 bp, Homo sapiens
ggcatatagacagaa

SEQ ID NO: 130620 - DNA, 15 bp, Homo sapiens
aggcatatagacaga

SEQ ID NO: 130621 - DNA, 15 bp, Homo sapiens
aaggcatatagacag

SEQ ID NO: 130622 - DNA, 15 bp, Homo sapiens
caaaaggcatataga

SEQ ID NO: 130623 - DNA, 15 bp, Homo sapiens
ccaaaaggcatatag

SEQ ID NO: 130624 - DNA, 15 bp, Homo sapiens
accaaaaggcatata

SEQ ID NO: 130625 - DNA, 15 bp, Homo sapiens
caccaaaaggcatat

SEQ ID NO: 130626 - DNA, 15 bp, Homo sapiens
gcaccaaaaggcata

SEQ ID NO: 130627 - DNA, 15 bp, Homo sapiens
ggcaccaaaaggcat

SEQ ID NO: 130628 - DNA, 15 bp, Homo sapiens
gggcaccaaaaggca

SEQ ID NO: 130629 - DNA, 15 bp, Homo sapiens
cgggcaccaaaaggc

SEQ ID NO: 130630 - DNA, 15 bp, Homo sapiens
tcgggcaccaaaagg

SEQ ID NO: 130631 - DNA, 15 bp, Homo sapiens
ttcgggcaccaaaag

SEQ ID NO: 130632 - DNA, 15 bp, Homo sapiens
gttcgggcaccaaaa

SEQ ID NO: 130633 - DNA, 15 bp, Homo sapiens
tgttcgggcaccaaa

SEQ ID NO: 130634 - DNA, 15 bp, Homo sapiens
atgttcgggcaccaa

SEQ ID NO: 130635 - DNA, 15 bp, Homo sapiens
aatgttcgggcacca

SEQ ID NO: 130636 - DNA, 15 bp, Homo sapiens
taatgttcgggcacc

SEQ ID NO: 130637 - DNA, 15 bp, Homo sapiens
ataatgttcgggcac

SEQ ID NO: 130638 - DNA, 15 bp, Homo sapiens
tataatgttcgggca

SEQ ID NO: 130639 - DNA, 15 bp, Homo sapiens
gtataatgttcgggc

SEQ ID NO: 130640 - DNA, 15 bp, Homo sapiens
agtataatgttcggg

SEQ ID NO: 130641 - DNA, 15 bp, Homo sapiens
aagtataatgttcgg

SEQ ID NO: 130642 - DNA, 15 bp, Homo sapiens
gaagtataatgttcg

SEQ ID NO: 130643 - DNA, 15 bp, Homo sapiens
tgaagtataatgttc

SEQ ID NO: 130644 - DNA, 15 bp, Homo sapiens
ctgaagtataatgtt

SEQ ID NO: 130645 - DNA, 15 bp, Homo sapiens
tctgaagtataatgt

SEQ ID NO: 130646 - DNA, 15 bp, Homo sapiens
ctctgaagtataatg

SEQ ID NO: 130647 - DNA, 15 bp, Homo sapiens
actctgaagtataat

SEQ ID NO: 130648 - DNA, 15 bp, Homo sapiens
gactctgaagtataa

SEQ ID NO: 130649 - DNA, 15 bp, Homo sapiens
tgactctgaagtata

SEQ ID NO: 130650 - DNA, 15 bp, Homo sapiens
gtgactctgaagtat

SEQ ID NO: 130651 - DNA, 15 bp, Homo sapiens
tgtgactctgaagta

SEQ ID NO: 130652 - DNA, 15 bp, Homo sapiens
atgtgactctgaagt

SEQ ID NO: 130653 - DNA, 15 bp, Homo sapiens
tatgtgactctgaag

SEQ ID NO: 130654 - DNA, 15 bp, Homo sapiens
gtatgtgactctgaa

SEQ ID NO: 130655 - DNA, 15 bp, Homo sapiens
agtatgtgactctga

SEQ ID NO: 130656 - DNA, 15 bp, Homo sapiens
cagtatgtgactctg

SEQ ID NO: 130657 - DNA, 15 bp, Homo sapiens
gcagtatgtgactct

SEQ ID NO: 130658 - DNA, 15 bp, Homo sapiens
cgcagtatgtgactc

SEQ ID NO: 130659 - DNA, 15 bp, Homo sapiens
acgcagtatgtgact

SEQ ID NO: 130660 - DNA, 15 bp, Homo sapiens
cacgcagtatgtgac

SEQ ID NO: 130661 - DNA, 15 bp, Homo sapiens
acacgcagtatgtga

SEQ ID NO: 130662 - DNA, 15 bp, Homo sapiens
gacacgcagtatgtg

SEQ ID NO: 130663 - DNA, 15 bp, Homo sapiens
agacacgcagtatgt

SEQ ID NO: 130664 - DNA, 15 bp, Homo sapiens
gagacacgcagtatg

SEQ ID NO: 130665 - DNA, 15 bp, Homo sapiens
tgagacacgcagtat

SEQ ID NO: 130666 - DNA, 15 bp, Homo sapiens
ttgagacacgcagta

SEQ ID NO: 130667 - DNA, 15 bp, Homo sapiens
cttgagacacgcagt

SEQ ID NO: 130668 - DNA, 15 bp, Homo sapiens
tcttgagacacgcag

SEQ ID NO: 130669 - DNA, 15 bp, Homo sapiens
ttcttgagacacgca

SEQ ID NO: 130670 - DNA, 15 bp, Homo sapiens
cttcttgagacacgc

SEQ ID NO: 130671 - DNA, 15 bp, Homo sapiens
tcttcttgagacacg

SEQ ID NO: 130672 - DNA, 15 bp, Homo sapiens
ttcttcttgagacac

SEQ ID NO: 130673 - DNA, 15 bp, Homo sapiens
tttcttcttgagaca

SEQ ID NO: 130674 - DNA, 15 bp, Homo sapiens
ttttcttcttgagac

SEQ ID NO: 130675 - DNA, 15 bp, Homo sapiens
cttttcttcttgaga

SEQ ID NO: 130676 - DNA, 15 bp, Homo sapiens
ccttttcttcttgag

SEQ ID NO: 130677 - DNA, 15 bp, Homo sapiens
cccttttcttcttga

SEQ ID NO: 130678 - DNA, 15 bp, Homo sapiens
tcccttttcttcttg

SEQ ID NO: 130679 - DNA, 15 bp, Homo sapiens
ttcccttttcttctt

SEQ ID NO: 130680 - DNA, 15 bp, Homo sapiens
tttcccttttcttct

SEQ ID NO: 130681 - DNA, 15 bp, Homo sapiens
ttttcccttttcttc

SEQ ID NO: 130682 - DNA, 15 bp, Homo sapiens
cttttcccttttctt

SEQ ID NO: 130683 - DNA, 15 bp, Homo sapiens
tcttttcccttttct

SEQ ID NO: 130684 - DNA, 15 bp, Homo sapiens
ttcttttcccttttc

SEQ ID NO: 130685 - DNA, 15 bp, Homo sapiens
tttcttttccctttt

SEQ ID NO: 130686 - DNA, 15 bp, Homo sapiens
gtttcttttcccttt

SEQ ID NO: 130687 - DNA, 15 bp, Homo sapiens
agtttcttttccctt

SEQ ID NO: 130688 - DNA, 15 bp, Homo sapiens
aagtttcttttccct

SEQ ID NO: 130689 - DNA, 15 bp, Homo sapiens
aaagtttcttttccc

SEQ ID NO: 130690 - DNA, 15 bp, Homo sapiens
caaagtttcttttcc

SEQ ID NO: 130691 - DNA, 15 bp, Homo sapiens
acaaagtttcttttc

SEQ ID NO: 130692 - DNA, 15 bp, Homo sapiens
tacaaagtttctttt

SEQ ID NO: 130693 - DNA, 15 bp, Homo sapiens
gtacaaagtttcttt

SEQ ID NO: 130694 - DNA, 15 bp, Homo sapiens
agtacaaagtttctt

SEQ ID NO: 130695 - DNA, 15 bp, Homo sapiens
aagtacaaagtttct

SEQ ID NO: 130696 - DNA, 15 bp, Homo sapiens
aaagtacaaagtttc

SEQ ID NO: 130697 - DNA, 15 bp, Homo sapiens
aaaagtacaaagttt

SEQ ID NO: 130698 - DNA, 15 bp, Homo sapiens
aaaaagtacaaagtt

SEQ ID NO: 130699 - DNA, 15 bp, Homo sapiens
caaaaagtacaaagt

SEQ ID NO: 130700 - DNA, 15 bp, Homo sapiens
ccaaaaagtacaaag

SEQ ID NO: 130701 - DNA, 15 bp, Homo sapiens
accaaaaagtacaaa

SEQ ID NO: 130702 - DNA, 15 bp, Homo sapiens
taccaaaaagtacaa

SEQ ID NO: 130703 - DNA, 15 bp, Homo sapiens
ttaccaaaaagtaca

SEQ ID NO: 130704 - DNA, 15 bp, Homo sapiens
tttaccaaaaagtac

SEQ ID NO: 130705 - DNA, 15 bp, Homo sapiens
atttaccaaaaagta

SEQ ID NO: 130706 - DNA, 15 bp, Homo sapiens
catttaccaaaaagt

SEQ ID NO: 130707 - DNA, 15 bp, Homo sapiens
acatttaccaaaaag

SEQ ID NO: 130708 - DNA, 15 bp, Homo sapiens
cacatttaccaaaaa

SEQ ID NO: 130709 - DNA, 15 bp, Homo sapiens
ccacatttaccaaaa

SEQ ID NO: 130710 - DNA, 15 bp, Homo sapiens
accacatttaccaaa

SEQ ID NO: 130711 - DNA, 15 bp, Homo sapiens
caccacatttaccaa

SEQ ID NO: 130712 - DNA, 15 bp, Homo sapiens
tcaccacatttacca

SEQ ID NO: 130713 - DNA, 15 bp, Homo sapiens
ttcaccacatttacc

SEQ ID NO: 130714 - DNA, 15 bp, Homo sapiens
gttcaccacatttac

SEQ ID NO: 130715 - DNA, 15 bp, Homo sapiens
ggttcaccacattta

SEQ ID NO: 130716 - DNA, 15 bp, Homo sapiens
aggttcaccacattt

SEQ ID NO: 130717 - DNA, 15 bp, Homo sapiens
caggttcaccacatt

SEQ ID NO: 130718 - DNA, 15 bp, Homo sapiens
tcaggttcaccacat

SEQ ID NO: 130719 - DNA, 15 bp, Homo sapiens
ttcaggttcaccaca

SEQ ID NO: 130720 - DNA, 15 bp, Homo sapiens
tttcaggttcaccac

SEQ ID NO: 130721 - DNA, 15 bp, Homo sapiens
ctttcaggttcacca

SEQ ID NO: 130722 - DNA, 15 bp, Homo sapiens
tctttcaggttcacc

SEQ ID NO: 130723 - DNA, 15 bp, Homo sapiens
ctctttcaggttcac

SEQ ID NO: 130724 - DNA, 15 bp, Homo sapiens
cctctttcaggttca

SEQ ID NO: 130725 - DNA, 15 bp, Homo sapiens
tcctctttcaggttc

SEQ ID NO: 130726 - DNA, 15 bp, Homo sapiens
ttcctctttcaggtt

SEQ ID NO: 130727 - DNA, 15 bp, Homo sapiens
attcctctttcaggt

SEQ ID NO: 130728 - DNA, 15 bp, Homo sapiens
tattcctctttcagg

SEQ ID NO: 130729 - DNA, 15 bp, Homo sapiens
atattcctctttcag

SEQ ID NO: 130730 - DNA, 15 bp, Homo sapiens
gatattcctctttca

SEQ ID NO: 130731 - DNA, 15 bp, Homo sapiens
agatattcctctttc

SEQ ID NO: 130732 - DNA, 15 bp, Homo sapiens
aagatattcctcttt

SEQ ID NO: 130733 - DNA, 15 bp, Homo sapiens
aaagatattcctctt

SEQ ID NO: 130734 - DNA, 15 bp, Homo sapiens
aaaagatattcctct

SEQ ID NO: 130735 - DNA, 15 bp, Homo sapiens
taaaagatattcctc

SEQ ID NO: 130736 - DNA, 15 bp, Homo sapiens
ataaaagatattcct

SEQ ID NO: 130737 - DNA, 15 bp, Homo sapiens
aataaaagatattcc

SEQ ID NO: 130738 - DNA, 15 bp, Homo sapiens
aaataaaagatattc

SEQ ID NO: 130739 - DNA, 15 bp, Homo sapiens
aaaataaaagatatt

SEQ ID NO: 130740 - DNA, 15 bp, Homo sapiens
aaaaataaaagatat

SEQ ID NO: 130741 - DNA, 15 bp, Homo sapiens
aaaaaataaaagata

SEQ ID NO: 130742 - DNA, 15 bp, Homo sapiens
taaaaaataaaagat

SEQ ID NO: 130743 - DNA, 15 bp, Homo sapiens
ttaaaaaataaaaga

SEQ ID NO: 130744 - DNA, 15 bp, Homo sapiens
tttaaaaaataaaag

SEQ ID NO: 130745 - DNA, 15 bp, Homo sapiens
tctttaaaaaataaa

SEQ ID NO: 130746 - DNA, 15 bp, Homo sapiens
ctctttaaaaaataa

SEQ ID NO: 130747 - DNA, 15 bp, Homo sapiens
gctctttaaaaaata

SEQ ID NO: 130748 - DNA, 15 bp, Homo sapiens
tgctctttaaaaaat

SEQ ID NO: 130749 - DNA, 15 bp, Homo sapiens
ctgctctttaaaaaa

SEQ ID NO: 130750 - DNA, 15 bp, Homo sapiens
actgctctttaaaaa

SEQ ID NO: 130751 - DNA, 15 bp, Homo sapiens
aactgctctttaaaa

SEQ ID NO: 130752 - DNA, 15 bp, Homo sapiens
taactgctctttaaa

SEQ ID NO: 130753 - DNA, 15 bp, Homo sapiens
ataactgctctttaa

SEQ ID NO: 130754 - DNA, 15 bp, Homo sapiens
tataactgctcttta

SEQ ID NO: 130755 - DNA, 15 bp, Homo sapiens
ttataactgctcttt

SEQ ID NO: 130756 - DNA, 15 bp, Homo sapiens
attataactgctctt

SEQ ID NO: 130757 - DNA, 15 bp, Homo sapiens
aattataactgctct

SEQ ID NO: 130758 - DNA, 15 bp, Homo sapiens
aaattataactgctc

SEQ ID NO: 130759 - DNA, 15 bp, Homo sapiens
aaaattataactgct

SEQ ID NO: 130760 - DNA, 15 bp, Homo sapiens
caaaattataactgc

SEQ ID NO: 130761 - DNA, 15 bp, Homo sapiens
ccaaaattataactg

SEQ ID NO: 130762 - DNA, 15 bp, Homo sapiens
accaaaattataact

SEQ ID NO: 130763 - DNA, 15 bp, Homo sapiens
gaccaaaattataac

SEQ ID NO: 130764 - DNA, 15 bp, Homo sapiens
agaccaaaattataa

SEQ ID NO: 130765 - DNA, 15 bp, Homo sapiens
aagaccaaaattata

SEQ ID NO: 130766 - DNA, 15 bp, Homo sapiens
caagaccaaaattat

SEQ ID NO: 130767 - DNA, 15 bp, Homo sapiens
gcaagaccaaaatta

SEQ ID NO: 130768 - DNA, 15 bp, Homo sapiens
tgcaagaccaaaatt

SEQ ID NO: 130769 - DNA, 15 bp, Homo sapiens
ctgcaagaccaaaat

SEQ ID NO: 130770 - DNA, 15 bp, Homo sapiens
tctgcaagaccaaaa

SEQ ID NO: 130771 - DNA, 15 bp, Homo sapiens
ctctgcaagaccaaa

SEQ ID NO: 130772 - DNA, 15 bp, Homo sapiens
gctctgcaagaccaa

SEQ ID NO: 130773 - DNA, 15 bp, Homo sapiens
agctctgcaagacca

SEQ ID NO: 130774 - DNA, 15 bp, Homo sapiens
aagctctgcaagacc

SEQ ID NO: 130775 - DNA, 15 bp, Homo sapiens
taagctctgcaagac

SEQ ID NO: 130776 - DNA, 15 bp, Homo sapiens
ttaagctctgcaaga

SEQ ID NO: 130777 - DNA, 15 bp, Homo sapiens
tttaagctctgcaag

SEQ ID NO: 130778 - DNA, 15 bp, Homo sapiens
gtttaagctctgcaa

SEQ ID NO: 130779 - DNA, 15 bp, Homo sapiens
agtttaagctctgca

SEQ ID NO: 130780 - DNA, 15 bp, Homo sapiens
aagtttaagctctgc

SEQ ID NO: 130781 - DNA, 15 bp, Homo sapiens
gaagtttaagctctg

SEQ ID NO: 130782 - DNA, 15 bp, Homo sapiens
tgaagtttaagctct

SEQ ID NO: 130783 - DNA, 15 bp, Homo sapiens
gtgaagtttaagctc

SEQ ID NO: 130784 - DNA, 15 bp, Homo sapiens
agtgaagtttaagct

SEQ ID NO: 130785 - DNA, 15 bp, Homo sapiens
aagtgaagtttaagc

SEQ ID NO: 130786 - DNA, 15 bp, Homo sapiens
taagtgaagtttaag

SEQ ID NO: 130787 - DNA, 15 bp, Homo sapiens
ataagtgaagtttaa

SEQ ID NO: 130788 - DNA, 15 bp, Homo sapiens
cataagtgaagttta

SEQ ID NO: 130789 - DNA, 15 bp, Homo sapiens
acataagtgaagttt

SEQ ID NO: 130790 - DNA, 15 bp, Homo sapiens
tacataagtgaagtt

SEQ ID NO: 130791 - DNA, 15 bp, Homo sapiens
ttacataagtgaagt

SEQ ID NO: 130792 - DNA, 15 bp, Homo sapiens
tttacataagtgaag

SEQ ID NO: 130793 - DNA, 15 bp, Homo sapiens
ttttacataagtgaa

SEQ ID NO: 130794 - DNA, 15 bp, Homo sapiens
tttttacataagtga

SEQ ID NO: 130795 - DNA, 15 bp, Homo sapiens
ctttttacataagtg

SEQ ID NO: 130796 - DNA, 15 bp, Homo sapiens
tctttttacataagt

SEQ ID NO: 130797 - DNA, 15 bp, Homo sapiens
ttctttttacataag

SEQ ID NO: 130798 - DNA, 15 bp, Homo sapiens
gttctttttacataa

SEQ ID NO: 130799 - DNA, 15 bp, Homo sapiens
tgttctttttacata

SEQ ID NO: 130800 - DNA, 15 bp, Homo sapiens
ttgttctttttacat

SEQ ID NO: 130801 - DNA, 15 bp, Homo sapiens
tttgttctttttaca

SEQ ID NO: 130802 - DNA, 15 bp, Homo sapiens
gtttgttctttttac

SEQ ID NO: 130803 - DNA, 15 bp, Homo sapiens
agtttgttcttttta

SEQ ID NO: 130804 - DNA, 15 bp, Homo sapiens
tagtttgttcttttt

SEQ ID NO: 130805 - DNA, 15 bp, Homo sapiens
atagtttgttctttt

SEQ ID NO: 130806 - DNA, 15 bp, Homo sapiens
aatagtttgttcttt

SEQ ID NO: 130807 - DNA, 15 bp, Homo sapiens
taatagtttgttctt

SEQ ID NO: 130808 - DNA, 15 bp, Homo sapiens
ataatagtttgttct

SEQ ID NO: 130809 - DNA, 15 bp, Homo sapiens
cataatagtttgttc

SEQ ID NO: 130810 - DNA, 15 bp, Homo sapiens
ccataatagtttgtt

SEQ ID NO: 130811 - DNA, 15 bp, Homo sapiens
accataatagtttgt

SEQ ID NO: 130812 - DNA, 15 bp, Homo sapiens
caccataatagtttg

SEQ ID NO: 130813 - DNA, 15 bp, Homo sapiens
acaccataatagttt

SEQ ID NO: 130814 - DNA, 15 bp, Homo sapiens
gacaccataatagtt

SEQ ID NO: 130815 - DNA, 15 bp, Homo sapiens
tgacaccataatagt

SEQ ID NO: 130816 - DNA, 15 bp, Homo sapiens
ctgacaccataatag

SEQ ID NO: 130817 - DNA, 15 bp, Homo sapiens
actgacaccataata

SEQ ID NO: 130818 - DNA, 15 bp, Homo sapiens
tactgacaccataat

SEQ ID NO: 130819 - DNA, 15 bp, Homo sapiens
atactgacaccataa

SEQ ID NO: 130820 - DNA, 15 bp, Homo sapiens
aatactgacaccata

SEQ ID NO: 130821 - DNA, 15 bp, Homo sapiens
taatactgacaccat

SEQ ID NO: 130822 - DNA, 15 bp, Homo sapiens
ctaatactgacacca

SEQ ID NO: 130823 - DNA, 15 bp, Homo sapiens
tctaatactgacacc

SEQ ID NO: 130824 - DNA, 15 bp, Homo sapiens
gtctaatactgacac

SEQ ID NO: 130825 - DNA, 15 bp, Homo sapiens
ggtctaatactgaca

SEQ ID NO: 130826 - DNA, 15 bp, Homo sapiens
tggtctaatactgac

SEQ ID NO: 130827 - DNA, 15 bp, Homo sapiens
ttggtctaatactga

SEQ ID NO: 130828 - DNA, 15 bp, Homo sapiens
tttggtctaatactg

SEQ ID NO: 130829 - DNA, 15 bp, Homo sapiens
ctttggtctaatact

SEQ ID NO: 130830 - DNA, 15 bp, Homo sapiens
cctttggtctaatac

SEQ ID NO: 130831 - DNA, 15 bp, Homo sapiens
acctttggtctaata

SEQ ID NO: 130832 - DNA, 15 bp, Homo sapiens
aacctttggtctaat

SEQ ID NO: 130833 - DNA, 15 bp, Homo sapiens
aaacctttggtctaa

SEQ ID NO: 130834 - DNA, 15 bp, Homo sapiens
aaaacctttggtcta

SEQ ID NO: 130835 - DNA, 15 bp, Homo sapiens
aaaaacctttggtct

SEQ ID NO: 130836 - DNA, 15 bp, Homo sapiens
taaaaacctttggtc

SEQ ID NO: 130837 - DNA, 15 bp, Homo sapiens
ctaaaaacctttggt

SEQ ID NO: 130838 - DNA, 15 bp, Homo sapiens
cctaaaaacctttgg

SEQ ID NO: 130839 - DNA, 15 bp, Homo sapiens
tcctaaaaacctttg

SEQ ID NO: 130840 - DNA, 15 bp, Homo sapiens
atcctaaaaaccttt

SEQ ID NO: 130841 - DNA, 15 bp, Homo sapiens
tatcctaaaaacctt

SEQ ID NO: 130842 - DNA, 15 bp, Homo sapiens
atatcctaaaaacct

SEQ ID NO: 130843 - DNA, 15 bp, Homo sapiens
aatatcctaaaaacc

SEQ ID NO: 130844 - DNA, 15 bp, Homo sapiens
caatatcctaaaaac

SEQ ID NO: 130845 - DNA, 15 bp, Homo sapiens
acaatatcctaaaaa

SEQ ID NO: 130846 - DNA, 15 bp, Homo sapiens
tacaatatcctaaaa

SEQ ID NO: 130847 - DNA, 15 bp, Homo sapiens
ttacaatatcctaaa

SEQ ID NO: 130848 - DNA, 15 bp, Homo sapiens
tttacaatatcctaa

SEQ ID NO: 130849 - DNA, 15 bp, Homo sapiens
gtttacaatatccta

SEQ ID NO: 130850 - DNA, 15 bp, Homo sapiens
agtttacaatatcct

SEQ ID NO: 130851 - DNA, 15 bp, Homo sapiens
cagtttacaatatcc

SEQ ID NO: 130852 - DNA, 15 bp, Homo sapiens
tcagtttacaatatc

SEQ ID NO: 130853 - DNA, 15 bp, Homo sapiens
gtcagtttacaatat

SEQ ID NO: 130854 - DNA, 15 bp, Homo sapiens
ggtcagtttacaata

SEQ ID NO: 130855 - DNA, 15 bp, Homo sapiens
aggtcagtttacaat

SEQ ID NO: 130856 - DNA, 15 bp, Homo sapiens
aaggtcagtttacaa

SEQ ID NO: 130857 - DNA, 15 bp, Homo sapiens
taaggtcagtttaca

SEQ ID NO: 130858 - DNA, 15 bp, Homo sapiens
ataaggtcagtttac

SEQ ID NO: 130859 - DNA, 15 bp, Homo sapiens
gataaggtcagttta

SEQ ID NO: 130860 - DNA, 15 bp, Homo sapiens
tgataaggtcagttt

SEQ ID NO: 130861 - DNA, 15 bp, Homo sapiens
atgataaggtcagtt

SEQ ID NO: 130862 - DNA, 15 bp, Homo sapiens
aatgataaggtcagt

SEQ ID NO: 130863 - DNA, 15 bp, Homo sapiens
aaatgataaggtcag

SEQ ID NO: 130864 - DNA, 15 bp, Homo sapiens
aaaatgataaggtca

SEQ ID NO: 130865 - DNA, 15 bp, Homo sapiens
taaaatgataaggtc

SEQ ID NO: 130866 - DNA, 15 bp, Homo sapiens
ttaaaatgataaggt

SEQ ID NO: 130867 - DNA, 15 bp, Homo sapiens
tttaaaatgataagg

SEQ ID NO: 130868 - DNA, 15 bp, Homo sapiens
ttttaaaatgataag

SEQ ID NO: 130869 - DNA, 15 bp, Homo sapiens
attttaaaatgataa

SEQ ID NO: 130870 - DNA, 15 bp, Homo sapiens
tattttaaaatgata

SEQ ID NO: 130871 - DNA, 15 bp, Homo sapiens
gtattttaaaatgat

SEQ ID NO: 130872 - DNA, 15 bp, Homo sapiens
tgtattttaaaatga

SEQ ID NO: 130873 - DNA, 15 bp, Homo sapiens
ttgtattttaaaatg

SEQ ID NO: 130874 - DNA, 15 bp, Homo sapiens
attgtattttaaaat

SEQ ID NO: 130875 - DNA, 15 bp, Homo sapiens
tattgtattttaaaa

SEQ ID NO: 130876 - DNA, 15 bp, Homo sapiens
ctattgtattttaaa

SEQ ID NO: 130877 - DNA, 15 bp, Homo sapiens
cctattgtattttaa

SEQ ID NO: 130878 - DNA, 15 bp, Homo sapiens
ccctattgtatttta

SEQ ID NO: 130879 - DNA, 15 bp, Homo sapiens
gccctattgtatttt

SEQ ID NO: 130880 - DNA, 15 bp, Homo sapiens
agccctattgtattt

SEQ ID NO: 130881 - DNA, 15 bp, Homo sapiens
tagccctattgtatt

SEQ ID NO: 130882 - DNA, 15 bp, Homo sapiens
atagccctattgtat

SEQ ID NO: 130883 - DNA, 15 bp, Homo sapiens
catagccctattgta

SEQ ID NO: 130884 - DNA, 15 bp, Homo sapiens
tcatagccctattgt

SEQ ID NO: 130885 - DNA, 15 bp, Homo sapiens
ttcatagccctattg

SEQ ID NO: 130886 - DNA, 15 bp, Homo sapiens
tttcatagccctatt

SEQ ID NO: 130887 - DNA, 15 bp, Homo sapiens
atttcatagccctat

SEQ ID NO: 130888 - DNA, 15 bp, Homo sapiens
tatttcatagcccta

SEQ ID NO: 130889 - DNA, 15 bp, Homo sapiens
atatttcatagccct

SEQ ID NO: 130890 - DNA, 15 bp, Homo sapiens
gatatttcatagccc

SEQ ID NO: 130891 - DNA, 15 bp, Homo sapiens
cgatatttcatagcc

SEQ ID NO: 130892 - DNA, 15 bp, Homo sapiens
acgatatttcatagc

SEQ ID NO: 130893 - DNA, 15 bp, Homo sapiens
aacgatatttcatag

SEQ ID NO: 130894 - DNA, 15 bp, Homo sapiens
aaacgatatttcata

SEQ ID NO: 130895 - DNA, 15 bp, Homo sapiens
aaaacgatatttcat

SEQ ID NO: 130896 - DNA, 15 bp, Homo sapiens
aaaaacgatatttca

SEQ ID NO: 130897 - DNA, 15 bp, Homo sapiens
aaaaaacgatatttc

SEQ ID NO: 130898 - DNA, 15 bp, Homo sapiens
caaaaaacgatattt

SEQ ID NO: 130899 - DNA, 15 bp, Homo sapiens
acaaaaaacgatatt

SEQ ID NO: 130900 - DNA, 15 bp, Homo sapiens
aacaaaaaacgatat

SEQ ID NO: 130901 - DNA, 15 bp, Homo sapiens
aaacaaaaaacgata

SEQ ID NO: 130902 - DNA, 15 bp, Homo sapiens
aaaacaaaaaacgat

SEQ ID NO: 130903 - DNA, 15 bp, Homo sapiens
aaaaacaaaaaacga

SEQ ID NO: 130904 - DNA, 15 bp, Homo sapiens
taaaaacaaaaaacg

SEQ ID NO: 130905 - DNA, 15 bp, Homo sapiens
ctaaaaacaaaaaac

SEQ ID NO: 130906 - DNA, 15 bp, Homo sapiens
tctaaaaacaaaaaa

SEQ ID NO: 130907 - DNA, 15 bp, Homo sapiens
atctaaaaacaaaaa

SEQ ID NO: 130908 - DNA, 15 bp, Homo sapiens
aatctaaaaacaaaa

SEQ ID NO: 130909 - DNA, 15 bp, Homo sapiens
aaatctaaaaacaaa

SEQ ID NO: 130910 - DNA, 15 bp, Homo sapiens
caaatctaaaaacaa

SEQ ID NO: 130911 - DNA, 15 bp, Homo sapiens
ccaaatctaaaaaca

SEQ ID NO: 130912 - DNA, 15 bp, Homo sapiens
tccaaatctaaaaac

SEQ ID NO: 130913 - DNA, 15 bp, Homo sapiens
ttccaaatctaaaaa

SEQ ID NO: 130914 - DNA, 15 bp, Homo sapiens
cttccaaatctaaaa

SEQ ID NO: 130915 - DNA, 15 bp, Homo sapiens
tcttccaaatctaaa

SEQ ID NO: 130916 - DNA, 15 bp, Homo sapiens
ttcttccaaatctaa

SEQ ID NO: 130917 - DNA, 15 bp, Homo sapiens
tttcttccaaatcta

SEQ ID NO: 130918 - DNA, 15 bp, Homo sapiens
ttttcttccaaatct

SEQ ID NO: 130919 - DNA, 15 bp, Homo sapiens
attttcttccaaatc

SEQ ID NO: 130920 - DNA, 15 bp, Homo sapiens
aattttcttccaaat

SEQ ID NO: 130921 - DNA, 15 bp, Homo sapiens
taattttcttccaaa

SEQ ID NO: 130922 - DNA, 15 bp, Homo sapiens
gtaattttcttccaa

SEQ ID NO: 130923 - DNA, 15 bp, Homo sapiens
agtaattttcttcca

SEQ ID NO: 130924 - DNA, 15 bp, Homo sapiens
cagtaattttcttcc

SEQ ID NO: 130925 - DNA, 15 bp, Homo sapiens
tcagtaattttcttc

SEQ ID NO: 130926 - DNA, 15 bp, Homo sapiens
atcagtaattttctt

SEQ ID NO: 130927 - DNA, 15 bp, Homo sapiens
aatcagtaattttct

SEQ ID NO: 130928 - DNA, 15 bp, Homo sapiens
taatcagtaattttc

SEQ ID NO: 130929 - DNA, 15 bp, Homo sapiens
ataatcagtaatttt

SEQ ID NO: 130930 - DNA, 15 bp, Homo sapiens
aataatcagtaattt

SEQ ID NO: 130931 - DNA, 15 bp, Homo sapiens
caataatcagtaatt

SEQ ID NO: 130932 - DNA, 15 bp, Homo sapiens
acaataatcagtaat

SEQ ID NO: 130933 - DNA, 15 bp, Homo sapiens
gacaataatcagtaa

SEQ ID NO: 130934 - DNA, 15 bp, Homo sapiens
agacaataatcagta

SEQ ID NO: 130935 - DNA, 15 bp, Homo sapiens
tagacaataatcagt

SEQ ID NO: 130936 - DNA, 15 bp, Homo sapiens
atagacaataatcag

SEQ ID NO: 130937 - DNA, 15 bp, Homo sapiens
tatagacaataatca

SEQ ID NO: 130938 - DNA, 15 bp, Homo sapiens
ttatagacaataatc

SEQ ID NO: 130939 - DNA, 15 bp, Homo sapiens
tttatagacaataat

SEQ ID NO: 130940 - DNA, 15 bp, Homo sapiens
ctttatagacaataa

SEQ ID NO: 130941 - DNA, 15 bp, Homo sapiens
gctttatagacaata

SEQ ID NO: 130942 - DNA, 15 bp, Homo sapiens
agctttatagacaat

SEQ ID NO: 130943 - DNA, 15 bp, Homo sapiens
cagctttatagacaa

SEQ ID NO: 130944 - DNA, 15 bp, Homo sapiens
gcagctttatagaca

SEQ ID NO: 130945 - DNA, 15 bp, Homo sapiens
tgcagctttatagac

SEQ ID NO: 130946 - DNA, 15 bp, Homo sapiens
ttgcagctttataga

SEQ ID NO: 130947 - DNA, 15 bp, Homo sapiens
tttgcagctttatag

SEQ ID NO: 130948 - DNA, 15 bp, Homo sapiens
ttttgcagctttata

SEQ ID NO: 130949 - DNA, 15 bp, Homo sapiens
gttttgcagctttat

SEQ ID NO: 130950 - DNA, 15 bp, Homo sapiens
agttttgcagcttta

SEQ ID NO: 130951 - DNA, 15 bp, Homo sapiens
gagttttgcagcttt

SEQ ID NO: 130952 - DNA, 15 bp, Homo sapiens
tgagttttgcagctt

SEQ ID NO: 130953 - DNA, 15 bp, Homo sapiens
ttgagttttgcagct

SEQ ID NO: 130954 - DNA, 15 bp, Homo sapiens
gttgagttttgcagc

SEQ ID NO: 130955 - DNA, 15 bp, Homo sapiens
agttgagttttgcag

SEQ ID NO: 130956 - DNA, 15 bp, Homo sapiens
aagttgagttttgca

SEQ ID NO: 130957 - DNA, 15 bp, Homo sapiens
aaagttgagttttgc

SEQ ID NO: 130958 - DNA, 15 bp, Homo sapiens
taaagttgagttttg

SEQ ID NO: 130959 - DNA, 15 bp, Homo sapiens
ataaagttgagtttt

SEQ ID NO: 130960 - DNA, 15 bp, Homo sapiens
tataaagttgagttt

SEQ ID NO: 130961 - DNA, 15 bp, Homo sapiens
ctataaagttgagtt

SEQ ID NO: 130962 - DNA, 15 bp, Homo sapiens
tctataaagttgagt

SEQ ID NO: 130963 - DNA, 15 bp, Homo sapiens
atctataaagttgag

SEQ ID NO: 130964 - DNA, 15 bp, Homo sapiens
tatctataaagttga

SEQ ID NO: 130965 - DNA, 15 bp, Homo sapiens
ttatctataaagttg

SEQ ID NO: 130966 - DNA, 15 bp, Homo sapiens
attatctataaagtt

SEQ ID NO: 130967 - DNA, 15 bp, Homo sapiens
gattatctataaagt

SEQ ID NO: 130968 - DNA, 15 bp, Homo sapiens
tgattatctataaag

SEQ ID NO: 130969 - DNA, 15 bp, Homo sapiens
ctgattatctataaa

SEQ ID NO: 130970 - DNA, 15 bp, Homo sapiens
actgattatctataa

SEQ ID NO: 130971 - DNA, 15 bp, Homo sapiens
tactgattatctata

SEQ ID NO: 130972 - DNA, 15 bp, Homo sapiens
ttactgattatctat

SEQ ID NO: 130973 - DNA, 15 bp, Homo sapiens
attactgattatcta

SEQ ID NO: 130974 - DNA, 15 bp, Homo sapiens
aattactgattatct

SEQ ID NO: 130975 - DNA, 15 bp, Homo sapiens
taattactgattatc

SEQ ID NO: 130976 - DNA, 15 bp, Homo sapiens
ataattactgattat

SEQ ID NO: 130977 - DNA, 15 bp, Homo sapiens
gataattactgatta

SEQ ID NO: 130978 - DNA, 15 bp, Homo sapiens
tgataattactgatt

SEQ ID NO: 130979 - DNA, 15 bp, Homo sapiens
ctgataattactgat

SEQ ID NO: 130980 - DNA, 15 bp, Homo sapiens
tctgataattactga

SEQ ID NO: 130981 - DNA, 15 bp, Homo sapiens
ctctgataattactg

SEQ ID NO: 130982 - DNA, 15 bp, Homo sapiens
actctgataattact

SEQ ID NO: 130983 - DNA, 15 bp, Homo sapiens
cactctgataattac

SEQ ID NO: 130984 - DNA, 15 bp, Homo sapiens
tcactctgataatta

SEQ ID NO: 130985 - DNA, 15 bp, Homo sapiens
gtcactctgataatt

SEQ ID NO: 130986 - DNA, 15 bp, Homo sapiens
agtcactctgataat

SEQ ID NO: 130987 - DNA, 15 bp, Homo sapiens
aagtcactctgataa

SEQ ID NO: 130988 - DNA, 15 bp, Homo sapiens
caagtcactctgata

SEQ ID NO: 130989 - DNA, 15 bp, Homo sapiens
gcaagtcactctgat

SEQ ID NO: 130990 - DNA, 15 bp, Homo sapiens
agcaagtcactctga

SEQ ID NO: 130991 - DNA, 15 bp, Homo sapiens
cagcaagtcactctg

SEQ ID NO: 130992 - DNA, 15 bp, Homo sapiens
tcagcaagtcactct

SEQ ID NO: 130993 - DNA, 15 bp, Homo sapiens
ctcagcaagtcactc

SEQ ID NO: 130994 - DNA, 15 bp, Homo sapiens
cctcagcaagtcact

SEQ ID NO: 130995 - DNA, 15 bp, Homo sapiens
tcctcagcaagtcac

SEQ ID NO: 130996 - DNA, 15 bp, Homo sapiens
ttcctcagcaagtca

SEQ ID NO: 130997 - DNA, 15 bp, Homo sapiens
gttcctcagcaagtc

SEQ ID NO: 130998 - DNA, 15 bp, Homo sapiens
tgttcctcagcaagt

SEQ ID NO: 130999 - DNA, 15 bp, Homo sapiens
ttgttcctcagcaag

SEQ ID NO: 131000 - DNA, 15 bp, Homo sapiens
tttgttcctcagcaa

SEQ ID NO: 131001 - DNA, 15 bp, Homo sapiens
ttttgttcctcagca

SEQ ID NO: 131002 - DNA, 15 bp, Homo sapiens
attttgttcctcagc

SEQ ID NO: 131003 - DNA, 15 bp, Homo sapiens
cattttgttcctcag

SEQ ID NO: 131004 - DNA, 15 bp, Homo sapiens
gcattttgttcctca

SEQ ID NO: 131005 - DNA, 15 bp, Homo sapiens
tgcattttgttcctc

SEQ ID NO: 131006 - DNA, 15 bp, Homo sapiens
ctgcattttgttcct

SEQ ID NO: 131007 - DNA, 15 bp, Homo sapiens
gctgcattttgttcc

SEQ ID NO: 131008 - DNA, 15 bp, Homo sapiens
agctgcattttgttc

SEQ ID NO: 131009 - DNA, 15 bp, Homo sapiens
aagctgcattttgtt

SEQ ID NO: 131010 - DNA, 15 bp, Homo sapiens
caagctgcattttgt

SEQ ID NO: 131011 - DNA, 15 bp, Homo sapiens
gcaagctgcattttg

SEQ ID NO: 131012 - DNA, 15 bp, Homo sapiens
tgcaagctgcatttt

SEQ ID NO: 131013 - DNA, 15 bp, Homo sapiens
ttgcaagctgcattt

SEQ ID NO: 131014 - DNA, 15 bp, Homo sapiens
attgcaagctgcatt

SEQ ID NO: 131015 - DNA, 15 bp, Homo sapiens
tattgcaagctgcat

SEQ ID NO: 131016 - DNA, 15 bp, Homo sapiens
ctattgcaagctgca

SEQ ID NO: 131017 - DNA, 15 bp, Homo sapiens
cctattgcaagctgc

SEQ ID NO: 131018 - DNA, 15 bp, Homo sapiens
acctattgcaagctg

SEQ ID NO: 131019 - DNA, 15 bp, Homo sapiens
aacctattgcaagct

SEQ ID NO: 131020 - DNA, 15 bp, Homo sapiens
aaacctattgcaagc

SEQ ID NO: 131021 - DNA, 15 bp, Homo sapiens
taaacctattgcaag

SEQ ID NO: 131022 - DNA, 15 bp, Homo sapiens
ctaaacctattgcaa

SEQ ID NO: 131023 - DNA, 15 bp, Homo sapiens
actaaacctattgca

SEQ ID NO: 131024 - DNA, 15 bp, Homo sapiens
cactaaacctattgc

SEQ ID NO: 131025 - DNA, 15 bp, Homo sapiens
acactaaacctattg

SEQ ID NO: 131026 - DNA, 15 bp, Homo sapiens
gacactaaacctatt

SEQ ID NO: 131027 - DNA, 15 bp, Homo sapiens
tgacactaaacctat

SEQ ID NO: 131028 - DNA, 15 bp, Homo sapiens
atgacactaaaccta

SEQ ID NO: 131029 - DNA, 15 bp, Homo sapiens
catgacactaaacct

SEQ ID NO: 131030 - DNA, 15 bp, Homo sapiens
ccatgacactaaacc

SEQ ID NO: 131031 - DNA, 15 bp, Homo sapiens
accatgacactaaac

SEQ ID NO: 131032 - DNA, 15 bp, Homo sapiens
aaccatgacactaaa

SEQ ID NO: 131033 - DNA, 15 bp, Homo sapiens
caaccatgacactaa

SEQ ID NO: 131034 - DNA, 15 bp, Homo sapiens
acaaccatgacacta

SEQ ID NO: 131035 - DNA, 15 bp, Homo sapiens
tacaaccatgacact

SEQ ID NO: 131036 - DNA, 15 bp, Homo sapiens
atacaaccatgacac

SEQ ID NO: 131037 - DNA, 15 bp, Homo sapiens
aatacaaccatgaca

SEQ ID NO: 131038 - DNA, 15 bp, Homo sapiens
taatacaaccatgac

SEQ ID NO: 131039 - DNA, 15 bp, Homo sapiens
attaatacaaccatg

SEQ ID NO: 131040 - DNA, 15 bp, Homo sapiens
gattaatacaaccat

SEQ ID NO: 131041 - DNA, 15 bp, Homo sapiens
tgattaatacaacca

SEQ ID NO: 131042 - DNA, 15 bp, Homo sapiens
ctgattaatacaacc

SEQ ID NO: 131043 - DNA, 15 bp, Homo sapiens
tctgattaatacaac

SEQ ID NO: 131044 - DNA, 15 bp, Homo sapiens
atctgattaatacaa

SEQ ID NO: 131045 - DNA, 15 bp, Homo sapiens
aatctgattaataca

SEQ ID NO: 131046 - DNA, 15 bp, Homo sapiens
aaatctgattaatac

SEQ ID NO: 131047 - DNA, 15 bp, Homo sapiens
aaaatctgattaata

SEQ ID NO: 131048 - DNA, 15 bp, Homo sapiens
gaaaatctgattaat

SEQ ID NO: 131049 - DNA, 15 bp, Homo sapiens
agaaaatctgattaa

SEQ ID NO: 131050 - DNA, 15 bp, Homo sapiens
aagaaaatctgatta

SEQ ID NO: 131051 - DNA, 15 bp, Homo sapiens
aaagaaaatctgatt

SEQ ID NO: 131052 - DNA, 15 bp, Homo sapiens
caaagaaaatctgat

SEQ ID NO: 131053 - DNA, 15 bp, Homo sapiens
acaaagaaaatctga

SEQ ID NO: 131054 - DNA, 15 bp, Homo sapiens
aacaaagaaaatctg

SEQ ID NO: 131055 - DNA, 15 bp, Homo sapiens
caacaaagaaaatct

SEQ ID NO: 131056 - DNA, 15 bp, Homo sapiens
ccaacaaagaaaatc

SEQ ID NO: 131057 - DNA, 15 bp, Homo sapiens
accaacaaagaaaat

SEQ ID NO: 131058 - DNA, 15 bp, Homo sapiens
aaccaacaaagaaaa

SEQ ID NO: 131059 - DNA, 15 bp, Homo sapiens
aaaccaacaaagaaa

SEQ ID NO: 131060 - DNA, 15 bp, Homo sapiens
caaaccaacaaagaa

SEQ ID NO: 131061 - DNA, 15 bp, Homo sapiens
gcaaaccaacaaaga

SEQ ID NO: 131062 - DNA, 15 bp, Homo sapiens
tgcaaaccaacaaag

SEQ ID NO: 131063 - DNA, 15 bp, Homo sapiens
ttgcaaaccaacaaa

SEQ ID NO: 131064 - DNA, 15 bp, Homo sapiens
gttgcaaaccaacaa

SEQ ID NO: 131065 - DNA, 15 bp, Homo sapiens
agttgcaaaccaaca

SEQ ID NO: 131066 - DNA, 15 bp, Homo sapiens
tagttgcaaaccaac

SEQ ID NO: 131067 - DNA, 15 bp, Homo sapiens
ttagttgcaaaccaa

SEQ ID NO: 131068 - DNA, 15 bp, Homo sapiens
gttagttgcaaacca

SEQ ID NO: 131069 - DNA, 15 bp, Homo sapiens
tgttagttgcaaacc

SEQ ID NO: 131070 - DNA, 15 bp, Homo sapiens
ttgttagttgcaaac

SEQ ID NO: 131071 - DNA, 15 bp, Homo sapiens
cttgttagttgcaaa

SEQ ID NO: 131072 - DNA, 15 bp, Homo sapiens
acttgttagttgcaa

SEQ ID NO: 131073 - DNA, 15 bp, Homo sapiens
tacttgttagttgca

SEQ ID NO: 131074 - DNA, 15 bp, Homo sapiens
atacttgttagttgc

SEQ ID NO: 131075 - DNA, 15 bp, Homo sapiens
aatacttgttagttg

SEQ ID NO: 131076 - DNA, 15 bp, Homo sapiens
caatacttgttagtt

SEQ ID NO: 131077 - DNA, 15 bp, Homo sapiens
acaatacttgttagt

SEQ ID NO: 131078 - DNA, 15 bp, Homo sapiens
aacaatacttgttag

SEQ ID NO: 131079 - DNA, 15 bp, Homo sapiens
aaacaatacttgtta

SEQ ID NO: 131080 - DNA, 15 bp, Homo sapiens
taaacaatacttgtt

SEQ ID NO: 131081 - DNA, 15 bp, Homo sapiens
ataaacaatacttgt

SEQ ID NO: 131082 - DNA, 15 bp, Homo sapiens
tataaacaatacttg

SEQ ID NO: 131083 - DNA, 15 bp, Homo sapiens
ctataaacaatactt

SEQ ID NO: 131084 - DNA, 15 bp, Homo sapiens
actataaacaatact

SEQ ID NO: 131085 - DNA, 15 bp, Homo sapiens
aactataaacaatac

SEQ ID NO: 131086 - DNA, 15 bp, Homo sapiens
caactataaacaata

SEQ ID NO: 131087 - DNA, 15 bp, Homo sapiens
acaactataaacaat

SEQ ID NO: 131088 - DNA, 15 bp, Homo sapiens
tacaactataaacaa

SEQ ID NO: 131089 - DNA, 15 bp, Homo sapiens
atacaactataaaca

SEQ ID NO: 131090 - DNA, 15 bp, Homo sapiens
tatacaactataaac

SEQ ID NO: 131091 - DNA, 15 bp, Homo sapiens
atatacaactataaa

SEQ ID NO: 131092 - DNA, 15 bp, Homo sapiens
catatacaactataa

SEQ ID NO: 131093 - DNA, 15 bp, Homo sapiens
acatatacaactata

SEQ ID NO: 131094 - DNA, 15 bp, Homo sapiens
tacatatacaactat

SEQ ID NO: 131095 - DNA, 15 bp, Homo sapiens
atacatatacaacta

SEQ ID NO: 131096 - DNA, 15 bp, Homo sapiens
tatacatatacaact

SEQ ID NO: 131097 - DNA, 15 bp, Homo sapiens
atatacatatacaac

SEQ ID NO: 131098 - DNA, 15 bp, Homo sapiens
tatatacatatacaa

SEQ ID NO: 131099 - DNA, 15 bp, Homo sapiens
ttatatacatataca

SEQ ID NO: 131100 - DNA, 15 bp, Homo sapiens
attatatacatatac

SEQ ID NO: 131101 - DNA, 15 bp, Homo sapiens
gattatatacatata

SEQ ID NO: 131102 - DNA, 15 bp, Homo sapiens
agattatatacatat

SEQ ID NO: 131103 - DNA, 15 bp, Homo sapiens
tagattatatacata

SEQ ID NO: 131104 - DNA, 15 bp, Homo sapiens
atagattatatacat

SEQ ID NO: 131105 - DNA, 15 bp, Homo sapiens
tatagattatataca

SEQ ID NO: 131106 - DNA, 15 bp, Homo sapiens
ttatagattatatac

SEQ ID NO: 131107 - DNA, 15 bp, Homo sapiens
tttatagattatata

SEQ ID NO: 131108 - DNA, 15 bp, Homo sapiens
ttttatagattatat

SEQ ID NO: 131109 - DNA, 15 bp, Homo sapiens
tttttatagattata

SEQ ID NO: 131110 - DNA, 15 bp, Homo sapiens
atttttatagattat

SEQ ID NO: 131111 - DNA, 15 bp, Homo sapiens
aatttttatagatta

SEQ ID NO: 131112 - DNA, 15 bp, Homo sapiens
gaatttttatagatt

SEQ ID NO: 131113 - DNA, 15 bp, Homo sapiens
tgaatttttatagat

SEQ ID NO: 131114 - DNA, 15 bp, Homo sapiens
atgaatttttataga

SEQ ID NO: 131115 - DNA, 15 bp, Homo sapiens
tatgaatttttatag

SEQ ID NO: 131116 - DNA, 15 bp, Homo sapiens
gtatgaatttttata

SEQ ID NO: 131117 - DNA, 15 bp, Homo sapiens
tgtatgaatttttat

SEQ ID NO: 131118 - DNA, 15 bp, Homo sapiens
atgtatgaattttta

SEQ ID NO: 131119 - DNA, 15 bp, Homo sapiens
tatgtatgaattttt

SEQ ID NO: 131120 - DNA, 15 bp, Homo sapiens
atatatgtatgaatt

SEQ ID NO: 131121 - DNA, 15 bp, Homo sapiens
tatatatgtatgaat

SEQ ID NO: 131122 - DNA, 15 bp, Homo sapiens
ctatatatgtatgaa

SEQ ID NO: 131123 - DNA, 15 bp, Homo sapiens
tctatatatgtatga

SEQ ID NO: 131124 - DNA, 15 bp, Homo sapiens
atctatatatgtatg

SEQ ID NO: 131125 - DNA, 15 bp, Homo sapiens
catctatatatgtat

SEQ ID NO: 131126 - DNA, 15 bp, Homo sapiens
acatctatatatgta

SEQ ID NO: 131127 - DNA, 15 bp, Homo sapiens
tacatctatatatgt

SEQ ID NO: 131128 - DNA, 15 bp, Homo sapiens
atacatctatatatg

SEQ ID NO: 131129 - DNA, 15 bp, Homo sapiens
tatacatctatatat

SEQ ID NO: 131130 - DNA, 15 bp, Homo sapiens
ttatacatctatata

SEQ ID NO: 131131 - DNA, 15 bp, Homo sapiens
tttatacatctatat

SEQ ID NO: 131132 - DNA, 15 bp, Homo sapiens
atttatacatctata

SEQ ID NO: 131133 - DNA, 15 bp, Homo sapiens
tatttatacatctat

SEQ ID NO: 131134 - DNA, 15 bp, Homo sapiens
atatttatacatcta

SEQ ID NO: 131135 - DNA, 15 bp, Homo sapiens
tatatttatacatct

SEQ ID NO: 131136 - DNA, 15 bp, Homo sapiens
atatatttatacatc

SEQ ID NO: 131137 - DNA, 15 bp, Homo sapiens
gatatatttatacat

SEQ ID NO: 131138 - DNA, 15 bp, Homo sapiens
ggatatatttataca

SEQ ID NO: 131139 - DNA, 15 bp, Homo sapiens
tggatatatttatac

SEQ ID NO: 131140 - DNA, 15 bp, Homo sapiens
ttggatatatttata

SEQ ID NO: 131141 - DNA, 15 bp, Homo sapiens
tttggatatatttat

SEQ ID NO: 131142 - DNA, 15 bp, Homo sapiens
atttggatatattta

SEQ ID NO: 131143 - DNA, 15 bp, Homo sapiens
tatttggatatattt

SEQ ID NO: 131144 - DNA, 15 bp, Homo sapiens
atatttggatatatt

SEQ ID NO: 131145 - DNA, 15 bp, Homo sapiens
gatatttggatatat

SEQ ID NO: 131146 - DNA, 15 bp, Homo sapiens
ggatatttggatata

SEQ ID NO: 131147 - DNA, 15 bp, Homo sapiens
tggatatttggatat

SEQ ID NO: 131148 - DNA, 15 bp, Homo sapiens
atggatatttggata

SEQ ID NO: 131149 - DNA, 15 bp, Homo sapiens
tatggatatttggat

SEQ ID NO: 131150 - DNA, 15 bp, Homo sapiens
ttatggatatttgga

SEQ ID NO: 131151 - DNA, 15 bp, Homo sapiens
tttatggatatttgg

SEQ ID NO: 131152 - DNA, 15 bp, Homo sapiens
atttatggatatttg

SEQ ID NO: 131153 - DNA, 15 bp, Homo sapiens
aatttatggatattt

SEQ ID NO: 131154 - DNA, 15 bp, Homo sapiens
aaatttatggatatt

SEQ ID NO: 131155 - DNA, 15 bp, Homo sapiens
aaaatttatggatat

SEQ ID NO: 131156 - DNA, 15 bp, Homo sapiens
caaaatttatggata

SEQ ID NO: 131157 - DNA, 15 bp, Homo sapiens
acaaaatttatggat

SEQ ID NO: 131158 - DNA, 15 bp, Homo sapiens
tacaaaatttatgga

SEQ ID NO: 131159 - DNA, 15 bp, Homo sapiens
atacaaaatttatgg

SEQ ID NO: 131160 - DNA, 15 bp, Homo sapiens
aatacaaaatttatg

SEQ ID NO: 131161 - DNA, 15 bp, Homo sapiens
gaatacaaaatttat

SEQ ID NO: 131162 - DNA, 15 bp, Homo sapiens
tgaatacaaaattta

SEQ ID NO: 131163 - DNA, 15 bp, Homo sapiens
atgaatacaaaattt

SEQ ID NO: 131164 - DNA, 15 bp, Homo sapiens
tatgaatacaaaatt

SEQ ID NO: 131165 - DNA, 15 bp, Homo sapiens
ttatgaatacaaaat

SEQ ID NO: 131166 - DNA, 15 bp, Homo sapiens
tttatgaatacaaaa

SEQ ID NO: 131167 - DNA, 15 bp, Homo sapiens
atttatgaatacaaa

SEQ ID NO: 131168 - DNA, 15 bp, Homo sapiens
tatttatgaatacaa

SEQ ID NO: 131169 - DNA, 15 bp, Homo sapiens
atatttatgaataca

SEQ ID NO: 131170 - DNA, 15 bp, Homo sapiens
aatatttatgaatac

SEQ ID NO: 131171 - DNA, 15 bp, Homo sapiens
aaatatttatgaata

SEQ ID NO: 131172 - DNA, 15 bp, Homo sapiens
taaatatttatgaat

SEQ ID NO: 131173 - DNA, 15 bp, Homo sapiens
ataaatatttatgaa

SEQ ID NO: 131174 - DNA, 15 bp, Homo sapiens
aataaatatttatga

SEQ ID NO: 131175 - DNA, 15 bp, Homo sapiens
aaataaatatttatg

SEQ ID NO: 131176 - DNA, 15 bp, Homo sapiens
aaaataaatatttat

SEQ ID NO: 131177 - DNA, 15 bp, Homo sapiens
aaaaataaatattta

SEQ ID NO: 131178 - DNA, 15 bp, Homo sapiens
aaaaaataaatattt

SEQ ID NO: 131179 - DNA, 15 bp, Homo sapiens
caaaaaataaatatt

SEQ ID NO: 131180 - DNA, 15 bp, Homo sapiens
acaaaaaataaatat

SEQ ID NO: 131181 - DNA, 15 bp, Homo sapiens
cacaaaaaataaata

SEQ ID NO: 131182 - DNA, 15 bp, Homo sapiens
acacaaaaaataaat

SEQ ID NO: 131183 - DNA, 15 bp, Homo sapiens
aacacaaaaaataaa

SEQ ID NO: 131184 - DNA, 15 bp, Homo sapiens
taacacaaaaaataa

SEQ ID NO: 131185 - DNA, 15 bp, Homo sapiens
ttaacacaaaaaata

SEQ ID NO: 131186 - DNA, 15 bp, Homo sapiens
cttaacacaaaaaat

SEQ ID NO: 131187 - DNA, 15 bp, Homo sapiens
tcttaacacaaaaaa

SEQ ID NO: 131188 - DNA, 15 bp, Homo sapiens
ttcttaacacaaaaa

SEQ ID NO: 131189 - DNA, 15 bp, Homo sapiens
attcttaacacaaaa

SEQ ID NO: 131190 - DNA, 15 bp, Homo sapiens
aattcttaacacaaa

SEQ ID NO: 131191 - DNA, 15 bp, Homo sapiens
taattcttaacacaa

SEQ ID NO: 131192 - DNA, 15 bp, Homo sapiens
ttaattcttaacaca

SEQ ID NO: 131193 - DNA, 15 bp, Homo sapiens
tttaattcttaacac

SEQ ID NO: 131194 - DNA, 15 bp, Homo sapiens
ttttaattcttaaca

SEQ ID NO: 131195 - DNA, 15 bp, Homo sapiens
attttaattcttaac

SEQ ID NO: 131196 - DNA, 15 bp, Homo sapiens
tattttaattcttaa

SEQ ID NO: 131197 - DNA, 15 bp, Homo sapiens
gtattttaattctta

SEQ ID NO: 131198 - DNA, 15 bp, Homo sapiens
agtattttaattctt

SEQ ID NO: 131199 - DNA, 15 bp, Homo sapiens
aagtattttaattct

SEQ ID NO: 131200 - DNA, 15 bp, Homo sapiens
caagtattttaattc

SEQ ID NO: 131201 - DNA, 15 bp, Homo sapiens
acaagtattttaatt

SEQ ID NO: 131202 - DNA, 15 bp, Homo sapiens
aacaagtattttaat

SEQ ID NO: 131203 - DNA, 15 bp, Homo sapiens
caacaagtattttaa

SEQ ID NO: 131204 - DNA, 15 bp, Homo sapiens
gcaacaagtatttta

SEQ ID NO: 131205 - DNA, 15 bp, Homo sapiens
tgcaacaagtatttt

SEQ ID NO: 131206 - DNA, 15 bp, Homo sapiens
ctgcaacaagtattt

SEQ ID NO: 131207 - DNA, 15 bp, Homo sapiens
tctgcaacaagtatt

SEQ ID NO: 131208 - DNA, 15 bp, Homo sapiens
ttctgcaacaagtat

SEQ ID NO: 131209 - DNA, 15 bp, Homo sapiens
gttctgcaacaagta

SEQ ID NO: 131210 - DNA, 15 bp, Homo sapiens
tgttctgcaacaagt

SEQ ID NO: 131211 - DNA, 15 bp, Homo sapiens
gtgttctgcaacaag

SEQ ID NO: 131212 - DNA, 15 bp, Homo sapiens
agtgttctgcaacaa

SEQ ID NO: 131213 - DNA, 15 bp, Homo sapiens
gagtgttctgcaaca

SEQ ID NO: 131214 - DNA, 15 bp, Homo sapiens
tgagtgttctgcaac

SEQ ID NO: 131215 - DNA, 15 bp, Homo sapiens
ctgagtgttctgcaa

SEQ ID NO: 131216 - DNA, 15 bp, Homo sapiens
gctgagtgttctgca

SEQ ID NO: 131217 - DNA, 15 bp, Homo sapiens
tgctgagtgttctgc

SEQ ID NO: 131218 - DNA, 15 bp, Homo sapiens
atgctgagtgttctg

SEQ ID NO: 131219 - DNA, 15 bp, Homo sapiens
tatgctgagtgttct

SEQ ID NO: 131220 - DNA, 15 bp, Homo sapiens
ttatgctgagtgttc

SEQ ID NO: 131221 - DNA, 15 bp, Homo sapiens
attatgctgagtgtt

SEQ ID NO: 131222 - DNA, 15 bp, Homo sapiens
cattatgctgagtgt

SEQ ID NO: 131223 - DNA, 15 bp, Homo sapiens
acattatgctgagtg

SEQ ID NO: 131224 - DNA, 15 bp, Homo sapiens
cacattatgctgagt

SEQ ID NO: 131225 - DNA, 15 bp, Homo sapiens
gcacattatgctgag

SEQ ID NO: 131226 - DNA, 15 bp, Homo sapiens
agcacattatgctga

SEQ ID NO: 131227 - DNA, 15 bp, Homo sapiens
gagcacattatgctg

SEQ ID NO: 131228 - DNA, 15 bp, Homo sapiens
tgagcacattatgct

SEQ ID NO: 131229 - DNA, 15 bp, Homo sapiens
gtgagcacattatgc

SEQ ID NO: 131230 - DNA, 15 bp, Homo sapiens
tgtgagcacattatg

SEQ ID NO: 131231 - DNA, 15 bp, Homo sapiens
atgtgagcacattat

SEQ ID NO: 131232 - DNA, 15 bp, Homo sapiens
aatgtgagcacatta

SEQ ID NO: 131233 - DNA, 15 bp, Homo sapiens
aaatgtgagcacatt

SEQ ID NO: 131234 - DNA, 15 bp, Homo sapiens
aaaatgtgagcacat

SEQ ID NO: 131235 - DNA, 15 bp, Homo sapiens
aaaaatgtgagcaca

SEQ ID NO: 131236 - DNA, 15 bp, Homo sapiens
aaaaaatgtgagcac

SEQ ID NO: 131237 - DNA, 15 bp, Homo sapiens
aaaaaaatgtgagca

SEQ ID NO: 131238 - DNA, 15 bp, Homo sapiens
aaaaaaaatgtgagc

SEQ ID NO: 131239 - DNA, 15 bp, Homo sapiens
aaaaaaaaatgtgag

SEQ ID NO: 131240 - DNA, 15 bp, Homo sapiens
taaaaaaaaatgtga

SEQ ID NO: 131241 - DNA, 15 bp, Homo sapiens
ttaaaaaaaaatgtg

SEQ ID NO: 131242 - DNA, 15 bp, Homo sapiens
ttttaaaaaaaaatg

SEQ ID NO: 131243 - DNA, 15 bp, Homo sapiens
tttttaaaaaaaaat

SEQ ID NO: 131244 - DNA, 15 bp, Homo sapiens
ttttttaaaaaaaaa

SEQ ID NO: 131245 - DNA, 15 bp, Homo sapiens
tttttttaaaaaaaa

SEQ ID NO: 131246 - DNA, 15 bp, Homo sapiens
ctttttttaaaaaaa

SEQ ID NO: 131247 - DNA, 15 bp, Homo sapiens
tctttttttaaaaaa

SEQ ID NO: 131248 - DNA, 15 bp, Homo sapiens
ttctttttttaaaaa

SEQ ID NO: 131249 - DNA, 15 bp, Homo sapiens
atttctttttttaaa

SEQ ID NO: 131250 - DNA, 15 bp, Homo sapiens
aatttctttttttaa

SEQ ID NO: 131251 - DNA, 15 bp, Homo sapiens
caatttcttttttta

SEQ ID NO: 131252 - DNA, 15 bp, Homo sapiens
acaatttcttttttt

SEQ ID NO: 131253 - DNA, 15 bp, Homo sapiens
cacaatttctttttt

SEQ ID NO: 131254 - DNA, 15 bp, Homo sapiens
ccacaatttcttttt

SEQ ID NO: 131255 - DNA, 15 bp, Homo sapiens
cccacaatttctttt

SEQ ID NO: 131256 - DNA, 15 bp, Homo sapiens
gcccacaatttcttt

SEQ ID NO: 131257 - DNA, 15 bp, Homo sapiens
agcccacaatttctt

SEQ ID NO: 131258 - DNA, 15 bp, Homo sapiens
cagcccacaatttct

SEQ ID NO: 131259 - DNA, 15 bp, Homo sapiens
ccagcccacaatttc

SEQ ID NO: 131260 - DNA, 15 bp, Homo sapiens
cccagcccacaattt

SEQ ID NO: 131261 - DNA, 15 bp, Homo sapiens
acccagcccacaatt

SEQ ID NO: 131262 - DNA, 15 bp, Homo sapiens
cacccagcccacaat

SEQ ID NO: 131263 - DNA, 15 bp, Homo sapiens
acacccagcccacaa

SEQ ID NO: 131264 - DNA, 15 bp, Homo sapiens
cacacccagcccaca

SEQ ID NO: 131265 - DNA, 15 bp, Homo sapiens
ccacacccagcccac

SEQ ID NO: 131266 - DNA, 15 bp, Homo sapiens
accacacccagccca

SEQ ID NO: 131267 - DNA, 15 bp, Homo sapiens
caccacacccagccc

SEQ ID NO: 131268 - DNA, 15 bp, Homo sapiens
ccaccacacccagcc

SEQ ID NO: 131269 - DNA, 15 bp, Homo sapiens
cgtgagccaccacac

SEQ ID NO: 131270 - DNA, 15 bp, Homo sapiens
gcgtgagccaccaca

SEQ ID NO: 131271 - DNA, 15 bp, Homo sapiens
acccgcctcggcctc

SEQ ID NO: 131272 - DNA, 15 bp, Homo sapiens
cacccgcctcggcct

SEQ ID NO: 131273 - DNA, 15 bp, Homo sapiens
ccacccgcctcggcc

SEQ ID NO: 131274 - DNA, 15 bp, Homo sapiens
tccacccgcctcggc

SEQ ID NO: 131275 - DNA, 15 bp, Homo sapiens
atccacccgcctcgg

SEQ ID NO: 131276 - DNA, 15 bp, Homo sapiens
gatccacccgcctcg

SEQ ID NO: 131277 - DNA, 15 bp, Homo sapiens
tgtgatccacccgcc

SEQ ID NO: 131278 - DNA, 15 bp, Homo sapiens
ttgtgatccacccgc

SEQ ID NO: 131279 - DNA, 15 bp, Homo sapiens
cttgtgatccacccg

SEQ ID NO: 131280 - DNA, 15 bp, Homo sapiens
ccttgtgatccaccc

SEQ ID NO: 131281 - DNA, 15 bp, Homo sapiens
atgaccttgtgatcc

SEQ ID NO: 131282 - DNA, 15 bp, Homo sapiens
catgaccttgtgatc

SEQ ID NO: 131283 - DNA, 15 bp, Homo sapiens
tcatgaccttgtgat

SEQ ID NO: 131284 - DNA, 15 bp, Homo sapiens
ctcatgaccttgtga

SEQ ID NO: 131285 - DNA, 15 bp, Homo sapiens
tctcatgaccttgtg

SEQ ID NO: 131286 - DNA, 15 bp, Homo sapiens
atctcatgaccttgt

SEQ ID NO: 131287 - DNA, 15 bp, Homo sapiens
gatctcatgaccttg

SEQ ID NO: 131288 - DNA, 15 bp, Homo sapiens
cgatctcatgacctt

SEQ ID NO: 131289 - DNA, 15 bp, Homo sapiens
tcgatctcatgacct

SEQ ID NO: 131290 - DNA, 15 bp, Homo sapiens
ctcgatctcatgacc

SEQ ID NO: 131291 - DNA, 15 bp, Homo sapiens
tctcgatctcatgac

SEQ ID NO: 131292 - DNA, 15 bp, Homo sapiens
gtctcgatctcatga

SEQ ID NO: 131293 - DNA, 15 bp, Homo sapiens
ggtctcgatctcatg

SEQ ID NO: 131294 - DNA, 15 bp, Homo sapiens
tggtctcgatctcat

SEQ ID NO: 131295 - DNA, 15 bp, Homo sapiens
atggtctcgatctca

SEQ ID NO: 131296 - DNA, 15 bp, Homo sapiens
agatggtctcgatct

SEQ ID NO: 131297 - DNA, 15 bp, Homo sapiens
cagatggtctcgatc

SEQ ID NO: 131298 - DNA, 15 bp, Homo sapiens
ccagatggtctcgat

SEQ ID NO: 131299 - DNA, 15 bp, Homo sapiens
gccagatggtctcga

SEQ ID NO: 131300 - DNA, 15 bp, Homo sapiens
agccagatggtctcg

SEQ ID NO: 131301 - DNA, 15 bp, Homo sapiens
tagccagatggtctc

SEQ ID NO: 131302 - DNA, 15 bp, Homo sapiens
ttagccagatggtct

SEQ ID NO: 131303 - DNA, 15 bp, Homo sapiens
gttagccagatggtc

SEQ ID NO: 131304 - DNA, 15 bp, Homo sapiens
tgttagccagatggt

SEQ ID NO: 131305 - DNA, 15 bp, Homo sapiens
atgttagccagatgg

SEQ ID NO: 131306 - DNA, 15 bp, Homo sapiens
catgttagccagatg

SEQ ID NO: 131307 - DNA, 15 bp, Homo sapiens
ccatgttagccagat

SEQ ID NO: 131308 - DNA, 15 bp, Homo sapiens
accatgttagccaga

SEQ ID NO: 131309 - DNA, 15 bp, Homo sapiens
tatagagatggggtt

SEQ ID NO: 131310 - DNA, 15 bp, Homo sapiens
ttatagagatggggt

SEQ ID NO: 131311 - DNA, 15 bp, Homo sapiens
tttatagagatgggg

SEQ ID NO: 131312 - DNA, 15 bp, Homo sapiens
ttttatagagatggg

SEQ ID NO: 131313 - DNA, 15 bp, Homo sapiens
tttttatagagatgg

SEQ ID NO: 131314 - DNA, 15 bp, Homo sapiens
atttttatagagatg

SEQ ID NO: 131315 - DNA, 15 bp, Homo sapiens
tatttttatagagat

SEQ ID NO: 131316 - DNA, 15 bp, Homo sapiens
gtatttttatagaga

SEQ ID NO: 131317 - DNA, 15 bp, Homo sapiens
tgtatttttatagag

SEQ ID NO: 131318 - DNA, 15 bp, Homo sapiens
ttgtatttttataga

SEQ ID NO: 131319 - DNA, 15 bp, Homo sapiens
tttgtatttttatag

SEQ ID NO: 131320 - DNA, 15 bp, Homo sapiens
ttttgtatttttata

SEQ ID NO: 131321 - DNA, 15 bp, Homo sapiens
tttttgtatttttat

SEQ ID NO: 131322 - DNA, 15 bp, Homo sapiens
atttttttttgtatt

SEQ ID NO: 131323 - DNA, 15 bp, Homo sapiens
taatttttttttgta

SEQ ID NO: 131324 - DNA, 15 bp, Homo sapiens
ctaatttttttttgt

SEQ ID NO: 131325 - DNA, 15 bp, Homo sapiens
ccagctaattttttt

SEQ ID NO: 131326 - DNA, 15 bp, Homo sapiens
gccagctaatttttt

SEQ ID NO: 131327 - DNA, 15 bp, Homo sapiens
ggccagctaattttt

SEQ ID NO: 131328 - DNA, 15 bp, Homo sapiens
cggccagctaatttt

SEQ ID NO: 131329 - DNA, 15 bp, Homo sapiens
acggccagctaattt

SEQ ID NO: 131330 - DNA, 15 bp, Homo sapiens
cacggccagctaatt

SEQ ID NO: 131331 - DNA, 15 bp, Homo sapiens
ccacggccagctaat

SEQ ID NO: 131332 - DNA, 15 bp, Homo sapiens
accacggccagctaa

SEQ ID NO: 131333 - DNA, 15 bp, Homo sapiens
caccacggccagcta

SEQ ID NO: 131334 - DNA, 15 bp, Homo sapiens
ccaccacggccagct

SEQ ID NO: 131335 - DNA, 15 bp, Homo sapiens
gccaccacggccagc

SEQ ID NO: 131336 - DNA, 15 bp, Homo sapiens
tgccaccacggccag

SEQ ID NO: 131337 - DNA, 15 bp, Homo sapiens
ctgccaccacggcca

SEQ ID NO: 131338 - DNA, 15 bp, Homo sapiens
cctgccaccacggcc

SEQ ID NO: 131339 - DNA, 15 bp, Homo sapiens
gcctgccaccacggc

SEQ ID NO: 131340 - DNA, 15 bp, Homo sapiens
cgcctgccaccacgg

SEQ ID NO: 131341 - DNA, 15 bp, Homo sapiens
gcgcctgccaccacg

SEQ ID NO: 131342 - DNA, 15 bp, Homo sapiens
tgcgcctgccaccac

SEQ ID NO: 131343 - DNA, 15 bp, Homo sapiens
atgcgcctgccacca

SEQ ID NO: 131344 - DNA, 15 bp, Homo sapiens
catgcgcctgccacc

SEQ ID NO: 131345 - DNA, 15 bp, Homo sapiens
acatgcgcctgccac

SEQ ID NO: 131346 - DNA, 15 bp, Homo sapiens
tacatgcgcctgcca

SEQ ID NO: 131347 - DNA, 15 bp, Homo sapiens
ctacatgcgcctgcc

SEQ ID NO: 131348 - DNA, 15 bp, Homo sapiens
actacatgcgcctgc

SEQ ID NO: 131349 - DNA, 15 bp, Homo sapiens
gactacatgcgcctg

SEQ ID NO: 131350 - DNA, 15 bp, Homo sapiens
agactacatgcgcct

SEQ ID NO: 131351 - DNA, 15 bp, Homo sapiens
gagactacatgcgcc

SEQ ID NO: 131352 - DNA, 15 bp, Homo sapiens
tgagactacatgcgc

SEQ ID NO: 131353 - DNA, 15 bp, Homo sapiens
ctgagactacatgcg

SEQ ID NO: 131354 - DNA, 15 bp, Homo sapiens
gctgagactacatgc

SEQ ID NO: 131355 - DNA, 15 bp, Homo sapiens
agctgagactacatg

SEQ ID NO: 131356 - DNA, 15 bp, Homo sapiens
tagctgagactacat

SEQ ID NO: 131357 - DNA, 15 bp, Homo sapiens
gtagctgagactaca

SEQ ID NO: 131358 - DNA, 15 bp, Homo sapiens
agtagctgagactac

SEQ ID NO: 131359 - DNA, 15 bp, Homo sapiens
gagtagctgagacta

SEQ ID NO: 131360 - DNA, 15 bp, Homo sapiens
cgagtagctgagact

SEQ ID NO: 131361 - DNA, 15 bp, Homo sapiens
ccgagtagctgagac

SEQ ID NO: 131362 - DNA, 15 bp, Homo sapiens
cccgagtagctgaga

SEQ ID NO: 131363 - DNA, 15 bp, Homo sapiens
tcccgagtagctgag

SEQ ID NO: 131364 - DNA, 15 bp, Homo sapiens
ctcccgagtagctga

SEQ ID NO: 131365 - DNA, 15 bp, Homo sapiens
ttcagcctcccgagt

SEQ ID NO: 131366 - DNA, 15 bp, Homo sapiens
cttcagcctcccgag

SEQ ID NO: 131367 - DNA, 15 bp, Homo sapiens
gcttcagcctcccga

SEQ ID NO: 131368 - DNA, 15 bp, Homo sapiens
tgcttcagcctcccg

SEQ ID NO: 131369 - DNA, 15 bp, Homo sapiens
tcctgcttcagcctc

SEQ ID NO: 131370 - DNA, 15 bp, Homo sapiens
ctcctgcttcagcct

SEQ ID NO: 131371 - DNA, 15 bp, Homo sapiens
tctcctgcttcagcc

SEQ ID NO: 131372 - DNA, 15 bp, Homo sapiens
ttctcctgcttcagc

SEQ ID NO: 131373 - DNA, 15 bp, Homo sapiens
attctcctgcttcag

SEQ ID NO: 131374 - DNA, 15 bp, Homo sapiens
cattctcctgcttca

SEQ ID NO: 131375 - DNA, 15 bp, Homo sapiens
ccattctcctgcttc

SEQ ID NO: 131376 - DNA, 15 bp, Homo sapiens
gccattctcctgctt

SEQ ID NO: 131377 - DNA, 15 bp, Homo sapiens
tgccattctcctgct

SEQ ID NO: 131378 - DNA, 15 bp, Homo sapiens
atgccattctcctgc

SEQ ID NO: 131379 - DNA, 15 bp, Homo sapiens
catgccattctcctg

SEQ ID NO: 131380 - DNA, 15 bp, Homo sapiens
tcatgccattctcct

SEQ ID NO: 131381 - DNA, 15 bp, Homo sapiens
ttcatgccattctcc

SEQ ID NO: 131382 - DNA, 15 bp, Homo sapiens
gttcatgccattctc

SEQ ID NO: 131383 - DNA, 15 bp, Homo sapiens
ggttcatgccattct

SEQ ID NO: 131384 - DNA, 15 bp, Homo sapiens
gggttcatgccattc

SEQ ID NO: 131385 - DNA, 15 bp, Homo sapiens
tgggttcatgccatt

SEQ ID NO: 131386 - DNA, 15 bp, Homo sapiens
ctgggttcatgccat

SEQ ID NO: 131387 - DNA, 15 bp, Homo sapiens
cctgggttcatgcca

SEQ ID NO: 131388 - DNA, 15 bp, Homo sapiens
tcctgggttcatgcc

SEQ ID NO: 131389 - DNA, 15 bp, Homo sapiens
ctcctgggttcatgc

SEQ ID NO: 131390 - DNA, 15 bp, Homo sapiens
cctcctgggttcatg

SEQ ID NO: 131391 - DNA, 15 bp, Homo sapiens
gcctcctgggttcat

SEQ ID NO: 131392 - DNA, 15 bp, Homo sapiens
gtggcacgatctcgg

SEQ ID NO: 131393 - DNA, 15 bp, Homo sapiens
agtggcacgatctcg

SEQ ID NO: 131394 - DNA, 15 bp, Homo sapiens
agccaggctggagtg

SEQ ID NO: 131395 - DNA, 15 bp, Homo sapiens
cagccaggctggagt

SEQ ID NO: 131396 - DNA, 15 bp, Homo sapiens
tcagccaggctggag

SEQ ID NO: 131397 - DNA, 15 bp, Homo sapiens
gtcagccaggctgga

SEQ ID NO: 131398 - DNA, 15 bp, Homo sapiens
tgtcagccaggctgg

SEQ ID NO: 131399 - DNA, 15 bp, Homo sapiens
ctgtcagccaggctg

SEQ ID NO: 131400 - DNA, 15 bp, Homo sapiens
tctgtcagccaggct

SEQ ID NO: 131401 - DNA, 15 bp, Homo sapiens
ctctgtcagccaggc

SEQ ID NO: 131402 - DNA, 15 bp, Homo sapiens
gctctgtcagccagg

SEQ ID NO: 131403 - DNA, 15 bp, Homo sapiens
cgctctgtcagccag

SEQ ID NO: 131404 - DNA, 15 bp, Homo sapiens
tcgctctgtcagcca

SEQ ID NO: 131405 - DNA, 15 bp, Homo sapiens
ctcgctctgtcagcc

SEQ ID NO: 131406 - DNA, 15 bp, Homo sapiens
tctcgctctgtcagc

SEQ ID NO: 131407 - DNA, 15 bp, Homo sapiens
gtctcgctctgtcag

SEQ ID NO: 131408 - DNA, 15 bp, Homo sapiens
agtctcgctctgtca

SEQ ID NO: 131409 - DNA, 15 bp, Homo sapiens
ggagtctcgctctgt

SEQ ID NO: 131410 - DNA, 15 bp, Homo sapiens
cggagtctcgctctg

SEQ ID NO: 131411 - DNA, 15 bp, Homo sapiens
acggagtctcgctct

SEQ ID NO: 131412 - DNA, 15 bp, Homo sapiens
gacggagtctcgctc

SEQ ID NO: 131413 - DNA, 15 bp, Homo sapiens
agacggagtctcgct

SEQ ID NO: 131414 - DNA, 15 bp, Homo sapiens
gagacggagtctcgc

SEQ ID NO: 131415 - DNA, 15 bp, Homo sapiens
tgagacggagtctcg

SEQ ID NO: 131416 - DNA, 15 bp, Homo sapiens
atttctttttttttt

SEQ ID NO: 131417 - DNA, 15 bp, Homo sapiens
aatttcttttttttt

SEQ ID NO: 131418 - DNA, 15 bp, Homo sapiens
taatttctttttttt

SEQ ID NO: 131419 - DNA, 15 bp, Homo sapiens
ataatttcttttttt

SEQ ID NO: 131420 - DNA, 15 bp, Homo sapiens
cataatttctttttt

SEQ ID NO: 131421 - DNA, 15 bp, Homo sapiens
tcataatttcttttt

SEQ ID NO: 131422 - DNA, 15 bp, Homo sapiens
ctcataatttctttt

SEQ ID NO: 131423 - DNA, 15 bp, Homo sapiens
actcataatttcttt

SEQ ID NO: 131424 - DNA, 15 bp, Homo sapiens
cactcataatttctt

SEQ ID NO: 131425 - DNA, 15 bp, Homo sapiens
acactcataatttct

SEQ ID NO: 131426 - DNA, 15 bp, Homo sapiens
cacactcataatttc

SEQ ID NO: 131427 - DNA, 15 bp, Homo sapiens
acacactcataattt

SEQ ID NO: 131428 - DNA, 15 bp, Homo sapiens
tacacactcataatt

SEQ ID NO: 131429 - DNA, 15 bp, Homo sapiens
atacacactcataat

SEQ ID NO: 131430 - DNA, 15 bp, Homo sapiens
aatacacactcataa

SEQ ID NO: 131431 - DNA, 15 bp, Homo sapiens
gaatacacactcata

SEQ ID NO: 131432 - DNA, 15 bp, Homo sapiens
tgaatacacactcat

SEQ ID NO: 131433 - DNA, 15 bp, Homo sapiens
atgaatacacactca

SEQ ID NO: 131434 - DNA, 15 bp, Homo sapiens
tatgaatacacactc

SEQ ID NO: 131435 - DNA, 15 bp, Homo sapiens
gtatgaatacacact

SEQ ID NO: 131436 - DNA, 15 bp, Homo sapiens
tgtatgaatacacac

SEQ ID NO: 131437 - DNA, 15 bp, Homo sapiens
atgtatgaatacaca

SEQ ID NO: 131438 - DNA, 15 bp, Homo sapiens
catgtatgaatacac

SEQ ID NO: 131439 - DNA, 15 bp, Homo sapiens
acatgtatgaataca

SEQ ID NO: 131440 - DNA, 15 bp, Homo sapiens
tacatgtatgaatac

SEQ ID NO: 131441 - DNA, 15 bp, Homo sapiens
gtacatgtatgaata

SEQ ID NO: 131442 - DNA, 15 bp, Homo sapiens
tgtacatgtatgaat

SEQ ID NO: 131443 - DNA, 15 bp, Homo sapiens
ttgtacatgtatgaa

SEQ ID NO: 131444 - DNA, 15 bp, Homo sapiens
cttgtacatgtatga

SEQ ID NO: 131445 - DNA, 15 bp, Homo sapiens
gcttgtacatgtatg

SEQ ID NO: 131446 - DNA, 15 bp, Homo sapiens
tgcttgtacatgtat

SEQ ID NO: 131447 - DNA, 15 bp, Homo sapiens
atgcttgtacatgta

SEQ ID NO: 131448 - DNA, 15 bp, Homo sapiens
tatgcttgtacatgt

SEQ ID NO: 131449 - DNA, 15 bp, Homo sapiens
ttatgcttgtacatg

SEQ ID NO: 131450 - DNA, 15 bp, Homo sapiens
cttatgcttgtacat

SEQ ID NO: 131451 - DNA, 15 bp, Homo sapiens
acttatgcttgtaca

SEQ ID NO: 131452 - DNA, 15 bp, Homo sapiens
cacttatgcttgtac

SEQ ID NO: 131453 - DNA, 15 bp, Homo sapiens
acacttatgcttgta

SEQ ID NO: 131454 - DNA, 15 bp, Homo sapiens
cacacttatgcttgt

SEQ ID NO: 131455 - DNA, 15 bp, Homo sapiens
acacacttatgcttg

SEQ ID NO: 131456 - DNA, 15 bp, Homo sapiens
cacacacttatgctt

SEQ ID NO: 131457 - DNA, 15 bp, Homo sapiens
acacacacttatgct

SEQ ID NO: 131458 - DNA, 15 bp, Homo sapiens
cacacacacttatgc

SEQ ID NO: 131459 - DNA, 15 bp, Homo sapiens
tcacacacacttatg

SEQ ID NO: 131460 - DNA, 15 bp, Homo sapiens
ttcacacacacttat

SEQ ID NO: 131461 - DNA, 15 bp, Homo sapiens
tttcacacacactta

SEQ ID NO: 131462 - DNA, 15 bp, Homo sapiens
ctttcacacacactt

SEQ ID NO: 131463 - DNA, 15 bp, Homo sapiens
cctttcacacacact

SEQ ID NO: 131464 - DNA, 15 bp, Homo sapiens
acctttcacacacac

SEQ ID NO: 131465 - DNA, 15 bp, Homo sapiens
aacctttcacacaca

SEQ ID NO: 131466 - DNA, 15 bp, Homo sapiens
taacctttcacacac

SEQ ID NO: 131467 - DNA, 15 bp, Homo sapiens
gtaacctttcacaca

SEQ ID NO: 131468 - DNA, 15 bp, Homo sapiens
agtaacctttcacac

SEQ ID NO: 131469 - DNA, 15 bp, Homo sapiens
aagtaacctttcaca

SEQ ID NO: 131470 - DNA, 15 bp, Homo sapiens
taagtaacctttcac

SEQ ID NO: 131471 - DNA, 15 bp, Homo sapiens
gtaagtaacctttca

SEQ ID NO: 131472 - DNA, 15 bp, Homo sapiens
agtaagtaacctttc

SEQ ID NO: 131473 - DNA, 15 bp, Homo sapiens
tagtaagtaaccttt

SEQ ID NO: 131474 - DNA, 15 bp, Homo sapiens
ttagtaagtaacctt

SEQ ID NO: 131475 - DNA, 15 bp, Homo sapiens
attagtaagtaacct

SEQ ID NO: 131476 - DNA, 15 bp, Homo sapiens
aattagtaagtaacc

SEQ ID NO: 131477 - DNA, 15 bp, Homo sapiens
gaattagtaagtaac

SEQ ID NO: 131478 - DNA, 15 bp, Homo sapiens
tgaattagtaagtaa

SEQ ID NO: 131479 - DNA, 15 bp, Homo sapiens
ctgaattagtaagta

SEQ ID NO: 131480 - DNA, 15 bp, Homo sapiens
tctgaattagtaagt

SEQ ID NO: 131481 - DNA, 15 bp, Homo sapiens
ctctgaattagtaag

SEQ ID NO: 131482 - DNA, 15 bp, Homo sapiens
tctctgaattagtaa

SEQ ID NO: 131483 - DNA, 15 bp, Homo sapiens
atctctgaattagta

SEQ ID NO: 131484 - DNA, 15 bp, Homo sapiens
aatctctgaattagt

SEQ ID NO: 131485 - DNA, 15 bp, Homo sapiens
aaatctctgaattag

SEQ ID NO: 131486 - DNA, 15 bp, Homo sapiens
aaaatctctgaatta

SEQ ID NO: 131487 - DNA, 15 bp, Homo sapiens
agacaaaatctctga

SEQ ID NO: 131488 - DNA, 15 bp, Homo sapiens
tagacaaaatctctg

SEQ ID NO: 131489 - DNA, 15 bp, Homo sapiens
atagacaaaatctct

SEQ ID NO: 131490 - DNA, 15 bp, Homo sapiens
tatagacaaaatctc

SEQ ID NO: 131491 - DNA, 15 bp, Homo sapiens
ttatagacaaaatct

SEQ ID NO: 131492 - DNA, 15 bp, Homo sapiens
tttatagacaaaatc

SEQ ID NO: 131493 - DNA, 15 bp, Homo sapiens
ctttatagacaaaat

SEQ ID NO: 131494 - DNA, 15 bp, Homo sapiens
cctttatagacaaaa

SEQ ID NO: 131495 - DNA, 15 bp, Homo sapiens
tcctttatagacaaa

SEQ ID NO: 131496 - DNA, 15 bp, Homo sapiens
ctcctttatagacaa

SEQ ID NO: 131497 - DNA, 15 bp, Homo sapiens
actcctttatagaca

SEQ ID NO: 131498 - DNA, 15 bp, Homo sapiens
tactcctttatagac

SEQ ID NO: 131499 - DNA, 15 bp, Homo sapiens
atactcctttataga

SEQ ID NO: 131500 - DNA, 15 bp, Homo sapiens
catactcctttatag

SEQ ID NO: 131501 - DNA, 15 bp, Homo sapiens
tcatactcctttata

SEQ ID NO: 131502 - DNA, 15 bp, Homo sapiens
atcatactcctttat

SEQ ID NO: 131503 - DNA, 15 bp, Homo sapiens
aatcatactccttta

SEQ ID NO: 131504 - DNA, 15 bp, Homo sapiens
caatcatactccttt

SEQ ID NO: 131505 - DNA, 15 bp, Homo sapiens
tcaatcatactcctt

SEQ ID NO: 131506 - DNA, 15 bp, Homo sapiens
ttcaatcatactcct

SEQ ID NO: 131507 - DNA, 15 bp, Homo sapiens
cttcaatcatactcc

SEQ ID NO: 131508 - DNA, 15 bp, Homo sapiens
gcttcaatcatactc

SEQ ID NO: 131509 - DNA, 15 bp, Homo sapiens
tgcttcaatcatact

SEQ ID NO: 131510 - DNA, 15 bp, Homo sapiens
atgcttcaatcatac

SEQ ID NO: 131511 - DNA, 15 bp, Homo sapiens
aatgcttcaatcata

SEQ ID NO: 131512 - DNA, 15 bp, Homo sapiens
aaatgcttcaatcat

SEQ ID NO: 131513 - DNA, 15 bp, Homo sapiens
aaaatgcttcaatca

SEQ ID NO: 131514 - DNA, 15 bp, Homo sapiens
caaaatgcttcaatc

SEQ ID NO: 131515 - DNA, 15 bp, Homo sapiens
tcaaaatgcttcaat

SEQ ID NO: 131516 - DNA, 15 bp, Homo sapiens
ctcaaaatgcttcaa

SEQ ID NO: 131517 - DNA, 15 bp, Homo sapiens
tctcaaaatgcttca

SEQ ID NO: 131518 - DNA, 15 bp, Homo sapiens
ttctcaaaatgcttc

SEQ ID NO: 131519 - DNA, 15 bp, Homo sapiens
tttctcaaaatgctt

SEQ ID NO: 131520 - DNA, 15 bp, Homo sapiens
ctttctcaaaatgct

SEQ ID NO: 131521 - DNA, 15 bp, Homo sapiens
tctttctcaaaatgc

SEQ ID NO: 131522 - DNA, 15 bp, Homo sapiens
ttctttctcaaaatg

SEQ ID NO: 131523 - DNA, 15 bp, Homo sapiens
tttctttctcaaaat

SEQ ID NO: 131524 - DNA, 15 bp, Homo sapiens
gtttctttctcaaaa

SEQ ID NO: 131525 - DNA, 15 bp, Homo sapiens
tgtttctttctcaaa

SEQ ID NO: 131526 - DNA, 15 bp, Homo sapiens
atgtttctttctcaa

SEQ ID NO: 131527 - DNA, 15 bp, Homo sapiens
aatgtttctttctca

SEQ ID NO: 131528 - DNA, 15 bp, Homo sapiens
caatgtttctttctc

SEQ ID NO: 131529 - DNA, 15 bp, Homo sapiens
tcaatgtttctttct

SEQ ID NO: 131530 - DNA, 15 bp, Homo sapiens
ttcaatgtttctttc

SEQ ID NO: 131531 - DNA, 15 bp, Homo sapiens
attcaatgtttcttt

SEQ ID NO: 131532 - DNA, 15 bp, Homo sapiens
tattcaatgtttctt

SEQ ID NO: 131533 - DNA, 15 bp, Homo sapiens
ttattcaatgtttct

SEQ ID NO: 131534 - DNA, 15 bp, Homo sapiens
attattcaatgtttc

SEQ ID NO: 131535 - DNA, 15 bp, Homo sapiens
cattattcaatgttt

SEQ ID NO: 131536 - DNA, 15 bp, Homo sapiens
tcattattcaatgtt

SEQ ID NO: 131537 - DNA, 15 bp, Homo sapiens
atcattattcaatgt

SEQ ID NO: 131538 - DNA, 15 bp, Homo sapiens
catcattattcaatg

SEQ ID NO: 131539 - DNA, 15 bp, Homo sapiens
tcatcattattcaat

SEQ ID NO: 131540 - DNA, 15 bp, Homo sapiens
ttcatcattattcaa

SEQ ID NO: 131541 - DNA, 15 bp, Homo sapiens
tttcatcattattca

SEQ ID NO: 131542 - DNA, 15 bp, Homo sapiens
ttttcatcattattc

SEQ ID NO: 131543 - DNA, 15 bp, Homo sapiens
tttttcatcattatt

SEQ ID NO: 131544 - DNA, 15 bp, Homo sapiens
atttttcatcattat

SEQ ID NO: 131545 - DNA, 15 bp, Homo sapiens
tatttttcatcatta

SEQ ID NO: 131546 - DNA, 15 bp, Homo sapiens
atatttttcatcatt

SEQ ID NO: 131547 - DNA, 15 bp, Homo sapiens
aatatttttcatcat

SEQ ID NO: 131548 - DNA, 15 bp, Homo sapiens
aaatatttttcatca

SEQ ID NO: 131549 - DNA, 15 bp, Homo sapiens
aaaatatttttcatc

SEQ ID NO: 131550 - DNA, 15 bp, Homo sapiens
caaaatatttttcat

SEQ ID NO: 131551 - DNA, 15 bp, Homo sapiens
acaaaatatttttca

SEQ ID NO: 131552 - DNA, 15 bp, Homo sapiens
cacaaaatatttttc

SEQ ID NO: 131553 - DNA, 15 bp, Homo sapiens
ccacaaaatattttt

SEQ ID NO: 131554 - DNA, 15 bp, Homo sapiens
tccacaaaatatttt

SEQ ID NO: 131555 - DNA, 15 bp, Homo sapiens
ttccacaaaatattt

SEQ ID NO: 131556 - DNA, 15 bp, Homo sapiens
gttccacaaaatatt

SEQ ID NO: 131557 - DNA, 15 bp, Homo sapiens
tgttccacaaaatat

SEQ ID NO: 131558 - DNA, 15 bp, Homo sapiens
atgttccacaaaata

SEQ ID NO: 131559 - DNA, 15 bp, Homo sapiens
tatgttccacaaaat

SEQ ID NO: 131560 - DNA, 15 bp, Homo sapiens
atatgttccacaaaa

SEQ ID NO: 131561 - DNA, 15 bp, Homo sapiens
tatatgttccacaaa

SEQ ID NO: 131562 - DNA, 15 bp, Homo sapiens
atatatgttccacaa

SEQ ID NO: 131563 - DNA, 15 bp, Homo sapiens
aatatatgttccaca

SEQ ID NO: 131564 - DNA, 15 bp, Homo sapiens
taatatatgttccac

SEQ ID NO: 131565 - DNA, 15 bp, Homo sapiens
ttaatatatgttcca

SEQ ID NO: 131566 - DNA, 15 bp, Homo sapiens
cttaatatatgttcc

SEQ ID NO: 131567 - DNA, 15 bp, Homo sapiens
acttaatatatgttc

SEQ ID NO: 131568 - DNA, 15 bp, Homo sapiens
aacttaatatatgtt

SEQ ID NO: 131569 - DNA, 15 bp, Homo sapiens
aaacttaatatatgt

SEQ ID NO: 131570 - DNA, 15 bp, Homo sapiens
aaaacttaatatatg

SEQ ID NO: 131571 - DNA, 15 bp, Homo sapiens
gaaaacttaatatat

SEQ ID NO: 131572 - DNA, 15 bp, Homo sapiens
agaaaacttaatata

SEQ ID NO: 131573 - DNA, 15 bp, Homo sapiens
aagaaaacttaatat

SEQ ID NO: 131574 - DNA, 15 bp, Homo sapiens
aaagaaaacttaata

SEQ ID NO: 131575 - DNA, 15 bp, Homo sapiens
aaaagaaaacttaat

SEQ ID NO: 131576 - DNA, 15 bp, Homo sapiens
aaaaagaaaacttaa

SEQ ID NO: 131577 - DNA, 15 bp, Homo sapiens
taaaaagaaaactta

SEQ ID NO: 131578 - DNA, 15 bp, Homo sapiens
ttaaaaagaaaactt

SEQ ID NO: 131579 - DNA, 15 bp, Homo sapiens
tttaaaaagaaaact

SEQ ID NO: 131580 - DNA, 15 bp, Homo sapiens
ttttaaaaagaaaac

SEQ ID NO: 131581 - DNA, 15 bp, Homo sapiens
attttaaaaagaaaa

SEQ ID NO: 131582 - DNA, 15 bp, Homo sapiens
cattttaaaaagaaa

SEQ ID NO: 131583 - DNA, 15 bp, Homo sapiens
acattttaaaaagaa

SEQ ID NO: 131584 - DNA, 15 bp, Homo sapiens
cacattttaaaaaga

SEQ ID NO: 131585 - DNA, 15 bp, Homo sapiens
tcacattttaaaaag

SEQ ID NO: 131586 - DNA, 15 bp, Homo sapiens
gtcacattttaaaaa

SEQ ID NO: 131587 - DNA, 15 bp, Homo sapiens
tgtcacattttaaaa

SEQ ID NO: 131588 - DNA, 15 bp, Homo sapiens
ttgtcacattttaaa

SEQ ID NO: 131589 - DNA, 15 bp, Homo sapiens
attgtcacattttaa

SEQ ID NO: 131590 - DNA, 15 bp, Homo sapiens
tattgtcacatttta

SEQ ID NO: 131591 - DNA, 15 bp, Homo sapiens
atattgtcacatttt

SEQ ID NO: 131592 - DNA, 15 bp, Homo sapiens
gatattgtcacattt

SEQ ID NO: 131593 - DNA, 15 bp, Homo sapiens
agatattgtcacatt

SEQ ID NO: 131594 - DNA, 15 bp, Homo sapiens
tagatattgtcacat

SEQ ID NO: 131595 - DNA, 15 bp, Homo sapiens
ttagatattgtcaca

SEQ ID NO: 131596 - DNA, 15 bp, Homo sapiens
gttagatattgtcac

SEQ ID NO: 131597 - DNA, 15 bp, Homo sapiens
tgttagatattgtca

SEQ ID NO: 131598 - DNA, 15 bp, Homo sapiens
ttgttagatattgtc

SEQ ID NO: 131599 - DNA, 15 bp, Homo sapiens
cttgttagatattgt

SEQ ID NO: 131600 - DNA, 15 bp, Homo sapiens
gcttgttagatattg

SEQ ID NO: 131601 - DNA, 15 bp, Homo sapiens
agcttgttagatatt

SEQ ID NO: 131602 - DNA, 15 bp, Homo sapiens
aagcttgttagatat

SEQ ID NO: 131603 - DNA, 15 bp, Homo sapiens
gaagcttgttagata

SEQ ID NO: 131604 - DNA, 15 bp, Homo sapiens
ggaagcttgttagat

SEQ ID NO: 131605 - DNA, 15 bp, Homo sapiens
aggaagcttgttaga

SEQ ID NO: 131606 - DNA, 15 bp, Homo sapiens
aaggaagcttgttag

SEQ ID NO: 131607 - DNA, 15 bp, Homo sapiens
aaaggaagcttgtta

SEQ ID NO: 131608 - DNA, 15 bp, Homo sapiens
aaaaggaagcttgtt

SEQ ID NO: 131609 - DNA, 15 bp, Homo sapiens
aaaaaggaagcttgt

SEQ ID NO: 131610 - DNA, 15 bp, Homo sapiens
aaaaaaggaagcttg

SEQ ID NO: 131611 - DNA, 15 bp, Homo sapiens
taaaaaaggaagctt

SEQ ID NO: 131612 - DNA, 15 bp, Homo sapiens
gtaaaaaaggaagct

SEQ ID NO: 131613 - DNA, 15 bp, Homo sapiens
ggtaaaaaaggaagc

SEQ ID NO: 131614 - DNA, 15 bp, Homo sapiens
aggtaaaaaaggaag

SEQ ID NO: 131615 - DNA, 15 bp, Homo sapiens
taggtaaaaaaggaa

SEQ ID NO: 131616 - DNA, 15 bp, Homo sapiens
ttaggtaaaaaagga

SEQ ID NO: 131617 - DNA, 15 bp, Homo sapiens
tttaggtaaaaaagg

SEQ ID NO: 131618 - DNA, 15 bp, Homo sapiens
ttttaggtaaaaaag

SEQ ID NO: 131619 - DNA, 15 bp, Homo sapiens
tttttaggtaaaaaa

SEQ ID NO: 131620 - DNA, 15 bp, Homo sapiens
atttttaggtaaaaa

SEQ ID NO: 131621 - DNA, 15 bp, Homo sapiens
aatttttaggtaaaa

SEQ ID NO: 131622 - DNA, 15 bp, Homo sapiens
aaatttttaggtaaa

SEQ ID NO: 131623 - DNA, 15 bp, Homo sapiens
gaaatttttaggtaa

SEQ ID NO: 131624 - DNA, 15 bp, Homo sapiens
tgaaatttttaggta

SEQ ID NO: 131625 - DNA, 15 bp, Homo sapiens
ctgaaatttttaggt

SEQ ID NO: 131626 - DNA, 15 bp, Homo sapiens
actgaaatttttagg

SEQ ID NO: 131627 - DNA, 15 bp, Homo sapiens
cactgaaatttttag

SEQ ID NO: 131628 - DNA, 15 bp, Homo sapiens
ccactgaaattttta

SEQ ID NO: 131629 - DNA, 15 bp, Homo sapiens
accactgaaattttt

SEQ ID NO: 131630 - DNA, 15 bp, Homo sapiens
aaccactgaaatttt

SEQ ID NO: 131631 - DNA, 15 bp, Homo sapiens
aaaccactgaaattt

SEQ ID NO: 131632 - DNA, 15 bp, Homo sapiens
aaaaccactgaaatt

SEQ ID NO: 131633 - DNA, 15 bp, Homo sapiens
aaaaaccactgaaat

SEQ ID NO: 131634 - DNA, 15 bp, Homo sapiens
aaaaaaccactgaaa

SEQ ID NO: 131635 - DNA, 15 bp, Homo sapiens
aaaaaaaccactgaa

SEQ ID NO: 131636 - DNA, 15 bp, Homo sapiens
caaaaaaaccactga

SEQ ID NO: 131637 - DNA, 15 bp, Homo sapiens
ccaaaaaaaccactg

SEQ ID NO: 131638 - DNA, 15 bp, Homo sapiens
cccaaaaaaaccact

SEQ ID NO: 131639 - DNA, 15 bp, Homo sapiens
tcccaaaaaaaccac

SEQ ID NO: 131640 - DNA, 15 bp, Homo sapiens
ttcccaaaaaaacca

SEQ ID NO: 131641 - DNA, 15 bp, Homo sapiens
attcccaaaaaaacc

SEQ ID NO: 131642 - DNA, 15 bp, Homo sapiens
cattcccaaaaaaac

SEQ ID NO: 131643 - DNA, 15 bp, Homo sapiens
acattcccaaaaaaa

SEQ ID NO: 131644 - DNA, 15 bp, Homo sapiens
gacattcccaaaaaa

SEQ ID NO: 131645 - DNA, 15 bp, Homo sapiens
agacattcccaaaaa

SEQ ID NO: 131646 - DNA, 15 bp, Homo sapiens
gagacattcccaaaa

SEQ ID NO: 131647 - DNA, 15 bp, Homo sapiens
agagacattcccaaa

SEQ ID NO: 131648 - DNA, 15 bp, Homo sapiens
aagagacattcccaa

SEQ ID NO: 131649 - DNA, 15 bp, Homo sapiens
aaagagacattccca

SEQ ID NO: 131650 - DNA, 15 bp, Homo sapiens
aaaagagacattccc

SEQ ID NO: 131651 - DNA, 15 bp, Homo sapiens
caaaagagacattcc

SEQ ID NO: 131652 - DNA, 15 bp, Homo sapiens
acaaaagagacattc

SEQ ID NO: 131653 - DNA, 15 bp, Homo sapiens
tacaaaagagacatt

SEQ ID NO: 131654 - DNA, 15 bp, Homo sapiens
ttacaaaagagacat

SEQ ID NO: 131655 - DNA, 15 bp, Homo sapiens
tttacaaaagagaca

SEQ ID NO: 131656 - DNA, 15 bp, Homo sapiens
gtttacaaaagagac

SEQ ID NO: 131657 - DNA, 15 bp, Homo sapiens
tgtttacaaaagaga

SEQ ID NO: 131658 - DNA, 15 bp, Homo sapiens
ttgtttacaaaagag

SEQ ID NO: 131659 - DNA, 15 bp, Homo sapiens
attgtttacaaaaga

SEQ ID NO: 131660 - DNA, 15 bp, Homo sapiens
aattgtttacaaaag

SEQ ID NO: 131661 - DNA, 15 bp, Homo sapiens
aaattgtttacaaaa

SEQ ID NO: 131662 - DNA, 15 bp, Homo sapiens
caaattgtttacaaa

SEQ ID NO: 131663 - DNA, 15 bp, Homo sapiens
tcaaattgtttacaa

SEQ ID NO: 131664 - DNA, 15 bp, Homo sapiens
ctcaaattgtttaca

SEQ ID NO: 131665 - DNA, 15 bp, Homo sapiens
cctcaaattgtttac

SEQ ID NO: 131666 - DNA, 15 bp, Homo sapiens
tcctcaaattgttta

SEQ ID NO: 131667 - DNA, 15 bp, Homo sapiens
ctcctcaaattgttt

SEQ ID NO: 131668 - DNA, 15 bp, Homo sapiens
tctcctcaaattgtt

SEQ ID NO: 131669 - DNA, 15 bp, Homo sapiens
ctctcctcaaattgt

SEQ ID NO: 131670 - DNA, 15 bp, Homo sapiens
actctcctcaaattg

SEQ ID NO: 131671 - DNA, 15 bp, Homo sapiens
aactctcctcaaatt

SEQ ID NO: 131672 - DNA, 15 bp, Homo sapiens
taactctcctcaaat

SEQ ID NO: 131673 - DNA, 15 bp, Homo sapiens
ctaactctcctcaaa

SEQ ID NO: 131674 - DNA, 15 bp, Homo sapiens
tctaactctcctcaa

SEQ ID NO: 131675 - DNA, 15 bp, Homo sapiens
ttctaactctcctca

SEQ ID NO: 131676 - DNA, 15 bp, Homo sapiens
tttctaactctcctc

SEQ ID NO: 131677 - DNA, 15 bp, Homo sapiens
ttttctaactctcct

SEQ ID NO: 131678 - DNA, 15 bp, Homo sapiens
cttttctaactctcc

SEQ ID NO: 131679 - DNA, 15 bp, Homo sapiens
ccttttctaactctc

SEQ ID NO: 131680 - DNA, 15 bp, Homo sapiens
accttttctaactct

SEQ ID NO: 131681 - DNA, 15 bp, Homo sapiens
caccttttctaactc

SEQ ID NO: 131682 - DNA, 15 bp, Homo sapiens
ccaccttttctaact

SEQ ID NO: 131683 - DNA, 15 bp, Homo sapiens
tccaccttttctaac

SEQ ID NO: 131684 - DNA, 15 bp, Homo sapiens
ttccaccttttctaa

SEQ ID NO: 131685 - DNA, 15 bp, Homo sapiens
gttccaccttttcta

SEQ ID NO: 131686 - DNA, 15 bp, Homo sapiens
tgttccaccttttct

SEQ ID NO: 131687 - DNA, 15 bp, Homo sapiens
ctgttccaccttttc

SEQ ID NO: 131688 - DNA, 15 bp, Homo sapiens
actgttccacctttt

SEQ ID NO: 131689 - DNA, 15 bp, Homo sapiens
tactgttccaccttt

SEQ ID NO: 131690 - DNA, 15 bp, Homo sapiens
atactgttccacctt

SEQ ID NO: 131691 - DNA, 15 bp, Homo sapiens
tatactgttccacct

SEQ ID NO: 131692 - DNA, 15 bp, Homo sapiens
atatactgttccacc

SEQ ID NO: 131693 - DNA, 15 bp, Homo sapiens
aatatactgttccac

SEQ ID NO: 131694 - DNA, 15 bp, Homo sapiens
taatatactgttcca

SEQ ID NO: 131695 - DNA, 15 bp, Homo sapiens
ctaatatactgttcc

SEQ ID NO: 131696 - DNA, 15 bp, Homo sapiens
cctaatatactgttc

SEQ ID NO: 131697 - DNA, 15 bp, Homo sapiens
tcctaatatactgtt

SEQ ID NO: 131698 - DNA, 15 bp, Homo sapiens
atcctaatatactgt

SEQ ID NO: 131699 - DNA, 15 bp, Homo sapiens
catcctaatatactg

SEQ ID NO: 131700 - DNA, 15 bp, Homo sapiens
ccatcctaatatact

SEQ ID NO: 131701 - DNA, 15 bp, Homo sapiens
tccatcctaatatac

SEQ ID NO: 131702 - DNA, 15 bp, Homo sapiens
ctccatcctaatata

SEQ ID NO: 131703 - DNA, 15 bp, Homo sapiens
actccatcctaatat

SEQ ID NO: 131704 - DNA, 15 bp, Homo sapiens
tactccatcctaata

SEQ ID NO: 131705 - DNA, 15 bp, Homo sapiens
ctactccatcctaat

SEQ ID NO: 131706 - DNA, 15 bp, Homo sapiens
gctactccatcctaa

SEQ ID NO: 131707 - DNA, 15 bp, Homo sapiens
tgctactccatccta

SEQ ID NO: 131708 - DNA, 15 bp, Homo sapiens
ttgctactccatcct

SEQ ID NO: 131709 - DNA, 15 bp, Homo sapiens
cttgctactccatcc

SEQ ID NO: 131710 - DNA, 15 bp, Homo sapiens
ccttgctactccatc

SEQ ID NO: 131711 - DNA, 15 bp, Homo sapiens
tccttgctactccat

SEQ ID NO: 131712 - DNA, 15 bp, Homo sapiens
ctccttgctactcca

SEQ ID NO: 131713 - DNA, 15 bp, Homo sapiens
cctccttgctactcc

SEQ ID NO: 131714 - DNA, 15 bp, Homo sapiens
tcctccttgctactc

SEQ ID NO: 131715 - DNA, 15 bp, Homo sapiens
ctcctccttgctact

SEQ ID NO: 131716 - DNA, 15 bp, Homo sapiens
tctcctccttgctac

SEQ ID NO: 131717 - DNA, 15 bp, Homo sapiens
atctcctccttgcta

SEQ ID NO: 131718 - DNA, 15 bp, Homo sapiens
tatctcctccttgct

SEQ ID NO: 131719 - DNA, 15 bp, Homo sapiens
ttatctcctccttgc

SEQ ID NO: 131720 - DNA, 15 bp, Homo sapiens
cttatctcctccttg

SEQ ID NO: 131721 - DNA, 15 bp, Homo sapiens
tcttatctcctcctt

SEQ ID NO: 131722 - DNA, 15 bp, Homo sapiens
ttcttatctcctcct

SEQ ID NO: 131723 - DNA, 15 bp, Homo sapiens
gttcttatctcctcc

SEQ ID NO: 131724 - DNA, 15 bp, Homo sapiens
tgttcttatctcctc

SEQ ID NO: 131725 - DNA, 15 bp, Homo sapiens
ctgttcttatctcct

SEQ ID NO: 131726 - DNA, 15 bp, Homo sapiens
tctgttcttatctcc

SEQ ID NO: 131727 - DNA, 15 bp, Homo sapiens
ttctgttcttatctc

SEQ ID NO: 131728 - DNA, 15 bp, Homo sapiens
attctgttcttatct

SEQ ID NO: 131729 - DNA, 15 bp, Homo sapiens
cattctgttcttatc

SEQ ID NO: 131730 - DNA, 15 bp, Homo sapiens
acattctgttcttat

SEQ ID NO: 131731 - DNA, 15 bp, Homo sapiens
aacattctgttctta

SEQ ID NO: 131732 - DNA, 15 bp, Homo sapiens
taacattctgttctt

SEQ ID NO: 131733 - DNA, 15 bp, Homo sapiens
ttaacattctgttct

SEQ ID NO: 131734 - DNA, 15 bp, Homo sapiens
tttaacattctgttc

SEQ ID NO: 131735 - DNA, 15 bp, Homo sapiens
atttaacattctgtt

SEQ ID NO: 131736 - DNA, 15 bp, Homo sapiens
aatttaacattctgt

SEQ ID NO: 131737 - DNA, 15 bp, Homo sapiens
taatttaacattctg

SEQ ID NO: 131738 - DNA, 15 bp, Homo sapiens
ctaatttaacattct

SEQ ID NO: 131739 - DNA, 15 bp, Homo sapiens
gctaatttaacattc

SEQ ID NO: 131740 - DNA, 15 bp, Homo sapiens
tgctaatttaacatt

SEQ ID NO: 131741 - DNA, 15 bp, Homo sapiens
ctgctaatttaacat

SEQ ID NO: 131742 - DNA, 15 bp, Homo sapiens
actgctaatttaaca

SEQ ID NO: 131743 - DNA, 15 bp, Homo sapiens
cactgctaatttaac

SEQ ID NO: 131744 - DNA, 15 bp, Homo sapiens
acactgctaatttaa

SEQ ID NO: 131745 - DNA, 15 bp, Homo sapiens
tacactgctaattta

SEQ ID NO: 131746 - DNA, 15 bp, Homo sapiens
ttacactgctaattt

SEQ ID NO: 131747 - DNA, 15 bp, Homo sapiens
tttacactgctaatt

SEQ ID NO: 131748 - DNA, 15 bp, Homo sapiens
ttttacactgctaat

SEQ ID NO: 131749 - DNA, 15 bp, Homo sapiens
tttttacactgctaa

SEQ ID NO: 131750 - DNA, 15 bp, Homo sapiens
atttttacactgcta

SEQ ID NO: 131751 - DNA, 15 bp, Homo sapiens
tatttttacactgct

SEQ ID NO: 131752 - DNA, 15 bp, Homo sapiens
ttatttttacactgc

SEQ ID NO: 131753 - DNA, 15 bp, Homo sapiens
attatttttacactg

SEQ ID NO: 131754 - DNA, 15 bp, Homo sapiens
tattatttttacact

SEQ ID NO: 131755 - DNA, 15 bp, Homo sapiens
atattatttttacac

SEQ ID NO: 131756 - DNA, 15 bp, Homo sapiens
tatattatttttaca

SEQ ID NO: 131757 - DNA, 15 bp, Homo sapiens
atatattatttttac

SEQ ID NO: 131758 - DNA, 15 bp, Homo sapiens
catatattattttta

SEQ ID NO: 131759 - DNA, 15 bp, Homo sapiens
tcatatattattttt

SEQ ID NO: 131760 - DNA, 15 bp, Homo sapiens
gtcatatattatttt

SEQ ID NO: 131761 - DNA, 15 bp, Homo sapiens
ggtcatatattattt

SEQ ID NO: 131762 - DNA, 15 bp, Homo sapiens
gggtcatatattatt

SEQ ID NO: 131763 - DNA, 15 bp, Homo sapiens
cgggtcatatattat

SEQ ID NO: 131764 - DNA, 15 bp, Homo sapiens
ccgggtcatatatta

SEQ ID NO: 131765 - DNA, 15 bp, Homo sapiens
accgggtcatatatt

SEQ ID NO: 131766 - DNA, 15 bp, Homo sapiens
aaccgggtcatatat

SEQ ID NO: 131767 - DNA, 15 bp, Homo sapiens
taaccgggtcatata

SEQ ID NO: 131768 - DNA, 15 bp, Homo sapiens
ttaaccgggtcatat

SEQ ID NO: 131769 - DNA, 15 bp, Homo sapiens
cttaaccgggtcata

SEQ ID NO: 131770 - DNA, 15 bp, Homo sapiens
tcttaaccgggtcat

SEQ ID NO: 131771 - DNA, 15 bp, Homo sapiens
ctcttaaccgggtca

SEQ ID NO: 131772 - DNA, 15 bp, Homo sapiens
tctcttaaccgggtc

SEQ ID NO: 131773 - DNA, 15 bp, Homo sapiens
gtctcttaaccgggt

SEQ ID NO: 131774 - DNA, 15 bp, Homo sapiens
tgtctcttaaccggg

SEQ ID NO: 131775 - DNA, 15 bp, Homo sapiens
ctgtctcttaaccgg

SEQ ID NO: 131776 - DNA, 15 bp, Homo sapiens
actgtctcttaaccg

SEQ ID NO: 131777 - DNA, 15 bp, Homo sapiens
cactgtctcttaacc

SEQ ID NO: 131778 - DNA, 15 bp, Homo sapiens
tcactgtctcttaac

SEQ ID NO: 131779 - DNA, 15 bp, Homo sapiens
ctcactgtctcttaa

SEQ ID NO: 131780 - DNA, 15 bp, Homo sapiens
actcactgtctctta

SEQ ID NO: 131781 - DNA, 15 bp, Homo sapiens
tactcactgtctctt

SEQ ID NO: 131782 - DNA, 15 bp, Homo sapiens
gtactcactgtctct

SEQ ID NO: 131783 - DNA, 15 bp, Homo sapiens
ggtactcactgtctc

SEQ ID NO: 131784 - DNA, 15 bp, Homo sapiens
tggtactcactgtct

SEQ ID NO: 131785 - DNA, 15 bp, Homo sapiens
ctggtactcactgtc

SEQ ID NO: 131786 - DNA, 15 bp, Homo sapiens
tctggtactcactgt

SEQ ID NO: 131787 - DNA, 15 bp, Homo sapiens
ctctggtactcactg

SEQ ID NO: 131788 - DNA, 15 bp, Homo sapiens
tctctggtactcact

SEQ ID NO: 131789 - DNA, 15 bp, Homo sapiens
ctctctggtactcac

SEQ ID NO: 131790 - DNA, 15 bp, Homo sapiens
gctctctggtactca

SEQ ID NO: 131791 - DNA, 15 bp, Homo sapiens
ggctctctggtactc

SEQ ID NO: 131792 - DNA, 15 bp, Homo sapiens
gggctctctggtact

SEQ ID NO: 131793 - DNA, 15 bp, Homo sapiens
cgggctctctggtac

SEQ ID NO: 131794 - DNA, 15 bp, Homo sapiens
acgggctctctggta

SEQ ID NO: 131795 - DNA, 15 bp, Homo sapiens
aacgggctctctggt

SEQ ID NO: 131796 - DNA, 15 bp, Homo sapiens
aaacgggctctctgg

SEQ ID NO: 131797 - DNA, 15 bp, Homo sapiens
caaacgggctctctg

SEQ ID NO: 131798 - DNA, 15 bp, Homo sapiens
acaaacgggctctct

SEQ ID NO: 131799 - DNA, 15 bp, Homo sapiens
cacaaacgggctctc

SEQ ID NO: 131800 - DNA, 15 bp, Homo sapiens
gcacaaacgggctct

SEQ ID NO: 131801 - DNA, 15 bp, Homo sapiens
tgcacaaacgggctc

SEQ ID NO: 131802 - DNA, 15 bp, Homo sapiens
gtgcacaaacgggct

SEQ ID NO: 131803 - DNA, 15 bp, Homo sapiens
tgtgcacaaacgggc

SEQ ID NO: 131804 - DNA, 15 bp, Homo sapiens
ctgtgcacaaacggg

SEQ ID NO: 131805 - DNA, 15 bp, Homo sapiens
cctgtgcacaaacgg

SEQ ID NO: 131806 - DNA, 15 bp, Homo sapiens
tcctgtgcacaaacg

SEQ ID NO: 131807 - DNA, 15 bp, Homo sapiens
ctcctgtgcacaaac

SEQ ID NO: 131808 - DNA, 15 bp, Homo sapiens
actcctgtgcacaaa

SEQ ID NO: 131809 - DNA, 15 bp, Homo sapiens
cactcctgtgcacaa

SEQ ID NO: 131810 - DNA, 15 bp, Homo sapiens
gcactcctgtgcaca

SEQ ID NO: 131811 - DNA, 15 bp, Homo sapiens
tgcactcctgtgcac

SEQ ID NO: 131812 - DNA, 15 bp, Homo sapiens
ttgcactcctgtgca

SEQ ID NO: 131813 - DNA, 15 bp, Homo sapiens
tttgcactcctgtgc

SEQ ID NO: 131814 - DNA, 15 bp, Homo sapiens
ttttgcactcctgtg

SEQ ID NO: 131815 - DNA, 15 bp, Homo sapiens
tttttgcactcctgt

SEQ ID NO: 131816 - DNA, 15 bp, Homo sapiens
atttttgcactcctg

SEQ ID NO: 131817 - DNA, 15 bp, Homo sapiens
tatttttgcactcct

SEQ ID NO: 131818 - DNA, 15 bp, Homo sapiens
gtatttttgcactcc

SEQ ID NO: 131819 - DNA, 15 bp, Homo sapiens
tgtatttttgcactc

SEQ ID NO: 131820 - DNA, 15 bp, Homo sapiens
gtgtatttttgcact

SEQ ID NO: 131821 - DNA, 15 bp, Homo sapiens
tgtgtatttttgcac

SEQ ID NO: 131822 - DNA, 15 bp, Homo sapiens
gtgtgtatttttgca

SEQ ID NO: 131823 - DNA, 15 bp, Homo sapiens
tgtgtgtatttttgc

SEQ ID NO: 131824 - DNA, 15 bp, Homo sapiens
ctgtgtgtatttttg

SEQ ID NO: 131825 - DNA, 15 bp, Homo sapiens
tctgtgtgtattttt

SEQ ID NO: 131826 - DNA, 15 bp, Homo sapiens
ttctgtgtgtatttt

SEQ ID NO: 131827 - DNA, 15 bp, Homo sapiens
cttctgtgtgtattt

SEQ ID NO: 131828 - DNA, 15 bp, Homo sapiens
ccttctgtgtgtatt

SEQ ID NO: 131829 - DNA, 15 bp, Homo sapiens
gccttctgtgtgtat

SEQ ID NO: 131830 - DNA, 15 bp, Homo sapiens
tgccttctgtgtgta

SEQ ID NO: 131831 - DNA, 15 bp, Homo sapiens
atgccttctgtgtgt

SEQ ID NO: 131832 - DNA, 15 bp, Homo sapiens
catgccttctgtgtg

SEQ ID NO: 131833 - DNA, 15 bp, Homo sapiens
acatgccttctgtgt

SEQ ID NO: 131834 - DNA, 15 bp, Homo sapiens
cacatgccttctgtg

SEQ ID NO: 131835 - DNA, 15 bp, Homo sapiens
gcacatgccttctgt

SEQ ID NO: 131836 - DNA, 15 bp, Homo sapiens
agcacatgccttctg

SEQ ID NO: 131837 - DNA, 15 bp, Homo sapiens
gagcacatgccttct

SEQ ID NO: 131838 - DNA, 15 bp, Homo sapiens
tgagcacatgccttc

SEQ ID NO: 131839 - DNA, 15 bp, Homo sapiens
gtgagcacatgcctt

SEQ ID NO: 131840 - DNA, 15 bp, Homo sapiens
agtgagcacatgcct

SEQ ID NO: 131841 - DNA, 15 bp, Homo sapiens
gagtgagcacatgcc

SEQ ID NO: 131842 - DNA, 15 bp, Homo sapiens
ggagtgagcacatgc

SEQ ID NO: 131843 - DNA, 15 bp, Homo sapiens
gggagtgagcacatg

SEQ ID NO: 131844 - DNA, 15 bp, Homo sapiens
agggagtgagcacat

SEQ ID NO: 131845 - DNA, 15 bp, Homo sapiens
aagggagtgagcaca

SEQ ID NO: 131846 - DNA, 15 bp, Homo sapiens
gaagggagtgagcac

SEQ ID NO: 131847 - DNA, 15 bp, Homo sapiens
ggaagggagtgagca

SEQ ID NO: 131848 - DNA, 15 bp, Homo sapiens
aggaagggagtgagc

SEQ ID NO: 131849 - DNA, 15 bp, Homo sapiens
taggaagggagtgag

SEQ ID NO: 131850 - DNA, 15 bp, Homo sapiens
ctaggaagggagtga

SEQ ID NO: 131851 - DNA, 15 bp, Homo sapiens
actaggaagggagtg

SEQ ID NO: 131852 - DNA, 15 bp, Homo sapiens
aactaggaagggagt

SEQ ID NO: 131853 - DNA, 15 bp, Homo sapiens
taactaggaagggag

SEQ ID NO: 131854 - DNA, 15 bp, Homo sapiens
ataactaggaaggga

SEQ ID NO: 131855 - DNA, 15 bp, Homo sapiens
gataactaggaaggg

SEQ ID NO: 131856 - DNA, 15 bp, Homo sapiens
tgataactaggaagg

SEQ ID NO: 131857 - DNA, 15 bp, Homo sapiens
atgataactaggaag

SEQ ID NO: 131858 - DNA, 15 bp, Homo sapiens
aatgataactaggaa

SEQ ID NO: 131859 - DNA, 15 bp, Homo sapiens
aaatgataactagga

SEQ ID NO: 131860 - DNA, 15 bp, Homo sapiens
caaatgataactagg

SEQ ID NO: 131861 - DNA, 15 bp, Homo sapiens
acaaatgataactag

SEQ ID NO: 131862 - DNA, 15 bp, Homo sapiens
aacaaatgataacta

SEQ ID NO: 131863 - DNA, 15 bp, Homo sapiens
taacaaatgataact

SEQ ID NO: 131864 - DNA, 15 bp, Homo sapiens
ctaacaaatgataac

SEQ ID NO: 131865 - DNA, 15 bp, Homo sapiens
gctaacaaatgataa

SEQ ID NO: 131866 - DNA, 15 bp, Homo sapiens
tgctaacaaatgata

SEQ ID NO: 131867 - DNA, 15 bp, Homo sapiens
atgctaacaaatgat

SEQ ID NO: 131868 - DNA, 15 bp, Homo sapiens
catgctaacaaatga

SEQ ID NO: 131869 - DNA, 15 bp, Homo sapiens
tcatgctaacaaatg

SEQ ID NO: 131870 - DNA, 15 bp, Homo sapiens
ctcatgctaacaaat

SEQ ID NO: 131871 - DNA, 15 bp, Homo sapiens
gctcatgctaacaaa

SEQ ID NO: 131872 - DNA, 15 bp, Homo sapiens
agctcatgctaacaa

SEQ ID NO: 131873 - DNA, 15 bp, Homo sapiens
aagctcatgctaaca

SEQ ID NO: 131874 - DNA, 15 bp, Homo sapiens
taagctcatgctaac

SEQ ID NO: 131875 - DNA, 15 bp, Homo sapiens
ttaagctcatgctaa

SEQ ID NO: 131876 - DNA, 15 bp, Homo sapiens
cttaagctcatgcta

SEQ ID NO: 131877 - DNA, 15 bp, Homo sapiens
gcttaagctcatgct

SEQ ID NO: 131878 - DNA, 15 bp, Homo sapiens
agcttaagctcatgc

SEQ ID NO: 131879 - DNA, 15 bp, Homo sapiens
aagcttaagctcatg

SEQ ID NO: 131880 - DNA, 15 bp, Homo sapiens
gaagcttaagctcat

SEQ ID NO: 131881 - DNA, 15 bp, Homo sapiens
agaagcttaagctca

SEQ ID NO: 131882 - DNA, 15 bp, Homo sapiens
aagaagcttaagctc

SEQ ID NO: 131883 - DNA, 15 bp, Homo sapiens
taagaagcttaagct

SEQ ID NO: 131884 - DNA, 15 bp, Homo sapiens
ataagaagcttaagc

SEQ ID NO: 131885 - DNA, 15 bp, Homo sapiens
tataagaagcttaag

SEQ ID NO: 131886 - DNA, 15 bp, Homo sapiens
ttataagaagcttaa

SEQ ID NO: 131887 - DNA, 15 bp, Homo sapiens
cttataagaagctta

SEQ ID NO: 131888 - DNA, 15 bp, Homo sapiens
acttataagaagctt

SEQ ID NO: 131889 - DNA, 15 bp, Homo sapiens
aacttataagaagct

SEQ ID NO: 131890 - DNA, 15 bp, Homo sapiens
aaacttataagaagc

SEQ ID NO: 131891 - DNA, 15 bp, Homo sapiens
taaacttataagaag

SEQ ID NO: 131892 - DNA, 15 bp, Homo sapiens
ataaacttataagaa

SEQ ID NO: 131893 - DNA, 15 bp, Homo sapiens
aataaacttataaga

SEQ ID NO: 131894 - DNA, 15 bp, Homo sapiens
aaataaacttataag

SEQ ID NO: 131895 - DNA, 15 bp, Homo sapiens
aaaataaacttataa

SEQ ID NO: 131896 - DNA, 15 bp, Homo sapiens
aaaaataaacttata

SEQ ID NO: 131897 - DNA, 15 bp, Homo sapiens
aaaaaataaacttat

SEQ ID NO: 131898 - DNA, 15 bp, Homo sapiens
tgaaaaaataaactt

SEQ ID NO: 131899 - DNA, 15 bp, Homo sapiens
gtgaaaaaataaact

SEQ ID NO: 131900 - DNA, 15 bp, Homo sapiens
agtgaaaaaataaac

SEQ ID NO: 131901 - DNA, 15 bp, Homo sapiens
aagtgaaaaaataaa

SEQ ID NO: 131902 - DNA, 15 bp, Homo sapiens
taagtgaaaaaataa

SEQ ID NO: 131903 - DNA, 15 bp, Homo sapiens
ttaagtgaaaaaata

SEQ ID NO: 131904 - DNA, 15 bp, Homo sapiens
gttaagtgaaaaaat

SEQ ID NO: 131905 - DNA, 15 bp, Homo sapiens
tgttaagtgaaaaaa

SEQ ID NO: 131906 - DNA, 15 bp, Homo sapiens
ttgttaagtgaaaaa

SEQ ID NO: 131907 - DNA, 15 bp, Homo sapiens
tttgttaagtgaaaa

SEQ ID NO: 131908 - DNA, 15 bp, Homo sapiens
atttgttaagtgaaa

SEQ ID NO: 131909 - DNA, 15 bp, Homo sapiens
aatttgttaagtgaa

SEQ ID NO: 131910 - DNA, 15 bp, Homo sapiens
taatttgttaagtga

SEQ ID NO: 131911 - DNA, 15 bp, Homo sapiens
ctaatttgttaagtg

SEQ ID NO: 131912 - DNA, 15 bp, Homo sapiens
tctaatttgttaagt

SEQ ID NO: 131913 - DNA, 15 bp, Homo sapiens
ttctaatttgttaag

SEQ ID NO: 131914 - DNA, 15 bp, Homo sapiens
tttctaatttgttaa

SEQ ID NO: 131915 - DNA, 15 bp, Homo sapiens
ctttctaatttgtta

SEQ ID NO: 131916 - DNA, 15 bp, Homo sapiens
actttctaatttgtt

SEQ ID NO: 131917 - DNA, 15 bp, Homo sapiens
aactttctaatttgt

SEQ ID NO: 131918 - DNA, 15 bp, Homo sapiens
taactttctaatttg

SEQ ID NO: 131919 - DNA, 15 bp, Homo sapiens
gtaactttctaattt

SEQ ID NO: 131920 - DNA, 15 bp, Homo sapiens
tgtaactttctaatt

SEQ ID NO: 131921 - DNA, 15 bp, Homo sapiens
atgtaactttctaat

SEQ ID NO: 131922 - DNA, 15 bp, Homo sapiens
aatgtaactttctaa

SEQ ID NO: 131923 - DNA, 15 bp, Homo sapiens
aaatgtaactttcta

SEQ ID NO: 131924 - DNA, 15 bp, Homo sapiens
caaatgtaactttct

SEQ ID NO: 131925 - DNA, 15 bp, Homo sapiens
acaaatgtaactttc

SEQ ID NO: 131926 - DNA, 15 bp, Homo sapiens
tacaaatgtaacttt

SEQ ID NO: 131927 - DNA, 15 bp, Homo sapiens
ttacaaatgtaactt

SEQ ID NO: 131928 - DNA, 15 bp, Homo sapiens
attacaaatgtaact

SEQ ID NO: 131929 - DNA, 15 bp, Homo sapiens
tattacaaatgtaac

SEQ ID NO: 131930 - DNA, 15 bp, Homo sapiens
ttattacaaatgtaa

SEQ ID NO: 131931 - DNA, 15 bp, Homo sapiens
attattacaaatgta

SEQ ID NO: 131932 - DNA, 15 bp, Homo sapiens
tattattacaaatgt

SEQ ID NO: 131933 - DNA, 15 bp, Homo sapiens
gtattattacaaatg

SEQ ID NO: 131934 - DNA, 15 bp, Homo sapiens
ggtattattacaaat

SEQ ID NO: 131935 - DNA, 15 bp, Homo sapiens
tggtattattacaaa

SEQ ID NO: 131936 - DNA, 15 bp, Homo sapiens
ttggtattattacaa

SEQ ID NO: 131937 - DNA, 15 bp, Homo sapiens
tttggtattattaca

SEQ ID NO: 131938 - DNA, 15 bp, Homo sapiens
ttttggtattattac

SEQ ID NO: 131939 - DNA, 15 bp, Homo sapiens
tttttggtattatta

SEQ ID NO: 131940 - DNA, 15 bp, Homo sapiens
ctttttggtattatt

SEQ ID NO: 131941 - DNA, 15 bp, Homo sapiens
cctttttggtattat

SEQ ID NO: 131942 - DNA, 15 bp, Homo sapiens
acctttttggtatta

SEQ ID NO: 131943 - DNA, 15 bp, Homo sapiens
aacctttttggtatt

SEQ ID NO: 131944 - DNA, 15 bp, Homo sapiens
aaacctttttggtat

SEQ ID NO: 131945 - DNA, 15 bp, Homo sapiens
gaaacctttttggta

SEQ ID NO: 131946 - DNA, 15 bp, Homo sapiens
agaaacctttttggt

SEQ ID NO: 131947 - DNA, 15 bp, Homo sapiens
tagaaacctttttgg

SEQ ID NO: 131948 - DNA, 15 bp, Homo sapiens
ttagaaacctttttg

SEQ ID NO: 131949 - DNA, 15 bp, Homo sapiens
attagaaaccttttt

SEQ ID NO: 131950 - DNA, 15 bp, Homo sapiens
tattagaaacctttt

SEQ ID NO: 131951 - DNA, 15 bp, Homo sapiens
gtattagaaaccttt

SEQ ID NO: 131952 - DNA, 15 bp, Homo sapiens
tgtattagaaacctt

SEQ ID NO: 131953 - DNA, 15 bp, Homo sapiens
ctgtattagaaacct

SEQ ID NO: 131954 - DNA, 15 bp, Homo sapiens
aactgtattagaaac

SEQ ID NO: 131955 - DNA, 15 bp, Homo sapiens
gaactgtattagaaa

SEQ ID NO: 131956 - DNA, 15 bp, Homo sapiens
agaactgtattagaa

SEQ ID NO: 131957 - DNA, 15 bp, Homo sapiens
aagaactgtattaga

SEQ ID NO: 131958 - DNA, 15 bp, Homo sapiens
caagaactgtattag

SEQ ID NO: 131959 - DNA, 15 bp, Homo sapiens
tcaagaactgtatta

SEQ ID NO: 131960 - DNA, 15 bp, Homo sapiens
ttcaagaactgtatt

SEQ ID NO: 131961 - DNA, 15 bp, Homo sapiens
attcaagaactgtat

SEQ ID NO: 131962 - DNA, 15 bp, Homo sapiens
aattcaagaactgta

SEQ ID NO: 131963 - DNA, 15 bp, Homo sapiens
aaattcaagaactgt

SEQ ID NO: 131964 - DNA, 15 bp, Homo sapiens
aaaattcaagaactg

SEQ ID NO: 131965 - DNA, 15 bp, Homo sapiens
gaaaattcaagaact

SEQ ID NO: 131966 - DNA, 15 bp, Homo sapiens
ggaaaattcaagaac

SEQ ID NO: 131967 - DNA, 15 bp, Homo sapiens
gggaaaattcaagaa

SEQ ID NO: 131968 - DNA, 15 bp, Homo sapiens
agggaaaattcaaga

SEQ ID NO: 131969 - DNA, 15 bp, Homo sapiens
aagggaaaattcaag

SEQ ID NO: 131970 - DNA, 15 bp, Homo sapiens
taagggaaaattcaa

SEQ ID NO: 131971 - DNA, 15 bp, Homo sapiens
ataagggaaaattca

SEQ ID NO: 131972 - DNA, 15 bp, Homo sapiens
gataagggaaaattc

SEQ ID NO: 131973 - DNA, 15 bp, Homo sapiens
agataagggaaaatt

SEQ ID NO: 131974 - DNA, 15 bp, Homo sapiens
cagataagggaaaat

SEQ ID NO: 131975 - DNA, 15 bp, Homo sapiens
tcagataagggaaaa

SEQ ID NO: 131976 - DNA, 15 bp, Homo sapiens
gtcagataagggaaa

SEQ ID NO: 131977 - DNA, 15 bp, Homo sapiens
agtcagataagggaa

SEQ ID NO: 131978 - DNA, 15 bp, Homo sapiens
tagtcagataaggga

SEQ ID NO: 131979 - DNA, 15 bp, Homo sapiens
gtagtcagataaggg

SEQ ID NO: 131980 - DNA, 15 bp, Homo sapiens
ggtagtcagataagg

SEQ ID NO: 131981 - DNA, 15 bp, Homo sapiens
aggtagtcagataag

SEQ ID NO: 131982 - DNA, 15 bp, Homo sapiens
aaggtagtcagataa

SEQ ID NO: 131983 - DNA, 15 bp, Homo sapiens
gaaggtagtcagata

SEQ ID NO: 131984 - DNA, 15 bp, Homo sapiens
agaaggtagtcagat

SEQ ID NO: 131985 - DNA, 15 bp, Homo sapiens
tagaaggtagtcaga

SEQ ID NO: 131986 - DNA, 15 bp, Homo sapiens
ttagaaggtagtcag

SEQ ID NO: 131987 - DNA, 15 bp, Homo sapiens
gttagaaggtagtca

SEQ ID NO: 131988 - DNA, 15 bp, Homo sapiens
ggttagaaggtagtc

SEQ ID NO: 131989 - DNA, 15 bp, Homo sapiens
tggttagaaggtagt

SEQ ID NO: 131990 - DNA, 15 bp, Homo sapiens
gtggttagaaggtag

SEQ ID NO: 131991 - DNA, 15 bp, Homo sapiens
tgtggttagaaggta

SEQ ID NO: 131992 - DNA, 15 bp, Homo sapiens
gtgtggttagaaggt

SEQ ID NO: 131993 - DNA, 15 bp, Homo sapiens
ggtgtggttagaagg

SEQ ID NO: 131994 - DNA, 15 bp, Homo sapiens
aggtgtggttagaag

SEQ ID NO: 131995 - DNA, 15 bp, Homo sapiens
taggtgtggttagaa

SEQ ID NO: 131996 - DNA, 15 bp, Homo sapiens
ataggtgtggttaga

SEQ ID NO: 131997 - DNA, 15 bp, Homo sapiens
gataggtgtggttag

SEQ ID NO: 131998 - DNA, 15 bp, Homo sapiens
agataggtgtggtta

SEQ ID NO: 131999 - DNA, 15 bp, Homo sapiens
aagataggtgtggtt

SEQ ID NO: 132000 - DNA, 15 bp, Homo sapiens
aaagataggtgtggt

SEQ ID NO: 132001 - DNA, 15 bp, Homo sapiens
aaaagataggtgtgg

SEQ ID NO: 132002 - DNA, 15 bp, Homo sapiens
taaaagataggtgtg

SEQ ID NO: 132003 - DNA, 15 bp, Homo sapiens
ttaaaagataggtgt

SEQ ID NO: 132004 - DNA, 15 bp, Homo sapiens
gttaaaagataggtg

SEQ ID NO: 132005 - DNA, 15 bp, Homo sapiens
agttaaaagataggt

SEQ ID NO: 132006 - DNA, 15 bp, Homo sapiens
aagttaaaagatagg

SEQ ID NO: 132007 - DNA, 15 bp, Homo sapiens
gaagttaaaagatag

SEQ ID NO: 132008 - DNA, 15 bp, Homo sapiens
agaagttaaaagata

SEQ ID NO: 132009 - DNA, 15 bp, Homo sapiens
gagaagttaaaagat

SEQ ID NO: 132010 - DNA, 15 bp, Homo sapiens
ggagaagttaaaaga

SEQ ID NO: 132011 - DNA, 15 bp, Homo sapiens
tggagaagttaaaag

SEQ ID NO: 132012 - DNA, 15 bp, Homo sapiens
ctggagaagttaaaa

SEQ ID NO: 132013 - DNA, 15 bp, Homo sapiens
cctggagaagttaaa

SEQ ID NO: 132014 - DNA, 15 bp, Homo sapiens
tcctggagaagttaa

SEQ ID NO: 132015 - DNA, 15 bp, Homo sapiens
gtcctggagaagtta

SEQ ID NO: 132016 - DNA, 15 bp, Homo sapiens
agtcctggagaagtt

SEQ ID NO: 132017 - DNA, 15 bp, Homo sapiens
aagtcctggagaagt

SEQ ID NO: 132018 - DNA, 15 bp, Homo sapiens
taagtcctggagaag

SEQ ID NO: 132019 - DNA, 15 bp, Homo sapiens
ttaagtcctggagaa

SEQ ID NO: 132020 - DNA, 15 bp, Homo sapiens
gttaagtcctggaga

SEQ ID NO: 132021 - DNA, 15 bp, Homo sapiens
agttaagtcctggag

SEQ ID NO: 132022 - DNA, 15 bp, Homo sapiens
gagttaagtcctgga

SEQ ID NO: 132023 - DNA, 15 bp, Homo sapiens
tgagttaagtcctgg

SEQ ID NO: 132024 - DNA, 15 bp, Homo sapiens
ttgagttaagtcctg

SEQ ID NO: 132025 - DNA, 15 bp, Homo sapiens
cttgagttaagtcct

SEQ ID NO: 132026 - DNA, 15 bp, Homo sapiens
tcttgagttaagtcc

SEQ ID NO: 132027 - DNA, 15 bp, Homo sapiens
ttcttgagttaagtc

SEQ ID NO: 132028 - DNA, 15 bp, Homo sapiens
tttcttgagttaagt

SEQ ID NO: 132029 - DNA, 15 bp, Homo sapiens
atttcttgagttaag

SEQ ID NO: 132030 - DNA, 15 bp, Homo sapiens
catttcttgagttaa

SEQ ID NO: 132031 - DNA, 15 bp, Homo sapiens
ccatttcttgagtta

SEQ ID NO: 132032 - DNA, 15 bp, Homo sapiens
tccatttcttgagtt

SEQ ID NO: 132033 - DNA, 15 bp, Homo sapiens
ttccatttcttgagt

SEQ ID NO: 132034 - DNA, 15 bp, Homo sapiens
cttccatttcttgag

SEQ ID NO: 132035 - DNA, 15 bp, Homo sapiens
acttccatttcttga

SEQ ID NO: 132036 - DNA, 15 bp, Homo sapiens
tacttccatttcttg

SEQ ID NO: 132037 - DNA, 15 bp, Homo sapiens
gtacttccatttctt

SEQ ID NO: 132038 - DNA, 15 bp, Homo sapiens
tgtacttccatttct

SEQ ID NO: 132039 - DNA, 15 bp, Homo sapiens
atgtacttccatttc

SEQ ID NO: 132040 - DNA, 15 bp, Homo sapiens
catgtacttccattt

SEQ ID NO: 132041 - DNA, 15 bp, Homo sapiens
gcatgtacttccatt

SEQ ID NO: 132042 - DNA, 15 bp, Homo sapiens
agcatgtacttccat

SEQ ID NO: 132043 - DNA, 15 bp, Homo sapiens
cagcatgtacttcca

SEQ ID NO: 132044 - DNA, 15 bp, Homo sapiens
tcagcatgtacttcc

SEQ ID NO: 132045 - DNA, 15 bp, Homo sapiens
ttcagcatgtacttc

SEQ ID NO: 132046 - DNA, 15 bp, Homo sapiens
tttcagcatgtactt

SEQ ID NO: 132047 - DNA, 15 bp, Homo sapiens
ttttcagcatgtact

SEQ ID NO: 132048 - DNA, 15 bp, Homo sapiens
tttttcagcatgtac

SEQ ID NO: 132049 - DNA, 15 bp, Homo sapiens
gtttttcagcatgta

SEQ ID NO: 132050 - DNA, 15 bp, Homo sapiens
agtttttcagcatgt

SEQ ID NO: 132051 - DNA, 15 bp, Homo sapiens
gagtttttcagcatg

SEQ ID NO: 132052 - DNA, 15 bp, Homo sapiens
tgagtttttcagcat

SEQ ID NO: 132053 - DNA, 15 bp, Homo sapiens
ttgagtttttcagca

SEQ ID NO: 132054 - DNA, 15 bp, Homo sapiens
tttgagtttttcagc

SEQ ID NO: 132055 - DNA, 15 bp, Homo sapiens
atttgagtttttcag

SEQ ID NO: 132056 - DNA, 15 bp, Homo sapiens
catttgagtttttca

SEQ ID NO: 132057 - DNA, 15 bp, Homo sapiens
ccatttgagtttttc

SEQ ID NO: 132058 - DNA, 15 bp, Homo sapiens
gccatttgagttttt

SEQ ID NO: 132059 - DNA, 15 bp, Homo sapiens
agccatttgagtttt

SEQ ID NO: 132060 - DNA, 15 bp, Homo sapiens
cagccatttgagttt

SEQ ID NO: 132061 - DNA, 15 bp, Homo sapiens
tcagccatttgagtt

SEQ ID NO: 132062 - DNA, 15 bp, Homo sapiens
ttcagccatttgagt

SEQ ID NO: 132063 - DNA, 15 bp, Homo sapiens
attcagccatttgag

SEQ ID NO: 132064 - DNA, 15 bp, Homo sapiens
tattcagccatttga

SEQ ID NO: 132065 - DNA, 15 bp, Homo sapiens
ctattcagccatttg

SEQ ID NO: 132066 - DNA, 15 bp, Homo sapiens
tctattcagccattt

SEQ ID NO: 132067 - DNA, 15 bp, Homo sapiens
ttctattcagccatt

SEQ ID NO: 132068 - DNA, 15 bp, Homo sapiens
gttctattcagccat

SEQ ID NO: 132069 - DNA, 15 bp, Homo sapiens
agttctattcagcca

SEQ ID NO: 132070 - DNA, 15 bp, Homo sapiens
cagttctattcagcc

SEQ ID NO: 132071 - DNA, 15 bp, Homo sapiens
tcagttctattcagc

SEQ ID NO: 132072 - DNA, 15 bp, Homo sapiens
ttcagttctattcag

SEQ ID NO: 132073 - DNA, 15 bp, Homo sapiens
attcagttctattca

SEQ ID NO: 132074 - DNA, 15 bp, Homo sapiens
aattcagttctattc

SEQ ID NO: 132075 - DNA, 15 bp, Homo sapiens
caattcagttctatt

SEQ ID NO: 132076 - DNA, 15 bp, Homo sapiens
ccaattcagttctat

SEQ ID NO: 132077 - DNA, 15 bp, Homo sapiens
tccaattcagttcta

SEQ ID NO: 132078 - DNA, 15 bp, Homo sapiens
ctccaattcagttct

SEQ ID NO: 132079 - DNA, 15 bp, Homo sapiens
tctccaattcagttc

SEQ ID NO: 132080 - DNA, 15 bp, Homo sapiens
atctccaattcagtt

SEQ ID NO: 132081 - DNA, 15 bp, Homo sapiens
catctccaattcagt

SEQ ID NO: 132082 - DNA, 15 bp, Homo sapiens
gcatctccaattcag

SEQ ID NO: 132083 - DNA, 15 bp, Homo sapiens
agcatctccaattca

SEQ ID NO: 132084 - DNA, 15 bp, Homo sapiens
aagcatctccaattc

SEQ ID NO: 132085 - DNA, 15 bp, Homo sapiens
aaagcatctccaatt

SEQ ID NO: 132086 - DNA, 15 bp, Homo sapiens
gaaagcatctccaat

SEQ ID NO: 132087 - DNA, 15 bp, Homo sapiens
tgaaagcatctccaa

SEQ ID NO: 132088 - DNA, 15 bp, Homo sapiens
ctgaaagcatctcca

SEQ ID NO: 132089 - DNA, 15 bp, Homo sapiens
tctgaaagcatctcc

SEQ ID NO: 132090 - DNA, 15 bp, Homo sapiens
atctgaaagcatctc

SEQ ID NO: 132091 - DNA, 15 bp, Homo sapiens
tatctgaaagcatct

SEQ ID NO: 132092 - DNA, 15 bp, Homo sapiens
ttatctgaaagcatc

SEQ ID NO: 132093 - DNA, 15 bp, Homo sapiens
tttatctgaaagcat

SEQ ID NO: 132094 - DNA, 15 bp, Homo sapiens
ttttatctgaaagca

SEQ ID NO: 132095 - DNA, 15 bp, Homo sapiens
cttttatctgaaagc

SEQ ID NO: 132096 - DNA, 15 bp, Homo sapiens
acttttatctgaaag

SEQ ID NO: 132097 - DNA, 15 bp, Homo sapiens
gacttttatctgaaa

SEQ ID NO: 132098 - DNA, 15 bp, Homo sapiens
agacttttatctgaa

SEQ ID NO: 132099 - DNA, 15 bp, Homo sapiens
cagacttttatctga

SEQ ID NO: 132100 - DNA, 15 bp, Homo sapiens
tcagacttttatctg

SEQ ID NO: 132101 - DNA, 15 bp, Homo sapiens
ctcagacttttatct

SEQ ID NO: 132102 - DNA, 15 bp, Homo sapiens
actcagacttttatc

SEQ ID NO: 132103 - DNA, 15 bp, Homo sapiens
aactcagacttttat

SEQ ID NO: 132104 - DNA, 15 bp, Homo sapiens
aaactcagactttta

SEQ ID NO: 132105 - DNA, 15 bp, Homo sapiens
taaactcagactttt

SEQ ID NO: 132106 - DNA, 15 bp, Homo sapiens
gtaaactcagacttt

SEQ ID NO: 132107 - DNA, 15 bp, Homo sapiens
ggtaaactcagactt

SEQ ID NO: 132108 - DNA, 15 bp, Homo sapiens
aggtaaactcagact

SEQ ID NO: 132109 - DNA, 15 bp, Homo sapiens
caggtaaactcagac

SEQ ID NO: 132110 - DNA, 15 bp, Homo sapiens
tcaggtaaactcaga

SEQ ID NO: 132111 - DNA, 15 bp, Homo sapiens
ttcaggtaaactcag

SEQ ID NO: 132112 - DNA, 15 bp, Homo sapiens
tttcaggtaaactca

SEQ ID NO: 132113 - DNA, 15 bp, Homo sapiens
ctttcaggtaaactc

SEQ ID NO: 132114 - DNA, 15 bp, Homo sapiens
cctttcaggtaaact

SEQ ID NO: 132115 - DNA, 15 bp, Homo sapiens
ccctttcaggtaaac

SEQ ID NO: 132116 - DNA, 15 bp, Homo sapiens
tccctttcaggtaaa

SEQ ID NO: 132117 - DNA, 15 bp, Homo sapiens
atccctttcaggtaa

SEQ ID NO: 132118 - DNA, 15 bp, Homo sapiens
tatccctttcaggta

SEQ ID NO: 132119 - DNA, 15 bp, Homo sapiens
ttatccctttcaggt

SEQ ID NO: 132120 - DNA, 15 bp, Homo sapiens
tttatccctttcagg

SEQ ID NO: 132121 - DNA, 15 bp, Homo sapiens
ttttatccctttcag

SEQ ID NO: 132122 - DNA, 15 bp, Homo sapiens
attttatccctttca

SEQ ID NO: 132123 - DNA, 15 bp, Homo sapiens
aattttatccctttc

SEQ ID NO: 132124 - DNA, 15 bp, Homo sapiens
aaattttatcccttt

SEQ ID NO: 132125 - DNA, 15 bp, Homo sapiens
gaaattttatccctt

SEQ ID NO: 132126 - DNA, 15 bp, Homo sapiens
tgaaattttatccct

SEQ ID NO: 132127 - DNA, 15 bp, Homo sapiens
ctgaaattttatccc

SEQ ID NO: 132128 - DNA, 15 bp, Homo sapiens
tctgaaattttatcc

SEQ ID NO: 132129 - DNA, 15 bp, Homo sapiens
ttctgaaattttatc

SEQ ID NO: 132130 - DNA, 15 bp, Homo sapiens
tttctgaaattttat

SEQ ID NO: 132131 - DNA, 15 bp, Homo sapiens
ctttctgaaatttta

SEQ ID NO: 132132 - DNA, 15 bp, Homo sapiens
gctttctgaaatttt

SEQ ID NO: 132133 - DNA, 15 bp, Homo sapiens
agctttctgaaattt

SEQ ID NO: 132134 - DNA, 15 bp, Homo sapiens
aagctttctgaaatt

SEQ ID NO: 132135 - DNA, 15 bp, Homo sapiens
taagctttctgaaat

SEQ ID NO: 132136 - DNA, 15 bp, Homo sapiens
ttaagctttctgaaa

SEQ ID NO: 132137 - DNA, 15 bp, Homo sapiens
cttaagctttctgaa

SEQ ID NO: 132138 - DNA, 15 bp, Homo sapiens
ccttaagctttctga

SEQ ID NO: 132139 - DNA, 15 bp, Homo sapiens
tccttaagctttctg

SEQ ID NO: 132140 - DNA, 15 bp, Homo sapiens
gtccttaagctttct

SEQ ID NO: 132141 - DNA, 15 bp, Homo sapiens
agtccttaagctttc

SEQ ID NO: 132142 - DNA, 15 bp, Homo sapiens
cagtccttaagcttt

SEQ ID NO: 132143 - DNA, 15 bp, Homo sapiens
acagtccttaagctt

SEQ ID NO: 132144 - DNA, 15 bp, Homo sapiens
tacagtccttaagct

SEQ ID NO: 132145 - DNA, 15 bp, Homo sapiens
ttacagtccttaagc

SEQ ID NO: 132146 - DNA, 15 bp, Homo sapiens
tttacagtccttaag

SEQ ID NO: 132147 - DNA, 15 bp, Homo sapiens
atttacagtccttaa

SEQ ID NO: 132148 - DNA, 15 bp, Homo sapiens
tatttacagtcctta

SEQ ID NO: 132149 - DNA, 15 bp, Homo sapiens
atatttacagtcctt

SEQ ID NO: 132150 - DNA, 15 bp, Homo sapiens
catatttacagtcct

SEQ ID NO: 132151 - DNA, 15 bp, Homo sapiens
tcatatttacagtcc

SEQ ID NO: 132152 - DNA, 15 bp, Homo sapiens
gtcatatttacagtc

SEQ ID NO: 132153 - DNA, 15 bp, Homo sapiens
tgtcatatttacagt

SEQ ID NO: 132154 - DNA, 15 bp, Homo sapiens
atgtcatatttacag

SEQ ID NO: 132155 - DNA, 15 bp, Homo sapiens
catgtcatatttaca

SEQ ID NO: 132156 - DNA, 15 bp, Homo sapiens
ccatgtcatatttac

SEQ ID NO: 132157 - DNA, 15 bp, Homo sapiens
tccatgtcatattta

SEQ ID NO: 132158 - DNA, 15 bp, Homo sapiens
ttccatgtcatattt

SEQ ID NO: 132159 - DNA, 15 bp, Homo sapiens
attccatgtcatatt

SEQ ID NO: 132160 - DNA, 15 bp, Homo sapiens
tattccatgtcatat

SEQ ID NO: 132161 - DNA, 15 bp, Homo sapiens
ttattccatgtcata

SEQ ID NO: 132162 - DNA, 15 bp, Homo sapiens
cttattccatgtcat

SEQ ID NO: 132163 - DNA, 15 bp, Homo sapiens
ccttattccatgtca

SEQ ID NO: 132164 - DNA, 15 bp, Homo sapiens
accttattccatgtc

SEQ ID NO: 132165 - DNA, 15 bp, Homo sapiens
caccttattccatgt

SEQ ID NO: 132166 - DNA, 15 bp, Homo sapiens
acaccttattccatg

SEQ ID NO: 132167 - DNA, 15 bp, Homo sapiens
cacaccttattccat

SEQ ID NO: 132168 - DNA, 15 bp, Homo sapiens
acacaccttattcca

SEQ ID NO: 132169 - DNA, 15 bp, Homo sapiens
cacacaccttattcc

SEQ ID NO: 132170 - DNA, 15 bp, Homo sapiens
acacacaccttattc

SEQ ID NO: 132171 - DNA, 15 bp, Homo sapiens
tacacacaccttatt

SEQ ID NO: 132172 - DNA, 15 bp, Homo sapiens
ttacacacaccttat

SEQ ID NO: 132173 - DNA, 15 bp, Homo sapiens
tttacacacacctta

SEQ ID NO: 132174 - DNA, 15 bp, Homo sapiens
ctttacacacacctt

SEQ ID NO: 132175 - DNA, 15 bp, Homo sapiens
actttacacacacct

SEQ ID NO: 132176 - DNA, 15 bp, Homo sapiens
aactttacacacacc

SEQ ID NO: 132177 - DNA, 15 bp, Homo sapiens
taactttacacacac

SEQ ID NO: 132178 - DNA, 15 bp, Homo sapiens
gtaactttacacaca

SEQ ID NO: 132179 - DNA, 15 bp, Homo sapiens
agtaactttacacac

SEQ ID NO: 132180 - DNA, 15 bp, Homo sapiens
tagtaactttacaca

SEQ ID NO: 132181 - DNA, 15 bp, Homo sapiens
atagtaactttacac

SEQ ID NO: 132182 - DNA, 15 bp, Homo sapiens
gatagtaactttaca

SEQ ID NO: 132183 - DNA, 15 bp, Homo sapiens
tgatagtaactttac

SEQ ID NO: 132184 - DNA, 15 bp, Homo sapiens
gtgatagtaacttta

SEQ ID NO: 132185 - DNA, 15 bp, Homo sapiens
tgtgatagtaacttt

SEQ ID NO: 132186 - DNA, 15 bp, Homo sapiens
gtgtgatagtaactt

SEQ ID NO: 132187 - DNA, 15 bp, Homo sapiens
tgtgtgatagtaact

SEQ ID NO: 132188 - DNA, 15 bp, Homo sapiens
atgtgtgatagtaac

SEQ ID NO: 132189 - DNA, 15 bp, Homo sapiens
aatgtgtgatagtaa

SEQ ID NO: 132190 - DNA, 15 bp, Homo sapiens
aaatgtgtgatagta

SEQ ID NO: 132191 - DNA, 15 bp, Homo sapiens
gaaatgtgtgatagt

SEQ ID NO: 132192 - DNA, 15 bp, Homo sapiens
agaaatgtgtgatag

SEQ ID NO: 132193 - DNA, 15 bp, Homo sapiens
gagaaatgtgtgata

SEQ ID NO: 132194 - DNA, 15 bp, Homo sapiens
tgagaaatgtgtgat

SEQ ID NO: 132195 - DNA, 15 bp, Homo sapiens
atgagaaatgtgtga

SEQ ID NO: 132196 - DNA, 15 bp, Homo sapiens
tatgagaaatgtgtg

SEQ ID NO: 132197 - DNA, 15 bp, Homo sapiens
atatgagaaatgtgt

SEQ ID NO: 132198 - DNA, 15 bp, Homo sapiens
aaatatgagaaatgt

SEQ ID NO: 132199 - DNA, 15 bp, Homo sapiens
taaatatgagaaatg

SEQ ID NO: 132200 - DNA, 15 bp, Homo sapiens
ataaatatgagaaat

SEQ ID NO: 132201 - DNA, 15 bp, Homo sapiens
aataaatatgagaaa

SEQ ID NO: 132202 - DNA, 15 bp, Homo sapiens
caataaatatgagaa

SEQ ID NO: 132203 - DNA, 15 bp, Homo sapiens
tcaataaatatgaga

SEQ ID NO: 132204 - DNA, 15 bp, Homo sapiens
atcaataaatatgag

SEQ ID NO: 132205 - DNA, 15 bp, Homo sapiens
aatcaataaatatga

SEQ ID NO: 132206 - DNA, 15 bp, Homo sapiens
aaatcaataaatatg

SEQ ID NO: 132207 - DNA, 15 bp, Homo sapiens
aaaatcaataaatat

SEQ ID NO: 132208 - DNA, 15 bp, Homo sapiens
caaaatcaataaata

SEQ ID NO: 132209 - DNA, 15 bp, Homo sapiens
acaaaatcaataaat

SEQ ID NO: 132210 - DNA, 15 bp, Homo sapiens
aacaaaatcaataaa

SEQ ID NO: 132211 - DNA, 15 bp, Homo sapiens
caacaaaatcaataa

SEQ ID NO: 132212 - DNA, 15 bp, Homo sapiens
acaacaaaatcaata

SEQ ID NO: 132213 - DNA, 15 bp, Homo sapiens
gacaacaaaatcaat

SEQ ID NO: 132214 - DNA, 15 bp, Homo sapiens
tgacaacaaaatcaa

SEQ ID NO: 132215 - DNA, 15 bp, Homo sapiens
ctgacaacaaaatca

SEQ ID NO: 132216 - DNA, 15 bp, Homo sapiens
tctgacaacaaaatc

SEQ ID NO: 132217 - DNA, 15 bp, Homo sapiens
ctctgacaacaaaat

SEQ ID NO: 132218 - DNA, 15 bp, Homo sapiens
tctctgacaacaaaa

SEQ ID NO: 132219 - DNA, 15 bp, Homo sapiens
atctctgacaacaaa

SEQ ID NO: 132220 - DNA, 15 bp, Homo sapiens
catctctgacaacaa

SEQ ID NO: 132221 - DNA, 15 bp, Homo sapiens
acatctctgacaaca

SEQ ID NO: 132222 - DNA, 15 bp, Homo sapiens
cacatctctgacaac

SEQ ID NO: 132223 - DNA, 15 bp, Homo sapiens
ccacatctctgacaa

SEQ ID NO: 132224 - DNA, 15 bp, Homo sapiens
cccacatctctgaca

SEQ ID NO: 132225 - DNA, 15 bp, Homo sapiens
tcccacatctctgac

SEQ ID NO: 132226 - DNA, 15 bp, Homo sapiens
atcccacatctctga

SEQ ID NO: 132227 - DNA, 15 bp, Homo sapiens
gatcccacatctctg

SEQ ID NO: 132228 - DNA, 15 bp, Homo sapiens
tgatcccacatctct

SEQ ID NO: 132229 - DNA, 15 bp, Homo sapiens
atgatcccacatctc

SEQ ID NO: 132230 - DNA, 15 bp, Homo sapiens
catgatcccacatct

SEQ ID NO: 132231 - DNA, 15 bp, Homo sapiens
acatgatcccacatc

SEQ ID NO: 132232 - DNA, 15 bp, Homo sapiens
tacatgatcccacat

SEQ ID NO: 132233 - DNA, 15 bp, Homo sapiens
ttacatgatcccaca

SEQ ID NO: 132234 - DNA, 15 bp, Homo sapiens
gttacatgatcccac

SEQ ID NO: 132235 - DNA, 15 bp, Homo sapiens
agttacatgatccca

SEQ ID NO: 132236 - DNA, 15 bp, Homo sapiens
cagttacatgatccc

SEQ ID NO: 132237 - DNA, 15 bp, Homo sapiens
gcagttacatgatcc

SEQ ID NO: 132238 - DNA, 15 bp, Homo sapiens
agcagttacatgatc

SEQ ID NO: 132239 - DNA, 15 bp, Homo sapiens
aagcagttacatgat

SEQ ID NO: 132240 - DNA, 15 bp, Homo sapiens
aaagcagttacatga

SEQ ID NO: 132241 - DNA, 15 bp, Homo sapiens
taaagcagttacatg

SEQ ID NO: 132242 - DNA, 15 bp, Homo sapiens
gtaaagcagttacat

SEQ ID NO: 132243 - DNA, 15 bp, Homo sapiens
agtaaagcagttaca

SEQ ID NO: 132244 - DNA, 15 bp, Homo sapiens
aagtaaagcagttac

SEQ ID NO: 132245 - DNA, 15 bp, Homo sapiens
aaagtaaagcagtta

SEQ ID NO: 132246 - DNA, 15 bp, Homo sapiens
gaaagtaaagcagtt

SEQ ID NO: 132247 - DNA, 15 bp, Homo sapiens
tgaaagtaaagcagt

SEQ ID NO: 132248 - DNA, 15 bp, Homo sapiens
ttgaaagtaaagcag

SEQ ID NO: 132249 - DNA, 15 bp, Homo sapiens
cttgaaagtaaagca

SEQ ID NO: 132250 - DNA, 15 bp, Homo sapiens
acttgaaagtaaagc

SEQ ID NO: 132251 - DNA, 15 bp, Homo sapiens
tacttgaaagtaaag

SEQ ID NO: 132252 - DNA, 15 bp, Homo sapiens
atacttgaaagtaaa

SEQ ID NO: 132253 - DNA, 15 bp, Homo sapiens
catacttgaaagtaa

SEQ ID NO: 132254 - DNA, 15 bp, Homo sapiens
acatacttgaaagta

SEQ ID NO: 132255 - DNA, 15 bp, Homo sapiens
gacatacttgaaagt

SEQ ID NO: 132256 - DNA, 15 bp, Homo sapiens
ggacatacttgaaag

SEQ ID NO: 132257 - DNA, 15 bp, Homo sapiens
tggacatacttgaaa

SEQ ID NO: 132258 - DNA, 15 bp, Homo sapiens
ttggacatacttgaa

SEQ ID NO: 132259 - DNA, 15 bp, Homo sapiens
tttggacatacttga

SEQ ID NO: 132260 - DNA, 15 bp, Homo sapiens
atttggacatacttg

SEQ ID NO: 132261 - DNA, 15 bp, Homo sapiens
catttggacatactt

SEQ ID NO: 132262 - DNA, 15 bp, Homo sapiens
ccatttggacatact

SEQ ID NO: 132263 - DNA, 15 bp, Homo sapiens
cccatttggacatac

SEQ ID NO: 132264 - DNA, 15 bp, Homo sapiens
ccccatttggacata

SEQ ID NO: 132265 - DNA, 15 bp, Homo sapiens
gccccatttggacat

SEQ ID NO: 132266 - DNA, 15 bp, Homo sapiens
tgccccatttggaca

SEQ ID NO: 132267 - DNA, 15 bp, Homo sapiens
ttgccccatttggac

SEQ ID NO: 132268 - DNA, 15 bp, Homo sapiens
tttgccccatttgga

SEQ ID NO: 132269 - DNA, 15 bp, Homo sapiens
atttgccccatttgg

SEQ ID NO: 132270 - DNA, 15 bp, Homo sapiens
aatttgccccatttg

SEQ ID NO: 132271 - DNA, 15 bp, Homo sapiens
aaatttgccccattt

SEQ ID NO: 132272 - DNA, 15 bp, Homo sapiens
aaaatttgccccatt

SEQ ID NO: 132273 - DNA, 15 bp, Homo sapiens
taaaatttgccccat

SEQ ID NO: 132274 - DNA, 15 bp, Homo sapiens
gtaaaatttgcccca

SEQ ID NO: 132275 - DNA, 15 bp, Homo sapiens
agtaaaatttgcccc

SEQ ID NO: 132276 - DNA, 15 bp, Homo sapiens
tagtaaaatttgccc

SEQ ID NO: 132277 - DNA, 15 bp, Homo sapiens
ttagtaaaatttgcc

SEQ ID NO: 132278 - DNA, 15 bp, Homo sapiens
tttagtaaaatttgc

SEQ ID NO: 132279 - DNA, 15 bp, Homo sapiens
ctttagtaaaatttg

SEQ ID NO: 132280 - DNA, 15 bp, Homo sapiens
gctttagtaaaattt

SEQ ID NO: 132281 - DNA, 15 bp, Homo sapiens
agctttagtaaaatt

SEQ ID NO: 132282 - DNA, 15 bp, Homo sapiens
aagctttagtaaaat

SEQ ID NO: 132283 - DNA, 15 bp, Homo sapiens
taagctttagtaaaa

SEQ ID NO: 132284 - DNA, 15 bp, Homo sapiens
gtaagctttagtaaa

SEQ ID NO: 132285 - DNA, 15 bp, Homo sapiens
agtaagctttagtaa

SEQ ID NO: 132286 - DNA, 15 bp, Homo sapiens
tagtaagctttagta

SEQ ID NO: 132287 - DNA, 15 bp, Homo sapiens
ttagtaagctttagt

SEQ ID NO: 132288 - DNA, 15 bp, Homo sapiens
attagtaagctttag

SEQ ID NO: 132289 - DNA, 15 bp, Homo sapiens
cattagtaagcttta

SEQ ID NO: 132290 - DNA, 15 bp, Homo sapiens
acattagtaagcttt

SEQ ID NO: 132291 - DNA, 15 bp, Homo sapiens
aacattagtaagctt

SEQ ID NO: 132292 - DNA, 15 bp, Homo sapiens
aaacattagtaagct

SEQ ID NO: 132293 - DNA, 15 bp, Homo sapiens
taaacattagtaagc

SEQ ID NO: 132294 - DNA, 15 bp, Homo sapiens
ataaacattagtaag

SEQ ID NO: 132295 - DNA, 15 bp, Homo sapiens
tataaacattagtaa

SEQ ID NO: 132296 - DNA, 15 bp, Homo sapiens
atataaacattagta

SEQ ID NO: 132297 - DNA, 15 bp, Homo sapiens
aatataaacattagt

SEQ ID NO: 132298 - DNA, 15 bp, Homo sapiens
aaatataaacattag

SEQ ID NO: 132299 - DNA, 15 bp, Homo sapiens
aaaatataaacatta

SEQ ID NO: 132300 - DNA, 15 bp, Homo sapiens
aaaaatataaacatt

SEQ ID NO: 132301 - DNA, 15 bp, Homo sapiens
aaaaaatataaacat

SEQ ID NO: 132302 - DNA, 15 bp, Homo sapiens
taaaaaatataaaca

SEQ ID NO: 132303 - DNA, 15 bp, Homo sapiens
ataaaaaatataaac

SEQ ID NO: 132304 - DNA, 15 bp, Homo sapiens
gataaaaaatataaa

SEQ ID NO: 132305 - DNA, 15 bp, Homo sapiens
agataaaaaatataa

SEQ ID NO: 132306 - DNA, 15 bp, Homo sapiens
cagataaaaaatata

SEQ ID NO: 132307 - DNA, 15 bp, Homo sapiens
acagataaaaaatat

SEQ ID NO: 132308 - DNA, 15 bp, Homo sapiens
gacagataaaaaata

SEQ ID NO: 132309 - DNA, 15 bp, Homo sapiens
tgacagataaaaaat

SEQ ID NO: 132310 - DNA, 15 bp, Homo sapiens
atgacagataaaaaa

SEQ ID NO: 132311 - DNA, 15 bp, Homo sapiens
tatgacagataaaaa

SEQ ID NO: 132312 - DNA, 15 bp, Homo sapiens
ctatgacagataaaa

SEQ ID NO: 132313 - DNA, 15 bp, Homo sapiens
tctatgacagataaa

SEQ ID NO: 132314 - DNA, 15 bp, Homo sapiens
gtctatgacagataa

SEQ ID NO: 132315 - DNA, 15 bp, Homo sapiens
tgtctatgacagata

SEQ ID NO: 132316 - DNA, 15 bp, Homo sapiens
ctgtctatgacagat

SEQ ID NO: 132317 - DNA, 15 bp, Homo sapiens
tctgtctatgacaga

SEQ ID NO: 132318 - DNA, 15 bp, Homo sapiens
ctctgtctatgacag

SEQ ID NO: 132319 - DNA, 15 bp, Homo sapiens
cctctgtctatgaca

SEQ ID NO: 132320 - DNA, 15 bp, Homo sapiens
gcctctgtctatgac

SEQ ID NO: 132321 - DNA, 15 bp, Homo sapiens
tgcctctgtctatga

SEQ ID NO: 132322 - DNA, 15 bp, Homo sapiens
atgcctctgtctatg

SEQ ID NO: 132323 - DNA, 15 bp, Homo sapiens
tatgcctctgtctat

SEQ ID NO: 132324 - DNA, 15 bp, Homo sapiens
atatgcctctgtcta

SEQ ID NO: 132325 - DNA, 15 bp, Homo sapiens
tatatgcctctgtct

SEQ ID NO: 132326 - DNA, 15 bp, Homo sapiens
atatatgcctctgtc

SEQ ID NO: 132327 - DNA, 15 bp, Homo sapiens
aatatatgcctctgt

SEQ ID NO: 132328 - DNA, 15 bp, Homo sapiens
gaatatatgcctctg

SEQ ID NO: 132329 - DNA, 15 bp, Homo sapiens
agaatatatgcctct

SEQ ID NO: 132330 - DNA, 15 bp, Homo sapiens
tagaatatatgcctc

SEQ ID NO: 132331 - DNA, 15 bp, Homo sapiens
ctagaatatatgcct

SEQ ID NO: 132332 - DNA, 15 bp, Homo sapiens
tctagaatatatgcc

SEQ ID NO: 132333 - DNA, 15 bp, Homo sapiens
ttctagaatatatgc

SEQ ID NO: 132334 - DNA, 15 bp, Homo sapiens
cttctagaatatatg

SEQ ID NO: 132335 - DNA, 15 bp, Homo sapiens
tcttctagaatatat

SEQ ID NO: 132336 - DNA, 15 bp, Homo sapiens
ttcttctagaatata

SEQ ID NO: 132337 - DNA, 15 bp, Homo sapiens
attcttctagaatat

SEQ ID NO: 132338 - DNA, 15 bp, Homo sapiens
tattcttctagaata

SEQ ID NO: 132339 - DNA, 15 bp, Homo sapiens
gtattcttctagaat

SEQ ID NO: 132340 - DNA, 15 bp, Homo sapiens
agtattcttctagaa

SEQ ID NO: 132341 - DNA, 15 bp, Homo sapiens
aagtattcttctaga

SEQ ID NO: 132342 - DNA, 15 bp, Homo sapiens
aaagtattcttctag

SEQ ID NO: 132343 - DNA, 15 bp, Homo sapiens
aaaagtattcttcta

SEQ ID NO: 132344 - DNA, 15 bp, Homo sapiens
aaaaagtattcttct

SEQ ID NO: 132345 - DNA, 15 bp, Homo sapiens
taaaaagtattcttc

SEQ ID NO: 132346 - DNA, 15 bp, Homo sapiens
ataaaaagtattctt

SEQ ID NO: 132347 - DNA, 15 bp, Homo sapiens
aataaaaagtattct

SEQ ID NO: 132348 - DNA, 15 bp, Homo sapiens
aaataaaaagtattc

SEQ ID NO: 132349 - DNA, 15 bp, Homo sapiens
aaaataaaaagtatt

SEQ ID NO: 132350 - DNA, 15 bp, Homo sapiens
taaaataaaaagtat

SEQ ID NO: 132351 - DNA, 15 bp, Homo sapiens
ataaaataaaaagta

SEQ ID NO: 132352 - DNA, 15 bp, Homo sapiens
tataaaataaaaagt

SEQ ID NO: 132353 - DNA, 15 bp, Homo sapiens
gtataaaataaaaag

SEQ ID NO: 132354 - DNA, 15 bp, Homo sapiens
tgtataaaataaaaa

SEQ ID NO: 132355 - DNA, 15 bp, Homo sapiens
ctgtataaaataaaa

SEQ ID NO: 132356 - DNA, 15 bp, Homo sapiens
tctgtataaaataaa

SEQ ID NO: 132357 - DNA, 15 bp, Homo sapiens
ttctgtataaaataa

SEQ ID NO: 132358 - DNA, 15 bp, Homo sapiens
gttctgtataaaata

SEQ ID NO: 132359 - DNA, 15 bp, Homo sapiens
agttctgtataaaat

SEQ ID NO: 132360 - DNA, 15 bp, Homo sapiens
gagttctgtataaaa

SEQ ID NO: 132361 - DNA, 15 bp, Homo sapiens
agagttctgtataaa

SEQ ID NO: 132362 - DNA, 15 bp, Homo sapiens
aagagttctgtataa

SEQ ID NO: 132363 - DNA, 15 bp, Homo sapiens
aaagagttctgtata

SEQ ID NO: 132364 - DNA, 15 bp, Homo sapiens
caaagagttctgtat

SEQ ID NO: 132365 - DNA, 15 bp, Homo sapiens
ccaaagagttctgta

SEQ ID NO: 132366 - DNA, 15 bp, Homo sapiens
gccaaagagttctgt

SEQ ID NO: 132367 - DNA, 15 bp, Homo sapiens
ggccaaagagttctg

SEQ ID NO: 132368 - DNA, 15 bp, Homo sapiens
aggccaaagagttct

SEQ ID NO: 132369 - DNA, 15 bp, Homo sapiens
taggccaaagagttc

SEQ ID NO: 132370 - DNA, 15 bp, Homo sapiens
ctaggccaaagagtt

SEQ ID NO: 132371 - DNA, 15 bp, Homo sapiens
cctaggccaaagagt

SEQ ID NO: 132372 - DNA, 15 bp, Homo sapiens
ccctaggccaaagag

SEQ ID NO: 132373 - DNA, 15 bp, Homo sapiens
cccctaggccaaaga

SEQ ID NO: 132374 - DNA, 15 bp, Homo sapiens
tcccctaggccaaag

SEQ ID NO: 132375 - DNA, 15 bp, Homo sapiens
atcccctaggccaaa

SEQ ID NO: 132376 - DNA, 15 bp, Homo sapiens
aatcccctaggccaa

SEQ ID NO: 132377 - DNA, 15 bp, Homo sapiens
aaatcccctaggcca

SEQ ID NO: 132378 - DNA, 15 bp, Homo sapiens
taaatcccctaggcc

SEQ ID NO: 132379 - DNA, 15 bp, Homo sapiens
ataaatcccctaggc

SEQ ID NO: 132380 - DNA, 15 bp, Homo sapiens
tataaatcccctagg

SEQ ID NO: 132381 - DNA, 15 bp, Homo sapiens
gtataaatcccctag

SEQ ID NO: 132382 - DNA, 15 bp, Homo sapiens
tgtataaatccccta

SEQ ID NO: 132383 - DNA, 15 bp, Homo sapiens
atgtataaatcccct

SEQ ID NO: 132384 - DNA, 15 bp, Homo sapiens
aatgtataaatcccc

SEQ ID NO: 132385 - DNA, 15 bp, Homo sapiens
taatgtataaatccc

SEQ ID NO: 132386 - DNA, 15 bp, Homo sapiens
ataatgtataaatcc

SEQ ID NO: 132387 - DNA, 15 bp, Homo sapiens
tataatgtataaatc

SEQ ID NO: 132388 - DNA, 15 bp, Homo sapiens
atataatgtataaat

SEQ ID NO: 132389 - DNA, 15 bp, Homo sapiens
tatataatgtataaa

SEQ ID NO: 132390 - DNA, 15 bp, Homo sapiens
gtatataatgtataa

SEQ ID NO: 132391 - DNA, 15 bp, Homo sapiens
agtatataatgtata

SEQ ID NO: 132392 - DNA, 15 bp, Homo sapiens
tagtatataatgtat

SEQ ID NO: 132393 - DNA, 15 bp, Homo sapiens
gtagtatataatgta

SEQ ID NO: 132394 - DNA, 15 bp, Homo sapiens
tgtagtatataatgt

SEQ ID NO: 132395 - DNA, 15 bp, Homo sapiens
aaatctgaccttggc

SEQ ID NO: 132396 - DNA, 15 bp, Homo sapiens
gaaatctgaccttgg

SEQ ID NO: 132397 - DNA, 15 bp, Homo sapiens
agaaatctgaccttg

SEQ ID NO: 132398 - DNA, 15 bp, Homo sapiens
gagaaatctgacctt

SEQ ID NO: 132399 - DNA, 15 bp, Homo sapiens
agagaaatctgacct

SEQ ID NO: 132400 - DNA, 15 bp, Homo sapiens
cagagaaatctgacc

SEQ ID NO: 132401 - DNA, 15 bp, Homo sapiens
gcagagaaatctgac

SEQ ID NO: 132402 - DNA, 15 bp, Homo sapiens
ggcagagaaatctga

SEQ ID NO: 132403 - DNA, 15 bp, Homo sapiens
tggcagagaaatctg

SEQ ID NO: 132404 - DNA, 15 bp, Homo sapiens
gtggcagagaaatct

SEQ ID NO: 132405 - DNA, 15 bp, Homo sapiens
ggtggcagagaaatc

SEQ ID NO: 132406 - DNA, 15 bp, Homo sapiens
aggtggcagagaaat

SEQ ID NO: 132407 - DNA, 15 bp, Homo sapiens
taggtggcagagaaa

SEQ ID NO: 132408 - DNA, 15 bp, Homo sapiens
gtaggtggcagagaa

SEQ ID NO: 132409 - DNA, 15 bp, Homo sapiens
tgtaggtggcagaga

SEQ ID NO: 132410 - DNA, 15 bp, Homo sapiens
gtgtaggtggcagag

SEQ ID NO: 132411 - DNA, 15 bp, Homo sapiens
tgtgtaggtggcaga

SEQ ID NO: 132412 - DNA, 15 bp, Homo sapiens
atgtgtaggtggcag

SEQ ID NO: 132413 - DNA, 15 bp, Homo sapiens
aatgtgtaggtggca

SEQ ID NO: 132414 - DNA, 15 bp, Homo sapiens
caatgtgtaggtggc

SEQ ID NO: 132415 - DNA, 15 bp, Homo sapiens
acaatgtgtaggtgg

SEQ ID NO: 132416 - DNA, 15 bp, Homo sapiens
cacaatgtgtaggtg

SEQ ID NO: 132417 - DNA, 15 bp, Homo sapiens
tcacaatgtgtaggt

SEQ ID NO: 132418 - DNA, 15 bp, Homo sapiens
gtcacaatgtgtagg

SEQ ID NO: 132419 - DNA, 15 bp, Homo sapiens
agtcacaatgtgtag

SEQ ID NO: 132420 - DNA, 15 bp, Homo sapiens
gagtcacaatgtgta

SEQ ID NO: 132421 - DNA, 15 bp, Homo sapiens
agagtcacaatgtgt

SEQ ID NO: 132422 - DNA, 15 bp, Homo sapiens
aagagtcacaatgtg

SEQ ID NO: 132423 - DNA, 15 bp, Homo sapiens
gaagagtcacaatgt

SEQ ID NO: 132424 - DNA, 15 bp, Homo sapiens
agaagagtcacaatg

SEQ ID NO: 132425 - DNA, 15 bp, Homo sapiens
gagaagagtcacaat

SEQ ID NO: 132426 - DNA, 15 bp, Homo sapiens
agagaagagtcacaa

SEQ ID NO: 132427 - DNA, 15 bp, Homo sapiens
aagagaagagtcaca

SEQ ID NO: 132428 - DNA, 15 bp, Homo sapiens
gaagagaagagtcac

SEQ ID NO: 132429 - DNA, 15 bp, Homo sapiens
agaagagaagagtca

SEQ ID NO: 132430 - DNA, 15 bp, Homo sapiens
cagaagagaagagtc

SEQ ID NO: 132431 - DNA, 15 bp, Homo sapiens
acagaagagaagagt

SEQ ID NO: 132432 - DNA, 15 bp, Homo sapiens
aacagaagagaagag

SEQ ID NO: 132433 - DNA, 15 bp, Homo sapiens
caacagaagagaaga

SEQ ID NO: 132434 - DNA, 15 bp, Homo sapiens
ccaacagaagagaag

SEQ ID NO: 132435 - DNA, 15 bp, Homo sapiens
accaacagaagagaa

SEQ ID NO: 132436 - DNA, 15 bp, Homo sapiens
gaccaacagaagaga

SEQ ID NO: 132437 - DNA, 15 bp, Homo sapiens
agaccaacagaagag

SEQ ID NO: 132438 - DNA, 15 bp, Homo sapiens
gagaccaacagaaga

SEQ ID NO: 132439 - DNA, 15 bp, Homo sapiens
agagaccaacagaag

SEQ ID NO: 132440 - DNA, 15 bp, Homo sapiens
aagagaccaacagaa

SEQ ID NO: 132441 - DNA, 15 bp, Homo sapiens
aaagagaccaacaga

SEQ ID NO: 132442 - DNA, 15 bp, Homo sapiens
taaagagaccaacag

SEQ ID NO: 132443 - DNA, 15 bp, Homo sapiens
ttaaagagaccaaca

SEQ ID NO: 132444 - DNA, 15 bp, Homo sapiens
tttaaagagaccaac

SEQ ID NO: 132445 - DNA, 15 bp, Homo sapiens
atttaaagagaccaa

SEQ ID NO: 132446 - DNA, 15 bp, Homo sapiens
catttaaagagacca

SEQ ID NO: 132447 - DNA, 15 bp, Homo sapiens
acatttaaagagacc

SEQ ID NO: 132448 - DNA, 15 bp, Homo sapiens
gacatttaaagagac

SEQ ID NO: 132449 - DNA, 15 bp, Homo sapiens
agacatttaaagaga

SEQ ID NO: 132450 - DNA, 15 bp, Homo sapiens
gagacatttaaagag

SEQ ID NO: 132451 - DNA, 15 bp, Homo sapiens
tgagacatttaaaga

SEQ ID NO: 132452 - DNA, 15 bp, Homo sapiens
ctgagacatttaaag

SEQ ID NO: 132453 - DNA, 15 bp, Homo sapiens
actgagacatttaaa

SEQ ID NO: 132454 - DNA, 15 bp, Homo sapiens
gactgagacatttaa

SEQ ID NO: 132455 - DNA, 15 bp, Homo sapiens
agactgagacattta

SEQ ID NO: 132456 - DNA, 15 bp, Homo sapiens
tagactgagacattt

SEQ ID NO: 132457 - DNA, 15 bp, Homo sapiens
atagactgagacatt

SEQ ID NO: 132458 - DNA, 15 bp, Homo sapiens
tatagactgagacat

SEQ ID NO: 132459 - DNA, 15 bp, Homo sapiens
ttatagactgagaca

SEQ ID NO: 132460 - DNA, 15 bp, Homo sapiens
attatagactgagac

SEQ ID NO: 132461 - DNA, 15 bp, Homo sapiens
tattatagactgaga

SEQ ID NO: 132462 - DNA, 15 bp, Homo sapiens
atattatagactgag

SEQ ID NO: 132463 - DNA, 15 bp, Homo sapiens
tatattatagactga

SEQ ID NO: 132464 - DNA, 15 bp, Homo sapiens
gtatattatagactg

SEQ ID NO: 132465 - DNA, 15 bp, Homo sapiens
agtatattatagact

SEQ ID NO: 132466 - DNA, 15 bp, Homo sapiens
cagtatattatagac

SEQ ID NO: 132467 - DNA, 15 bp, Homo sapiens
tcagtatattataga

SEQ ID NO: 132468 - DNA, 15 bp, Homo sapiens
ctcagtatattatag

SEQ ID NO: 132469 - DNA, 15 bp, Homo sapiens
actcagtatattata

SEQ ID NO: 132470 - DNA, 15 bp, Homo sapiens
aactcagtatattat

SEQ ID NO: 132471 - DNA, 15 bp, Homo sapiens
taactcagtatatta

SEQ ID NO: 132472 - DNA, 15 bp, Homo sapiens
ttaactcagtatatt

SEQ ID NO: 132473 - DNA, 15 bp, Homo sapiens
attaactcagtatat

SEQ ID NO: 132474 - DNA, 15 bp, Homo sapiens
tattaactcagtata

SEQ ID NO: 132475 - DNA, 15 bp, Homo sapiens
ttattaactcagtat

SEQ ID NO: 132476 - DNA, 15 bp, Homo sapiens
attattaactcagta

SEQ ID NO: 132477 - DNA, 15 bp, Homo sapiens
aattattaactcagt

SEQ ID NO: 132478 - DNA, 15 bp, Homo sapiens
taattattaactcag

SEQ ID NO: 132479 - DNA, 15 bp, Homo sapiens
ataattattaactca

SEQ ID NO: 132480 - DNA, 15 bp, Homo sapiens
aataattattaactc

SEQ ID NO: 132481 - DNA, 15 bp, Homo sapiens
taataattattaact

SEQ ID NO: 132482 - DNA, 15 bp, Homo sapiens
ctaataattattaac

SEQ ID NO: 132483 - DNA, 15 bp, Homo sapiens
gctaataattattaa

SEQ ID NO: 132484 - DNA, 15 bp, Homo sapiens
agctaataattatta

SEQ ID NO: 132485 - DNA, 15 bp, Homo sapiens
tagctaataattatt

SEQ ID NO: 132486 - DNA, 15 bp, Homo sapiens
ttagctaataattat

SEQ ID NO: 132487 - DNA, 15 bp, Homo sapiens
tttagctaataatta

SEQ ID NO: 132488 - DNA, 15 bp, Homo sapiens
atttagctaataatt

SEQ ID NO: 132489 - DNA, 15 bp, Homo sapiens
tatttagctaataat

SEQ ID NO: 132490 - DNA, 15 bp, Homo sapiens
ttatttagctaataa

SEQ ID NO: 132491 - DNA, 15 bp, Homo sapiens
attatttagctaata

SEQ ID NO: 132492 - DNA, 15 bp, Homo sapiens
tattatttagctaat

SEQ ID NO: 132493 - DNA, 15 bp, Homo sapiens
atattatttagctaa

SEQ ID NO: 132494 - DNA, 15 bp, Homo sapiens
tatattatttagcta

SEQ ID NO: 132495 - DNA, 15 bp, Homo sapiens
ttatattatttagct

SEQ ID NO: 132496 - DNA, 15 bp, Homo sapiens
gttatattatttagc

SEQ ID NO: 132497 - DNA, 15 bp, Homo sapiens
agttatattatttag

SEQ ID NO: 132498 - DNA, 15 bp, Homo sapiens
aagttatattattta

SEQ ID NO: 132499 - DNA, 15 bp, Homo sapiens
taagttatattattt

SEQ ID NO: 132500 - DNA, 15 bp, Homo sapiens
ttaagttatattatt

SEQ ID NO: 132501 - DNA, 15 bp, Homo sapiens
attaagttatattat

SEQ ID NO: 132502 - DNA, 15 bp, Homo sapiens
tattaagttatatta

SEQ ID NO: 132503 - DNA, 15 bp, Homo sapiens
atattaagttatatt

SEQ ID NO: 132504 - DNA, 15 bp, Homo sapiens
gatattaagttatat

SEQ ID NO: 132505 - DNA, 15 bp, Homo sapiens
agatattaagttata

SEQ ID NO: 132506 - DNA, 15 bp, Homo sapiens
cagatattaagttat

SEQ ID NO: 132507 - DNA, 15 bp, Homo sapiens
ccagatattaagtta

SEQ ID NO: 132508 - DNA, 15 bp, Homo sapiens
cccagatattaagtt

SEQ ID NO: 132509 - DNA, 15 bp, Homo sapiens
tcccagatattaagt

SEQ ID NO: 132510 - DNA, 15 bp, Homo sapiens
ctcccagatattaag

SEQ ID NO: 132511 - DNA, 15 bp, Homo sapiens
cctcccagatattaa

SEQ ID NO: 132512 - DNA, 15 bp, Homo sapiens
ccctcccagatatta

SEQ ID NO: 132513 - DNA, 15 bp, Homo sapiens
gccctcccagatatt

SEQ ID NO: 132514 - DNA, 15 bp, Homo sapiens
tgccctcccagatat

SEQ ID NO: 132515 - DNA, 15 bp, Homo sapiens
atgccctcccagata

SEQ ID NO: 132516 - DNA, 15 bp, Homo sapiens
tatgccctcccagat

SEQ ID NO: 132517 - DNA, 15 bp, Homo sapiens
atatgccctcccaga

SEQ ID NO: 132518 - DNA, 15 bp, Homo sapiens
aatatgccctcccag

SEQ ID NO: 132519 - DNA, 15 bp, Homo sapiens
gaatatgccctccca

SEQ ID NO: 132520 - DNA, 15 bp, Homo sapiens
ggaatatgccctccc

SEQ ID NO: 132521 - DNA, 15 bp, Homo sapiens
aggaatatgccctcc

SEQ ID NO: 132522 - DNA, 15 bp, Homo sapiens
gaggaatatgccctc

SEQ ID NO: 132523 - DNA, 15 bp, Homo sapiens
agaggaatatgccct

SEQ ID NO: 132524 - DNA, 15 bp, Homo sapiens
tagaggaatatgccc

SEQ ID NO: 132525 - DNA, 15 bp, Homo sapiens
atagaggaatatgcc

SEQ ID NO: 132526 - DNA, 15 bp, Homo sapiens
gatagaggaatatgc

SEQ ID NO: 132527 - DNA, 15 bp, Homo sapiens
tgatagaggaatatg

SEQ ID NO: 132528 - DNA, 15 bp, Homo sapiens
ttgatagaggaatat

SEQ ID NO: 132529 - DNA, 15 bp, Homo sapiens
tttgatagaggaata

SEQ ID NO: 132530 - DNA, 15 bp, Homo sapiens
ttttgatagaggaat

SEQ ID NO: 132531 - DNA, 15 bp, Homo sapiens
tttttgatagaggaa

SEQ ID NO: 132532 - DNA, 15 bp, Homo sapiens
ttttttgatagagga

SEQ ID NO: 132533 - DNA, 15 bp, Homo sapiens
attttttgatagagg

SEQ ID NO: 132534 - DNA, 15 bp, Homo sapiens
tattttttgatagag

SEQ ID NO: 132535 - DNA, 15 bp, Homo sapiens
ttattttttgataga

SEQ ID NO: 132536 - DNA, 15 bp, Homo sapiens
attattttttgatag

SEQ ID NO: 132537 - DNA, 15 bp, Homo sapiens
aattattttttgata

SEQ ID NO: 132538 - DNA, 15 bp, Homo sapiens
aaattattttttgat

SEQ ID NO: 132539 - DNA, 15 bp, Homo sapiens
caaattattttttga

SEQ ID NO: 132540 - DNA, 15 bp, Homo sapiens
tcaaattattttttg

SEQ ID NO: 132541 - DNA, 15 bp, Homo sapiens
gtcaaattatttttt

SEQ ID NO: 132542 - DNA, 15 bp, Homo sapiens
agtcaaattattttt

SEQ ID NO: 132543 - DNA, 15 bp, Homo sapiens
cagtcaaattatttt

SEQ ID NO: 132544 - DNA, 15 bp, Homo sapiens
acagtcaaattattt

SEQ ID NO: 132545 - DNA, 15 bp, Homo sapiens
aacagtcaaattatt

SEQ ID NO: 132546 - DNA, 15 bp, Homo sapiens
aaacagtcaaattat

SEQ ID NO: 132547 - DNA, 15 bp, Homo sapiens
aaaacagtcaaatta

SEQ ID NO: 132548 - DNA, 15 bp, Homo sapiens
aaaaacagtcaaatt

SEQ ID NO: 132549 - DNA, 15 bp, Homo sapiens
aaaaaacagtcaaat

SEQ ID NO: 132550 - DNA, 15 bp, Homo sapiens
caaaaaacagtcaaa

SEQ ID NO: 132551 - DNA, 15 bp, Homo sapiens
acaaaaaacagtcaa

SEQ ID NO: 132552 - DNA, 15 bp, Homo sapiens
gacaaaaaacagtca

SEQ ID NO: 132553 - DNA, 15 bp, Homo sapiens
ggacaaaaaacagtc

SEQ ID NO: 132554 - DNA, 15 bp, Homo sapiens
aggacaaaaaacagt

SEQ ID NO: 132555 - DNA, 15 bp, Homo sapiens
aaggacaaaaaacag

SEQ ID NO: 132556 - DNA, 15 bp, Homo sapiens
aaaggacaaaaaaca

SEQ ID NO: 132557 - DNA, 15 bp, Homo sapiens
aaaaggacaaaaaac

SEQ ID NO: 132558 - DNA, 15 bp, Homo sapiens
gaaaaggacaaaaaa

SEQ ID NO: 132559 - DNA, 15 bp, Homo sapiens
agaaaaggacaaaaa

SEQ ID NO: 132560 - DNA, 15 bp, Homo sapiens
gagaaaaggacaaaa

SEQ ID NO: 132561 - DNA, 15 bp, Homo sapiens
agagaaaaggacaaa

SEQ ID NO: 132562 - DNA, 15 bp, Homo sapiens
aagagaaaaggacaa

SEQ ID NO: 132563 - DNA, 15 bp, Homo sapiens
gaagagaaaaggaca

SEQ ID NO: 132564 - DNA, 15 bp, Homo sapiens
tgaagagaaaaggac

SEQ ID NO: 132565 - DNA, 15 bp, Homo sapiens
ttgaagagaaaagga

SEQ ID NO: 132566 - DNA, 15 bp, Homo sapiens
attgaagagaaaagg

SEQ ID NO: 132567 - DNA, 15 bp, Homo sapiens
tattgaagagaaaag

SEQ ID NO: 132568 - DNA, 15 bp, Homo sapiens
atattgaagagaaaa

SEQ ID NO: 132569 - DNA, 15 bp, Homo sapiens
aatattgaagagaaa

SEQ ID NO: 132570 - DNA, 15 bp, Homo sapiens
taatattgaagagaa

SEQ ID NO: 132571 - DNA, 15 bp, Homo sapiens
ttaatattgaagaga

SEQ ID NO: 132572 - DNA, 15 bp, Homo sapiens
attaatattgaagag

SEQ ID NO: 132573 - DNA, 15 bp, Homo sapiens
aattaatattgaaga

SEQ ID NO: 132574 - DNA, 15 bp, Homo sapiens
aaattaatattgaag

SEQ ID NO: 132575 - DNA, 15 bp, Homo sapiens
aaaattaatattgaa

SEQ ID NO: 132576 - DNA, 15 bp, Homo sapiens
taaaattaatattga

SEQ ID NO: 132577 - DNA, 15 bp, Homo sapiens
ataaaattaatattg

SEQ ID NO: 132578 - DNA, 15 bp, Homo sapiens
tataaaattaatatt

SEQ ID NO: 132579 - DNA, 15 bp, Homo sapiens
ttataaaattaatat

SEQ ID NO: 132580 - DNA, 15 bp, Homo sapiens
gttataaaattaata

SEQ ID NO: 132581 - DNA, 15 bp, Homo sapiens
ggttataaaattaat

SEQ ID NO: 132582 - DNA, 15 bp, Homo sapiens
tggttataaaattaa

SEQ ID NO: 132583 - DNA, 15 bp, Homo sapiens
ctggttataaaatta

SEQ ID NO: 132584 - DNA, 15 bp, Homo sapiens
tctggttataaaatt

SEQ ID NO: 132585 - DNA, 15 bp, Homo sapiens
ttctggttataaaat

SEQ ID NO: 132586 - DNA, 15 bp, Homo sapiens
tttctggttataaaa

SEQ ID NO: 132587 - DNA, 15 bp, Homo sapiens
atttctggttataaa

SEQ ID NO: 132588 - DNA, 15 bp, Homo sapiens
aatttctggttataa

SEQ ID NO: 132589 - DNA, 15 bp, Homo sapiens
aaatttctggttata

SEQ ID NO: 132590 - DNA, 15 bp, Homo sapiens
caaatttctggttat

SEQ ID NO: 132591 - DNA, 15 bp, Homo sapiens
tcaaatttctggtta

SEQ ID NO: 132592 - DNA, 15 bp, Homo sapiens
ttcaaatttctggtt

SEQ ID NO: 132593 - DNA, 15 bp, Homo sapiens
attcaaatttctggt

SEQ ID NO: 132594 - DNA, 15 bp, Homo sapiens
aattcaaatttctgg

SEQ ID NO: 132595 - DNA, 15 bp, Homo sapiens
taattcaaatttctg

SEQ ID NO: 132596 - DNA, 15 bp, Homo sapiens
ttaattcaaatttct

SEQ ID NO: 132597 - DNA, 15 bp, Homo sapiens
attaattcaaatttc

SEQ ID NO: 132598 - DNA, 15 bp, Homo sapiens
cattaattcaaattt

SEQ ID NO: 132599 - DNA, 15 bp, Homo sapiens
tcattaattcaaatt

SEQ ID NO: 132600 - DNA, 15 bp, Homo sapiens
atcattaattcaaat

SEQ ID NO: 132601 - DNA, 15 bp, Homo sapiens
aatcattaattcaaa

SEQ ID NO: 132602 - DNA, 15 bp, Homo sapiens
aaatcattaattcaa

SEQ ID NO: 132603 - DNA, 15 bp, Homo sapiens
aaaatcattaattca

SEQ ID NO: 132604 - DNA, 15 bp, Homo sapiens
caaaatcattaattc

SEQ ID NO: 132605 - DNA, 15 bp, Homo sapiens
acaaaatcattaatt

SEQ ID NO: 132606 - DNA, 15 bp, Homo sapiens
aacaaaatcattaat

SEQ ID NO: 132607 - DNA, 15 bp, Homo sapiens
taacaaaatcattaa

SEQ ID NO: 132608 - DNA, 15 bp, Homo sapiens
gtaacaaaatcatta

SEQ ID NO: 132609 - DNA, 15 bp, Homo sapiens
tgtaacaaaatcatt

SEQ ID NO: 132610 - DNA, 15 bp, Homo sapiens
atgtaacaaaatcat

SEQ ID NO: 132611 - DNA, 15 bp, Homo sapiens
aatgtaacaaaatca

SEQ ID NO: 132612 - DNA, 15 bp, Homo sapiens
gaatgtaacaaaatc

SEQ ID NO: 132613 - DNA, 15 bp, Homo sapiens
tgaatgtaacaaaat

SEQ ID NO: 132614 - DNA, 15 bp, Homo sapiens
ttgaatgtaacaaaa

SEQ ID NO: 132615 - DNA, 15 bp, Homo sapiens
cttgaatgtaacaaa

SEQ ID NO: 132616 - DNA, 15 bp, Homo sapiens
gcttgaatgtaacaa

SEQ ID NO: 132617 - DNA, 15 bp, Homo sapiens
ggcttgaatgtaaca

SEQ ID NO: 132618 - DNA, 15 bp, Homo sapiens
aggcttgaatgtaac

SEQ ID NO: 132619 - DNA, 15 bp, Homo sapiens
caggcttgaatgtaa

SEQ ID NO: 132620 - DNA, 15 bp, Homo sapiens
acaggcttgaatgta

SEQ ID NO: 132621 - DNA, 15 bp, Homo sapiens
aacaggcttgaatgt

SEQ ID NO: 132622 - DNA, 15 bp, Homo sapiens
caacaggcttgaatg

SEQ ID NO: 132623 - DNA, 15 bp, Homo sapiens
ccaacaggcttgaat

SEQ ID NO: 132624 - DNA, 15 bp, Homo sapiens
cccaacaggcttgaa

SEQ ID NO: 132625 - DNA, 15 bp, Homo sapiens
tcccaacaggcttga

SEQ ID NO: 132626 - DNA, 15 bp, Homo sapiens
atcccaacaggcttg

SEQ ID NO: 132627 - DNA, 15 bp, Homo sapiens
aatcccaacaggctt

SEQ ID NO: 132628 - DNA, 15 bp, Homo sapiens
aaatcccaacaggct

SEQ ID NO: 132629 - DNA, 15 bp, Homo sapiens
aaaatcccaacaggc

SEQ ID NO: 132630 - DNA, 15 bp, Homo sapiens
aaaaatcccaacagg

SEQ ID NO: 132631 - DNA, 15 bp, Homo sapiens
taaaaatcccaacag

SEQ ID NO: 132632 - DNA, 15 bp, Homo sapiens
ataaaaatcccaaca

SEQ ID NO: 132633 - DNA, 15 bp, Homo sapiens
aataaaaatcccaac

SEQ ID NO: 132634 - DNA, 15 bp, Homo sapiens
taataaaaatcccaa

SEQ ID NO: 132635 - DNA, 15 bp, Homo sapiens
ctaataaaaatccca

SEQ ID NO: 132636 - DNA, 15 bp, Homo sapiens
cctaataaaaatccc

SEQ ID NO: 132637 - DNA, 15 bp, Homo sapiens
tcctaataaaaatcc

SEQ ID NO: 132638 - DNA, 15 bp, Homo sapiens
atcctaataaaaatc

SEQ ID NO: 132639 - DNA, 15 bp, Homo sapiens
aatcctaataaaaat

SEQ ID NO: 132640 - DNA, 15 bp, Homo sapiens
caatcctaataaaaa

SEQ ID NO: 132641 - DNA, 15 bp, Homo sapiens
acaatcctaataaaa

SEQ ID NO: 132642 - DNA, 15 bp, Homo sapiens
cacaatcctaataaa

SEQ ID NO: 132643 - DNA, 15 bp, Homo sapiens
gcacaatcctaataa

SEQ ID NO: 132644 - DNA, 15 bp, Homo sapiens
agcacaatcctaata

SEQ ID NO: 132645 - DNA, 15 bp, Homo sapiens
cagcacaatcctaat

SEQ ID NO: 132646 - DNA, 15 bp, Homo sapiens
tcagcacaatcctaa

SEQ ID NO: 132647 - DNA, 15 bp, Homo sapiens
ttcagcacaatccta

SEQ ID NO: 132648 - DNA, 15 bp, Homo sapiens
attcagcacaatcct

SEQ ID NO: 132649 - DNA, 15 bp, Homo sapiens
aattcagcacaatcc

SEQ ID NO: 132650 - DNA, 15 bp, Homo sapiens
aaattcagcacaatc

SEQ ID NO: 132651 - DNA, 15 bp, Homo sapiens
taaattcagcacaat

SEQ ID NO: 132652 - DNA, 15 bp, Homo sapiens
gtaaattcagcacaa

SEQ ID NO: 132653 - DNA, 15 bp, Homo sapiens
tgtaaattcagcaca

SEQ ID NO: 132654 - DNA, 15 bp, Homo sapiens
ctgtaaattcagcac

SEQ ID NO: 132655 - DNA, 15 bp, Homo sapiens
tctgtaaattcagca

SEQ ID NO: 132656 - DNA, 15 bp, Homo sapiens
atctgtaaattcagc

SEQ ID NO: 132657 - DNA, 15 bp, Homo sapiens
aatctgtaaattcag

SEQ ID NO: 132658 - DNA, 15 bp, Homo sapiens
caatctgtaaattca

SEQ ID NO: 132659 - DNA, 15 bp, Homo sapiens
ccaatctgtaaattc

SEQ ID NO: 132660 - DNA, 15 bp, Homo sapiens
gccaatctgtaaatt

SEQ ID NO: 132661 - DNA, 15 bp, Homo sapiens
agccaatctgtaaat

SEQ ID NO: 132662 - DNA, 15 bp, Homo sapiens
tagccaatctgtaaa

SEQ ID NO: 132663 - DNA, 15 bp, Homo sapiens
atagccaatctgtaa

SEQ ID NO: 132664 - DNA, 15 bp, Homo sapiens
tatagccaatctgta

SEQ ID NO: 132665 - DNA, 15 bp, Homo sapiens
gtatagccaatctgt

SEQ ID NO: 132666 - DNA, 15 bp, Homo sapiens
tgtatagccaatctg

SEQ ID NO: 132667 - DNA, 15 bp, Homo sapiens
atgtatagccaatct

SEQ ID NO: 132668 - DNA, 15 bp, Homo sapiens
aatgtatagccaatc

SEQ ID NO: 132669 - DNA, 15 bp, Homo sapiens
aaatgtatagccaat

SEQ ID NO: 132670 - DNA, 15 bp, Homo sapiens
aaaatgtatagccaa

SEQ ID NO: 132671 - DNA, 15 bp, Homo sapiens
taaaatgtatagcca

SEQ ID NO: 132672 - DNA, 15 bp, Homo sapiens
ctaaaatgtatagcc

SEQ ID NO: 132673 - DNA, 15 bp, Homo sapiens
tctaaaatgtatagc

SEQ ID NO: 132674 - DNA, 15 bp, Homo sapiens
ttctaaaatgtatag

SEQ ID NO: 132675 - DNA, 15 bp, Homo sapiens
tttctaaaatgtata

SEQ ID NO: 132676 - DNA, 15 bp, Homo sapiens
ttttctaaaatgtat

SEQ ID NO: 132677 - DNA, 15 bp, Homo sapiens
attttctaaaatgta

SEQ ID NO: 132678 - DNA, 15 bp, Homo sapiens
aattttctaaaatgt

SEQ ID NO: 132679 - DNA, 15 bp, Homo sapiens
taattttctaaaatg

SEQ ID NO: 132680 - DNA, 15 bp, Homo sapiens
ataattttctaaaat

SEQ ID NO: 132681 - DNA, 15 bp, Homo sapiens
aataattttctaaaa

SEQ ID NO: 132682 - DNA, 15 bp, Homo sapiens
aaataattttctaaa

SEQ ID NO: 132683 - DNA, 15 bp, Homo sapiens
taaataattttctaa

SEQ ID NO: 132684 - DNA, 15 bp, Homo sapiens
ttaaataattttcta

SEQ ID NO: 132685 - DNA, 15 bp, Homo sapiens
cttaaataattttct

SEQ ID NO: 132686 - DNA, 15 bp, Homo sapiens
gcttaaataattttc

SEQ ID NO: 132687 - DNA, 15 bp, Homo sapiens
ggcttaaataatttt

SEQ ID NO: 132688 - DNA, 15 bp, Homo sapiens
aggcttaaataattt

SEQ ID NO: 132689 - DNA, 15 bp, Homo sapiens
gaggcttaaataatt

SEQ ID NO: 132690 - DNA, 15 bp, Homo sapiens
tgaggcttaaataat

SEQ ID NO: 132691 - DNA, 15 bp, Homo sapiens
atgaggcttaaataa

SEQ ID NO: 132692 - DNA, 15 bp, Homo sapiens
gatgaggcttaaata

SEQ ID NO: 132693 - DNA, 15 bp, Homo sapiens
agatgaggcttaaat

SEQ ID NO: 132694 - DNA, 15 bp, Homo sapiens
tagatgaggcttaaa

SEQ ID NO: 132695 - DNA, 15 bp, Homo sapiens
ttagatgaggcttaa

SEQ ID NO: 132696 - DNA, 15 bp, Homo sapiens
attagatgaggctta

SEQ ID NO: 132697 - DNA, 15 bp, Homo sapiens
tattagatgaggctt

SEQ ID NO: 132698 - DNA, 15 bp, Homo sapiens
atattagatgaggct

SEQ ID NO: 132699 - DNA, 15 bp, Homo sapiens
tatattagatgaggc

SEQ ID NO: 132700 - DNA, 15 bp, Homo sapiens
atatattagatgagg

SEQ ID NO: 132701 - DNA, 15 bp, Homo sapiens
gatatattagatgag

SEQ ID NO: 132702 - DNA, 15 bp, Homo sapiens
tgatatattagatga

SEQ ID NO: 132703 - DNA, 15 bp, Homo sapiens
atgatatattagatg

SEQ ID NO: 132704 - DNA, 15 bp, Homo sapiens
tatgatatattagat

SEQ ID NO: 132705 - DNA, 15 bp, Homo sapiens
gtatgatatattaga

SEQ ID NO: 132706 - DNA, 15 bp, Homo sapiens
ggtatgatatattag

SEQ ID NO: 132707 - DNA, 15 bp, Homo sapiens
aggtatgatatatta

SEQ ID NO: 132708 - DNA, 15 bp, Homo sapiens
caggtatgatatatt

SEQ ID NO: 132709 - DNA, 15 bp, Homo sapiens
tcaggtatgatatat

SEQ ID NO: 132710 - DNA, 15 bp, Homo sapiens
ttcaggtatgatata

SEQ ID NO: 132711 - DNA, 15 bp, Homo sapiens
cttcaggtatgatat

SEQ ID NO: 132712 - DNA, 15 bp, Homo sapiens
acttcaggtatgata

SEQ ID NO: 132713 - DNA, 15 bp, Homo sapiens
tacttcaggtatgat

SEQ ID NO: 132714 - DNA, 15 bp, Homo sapiens
ctacttcaggtatga

SEQ ID NO: 132715 - DNA, 15 bp, Homo sapiens
cctacttcaggtatg

SEQ ID NO: 132716 - DNA, 15 bp, Homo sapiens
acctacttcaggtat

SEQ ID NO: 132717 - DNA, 15 bp, Homo sapiens
aacctacttcaggta

SEQ ID NO: 132718 - DNA, 15 bp, Homo sapiens
taacctacttcaggt

SEQ ID NO: 132719 - DNA, 15 bp, Homo sapiens
gtaacctacttcagg

SEQ ID NO: 132720 - DNA, 15 bp, Homo sapiens
tgtaacctacttcag

SEQ ID NO: 132721 - DNA, 15 bp, Homo sapiens
ctgtaacctacttca

SEQ ID NO: 132722 - DNA, 15 bp, Homo sapiens
tctgtaacctacttc

SEQ ID NO: 132723 - DNA, 15 bp, Homo sapiens
atctgtaacctactt

SEQ ID NO: 132724 - DNA, 15 bp, Homo sapiens
tatctgtaacctact

SEQ ID NO: 132725 - DNA, 15 bp, Homo sapiens
ctatctgtaacctac

SEQ ID NO: 132726 - DNA, 15 bp, Homo sapiens
actatctgtaaccta

SEQ ID NO: 132727 - DNA, 15 bp, Homo sapiens
aactatctgtaacct

SEQ ID NO: 132728 - DNA, 15 bp, Homo sapiens
aaactatctgtaacc

SEQ ID NO: 132729 - DNA, 15 bp, Homo sapiens
aaaactatctgtaac

SEQ ID NO: 132730 - DNA, 15 bp, Homo sapiens
taaaactatctgtaa

SEQ ID NO: 132731 - DNA, 15 bp, Homo sapiens
ttaaaactatctgta

SEQ ID NO: 132732 - DNA, 15 bp, Homo sapiens
attaaaactatctgt

SEQ ID NO: 132733 - DNA, 15 bp, Homo sapiens
aattaaaactatctg

SEQ ID NO: 132734 - DNA, 15 bp, Homo sapiens
taattaaaactatct

SEQ ID NO: 132735 - DNA, 15 bp, Homo sapiens
gtaattaaaactatc

SEQ ID NO: 132736 - DNA, 15 bp, Homo sapiens
agtaattaaaactat

SEQ ID NO: 132737 - DNA, 15 bp, Homo sapiens
tagtaattaaaacta

SEQ ID NO: 132738 - DNA, 15 bp, Homo sapiens
ttagtaattaaaact

SEQ ID NO: 132739 - DNA, 15 bp, Homo sapiens
attagtaattaaaac

SEQ ID NO: 132740 - DNA, 15 bp, Homo sapiens
aattagtaattaaaa

SEQ ID NO: 132741 - DNA, 15 bp, Homo sapiens
gaattagtaattaaa

SEQ ID NO: 132742 - DNA, 15 bp, Homo sapiens
tgaattagtaattaa

SEQ ID NO: 132743 - DNA, 15 bp, Homo sapiens
ttgaattagtaatta

SEQ ID NO: 132744 - DNA, 15 bp, Homo sapiens
gttgaattagtaatt

SEQ ID NO: 132745 - DNA, 15 bp, Homo sapiens
agttgaattagtaat

SEQ ID NO: 132746 - DNA, 15 bp, Homo sapiens
tagttgaattagtaa

SEQ ID NO: 132747 - DNA, 15 bp, Homo sapiens
gtagttgaattagta

SEQ ID NO: 132748 - DNA, 15 bp, Homo sapiens
agtagttgaattagt

SEQ ID NO: 132749 - DNA, 15 bp, Homo sapiens
aagtagttgaattag

SEQ ID NO: 132750 - DNA, 15 bp, Homo sapiens
taagtagttgaatta

SEQ ID NO: 132751 - DNA, 15 bp, Homo sapiens
ataagtagttgaatt

SEQ ID NO: 132752 - DNA, 15 bp, Homo sapiens
aataagtagttgaat

SEQ ID NO: 132753 - DNA, 15 bp, Homo sapiens
caataagtagttgaa

SEQ ID NO: 132754 - DNA, 15 bp, Homo sapiens
acaataagtagttga

SEQ ID NO: 132755 - DNA, 15 bp, Homo sapiens
tacaataagtagttg

SEQ ID NO: 132756 - DNA, 15 bp, Homo sapiens
atacaataagtagtt

SEQ ID NO: 132757 - DNA, 15 bp, Homo sapiens
gatacaataagtagt

SEQ ID NO: 132758 - DNA, 15 bp, Homo sapiens
tgatacaataagtag

SEQ ID NO: 132759 - DNA, 15 bp, Homo sapiens
ttgatacaataagta

SEQ ID NO: 132760 - DNA, 15 bp, Homo sapiens
tttgatacaataagt

SEQ ID NO: 132761 - DNA, 15 bp, Homo sapiens
ttttgatacaataag

SEQ ID NO: 132762 - DNA, 15 bp, Homo sapiens
gttttgatacaataa

SEQ ID NO: 132763 - DNA, 15 bp, Homo sapiens
ggttttgatacaata

SEQ ID NO: 132764 - DNA, 15 bp, Homo sapiens
tggttttgatacaat

SEQ ID NO: 132765 - DNA, 15 bp, Homo sapiens
ttggttttgatacaa

SEQ ID NO: 132766 - DNA, 15 bp, Homo sapiens
attggttttgataca

SEQ ID NO: 132767 - DNA, 15 bp, Homo sapiens
gattggttttgatac

SEQ ID NO: 132768 - DNA, 15 bp, Homo sapiens
tgattggttttgata

SEQ ID NO: 132769 - DNA, 15 bp, Homo sapiens
ttgattggttttgat

SEQ ID NO: 132770 - DNA, 15 bp, Homo sapiens
attgattggttttga

SEQ ID NO: 132771 - DNA, 15 bp, Homo sapiens
aattgattggttttg

SEQ ID NO: 132772 - DNA, 15 bp, Homo sapiens
aaattgattggtttt

SEQ ID NO: 132773 - DNA, 15 bp, Homo sapiens
caaattgattggttt

SEQ ID NO: 132774 - DNA, 15 bp, Homo sapiens
ccaaattgattggtt

SEQ ID NO: 132775 - DNA, 15 bp, Homo sapiens
gccaaattgattggt

SEQ ID NO: 132776 - DNA, 15 bp, Homo sapiens
tgccaaattgattgg

SEQ ID NO: 132777 - DNA, 15 bp, Homo sapiens
ttgccaaattgattg

SEQ ID NO: 132778 - DNA, 15 bp, Homo sapiens
attgccaaattgatt

SEQ ID NO: 132779 - DNA, 15 bp, Homo sapiens
cattgccaaattgat

SEQ ID NO: 132780 - DNA, 15 bp, Homo sapiens
tcattgccaaattga

SEQ ID NO: 132781 - DNA, 15 bp, Homo sapiens
ttcattgccaaattg

SEQ ID NO: 132782 - DNA, 15 bp, Homo sapiens
attcattgccaaatt

SEQ ID NO: 132783 - DNA, 15 bp, Homo sapiens
tattcattgccaaat

SEQ ID NO: 132784 - DNA, 15 bp, Homo sapiens
atattcattgccaaa

SEQ ID NO: 132785 - DNA, 15 bp, Homo sapiens
aatattcattgccaa

SEQ ID NO: 132786 - DNA, 15 bp, Homo sapiens
taatattcattgcca

SEQ ID NO: 132787 - DNA, 15 bp, Homo sapiens
ttaatattcattgcc

SEQ ID NO: 132788 - DNA, 15 bp, Homo sapiens
tttaatattcattgc

SEQ ID NO: 132789 - DNA, 15 bp, Homo sapiens
atttaatattcattg

SEQ ID NO: 132790 - DNA, 15 bp, Homo sapiens
tatttaatattcatt

SEQ ID NO: 132791 - DNA, 15 bp, Homo sapiens
gtatttaatattcat

SEQ ID NO: 132792 - DNA, 15 bp, Homo sapiens
tgtatttaatattca

SEQ ID NO: 132793 - DNA, 15 bp, Homo sapiens
atgtatttaatattc

SEQ ID NO: 132794 - DNA, 15 bp, Homo sapiens
tatgtatttaatatt

SEQ ID NO: 132795 - DNA, 15 bp, Homo sapiens
gtatgtatttaatat

SEQ ID NO: 132796 - DNA, 15 bp, Homo sapiens
agtatgtatttaata

SEQ ID NO: 132797 - DNA, 15 bp, Homo sapiens
aagtatgtatttaat

SEQ ID NO: 132798 - DNA, 15 bp, Homo sapiens
aaagtatgtatttaa

SEQ ID NO: 132799 - DNA, 15 bp, Homo sapiens
aaaagtatgtattta

SEQ ID NO: 132800 - DNA, 15 bp, Homo sapiens
aaaaagtatgtattt

SEQ ID NO: 132801 - DNA, 15 bp, Homo sapiens
aaaaaagtatgtatt

SEQ ID NO: 132802 - DNA, 15 bp, Homo sapiens
aaaaaaagtatgtat

SEQ ID NO: 132803 - DNA, 15 bp, Homo sapiens
aaaaaaaagtatgta

SEQ ID NO: 132804 - DNA, 15 bp, Homo sapiens
caaaaaaaagtatgt

SEQ ID NO: 132805 - DNA, 15 bp, Homo sapiens
acaaaaaaaagtatg

SEQ ID NO: 132806 - DNA, 15 bp, Homo sapiens
tacaaaaaaaagtat

SEQ ID NO: 132807 - DNA, 15 bp, Homo sapiens
atacaaaaaaaagta

SEQ ID NO: 132808 - DNA, 15 bp, Homo sapiens
aatacaaaaaaaagt

SEQ ID NO: 132809 - DNA, 15 bp, Homo sapiens
aaatacaaaaaaaag

SEQ ID NO: 132810 - DNA, 15 bp, Homo sapiens
gaaaatacaaaaaaa

SEQ ID NO: 132811 - DNA, 15 bp, Homo sapiens
agaaaatacaaaaaa

SEQ ID NO: 132812 - DNA, 15 bp, Homo sapiens
cagaaaatacaaaaa

SEQ ID NO: 132813 - DNA, 15 bp, Homo sapiens
tcagaaaatacaaaa

SEQ ID NO: 132814 - DNA, 15 bp, Homo sapiens
gtcagaaaatacaaa

SEQ ID NO: 132815 - DNA, 15 bp, Homo sapiens
agtcagaaaatacaa

SEQ ID NO: 132816 - DNA, 15 bp, Homo sapiens
gagtcagaaaataca

SEQ ID NO: 132817 - DNA, 15 bp, Homo sapiens
tgagtcagaaaatac

SEQ ID NO: 132818 - DNA, 15 bp, Homo sapiens
ctgagtcagaaaata

SEQ ID NO: 132819 - DNA, 15 bp, Homo sapiens
actgagtcagaaaat

SEQ ID NO: 132820 - DNA, 15 bp, Homo sapiens
tactgagtcagaaaa

SEQ ID NO: 132821 - DNA, 15 bp, Homo sapiens
ttactgagtcagaaa

SEQ ID NO: 132822 - DNA, 15 bp, Homo sapiens
attactgagtcagaa

SEQ ID NO: 132823 - DNA, 15 bp, Homo sapiens
aattactgagtcaga

SEQ ID NO: 132824 - DNA, 15 bp, Homo sapiens
gaattactgagtcag

SEQ ID NO: 132825 - DNA, 15 bp, Homo sapiens
agaattactgagtca

SEQ ID NO: 132826 - DNA, 15 bp, Homo sapiens
tagaattactgagtc

SEQ ID NO: 132827 - DNA, 15 bp, Homo sapiens
gtagaattactgagt

SEQ ID NO: 132828 - DNA, 15 bp, Homo sapiens
agtagaattactgag

SEQ ID NO: 132829 - DNA, 15 bp, Homo sapiens
aagtagaattactga

SEQ ID NO: 132830 - DNA, 15 bp, Homo sapiens
caagtagaattactg

SEQ ID NO: 132831 - DNA, 15 bp, Homo sapiens
ccaagtagaattact

SEQ ID NO: 132832 - DNA, 15 bp, Homo sapiens
cccaagtagaattac

SEQ ID NO: 132833 - DNA, 15 bp, Homo sapiens
tcccaagtagaatta

SEQ ID NO: 132834 - DNA, 15 bp, Homo sapiens
ttcccaagtagaatt

SEQ ID NO: 132835 - DNA, 15 bp, Homo sapiens
tttcccaagtagaat

SEQ ID NO: 132836 - DNA, 15 bp, Homo sapiens
atttcccaagtagaa

SEQ ID NO: 132837 - DNA, 15 bp, Homo sapiens
gatttcccaagtaga

SEQ ID NO: 132838 - DNA, 15 bp, Homo sapiens
agatttcccaagtag

SEQ ID NO: 132839 - DNA, 15 bp, Homo sapiens
tagatttcccaagta

SEQ ID NO: 132840 - DNA, 15 bp, Homo sapiens
atagatttcccaagt

SEQ ID NO: 132841 - DNA, 15 bp, Homo sapiens
catagatttcccaag

SEQ ID NO: 132842 - DNA, 15 bp, Homo sapiens
gcatagatttcccaa

SEQ ID NO: 132843 - DNA, 15 bp, Homo sapiens
agcatagatttccca

SEQ ID NO: 132844 - DNA, 15 bp, Homo sapiens
tagcatagatttccc

SEQ ID NO: 132845 - DNA, 15 bp, Homo sapiens
ttagcatagatttcc

SEQ ID NO: 132846 - DNA, 15 bp, Homo sapiens
cttagcatagatttc

SEQ ID NO: 132847 - DNA, 15 bp, Homo sapiens
tcttagcatagattt

SEQ ID NO: 132848 - DNA, 15 bp, Homo sapiens
atcttagcatagatt

SEQ ID NO: 132849 - DNA, 15 bp, Homo sapiens
tatcttagcatagat

SEQ ID NO: 132850 - DNA, 15 bp, Homo sapiens
ctatcttagcataga

SEQ ID NO: 132851 - DNA, 15 bp, Homo sapiens
tctatcttagcatag

SEQ ID NO: 132852 - DNA, 15 bp, Homo sapiens
ctctatcttagcata

SEQ ID NO: 132853 - DNA, 15 bp, Homo sapiens
tctctatcttagcat

SEQ ID NO: 132854 - DNA, 15 bp, Homo sapiens
atctctatcttagca

SEQ ID NO: 132855 - DNA, 15 bp, Homo sapiens
gatctctatcttagc

SEQ ID NO: 132856 - DNA, 15 bp, Homo sapiens
tgatctctatcttag

SEQ ID NO: 132857 - DNA, 15 bp, Homo sapiens
ctgatctctatctta

SEQ ID NO: 132858 - DNA, 15 bp, Homo sapiens
tctgatctctatctt

SEQ ID NO: 132859 - DNA, 15 bp, Homo sapiens
ttctgatctctatct

SEQ ID NO: 132860 - DNA, 15 bp, Homo sapiens
tttctgatctctatc

SEQ ID NO: 132861 - DNA, 15 bp, Homo sapiens
atttctgatctctat

SEQ ID NO: 132862 - DNA, 15 bp, Homo sapiens
catttctgatctcta

SEQ ID NO: 132863 - DNA, 15 bp, Homo sapiens
acatttctgatctct

SEQ ID NO: 132864 - DNA, 15 bp, Homo sapiens
cacatttctgatctc

SEQ ID NO: 132865 - DNA, 15 bp, Homo sapiens
gcacatttctgatct

SEQ ID NO: 132866 - DNA, 15 bp, Homo sapiens
tgcacatttctgatc

SEQ ID NO: 132867 - DNA, 15 bp, Homo sapiens
ttgcacatttctgat

SEQ ID NO: 132868 - DNA, 15 bp, Homo sapiens
tttgcacatttctga

SEQ ID NO: 132869 - DNA, 15 bp, Homo sapiens
ttttgcacatttctg

SEQ ID NO: 132870 - DNA, 15 bp, Homo sapiens
attttgcacatttct

SEQ ID NO: 132871 - DNA, 15 bp, Homo sapiens
tattttgcacatttc

SEQ ID NO: 132872 - DNA, 15 bp, Homo sapiens
gtattttgcacattt

SEQ ID NO: 132873 - DNA, 15 bp, Homo sapiens
agtattttgcacatt

SEQ ID NO: 132874 - DNA, 15 bp, Homo sapiens
gagtattttgcacat

SEQ ID NO: 132875 - DNA, 15 bp, Homo sapiens
agagtattttgcaca

SEQ ID NO: 132876 - DNA, 15 bp, Homo sapiens
tagagtattttgcac

SEQ ID NO: 132877 - DNA, 15 bp, Homo sapiens
gtagagtattttgca

SEQ ID NO: 132878 - DNA, 15 bp, Homo sapiens
tgtagagtattttgc

SEQ ID NO: 132879 - DNA, 15 bp, Homo sapiens
atgtagagtattttg

SEQ ID NO: 132880 - DNA, 15 bp, Homo sapiens
catgtagagtatttt

SEQ ID NO: 132881 - DNA, 15 bp, Homo sapiens
tcatgtagagtattt

SEQ ID NO: 132882 - DNA, 15 bp, Homo sapiens
ttcatgtagagtatt

SEQ ID NO: 132883 - DNA, 15 bp, Homo sapiens
tttcatgtagagtat

SEQ ID NO: 132884 - DNA, 15 bp, Homo sapiens
ttttcatgtagagta

SEQ ID NO: 132885 - DNA, 15 bp, Homo sapiens
cttttcatgtagagt

SEQ ID NO: 132886 - DNA, 15 bp, Homo sapiens
tcttttcatgtagag

SEQ ID NO: 132887 - DNA, 15 bp, Homo sapiens
atcttttcatgtaga

SEQ ID NO: 132888 - DNA, 15 bp, Homo sapiens
tatcttttcatgtag

SEQ ID NO: 132889 - DNA, 15 bp, Homo sapiens
atatcttttcatgta

SEQ ID NO: 132890 - DNA, 15 bp, Homo sapiens
aatatcttttcatgt

SEQ ID NO: 132891 - DNA, 15 bp, Homo sapiens
gaatatcttttcatg

SEQ ID NO: 132892 - DNA, 15 bp, Homo sapiens
agaatatcttttcat

SEQ ID NO: 132893 - DNA, 15 bp, Homo sapiens
aagaatatcttttca

SEQ ID NO: 132894 - DNA, 15 bp, Homo sapiens
aaagaatatcttttc

SEQ ID NO: 132895 - DNA, 15 bp, Homo sapiens
caaagaatatctttt

SEQ ID NO: 132896 - DNA, 15 bp, Homo sapiens
gcaaagaatatcttt

SEQ ID NO: 132897 - DNA, 15 bp, Homo sapiens
tgcaaagaatatctt

SEQ ID NO: 132898 - DNA, 15 bp, Homo sapiens
ttgcaaagaatatct

SEQ ID NO: 132899 - DNA, 15 bp, Homo sapiens
cttgcaaagaatatc

SEQ ID NO: 132900 - DNA, 15 bp, Homo sapiens
acttgcaaagaatat

SEQ ID NO: 132901 - DNA, 15 bp, Homo sapiens
aacttgcaaagaata

SEQ ID NO: 132902 - DNA, 15 bp, Homo sapiens
aaacttgcaaagaat

SEQ ID NO: 132903 - DNA, 15 bp, Homo sapiens
aaaacttgcaaagaa

SEQ ID NO: 132904 - DNA, 15 bp, Homo sapiens
aaaaacttgcaaaga

SEQ ID NO: 132905 - DNA, 15 bp, Homo sapiens
aaaaaacttgcaaag

SEQ ID NO: 132906 - DNA, 15 bp, Homo sapiens
taaaaaacttgcaaa

SEQ ID NO: 132907 - DNA, 15 bp, Homo sapiens
ttaaaaaacttgcaa

SEQ ID NO: 132908 - DNA, 15 bp, Homo sapiens
tttaaaaaacttgca

SEQ ID NO: 132909 - DNA, 15 bp, Homo sapiens
ttttaaaaaacttgc

SEQ ID NO: 132910 - DNA, 15 bp, Homo sapiens
tttttaaaaaacttg

SEQ ID NO: 132911 - DNA, 15 bp, Homo sapiens
aattttttaaaaaac

SEQ ID NO: 132912 - DNA, 15 bp, Homo sapiens
taattttttaaaaaa

SEQ ID NO: 132913 - DNA, 15 bp, Homo sapiens
ttaattttttaaaaa

SEQ ID NO: 132914 - DNA, 15 bp, Homo sapiens
tttaattttttaaaa

SEQ ID NO: 132915 - DNA, 15 bp, Homo sapiens
attttaattttttaa

SEQ ID NO: 132916 - DNA, 15 bp, Homo sapiens
tattttaatttttta

SEQ ID NO: 132917 - DNA, 15 bp, Homo sapiens
ttattttaatttttt

SEQ ID NO: 132918 - DNA, 15 bp, Homo sapiens
tttattttaattttt

SEQ ID NO: 132919 - DNA, 15 bp, Homo sapiens
ttttattttaatttt

SEQ ID NO: 132920 - DNA, 15 bp, Homo sapiens
attttattttaattt

SEQ ID NO: 132921 - DNA, 15 bp, Homo sapiens
aattttattttaatt

SEQ ID NO: 132922 - DNA, 15 bp, Homo sapiens
aaattttattttaat

SEQ ID NO: 132923 - DNA, 15 bp, Homo sapiens
gaaattttattttaa

SEQ ID NO: 132924 - DNA, 15 bp, Homo sapiens
tgaaattttatttta

SEQ ID NO: 132925 - DNA, 15 bp, Homo sapiens
ctgaaattttatttt

SEQ ID NO: 132926 - DNA, 15 bp, Homo sapiens
cctgaaattttattt

SEQ ID NO: 132927 - DNA, 15 bp, Homo sapiens
tcctgaaattttatt

SEQ ID NO: 132928 - DNA, 15 bp, Homo sapiens
ctcctgaaattttat

SEQ ID NO: 132929 - DNA, 15 bp, Homo sapiens
gctcctgaaatttta

SEQ ID NO: 132930 - DNA, 15 bp, Homo sapiens
tgctcctgaaatttt

SEQ ID NO: 132931 - DNA, 15 bp, Homo sapiens
ttgctcctgaaattt

SEQ ID NO: 132932 - DNA, 15 bp, Homo sapiens
attgctcctgaaatt

SEQ ID NO: 132933 - DNA, 15 bp, Homo sapiens
gattgctcctgaaat

SEQ ID NO: 132934 - DNA, 15 bp, Homo sapiens
agattgctcctgaaa

SEQ ID NO: 132935 - DNA, 15 bp, Homo sapiens
tagattgctcctgaa

SEQ ID NO: 132936 - DNA, 15 bp, Homo sapiens
ttagattgctcctga

SEQ ID NO: 132937 - DNA, 15 bp, Homo sapiens
tttagattgctcctg

SEQ ID NO: 132938 - DNA, 15 bp, Homo sapiens
atttagattgctcct

SEQ ID NO: 132939 - DNA, 15 bp, Homo sapiens
tatttagattgctcc

SEQ ID NO: 132940 - DNA, 15 bp, Homo sapiens
atatttagattgctc

SEQ ID NO: 132941 - DNA, 15 bp, Homo sapiens
gatatttagattgct

SEQ ID NO: 132942 - DNA, 15 bp, Homo sapiens
ggatatttagattgc

SEQ ID NO: 132943 - DNA, 15 bp, Homo sapiens
tggatatttagattg

SEQ ID NO: 132944 - DNA, 15 bp, Homo sapiens
ttggatatttagatt

SEQ ID NO: 132945 - DNA, 15 bp, Homo sapiens
cttggatatttagat

SEQ ID NO: 132946 - DNA, 15 bp, Homo sapiens
ccttggatatttaga

SEQ ID NO: 132947 - DNA, 15 bp, Homo sapiens
cccttggatatttag

SEQ ID NO: 132948 - DNA, 15 bp, Homo sapiens
acccttggatattta

SEQ ID NO: 132949 - DNA, 15 bp, Homo sapiens
aacccttggatattt

SEQ ID NO: 132950 - DNA, 15 bp, Homo sapiens
taacccttggatatt

SEQ ID NO: 132951 - DNA, 15 bp, Homo sapiens
ttaacccttggatat

SEQ ID NO: 132952 - DNA, 15 bp, Homo sapiens
tttaacccttggata

SEQ ID NO: 132953 - DNA, 15 bp, Homo sapiens
atttaacccttggat

SEQ ID NO: 132954 - DNA, 15 bp, Homo sapiens
tatttaacccttgga

SEQ ID NO: 132955 - DNA, 15 bp, Homo sapiens
ttatttaacccttgg

SEQ ID NO: 132956 - DNA, 15 bp, Homo sapiens
tttatttaacccttg

SEQ ID NO: 132957 - DNA, 15 bp, Homo sapiens
ttttatttaaccctt

SEQ ID NO: 132958 - DNA, 15 bp, Homo sapiens
cttttatttaaccct

SEQ ID NO: 132959 - DNA, 15 bp, Homo sapiens
acttttatttaaccc

SEQ ID NO: 132960 - DNA, 15 bp, Homo sapiens
cacttttatttaacc

SEQ ID NO: 132961 - DNA, 15 bp, Homo sapiens
tcacttttatttaac

SEQ ID NO: 132962 - DNA, 15 bp, Homo sapiens
ttcacttttatttaa

SEQ ID NO: 132963 - DNA, 15 bp, Homo sapiens
attcacttttattta

SEQ ID NO: 132964 - DNA, 15 bp, Homo sapiens
tattcacttttattt

SEQ ID NO: 132965 - DNA, 15 bp, Homo sapiens
atattcacttttatt

SEQ ID NO: 132966 - DNA, 15 bp, Homo sapiens
catattcacttttat

SEQ ID NO: 132967 - DNA, 15 bp, Homo sapiens
ccatattcactttta

SEQ ID NO: 132968 - DNA, 15 bp, Homo sapiens
cccatattcactttt

SEQ ID NO: 132969 - DNA, 15 bp, Homo sapiens
acccatattcacttt

SEQ ID NO: 132970 - DNA, 15 bp, Homo sapiens
tacccatattcactt

SEQ ID NO: 132971 - DNA, 15 bp, Homo sapiens
atacccatattcact

SEQ ID NO: 132972 - DNA, 15 bp, Homo sapiens
tatacccatattcac

SEQ ID NO: 132973 - DNA, 15 bp, Homo sapiens
ctatacccatattca

SEQ ID NO: 132974 - DNA, 15 bp, Homo sapiens
cctatacccatattc

SEQ ID NO: 132975 - DNA, 15 bp, Homo sapiens
acctatacccatatt

SEQ ID NO: 132976 - DNA, 15 bp, Homo sapiens
aacctatacccatat

SEQ ID NO: 132977 - DNA, 15 bp, Homo sapiens
taacctatacccata

SEQ ID NO: 132978 - DNA, 15 bp, Homo sapiens
ataacctatacccat

SEQ ID NO: 132979 - DNA, 15 bp, Homo sapiens
aataacctataccca

SEQ ID NO: 132980 - DNA, 15 bp, Homo sapiens
taataacctataccc

SEQ ID NO: 132981 - DNA, 15 bp, Homo sapiens
gtaataacctatacc

SEQ ID NO: 132982 - DNA, 15 bp, Homo sapiens
tgtaataacctatac

SEQ ID NO: 132983 - DNA, 15 bp, Homo sapiens
atgtaataacctata

SEQ ID NO: 132984 - DNA, 15 bp, Homo sapiens
tatgtaataacctat

SEQ ID NO: 132985 - DNA, 15 bp, Homo sapiens
ctatgtaataaccta

SEQ ID NO: 132986 - DNA, 15 bp, Homo sapiens
cctatgtaataacct

SEQ ID NO: 132987 - DNA, 15 bp, Homo sapiens
acctatgtaataacc

SEQ ID NO: 132988 - DNA, 15 bp, Homo sapiens
tacctatgtaataac

SEQ ID NO: 132989 - DNA, 15 bp, Homo sapiens
atacctatgtaataa

SEQ ID NO: 132990 - DNA, 15 bp, Homo sapiens
aatacctatgtaata

SEQ ID NO: 132991 - DNA, 15 bp, Homo sapiens
gaatacctatgtaat

SEQ ID NO: 132992 - DNA, 15 bp, Homo sapiens
tgaatacctatgtaa

SEQ ID NO: 132993 - DNA, 15 bp, Homo sapiens
atgaatacctatgta

SEQ ID NO: 132994 - DNA, 15 bp, Homo sapiens
tatgaatacctatgt

SEQ ID NO: 132995 - DNA, 15 bp, Homo sapiens
ttatgaatacctatg

SEQ ID NO: 132996 - DNA, 15 bp, Homo sapiens
attatgaatacctat

SEQ ID NO: 132997 - DNA, 15 bp, Homo sapiens
aattatgaataccta

SEQ ID NO: 132998 - DNA, 15 bp, Homo sapiens
caattatgaatacct

SEQ ID NO: 132999 - DNA, 15 bp, Homo sapiens
acacaattatgaata

SEQ ID NO: 133000 - DNA, 15 bp, Homo sapiens
aacacaattatgaat

SEQ ID NO: 133001 - DNA, 15 bp, Homo sapiens
aaacacaattatgaa

SEQ ID NO: 133002 - DNA, 15 bp, Homo sapiens
taaacacaattatga

SEQ ID NO: 133003 - DNA, 15 bp, Homo sapiens
gtaaacacaattatg

SEQ ID NO: 133004 - DNA, 15 bp, Homo sapiens
agtaaacacaattat

SEQ ID NO: 133005 - DNA, 15 bp, Homo sapiens
tagtaaacacaatta

SEQ ID NO: 133006 - DNA, 15 bp, Homo sapiens
ttagtaaacacaatt

SEQ ID NO: 133007 - DNA, 15 bp, Homo sapiens
cttagtaaacacaat

SEQ ID NO: 133008 - DNA, 15 bp, Homo sapiens
tcttagtaaacacaa

SEQ ID NO: 133009 - DNA, 15 bp, Homo sapiens
ttcttagtaaacaca

SEQ ID NO: 133010 - DNA, 15 bp, Homo sapiens
attcttagtaaacac

SEQ ID NO: 133011 - DNA, 15 bp, Homo sapiens
tattcttagtaaaca

SEQ ID NO: 133012 - DNA, 15 bp, Homo sapiens
ttattcttagtaaac

SEQ ID NO: 133013 - DNA, 15 bp, Homo sapiens
tttattcttagtaaa

SEQ ID NO: 133014 - DNA, 15 bp, Homo sapiens
ttttattcttagtaa

SEQ ID NO: 133015 - DNA, 15 bp, Homo sapiens
attttattcttagta

SEQ ID NO: 133016 - DNA, 15 bp, Homo sapiens
tattttattcttagt

SEQ ID NO: 133017 - DNA, 15 bp, Homo sapiens
atattttattcttag

SEQ ID NO: 133018 - DNA, 15 bp, Homo sapiens
catattttattctta

SEQ ID NO: 133019 - DNA, 15 bp, Homo sapiens
gcatattttattctt

SEQ ID NO: 133020 - DNA, 15 bp, Homo sapiens
tgagcatattttatt

SEQ ID NO: 133021 - DNA, 15 bp, Homo sapiens
gtgagcatattttat

SEQ ID NO: 133022 - DNA, 15 bp, Homo sapiens
tgtgagcatatttta

SEQ ID NO: 133023 - DNA, 15 bp, Homo sapiens
atgtgagcatatttt

SEQ ID NO: 133024 - DNA, 15 bp, Homo sapiens
aatgtgagcatattt

SEQ ID NO: 133025 - DNA, 15 bp, Homo sapiens
taatgtgagcatatt

SEQ ID NO: 133026 - DNA, 15 bp, Homo sapiens
ataatgtgagcatat

SEQ ID NO: 133027 - DNA, 15 bp, Homo sapiens
tataatgtgagcata

SEQ ID NO: 133028 - DNA, 15 bp, Homo sapiens
ttataatgtgagcat

SEQ ID NO: 133029 - DNA, 15 bp, Homo sapiens
tttataatgtgagca

SEQ ID NO: 133030 - DNA, 15 bp, Homo sapiens
ctttataatgtgagc

SEQ ID NO: 133031 - DNA, 15 bp, Homo sapiens
actttataatgtgag

SEQ ID NO: 133032 - DNA, 15 bp, Homo sapiens
aactttataatgtga

SEQ ID NO: 133033 - DNA, 15 bp, Homo sapiens
taactttataatgtg

SEQ ID NO: 133034 - DNA, 15 bp, Homo sapiens
ttaactttataatgt

SEQ ID NO: 133035 - DNA, 15 bp, Homo sapiens
tttaactttataatg

SEQ ID NO: 133036 - DNA, 15 bp, Homo sapiens
atttaactttataat

SEQ ID NO: 133037 - DNA, 15 bp, Homo sapiens
catttaactttataa

SEQ ID NO: 133038 - DNA, 15 bp, Homo sapiens
tcatttaactttata

SEQ ID NO: 133039 - DNA, 15 bp, Homo sapiens
ttcatttaactttat

SEQ ID NO: 133040 - DNA, 15 bp, Homo sapiens
tttcatttaacttta

SEQ ID NO: 133041 - DNA, 15 bp, Homo sapiens
ttttcatttaacttt

SEQ ID NO: 133042 - DNA, 15 bp, Homo sapiens
tttttcatttaactt

SEQ ID NO: 133043 - DNA, 15 bp, Homo sapiens
ttttttcatttaact

SEQ ID NO: 133044 - DNA, 15 bp, Homo sapiens
tttttttcatttaac

SEQ ID NO: 133045 - DNA, 15 bp, Homo sapiens
atttttttcatttaa

SEQ ID NO: 133046 - DNA, 15 bp, Homo sapiens
tatttttttcattta

SEQ ID NO: 133047 - DNA, 15 bp, Homo sapiens
ttatttttttcattt

SEQ ID NO: 133048 - DNA, 15 bp, Homo sapiens
tttatttttttcatt

SEQ ID NO: 133049 - DNA, 15 bp, Homo sapiens
ttttatttttttcat

SEQ ID NO: 133050 - DNA, 15 bp, Homo sapiens
tttttatttttttca

SEQ ID NO: 133051 - DNA, 15 bp, Homo sapiens
ttttttatttttttc

SEQ ID NO: 133052 - DNA, 15 bp, Homo sapiens
attttttattttttt

SEQ ID NO: 133053 - DNA, 15 bp, Homo sapiens
aattttttatttttt

SEQ ID NO: 133054 - DNA, 15 bp, Homo sapiens
taattttttattttt

SEQ ID NO: 133055 - DNA, 15 bp, Homo sapiens
ataattttttatttt

SEQ ID NO: 133056 - DNA, 15 bp, Homo sapiens
cataattttttattt

SEQ ID NO: 133057 - DNA, 15 bp, Homo sapiens
tcataattttttatt

SEQ ID NO: 133058 - DNA, 15 bp, Homo sapiens
ttcataattttttat

SEQ ID NO: 133059 - DNA, 15 bp, Homo sapiens
attcataatttttta

SEQ ID NO: 133060 - DNA, 15 bp, Homo sapiens
tattcataatttttt

SEQ ID NO: 133061 - DNA, 15 bp, Homo sapiens
ttattcataattttt

SEQ ID NO: 133062 - DNA, 15 bp, Homo sapiens
cttattcataatttt

SEQ ID NO: 133063 - DNA, 15 bp, Homo sapiens
acttattcataattt

SEQ ID NO: 133064 - DNA, 15 bp, Homo sapiens
aacttattcataatt

SEQ ID NO: 133065 - DNA, 15 bp, Homo sapiens
caacttattcataat

SEQ ID NO: 133066 - DNA, 15 bp, Homo sapiens
ccaacttattcataa

SEQ ID NO: 133067 - DNA, 15 bp, Homo sapiens
gccaacttattcata

SEQ ID NO: 133068 - DNA, 15 bp, Homo sapiens
agccaacttattcat

SEQ ID NO: 133069 - DNA, 15 bp, Homo sapiens
aagccaacttattca

SEQ ID NO: 133070 - DNA, 15 bp, Homo sapiens
aaagccaacttattc

SEQ ID NO: 133071 - DNA, 15 bp, Homo sapiens
taaagccaacttatt

SEQ ID NO: 133072 - DNA, 15 bp, Homo sapiens
ataaagccaacttat

SEQ ID NO: 133073 - DNA, 15 bp, Homo sapiens
tataaagccaactta

SEQ ID NO: 133074 - DNA, 15 bp, Homo sapiens
ttataaagccaactt

SEQ ID NO: 133075 - DNA, 15 bp, Homo sapiens
attataaagccaact

SEQ ID NO: 133076 - DNA, 15 bp, Homo sapiens
aattataaagccaac

SEQ ID NO: 133077 - DNA, 15 bp, Homo sapiens
taattataaagccaa

SEQ ID NO: 133078 - DNA, 15 bp, Homo sapiens
ttaattataaagcca

SEQ ID NO: 133079 - DNA, 15 bp, Homo sapiens
tttaattataaagcc

SEQ ID NO: 133080 - DNA, 15 bp, Homo sapiens
ttttaattataaagc

SEQ ID NO: 133081 - DNA, 15 bp, Homo sapiens
attttaattataaag

SEQ ID NO: 133082 - DNA, 15 bp, Homo sapiens
gattttaattataaa

SEQ ID NO: 133083 - DNA, 15 bp, Homo sapiens
tgattttaattataa

SEQ ID NO: 133084 - DNA, 15 bp, Homo sapiens
atgattttaattata

SEQ ID NO: 133085 - DNA, 15 bp, Homo sapiens
gatgattttaattat

SEQ ID NO: 133086 - DNA, 15 bp, Homo sapiens
agatgattttaatta

SEQ ID NO: 133087 - DNA, 15 bp, Homo sapiens
aagatgattttaatt

SEQ ID NO: 133088 - DNA, 15 bp, Homo sapiens
caagatgattttaat

SEQ ID NO: 133089 - DNA, 15 bp, Homo sapiens
gcaagatgattttaa

SEQ ID NO: 133090 - DNA, 15 bp, Homo sapiens
ggcaagatgatttta

SEQ ID NO: 133091 - DNA, 15 bp, Homo sapiens
tggcaagatgatttt

SEQ ID NO: 133092 - DNA, 15 bp, Homo sapiens
ttggcaagatgattt

SEQ ID NO: 133093 - DNA, 15 bp, Homo sapiens
tttggcaagatgatt

SEQ ID NO: 133094 - DNA, 15 bp, Homo sapiens
ttttggcaagatgat

SEQ ID NO: 133095 - DNA, 15 bp, Homo sapiens
attttggcaagatga

SEQ ID NO: 133096 - DNA, 15 bp, Homo sapiens
tattttggcaagatg

SEQ ID NO: 133097 - DNA, 15 bp, Homo sapiens
ttattttggcaagat

SEQ ID NO: 133098 - DNA, 15 bp, Homo sapiens
tttattttggcaaga

SEQ ID NO: 133099 - DNA, 15 bp, Homo sapiens
ttttattttggcaag

SEQ ID NO: 133100 - DNA, 15 bp, Homo sapiens
attttattttggcaa

SEQ ID NO: 133101 - DNA, 15 bp, Homo sapiens
tattttattttggca

SEQ ID NO: 133102 - DNA, 15 bp, Homo sapiens
ttattttattttggc

SEQ ID NO: 133103 - DNA, 15 bp, Homo sapiens
attattttattttgg

SEQ ID NO: 133104 - DNA, 15 bp, Homo sapiens
tattattttattttg

SEQ ID NO: 133105 - DNA, 15 bp, Homo sapiens
gtattattttatttt

SEQ ID NO: 133106 - DNA, 15 bp, Homo sapiens
agtattattttattt

SEQ ID NO: 133107 - DNA, 15 bp, Homo sapiens
aagtattattttatt

SEQ ID NO: 133108 - DNA, 15 bp, Homo sapiens
gaagtattattttat

SEQ ID NO: 133109 - DNA, 15 bp, Homo sapiens
ggaagtattatttta

SEQ ID NO: 133110 - DNA, 15 bp, Homo sapiens
tggaagtattatttt

SEQ ID NO: 133111 - DNA, 15 bp, Homo sapiens
ctggaagtattattt

SEQ ID NO: 133112 - DNA, 15 bp, Homo sapiens
actggaagtattatt

SEQ ID NO: 133113 - DNA, 15 bp, Homo sapiens
aactggaagtattat

SEQ ID NO: 133114 - DNA, 15 bp, Homo sapiens
gaactggaagtatta

SEQ ID NO: 133115 - DNA, 15 bp, Homo sapiens
agaactggaagtatt

SEQ ID NO: 133116 - DNA, 15 bp, Homo sapiens
gagaactggaagtat

SEQ ID NO: 133117 - DNA, 15 bp, Homo sapiens
ggagaactggaagta

SEQ ID NO: 133118 - DNA, 15 bp, Homo sapiens
gggagaactggaagt

SEQ ID NO: 133119 - DNA, 15 bp, Homo sapiens
tgggagaactggaag

SEQ ID NO: 133120 - DNA, 15 bp, Homo sapiens
gtgggagaactggaa

SEQ ID NO: 133121 - DNA, 15 bp, Homo sapiens
tgtgggagaactgga

SEQ ID NO: 133122 - DNA, 15 bp, Homo sapiens
atgtgggagaactgg

SEQ ID NO: 133123 - DNA, 15 bp, Homo sapiens
aatgtgggagaactg

SEQ ID NO: 133124 - DNA, 15 bp, Homo sapiens
aaatgtgggagaact

SEQ ID NO: 133125 - DNA, 15 bp, Homo sapiens
caaatgtgggagaac

SEQ ID NO: 133126 - DNA, 15 bp, Homo sapiens
acaaatgtgggagaa

SEQ ID NO: 133127 - DNA, 15 bp, Homo sapiens
tacaaatgtgggaga

SEQ ID NO: 133128 - DNA, 15 bp, Homo sapiens
gtacaaatgtgggag

SEQ ID NO: 133129 - DNA, 15 bp, Homo sapiens
agtacaaatgtggga

SEQ ID NO: 133130 - DNA, 15 bp, Homo sapiens
aagtacaaatgtggg

SEQ ID NO: 133131 - DNA, 15 bp, Homo sapiens
aaagtacaaatgtgg

SEQ ID NO: 133132 - DNA, 15 bp, Homo sapiens
aaaagtacaaatgtg

SEQ ID NO: 133133 - DNA, 15 bp, Homo sapiens
taaaagtacaaatgt

SEQ ID NO: 133134 - DNA, 15 bp, Homo sapiens
ttaaaagtacaaatg

SEQ ID NO: 133135 - DNA, 15 bp, Homo sapiens
attaaaagtacaaat

SEQ ID NO: 133136 - DNA, 15 bp, Homo sapiens
aattaaaagtacaaa

SEQ ID NO: 133137 - DNA, 15 bp, Homo sapiens
aaattaaaagtacaa

SEQ ID NO: 133138 - DNA, 15 bp, Homo sapiens
aaaattaaaagtaca

SEQ ID NO: 133139 - DNA, 15 bp, Homo sapiens
aaaaattaaaagtac

SEQ ID NO: 133140 - DNA, 15 bp, Homo sapiens
gaaaaattaaaagta

SEQ ID NO: 133141 - DNA, 15 bp, Homo sapiens
agaaaaattaaaagt

SEQ ID NO: 133142 - DNA, 15 bp, Homo sapiens
gagaaaaattaaaag

SEQ ID NO: 133143 - DNA, 15 bp, Homo sapiens
tgagaaaaattaaaa

SEQ ID NO: 133144 - DNA, 15 bp, Homo sapiens
ctgagaaaaattaaa

SEQ ID NO: 133145 - DNA, 15 bp, Homo sapiens
actgagaaaaattaa

SEQ ID NO: 133146 - DNA, 15 bp, Homo sapiens
cactgagaaaaatta

SEQ ID NO: 133147 - DNA, 15 bp, Homo sapiens
acactgagaaaaatt

SEQ ID NO: 133148 - DNA, 15 bp, Homo sapiens
gacactgagaaaaat

SEQ ID NO: 133149 - DNA, 15 bp, Homo sapiens
tgacactgagaaaaa

SEQ ID NO: 133150 - DNA, 15 bp, Homo sapiens
ctgacactgagaaaa

SEQ ID NO: 133151 - DNA, 15 bp, Homo sapiens
actgacactgagaaa

SEQ ID NO: 133152 - DNA, 15 bp, Homo sapiens
cactgacactgagaa

SEQ ID NO: 133153 - DNA, 15 bp, Homo sapiens
gcactgacactgaga

SEQ ID NO: 133154 - DNA, 15 bp, Homo sapiens
agcactgacactgag

SEQ ID NO: 133155 - DNA, 15 bp, Homo sapiens
cagcactgacactga

SEQ ID NO: 133156 - DNA, 15 bp, Homo sapiens
tcagcactgacactg

SEQ ID NO: 133157 - DNA, 15 bp, Homo sapiens
atcagcactgacact

SEQ ID NO: 133158 - DNA, 15 bp, Homo sapiens
aatcagcactgacac

SEQ ID NO: 133159 - DNA, 15 bp, Homo sapiens
taatcagcactgaca

SEQ ID NO: 133160 - DNA, 15 bp, Homo sapiens
ataatcagcactgac

SEQ ID NO: 133161 - DNA, 15 bp, Homo sapiens
cataatcagcactga

SEQ ID NO: 133162 - DNA, 15 bp, Homo sapiens
acataatcagcactg

SEQ ID NO: 133163 - DNA, 15 bp, Homo sapiens
aacataatcagcact

SEQ ID NO: 133164 - DNA, 15 bp, Homo sapiens
taacataatcagcac

SEQ ID NO: 133165 - DNA, 15 bp, Homo sapiens
ataacataatcagca

SEQ ID NO: 133166 - DNA, 15 bp, Homo sapiens
tataacataatcagc

SEQ ID NO: 133167 - DNA, 15 bp, Homo sapiens
ctataacataatcag

SEQ ID NO: 133168 - DNA, 15 bp, Homo sapiens
tctataacataatca

SEQ ID NO: 133169 - DNA, 15 bp, Homo sapiens
ttctataacataatc

SEQ ID NO: 133170 - DNA, 15 bp, Homo sapiens
attctataacataat

SEQ ID NO: 133171 - DNA, 15 bp, Homo sapiens
cattctataacataa

SEQ ID NO: 133172 - DNA, 15 bp, Homo sapiens
acattctataacata

SEQ ID NO: 133173 - DNA, 15 bp, Homo sapiens
aacattctataacat

SEQ ID NO: 133174 - DNA, 15 bp, Homo sapiens
caacattctataaca

SEQ ID NO: 133175 - DNA, 15 bp, Homo sapiens
gcaacattctataac

SEQ ID NO: 133176 - DNA, 15 bp, Homo sapiens
tgcaacattctataa

SEQ ID NO: 133177 - DNA, 15 bp, Homo sapiens
ttgcaacattctata

SEQ ID NO: 133178 - DNA, 15 bp, Homo sapiens
tttgcaacattctat

SEQ ID NO: 133179 - DNA, 15 bp, Homo sapiens
ttttgcaacattcta

SEQ ID NO: 133180 - DNA, 15 bp, Homo sapiens
gttttgcaacattct

SEQ ID NO: 133181 - DNA, 15 bp, Homo sapiens
agttttgcaacattc

SEQ ID NO: 133182 - DNA, 15 bp, Homo sapiens
cagttttgcaacatt

SEQ ID NO: 133183 - DNA, 15 bp, Homo sapiens
acagttttgcaacat

SEQ ID NO: 133184 - DNA, 15 bp, Homo sapiens
aacagttttgcaaca

SEQ ID NO: 133185 - DNA, 15 bp, Homo sapiens
aaacagttttgcaac

SEQ ID NO: 133186 - DNA, 15 bp, Homo sapiens
aaaacagttttgcaa

SEQ ID NO: 133187 - DNA, 15 bp, Homo sapiens
caaaacagttttgca

SEQ ID NO: 133188 - DNA, 15 bp, Homo sapiens
acaaaacagttttgc

SEQ ID NO: 133189 - DNA, 15 bp, Homo sapiens
aacaaaacagttttg

SEQ ID NO: 133190 - DNA, 15 bp, Homo sapiens
caacaaaacagtttt

SEQ ID NO: 133191 - DNA, 15 bp, Homo sapiens
ccaacaaaacagttt

SEQ ID NO: 133192 - DNA, 15 bp, Homo sapiens
gccaacaaaacagtt

SEQ ID NO: 133193 - DNA, 15 bp, Homo sapiens
agccaacaaaacagt

SEQ ID NO: 133194 - DNA, 15 bp, Homo sapiens
aagccaacaaaacag

SEQ ID NO: 133195 - DNA, 15 bp, Homo sapiens
caagccaacaaaaca

SEQ ID NO: 133196 - DNA, 15 bp, Homo sapiens
tcaagccaacaaaac

SEQ ID NO: 133197 - DNA, 15 bp, Homo sapiens
atcaagccaacaaaa

SEQ ID NO: 133198 - DNA, 15 bp, Homo sapiens
tatcaagccaacaaa

SEQ ID NO: 133199 - DNA, 15 bp, Homo sapiens
ctatcaagccaacaa

SEQ ID NO: 133200 - DNA, 15 bp, Homo sapiens
gctatcaagccaaca

SEQ ID NO: 133201 - DNA, 15 bp, Homo sapiens
agctatcaagccaac

SEQ ID NO: 133202 - DNA, 15 bp, Homo sapiens
tagctatcaagccaa

SEQ ID NO: 133203 - DNA, 15 bp, Homo sapiens
gtagctatcaagcca

SEQ ID NO: 133204 - DNA, 15 bp, Homo sapiens
ggtagctatcaagcc

SEQ ID NO: 133205 - DNA, 15 bp, Homo sapiens
tggtagctatcaagc

SEQ ID NO: 133206 - DNA, 15 bp, Homo sapiens
ttggtagctatcaag

SEQ ID NO: 133207 - DNA, 15 bp, Homo sapiens
tttggtagctatcaa

SEQ ID NO: 133208 - DNA, 15 bp, Homo sapiens
ctttggtagctatca

SEQ ID NO: 133209 - DNA, 15 bp, Homo sapiens
tctttggtagctatc

SEQ ID NO: 133210 - DNA, 15 bp, Homo sapiens
gtctttggtagctat

SEQ ID NO: 133211 - DNA, 15 bp, Homo sapiens
tgtctttggtagcta

SEQ ID NO: 133212 - DNA, 15 bp, Homo sapiens
atgtctttggtagct

SEQ ID NO: 133213 - DNA, 15 bp, Homo sapiens
tatgtctttggtagc

SEQ ID NO: 133214 - DNA, 15 bp, Homo sapiens
atatgtctttggtag

SEQ ID NO: 133215 - DNA, 15 bp, Homo sapiens
catatgtctttggta

SEQ ID NO: 133216 - DNA, 15 bp, Homo sapiens
ccatatgtctttggt

SEQ ID NO: 133217 - DNA, 15 bp, Homo sapiens
tccatatgtctttgg

SEQ ID NO: 133218 - DNA, 15 bp, Homo sapiens
atccatatgtctttg

SEQ ID NO: 133219 - DNA, 15 bp, Homo sapiens
tatccatatgtcttt

SEQ ID NO: 133220 - DNA, 15 bp, Homo sapiens
atatccatatgtctt

SEQ ID NO: 133221 - DNA, 15 bp, Homo sapiens
aatatccatatgtct

SEQ ID NO: 133222 - DNA, 15 bp, Homo sapiens
taatatccatatgtc

SEQ ID NO: 133223 - DNA, 15 bp, Homo sapiens
gtaatatccatatgt

SEQ ID NO: 133224 - DNA, 15 bp, Homo sapiens
tgtaatatccatatg

SEQ ID NO: 133225 - DNA, 15 bp, Homo sapiens
ctgtaatatccatat

SEQ ID NO: 133226 - DNA, 15 bp, Homo sapiens
cctgtaatatccata

SEQ ID NO: 133227 - DNA, 15 bp, Homo sapiens
acctgtaatatccat

SEQ ID NO: 133228 - DNA, 15 bp, Homo sapiens
tacctgtaatatcca

SEQ ID NO: 133229 - DNA, 15 bp, Homo sapiens
ttacctgtaatatcc

SEQ ID NO: 133230 - DNA, 15 bp, Homo sapiens
attacctgtaatatc

SEQ ID NO: 133231 - DNA, 15 bp, Homo sapiens
tattacctgtaatat

SEQ ID NO: 133232 - DNA, 15 bp, Homo sapiens
gtattacctgtaata

SEQ ID NO: 133233 - DNA, 15 bp, Homo sapiens
ggtattacctgtaat

SEQ ID NO: 133234 - DNA, 15 bp, Homo sapiens
tggtattacctgtaa

SEQ ID NO: 133235 - DNA, 15 bp, Homo sapiens
atggtattacctgta

SEQ ID NO: 133236 - DNA, 15 bp, Homo sapiens
tatggtattacctgt

SEQ ID NO: 133237 - DNA, 15 bp, Homo sapiens
ctatggtattacctg

SEQ ID NO: 133238 - DNA, 15 bp, Homo sapiens
gctatggtattacct

SEQ ID NO: 133239 - DNA, 15 bp, Homo sapiens
ggctatggtattacc

SEQ ID NO: 133240 - DNA, 15 bp, Homo sapiens
tggctatggtattac

SEQ ID NO: 133241 - DNA, 15 bp, Homo sapiens
atggctatggtatta

SEQ ID NO: 133242 - DNA, 15 bp, Homo sapiens
aatggctatggtatt

SEQ ID NO: 133243 - DNA, 15 bp, Homo sapiens
aaatggctatggtat

SEQ ID NO: 133244 - DNA, 15 bp, Homo sapiens
gaaatggctatggta

SEQ ID NO: 133245 - DNA, 15 bp, Homo sapiens
tgaaatggctatggt

SEQ ID NO: 133246 - DNA, 15 bp, Homo sapiens
ctgaaatggctatgg

SEQ ID NO: 133247 - DNA, 15 bp, Homo sapiens
actgaaatggctatg

SEQ ID NO: 133248 - DNA, 15 bp, Homo sapiens
tactgaaatggctat

SEQ ID NO: 133249 - DNA, 15 bp, Homo sapiens
atactgaaatggcta

SEQ ID NO: 133250 - DNA, 15 bp, Homo sapiens
catactgaaatggct

SEQ ID NO: 133251 - DNA, 15 bp, Homo sapiens
tcatactgaaatggc

SEQ ID NO: 133252 - DNA, 15 bp, Homo sapiens
ttcatactgaaatgg

SEQ ID NO: 133253 - DNA, 15 bp, Homo sapiens
tttcatactgaaatg

SEQ ID NO: 133254 - DNA, 15 bp, Homo sapiens
ttttcatactgaaat

SEQ ID NO: 133255 - DNA, 15 bp, Homo sapiens
tttttcatactgaaa

SEQ ID NO: 133256 - DNA, 15 bp, Homo sapiens
ttttttcatactgaa

SEQ ID NO: 133257 - DNA, 15 bp, Homo sapiens
attttttcatactga

SEQ ID NO: 133258 - DNA, 15 bp, Homo sapiens
tattttttcatactg

SEQ ID NO: 133259 - DNA, 15 bp, Homo sapiens
ttattttttcatact

SEQ ID NO: 133260 - DNA, 15 bp, Homo sapiens
gttattttttcatac

SEQ ID NO: 133261 - DNA, 15 bp, Homo sapiens
ggttattttttcata

SEQ ID NO: 133262 - DNA, 15 bp, Homo sapiens
aggttattttttcat

SEQ ID NO: 133263 - DNA, 15 bp, Homo sapiens
gaggttattttttca

SEQ ID NO: 133264 - DNA, 15 bp, Homo sapiens
agaggttattttttc

SEQ ID NO: 133265 - DNA, 15 bp, Homo sapiens
aagaggttatttttt

SEQ ID NO: 133266 - DNA, 15 bp, Homo sapiens
taagaggttattttt

SEQ ID NO: 133267 - DNA, 15 bp, Homo sapiens
ctaagaggttatttt

SEQ ID NO: 133268 - DNA, 15 bp, Homo sapiens
tctaagaggttattt

SEQ ID NO: 133269 - DNA, 15 bp, Homo sapiens
ttctaagaggttatt

SEQ ID NO: 133270 - DNA, 15 bp, Homo sapiens
attctaagaggttat

SEQ ID NO: 133271 - DNA, 15 bp, Homo sapiens
aattctaagaggtta

SEQ ID NO: 133272 - DNA, 15 bp, Homo sapiens
aaattctaagaggtt

SEQ ID NO: 133273 - DNA, 15 bp, Homo sapiens
aaaattctaagaggt

SEQ ID NO: 133274 - DNA, 15 bp, Homo sapiens
aaaaattctaagagg

SEQ ID NO: 133275 - DNA, 15 bp, Homo sapiens
aaaaaaattctaaga

SEQ ID NO: 133276 - DNA, 15 bp, Homo sapiens
aaaaaaaattctaag

SEQ ID NO: 133277 - DNA, 15 bp, Homo sapiens
taaaaaaaattctaa

SEQ ID NO: 133278 - DNA, 15 bp, Homo sapiens
gtaaaaaaaattcta

SEQ ID NO: 133279 - DNA, 15 bp, Homo sapiens
agtaaaaaaaattct

SEQ ID NO: 133280 - DNA, 15 bp, Homo sapiens
aagtaaaaaaaattc

SEQ ID NO: 133281 - DNA, 15 bp, Homo sapiens
taagtaaaaaaaatt

SEQ ID NO: 133282 - DNA, 15 bp, Homo sapiens
ttaagtaaaaaaaat

SEQ ID NO: 133283 - DNA, 15 bp, Homo sapiens
tttaagtaaaaaaaa

SEQ ID NO: 133284 - DNA, 15 bp, Homo sapiens
gtttaagtaaaaaaa

SEQ ID NO: 133285 - DNA, 15 bp, Homo sapiens
agtttaagtaaaaaa

SEQ ID NO: 133286 - DNA, 15 bp, Homo sapiens
tagtttaagtaaaaa

SEQ ID NO: 133287 - DNA, 15 bp, Homo sapiens
ttagtttaagtaaaa

SEQ ID NO: 133288 - DNA, 15 bp, Homo sapiens
tttagtttaagtaaa

SEQ ID NO: 133289 - DNA, 15 bp, Homo sapiens
atttagtttaagtaa

SEQ ID NO: 133290 - DNA, 15 bp, Homo sapiens
aatttagtttaagta

SEQ ID NO: 133291 - DNA, 15 bp, Homo sapiens
aaatttagtttaagt

SEQ ID NO: 133292 - DNA, 15 bp, Homo sapiens
aaaatttagtttaag

SEQ ID NO: 133293 - DNA, 15 bp, Homo sapiens
taaaatttagtttaa

SEQ ID NO: 133294 - DNA, 15 bp, Homo sapiens
ataaaatttagttta

SEQ ID NO: 133295 - DNA, 15 bp, Homo sapiens
aataaaatttagttt

SEQ ID NO: 133296 - DNA, 15 bp, Homo sapiens
aaataaaatttagtt

SEQ ID NO: 133297 - DNA, 15 bp, Homo sapiens
taaataaaatttagt

SEQ ID NO: 133298 - DNA, 15 bp, Homo sapiens
ttaaataaaatttag

SEQ ID NO: 133299 - DNA, 15 bp, Homo sapiens
tttaaataaaattta

SEQ ID NO: 133300 - DNA, 15 bp, Homo sapiens
atttaaataaaattt

SEQ ID NO: 133301 - DNA, 15 bp, Homo sapiens
tatttaaataaaatt

SEQ ID NO: 133302 - DNA, 15 bp, Homo sapiens
gtatttaaataaaat

SEQ ID NO: 133303 - DNA, 15 bp, Homo sapiens
tgtatttaaataaaa

SEQ ID NO: 133304 - DNA, 15 bp, Homo sapiens
gtgtatttaaataaa

SEQ ID NO: 133305 - DNA, 15 bp, Homo sapiens
tgtgtatttaaataa

SEQ ID NO: 133306 - DNA, 15 bp, Homo sapiens
atgtgtatttaaata

SEQ ID NO: 133307 - DNA, 15 bp, Homo sapiens
tatgtgtatttaaat

SEQ ID NO: 133308 - DNA, 15 bp, Homo sapiens
gtatgtgtatttaaa

SEQ ID NO: 133309 - DNA, 15 bp, Homo sapiens
tgtatgtgtatttaa

SEQ ID NO: 133310 - DNA, 15 bp, Homo sapiens
gtgtatgtgtattta

SEQ ID NO: 133311 - DNA, 15 bp, Homo sapiens
cgtgtatgtgtattt

SEQ ID NO: 133312 - DNA, 15 bp, Homo sapiens
acgtgtatgtgtatt

SEQ ID NO: 133313 - DNA, 15 bp, Homo sapiens
cacgtgtatgtgtat

SEQ ID NO: 133314 - DNA, 15 bp, Homo sapiens
acacgtgtatgtgta

SEQ ID NO: 133315 - DNA, 15 bp, Homo sapiens
gacacgtgtatgtgt

SEQ ID NO: 133316 - DNA, 15 bp, Homo sapiens
tgacacgtgtatgtg

SEQ ID NO: 133317 - DNA, 15 bp, Homo sapiens
gtgacacgtgtatgt

SEQ ID NO: 133318 - DNA, 15 bp, Homo sapiens
ggtgacacgtgtatg

SEQ ID NO: 133319 - DNA, 15 bp, Homo sapiens
tggtgacacgtgtat

SEQ ID NO: 133320 - DNA, 15 bp, Homo sapiens
atggtgacacgtgta

SEQ ID NO: 133321 - DNA, 15 bp, Homo sapiens
catggtgacacgtgt

SEQ ID NO: 133322 - DNA, 15 bp, Homo sapiens
tcatggtgacacgtg

SEQ ID NO: 133323 - DNA, 15 bp, Homo sapiens
gtcatggtgacacgt

SEQ ID NO: 133324 - DNA, 15 bp, Homo sapiens
tgtcatggtgacacg

SEQ ID NO: 133325 - DNA, 15 bp, Homo sapiens
gtgtcatggtgacac

SEQ ID NO: 133326 - DNA, 15 bp, Homo sapiens
ggtgtcatggtgaca

SEQ ID NO: 133327 - DNA, 15 bp, Homo sapiens
tggtgtcatggtgac

SEQ ID NO: 133328 - DNA, 15 bp, Homo sapiens
gtggtgtcatggtga

SEQ ID NO: 133329 - DNA, 15 bp, Homo sapiens
ggtggtgtcatggtg

SEQ ID NO: 133330 - DNA, 15 bp, Homo sapiens
tggtggtgtcatggt

SEQ ID NO: 133331 - DNA, 15 bp, Homo sapiens
atggtggtgtcatgg

SEQ ID NO: 133332 - DNA, 15 bp, Homo sapiens
tatggtggtgtcatg

SEQ ID NO: 133333 - DNA, 15 bp, Homo sapiens
ttatggtggtgtcat

SEQ ID NO: 133334 - DNA, 15 bp, Homo sapiens
attatggtggtgtca

SEQ ID NO: 133335 - DNA, 15 bp, Homo sapiens
aattatggtggtgtc

SEQ ID NO: 133336 - DNA, 15 bp, Homo sapiens
taattatggtggtgt

SEQ ID NO: 133337 - DNA, 15 bp, Homo sapiens
ttaattatggtggtg

SEQ ID NO: 133338 - DNA, 15 bp, Homo sapiens
tttaattatggtggt

SEQ ID NO: 133339 - DNA, 15 bp, Homo sapiens
ttttaattatggtgg

SEQ ID NO: 133340 - DNA, 15 bp, Homo sapiens
gttttaattatggtg

SEQ ID NO: 133341 - DNA, 15 bp, Homo sapiens
tgttttaattatggt

SEQ ID NO: 133342 - DNA, 15 bp, Homo sapiens
atgttttaattatgg

SEQ ID NO: 133343 - DNA, 15 bp, Homo sapiens
gatgttttaattatg

SEQ ID NO: 133344 - DNA, 15 bp, Homo sapiens
ggatgttttaattat

SEQ ID NO: 133345 - DNA, 15 bp, Homo sapiens
aggatgttttaatta

SEQ ID NO: 133346 - DNA, 15 bp, Homo sapiens
caggatgttttaatt

SEQ ID NO: 133347 - DNA, 15 bp, Homo sapiens
acaggatgttttaat

SEQ ID NO: 133348 - DNA, 15 bp, Homo sapiens
aacaggatgttttaa

SEQ ID NO: 133349 - DNA, 15 bp, Homo sapiens
caacaggatgtttta

SEQ ID NO: 133350 - DNA, 15 bp, Homo sapiens
tcaacaggatgtttt

SEQ ID NO: 133351 - DNA, 15 bp, Homo sapiens
atcaacaggatgttt

SEQ ID NO: 133352 - DNA, 15 bp, Homo sapiens
aatcaacaggatgtt

SEQ ID NO: 133353 - DNA, 15 bp, Homo sapiens
taatcaacaggatgt

SEQ ID NO: 133354 - DNA, 15 bp, Homo sapiens
ttaatcaacaggatg

SEQ ID NO: 133355 - DNA, 15 bp, Homo sapiens
attaatcaacaggat

SEQ ID NO: 133356 - DNA, 15 bp, Homo sapiens
aattaatcaacagga

SEQ ID NO: 133357 - DNA, 15 bp, Homo sapiens
aaattaatcaacagg

SEQ ID NO: 133358 - DNA, 15 bp, Homo sapiens
gaaattaatcaacag

SEQ ID NO: 133359 - DNA, 15 bp, Homo sapiens
agaaattaatcaaca

SEQ ID NO: 133360 - DNA, 15 bp, Homo sapiens
gagaaattaatcaac

SEQ ID NO: 133361 - DNA, 15 bp, Homo sapiens
agagaaattaatcaa

SEQ ID NO: 133362 - DNA, 15 bp, Homo sapiens
aagagaaattaatca

SEQ ID NO: 133363 - DNA, 15 bp, Homo sapiens
aaagagaaattaatc

SEQ ID NO: 133364 - DNA, 15 bp, Homo sapiens
aaaagagaaattaat

SEQ ID NO: 133365 - DNA, 15 bp, Homo sapiens
caaaagagaaattaa

SEQ ID NO: 133366 - DNA, 15 bp, Homo sapiens
gcaaaagagaaatta

SEQ ID NO: 133367 - DNA, 15 bp, Homo sapiens
agcaaaagagaaatt

SEQ ID NO: 133368 - DNA, 15 bp, Homo sapiens
tagcaaaagagaaat

SEQ ID NO: 133369 - DNA, 15 bp, Homo sapiens
gtagcaaaagagaaa

SEQ ID NO: 133370 - DNA, 15 bp, Homo sapiens
tgtagcaaaagagaa

SEQ ID NO: 133371 - DNA, 15 bp, Homo sapiens
atgtagcaaaagaga

SEQ ID NO: 133372 - DNA, 15 bp, Homo sapiens
aatgtagcaaaagag

SEQ ID NO: 133373 - DNA, 15 bp, Homo sapiens
aaatgtagcaaaaga

SEQ ID NO: 133374 - DNA, 15 bp, Homo sapiens
aaaatgtagcaaaag

SEQ ID NO: 133375 - DNA, 15 bp, Homo sapiens
aaaaatgtagcaaaa

SEQ ID NO: 133376 - DNA, 15 bp, Homo sapiens
gaaaaatgtagcaaa

SEQ ID NO: 133377 - DNA, 15 bp, Homo sapiens
tgaaaaatgtagcaa

SEQ ID NO: 133378 - DNA, 15 bp, Homo sapiens
atgaaaaatgtagca

SEQ ID NO: 133379 - DNA, 15 bp, Homo sapiens
aatgaaaaatgtagc

SEQ ID NO: 133380 - DNA, 15 bp, Homo sapiens
aaatgaaaaatgtag

SEQ ID NO: 133381 - DNA, 15 bp, Homo sapiens
gaaatgaaaaatgta

SEQ ID NO: 133382 - DNA, 15 bp, Homo sapiens
tgaaatgaaaaatgt

SEQ ID NO: 133383 - DNA, 15 bp, Homo sapiens
ctgaaatgaaaaatg

SEQ ID NO: 133384 - DNA, 15 bp, Homo sapiens
gctgaaatgaaaaat

SEQ ID NO: 133385 - DNA, 15 bp, Homo sapiens
agctgaaatgaaaaa

SEQ ID NO: 133386 - DNA, 15 bp, Homo sapiens
gagctgaaatgaaaa

SEQ ID NO: 133387 - DNA, 15 bp, Homo sapiens
tgagctgaaatgaaa

SEQ ID NO: 133388 - DNA, 15 bp, Homo sapiens
atgagctgaaatgaa

SEQ ID NO: 133389 - DNA, 15 bp, Homo sapiens
gatgagctgaaatga

SEQ ID NO: 133390 - DNA, 15 bp, Homo sapiens
ggatgagctgaaatg

SEQ ID NO: 133391 - DNA, 15 bp, Homo sapiens
aggatgagctgaaat

SEQ ID NO: 133392 - DNA, 15 bp, Homo sapiens
taggatgagctgaaa

SEQ ID NO: 133393 - DNA, 15 bp, Homo sapiens
ttaggatgagctgaa

SEQ ID NO: 133394 - DNA, 15 bp, Homo sapiens
attaggatgagctga

SEQ ID NO: 133395 - DNA, 15 bp, Homo sapiens
cattaggatgagctg

SEQ ID NO: 133396 - DNA, 15 bp, Homo sapiens
acattaggatgagct

SEQ ID NO: 133397 - DNA, 15 bp, Homo sapiens
gacattaggatgagc

SEQ ID NO: 133398 - DNA, 15 bp, Homo sapiens
ggacattaggatgag

SEQ ID NO: 133399 - DNA, 15 bp, Homo sapiens
tggacattaggatga

SEQ ID NO: 133400 - DNA, 15 bp, Homo sapiens
ttggacattaggatg

SEQ ID NO: 133401 - DNA, 15 bp, Homo sapiens
tttggacattaggat

SEQ ID NO: 133402 - DNA, 15 bp, Homo sapiens
ttttggacattagga

SEQ ID NO: 133403 - DNA, 15 bp, Homo sapiens
cttttggacattagg

SEQ ID NO: 133404 - DNA, 15 bp, Homo sapiens
ccttttggacattag

SEQ ID NO: 133405 - DNA, 15 bp, Homo sapiens
accttttggacatta

SEQ ID NO: 133406 - DNA, 15 bp, Homo sapiens
caccttttggacatt

SEQ ID NO: 133407 - DNA, 15 bp, Homo sapiens
ccaccttttggacat

SEQ ID NO: 133408 - DNA, 15 bp, Homo sapiens
accaccttttggaca

SEQ ID NO: 133409 - DNA, 15 bp, Homo sapiens
caccaccttttggac

SEQ ID NO: 133410 - DNA, 15 bp, Homo sapiens
gcaccaccttttgga

SEQ ID NO: 133411 - DNA, 15 bp, Homo sapiens
agcaccaccttttgg

SEQ ID NO: 133412 - DNA, 15 bp, Homo sapiens
tagcaccaccttttg

SEQ ID NO: 133413 - DNA, 15 bp, Homo sapiens
ctagcaccacctttt

SEQ ID NO: 133414 - DNA, 15 bp, Homo sapiens
actagcaccaccttt

SEQ ID NO: 133415 - DNA, 15 bp, Homo sapiens
tactagcaccacctt

SEQ ID NO: 133416 - DNA, 15 bp, Homo sapiens
atactagcaccacct

SEQ ID NO: 133417 - DNA, 15 bp, Homo sapiens
gatactagcaccacc

SEQ ID NO: 133418 - DNA, 15 bp, Homo sapiens
tgatactagcaccac

SEQ ID NO: 133419 - DNA, 15 bp, Homo sapiens
atgatactagcacca

SEQ ID NO: 133420 - DNA, 15 bp, Homo sapiens
gatgatactagcacc

SEQ ID NO: 133421 - DNA, 15 bp, Homo sapiens
agatgatactagcac

SEQ ID NO: 133422 - DNA, 15 bp, Homo sapiens
cagatgatactagca

SEQ ID NO: 133423 - DNA, 15 bp, Homo sapiens
gcagatgatactagc

SEQ ID NO: 133424 - DNA, 15 bp, Homo sapiens
cgcagatgatactag

SEQ ID NO: 133425 - DNA, 15 bp, Homo sapiens
acgcagatgatacta

SEQ ID NO: 133426 - DNA, 15 bp, Homo sapiens
gacgcagatgatact

SEQ ID NO: 133427 - DNA, 15 bp, Homo sapiens
tgacgcagatgatac

SEQ ID NO: 133428 - DNA, 15 bp, Homo sapiens
ctgacgcagatgata

SEQ ID NO: 133429 - DNA, 15 bp, Homo sapiens
tctgacgcagatgat

SEQ ID NO: 133430 - DNA, 15 bp, Homo sapiens
atctgacgcagatga

SEQ ID NO: 133431 - DNA, 15 bp, Homo sapiens
tatctgacgcagatg

SEQ ID NO: 133432 - DNA, 15 bp, Homo sapiens
atatctgacgcagat

SEQ ID NO: 133433 - DNA, 15 bp, Homo sapiens
aatatctgacgcaga

SEQ ID NO: 133434 - DNA, 15 bp, Homo sapiens
gaatatctgacgcag

SEQ ID NO: 133435 - DNA, 15 bp, Homo sapiens
ggaatatctgacgca

SEQ ID NO: 133436 - DNA, 15 bp, Homo sapiens
aggaatatctgacgc

SEQ ID NO: 133437 - DNA, 15 bp, Homo sapiens
caggaatatctgacg

SEQ ID NO: 133438 - DNA, 15 bp, Homo sapiens
acaggaatatctgac

SEQ ID NO: 133439 - DNA, 15 bp, Homo sapiens
aacaggaatatctga

SEQ ID NO: 133440 - DNA, 15 bp, Homo sapiens
gaacaggaatatctg

SEQ ID NO: 133441 - DNA, 15 bp, Homo sapiens
tgaacaggaatatct

SEQ ID NO: 133442 - DNA, 15 bp, Homo sapiens
ctgaacaggaatatc

SEQ ID NO: 133443 - DNA, 15 bp, Homo sapiens
actgaacaggaatat

SEQ ID NO: 133444 - DNA, 15 bp, Homo sapiens
gactgaacaggaata

SEQ ID NO: 133445 - DNA, 15 bp, Homo sapiens
agactgaacaggaat

SEQ ID NO: 133446 - DNA, 15 bp, Homo sapiens
gagactgaacaggaa

SEQ ID NO: 133447 - DNA, 15 bp, Homo sapiens
tgagactgaacagga

SEQ ID NO: 133448 - DNA, 15 bp, Homo sapiens
atgagactgaacagg

SEQ ID NO: 133449 - DNA, 15 bp, Homo sapiens
gatgagactgaacag

SEQ ID NO: 133450 - DNA, 15 bp, Homo sapiens
cgatgagactgaaca

SEQ ID NO: 133451 - DNA, 15 bp, Homo sapiens
acgatgagactgaac

SEQ ID NO: 133452 - DNA, 15 bp, Homo sapiens
tacgatgagactgaa

SEQ ID NO: 133453 - DNA, 15 bp, Homo sapiens
gtacgatgagactga

SEQ ID NO: 133454 - DNA, 15 bp, Homo sapiens
agtacgatgagactg

SEQ ID NO: 133455 - DNA, 15 bp, Homo sapiens
aagtacgatgagact

SEQ ID NO: 133456 - DNA, 15 bp, Homo sapiens
gaagtacgatgagac

SEQ ID NO: 133457 - DNA, 15 bp, Homo sapiens
cgaagtacgatgaga

SEQ ID NO: 133458 - DNA, 15 bp, Homo sapiens
ccgaagtacgatgag

SEQ ID NO: 133459 - DNA, 15 bp, Homo sapiens
tccgaagtacgatga

SEQ ID NO: 133460 - DNA, 15 bp, Homo sapiens
ttccgaagtacgatg

SEQ ID NO: 133461 - DNA, 15 bp, Homo sapiens
tttccgaagtacgat

SEQ ID NO: 133462 - DNA, 15 bp, Homo sapiens
atttccgaagtacga

SEQ ID NO: 133463 - DNA, 15 bp, Homo sapiens
aatttccgaagtacg

SEQ ID NO: 133464 - DNA, 15 bp, Homo sapiens
aaatttccgaagtac

SEQ ID NO: 133465 - DNA, 15 bp, Homo sapiens
gaaatttccgaagta

SEQ ID NO: 133466 - DNA, 15 bp, Homo sapiens
tgaaatttccgaagt

SEQ ID NO: 133467 - DNA, 15 bp, Homo sapiens
ttgaaatttccgaag

SEQ ID NO: 133468 - DNA, 15 bp, Homo sapiens
attgaaatttccgaa

SEQ ID NO: 133469 - DNA, 15 bp, Homo sapiens
aattgaaatttccga

SEQ ID NO: 133470 - DNA, 15 bp, Homo sapiens
gaattgaaatttccg

SEQ ID NO: 133471 - DNA, 15 bp, Homo sapiens
ggaattgaaatttcc

SEQ ID NO: 133472 - DNA, 15 bp, Homo sapiens
aggaattgaaatttc

SEQ ID NO: 133473 - DNA, 15 bp, Homo sapiens
caggaattgaaattt

SEQ ID NO: 133474 - DNA, 15 bp, Homo sapiens
gcaggaattgaaatt

SEQ ID NO: 133475 - DNA, 15 bp, Homo sapiens
agcaggaattgaaat

SEQ ID NO: 133476 - DNA, 15 bp, Homo sapiens
cagcaggaattgaaa

SEQ ID NO: 133477 - DNA, 15 bp, Homo sapiens
tcagcaggaattgaa

SEQ ID NO: 133478 - DNA, 15 bp, Homo sapiens
atcagcaggaattga

SEQ ID NO: 133479 - DNA, 15 bp, Homo sapiens
gatcagcaggaattg

SEQ ID NO: 133480 - DNA, 15 bp, Homo sapiens
agatcagcaggaatt

SEQ ID NO: 133481 - DNA, 15 bp, Homo sapiens
aagatcagcaggaat

SEQ ID NO: 133482 - DNA, 15 bp, Homo sapiens
caagatcagcaggaa

SEQ ID NO: 133483 - DNA, 15 bp, Homo sapiens
tcaagatcagcagga

SEQ ID NO: 133484 - DNA, 15 bp, Homo sapiens
atcaagatcagcagg

SEQ ID NO: 133485 - DNA, 15 bp, Homo sapiens
tatcaagatcagcag

SEQ ID NO: 133486 - DNA, 15 bp, Homo sapiens
ttatcaagatcagca

SEQ ID NO: 133487 - DNA, 15 bp, Homo sapiens
tttatcaagatcagc

SEQ ID NO: 133488 - DNA, 15 bp, Homo sapiens
ttttatcaagatcag

SEQ ID NO: 133489 - DNA, 15 bp, Homo sapiens
gttttatcaagatca

SEQ ID NO: 133490 - DNA, 15 bp, Homo sapiens
agttttatcaagatc

SEQ ID NO: 133491 - DNA, 15 bp, Homo sapiens
tagttttatcaagat

SEQ ID NO: 133492 - DNA, 15 bp, Homo sapiens
atagttttatcaaga

SEQ ID NO: 133493 - DNA, 15 bp, Homo sapiens
tatagttttatcaag

SEQ ID NO: 133494 - DNA, 15 bp, Homo sapiens
ttatagttttatcaa

SEQ ID NO: 133495 - DNA, 15 bp, Homo sapiens
gttatagttttatca

SEQ ID NO: 133496 - DNA, 15 bp, Homo sapiens
tgttatagttttatc

SEQ ID NO: 133497 - DNA, 15 bp, Homo sapiens
ctgttatagttttat

SEQ ID NO: 133498 - DNA, 15 bp, Homo sapiens
tctgttatagtttta

SEQ ID NO: 133499 - DNA, 15 bp, Homo sapiens
ttctgttatagtttt

SEQ ID NO: 133500 - DNA, 15 bp, Homo sapiens
gttctgttatagttt

SEQ ID NO: 133501 - DNA, 15 bp, Homo sapiens
agttctgttatagtt

SEQ ID NO: 133502 - DNA, 15 bp, Homo sapiens
tagttctgttatagt

SEQ ID NO: 133503 - DNA, 15 bp, Homo sapiens
ctagttctgttatag

SEQ ID NO: 133504 - DNA, 15 bp, Homo sapiens
gctagttctgttata

SEQ ID NO: 133505 - DNA, 15 bp, Homo sapiens
ggctagttctgttat

SEQ ID NO: 133506 - DNA, 15 bp, Homo sapiens
cggctagttctgtta

SEQ ID NO: 133507 - DNA, 15 bp, Homo sapiens
tcggctagttctgtt

SEQ ID NO: 133508 - DNA, 15 bp, Homo sapiens
gtcggctagttctgt

SEQ ID NO: 133509 - DNA, 15 bp, Homo sapiens
agtcggctagttctg

SEQ ID NO: 133510 - DNA, 15 bp, Homo sapiens
cagtcggctagttct

SEQ ID NO: 133511 - DNA, 15 bp, Homo sapiens
ccagtcggctagttc

SEQ ID NO: 133512 - DNA, 15 bp, Homo sapiens
gccagtcggctagtt

SEQ ID NO: 133513 - DNA, 15 bp, Homo sapiens
agccagtcggctagt

SEQ ID NO: 133514 - DNA, 15 bp, Homo sapiens
cagccagtcggctag

SEQ ID NO: 133515 - DNA, 15 bp, Homo sapiens
ccagccagtcggcta

SEQ ID NO: 133516 - DNA, 15 bp, Homo sapiens
accagccagtcggct

SEQ ID NO: 133517 - DNA, 15 bp, Homo sapiens
taccagccagtcggc

SEQ ID NO: 133518 - DNA, 15 bp, Homo sapiens
ataccagccagtcgg

SEQ ID NO: 133519 - DNA, 15 bp, Homo sapiens
aataccagccagtcg

SEQ ID NO: 133520 - DNA, 15 bp, Homo sapiens
taataccagccagtc

SEQ ID NO: 133521 - DNA, 15 bp, Homo sapiens
ttaataccagccagt

SEQ ID NO: 133522 - DNA, 15 bp, Homo sapiens
attaataccagccag

SEQ ID NO: 133523 - DNA, 15 bp, Homo sapiens
gattaataccagcca

SEQ ID NO: 133524 - DNA, 15 bp, Homo sapiens
cgattaataccagcc

SEQ ID NO: 133525 - DNA, 15 bp, Homo sapiens
tcgattaataccagc

SEQ ID NO: 133526 - DNA, 15 bp, Homo sapiens
gtcgattaataccag

SEQ ID NO: 133527 - DNA, 15 bp, Homo sapiens
ggtcgattaatacca

SEQ ID NO: 133528 - DNA, 15 bp, Homo sapiens
tggtcgattaatacc

SEQ ID NO: 133529 - DNA, 15 bp, Homo sapiens
ctggtcgattaatac

SEQ ID NO: 133530 - DNA, 15 bp, Homo sapiens
tctggtcgattaata

SEQ ID NO: 133531 - DNA, 15 bp, Homo sapiens
atctggtcgattaat

SEQ ID NO: 133532 - DNA, 15 bp, Homo sapiens
catctggtcgattaa

SEQ ID NO: 133533 - DNA, 15 bp, Homo sapiens
gcatctggtcgatta

SEQ ID NO: 133534 - DNA, 15 bp, Homo sapiens
agcatctggtcgatt

SEQ ID NO: 133535 - DNA, 15 bp, Homo sapiens
cagcatctggtcgat

SEQ ID NO: 133536 - DNA, 15 bp, Homo sapiens
tcagcatctggtcga

SEQ ID NO: 133537 - DNA, 15 bp, Homo sapiens
ttcagcatctggtcg

SEQ ID NO: 133538 - DNA, 15 bp, Homo sapiens
cttcagcatctggtc

SEQ ID NO: 133539 - DNA, 15 bp, Homo sapiens
acttcagcatctggt

SEQ ID NO: 133540 - DNA, 15 bp, Homo sapiens
gacttcagcatctgg

SEQ ID NO: 133541 - DNA, 15 bp, Homo sapiens
ggacttcagcatctg

SEQ ID NO: 133542 - DNA, 15 bp, Homo sapiens
tggacttcagcatct

SEQ ID NO: 133543 - DNA, 15 bp, Homo sapiens
ttggacttcagcatc

SEQ ID NO: 133544 - DNA, 15 bp, Homo sapiens
gttggacttcagcat

SEQ ID NO: 133545 - DNA, 15 bp, Homo sapiens
tgttggacttcagca

SEQ ID NO: 133546 - DNA, 15 bp, Homo sapiens
atgttggacttcagc

SEQ ID NO: 133547 - DNA, 15 bp, Homo sapiens
aatgttggacttcag

SEQ ID NO: 133548 - DNA, 15 bp, Homo sapiens
caatgttggacttca

SEQ ID NO: 133549 - DNA, 15 bp, Homo sapiens
acaatgttggacttc

SEQ ID NO: 133550 - DNA, 15 bp, Homo sapiens
gacaatgttggactt

SEQ ID NO: 133551 - DNA, 15 bp, Homo sapiens
tgacaatgttggact

SEQ ID NO: 133552 - DNA, 15 bp, Homo sapiens
gtgacaatgttggac

SEQ ID NO: 133553 - DNA, 15 bp, Homo sapiens
agtgacaatgttgga

SEQ ID NO: 133554 - DNA, 15 bp, Homo sapiens
cagtgacaatgttgg

SEQ ID NO: 133555 - DNA, 15 bp, Homo sapiens
acagtgacaatgttg

SEQ ID NO: 133556 - DNA, 15 bp, Homo sapiens
aacagtgacaatgtt

SEQ ID NO: 133557 - DNA, 15 bp, Homo sapiens
caacagtgacaatgt

SEQ ID NO: 133558 - DNA, 15 bp, Homo sapiens
ccaacagtgacaatg

SEQ ID NO: 133559 - DNA, 15 bp, Homo sapiens
cccaacagtgacaat

SEQ ID NO: 133560 - DNA, 15 bp, Homo sapiens
ccccaacagtgacaa

SEQ ID NO: 133561 - DNA, 15 bp, Homo sapiens
tccccaacagtgaca

SEQ ID NO: 133562 - DNA, 15 bp, Homo sapiens
atccccaacagtgac

SEQ ID NO: 133563 - DNA, 15 bp, Homo sapiens
catccccaacagtga

SEQ ID NO: 133564 - DNA, 15 bp, Homo sapiens
acatccccaacagtg

SEQ ID NO: 133565 - DNA, 15 bp, Homo sapiens
tacatccccaacagt

SEQ ID NO: 133566 - DNA, 15 bp, Homo sapiens
ctacatccccaacag

SEQ ID NO: 133567 - DNA, 15 bp, Homo sapiens
tctacatccccaaca

SEQ ID NO: 133568 - DNA, 15 bp, Homo sapiens
ttctacatccccaac

SEQ ID NO: 133569 - DNA, 15 bp, Homo sapiens
cttctacatccccaa

SEQ ID NO: 133570 - DNA, 15 bp, Homo sapiens
tcttctacatcccca

SEQ ID NO: 133571 - DNA, 15 bp, Homo sapiens
ctcttctacatcccc

SEQ ID NO: 133572 - DNA, 15 bp, Homo sapiens
tctcttctacatccc

SEQ ID NO: 133573 - DNA, 15 bp, Homo sapiens
atctcttctacatcc

SEQ ID NO: 133574 - DNA, 15 bp, Homo sapiens
gatctcttctacatc

SEQ ID NO: 133575 - DNA, 15 bp, Homo sapiens
tgatctcttctacat

SEQ ID NO: 133576 - DNA, 15 bp, Homo sapiens
ttgatctcttctaca

SEQ ID NO: 133577 - DNA, 15 bp, Homo sapiens
attgatctcttctac

SEQ ID NO: 133578 - DNA, 15 bp, Homo sapiens
tattgatctcttcta

SEQ ID NO: 133579 - DNA, 15 bp, Homo sapiens
ttattgatctcttct

SEQ ID NO: 133580 - DNA, 15 bp, Homo sapiens
cttattgatctcttc

SEQ ID NO: 133581 - DNA, 15 bp, Homo sapiens
tcttattgatctctt

SEQ ID NO: 133582 - DNA, 15 bp, Homo sapiens
gtcttattgatctct

SEQ ID NO: 133583 - DNA, 15 bp, Homo sapiens
ggtcttattgatctc

SEQ ID NO: 133584 - DNA, 15 bp, Homo sapiens
cggtcttattgatct

SEQ ID NO: 133585 - DNA, 15 bp, Homo sapiens
acggtcttattgatc

SEQ ID NO: 133586 - DNA, 15 bp, Homo sapiens
aacggtcttattgat

SEQ ID NO: 133587 - DNA, 15 bp, Homo sapiens
aaacggtcttattga

SEQ ID NO: 133588 - DNA, 15 bp, Homo sapiens
gaaacggtcttattg

SEQ ID NO: 133589 - DNA, 15 bp, Homo sapiens
ggaaacggtcttatt

SEQ ID NO: 133590 - DNA, 15 bp, Homo sapiens
gggaaacggtcttat

SEQ ID NO: 133591 - DNA, 15 bp, Homo sapiens
cgggaaacggtctta

SEQ ID NO: 133592 - DNA, 15 bp, Homo sapiens
tcgggaaacggtctt

SEQ ID NO: 133593 - DNA, 15 bp, Homo sapiens
ttcgggaaacggtct

SEQ ID NO: 133594 - DNA, 15 bp, Homo sapiens
attcgggaaacggtc

SEQ ID NO: 133595 - DNA, 15 bp, Homo sapiens
cattcgggaaacggt

SEQ ID NO: 133596 - DNA, 15 bp, Homo sapiens
tcattcgggaaacgg

SEQ ID NO: 133597 - DNA, 15 bp, Homo sapiens
ttcattcgggaaacg

SEQ ID NO: 133598 - DNA, 15 bp, Homo sapiens
tttcattcgggaaac

SEQ ID NO: 133599 - DNA, 15 bp, Homo sapiens
ctttcattcgggaaa

SEQ ID NO: 133600 - DNA, 15 bp, Homo sapiens
actttcattcgggaa

SEQ ID NO: 133601 - DNA, 15 bp, Homo sapiens
tactttcattcggga

SEQ ID NO: 133602 - DNA, 15 bp, Homo sapiens
ctactttcattcggg

SEQ ID NO: 133603 - DNA, 15 bp, Homo sapiens
cctactttcattcgg

SEQ ID NO: 133604 - DNA, 15 bp, Homo sapiens
acctactttcattcg

SEQ ID NO: 133605 - DNA, 15 bp, Homo sapiens
cacctactttcattc

SEQ ID NO: 133606 - DNA, 15 bp, Homo sapiens
gcacctactttcatt

SEQ ID NO: 133607 - DNA, 15 bp, Homo sapiens
tgcacctactttcat

SEQ ID NO: 133608 - DNA, 15 bp, Homo sapiens
atgcacctactttca

SEQ ID NO: 133609 - DNA, 15 bp, Homo sapiens
tatgcacctactttc

SEQ ID NO: 133610 - DNA, 15 bp, Homo sapiens
ctatgcacctacttt

SEQ ID NO: 133611 - DNA, 15 bp, Homo sapiens
actatgcacctactt

SEQ ID NO: 133612 - DNA, 15 bp, Homo sapiens
cactatgcacctact

SEQ ID NO: 133613 - DNA, 15 bp, Homo sapiens
acactatgcacctac

SEQ ID NO: 133614 - DNA, 15 bp, Homo sapiens
tacactatgcaccta

SEQ ID NO: 133615 - DNA, 15 bp, Homo sapiens
ttacactatgcacct

SEQ ID NO: 133616 - DNA, 15 bp, Homo sapiens
tttacactatgcacc

SEQ ID NO: 133617 - DNA, 15 bp, Homo sapiens
ttttacactatgcac

SEQ ID NO: 133618 - DNA, 15 bp, Homo sapiens
cttttacactatgca

SEQ ID NO: 133619 - DNA, 15 bp, Homo sapiens
gcttttacactatgc

SEQ ID NO: 133620 - DNA, 15 bp, Homo sapiens
agcttttacactatg

SEQ ID NO: 133621 - DNA, 15 bp, Homo sapiens
aagcttttacactat

SEQ ID NO: 133622 - DNA, 15 bp, Homo sapiens
caagcttttacacta

SEQ ID NO: 133623 - DNA, 15 bp, Homo sapiens
acaagcttttacact

SEQ ID NO: 133624 - DNA, 15 bp, Homo sapiens
gacaagcttttacac

SEQ ID NO: 133625 - DNA, 15 bp, Homo sapiens
tgacaagcttttaca

SEQ ID NO: 133626 - DNA, 15 bp, Homo sapiens
atgacaagcttttac

SEQ ID NO: 133627 - DNA, 15 bp, Homo sapiens
catgacaagctttta

SEQ ID NO: 133628 - DNA, 15 bp, Homo sapiens
ccatgacaagctttt

SEQ ID NO: 133629 - DNA, 15 bp, Homo sapiens
tccatgacaagcttt

SEQ ID NO: 133630 - DNA, 15 bp, Homo sapiens
ttccatgacaagctt

SEQ ID NO: 133631 - DNA, 15 bp, Homo sapiens
tttccatgacaagct

SEQ ID NO: 133632 - DNA, 15 bp, Homo sapiens
gtttccatgacaagc

SEQ ID NO: 133633 - DNA, 15 bp, Homo sapiens
cgtttccatgacaag

SEQ ID NO: 133634 - DNA, 15 bp, Homo sapiens
gcgtttccatgacaa

SEQ ID NO: 133635 - DNA, 15 bp, Homo sapiens
ggcgtttccatgaca

SEQ ID NO: 133636 - DNA, 15 bp, Homo sapiens
tggcgtttccatgac

SEQ ID NO: 133637 - DNA, 15 bp, Homo sapiens
gtggcgtttccatga

SEQ ID NO: 133638 - DNA, 15 bp, Homo sapiens
tgtggcgtttccatg

SEQ ID NO: 133639 - DNA, 15 bp, Homo sapiens
ttgtggcgtttccat

SEQ ID NO: 133640 - DNA, 15 bp, Homo sapiens
gttgtggcgtttcca

SEQ ID NO: 133641 - DNA, 15 bp, Homo sapiens
ggttgtggcgtttcc

SEQ ID NO: 133642 - DNA, 15 bp, Homo sapiens
gggttgtggcgtttc

SEQ ID NO: 133643 - DNA, 15 bp, Homo sapiens
tgggttgtggcgttt

SEQ ID NO: 133644 - DNA, 15 bp, Homo sapiens
ctgggttgtggcgtt

SEQ ID NO: 133645 - DNA, 15 bp, Homo sapiens
tctgggttgtggcgt

SEQ ID NO: 133646 - DNA, 15 bp, Homo sapiens
ctctgggttgtggcg

SEQ ID NO: 133647 - DNA, 15 bp, Homo sapiens
cctctgggttgtggc

SEQ ID NO: 133648 - DNA, 15 bp, Homo sapiens
acctctgggttgtgg

SEQ ID NO: 133649 - DNA, 15 bp, Homo sapiens
tacctctgggttgtg

SEQ ID NO: 133650 - DNA, 15 bp, Homo sapiens
ctacctctgggttgt

SEQ ID NO: 133651 - DNA, 15 bp, Homo sapiens
tctacctctgggttg

SEQ ID NO: 133652 - DNA, 15 bp, Homo sapiens
gtctacctctgggtt

SEQ ID NO: 133653 - DNA, 15 bp, Homo sapiens
ggtctacctctgggt

SEQ ID NO: 133654 - DNA, 15 bp, Homo sapiens
tggtctacctctggg

SEQ ID NO: 133655 - DNA, 15 bp, Homo sapiens
ctggtctacctctgg

SEQ ID NO: 133656 - DNA, 15 bp, Homo sapiens
tctggtctacctctg

SEQ ID NO: 133657 - DNA, 15 bp, Homo sapiens
atctggtctacctct

SEQ ID NO: 133658 - DNA, 15 bp, Homo sapiens
gatctggtctacctc

SEQ ID NO: 133659 - DNA, 15 bp, Homo sapiens
agatctggtctacct

SEQ ID NO: 133660 - DNA, 15 bp, Homo sapiens
cagatctggtctacc

SEQ ID NO: 133661 - DNA, 15 bp, Homo sapiens
acagatctggtctac

SEQ ID NO: 133662 - DNA, 15 bp, Homo sapiens
aacagatctggtcta

SEQ ID NO: 133663 - DNA, 15 bp, Homo sapiens
aaacagatctggtct

SEQ ID NO: 133664 - DNA, 15 bp, Homo sapiens
caaacagatctggtc

SEQ ID NO: 133665 - DNA, 15 bp, Homo sapiens
tcaaacagatctggt

SEQ ID NO: 133666 - DNA, 15 bp, Homo sapiens
ttcaaacagatctgg

SEQ ID NO: 133667 - DNA, 15 bp, Homo sapiens
attcaaacagatctg

SEQ ID NO: 133668 - DNA, 15 bp, Homo sapiens
gattcaaacagatct

SEQ ID NO: 133669 - DNA, 15 bp, Homo sapiens
ggattcaaacagatc

SEQ ID NO: 133670 - DNA, 15 bp, Homo sapiens
gggattcaaacagat

SEQ ID NO: 133671 - DNA, 15 bp, Homo sapiens
agggattcaaacaga

SEQ ID NO: 133672 - DNA, 15 bp, Homo sapiens
aagggattcaaacag

SEQ ID NO: 133673 - DNA, 15 bp, Homo sapiens
aaagggattcaaaca

SEQ ID NO: 133674 - DNA, 15 bp, Homo sapiens
aaaagggattcaaac

SEQ ID NO: 133675 - DNA, 15 bp, Homo sapiens
caaaagggattcaaa

SEQ ID NO: 133676 - DNA, 15 bp, Homo sapiens
acaaaagggattcaa

SEQ ID NO: 133677 - DNA, 15 bp, Homo sapiens
aacaaaagggattca

SEQ ID NO: 133678 - DNA, 15 bp, Homo sapiens
aaacaaaagggattc

SEQ ID NO: 133679 - DNA, 15 bp, Homo sapiens
taaacaaaagggatt

SEQ ID NO: 133680 - DNA, 15 bp, Homo sapiens
ataaacaaaagggat

SEQ ID NO: 133681 - DNA, 15 bp, Homo sapiens
gataaacaaaaggga

SEQ ID NO: 133682 - DNA, 15 bp, Homo sapiens
ggataaacaaaaggg

SEQ ID NO: 133683 - DNA, 15 bp, Homo sapiens
aggataaacaaaagg

SEQ ID NO: 133684 - DNA, 15 bp, Homo sapiens
taggataaacaaaag

SEQ ID NO: 133685 - DNA, 15 bp, Homo sapiens
ttaggataaacaaaa

SEQ ID NO: 133686 - DNA, 15 bp, Homo sapiens
tttaggataaacaaa

SEQ ID NO: 133687 - DNA, 15 bp, Homo sapiens
gtttaggataaacaa

SEQ ID NO: 133688 - DNA, 15 bp, Homo sapiens
agtttaggataaaca

SEQ ID NO: 133689 - DNA, 15 bp, Homo sapiens
tagtttaggataaac

SEQ ID NO: 133690 - DNA, 15 bp, Homo sapiens
atagtttaggataaa

SEQ ID NO: 133691 - DNA, 15 bp, Homo sapiens
catagtttaggataa

SEQ ID NO: 133692 - DNA, 15 bp, Homo sapiens
tcatagtttaggata

SEQ ID NO: 133693 - DNA, 15 bp, Homo sapiens
ctcatagtttaggat

SEQ ID NO: 133694 - DNA, 15 bp, Homo sapiens
tctcatagtttagga

SEQ ID NO: 133695 - DNA, 15 bp, Homo sapiens
ctctcatagtttagg

SEQ ID NO: 133696 - DNA, 15 bp, Homo sapiens
tctctcatagtttag

SEQ ID NO: 133697 - DNA, 15 bp, Homo sapiens
ttctctcatagttta

SEQ ID NO: 133698 - DNA, 15 bp, Homo sapiens
attctctcatagttt

SEQ ID NO: 133699 - DNA, 15 bp, Homo sapiens
cattctctcatagtt

SEQ ID NO: 133700 - DNA, 15 bp, Homo sapiens
tcattctctcatagt

SEQ ID NO: 133701 - DNA, 15 bp, Homo sapiens
ctcattctctcatag

SEQ ID NO: 133702 - DNA, 15 bp, Homo sapiens
cctcattctctcata

SEQ ID NO: 133703 - DNA, 15 bp, Homo sapiens
acctcattctctcat

SEQ ID NO: 133704 - DNA, 15 bp, Homo sapiens
aacctcattctctca

SEQ ID NO: 133705 - DNA, 15 bp, Homo sapiens
aaacctcattctctc

SEQ ID NO: 133706 - DNA, 15 bp, Homo sapiens
taaacctcattctct

SEQ ID NO: 133707 - DNA, 15 bp, Homo sapiens
ttaaacctcattctc

SEQ ID NO: 133708 - DNA, 15 bp, Homo sapiens
tttaaacctcattct

SEQ ID NO: 133709 - DNA, 15 bp, Homo sapiens
ttttaaacctcattc

SEQ ID NO: 133710 - DNA, 15 bp, Homo sapiens
tttttaaacctcatt

SEQ ID NO: 133711 - DNA, 15 bp, Homo sapiens
ttttttaaacctcat

SEQ ID NO: 133712 - DNA, 15 bp, Homo sapiens
attttttaaacctca

SEQ ID NO: 133713 - DNA, 15 bp, Homo sapiens
aattttttaaacctc

SEQ ID NO: 133714 - DNA, 15 bp, Homo sapiens
gaattttttaaacct

SEQ ID NO: 133715 - DNA, 15 bp, Homo sapiens
agaattttttaaacc

SEQ ID NO: 133716 - DNA, 15 bp, Homo sapiens
cagaattttttaaac

SEQ ID NO: 133717 - DNA, 15 bp, Homo sapiens
acagaattttttaaa

SEQ ID NO: 133718 - DNA, 15 bp, Homo sapiens
tacagaattttttaa

SEQ ID NO: 133719 - DNA, 15 bp, Homo sapiens
atacagaatttttta

SEQ ID NO: 133720 - DNA, 15 bp, Homo sapiens
gatacagaatttttt

SEQ ID NO: 133721 - DNA, 15 bp, Homo sapiens
agatacagaattttt

SEQ ID NO: 133722 - DNA, 15 bp, Homo sapiens
cagatacagaatttt

SEQ ID NO: 133723 - DNA, 15 bp, Homo sapiens
acagatacagaattt

SEQ ID NO: 133724 - DNA, 15 bp, Homo sapiens
gacagatacagaatt

SEQ ID NO: 133725 - DNA, 15 bp, Homo sapiens
tgacagatacagaat

SEQ ID NO: 133726 - DNA, 15 bp, Homo sapiens
ttgacagatacagaa

SEQ ID NO: 133727 - DNA, 15 bp, Homo sapiens
tttgacagatacaga

SEQ ID NO: 133728 - DNA, 15 bp, Homo sapiens
gtttgacagatacag

SEQ ID NO: 133729 - DNA, 15 bp, Homo sapiens
tgtttgacagataca

SEQ ID NO: 133730 - DNA, 15 bp, Homo sapiens
ttgtttgacagatac

SEQ ID NO: 133731 - DNA, 15 bp, Homo sapiens
gttgtttgacagata

SEQ ID NO: 133732 - DNA, 15 bp, Homo sapiens
ggttgtttgacagat

SEQ ID NO: 133733 - DNA, 15 bp, Homo sapiens
tggttgtttgacaga

SEQ ID NO: 133734 - DNA, 15 bp, Homo sapiens
atggttgtttgacag

SEQ ID NO: 133735 - DNA, 15 bp, Homo sapiens
aatggttgtttgaca

SEQ ID NO: 133736 - DNA, 15 bp, Homo sapiens
gaatggttgtttgac

SEQ ID NO: 133737 - DNA, 15 bp, Homo sapiens
tgaatggttgtttga

SEQ ID NO: 133738 - DNA, 15 bp, Homo sapiens
ctgaatggttgtttg

SEQ ID NO: 133739 - DNA, 15 bp, Homo sapiens
cctgaatggttgttt

SEQ ID NO: 133740 - DNA, 15 bp, Homo sapiens
ccctgaatggttgtt

SEQ ID NO: 133741 - DNA, 15 bp, Homo sapiens
gccctgaatggttgt

SEQ ID NO: 133742 - DNA, 15 bp, Homo sapiens
agccctgaatggttg

SEQ ID NO: 133743 - DNA, 15 bp, Homo sapiens
tagccctgaatggtt

SEQ ID NO: 133744 - DNA, 15 bp, Homo sapiens
ttagccctgaatggt

SEQ ID NO: 133745 - DNA, 15 bp, Homo sapiens
gttagccctgaatgg

SEQ ID NO: 133746 - DNA, 15 bp, Homo sapiens
agttagccctgaatg

SEQ ID NO: 133747 - DNA, 15 bp, Homo sapiens
tagttagccctgaat

SEQ ID NO: 133748 - DNA, 15 bp, Homo sapiens
gtagttagccctgaa

SEQ ID NO: 133749 - DNA, 15 bp, Homo sapiens
tgtagttagccctga

SEQ ID NO: 133750 - DNA, 15 bp, Homo sapiens
ttgtagttagccctg

SEQ ID NO: 133751 - DNA, 15 bp, Homo sapiens
tttgtagttagccct

SEQ ID NO: 133752 - DNA, 15 bp, Homo sapiens
ctttgtagttagccc

SEQ ID NO: 133753 - DNA, 15 bp, Homo sapiens
gctttgtagttagcc

SEQ ID NO: 133754 - DNA, 15 bp, Homo sapiens
tgctttgtagttagc

SEQ ID NO: 133755 - DNA, 15 bp, Homo sapiens
atgctttgtagttag

SEQ ID NO: 133756 - DNA, 15 bp, Homo sapiens
tatgctttgtagtta

SEQ ID NO: 133757 - DNA, 15 bp, Homo sapiens
ctatgctttgtagtt

SEQ ID NO: 133758 - DNA, 15 bp, Homo sapiens
tctatgctttgtagt

SEQ ID NO: 133759 - DNA, 15 bp, Homo sapiens
ctctatgctttgtag

SEQ ID NO: 133760 - DNA, 15 bp, Homo sapiens
gctctatgctttgta

SEQ ID NO: 133761 - DNA, 15 bp, Homo sapiens
agctctatgctttgt

SEQ ID NO: 133762 - DNA, 15 bp, Homo sapiens
aagctctatgctttg

SEQ ID NO: 133763 - DNA, 15 bp, Homo sapiens
aaagctctatgcttt

SEQ ID NO: 133764 - DNA, 15 bp, Homo sapiens
aaaagctctatgctt

SEQ ID NO: 133765 - DNA, 15 bp, Homo sapiens
gaaaagctctatgct

SEQ ID NO: 133766 - DNA, 15 bp, Homo sapiens
agaaaagctctatgc

SEQ ID NO: 133767 - DNA, 15 bp, Homo sapiens
aagaaaagctctatg

SEQ ID NO: 133768 - DNA, 15 bp, Homo sapiens
caagaaaagctctat

SEQ ID NO: 133769 - DNA, 15 bp, Homo sapiens
gcaagaaaagctcta

SEQ ID NO: 133770 - DNA, 15 bp, Homo sapiens
tgcaagaaaagctct

SEQ ID NO: 133771 - DNA, 15 bp, Homo sapiens
atgcaagaaaagctc

SEQ ID NO: 133772 - DNA, 15 bp, Homo sapiens
aatgcaagaaaagct

SEQ ID NO: 133773 - DNA, 15 bp, Homo sapiens
aaatgcaagaaaagc

SEQ ID NO: 133774 - DNA, 15 bp, Homo sapiens
taaatgcaagaaaag

SEQ ID NO: 133775 - DNA, 15 bp, Homo sapiens
ataaatgcaagaaaa

SEQ ID NO: 133776 - DNA, 15 bp, Homo sapiens
tataaatgcaagaaa

SEQ ID NO: 133777 - DNA, 15 bp, Homo sapiens
gtataaatgcaagaa

SEQ ID NO: 133778 - DNA, 15 bp, Homo sapiens
agtataaatgcaaga

SEQ ID NO: 133779 - DNA, 15 bp, Homo sapiens
cagtataaatgcaag

SEQ ID NO: 133780 - DNA, 15 bp, Homo sapiens
acagtataaatgcaa

SEQ ID NO: 133781 - DNA, 15 bp, Homo sapiens
aacagtataaatgca

SEQ ID NO: 133782 - DNA, 15 bp, Homo sapiens
caacagtataaatgc

SEQ ID NO: 133783 - DNA, 15 bp, Homo sapiens
acaacagtataaatg

SEQ ID NO: 133784 - DNA, 15 bp, Homo sapiens
cacaacagtataaat

SEQ ID NO: 133785 - DNA, 15 bp, Homo sapiens
tcacaacagtataaa

SEQ ID NO: 133786 - DNA, 15 bp, Homo sapiens
atcacaacagtataa

SEQ ID NO: 133787 - DNA, 15 bp, Homo sapiens
tatcacaacagtata

SEQ ID NO: 133788 - DNA, 15 bp, Homo sapiens
atatcacaacagtat

SEQ ID NO: 133789 - DNA, 15 bp, Homo sapiens
catatcacaacagta

SEQ ID NO: 133790 - DNA, 15 bp, Homo sapiens
tcatatcacaacagt

SEQ ID NO: 133791 - DNA, 15 bp, Homo sapiens
atcatatcacaacag

SEQ ID NO: 133792 - DNA, 15 bp, Homo sapiens
gatcatatcacaaca

SEQ ID NO: 133793 - DNA, 15 bp, Homo sapiens
tgatcatatcacaac

SEQ ID NO: 133794 - DNA, 15 bp, Homo sapiens
ctgatcatatcacaa

SEQ ID NO: 133795 - DNA, 15 bp, Homo sapiens
cctgatcatatcaca

SEQ ID NO: 133796 - DNA, 15 bp, Homo sapiens
acctgatcatatcac

SEQ ID NO: 133797 - DNA, 15 bp, Homo sapiens
aacctgatcatatca

SEQ ID NO: 133798 - DNA, 15 bp, Homo sapiens
aaacctgatcatatc

SEQ ID NO: 133799 - DNA, 15 bp, Homo sapiens
taaacctgatcatat

SEQ ID NO: 133800 - DNA, 15 bp, Homo sapiens
gtaaacctgatcata

SEQ ID NO: 133801 - DNA, 15 bp, Homo sapiens
agtaaacctgatcat

SEQ ID NO: 133802 - DNA, 15 bp, Homo sapiens
cagtaaacctgatca

SEQ ID NO: 133803 - DNA, 15 bp, Homo sapiens
tcagtaaacctgatc

SEQ ID NO: 133804 - DNA, 15 bp, Homo sapiens
gtcagtaaacctgat

SEQ ID NO: 133805 - DNA, 15 bp, Homo sapiens
agtcagtaaacctga

SEQ ID NO: 133806 - DNA, 15 bp, Homo sapiens
aagtcagtaaacctg

SEQ ID NO: 133807 - DNA, 15 bp, Homo sapiens
taagtcagtaaacct

SEQ ID NO: 133808 - DNA, 15 bp, Homo sapiens
ttaagtcagtaaacc

SEQ ID NO: 133809 - DNA, 15 bp, Homo sapiens
tttaagtcagtaaac

SEQ ID NO: 133810 - DNA, 15 bp, Homo sapiens
gtttaagtcagtaaa

SEQ ID NO: 133811 - DNA, 15 bp, Homo sapiens
agtttaagtcagtaa

SEQ ID NO: 133812 - DNA, 15 bp, Homo sapiens
tagtttaagtcagta

SEQ ID NO: 133813 - DNA, 15 bp, Homo sapiens
ttagtttaagtcagt

SEQ ID NO: 133814 - DNA, 15 bp, Homo sapiens
tttagtttaagtcag

SEQ ID NO: 133815 - DNA, 15 bp, Homo sapiens
ctttagtttaagtca

SEQ ID NO: 133816 - DNA, 15 bp, Homo sapiens
tctttagtttaagtc

SEQ ID NO: 133817 - DNA, 15 bp, Homo sapiens
gtctttagtttaagt

SEQ ID NO: 133818 - DNA, 15 bp, Homo sapiens
ggtctttagtttaag

SEQ ID NO: 133819 - DNA, 15 bp, Homo sapiens
gggtctttagtttaa

SEQ ID NO: 133820 - DNA, 15 bp, Homo sapiens
tgggtctttagttta

SEQ ID NO: 133821 - DNA, 15 bp, Homo sapiens
ctgggtctttagttt

SEQ ID NO: 133822 - DNA, 15 bp, Homo sapiens
actgggtctttagtt

SEQ ID NO: 133823 - DNA, 15 bp, Homo sapiens
cactgggtctttagt

SEQ ID NO: 133824 - DNA, 15 bp, Homo sapiens
gcactgggtctttag

SEQ ID NO: 133825 - DNA, 15 bp, Homo sapiens
tgcactgggtcttta

SEQ ID NO: 133826 - DNA, 15 bp, Homo sapiens
atgcactgggtcttt

SEQ ID NO: 133827 - DNA, 15 bp, Homo sapiens
aatgcactgggtctt

SEQ ID NO: 133828 - DNA, 15 bp, Homo sapiens
aaatgcactgggtct

SEQ ID NO: 133829 - DNA, 15 bp, Homo sapiens
aaaatgcactgggtc

SEQ ID NO: 133830 - DNA, 15 bp, Homo sapiens
aaaaatgcactgggt

SEQ ID NO: 133831 - DNA, 15 bp, Homo sapiens
taaaaatgcactggg

SEQ ID NO: 133832 - DNA, 15 bp, Homo sapiens
ttaaaaatgcactgg

SEQ ID NO: 133833 - DNA, 15 bp, Homo sapiens
tttaaaaatgcactg

SEQ ID NO: 133834 - DNA, 15 bp, Homo sapiens
ttttaaaaatgcact

SEQ ID NO: 133835 - DNA, 15 bp, Homo sapiens
attttaaaaatgcac

SEQ ID NO: 133836 - DNA, 15 bp, Homo sapiens
gattttaaaaatgca

SEQ ID NO: 133837 - DNA, 15 bp, Homo sapiens
agattttaaaaatgc

SEQ ID NO: 133838 - DNA, 15 bp, Homo sapiens
tagattttaaaaatg

SEQ ID NO: 133839 - DNA, 15 bp, Homo sapiens
ttagattttaaaaat

SEQ ID NO: 133840 - DNA, 15 bp, Homo sapiens
tttagattttaaaaa

SEQ ID NO: 133841 - DNA, 15 bp, Homo sapiens
ttttagattttaaaa

SEQ ID NO: 133842 - DNA, 15 bp, Homo sapiens
gttttagattttaaa

SEQ ID NO: 133843 - DNA, 15 bp, Homo sapiens
agttttagattttaa

SEQ ID NO: 133844 - DNA, 15 bp, Homo sapiens
cagttttagatttta

SEQ ID NO: 133845 - DNA, 15 bp, Homo sapiens
tcagttttagatttt

SEQ ID NO: 133846 - DNA, 15 bp, Homo sapiens
atcagttttagattt

SEQ ID NO: 133847 - DNA, 15 bp, Homo sapiens
tatcagttttagatt

SEQ ID NO: 133848 - DNA, 15 bp, Homo sapiens
gtatcagttttagat

SEQ ID NO: 133849 - DNA, 15 bp, Homo sapiens
ggtatcagttttaga

SEQ ID NO: 133850 - DNA, 15 bp, Homo sapiens
cggtatcagttttag

SEQ ID NO: 133851 - DNA, 15 bp, Homo sapiens
acggtatcagtttta

SEQ ID NO: 133852 - DNA, 15 bp, Homo sapiens
tacggtatcagtttt

SEQ ID NO: 133853 - DNA, 15 bp, Homo sapiens
ttacggtatcagttt

SEQ ID NO: 133854 - DNA, 15 bp, Homo sapiens
tttacggtatcagtt

SEQ ID NO: 133855 - DNA, 15 bp, Homo sapiens
ctttacggtatcagt

SEQ ID NO: 133856 - DNA, 15 bp, Homo sapiens
gctttacggtatcag

SEQ ID NO: 133857 - DNA, 15 bp, Homo sapiens
agctttacggtatca

SEQ ID NO: 133858 - DNA, 15 bp, Homo sapiens
tagctttacggtatc

SEQ ID NO: 133859 - DNA, 15 bp, Homo sapiens
ctagctttacggtat

SEQ ID NO: 133860 - DNA, 15 bp, Homo sapiens
cctagctttacggta

SEQ ID NO: 133861 - DNA, 15 bp, Homo sapiens
gcctagctttacggt

SEQ ID NO: 133862 - DNA, 15 bp, Homo sapiens
tgcctagctttacgg

SEQ ID NO: 133863 - DNA, 15 bp, Homo sapiens
gtgcctagctttacg

SEQ ID NO: 133864 - DNA, 15 bp, Homo sapiens
tgtgcctagctttac

SEQ ID NO: 133865 - DNA, 15 bp, Homo sapiens
atgtgcctagcttta

SEQ ID NO: 133866 - DNA, 15 bp, Homo sapiens
aatgtgcctagcttt

SEQ ID NO: 133867 - DNA, 15 bp, Homo sapiens
taatgtgcctagctt

SEQ ID NO: 133868 - DNA, 15 bp, Homo sapiens
ctaatgtgcctagct

SEQ ID NO: 133869 - DNA, 15 bp, Homo sapiens
actaatgtgcctagc

SEQ ID NO: 133870 - DNA, 15 bp, Homo sapiens
tactaatgtgcctag

SEQ ID NO: 133871 - DNA, 15 bp, Homo sapiens
atactaatgtgccta

SEQ ID NO: 133872 - DNA, 15 bp, Homo sapiens
tatactaatgtgcct

SEQ ID NO: 133873 - DNA, 15 bp, Homo sapiens
ttatactaatgtgcc

SEQ ID NO: 133874 - DNA, 15 bp, Homo sapiens
tttatactaatgtgc

SEQ ID NO: 133875 - DNA, 15 bp, Homo sapiens
atttatactaatgtg

SEQ ID NO: 133876 - DNA, 15 bp, Homo sapiens
tatttatactaatgt

SEQ ID NO: 133877 - DNA, 15 bp, Homo sapiens
atatttatactaatg

SEQ ID NO: 133878 - DNA, 15 bp, Homo sapiens
tatatttatactaat

SEQ ID NO: 133879 - DNA, 15 bp, Homo sapiens
ttatatttatactaa

SEQ ID NO: 133880 - DNA, 15 bp, Homo sapiens
cttatatttatacta

SEQ ID NO: 133881 - DNA, 15 bp, Homo sapiens
gcttatatttatact

SEQ ID NO: 133882 - DNA, 15 bp, Homo sapiens
agcttatatttatac

SEQ ID NO: 133883 - DNA, 15 bp, Homo sapiens
cagcttatatttata

SEQ ID NO: 133884 - DNA, 15 bp, Homo sapiens
ccagcttatatttat

SEQ ID NO: 133885 - DNA, 15 bp, Homo sapiens
gccagcttatattta

SEQ ID NO: 133886 - DNA, 15 bp, Homo sapiens
cgccagcttatattt

SEQ ID NO: 133887 - DNA, 15 bp, Homo sapiens
acgccagcttatatt

SEQ ID NO: 133888 - DNA, 15 bp, Homo sapiens
aacgccagcttatat

SEQ ID NO: 133889 - DNA, 15 bp, Homo sapiens
taacgccagcttata

SEQ ID NO: 133890 - DNA, 15 bp, Homo sapiens
ctaacgccagcttat

SEQ ID NO: 133891 - DNA, 15 bp, Homo sapiens
gctaacgccagctta

SEQ ID NO: 133892 - DNA, 15 bp, Homo sapiens
tgctaacgccagctt

SEQ ID NO: 133893 - DNA, 15 bp, Homo sapiens
atgctaacgccagct

SEQ ID NO: 133894 - DNA, 15 bp, Homo sapiens
aatgctaacgccagc

SEQ ID NO: 133895 - DNA, 15 bp, Homo sapiens
aaatgctaacgccag

SEQ ID NO: 133896 - DNA, 15 bp, Homo sapiens
gaaatgctaacgcca

SEQ ID NO: 133897 - DNA, 15 bp, Homo sapiens
tgaaatgctaacgcc

SEQ ID NO: 133898 - DNA, 15 bp, Homo sapiens
atgaaatgctaacgc

SEQ ID NO: 133899 - DNA, 15 bp, Homo sapiens
catgaaatgctaacg

SEQ ID NO: 133900 - DNA, 15 bp, Homo sapiens
gcatgaaatgctaac

SEQ ID NO: 133901 - DNA, 15 bp, Homo sapiens
ggcatgaaatgctaa

SEQ ID NO: 133902 - DNA, 15 bp, Homo sapiens
aggcatgaaatgcta

SEQ ID NO: 133903 - DNA, 15 bp, Homo sapiens
caggcatgaaatgct

SEQ ID NO: 133904 - DNA, 15 bp, Homo sapiens
acaggcatgaaatgc

SEQ ID NO: 133905 - DNA, 15 bp, Homo sapiens
aacaggcatgaaatg

SEQ ID NO: 133906 - DNA, 15 bp, Homo sapiens
caacaggcatgaaat

SEQ ID NO: 133907 - DNA, 15 bp, Homo sapiens
acaacaggcatgaaa

SEQ ID NO: 133908 - DNA, 15 bp, Homo sapiens
cacaacaggcatgaa

SEQ ID NO: 133909 - DNA, 15 bp, Homo sapiens
acacaacaggcatga

SEQ ID NO: 133910 - DNA, 15 bp, Homo sapiens
cacacaacaggcatg

SEQ ID NO: 133911 - DNA, 15 bp, Homo sapiens
tcacacaacaggcat

SEQ ID NO: 133912 - DNA, 15 bp, Homo sapiens
atcacacaacaggca

SEQ ID NO: 133913 - DNA, 15 bp, Homo sapiens
catcacacaacaggc

SEQ ID NO: 133914 - DNA, 15 bp, Homo sapiens
acatcacacaacagg

SEQ ID NO: 133915 - DNA, 15 bp, Homo sapiens
tacatcacacaacag

SEQ ID NO: 133916 - DNA, 15 bp, Homo sapiens
ctacatcacacaaca

SEQ ID NO: 133917 - DNA, 15 bp, Homo sapiens
cctacatcacacaac

SEQ ID NO: 133918 - DNA, 15 bp, Homo sapiens
tcctacatcacacaa

SEQ ID NO: 133919 - DNA, 15 bp, Homo sapiens
atcctacatcacaca

SEQ ID NO: 133920 - DNA, 15 bp, Homo sapiens
tatcctacatcacac

SEQ ID NO: 133921 - DNA, 15 bp, Homo sapiens
ttatcctacatcaca

SEQ ID NO: 133922 - DNA, 15 bp, Homo sapiens
attatcctacatcac

SEQ ID NO: 133923 - DNA, 15 bp, Homo sapiens
gattatcctacatca

SEQ ID NO: 133924 - DNA, 15 bp, Homo sapiens
agattatcctacatc

SEQ ID NO: 133925 - DNA, 15 bp, Homo sapiens
gagattatcctacat

SEQ ID NO: 133926 - DNA, 15 bp, Homo sapiens
ggagattatcctaca

SEQ ID NO: 133927 - DNA, 15 bp, Homo sapiens
aggagattatcctac

SEQ ID NO: 133928 - DNA, 15 bp, Homo sapiens
taggagattatccta

SEQ ID NO: 133929 - DNA, 15 bp, Homo sapiens
ttaggagattatcct

SEQ ID NO: 133930 - DNA, 15 bp, Homo sapiens
tttaggagattatcc

SEQ ID NO: 133931 - DNA, 15 bp, Homo sapiens
ctttaggagattatc

SEQ ID NO: 133932 - DNA, 15 bp, Homo sapiens
actttaggagattat

SEQ ID NO: 133933 - DNA, 15 bp, Homo sapiens
cactttaggagatta

SEQ ID NO: 133934 - DNA, 15 bp, Homo sapiens
gcactttaggagatt

SEQ ID NO: 133935 - DNA, 15 bp, Homo sapiens
ggcactttaggagat

SEQ ID NO: 133936 - DNA, 15 bp, Homo sapiens
aggcactttaggaga

SEQ ID NO: 133937 - DNA, 15 bp, Homo sapiens
aaggcactttaggag

SEQ ID NO: 133938 - DNA, 15 bp, Homo sapiens
aaaggcactttagga

SEQ ID NO: 133939 - DNA, 15 bp, Homo sapiens
caaaggcactttagg

SEQ ID NO: 133940 - DNA, 15 bp, Homo sapiens
gcaaaggcactttag

SEQ ID NO: 133941 - DNA, 15 bp, Homo sapiens
tgcaaaggcacttta

SEQ ID NO: 133942 - DNA, 15 bp, Homo sapiens
ttgcaaaggcacttt

SEQ ID NO: 133943 - DNA, 15 bp, Homo sapiens
gttgcaaaggcactt

SEQ ID NO: 133944 - DNA, 15 bp, Homo sapiens
agttgcaaaggcact

SEQ ID NO: 133945 - DNA, 15 bp, Homo sapiens
aagttgcaaaggcac

SEQ ID NO: 133946 - DNA, 15 bp, Homo sapiens
taagttgcaaaggca

SEQ ID NO: 133947 - DNA, 15 bp, Homo sapiens
ataagttgcaaaggc

SEQ ID NO: 133948 - DNA, 15 bp, Homo sapiens
tataagttgcaaagg

SEQ ID NO: 133949 - DNA, 15 bp, Homo sapiens
atataagttgcaaag

SEQ ID NO: 133950 - DNA, 15 bp, Homo sapiens
aatataagttgcaaa

SEQ ID NO: 133951 - DNA, 15 bp, Homo sapiens
aaatataagttgcaa

SEQ ID NO: 133952 - DNA, 15 bp, Homo sapiens
gaaatataagttgca

SEQ ID NO: 133953 - DNA, 15 bp, Homo sapiens
tgaaatataagttgc

SEQ ID NO: 133954 - DNA, 15 bp, Homo sapiens
atgaaatataagttg

SEQ ID NO: 133955 - DNA, 15 bp, Homo sapiens
tatgaaatataagtt

SEQ ID NO: 133956 - DNA, 15 bp, Homo sapiens
ttatgaaatataagt

SEQ ID NO: 133957 - DNA, 15 bp, Homo sapiens
attatgaaatataag

SEQ ID NO: 133958 - DNA, 15 bp, Homo sapiens
cattatgaaatataa

SEQ ID NO: 133959 - DNA, 15 bp, Homo sapiens
tcattatgaaatata

SEQ ID NO: 133960 - DNA, 15 bp, Homo sapiens
ctcattatgaaatat

SEQ ID NO: 133961 - DNA, 15 bp, Homo sapiens
tctcattatgaaata

SEQ ID NO: 133962 - DNA, 15 bp, Homo sapiens
atctcattatgaaat

SEQ ID NO: 133963 - DNA, 15 bp, Homo sapiens
aatctcattatgaaa

SEQ ID NO: 133964 - DNA, 15 bp, Homo sapiens
taatctcattatgaa

SEQ ID NO: 133965 - DNA, 15 bp, Homo sapiens
ttaatctcattatga

SEQ ID NO: 133966 - DNA, 15 bp, Homo sapiens
attaatctcattatg

SEQ ID NO: 133967 - DNA, 15 bp, Homo sapiens
aattaatctcattat

SEQ ID NO: 133968 - DNA, 15 bp, Homo sapiens
aaattaatctcatta

SEQ ID NO: 133969 - DNA, 15 bp, Homo sapiens
gaaattaatctcatt

SEQ ID NO: 133970 - DNA, 15 bp, Homo sapiens
agaaattaatctcat

SEQ ID NO: 133971 - DNA, 15 bp, Homo sapiens
cagaaattaatctca

SEQ ID NO: 133972 - DNA, 15 bp, Homo sapiens
tcagaaattaatctc

SEQ ID NO: 133973 - DNA, 15 bp, Homo sapiens
atcagaaattaatct

SEQ ID NO: 133974 - DNA, 15 bp, Homo sapiens
aatcagaaattaatc

SEQ ID NO: 133975 - DNA, 15 bp, Homo sapiens
aaatcagaaattaat

SEQ ID NO: 133976 - DNA, 15 bp, Homo sapiens
aaaatcagaaattaa

SEQ ID NO: 133977 - DNA, 15 bp, Homo sapiens
taaaatcagaaatta

SEQ ID NO: 133978 - DNA, 15 bp, Homo sapiens
ttaaaatcagaaatt

SEQ ID NO: 133979 - DNA, 15 bp, Homo sapiens
tttaaaatcagaaat

SEQ ID NO: 133980 - DNA, 15 bp, Homo sapiens
ttttaaaatcagaaa

SEQ ID NO: 133981 - DNA, 15 bp, Homo sapiens
cttttaaaatcagaa

SEQ ID NO: 133982 - DNA, 15 bp, Homo sapiens
acttttaaaatcaga

SEQ ID NO: 133983 - DNA, 15 bp, Homo sapiens
cacttttaaaatcag

SEQ ID NO: 133984 - DNA, 15 bp, Homo sapiens
tcacttttaaaatca

SEQ ID NO: 133985 - DNA, 15 bp, Homo sapiens
ttcacttttaaaatc

SEQ ID NO: 133986 - DNA, 15 bp, Homo sapiens
attcacttttaaaat

SEQ ID NO: 133987 - DNA, 15 bp, Homo sapiens
tattcacttttaaaa

SEQ ID NO: 133988 - DNA, 15 bp, Homo sapiens
atattcacttttaaa

SEQ ID NO: 133989 - DNA, 15 bp, Homo sapiens
gatattcacttttaa

SEQ ID NO: 133990 - DNA, 15 bp, Homo sapiens
agatattcactttta

SEQ ID NO: 133991 - DNA, 15 bp, Homo sapiens
gagatattcactttt

SEQ ID NO: 133992 - DNA, 15 bp, Homo sapiens
ggagatattcacttt

SEQ ID NO: 133993 - DNA, 15 bp, Homo sapiens
aggagatattcactt

SEQ ID NO: 133994 - DNA, 15 bp, Homo sapiens
taggagatattcact

SEQ ID NO: 133995 - DNA, 15 bp, Homo sapiens
ataggagatattcac

SEQ ID NO: 133996 - DNA, 15 bp, Homo sapiens
tataggagatattca

SEQ ID NO: 133997 - DNA, 15 bp, Homo sapiens
ttataggagatattc

SEQ ID NO: 133998 - DNA, 15 bp, Homo sapiens
gttataggagatatt

SEQ ID NO: 133999 - DNA, 15 bp, Homo sapiens
agttataggagatat

SEQ ID NO: 134000 - DNA, 15 bp, Homo sapiens
aagttataggagata

SEQ ID NO: 134001 - DNA, 15 bp, Homo sapiens
aaagttataggagat

SEQ ID NO: 134002 - DNA, 15 bp, Homo sapiens
taaagttataggaga

SEQ ID NO: 134003 - DNA, 15 bp, Homo sapiens
gtaaagttataggag

SEQ ID NO: 134004 - DNA, 15 bp, Homo sapiens
agtaaagttatagga

SEQ ID NO: 134005 - DNA, 15 bp, Homo sapiens
tagtaaagttatagg

SEQ ID NO: 134006 - DNA, 15 bp, Homo sapiens
gtagtaaagttatag

SEQ ID NO: 134007 - DNA, 15 bp, Homo sapiens
agtagtaaagttata

SEQ ID NO: 134008 - DNA, 15 bp, Homo sapiens
tagtagtaaagttat

SEQ ID NO: 134009 - DNA, 15 bp, Homo sapiens
atagtagtaaagtta

SEQ ID NO: 134010 - DNA, 15 bp, Homo sapiens
tatagtagtaaagtt

SEQ ID NO: 134011 - DNA, 15 bp, Homo sapiens
gtatagtagtaaagt

SEQ ID NO: 134012 - DNA, 15 bp, Homo sapiens
tgtatagtagtaaag

SEQ ID NO: 134013 - DNA, 15 bp, Homo sapiens
atgtatagtagtaaa

SEQ ID NO: 134014 - DNA, 15 bp, Homo sapiens
catgtatagtagtaa

SEQ ID NO: 134015 - DNA, 15 bp, Homo sapiens
acatgtatagtagta

SEQ ID NO: 134016 - DNA, 15 bp, Homo sapiens
tacatgtatagtagt

SEQ ID NO: 134017 - DNA, 15 bp, Homo sapiens
gtacatgtatagtag

SEQ ID NO: 134018 - DNA, 15 bp, Homo sapiens
ggtacatgtatagta

SEQ ID NO: 134019 - DNA, 15 bp, Homo sapiens
tggtacatgtatagt

SEQ ID NO: 134020 - DNA, 15 bp, Homo sapiens
atggtacatgtatag

SEQ ID NO: 134021 - DNA, 15 bp, Homo sapiens
gatggtacatgtata

SEQ ID NO: 134022 - DNA, 15 bp, Homo sapiens
agatggtacatgtat

SEQ ID NO: 134023 - DNA, 15 bp, Homo sapiens
tagatggtacatgta

SEQ ID NO: 134024 - DNA, 15 bp, Homo sapiens
ttagatggtacatgt

SEQ ID NO: 134025 - DNA, 15 bp, Homo sapiens
attagatggtacatg

SEQ ID NO: 134026 - DNA, 15 bp, Homo sapiens
tattagatggtacat

SEQ ID NO: 134027 - DNA, 15 bp, Homo sapiens
atattagatggtaca

SEQ ID NO: 134028 - DNA, 15 bp, Homo sapiens
aatattagatggtac

SEQ ID NO: 134029 - DNA, 15 bp, Homo sapiens
gaatattagatggta

SEQ ID NO: 134030 - DNA, 15 bp, Homo sapiens
tgaatattagatggt

SEQ ID NO: 134031 - DNA, 15 bp, Homo sapiens
atgaatattagatgg

SEQ ID NO: 134032 - DNA, 15 bp, Homo sapiens
aatgaatattagatg

SEQ ID NO: 134033 - DNA, 15 bp, Homo sapiens
aaatgaatattagat

SEQ ID NO: 134034 - DNA, 15 bp, Homo sapiens
caaatgaatattaga

SEQ ID NO: 134035 - DNA, 15 bp, Homo sapiens
acaaatgaatattag

SEQ ID NO: 134036 - DNA, 15 bp, Homo sapiens
tacaaatgaatatta

SEQ ID NO: 134037 - DNA, 15 bp, Homo sapiens
ttacaaatgaatatt

SEQ ID NO: 134038 - DNA, 15 bp, Homo sapiens
tttacaaatgaatat

SEQ ID NO: 134039 - DNA, 15 bp, Homo sapiens
ttttacaaatgaata

SEQ ID NO: 134040 - DNA, 15 bp, Homo sapiens
tttttacaaatgaat

SEQ ID NO: 134041 - DNA, 15 bp, Homo sapiens
atttttacaaatgaa

SEQ ID NO: 134042 - DNA, 15 bp, Homo sapiens
aatttttacaaatga

SEQ ID NO: 134043 - DNA, 15 bp, Homo sapiens
gaatttttacaaatg

SEQ ID NO: 134044 - DNA, 15 bp, Homo sapiens
agaatttttacaaat

SEQ ID NO: 134045 - DNA, 15 bp, Homo sapiens
aagaatttttacaaa

SEQ ID NO: 134046 - DNA, 15 bp, Homo sapiens
aaagaatttttacaa

SEQ ID NO: 134047 - DNA, 15 bp, Homo sapiens
aaaagaatttttaca

SEQ ID NO: 134048 - DNA, 15 bp, Homo sapiens
aaaaagaatttttac

SEQ ID NO: 134049 - DNA, 15 bp, Homo sapiens
gaaaaagaattttta

SEQ ID NO: 134050 - DNA, 15 bp, Homo sapiens
ggaaaaagaattttt

SEQ ID NO: 134051 - DNA, 15 bp, Homo sapiens
gggaaaaagaatttt

SEQ ID NO: 134052 - DNA, 15 bp, Homo sapiens
agggaaaaagaattt

SEQ ID NO: 134053 - DNA, 15 bp, Homo sapiens
tagggaaaaagaatt

SEQ ID NO: 134054 - DNA, 15 bp, Homo sapiens
atagggaaaaagaat

SEQ ID NO: 134055 - DNA, 15 bp, Homo sapiens
aatagggaaaaagaa

SEQ ID NO: 134056 - DNA, 15 bp, Homo sapiens
aaatagggaaaaaga

SEQ ID NO: 134057 - DNA, 15 bp, Homo sapiens
taaatagggaaaaag

SEQ ID NO: 134058 - DNA, 15 bp, Homo sapiens
ctaaatagggaaaaa

SEQ ID NO: 134059 - DNA, 15 bp, Homo sapiens
actaaatagggaaaa

SEQ ID NO: 134060 - DNA, 15 bp, Homo sapiens
cactaaatagggaaa

SEQ ID NO: 134061 - DNA, 15 bp, Homo sapiens
acactaaatagggaa

SEQ ID NO: 134062 - DNA, 15 bp, Homo sapiens
cacactaaataggga

SEQ ID NO: 134063 - DNA, 15 bp, Homo sapiens
acacactaaataggg

SEQ ID NO: 134064 - DNA, 15 bp, Homo sapiens
cacacactaaatagg

SEQ ID NO: 134065 - DNA, 15 bp, Homo sapiens
gcacacactaaatag

SEQ ID NO: 134066 - DNA, 15 bp, Homo sapiens
agcacacactaaata

SEQ ID NO: 134067 - DNA, 15 bp, Homo sapiens
tagcacacactaaat

SEQ ID NO: 134068 - DNA, 15 bp, Homo sapiens
ttagcacacactaaa

SEQ ID NO: 134069 - DNA, 15 bp, Homo sapiens
cttagcacacactaa

SEQ ID NO: 134070 - DNA, 15 bp, Homo sapiens
acttagcacacacta

SEQ ID NO: 134071 - DNA, 15 bp, Homo sapiens
aacttagcacacact

SEQ ID NO: 134072 - DNA, 15 bp, Homo sapiens
gaacttagcacacac

SEQ ID NO: 134073 - DNA, 15 bp, Homo sapiens
agaacttagcacaca

SEQ ID NO: 134074 - DNA, 15 bp, Homo sapiens
cagaacttagcacac

SEQ ID NO: 134075 - DNA, 15 bp, Homo sapiens
ccagaacttagcaca

SEQ ID NO: 134076 - DNA, 15 bp, Homo sapiens
cccagaacttagcac

SEQ ID NO: 134077 - DNA, 15 bp, Homo sapiens
gcccagaacttagca

SEQ ID NO: 134078 - DNA, 15 bp, Homo sapiens
agcccagaacttagc

SEQ ID NO: 134079 - DNA, 15 bp, Homo sapiens
cagcccagaacttag

SEQ ID NO: 134080 - DNA, 15 bp, Homo sapiens
acagcccagaactta

SEQ ID NO: 134081 - DNA, 15 bp, Homo sapiens
cacagcccagaactt

SEQ ID NO: 134082 - DNA, 15 bp, Homo sapiens
tcacagcccagaact

SEQ ID NO: 134083 - DNA, 15 bp, Homo sapiens
ctcacagcccagaac

SEQ ID NO: 134084 - DNA, 15 bp, Homo sapiens
actcacagcccagaa

SEQ ID NO: 134085 - DNA, 15 bp, Homo sapiens
cactcacagcccaga

SEQ ID NO: 134086 - DNA, 15 bp, Homo sapiens
ccactcacagcccag

SEQ ID NO: 134087 - DNA, 15 bp, Homo sapiens
accactcacagccca

SEQ ID NO: 134088 - DNA, 15 bp, Homo sapiens
taccactcacagccc

SEQ ID NO: 134089 - DNA, 15 bp, Homo sapiens
gtaccactcacagcc

SEQ ID NO: 134090 - DNA, 15 bp, Homo sapiens
tgtaccactcacagc

SEQ ID NO: 134091 - DNA, 15 bp, Homo sapiens
ttgtaccactcacag

SEQ ID NO: 134092 - DNA, 15 bp, Homo sapiens
cttgtaccactcaca

SEQ ID NO: 134093 - DNA, 15 bp, Homo sapiens
ccttgtaccactcac

SEQ ID NO: 134094 - DNA, 15 bp, Homo sapiens
tccttgtaccactca

SEQ ID NO: 134095 - DNA, 15 bp, Homo sapiens
atccttgtaccactc

SEQ ID NO: 134096 - DNA, 15 bp, Homo sapiens
tatccttgtaccact

SEQ ID NO: 134097 - DNA, 15 bp, Homo sapiens
gtatccttgtaccac

SEQ ID NO: 134098 - DNA, 15 bp, Homo sapiens
agtatccttgtacca

SEQ ID NO: 134099 - DNA, 15 bp, Homo sapiens
cagtatccttgtacc

SEQ ID NO: 134100 - DNA, 15 bp, Homo sapiens
tcagtatccttgtac

SEQ ID NO: 134101 - DNA, 15 bp, Homo sapiens
gtcagtatccttgta

SEQ ID NO: 134102 - DNA, 15 bp, Homo sapiens
tgtcagtatccttgt

SEQ ID NO: 134103 - DNA, 15 bp, Homo sapiens
ttgtcagtatccttg

SEQ ID NO: 134104 - DNA, 15 bp, Homo sapiens
cttgtcagtatcctt

SEQ ID NO: 134105 - DNA, 15 bp, Homo sapiens
tcttgtcagtatcct

SEQ ID NO: 134106 - DNA, 15 bp, Homo sapiens
ttcttgtcagtatcc

SEQ ID NO: 134107 - DNA, 15 bp, Homo sapiens
attcttgtcagtatc

SEQ ID NO: 134108 - DNA, 15 bp, Homo sapiens
tattcttgtcagtat

SEQ ID NO: 134109 - DNA, 15 bp, Homo sapiens
atattcttgtcagta

SEQ ID NO: 134110 - DNA, 15 bp, Homo sapiens
aatattcttgtcagt

SEQ ID NO: 134111 - DNA, 15 bp, Homo sapiens
gaatattcttgtcag

SEQ ID NO: 134112 - DNA, 15 bp, Homo sapiens
agaatattcttgtca

SEQ ID NO: 134113 - DNA, 15 bp, Homo sapiens
tagaatattcttgtc

SEQ ID NO: 134114 - DNA, 15 bp, Homo sapiens
ctagaatattcttgt

SEQ ID NO: 134115 - DNA, 15 bp, Homo sapiens
cctagaatattcttg

SEQ ID NO: 134116 - DNA, 15 bp, Homo sapiens
acctagaatattctt

SEQ ID NO: 134117 - DNA, 15 bp, Homo sapiens
tacctagaatattct

SEQ ID NO: 134118 - DNA, 15 bp, Homo sapiens
ctacctagaatattc

SEQ ID NO: 134119 - DNA, 15 bp, Homo sapiens
tctacctagaatatt

SEQ ID NO: 134120 - DNA, 15 bp, Homo sapiens
ttctacctagaatat

SEQ ID NO: 134121 - DNA, 15 bp, Homo sapiens
tttctacctagaata

SEQ ID NO: 134122 - DNA, 15 bp, Homo sapiens
atttctacctagaat

SEQ ID NO: 134123 - DNA, 15 bp, Homo sapiens
aatttctacctagaa

SEQ ID NO: 134124 - DNA, 15 bp, Homo sapiens
caatttctacctaga

SEQ ID NO: 134125 - DNA, 15 bp, Homo sapiens
ccaatttctacctag

SEQ ID NO: 134126 - DNA, 15 bp, Homo sapiens
cccaatttctaccta

SEQ ID NO: 134127 - DNA, 15 bp, Homo sapiens
tcccaatttctacct

SEQ ID NO: 134128 - DNA, 15 bp, Homo sapiens
ttcccaatttctacc

SEQ ID NO: 134129 - DNA, 15 bp, Homo sapiens
tttcccaatttctac

SEQ ID NO: 134130 - DNA, 15 bp, Homo sapiens
gtttcccaatttcta

SEQ ID NO: 134131 - DNA, 15 bp, Homo sapiens
agtttcccaatttct

SEQ ID NO: 134132 - DNA, 15 bp, Homo sapiens
tagtttcccaatttc

SEQ ID NO: 134133 - DNA, 15 bp, Homo sapiens
gtagtttcccaattt

SEQ ID NO: 134134 - DNA, 15 bp, Homo sapiens
tgtagtttcccaatt

SEQ ID NO: 134135 - DNA, 15 bp, Homo sapiens
ttgtagtttcccaat

SEQ ID NO: 134136 - DNA, 15 bp, Homo sapiens
attgtagtttcccaa

SEQ ID NO: 134137 - DNA, 15 bp, Homo sapiens
cattgtagtttccca

SEQ ID NO: 134138 - DNA, 15 bp, Homo sapiens
tcattgtagtttccc

SEQ ID NO: 134139 - DNA, 15 bp, Homo sapiens
ttcattgtagtttcc

SEQ ID NO: 134140 - DNA, 15 bp, Homo sapiens
tttcattgtagtttc

SEQ ID NO: 134141 - DNA, 15 bp, Homo sapiens
atttcattgtagttt

SEQ ID NO: 134142 - DNA, 15 bp, Homo sapiens
tatttcattgtagtt

SEQ ID NO: 134143 - DNA, 15 bp, Homo sapiens
ttatttcattgtagt

SEQ ID NO: 134144 - DNA, 15 bp, Homo sapiens
attatttcattgtag

SEQ ID NO: 134145 - DNA, 15 bp, Homo sapiens
tattatttcattgta

SEQ ID NO: 134146 - DNA, 15 bp, Homo sapiens
ttattatttcattgt

SEQ ID NO: 134147 - DNA, 15 bp, Homo sapiens
attattatttcattg

SEQ ID NO: 134148 - DNA, 15 bp, Homo sapiens
tattattatttcatt

SEQ ID NO: 134149 - DNA, 15 bp, Homo sapiens
ttattattatttcat

SEQ ID NO: 134150 - DNA, 15 bp, Homo sapiens
gttattattatttca

SEQ ID NO: 134151 - DNA, 15 bp, Homo sapiens
tgttattattatttc

SEQ ID NO: 134152 - DNA, 15 bp, Homo sapiens
ctgttattattattt

SEQ ID NO: 134153 - DNA, 15 bp, Homo sapiens
gctgttattattatt

SEQ ID NO: 134154 - DNA, 15 bp, Homo sapiens
agctgttattattat

SEQ ID NO: 134155 - DNA, 15 bp, Homo sapiens
gagctgttattatta

SEQ ID NO: 134156 - DNA, 15 bp, Homo sapiens
agagctgttattatt

SEQ ID NO: 134157 - DNA, 15 bp, Homo sapiens
aagagctgttattat

SEQ ID NO: 134158 - DNA, 15 bp, Homo sapiens
caagagctgttatta

SEQ ID NO: 134159 - DNA, 15 bp, Homo sapiens
gcaagagctgttatt

SEQ ID NO: 134160 - DNA, 15 bp, Homo sapiens
agcaagagctgttat

SEQ ID NO: 134161 - DNA, 15 bp, Homo sapiens
tagcaagagctgtta

SEQ ID NO: 134162 - DNA, 15 bp, Homo sapiens
ttagcaagagctgtt

SEQ ID NO: 134163 - DNA, 15 bp, Homo sapiens
tttagcaagagctgt

SEQ ID NO: 134164 - DNA, 15 bp, Homo sapiens
atttagcaagagctg

SEQ ID NO: 134165 - DNA, 15 bp, Homo sapiens
aatttagcaagagct

SEQ ID NO: 134166 - DNA, 15 bp, Homo sapiens
aaatttagcaagagc

SEQ ID NO: 134167 - DNA, 15 bp, Homo sapiens
aaaatttagcaagag

SEQ ID NO: 134168 - DNA, 15 bp, Homo sapiens
taaaatttagcaaga

SEQ ID NO: 134169 - DNA, 15 bp, Homo sapiens
ataaaatttagcaag

SEQ ID NO: 134170 - DNA, 15 bp, Homo sapiens
aataaaatttagcaa

SEQ ID NO: 134171 - DNA, 15 bp, Homo sapiens
taataaaatttagca

SEQ ID NO: 134172 - DNA, 15 bp, Homo sapiens
ttaataaaatttagc

SEQ ID NO: 134173 - DNA, 15 bp, Homo sapiens
cttaataaaatttag

SEQ ID NO: 134174 - DNA, 15 bp, Homo sapiens
acttaataaaattta

SEQ ID NO: 134175 - DNA, 15 bp, Homo sapiens
cacttaataaaattt

SEQ ID NO: 134176 - DNA, 15 bp, Homo sapiens
gcacttaataaaatt

SEQ ID NO: 134177 - DNA, 15 bp, Homo sapiens
agcacttaataaaat

SEQ ID NO: 134178 - DNA, 15 bp, Homo sapiens
aagcacttaataaaa

SEQ ID NO: 134179 - DNA, 15 bp, Homo sapiens
gaagcacttaataaa

SEQ ID NO: 134180 - DNA, 15 bp, Homo sapiens
tgaagcacttaataa

SEQ ID NO: 134181 - DNA, 15 bp, Homo sapiens
atgaagcacttaata

SEQ ID NO: 134182 - DNA, 15 bp, Homo sapiens
catgaagcacttaat

SEQ ID NO: 134183 - DNA, 15 bp, Homo sapiens
acatgaagcacttaa

SEQ ID NO: 134184 - DNA, 15 bp, Homo sapiens
cacatgaagcactta

SEQ ID NO: 134185 - DNA, 15 bp, Homo sapiens
acacatgaagcactt

SEQ ID NO: 134186 - DNA, 15 bp, Homo sapiens
cacacatgaagcact

SEQ ID NO: 134187 - DNA, 15 bp, Homo sapiens
gcacacatgaagcac

SEQ ID NO: 134188 - DNA, 15 bp, Homo sapiens
agcacacatgaagca

SEQ ID NO: 134189 - DNA, 15 bp, Homo sapiens
cagcacacatgaagc

SEQ ID NO: 134190 - DNA, 15 bp, Homo sapiens
ccagcacacatgaag

SEQ ID NO: 134191 - DNA, 15 bp, Homo sapiens
accagcacacatgaa

SEQ ID NO: 134192 - DNA, 15 bp, Homo sapiens
gaccagcacacatga

SEQ ID NO: 134193 - DNA, 15 bp, Homo sapiens
tgaccagcacacatg

SEQ ID NO: 134194 - DNA, 15 bp, Homo sapiens
atgaccagcacacat

SEQ ID NO: 134195 - DNA, 15 bp, Homo sapiens
aatgaccagcacaca

SEQ ID NO: 134196 - DNA, 15 bp, Homo sapiens
aaatgaccagcacac

SEQ ID NO: 134197 - DNA, 15 bp, Homo sapiens
aaaatgaccagcaca

SEQ ID NO: 134198 - DNA, 15 bp, Homo sapiens
aaaaatgaccagcac

SEQ ID NO: 134199 - DNA, 15 bp, Homo sapiens
gaaaaatgaccagca

SEQ ID NO: 134200 - DNA, 15 bp, Homo sapiens
agaaaaatgaccagc

SEQ ID NO: 134201 - DNA, 15 bp, Homo sapiens
tagaaaaatgaccag

SEQ ID NO: 134202 - DNA, 15 bp, Homo sapiens
ttagaaaaatgacca

SEQ ID NO: 134203 - DNA, 15 bp, Homo sapiens
cttagaaaaatgacc

SEQ ID NO: 134204 - DNA, 15 bp, Homo sapiens
acttagaaaaatgac

SEQ ID NO: 134205 - DNA, 15 bp, Homo sapiens
tacttagaaaaatga

SEQ ID NO: 134206 - DNA, 15 bp, Homo sapiens
atacttagaaaaatg

SEQ ID NO: 134207 - DNA, 15 bp, Homo sapiens
aatacttagaaaaat

SEQ ID NO: 134208 - DNA, 15 bp, Homo sapiens
caatacttagaaaaa

SEQ ID NO: 134209 - DNA, 15 bp, Homo sapiens
acaatacttagaaaa

SEQ ID NO: 134210 - DNA, 15 bp, Homo sapiens
tacaatacttagaaa

SEQ ID NO: 134211 - DNA, 15 bp, Homo sapiens
gtacaatacttagaa

SEQ ID NO: 134212 - DNA, 15 bp, Homo sapiens
tgtacaatacttaga

SEQ ID NO: 134213 - DNA, 15 bp, Homo sapiens
gtgtacaatacttag

SEQ ID NO: 134214 - DNA, 15 bp, Homo sapiens
cgtgtacaatactta

SEQ ID NO: 134215 - DNA, 15 bp, Homo sapiens
acgtgtacaatactt

SEQ ID NO: 134216 - DNA, 15 bp, Homo sapiens
aacgtgtacaatact

SEQ ID NO: 134217 - DNA, 15 bp, Homo sapiens
taacgtgtacaatac

SEQ ID NO: 134218 - DNA, 15 bp, Homo sapiens
ataacgtgtacaata

SEQ ID NO: 134219 - DNA, 15 bp, Homo sapiens
gataacgtgtacaat

SEQ ID NO: 134220 - DNA, 15 bp, Homo sapiens
agataacgtgtacaa

SEQ ID NO: 134221 - DNA, 15 bp, Homo sapiens
gagataacgtgtaca

SEQ ID NO: 134222 - DNA, 15 bp, Homo sapiens
tgagataacgtgtac

SEQ ID NO: 134223 - DNA, 15 bp, Homo sapiens
atgagataacgtgta

SEQ ID NO: 134224 - DNA, 15 bp, Homo sapiens
aatgagataacgtgt

SEQ ID NO: 134225 - DNA, 15 bp, Homo sapiens
gaatgagataacgtg

SEQ ID NO: 134226 - DNA, 15 bp, Homo sapiens
tgaatgagataacgt

SEQ ID NO: 134227 - DNA, 15 bp, Homo sapiens
ttgaatgagataacg

SEQ ID NO: 134228 - DNA, 15 bp, Homo sapiens
attgaatgagataac

SEQ ID NO: 134229 - DNA, 15 bp, Homo sapiens
aattgaatgagataa

SEQ ID NO: 134230 - DNA, 15 bp, Homo sapiens
gaattgaatgagata

SEQ ID NO: 134231 - DNA, 15 bp, Homo sapiens
agaattgaatgagat

SEQ ID NO: 134232 - DNA, 15 bp, Homo sapiens
aagaattgaatgaga

SEQ ID NO: 134233 - DNA, 15 bp, Homo sapiens
aaagaattgaatgag

SEQ ID NO: 134234 - DNA, 15 bp, Homo sapiens
taaagaattgaatga

SEQ ID NO: 134235 - DNA, 15 bp, Homo sapiens
ttaaagaattgaatg

SEQ ID NO: 134236 - DNA, 15 bp, Homo sapiens
attaaagaattgaat

SEQ ID NO: 134237 - DNA, 15 bp, Homo sapiens
tattaaagaattgaa

SEQ ID NO: 134238 - DNA, 15 bp, Homo sapiens
ctattaaagaattga

SEQ ID NO: 134239 - DNA, 15 bp, Homo sapiens
actattaaagaattg

SEQ ID NO: 134240 - DNA, 15 bp, Homo sapiens
gactattaaagaatt

SEQ ID NO: 134241 - DNA, 15 bp, Homo sapiens
agactattaaagaat

SEQ ID NO: 134242 - DNA, 15 bp, Homo sapiens
aagactattaaagaa

SEQ ID NO: 134243 - DNA, 15 bp, Homo sapiens
caagactattaaaga

SEQ ID NO: 134244 - DNA, 15 bp, Homo sapiens
acaagactattaaag

SEQ ID NO: 134245 - DNA, 15 bp, Homo sapiens
cacaagactattaaa

SEQ ID NO: 134246 - DNA, 15 bp, Homo sapiens
tcacaagactattaa

SEQ ID NO: 134247 - DNA, 15 bp, Homo sapiens
ctcacaagactatta

SEQ ID NO: 134248 - DNA, 15 bp, Homo sapiens
tctcacaagactatt

SEQ ID NO: 134249 - DNA, 15 bp, Homo sapiens
atctcacaagactat

SEQ ID NO: 134250 - DNA, 15 bp, Homo sapiens
tatctcacaagacta

SEQ ID NO: 134251 - DNA, 15 bp, Homo sapiens
ctatctcacaagact

SEQ ID NO: 134252 - DNA, 15 bp, Homo sapiens
cctatctcacaagac

SEQ ID NO: 134253 - DNA, 15 bp, Homo sapiens
acctatctcacaaga

SEQ ID NO: 134254 - DNA, 15 bp, Homo sapiens
tacctatctcacaag

SEQ ID NO: 134255 - DNA, 15 bp, Homo sapiens
gtacctatctcacaa

SEQ ID NO: 134256 - DNA, 15 bp, Homo sapiens
agtacctatctcaca

SEQ ID NO: 134257 - DNA, 15 bp, Homo sapiens
cagtacctatctcac

SEQ ID NO: 134258 - DNA, 15 bp, Homo sapiens
acagtacctatctca

SEQ ID NO: 134259 - DNA, 15 bp, Homo sapiens
aacagtacctatctc

SEQ ID NO: 134260 - DNA, 15 bp, Homo sapiens
aaacagtacctatct

SEQ ID NO: 134261 - DNA, 15 bp, Homo sapiens
aaaacagtacctatc

SEQ ID NO: 134262 - DNA, 15 bp, Homo sapiens
aaaaacagtacctat

SEQ ID NO: 134263 - DNA, 15 bp, Homo sapiens
taaaaacagtaccta

SEQ ID NO: 134264 - DNA, 15 bp, Homo sapiens
ataaaaacagtacct

SEQ ID NO: 134265 - DNA, 15 bp, Homo sapiens
gataaaaacagtacc

SEQ ID NO: 134266 - DNA, 15 bp, Homo sapiens
ggataaaaacagtac

SEQ ID NO: 134267 - DNA, 15 bp, Homo sapiens
gggataaaaacagta

SEQ ID NO: 134268 - DNA, 15 bp, Homo sapiens
ggggataaaaacagt

SEQ ID NO: 134269 - DNA, 15 bp, Homo sapiens
tggggataaaaacag

SEQ ID NO: 134270 - DNA, 15 bp, Homo sapiens
gtggggataaaaaca

SEQ ID NO: 134271 - DNA, 15 bp, Homo sapiens
tgtggggataaaaac

SEQ ID NO: 134272 - DNA, 15 bp, Homo sapiens
atgtggggataaaaa

SEQ ID NO: 134273 - DNA, 15 bp, Homo sapiens
aatgtggggataaaa

SEQ ID NO: 134274 - DNA, 15 bp, Homo sapiens
taatgtggggataaa

SEQ ID NO: 134275 - DNA, 15 bp, Homo sapiens
gtaatgtggggataa

SEQ ID NO: 134276 - DNA, 15 bp, Homo sapiens
tgtaatgtggggata

SEQ ID NO: 134277 - DNA, 15 bp, Homo sapiens
ttgtaatgtggggat

SEQ ID NO: 134278 - DNA, 15 bp, Homo sapiens
tttgtaatgtgggga

SEQ ID NO: 134279 - DNA, 15 bp, Homo sapiens
atttgtaatgtgggg

SEQ ID NO: 134280 - DNA, 15 bp, Homo sapiens
tatttgtaatgtggg

SEQ ID NO: 134281 - DNA, 15 bp, Homo sapiens
ttatttgtaatgtgg

SEQ ID NO: 134282 - DNA, 15 bp, Homo sapiens
cttatttgtaatgtg

SEQ ID NO: 134283 - DNA, 15 bp, Homo sapiens
acttatttgtaatgt

SEQ ID NO: 134284 - DNA, 15 bp, Homo sapiens
gacttatttgtaatg

SEQ ID NO: 134285 - DNA, 15 bp, Homo sapiens
ggacttatttgtaat

SEQ ID NO: 134286 - DNA, 15 bp, Homo sapiens
tggacttatttgtaa

SEQ ID NO: 134287 - DNA, 15 bp, Homo sapiens
gtggacttatttgta

SEQ ID NO: 134288 - DNA, 15 bp, Homo sapiens
tgtggacttatttgt

SEQ ID NO: 134289 - DNA, 15 bp, Homo sapiens
gtgtggacttatttg

SEQ ID NO: 134290 - DNA, 15 bp, Homo sapiens
ggtgtggacttattt

SEQ ID NO: 134291 - DNA, 15 bp, Homo sapiens
cggtgtggacttatt

SEQ ID NO: 134292 - DNA, 15 bp, Homo sapiens
tcggtgtggacttat

SEQ ID NO: 134293 - DNA, 15 bp, Homo sapiens
ctcggtgtggactta

SEQ ID NO: 134294 - DNA, 15 bp, Homo sapiens
cctcggtgtggactt

SEQ ID NO: 134295 - DNA, 15 bp, Homo sapiens
gcctcggtgtggact

SEQ ID NO: 134296 - DNA, 15 bp, Homo sapiens
tgcctcggtgtggac

SEQ ID NO: 134297 - DNA, 15 bp, Homo sapiens
ctgcctcggtgtgga

SEQ ID NO: 134298 - DNA, 15 bp, Homo sapiens
tctgcctcggtgtgg

SEQ ID NO: 134299 - DNA, 15 bp, Homo sapiens
ctctgcctcggtgtg

SEQ ID NO: 134300 - DNA, 15 bp, Homo sapiens
cctctgcctcggtgt

SEQ ID NO: 134301 - DNA, 15 bp, Homo sapiens
gcctctgcctcggtg

SEQ ID NO: 134302 - DNA, 15 bp, Homo sapiens
tgcctctgcctcggt

SEQ ID NO: 134303 - DNA, 15 bp, Homo sapiens
gtgcctctgcctcgg

SEQ ID NO: 134304 - DNA, 15 bp, Homo sapiens
agtgcctctgcctcg

SEQ ID NO: 134305 - DNA, 15 bp, Homo sapiens
cagtgcctctgcctc

SEQ ID NO: 134306 - DNA, 15 bp, Homo sapiens
tcagtgcctctgcct

SEQ ID NO: 134307 - DNA, 15 bp, Homo sapiens
ctcagtgcctctgcc

SEQ ID NO: 134308 - DNA, 15 bp, Homo sapiens
actcagtgcctctgc

SEQ ID NO: 134309 - DNA, 15 bp, Homo sapiens
cactcagtgcctctg

SEQ ID NO: 134310 - DNA, 15 bp, Homo sapiens
gcactcagtgcctct

SEQ ID NO: 134311 - DNA, 15 bp, Homo sapiens
tgcactcagtgcctc

SEQ ID NO: 134312 - DNA, 15 bp, Homo sapiens
atgcactcagtgcct

SEQ ID NO: 134313 - DNA, 15 bp, Homo sapiens
tatgcactcagtgcc

SEQ ID NO: 134314 - DNA, 15 bp, Homo sapiens
atatgcactcagtgc

SEQ ID NO: 134315 - DNA, 15 bp, Homo sapiens
catatgcactcagtg

SEQ ID NO: 134316 - DNA, 15 bp, Homo sapiens
tcatatgcactcagt

SEQ ID NO: 134317 - DNA, 15 bp, Homo sapiens
ctcatatgcactcag

SEQ ID NO: 134318 - DNA, 15 bp, Homo sapiens
actcatatgcactca

SEQ ID NO: 134319 - DNA, 15 bp, Homo sapiens
aactcatatgcactc

SEQ ID NO: 134320 - DNA, 15 bp, Homo sapiens
caactcatatgcact

SEQ ID NO: 134321 - DNA, 15 bp, Homo sapiens
tcaactcatatgcac

SEQ ID NO: 134322 - DNA, 15 bp, Homo sapiens
gtcaactcatatgca

SEQ ID NO: 134323 - DNA, 15 bp, Homo sapiens
tgtcaactcatatgc

SEQ ID NO: 134324 - DNA, 15 bp, Homo sapiens
ttgtcaactcatatg

SEQ ID NO: 134325 - DNA, 15 bp, Homo sapiens
tttgtcaactcatat

SEQ ID NO: 134326 - DNA, 15 bp, Homo sapiens
atttgtcaactcata

SEQ ID NO: 134327 - DNA, 15 bp, Homo sapiens
aatttgtcaactcat

SEQ ID NO: 134328 - DNA, 15 bp, Homo sapiens
taatttgtcaactca

SEQ ID NO: 134329 - DNA, 15 bp, Homo sapiens
gtaatttgtcaactc

SEQ ID NO: 134330 - DNA, 15 bp, Homo sapiens
agtaatttgtcaact

SEQ ID NO: 134331 - DNA, 15 bp, Homo sapiens
cagtaatttgtcaac

SEQ ID NO: 134332 - DNA, 15 bp, Homo sapiens
acagtaatttgtcaa

SEQ ID NO: 134333 - DNA, 15 bp, Homo sapiens
tacagtaatttgtca

SEQ ID NO: 134334 - DNA, 15 bp, Homo sapiens
ctacagtaatttgtc

SEQ ID NO: 134335 - DNA, 15 bp, Homo sapiens
gctacagtaatttgt

SEQ ID NO: 134336 - DNA, 15 bp, Homo sapiens
tgctacagtaatttg

SEQ ID NO: 134337 - DNA, 15 bp, Homo sapiens
ttgctacagtaattt

SEQ ID NO: 134338 - DNA, 15 bp, Homo sapiens
cttgctacagtaatt

SEQ ID NO: 134339 - DNA, 15 bp, Homo sapiens
ccttgctacagtaat

SEQ ID NO: 134340 - DNA, 15 bp, Homo sapiens
gccttgctacagtaa

SEQ ID NO: 134341 - DNA, 15 bp, Homo sapiens
tgccttgctacagta

SEQ ID NO: 134342 - DNA, 15 bp, Homo sapiens
ttgccttgctacagt

SEQ ID NO: 134343 - DNA, 15 bp, Homo sapiens
cttgccttgctacag

SEQ ID NO: 134344 - DNA, 15 bp, Homo sapiens
tcttgccttgctaca

SEQ ID NO: 134345 - DNA, 15 bp, Homo sapiens
ctcttgccttgctac

SEQ ID NO: 134346 - DNA, 15 bp, Homo sapiens
actcttgccttgcta

SEQ ID NO: 134347 - DNA, 15 bp, Homo sapiens
gactcttgccttgct

SEQ ID NO: 134348 - DNA, 15 bp, Homo sapiens
agactcttgccttgc

SEQ ID NO: 134349 - DNA, 15 bp, Homo sapiens
tagactcttgccttg

SEQ ID NO: 134350 - DNA, 15 bp, Homo sapiens
ttagactcttgcctt

SEQ ID NO: 134351 - DNA, 15 bp, Homo sapiens
attagactcttgcct

SEQ ID NO: 134352 - DNA, 15 bp, Homo sapiens
tattagactcttgcc

SEQ ID NO: 134353 - DNA, 15 bp, Homo sapiens
ttattagactcttgc

SEQ ID NO: 134354 - DNA, 15 bp, Homo sapiens
tttattagactcttg

SEQ ID NO: 134355 - DNA, 15 bp, Homo sapiens
ttttattagactctt

SEQ ID NO: 134356 - DNA, 15 bp, Homo sapiens
cttttattagactct

SEQ ID NO: 134357 - DNA, 15 bp, Homo sapiens
gcttttattagactc

SEQ ID NO: 134358 - DNA, 15 bp, Homo sapiens
ggcttttattagact

SEQ ID NO: 134359 - DNA, 15 bp, Homo sapiens
aggcttttattagac

SEQ ID NO: 134360 - DNA, 15 bp, Homo sapiens
gaggcttttattaga

SEQ ID NO: 134361 - DNA, 15 bp, Homo sapiens
tgaggcttttattag

SEQ ID NO: 134362 - DNA, 15 bp, Homo sapiens
ctgaggcttttatta

SEQ ID NO: 134363 - DNA, 15 bp, Homo sapiens
cctgaggcttttatt

SEQ ID NO: 134364 - DNA, 15 bp, Homo sapiens
tcctgaggcttttat

SEQ ID NO: 134365 - DNA, 15 bp, Homo sapiens
ctcctgaggctttta

SEQ ID NO: 134366 - DNA, 15 bp, Homo sapiens
tctcctgaggctttt

SEQ ID NO: 134367 - DNA, 15 bp, Homo sapiens
ttctcctgaggcttt

SEQ ID NO: 134368 - DNA, 15 bp, Homo sapiens
cttctcctgaggctt

SEQ ID NO: 134369 - DNA, 15 bp, Homo sapiens
acttctcctgaggct

SEQ ID NO: 134370 - DNA, 15 bp, Homo sapiens
tacttctcctgaggc

SEQ ID NO: 134371 - DNA, 15 bp, Homo sapiens
gtacttctcctgagg

SEQ ID NO: 134372 - DNA, 15 bp, Homo sapiens
tgtacttctcctgag

SEQ ID NO: 134373 - DNA, 15 bp, Homo sapiens
ctgtacttctcctga

SEQ ID NO: 134374 - DNA, 15 bp, Homo sapiens
cctgtacttctcctg

SEQ ID NO: 134375 - DNA, 15 bp, Homo sapiens
gcctgtacttctcct

SEQ ID NO: 134376 - DNA, 15 bp, Homo sapiens
tgcctgtacttctcc

SEQ ID NO: 134377 - DNA, 15 bp, Homo sapiens
ttgcctgtacttctc

SEQ ID NO: 134378 - DNA, 15 bp, Homo sapiens
gttgcctgtacttct

SEQ ID NO: 134379 - DNA, 15 bp, Homo sapiens
ggttgcctgtacttc

SEQ ID NO: 134380 - DNA, 15 bp, Homo sapiens
aggttgcctgtactt

SEQ ID NO: 134381 - DNA, 15 bp, Homo sapiens
caggttgcctgtact

SEQ ID NO: 134382 - DNA, 15 bp, Homo sapiens
acaggttgcctgtac

SEQ ID NO: 134383 - DNA, 15 bp, Homo sapiens
aacaggttgcctgta

SEQ ID NO: 134384 - DNA, 15 bp, Homo sapiens
caacaggttgcctgt

SEQ ID NO: 134385 - DNA, 15 bp, Homo sapiens
ccaacaggttgcctg

SEQ ID NO: 134386 - DNA, 15 bp, Homo sapiens
cccaacaggttgcct

SEQ ID NO: 134387 - DNA, 15 bp, Homo sapiens
ccccaacaggttgcc

SEQ ID NO: 134388 - DNA, 15 bp, Homo sapiens
cccccaacaggttgc

SEQ ID NO: 134389 - DNA, 15 bp, Homo sapiens
tcccccaacaggttg

SEQ ID NO: 134390 - DNA, 15 bp, Homo sapiens
ctcccccaacaggtt

SEQ ID NO: 134391 - DNA, 15 bp, Homo sapiens
gctcccccaacaggt

SEQ ID NO: 134392 - DNA, 15 bp, Homo sapiens
ggctcccccaacagg

SEQ ID NO: 134393 - DNA, 15 bp, Homo sapiens
tggctcccccaacag

SEQ ID NO: 134394 - DNA, 15 bp, Homo sapiens
ctggctcccccaaca

SEQ ID NO: 134395 - DNA, 15 bp, Homo sapiens
cctggctcccccaac

SEQ ID NO: 134396 - DNA, 15 bp, Homo sapiens
tcctggctcccccaa

SEQ ID NO: 134397 - DNA, 15 bp, Homo sapiens
atcctggctccccca

SEQ ID NO: 134398 - DNA, 15 bp, Homo sapiens
catcctggctccccc

SEQ ID NO: 134399 - DNA, 15 bp, Homo sapiens
tcatcctggctcccc

SEQ ID NO: 134400 - DNA, 15 bp, Homo sapiens
ctcatcctggctccc

SEQ ID NO: 134401 - DNA, 15 bp, Homo sapiens
cctcatcctggctcc

SEQ ID NO: 134402 - DNA, 15 bp, Homo sapiens
tcctcatcctggctc

SEQ ID NO: 134403 - DNA, 15 bp, Homo sapiens
ttcctcatcctggct

SEQ ID NO: 134404 - DNA, 15 bp, Homo sapiens
cttcctcatcctggc

SEQ ID NO: 134405 - DNA, 15 bp, Homo sapiens
ccttcctcatcctgg

SEQ ID NO: 134406 - DNA, 15 bp, Homo sapiens
cccttcctcatcctg

SEQ ID NO: 134407 - DNA, 15 bp, Homo sapiens
ccccttcctcatcct

SEQ ID NO: 134408 - DNA, 15 bp, Homo sapiens
tccccttcctcatcc

SEQ ID NO: 134409 - DNA, 15 bp, Homo sapiens
atccccttcctcatc

SEQ ID NO: 134410 - DNA, 15 bp, Homo sapiens
gatccccttcctcat

SEQ ID NO: 134411 - DNA, 15 bp, Homo sapiens
tgatccccttcctca

SEQ ID NO: 134412 - DNA, 15 bp, Homo sapiens
gtgatccccttcctc

SEQ ID NO: 134413 - DNA, 15 bp, Homo sapiens
agtgatccccttcct

SEQ ID NO: 134414 - DNA, 15 bp, Homo sapiens
aagtgatccccttcc

SEQ ID NO: 134415 - DNA, 15 bp, Homo sapiens
gaagtgatccccttc

SEQ ID NO: 134416 - DNA, 15 bp, Homo sapiens
agaagtgatcccctt

SEQ ID NO: 134417 - DNA, 15 bp, Homo sapiens
gagaagtgatcccct

SEQ ID NO: 134418 - DNA, 15 bp, Homo sapiens
ggagaagtgatcccc

SEQ ID NO: 134419 - DNA, 15 bp, Homo sapiens
tggagaagtgatccc

SEQ ID NO: 134420 - DNA, 15 bp, Homo sapiens
ctggagaagtgatcc

SEQ ID NO: 134421 - DNA, 15 bp, Homo sapiens
actggagaagtgatc

SEQ ID NO: 134422 - DNA, 15 bp, Homo sapiens
cactggagaagtgat

SEQ ID NO: 134423 - DNA, 15 bp, Homo sapiens
tcactggagaagtga

SEQ ID NO: 134424 - DNA, 15 bp, Homo sapiens
atcactggagaagtg

SEQ ID NO: 134425 - DNA, 15 bp, Homo sapiens
catcactggagaagt

SEQ ID NO: 134426 - DNA, 15 bp, Homo sapiens
ccatcactggagaag

SEQ ID NO: 134427 - DNA, 15 bp, Homo sapiens
tccatcactggagaa

SEQ ID NO: 134428 - DNA, 15 bp, Homo sapiens
ttccatcactggaga

SEQ ID NO: 134429 - DNA, 15 bp, Homo sapiens
tttccatcactggag

SEQ ID NO: 134430 - DNA, 15 bp, Homo sapiens
ctttccatcactgga

SEQ ID NO: 134431 - DNA, 15 bp, Homo sapiens
gctttccatcactgg

SEQ ID NO: 134432 - DNA, 15 bp, Homo sapiens
tgctttccatcactg

SEQ ID NO: 134433 - DNA, 15 bp, Homo sapiens
ttgctttccatcact

SEQ ID NO: 134434 - DNA, 15 bp, Homo sapiens
tttgctttccatcac

SEQ ID NO: 134435 - DNA, 15 bp, Homo sapiens
gtttgctttccatca

SEQ ID NO: 134436 - DNA, 15 bp, Homo sapiens
agtttgctttccatc

SEQ ID NO: 134437 - DNA, 15 bp, Homo sapiens
cagtttgctttccat

SEQ ID NO: 134438 - DNA, 15 bp, Homo sapiens
acagtttgctttcca

SEQ ID NO: 134439 - DNA, 15 bp, Homo sapiens
cacagtttgctttcc

SEQ ID NO: 134440 - DNA, 15 bp, Homo sapiens
acacagtttgctttc

SEQ ID NO: 134441 - DNA, 15 bp, Homo sapiens
cacacagtttgcttt

SEQ ID NO: 134442 - DNA, 15 bp, Homo sapiens
ccacacagtttgctt

SEQ ID NO: 134443 - DNA, 15 bp, Homo sapiens
cccacacagtttgct

SEQ ID NO: 134444 - DNA, 15 bp, Homo sapiens
tcccacacagtttgc

SEQ ID NO: 134445 - DNA, 15 bp, Homo sapiens
atcccacacagtttg

SEQ ID NO: 134446 - DNA, 15 bp, Homo sapiens
aatcccacacagttt

SEQ ID NO: 134447 - DNA, 15 bp, Homo sapiens
aaatcccacacagtt

SEQ ID NO: 134448 - DNA, 15 bp, Homo sapiens
aaaatcccacacagt

SEQ ID NO: 134449 - DNA, 15 bp, Homo sapiens
caaaatcccacacag

SEQ ID NO: 134450 - DNA, 15 bp, Homo sapiens
ccaaaatcccacaca

SEQ ID NO: 134451 - DNA, 15 bp, Homo sapiens
gccaaaatcccacac

SEQ ID NO: 134452 - DNA, 15 bp, Homo sapiens
tgccaaaatcccaca

SEQ ID NO: 134453 - DNA, 15 bp, Homo sapiens
atgccaaaatcccac

SEQ ID NO: 134454 - DNA, 15 bp, Homo sapiens
gatgccaaaatccca

SEQ ID NO: 134455 - DNA, 15 bp, Homo sapiens
agatgccaaaatccc

SEQ ID NO: 134456 - DNA, 15 bp, Homo sapiens
cagatgccaaaatcc

SEQ ID NO: 134457 - DNA, 15 bp, Homo sapiens
ccagatgccaaaatc

SEQ ID NO: 134458 - DNA, 15 bp, Homo sapiens
cccagatgccaaaat

SEQ ID NO: 134459 - DNA, 15 bp, Homo sapiens
tcccagatgccaaaa

SEQ ID NO: 134460 - DNA, 15 bp, Homo sapiens
gtcccagatgccaaa

SEQ ID NO: 134461 - DNA, 15 bp, Homo sapiens
tgtcccagatgccaa

SEQ ID NO: 134462 - DNA, 15 bp, Homo sapiens
ttgtcccagatgcca

SEQ ID NO: 134463 - DNA, 15 bp, Homo sapiens
tttgtcccagatgcc

SEQ ID NO: 134464 - DNA, 15 bp, Homo sapiens
ctttgtcccagatgc

SEQ ID NO: 134465 - DNA, 15 bp, Homo sapiens
actttgtcccagatg

SEQ ID NO: 134466 - DNA, 15 bp, Homo sapiens
cactttgtcccagat

SEQ ID NO: 134467 - DNA, 15 bp, Homo sapiens
ccactttgtcccaga

SEQ ID NO: 134468 - DNA, 15 bp, Homo sapiens
accactttgtcccag

SEQ ID NO: 134469 - DNA, 15 bp, Homo sapiens
caccactttgtccca

SEQ ID NO: 134470 - DNA, 15 bp, Homo sapiens
tcaccactttgtccc

SEQ ID NO: 134471 - DNA, 15 bp, Homo sapiens
gtcaccactttgtcc

SEQ ID NO: 134472 - DNA, 15 bp, Homo sapiens
tgtcaccactttgtc

SEQ ID NO: 134473 - DNA, 15 bp, Homo sapiens
atgtcaccactttgt

SEQ ID NO: 134474 - DNA, 15 bp, Homo sapiens
aatgtcaccactttg

SEQ ID NO: 134475 - DNA, 15 bp, Homo sapiens
gaatgtcaccacttt

SEQ ID NO: 134476 - DNA, 15 bp, Homo sapiens
ggaatgtcaccactt

SEQ ID NO: 134477 - DNA, 15 bp, Homo sapiens
aggaatgtcaccact

SEQ ID NO: 134478 - DNA, 15 bp, Homo sapiens
caggaatgtcaccac

SEQ ID NO: 134479 - DNA, 15 bp, Homo sapiens
ccaggaatgtcacca

SEQ ID NO: 134480 - DNA, 15 bp, Homo sapiens
accaggaatgtcacc

SEQ ID NO: 134481 - DNA, 15 bp, Homo sapiens
taccaggaatgtcac

SEQ ID NO: 134482 - DNA, 15 bp, Homo sapiens
ataccaggaatgtca

SEQ ID NO: 134483 - DNA, 15 bp, Homo sapiens
tataccaggaatgtc

SEQ ID NO: 134484 - DNA, 15 bp, Homo sapiens
ctataccaggaatgt

SEQ ID NO: 134485 - DNA, 15 bp, Homo sapiens
cctataccaggaatg

SEQ ID NO: 134486 - DNA, 15 bp, Homo sapiens
ccctataccaggaat

SEQ ID NO: 134487 - DNA, 15 bp, Homo sapiens
tccctataccaggaa

SEQ ID NO: 134488 - DNA, 15 bp, Homo sapiens
ttccctataccagga

SEQ ID NO: 134489 - DNA, 15 bp, Homo sapiens
gttccctataccagg

SEQ ID NO: 134490 - DNA, 15 bp, Homo sapiens
tgttccctataccag

SEQ ID NO: 134491 - DNA, 15 bp, Homo sapiens
ctgttccctatacca

SEQ ID NO: 134492 - DNA, 15 bp, Homo sapiens
tctgttccctatacc

SEQ ID NO: 134493 - DNA, 15 bp, Homo sapiens
ctctgttccctatac

SEQ ID NO: 134494 - DNA, 15 bp, Homo sapiens
actctgttccctata

SEQ ID NO: 134495 - DNA, 15 bp, Homo sapiens
cactctgttccctat

SEQ ID NO: 134496 - DNA, 15 bp, Homo sapiens
tcactctgttcccta

SEQ ID NO: 134497 - DNA, 15 bp, Homo sapiens
ttcactctgttccct

SEQ ID NO: 134498 - DNA, 15 bp, Homo sapiens
attcactctgttccc

SEQ ID NO: 134499 - DNA, 15 bp, Homo sapiens
tattcactctgttcc

SEQ ID NO: 134500 - DNA, 15 bp, Homo sapiens
ttattcactctgttc

SEQ ID NO: 134501 - DNA, 15 bp, Homo sapiens
tttattcactctgtt

SEQ ID NO: 134502 - DNA, 15 bp, Homo sapiens
ctttattcactctgt

SEQ ID NO: 134503 - DNA, 15 bp, Homo sapiens
actttattcactctg

SEQ ID NO: 134504 - DNA, 15 bp, Homo sapiens
gactttattcactct

SEQ ID NO: 134505 - DNA, 15 bp, Homo sapiens
tgactttattcactc

SEQ ID NO: 134506 - DNA, 15 bp, Homo sapiens
atgactttattcact

SEQ ID NO: 134507 - DNA, 15 bp, Homo sapiens
catgactttattcac

SEQ ID NO: 134508 - DNA, 15 bp, Homo sapiens
acatgactttattca

SEQ ID NO: 134509 - DNA, 15 bp, Homo sapiens
cacatgactttattc

SEQ ID NO: 134510 - DNA, 15 bp, Homo sapiens
ccacatgactttatt

SEQ ID NO: 134511 - DNA, 15 bp, Homo sapiens
accacatgactttat

SEQ ID NO: 134512 - DNA, 15 bp, Homo sapiens
taccacatgacttta

SEQ ID NO: 134513 - DNA, 15 bp, Homo sapiens
gtaccacatgacttt

SEQ ID NO: 134514 - DNA, 15 bp, Homo sapiens
tgtaccacatgactt

SEQ ID NO: 134515 - DNA, 15 bp, Homo sapiens
ctgtaccacatgact

SEQ ID NO: 134516 - DNA, 15 bp, Homo sapiens
cctgtaccacatgac

SEQ ID NO: 134517 - DNA, 15 bp, Homo sapiens
tcctgtaccacatga

SEQ ID NO: 134518 - DNA, 15 bp, Homo sapiens
ctcctgtaccacatg

SEQ ID NO: 134519 - DNA, 15 bp, Homo sapiens
cctcctgtaccacat

SEQ ID NO: 134520 - DNA, 15 bp, Homo sapiens
gcctcctgtaccaca

SEQ ID NO: 134521 - DNA, 15 bp, Homo sapiens
tgcctcctgtaccac

SEQ ID NO: 134522 - DNA, 15 bp, Homo sapiens
gtgcctcctgtacca

SEQ ID NO: 134523 - DNA, 15 bp, Homo sapiens
tgtgcctcctgtacc

SEQ ID NO: 134524 - DNA, 15 bp, Homo sapiens
ttgtgcctcctgtac

SEQ ID NO: 134525 - DNA, 15 bp, Homo sapiens
tttgtgcctcctgta

SEQ ID NO: 134526 - DNA, 15 bp, Homo sapiens
ctttgtgcctcctgt

SEQ ID NO: 134527 - DNA, 15 bp, Homo sapiens
cctttgtgcctcctg

SEQ ID NO: 134528 - DNA, 15 bp, Homo sapiens
tcctttgtgcctcct

SEQ ID NO: 134529 - DNA, 15 bp, Homo sapiens
gtcctttgtgcctcc

SEQ ID NO: 134530 - DNA, 15 bp, Homo sapiens
tgtcctttgtgcctc

SEQ ID NO: 134531 - DNA, 15 bp, Homo sapiens
ctgtcctttgtgcct

SEQ ID NO: 134532 - DNA, 15 bp, Homo sapiens
actgtcctttgtgcc

SEQ ID NO: 134533 - DNA, 15 bp, Homo sapiens
tactgtcctttgtgc

SEQ ID NO: 134534 - DNA, 15 bp, Homo sapiens
ctactgtcctttgtg

SEQ ID NO: 134535 - DNA, 15 bp, Homo sapiens
cctactgtcctttgt

SEQ ID NO: 134536 - DNA, 15 bp, Homo sapiens
ccctactgtcctttg

SEQ ID NO: 134537 - DNA, 15 bp, Homo sapiens
gccctactgtccttt

SEQ ID NO: 134538 - DNA, 15 bp, Homo sapiens
ggccctactgtcctt

SEQ ID NO: 134539 - DNA, 15 bp, Homo sapiens
tggccctactgtcct

SEQ ID NO: 134540 - DNA, 15 bp, Homo sapiens
ttggccctactgtcc

SEQ ID NO: 134541 - DNA, 15 bp, Homo sapiens
gttggccctactgtc

SEQ ID NO: 134542 - DNA, 15 bp, Homo sapiens
tgttggccctactgt

SEQ ID NO: 134543 - DNA, 15 bp, Homo sapiens
atgttggccctactg

SEQ ID NO: 134544 - DNA, 15 bp, Homo sapiens
aatgttggccctact

SEQ ID NO: 134545 - DNA, 15 bp, Homo sapiens
aaatgttggccctac

SEQ ID NO: 134546 - DNA, 15 bp, Homo sapiens
caaatgttggcccta

SEQ ID NO: 134547 - DNA, 15 bp, Homo sapiens
acaaatgttggccct

SEQ ID NO: 134548 - DNA, 15 bp, Homo sapiens
cacaaatgttggccc

SEQ ID NO: 134549 - DNA, 15 bp, Homo sapiens
gcacaaatgttggcc

SEQ ID NO: 134550 - DNA, 15 bp, Homo sapiens
tgcacaaatgttggc

SEQ ID NO: 134551 - DNA, 15 bp, Homo sapiens
ttgcacaaatgttgg

SEQ ID NO: 134552 - DNA, 15 bp, Homo sapiens
attgcacaaatgttg

SEQ ID NO: 134553 - DNA, 15 bp, Homo sapiens
aattgcacaaatgtt

SEQ ID NO: 134554 - DNA, 15 bp, Homo sapiens
taattgcacaaatgt

SEQ ID NO: 134555 - DNA, 15 bp, Homo sapiens
ttaattgcacaaatg

SEQ ID NO: 134556 - DNA, 15 bp, Homo sapiens
cttaattgcacaaat

SEQ ID NO: 134557 - DNA, 15 bp, Homo sapiens
tcttaattgcacaaa

SEQ ID NO: 134558 - DNA, 15 bp, Homo sapiens
ttcttaattgcacaa

SEQ ID NO: 134559 - DNA, 15 bp, Homo sapiens
tttcttaattgcaca

SEQ ID NO: 134560 - DNA, 15 bp, Homo sapiens
atttcttaattgcac

SEQ ID NO: 134561 - DNA, 15 bp, Homo sapiens
tatttcttaattgca

SEQ ID NO: 134562 - DNA, 15 bp, Homo sapiens
gtatttcttaattgc

SEQ ID NO: 134563 - DNA, 15 bp, Homo sapiens
tgtatttcttaattg

SEQ ID NO: 134564 - DNA, 15 bp, Homo sapiens
ctgtatttcttaatt

SEQ ID NO: 134565 - DNA, 15 bp, Homo sapiens
actgtatttcttaat

SEQ ID NO: 134566 - DNA, 15 bp, Homo sapiens
cactgtatttcttaa

SEQ ID NO: 134567 - DNA, 15 bp, Homo sapiens
acactgtatttctta

SEQ ID NO: 134568 - DNA, 15 bp, Homo sapiens
cacactgtatttctt

SEQ ID NO: 134569 - DNA, 15 bp, Homo sapiens
tcacactgtatttct

SEQ ID NO: 134570 - DNA, 15 bp, Homo sapiens
ttcacactgtatttc

SEQ ID NO: 134571 - DNA, 15 bp, Homo sapiens
tttcacactgtattt

SEQ ID NO: 134572 - DNA, 15 bp, Homo sapiens
gtttcacactgtatt

SEQ ID NO: 134573 - DNA, 15 bp, Homo sapiens
tgtttcacactgtat

SEQ ID NO: 134574 - DNA, 15 bp, Homo sapiens
ttgtttcacactgta

SEQ ID NO: 134575 - DNA, 15 bp, Homo sapiens
cttgtttcacactgt

SEQ ID NO: 134576 - DNA, 15 bp, Homo sapiens
ccttgtttcacactg

SEQ ID NO: 134577 - DNA, 15 bp, Homo sapiens
gccttgtttcacact

SEQ ID NO: 134578 - DNA, 15 bp, Homo sapiens
tgccttgtttcacac

SEQ ID NO: 134579 - DNA, 15 bp, Homo sapiens
ctgccttgtttcaca

SEQ ID NO: 134580 - DNA, 15 bp, Homo sapiens
cctgccttgtttcac

SEQ ID NO: 134581 - DNA, 15 bp, Homo sapiens
tcctgccttgtttca

SEQ ID NO: 134582 - DNA, 15 bp, Homo sapiens
ttcctgccttgtttc

SEQ ID NO: 134583 - DNA, 15 bp, Homo sapiens
tttcctgccttgttt

SEQ ID NO: 134584 - DNA, 15 bp, Homo sapiens
ttttcctgccttgtt

SEQ ID NO: 134585 - DNA, 15 bp, Homo sapiens
cttttcctgccttgt

SEQ ID NO: 134586 - DNA, 15 bp, Homo sapiens
gcttttcctgccttg

SEQ ID NO: 134587 - DNA, 15 bp, Homo sapiens
tgcttttcctgcctt

SEQ ID NO: 134588 - DNA, 15 bp, Homo sapiens
ctgcttttcctgcct

SEQ ID NO: 134589 - DNA, 15 bp, Homo sapiens
gctgcttttcctgcc

SEQ ID NO: 134590 - DNA, 15 bp, Homo sapiens
agctgcttttcctgc

SEQ ID NO: 134591 - DNA, 15 bp, Homo sapiens
gagctgcttttcctg

SEQ ID NO: 134592 - DNA, 15 bp, Homo sapiens
tgagctgcttttcct

SEQ ID NO: 134593 - DNA, 15 bp, Homo sapiens
ttgagctgcttttcc

SEQ ID NO: 134594 - DNA, 15 bp, Homo sapiens
tttgagctgcttttc

SEQ ID NO: 134595 - DNA, 15 bp, Homo sapiens
atttgagctgctttt

SEQ ID NO: 134596 - DNA, 15 bp, Homo sapiens
aatttgagctgcttt

SEQ ID NO: 134597 - DNA, 15 bp, Homo sapiens
gaatttgagctgctt

SEQ ID NO: 134598 - DNA, 15 bp, Homo sapiens
ggaatttgagctgct

SEQ ID NO: 134599 - DNA, 15 bp, Homo sapiens
gggaatttgagctgc

SEQ ID NO: 134600 - DNA, 15 bp, Homo sapiens
agggaatttgagctg

SEQ ID NO: 134601 - DNA, 15 bp, Homo sapiens
aagggaatttgagct

SEQ ID NO: 134602 - DNA, 15 bp, Homo sapiens
aaagggaatttgagc

SEQ ID NO: 134603 - DNA, 15 bp, Homo sapiens
caaagggaatttgag

SEQ ID NO: 134604 - DNA, 15 bp, Homo sapiens
acaaagggaatttga

SEQ ID NO: 134605 - DNA, 15 bp, Homo sapiens
cacaaagggaatttg

SEQ ID NO: 134606 - DNA, 15 bp, Homo sapiens
tcacaaagggaattt

SEQ ID NO: 134607 - DNA, 15 bp, Homo sapiens
ttcacaaagggaatt

SEQ ID NO: 134608 - DNA, 15 bp, Homo sapiens
cttcacaaagggaat

SEQ ID NO: 134609 - DNA, 15 bp, Homo sapiens
ccttcacaaagggaa

SEQ ID NO: 134610 - DNA, 15 bp, Homo sapiens
tccttcacaaaggga

SEQ ID NO: 134611 - DNA, 15 bp, Homo sapiens
ctccttcacaaaggg

SEQ ID NO: 134612 - DNA, 15 bp, Homo sapiens
gctccttcacaaagg

SEQ ID NO: 134613 - DNA, 15 bp, Homo sapiens
ggctccttcacaaag

SEQ ID NO: 134614 - DNA, 15 bp, Homo sapiens
aggctccttcacaaa

SEQ ID NO: 134615 - DNA, 15 bp, Homo sapiens
caggctccttcacaa

SEQ ID NO: 134616 - DNA, 15 bp, Homo sapiens
gcaggctccttcaca

SEQ ID NO: 134617 - DNA, 15 bp, Homo sapiens
tgcaggctccttcac

SEQ ID NO: 134618 - DNA, 15 bp, Homo sapiens
ctgcaggctccttca

SEQ ID NO: 134619 - DNA, 15 bp, Homo sapiens
cctgcaggctccttc

SEQ ID NO: 134620 - DNA, 15 bp, Homo sapiens
gcctgcaggctcctt

SEQ ID NO: 134621 - DNA, 15 bp, Homo sapiens
agcctgcaggctcct

SEQ ID NO: 134622 - DNA, 15 bp, Homo sapiens
cagcctgcaggctcc

SEQ ID NO: 134623 - DNA, 15 bp, Homo sapiens
acagcctgcaggctc

SEQ ID NO: 134624 - DNA, 15 bp, Homo sapiens
cacagcctgcaggct

SEQ ID NO: 134625 - DNA, 15 bp, Homo sapiens
gcacagcctgcaggc

SEQ ID NO: 134626 - DNA, 15 bp, Homo sapiens
tgcacagcctgcagg

SEQ ID NO: 134627 - DNA, 15 bp, Homo sapiens
ttgcacagcctgcag

SEQ ID NO: 134628 - DNA, 15 bp, Homo sapiens
tttgcacagcctgca

SEQ ID NO: 134629 - DNA, 15 bp, Homo sapiens
ctttgcacagcctgc

SEQ ID NO: 134630 - DNA, 15 bp, Homo sapiens
gctttgcacagcctg

SEQ ID NO: 134631 - DNA, 15 bp, Homo sapiens
ggctttgcacagcct

SEQ ID NO: 134632 - DNA, 15 bp, Homo sapiens
gggctttgcacagcc

SEQ ID NO: 134633 - DNA, 15 bp, Homo sapiens
agggctttgcacagc

SEQ ID NO: 134634 - DNA, 15 bp, Homo sapiens
aagggctttgcacag

SEQ ID NO: 134635 - DNA, 15 bp, Homo sapiens
aaagggctttgcaca

SEQ ID NO: 134636 - DNA, 15 bp, Homo sapiens
caaagggctttgcac

SEQ ID NO: 134637 - DNA, 15 bp, Homo sapiens
ccaaagggctttgca

SEQ ID NO: 134638 - DNA, 15 bp, Homo sapiens
tccaaagggctttgc

SEQ ID NO: 134639 - DNA, 15 bp, Homo sapiens
atccaaagggctttg

SEQ ID NO: 134640 - DNA, 15 bp, Homo sapiens
aatccaaagggcttt

SEQ ID NO: 134641 - DNA, 15 bp, Homo sapiens
aaatccaaagggctt

SEQ ID NO: 134642 - DNA, 15 bp, Homo sapiens
aaaatccaaagggct

SEQ ID NO: 134643 - DNA, 15 bp, Homo sapiens
aaaaatccaaagggc

SEQ ID NO: 134644 - DNA, 15 bp, Homo sapiens
taaaaatccaaaggg

SEQ ID NO: 134645 - DNA, 15 bp, Homo sapiens
ctaaaaatccaaagg

SEQ ID NO: 134646 - DNA, 15 bp, Homo sapiens
actaaaaatccaaag

SEQ ID NO: 134647 - DNA, 15 bp, Homo sapiens
gactaaaaatccaaa

SEQ ID NO: 134648 - DNA, 15 bp, Homo sapiens
agactaaaaatccaa

SEQ ID NO: 134649 - DNA, 15 bp, Homo sapiens
cagactaaaaatcca

SEQ ID NO: 134650 - DNA, 15 bp, Homo sapiens
acagactaaaaatcc

SEQ ID NO: 134651 - DNA, 15 bp, Homo sapiens
tacagactaaaaatc

SEQ ID NO: 134652 - DNA, 15 bp, Homo sapiens
ttacagactaaaaat

SEQ ID NO: 134653 - DNA, 15 bp, Homo sapiens
cttacagactaaaaa

SEQ ID NO: 134654 - DNA, 15 bp, Homo sapiens
gcttacagactaaaa

SEQ ID NO: 134655 - DNA, 15 bp, Homo sapiens
tgcttacagactaaa

SEQ ID NO: 134656 - DNA, 15 bp, Homo sapiens
ttgcttacagactaa

SEQ ID NO: 134657 - DNA, 15 bp, Homo sapiens
attgcttacagacta

SEQ ID NO: 134658 - DNA, 15 bp, Homo sapiens
aattgcttacagact

SEQ ID NO: 134659 - DNA, 15 bp, Homo sapiens
caattgcttacagac

SEQ ID NO: 134660 - DNA, 15 bp, Homo sapiens
ccaattgcttacaga

SEQ ID NO: 134661 - DNA, 15 bp, Homo sapiens
accaattgcttacag

SEQ ID NO: 134662 - DNA, 15 bp, Homo sapiens
taccaattgcttaca

SEQ ID NO: 134663 - DNA, 15 bp, Homo sapiens
ttaccaattgcttac

SEQ ID NO: 134664 - DNA, 15 bp, Homo sapiens
tttaccaattgctta

SEQ ID NO: 134665 - DNA, 15 bp, Homo sapiens
gtttaccaattgctt

SEQ ID NO: 134666 - DNA, 15 bp, Homo sapiens
tgtttaccaattgct

SEQ ID NO: 134667 - DNA, 15 bp, Homo sapiens
atgtttaccaattgc

SEQ ID NO: 134668 - DNA, 15 bp, Homo sapiens
gatgtttaccaattg

SEQ ID NO: 134669 - DNA, 15 bp, Homo sapiens
agatgtttaccaatt

SEQ ID NO: 134670 - DNA, 15 bp, Homo sapiens
aagatgtttaccaat

SEQ ID NO: 134671 - DNA, 15 bp, Homo sapiens
gaagatgtttaccaa

SEQ ID NO: 134672 - DNA, 15 bp, Homo sapiens
ggaagatgtttacca

SEQ ID NO: 134673 - DNA, 15 bp, Homo sapiens
aggaagatgtttacc

SEQ ID NO: 134674 - DNA, 15 bp, Homo sapiens
aaggaagatgtttac

SEQ ID NO: 134675 - DNA, 15 bp, Homo sapiens
gaaggaagatgttta

SEQ ID NO: 134676 - DNA, 15 bp, Homo sapiens
ggaaggaagatgttt

SEQ ID NO: 134677 - DNA, 15 bp, Homo sapiens
gggaaggaagatgtt

SEQ ID NO: 134678 - DNA, 15 bp, Homo sapiens
tgggaaggaagatgt

SEQ ID NO: 134679 - DNA, 15 bp, Homo sapiens
atgggaaggaagatg

SEQ ID NO: 134680 - DNA, 15 bp, Homo sapiens
aatgggaaggaagat

SEQ ID NO: 134681 - DNA, 15 bp, Homo sapiens
aaatgggaaggaaga

SEQ ID NO: 134682 - DNA, 15 bp, Homo sapiens
gaaatgggaaggaag

SEQ ID NO: 134683 - DNA, 15 bp, Homo sapiens
agaaatgggaaggaa

SEQ ID NO: 134684 - DNA, 15 bp, Homo sapiens
aagaaatgggaagga

SEQ ID NO: 134685 - DNA, 15 bp, Homo sapiens
aaagaaatgggaagg

SEQ ID NO: 134686 - DNA, 15 bp, Homo sapiens
aaaagaaatgggaag

SEQ ID NO: 134687 - DNA, 15 bp, Homo sapiens
aaaaagaaatgggaa

SEQ ID NO: 134688 - DNA, 15 bp, Homo sapiens
gaaaaagaaatggga

SEQ ID NO: 134689 - DNA, 15 bp, Homo sapiens
agaaaaagaaatggg

SEQ ID NO: 134690 - DNA, 15 bp, Homo sapiens
aagaaaaagaaatgg

SEQ ID NO: 134691 - DNA, 15 bp, Homo sapiens
aaagaaaaagaaatg

SEQ ID NO: 134692 - DNA, 15 bp, Homo sapiens
aaaagaaaaagaaat

SEQ ID NO: 134693 - DNA, 15 bp, Homo sapiens
aaaaagaaaaagaaa

SEQ ID NO: 134694 - DNA, 15 bp, Homo sapiens
taaaaagaaaaagaa

SEQ ID NO: 134695 - DNA, 15 bp, Homo sapiens
ttaaaaagaaaaaga

SEQ ID NO: 134696 - DNA, 15 bp, Homo sapiens
tttaaaaagaaaaag

SEQ ID NO: 134697 - DNA, 15 bp, Homo sapiens
aattttaaaaagaaa

SEQ ID NO: 134698 - DNA, 15 bp, Homo sapiens
caattttaaaaagaa

SEQ ID NO: 134699 - DNA, 15 bp, Homo sapiens
acaattttaaaaaga

SEQ ID NO: 134700 - DNA, 15 bp, Homo sapiens
cacaattttaaaaag

SEQ ID NO: 134701 - DNA, 15 bp, Homo sapiens
acacaattttaaaaa

SEQ ID NO: 134702 - DNA, 15 bp, Homo sapiens
aacacaattttaaaa

SEQ ID NO: 134703 - DNA, 15 bp, Homo sapiens
aaacacaattttaaa

SEQ ID NO: 134704 - DNA, 15 bp, Homo sapiens
taaacacaattttaa

SEQ ID NO: 134705 - DNA, 15 bp, Homo sapiens
ataaacacaatttta

SEQ ID NO: 134706 - DNA, 15 bp, Homo sapiens
cataaacacaatttt

SEQ ID NO: 134707 - DNA, 15 bp, Homo sapiens
tcataaacacaattt

SEQ ID NO: 134708 - DNA, 15 bp, Homo sapiens
ttcataaacacaatt

SEQ ID NO: 134709 - DNA, 15 bp, Homo sapiens
gttcataaacacaat

SEQ ID NO: 134710 - DNA, 15 bp, Homo sapiens
agttcataaacacaa

SEQ ID NO: 134711 - DNA, 15 bp, Homo sapiens
gagttcataaacaca

SEQ ID NO: 134712 - DNA, 15 bp, Homo sapiens
tgagttcataaacac

SEQ ID NO: 134713 - DNA, 15 bp, Homo sapiens
atgagttcataaaca

SEQ ID NO: 134714 - DNA, 15 bp, Homo sapiens
catgagttcataaac

SEQ ID NO: 134715 - DNA, 15 bp, Homo sapiens
tcatgagttcataaa

SEQ ID NO: 134716 - DNA, 15 bp, Homo sapiens
atcatgagttcataa

SEQ ID NO: 134717 - DNA, 15 bp, Homo sapiens
tatcatgagttcata

SEQ ID NO: 134718 - DNA, 15 bp, Homo sapiens
ttatcatgagttcat

SEQ ID NO: 134719 - DNA, 15 bp, Homo sapiens
gttatcatgagttca

SEQ ID NO: 134720 - DNA, 15 bp, Homo sapiens
ggttatcatgagttc

SEQ ID NO: 134721 - DNA, 15 bp, Homo sapiens
cggttatcatgagtt

SEQ ID NO: 134722 - DNA, 15 bp, Homo sapiens
acggttatcatgagt

SEQ ID NO: 134723 - DNA, 15 bp, Homo sapiens
cacggttatcatgag

SEQ ID NO: 134724 - DNA, 15 bp, Homo sapiens
gcacggttatcatga

SEQ ID NO: 134725 - DNA, 15 bp, Homo sapiens
agcacggttatcatg

SEQ ID NO: 134726 - DNA, 15 bp, Homo sapiens
gagcacggttatcat

SEQ ID NO: 134727 - DNA, 15 bp, Homo sapiens
agagcacggttatca

SEQ ID NO: 134728 - DNA, 15 bp, Homo sapiens
cagagcacggttatc

SEQ ID NO: 134729 - DNA, 15 bp, Homo sapiens
gcagagcacggttat

SEQ ID NO: 134730 - DNA, 15 bp, Homo sapiens
agcagagcacggtta

SEQ ID NO: 134731 - DNA, 15 bp, Homo sapiens
aagcagagcacggtt

SEQ ID NO: 134732 - DNA, 15 bp, Homo sapiens
aaagcagagcacggt

SEQ ID NO: 134733 - DNA, 15 bp, Homo sapiens
taaagcagagcacgg

SEQ ID NO: 134734 - DNA, 15 bp, Homo sapiens
ctaaagcagagcacg

SEQ ID NO: 134735 - DNA, 15 bp, Homo sapiens
actaaagcagagcac

SEQ ID NO: 134736 - DNA, 15 bp, Homo sapiens
tactaaagcagagca

SEQ ID NO: 134737 - DNA, 15 bp, Homo sapiens
ctactaaagcagagc

SEQ ID NO: 134738 - DNA, 15 bp, Homo sapiens
tctactaaagcagag

SEQ ID NO: 134739 - DNA, 15 bp, Homo sapiens
ttctactaaagcaga

SEQ ID NO: 134740 - DNA, 15 bp, Homo sapiens
cttctactaaagcag

SEQ ID NO: 134741 - DNA, 15 bp, Homo sapiens
tcttctactaaagca

SEQ ID NO: 134742 - DNA, 15 bp, Homo sapiens
gtcttctactaaagc

SEQ ID NO: 134743 - DNA, 15 bp, Homo sapiens
agtcttctactaaag

SEQ ID NO: 134744 - DNA, 15 bp, Homo sapiens
tagtcttctactaaa

SEQ ID NO: 134745 - DNA, 15 bp, Homo sapiens
ctagtcttctactaa

SEQ ID NO: 134746 - DNA, 15 bp, Homo sapiens
cctagtcttctacta

SEQ ID NO: 134747 - DNA, 15 bp, Homo sapiens
tcctagtcttctact

SEQ ID NO: 134748 - DNA, 15 bp, Homo sapiens
atcctagtcttctac

SEQ ID NO: 134749 - DNA, 15 bp, Homo sapiens
catcctagtcttcta

SEQ ID NO: 134750 - DNA, 15 bp, Homo sapiens
ccatcctagtcttct

SEQ ID NO: 134751 - DNA, 15 bp, Homo sapiens
tccatcctagtcttc

SEQ ID NO: 134752 - DNA, 15 bp, Homo sapiens
atccatcctagtctt

SEQ ID NO: 134753 - DNA, 15 bp, Homo sapiens
aatccatcctagtct

SEQ ID NO: 134754 - DNA, 15 bp, Homo sapiens
caatccatcctagtc

SEQ ID NO: 134755 - DNA, 15 bp, Homo sapiens
ccaatccatcctagt

SEQ ID NO: 134756 - DNA, 15 bp, Homo sapiens
tccaatccatcctag

SEQ ID NO: 134757 - DNA, 15 bp, Homo sapiens
ctccaatccatccta

SEQ ID NO: 134758 - DNA, 15 bp, Homo sapiens
cctccaatccatcct

SEQ ID NO: 134759 - DNA, 15 bp, Homo sapiens
gcctccaatccatcc

SEQ ID NO: 134760 - DNA, 15 bp, Homo sapiens
tgcctccaatccatc

SEQ ID NO: 134761 - DNA, 15 bp, Homo sapiens
ttgcctccaatccat

SEQ ID NO: 134762 - DNA, 15 bp, Homo sapiens
cttgcctccaatcca

SEQ ID NO: 134763 - DNA, 15 bp, Homo sapiens
tcttgcctccaatcc

SEQ ID NO: 134764 - DNA, 15 bp, Homo sapiens
ttcttgcctccaatc

SEQ ID NO: 134765 - DNA, 15 bp, Homo sapiens
tttcttgcctccaat

SEQ ID NO: 134766 - DNA, 15 bp, Homo sapiens
atttcttgcctccaa

SEQ ID NO: 134767 - DNA, 15 bp, Homo sapiens
catttcttgcctcca

SEQ ID NO: 134768 - DNA, 15 bp, Homo sapiens
gcatttcttgcctcc

SEQ ID NO: 134769 - DNA, 15 bp, Homo sapiens
tgcatttcttgcctc

SEQ ID NO: 134770 - DNA, 15 bp, Homo sapiens
atgcatttcttgcct

SEQ ID NO: 134771 - DNA, 15 bp, Homo sapiens
tatgcatttcttgcc

SEQ ID NO: 134772 - DNA, 15 bp, Homo sapiens
ttatgcatttcttgc

SEQ ID NO: 134773 - DNA, 15 bp, Homo sapiens
tttatgcatttcttg

SEQ ID NO: 134774 - DNA, 15 bp, Homo sapiens
atttatgcatttctt

SEQ ID NO: 134775 - DNA, 15 bp, Homo sapiens
gatttatgcatttct

SEQ ID NO: 134776 - DNA, 15 bp, Homo sapiens
tgatttatgcatttc

SEQ ID NO: 134777 - DNA, 15 bp, Homo sapiens
cttgatttatgcatt

SEQ ID NO: 134778 - DNA, 15 bp, Homo sapiens
ccttgatttatgcat

SEQ ID NO: 134779 - DNA, 15 bp, Homo sapiens
gccttgatttatgca

SEQ ID NO: 134780 - DNA, 15 bp, Homo sapiens
tgccttgatttatgc

SEQ ID NO: 134781 - DNA, 15 bp, Homo sapiens
ttgccttgatttatg

SEQ ID NO: 134782 - DNA, 15 bp, Homo sapiens
tttgccttgatttat

SEQ ID NO: 134783 - DNA, 15 bp, Homo sapiens
ctttgccttgattta

SEQ ID NO: 134784 - DNA, 15 bp, Homo sapiens
tctttgccttgattt

SEQ ID NO: 134785 - DNA, 15 bp, Homo sapiens
ctctttgccttgatt

SEQ ID NO: 134786 - DNA, 15 bp, Homo sapiens
gctctttgccttgat

SEQ ID NO: 134787 - DNA, 15 bp, Homo sapiens
ggctctttgccttga

SEQ ID NO: 134788 - DNA, 15 bp, Homo sapiens
gggctctttgccttg

SEQ ID NO: 134789 - DNA, 15 bp, Homo sapiens
agggctctttgcctt

SEQ ID NO: 134790 - DNA, 15 bp, Homo sapiens
aagggctctttgcct

SEQ ID NO: 134791 - DNA, 15 bp, Homo sapiens
aaagggctctttgcc

SEQ ID NO: 134792 - DNA, 15 bp, Homo sapiens
gaaagggctctttgc

SEQ ID NO: 134793 - DNA, 15 bp, Homo sapiens
agaaagggctctttg

SEQ ID NO: 134794 - DNA, 15 bp, Homo sapiens
cagaaagggctcttt

SEQ ID NO: 134795 - DNA, 15 bp, Homo sapiens
tcagaaagggctctt

SEQ ID NO: 134796 - DNA, 15 bp, Homo sapiens
ttcagaaagggctct

SEQ ID NO: 134797 - DNA, 15 bp, Homo sapiens
tttcagaaagggctc

SEQ ID NO: 134798 - DNA, 15 bp, Homo sapiens
atttcagaaagggct

SEQ ID NO: 134799 - DNA, 15 bp, Homo sapiens
catttcagaaagggc

SEQ ID NO: 134800 - DNA, 15 bp, Homo sapiens
tcatttcagaaaggg

SEQ ID NO: 134801 - DNA, 15 bp, Homo sapiens
gtcatttcagaaagg

SEQ ID NO: 134802 - DNA, 15 bp, Homo sapiens
agtcatttcagaaag

SEQ ID NO: 134803 - DNA, 15 bp, Homo sapiens
tagtcatttcagaaa

SEQ ID NO: 134804 - DNA, 15 bp, Homo sapiens
ttagtcatttcagaa

SEQ ID NO: 134805 - DNA, 15 bp, Homo sapiens
cttagtcatttcaga

SEQ ID NO: 134806 - DNA, 15 bp, Homo sapiens
tcttagtcatttcag

SEQ ID NO: 134807 - DNA, 15 bp, Homo sapiens
atcttagtcatttca

SEQ ID NO: 134808 - DNA, 15 bp, Homo sapiens
catcttagtcatttc

SEQ ID NO: 134809 - DNA, 15 bp, Homo sapiens
tcatcttagtcattt

SEQ ID NO: 134810 - DNA, 15 bp, Homo sapiens
atcatcttagtcatt

SEQ ID NO: 134811 - DNA, 15 bp, Homo sapiens
catcatcttagtcat

SEQ ID NO: 134812 - DNA, 15 bp, Homo sapiens
gcatcatcttagtca

SEQ ID NO: 134813 - DNA, 15 bp, Homo sapiens
agcatcatcttagtc

SEQ ID NO: 134814 - DNA, 15 bp, Homo sapiens
cagcatcatcttagt

SEQ ID NO: 134815 - DNA, 15 bp, Homo sapiens
acagcatcatcttag

SEQ ID NO: 134816 - DNA, 15 bp, Homo sapiens
aacagcatcatctta

SEQ ID NO: 134817 - DNA, 15 bp, Homo sapiens
caacagcatcatctt

SEQ ID NO: 134818 - DNA, 15 bp, Homo sapiens
gcaacagcatcatct

SEQ ID NO: 134819 - DNA, 15 bp, Homo sapiens
tgcaacagcatcatc

SEQ ID NO: 134820 - DNA, 15 bp, Homo sapiens
ttgcaacagcatcat

SEQ ID NO: 134821 - DNA, 15 bp, Homo sapiens
attgcaacagcatca

SEQ ID NO: 134822 - DNA, 15 bp, Homo sapiens
aattgcaacagcatc

SEQ ID NO: 134823 - DNA, 15 bp, Homo sapiens
taattgcaacagcat

SEQ ID NO: 134824 - DNA, 15 bp, Homo sapiens
ctaattgcaacagca

SEQ ID NO: 134825 - DNA, 15 bp, Homo sapiens
gctaattgcaacagc

SEQ ID NO: 134826 - DNA, 15 bp, Homo sapiens
tgctaattgcaacag

SEQ ID NO: 134827 - DNA, 15 bp, Homo sapiens
ctgctaattgcaaca

SEQ ID NO: 134828 - DNA, 15 bp, Homo sapiens
tctgctaattgcaac

SEQ ID NO: 134829 - DNA, 15 bp, Homo sapiens
ttctgctaattgcaa

SEQ ID NO: 134830 - DNA, 15 bp, Homo sapiens
tttctgctaattgca

SEQ ID NO: 134831 - DNA, 15 bp, Homo sapiens
atttctgctaattgc

SEQ ID NO: 134832 - DNA, 15 bp, Homo sapiens
tatttctgctaattg

SEQ ID NO: 134833 - DNA, 15 bp, Homo sapiens
ttatttctgctaatt

SEQ ID NO: 134834 - DNA, 15 bp, Homo sapiens
cttatttctgctaat

SEQ ID NO: 134835 - DNA, 15 bp, Homo sapiens
ccttatttctgctaa

SEQ ID NO: 134836 - DNA, 15 bp, Homo sapiens
tccttatttctgcta

SEQ ID NO: 134837 - DNA, 15 bp, Homo sapiens
ttccttatttctgct

SEQ ID NO: 134838 - DNA, 15 bp, Homo sapiens
attccttatttctgc

SEQ ID NO: 134839 - DNA, 15 bp, Homo sapiens
tattccttatttctg

SEQ ID NO: 134840 - DNA, 15 bp, Homo sapiens
ctattccttatttct

SEQ ID NO: 134841 - DNA, 15 bp, Homo sapiens
tctattccttatttc

SEQ ID NO: 134842 - DNA, 15 bp, Homo sapiens
ttctattccttattt

SEQ ID NO: 134843 - DNA, 15 bp, Homo sapiens
cttctattccttatt

SEQ ID NO: 134844 - DNA, 15 bp, Homo sapiens
tcttctattccttat

SEQ ID NO: 134845 - DNA, 15 bp, Homo sapiens
ttcttctattcctta

SEQ ID NO: 134846 - DNA, 15 bp, Homo sapiens
tttcttctattcctt

SEQ ID NO: 134847 - DNA, 15 bp, Homo sapiens
atttcttctattcct

SEQ ID NO: 134848 - DNA, 15 bp, Homo sapiens
aatttcttctattcc

SEQ ID NO: 134849 - DNA, 15 bp, Homo sapiens
caatttcttctattc

SEQ ID NO: 134850 - DNA, 15 bp, Homo sapiens
tcaatttcttctatt

SEQ ID NO: 134851 - DNA, 15 bp, Homo sapiens
ctcaatttcttctat

SEQ ID NO: 134852 - DNA, 15 bp, Homo sapiens
actcaatttcttcta

SEQ ID NO: 134853 - DNA, 15 bp, Homo sapiens
cactcaatttcttct

SEQ ID NO: 134854 - DNA, 15 bp, Homo sapiens
acactcaatttcttc

SEQ ID NO: 134855 - DNA, 15 bp, Homo sapiens
cacactcaatttctt

SEQ ID NO: 134856 - DNA, 15 bp, Homo sapiens
tcacactcaatttct

SEQ ID NO: 134857 - DNA, 15 bp, Homo sapiens
ttcacactcaatttc

SEQ ID NO: 134858 - DNA, 15 bp, Homo sapiens
attcacactcaattt

SEQ ID NO: 134859 - DNA, 15 bp, Homo sapiens
cattcacactcaatt

SEQ ID NO: 134860 - DNA, 15 bp, Homo sapiens
tcattcacactcaat

SEQ ID NO: 134861 - DNA, 15 bp, Homo sapiens
ctcattcacactcaa

SEQ ID NO: 134862 - DNA, 15 bp, Homo sapiens
cctcattcacactca

SEQ ID NO: 134863 - DNA, 15 bp, Homo sapiens
ccctcattcacactc

SEQ ID NO: 134864 - DNA, 15 bp, Homo sapiens
accctcattcacact

SEQ ID NO: 134865 - DNA, 15 bp, Homo sapiens
aaccctcattcacac

SEQ ID NO: 134866 - DNA, 15 bp, Homo sapiens
aaaccctcattcaca

SEQ ID NO: 134867 - DNA, 15 bp, Homo sapiens
caaaccctcattcac

SEQ ID NO: 134868 - DNA, 15 bp, Homo sapiens
tcaaaccctcattca

SEQ ID NO: 134869 - DNA, 15 bp, Homo sapiens
ctcaaaccctcattc

SEQ ID NO: 134870 - DNA, 15 bp, Homo sapiens
actcaaaccctcatt

SEQ ID NO: 134871 - DNA, 15 bp, Homo sapiens
cactcaaaccctcat

SEQ ID NO: 134872 - DNA, 15 bp, Homo sapiens
tcactcaaaccctca

SEQ ID NO: 134873 - DNA, 15 bp, Homo sapiens
atcactcaaaccctc

SEQ ID NO: 134874 - DNA, 15 bp, Homo sapiens
aatcactcaaaccct

SEQ ID NO: 134875 - DNA, 15 bp, Homo sapiens
aaatcactcaaaccc

SEQ ID NO: 134876 - DNA, 15 bp, Homo sapiens
taaatcactcaaacc

SEQ ID NO: 134877 - DNA, 15 bp, Homo sapiens
ctaaatcactcaaac

SEQ ID NO: 134878 - DNA, 15 bp, Homo sapiens
actaaatcactcaaa

SEQ ID NO: 134879 - DNA, 15 bp, Homo sapiens
aactaaatcactcaa

SEQ ID NO: 134880 - DNA, 15 bp, Homo sapiens
aaactaaatcactca

SEQ ID NO: 134881 - DNA, 15 bp, Homo sapiens
gaaactaaatcactc

SEQ ID NO: 134882 - DNA, 15 bp, Homo sapiens
tgaaactaaatcact

SEQ ID NO: 134883 - DNA, 15 bp, Homo sapiens
ctgaaactaaatcac

SEQ ID NO: 134884 - DNA, 15 bp, Homo sapiens
tctgaaactaaatca

SEQ ID NO: 134885 - DNA, 15 bp, Homo sapiens
gtctgaaactaaatc

SEQ ID NO: 134886 - DNA, 15 bp, Homo sapiens
cgtctgaaactaaat

SEQ ID NO: 134887 - DNA, 15 bp, Homo sapiens
acgtctgaaactaaa

SEQ ID NO: 134888 - DNA, 15 bp, Homo sapiens
cacgtctgaaactaa

SEQ ID NO: 134889 - DNA, 15 bp, Homo sapiens
acacgtctgaaacta

SEQ ID NO: 134890 - DNA, 15 bp, Homo sapiens
aacacgtctgaaact

SEQ ID NO: 134891 - DNA, 15 bp, Homo sapiens
caacacgtctgaaac

SEQ ID NO: 134892 - DNA, 15 bp, Homo sapiens
acaacacgtctgaaa

SEQ ID NO: 134893 - DNA, 15 bp, Homo sapiens
cacaacacgtctgaa

SEQ ID NO: 134894 - DNA, 15 bp, Homo sapiens
ccacaacacgtctga

SEQ ID NO: 134895 - DNA, 15 bp, Homo sapiens
accacaacacgtctg

SEQ ID NO: 134896 - DNA, 15 bp, Homo sapiens
caccacaacacgtct

SEQ ID NO: 134897 - DNA, 15 bp, Homo sapiens
ccaccacaacacgtc

SEQ ID NO: 134898 - DNA, 15 bp, Homo sapiens
cccaccacaacacgt

SEQ ID NO: 134899 - DNA, 15 bp, Homo sapiens
ccccaccacaacacg

SEQ ID NO: 134900 - DNA, 15 bp, Homo sapiens
tccccaccacaacac

SEQ ID NO: 134901 - DNA, 15 bp, Homo sapiens
ctccccaccacaaca

SEQ ID NO: 134902 - DNA, 15 bp, Homo sapiens
actccccaccacaac

SEQ ID NO: 134903 - DNA, 15 bp, Homo sapiens
gactccccaccacaa

SEQ ID NO: 134904 - DNA, 15 bp, Homo sapiens
ggactccccaccaca

SEQ ID NO: 134905 - DNA, 15 bp, Homo sapiens
aggactccccaccac

SEQ ID NO: 134906 - DNA, 15 bp, Homo sapiens
aaggactccccacca

SEQ ID NO: 134907 - DNA, 15 bp, Homo sapiens
taaggactccccacc

SEQ ID NO: 134908 - DNA, 15 bp, Homo sapiens
ataaggactccccac

SEQ ID NO: 134909 - DNA, 15 bp, Homo sapiens
cataaggactcccca

SEQ ID NO: 134910 - DNA, 15 bp, Homo sapiens
gcataaggactcccc

SEQ ID NO: 134911 - DNA, 15 bp, Homo sapiens
ggcataaggactccc

SEQ ID NO: 134912 - DNA, 15 bp, Homo sapiens
tggcataaggactcc

SEQ ID NO: 134913 - DNA, 15 bp, Homo sapiens
atggcataaggactc

SEQ ID NO: 134914 - DNA, 15 bp, Homo sapiens
aatggcataaggact

SEQ ID NO: 134915 - DNA, 15 bp, Homo sapiens
aaatggcataaggac

SEQ ID NO: 134916 - DNA, 15 bp, Homo sapiens
taaatggcataagga

SEQ ID NO: 134917 - DNA, 15 bp, Homo sapiens
ctaaatggcataagg

SEQ ID NO: 134918 - DNA, 15 bp, Homo sapiens
tctaaatggcataag

SEQ ID NO: 134919 - DNA, 15 bp, Homo sapiens
ttctaaatggcataa

SEQ ID NO: 134920 - DNA, 15 bp, Homo sapiens
cttctaaatggcata

SEQ ID NO: 134921 - DNA, 15 bp, Homo sapiens
ccttctaaatggcat

SEQ ID NO: 134922 - DNA, 15 bp, Homo sapiens
tccttctaaatggca

SEQ ID NO: 134923 - DNA, 15 bp, Homo sapiens
ttccttctaaatggc

SEQ ID NO: 134924 - DNA, 15 bp, Homo sapiens
cttccttctaaatgg

SEQ ID NO: 134925 - DNA, 15 bp, Homo sapiens
acttccttctaaatg

SEQ ID NO: 134926 - DNA, 15 bp, Homo sapiens
cacttccttctaaat

SEQ ID NO: 134927 - DNA, 15 bp, Homo sapiens
tcacttccttctaaa

SEQ ID NO: 134928 - DNA, 15 bp, Homo sapiens
atcacttccttctaa

SEQ ID NO: 134929 - DNA, 15 bp, Homo sapiens
gatcacttccttcta

SEQ ID NO: 134930 - DNA, 15 bp, Homo sapiens
tgatcacttccttct

SEQ ID NO: 134931 - DNA, 15 bp, Homo sapiens
ctgatcacttccttc

SEQ ID NO: 134932 - DNA, 15 bp, Homo sapiens
actgatcacttcctt

SEQ ID NO: 134933 - DNA, 15 bp, Homo sapiens
tactgatcacttcct

SEQ ID NO: 134934 - DNA, 15 bp, Homo sapiens
atactgatcacttcc

SEQ ID NO: 134935 - DNA, 15 bp, Homo sapiens
aatactgatcacttc

SEQ ID NO: 134936 - DNA, 15 bp, Homo sapiens
gaatactgatcactt

SEQ ID NO: 134937 - DNA, 15 bp, Homo sapiens
tgaatactgatcact

SEQ ID NO: 134938 - DNA, 15 bp, Homo sapiens
atgaatactgatcac

SEQ ID NO: 134939 - DNA, 15 bp, Homo sapiens
aatgaatactgatca

SEQ ID NO: 134940 - DNA, 15 bp, Homo sapiens
taatgaatactgatc

SEQ ID NO: 134941 - DNA, 15 bp, Homo sapiens
gtaatgaatactgat

SEQ ID NO: 134942 - DNA, 15 bp, Homo sapiens
ggtaatgaatactga

SEQ ID NO: 134943 - DNA, 15 bp, Homo sapiens
tggtaatgaatactg

SEQ ID NO: 134944 - DNA, 15 bp, Homo sapiens
atggtaatgaatact

SEQ ID NO: 134945 - DNA, 15 bp, Homo sapiens
catggtaatgaatac

SEQ ID NO: 134946 - DNA, 15 bp, Homo sapiens
acatggtaatgaata

SEQ ID NO: 134947 - DNA, 15 bp, Homo sapiens
cacatggtaatgaat

SEQ ID NO: 134948 - DNA, 15 bp, Homo sapiens
gcacatggtaatgaa

SEQ ID NO: 134949 - DNA, 15 bp, Homo sapiens
ggcacatggtaatga

SEQ ID NO: 134950 - DNA, 15 bp, Homo sapiens
gggcacatggtaatg

SEQ ID NO: 134951 - DNA, 15 bp, Homo sapiens
agggcacatggtaat

SEQ ID NO: 134952 - DNA, 15 bp, Homo sapiens
cagggcacatggtaa

SEQ ID NO: 134953 - DNA, 15 bp, Homo sapiens
ccagggcacatggta

SEQ ID NO: 134954 - DNA, 15 bp, Homo sapiens
cccagggcacatggt

SEQ ID NO: 134955 - DNA, 15 bp, Homo sapiens
tcccagggcacatgg

SEQ ID NO: 134956 - DNA, 15 bp, Homo sapiens
atcccagggcacatg

SEQ ID NO: 134957 - DNA, 15 bp, Homo sapiens
aatcccagggcacat

SEQ ID NO: 134958 - DNA, 15 bp, Homo sapiens
aaatcccagggcaca

SEQ ID NO: 134959 - DNA, 15 bp, Homo sapiens
taaatcccagggcac

SEQ ID NO: 134960 - DNA, 15 bp, Homo sapiens
ctaaatcccagggca

SEQ ID NO: 134961 - DNA, 15 bp, Homo sapiens
cctaaatcccagggc

SEQ ID NO: 134962 - DNA, 15 bp, Homo sapiens
tcctaaatcccaggg

SEQ ID NO: 134963 - DNA, 15 bp, Homo sapiens
atcctaaatcccagg

SEQ ID NO: 134964 - DNA, 15 bp, Homo sapiens
aatcctaaatcccag

SEQ ID NO: 134965 - DNA, 15 bp, Homo sapiens
caatcctaaatccca

SEQ ID NO: 134966 - DNA, 15 bp, Homo sapiens
tcaatcctaaatccc

SEQ ID NO: 134967 - DNA, 15 bp, Homo sapiens
ttcaatcctaaatcc

SEQ ID NO: 134968 - DNA, 15 bp, Homo sapiens
tttcaatcctaaatc

SEQ ID NO: 134969 - DNA, 15 bp, Homo sapiens
ctttcaatcctaaat

SEQ ID NO: 134970 - DNA, 15 bp, Homo sapiens
actttcaatcctaaa

SEQ ID NO: 134971 - DNA, 15 bp, Homo sapiens
aactttcaatcctaa

SEQ ID NO: 134972 - DNA, 15 bp, Homo sapiens
caactttcaatccta

SEQ ID NO: 134973 - DNA, 15 bp, Homo sapiens
acaactttcaatcct

SEQ ID NO: 134974 - DNA, 15 bp, Homo sapiens
cacaactttcaatcc

SEQ ID NO: 134975 - DNA, 15 bp, Homo sapiens
tcacaactttcaatc

SEQ ID NO: 134976 - DNA, 15 bp, Homo sapiens
ctcacaactttcaat

SEQ ID NO: 134977 - DNA, 15 bp, Homo sapiens
gctcacaactttcaa

SEQ ID NO: 134978 - DNA, 15 bp, Homo sapiens
tgctcacaactttca

SEQ ID NO: 134979 - DNA, 15 bp, Homo sapiens
ttgctcacaactttc

SEQ ID NO: 134980 - DNA, 15 bp, Homo sapiens
attgctcacaacttt

SEQ ID NO: 134981 - DNA, 15 bp, Homo sapiens
gattgctcacaactt

SEQ ID NO: 134982 - DNA, 15 bp, Homo sapiens
ggattgctcacaact

SEQ ID NO: 134983 - DNA, 15 bp, Homo sapiens
tggattgctcacaac

SEQ ID NO: 134984 - DNA, 15 bp, Homo sapiens
atggattgctcacaa

SEQ ID NO: 134985 - DNA, 15 bp, Homo sapiens
aatggattgctcaca

SEQ ID NO: 134986 - DNA, 15 bp, Homo sapiens
aaatggattgctcac

SEQ ID NO: 134987 - DNA, 15 bp, Homo sapiens
taaatggattgctca

SEQ ID NO: 134988 - DNA, 15 bp, Homo sapiens
ctaaatggattgctc

SEQ ID NO: 134989 - DNA, 15 bp, Homo sapiens
tctaaatggattgct

SEQ ID NO: 134990 - DNA, 15 bp, Homo sapiens
ttctaaatggattgc

SEQ ID NO: 134991 - DNA, 15 bp, Homo sapiens
cttctaaatggattg

SEQ ID NO: 134992 - DNA, 15 bp, Homo sapiens
acttctaaatggatt

SEQ ID NO: 134993 - DNA, 15 bp, Homo sapiens
tacttctaaatggat

SEQ ID NO: 134994 - DNA, 15 bp, Homo sapiens
ttacttctaaatgga

SEQ ID NO: 134995 - DNA, 15 bp, Homo sapiens
attacttctaaatgg

SEQ ID NO: 134996 - DNA, 15 bp, Homo sapiens
tattacttctaaatg

SEQ ID NO: 134997 - DNA, 15 bp, Homo sapiens
atattacttctaaat

SEQ ID NO: 134998 - DNA, 15 bp, Homo sapiens
aatattacttctaaa

SEQ ID NO: 134999 - DNA, 15 bp, Homo sapiens
aaatattacttctaa

SEQ ID NO: 135000 - DNA, 15 bp, Homo sapiens
caaatattacttcta

SEQ ID NO: 135001 - DNA, 15 bp, Homo sapiens
tcaaatattacttct

SEQ ID NO: 135002 - DNA, 15 bp, Homo sapiens
gtcaaatattacttc

SEQ ID NO: 135003 - DNA, 15 bp, Homo sapiens
tgtcaaatattactt

SEQ ID NO: 135004 - DNA, 15 bp, Homo sapiens
gtgtcaaatattact

SEQ ID NO: 135005 - DNA, 15 bp, Homo sapiens
ggtgtcaaatattac

SEQ ID NO: 135006 - DNA, 15 bp, Homo sapiens
tggtgtcaaatatta

SEQ ID NO: 135007 - DNA, 15 bp, Homo sapiens
ttggtgtcaaatatt

SEQ ID NO: 135008 - DNA, 15 bp, Homo sapiens
tttggtgtcaaatat

SEQ ID NO: 135009 - DNA, 15 bp, Homo sapiens
ctttggtgtcaaata

SEQ ID NO: 135010 - DNA, 15 bp, Homo sapiens
cctttggtgtcaaat

SEQ ID NO: 135011 - DNA, 15 bp, Homo sapiens
tcctttggtgtcaaa

SEQ ID NO: 135012 - DNA, 15 bp, Homo sapiens
ctcctttggtgtcaa

SEQ ID NO: 135013 - DNA, 15 bp, Homo sapiens
actcctttggtgtca

SEQ ID NO: 135014 - DNA, 15 bp, Homo sapiens
tactcctttggtgtc

SEQ ID NO: 135015 - DNA, 15 bp, Homo sapiens
ctactcctttggtgt

SEQ ID NO: 135016 - DNA, 15 bp, Homo sapiens
gctactcctttggtg

SEQ ID NO: 135017 - DNA, 15 bp, Homo sapiens
agctactcctttggt

SEQ ID NO: 135018 - DNA, 15 bp, Homo sapiens
cagctactcctttgg

SEQ ID NO: 135019 - DNA, 15 bp, Homo sapiens
ccagctactcctttg

SEQ ID NO: 135020 - DNA, 15 bp, Homo sapiens
tccagctactccttt

SEQ ID NO: 135021 - DNA, 15 bp, Homo sapiens
ttccagctactcctt

SEQ ID NO: 135022 - DNA, 15 bp, Homo sapiens
attccagctactcct

SEQ ID NO: 135023 - DNA, 15 bp, Homo sapiens
gattccagctactcc

SEQ ID NO: 135024 - DNA, 15 bp, Homo sapiens
agattccagctactc

SEQ ID NO: 135025 - DNA, 15 bp, Homo sapiens
tagattccagctact

SEQ ID NO: 135026 - DNA, 15 bp, Homo sapiens
gtagattccagctac

SEQ ID NO: 135027 - DNA, 15 bp, Homo sapiens
tgtagattccagcta

SEQ ID NO: 135028 - DNA, 15 bp, Homo sapiens
ttgtagattccagct

SEQ ID NO: 135029 - DNA, 15 bp, Homo sapiens
tttgtagattccagc

SEQ ID NO: 135030 - DNA, 15 bp, Homo sapiens
ttttgtagattccag

SEQ ID NO: 135031 - DNA, 15 bp, Homo sapiens
gttttgtagattcca

SEQ ID NO: 135032 - DNA, 15 bp, Homo sapiens
cgttttgtagattcc

SEQ ID NO: 135033 - DNA, 15 bp, Homo sapiens
ccgttttgtagattc

SEQ ID NO: 135034 - DNA, 15 bp, Homo sapiens
cccgttttgtagatt

SEQ ID NO: 135035 - DNA, 15 bp, Homo sapiens
acccgttttgtagat

SEQ ID NO: 135036 - DNA, 15 bp, Homo sapiens
cacccgttttgtaga

SEQ ID NO: 135037 - DNA, 15 bp, Homo sapiens
tcacccgttttgtag

SEQ ID NO: 135038 - DNA, 15 bp, Homo sapiens
ttcacccgttttgta

SEQ ID NO: 135039 - DNA, 15 bp, Homo sapiens
attcacccgttttgt

SEQ ID NO: 135040 - DNA, 15 bp, Homo sapiens
aattcacccgttttg

SEQ ID NO: 135041 - DNA, 15 bp, Homo sapiens
aaattcacccgtttt

SEQ ID NO: 135042 - DNA, 15 bp, Homo sapiens
caaattcacccgttt

SEQ ID NO: 135043 - DNA, 15 bp, Homo sapiens
acaaattcacccgtt

SEQ ID NO: 135044 - DNA, 15 bp, Homo sapiens
tacaaattcacccgt

SEQ ID NO: 135045 - DNA, 15 bp, Homo sapiens
ttacaaattcacccg

SEQ ID NO: 135046 - DNA, 15 bp, Homo sapiens
tttacaaattcaccc

SEQ ID NO: 135047 - DNA, 15 bp, Homo sapiens
ctttacaaattcacc

SEQ ID NO: 135048 - DNA, 15 bp, Homo sapiens
tctttacaaattcac

SEQ ID NO: 135049 - DNA, 15 bp, Homo sapiens
ctctttacaaattca

SEQ ID NO: 135050 - DNA, 15 bp, Homo sapiens
cctctttacaaattc

SEQ ID NO: 135051 - DNA, 15 bp, Homo sapiens
tcctctttacaaatt

SEQ ID NO: 135052 - DNA, 15 bp, Homo sapiens
ttcctctttacaaat

SEQ ID NO: 135053 - DNA, 15 bp, Homo sapiens
cttcctctttacaaa

SEQ ID NO: 135054 - DNA, 15 bp, Homo sapiens
ccttcctctttacaa

SEQ ID NO: 135055 - DNA, 15 bp, Homo sapiens
tccttcctctttaca

SEQ ID NO: 135056 - DNA, 15 bp, Homo sapiens
gtccttcctctttac

SEQ ID NO: 135057 - DNA, 15 bp, Homo sapiens
agtccttcctcttta

SEQ ID NO: 135058 - DNA, 15 bp, Homo sapiens
cagtccttcctcttt

SEQ ID NO: 135059 - DNA, 15 bp, Homo sapiens
ccagtccttcctctt

SEQ ID NO: 135060 - DNA, 15 bp, Homo sapiens
cccagtccttcctct

SEQ ID NO: 135061 - DNA, 15 bp, Homo sapiens
tcccagtccttcctc

SEQ ID NO: 135062 - DNA, 15 bp, Homo sapiens
ttcccagtccttcct

SEQ ID NO: 135063 - DNA, 15 bp, Homo sapiens
tttcccagtccttcc

SEQ ID NO: 135064 - DNA, 15 bp, Homo sapiens
ttttcccagtccttc

SEQ ID NO: 135065 - DNA, 15 bp, Homo sapiens
tttttcccagtcctt

SEQ ID NO: 135066 - DNA, 15 bp, Homo sapiens
ctttttcccagtcct

SEQ ID NO: 135067 - DNA, 15 bp, Homo sapiens
actttttcccagtcc

SEQ ID NO: 135068 - DNA, 15 bp, Homo sapiens
gactttttcccagtc

SEQ ID NO: 135069 - DNA, 15 bp, Homo sapiens
tgactttttcccagt

SEQ ID NO: 135070 - DNA, 15 bp, Homo sapiens
atgactttttcccag

SEQ ID NO: 135071 - DNA, 15 bp, Homo sapiens
aatgactttttccca

SEQ ID NO: 135072 - DNA, 15 bp, Homo sapiens
aaatgactttttccc

SEQ ID NO: 135073 - DNA, 15 bp, Homo sapiens
caaatgactttttcc

SEQ ID NO: 135074 - DNA, 15 bp, Homo sapiens
gcaaatgactttttc

SEQ ID NO: 135075 - DNA, 15 bp, Homo sapiens
ggcaaatgacttttt

SEQ ID NO: 135076 - DNA, 15 bp, Homo sapiens
tggcaaatgactttt

SEQ ID NO: 135077 - DNA, 15 bp, Homo sapiens
gtggcaaatgacttt

SEQ ID NO: 135078 - DNA, 15 bp, Homo sapiens
agtggcaaatgactt

SEQ ID NO: 135079 - DNA, 15 bp, Homo sapiens
tagtggcaaatgact

SEQ ID NO: 135080 - DNA, 15 bp, Homo sapiens
atagtggcaaatgac

SEQ ID NO: 135081 - DNA, 15 bp, Homo sapiens
aatagtggcaaatga

SEQ ID NO: 135082 - DNA, 15 bp, Homo sapiens
aaatagtggcaaatg

SEQ ID NO: 135083 - DNA, 15 bp, Homo sapiens
caaatagtggcaaat

SEQ ID NO: 135084 - DNA, 15 bp, Homo sapiens
acaaatagtggcaaa

SEQ ID NO: 135085 - DNA, 15 bp, Homo sapiens
tacaaatagtggcaa

SEQ ID NO: 135086 - DNA, 15 bp, Homo sapiens
atacaaatagtggca

SEQ ID NO: 135087 - DNA, 15 bp, Homo sapiens
aatacaaatagtggc

SEQ ID NO: 135088 - DNA, 15 bp, Homo sapiens
aaatacaaatagtgg

SEQ ID NO: 135089 - DNA, 15 bp, Homo sapiens
aaaatacaaatagtg

SEQ ID NO: 135090 - DNA, 15 bp, Homo sapiens
aaaaatacaaatagt

SEQ ID NO: 135091 - DNA, 15 bp, Homo sapiens
aaaaaatacaaatag

SEQ ID NO: 135092 - DNA, 15 bp, Homo sapiens
caaaaaatacaaata

SEQ ID NO: 135093 - DNA, 15 bp, Homo sapiens
acaaaaaatacaaat

SEQ ID NO: 135094 - DNA, 15 bp, Homo sapiens
ttacaaaaaatacaa

SEQ ID NO: 135095 - DNA, 15 bp, Homo sapiens
tttacaaaaaataca

SEQ ID NO: 135096 - DNA, 15 bp, Homo sapiens
atttacaaaaaatac

SEQ ID NO: 135097 - DNA, 15 bp, Homo sapiens
aatttacaaaaaata

SEQ ID NO: 135098 - DNA, 15 bp, Homo sapiens
caatttacaaaaaat

SEQ ID NO: 135099 - DNA, 15 bp, Homo sapiens
gcaatttacaaaaaa

SEQ ID NO: 135100 - DNA, 15 bp, Homo sapiens
agcaatttacaaaaa

SEQ ID NO: 135101 - DNA, 15 bp, Homo sapiens
aagcaatttacaaaa

SEQ ID NO: 135102 - DNA, 15 bp, Homo sapiens
aaagcaatttacaaa

SEQ ID NO: 135103 - DNA, 15 bp, Homo sapiens
gaaagcaatttacaa

SEQ ID NO: 135104 - DNA, 15 bp, Homo sapiens
agaaagcaatttaca

SEQ ID NO: 135105 - DNA, 15 bp, Homo sapiens
tagaaagcaatttac

SEQ ID NO: 135106 - DNA, 15 bp, Homo sapiens
ctagaaagcaattta

SEQ ID NO: 135107 - DNA, 15 bp, Homo sapiens
actagaaagcaattt

SEQ ID NO: 135108 - DNA, 15 bp, Homo sapiens
gactagaaagcaatt

SEQ ID NO: 135109 - DNA, 15 bp, Homo sapiens
agactagaaagcaat

SEQ ID NO: 135110 - DNA, 15 bp, Homo sapiens
gagactagaaagcaa

SEQ ID NO: 135111 - DNA, 15 bp, Homo sapiens
agagactagaaagca

SEQ ID NO: 135112 - DNA, 15 bp, Homo sapiens
tagagactagaaagc

SEQ ID NO: 135113 - DNA, 15 bp, Homo sapiens
atagagactagaaag

SEQ ID NO: 135114 - DNA, 15 bp, Homo sapiens
catagagactagaaa

SEQ ID NO: 135115 - DNA, 15 bp, Homo sapiens
tcatagagactagaa

SEQ ID NO: 135116 - DNA, 15 bp, Homo sapiens
gtcatagagactaga

SEQ ID NO: 135117 - DNA, 15 bp, Homo sapiens
agtcatagagactag

SEQ ID NO: 135118 - DNA, 15 bp, Homo sapiens
cagtcatagagacta

SEQ ID NO: 135119 - DNA, 15 bp, Homo sapiens
acagtcatagagact

SEQ ID NO: 135120 - DNA, 15 bp, Homo sapiens
gacagtcatagagac

SEQ ID NO: 135121 - DNA, 15 bp, Homo sapiens
tgacagtcatagaga

SEQ ID NO: 135122 - DNA, 15 bp, Homo sapiens
atgacagtcatagag

SEQ ID NO: 135123 - DNA, 15 bp, Homo sapiens
aatgacagtcataga

SEQ ID NO: 135124 - DNA, 15 bp, Homo sapiens
taatgacagtcatag

SEQ ID NO: 135125 - DNA, 15 bp, Homo sapiens
ctaatgacagtcata

SEQ ID NO: 135126 - DNA, 15 bp, Homo sapiens
actaatgacagtcat

SEQ ID NO: 135127 - DNA, 15 bp, Homo sapiens
aactaatgacagtca

SEQ ID NO: 135128 - DNA, 15 bp, Homo sapiens
gaactaatgacagtc

SEQ ID NO: 135129 - DNA, 15 bp, Homo sapiens
agaactaatgacagt

SEQ ID NO: 135130 - DNA, 15 bp, Homo sapiens
cagaactaatgacag

SEQ ID NO: 135131 - DNA, 15 bp, Homo sapiens
acagaactaatgaca

SEQ ID NO: 135132 - DNA, 15 bp, Homo sapiens
tacagaactaatgac

SEQ ID NO: 135133 - DNA, 15 bp, Homo sapiens
gtacagaactaatga

SEQ ID NO: 135134 - DNA, 15 bp, Homo sapiens
agtacagaactaatg

SEQ ID NO: 135135 - DNA, 15 bp, Homo sapiens
cagtacagaactaat

SEQ ID NO: 135136 - DNA, 15 bp, Homo sapiens
tcagtacagaactaa

SEQ ID NO: 135137 - DNA, 15 bp, Homo sapiens
ttcagtacagaacta

SEQ ID NO: 135138 - DNA, 15 bp, Homo sapiens
tttcagtacagaact

SEQ ID NO: 135139 - DNA, 15 bp, Homo sapiens
ttttcagtacagaac

SEQ ID NO: 135140 - DNA, 15 bp, Homo sapiens
gttttcagtacagaa

SEQ ID NO: 135141 - DNA, 15 bp, Homo sapiens
tgttttcagtacaga

SEQ ID NO: 135142 - DNA, 15 bp, Homo sapiens
gtgttttcagtacag

SEQ ID NO: 135143 - DNA, 15 bp, Homo sapiens
tgtgttttcagtaca

SEQ ID NO: 135144 - DNA, 15 bp, Homo sapiens
atcatgtgttttcag

SEQ ID NO: 135145 - DNA, 15 bp, Homo sapiens
aatcatgtgttttca

SEQ ID NO: 135146 - DNA, 15 bp, Homo sapiens
aaatcatgtgttttc

SEQ ID NO: 135147 - DNA, 15 bp, Homo sapiens
aaaatcatgtgtttt

SEQ ID NO: 135148 - DNA, 15 bp, Homo sapiens
gaaaatcatgtgttt

SEQ ID NO: 135149 - DNA, 15 bp, Homo sapiens
ggaaaatcatgtgtt

SEQ ID NO: 135150 - DNA, 15 bp, Homo sapiens
aggaaaatcatgtgt

SEQ ID NO: 135151 - DNA, 15 bp, Homo sapiens
caggaaaatcatgtg

SEQ ID NO: 135152 - DNA, 15 bp, Homo sapiens
tcaggaaaatcatgt

SEQ ID NO: 135153 - DNA, 15 bp, Homo sapiens
atcaggaaaatcatg

SEQ ID NO: 135154 - DNA, 15 bp, Homo sapiens
catcaggaaaatcat

SEQ ID NO: 135155 - DNA, 15 bp, Homo sapiens
acatcaggaaaatca

SEQ ID NO: 135156 - DNA, 15 bp, Homo sapiens
aacatcaggaaaatc

SEQ ID NO: 135157 - DNA, 15 bp, Homo sapiens
caacatcaggaaaat

SEQ ID NO: 135158 - DNA, 15 bp, Homo sapiens
acaacatcaggaaaa

SEQ ID NO: 135159 - DNA, 15 bp, Homo sapiens
aacaacatcaggaaa

SEQ ID NO: 135160 - DNA, 15 bp, Homo sapiens
taacaacatcaggaa

SEQ ID NO: 135161 - DNA, 15 bp, Homo sapiens
gtaacaacatcagga

SEQ ID NO: 135162 - DNA, 15 bp, Homo sapiens
ggtaacaacatcagg

SEQ ID NO: 135163 - DNA, 15 bp, Homo sapiens
tggtaacaacatcag

SEQ ID NO: 135164 - DNA, 15 bp, Homo sapiens
atggtaacaacatca

SEQ ID NO: 135165 - DNA, 15 bp, Homo sapiens
aatggtaacaacatc

SEQ ID NO: 135166 - DNA, 15 bp, Homo sapiens
aaatggtaacaacat

SEQ ID NO: 135167 - DNA, 15 bp, Homo sapiens
gaaatggtaacaaca

SEQ ID NO: 135168 - DNA, 15 bp, Homo sapiens
agaaatggtaacaac

SEQ ID NO: 135169 - DNA, 15 bp, Homo sapiens
gagaaatggtaacaa

SEQ ID NO: 135170 - DNA, 15 bp, Homo sapiens
ggagaaatggtaaca

SEQ ID NO: 135171 - DNA, 15 bp, Homo sapiens
gggagaaatggtaac

SEQ ID NO: 135172 - DNA, 15 bp, Homo sapiens
tgggagaaatggtaa

SEQ ID NO: 135173 - DNA, 15 bp, Homo sapiens
atgggagaaatggta

SEQ ID NO: 135174 - DNA, 15 bp, Homo sapiens
tatgggagaaatggt

SEQ ID NO: 135175 - DNA, 15 bp, Homo sapiens
atatgggagaaatgg

SEQ ID NO: 135176 - DNA, 15 bp, Homo sapiens
aatatgggagaaatg

SEQ ID NO: 135177 - DNA, 15 bp, Homo sapiens
aaatatgggagaaat

SEQ ID NO: 135178 - DNA, 15 bp, Homo sapiens
taaatatgggagaaa

SEQ ID NO: 135179 - DNA, 15 bp, Homo sapiens
ataaatatgggagaa

SEQ ID NO: 135180 - DNA, 15 bp, Homo sapiens
aataaatatgggaga

SEQ ID NO: 135181 - DNA, 15 bp, Homo sapiens
taataaatatgggag

SEQ ID NO: 135182 - DNA, 15 bp, Homo sapiens
ctaataaatatggga

SEQ ID NO: 135183 - DNA, 15 bp, Homo sapiens
gctaataaatatggg

SEQ ID NO: 135184 - DNA, 15 bp, Homo sapiens
tgctaataaatatgg

SEQ ID NO: 135185 - DNA, 15 bp, Homo sapiens
gtgctaataaatatg

SEQ ID NO: 135186 - DNA, 15 bp, Homo sapiens
agtgctaataaatat

SEQ ID NO: 135187 - DNA, 15 bp, Homo sapiens
cagtgctaataaata

SEQ ID NO: 135188 - DNA, 15 bp, Homo sapiens
tcagtgctaataaat

SEQ ID NO: 135189 - DNA, 15 bp, Homo sapiens
ctcagtgctaataaa

SEQ ID NO: 135190 - DNA, 15 bp, Homo sapiens
tctcagtgctaataa

SEQ ID NO: 135191 - DNA, 15 bp, Homo sapiens
ctctcagtgctaata

SEQ ID NO: 135192 - DNA, 15 bp, Homo sapiens
tctctcagtgctaat

SEQ ID NO: 135193 - DNA, 15 bp, Homo sapiens
gtctctcagtgctaa

SEQ ID NO: 135194 - DNA, 15 bp, Homo sapiens
tgtctctcagtgcta

SEQ ID NO: 135195 - DNA, 15 bp, Homo sapiens
ttgtctctcagtgct

SEQ ID NO: 135196 - DNA, 15 bp, Homo sapiens
tttgtctctcagtgc

SEQ ID NO: 135197 - DNA, 15 bp, Homo sapiens
gtttgtctctcagtg

SEQ ID NO: 135198 - DNA, 15 bp, Homo sapiens
ggtttgtctctcagt

SEQ ID NO: 135199 - DNA, 15 bp, Homo sapiens
tggtttgtctctcag

SEQ ID NO: 135200 - DNA, 15 bp, Homo sapiens
atggtttgtctctca

SEQ ID NO: 135201 - DNA, 15 bp, Homo sapiens
gatggtttgtctctc

SEQ ID NO: 135202 - DNA, 15 bp, Homo sapiens
agatggtttgtctct

SEQ ID NO: 135203 - DNA, 15 bp, Homo sapiens
tagatggtttgtctc

SEQ ID NO: 135204 - DNA, 15 bp, Homo sapiens
gtagatggtttgtct

SEQ ID NO: 135205 - DNA, 15 bp, Homo sapiens
tgtagatggtttgtc

SEQ ID NO: 135206 - DNA, 15 bp, Homo sapiens
ctgtagatggtttgt

SEQ ID NO: 135207 - DNA, 15 bp, Homo sapiens
gctgtagatggtttg

SEQ ID NO: 135208 - DNA, 15 bp, Homo sapiens
tgctgtagatggttt

SEQ ID NO: 135209 - DNA, 15 bp, Homo sapiens
ctgctgtagatggtt

SEQ ID NO: 135210 - DNA, 15 bp, Homo sapiens
gctgctgtagatggt

SEQ ID NO: 135211 - DNA, 15 bp, Homo sapiens
tgctgctgtagatgg

SEQ ID NO: 135212 - DNA, 15 bp, Homo sapiens
ctgctgctgtagatg

SEQ ID NO: 135213 - DNA, 15 bp, Homo sapiens
actgctgctgtagat

SEQ ID NO: 135214 - DNA, 15 bp, Homo sapiens
aactgctgctgtaga

SEQ ID NO: 135215 - DNA, 15 bp, Homo sapiens
aaactgctgctgtag

SEQ ID NO: 135216 - DNA, 15 bp, Homo sapiens
aaaactgctgctgta

SEQ ID NO: 135217 - DNA, 15 bp, Homo sapiens
aaaaactgctgctgt

SEQ ID NO: 135218 - DNA, 15 bp, Homo sapiens
gaaaaactgctgctg

SEQ ID NO: 135219 - DNA, 15 bp, Homo sapiens
cgaaaaactgctgct

SEQ ID NO: 135220 - DNA, 15 bp, Homo sapiens
acgaaaaactgctgc

SEQ ID NO: 135221 - DNA, 15 bp, Homo sapiens
cacgaaaaactgctg

SEQ ID NO: 135222 - DNA, 15 bp, Homo sapiens
acacgaaaaactgct

SEQ ID NO: 135223 - DNA, 15 bp, Homo sapiens
gacacgaaaaactgc

SEQ ID NO: 135224 - DNA, 15 bp, Homo sapiens
agacacgaaaaactg

SEQ ID NO: 135225 - DNA, 15 bp, Homo sapiens
tagacacgaaaaact

SEQ ID NO: 135226 - DNA, 15 bp, Homo sapiens
ttagacacgaaaaac

SEQ ID NO: 135227 - DNA, 15 bp, Homo sapiens
cttagacacgaaaaa

SEQ ID NO: 135228 - DNA, 15 bp, Homo sapiens
tcttagacacgaaaa

SEQ ID NO: 135229 - DNA, 15 bp, Homo sapiens
ctcttagacacgaaa

SEQ ID NO: 135230 - DNA, 15 bp, Homo sapiens
cctcttagacacgaa

SEQ ID NO: 135231 - DNA, 15 bp, Homo sapiens
tcctcttagacacga

SEQ ID NO: 135232 - DNA, 15 bp, Homo sapiens
atcctcttagacacg

SEQ ID NO: 135233 - DNA, 15 bp, Homo sapiens
aatcctcttagacac

SEQ ID NO: 135234 - DNA, 15 bp, Homo sapiens
aaatcctcttagaca

SEQ ID NO: 135235 - DNA, 15 bp, Homo sapiens
taaatcctcttagac

SEQ ID NO: 135236 - DNA, 15 bp, Homo sapiens
ttaaatcctcttaga

SEQ ID NO: 135237 - DNA, 15 bp, Homo sapiens
attaaatcctcttag

SEQ ID NO: 135238 - DNA, 15 bp, Homo sapiens
aattaaatcctctta

SEQ ID NO: 135239 - DNA, 15 bp, Homo sapiens
aaattaaatcctctt

SEQ ID NO: 135240 - DNA, 15 bp, Homo sapiens
taaattaaatcctct

SEQ ID NO: 135241 - DNA, 15 bp, Homo sapiens
ataaattaaatcctc

SEQ ID NO: 135242 - DNA, 15 bp, Homo sapiens
tataaattaaatcct

SEQ ID NO: 135243 - DNA, 15 bp, Homo sapiens
ctataaattaaatcc

SEQ ID NO: 135244 - DNA, 15 bp, Homo sapiens
actataaattaaatc

SEQ ID NO: 135245 - DNA, 15 bp, Homo sapiens
aactataaattaaat

SEQ ID NO: 135246 - DNA, 15 bp, Homo sapiens
taactataaattaaa

SEQ ID NO: 135247 - DNA, 15 bp, Homo sapiens
ataactataaattaa

SEQ ID NO: 135248 - DNA, 15 bp, Homo sapiens
aataactataaatta

SEQ ID NO: 135249 - DNA, 15 bp, Homo sapiens
gaataactataaatt

SEQ ID NO: 135250 - DNA, 15 bp, Homo sapiens
ggaataactataaat

SEQ ID NO: 135251 - DNA, 15 bp, Homo sapiens
aggaataactataaa

SEQ ID NO: 135252 - DNA, 15 bp, Homo sapiens
gaggaataactataa

SEQ ID NO: 135253 - DNA, 15 bp, Homo sapiens
agaggaataactata

SEQ ID NO: 135254 - DNA, 15 bp, Homo sapiens
aagaggaataactat

SEQ ID NO: 135255 - DNA, 15 bp, Homo sapiens
taagaggaataacta

SEQ ID NO: 135256 - DNA, 15 bp, Homo sapiens
ctaagaggaataact

SEQ ID NO: 135257 - DNA, 15 bp, Homo sapiens
gctaagaggaataac

SEQ ID NO: 135258 - DNA, 15 bp, Homo sapiens
tgctaagaggaataa

SEQ ID NO: 135259 - DNA, 15 bp, Homo sapiens
gtgctaagaggaata

SEQ ID NO: 135260 - DNA, 15 bp, Homo sapiens
agtgctaagaggaat

SEQ ID NO: 135261 - DNA, 15 bp, Homo sapiens
aagtgctaagaggaa

SEQ ID NO: 135262 - DNA, 15 bp, Homo sapiens
aaagtgctaagagga

SEQ ID NO: 135263 - DNA, 15 bp, Homo sapiens
aaaagtgctaagagg

SEQ ID NO: 135264 - DNA, 15 bp, Homo sapiens
gaaaagtgctaagag

SEQ ID NO: 135265 - DNA, 15 bp, Homo sapiens
agaaaagtgctaaga

SEQ ID NO: 135266 - DNA, 15 bp, Homo sapiens
cagaaaagtgctaag

SEQ ID NO: 135267 - DNA, 15 bp, Homo sapiens
acagaaaagtgctaa

SEQ ID NO: 135268 - DNA, 15 bp, Homo sapiens
cacagaaaagtgcta

SEQ ID NO: 135269 - DNA, 15 bp, Homo sapiens
acacagaaaagtgct

SEQ ID NO: 135270 - DNA, 15 bp, Homo sapiens
gacacagaaaagtgc

SEQ ID NO: 135271 - DNA, 15 bp, Homo sapiens
tgacacagaaaagtg

SEQ ID NO: 135272 - DNA, 15 bp, Homo sapiens
gtgacacagaaaagt

SEQ ID NO: 135273 - DNA, 15 bp, Homo sapiens
ggtgacacagaaaag

SEQ ID NO: 135274 - DNA, 15 bp, Homo sapiens
gggtgacacagaaaa

SEQ ID NO: 135275 - DNA, 15 bp, Homo sapiens
ggggtgacacagaaa

SEQ ID NO: 135276 - DNA, 15 bp, Homo sapiens
gggggtgacacagaa

SEQ ID NO: 135277 - DNA, 15 bp, Homo sapiens
tgggggtgacacaga

SEQ ID NO: 135278 - DNA, 15 bp, Homo sapiens
ttgggggtgacacag

SEQ ID NO: 135279 - DNA, 15 bp, Homo sapiens
gttgggggtgacaca

SEQ ID NO: 135280 - DNA, 15 bp, Homo sapiens
ggttgggggtgacac

SEQ ID NO: 135281 - DNA, 15 bp, Homo sapiens
gggttgggggtgaca

SEQ ID NO: 135282 - DNA, 15 bp, Homo sapiens
agggttgggggtgac

SEQ ID NO: 135283 - DNA, 15 bp, Homo sapiens
tagggttgggggtga

SEQ ID NO: 135284 - DNA, 15 bp, Homo sapiens
atagggttgggggtg

SEQ ID NO: 135285 - DNA, 15 bp, Homo sapiens
catagggttgggggt

SEQ ID NO: 135286 - DNA, 15 bp, Homo sapiens
tcatagggttggggg

SEQ ID NO: 135287 - DNA, 15 bp, Homo sapiens
gtcatagggttgggg

SEQ ID NO: 135288 - DNA, 15 bp, Homo sapiens
tgtcatagggttggg

SEQ ID NO: 135289 - DNA, 15 bp, Homo sapiens
atgtcatagggttgg

SEQ ID NO: 135290 - DNA, 15 bp, Homo sapiens
aatgtcatagggttg

SEQ ID NO: 135291 - DNA, 15 bp, Homo sapiens
taatgtcatagggtt

SEQ ID NO: 135292 - DNA, 15 bp, Homo sapiens
ctaatgtcatagggt

SEQ ID NO: 135293 - DNA, 15 bp, Homo sapiens
actaatgtcataggg

SEQ ID NO: 135294 - DNA, 15 bp, Homo sapiens
aactaatgtcatagg

SEQ ID NO: 135295 - DNA, 15 bp, Homo sapiens
aaactaatgtcatag

SEQ ID NO: 135296 - DNA, 15 bp, Homo sapiens
caaactaatgtcata

SEQ ID NO: 135297 - DNA, 15 bp, Homo sapiens
acaaactaatgtcat

SEQ ID NO: 135298 - DNA, 15 bp, Homo sapiens
cacaaactaatgtca

SEQ ID NO: 135299 - DNA, 15 bp, Homo sapiens
acacaaactaatgtc

SEQ ID NO: 135300 - DNA, 15 bp, Homo sapiens
aacacaaactaatgt

SEQ ID NO: 135301 - DNA, 15 bp, Homo sapiens
gaacacaaactaatg

SEQ ID NO: 135302 - DNA, 15 bp, Homo sapiens
cgaacacaaactaat

SEQ ID NO: 135303 - DNA, 15 bp, Homo sapiens
acgaacacaaactaa

SEQ ID NO: 135304 - DNA, 15 bp, Homo sapiens
tacgaacacaaacta

SEQ ID NO: 135305 - DNA, 15 bp, Homo sapiens
gtacgaacacaaact

SEQ ID NO: 135306 - DNA, 15 bp, Homo sapiens
ggtacgaacacaaac

SEQ ID NO: 135307 - DNA, 15 bp, Homo sapiens
aggtacgaacacaaa

SEQ ID NO: 135308 - DNA, 15 bp, Homo sapiens
caggtacgaacacaa

SEQ ID NO: 135309 - DNA, 15 bp, Homo sapiens
tcaggtacgaacaca

SEQ ID NO: 135310 - DNA, 15 bp, Homo sapiens
gtcaggtacgaacac

SEQ ID NO: 135311 - DNA, 15 bp, Homo sapiens
tgtcaggtacgaaca

SEQ ID NO: 135312 - DNA, 15 bp, Homo sapiens
gtgtcaggtacgaac

SEQ ID NO: 135313 - DNA, 15 bp, Homo sapiens
tgtgtcaggtacgaa

SEQ ID NO: 135314 - DNA, 15 bp, Homo sapiens
ctgtgtcaggtacga

SEQ ID NO: 135315 - DNA, 15 bp, Homo sapiens
tctgtgtcaggtacg

SEQ ID NO: 135316 - DNA, 15 bp, Homo sapiens
ttctgtgtcaggtac

SEQ ID NO: 135317 - DNA, 15 bp, Homo sapiens
gttctgtgtcaggta

SEQ ID NO: 135318 - DNA, 15 bp, Homo sapiens
tgttctgtgtcaggt

SEQ ID NO: 135319 - DNA, 15 bp, Homo sapiens
ctgttctgtgtcagg

SEQ ID NO: 135320 - DNA, 15 bp, Homo sapiens
tctgttctgtgtcag

SEQ ID NO: 135321 - DNA, 15 bp, Homo sapiens
atctgttctgtgtca

SEQ ID NO: 135322 - DNA, 15 bp, Homo sapiens
tatctgttctgtgtc

SEQ ID NO: 135323 - DNA, 15 bp, Homo sapiens
atatctgttctgtgt

SEQ ID NO: 135324 - DNA, 15 bp, Homo sapiens
catatctgttctgtg

SEQ ID NO: 135325 - DNA, 15 bp, Homo sapiens
gcatatctgttctgt

SEQ ID NO: 135326 - DNA, 15 bp, Homo sapiens
tgcatatctgttctg

SEQ ID NO: 135327 - DNA, 15 bp, Homo sapiens
ttgcatatctgttct

SEQ ID NO: 135328 - DNA, 15 bp, Homo sapiens
cttgcatatctgttc

SEQ ID NO: 135329 - DNA, 15 bp, Homo sapiens
acttgcatatctgtt

SEQ ID NO: 135330 - DNA, 15 bp, Homo sapiens
gacttgcatatctgt

SEQ ID NO: 135331 - DNA, 15 bp, Homo sapiens
tgacttgcatatctg

SEQ ID NO: 135332 - DNA, 15 bp, Homo sapiens
atgacttgcatatct

SEQ ID NO: 135333 - DNA, 15 bp, Homo sapiens
gatgacttgcatatc

SEQ ID NO: 135334 - DNA, 15 bp, Homo sapiens
tgatgacttgcatat

SEQ ID NO: 135335 - DNA, 15 bp, Homo sapiens
atgatgacttgcata

SEQ ID NO: 135336 - DNA, 15 bp, Homo sapiens
gatgatgacttgcat

SEQ ID NO: 135337 - DNA, 15 bp, Homo sapiens
tgatgatgacttgca

SEQ ID NO: 135338 - DNA, 15 bp, Homo sapiens
ctgatgatgacttgc

SEQ ID NO: 135339 - DNA, 15 bp, Homo sapiens
gctgatgatgacttg

SEQ ID NO: 135340 - DNA, 15 bp, Homo sapiens
tgctgatgatgactt

SEQ ID NO: 135341 - DNA, 15 bp, Homo sapiens
ctgctgatgatgact

SEQ ID NO: 135342 - DNA, 15 bp, Homo sapiens
gctgctgatgatgac

SEQ ID NO: 135343 - DNA, 15 bp, Homo sapiens
tgctgctgatgatga

SEQ ID NO: 135344 - DNA, 15 bp, Homo sapiens
ttgctgctgatgatg

SEQ ID NO: 135345 - DNA, 15 bp, Homo sapiens
attgctgctgatgat

SEQ ID NO: 135346 - DNA, 15 bp, Homo sapiens
tattgctgctgatga

SEQ ID NO: 135347 - DNA, 15 bp, Homo sapiens
ttattgctgctgatg

SEQ ID NO: 135348 - DNA, 15 bp, Homo sapiens
gttattgctgctgat

SEQ ID NO: 135349 - DNA, 15 bp, Homo sapiens
agttattgctgctga

SEQ ID NO: 135350 - DNA, 15 bp, Homo sapiens
cagttattgctgctg

SEQ ID NO: 135351 - DNA, 15 bp, Homo sapiens
gcagttattgctgct

SEQ ID NO: 135352 - DNA, 15 bp, Homo sapiens
agcagttattgctgc

SEQ ID NO: 135353 - DNA, 15 bp, Homo sapiens
tagcagttattgctg

SEQ ID NO: 135354 - DNA, 15 bp, Homo sapiens
ttagcagttattgct

SEQ ID NO: 135355 - DNA, 15 bp, Homo sapiens
attagcagttattgc

SEQ ID NO: 135356 - DNA, 15 bp, Homo sapiens
cattagcagttattg

SEQ ID NO: 135357 - DNA, 15 bp, Homo sapiens
acattagcagttatt

SEQ ID NO: 135358 - DNA, 15 bp, Homo sapiens
aacattagcagttat

SEQ ID NO: 135359 - DNA, 15 bp, Homo sapiens
aaacattagcagtta

SEQ ID NO: 135360 - DNA, 15 bp, Homo sapiens
aaaacattagcagtt

SEQ ID NO: 135361 - DNA, 15 bp, Homo sapiens
gaaaacattagcagt

SEQ ID NO: 135362 - DNA, 15 bp, Homo sapiens
tgaaaacattagcag

SEQ ID NO: 135363 - DNA, 15 bp, Homo sapiens
ctgaaaacattagca

SEQ ID NO: 135364 - DNA, 15 bp, Homo sapiens
cctgaaaacattagc

SEQ ID NO: 135365 - DNA, 15 bp, Homo sapiens
ccctgaaaacattag

SEQ ID NO: 135366 - DNA, 15 bp, Homo sapiens
gccctgaaaacatta

SEQ ID NO: 135367 - DNA, 15 bp, Homo sapiens
tgccctgaaaacatt

SEQ ID NO: 135368 - DNA, 15 bp, Homo sapiens
atgccctgaaaacat

SEQ ID NO: 135369 - DNA, 15 bp, Homo sapiens
aatgccctgaaaaca

SEQ ID NO: 135370 - DNA, 15 bp, Homo sapiens
aaatgccctgaaaac

SEQ ID NO: 135371 - DNA, 15 bp, Homo sapiens
aaaatgccctgaaaa

SEQ ID NO: 135372 - DNA, 15 bp, Homo sapiens
aaaaatgccctgaaa

SEQ ID NO: 135373 - DNA, 15 bp, Homo sapiens
gaaaaatgccctgaa

SEQ ID NO: 135374 - DNA, 15 bp, Homo sapiens
tgaaaaatgccctga

SEQ ID NO: 135375 - DNA, 15 bp, Homo sapiens
ctgaaaaatgccctg

SEQ ID NO: 135376 - DNA, 15 bp, Homo sapiens
gctgaaaaatgccct

SEQ ID NO: 135377 - DNA, 15 bp, Homo sapiens
agctgaaaaatgccc

SEQ ID NO: 135378 - DNA, 15 bp, Homo sapiens
aagctgaaaaatgcc

SEQ ID NO: 135379 - DNA, 15 bp, Homo sapiens
aaagctgaaaaatgc

SEQ ID NO: 135380 - DNA, 15 bp, Homo sapiens
aaaagctgaaaaatg

SEQ ID NO: 135381 - DNA, 15 bp, Homo sapiens
caaaagctgaaaaat

SEQ ID NO: 135382 - DNA, 15 bp, Homo sapiens
tcaaaagctgaaaaa

SEQ ID NO: 135383 - DNA, 15 bp, Homo sapiens
ttcaaaagctgaaaa

SEQ ID NO: 135384 - DNA, 15 bp, Homo sapiens
cttcaaaagctgaaa

SEQ ID NO: 135385 - DNA, 15 bp, Homo sapiens
ccttcaaaagctgaa

SEQ ID NO: 135386 - DNA, 15 bp, Homo sapiens
cccttcaaaagctga

SEQ ID NO: 135387 - DNA, 15 bp, Homo sapiens
tcccttcaaaagctg

SEQ ID NO: 135388 - DNA, 15 bp, Homo sapiens
atcccttcaaaagct

SEQ ID NO: 135389 - DNA, 15 bp, Homo sapiens
aatcccttcaaaagc

SEQ ID NO: 135390 - DNA, 15 bp, Homo sapiens
aaatcccttcaaaag

SEQ ID NO: 135391 - DNA, 15 bp, Homo sapiens
aaaatcccttcaaaa

SEQ ID NO: 135392 - DNA, 15 bp, Homo sapiens
gaaaatcccttcaaa

SEQ ID NO: 135393 - DNA, 15 bp, Homo sapiens
agaaaatcccttcaa

SEQ ID NO: 135394 - DNA, 15 bp, Homo sapiens
aagaaaatcccttca

SEQ ID NO: 135395 - DNA, 15 bp, Homo sapiens
aaagaaaatcccttc

SEQ ID NO: 135396 - DNA, 15 bp, Homo sapiens
caaagaaaatccctt

SEQ ID NO: 135397 - DNA, 15 bp, Homo sapiens
acaaagaaaatccct

SEQ ID NO: 135398 - DNA, 15 bp, Homo sapiens
aacaaagaaaatccc

SEQ ID NO: 135399 - DNA, 15 bp, Homo sapiens
aaacaaagaaaatcc

SEQ ID NO: 135400 - DNA, 15 bp, Homo sapiens
taaacaaagaaaatc

SEQ ID NO: 135401 - DNA, 15 bp, Homo sapiens
ttaaacaaagaaaat

SEQ ID NO: 135402 - DNA, 15 bp, Homo sapiens
attaaacaaagaaaa

SEQ ID NO: 135403 - DNA, 15 bp, Homo sapiens
cattaaacaaagaaa

SEQ ID NO: 135404 - DNA, 15 bp, Homo sapiens
acattaaacaaagaa

SEQ ID NO: 135405 - DNA, 15 bp, Homo sapiens
gacattaaacaaaga

SEQ ID NO: 135406 - DNA, 15 bp, Homo sapiens
ggacattaaacaaag

SEQ ID NO: 135407 - DNA, 15 bp, Homo sapiens
aggacattaaacaaa

SEQ ID NO: 135408 - DNA, 15 bp, Homo sapiens
gaggacattaaacaa

SEQ ID NO: 135409 - DNA, 15 bp, Homo sapiens
tgaggacattaaaca

SEQ ID NO: 135410 - DNA, 15 bp, Homo sapiens
ctgaggacattaaac

SEQ ID NO: 135411 - DNA, 15 bp, Homo sapiens
tctgaggacattaaa

SEQ ID NO: 135412 - DNA, 15 bp, Homo sapiens
gtctgaggacattaa

SEQ ID NO: 135413 - DNA, 15 bp, Homo sapiens
agtctgaggacatta

SEQ ID NO: 135414 - DNA, 15 bp, Homo sapiens
cagtctgaggacatt

SEQ ID NO: 135415 - DNA, 15 bp, Homo sapiens
ccagtctgaggacat

SEQ ID NO: 135416 - DNA, 15 bp, Homo sapiens
tccagtctgaggaca

SEQ ID NO: 135417 - DNA, 15 bp, Homo sapiens
atccagtctgaggac

SEQ ID NO: 135418 - DNA, 15 bp, Homo sapiens
catccagtctgagga

SEQ ID NO: 135419 - DNA, 15 bp, Homo sapiens
acatccagtctgagg

SEQ ID NO: 135420 - DNA, 15 bp, Homo sapiens
tacatccagtctgag

SEQ ID NO: 135421 - DNA, 15 bp, Homo sapiens
ttacatccagtctga

SEQ ID NO: 135422 - DNA, 15 bp, Homo sapiens
attacatccagtctg

SEQ ID NO: 135423 - DNA, 15 bp, Homo sapiens
aattacatccagtct

SEQ ID NO: 135424 - DNA, 15 bp, Homo sapiens
caattacatccagtc

SEQ ID NO: 135425 - DNA, 15 bp, Homo sapiens
tcaattacatccagt

SEQ ID NO: 135426 - DNA, 15 bp, Homo sapiens
ctcaattacatccag

SEQ ID NO: 135427 - DNA, 15 bp, Homo sapiens
gctcaattacatcca

SEQ ID NO: 135428 - DNA, 15 bp, Homo sapiens
agctcaattacatcc

SEQ ID NO: 135429 - DNA, 15 bp, Homo sapiens
cagctcaattacatc

SEQ ID NO: 135430 - DNA, 15 bp, Homo sapiens
acagctcaattacat

SEQ ID NO: 135431 - DNA, 15 bp, Homo sapiens
gacagctcaattaca

SEQ ID NO: 135432 - DNA, 15 bp, Homo sapiens
tgacagctcaattac

SEQ ID NO: 135433 - DNA, 15 bp, Homo sapiens
ctgacagctcaatta

SEQ ID NO: 135434 - DNA, 15 bp, Homo sapiens
actgacagctcaatt

SEQ ID NO: 135435 - DNA, 15 bp, Homo sapiens
tactgacagctcaat

SEQ ID NO: 135436 - DNA, 15 bp, Homo sapiens
atactgacagctcaa

SEQ ID NO: 135437 - DNA, 15 bp, Homo sapiens
aatactgacagctca

SEQ ID NO: 135438 - DNA, 15 bp, Homo sapiens
aaatactgacagctc

SEQ ID NO: 135439 - DNA, 15 bp, Homo sapiens
aaaatactgacagct

SEQ ID NO: 135440 - DNA, 15 bp, Homo sapiens
taaaatactgacagc

SEQ ID NO: 135441 - DNA, 15 bp, Homo sapiens
ataaaatactgacag

SEQ ID NO: 135442 - DNA, 15 bp, Homo sapiens
aataaaatactgaca

SEQ ID NO: 135443 - DNA, 15 bp, Homo sapiens
taataaaatactgac

SEQ ID NO: 135444 - DNA, 15 bp, Homo sapiens
ataataaaatactga

SEQ ID NO: 135445 - DNA, 15 bp, Homo sapiens
aataataaaatactg

SEQ ID NO: 135446 - DNA, 15 bp, Homo sapiens
aaataataaaatact

SEQ ID NO: 135447 - DNA, 15 bp, Homo sapiens
gaaataataaaatac

SEQ ID NO: 135448 - DNA, 15 bp, Homo sapiens
agaaataataaaata

SEQ ID NO: 135449 - DNA, 15 bp, Homo sapiens
aagaaataataaaat

SEQ ID NO: 135450 - DNA, 15 bp, Homo sapiens
aaagaaataataaaa

SEQ ID NO: 135451 - DNA, 15 bp, Homo sapiens
aaaagaaataataaa

SEQ ID NO: 135452 - DNA, 15 bp, Homo sapiens
aaaaagaaataataa

SEQ ID NO: 135453 - DNA, 15 bp, Homo sapiens
aaaaaagaaataata

SEQ ID NO: 135454 - DNA, 15 bp, Homo sapiens
caaaaaagaaataat

SEQ ID NO: 135455 - DNA, 15 bp, Homo sapiens
acaaaaaagaaataa

SEQ ID NO: 135456 - DNA, 15 bp, Homo sapiens
cacaaaaaagaaata

SEQ ID NO: 135457 - DNA, 15 bp, Homo sapiens
tcacaaaaaagaaat

SEQ ID NO: 135458 - DNA, 15 bp, Homo sapiens
ttcacaaaaaagaaa

SEQ ID NO: 135459 - DNA, 15 bp, Homo sapiens
tttcacaaaaaagaa

SEQ ID NO: 135460 - DNA, 15 bp, Homo sapiens
ttttcacaaaaaaga

SEQ ID NO: 135461 - DNA, 15 bp, Homo sapiens
gttttcacaaaaaag

SEQ ID NO: 135462 - DNA, 15 bp, Homo sapiens
tgttttcacaaaaaa

SEQ ID NO: 135463 - DNA, 15 bp, Homo sapiens
ttgttttcacaaaaa

SEQ ID NO: 135464 - DNA, 15 bp, Homo sapiens
tttgttttcacaaaa

SEQ ID NO: 135465 - DNA, 15 bp, Homo sapiens
ttttgttttcacaaa

SEQ ID NO: 135466 - DNA, 15 bp, Homo sapiens
tttttgttttcacaa

SEQ ID NO: 135467 - DNA, 15 bp, Homo sapiens
gtttttgttttcaca

SEQ ID NO: 135468 - DNA, 15 bp, Homo sapiens
tgtttttgttttcac

SEQ ID NO: 135469 - DNA, 15 bp, Homo sapiens
gtgtttttgttttca

SEQ ID NO: 135470 - DNA, 15 bp, Homo sapiens
tgtgtttttgttttc

SEQ ID NO: 135471 - DNA, 15 bp, Homo sapiens
ctgtgtttttgtttt

SEQ ID NO: 135472 - DNA, 15 bp, Homo sapiens
tctgtgtttttgttt

SEQ ID NO: 135473 - DNA, 15 bp, Homo sapiens
ctctgtgtttttgtt

SEQ ID NO: 135474 - DNA, 15 bp, Homo sapiens
tctctgtgtttttgt

SEQ ID NO: 135475 - DNA, 15 bp, Homo sapiens
ctctctgtgtttttg

SEQ ID NO: 135476 - DNA, 15 bp, Homo sapiens
cctctctgtgttttt

SEQ ID NO: 135477 - DNA, 15 bp, Homo sapiens
acctctctgtgtttt

SEQ ID NO: 135478 - DNA, 15 bp, Homo sapiens
tacctctctgtgttt

SEQ ID NO: 135479 - DNA, 15 bp, Homo sapiens
ttacctctctgtgtt

SEQ ID NO: 135480 - DNA, 15 bp, Homo sapiens
tttacctctctgtgt

SEQ ID NO: 135481 - DNA, 15 bp, Homo sapiens
ctttacctctctgtg

SEQ ID NO: 135482 - DNA, 15 bp, Homo sapiens
gctttacctctctgt

SEQ ID NO: 135483 - DNA, 15 bp, Homo sapiens
agctttacctctctg

SEQ ID NO: 135484 - DNA, 15 bp, Homo sapiens
gagctttacctctct

SEQ ID NO: 135485 - DNA, 15 bp, Homo sapiens
ggagctttacctctc

SEQ ID NO: 135486 - DNA, 15 bp, Homo sapiens
aggagctttacctct

SEQ ID NO: 135487 - DNA, 15 bp, Homo sapiens
aaggagctttacctc

SEQ ID NO: 135488 - DNA, 15 bp, Homo sapiens
caaggagctttacct

SEQ ID NO: 135489 - DNA, 15 bp, Homo sapiens
gcaaggagctttacc

SEQ ID NO: 135490 - DNA, 15 bp, Homo sapiens
ggcaaggagctttac

SEQ ID NO: 135491 - DNA, 15 bp, Homo sapiens
aggcaaggagcttta

SEQ ID NO: 135492 - DNA, 15 bp, Homo sapiens
caggcaaggagcttt

SEQ ID NO: 135493 - DNA, 15 bp, Homo sapiens
ccaggcaaggagctt

SEQ ID NO: 135494 - DNA, 15 bp, Homo sapiens
accaggcaaggagct

SEQ ID NO: 135495 - DNA, 15 bp, Homo sapiens
caccaggcaaggagc

SEQ ID NO: 135496 - DNA, 15 bp, Homo sapiens
tcaccaggcaaggag

SEQ ID NO: 135497 - DNA, 15 bp, Homo sapiens
gtcaccaggcaagga

SEQ ID NO: 135498 - DNA, 15 bp, Homo sapiens
agtcaccaggcaagg

SEQ ID NO: 135499 - DNA, 15 bp, Homo sapiens
gagtcaccaggcaag

SEQ ID NO: 135500 - DNA, 15 bp, Homo sapiens
tgagtcaccaggcaa

SEQ ID NO: 135501 - DNA, 15 bp, Homo sapiens
ctgagtcaccaggca

SEQ ID NO: 135502 - DNA, 15 bp, Homo sapiens
cctgagtcaccaggc

SEQ ID NO: 135503 - DNA, 15 bp, Homo sapiens
acctgagtcaccagg

SEQ ID NO: 135504 - DNA, 15 bp, Homo sapiens
cacctgagtcaccag

SEQ ID NO: 135505 - DNA, 15 bp, Homo sapiens
gcacctgagtcacca

SEQ ID NO: 135506 - DNA, 15 bp, Homo sapiens
agcacctgagtcacc

SEQ ID NO: 135507 - DNA, 15 bp, Homo sapiens
tagcacctgagtcac

SEQ ID NO: 135508 - DNA, 15 bp, Homo sapiens
ttagcacctgagtca

SEQ ID NO: 135509 - DNA, 15 bp, Homo sapiens
tttagcacctgagtc

SEQ ID NO: 135510 - DNA, 15 bp, Homo sapiens
atttagcacctgagt

SEQ ID NO: 135511 - DNA, 15 bp, Homo sapiens
catttagcacctgag

SEQ ID NO: 135512 - DNA, 15 bp, Homo sapiens
ccatttagcacctga

SEQ ID NO: 135513 - DNA, 15 bp, Homo sapiens
tccatttagcacctg

SEQ ID NO: 135514 - DNA, 15 bp, Homo sapiens
ttccatttagcacct

SEQ ID NO: 135515 - DNA, 15 bp, Homo sapiens
cttccatttagcacc

SEQ ID NO: 135516 - DNA, 15 bp, Homo sapiens
tcttccatttagcac

SEQ ID NO: 135517 - DNA, 15 bp, Homo sapiens
ttcttccatttagca

SEQ ID NO: 135518 - DNA, 15 bp, Homo sapiens
gttcttccatttagc

SEQ ID NO: 135519 - DNA, 15 bp, Homo sapiens
agttcttccatttag

SEQ ID NO: 135520 - DNA, 15 bp, Homo sapiens
cagttcttccattta

SEQ ID NO: 135521 - DNA, 15 bp, Homo sapiens
tcagttcttccattt

SEQ ID NO: 135522 - DNA, 15 bp, Homo sapiens
ctcagttcttccatt

SEQ ID NO: 135523 - DNA, 15 bp, Homo sapiens
tctcagttcttccat

SEQ ID NO: 135524 - DNA, 15 bp, Homo sapiens
atctcagttcttcca

SEQ ID NO: 135525 - DNA, 15 bp, Homo sapiens
aatctcagttcttcc

SEQ ID NO: 135526 - DNA, 15 bp, Homo sapiens
aaatctcagttcttc

SEQ ID NO: 135527 - DNA, 15 bp, Homo sapiens
caaatctcagttctt

SEQ ID NO: 135528 - DNA, 15 bp, Homo sapiens
tcaaatctcagttct

SEQ ID NO: 135529 - DNA, 15 bp, Homo sapiens
ttcaaatctcagttc

SEQ ID NO: 135530 - DNA, 15 bp, Homo sapiens
attcaaatctcagtt

SEQ ID NO: 135531 - DNA, 15 bp, Homo sapiens
cattcaaatctcagt

SEQ ID NO: 135532 - DNA, 15 bp, Homo sapiens
gcattcaaatctcag

SEQ ID NO: 135533 - DNA, 15 bp, Homo sapiens
tgcattcaaatctca

SEQ ID NO: 135534 - DNA, 15 bp, Homo sapiens
ctgcattcaaatctc

SEQ ID NO: 135535 - DNA, 15 bp, Homo sapiens
cctgcattcaaatct

SEQ ID NO: 135536 - DNA, 15 bp, Homo sapiens
tcctgcattcaaatc

SEQ ID NO: 135537 - DNA, 15 bp, Homo sapiens
atcctgcattcaaat

SEQ ID NO: 135538 - DNA, 15 bp, Homo sapiens
gatcctgcattcaaa

SEQ ID NO: 135539 - DNA, 15 bp, Homo sapiens
ggatcctgcattcaa

SEQ ID NO: 135540 - DNA, 15 bp, Homo sapiens
aggatcctgcattca

SEQ ID NO: 135541 - DNA, 15 bp, Homo sapiens
aaggatcctgcattc

SEQ ID NO: 135542 - DNA, 15 bp, Homo sapiens
caaggatcctgcatt

SEQ ID NO: 135543 - DNA, 15 bp, Homo sapiens
tcaaggatcctgcat

SEQ ID NO: 135544 - DNA, 15 bp, Homo sapiens
gtcaaggatcctgca

SEQ ID NO: 135545 - DNA, 15 bp, Homo sapiens
agtcaaggatcctgc

SEQ ID NO: 135546 - DNA, 15 bp, Homo sapiens
aagtcaaggatcctg

SEQ ID NO: 135547 - DNA, 15 bp, Homo sapiens
aaagtcaaggatcct

SEQ ID NO: 135548 - DNA, 15 bp, Homo sapiens
taaagtcaaggatcc

SEQ ID NO: 135549 - DNA, 15 bp, Homo sapiens
ttaaagtcaaggatc

SEQ ID NO: 135550 - DNA, 15 bp, Homo sapiens
tttaaagtcaaggat

SEQ ID NO: 135551 - DNA, 15 bp, Homo sapiens
atttaaagtcaagga

SEQ ID NO: 135552 - DNA, 15 bp, Homo sapiens
gatttaaagtcaagg

SEQ ID NO: 135553 - DNA, 15 bp, Homo sapiens
tgatttaaagtcaag

SEQ ID NO: 135554 - DNA, 15 bp, Homo sapiens
atgatttaaagtcaa

SEQ ID NO: 135555 - DNA, 15 bp, Homo sapiens
catgatttaaagtca

SEQ ID NO: 135556 - DNA, 15 bp, Homo sapiens
gcatgatttaaagtc

SEQ ID NO: 135557 - DNA, 15 bp, Homo sapiens
tgcatgatttaaagt

SEQ ID NO: 135558 - DNA, 15 bp, Homo sapiens
gtgcatgatttaaag

SEQ ID NO: 135559 - DNA, 15 bp, Homo sapiens
agtgcatgatttaaa

SEQ ID NO: 135560 - DNA, 15 bp, Homo sapiens
gagtgcatgatttaa

SEQ ID NO: 135561 - DNA, 15 bp, Homo sapiens
tgagtgcatgattta

SEQ ID NO: 135562 - DNA, 15 bp, Homo sapiens
atgagtgcatgattt

SEQ ID NO: 135563 - DNA, 15 bp, Homo sapiens
aatgagtgcatgatt

SEQ ID NO: 135564 - DNA, 15 bp, Homo sapiens
aaatgagtgcatgat

SEQ ID NO: 135565 - DNA, 15 bp, Homo sapiens
aaaatgagtgcatga

SEQ ID NO: 135566 - DNA, 15 bp, Homo sapiens
gaaaatgagtgcatg

SEQ ID NO: 135567 - DNA, 15 bp, Homo sapiens
agaaaatgagtgcat

SEQ ID NO: 135568 - DNA, 15 bp, Homo sapiens
cagaaaatgagtgca

SEQ ID NO: 135569 - DNA, 15 bp, Homo sapiens
gcagaaaatgagtgc

SEQ ID NO: 135570 - DNA, 15 bp, Homo sapiens
ggcagaaaatgagtg

SEQ ID NO: 135571 - DNA, 15 bp, Homo sapiens
tggcagaaaatgagt

SEQ ID NO: 135572 - DNA, 15 bp, Homo sapiens
gtggcagaaaatgag

SEQ ID NO: 135573 - DNA, 15 bp, Homo sapiens
cgtggcagaaaatga

SEQ ID NO: 135574 - DNA, 15 bp, Homo sapiens
acgtggcagaaaatg

SEQ ID NO: 135575 - DNA, 15 bp, Homo sapiens
aacgtggcagaaaat

SEQ ID NO: 135576 - DNA, 15 bp, Homo sapiens
caacgtggcagaaaa

SEQ ID NO: 135577 - DNA, 15 bp, Homo sapiens
gcaacgtggcagaaa

SEQ ID NO: 135578 - DNA, 15 bp, Homo sapiens
agcaacgtggcagaa

SEQ ID NO: 135579 - DNA, 15 bp, Homo sapiens
cagcaacgtggcaga

SEQ ID NO: 135580 - DNA, 15 bp, Homo sapiens
tcagcaacgtggcag

SEQ ID NO: 135581 - DNA, 15 bp, Homo sapiens
atcagcaacgtggca

SEQ ID NO: 135582 - DNA, 15 bp, Homo sapiens
catcagcaacgtggc

SEQ ID NO: 135583 - DNA, 15 bp, Homo sapiens
gcatcagcaacgtgg

SEQ ID NO: 135584 - DNA, 15 bp, Homo sapiens
agcatcagcaacgtg

SEQ ID NO: 135585 - DNA, 15 bp, Homo sapiens
aagcatcagcaacgt

SEQ ID NO: 135586 - DNA, 15 bp, Homo sapiens
gaagcatcagcaacg

SEQ ID NO: 135587 - DNA, 15 bp, Homo sapiens
tgaagcatcagcaac

SEQ ID NO: 135588 - DNA, 15 bp, Homo sapiens
gtgaagcatcagcaa

SEQ ID NO: 135589 - DNA, 15 bp, Homo sapiens
agtgaagcatcagca

SEQ ID NO: 135590 - DNA, 15 bp, Homo sapiens
tagtgaagcatcagc

SEQ ID NO: 135591 - DNA, 15 bp, Homo sapiens
atagtgaagcatcag

SEQ ID NO: 135592 - DNA, 15 bp, Homo sapiens
catagtgaagcatca

SEQ ID NO: 135593 - DNA, 15 bp, Homo sapiens
gcatagtgaagcatc

SEQ ID NO: 135594 - DNA, 15 bp, Homo sapiens
ggcatagtgaagcat

SEQ ID NO: 135595 - DNA, 15 bp, Homo sapiens
tggcatagtgaagca

SEQ ID NO: 135596 - DNA, 15 bp, Homo sapiens
atggcatagtgaagc

SEQ ID NO: 135597 - DNA, 15 bp, Homo sapiens
tatggcatagtgaag

SEQ ID NO: 135598 - DNA, 15 bp, Homo sapiens
ctatggcatagtgaa

SEQ ID NO: 135599 - DNA, 15 bp, Homo sapiens
tctatggcatagtga

SEQ ID NO: 135600 - DNA, 15 bp, Homo sapiens
ctctatggcatagtg

SEQ ID NO: 135601 - DNA, 15 bp, Homo sapiens
cctctatggcatagt

SEQ ID NO: 135602 - DNA, 15 bp, Homo sapiens
tcctctatggcatag

SEQ ID NO: 135603 - DNA, 15 bp, Homo sapiens
ctcctctatggcata

SEQ ID NO: 135604 - DNA, 15 bp, Homo sapiens
cctcctctatggcat

SEQ ID NO: 135605 - DNA, 15 bp, Homo sapiens
tcctcctctatggca

SEQ ID NO: 135606 - DNA, 15 bp, Homo sapiens
ttcctcctctatggc

SEQ ID NO: 135607 - DNA, 15 bp, Homo sapiens
tttcctcctctatgg

SEQ ID NO: 135608 - DNA, 15 bp, Homo sapiens
ttttcctcctctatg

SEQ ID NO: 135609 - DNA, 15 bp, Homo sapiens
gttttcctcctctat

SEQ ID NO: 135610 - DNA, 15 bp, Homo sapiens
tgttttcctcctcta

SEQ ID NO: 135611 - DNA, 15 bp, Homo sapiens
ttgttttcctcctct

SEQ ID NO: 135612 - DNA, 15 bp, Homo sapiens
gttgttttcctcctc

SEQ ID NO: 135613 - DNA, 15 bp, Homo sapiens
cgttgttttcctcct

SEQ ID NO: 135614 - DNA, 15 bp, Homo sapiens
tcgttgttttcctcc

SEQ ID NO: 135615 - DNA, 15 bp, Homo sapiens
gtcgttgttttcctc

SEQ ID NO: 135616 - DNA, 15 bp, Homo sapiens
tgtcgttgttttcct

SEQ ID NO: 135617 - DNA, 15 bp, Homo sapiens
ttgtcgttgttttcc

SEQ ID NO: 135618 - DNA, 15 bp, Homo sapiens
gttgtcgttgttttc

SEQ ID NO: 135619 - DNA, 15 bp, Homo sapiens
agttgtcgttgtttt

SEQ ID NO: 135620 - DNA, 15 bp, Homo sapiens
aagttgtcgttgttt

SEQ ID NO: 135621 - DNA, 15 bp, Homo sapiens
aaagttgtcgttgtt

SEQ ID NO: 135622 - DNA, 15 bp, Homo sapiens
caaagttgtcgttgt

SEQ ID NO: 135623 - DNA, 15 bp, Homo sapiens
tcaaagttgtcgttg

SEQ ID NO: 135624 - DNA, 15 bp, Homo sapiens
atcaaagttgtcgtt

SEQ ID NO: 135625 - DNA, 15 bp, Homo sapiens
catcaaagttgtcgt

SEQ ID NO: 135626 - DNA, 15 bp, Homo sapiens
acatcaaagttgtcg

SEQ ID NO: 135627 - DNA, 15 bp, Homo sapiens
gacatcaaagttgtc

SEQ ID NO: 135628 - DNA, 15 bp, Homo sapiens
tgacatcaaagttgt

SEQ ID NO: 135629 - DNA, 15 bp, Homo sapiens
ctgacatcaaagttg

SEQ ID NO: 135630 - DNA, 15 bp, Homo sapiens
gctgacatcaaagtt

SEQ ID NO: 135631 - DNA, 15 bp, Homo sapiens
tgctgacatcaaagt

SEQ ID NO: 135632 - DNA, 15 bp, Homo sapiens
gtgctgacatcaaag

SEQ ID NO: 135633 - DNA, 15 bp, Homo sapiens
tgtgctgacatcaaa

SEQ ID NO: 135634 - DNA, 15 bp, Homo sapiens
ttgtgctgacatcaa

SEQ ID NO: 135635 - DNA, 15 bp, Homo sapiens
gttgtgctgacatca

SEQ ID NO: 135636 - DNA, 15 bp, Homo sapiens
agttgtgctgacatc

SEQ ID NO: 135637 - DNA, 15 bp, Homo sapiens
cagttgtgctgacat

SEQ ID NO: 135638 - DNA, 15 bp, Homo sapiens
acagttgtgctgaca

SEQ ID NO: 135639 - DNA, 15 bp, Homo sapiens
aacagttgtgctgac

SEQ ID NO: 135640 - DNA, 15 bp, Homo sapiens
aaacagttgtgctga

SEQ ID NO: 135641 - DNA, 15 bp, Homo sapiens
aaaacagttgtgctg

SEQ ID NO: 135642 - DNA, 15 bp, Homo sapiens
caaaacagttgtgct

SEQ ID NO: 135643 - DNA, 15 bp, Homo sapiens
gcaaaacagttgtgc

SEQ ID NO: 135644 - DNA, 15 bp, Homo sapiens
agcaaaacagttgtg

SEQ ID NO: 135645 - DNA, 15 bp, Homo sapiens
aagcaaaacagttgt

SEQ ID NO: 135646 - DNA, 15 bp, Homo sapiens
taagcaaaacagttg

SEQ ID NO: 135647 - DNA, 15 bp, Homo sapiens
ataagcaaaacagtt

SEQ ID NO: 135648 - DNA, 15 bp, Homo sapiens
aataagcaaaacagt

SEQ ID NO: 135649 - DNA, 15 bp, Homo sapiens
taataagcaaaacag

SEQ ID NO: 135650 - DNA, 15 bp, Homo sapiens
ataataagcaaaaca

SEQ ID NO: 135651 - DNA, 15 bp, Homo sapiens
aataataagcaaaac

SEQ ID NO: 135652 - DNA, 15 bp, Homo sapiens
gaataataagcaaaa

SEQ ID NO: 135653 - DNA, 15 bp, Homo sapiens
agaataataagcaaa

SEQ ID NO: 135654 - DNA, 15 bp, Homo sapiens
aagaataataagcaa

SEQ ID NO: 135655 - DNA, 15 bp, Homo sapiens
gaagaataataagca

SEQ ID NO: 135656 - DNA, 15 bp, Homo sapiens
agaagaataataagc

SEQ ID NO: 135657 - DNA, 15 bp, Homo sapiens
gagaagaataataag

SEQ ID NO: 135658 - DNA, 15 bp, Homo sapiens
tgagaagaataataa

SEQ ID NO: 135659 - DNA, 15 bp, Homo sapiens
atgagaagaataata

SEQ ID NO: 135660 - DNA, 15 bp, Homo sapiens
tatgagaagaataat

SEQ ID NO: 135661 - DNA, 15 bp, Homo sapiens
atatgagaagaataa

SEQ ID NO: 135662 - DNA, 15 bp, Homo sapiens
catatgagaagaata

SEQ ID NO: 135663 - DNA, 15 bp, Homo sapiens
ccatatgagaagaat

SEQ ID NO: 135664 - DNA, 15 bp, Homo sapiens
gccatatgagaagaa

SEQ ID NO: 135665 - DNA, 15 bp, Homo sapiens
agccatatgagaaga

SEQ ID NO: 135666 - DNA, 15 bp, Homo sapiens
aagccatatgagaag

SEQ ID NO: 135667 - DNA, 15 bp, Homo sapiens
taagccatatgagaa

SEQ ID NO: 135668 - DNA, 15 bp, Homo sapiens
ataagccatatgaga

SEQ ID NO: 135669 - DNA, 15 bp, Homo sapiens
aataagccatatgag

SEQ ID NO: 135670 - DNA, 15 bp, Homo sapiens
taataagccatatga

SEQ ID NO: 135671 - DNA, 15 bp, Homo sapiens
ttaataagccatatg

SEQ ID NO: 135672 - DNA, 15 bp, Homo sapiens
gttaataagccatat

SEQ ID NO: 135673 - DNA, 15 bp, Homo sapiens
ggttaataagccata

SEQ ID NO: 135674 - DNA, 15 bp, Homo sapiens
aggttaataagccat

SEQ ID NO: 135675 - DNA, 15 bp, Homo sapiens
taggttaataagcca

SEQ ID NO: 135676 - DNA, 15 bp, Homo sapiens
ataggttaataagcc

SEQ ID NO: 135677 - DNA, 15 bp, Homo sapiens
gataggttaataagc

SEQ ID NO: 135678 - DNA, 15 bp, Homo sapiens
ggataggttaataag

SEQ ID NO: 135679 - DNA, 15 bp, Homo sapiens
cggataggttaataa

SEQ ID NO: 135680 - DNA, 15 bp, Homo sapiens
tcggataggttaata

SEQ ID NO: 135681 - DNA, 15 bp, Homo sapiens
ttcggataggttaat

SEQ ID NO: 135682 - DNA, 15 bp, Homo sapiens
attcggataggttaa

SEQ ID NO: 135683 - DNA, 15 bp, Homo sapiens
tattcggataggtta

SEQ ID NO: 135684 - DNA, 15 bp, Homo sapiens
ttattcggataggtt

SEQ ID NO: 135685 - DNA, 15 bp, Homo sapiens
attattcggataggt

SEQ ID NO: 135686 - DNA, 15 bp, Homo sapiens
gattattcggatagg

SEQ ID NO: 135687 - DNA, 15 bp, Homo sapiens
tgattattcggatag

SEQ ID NO: 135688 - DNA, 15 bp, Homo sapiens
atgattattcggata

SEQ ID NO: 135689 - DNA, 15 bp, Homo sapiens
aatgattattcggat

SEQ ID NO: 135690 - DNA, 15 bp, Homo sapiens
aaatgattattcgga

SEQ ID NO: 135691 - DNA, 15 bp, Homo sapiens
gaaatgattattcgg

SEQ ID NO: 135692 - DNA, 15 bp, Homo sapiens
agaaatgattattcg

SEQ ID NO: 135693 - DNA, 15 bp, Homo sapiens
tagaaatgattattc

SEQ ID NO: 135694 - DNA, 15 bp, Homo sapiens
gtagaaatgattatt

SEQ ID NO: 135695 - DNA, 15 bp, Homo sapiens
agtagaaatgattat

SEQ ID NO: 135696 - DNA, 15 bp, Homo sapiens
aagtagaaatgatta

SEQ ID NO: 135697 - DNA, 15 bp, Homo sapiens
taagtagaaatgatt

SEQ ID NO: 135698 - DNA, 15 bp, Homo sapiens
ttaagtagaaatgat

SEQ ID NO: 135699 - DNA, 15 bp, Homo sapiens
gttaagtagaaatga

SEQ ID NO: 135700 - DNA, 15 bp, Homo sapiens
tgttaagtagaaatg

SEQ ID NO: 135701 - DNA, 15 bp, Homo sapiens
ctgttaagtagaaat

SEQ ID NO: 135702 - DNA, 15 bp, Homo sapiens
tctgttaagtagaaa

SEQ ID NO: 135703 - DNA, 15 bp, Homo sapiens
atctgttaagtagaa

SEQ ID NO: 135704 - DNA, 15 bp, Homo sapiens
aatctgttaagtaga

SEQ ID NO: 135705 - DNA, 15 bp, Homo sapiens
taatctgttaagtag

SEQ ID NO: 135706 - DNA, 15 bp, Homo sapiens
gtaatctgttaagta

SEQ ID NO: 135707 - DNA, 15 bp, Homo sapiens
tgtaatctgttaagt

SEQ ID NO: 135708 - DNA, 15 bp, Homo sapiens
ttgtaatctgttaag

SEQ ID NO: 135709 - DNA, 15 bp, Homo sapiens
tttgtaatctgttaa

SEQ ID NO: 135710 - DNA, 15 bp, Homo sapiens
ctttgtaatctgtta

SEQ ID NO: 135711 - DNA, 15 bp, Homo sapiens
cctttgtaatctgtt

SEQ ID NO: 135712 - DNA, 15 bp, Homo sapiens
gcctttgtaatctgt

SEQ ID NO: 135713 - DNA, 15 bp, Homo sapiens
agcctttgtaatctg

SEQ ID NO: 135714 - DNA, 15 bp, Homo sapiens
cagcctttgtaatct

SEQ ID NO: 135715 - DNA, 15 bp, Homo sapiens
tcagcctttgtaatc

SEQ ID NO: 135716 - DNA, 15 bp, Homo sapiens
gtcagcctttgtaat

SEQ ID NO: 135717 - DNA, 15 bp, Homo sapiens
agtcagcctttgtaa

SEQ ID NO: 135718 - DNA, 15 bp, Homo sapiens
aagtcagcctttgta

SEQ ID NO: 135719 - DNA, 15 bp, Homo sapiens
taagtcagcctttgt

SEQ ID NO: 135720 - DNA, 15 bp, Homo sapiens
ctaagtcagcctttg

SEQ ID NO: 135721 - DNA, 15 bp, Homo sapiens
tctaagtcagccttt

SEQ ID NO: 135722 - DNA, 15 bp, Homo sapiens
ttctaagtcagcctt

SEQ ID NO: 135723 - DNA, 15 bp, Homo sapiens
gttctaagtcagcct

SEQ ID NO: 135724 - DNA, 15 bp, Homo sapiens
tgttctaagtcagcc

SEQ ID NO: 135725 - DNA, 15 bp, Homo sapiens
ctgttctaagtcagc

SEQ ID NO: 135726 - DNA, 15 bp, Homo sapiens
gctgttctaagtcag

SEQ ID NO: 135727 - DNA, 15 bp, Homo sapiens
cgctgttctaagtca

SEQ ID NO: 135728 - DNA, 15 bp, Homo sapiens
gcgctgttctaagtc

SEQ ID NO: 135729 - DNA, 15 bp, Homo sapiens
ggcgctgttctaagt

SEQ ID NO: 135730 - DNA, 15 bp, Homo sapiens
tggcgctgttctaag

SEQ ID NO: 135731 - DNA, 15 bp, Homo sapiens
atggcgctgttctaa

SEQ ID NO: 135732 - DNA, 15 bp, Homo sapiens
gatggcgctgttcta

SEQ ID NO: 135733 - DNA, 15 bp, Homo sapiens
ggatggcgctgttct

SEQ ID NO: 135734 - DNA, 15 bp, Homo sapiens
aggatggcgctgttc

SEQ ID NO: 135735 - DNA, 15 bp, Homo sapiens
gaggatggcgctgtt

SEQ ID NO: 135736 - DNA, 15 bp, Homo sapiens
tgaggatggcgctgt

SEQ ID NO: 135737 - DNA, 15 bp, Homo sapiens
ctgaggatggcgctg

SEQ ID NO: 135738 - DNA, 15 bp, Homo sapiens
gctgaggatggcgct

SEQ ID NO: 135739 - DNA, 15 bp, Homo sapiens
agctgaggatggcgc

SEQ ID NO: 135740 - DNA, 15 bp, Homo sapiens
cagctgaggatggcg

SEQ ID NO: 135741 - DNA, 15 bp, Homo sapiens
ccagctgaggatggc

SEQ ID NO: 135742 - DNA, 15 bp, Homo sapiens
tccagctgaggatgg

SEQ ID NO: 135743 - DNA, 15 bp, Homo sapiens
atccagctgaggatg

SEQ ID NO: 135744 - DNA, 15 bp, Homo sapiens
aatccagctgaggat

SEQ ID NO: 135745 - DNA, 15 bp, Homo sapiens
taatccagctgagga

SEQ ID NO: 135746 - DNA, 15 bp, Homo sapiens
ataatccagctgagg

SEQ ID NO: 135747 - DNA, 15 bp, Homo sapiens
cataatccagctgag

SEQ ID NO: 135748 - DNA, 15 bp, Homo sapiens
acataatccagctga

SEQ ID NO: 135749 - DNA, 15 bp, Homo sapiens
aacataatccagctg

SEQ ID NO: 135750 - DNA, 15 bp, Homo sapiens
aaacataatccagct

SEQ ID NO: 135751 - DNA, 15 bp, Homo sapiens
aaaacataatccagc

SEQ ID NO: 135752 - DNA, 15 bp, Homo sapiens
aaaaacataatccag

SEQ ID NO: 135753 - DNA, 15 bp, Homo sapiens
taaaaacataatcca

SEQ ID NO: 135754 - DNA, 15 bp, Homo sapiens
gtaaaaacataatcc

SEQ ID NO: 135755 - DNA, 15 bp, Homo sapiens
tgtaaaaacataatc

SEQ ID NO: 135756 - DNA, 15 bp, Homo sapiens
atgtaaaaacataat

SEQ ID NO: 135757 - DNA, 15 bp, Homo sapiens
aatgtaaaaacataa

SEQ ID NO: 135758 - DNA, 15 bp, Homo sapiens
caatgtaaaaacata

SEQ ID NO: 135759 - DNA, 15 bp, Homo sapiens
ccaatgtaaaaacat

SEQ ID NO: 135760 - DNA, 15 bp, Homo sapiens
gccaatgtaaaaaca

SEQ ID NO: 135761 - DNA, 15 bp, Homo sapiens
tgccaatgtaaaaac

SEQ ID NO: 135762 - DNA, 15 bp, Homo sapiens
gtgccaatgtaaaaa

SEQ ID NO: 135763 - DNA, 15 bp, Homo sapiens
tgtgccaatgtaaaa

SEQ ID NO: 135764 - DNA, 15 bp, Homo sapiens
ctgtgccaatgtaaa

SEQ ID NO: 135765 - DNA, 15 bp, Homo sapiens
tctgtgccaatgtaa

SEQ ID NO: 135766 - DNA, 15 bp, Homo sapiens
ttctgtgccaatgta

SEQ ID NO: 135767 - DNA, 15 bp, Homo sapiens
attctgtgccaatgt

SEQ ID NO: 135768 - DNA, 15 bp, Homo sapiens
aattctgtgccaatg

SEQ ID NO: 135769 - DNA, 15 bp, Homo sapiens
aaattctgtgccaat

SEQ ID NO: 135770 - DNA, 15 bp, Homo sapiens
caaattctgtgccaa

SEQ ID NO: 135771 - DNA, 15 bp, Homo sapiens
tcaaattctgtgcca

SEQ ID NO: 135772 - DNA, 15 bp, Homo sapiens
ttcaaattctgtgcc

SEQ ID NO: 135773 - DNA, 15 bp, Homo sapiens
tttcaaattctgtgc

SEQ ID NO: 135774 - DNA, 15 bp, Homo sapiens
ttttcaaattctgtg

SEQ ID NO: 135775 - DNA, 15 bp, Homo sapiens
tttttcaaattctgt

SEQ ID NO: 135776 - DNA, 15 bp, Homo sapiens
atttttcaaattctg

SEQ ID NO: 135777 - DNA, 15 bp, Homo sapiens
tatttttcaaattct

SEQ ID NO: 135778 - DNA, 15 bp, Homo sapiens
ttatttttcaaattc

SEQ ID NO: 135779 - DNA, 15 bp, Homo sapiens
tttatttttcaaatt

SEQ ID NO: 135780 - DNA, 15 bp, Homo sapiens
ctttatttttcaaat

SEQ ID NO: 135781 - DNA, 15 bp, Homo sapiens
gctttatttttcaaa

SEQ ID NO: 135782 - DNA, 15 bp, Homo sapiens
agctttatttttcaa

SEQ ID NO: 135783 - DNA, 15 bp, Homo sapiens
aagctttatttttca

SEQ ID NO: 135784 - DNA, 15 bp, Homo sapiens
gaagctttatttttc

SEQ ID NO: 135785 - DNA, 15 bp, Homo sapiens
ggaagctttattttt

SEQ ID NO: 135786 - DNA, 15 bp, Homo sapiens
tggaagctttatttt

SEQ ID NO: 135787 - DNA, 15 bp, Homo sapiens
ctggaagctttattt

SEQ ID NO: 135788 - DNA, 15 bp, Homo sapiens
actggaagctttatt

SEQ ID NO: 135789 - DNA, 15 bp, Homo sapiens
aactggaagctttat

SEQ ID NO: 135790 - DNA, 15 bp, Homo sapiens
gaactggaagcttta

SEQ ID NO: 135791 - DNA, 15 bp, Homo sapiens
tgaactggaagcttt

SEQ ID NO: 135792 - DNA, 15 bp, Homo sapiens
ctgaactggaagctt

SEQ ID NO: 135793 - DNA, 15 bp, Homo sapiens
tctgaactggaagct

SEQ ID NO: 135794 - DNA, 15 bp, Homo sapiens
atctgaactggaagc

SEQ ID NO: 135795 - DNA, 15 bp, Homo sapiens
tatctgaactggaag

SEQ ID NO: 135796 - DNA, 15 bp, Homo sapiens
atatctgaactggaa

SEQ ID NO: 135797 - DNA, 15 bp, Homo sapiens
catatctgaactgga

SEQ ID NO: 135798 - DNA, 15 bp, Homo sapiens
tcatatctgaactgg

SEQ ID NO: 135799 - DNA, 15 bp, Homo sapiens
ctcatatctgaactg

SEQ ID NO: 135800 - DNA, 15 bp, Homo sapiens
tctcatatctgaact

SEQ ID NO: 135801 - DNA, 15 bp, Homo sapiens
ttctcatatctgaac

SEQ ID NO: 135802 - DNA, 15 bp, Homo sapiens
gttctcatatctgaa

SEQ ID NO: 135803 - DNA, 15 bp, Homo sapiens
tgttctcatatctga

SEQ ID NO: 135804 - DNA, 15 bp, Homo sapiens
ctgttctcatatctg

SEQ ID NO: 135805 - DNA, 15 bp, Homo sapiens
gctgttctcatatct

SEQ ID NO: 135806 - DNA, 15 bp, Homo sapiens
tgctgttctcatatc

SEQ ID NO: 135807 - DNA, 15 bp, Homo sapiens
ttgctgttctcatat

SEQ ID NO: 135808 - DNA, 15 bp, Homo sapiens
attgctgttctcata

SEQ ID NO: 135809 - DNA, 15 bp, Homo sapiens
aattgctgttctcat

SEQ ID NO: 135810 - DNA, 15 bp, Homo sapiens
taattgctgttctca

SEQ ID NO: 135811 - DNA, 15 bp, Homo sapiens
gtaattgctgttctc

SEQ ID NO: 135812 - DNA, 15 bp, Homo sapiens
tgtaattgctgttct

SEQ ID NO: 135813 - DNA, 15 bp, Homo sapiens
ctgtaattgctgttc

SEQ ID NO: 135814 - DNA, 15 bp, Homo sapiens
tctgtaattgctgtt

SEQ ID NO: 135815 - DNA, 15 bp, Homo sapiens
ttctgtaattgctgt

SEQ ID NO: 135816 - DNA, 15 bp, Homo sapiens
tttctgtaattgctg

SEQ ID NO: 135817 - DNA, 15 bp, Homo sapiens
ttttctgtaattgct

SEQ ID NO: 135818 - DNA, 15 bp, Homo sapiens
tttttctgtaattgc

SEQ ID NO: 135819 - DNA, 15 bp, Homo sapiens
atttttctgtaattg

SEQ ID NO: 135820 - DNA, 15 bp, Homo sapiens
catttttctgtaatt

SEQ ID NO: 135821 - DNA, 15 bp, Homo sapiens
acatttttctgtaat

SEQ ID NO: 135822 - DNA, 15 bp, Homo sapiens
tacatttttctgtaa

SEQ ID NO: 135823 - DNA, 15 bp, Homo sapiens
ttacatttttctgta

SEQ ID NO: 135824 - DNA, 15 bp, Homo sapiens
cttacatttttctgt

SEQ ID NO: 135825 - DNA, 15 bp, Homo sapiens
acttacatttttctg

SEQ ID NO: 135826 - DNA, 15 bp, Homo sapiens
aacttacatttttct

SEQ ID NO: 135827 - DNA, 15 bp, Homo sapiens
aaacttacatttttc

SEQ ID NO: 135828 - DNA, 15 bp, Homo sapiens
aaaacttacattttt

SEQ ID NO: 135829 - DNA, 15 bp, Homo sapiens
aaaaacttacatttt

SEQ ID NO: 135830 - DNA, 15 bp, Homo sapiens
aaaaaacttacattt

SEQ ID NO: 135831 - DNA, 15 bp, Homo sapiens
taaaaaacttacatt

SEQ ID NO: 135832 - DNA, 15 bp, Homo sapiens
ttaaaaaacttacat

SEQ ID NO: 135833 - DNA, 15 bp, Homo sapiens
tttaaaaaacttaca

SEQ ID NO: 135834 - DNA, 15 bp, Homo sapiens
ttttaaaaaacttac

SEQ ID NO: 135835 - DNA, 15 bp, Homo sapiens
tttttaaaaaactta

SEQ ID NO: 135836 - DNA, 15 bp, Homo sapiens
tttttttaaaaaact

SEQ ID NO: 135837 - DNA, 15 bp, Homo sapiens
ctttttttaaaaaac

SEQ ID NO: 135838 - DNA, 15 bp, Homo sapiens
actttttttaaaaaa

SEQ ID NO: 135839 - DNA, 15 bp, Homo sapiens
aactttttttaaaaa

SEQ ID NO: 135840 - DNA, 15 bp, Homo sapiens
taactttttttaaaa

SEQ ID NO: 135841 - DNA, 15 bp, Homo sapiens
ataactttttttaaa

SEQ ID NO: 135842 - DNA, 15 bp, Homo sapiens
cataactttttttaa

SEQ ID NO: 135843 - DNA, 15 bp, Homo sapiens
acataacttttttta

SEQ ID NO: 135844 - DNA, 15 bp, Homo sapiens
tacataacttttttt

SEQ ID NO: 135845 - DNA, 15 bp, Homo sapiens
atacataactttttt

SEQ ID NO: 135846 - DNA, 15 bp, Homo sapiens
aatacataacttttt

SEQ ID NO: 135847 - DNA, 15 bp, Homo sapiens
taatacataactttt

SEQ ID NO: 135848 - DNA, 15 bp, Homo sapiens
ataatacataacttt

SEQ ID NO: 135849 - DNA, 15 bp, Homo sapiens
gataatacataactt

SEQ ID NO: 135850 - DNA, 15 bp, Homo sapiens
tgataatacataact

SEQ ID NO: 135851 - DNA, 15 bp, Homo sapiens
atgataatacataac

SEQ ID NO: 135852 - DNA, 15 bp, Homo sapiens
gatgataatacataa

SEQ ID NO: 135853 - DNA, 15 bp, Homo sapiens
ggatgataatacata

SEQ ID NO: 135854 - DNA, 15 bp, Homo sapiens
tggatgataatacat

SEQ ID NO: 135855 - DNA, 15 bp, Homo sapiens
gtggatgataataca

SEQ ID NO: 135856 - DNA, 15 bp, Homo sapiens
agtggatgataatac

SEQ ID NO: 135857 - DNA, 15 bp, Homo sapiens
aagtggatgataata

SEQ ID NO: 135858 - DNA, 15 bp, Homo sapiens
aaagtggatgataat

SEQ ID NO: 135859 - DNA, 15 bp, Homo sapiens
gaaagtggatgataa

SEQ ID NO: 135860 - DNA, 15 bp, Homo sapiens
ggaaagtggatgata

SEQ ID NO: 135861 - DNA, 15 bp, Homo sapiens
gggaaagtggatgat

SEQ ID NO: 135862 - DNA, 15 bp, Homo sapiens
agggaaagtggatga

SEQ ID NO: 135863 - DNA, 15 bp, Homo sapiens
cagggaaagtggatg

SEQ ID NO: 135864 - DNA, 15 bp, Homo sapiens
gcagggaaagtggat

SEQ ID NO: 135865 - DNA, 15 bp, Homo sapiens
tgcagggaaagtgga

SEQ ID NO: 135866 - DNA, 15 bp, Homo sapiens
ttgcagggaaagtgg

SEQ ID NO: 135867 - DNA, 15 bp, Homo sapiens
tttgcagggaaagtg

SEQ ID NO: 135868 - DNA, 15 bp, Homo sapiens
atttgcagggaaagt

SEQ ID NO: 135869 - DNA, 15 bp, Homo sapiens
catttgcagggaaag

SEQ ID NO: 135870 - DNA, 15 bp, Homo sapiens
ccatttgcagggaaa

SEQ ID NO: 135871 - DNA, 15 bp, Homo sapiens
accatttgcagggaa

SEQ ID NO: 135872 - DNA, 15 bp, Homo sapiens
caccatttgcaggga

SEQ ID NO: 135873 - DNA, 15 bp, Homo sapiens
tcaccatttgcaggg

SEQ ID NO: 135874 - DNA, 15 bp, Homo sapiens
gtcaccatttgcagg

SEQ ID NO: 135875 - DNA, 15 bp, Homo sapiens
tgtcaccatttgcag

SEQ ID NO: 135876 - DNA, 15 bp, Homo sapiens
gtgtcaccatttgca

SEQ ID NO: 135877 - DNA, 15 bp, Homo sapiens
tgtgtcaccatttgc

SEQ ID NO: 135878 - DNA, 15 bp, Homo sapiens
gtgtgtcaccatttg

SEQ ID NO: 135879 - DNA, 15 bp, Homo sapiens
tgtgtgtcaccattt

SEQ ID NO: 135880 - DNA, 15 bp, Homo sapiens
gtgtgtgtcaccatt

SEQ ID NO: 135881 - DNA, 15 bp, Homo sapiens
tgtgtgtgtcaccat

SEQ ID NO: 135882 - DNA, 15 bp, Homo sapiens
gtgtgtgtgtcacca

SEQ ID NO: 135883 - DNA, 15 bp, Homo sapiens
tgtgtgtgtgtcacc

SEQ ID NO: 135884 - DNA, 15 bp, Homo sapiens
gtgtgtgtgtgtcac

SEQ ID NO: 135885 - DNA, 15 bp, Homo sapiens
tgtgtgtgtgtgtca

SEQ ID NO: 135886 - DNA, 15 bp, Homo sapiens
atgtgtttgtgtgtg

SEQ ID NO: 135887 - DNA, 15 bp, Homo sapiens
aatgtgtttgtgtgt

SEQ ID NO: 135888 - DNA, 15 bp, Homo sapiens
aaatgtgtttgtgtg

SEQ ID NO: 135889 - DNA, 15 bp, Homo sapiens
aaaatgtgtttgtgt

SEQ ID NO: 135890 - DNA, 15 bp, Homo sapiens
gaaaatgtgtttgtg

SEQ ID NO: 135891 - DNA, 15 bp, Homo sapiens
tgaaaatgtgtttgt

SEQ ID NO: 135892 - DNA, 15 bp, Homo sapiens
ttgaaaatgtgtttg

SEQ ID NO: 135893 - DNA, 15 bp, Homo sapiens
tttgaaaatgtgttt

SEQ ID NO: 135894 - DNA, 15 bp, Homo sapiens
ctttgaaaatgtgtt

SEQ ID NO: 135895 - DNA, 15 bp, Homo sapiens
tctttgaaaatgtgt

SEQ ID NO: 135896 - DNA, 15 bp, Homo sapiens
atctttgaaaatgtg

SEQ ID NO: 135897 - DNA, 15 bp, Homo sapiens
aatctttgaaaatgt

SEQ ID NO: 135898 - DNA, 15 bp, Homo sapiens
taatctttgaaaatg

SEQ ID NO: 135899 - DNA, 15 bp, Homo sapiens
ataatctttgaaaat

SEQ ID NO: 135900 - DNA, 15 bp, Homo sapiens
aataatctttgaaaa

SEQ ID NO: 135901 - DNA, 15 bp, Homo sapiens
gaataatctttgaaa

SEQ ID NO: 135902 - DNA, 15 bp, Homo sapiens
tgaataatctttgaa

SEQ ID NO: 135903 - DNA, 15 bp, Homo sapiens
ttgaataatctttga

SEQ ID NO: 135904 - DNA, 15 bp, Homo sapiens
gttgaataatctttg

SEQ ID NO: 135905 - DNA, 15 bp, Homo sapiens
agttgaataatcttt

SEQ ID NO: 135906 - DNA, 15 bp, Homo sapiens
tagttgaataatctt

SEQ ID NO: 135907 - DNA, 15 bp, Homo sapiens
ctagttgaataatct

SEQ ID NO: 135908 - DNA, 15 bp, Homo sapiens
tctagttgaataatc

SEQ ID NO: 135909 - DNA, 15 bp, Homo sapiens
ttctagttgaataat

SEQ ID NO: 135910 - DNA, 15 bp, Homo sapiens
tttctagttgaataa

SEQ ID NO: 135911 - DNA, 15 bp, Homo sapiens
ctttctagttgaata

SEQ ID NO: 135912 - DNA, 15 bp, Homo sapiens
actttctagttgaat

SEQ ID NO: 135913 - DNA, 15 bp, Homo sapiens
tactttctagttgaa

SEQ ID NO: 135914 - DNA, 15 bp, Homo sapiens
ttactttctagttga

SEQ ID NO: 135915 - DNA, 15 bp, Homo sapiens
attactttctagttg

SEQ ID NO: 135916 - DNA, 15 bp, Homo sapiens
tattactttctagtt

SEQ ID NO: 135917 - DNA, 15 bp, Homo sapiens
ctattactttctagt

SEQ ID NO: 135918 - DNA, 15 bp, Homo sapiens
actattactttctag

SEQ ID NO: 135919 - DNA, 15 bp, Homo sapiens
cactattactttcta

SEQ ID NO: 135920 - DNA, 15 bp, Homo sapiens
acactattactttct

SEQ ID NO: 135921 - DNA, 15 bp, Homo sapiens
aacactattactttc

SEQ ID NO: 135922 - DNA, 15 bp, Homo sapiens
aaacactattacttt

SEQ ID NO: 135923 - DNA, 15 bp, Homo sapiens
taaacactattactt

SEQ ID NO: 135924 - DNA, 15 bp, Homo sapiens
ttaaacactattact

SEQ ID NO: 135925 - DNA, 15 bp, Homo sapiens
attaaacactattac

SEQ ID NO: 135926 - DNA, 15 bp, Homo sapiens
tattaaacactatta

SEQ ID NO: 135927 - DNA, 15 bp, Homo sapiens
atattaaacactatt

SEQ ID NO: 135928 - DNA, 15 bp, Homo sapiens
aatattaaacactat

SEQ ID NO: 135929 - DNA, 15 bp, Homo sapiens
aaatattaaacacta

SEQ ID NO: 135930 - DNA, 15 bp, Homo sapiens
caaatattaaacact

SEQ ID NO: 135931 - DNA, 15 bp, Homo sapiens
acaaatattaaacac

SEQ ID NO: 135932 - DNA, 15 bp, Homo sapiens
aacaaatattaaaca

SEQ ID NO: 135933 - DNA, 15 bp, Homo sapiens
taacaaatattaaac

SEQ ID NO: 135934 - DNA, 15 bp, Homo sapiens
gtaacaaatattaaa

SEQ ID NO: 135935 - DNA, 15 bp, Homo sapiens
agtaacaaatattaa

SEQ ID NO: 135936 - DNA, 15 bp, Homo sapiens
gagtaacaaatatta

SEQ ID NO: 135937 - DNA, 15 bp, Homo sapiens
agagtaacaaatatt

SEQ ID NO: 135938 - DNA, 15 bp, Homo sapiens
aagagtaacaaatat

SEQ ID NO: 135939 - DNA, 15 bp, Homo sapiens
aaagagtaacaaata

SEQ ID NO: 135940 - DNA, 15 bp, Homo sapiens
taaagagtaacaaat

SEQ ID NO: 135941 - DNA, 15 bp, Homo sapiens
ataaagagtaacaaa

SEQ ID NO: 135942 - DNA, 15 bp, Homo sapiens
aataaagagtaacaa

SEQ ID NO: 135943 - DNA, 15 bp, Homo sapiens
aaataaagagtaaca

SEQ ID NO: 135944 - DNA, 15 bp, Homo sapiens
taaataaagagtaac

SEQ ID NO: 135945 - DNA, 15 bp, Homo sapiens
ataaataaagagtaa

SEQ ID NO: 135946 - DNA, 15 bp, Homo sapiens
tataaataaagagta

SEQ ID NO: 135947 - DNA, 15 bp, Homo sapiens
gtataaataaagagt

SEQ ID NO: 135948 - DNA, 15 bp, Homo sapiens
tgtataaataaagag

SEQ ID NO: 135949 - DNA, 15 bp, Homo sapiens
ctgtataaataaaga

SEQ ID NO: 135950 - DNA, 15 bp, Homo sapiens
tctgtataaataaag

SEQ ID NO: 135951 - DNA, 15 bp, Homo sapiens
ttctgtataaataaa

SEQ ID NO: 135952 - DNA, 15 bp, Homo sapiens
tttctgtataaataa

SEQ ID NO: 135953 - DNA, 15 bp, Homo sapiens
atttctgtataaata

SEQ ID NO: 135954 - DNA, 15 bp, Homo sapiens
catttctgtataaat

SEQ ID NO: 135955 - DNA, 15 bp, Homo sapiens
acatttctgtataaa

SEQ ID NO: 135956 - DNA, 15 bp, Homo sapiens
tacatttctgtataa

SEQ ID NO: 135957 - DNA, 15 bp, Homo sapiens
ctacatttctgtata

SEQ ID NO: 135958 - DNA, 15 bp, Homo sapiens
gctacatttctgtat

SEQ ID NO: 135959 - DNA, 15 bp, Homo sapiens
agctacatttctgta

SEQ ID NO: 135960 - DNA, 15 bp, Homo sapiens
aagctacatttctgt

SEQ ID NO: 135961 - DNA, 15 bp, Homo sapiens
aaagctacatttctg

SEQ ID NO: 135962 - DNA, 15 bp, Homo sapiens
gaaagctacatttct

SEQ ID NO: 135963 - DNA, 15 bp, Homo sapiens
ggaaagctacatttc

SEQ ID NO: 135964 - DNA, 15 bp, Homo sapiens
gggaaagctacattt

SEQ ID NO: 135965 - DNA, 15 bp, Homo sapiens
agggaaagctacatt

SEQ ID NO: 135966 - DNA, 15 bp, Homo sapiens
aagggaaagctacat

SEQ ID NO: 135967 - DNA, 15 bp, Homo sapiens
caagggaaagctaca

SEQ ID NO: 135968 - DNA, 15 bp, Homo sapiens
acaagggaaagctac

SEQ ID NO: 135969 - DNA, 15 bp, Homo sapiens
aacaagggaaagcta

SEQ ID NO: 135970 - DNA, 15 bp, Homo sapiens
aaacaagggaaagct

SEQ ID NO: 135971 - DNA, 15 bp, Homo sapiens
aaaacaagggaaagc

SEQ ID NO: 135972 - DNA, 15 bp, Homo sapiens
aaaaacaagggaaag

SEQ ID NO: 135973 - DNA, 15 bp, Homo sapiens
taaaaacaagggaaa

SEQ ID NO: 135974 - DNA, 15 bp, Homo sapiens
ataaaaacaagggaa

SEQ ID NO: 135975 - DNA, 15 bp, Homo sapiens
cataaaaacaaggga

SEQ ID NO: 135976 - DNA, 15 bp, Homo sapiens
acataaaaacaaggg

SEQ ID NO: 135977 - DNA, 15 bp, Homo sapiens
aacataaaaacaagg

SEQ ID NO: 135978 - DNA, 15 bp, Homo sapiens
aaacataaaaacaag

SEQ ID NO: 135979 - DNA, 15 bp, Homo sapiens
aaaacataaaaacaa

SEQ ID NO: 135980 - DNA, 15 bp, Homo sapiens
caaaacataaaaaca

SEQ ID NO: 135981 - DNA, 15 bp, Homo sapiens
acaaaacataaaaac

SEQ ID NO: 135982 - DNA, 15 bp, Homo sapiens
cacaaaacataaaaa

SEQ ID NO: 135983 - DNA, 15 bp, Homo sapiens
tcacaaaacataaaa

SEQ ID NO: 135984 - DNA, 15 bp, Homo sapiens
ttcacaaaacataaa

SEQ ID NO: 135985 - DNA, 15 bp, Homo sapiens
gttcacaaaacataa

SEQ ID NO: 135986 - DNA, 15 bp, Homo sapiens
tgttcacaaaacata

SEQ ID NO: 135987 - DNA, 15 bp, Homo sapiens
atgttcacaaaacat

SEQ ID NO: 135988 - DNA, 15 bp, Homo sapiens
aatgttcacaaaaca

SEQ ID NO: 135989 - DNA, 15 bp, Homo sapiens
caatgttcacaaaac

SEQ ID NO: 135990 - DNA, 15 bp, Homo sapiens
acaatgttcacaaaa

SEQ ID NO: 135991 - DNA, 15 bp, Homo sapiens
aacaatgttcacaaa

SEQ ID NO: 135992 - DNA, 15 bp, Homo sapiens
taacaatgttcacaa

SEQ ID NO: 135993 - DNA, 15 bp, Homo sapiens
gtaacaatgttcaca

SEQ ID NO: 135994 - DNA, 15 bp, Homo sapiens
tgtaacaatgttcac

SEQ ID NO: 135995 - DNA, 15 bp, Homo sapiens
ttgtaacaatgttca

SEQ ID NO: 135996 - DNA, 15 bp, Homo sapiens
attgtaacaatgttc

SEQ ID NO: 135997 - DNA, 15 bp, Homo sapiens
tattgtaacaatgtt

SEQ ID NO: 135998 - DNA, 15 bp, Homo sapiens
ttattgtaacaatgt

SEQ ID NO: 135999 - DNA, 15 bp, Homo sapiens
gttattgtaacaatg

SEQ ID NO: 136000 - DNA, 15 bp, Homo sapiens
ggttattgtaacaat

SEQ ID NO: 136001 - DNA, 15 bp, Homo sapiens
aggttattgtaacaa

SEQ ID NO: 136002 - DNA, 15 bp, Homo sapiens
aaggttattgtaaca

SEQ ID NO: 136003 - DNA, 15 bp, Homo sapiens
taaggttattgtaac

SEQ ID NO: 136004 - DNA, 15 bp, Homo sapiens
ataaggttattgtaa

SEQ ID NO: 136005 - DNA, 15 bp, Homo sapiens
cataaggttattgta

SEQ ID NO: 136006 - DNA, 15 bp, Homo sapiens
tcataaggttattgt

SEQ ID NO: 136007 - DNA, 15 bp, Homo sapiens
ttcataaggttattg

SEQ ID NO: 136008 - DNA, 15 bp, Homo sapiens
cttcataaggttatt

SEQ ID NO: 136009 - DNA, 15 bp, Homo sapiens
acttcataaggttat

SEQ ID NO: 136010 - DNA, 15 bp, Homo sapiens
gacttcataaggtta

SEQ ID NO: 136011 - DNA, 15 bp, Homo sapiens
ggacttcataaggtt

SEQ ID NO: 136012 - DNA, 15 bp, Homo sapiens
aggacttcataaggt

SEQ ID NO: 136013 - DNA, 15 bp, Homo sapiens
aaggacttcataagg

SEQ ID NO: 136014 - DNA, 15 bp, Homo sapiens
taaggacttcataag

SEQ ID NO: 136015 - DNA, 15 bp, Homo sapiens
ttaaggacttcataa

SEQ ID NO: 136016 - DNA, 15 bp, Homo sapiens
attaaggacttcata

SEQ ID NO: 136017 - DNA, 15 bp, Homo sapiens
aattaaggacttcat

SEQ ID NO: 136018 - DNA, 15 bp, Homo sapiens
taattaaggacttca

SEQ ID NO: 136019 - DNA, 15 bp, Homo sapiens
ataattaaggacttc

SEQ ID NO: 136020 - DNA, 15 bp, Homo sapiens
aataattaaggactt

SEQ ID NO: 136021 - DNA, 15 bp, Homo sapiens
taataattaaggact

SEQ ID NO: 136022 - DNA, 15 bp, Homo sapiens
ttaataattaaggac

SEQ ID NO: 136023 - DNA, 15 bp, Homo sapiens
gttaataattaagga

SEQ ID NO: 136024 - DNA, 15 bp, Homo sapiens
tgttaataattaagg

SEQ ID NO: 136025 - DNA, 15 bp, Homo sapiens
atgttaataattaag

SEQ ID NO: 136026 - DNA, 15 bp, Homo sapiens
gatgttaataattaa

SEQ ID NO: 136027 - DNA, 15 bp, Homo sapiens
tgatgttaataatta

SEQ ID NO: 136028 - DNA, 15 bp, Homo sapiens
gtgatgttaataatt

SEQ ID NO: 136029 - DNA, 15 bp, Homo sapiens
cgtgatgttaataat

SEQ ID NO: 136030 - DNA, 15 bp, Homo sapiens
tcgtgatgttaataa

SEQ ID NO: 136031 - DNA, 15 bp, Homo sapiens
gtcgtgatgttaata

SEQ ID NO: 136032 - DNA, 15 bp, Homo sapiens
agtcgtgatgttaat

SEQ ID NO: 136033 - DNA, 15 bp, Homo sapiens
gagtcgtgatgttaa

SEQ ID NO: 136034 - DNA, 15 bp, Homo sapiens
agagtcgtgatgtta

SEQ ID NO: 136035 - DNA, 15 bp, Homo sapiens
aagagtcgtgatgtt

SEQ ID NO: 136036 - DNA, 15 bp, Homo sapiens
taagagtcgtgatgt

SEQ ID NO: 136037 - DNA, 15 bp, Homo sapiens
ttaagagtcgtgatg

SEQ ID NO: 136038 - DNA, 15 bp, Homo sapiens
cttaagagtcgtgat

SEQ ID NO: 136039 - DNA, 15 bp, Homo sapiens
acttaagagtcgtga

SEQ ID NO: 136040 - DNA, 15 bp, Homo sapiens
tacttaagagtcgtg

SEQ ID NO: 136041 - DNA, 15 bp, Homo sapiens
ttacttaagagtcgt

SEQ ID NO: 136042 - DNA, 15 bp, Homo sapiens
attacttaagagtcg

SEQ ID NO: 136043 - DNA, 15 bp, Homo sapiens
aattacttaagagtc

SEQ ID NO: 136044 - DNA, 15 bp, Homo sapiens
taattacttaagagt

SEQ ID NO: 136045 - DNA, 15 bp, Homo sapiens
gtaattacttaagag

SEQ ID NO: 136046 - DNA, 15 bp, Homo sapiens
agtaattacttaaga

SEQ ID NO: 136047 - DNA, 15 bp, Homo sapiens
aagtaattacttaag

SEQ ID NO: 136048 - DNA, 15 bp, Homo sapiens
taagtaattacttaa

SEQ ID NO: 136049 - DNA, 15 bp, Homo sapiens
gtaagtaattactta

SEQ ID NO: 136050 - DNA, 15 bp, Homo sapiens
tgtaagtaattactt

SEQ ID NO: 136051 - DNA, 15 bp, Homo sapiens
gtgtaagtaattact

SEQ ID NO: 136052 - DNA, 15 bp, Homo sapiens
tgtgtaagtaattac

SEQ ID NO: 136053 - DNA, 15 bp, Homo sapiens
atgtgtaagtaatta

SEQ ID NO: 136054 - DNA, 15 bp, Homo sapiens
aatgtgtaagtaatt

SEQ ID NO: 136055 - DNA, 15 bp, Homo sapiens
caatgtgtaagtaat

SEQ ID NO: 136056 - DNA, 15 bp, Homo sapiens
ccaatgtgtaagtaa

SEQ ID NO: 136057 - DNA, 15 bp, Homo sapiens
cccaatgtgtaagta

SEQ ID NO: 136058 - DNA, 15 bp, Homo sapiens
acccaatgtgtaagt

SEQ ID NO: 136059 - DNA, 15 bp, Homo sapiens
aacccaatgtgtaag

SEQ ID NO: 136060 - DNA, 15 bp, Homo sapiens
aaacccaatgtgtaa

SEQ ID NO: 136061 - DNA, 15 bp, Homo sapiens
aaaacccaatgtgta

SEQ ID NO: 136062 - DNA, 15 bp, Homo sapiens
gaaaacccaatgtgt

SEQ ID NO: 136063 - DNA, 15 bp, Homo sapiens
agaaaacccaatgtg

SEQ ID NO: 136064 - DNA, 15 bp, Homo sapiens
aagaaaacccaatgt

SEQ ID NO: 136065 - DNA, 15 bp, Homo sapiens
gaagaaaacccaatg

SEQ ID NO: 136066 - DNA, 15 bp, Homo sapiens
agaagaaaacccaat

SEQ ID NO: 136067 - DNA, 15 bp, Homo sapiens
gagaagaaaacccaa

SEQ ID NO: 136068 - DNA, 15 bp, Homo sapiens
agagaagaaaaccca

SEQ ID NO: 136069 - DNA, 15 bp, Homo sapiens
aagagaagaaaaccc

SEQ ID NO: 136070 - DNA, 15 bp, Homo sapiens
taagagaagaaaacc

SEQ ID NO: 136071 - DNA, 15 bp, Homo sapiens
ttaagagaagaaaac

SEQ ID NO: 136072 - DNA, 15 bp, Homo sapiens
gttaagagaagaaaa

SEQ ID NO: 136073 - DNA, 15 bp, Homo sapiens
agttaagagaagaaa

SEQ ID NO: 136074 - DNA, 15 bp, Homo sapiens
aagttaagagaagaa

SEQ ID NO: 136075 - DNA, 15 bp, Homo sapiens
taagttaagagaaga

SEQ ID NO: 136076 - DNA, 15 bp, Homo sapiens
ctaagttaagagaag

SEQ ID NO: 136077 - DNA, 15 bp, Homo sapiens
cctaagttaagagaa

SEQ ID NO: 136078 - DNA, 15 bp, Homo sapiens
gcctaagttaagaga

SEQ ID NO: 136079 - DNA, 15 bp, Homo sapiens
agcctaagttaagag

SEQ ID NO: 136080 - DNA, 15 bp, Homo sapiens
aagcctaagttaaga

SEQ ID NO: 136081 - DNA, 15 bp, Homo sapiens
aaagcctaagttaag

SEQ ID NO: 136082 - DNA, 15 bp, Homo sapiens
gaaagcctaagttaa

SEQ ID NO: 136083 - DNA, 15 bp, Homo sapiens
agaaagcctaagtta

SEQ ID NO: 136084 - DNA, 15 bp, Homo sapiens
aagaaagcctaagtt

SEQ ID NO: 136085 - DNA, 15 bp, Homo sapiens
aaagaaagcctaagt

SEQ ID NO: 136086 - DNA, 15 bp, Homo sapiens
aaaagaaagcctaag

SEQ ID NO: 136087 - DNA, 15 bp, Homo sapiens
taaaagaaagcctaa

SEQ ID NO: 136088 - DNA, 15 bp, Homo sapiens
ctaaaagaaagccta

SEQ ID NO: 136089 - DNA, 15 bp, Homo sapiens
tctaaaagaaagcct

SEQ ID NO: 136090 - DNA, 15 bp, Homo sapiens
ctctaaaagaaagcc

SEQ ID NO: 136091 - DNA, 15 bp, Homo sapiens
cctctaaaagaaagc

SEQ ID NO: 136092 - DNA, 15 bp, Homo sapiens
tcctctaaaagaaag

SEQ ID NO: 136093 - DNA, 15 bp, Homo sapiens
ttcctctaaaagaaa

SEQ ID NO: 136094 - DNA, 15 bp, Homo sapiens
attcctctaaaagaa

SEQ ID NO: 136095 - DNA, 15 bp, Homo sapiens
tattcctctaaaaga

SEQ ID NO: 136096 - DNA, 15 bp, Homo sapiens
ttattcctctaaaag

SEQ ID NO: 136097 - DNA, 15 bp, Homo sapiens
tttattcctctaaaa

SEQ ID NO: 136098 - DNA, 15 bp, Homo sapiens
ttttattcctctaaa

SEQ ID NO: 136099 - DNA, 15 bp, Homo sapiens
tttttattcctctaa

SEQ ID NO: 136100 - DNA, 15 bp, Homo sapiens
ttttttattcctcta

SEQ ID NO: 136101 - DNA, 15 bp, Homo sapiens
tttttttattcctct

SEQ ID NO: 136102 - DNA, 15 bp, Homo sapiens
ctttttttattcctc

SEQ ID NO: 136103 - DNA, 15 bp, Homo sapiens
cctttttttattcct

SEQ ID NO: 136104 - DNA, 15 bp, Homo sapiens
acctttttttattcc

SEQ ID NO: 136105 - DNA, 15 bp, Homo sapiens
aacctttttttattc

SEQ ID NO: 136106 - DNA, 15 bp, Homo sapiens
taacctttttttatt

SEQ ID NO: 136107 - DNA, 15 bp, Homo sapiens
ttaacctttttttat

SEQ ID NO: 136108 - DNA, 15 bp, Homo sapiens
tttaaccttttttta

SEQ ID NO: 136109 - DNA, 15 bp, Homo sapiens
ctttaaccttttttt

SEQ ID NO: 136110 - DNA, 15 bp, Homo sapiens
cctttaacctttttt

SEQ ID NO: 136111 - DNA, 15 bp, Homo sapiens
tcctttaaccttttt

SEQ ID NO: 136112 - DNA, 15 bp, Homo sapiens
ttcctttaacctttt

SEQ ID NO: 136113 - DNA, 15 bp, Homo sapiens
gttcctttaaccttt

SEQ ID NO: 136114 - DNA, 15 bp, Homo sapiens
agttcctttaacctt

SEQ ID NO: 136115 - DNA, 15 bp, Homo sapiens
gagttcctttaacct

SEQ ID NO: 136116 - DNA, 15 bp, Homo sapiens
tgagttcctttaacc

SEQ ID NO: 136117 - DNA, 15 bp, Homo sapiens
gtgagttcctttaac

SEQ ID NO: 136118 - DNA, 15 bp, Homo sapiens
tgtgagttcctttaa

SEQ ID NO: 136119 - DNA, 15 bp, Homo sapiens
ttgtgagttccttta

SEQ ID NO: 136120 - DNA, 15 bp, Homo sapiens
cttgtgagttccttt

SEQ ID NO: 136121 - DNA, 15 bp, Homo sapiens
tcttgtgagttcctt

SEQ ID NO: 136122 - DNA, 15 bp, Homo sapiens
ttcttgtgagttcct

SEQ ID NO: 136123 - DNA, 15 bp, Homo sapiens
attcttgtgagttcc

SEQ ID NO: 136124 - DNA, 15 bp, Homo sapiens
cattcttgtgagttc

SEQ ID NO: 136125 - DNA, 15 bp, Homo sapiens
gcattcttgtgagtt

SEQ ID NO: 136126 - DNA, 15 bp, Homo sapiens
tgcattcttgtgagt

SEQ ID NO: 136127 - DNA, 15 bp, Homo sapiens
ttgcattcttgtgag

SEQ ID NO: 136128 - DNA, 15 bp, Homo sapiens
tttgcattcttgtga

SEQ ID NO: 136129 - DNA, 15 bp, Homo sapiens
atttgcattcttgtg

SEQ ID NO: 136130 - DNA, 15 bp, Homo sapiens
gatttgcattcttgt

SEQ ID NO: 136131 - DNA, 15 bp, Homo sapiens
ggatttgcattcttg

SEQ ID NO: 136132 - DNA, 15 bp, Homo sapiens
aggatttgcattctt

SEQ ID NO: 136133 - DNA, 15 bp, Homo sapiens
aaggatttgcattct

SEQ ID NO: 136134 - DNA, 15 bp, Homo sapiens
aaaggatttgcattc

SEQ ID NO: 136135 - DNA, 15 bp, Homo sapiens
gaaaggatttgcatt

SEQ ID NO: 136136 - DNA, 15 bp, Homo sapiens
agaaaggatttgcat

SEQ ID NO: 136137 - DNA, 15 bp, Homo sapiens
gagaaaggatttgca

SEQ ID NO: 136138 - DNA, 15 bp, Homo sapiens
agagaaaggatttgc

SEQ ID NO: 136139 - DNA, 15 bp, Homo sapiens
gagagaaaggatttg

SEQ ID NO: 136140 - DNA, 15 bp, Homo sapiens
tgagagaaaggattt

SEQ ID NO: 136141 - DNA, 15 bp, Homo sapiens
atgagagaaaggatt

SEQ ID NO: 136142 - DNA, 15 bp, Homo sapiens
aatgagagaaaggat

SEQ ID NO: 136143 - DNA, 15 bp, Homo sapiens
taatgagagaaagga

SEQ ID NO: 136144 - DNA, 15 bp, Homo sapiens
ataatgagagaaagg

SEQ ID NO: 136145 - DNA, 15 bp, Homo sapiens
tataatgagagaaag

SEQ ID NO: 136146 - DNA, 15 bp, Homo sapiens
gtataatgagagaaa

SEQ ID NO: 136147 - DNA, 15 bp, Homo sapiens
agtataatgagagaa

SEQ ID NO: 136148 - DNA, 15 bp, Homo sapiens
aagtataatgagaga

SEQ ID NO: 136149 - DNA, 15 bp, Homo sapiens
aaagtataatgagag

SEQ ID NO: 136150 - DNA, 15 bp, Homo sapiens
taaagtataatgaga

SEQ ID NO: 136151 - DNA, 15 bp, Homo sapiens
ataaagtataatgag

SEQ ID NO: 136152 - DNA, 15 bp, Homo sapiens
aataaagtataatga

SEQ ID NO: 136153 - DNA, 15 bp, Homo sapiens
gaataaagtataatg

SEQ ID NO: 136154 - DNA, 15 bp, Homo sapiens
agaataaagtataat

SEQ ID NO: 136155 - DNA, 15 bp, Homo sapiens
gagaataaagtataa

SEQ ID NO: 136156 - DNA, 15 bp, Homo sapiens
agagaataaagtata

SEQ ID NO: 136157 - DNA, 15 bp, Homo sapiens
tagagaataaagtat

SEQ ID NO: 136158 - DNA, 15 bp, Homo sapiens
ttagagaataaagta

SEQ ID NO: 136159 - DNA, 15 bp, Homo sapiens
tttagagaataaagt

SEQ ID NO: 136160 - DNA, 15 bp, Homo sapiens
ttttagagaataaag

SEQ ID NO: 136161 - DNA, 15 bp, Homo sapiens
attttagagaataaa

SEQ ID NO: 136162 - DNA, 15 bp, Homo sapiens
gattttagagaataa

SEQ ID NO: 136163 - DNA, 15 bp, Homo sapiens
tgattttagagaata

SEQ ID NO: 136164 - DNA, 15 bp, Homo sapiens
ctgattttagagaat

SEQ ID NO: 136165 - DNA, 15 bp, Homo sapiens
cctgattttagagaa

SEQ ID NO: 136166 - DNA, 15 bp, Homo sapiens
acctgattttagaga

SEQ ID NO: 136167 - DNA, 15 bp, Homo sapiens
gacctgattttagag

SEQ ID NO: 136168 - DNA, 15 bp, Homo sapiens
agacctgattttaga

SEQ ID NO: 136169 - DNA, 15 bp, Homo sapiens
aagacctgattttag

SEQ ID NO: 136170 - DNA, 15 bp, Homo sapiens
taagacctgatttta

SEQ ID NO: 136171 - DNA, 15 bp, Homo sapiens
gtaagacctgatttt

SEQ ID NO: 136172 - DNA, 15 bp, Homo sapiens
agtaagacctgattt

SEQ ID NO: 136173 - DNA, 15 bp, Homo sapiens
cagtaagacctgatt

SEQ ID NO: 136174 - DNA, 15 bp, Homo sapiens
acagtaagacctgat

SEQ ID NO: 136175 - DNA, 15 bp, Homo sapiens
cacagtaagacctga

SEQ ID NO: 136176 - DNA, 15 bp, Homo sapiens
acacagtaagacctg

SEQ ID NO: 136177 - DNA, 15 bp, Homo sapiens
gacacagtaagacct

SEQ ID NO: 136178 - DNA, 15 bp, Homo sapiens
agacacagtaagacc

SEQ ID NO: 136179 - DNA, 15 bp, Homo sapiens
aagacacagtaagac

SEQ ID NO: 136180 - DNA, 15 bp, Homo sapiens
aaagacacagtaaga

SEQ ID NO: 136181 - DNA, 15 bp, Homo sapiens
aaaagacacagtaag

SEQ ID NO: 136182 - DNA, 15 bp, Homo sapiens
taaaagacacagtaa

SEQ ID NO: 136183 - DNA, 15 bp, Homo sapiens
ttaaaagacacagta

SEQ ID NO: 136184 - DNA, 15 bp, Homo sapiens
gttaaaagacacagt

SEQ ID NO: 136185 - DNA, 15 bp, Homo sapiens
agttaaaagacacag

SEQ ID NO: 136186 - DNA, 15 bp, Homo sapiens
gagttaaaagacaca

SEQ ID NO: 136187 - DNA, 15 bp, Homo sapiens
tgagttaaaagacac

SEQ ID NO: 136188 - DNA, 15 bp, Homo sapiens
ttgagttaaaagaca

SEQ ID NO: 136189 - DNA, 15 bp, Homo sapiens
gttgagttaaaagac

SEQ ID NO: 136190 - DNA, 15 bp, Homo sapiens
ggttgagttaaaaga

SEQ ID NO: 136191 - DNA, 15 bp, Homo sapiens
gggttgagttaaaag

SEQ ID NO: 136192 - DNA, 15 bp, Homo sapiens
tgggttgagttaaaa

SEQ ID NO: 136193 - DNA, 15 bp, Homo sapiens
ttgggttgagttaaa

SEQ ID NO: 136194 - DNA, 15 bp, Homo sapiens
tttgggttgagttaa

SEQ ID NO: 136195 - DNA, 15 bp, Homo sapiens
ttttgggttgagtta

SEQ ID NO: 136196 - DNA, 15 bp, Homo sapiens
attttgggttgagtt

SEQ ID NO: 136197 - DNA, 15 bp, Homo sapiens
aattttgggttgagt

SEQ ID NO: 136198 - DNA, 15 bp, Homo sapiens
gaattttgggttgag

SEQ ID NO: 136199 - DNA, 15 bp, Homo sapiens
tgaattttgggttga

SEQ ID NO: 136200 - DNA, 15 bp, Homo sapiens
ctgaattttgggttg

SEQ ID NO: 136201 - DNA, 15 bp, Homo sapiens
actgaattttgggtt

SEQ ID NO: 136202 - DNA, 15 bp, Homo sapiens
gactgaattttgggt

SEQ ID NO: 136203 - DNA, 15 bp, Homo sapiens
ggactgaattttggg

SEQ ID NO: 136204 - DNA, 15 bp, Homo sapiens
tggactgaattttgg

SEQ ID NO: 136205 - DNA, 15 bp, Homo sapiens
gtggactgaattttg

SEQ ID NO: 136206 - DNA, 15 bp, Homo sapiens
tgtggactgaatttt

SEQ ID NO: 136207 - DNA, 15 bp, Homo sapiens
ttgtggactgaattt

SEQ ID NO: 136208 - DNA, 15 bp, Homo sapiens
tttgtggactgaatt

SEQ ID NO: 136209 - DNA, 15 bp, Homo sapiens
atttgtggactgaat

SEQ ID NO: 136210 - DNA, 15 bp, Homo sapiens
tatttgtggactgaa

SEQ ID NO: 136211 - DNA, 15 bp, Homo sapiens
atatttgtggactga

SEQ ID NO: 136212 - DNA, 15 bp, Homo sapiens
aatatttgtggactg

SEQ ID NO: 136213 - DNA, 15 bp, Homo sapiens
aaatatttgtggact

SEQ ID NO: 136214 - DNA, 15 bp, Homo sapiens
taaatatttgtggac

SEQ ID NO: 136215 - DNA, 15 bp, Homo sapiens
ataaatatttgtgga

SEQ ID NO: 136216 - DNA, 15 bp, Homo sapiens
aataaatatttgtgg

SEQ ID NO: 136217 - DNA, 15 bp, Homo sapiens
caataaatatttgtg

SEQ ID NO: 136218 - DNA, 15 bp, Homo sapiens
tcaataaatatttgt

SEQ ID NO: 136219 - DNA, 15 bp, Homo sapiens
gctcaataaatattt

SEQ ID NO: 136220 - DNA, 15 bp, Homo sapiens
tgctcaataaatatt

SEQ ID NO: 136221 - DNA, 15 bp, Homo sapiens
ttgctcaataaatat

SEQ ID NO: 136222 - DNA, 15 bp, Homo sapiens
gttgctcaataaata

SEQ ID NO: 136223 - DNA, 15 bp, Homo sapiens
tagttgctcaataaa

SEQ ID NO: 136224 - DNA, 15 bp, Homo sapiens
gtagttgctcaataa

SEQ ID NO: 136225 - DNA, 15 bp, Homo sapiens
agtagttgctcaata

SEQ ID NO: 136226 - DNA, 15 bp, Homo sapiens
tagtagttgctcaat

SEQ ID NO: 136227 - DNA, 15 bp, Homo sapiens
atagtagttgctcaa

SEQ ID NO: 136228 - DNA, 15 bp, Homo sapiens
catagtagttgctca

SEQ ID NO: 136229 - DNA, 15 bp, Homo sapiens
acatagtagttgctc

SEQ ID NO: 136230 - DNA, 15 bp, Homo sapiens
cacatagtagttgct

SEQ ID NO: 136231 - DNA, 15 bp, Homo sapiens
gcacatagtagttgc

SEQ ID NO: 136232 - DNA, 15 bp, Homo sapiens
agcacatagtagttg

SEQ ID NO: 136233 - DNA, 15 bp, Homo sapiens
aagcacatagtagtt

SEQ ID NO: 136234 - DNA, 15 bp, Homo sapiens
taagcacatagtagt

SEQ ID NO: 136235 - DNA, 15 bp, Homo sapiens
ataagcacatagtag

SEQ ID NO: 136236 - DNA, 15 bp, Homo sapiens
cataagcacatagta

SEQ ID NO: 136237 - DNA, 15 bp, Homo sapiens
acataagcacatagt

SEQ ID NO: 136238 - DNA, 15 bp, Homo sapiens
cacataagcacatag

SEQ ID NO: 136239 - DNA, 15 bp, Homo sapiens
tcacataagcacata

SEQ ID NO: 136240 - DNA, 15 bp, Homo sapiens
gtcacataagcacat

SEQ ID NO: 136241 - DNA, 15 bp, Homo sapiens
agtcacataagcaca

SEQ ID NO: 136242 - DNA, 15 bp, Homo sapiens
cagtcacataagcac

SEQ ID NO: 136243 - DNA, 15 bp, Homo sapiens
ccagtcacataagca

SEQ ID NO: 136244 - DNA, 15 bp, Homo sapiens
gccagtcacataagc

SEQ ID NO: 136245 - DNA, 15 bp, Homo sapiens
tgccagtcacataag

SEQ ID NO: 136246 - DNA, 15 bp, Homo sapiens
atgccagtcacataa

SEQ ID NO: 136247 - DNA, 15 bp, Homo sapiens
aatgccagtcacata

SEQ ID NO: 136248 - DNA, 15 bp, Homo sapiens
taatgccagtcacat

SEQ ID NO: 136249 - DNA, 15 bp, Homo sapiens
ttaatgccagtcaca

SEQ ID NO: 136250 - DNA, 15 bp, Homo sapiens
attaatgccagtcac

SEQ ID NO: 136251 - DNA, 15 bp, Homo sapiens
aattaatgccagtca

SEQ ID NO: 136252 - DNA, 15 bp, Homo sapiens
aaattaatgccagtc

SEQ ID NO: 136253 - DNA, 15 bp, Homo sapiens
caaattaatgccagt

SEQ ID NO: 136254 - DNA, 15 bp, Homo sapiens
ccaaattaatgccag

SEQ ID NO: 136255 - DNA, 15 bp, Homo sapiens
cccaaattaatgcca

SEQ ID NO: 136256 - DNA, 15 bp, Homo sapiens
ccccaaattaatgcc

SEQ ID NO: 136257 - DNA, 15 bp, Homo sapiens
tccccaaattaatgc

SEQ ID NO: 136258 - DNA, 15 bp, Homo sapiens
atccccaaattaatg

SEQ ID NO: 136259 - DNA, 15 bp, Homo sapiens
tatccccaaattaat

SEQ ID NO: 136260 - DNA, 15 bp, Homo sapiens
gtatccccaaattaa

SEQ ID NO: 136261 - DNA, 15 bp, Homo sapiens
agtatccccaaatta

SEQ ID NO: 136262 - DNA, 15 bp, Homo sapiens
aagtatccccaaatt

SEQ ID NO: 136263 - DNA, 15 bp, Homo sapiens
aaagtatccccaaat

SEQ ID NO: 136264 - DNA, 15 bp, Homo sapiens
taaagtatccccaaa

SEQ ID NO: 136265 - DNA, 15 bp, Homo sapiens
ctaaagtatccccaa

SEQ ID NO: 136266 - DNA, 15 bp, Homo sapiens
actaaagtatcccca

SEQ ID NO: 136267 - DNA, 15 bp, Homo sapiens
aactaaagtatcccc

SEQ ID NO: 136268 - DNA, 15 bp, Homo sapiens
taactaaagtatccc

SEQ ID NO: 136269 - DNA, 15 bp, Homo sapiens
ataactaaagtatcc

SEQ ID NO: 136270 - DNA, 15 bp, Homo sapiens
tataactaaagtatc

SEQ ID NO: 136271 - DNA, 15 bp, Homo sapiens
ttataactaaagtat

SEQ ID NO: 136272 - DNA, 15 bp, Homo sapiens
tttataactaaagta

SEQ ID NO: 136273 - DNA, 15 bp, Homo sapiens
tcatttataactaaa

SEQ ID NO: 136274 - DNA, 15 bp, Homo sapiens
ctcatttataactaa

SEQ ID NO: 136275 - DNA, 15 bp, Homo sapiens
tctcatttataacta

SEQ ID NO: 136276 - DNA, 15 bp, Homo sapiens
ctctcatttataact

SEQ ID NO: 136277 - DNA, 15 bp, Homo sapiens
tctctcatttataac

SEQ ID NO: 136278 - DNA, 15 bp, Homo sapiens
ttctctcatttataa

SEQ ID NO: 136279 - DNA, 15 bp, Homo sapiens
tttctctcatttata

SEQ ID NO: 136280 - DNA, 15 bp, Homo sapiens
ttttctctcatttat

SEQ ID NO: 136281 - DNA, 15 bp, Homo sapiens
gttttctctcattta

SEQ ID NO: 136282 - DNA, 15 bp, Homo sapiens
tgttttctctcattt

SEQ ID NO: 136283 - DNA, 15 bp, Homo sapiens
ttgttttctctcatt

SEQ ID NO: 136284 - DNA, 15 bp, Homo sapiens
gttgttttctctcat

SEQ ID NO: 136285 - DNA, 15 bp, Homo sapiens
tgttgttttctctca

SEQ ID NO: 136286 - DNA, 15 bp, Homo sapiens
ttgttgttttctctc

SEQ ID NO: 136287 - DNA, 15 bp, Homo sapiens
gttgttgttttctct

SEQ ID NO: 136288 - DNA, 15 bp, Homo sapiens
tgttgttgttttctc

SEQ ID NO: 136289 - DNA, 15 bp, Homo sapiens
ttgttgttgttttct

SEQ ID NO: 136290 - DNA, 15 bp, Homo sapiens
tttgttgttgttttc

SEQ ID NO: 136291 - DNA, 15 bp, Homo sapiens
ttttgttgttgtttt

SEQ ID NO: 136292 - DNA, 15 bp, Homo sapiens
tttttgttgttgttt

SEQ ID NO: 136293 - DNA, 15 bp, Homo sapiens
attttttgttgttgt

SEQ ID NO: 136294 - DNA, 15 bp, Homo sapiens
tattttttgttgttg

SEQ ID NO: 136295 - DNA, 15 bp, Homo sapiens
ttattttttgttgtt

SEQ ID NO: 136296 - DNA, 15 bp, Homo sapiens
tttattttttgttgt

SEQ ID NO: 136297 - DNA, 15 bp, Homo sapiens
gtttattttttgttg

SEQ ID NO: 136298 - DNA, 15 bp, Homo sapiens
tgtttattttttgtt

SEQ ID NO: 136299 - DNA, 15 bp, Homo sapiens
atgtttattttttgt

SEQ ID NO: 136300 - DNA, 15 bp, Homo sapiens
tatgtttattttttg

SEQ ID NO: 136301 - DNA, 15 bp, Homo sapiens
gtatgtttatttttt

SEQ ID NO: 136302 - DNA, 15 bp, Homo sapiens
tgtatgtttattttt

SEQ ID NO: 136303 - DNA, 15 bp, Homo sapiens
ttgtatgtttatttt

SEQ ID NO: 136304 - DNA, 15 bp, Homo sapiens
tttgtatgtttattt

SEQ ID NO: 136305 - DNA, 15 bp, Homo sapiens
ttttgtatgtttatt

SEQ ID NO: 136306 - DNA, 15 bp, Homo sapiens
gttttgtatgtttat

SEQ ID NO: 136307 - DNA, 15 bp, Homo sapiens
tgttttgtatgttta

SEQ ID NO: 136308 - DNA, 15 bp, Homo sapiens
ttgttttgtatgttt

SEQ ID NO: 136309 - DNA, 15 bp, Homo sapiens
attgttttgtatgtt

SEQ ID NO: 136310 - DNA, 15 bp, Homo sapiens
tattgttttgtatgt

SEQ ID NO: 136311 - DNA, 15 bp, Homo sapiens
ctattgttttgtatg

SEQ ID NO: 136312 - DNA, 15 bp, Homo sapiens
gctattgttttgtat

SEQ ID NO: 136313 - DNA, 15 bp, Homo sapiens
tgctattgttttgta

SEQ ID NO: 136314 - DNA, 15 bp, Homo sapiens
ttgctattgttttgt

SEQ ID NO: 136315 - DNA, 15 bp, Homo sapiens
tttgctattgttttg

SEQ ID NO: 136316 - DNA, 15 bp, Homo sapiens
gtttgctattgtttt

SEQ ID NO: 136317 - DNA, 15 bp, Homo sapiens
tgtttgctattgttt

SEQ ID NO: 136318 - DNA, 15 bp, Homo sapiens
ttgtttgctattgtt

SEQ ID NO: 136319 - DNA, 15 bp, Homo sapiens
tttgtttgctattgt

SEQ ID NO: 136320 - DNA, 15 bp, Homo sapiens
ctttgtttgctattg

SEQ ID NO: 136321 - DNA, 15 bp, Homo sapiens
tctttgtttgctatt

SEQ ID NO: 136322 - DNA, 15 bp, Homo sapiens
atctttgtttgctat

SEQ ID NO: 136323 - DNA, 15 bp, Homo sapiens
gatctttgtttgcta

SEQ ID NO: 136324 - DNA, 15 bp, Homo sapiens
ggatctttgtttgct

SEQ ID NO: 136325 - DNA, 15 bp, Homo sapiens
aggatctttgtttgc

SEQ ID NO: 136326 - DNA, 15 bp, Homo sapiens
aaggatctttgtttg

SEQ ID NO: 136327 - DNA, 15 bp, Homo sapiens
caaggatctttgttt

SEQ ID NO: 136328 - DNA, 15 bp, Homo sapiens
gcaaggatctttgtt

SEQ ID NO: 136329 - DNA, 15 bp, Homo sapiens
agcaaggatctttgt

SEQ ID NO: 136330 - DNA, 15 bp, Homo sapiens
aagcaaggatctttg

SEQ ID NO: 136331 - DNA, 15 bp, Homo sapiens
caagcaaggatcttt

SEQ ID NO: 136332 - DNA, 15 bp, Homo sapiens
ccaagcaaggatctt

SEQ ID NO: 136333 - DNA, 15 bp, Homo sapiens
cccaagcaaggatct

SEQ ID NO: 136334 - DNA, 15 bp, Homo sapiens
ccccaagcaaggatc

SEQ ID NO: 136335 - DNA, 15 bp, Homo sapiens
accccaagcaaggat

SEQ ID NO: 136336 - DNA, 15 bp, Homo sapiens
aaccccaagcaagga

SEQ ID NO: 136337 - DNA, 15 bp, Homo sapiens
aaaccccaagcaagg

SEQ ID NO: 136338 - DNA, 15 bp, Homo sapiens
caaaccccaagcaag

SEQ ID NO: 136339 - DNA, 15 bp, Homo sapiens
gcaaaccccaagcaa

SEQ ID NO: 136340 - DNA, 15 bp, Homo sapiens
tgcaaaccccaagca

SEQ ID NO: 136341 - DNA, 15 bp, Homo sapiens
atgcaaaccccaagc

SEQ ID NO: 136342 - DNA, 15 bp, Homo sapiens
aatgcaaaccccaag

SEQ ID NO: 136343 - DNA, 15 bp, Homo sapiens
gaatgcaaaccccaa

SEQ ID NO: 136344 - DNA, 15 bp, Homo sapiens
agaatgcaaacccca

SEQ ID NO: 136345 - DNA, 15 bp, Homo sapiens
tagaatgcaaacccc

SEQ ID NO: 136346 - DNA, 15 bp, Homo sapiens
ctagaatgcaaaccc

SEQ ID NO: 136347 - DNA, 15 bp, Homo sapiens
gctagaatgcaaacc

SEQ ID NO: 136348 - DNA, 15 bp, Homo sapiens
agctagaatgcaaac

SEQ ID NO: 136349 - DNA, 15 bp, Homo sapiens
gagctagaatgcaaa

SEQ ID NO: 136350 - DNA, 15 bp, Homo sapiens
tgagctagaatgcaa

SEQ ID NO: 136351 - DNA, 15 bp, Homo sapiens
ctgagctagaatgca

SEQ ID NO: 136352 - DNA, 15 bp, Homo sapiens
tctgagctagaatgc

SEQ ID NO: 136353 - DNA, 15 bp, Homo sapiens
ttctgagctagaatg

SEQ ID NO: 136354 - DNA, 15 bp, Homo sapiens
cttctgagctagaat

SEQ ID NO: 136355 - DNA, 15 bp, Homo sapiens
gcttctgagctagaa

SEQ ID NO: 136356 - DNA, 15 bp, Homo sapiens
tgcttctgagctaga

SEQ ID NO: 136357 - DNA, 15 bp, Homo sapiens
atgcttctgagctag

SEQ ID NO: 136358 - DNA, 15 bp, Homo sapiens
gatgcttctgagcta

SEQ ID NO: 136359 - DNA, 15 bp, Homo sapiens
agatgcttctgagct

SEQ ID NO: 136360 - DNA, 15 bp, Homo sapiens
tagatgcttctgagc

SEQ ID NO: 136361 - DNA, 15 bp, Homo sapiens
ctagatgcttctgag

SEQ ID NO: 136362 - DNA, 15 bp, Homo sapiens
cctagatgcttctga

SEQ ID NO: 136363 - DNA, 15 bp, Homo sapiens
acctagatgcttctg

SEQ ID NO: 136364 - DNA, 15 bp, Homo sapiens
aacctagatgcttct

SEQ ID NO: 136365 - DNA, 15 bp, Homo sapiens
gaacctagatgcttc

SEQ ID NO: 136366 - DNA, 15 bp, Homo sapiens
agaacctagatgctt

SEQ ID NO: 136367 - DNA, 15 bp, Homo sapiens
tagaacctagatgct

SEQ ID NO: 136368 - DNA, 15 bp, Homo sapiens
gtagaacctagatgc

SEQ ID NO: 136369 - DNA, 15 bp, Homo sapiens
tgtagaacctagatg

SEQ ID NO: 136370 - DNA, 15 bp, Homo sapiens
ttgtagaacctagat

SEQ ID NO: 136371 - DNA, 15 bp, Homo sapiens
tttgtagaacctaga

SEQ ID NO: 136372 - DNA, 15 bp, Homo sapiens
gtttgtagaacctag

SEQ ID NO: 136373 - DNA, 15 bp, Homo sapiens
ggtttgtagaaccta

SEQ ID NO: 136374 - DNA, 15 bp, Homo sapiens
gggtttgtagaacct

SEQ ID NO: 136375 - DNA, 15 bp, Homo sapiens
agggtttgtagaacc

SEQ ID NO: 136376 - DNA, 15 bp, Homo sapiens
aagggtttgtagaac

SEQ ID NO: 136377 - DNA, 15 bp, Homo sapiens
gaagggtttgtagaa

SEQ ID NO: 136378 - DNA, 15 bp, Homo sapiens
agaagggtttgtaga

SEQ ID NO: 136379 - DNA, 15 bp, Homo sapiens
aagaagggtttgtag

SEQ ID NO: 136380 - DNA, 15 bp, Homo sapiens
taagaagggtttgta

SEQ ID NO: 136381 - DNA, 15 bp, Homo sapiens
ctaagaagggtttgt

SEQ ID NO: 136382 - DNA, 15 bp, Homo sapiens
actaagaagggtttg

SEQ ID NO: 136383 - DNA, 15 bp, Homo sapiens
cactaagaagggttt

SEQ ID NO: 136384 - DNA, 15 bp, Homo sapiens
ccactaagaagggtt

SEQ ID NO: 136385 - DNA, 15 bp, Homo sapiens
cccactaagaagggt

SEQ ID NO: 136386 - DNA, 15 bp, Homo sapiens
tcccactaagaaggg

SEQ ID NO: 136387 - DNA, 15 bp, Homo sapiens
ttcccactaagaagg

SEQ ID NO: 136388 - DNA, 15 bp, Homo sapiens
attcccactaagaag

SEQ ID NO: 136389 - DNA, 15 bp, Homo sapiens
cattcccactaagaa

SEQ ID NO: 136390 - DNA, 15 bp, Homo sapiens
acattcccactaaga

SEQ ID NO: 136391 - DNA, 15 bp, Homo sapiens
tacattcccactaag

SEQ ID NO: 136392 - DNA, 15 bp, Homo sapiens
gtacattcccactaa

SEQ ID NO: 136393 - DNA, 15 bp, Homo sapiens
agtacattcccacta

SEQ ID NO: 136394 - DNA, 15 bp, Homo sapiens
tagtacattcccact

SEQ ID NO: 136395 - DNA, 15 bp, Homo sapiens
gtagtacattcccac

SEQ ID NO: 136396 - DNA, 15 bp, Homo sapiens
ggtagtacattccca

SEQ ID NO: 136397 - DNA, 15 bp, Homo sapiens
tggtagtacattccc

SEQ ID NO: 136398 - DNA, 15 bp, Homo sapiens
ttggtagtacattcc

SEQ ID NO: 136399 - DNA, 15 bp, Homo sapiens
attggtagtacattc

SEQ ID NO: 136400 - DNA, 15 bp, Homo sapiens
tattggtagtacatt

SEQ ID NO: 136401 - DNA, 15 bp, Homo sapiens
ctattggtagtacat

SEQ ID NO: 136402 - DNA, 15 bp, Homo sapiens
gctattggtagtaca

SEQ ID NO: 136403 - DNA, 15 bp, Homo sapiens
tgctattggtagtac

SEQ ID NO: 136404 - DNA, 15 bp, Homo sapiens
ttgctattggtagta

SEQ ID NO: 136405 - DNA, 15 bp, Homo sapiens
tttgctattggtagt

SEQ ID NO: 136406 - DNA, 15 bp, Homo sapiens
gtttgctattggtag

SEQ ID NO: 136407 - DNA, 15 bp, Homo sapiens
cgtttgctattggta

SEQ ID NO: 136408 - DNA, 15 bp, Homo sapiens
tcgtttgctattggt

SEQ ID NO: 136409 - DNA, 15 bp, Homo sapiens
ttcgtttgctattgg

SEQ ID NO: 136410 - DNA, 15 bp, Homo sapiens
cttcgtttgctattg

SEQ ID NO: 136411 - DNA, 15 bp, Homo sapiens
acttcgtttgctatt

SEQ ID NO: 136412 - DNA, 15 bp, Homo sapiens
gacttcgtttgctat

SEQ ID NO: 136413 - DNA, 15 bp, Homo sapiens
agacttcgtttgcta

SEQ ID NO: 136414 - DNA, 15 bp, Homo sapiens
tagacttcgtttgct

SEQ ID NO: 136415 - DNA, 15 bp, Homo sapiens
ttagacttcgtttgc

SEQ ID NO: 136416 - DNA, 15 bp, Homo sapiens
tttagacttcgtttg

SEQ ID NO: 136417 - DNA, 15 bp, Homo sapiens
atttagacttcgttt

SEQ ID NO: 136418 - DNA, 15 bp, Homo sapiens
aatttagacttcgtt

SEQ ID NO: 136419 - DNA, 15 bp, Homo sapiens
gaatttagacttcgt

SEQ ID NO: 136420 - DNA, 15 bp, Homo sapiens
agaatttagacttcg

SEQ ID NO: 136421 - DNA, 15 bp, Homo sapiens
gagaatttagacttc

SEQ ID NO: 136422 - DNA, 15 bp, Homo sapiens
tgagaatttagactt

SEQ ID NO: 136423 - DNA, 15 bp, Homo sapiens
ttgagaatttagact

SEQ ID NO: 136424 - DNA, 15 bp, Homo sapiens
cttgagaatttagac

SEQ ID NO: 136425 - DNA, 15 bp, Homo sapiens
tcttgagaatttaga

SEQ ID NO: 136426 - DNA, 15 bp, Homo sapiens
ctcttgagaatttag

SEQ ID NO: 136427 - DNA, 15 bp, Homo sapiens
actcttgagaattta

SEQ ID NO: 136428 - DNA, 15 bp, Homo sapiens
cactcttgagaattt

SEQ ID NO: 136429 - DNA, 15 bp, Homo sapiens
tcactcttgagaatt

SEQ ID NO: 136430 - DNA, 15 bp, Homo sapiens
gtcactcttgagaat

SEQ ID NO: 136431 - DNA, 15 bp, Homo sapiens
tgtcactcttgagaa

SEQ ID NO: 136432 - DNA, 15 bp, Homo sapiens
gtgtcactcttgaga

SEQ ID NO: 136433 - DNA, 15 bp, Homo sapiens
ggtgtcactcttgag

SEQ ID NO: 136434 - DNA, 15 bp, Homo sapiens
aggtgtcactcttga

SEQ ID NO: 136435 - DNA, 15 bp, Homo sapiens
taggtgtcactcttg

SEQ ID NO: 136436 - DNA, 15 bp, Homo sapiens
ctaggtgtcactctt

SEQ ID NO: 136437 - DNA, 15 bp, Homo sapiens
cctaggtgtcactct

SEQ ID NO: 136438 - DNA, 15 bp, Homo sapiens
ccctaggtgtcactc

SEQ ID NO: 136439 - DNA, 15 bp, Homo sapiens
tccctaggtgtcact

SEQ ID NO: 136440 - DNA, 15 bp, Homo sapiens
atccctaggtgtcac

SEQ ID NO: 136441 - DNA, 15 bp, Homo sapiens
aatccctaggtgtca

SEQ ID NO: 136442 - DNA, 15 bp, Homo sapiens
caatccctaggtgtc

SEQ ID NO: 136443 - DNA, 15 bp, Homo sapiens
acaatccctaggtgt

SEQ ID NO: 136444 - DNA, 15 bp, Homo sapiens
gacaatccctaggtg

SEQ ID NO: 136445 - DNA, 15 bp, Homo sapiens
tgacaatccctaggt

SEQ ID NO: 136446 - DNA, 15 bp, Homo sapiens
gtgacaatccctagg

SEQ ID NO: 136447 - DNA, 15 bp, Homo sapiens
tgtgacaatccctag

SEQ ID NO: 136448 - DNA, 15 bp, Homo sapiens
ttgtgacaatcccta

SEQ ID NO: 136449 - DNA, 15 bp, Homo sapiens
attgtgacaatccct

SEQ ID NO: 136450 - DNA, 15 bp, Homo sapiens
gattgtgacaatccc

SEQ ID NO: 136451 - DNA, 15 bp, Homo sapiens
agattgtgacaatcc

SEQ ID NO: 136452 - DNA, 15 bp, Homo sapiens
cagattgtgacaatc

SEQ ID NO: 136453 - DNA, 15 bp, Homo sapiens
gcagattgtgacaat

SEQ ID NO: 136454 - DNA, 15 bp, Homo sapiens
agcagattgtgacaa

SEQ ID NO: 136455 - DNA, 15 bp, Homo sapiens
cagcagattgtgaca

SEQ ID NO: 136456 - DNA, 15 bp, Homo sapiens
gcagcagattgtgac

SEQ ID NO: 136457 - DNA, 15 bp, Homo sapiens
ggcagcagattgtga

SEQ ID NO: 136458 - DNA, 15 bp, Homo sapiens
tggcagcagattgtg

SEQ ID NO: 136459 - DNA, 15 bp, Homo sapiens
gtggcagcagattgt

SEQ ID NO: 136460 - DNA, 15 bp, Homo sapiens
agtggcagcagattg

SEQ ID NO: 136461 - DNA, 15 bp, Homo sapiens
tagtggcagcagatt

SEQ ID NO: 136462 - DNA, 15 bp, Homo sapiens
gtagtggcagcagat

SEQ ID NO: 136463 - DNA, 15 bp, Homo sapiens
ggtagtggcagcaga

SEQ ID NO: 136464 - DNA, 15 bp, Homo sapiens
gggtagtggcagcag

SEQ ID NO: 136465 - DNA, 15 bp, Homo sapiens
ggggtagtggcagca

SEQ ID NO: 136466 - DNA, 15 bp, Homo sapiens
aggggtagtggcagc

SEQ ID NO: 136467 - DNA, 15 bp, Homo sapiens
aaggggtagtggcag

SEQ ID NO: 136468 - DNA, 15 bp, Homo sapiens
aaaggggtagtggca

SEQ ID NO: 136469 - DNA, 15 bp, Homo sapiens
aaaaggggtagtggc

SEQ ID NO: 136470 - DNA, 15 bp, Homo sapiens
gaaaaggggtagtgg

SEQ ID NO: 136471 - DNA, 15 bp, Homo sapiens
agaaaaggggtagtg

SEQ ID NO: 136472 - DNA, 15 bp, Homo sapiens
gagaaaaggggtagt

SEQ ID NO: 136473 - DNA, 15 bp, Homo sapiens
tgagaaaaggggtag

SEQ ID NO: 136474 - DNA, 15 bp, Homo sapiens
gtgagaaaaggggta

SEQ ID NO: 136475 - DNA, 15 bp, Homo sapiens
agtgagaaaaggggt

SEQ ID NO: 136476 - DNA, 15 bp, Homo sapiens
aagtgagaaaagggg

SEQ ID NO: 136477 - DNA, 15 bp, Homo sapiens
gaagtgagaaaaggg

SEQ ID NO: 136478 - DNA, 15 bp, Homo sapiens
tgaagtgagaaaagg

SEQ ID NO: 136479 - DNA, 15 bp, Homo sapiens
ctgaagtgagaaaag

SEQ ID NO: 136480 - DNA, 15 bp, Homo sapiens
gctgaagtgagaaaa

SEQ ID NO: 136481 - DNA, 15 bp, Homo sapiens
ggctgaagtgagaaa

SEQ ID NO: 136482 - DNA, 15 bp, Homo sapiens
gggctgaagtgagaa

SEQ ID NO: 136483 - DNA, 15 bp, Homo sapiens
agggctgaagtgaga

SEQ ID NO: 136484 - DNA, 15 bp, Homo sapiens
gagggctgaagtgag

SEQ ID NO: 136485 - DNA, 15 bp, Homo sapiens
tgagggctgaagtga

SEQ ID NO: 136486 - DNA, 15 bp, Homo sapiens
ctgagggctgaagtg

SEQ ID NO: 136487 - DNA, 15 bp, Homo sapiens
gctgagggctgaagt

SEQ ID NO: 136488 - DNA, 15 bp, Homo sapiens
ggctgagggctgaag

SEQ ID NO: 136489 - DNA, 15 bp, Homo sapiens
gggctgagggctgaa

SEQ ID NO: 136490 - DNA, 15 bp, Homo sapiens
cgggctgagggctga

SEQ ID NO: 136491 - DNA, 15 bp, Homo sapiens
ccgggctgagggctg

SEQ ID NO: 136492 - DNA, 15 bp, Homo sapiens
gccgggctgagggct

SEQ ID NO: 136493 - DNA, 15 bp, Homo sapiens
ggccgggctgagggc

SEQ ID NO: 136494 - DNA, 15 bp, Homo sapiens
aggccgggctgaggg

SEQ ID NO: 136495 - DNA, 15 bp, Homo sapiens
caggccgggctgagg

SEQ ID NO: 136496 - DNA, 15 bp, Homo sapiens
acaggccgggctgag

SEQ ID NO: 136497 - DNA, 15 bp, Homo sapiens
tacaggccgggctga

SEQ ID NO: 136498 - DNA, 15 bp, Homo sapiens
ttacaggccgggctg

SEQ ID NO: 136499 - DNA, 15 bp, Homo sapiens
attacaggccgggct

SEQ ID NO: 136500 - DNA, 15 bp, Homo sapiens
aattacaggccgggc

SEQ ID NO: 136501 - DNA, 15 bp, Homo sapiens
taattacaggccggg

SEQ ID NO: 136502 - DNA, 15 bp, Homo sapiens
ataattacaggccgg

SEQ ID NO: 136503 - DNA, 15 bp, Homo sapiens
cataattacaggccg

SEQ ID NO: 136504 - DNA, 15 bp, Homo sapiens
gcataattacaggcc

SEQ ID NO: 136505 - DNA, 15 bp, Homo sapiens
agcataattacaggc

SEQ ID NO: 136506 - DNA, 15 bp, Homo sapiens
cagcataattacagg

SEQ ID NO: 136507 - DNA, 15 bp, Homo sapiens
acagcataattacag

SEQ ID NO: 136508 - DNA, 15 bp, Homo sapiens
aacagcataattaca

SEQ ID NO: 136509 - DNA, 15 bp, Homo sapiens
taacagcataattac

SEQ ID NO: 136510 - DNA, 15 bp, Homo sapiens
ataacagcataatta

SEQ ID NO: 136511 - DNA, 15 bp, Homo sapiens
aataacagcataatt

SEQ ID NO: 136512 - DNA, 15 bp, Homo sapiens
gaataacagcataat

SEQ ID NO: 136513 - DNA, 15 bp, Homo sapiens
ggaataacagcataa

SEQ ID NO: 136514 - DNA, 15 bp, Homo sapiens
aggaataacagcata

SEQ ID NO: 136515 - DNA, 15 bp, Homo sapiens
aaggaataacagcat

SEQ ID NO: 136516 - DNA, 15 bp, Homo sapiens
taaggaataacagca

SEQ ID NO: 136517 - DNA, 15 bp, Homo sapiens
ttaaggaataacagc

SEQ ID NO: 136518 - DNA, 15 bp, Homo sapiens
tttaaggaataacag

SEQ ID NO: 136519 - DNA, 15 bp, Homo sapiens
ttttaaggaataaca

SEQ ID NO: 136520 - DNA, 15 bp, Homo sapiens
attttaaggaataac

SEQ ID NO: 136521 - DNA, 15 bp, Homo sapiens
tattttaaggaataa

SEQ ID NO: 136522 - DNA, 15 bp, Homo sapiens
atattttaaggaata

SEQ ID NO: 136523 - DNA, 15 bp, Homo sapiens
gatattttaaggaat

SEQ ID NO: 136524 - DNA, 15 bp, Homo sapiens
ggatattttaaggaa

SEQ ID NO: 136525 - DNA, 15 bp, Homo sapiens
aggatattttaagga

SEQ ID NO: 136526 - DNA, 15 bp, Homo sapiens
caggatattttaagg

SEQ ID NO: 136527 - DNA, 15 bp, Homo sapiens
tcaggatattttaag

SEQ ID NO: 136528 - DNA, 15 bp, Homo sapiens
gtcaggatattttaa

SEQ ID NO: 136529 - DNA, 15 bp, Homo sapiens
tgtcaggatatttta

SEQ ID NO: 136530 - DNA, 15 bp, Homo sapiens
atgtcaggatatttt

SEQ ID NO: 136531 - DNA, 15 bp, Homo sapiens
aatgtcaggatattt

SEQ ID NO: 136532 - DNA, 15 bp, Homo sapiens
aaatgtcaggatatt

SEQ ID NO: 136533 - DNA, 15 bp, Homo sapiens
gaaatgtcaggatat

SEQ ID NO: 136534 - DNA, 15 bp, Homo sapiens
ggaaatgtcaggata

SEQ ID NO: 136535 - DNA, 15 bp, Homo sapiens
aggaaatgtcaggat

SEQ ID NO: 136536 - DNA, 15 bp, Homo sapiens
taggaaatgtcagga

SEQ ID NO: 136537 - DNA, 15 bp, Homo sapiens
ctaggaaatgtcagg

SEQ ID NO: 136538 - DNA, 15 bp, Homo sapiens
actaggaaatgtcag

SEQ ID NO: 136539 - DNA, 15 bp, Homo sapiens
gactaggaaatgtca

SEQ ID NO: 136540 - DNA, 15 bp, Homo sapiens
agactaggaaatgtc

SEQ ID NO: 136541 - DNA, 15 bp, Homo sapiens
aagactaggaaatgt

SEQ ID NO: 136542 - DNA, 15 bp, Homo sapiens
gaagactaggaaatg

SEQ ID NO: 136543 - DNA, 15 bp, Homo sapiens
agaagactaggaaat

SEQ ID NO: 136544 - DNA, 15 bp, Homo sapiens
aagaagactaggaaa

SEQ ID NO: 136545 - DNA, 15 bp, Homo sapiens
taagaagactaggaa

SEQ ID NO: 136546 - DNA, 15 bp, Homo sapiens
gtaagaagactagga

SEQ ID NO: 136547 - DNA, 15 bp, Homo sapiens
ggtaagaagactagg

SEQ ID NO: 136548 - DNA, 15 bp, Homo sapiens
aggtaagaagactag

SEQ ID NO: 136549 - DNA, 15 bp, Homo sapiens
aaggtaagaagacta

SEQ ID NO: 136550 - DNA, 15 bp, Homo sapiens
aaaggtaagaagact

SEQ ID NO: 136551 - DNA, 15 bp, Homo sapiens
taaaggtaagaagac

SEQ ID NO: 136552 - DNA, 15 bp, Homo sapiens
ataaaggtaagaaga

SEQ ID NO: 136553 - DNA, 15 bp, Homo sapiens
aataaaggtaagaag

SEQ ID NO: 136554 - DNA, 15 bp, Homo sapiens
aaataaaggtaagaa

SEQ ID NO: 136555 - DNA, 15 bp, Homo sapiens
caaataaaggtaaga

SEQ ID NO: 136556 - DNA, 15 bp, Homo sapiens
gcaaataaaggtaag

SEQ ID NO: 136557 - DNA, 15 bp, Homo sapiens
tgcaaataaaggtaa

SEQ ID NO: 136558 - DNA, 15 bp, Homo sapiens
atgcaaataaaggta

SEQ ID NO: 136559 - DNA, 15 bp, Homo sapiens
aatgcaaataaaggt

SEQ ID NO: 136560 - DNA, 15 bp, Homo sapiens
taatgcaaataaagg

SEQ ID NO: 136561 - DNA, 15 bp, Homo sapiens
ataatgcaaataaag

SEQ ID NO: 136562 - DNA, 15 bp, Homo sapiens
aataatgcaaataaa

SEQ ID NO: 136563 - DNA, 15 bp, Homo sapiens
aaataatgcaaataa

SEQ ID NO: 136564 - DNA, 15 bp, Homo sapiens
aaaataatgcaaata

SEQ ID NO: 136565 - DNA, 15 bp, Homo sapiens
taaaataatgcaaat

SEQ ID NO: 136566 - DNA, 15 bp, Homo sapiens
ataaaataatgcaaa

SEQ ID NO: 136567 - DNA, 15 bp, Homo sapiens
aataaaataatgcaa

SEQ ID NO: 136568 - DNA, 15 bp, Homo sapiens
aaataaaataatgca

SEQ ID NO: 136569 - DNA, 15 bp, Homo sapiens
gaaataaaataatgc

SEQ ID NO: 136570 - DNA, 15 bp, Homo sapiens
agaaataaaataatg

SEQ ID NO: 136571 - DNA, 15 bp, Homo sapiens
gagaaataaaataat

SEQ ID NO: 136572 - DNA, 15 bp, Homo sapiens
agagaaataaaataa

SEQ ID NO: 136573 - DNA, 15 bp, Homo sapiens
aagagaaataaaata

SEQ ID NO: 136574 - DNA, 15 bp, Homo sapiens
caagagaaataaaat

SEQ ID NO: 136575 - DNA, 15 bp, Homo sapiens
ccaagagaaataaaa

SEQ ID NO: 136576 - DNA, 15 bp, Homo sapiens
gccaagagaaataaa

SEQ ID NO: 136577 - DNA, 15 bp, Homo sapiens
ggccaagagaaataa

SEQ ID NO: 136578 - DNA, 15 bp, Homo sapiens
aggccaagagaaata

SEQ ID NO: 136579 - DNA, 15 bp, Homo sapiens
aaggccaagagaaat

SEQ ID NO: 136580 - DNA, 15 bp, Homo sapiens
aaaggccaagagaaa

SEQ ID NO: 136581 - DNA, 15 bp, Homo sapiens
aaaaggccaagagaa

SEQ ID NO: 136582 - DNA, 15 bp, Homo sapiens
gaaaaggccaagaga

SEQ ID NO: 136583 - DNA, 15 bp, Homo sapiens
agaaaaggccaagag

SEQ ID NO: 136584 - DNA, 15 bp, Homo sapiens
aagaaaaggccaaga

SEQ ID NO: 136585 - DNA, 15 bp, Homo sapiens
gaagaaaaggccaag

SEQ ID NO: 136586 - DNA, 15 bp, Homo sapiens
ggaagaaaaggccaa

SEQ ID NO: 136587 - DNA, 15 bp, Homo sapiens
gggaagaaaaggcca

SEQ ID NO: 136588 - DNA, 15 bp, Homo sapiens
tgggaagaaaaggcc

SEQ ID NO: 136589 - DNA, 15 bp, Homo sapiens
ctgggaagaaaaggc

SEQ ID NO: 136590 - DNA, 15 bp, Homo sapiens
cctgggaagaaaagg

SEQ ID NO: 136591 - DNA, 15 bp, Homo sapiens
acctgggaagaaaag

SEQ ID NO: 136592 - DNA, 15 bp, Homo sapiens
cacctgggaagaaaa

SEQ ID NO: 136593 - DNA, 15 bp, Homo sapiens
gcacctgggaagaaa

SEQ ID NO: 136594 - DNA, 15 bp, Homo sapiens
tgcacctgggaagaa

SEQ ID NO: 136595 - DNA, 15 bp, Homo sapiens
ttgcacctgggaaga

SEQ ID NO: 136596 - DNA, 15 bp, Homo sapiens
attgcacctgggaag

SEQ ID NO: 136597 - DNA, 15 bp, Homo sapiens
aattgcacctgggaa

SEQ ID NO: 136598 - DNA, 15 bp, Homo sapiens
gaattgcacctggga

SEQ ID NO: 136599 - DNA, 15 bp, Homo sapiens
agaattgcacctggg

SEQ ID NO: 136600 - DNA, 15 bp, Homo sapiens
tagaattgcacctgg

SEQ ID NO: 136601 - DNA, 15 bp, Homo sapiens
gtagaattgcacctg

SEQ ID NO: 136602 - DNA, 15 bp, Homo sapiens
cgtagaattgcacct

SEQ ID NO: 136603 - DNA, 15 bp, Homo sapiens
gcgtagaattgcacc

SEQ ID NO: 136604 - DNA, 15 bp, Homo sapiens
tgcgtagaattgcac

SEQ ID NO: 136605 - DNA, 15 bp, Homo sapiens
ctgcgtagaattgca

SEQ ID NO: 136606 - DNA, 15 bp, Homo sapiens
gctgcgtagaattgc

SEQ ID NO: 136607 - DNA, 15 bp, Homo sapiens
tgctgcgtagaattg

SEQ ID NO: 136608 - DNA, 15 bp, Homo sapiens
ctgctgcgtagaatt

SEQ ID NO: 136609 - DNA, 15 bp, Homo sapiens
gctgctgcgtagaat

SEQ ID NO: 136610 - DNA, 15 bp, Homo sapiens
agctgctgcgtagaa

SEQ ID NO: 136611 - DNA, 15 bp, Homo sapiens
tagctgctgcgtaga

SEQ ID NO: 136612 - DNA, 15 bp, Homo sapiens
ttagctgctgcgtag

SEQ ID NO: 136613 - DNA, 15 bp, Homo sapiens
tttagctgctgcgta

SEQ ID NO: 136614 - DNA, 15 bp, Homo sapiens
ttttagctgctgcgt

SEQ ID NO: 136615 - DNA, 15 bp, Homo sapiens
attttagctgctgcg

SEQ ID NO: 136616 - DNA, 15 bp, Homo sapiens
cattttagctgctgc

SEQ ID NO: 136617 - DNA, 15 bp, Homo sapiens
acattttagctgctg

SEQ ID NO: 136618 - DNA, 15 bp, Homo sapiens
gacattttagctgct

SEQ ID NO: 136619 - DNA, 15 bp, Homo sapiens
tgacattttagctgc

SEQ ID NO: 136620 - DNA, 15 bp, Homo sapiens
atgacattttagctg

SEQ ID NO: 136621 - DNA, 15 bp, Homo sapiens
gatgacattttagct

SEQ ID NO: 136622 - DNA, 15 bp, Homo sapiens
ggatgacattttagc

SEQ ID NO: 136623 - DNA, 15 bp, Homo sapiens
gggatgacattttag

SEQ ID NO: 136624 - DNA, 15 bp, Homo sapiens
ggggatgacatttta

SEQ ID NO: 136625 - DNA, 15 bp, Homo sapiens
aggggatgacatttt

SEQ ID NO: 136626 - DNA, 15 bp, Homo sapiens
aaggggatgacattt

SEQ ID NO: 136627 - DNA, 15 bp, Homo sapiens
aaaggggatgacatt

SEQ ID NO: 136628 - DNA, 15 bp, Homo sapiens
caaaggggatgacat

SEQ ID NO: 136629 - DNA, 15 bp, Homo sapiens
acaaaggggatgaca

SEQ ID NO: 136630 - DNA, 15 bp, Homo sapiens
cacaaaggggatgac

SEQ ID NO: 136631 - DNA, 15 bp, Homo sapiens
tcacaaaggggatga

SEQ ID NO: 136632 - DNA, 15 bp, Homo sapiens
gtcacaaaggggatg

SEQ ID NO: 136633 - DNA, 15 bp, Homo sapiens
tgtcacaaaggggat

SEQ ID NO: 136634 - DNA, 15 bp, Homo sapiens
atgtcacaaagggga

SEQ ID NO: 136635 - DNA, 15 bp, Homo sapiens
gatgtcacaaagggg

SEQ ID NO: 136636 - DNA, 15 bp, Homo sapiens
agatgtcacaaaggg

SEQ ID NO: 136637 - DNA, 15 bp, Homo sapiens
aagatgtcacaaagg

SEQ ID NO: 136638 - DNA, 15 bp, Homo sapiens
aaagatgtcacaaag

SEQ ID NO: 136639 - DNA, 15 bp, Homo sapiens
gaaagatgtcacaaa

SEQ ID NO: 136640 - DNA, 15 bp, Homo sapiens
ggaaagatgtcacaa

SEQ ID NO: 136641 - DNA, 15 bp, Homo sapiens
gggaaagatgtcaca

SEQ ID NO: 136642 - DNA, 15 bp, Homo sapiens
agggaaagatgtcac

SEQ ID NO: 136643 - DNA, 15 bp, Homo sapiens
gagggaaagatgtca

SEQ ID NO: 136644 - DNA, 15 bp, Homo sapiens
ggagggaaagatgtc

SEQ ID NO: 136645 - DNA, 15 bp, Homo sapiens
aggagggaaagatgt

SEQ ID NO: 136646 - DNA, 15 bp, Homo sapiens
gaggagggaaagatg

SEQ ID NO: 136647 - DNA, 15 bp, Homo sapiens
agaggagggaaagat

SEQ ID NO: 136648 - DNA, 15 bp, Homo sapiens
aagaggagggaaaga

SEQ ID NO: 136649 - DNA, 15 bp, Homo sapiens
gaagaggagggaaag

SEQ ID NO: 136650 - DNA, 15 bp, Homo sapiens
agaagaggagggaaa

SEQ ID NO: 136651 - DNA, 15 bp, Homo sapiens
cagaagaggagggaa

SEQ ID NO: 136652 - DNA, 15 bp, Homo sapiens
ccagaagaggaggga

SEQ ID NO: 136653 - DNA, 15 bp, Homo sapiens
accagaagaggaggg

SEQ ID NO: 136654 - DNA, 15 bp, Homo sapiens
gaccagaagaggagg

SEQ ID NO: 136655 - DNA, 15 bp, Homo sapiens
ggaccagaagaggag

SEQ ID NO: 136656 - DNA, 15 bp, Homo sapiens
gggaccagaagagga

SEQ ID NO: 136657 - DNA, 15 bp, Homo sapiens
agggaccagaagagg

SEQ ID NO: 136658 - DNA, 15 bp, Homo sapiens
cagggaccagaagag

SEQ ID NO: 136659 - DNA, 15 bp, Homo sapiens
ccagggaccagaaga

SEQ ID NO: 136660 - DNA, 15 bp, Homo sapiens
accagggaccagaag

SEQ ID NO: 136661 - DNA, 15 bp, Homo sapiens
caccagggaccagaa

SEQ ID NO: 136662 - DNA, 15 bp, Homo sapiens
tcaccagggaccaga

SEQ ID NO: 136663 - DNA, 15 bp, Homo sapiens
ttcaccagggaccag

SEQ ID NO: 136664 - DNA, 15 bp, Homo sapiens
attcaccagggacca

SEQ ID NO: 136665 - DNA, 15 bp, Homo sapiens
cattcaccagggacc

SEQ ID NO: 136666 - DNA, 15 bp, Homo sapiens
acattcaccagggac

SEQ ID NO: 136667 - DNA, 15 bp, Homo sapiens
aacattcaccaggga

SEQ ID NO: 136668 - DNA, 15 bp, Homo sapiens
taacattcaccaggg

SEQ ID NO: 136669 - DNA, 15 bp, Homo sapiens
ttaacattcaccagg

SEQ ID NO: 136670 - DNA, 15 bp, Homo sapiens
attaacattcaccag

SEQ ID NO: 136671 - DNA, 15 bp, Homo sapiens
aattaacattcacca

SEQ ID NO: 136672 - DNA, 15 bp, Homo sapiens
aaattaacattcacc

SEQ ID NO: 136673 - DNA, 15 bp, Homo sapiens
gaaattaacattcac

SEQ ID NO: 136674 - DNA, 15 bp, Homo sapiens
agaaattaacattca

SEQ ID NO: 136675 - DNA, 15 bp, Homo sapiens
tagaaattaacattc

SEQ ID NO: 136676 - DNA, 15 bp, Homo sapiens
atagaaattaacatt

SEQ ID NO: 136677 - DNA, 15 bp, Homo sapiens
aatagaaattaacat

SEQ ID NO: 136678 - DNA, 15 bp, Homo sapiens
aaatagaaattaaca

SEQ ID NO: 136679 - DNA, 15 bp, Homo sapiens
aaaatagaaattaac

SEQ ID NO: 136680 - DNA, 15 bp, Homo sapiens
aaaaatagaaattaa

SEQ ID NO: 136681 - DNA, 15 bp, Homo sapiens
taaaaatagaaatta

SEQ ID NO: 136682 - DNA, 15 bp, Homo sapiens
ctaaaaatagaaatt

SEQ ID NO: 136683 - DNA, 15 bp, Homo sapiens
actaaaaatagaaat

SEQ ID NO: 136684 - DNA, 15 bp, Homo sapiens
aactaaaaatagaaa

SEQ ID NO: 136685 - DNA, 15 bp, Homo sapiens
gaactaaaaatagaa

SEQ ID NO: 136686 - DNA, 15 bp, Homo sapiens
ggaactaaaaataga

SEQ ID NO: 136687 - DNA, 15 bp, Homo sapiens
aggaactaaaaatag

SEQ ID NO: 136688 - DNA, 15 bp, Homo sapiens
aaggaactaaaaata

SEQ ID NO: 136689 - DNA, 15 bp, Homo sapiens
gaaggaactaaaaat

SEQ ID NO: 136690 - DNA, 15 bp, Homo sapiens
agaaggaactaaaaa

SEQ ID NO: 136691 - DNA, 15 bp, Homo sapiens
tagaaggaactaaaa

SEQ ID NO: 136692 - DNA, 15 bp, Homo sapiens
atagaaggaactaaa

SEQ ID NO: 136693 - DNA, 15 bp, Homo sapiens
catagaaggaactaa

SEQ ID NO: 136694 - DNA, 15 bp, Homo sapiens
ccatagaaggaacta

SEQ ID NO: 136695 - DNA, 15 bp, Homo sapiens
gccatagaaggaact

SEQ ID NO: 136696 - DNA, 15 bp, Homo sapiens
ggccatagaaggaac

SEQ ID NO: 136697 - DNA, 15 bp, Homo sapiens
aggccatagaaggaa

SEQ ID NO: 136698 - DNA, 15 bp, Homo sapiens
aaggccatagaagga

SEQ ID NO: 136699 - DNA, 15 bp, Homo sapiens
aaaggccatagaagg

SEQ ID NO: 136700 - DNA, 15 bp, Homo sapiens
gaaaggccatagaag

SEQ ID NO: 136701 - DNA, 15 bp, Homo sapiens
ggaaaggccatagaa

SEQ ID NO: 136702 - DNA, 15 bp, Homo sapiens
gggaaaggccataga

SEQ ID NO: 136703 - DNA, 15 bp, Homo sapiens
ggggaaaggccatag

SEQ ID NO: 136704 - DNA, 15 bp, Homo sapiens
gggggaaaggccata

SEQ ID NO: 136705 - DNA, 15 bp, Homo sapiens
ggggggaaaggccat

SEQ ID NO: 136706 - DNA, 15 bp, Homo sapiens
tggggggaaaggcca

SEQ ID NO: 136707 - DNA, 15 bp, Homo sapiens
atggggggaaaggcc

SEQ ID NO: 136708 - DNA, 15 bp, Homo sapiens
aatggggggaaaggc

SEQ ID NO: 136709 - DNA, 15 bp, Homo sapiens
caatggggggaaagg

SEQ ID NO: 136710 - DNA, 15 bp, Homo sapiens
gcaatggggggaaag

SEQ ID NO: 136711 - DNA, 15 bp, Homo sapiens
agcaatggggggaaa

SEQ ID NO: 136712 - DNA, 15 bp, Homo sapiens
aagcaatggggggaa

SEQ ID NO: 136713 - DNA, 15 bp, Homo sapiens
aaagcaatgggggga

SEQ ID NO: 136714 - DNA, 15 bp, Homo sapiens
taaagcaatgggggg

SEQ ID NO: 136715 - DNA, 15 bp, Homo sapiens
ataaagcaatggggg

SEQ ID NO: 136716 - DNA, 15 bp, Homo sapiens
aataaagcaatgggg

SEQ ID NO: 136717 - DNA, 15 bp, Homo sapiens
taataaagcaatggg

SEQ ID NO: 136718 - DNA, 15 bp, Homo sapiens
ataataaagcaatgg

SEQ ID NO: 136719 - DNA, 15 bp, Homo sapiens
tataataaagcaatg

SEQ ID NO: 136720 - DNA, 15 bp, Homo sapiens
ctataataaagcaat

SEQ ID NO: 136721 - DNA, 15 bp, Homo sapiens
tctataataaagcaa

SEQ ID NO: 136722 - DNA, 15 bp, Homo sapiens
atctataataaagca

SEQ ID NO: 136723 - DNA, 15 bp, Homo sapiens
gatctataataaagc

SEQ ID NO: 136724 - DNA, 15 bp, Homo sapiens
agatctataataaag

SEQ ID NO: 136725 - DNA, 15 bp, Homo sapiens
aagatctataataaa

SEQ ID NO: 136726 - DNA, 15 bp, Homo sapiens
taagatctataataa

SEQ ID NO: 136727 - DNA, 15 bp, Homo sapiens
gtaagatctataata

SEQ ID NO: 136728 - DNA, 15 bp, Homo sapiens
tgtaagatctataat

SEQ ID NO: 136729 - DNA, 15 bp, Homo sapiens
ttgtaagatctataa

SEQ ID NO: 136730 - DNA, 15 bp, Homo sapiens
gttgtaagatctata

SEQ ID NO: 136731 - DNA, 15 bp, Homo sapiens
agttgtaagatctat

SEQ ID NO: 136732 - DNA, 15 bp, Homo sapiens
tagttgtaagatcta

SEQ ID NO: 136733 - DNA, 15 bp, Homo sapiens
gtagttgtaagatct

SEQ ID NO: 136734 - DNA, 15 bp, Homo sapiens
agtagttgtaagatc

SEQ ID NO: 136735 - DNA, 15 bp, Homo sapiens
aagtagttgtaagat

SEQ ID NO: 136736 - DNA, 15 bp, Homo sapiens
aaagtagttgtaaga

SEQ ID NO: 136737 - DNA, 15 bp, Homo sapiens
taaagtagttgtaag

SEQ ID NO: 136738 - DNA, 15 bp, Homo sapiens
ttaaagtagttgtaa

SEQ ID NO: 136739 - DNA, 15 bp, Homo sapiens
attaaagtagttgta

SEQ ID NO: 136740 - DNA, 15 bp, Homo sapiens
aattaaagtagttgt

SEQ ID NO: 136741 - DNA, 15 bp, Homo sapiens
caattaaagtagttg

SEQ ID NO: 136742 - DNA, 15 bp, Homo sapiens
acaattaaagtagtt

SEQ ID NO: 136743 - DNA, 15 bp, Homo sapiens
gacaattaaagtagt

SEQ ID NO: 136744 - DNA, 15 bp, Homo sapiens
agacaattaaagtag

SEQ ID NO: 136745 - DNA, 15 bp, Homo sapiens
gagacaattaaagta

SEQ ID NO: 136746 - DNA, 15 bp, Homo sapiens
agagacaattaaagt

SEQ ID NO: 136747 - DNA, 15 bp, Homo sapiens
gagagacaattaaag

SEQ ID NO: 136748 - DNA, 15 bp, Homo sapiens
agagagacaattaaa

SEQ ID NO: 136749 - DNA, 15 bp, Homo sapiens
gagagagacaattaa

SEQ ID NO: 136750 - DNA, 15 bp, Homo sapiens
agagagagacaatta

SEQ ID NO: 136751 - DNA, 15 bp, Homo sapiens
aagagagagacaatt

SEQ ID NO: 136752 - DNA, 15 bp, Homo sapiens
gaagagagagacaat

SEQ ID NO: 136753 - DNA, 15 bp, Homo sapiens
ggaagagagagacaa

SEQ ID NO: 136754 - DNA, 15 bp, Homo sapiens
tggaagagagagaca

SEQ ID NO: 136755 - DNA, 15 bp, Homo sapiens
atggaagagagagac

SEQ ID NO: 136756 - DNA, 15 bp, Homo sapiens
tatggaagagagaga

SEQ ID NO: 136757 - DNA, 15 bp, Homo sapiens
ctatggaagagagag

SEQ ID NO: 136758 - DNA, 15 bp, Homo sapiens
tctatggaagagaga

SEQ ID NO: 136759 - DNA, 15 bp, Homo sapiens
atctatggaagagag

SEQ ID NO: 136760 - DNA, 15 bp, Homo sapiens
aatctatggaagaga

SEQ ID NO: 136761 - DNA, 15 bp, Homo sapiens
caatctatggaagag

SEQ ID NO: 136762 - DNA, 15 bp, Homo sapiens
acaatctatggaaga

SEQ ID NO: 136763 - DNA, 15 bp, Homo sapiens
cacaatctatggaag

SEQ ID NO: 136764 - DNA, 15 bp, Homo sapiens
tcacaatctatggaa

SEQ ID NO: 136765 - DNA, 15 bp, Homo sapiens
ttcacaatctatgga

SEQ ID NO: 136766 - DNA, 15 bp, Homo sapiens
attcacaatctatgg

SEQ ID NO: 136767 - DNA, 15 bp, Homo sapiens
tattcacaatctatg

SEQ ID NO: 136768 - DNA, 15 bp, Homo sapiens
atattcacaatctat

SEQ ID NO: 136769 - DNA, 15 bp, Homo sapiens
gatattcacaatcta

SEQ ID NO: 136770 - DNA, 15 bp, Homo sapiens
ggatattcacaatct

SEQ ID NO: 136771 - DNA, 15 bp, Homo sapiens
cggatattcacaatc

SEQ ID NO: 136772 - DNA, 15 bp, Homo sapiens
acggatattcacaat

SEQ ID NO: 136773 - DNA, 15 bp, Homo sapiens
gacggatattcacaa

SEQ ID NO: 136774 - DNA, 15 bp, Homo sapiens
agacggatattcaca

SEQ ID NO: 136775 - DNA, 15 bp, Homo sapiens
aagacggatattcac

SEQ ID NO: 136776 - DNA, 15 bp, Homo sapiens
aaagacggatattca

SEQ ID NO: 136777 - DNA, 15 bp, Homo sapiens
gaaagacggatattc

SEQ ID NO: 136778 - DNA, 15 bp, Homo sapiens
agaaagacggatatt

SEQ ID NO: 136779 - DNA, 15 bp, Homo sapiens
cagaaagacggatat

SEQ ID NO: 136780 - DNA, 15 bp, Homo sapiens
gcagaaagacggata

SEQ ID NO: 136781 - DNA, 15 bp, Homo sapiens
ggcagaaagacggat

SEQ ID NO: 136782 - DNA, 15 bp, Homo sapiens
gggcagaaagacgga

SEQ ID NO: 136783 - DNA, 15 bp, Homo sapiens
agggcagaaagacgg

SEQ ID NO: 136784 - DNA, 15 bp, Homo sapiens
aagggcagaaagacg

SEQ ID NO: 136785 - DNA, 15 bp, Homo sapiens
caagggcagaaagac

SEQ ID NO: 136786 - DNA, 15 bp, Homo sapiens
ccaagggcagaaaga

SEQ ID NO: 136787 - DNA, 15 bp, Homo sapiens
cccaagggcagaaag

SEQ ID NO: 136788 - DNA, 15 bp, Homo sapiens
gcccaagggcagaaa

SEQ ID NO: 136789 - DNA, 15 bp, Homo sapiens
ggcccaagggcagaa

SEQ ID NO: 136790 - DNA, 15 bp, Homo sapiens
aggcccaagggcaga

SEQ ID NO: 136791 - DNA, 15 bp, Homo sapiens
aaggcccaagggcag

SEQ ID NO: 136792 - DNA, 15 bp, Homo sapiens
aaaggcccaagggca

SEQ ID NO: 136793 - DNA, 15 bp, Homo sapiens
taaaggcccaagggc

SEQ ID NO: 136794 - DNA, 15 bp, Homo sapiens
ttaaaggcccaaggg

SEQ ID NO: 136795 - DNA, 15 bp, Homo sapiens
gttaaaggcccaagg

SEQ ID NO: 136796 - DNA, 15 bp, Homo sapiens
tgttaaaggcccaag

SEQ ID NO: 136797 - DNA, 15 bp, Homo sapiens
ctgttaaaggcccaa

SEQ ID NO: 136798 - DNA, 15 bp, Homo sapiens
actgttaaaggccca

SEQ ID NO: 136799 - DNA, 15 bp, Homo sapiens
cactgttaaaggccc

SEQ ID NO: 136800 - DNA, 15 bp, Homo sapiens
gcactgttaaaggcc

SEQ ID NO: 136801 - DNA, 15 bp, Homo sapiens
ggcactgttaaaggc

SEQ ID NO: 136802 - DNA, 15 bp, Homo sapiens
tggcactgttaaagg

SEQ ID NO: 136803 - DNA, 15 bp, Homo sapiens
ttggcactgttaaag

SEQ ID NO: 136804 - DNA, 15 bp, Homo sapiens
attggcactgttaaa

SEQ ID NO: 136805 - DNA, 15 bp, Homo sapiens
tattggcactgttaa

SEQ ID NO: 136806 - DNA, 15 bp, Homo sapiens
gtattggcactgtta

SEQ ID NO: 136807 - DNA, 15 bp, Homo sapiens
tgtattggcactgtt

SEQ ID NO: 136808 - DNA, 15 bp, Homo sapiens
ttgtattggcactgt

SEQ ID NO: 136809 - DNA, 15 bp, Homo sapiens
tttgtattggcactg

SEQ ID NO: 136810 - DNA, 15 bp, Homo sapiens
atttgtattggcact

SEQ ID NO: 136811 - DNA, 15 bp, Homo sapiens
aatttgtattggcac

SEQ ID NO: 136812 - DNA, 15 bp, Homo sapiens
taatttgtattggca

SEQ ID NO: 136813 - DNA, 15 bp, Homo sapiens
ttaatttgtattggc

SEQ ID NO: 136814 - DNA, 15 bp, Homo sapiens
gttaatttgtattgg

SEQ ID NO: 136815 - DNA, 15 bp, Homo sapiens
agttaatttgtattg

SEQ ID NO: 136816 - DNA, 15 bp, Homo sapiens
tagttaatttgtatt

SEQ ID NO: 136817 - DNA, 15 bp, Homo sapiens
gtagttaatttgtat

SEQ ID NO: 136818 - DNA, 15 bp, Homo sapiens
ggtagttaatttgta

SEQ ID NO: 136819 - DNA, 15 bp, Homo sapiens
aggtagttaatttgt

SEQ ID NO: 136820 - DNA, 15 bp, Homo sapiens
taggtagttaatttg

SEQ ID NO: 136821 - DNA, 15 bp, Homo sapiens
ttaggtagttaattt

SEQ ID NO: 136822 - DNA, 15 bp, Homo sapiens
attaggtagttaatt

SEQ ID NO: 136823 - DNA, 15 bp, Homo sapiens
tattaggtagttaat

SEQ ID NO: 136824 - DNA, 15 bp, Homo sapiens
ttattaggtagttaa

SEQ ID NO: 136825 - DNA, 15 bp, Homo sapiens
tttattaggtagtta

SEQ ID NO: 136826 - DNA, 15 bp, Homo sapiens
atttattaggtagtt

SEQ ID NO: 136827 - DNA, 15 bp, Homo sapiens
tatttattaggtagt

SEQ ID NO: 136828 - DNA, 15 bp, Homo sapiens
atatttattaggtag

SEQ ID NO: 136829 - DNA, 15 bp, Homo sapiens
aatatttattaggta

SEQ ID NO: 136830 - DNA, 15 bp, Homo sapiens
aaatatttattaggt

SEQ ID NO: 136831 - DNA, 15 bp, Homo sapiens
caaatatttattagg

SEQ ID NO: 136832 - DNA, 15 bp, Homo sapiens
acaaatatttattag

SEQ ID NO: 136833 - DNA, 15 bp, Homo sapiens
cacaaatatttatta

SEQ ID NO: 136834 - DNA, 15 bp, Homo sapiens
tcacaaatatttatt

SEQ ID NO: 136835 - DNA, 15 bp, Homo sapiens
gtcacaaatatttat

SEQ ID NO: 136836 - DNA, 15 bp, Homo sapiens
tgtcacaaatattta

SEQ ID NO: 136837 - DNA, 15 bp, Homo sapiens
ttgtcacaaatattt

SEQ ID NO: 136838 - DNA, 15 bp, Homo sapiens
tttgtcacaaatatt

SEQ ID NO: 136839 - DNA, 15 bp, Homo sapiens
ttttgtcacaaatat

SEQ ID NO: 136840 - DNA, 15 bp, Homo sapiens
attttgtcacaaata

SEQ ID NO: 136841 - DNA, 15 bp, Homo sapiens
tattttgtcacaaat

SEQ ID NO: 136842 - DNA, 15 bp, Homo sapiens
atattttgtcacaaa

SEQ ID NO: 136843 - DNA, 15 bp, Homo sapiens
tatattttgtcacaa

SEQ ID NO: 136844 - DNA, 15 bp, Homo sapiens
ttatattttgtcaca

SEQ ID NO: 136845 - DNA, 15 bp, Homo sapiens
tttatattttgtcac

SEQ ID NO: 136846 - DNA, 15 bp, Homo sapiens
gtttatattttgtca

SEQ ID NO: 136847 - DNA, 15 bp, Homo sapiens
agtttatattttgtc

SEQ ID NO: 136848 - DNA, 15 bp, Homo sapiens
cagtttatattttgt

SEQ ID NO: 136849 - DNA, 15 bp, Homo sapiens
ccagtttatattttg

SEQ ID NO: 136850 - DNA, 15 bp, Homo sapiens
tccagtttatatttt

SEQ ID NO: 136851 - DNA, 15 bp, Homo sapiens
ttccagtttatattt

SEQ ID NO: 136852 - DNA, 15 bp, Homo sapiens
cttccagtttatatt

SEQ ID NO: 136853 - DNA, 15 bp, Homo sapiens
ccttccagtttatat

SEQ ID NO: 136854 - DNA, 15 bp, Homo sapiens
tccttccagtttata

SEQ ID NO: 136855 - DNA, 15 bp, Homo sapiens
atccttccagtttat

SEQ ID NO: 136856 - DNA, 15 bp, Homo sapiens
tatccttccagttta

SEQ ID NO: 136857 - DNA, 15 bp, Homo sapiens
ttatccttccagttt

SEQ ID NO: 136858 - DNA, 15 bp, Homo sapiens
tttatccttccagtt

SEQ ID NO: 136859 - DNA, 15 bp, Homo sapiens
atttatccttccagt

SEQ ID NO: 136860 - DNA, 15 bp, Homo sapiens
gatttatccttccag

SEQ ID NO: 136861 - DNA, 15 bp, Homo sapiens
ggatttatccttcca

SEQ ID NO: 136862 - DNA, 15 bp, Homo sapiens
aggatttatccttcc

SEQ ID NO: 136863 - DNA, 15 bp, Homo sapiens
taggatttatccttc

SEQ ID NO: 136864 - DNA, 15 bp, Homo sapiens
ttaggatttatcctt

SEQ ID NO: 136865 - DNA, 15 bp, Homo sapiens
attaggatttatcct

SEQ ID NO: 136866 - DNA, 15 bp, Homo sapiens
tattaggatttatcc

SEQ ID NO: 136867 - DNA, 15 bp, Homo sapiens
atattaggatttatc

SEQ ID NO: 136868 - DNA, 15 bp, Homo sapiens
aatattaggatttat

SEQ ID NO: 136869 - DNA, 15 bp, Homo sapiens
aaatattaggattta

SEQ ID NO: 136870 - DNA, 15 bp, Homo sapiens
caaatattaggattt

SEQ ID NO: 136871 - DNA, 15 bp, Homo sapiens
acaaatattaggatt

SEQ ID NO: 136872 - DNA, 15 bp, Homo sapiens
gacaaatattaggat

SEQ ID NO: 136873 - DNA, 15 bp, Homo sapiens
tgacaaatattagga

SEQ ID NO: 136874 - DNA, 15 bp, Homo sapiens
ttgacaaatattagg

SEQ ID NO: 136875 - DNA, 15 bp, Homo sapiens
cttgacaaatattag

SEQ ID NO: 136876 - DNA, 15 bp, Homo sapiens
ccttgacaaatatta

SEQ ID NO: 136877 - DNA, 15 bp, Homo sapiens
cccttgacaaatatt

SEQ ID NO: 136878 - DNA, 15 bp, Homo sapiens
tcccttgacaaatat

SEQ ID NO: 136879 - DNA, 15 bp, Homo sapiens
ttcccttgacaaata

SEQ ID NO: 136880 - DNA, 15 bp, Homo sapiens
cttcccttgacaaat

SEQ ID NO: 136881 - DNA, 15 bp, Homo sapiens
tcttcccttgacaaa

SEQ ID NO: 136882 - DNA, 15 bp, Homo sapiens
ttcttcccttgacaa

SEQ ID NO: 136883 - DNA, 15 bp, Homo sapiens
tttcttcccttgaca

SEQ ID NO: 136884 - DNA, 15 bp, Homo sapiens
ctttcttcccttgac

SEQ ID NO: 136885 - DNA, 15 bp, Homo sapiens
actttcttcccttga

SEQ ID NO: 136886 - DNA, 15 bp, Homo sapiens
gactttcttcccttg

SEQ ID NO: 136887 - DNA, 15 bp, Homo sapiens
tgactttcttccctt

SEQ ID NO: 136888 - DNA, 15 bp, Homo sapiens
ctgactttcttccct

SEQ ID NO: 136889 - DNA, 15 bp, Homo sapiens
gctgactttcttccc

SEQ ID NO: 136890 - DNA, 15 bp, Homo sapiens
agctgactttcttcc

SEQ ID NO: 136891 - DNA, 15 bp, Homo sapiens
tagctgactttcttc

SEQ ID NO: 136892 - DNA, 15 bp, Homo sapiens
gtagctgactttctt

SEQ ID NO: 136893 - DNA, 15 bp, Homo sapiens
agtagctgactttct

SEQ ID NO: 136894 - DNA, 15 bp, Homo sapiens
gagtagctgactttc

SEQ ID NO: 136895 - DNA, 15 bp, Homo sapiens
agagtagctgacttt

SEQ ID NO: 136896 - DNA, 15 bp, Homo sapiens
gagagtagctgactt

SEQ ID NO: 136897 - DNA, 15 bp, Homo sapiens
ggagagtagctgact

SEQ ID NO: 136898 - DNA, 15 bp, Homo sapiens
gggagagtagctgac

SEQ ID NO: 136899 - DNA, 15 bp, Homo sapiens
agggagagtagctga

SEQ ID NO: 136900 - DNA, 15 bp, Homo sapiens
cagggagagtagctg

SEQ ID NO: 136901 - DNA, 15 bp, Homo sapiens
acagggagagtagct

SEQ ID NO: 136902 - DNA, 15 bp, Homo sapiens
tacagggagagtagc

SEQ ID NO: 136903 - DNA, 15 bp, Homo sapiens
ttacagggagagtag

SEQ ID NO: 136904 - DNA, 15 bp, Homo sapiens
tttacagggagagta

SEQ ID NO: 136905 - DNA, 15 bp, Homo sapiens
ttttacagggagagt

SEQ ID NO: 136906 - DNA, 15 bp, Homo sapiens
tttttacagggagag

SEQ ID NO: 136907 - DNA, 15 bp, Homo sapiens
ctttttacagggaga

SEQ ID NO: 136908 - DNA, 15 bp, Homo sapiens
actttttacagggag

SEQ ID NO: 136909 - DNA, 15 bp, Homo sapiens
tactttttacaggga

SEQ ID NO: 136910 - DNA, 15 bp, Homo sapiens
atactttttacaggg

SEQ ID NO: 136911 - DNA, 15 bp, Homo sapiens
catactttttacagg

SEQ ID NO: 136912 - DNA, 15 bp, Homo sapiens
acatactttttacag

SEQ ID NO: 136913 - DNA, 15 bp, Homo sapiens
aacatactttttaca

SEQ ID NO: 136914 - DNA, 15 bp, Homo sapiens
aaacatactttttac

SEQ ID NO: 136915 - DNA, 15 bp, Homo sapiens
aaaacatacttttta

SEQ ID NO: 136916 - DNA, 15 bp, Homo sapiens
caaaacatacttttt

SEQ ID NO: 136917 - DNA, 15 bp, Homo sapiens
tcaaaacatactttt

SEQ ID NO: 136918 - DNA, 15 bp, Homo sapiens
atcaaaacatacttt

SEQ ID NO: 136919 - DNA, 15 bp, Homo sapiens
aatcaaaacatactt

SEQ ID NO: 136920 - DNA, 15 bp, Homo sapiens
aaatcaaaacatact

SEQ ID NO: 136921 - DNA, 15 bp, Homo sapiens
gaaatcaaaacatac

SEQ ID NO: 136922 - DNA, 15 bp, Homo sapiens
tgaaatcaaaacata

SEQ ID NO: 136923 - DNA, 15 bp, Homo sapiens
ttgaaatcaaaacat

SEQ ID NO: 136924 - DNA, 15 bp, Homo sapiens
tttgaaatcaaaaca

SEQ ID NO: 136925 - DNA, 15 bp, Homo sapiens
ttttgaaatcaaaac

SEQ ID NO: 136926 - DNA, 15 bp, Homo sapiens
attttgaaatcaaaa

SEQ ID NO: 136927 - DNA, 15 bp, Homo sapiens
tattttgaaatcaaa

SEQ ID NO: 136928 - DNA, 15 bp, Homo sapiens
ctattttgaaatcaa

SEQ ID NO: 136929 - DNA, 15 bp, Homo sapiens
actattttgaaatca

SEQ ID NO: 136930 - DNA, 15 bp, Homo sapiens
gactattttgaaatc

SEQ ID NO: 136931 - DNA, 15 bp, Homo sapiens
tgactattttgaaat

SEQ ID NO: 136932 - DNA, 15 bp, Homo sapiens
atgactattttgaaa

SEQ ID NO: 136933 - DNA, 15 bp, Homo sapiens
catgactattttgaa

SEQ ID NO: 136934 - DNA, 15 bp, Homo sapiens
ccatgactattttga

SEQ ID NO: 136935 - DNA, 15 bp, Homo sapiens
accatgactattttg

SEQ ID NO: 136936 - DNA, 15 bp, Homo sapiens
taccatgactatttt

SEQ ID NO: 136937 - DNA, 15 bp, Homo sapiens
ctaccatgactattt

SEQ ID NO: 136938 - DNA, 15 bp, Homo sapiens
gctaccatgactatt

SEQ ID NO: 136939 - DNA, 15 bp, Homo sapiens
tgctaccatgactat

SEQ ID NO: 136940 - DNA, 15 bp, Homo sapiens
ttgctaccatgacta

SEQ ID NO: 136941 - DNA, 15 bp, Homo sapiens
gttgctaccatgact

SEQ ID NO: 136942 - DNA, 15 bp, Homo sapiens
tgttgctaccatgac

SEQ ID NO: 136943 - DNA, 15 bp, Homo sapiens
ctgttgctaccatga

SEQ ID NO: 136944 - DNA, 15 bp, Homo sapiens
cctgttgctaccatg

SEQ ID NO: 136945 - DNA, 15 bp, Homo sapiens
ccctgttgctaccat

SEQ ID NO: 136946 - DNA, 15 bp, Homo sapiens
accctgttgctacca

SEQ ID NO: 136947 - DNA, 15 bp, Homo sapiens
aaccctgttgctacc

SEQ ID NO: 136948 - DNA, 15 bp, Homo sapiens
taaccctgttgctac

SEQ ID NO: 136949 - DNA, 15 bp, Homo sapiens
ataaccctgttgcta

SEQ ID NO: 136950 - DNA, 15 bp, Homo sapiens
aataaccctgttgct

SEQ ID NO: 136951 - DNA, 15 bp, Homo sapiens
taataaccctgttgc

SEQ ID NO: 136952 - DNA, 15 bp, Homo sapiens
ataataaccctgttg

SEQ ID NO: 136953 - DNA, 15 bp, Homo sapiens
tataataaccctgtt

SEQ ID NO: 136954 - DNA, 15 bp, Homo sapiens
ctataataaccctgt

SEQ ID NO: 136955 - DNA, 15 bp, Homo sapiens
cctataataaccctg

SEQ ID NO: 136956 - DNA, 15 bp, Homo sapiens
tcctataataaccct

SEQ ID NO: 136957 - DNA, 15 bp, Homo sapiens
ctcctataataaccc

SEQ ID NO: 136958 - DNA, 15 bp, Homo sapiens
tctcctataataacc

SEQ ID NO: 136959 - DNA, 15 bp, Homo sapiens
atctcctataataac

SEQ ID NO: 136960 - DNA, 15 bp, Homo sapiens
tatctcctataataa

SEQ ID NO: 136961 - DNA, 15 bp, Homo sapiens
gtatctcctataata

SEQ ID NO: 136962 - DNA, 15 bp, Homo sapiens
tgtatctcctataat

SEQ ID NO: 136963 - DNA, 15 bp, Homo sapiens
atgtatctcctataa

SEQ ID NO: 136964 - DNA, 15 bp, Homo sapiens
aatgtatctcctata

SEQ ID NO: 136965 - DNA, 15 bp, Homo sapiens
taatgtatctcctat

SEQ ID NO: 136966 - DNA, 15 bp, Homo sapiens
ctaatgtatctccta

SEQ ID NO: 136967 - DNA, 15 bp, Homo sapiens
tctaatgtatctcct

SEQ ID NO: 136968 - DNA, 15 bp, Homo sapiens
ttctaatgtatctcc

SEQ ID NO: 136969 - DNA, 15 bp, Homo sapiens
tttctaatgtatctc

SEQ ID NO: 136970 - DNA, 15 bp, Homo sapiens
ttttctaatgtatct

SEQ ID NO: 136971 - DNA, 15 bp, Homo sapiens
cttttctaatgtatc

SEQ ID NO: 136972 - DNA, 15 bp, Homo sapiens
tcttttctaatgtat

SEQ ID NO: 136973 - DNA, 15 bp, Homo sapiens
ttcttttctaatgta

SEQ ID NO: 136974 - DNA, 15 bp, Homo sapiens
gttcttttctaatgt

SEQ ID NO: 136975 - DNA, 15 bp, Homo sapiens
agttcttttctaatg

SEQ ID NO: 136976 - DNA, 15 bp, Homo sapiens
aagttcttttctaat

SEQ ID NO: 136977 - DNA, 15 bp, Homo sapiens
aaagttcttttctaa

SEQ ID NO: 136978 - DNA, 15 bp, Homo sapiens
aaaagttcttttcta

SEQ ID NO: 136979 - DNA, 15 bp, Homo sapiens
taaaagttcttttct

SEQ ID NO: 136980 - DNA, 15 bp, Homo sapiens
ttaaaagttcttttc

SEQ ID NO: 136981 - DNA, 15 bp, Homo sapiens
attaaaagttctttt

SEQ ID NO: 136982 - DNA, 15 bp, Homo sapiens
cattaaaagttcttt

SEQ ID NO: 136983 - DNA, 15 bp, Homo sapiens
acattaaaagttctt

SEQ ID NO: 136984 - DNA, 15 bp, Homo sapiens
gacattaaaagttct

SEQ ID NO: 136985 - DNA, 15 bp, Homo sapiens
agacattaaaagttc

SEQ ID NO: 136986 - DNA, 15 bp, Homo sapiens
tagacattaaaagtt

SEQ ID NO: 136987 - DNA, 15 bp, Homo sapiens
ttagacattaaaagt

SEQ ID NO: 136988 - DNA, 15 bp, Homo sapiens
gttagacattaaaag

SEQ ID NO: 136989 - DNA, 15 bp, Homo sapiens
tgttagacattaaaa

SEQ ID NO: 136990 - DNA, 15 bp, Homo sapiens
ctgttagacattaaa

SEQ ID NO: 136991 - DNA, 15 bp, Homo sapiens
actgttagacattaa

SEQ ID NO: 136992 - DNA, 15 bp, Homo sapiens
cactgttagacatta

SEQ ID NO: 136993 - DNA, 15 bp, Homo sapiens
acactgttagacatt

SEQ ID NO: 136994 - DNA, 15 bp, Homo sapiens
aacactgttagacat

SEQ ID NO: 136995 - DNA, 15 bp, Homo sapiens
caacactgttagaca

SEQ ID NO: 136996 - DNA, 15 bp, Homo sapiens
ccaacactgttagac

SEQ ID NO: 136997 - DNA, 15 bp, Homo sapiens
gccaacactgttaga

SEQ ID NO: 136998 - DNA, 15 bp, Homo sapiens
agccaacactgttag

SEQ ID NO: 136999 - DNA, 15 bp, Homo sapiens
aagccaacactgtta

SEQ ID NO: 137000 - DNA, 15 bp, Homo sapiens
taagccaacactgtt

SEQ ID NO: 137001 - DNA, 15 bp, Homo sapiens
ataagccaacactgt

SEQ ID NO: 137002 - DNA, 15 bp, Homo sapiens
aataagccaacactg

SEQ ID NO: 137003 - DNA, 15 bp, Homo sapiens
aaataagccaacact

SEQ ID NO: 137004 - DNA, 15 bp, Homo sapiens
aaaataagccaacac

SEQ ID NO: 137005 - DNA, 15 bp, Homo sapiens
aaaaataagccaaca

SEQ ID NO: 137006 - DNA, 15 bp, Homo sapiens
taaaaataagccaac

SEQ ID NO: 137007 - DNA, 15 bp, Homo sapiens
gtaaaaataagccaa

SEQ ID NO: 137008 - DNA, 15 bp, Homo sapiens
agtaaaaataagcca

SEQ ID NO: 137009 - DNA, 15 bp, Homo sapiens
tagtaaaaataagcc

SEQ ID NO: 137010 - DNA, 15 bp, Homo sapiens
ttagtaaaaataagc

SEQ ID NO: 137011 - DNA, 15 bp, Homo sapiens
tttagtaaaaataag

SEQ ID NO: 137012 - DNA, 15 bp, Homo sapiens
atttagtaaaaataa

SEQ ID NO: 137013 - DNA, 15 bp, Homo sapiens
tatttagtaaaaata

SEQ ID NO: 137014 - DNA, 15 bp, Homo sapiens
gtatttagtaaaaat

SEQ ID NO: 137015 - DNA, 15 bp, Homo sapiens
tgtatttagtaaaaa

SEQ ID NO: 137016 - DNA, 15 bp, Homo sapiens
atgtatttagtaaaa

SEQ ID NO: 137017 - DNA, 15 bp, Homo sapiens
gatgtatttagtaaa

SEQ ID NO: 137018 - DNA, 15 bp, Homo sapiens
tgatgtatttagtaa

SEQ ID NO: 137019 - DNA, 15 bp, Homo sapiens
atgatgtatttagta

SEQ ID NO: 137020 - DNA, 15 bp, Homo sapiens
aatgatgtatttagt

SEQ ID NO: 137021 - DNA, 15 bp, Homo sapiens
aaatgatgtatttag

SEQ ID NO: 137022 - DNA, 15 bp, Homo sapiens
aaaatgatgtattta

SEQ ID NO: 137023 - DNA, 15 bp, Homo sapiens
gaaaatgatgtattt

SEQ ID NO: 137024 - DNA, 15 bp, Homo sapiens
ggaaaatgatgtatt

SEQ ID NO: 137025 - DNA, 15 bp, Homo sapiens
aggaaaatgatgtat

SEQ ID NO: 137026 - DNA, 15 bp, Homo sapiens
aaggaaaatgatgta

SEQ ID NO: 137027 - DNA, 15 bp, Homo sapiens
gaaggaaaatgatgt

SEQ ID NO: 137028 - DNA, 15 bp, Homo sapiens
agaaggaaaatgatg

SEQ ID NO: 137029 - DNA, 15 bp, Homo sapiens
aagaaggaaaatgat

SEQ ID NO: 137030 - DNA, 15 bp, Homo sapiens
aaagaaggaaaatga

SEQ ID NO: 137031 - DNA, 15 bp, Homo sapiens
aaaagaaggaaaatg

SEQ ID NO: 137032 - DNA, 15 bp, Homo sapiens
gaaaagaaggaaaat

SEQ ID NO: 137033 - DNA, 15 bp, Homo sapiens
agaaaagaaggaaaa

SEQ ID NO: 137034 - DNA, 15 bp, Homo sapiens
gagaaaagaaggaaa

SEQ ID NO: 137035 - DNA, 15 bp, Homo sapiens
agagaaaagaaggaa

SEQ ID NO: 137036 - DNA, 15 bp, Homo sapiens
aagagaaaagaagga

SEQ ID NO: 137037 - DNA, 15 bp, Homo sapiens
aaagagaaaagaagg

SEQ ID NO: 137038 - DNA, 15 bp, Homo sapiens
aaaagagaaaagaag

SEQ ID NO: 137039 - DNA, 15 bp, Homo sapiens
aaaaagagaaaagaa

SEQ ID NO: 137040 - DNA, 15 bp, Homo sapiens
taaaaagagaaaaga

SEQ ID NO: 137041 - DNA, 15 bp, Homo sapiens
ataaaaagagaaaag

SEQ ID NO: 137042 - DNA, 15 bp, Homo sapiens
cataaaaagagaaaa

SEQ ID NO: 137043 - DNA, 15 bp, Homo sapiens
tcataaaaagagaaa

SEQ ID NO: 137044 - DNA, 15 bp, Homo sapiens
ttcataaaaagagaa

SEQ ID NO: 137045 - DNA, 15 bp, Homo sapiens
attcataaaaagaga

SEQ ID NO: 137046 - DNA, 15 bp, Homo sapiens
cattcataaaaagag

SEQ ID NO: 137047 - DNA, 15 bp, Homo sapiens
ccattcataaaaaga

SEQ ID NO: 137048 - DNA, 15 bp, Homo sapiens
tccattcataaaaag

SEQ ID NO: 137049 - DNA, 15 bp, Homo sapiens
atccattcataaaaa

SEQ ID NO: 137050 - DNA, 15 bp, Homo sapiens
catccattcataaaa

SEQ ID NO: 137051 - DNA, 15 bp, Homo sapiens
ccatccattcataaa

SEQ ID NO: 137052 - DNA, 15 bp, Homo sapiens
tccatccattcataa

SEQ ID NO: 137053 - DNA, 15 bp, Homo sapiens
atccatccattcata

SEQ ID NO: 137054 - DNA, 15 bp, Homo sapiens
aatccatccattcat

SEQ ID NO: 137055 - DNA, 15 bp, Homo sapiens
caatccatccattca

SEQ ID NO: 137056 - DNA, 15 bp, Homo sapiens
acaatccatccattc

SEQ ID NO: 137057 - DNA, 15 bp, Homo sapiens
cacaatccatccatt

SEQ ID NO: 137058 - DNA, 15 bp, Homo sapiens
gcacaatccatccat

SEQ ID NO: 137059 - DNA, 15 bp, Homo sapiens
ggcacaatccatcca

SEQ ID NO: 137060 - DNA, 15 bp, Homo sapiens
aggcacaatccatcc

SEQ ID NO: 137061 - DNA, 15 bp, Homo sapiens
taggcacaatccatc

SEQ ID NO: 137062 - DNA, 15 bp, Homo sapiens
ataggcacaatccat

SEQ ID NO: 137063 - DNA, 15 bp, Homo sapiens
aataggcacaatcca

SEQ ID NO: 137064 - DNA, 15 bp, Homo sapiens
taataggcacaatcc

SEQ ID NO: 137065 - DNA, 15 bp, Homo sapiens
ataataggcacaatc

SEQ ID NO: 137066 - DNA, 15 bp, Homo sapiens
cataataggcacaat

SEQ ID NO: 137067 - DNA, 15 bp, Homo sapiens
ccataataggcacaa

SEQ ID NO: 137068 - DNA, 15 bp, Homo sapiens
tccataataggcaca

SEQ ID NO: 137069 - DNA, 15 bp, Homo sapiens
ttccataataggcac

SEQ ID NO: 137070 - DNA, 15 bp, Homo sapiens
gttccataataggca

SEQ ID NO: 137071 - DNA, 15 bp, Homo sapiens
agttccataataggc

SEQ ID NO: 137072 - DNA, 15 bp, Homo sapiens
aagttccataatagg

SEQ ID NO: 137073 - DNA, 15 bp, Homo sapiens
aaagttccataatag

SEQ ID NO: 137074 - DNA, 15 bp, Homo sapiens
caaagttccataata

SEQ ID NO: 137075 - DNA, 15 bp, Homo sapiens
ccaaagttccataat

SEQ ID NO: 137076 - DNA, 15 bp, Homo sapiens
tccaaagttccataa

SEQ ID NO: 137077 - DNA, 15 bp, Homo sapiens
ctccaaagttccata

SEQ ID NO: 137078 - DNA, 15 bp, Homo sapiens
actccaaagttccat

SEQ ID NO: 137079 - DNA, 15 bp, Homo sapiens
cactccaaagttcca

SEQ ID NO: 137080 - DNA, 15 bp, Homo sapiens
tcactccaaagttcc

SEQ ID NO: 137081 - DNA, 15 bp, Homo sapiens
ctcactccaaagttc

SEQ ID NO: 137082 - DNA, 15 bp, Homo sapiens
gctcactccaaagtt

SEQ ID NO: 137083 - DNA, 15 bp, Homo sapiens
agctcactccaaagt

SEQ ID NO: 137084 - DNA, 15 bp, Homo sapiens
cagctcactccaaag

SEQ ID NO: 137085 - DNA, 15 bp, Homo sapiens
ccagctcactccaaa

SEQ ID NO: 137086 - DNA, 15 bp, Homo sapiens
accagctcactccaa

SEQ ID NO: 137087 - DNA, 15 bp, Homo sapiens
aaccagctcactcca

SEQ ID NO: 137088 - DNA, 15 bp, Homo sapiens
aaaccagctcactcc

SEQ ID NO: 137089 - DNA, 15 bp, Homo sapiens
gaaaccagctcactc

SEQ ID NO: 137090 - DNA, 15 bp, Homo sapiens
ggaaaccagctcact

SEQ ID NO: 137091 - DNA, 15 bp, Homo sapiens
gggaaaccagctcac

SEQ ID NO: 137092 - DNA, 15 bp, Homo sapiens
agggaaaccagctca

SEQ ID NO: 137093 - DNA, 15 bp, Homo sapiens
gagggaaaccagctc

SEQ ID NO: 137094 - DNA, 15 bp, Homo sapiens
tgagggaaaccagct

SEQ ID NO: 137095 - DNA, 15 bp, Homo sapiens
gtgagggaaaccagc

SEQ ID NO: 137096 - DNA, 15 bp, Homo sapiens
tgtgagggaaaccag

SEQ ID NO: 137097 - DNA, 15 bp, Homo sapiens
atgtgagggaaacca

SEQ ID NO: 137098 - DNA, 15 bp, Homo sapiens
gatgtgagggaaacc

SEQ ID NO: 137099 - DNA, 15 bp, Homo sapiens
tgatgtgagggaaac

SEQ ID NO: 137100 - DNA, 15 bp, Homo sapiens
gtgatgtgagggaaa

SEQ ID NO: 137101 - DNA, 15 bp, Homo sapiens
tgtgatgtgagggaa

SEQ ID NO: 137102 - DNA, 15 bp, Homo sapiens
ctgtgatgtgaggga

SEQ ID NO: 137103 - DNA, 15 bp, Homo sapiens
cctgtgatgtgaggg

SEQ ID NO: 137104 - DNA, 15 bp, Homo sapiens
ccctgtgatgtgagg

SEQ ID NO: 137105 - DNA, 15 bp, Homo sapiens
cccctgtgatgtgag

SEQ ID NO: 137106 - DNA, 15 bp, Homo sapiens
tcccctgtgatgtga

SEQ ID NO: 137107 - DNA, 15 bp, Homo sapiens
ctcccctgtgatgtg

SEQ ID NO: 137108 - DNA, 15 bp, Homo sapiens
gctcccctgtgatgt

SEQ ID NO: 137109 - DNA, 15 bp, Homo sapiens
agctcccctgtgatg

SEQ ID NO: 137110 - DNA, 15 bp, Homo sapiens
gagctcccctgtgat

SEQ ID NO: 137111 - DNA, 15 bp, Homo sapiens
ggagctcccctgtga

SEQ ID NO: 137112 - DNA, 15 bp, Homo sapiens
aggagctcccctgtg

SEQ ID NO: 137113 - DNA, 15 bp, Homo sapiens
gaggagctcccctgt

SEQ ID NO: 137114 - DNA, 15 bp, Homo sapiens
agaggagctcccctg

SEQ ID NO: 137115 - DNA, 15 bp, Homo sapiens
cagaggagctcccct

SEQ ID NO: 137116 - DNA, 15 bp, Homo sapiens
gcagaggagctcccc

SEQ ID NO: 137117 - DNA, 15 bp, Homo sapiens
agcagaggagctccc

SEQ ID NO: 137118 - DNA, 15 bp, Homo sapiens
gagcagaggagctcc

SEQ ID NO: 137119 - DNA, 15 bp, Homo sapiens
agagcagaggagctc

SEQ ID NO: 137120 - DNA, 15 bp, Homo sapiens
tagagcagaggagct

SEQ ID NO: 137121 - DNA, 15 bp, Homo sapiens
ctagagcagaggagc

SEQ ID NO: 137122 - DNA, 15 bp, Homo sapiens
actagagcagaggag

SEQ ID NO: 137123 - DNA, 15 bp, Homo sapiens
cactagagcagagga

SEQ ID NO: 137124 - DNA, 15 bp, Homo sapiens
tcactagagcagagg

SEQ ID NO: 137125 - DNA, 15 bp, Homo sapiens
atcactagagcagag

SEQ ID NO: 137126 - DNA, 15 bp, Homo sapiens
tatcactagagcaga

SEQ ID NO: 137127 - DNA, 15 bp, Homo sapiens
gtatcactagagcag

SEQ ID NO: 137128 - DNA, 15 bp, Homo sapiens
ggtatcactagagca

SEQ ID NO: 137129 - DNA, 15 bp, Homo sapiens
tggtatcactagagc

SEQ ID NO: 137130 - DNA, 15 bp, Homo sapiens
ttggtatcactagag

SEQ ID NO: 137131 - DNA, 15 bp, Homo sapiens
tttggtatcactaga

SEQ ID NO: 137132 - DNA, 15 bp, Homo sapiens
gtttggtatcactag

SEQ ID NO: 137133 - DNA, 15 bp, Homo sapiens
agtttggtatcacta

SEQ ID NO: 137134 - DNA, 15 bp, Homo sapiens
tagtttggtatcact

SEQ ID NO: 137135 - DNA, 15 bp, Homo sapiens
atagtttggtatcac

SEQ ID NO: 137136 - DNA, 15 bp, Homo sapiens
aatagtttggtatca

SEQ ID NO: 137137 - DNA, 15 bp, Homo sapiens
caatagtttggtatc

SEQ ID NO: 137138 - DNA, 15 bp, Homo sapiens
tcaatagtttggtat

SEQ ID NO: 137139 - DNA, 15 bp, Homo sapiens
gtcaatagtttggta

SEQ ID NO: 137140 - DNA, 15 bp, Homo sapiens
tgtcaatagtttggt

SEQ ID NO: 137141 - DNA, 15 bp, Homo sapiens
ttgtcaatagtttgg

SEQ ID NO: 137142 - DNA, 15 bp, Homo sapiens
cttgtcaatagtttg

SEQ ID NO: 137143 - DNA, 15 bp, Homo sapiens
gcttgtcaatagttt

SEQ ID NO: 137144 - DNA, 15 bp, Homo sapiens
ggcttgtcaatagtt

SEQ ID NO: 137145 - DNA, 15 bp, Homo sapiens
tggcttgtcaatagt

SEQ ID NO: 137146 - DNA, 15 bp, Homo sapiens
atggcttgtcaatag

SEQ ID NO: 137147 - DNA, 15 bp, Homo sapiens
aatggcttgtcaata

SEQ ID NO: 137148 - DNA, 15 bp, Homo sapiens
aaatggcttgtcaat

SEQ ID NO: 137149 - DNA, 15 bp, Homo sapiens
gaaatggcttgtcaa

SEQ ID NO: 137150 - DNA, 15 bp, Homo sapiens
ggaaatggcttgtca

SEQ ID NO: 137151 - DNA, 15 bp, Homo sapiens
tggaaatggcttgtc

SEQ ID NO: 137152 - DNA, 15 bp, Homo sapiens
ctggaaatggcttgt

SEQ ID NO: 137153 - DNA, 15 bp, Homo sapiens
actggaaatggcttg

SEQ ID NO: 137154 - DNA, 15 bp, Homo sapiens
aactggaaatggctt

SEQ ID NO: 137155 - DNA, 15 bp, Homo sapiens
aaactggaaatggct

SEQ ID NO: 137156 - DNA, 15 bp, Homo sapiens
caaactggaaatggc

SEQ ID NO: 137157 - DNA, 15 bp, Homo sapiens
gcaaactggaaatgg

SEQ ID NO: 137158 - DNA, 15 bp, Homo sapiens
agcaaactggaaatg

SEQ ID NO: 137159 - DNA, 15 bp, Homo sapiens
aagcaaactggaaat

SEQ ID NO: 137160 - DNA, 15 bp, Homo sapiens
aaagcaaactggaaa

SEQ ID NO: 137161 - DNA, 15 bp, Homo sapiens
aaaagcaaactggaa

SEQ ID NO: 137162 - DNA, 15 bp, Homo sapiens
aaaaagcaaactgga

SEQ ID NO: 137163 - DNA, 15 bp, Homo sapiens
gaaaaagcaaactgg

SEQ ID NO: 137164 - DNA, 15 bp, Homo sapiens
agaaaaagcaaactg

SEQ ID NO: 137165 - DNA, 15 bp, Homo sapiens
tagaaaaagcaaact

SEQ ID NO: 137166 - DNA, 15 bp, Homo sapiens
atagaaaaagcaaac

SEQ ID NO: 137167 - DNA, 15 bp, Homo sapiens
gatagaaaaagcaaa

SEQ ID NO: 137168 - DNA, 15 bp, Homo sapiens
tgatagaaaaagcaa

SEQ ID NO: 137169 - DNA, 15 bp, Homo sapiens
atgatagaaaaagca

SEQ ID NO: 137170 - DNA, 15 bp, Homo sapiens
gatgatagaaaaagc

SEQ ID NO: 137171 - DNA, 15 bp, Homo sapiens
agatgatagaaaaag

SEQ ID NO: 137172 - DNA, 15 bp, Homo sapiens
aagatgatagaaaaa

SEQ ID NO: 137173 - DNA, 15 bp, Homo sapiens
caagatgatagaaaa

SEQ ID NO: 137174 - DNA, 15 bp, Homo sapiens
tcaagatgatagaaa

SEQ ID NO: 137175 - DNA, 15 bp, Homo sapiens
atcaagatgatagaa

SEQ ID NO: 137176 - DNA, 15 bp, Homo sapiens
catcaagatgataga

SEQ ID NO: 137177 - DNA, 15 bp, Homo sapiens
acatcaagatgatag

SEQ ID NO: 137178 - DNA, 15 bp, Homo sapiens
aacatcaagatgata

SEQ ID NO: 137179 - DNA, 15 bp, Homo sapiens
aaacatcaagatgat

SEQ ID NO: 137180 - DNA, 15 bp, Homo sapiens
aaaacatcaagatga

SEQ ID NO: 137181 - DNA, 15 bp, Homo sapiens
gaaaacatcaagatg

SEQ ID NO: 137182 - DNA, 15 bp, Homo sapiens
agaaaacatcaagat

SEQ ID NO: 137183 - DNA, 15 bp, Homo sapiens
aagaaaacatcaaga

SEQ ID NO: 137184 - DNA, 15 bp, Homo sapiens
aaagaaaacatcaag

SEQ ID NO: 137185 - DNA, 15 bp, Homo sapiens
aaaagaaaacatcaa

SEQ ID NO: 137186 - DNA, 15 bp, Homo sapiens
taaaagaaaacatca

SEQ ID NO: 137187 - DNA, 15 bp, Homo sapiens
ttaaaagaaaacatc

SEQ ID NO: 137188 - DNA, 15 bp, Homo sapiens
attaaaagaaaacat

SEQ ID NO: 137189 - DNA, 15 bp, Homo sapiens
aattaaaagaaaaca

SEQ ID NO: 137190 - DNA, 15 bp, Homo sapiens
taattaaaagaaaac

SEQ ID NO: 137191 - DNA, 15 bp, Homo sapiens
ataattaaaagaaaa

SEQ ID NO: 137192 - DNA, 15 bp, Homo sapiens
aataattaaaagaaa

SEQ ID NO: 137193 - DNA, 15 bp, Homo sapiens
taataattaaaagaa

SEQ ID NO: 137194 - DNA, 15 bp, Homo sapiens
ataataattaaaaga

SEQ ID NO: 137195 - DNA, 15 bp, Homo sapiens
aataataattaaaag

SEQ ID NO: 137196 - DNA, 15 bp, Homo sapiens
aaataataattaaaa

SEQ ID NO: 137197 - DNA, 15 bp, Homo sapiens
aaaataataattaaa

SEQ ID NO: 137198 - DNA, 15 bp, Homo sapiens
aaaaataataattaa

SEQ ID NO: 137199 - DNA, 15 bp, Homo sapiens
aaaaaataataatta

SEQ ID NO: 137200 - DNA, 15 bp, Homo sapiens
gaaaaaataataatt

SEQ ID NO: 137201 - DNA, 15 bp, Homo sapiens
ggaaaaaataataat

SEQ ID NO: 137202 - DNA, 15 bp, Homo sapiens
tggaaaaaataataa

SEQ ID NO: 137203 - DNA, 15 bp, Homo sapiens
atggaaaaaataata

SEQ ID NO: 137204 - DNA, 15 bp, Homo sapiens
gatggaaaaaataat

SEQ ID NO: 137205 - DNA, 15 bp, Homo sapiens
tgatggaaaaaataa

SEQ ID NO: 137206 - DNA, 15 bp, Homo sapiens
gtgatggaaaaaata

SEQ ID NO: 137207 - DNA, 15 bp, Homo sapiens
ggtgatggaaaaaat

SEQ ID NO: 137208 - DNA, 15 bp, Homo sapiens
aggtgatggaaaaaa

SEQ ID NO: 137209 - DNA, 15 bp, Homo sapiens
gaggtgatggaaaaa

SEQ ID NO: 137210 - DNA, 15 bp, Homo sapiens
agaggtgatggaaaa

SEQ ID NO: 137211 - DNA, 15 bp, Homo sapiens
gagaggtgatggaaa

SEQ ID NO: 137212 - DNA, 15 bp, Homo sapiens
agagaggtgatggaa

SEQ ID NO: 137213 - DNA, 15 bp, Homo sapiens
aagagaggtgatgga

SEQ ID NO: 137214 - DNA, 15 bp, Homo sapiens
aaagagaggtgatgg

SEQ ID NO: 137215 - DNA, 15 bp, Homo sapiens
aaaagagaggtgatg

SEQ ID NO: 137216 - DNA, 15 bp, Homo sapiens
aaaaagagaggtgat

SEQ ID NO: 137217 - DNA, 15 bp, Homo sapiens
caaaaagagaggtga

SEQ ID NO: 137218 - DNA, 15 bp, Homo sapiens
acaaaaagagaggtg

SEQ ID NO: 137219 - DNA, 15 bp, Homo sapiens
gacaaaaagagaggt

SEQ ID NO: 137220 - DNA, 15 bp, Homo sapiens
ggacaaaaagagagg

SEQ ID NO: 137221 - DNA, 15 bp, Homo sapiens
tggacaaaaagagag

SEQ ID NO: 137222 - DNA, 15 bp, Homo sapiens
ttggacaaaaagaga

SEQ ID NO: 137223 - DNA, 15 bp, Homo sapiens
tttggacaaaaagag

SEQ ID NO: 137224 - DNA, 15 bp, Homo sapiens
ttttggacaaaaaga

SEQ ID NO: 137225 - DNA, 15 bp, Homo sapiens
gttttggacaaaaag

SEQ ID NO: 137226 - DNA, 15 bp, Homo sapiens
agttttggacaaaaa

SEQ ID NO: 137227 - DNA, 15 bp, Homo sapiens
aagttttggacaaaa

SEQ ID NO: 137228 - DNA, 15 bp, Homo sapiens
gaagttttggacaaa

SEQ ID NO: 137229 - DNA, 15 bp, Homo sapiens
agaagttttggacaa

SEQ ID NO: 137230 - DNA, 15 bp, Homo sapiens
aagaagttttggaca

SEQ ID NO: 137231 - DNA, 15 bp, Homo sapiens
aaagaagttttggac

SEQ ID NO: 137232 - DNA, 15 bp, Homo sapiens
gaaagaagttttgga

SEQ ID NO: 137233 - DNA, 15 bp, Homo sapiens
tgaaagaagttttgg

SEQ ID NO: 137234 - DNA, 15 bp, Homo sapiens
ctgaaagaagttttg

SEQ ID NO: 137235 - DNA, 15 bp, Homo sapiens
cctgaaagaagtttt

SEQ ID NO: 137236 - DNA, 15 bp, Homo sapiens
acctgaaagaagttt

SEQ ID NO: 137237 - DNA, 15 bp, Homo sapiens
cacctgaaagaagtt

SEQ ID NO: 137238 - DNA, 15 bp, Homo sapiens
acacctgaaagaagt

SEQ ID NO: 137239 - DNA, 15 bp, Homo sapiens
aacacctgaaagaag

SEQ ID NO: 137240 - DNA, 15 bp, Homo sapiens
aaacacctgaaagaa

SEQ ID NO: 137241 - DNA, 15 bp, Homo sapiens
caaacacctgaaaga

SEQ ID NO: 137242 - DNA, 15 bp, Homo sapiens
acaaacacctgaaag

SEQ ID NO: 137243 - DNA, 15 bp, Homo sapiens
aacaaacacctgaaa

SEQ ID NO: 137244 - DNA, 15 bp, Homo sapiens
aaacaaacacctgaa

SEQ ID NO: 137245 - DNA, 15 bp, Homo sapiens
aaaacaaacacctga

SEQ ID NO: 137246 - DNA, 15 bp, Homo sapiens
aaaaacaaacacctg

SEQ ID NO: 137247 - DNA, 15 bp, Homo sapiens
aaaaaacaaacacct

SEQ ID NO: 137248 - DNA, 15 bp, Homo sapiens
aaaaaaacaaacacc

SEQ ID NO: 137249 - DNA, 15 bp, Homo sapiens
caaaaaaacaaacac

SEQ ID NO: 137250 - DNA, 15 bp, Homo sapiens
acaaaaaaacaaaca

SEQ ID NO: 137251 - DNA, 15 bp, Homo sapiens
aacaaaaaaacaaac

SEQ ID NO: 137252 - DNA, 15 bp, Homo sapiens
aaacaaaaaaacaaa

SEQ ID NO: 137253 - DNA, 15 bp, Homo sapiens
aaaacaaaaaaacaa

SEQ ID NO: 137254 - DNA, 15 bp, Homo sapiens
taaaacaaaaaaaca

SEQ ID NO: 137255 - DNA, 15 bp, Homo sapiens
gtaaaacaaaaaaac

SEQ ID NO: 137256 - DNA, 15 bp, Homo sapiens
tgtaaaacaaaaaaa

SEQ ID NO: 137257 - DNA, 15 bp, Homo sapiens
ttgtaaaacaaaaaa

SEQ ID NO: 137258 - DNA, 15 bp, Homo sapiens
cttgtaaaacaaaaa

SEQ ID NO: 137259 - DNA, 15 bp, Homo sapiens
tcttgtaaaacaaaa

SEQ ID NO: 137260 - DNA, 15 bp, Homo sapiens
gtcttgtaaaacaaa

SEQ ID NO: 137261 - DNA, 15 bp, Homo sapiens
agtcttgtaaaacaa

SEQ ID NO: 137262 - DNA, 15 bp, Homo sapiens
aagtcttgtaaaaca

SEQ ID NO: 137263 - DNA, 15 bp, Homo sapiens
gaagtcttgtaaaac

SEQ ID NO: 137264 - DNA, 15 bp, Homo sapiens
agaagtcttgtaaaa

SEQ ID NO: 137265 - DNA, 15 bp, Homo sapiens
gagaagtcttgtaaa

SEQ ID NO: 137266 - DNA, 15 bp, Homo sapiens
ggagaagtcttgtaa

SEQ ID NO: 137267 - DNA, 15 bp, Homo sapiens
aggagaagtcttgta

SEQ ID NO: 137268 - DNA, 15 bp, Homo sapiens
taggagaagtcttgt

SEQ ID NO: 137269 - DNA, 15 bp, Homo sapiens
ttaggagaagtcttg

SEQ ID NO: 137270 - DNA, 15 bp, Homo sapiens
tttaggagaagtctt

SEQ ID NO: 137271 - DNA, 15 bp, Homo sapiens
atttaggagaagtct

SEQ ID NO: 137272 - DNA, 15 bp, Homo sapiens
tatttaggagaagtc

SEQ ID NO: 137273 - DNA, 15 bp, Homo sapiens
atatttaggagaagt

SEQ ID NO: 137274 - DNA, 15 bp, Homo sapiens
gatatttaggagaag

SEQ ID NO: 137275 - DNA, 15 bp, Homo sapiens
agatatttaggagaa

SEQ ID NO: 137276 - DNA, 15 bp, Homo sapiens
aagatatttaggaga

SEQ ID NO: 137277 - DNA, 15 bp, Homo sapiens
gaagatatttaggag

SEQ ID NO: 137278 - DNA, 15 bp, Homo sapiens
ggaagatatttagga

SEQ ID NO: 137279 - DNA, 15 bp, Homo sapiens
gggaagatatttagg

SEQ ID NO: 137280 - DNA, 15 bp, Homo sapiens
agggaagatatttag

SEQ ID NO: 137281 - DNA, 15 bp, Homo sapiens
aagggaagatattta

SEQ ID NO: 137282 - DNA, 15 bp, Homo sapiens
aaagggaagatattt

SEQ ID NO: 137283 - DNA, 15 bp, Homo sapiens
gaaagggaagatatt

SEQ ID NO: 137284 - DNA, 15 bp, Homo sapiens
ggaaagggaagatat

SEQ ID NO: 137285 - DNA, 15 bp, Homo sapiens
gggaaagggaagata

SEQ ID NO: 137286 - DNA, 15 bp, Homo sapiens
tgggaaagggaagat

SEQ ID NO: 137287 - DNA, 15 bp, Homo sapiens
atgggaaagggaaga

SEQ ID NO: 137288 - DNA, 15 bp, Homo sapiens
aatgggaaagggaag

SEQ ID NO: 137289 - DNA, 15 bp, Homo sapiens
caatgggaaagggaa

SEQ ID NO: 137290 - DNA, 15 bp, Homo sapiens
tcaatgggaaaggga

SEQ ID NO: 137291 - DNA, 15 bp, Homo sapiens
ttcaatgggaaaggg

SEQ ID NO: 137292 - DNA, 15 bp, Homo sapiens
attcaatgggaaagg

SEQ ID NO: 137293 - DNA, 15 bp, Homo sapiens
cattcaatgggaaag

SEQ ID NO: 137294 - DNA, 15 bp, Homo sapiens
acattcaatgggaaa

SEQ ID NO: 137295 - DNA, 15 bp, Homo sapiens
tacattcaatgggaa

SEQ ID NO: 137296 - DNA, 15 bp, Homo sapiens
gtacattcaatggga

SEQ ID NO: 137297 - DNA, 15 bp, Homo sapiens
tgtacattcaatggg

SEQ ID NO: 137298 - DNA, 15 bp, Homo sapiens
gtgtacattcaatgg

SEQ ID NO: 137299 - DNA, 15 bp, Homo sapiens
tgtgtacattcaatg

SEQ ID NO: 137300 - DNA, 15 bp, Homo sapiens
gtgtgtacattcaat

SEQ ID NO: 137301 - DNA, 15 bp, Homo sapiens
agtgtgtacattcaa

SEQ ID NO: 137302 - DNA, 15 bp, Homo sapiens
gagtgtgtacattca

SEQ ID NO: 137303 - DNA, 15 bp, Homo sapiens
agagtgtgtacattc

SEQ ID NO: 137304 - DNA, 15 bp, Homo sapiens
tagagtgtgtacatt

SEQ ID NO: 137305 - DNA, 15 bp, Homo sapiens
atagagtgtgtacat

SEQ ID NO: 137306 - DNA, 15 bp, Homo sapiens
aatagagtgtgtaca

SEQ ID NO: 137307 - DNA, 15 bp, Homo sapiens
aaatagagtgtgtac

SEQ ID NO: 137308 - DNA, 15 bp, Homo sapiens
aaaatagagtgtgta

SEQ ID NO: 137309 - DNA, 15 bp, Homo sapiens
gaaaatagagtgtgt

SEQ ID NO: 137310 - DNA, 15 bp, Homo sapiens
agaaaatagagtgtg

SEQ ID NO: 137311 - DNA, 15 bp, Homo sapiens
gagaaaatagagtgt

SEQ ID NO: 137312 - DNA, 15 bp, Homo sapiens
agagaaaatagagtg

SEQ ID NO: 137313 - DNA, 15 bp, Homo sapiens
gagagaaaatagagt

SEQ ID NO: 137314 - DNA, 15 bp, Homo sapiens
agagagaaaatagag

SEQ ID NO: 137315 - DNA, 15 bp, Homo sapiens
tagagagaaaataga

SEQ ID NO: 137316 - DNA, 15 bp, Homo sapiens
atagagagaaaatag

SEQ ID NO: 137317 - DNA, 15 bp, Homo sapiens
tatagagagaaaata

SEQ ID NO: 137318 - DNA, 15 bp, Homo sapiens
atatagagagaaaat

SEQ ID NO: 137319 - DNA, 15 bp, Homo sapiens
tatatagagagaaaa

SEQ ID NO: 137320 - DNA, 15 bp, Homo sapiens
atatatagagagaaa

SEQ ID NO: 137321 - DNA, 15 bp, Homo sapiens
tatatatagagagaa

SEQ ID NO: 137322 - DNA, 15 bp, Homo sapiens
ttatatatagagaga

SEQ ID NO: 137323 - DNA, 15 bp, Homo sapiens
tttatatatagagag

SEQ ID NO: 137324 - DNA, 15 bp, Homo sapiens
atttatatatagaga

SEQ ID NO: 137325 - DNA, 15 bp, Homo sapiens
tatttatatatagag

SEQ ID NO: 137326 - DNA, 15 bp, Homo sapiens
atatttatatataga

SEQ ID NO: 137327 - DNA, 15 bp, Homo sapiens
aatatttatatatag

SEQ ID NO: 137328 - DNA, 15 bp, Homo sapiens
aaatatttatatata

SEQ ID NO: 137329 - DNA, 15 bp, Homo sapiens
gaaatatttatatat

SEQ ID NO: 137330 - DNA, 15 bp, Homo sapiens
agaaatatttatata

SEQ ID NO: 137331 - DNA, 15 bp, Homo sapiens
cagaaatatttatat

SEQ ID NO: 137332 - DNA, 15 bp, Homo sapiens
acagaaatatttata

SEQ ID NO: 137333 - DNA, 15 bp, Homo sapiens
cacagaaatatttat

SEQ ID NO: 137334 - DNA, 15 bp, Homo sapiens
acacagaaatattta

SEQ ID NO: 137335 - DNA, 15 bp, Homo sapiens
cacacagaaatattt

SEQ ID NO: 137336 - DNA, 15 bp, Homo sapiens
acacacagaaatatt

SEQ ID NO: 137337 - DNA, 15 bp, Homo sapiens
cacacacagaaatat

SEQ ID NO: 137338 - DNA, 15 bp, Homo sapiens
acacacacagaaata

SEQ ID NO: 137339 - DNA, 15 bp, Homo sapiens
tacacacacagaaat

SEQ ID NO: 137340 - DNA, 15 bp, Homo sapiens
ctacacacacagaaa

SEQ ID NO: 137341 - DNA, 15 bp, Homo sapiens
tctacacacacagaa

SEQ ID NO: 137342 - DNA, 15 bp, Homo sapiens
ctctacacacacaga

SEQ ID NO: 137343 - DNA, 15 bp, Homo sapiens
cctctacacacacag

SEQ ID NO: 137344 - DNA, 15 bp, Homo sapiens
acctctacacacaca

SEQ ID NO: 137345 - DNA, 15 bp, Homo sapiens
aacctctacacacac

SEQ ID NO: 137346 - DNA, 15 bp, Homo sapiens
gaacctctacacaca

SEQ ID NO: 137347 - DNA, 15 bp, Homo sapiens
agaacctctacacac

SEQ ID NO: 137348 - DNA, 15 bp, Homo sapiens
tagaacctctacaca

SEQ ID NO: 137349 - DNA, 15 bp, Homo sapiens
atagaacctctacac

SEQ ID NO: 137350 - DNA, 15 bp, Homo sapiens
tatagaacctctaca

SEQ ID NO: 137351 - DNA, 15 bp, Homo sapiens
ttatagaacctctac

SEQ ID NO: 137352 - DNA, 15 bp, Homo sapiens
gttatagaacctcta

SEQ ID NO: 137353 - DNA, 15 bp, Homo sapiens
ggttatagaacctct

SEQ ID NO: 137354 - DNA, 15 bp, Homo sapiens
aggttatagaacctc

SEQ ID NO: 137355 - DNA, 15 bp, Homo sapiens
aaggttatagaacct

SEQ ID NO: 137356 - DNA, 15 bp, Homo sapiens
gaaggttatagaacc

SEQ ID NO: 137357 - DNA, 15 bp, Homo sapiens
tgaaggttatagaac

SEQ ID NO: 137358 - DNA, 15 bp, Homo sapiens
atgaaggttatagaa

SEQ ID NO: 137359 - DNA, 15 bp, Homo sapiens
gatgaaggttataga

SEQ ID NO: 137360 - DNA, 15 bp, Homo sapiens
tgatgaaggttatag

SEQ ID NO: 137361 - DNA, 15 bp, Homo sapiens
gtgatgaaggttata

SEQ ID NO: 137362 - DNA, 15 bp, Homo sapiens
agtgatgaaggttat

SEQ ID NO: 137363 - DNA, 15 bp, Homo sapiens
gagtgatgaaggtta

SEQ ID NO: 137364 - DNA, 15 bp, Homo sapiens
ggagtgatgaaggtt

SEQ ID NO: 137365 - DNA, 15 bp, Homo sapiens
aggagtgatgaaggt

SEQ ID NO: 137366 - DNA, 15 bp, Homo sapiens
gaggagtgatgaagg

SEQ ID NO: 137367 - DNA, 15 bp, Homo sapiens
tgaggagtgatgaag

SEQ ID NO: 137368 - DNA, 15 bp, Homo sapiens
atgaggagtgatgaa

SEQ ID NO: 137369 - DNA, 15 bp, Homo sapiens
aatgaggagtgatga

SEQ ID NO: 137370 - DNA, 15 bp, Homo sapiens
taatgaggagtgatg

SEQ ID NO: 137371 - DNA, 15 bp, Homo sapiens
ataatgaggagtgat

SEQ ID NO: 137372 - DNA, 15 bp, Homo sapiens
tataatgaggagtga

SEQ ID NO: 137373 - DNA, 15 bp, Homo sapiens
atataatgaggagtg

SEQ ID NO: 137374 - DNA, 15 bp, Homo sapiens
catataatgaggagt

SEQ ID NO: 137375 - DNA, 15 bp, Homo sapiens
tcatataatgaggag

SEQ ID NO: 137376 - DNA, 15 bp, Homo sapiens
ttcatataatgagga

SEQ ID NO: 137377 - DNA, 15 bp, Homo sapiens
tttcatataatgagg

SEQ ID NO: 137378 - DNA, 15 bp, Homo sapiens
ttttcatataatgag

SEQ ID NO: 137379 - DNA, 15 bp, Homo sapiens
tttttcatataatga

SEQ ID NO: 137380 - DNA, 15 bp, Homo sapiens
gtttttcatataatg

SEQ ID NO: 137381 - DNA, 15 bp, Homo sapiens
ggtttttcatataat

SEQ ID NO: 137382 - DNA, 15 bp, Homo sapiens
gggtttttcatataa

SEQ ID NO: 137383 - DNA, 15 bp, Homo sapiens
agggtttttcatata

SEQ ID NO: 137384 - DNA, 15 bp, Homo sapiens
aagggtttttcatat

SEQ ID NO: 137385 - DNA, 15 bp, Homo sapiens
gaagggtttttcata

SEQ ID NO: 137386 - DNA, 15 bp, Homo sapiens
ggaagggtttttcat

SEQ ID NO: 137387 - DNA, 15 bp, Homo sapiens
gggaagggtttttca

SEQ ID NO: 137388 - DNA, 15 bp, Homo sapiens
tgggaagggtttttc

SEQ ID NO: 137389 - DNA, 15 bp, Homo sapiens
ctgggaagggttttt

SEQ ID NO: 137390 - DNA, 15 bp, Homo sapiens
cctgggaagggtttt

SEQ ID NO: 137391 - DNA, 15 bp, Homo sapiens
ccctgggaagggttt

SEQ ID NO: 137392 - DNA, 15 bp, Homo sapiens
cccctgggaagggtt

SEQ ID NO: 137393 - DNA, 15 bp, Homo sapiens
ccccctgggaagggt

SEQ ID NO: 137394 - DNA, 15 bp, Homo sapiens
tccccctgggaaggg

SEQ ID NO: 137395 - DNA, 15 bp, Homo sapiens
ttccccctgggaagg

SEQ ID NO: 137396 - DNA, 15 bp, Homo sapiens
attccccctgggaag

SEQ ID NO: 137397 - DNA, 15 bp, Homo sapiens
cattccccctgggaa

SEQ ID NO: 137398 - DNA, 15 bp, Homo sapiens
acattccccctggga

SEQ ID NO: 137399 - DNA, 15 bp, Homo sapiens
tacattccccctggg

SEQ ID NO: 137400 - DNA, 15 bp, Homo sapiens
atacattccccctgg

SEQ ID NO: 137401 - DNA, 15 bp, Homo sapiens
aatacattccccctg

SEQ ID NO: 137402 - DNA, 15 bp, Homo sapiens
caatacattccccct

SEQ ID NO: 137403 - DNA, 15 bp, Homo sapiens
gcaatacattccccc

SEQ ID NO: 137404 - DNA, 15 bp, Homo sapiens
agcaatacattcccc

SEQ ID NO: 137405 - DNA, 15 bp, Homo sapiens
tagcaatacattccc

SEQ ID NO: 137406 - DNA, 15 bp, Homo sapiens
gtagcaatacattcc

SEQ ID NO: 137407 - DNA, 15 bp, Homo sapiens
ggtagcaatacattc

SEQ ID NO: 137408 - DNA, 15 bp, Homo sapiens
tggtagcaatacatt

SEQ ID NO: 137409 - DNA, 15 bp, Homo sapiens
ttggtagcaatacat

SEQ ID NO: 137410 - DNA, 15 bp, Homo sapiens
attggtagcaataca

SEQ ID NO: 137411 - DNA, 15 bp, Homo sapiens
tattggtagcaatac

SEQ ID NO: 137412 - DNA, 15 bp, Homo sapiens
ctattggtagcaata

SEQ ID NO: 137413 - DNA, 15 bp, Homo sapiens
actattggtagcaat

SEQ ID NO: 137414 - DNA, 15 bp, Homo sapiens
tactattggtagcaa

SEQ ID NO: 137415 - DNA, 15 bp, Homo sapiens
ttactattggtagca

SEQ ID NO: 137416 - DNA, 15 bp, Homo sapiens
gttactattggtagc

SEQ ID NO: 137417 - DNA, 15 bp, Homo sapiens
ggttactattggtag

SEQ ID NO: 137418 - DNA, 15 bp, Homo sapiens
aggttactattggta

SEQ ID NO: 137419 - DNA, 15 bp, Homo sapiens
gaggttactattggt

SEQ ID NO: 137420 - DNA, 15 bp, Homo sapiens
cgaggttactattgg

SEQ ID NO: 137421 - DNA, 15 bp, Homo sapiens
acgaggttactattg

SEQ ID NO: 137422 - DNA, 15 bp, Homo sapiens
aacgaggttactatt

SEQ ID NO: 137423 - DNA, 15 bp, Homo sapiens
aaacgaggttactat

SEQ ID NO: 137424 - DNA, 15 bp, Homo sapiens
aaaacgaggttacta

SEQ ID NO: 137425 - DNA, 15 bp, Homo sapiens
taaaacgaggttact

SEQ ID NO: 137426 - DNA, 15 bp, Homo sapiens
ctaaaacgaggttac

SEQ ID NO: 137427 - DNA, 15 bp, Homo sapiens
cctaaaacgaggtta

SEQ ID NO: 137428 - DNA, 15 bp, Homo sapiens
ccctaaaacgaggtt

SEQ ID NO: 137429 - DNA, 15 bp, Homo sapiens
gccctaaaacgaggt

SEQ ID NO: 137430 - DNA, 15 bp, Homo sapiens
agccctaaaacgagg

SEQ ID NO: 137431 - DNA, 15 bp, Homo sapiens
aagccctaaaacgag

SEQ ID NO: 137432 - DNA, 15 bp, Homo sapiens
taagccctaaaacga

SEQ ID NO: 137433 - DNA, 15 bp, Homo sapiens
ttaagccctaaaacg

SEQ ID NO: 137434 - DNA, 15 bp, Homo sapiens
gttaagccctaaaac

SEQ ID NO: 137435 - DNA, 15 bp, Homo sapiens
agttaagccctaaaa

SEQ ID NO: 137436 - DNA, 15 bp, Homo sapiens
gagttaagccctaaa

SEQ ID NO: 137437 - DNA, 15 bp, Homo sapiens
tgagttaagccctaa

SEQ ID NO: 137438 - DNA, 15 bp, Homo sapiens
gtgagttaagcccta

SEQ ID NO: 137439 - DNA, 15 bp, Homo sapiens
tgtgagttaagccct

SEQ ID NO: 137440 - DNA, 15 bp, Homo sapiens
ttgtgagttaagccc

SEQ ID NO: 137441 - DNA, 15 bp, Homo sapiens
attgtgagttaagcc

SEQ ID NO: 137442 - DNA, 15 bp, Homo sapiens
cattgtgagttaagc

SEQ ID NO: 137443 - DNA, 15 bp, Homo sapiens
tcattgtgagttaag

SEQ ID NO: 137444 - DNA, 15 bp, Homo sapiens
ttcattgtgagttaa

SEQ ID NO: 137445 - DNA, 15 bp, Homo sapiens
attcattgtgagtta

SEQ ID NO: 137446 - DNA, 15 bp, Homo sapiens
cattcattgtgagtt

SEQ ID NO: 137447 - DNA, 15 bp, Homo sapiens
ccattcattgtgagt

SEQ ID NO: 137448 - DNA, 15 bp, Homo sapiens
cccattcattgtgag

SEQ ID NO: 137449 - DNA, 15 bp, Homo sapiens
tcccattcattgtga

SEQ ID NO: 137450 - DNA, 15 bp, Homo sapiens
atcccattcattgtg

SEQ ID NO: 137451 - DNA, 15 bp, Homo sapiens
tatcccattcattgt

SEQ ID NO: 137452 - DNA, 15 bp, Homo sapiens
ttatcccattcattg

SEQ ID NO: 137453 - DNA, 15 bp, Homo sapiens
attatcccattcatt

SEQ ID NO: 137454 - DNA, 15 bp, Homo sapiens
aattatcccattcat

SEQ ID NO: 137455 - DNA, 15 bp, Homo sapiens
aaattatcccattca

SEQ ID NO: 137456 - DNA, 15 bp, Homo sapiens
caaattatcccattc

SEQ ID NO: 137457 - DNA, 15 bp, Homo sapiens
gcaaattatcccatt

SEQ ID NO: 137458 - DNA, 15 bp, Homo sapiens
ggcaaattatcccat

SEQ ID NO: 137459 - DNA, 15 bp, Homo sapiens
aggcaaattatccca

SEQ ID NO: 137460 - DNA, 15 bp, Homo sapiens
taggcaaattatccc

SEQ ID NO: 137461 - DNA, 15 bp, Homo sapiens
ataggcaaattatcc

SEQ ID NO: 137462 - DNA, 15 bp, Homo sapiens
aataggcaaattatc

SEQ ID NO: 137463 - DNA, 15 bp, Homo sapiens
aaataggcaaattat

SEQ ID NO: 137464 - DNA, 15 bp, Homo sapiens
gaaataggcaaatta

SEQ ID NO: 137465 - DNA, 15 bp, Homo sapiens
agaaataggcaaatt

SEQ ID NO: 137466 - DNA, 15 bp, Homo sapiens
aagaaataggcaaat

SEQ ID NO: 137467 - DNA, 15 bp, Homo sapiens
taagaaataggcaaa

SEQ ID NO: 137468 - DNA, 15 bp, Homo sapiens
ataagaaataggcaa

SEQ ID NO: 137469 - DNA, 15 bp, Homo sapiens
cataagaaataggca

SEQ ID NO: 137470 - DNA, 15 bp, Homo sapiens
tcataagaaataggc

SEQ ID NO: 137471 - DNA, 15 bp, Homo sapiens
atcataagaaatagg

SEQ ID NO: 137472 - DNA, 15 bp, Homo sapiens
tatcataagaaatag

SEQ ID NO: 137473 - DNA, 15 bp, Homo sapiens
ttatcataagaaata

SEQ ID NO: 137474 - DNA, 15 bp, Homo sapiens
tttatcataagaaat

SEQ ID NO: 137475 - DNA, 15 bp, Homo sapiens
gtttatcataagaaa

SEQ ID NO: 137476 - DNA, 15 bp, Homo sapiens
ggtttatcataagaa

SEQ ID NO: 137477 - DNA, 15 bp, Homo sapiens
aggtttatcataaga

SEQ ID NO: 137478 - DNA, 15 bp, Homo sapiens
caggtttatcataag

SEQ ID NO: 137479 - DNA, 15 bp, Homo sapiens
acaggtttatcataa

SEQ ID NO: 137480 - DNA, 15 bp, Homo sapiens
cacaggtttatcata

SEQ ID NO: 137481 - DNA, 15 bp, Homo sapiens
tcacaggtttatcat

SEQ ID NO: 137482 - DNA, 15 bp, Homo sapiens
atcacaggtttatca

SEQ ID NO: 137483 - DNA, 15 bp, Homo sapiens
tatcacaggtttatc

SEQ ID NO: 137484 - DNA, 15 bp, Homo sapiens
atatcacaggtttat

SEQ ID NO: 137485 - DNA, 15 bp, Homo sapiens
aatatcacaggttta

SEQ ID NO: 137486 - DNA, 15 bp, Homo sapiens
aaatatcacaggttt

SEQ ID NO: 137487 - DNA, 15 bp, Homo sapiens
taaatatcacaggtt

SEQ ID NO: 137488 - DNA, 15 bp, Homo sapiens
gtaaatatcacaggt

SEQ ID NO: 137489 - DNA, 15 bp, Homo sapiens
agtaaatatcacagg

SEQ ID NO: 137490 - DNA, 15 bp, Homo sapiens
gagtaaatatcacag

SEQ ID NO: 137491 - DNA, 15 bp, Homo sapiens
agagtaaatatcaca

SEQ ID NO: 137492 - DNA, 15 bp, Homo sapiens
gagagtaaatatcac

SEQ ID NO: 137493 - DNA, 15 bp, Homo sapiens
cgagagtaaatatca

SEQ ID NO: 137494 - DNA, 15 bp, Homo sapiens
gcgagagtaaatatc

SEQ ID NO: 137495 - DNA, 15 bp, Homo sapiens
agcgagagtaaatat

SEQ ID NO: 137496 - DNA, 15 bp, Homo sapiens
aagcgagagtaaata

SEQ ID NO: 137497 - DNA, 15 bp, Homo sapiens
caagcgagagtaaat

SEQ ID NO: 137498 - DNA, 15 bp, Homo sapiens
tcaagcgagagtaaa

SEQ ID NO: 137499 - DNA, 15 bp, Homo sapiens
atcaagcgagagtaa

SEQ ID NO: 137500 - DNA, 15 bp, Homo sapiens
catcaagcgagagta

SEQ ID NO: 137501 - DNA, 15 bp, Homo sapiens
acatcaagcgagagt

SEQ ID NO: 137502 - DNA, 15 bp, Homo sapiens
gacatcaagcgagag

SEQ ID NO: 137503 - DNA, 15 bp, Homo sapiens
agacatcaagcgaga

SEQ ID NO: 137504 - DNA, 15 bp, Homo sapiens
aagacatcaagcgag

SEQ ID NO: 137505 - DNA, 15 bp, Homo sapiens
aaagacatcaagcga

SEQ ID NO: 137506 - DNA, 15 bp, Homo sapiens
caaagacatcaagcg

SEQ ID NO: 137507 - DNA, 15 bp, Homo sapiens
ccaaagacatcaagc

SEQ ID NO: 137508 - DNA, 15 bp, Homo sapiens
accaaagacatcaag

SEQ ID NO: 137509 - DNA, 15 bp, Homo sapiens
aaccaaagacatcaa

SEQ ID NO: 137510 - DNA, 15 bp, Homo sapiens
aaaccaaagacatca

SEQ ID NO: 137511 - DNA, 15 bp, Homo sapiens
gaaaccaaagacatc

SEQ ID NO: 137512 - DNA, 15 bp, Homo sapiens
tgaaaccaaagacat

SEQ ID NO: 137513 - DNA, 15 bp, Homo sapiens
atgaaaccaaagaca

SEQ ID NO: 137514 - DNA, 15 bp, Homo sapiens
aatgaaaccaaagac

SEQ ID NO: 137515 - DNA, 15 bp, Homo sapiens
aaatgaaaccaaaga

SEQ ID NO: 137516 - DNA, 15 bp, Homo sapiens
caaatgaaaccaaag

SEQ ID NO: 137517 - DNA, 15 bp, Homo sapiens
acaaatgaaaccaaa

SEQ ID NO: 137518 - DNA, 15 bp, Homo sapiens
aacaaatgaaaccaa

SEQ ID NO: 137519 - DNA, 15 bp, Homo sapiens
aaacaaatgaaacca

SEQ ID NO: 137520 - DNA, 15 bp, Homo sapiens
taaacaaatgaaacc

SEQ ID NO: 137521 - DNA, 15 bp, Homo sapiens
gtaaacaaatgaaac

SEQ ID NO: 137522 - DNA, 15 bp, Homo sapiens
agtaaacaaatgaaa

SEQ ID NO: 137523 - DNA, 15 bp, Homo sapiens
cagtaaacaaatgaa

SEQ ID NO: 137524 - DNA, 15 bp, Homo sapiens
acagtaaacaaatga

SEQ ID NO: 137525 - DNA, 15 bp, Homo sapiens
aacagtaaacaaatg

SEQ ID NO: 137526 - DNA, 15 bp, Homo sapiens
taacagtaaacaaat

SEQ ID NO: 137527 - DNA, 15 bp, Homo sapiens
ttaacagtaaacaaa

SEQ ID NO: 137528 - DNA, 15 bp, Homo sapiens
tttaacagtaaacaa

SEQ ID NO: 137529 - DNA, 15 bp, Homo sapiens
ctttaacagtaaaca

SEQ ID NO: 137530 - DNA, 15 bp, Homo sapiens
cctttaacagtaaac

SEQ ID NO: 137531 - DNA, 15 bp, Homo sapiens
tcctttaacagtaaa

SEQ ID NO: 137532 - DNA, 15 bp, Homo sapiens
atcctttaacagtaa

SEQ ID NO: 137533 - DNA, 15 bp, Homo sapiens
aatcctttaacagta

SEQ ID NO: 137534 - DNA, 15 bp, Homo sapiens
gaatcctttaacagt

SEQ ID NO: 137535 - DNA, 15 bp, Homo sapiens
agaatcctttaacag

SEQ ID NO: 137536 - DNA, 15 bp, Homo sapiens
tagaatcctttaaca

SEQ ID NO: 137537 - DNA, 15 bp, Homo sapiens
atagaatcctttaac

SEQ ID NO: 137538 - DNA, 15 bp, Homo sapiens
aatagaatcctttaa

SEQ ID NO: 137539 - DNA, 15 bp, Homo sapiens
taatagaatccttta

SEQ ID NO: 137540 - DNA, 15 bp, Homo sapiens
ctaatagaatccttt

SEQ ID NO: 137541 - DNA, 15 bp, Homo sapiens
actaatagaatcctt

SEQ ID NO: 137542 - DNA, 15 bp, Homo sapiens
tactaatagaatcct

SEQ ID NO: 137543 - DNA, 15 bp, Homo sapiens
ttactaatagaatcc

SEQ ID NO: 137544 - DNA, 15 bp, Homo sapiens
attactaatagaatc

SEQ ID NO: 137545 - DNA, 15 bp, Homo sapiens
tattactaatagaat

SEQ ID NO: 137546 - DNA, 15 bp, Homo sapiens
ctattactaatagaa

SEQ ID NO: 137547 - DNA, 15 bp, Homo sapiens
tctattactaataga

SEQ ID NO: 137548 - DNA, 15 bp, Homo sapiens
ttctattactaatag

SEQ ID NO: 137549 - DNA, 15 bp, Homo sapiens
attctattactaata

SEQ ID NO: 137550 - DNA, 15 bp, Homo sapiens
aattctattactaat

SEQ ID NO: 137551 - DNA, 15 bp, Homo sapiens
caattctattactaa

SEQ ID NO: 137552 - DNA, 15 bp, Homo sapiens
ccaattctattacta

SEQ ID NO: 137553 - DNA, 15 bp, Homo sapiens
accaattctattact

SEQ ID NO: 137554 - DNA, 15 bp, Homo sapiens
gaccaattctattac

SEQ ID NO: 137555 - DNA, 15 bp, Homo sapiens
tgaccaattctatta

SEQ ID NO: 137556 - DNA, 15 bp, Homo sapiens
atgaccaattctatt

SEQ ID NO: 137557 - DNA, 15 bp, Homo sapiens
tatgaccaattctat

SEQ ID NO: 137558 - DNA, 15 bp, Homo sapiens
ttatgaccaattcta

SEQ ID NO: 137559 - DNA, 15 bp, Homo sapiens
cttatgaccaattct

SEQ ID NO: 137560 - DNA, 15 bp, Homo sapiens
acttatgaccaattc

SEQ ID NO: 137561 - DNA, 15 bp, Homo sapiens
tacttatgaccaatt

SEQ ID NO: 137562 - DNA, 15 bp, Homo sapiens
gtacttatgaccaat

SEQ ID NO: 137563 - DNA, 15 bp, Homo sapiens
agtacttatgaccaa

SEQ ID NO: 137564 - DNA, 15 bp, Homo sapiens
aagtacttatgacca

SEQ ID NO: 137565 - DNA, 15 bp, Homo sapiens
aaagtacttatgacc

SEQ ID NO: 137566 - DNA, 15 bp, Homo sapiens
taaagtacttatgac

SEQ ID NO: 137567 - DNA, 15 bp, Homo sapiens
ataaagtacttatga

SEQ ID NO: 137568 - DNA, 15 bp, Homo sapiens
cataaagtacttatg

SEQ ID NO: 137569 - DNA, 15 bp, Homo sapiens
acataaagtacttat

SEQ ID NO: 137570 - DNA, 15 bp, Homo sapiens
tacataaagtactta

SEQ ID NO: 137571 - DNA, 15 bp, Homo sapiens
ttacataaagtactt

SEQ ID NO: 137572 - DNA, 15 bp, Homo sapiens
gttacataaagtact

SEQ ID NO: 137573 - DNA, 15 bp, Homo sapiens
agttacataaagtac

SEQ ID NO: 137574 - DNA, 15 bp, Homo sapiens
aagttacataaagta

SEQ ID NO: 137575 - DNA, 15 bp, Homo sapiens
aaagttacataaagt

SEQ ID NO: 137576 - DNA, 15 bp, Homo sapiens
aaaagttacataaag

SEQ ID NO: 137577 - DNA, 15 bp, Homo sapiens
aaaaagttacataaa

SEQ ID NO: 137578 - DNA, 15 bp, Homo sapiens
taaaaagttacataa

SEQ ID NO: 137579 - DNA, 15 bp, Homo sapiens
ttaaaaagttacata

SEQ ID NO: 137580 - DNA, 15 bp, Homo sapiens
gttaaaaagttacat

SEQ ID NO: 137581 - DNA, 15 bp, Homo sapiens
agttaaaaagttaca

SEQ ID NO: 137582 - DNA, 15 bp, Homo sapiens
cagttaaaaagttac

SEQ ID NO: 137583 - DNA, 15 bp, Homo sapiens
tcagttaaaaagtta

SEQ ID NO: 137584 - DNA, 15 bp, Homo sapiens
gtcagttaaaaagtt

SEQ ID NO: 137585 - DNA, 15 bp, Homo sapiens
tgtcagttaaaaagt

SEQ ID NO: 137586 - DNA, 15 bp, Homo sapiens
ttgtcagttaaaaag

SEQ ID NO: 137587 - DNA, 15 bp, Homo sapiens
cttgtcagttaaaaa

SEQ ID NO: 137588 - DNA, 15 bp, Homo sapiens
tcttgtcagttaaaa

SEQ ID NO: 137589 - DNA, 15 bp, Homo sapiens
ctcttgtcagttaaa

SEQ ID NO: 137590 - DNA, 15 bp, Homo sapiens
tctcttgtcagttaa

SEQ ID NO: 137591 - DNA, 15 bp, Homo sapiens
ttctcttgtcagtta

SEQ ID NO: 137592 - DNA, 15 bp, Homo sapiens
gttctcttgtcagtt

SEQ ID NO: 137593 - DNA, 15 bp, Homo sapiens
tgttctcttgtcagt

SEQ ID NO: 137594 - DNA, 15 bp, Homo sapiens
atgttctcttgtcag

SEQ ID NO: 137595 - DNA, 15 bp, Homo sapiens
aatgttctcttgtca

SEQ ID NO: 137596 - DNA, 15 bp, Homo sapiens
taatgttctcttgtc

SEQ ID NO: 137597 - DNA, 15 bp, Homo sapiens
ataatgttctcttgt

SEQ ID NO: 137598 - DNA, 15 bp, Homo sapiens
cataatgttctcttg

SEQ ID NO: 137599 - DNA, 15 bp, Homo sapiens
tcataatgttctctt

SEQ ID NO: 137600 - DNA, 15 bp, Homo sapiens
atcataatgttctct

SEQ ID NO: 137601 - DNA, 15 bp, Homo sapiens
tatcataatgttctc

SEQ ID NO: 137602 - DNA, 15 bp, Homo sapiens
ctatcataatgttct

SEQ ID NO: 137603 - DNA, 15 bp, Homo sapiens
tctatcataatgttc

SEQ ID NO: 137604 - DNA, 15 bp, Homo sapiens
atctatcataatgtt

SEQ ID NO: 137605 - DNA, 15 bp, Homo sapiens
aatctatcataatgt

SEQ ID NO: 137606 - DNA, 15 bp, Homo sapiens
aaatctatcataatg

SEQ ID NO: 137607 - DNA, 15 bp, Homo sapiens
caaatctatcataat

SEQ ID NO: 137608 - DNA, 15 bp, Homo sapiens
ccaaatctatcataa

SEQ ID NO: 137609 - DNA, 15 bp, Homo sapiens
gccaaatctatcata

SEQ ID NO: 137610 - DNA, 15 bp, Homo sapiens
ggccaaatctatcat

SEQ ID NO: 137611 - DNA, 15 bp, Homo sapiens
aggccaaatctatca

SEQ ID NO: 137612 - DNA, 15 bp, Homo sapiens
gaggccaaatctatc

SEQ ID NO: 137613 - DNA, 15 bp, Homo sapiens
agaggccaaatctat

SEQ ID NO: 137614 - DNA, 15 bp, Homo sapiens
gagaggccaaatcta

SEQ ID NO: 137615 - DNA, 15 bp, Homo sapiens
agagaggccaaatct

SEQ ID NO: 137616 - DNA, 15 bp, Homo sapiens
aagagaggccaaatc

SEQ ID NO: 137617 - DNA, 15 bp, Homo sapiens
gaagagaggccaaat

SEQ ID NO: 137618 - DNA, 15 bp, Homo sapiens
ggaagagaggccaaa

SEQ ID NO: 137619 - DNA, 15 bp, Homo sapiens
aggaagagaggccaa

SEQ ID NO: 137620 - DNA, 15 bp, Homo sapiens
aaggaagagaggcca

SEQ ID NO: 137621 - DNA, 15 bp, Homo sapiens
taaggaagagaggcc

SEQ ID NO: 137622 - DNA, 15 bp, Homo sapiens
ttaaggaagagaggc

SEQ ID NO: 137623 - DNA, 15 bp, Homo sapiens
cttaaggaagagagg

SEQ ID NO: 137624 - DNA, 15 bp, Homo sapiens
acttaaggaagagag

SEQ ID NO: 137625 - DNA, 15 bp, Homo sapiens
aacttaaggaagaga

SEQ ID NO: 137626 - DNA, 15 bp, Homo sapiens
aaacttaaggaagag

SEQ ID NO: 137627 - DNA, 15 bp, Homo sapiens
taaacttaaggaaga

SEQ ID NO: 137628 - DNA, 15 bp, Homo sapiens
ttaaacttaaggaag

SEQ ID NO: 137629 - DNA, 15 bp, Homo sapiens
tttaaacttaaggaa

SEQ ID NO: 137630 - DNA, 15 bp, Homo sapiens
ttttaaacttaagga

SEQ ID NO: 137631 - DNA, 15 bp, Homo sapiens
gttttaaacttaagg

SEQ ID NO: 137632 - DNA, 15 bp, Homo sapiens
agttttaaacttaag

SEQ ID NO: 137633 - DNA, 15 bp, Homo sapiens
aagttttaaacttaa

SEQ ID NO: 137634 - DNA, 15 bp, Homo sapiens
taagttttaaactta

SEQ ID NO: 137635 - DNA, 15 bp, Homo sapiens
ttaagttttaaactt

SEQ ID NO: 137636 - DNA, 15 bp, Homo sapiens
cttaagttttaaact

SEQ ID NO: 137637 - DNA, 15 bp, Homo sapiens
gcttaagttttaaac

SEQ ID NO: 137638 - DNA, 15 bp, Homo sapiens
tgcttaagttttaaa

SEQ ID NO: 137639 - DNA, 15 bp, Homo sapiens
ttgcttaagttttaa

SEQ ID NO: 137640 - DNA, 15 bp, Homo sapiens
attgcttaagtttta

SEQ ID NO: 137641 - DNA, 15 bp, Homo sapiens
aattgcttaagtttt

SEQ ID NO: 137642 - DNA, 15 bp, Homo sapiens
aaattgcttaagttt

SEQ ID NO: 137643 - DNA, 15 bp, Homo sapiens
taaattgcttaagtt

SEQ ID NO: 137644 - DNA, 15 bp, Homo sapiens
ataaattgcttaagt

SEQ ID NO: 137645 - DNA, 15 bp, Homo sapiens
aataaattgcttaag

SEQ ID NO: 137646 - DNA, 15 bp, Homo sapiens
aaataaattgcttaa

SEQ ID NO: 137647 - DNA, 15 bp, Homo sapiens
taaataaattgctta

SEQ ID NO: 137648 - DNA, 15 bp, Homo sapiens
ttaaataaattgctt

SEQ ID NO: 137649 - DNA, 15 bp, Homo sapiens
tttaaataaattgct

SEQ ID NO: 137650 - DNA, 15 bp, Homo sapiens
gtttaaataaattgc

SEQ ID NO: 137651 - DNA, 15 bp, Homo sapiens
tgtttaaataaattg

SEQ ID NO: 137652 - DNA, 15 bp, Homo sapiens
ctgtttaaataaatt

SEQ ID NO: 137653 - DNA, 15 bp, Homo sapiens
gctgtttaaataaat

SEQ ID NO: 137654 - DNA, 15 bp, Homo sapiens
agctgtttaaataaa

SEQ ID NO: 137655 - DNA, 15 bp, Homo sapiens
tagctgtttaaataa

SEQ ID NO: 137656 - DNA, 15 bp, Homo sapiens
ttagctgtttaaata

SEQ ID NO: 137657 - DNA, 15 bp, Homo sapiens
cttagctgtttaaat

SEQ ID NO: 137658 - DNA, 15 bp, Homo sapiens
tcttagctgtttaaa

SEQ ID NO: 137659 - DNA, 15 bp, Homo sapiens
gtcttagctgtttaa

SEQ ID NO: 137660 - DNA, 15 bp, Homo sapiens
tgtcttagctgttta

SEQ ID NO: 137661 - DNA, 15 bp, Homo sapiens
ctgtcttagctgttt

SEQ ID NO: 137662 - DNA, 15 bp, Homo sapiens
tctgtcttagctgtt

SEQ ID NO: 137663 - DNA, 15 bp, Homo sapiens
ttctgtcttagctgt

SEQ ID NO: 137664 - DNA, 15 bp, Homo sapiens
attctgtcttagctg

SEQ ID NO: 137665 - DNA, 15 bp, Homo sapiens
cattctgtcttagct

SEQ ID NO: 137666 - DNA, 15 bp, Homo sapiens
tcattctgtcttagc

SEQ ID NO: 137667 - DNA, 15 bp, Homo sapiens
ttcattctgtcttag

SEQ ID NO: 137668 - DNA, 15 bp, Homo sapiens
tttcattctgtctta

SEQ ID NO: 137669 - DNA, 15 bp, Homo sapiens
gtttcattctgtctt

SEQ ID NO: 137670 - DNA, 15 bp, Homo sapiens
tgtttcattctgtct

SEQ ID NO: 137671 - DNA, 15 bp, Homo sapiens
ctgtttcattctgtc

SEQ ID NO: 137672 - DNA, 15 bp, Homo sapiens
tctgtttcattctgt

SEQ ID NO: 137673 - DNA, 15 bp, Homo sapiens
atctgtttcattctg

SEQ ID NO: 137674 - DNA, 15 bp, Homo sapiens
aatctgtttcattct

SEQ ID NO: 137675 - DNA, 15 bp, Homo sapiens
caatctgtttcattc

SEQ ID NO: 137676 - DNA, 15 bp, Homo sapiens
acaatctgtttcatt

SEQ ID NO: 137677 - DNA, 15 bp, Homo sapiens
gacaatctgtttcat

SEQ ID NO: 137678 - DNA, 15 bp, Homo sapiens
agacaatctgtttca

SEQ ID NO: 137679 - DNA, 15 bp, Homo sapiens
gagacaatctgtttc

SEQ ID NO: 137680 - DNA, 15 bp, Homo sapiens
tgagacaatctgttt

SEQ ID NO: 137681 - DNA, 15 bp, Homo sapiens
atgagacaatctgtt

SEQ ID NO: 137682 - DNA, 15 bp, Homo sapiens
aatgagacaatctgt

SEQ ID NO: 137683 - DNA, 15 bp, Homo sapiens
caatgagacaatctg

SEQ ID NO: 137684 - DNA, 15 bp, Homo sapiens
tcaatgagacaatct

SEQ ID NO: 137685 - DNA, 15 bp, Homo sapiens
ctcaatgagacaatc

SEQ ID NO: 137686 - DNA, 15 bp, Homo sapiens
gctcaatgagacaat

SEQ ID NO: 137687 - DNA, 15 bp, Homo sapiens
tgctcaatgagacaa

SEQ ID NO: 137688 - DNA, 15 bp, Homo sapiens
ttgctcaatgagaca

SEQ ID NO: 137689 - DNA, 15 bp, Homo sapiens
cttgctcaatgagac

SEQ ID NO: 137690 - DNA, 15 bp, Homo sapiens
acttgctcaatgaga

SEQ ID NO: 137691 - DNA, 15 bp, Homo sapiens
aacttgctcaatgag

SEQ ID NO: 137692 - DNA, 15 bp, Homo sapiens
aaacttgctcaatga

SEQ ID NO: 137693 - DNA, 15 bp, Homo sapiens
aaaacttgctcaatg

SEQ ID NO: 137694 - DNA, 15 bp, Homo sapiens
taaaacttgctcaat

SEQ ID NO: 137695 - DNA, 15 bp, Homo sapiens
ttaaaacttgctcaa

SEQ ID NO: 137696 - DNA, 15 bp, Homo sapiens
tttaaaacttgctca

SEQ ID NO: 137697 - DNA, 15 bp, Homo sapiens
ctttaaaacttgctc

SEQ ID NO: 137698 - DNA, 15 bp, Homo sapiens
tctttaaaacttgct

SEQ ID NO: 137699 - DNA, 15 bp, Homo sapiens
ttctttaaaacttgc

SEQ ID NO: 137700 - DNA, 15 bp, Homo sapiens
attctttaaaacttg

SEQ ID NO: 137701 - DNA, 15 bp, Homo sapiens
cattctttaaaactt

SEQ ID NO: 137702 - DNA, 15 bp, Homo sapiens
tcattctttaaaact

SEQ ID NO: 137703 - DNA, 15 bp, Homo sapiens
atcattctttaaaac

SEQ ID NO: 137704 - DNA, 15 bp, Homo sapiens
catcattctttaaaa

SEQ ID NO: 137705 - DNA, 15 bp, Homo sapiens
gtcatcattctttaa

SEQ ID NO: 137706 - DNA, 15 bp, Homo sapiens
tgtcatcattcttta

SEQ ID NO: 137707 - DNA, 15 bp, Homo sapiens
atgtcatcattcttt

SEQ ID NO: 137708 - DNA, 15 bp, Homo sapiens
catgtcatcattctt

SEQ ID NO: 137709 - DNA, 15 bp, Homo sapiens
acatgtcatcattct

SEQ ID NO: 137710 - DNA, 15 bp, Homo sapiens
tacatgtcatcattc

SEQ ID NO: 137711 - DNA, 15 bp, Homo sapiens
ttacatgtcatcatt

SEQ ID NO: 137712 - DNA, 15 bp, Homo sapiens
cttacatgtcatcat

SEQ ID NO: 137713 - DNA, 15 bp, Homo sapiens
acttacatgtcatca

SEQ ID NO: 137714 - DNA, 15 bp, Homo sapiens
tacttacatgtcatc

SEQ ID NO: 137715 - DNA, 15 bp, Homo sapiens
atacttacatgtcat

SEQ ID NO: 137716 - DNA, 15 bp, Homo sapiens
tatacttacatgtca

SEQ ID NO: 137717 - DNA, 15 bp, Homo sapiens
ttatacttacatgtc

SEQ ID NO: 137718 - DNA, 15 bp, Homo sapiens
gttatacttacatgt

SEQ ID NO: 137719 - DNA, 15 bp, Homo sapiens
agttatacttacatg

SEQ ID NO: 137720 - DNA, 15 bp, Homo sapiens
aagttatacttacat

SEQ ID NO: 137721 - DNA, 15 bp, Homo sapiens
taagttatacttaca

SEQ ID NO: 137722 - DNA, 15 bp, Homo sapiens
ttaagttatacttac

SEQ ID NO: 137723 - DNA, 15 bp, Homo sapiens
cttaagttatactta

SEQ ID NO: 137724 - DNA, 15 bp, Homo sapiens
ccttaagttatactt

SEQ ID NO: 137725 - DNA, 15 bp, Homo sapiens
gccttaagttatact

SEQ ID NO: 137726 - DNA, 15 bp, Homo sapiens
ggccttaagttatac

SEQ ID NO: 137727 - DNA, 15 bp, Homo sapiens
aggccttaagttata

SEQ ID NO: 137728 - DNA, 15 bp, Homo sapiens
caggccttaagttat

SEQ ID NO: 137729 - DNA, 15 bp, Homo sapiens
tcaggccttaagtta

SEQ ID NO: 137730 - DNA, 15 bp, Homo sapiens
ttcaggccttaagtt

SEQ ID NO: 137731 - DNA, 15 bp, Homo sapiens
gttcaggccttaagt

SEQ ID NO: 137732 - DNA, 15 bp, Homo sapiens
tgttcaggccttaag

SEQ ID NO: 137733 - DNA, 15 bp, Homo sapiens
ctgttcaggccttaa

SEQ ID NO: 137734 - DNA, 15 bp, Homo sapiens
gctgttcaggcctta

SEQ ID NO: 137735 - DNA, 15 bp, Homo sapiens
ggctgttcaggcctt

SEQ ID NO: 137736 - DNA, 15 bp, Homo sapiens
aggctgttcaggcct

SEQ ID NO: 137737 - DNA, 15 bp, Homo sapiens
aaggctgttcaggcc

SEQ ID NO: 137738 - DNA, 15 bp, Homo sapiens
caaggctgttcaggc

SEQ ID NO: 137739 - DNA, 15 bp, Homo sapiens
acaaggctgttcagg

SEQ ID NO: 137740 - DNA, 15 bp, Homo sapiens
aacaaggctgttcag

SEQ ID NO: 137741 - DNA, 15 bp, Homo sapiens
caacaaggctgttca

SEQ ID NO: 137742 - DNA, 15 bp, Homo sapiens
tcaacaaggctgttc

SEQ ID NO: 137743 - DNA, 15 bp, Homo sapiens
atcaacaaggctgtt

SEQ ID NO: 137744 - DNA, 15 bp, Homo sapiens
tatcaacaaggctgt

SEQ ID NO: 137745 - DNA, 15 bp, Homo sapiens
ctatcaacaaggctg

SEQ ID NO: 137746 - DNA, 15 bp, Homo sapiens
gctatcaacaaggct

SEQ ID NO: 137747 - DNA, 15 bp, Homo sapiens
agctatcaacaaggc

SEQ ID NO: 137748 - DNA, 15 bp, Homo sapiens
aagctatcaacaagg

SEQ ID NO: 137749 - DNA, 15 bp, Homo sapiens
aaagctatcaacaag

SEQ ID NO: 137750 - DNA, 15 bp, Homo sapiens
aaaagctatcaacaa

SEQ ID NO: 137751 - DNA, 15 bp, Homo sapiens
aaaaagctatcaaca

SEQ ID NO: 137752 - DNA, 15 bp, Homo sapiens
aaaaaagctatcaac

SEQ ID NO: 137753 - DNA, 15 bp, Homo sapiens
caaaaaagctatcaa

SEQ ID NO: 137754 - DNA, 15 bp, Homo sapiens
acaaaaaagctatca

SEQ ID NO: 137755 - DNA, 15 bp, Homo sapiens
aacaaaaaagctatc

SEQ ID NO: 137756 - DNA, 15 bp, Homo sapiens
aaacaaaaaagctat

SEQ ID NO: 137757 - DNA, 15 bp, Homo sapiens
aaaacaaaaaagcta

SEQ ID NO: 137758 - DNA, 15 bp, Homo sapiens
aaaaacaaaaaagct

SEQ ID NO: 137759 - DNA, 15 bp, Homo sapiens
aaaaaacaaaaaagc

SEQ ID NO: 137760 - DNA, 15 bp, Homo sapiens
caaaaaacaaaaaag

SEQ ID NO: 137761 - DNA, 15 bp, Homo sapiens
tcaaaaaacaaaaaa

SEQ ID NO: 137762 - DNA, 15 bp, Homo sapiens
atccagcctgggcaa

SEQ ID NO: 137763 - DNA, 15 bp, Homo sapiens
catccagcctgggca

SEQ ID NO: 137764 - DNA, 15 bp, Homo sapiens
gcatccagcctgggc

SEQ ID NO: 137765 - DNA, 15 bp, Homo sapiens
tgcatccagcctggg

SEQ ID NO: 137766 - DNA, 15 bp, Homo sapiens
ttgcatccagcctgg

SEQ ID NO: 137767 - DNA, 15 bp, Homo sapiens
attgcatccagcctg

SEQ ID NO: 137768 - DNA, 15 bp, Homo sapiens
cattgcatccagcct

SEQ ID NO: 137769 - DNA, 15 bp, Homo sapiens
ccattgcatccagcc

SEQ ID NO: 137770 - DNA, 15 bp, Homo sapiens
accattgcatccagc

SEQ ID NO: 137771 - DNA, 15 bp, Homo sapiens
caccattgcatccag

SEQ ID NO: 137772 - DNA, 15 bp, Homo sapiens
gcaccattgcatcca

SEQ ID NO: 137773 - DNA, 15 bp, Homo sapiens
tgcaccattgcatcc

SEQ ID NO: 137774 - DNA, 15 bp, Homo sapiens
ttgcaccattgcatc

SEQ ID NO: 137775 - DNA, 15 bp, Homo sapiens
attgcaccattgcat

SEQ ID NO: 137776 - DNA, 15 bp, Homo sapiens
agattgcaccattgc

SEQ ID NO: 137777 - DNA, 15 bp, Homo sapiens
aagattgcaccattg

SEQ ID NO: 137778 - DNA, 15 bp, Homo sapiens
caagattgcaccatt

SEQ ID NO: 137779 - DNA, 15 bp, Homo sapiens
tcaagattgcaccat

SEQ ID NO: 137780 - DNA, 15 bp, Homo sapiens
gtcaagattgcacca

SEQ ID NO: 137781 - DNA, 15 bp, Homo sapiens
agtcaagattgcacc

SEQ ID NO: 137782 - DNA, 15 bp, Homo sapiens
gagtcaagattgcac

SEQ ID NO: 137783 - DNA, 15 bp, Homo sapiens
tgagtcaagattgca

SEQ ID NO: 137784 - DNA, 15 bp, Homo sapiens
gtgagtcaagattgc

SEQ ID NO: 137785 - DNA, 15 bp, Homo sapiens
agtgagtcaagattg

SEQ ID NO: 137786 - DNA, 15 bp, Homo sapiens
cagtgagtcaagatt

SEQ ID NO: 137787 - DNA, 15 bp, Homo sapiens
gcagtgagtcaagat

SEQ ID NO: 137788 - DNA, 15 bp, Homo sapiens
tgcagtgagtcaaga

SEQ ID NO: 137789 - DNA, 15 bp, Homo sapiens
ttgcagtgagtcaag

SEQ ID NO: 137790 - DNA, 15 bp, Homo sapiens
gttgcagtgagtcaa

SEQ ID NO: 137791 - DNA, 15 bp, Homo sapiens
ggttgcagtgagtca

SEQ ID NO: 137792 - DNA, 15 bp, Homo sapiens
aggttgcagtgagtc

SEQ ID NO: 137793 - DNA, 15 bp, Homo sapiens
caggaggcagaggtt

SEQ ID NO: 137794 - DNA, 15 bp, Homo sapiens
ccaggaggcagaggt

SEQ ID NO: 137795 - DNA, 15 bp, Homo sapiens
tcccaggaggcagag

SEQ ID NO: 137796 - DNA, 15 bp, Homo sapiens
atcccaggaggcaga

SEQ ID NO: 137797 - DNA, 15 bp, Homo sapiens
gatcccaggaggcag

SEQ ID NO: 137798 - DNA, 15 bp, Homo sapiens
ggatcccaggaggca

SEQ ID NO: 137799 - DNA, 15 bp, Homo sapiens
tggatcccaggaggc

SEQ ID NO: 137800 - DNA, 15 bp, Homo sapiens
ctggatcccaggagg

SEQ ID NO: 137801 - DNA, 15 bp, Homo sapiens
gctggatcccaggag

SEQ ID NO: 137802 - DNA, 15 bp, Homo sapiens
cgctggatcccagga

SEQ ID NO: 137803 - DNA, 15 bp, Homo sapiens
tcgctggatcccagg

SEQ ID NO: 137804 - DNA, 15 bp, Homo sapiens
atcgctggatcccag

SEQ ID NO: 137805 - DNA, 15 bp, Homo sapiens
aatcgctggatccca

SEQ ID NO: 137806 - DNA, 15 bp, Homo sapiens
gaatcgctggatccc

SEQ ID NO: 137807 - DNA, 15 bp, Homo sapiens
agaatcgctggatcc

SEQ ID NO: 137808 - DNA, 15 bp, Homo sapiens
gagaatcgctggatc

SEQ ID NO: 137809 - DNA, 15 bp, Homo sapiens
ggagaatcgctggat

SEQ ID NO: 137810 - DNA, 15 bp, Homo sapiens
aggagaatcgctgga

SEQ ID NO: 137811 - DNA, 15 bp, Homo sapiens
caggagaatcgctgg

SEQ ID NO: 137812 - DNA, 15 bp, Homo sapiens
atggtggcaggtgcc

SEQ ID NO: 137813 - DNA, 15 bp, Homo sapiens
catggtggcaggtgc

SEQ ID NO: 137814 - DNA, 15 bp, Homo sapiens
gcatggtggcaggtg

SEQ ID NO: 137815 - DNA, 15 bp, Homo sapiens
ggcatggtggcaggt

SEQ ID NO: 137816 - DNA, 15 bp, Homo sapiens
taaaaattagctggg

SEQ ID NO: 137817 - DNA, 15 bp, Homo sapiens
tataaaaattagctg

SEQ ID NO: 137818 - DNA, 15 bp, Homo sapiens
atataaaaattagct

SEQ ID NO: 137819 - DNA, 15 bp, Homo sapiens
tggtgaaaccctgtc

SEQ ID NO: 137820 - DNA, 15 bp, Homo sapiens
atggtgaaaccctgt

SEQ ID NO: 137821 - DNA, 15 bp, Homo sapiens
gccagaagttcaaga

SEQ ID NO: 137822 - DNA, 15 bp, Homo sapiens
agccagaagttcaag

SEQ ID NO: 137823 - DNA, 15 bp, Homo sapiens
aagccagaagttcaa

SEQ ID NO: 137824 - DNA, 15 bp, Homo sapiens
gaagccagaagttca

SEQ ID NO: 137825 - DNA, 15 bp, Homo sapiens
tgaagccagaagttc

SEQ ID NO: 137826 - DNA, 15 bp, Homo sapiens
ctgaagccagaagtt

SEQ ID NO: 137827 - DNA, 15 bp, Homo sapiens
cctgaagccagaagt

SEQ ID NO: 137828 - DNA, 15 bp, Homo sapiens
acctgaagccagaag

SEQ ID NO: 137829 - DNA, 15 bp, Homo sapiens
cacctgaagccagaa

SEQ ID NO: 137830 - DNA, 15 bp, Homo sapiens
tcacctgaagccaga

SEQ ID NO: 137831 - DNA, 15 bp, Homo sapiens
atcacctgaagccag

SEQ ID NO: 137832 - DNA, 15 bp, Homo sapiens
gatcacctgaagcca

SEQ ID NO: 137833 - DNA, 15 bp, Homo sapiens
ggatcacctgaagcc

SEQ ID NO: 137834 - DNA, 15 bp, Homo sapiens
tggatcacctgaagc

SEQ ID NO: 137835 - DNA, 15 bp, Homo sapiens
gacacctgtaatccc

SEQ ID NO: 137836 - DNA, 15 bp, Homo sapiens
tgacacctgtaatcc

SEQ ID NO: 137837 - DNA, 15 bp, Homo sapiens
ctgacacctgtaatc

SEQ ID NO: 137838 - DNA, 15 bp, Homo sapiens
gctgacacctgtaat

SEQ ID NO: 137839 - DNA, 15 bp, Homo sapiens
ggctgacacctgtaa

SEQ ID NO: 137840 - DNA, 15 bp, Homo sapiens
tggctgacacctgta

SEQ ID NO: 137841 - DNA, 15 bp, Homo sapiens
gtggctgacacctgt

SEQ ID NO: 137842 - DNA, 15 bp, Homo sapiens
agtggctgacacctg

SEQ ID NO: 137843 - DNA, 15 bp, Homo sapiens
cagtggctgacacct

SEQ ID NO: 137844 - DNA, 15 bp, Homo sapiens
gcagtggctgacacc

SEQ ID NO: 137845 - DNA, 15 bp, Homo sapiens
tgcagtggctgacac

SEQ ID NO: 137846 - DNA, 15 bp, Homo sapiens
gtgcagtggctgaca

SEQ ID NO: 137847 - DNA, 15 bp, Homo sapiens
ggtgcagtggctgac

SEQ ID NO: 137848 - DNA, 15 bp, Homo sapiens
gggtgcagtggctga

SEQ ID NO: 137849 - DNA, 15 bp, Homo sapiens
tgggtgcagtggctg

SEQ ID NO: 137850 - DNA, 15 bp, Homo sapiens
gctgggtgcagtggc

SEQ ID NO: 137851 - DNA, 15 bp, Homo sapiens
ggctgggtgcagtgg

SEQ ID NO: 137852 - DNA, 15 bp, Homo sapiens
tggctgggtgcagtg

SEQ ID NO: 137853 - DNA, 15 bp, Homo sapiens
ctggctgggtgcagt

SEQ ID NO: 137854 - DNA, 15 bp, Homo sapiens
actggctgggtgcag

SEQ ID NO: 137855 - DNA, 15 bp, Homo sapiens
aactggctgggtgca

SEQ ID NO: 137856 - DNA, 15 bp, Homo sapiens
caactggctgggtgc

SEQ ID NO: 137857 - DNA, 15 bp, Homo sapiens
tcaactggctgggtg

SEQ ID NO: 137858 - DNA, 15 bp, Homo sapiens
atcaactggctgggt

SEQ ID NO: 137859 - DNA, 15 bp, Homo sapiens
tatcaactggctggg

SEQ ID NO: 137860 - DNA, 15 bp, Homo sapiens
ctatcaactggctgg

SEQ ID NO: 137861 - DNA, 15 bp, Homo sapiens
gctatcaactggctg

SEQ ID NO: 137862 - DNA, 15 bp, Homo sapiens
agctatcaactggct

SEQ ID NO: 137863 - DNA, 15 bp, Homo sapiens
aagctatcaactggc

SEQ ID NO: 137864 - DNA, 15 bp, Homo sapiens
aaagctatcaactgg

SEQ ID NO: 137865 - DNA, 15 bp, Homo sapiens
aaaagctatcaactg

SEQ ID NO: 137866 - DNA, 15 bp, Homo sapiens
taaaagctatcaact

SEQ ID NO: 137867 - DNA, 15 bp, Homo sapiens
ataaaagctatcaac

SEQ ID NO: 137868 - DNA, 15 bp, Homo sapiens
cataaaagctatcaa

SEQ ID NO: 137869 - DNA, 15 bp, Homo sapiens
acataaaagctatca

SEQ ID NO: 137870 - DNA, 15 bp, Homo sapiens
aacataaaagctatc

SEQ ID NO: 137871 - DNA, 15 bp, Homo sapiens
aaacataaaagctat

SEQ ID NO: 137872 - DNA, 15 bp, Homo sapiens
gaaacataaaagcta

SEQ ID NO: 137873 - DNA, 15 bp, Homo sapiens
tgaaacataaaagct

SEQ ID NO: 137874 - DNA, 15 bp, Homo sapiens
gtgaaacataaaagc

SEQ ID NO: 137875 - DNA, 15 bp, Homo sapiens
agtgaaacataaaag

SEQ ID NO: 137876 - DNA, 15 bp, Homo sapiens
tagtgaaacataaaa

SEQ ID NO: 137877 - DNA, 15 bp, Homo sapiens
atagtgaaacataaa

SEQ ID NO: 137878 - DNA, 15 bp, Homo sapiens
tatagtgaaacataa

SEQ ID NO: 137879 - DNA, 15 bp, Homo sapiens
ttatagtgaaacata

SEQ ID NO: 137880 - DNA, 15 bp, Homo sapiens
gttatagtgaaacat

SEQ ID NO: 137881 - DNA, 15 bp, Homo sapiens
ggttatagtgaaaca

SEQ ID NO: 137882 - DNA, 15 bp, Homo sapiens
tggttatagtgaaac

SEQ ID NO: 137883 - DNA, 15 bp, Homo sapiens
atggttatagtgaaa

SEQ ID NO: 137884 - DNA, 15 bp, Homo sapiens
tatggttatagtgaa

SEQ ID NO: 137885 - DNA, 15 bp, Homo sapiens
atatggttatagtga

SEQ ID NO: 137886 - DNA, 15 bp, Homo sapiens
tatatggttatagtg

SEQ ID NO: 137887 - DNA, 15 bp, Homo sapiens
atatatggttatagt

SEQ ID NO: 137888 - DNA, 15 bp, Homo sapiens
aatatatggttatag

SEQ ID NO: 137889 - DNA, 15 bp, Homo sapiens
taatatatggttata

SEQ ID NO: 137890 - DNA, 15 bp, Homo sapiens
ataatatatggttat

SEQ ID NO: 137891 - DNA, 15 bp, Homo sapiens
gataatatatggtta

SEQ ID NO: 137892 - DNA, 15 bp, Homo sapiens
ggataatatatggtt

SEQ ID NO: 137893 - DNA, 15 bp, Homo sapiens
gggataatatatggt

SEQ ID NO: 137894 - DNA, 15 bp, Homo sapiens
tgggataatatatgg

SEQ ID NO: 137895 - DNA, 15 bp, Homo sapiens
ttgggataatatatg

SEQ ID NO: 137896 - DNA, 15 bp, Homo sapiens
cttgggataatatat

SEQ ID NO: 137897 - DNA, 15 bp, Homo sapiens
tcttgggataatata

SEQ ID NO: 137898 - DNA, 15 bp, Homo sapiens
ttcttgggataatat

SEQ ID NO: 137899 - DNA, 15 bp, Homo sapiens
gttcttgggataata

SEQ ID NO: 137900 - DNA, 15 bp, Homo sapiens
agttcttgggataat

SEQ ID NO: 137901 - DNA, 15 bp, Homo sapiens
aagttcttgggataa

SEQ ID NO: 137902 - DNA, 15 bp, Homo sapiens
aaagttcttgggata

SEQ ID NO: 137903 - DNA, 15 bp, Homo sapiens
caaagttcttgggat

SEQ ID NO: 137904 - DNA, 15 bp, Homo sapiens
gcaaagttcttggga

SEQ ID NO: 137905 - DNA, 15 bp, Homo sapiens
ggcaaagttcttggg

SEQ ID NO: 137906 - DNA, 15 bp, Homo sapiens
tggcaaagttcttgg

SEQ ID NO: 137907 - DNA, 15 bp, Homo sapiens
ttggcaaagttcttg

SEQ ID NO: 137908 - DNA, 15 bp, Homo sapiens
tttggcaaagttctt

SEQ ID NO: 137909 - DNA, 15 bp, Homo sapiens
ctttggcaaagttct

SEQ ID NO: 137910 - DNA, 15 bp, Homo sapiens
actttggcaaagttc

SEQ ID NO: 137911 - DNA, 15 bp, Homo sapiens
cactttggcaaagtt

SEQ ID NO: 137912 - DNA, 15 bp, Homo sapiens
acactttggcaaagt

SEQ ID NO: 137913 - DNA, 15 bp, Homo sapiens
aacactttggcaaag

SEQ ID NO: 137914 - DNA, 15 bp, Homo sapiens
gaacactttggcaaa

SEQ ID NO: 137915 - DNA, 15 bp, Homo sapiens
ggaacactttggcaa

SEQ ID NO: 137916 - DNA, 15 bp, Homo sapiens
tggaacactttggca

SEQ ID NO: 137917 - DNA, 15 bp, Homo sapiens
atggaacactttggc

SEQ ID NO: 137918 - DNA, 15 bp, Homo sapiens
catggaacactttgg

SEQ ID NO: 137919 - DNA, 15 bp, Homo sapiens
tcatggaacactttg

SEQ ID NO: 137920 - DNA, 15 bp, Homo sapiens
atcatggaacacttt

SEQ ID NO: 137921 - DNA, 15 bp, Homo sapiens
tatcatggaacactt

SEQ ID NO: 137922 - DNA, 15 bp, Homo sapiens
ttatcatggaacact

SEQ ID NO: 137923 - DNA, 15 bp, Homo sapiens
gttatcatggaacac

SEQ ID NO: 137924 - DNA, 15 bp, Homo sapiens
agttatcatggaaca

SEQ ID NO: 137925 - DNA, 15 bp, Homo sapiens
gagttatcatggaac

SEQ ID NO: 137926 - DNA, 15 bp, Homo sapiens
tgagttatcatggaa

SEQ ID NO: 137927 - DNA, 15 bp, Homo sapiens
ctgagttatcatgga

SEQ ID NO: 137928 - DNA, 15 bp, Homo sapiens
gctgagttatcatgg

SEQ ID NO: 137929 - DNA, 15 bp, Homo sapiens
agctgagttatcatg

SEQ ID NO: 137930 - DNA, 15 bp, Homo sapiens
cagctgagttatcat

SEQ ID NO: 137931 - DNA, 15 bp, Homo sapiens
ccagctgagttatca

SEQ ID NO: 137932 - DNA, 15 bp, Homo sapiens
tccagctgagttatc

SEQ ID NO: 137933 - DNA, 15 bp, Homo sapiens
ttccagctgagttat

SEQ ID NO: 137934 - DNA, 15 bp, Homo sapiens
attccagctgagtta

SEQ ID NO: 137935 - DNA, 15 bp, Homo sapiens
cattccagctgagtt

SEQ ID NO: 137936 - DNA, 15 bp, Homo sapiens
acattccagctgagt

SEQ ID NO: 137937 - DNA, 15 bp, Homo sapiens
aacattccagctgag

SEQ ID NO: 137938 - DNA, 15 bp, Homo sapiens
taacattccagctga

SEQ ID NO: 137939 - DNA, 15 bp, Homo sapiens
ataacattccagctg

SEQ ID NO: 137940 - DNA, 15 bp, Homo sapiens
gataacattccagct

SEQ ID NO: 137941 - DNA, 15 bp, Homo sapiens
agataacattccagc

SEQ ID NO: 137942 - DNA, 15 bp, Homo sapiens
aagataacattccag

SEQ ID NO: 137943 - DNA, 15 bp, Homo sapiens
caagataacattcca

SEQ ID NO: 137944 - DNA, 15 bp, Homo sapiens
acaagataacattcc

SEQ ID NO: 137945 - DNA, 15 bp, Homo sapiens
tacaagataacattc

SEQ ID NO: 137946 - DNA, 15 bp, Homo sapiens
ctacaagataacatt

SEQ ID NO: 137947 - DNA, 15 bp, Homo sapiens
actacaagataacat

SEQ ID NO: 137948 - DNA, 15 bp, Homo sapiens
aactacaagataaca

SEQ ID NO: 137949 - DNA, 15 bp, Homo sapiens
taactacaagataac

SEQ ID NO: 137950 - DNA, 15 bp, Homo sapiens
gtaactacaagataa

SEQ ID NO: 137951 - DNA, 15 bp, Homo sapiens
cgtaactacaagata

SEQ ID NO: 137952 - DNA, 15 bp, Homo sapiens
acgtaactacaagat

SEQ ID NO: 137953 - DNA, 15 bp, Homo sapiens
aacgtaactacaaga

SEQ ID NO: 137954 - DNA, 15 bp, Homo sapiens
gaacgtaactacaag

SEQ ID NO: 137955 - DNA, 15 bp, Homo sapiens
ggaacgtaactacaa

SEQ ID NO: 137956 - DNA, 15 bp, Homo sapiens
aggaacgtaactaca

SEQ ID NO: 137957 - DNA, 15 bp, Homo sapiens
gaggaacgtaactac

SEQ ID NO: 137958 - DNA, 15 bp, Homo sapiens
agaggaacgtaacta

SEQ ID NO: 137959 - DNA, 15 bp, Homo sapiens
aagaggaacgtaact

SEQ ID NO: 137960 - DNA, 15 bp, Homo sapiens
caagaggaacgtaac

SEQ ID NO: 137961 - DNA, 15 bp, Homo sapiens
ccaagaggaacgtaa

SEQ ID NO: 137962 - DNA, 15 bp, Homo sapiens
cccaagaggaacgta

SEQ ID NO: 137963 - DNA, 15 bp, Homo sapiens
gcccaagaggaacgt

SEQ ID NO: 137964 - DNA, 15 bp, Homo sapiens
ggcccaagaggaacg

SEQ ID NO: 137965 - DNA, 15 bp, Homo sapiens
aggcccaagaggaac

SEQ ID NO: 137966 - DNA, 15 bp, Homo sapiens
caggcccaagaggaa

SEQ ID NO: 137967 - DNA, 15 bp, Homo sapiens
ccaggcccaagagga

SEQ ID NO: 137968 - DNA, 15 bp, Homo sapiens
accaggcccaagagg

SEQ ID NO: 137969 - DNA, 15 bp, Homo sapiens
taccaggcccaagag

SEQ ID NO: 137970 - DNA, 15 bp, Homo sapiens
gtaccaggcccaaga

SEQ ID NO: 137971 - DNA, 15 bp, Homo sapiens
agtaccaggcccaag

SEQ ID NO: 137972 - DNA, 15 bp, Homo sapiens
aagtaccaggcccaa

SEQ ID NO: 137973 - DNA, 15 bp, Homo sapiens
taagtaccaggccca

SEQ ID NO: 137974 - DNA, 15 bp, Homo sapiens
ttaagtaccaggccc

SEQ ID NO: 137975 - DNA, 15 bp, Homo sapiens
gttaagtaccaggcc

SEQ ID NO: 137976 - DNA, 15 bp, Homo sapiens
agttaagtaccaggc

SEQ ID NO: 137977 - DNA, 15 bp, Homo sapiens
tagttaagtaccagg

SEQ ID NO: 137978 - DNA, 15 bp, Homo sapiens
atagttaagtaccag

SEQ ID NO: 137979 - DNA, 15 bp, Homo sapiens
tatagttaagtacca

SEQ ID NO: 137980 - DNA, 15 bp, Homo sapiens
ctatagttaagtacc

SEQ ID NO: 137981 - DNA, 15 bp, Homo sapiens
gctatagttaagtac

SEQ ID NO: 137982 - DNA, 15 bp, Homo sapiens
ggctatagttaagta

SEQ ID NO: 137983 - DNA, 15 bp, Homo sapiens
aggctatagttaagt

SEQ ID NO: 137984 - DNA, 15 bp, Homo sapiens
aaggctatagttaag

SEQ ID NO: 137985 - DNA, 15 bp, Homo sapiens
aaaggctatagttaa

SEQ ID NO: 137986 - DNA, 15 bp, Homo sapiens
gaaaggctatagtta

SEQ ID NO: 137987 - DNA, 15 bp, Homo sapiens
agaaaggctatagtt

SEQ ID NO: 137988 - DNA, 15 bp, Homo sapiens
aagaaaggctatagt

SEQ ID NO: 137989 - DNA, 15 bp, Homo sapiens
aaagaaaggctatag

SEQ ID NO: 137990 - DNA, 15 bp, Homo sapiens
aaaagaaaggctata

SEQ ID NO: 137991 - DNA, 15 bp, Homo sapiens
aaaaagaaaggctat

SEQ ID NO: 137992 - DNA, 15 bp, Homo sapiens
caaaaagaaaggcta

SEQ ID NO: 137993 - DNA, 15 bp, Homo sapiens
acaaaaagaaaggct

SEQ ID NO: 137994 - DNA, 15 bp, Homo sapiens
gacaaaaagaaaggc

SEQ ID NO: 137995 - DNA, 15 bp, Homo sapiens
agacaaaaagaaagg

SEQ ID NO: 137996 - DNA, 15 bp, Homo sapiens
cagacaaaaagaaag

SEQ ID NO: 137997 - DNA, 15 bp, Homo sapiens
tcagacaaaaagaaa

SEQ ID NO: 137998 - DNA, 15 bp, Homo sapiens
atcagacaaaaagaa

SEQ ID NO: 137999 - DNA, 15 bp, Homo sapiens
tatcagacaaaaaga

SEQ ID NO: 138000 - DNA, 15 bp, Homo sapiens
atatcagacaaaaag

SEQ ID NO: 138001 - DNA, 15 bp, Homo sapiens
gatatcagacaaaaa

SEQ ID NO: 138002 - DNA, 15 bp, Homo sapiens
ggatatcagacaaaa

SEQ ID NO: 138003 - DNA, 15 bp, Homo sapiens
tggatatcagacaaa

SEQ ID NO: 138004 - DNA, 15 bp, Homo sapiens
ttggatatcagacaa

SEQ ID NO: 138005 - DNA, 15 bp, Homo sapiens
tttggatatcagaca

SEQ ID NO: 138006 - DNA, 15 bp, Homo sapiens
ctttggatatcagac

SEQ ID NO: 138007 - DNA, 15 bp, Homo sapiens
gctttggatatcaga

SEQ ID NO: 138008 - DNA, 15 bp, Homo sapiens
tgctttggatatcag

SEQ ID NO: 138009 - DNA, 15 bp, Homo sapiens
atgctttggatatca

SEQ ID NO: 138010 - DNA, 15 bp, Homo sapiens
gatgctttggatatc

SEQ ID NO: 138011 - DNA, 15 bp, Homo sapiens
agatgctttggatat

SEQ ID NO: 138012 - DNA, 15 bp, Homo sapiens
aagatgctttggata

SEQ ID NO: 138013 - DNA, 15 bp, Homo sapiens
aaagatgctttggat

SEQ ID NO: 138014 - DNA, 15 bp, Homo sapiens
gaaagatgctttgga

SEQ ID NO: 138015 - DNA, 15 bp, Homo sapiens
tgaaagatgctttgg

SEQ ID NO: 138016 - DNA, 15 bp, Homo sapiens
ctgaaagatgctttg

SEQ ID NO: 138017 - DNA, 15 bp, Homo sapiens
gctgaaagatgcttt

SEQ ID NO: 138018 - DNA, 15 bp, Homo sapiens
tgctgaaagatgctt

SEQ ID NO: 138019 - DNA, 15 bp, Homo sapiens
ctgctgaaagatgct

SEQ ID NO: 138020 - DNA, 15 bp, Homo sapiens
gctgctgaaagatgc

SEQ ID NO: 138021 - DNA, 15 bp, Homo sapiens
cgctgctgaaagatg

SEQ ID NO: 138022 - DNA, 15 bp, Homo sapiens
acgctgctgaaagat

SEQ ID NO: 138023 - DNA, 15 bp, Homo sapiens
cacgctgctgaaaga

SEQ ID NO: 138024 - DNA, 15 bp, Homo sapiens
ccacgctgctgaaag

SEQ ID NO: 138025 - DNA, 15 bp, Homo sapiens
accacgctgctgaaa

SEQ ID NO: 138026 - DNA, 15 bp, Homo sapiens
aaccacgctgctgaa

SEQ ID NO: 138027 - DNA, 15 bp, Homo sapiens
aaaccacgctgctga

SEQ ID NO: 138028 - DNA, 15 bp, Homo sapiens
aaaaccacgctgctg

SEQ ID NO: 138029 - DNA, 15 bp, Homo sapiens
taaaaccacgctgct

SEQ ID NO: 138030 - DNA, 15 bp, Homo sapiens
ttaaaaccacgctgc

SEQ ID NO: 138031 - DNA, 15 bp, Homo sapiens
gttaaaaccacgctg

SEQ ID NO: 138032 - DNA, 15 bp, Homo sapiens
tgttaaaaccacgct

SEQ ID NO: 138033 - DNA, 15 bp, Homo sapiens
atgttaaaaccacgc

SEQ ID NO: 138034 - DNA, 15 bp, Homo sapiens
aatgttaaaaccacg

SEQ ID NO: 138035 - DNA, 15 bp, Homo sapiens
gaatgttaaaaccac

SEQ ID NO: 138036 - DNA, 15 bp, Homo sapiens
agaatgttaaaacca

SEQ ID NO: 138037 - DNA, 15 bp, Homo sapiens
tagaatgttaaaacc

SEQ ID NO: 138038 - DNA, 15 bp, Homo sapiens
gtagaatgttaaaac

SEQ ID NO: 138039 - DNA, 15 bp, Homo sapiens
ggtagaatgttaaaa

SEQ ID NO: 138040 - DNA, 15 bp, Homo sapiens
aggtagaatgttaaa

SEQ ID NO: 138041 - DNA, 15 bp, Homo sapiens
taggtagaatgttaa

SEQ ID NO: 138042 - DNA, 15 bp, Homo sapiens
gtaggtagaatgtta

SEQ ID NO: 138043 - DNA, 15 bp, Homo sapiens
agtaggtagaatgtt

SEQ ID NO: 138044 - DNA, 15 bp, Homo sapiens
aagtaggtagaatgt

SEQ ID NO: 138045 - DNA, 15 bp, Homo sapiens
taagtaggtagaatg

SEQ ID NO: 138046 - DNA, 15 bp, Homo sapiens
ataagtaggtagaat

SEQ ID NO: 138047 - DNA, 15 bp, Homo sapiens
aataagtaggtagaa

SEQ ID NO: 138048 - DNA, 15 bp, Homo sapiens
taataagtaggtaga

SEQ ID NO: 138049 - DNA, 15 bp, Homo sapiens
ataataagtaggtag

SEQ ID NO: 138050 - DNA, 15 bp, Homo sapiens
gataataagtaggta

SEQ ID NO: 138051 - DNA, 15 bp, Homo sapiens
tgataataagtaggt

SEQ ID NO: 138052 - DNA, 15 bp, Homo sapiens
ctgataataagtagg

SEQ ID NO: 138053 - DNA, 15 bp, Homo sapiens
gctgataataagtag

SEQ ID NO: 138054 - DNA, 15 bp, Homo sapiens
tgctgataataagta

SEQ ID NO: 138055 - DNA, 15 bp, Homo sapiens
ctgctgataataagt

SEQ ID NO: 138056 - DNA, 15 bp, Homo sapiens
cctgctgataataag

SEQ ID NO: 138057 - DNA, 15 bp, Homo sapiens
acctgctgataataa

SEQ ID NO: 138058 - DNA, 15 bp, Homo sapiens
aacctgctgataata

SEQ ID NO: 138059 - DNA, 15 bp, Homo sapiens
gaacctgctgataat

SEQ ID NO: 138060 - DNA, 15 bp, Homo sapiens
agaacctgctgataa

SEQ ID NO: 138061 - DNA, 15 bp, Homo sapiens
aagaacctgctgata

SEQ ID NO: 138062 - DNA, 15 bp, Homo sapiens
caagaacctgctgat

SEQ ID NO: 138063 - DNA, 15 bp, Homo sapiens
gcaagaacctgctga

SEQ ID NO: 138064 - DNA, 15 bp, Homo sapiens
cgcaagaacctgctg

SEQ ID NO: 138065 - DNA, 15 bp, Homo sapiens
ccgcaagaacctgct

SEQ ID NO: 138066 - DNA, 15 bp, Homo sapiens
tccgcaagaacctgc

SEQ ID NO: 138067 - DNA, 15 bp, Homo sapiens
atccgcaagaacctg

SEQ ID NO: 138068 - DNA, 15 bp, Homo sapiens
tatccgcaagaacct

SEQ ID NO: 138069 - DNA, 15 bp, Homo sapiens
atatccgcaagaacc

SEQ ID NO: 138070 - DNA, 15 bp, Homo sapiens
aatatccgcaagaac

SEQ ID NO: 138071 - DNA, 15 bp, Homo sapiens
gaatatccgcaagaa

SEQ ID NO: 138072 - DNA, 15 bp, Homo sapiens
agaatatccgcaaga

SEQ ID NO: 138073 - DNA, 15 bp, Homo sapiens
tagaatatccgcaag

SEQ ID NO: 138074 - DNA, 15 bp, Homo sapiens
ttagaatatccgcaa

SEQ ID NO: 138075 - DNA, 15 bp, Homo sapiens
cttagaatatccgca

SEQ ID NO: 138076 - DNA, 15 bp, Homo sapiens
acttagaatatccgc

SEQ ID NO: 138077 - DNA, 15 bp, Homo sapiens
aacttagaatatccg

SEQ ID NO: 138078 - DNA, 15 bp, Homo sapiens
taacttagaatatcc

SEQ ID NO: 138079 - DNA, 15 bp, Homo sapiens
ataacttagaatatc

SEQ ID NO: 138080 - DNA, 15 bp, Homo sapiens
aataacttagaatat

SEQ ID NO: 138081 - DNA, 15 bp, Homo sapiens
caataacttagaata

SEQ ID NO: 138082 - DNA, 15 bp, Homo sapiens
acaataacttagaat

SEQ ID NO: 138083 - DNA, 15 bp, Homo sapiens
aacaataacttagaa

SEQ ID NO: 138084 - DNA, 15 bp, Homo sapiens
aaacaataacttaga

SEQ ID NO: 138085 - DNA, 15 bp, Homo sapiens
taaacaataacttag

SEQ ID NO: 138086 - DNA, 15 bp, Homo sapiens
ataaacaataactta

SEQ ID NO: 138087 - DNA, 15 bp, Homo sapiens
aataaacaataactt

SEQ ID NO: 138088 - DNA, 15 bp, Homo sapiens
taataaacaataact

SEQ ID NO: 138089 - DNA, 15 bp, Homo sapiens
ctaataaacaataac

SEQ ID NO: 138090 - DNA, 15 bp, Homo sapiens
actaataaacaataa

SEQ ID NO: 138091 - DNA, 15 bp, Homo sapiens
tactaataaacaata

SEQ ID NO: 138092 - DNA, 15 bp, Homo sapiens
gtactaataaacaat

SEQ ID NO: 138093 - DNA, 15 bp, Homo sapiens
ggtactaataaacaa

SEQ ID NO: 138094 - DNA, 15 bp, Homo sapiens
aggtactaataaaca

SEQ ID NO: 138095 - DNA, 15 bp, Homo sapiens
gaggtactaataaac

SEQ ID NO: 138096 - DNA, 15 bp, Homo sapiens
tgaggtactaataaa

SEQ ID NO: 138097 - DNA, 15 bp, Homo sapiens
ctgaggtactaataa

SEQ ID NO: 138098 - DNA, 15 bp, Homo sapiens
actgaggtactaata

SEQ ID NO: 138099 - DNA, 15 bp, Homo sapiens
aactgaggtactaat

SEQ ID NO: 138100 - DNA, 15 bp, Homo sapiens
gaactgaggtactaa

SEQ ID NO: 138101 - DNA, 15 bp, Homo sapiens
tgaactgaggtacta

SEQ ID NO: 138102 - DNA, 15 bp, Homo sapiens
ttgaactgaggtact

SEQ ID NO: 138103 - DNA, 15 bp, Homo sapiens
cttgaactgaggtac

SEQ ID NO: 138104 - DNA, 15 bp, Homo sapiens
tcttgaactgaggta

SEQ ID NO: 138105 - DNA, 15 bp, Homo sapiens
atcttgaactgaggt

SEQ ID NO: 138106 - DNA, 15 bp, Homo sapiens
aatcttgaactgagg

SEQ ID NO: 138107 - DNA, 15 bp, Homo sapiens
taatcttgaactgag

SEQ ID NO: 138108 - DNA, 15 bp, Homo sapiens
ataatcttgaactga

SEQ ID NO: 138109 - DNA, 15 bp, Homo sapiens
cataatcttgaactg

SEQ ID NO: 138110 - DNA, 15 bp, Homo sapiens
tcataatcttgaact

SEQ ID NO: 138111 - DNA, 15 bp, Homo sapiens
ttcataatcttgaac

SEQ ID NO: 138112 - DNA, 15 bp, Homo sapiens
gttcataatcttgaa

SEQ ID NO: 138113 - DNA, 15 bp, Homo sapiens
agttcataatcttga

SEQ ID NO: 138114 - DNA, 15 bp, Homo sapiens
tagttcataatcttg

SEQ ID NO: 138115 - DNA, 15 bp, Homo sapiens
ttagttcataatctt

SEQ ID NO: 138116 - DNA, 15 bp, Homo sapiens
gttagttcataatct

SEQ ID NO: 138117 - DNA, 15 bp, Homo sapiens
agttagttcataatc

SEQ ID NO: 138118 - DNA, 15 bp, Homo sapiens
gagttagttcataat

SEQ ID NO: 138119 - DNA, 15 bp, Homo sapiens
agagttagttcataa

SEQ ID NO: 138120 - DNA, 15 bp, Homo sapiens
cagagttagttcata

SEQ ID NO: 138121 - DNA, 15 bp, Homo sapiens
tcagagttagttcat

SEQ ID NO: 138122 - DNA, 15 bp, Homo sapiens
ttcagagttagttca

SEQ ID NO: 138123 - DNA, 15 bp, Homo sapiens
cttcagagttagttc

SEQ ID NO: 138124 - DNA, 15 bp, Homo sapiens
acttcagagttagtt

SEQ ID NO: 138125 - DNA, 15 bp, Homo sapiens
cacttcagagttagt

SEQ ID NO: 138126 - DNA, 15 bp, Homo sapiens
tcacttcagagttag

SEQ ID NO: 138127 - DNA, 15 bp, Homo sapiens
atcacttcagagtta

SEQ ID NO: 138128 - DNA, 15 bp, Homo sapiens
aatcacttcagagtt

SEQ ID NO: 138129 - DNA, 15 bp, Homo sapiens
taatcacttcagagt

SEQ ID NO: 138130 - DNA, 15 bp, Homo sapiens
ttaatcacttcagag

SEQ ID NO: 138131 - DNA, 15 bp, Homo sapiens
attaatcacttcaga

SEQ ID NO: 138132 - DNA, 15 bp, Homo sapiens
tattaatcacttcag

SEQ ID NO: 138133 - DNA, 15 bp, Homo sapiens
ttattaatcacttca

SEQ ID NO: 138134 - DNA, 15 bp, Homo sapiens
tttattaatcacttc

SEQ ID NO: 138135 - DNA, 15 bp, Homo sapiens
ttttattaatcactt

SEQ ID NO: 138136 - DNA, 15 bp, Homo sapiens
tttttattaatcact

SEQ ID NO: 138137 - DNA, 15 bp, Homo sapiens
ttttttattaatcac

SEQ ID NO: 138138 - DNA, 15 bp, Homo sapiens
attttttattaatca

SEQ ID NO: 138139 - DNA, 15 bp, Homo sapiens
aattttttattaatc

SEQ ID NO: 138140 - DNA, 15 bp, Homo sapiens
aaattttttattaat

SEQ ID NO: 138141 - DNA, 15 bp, Homo sapiens
taaattttttattaa

SEQ ID NO: 138142 - DNA, 15 bp, Homo sapiens
ttaaattttttatta

SEQ ID NO: 138143 - DNA, 15 bp, Homo sapiens
cttaaattttttatt

SEQ ID NO: 138144 - DNA, 15 bp, Homo sapiens
acttaaattttttat

SEQ ID NO: 138145 - DNA, 15 bp, Homo sapiens
aacttaaatttttta

SEQ ID NO: 138146 - DNA, 15 bp, Homo sapiens
aaacttaaatttttt

SEQ ID NO: 138147 - DNA, 15 bp, Homo sapiens
gaaacttaaattttt

SEQ ID NO: 138148 - DNA, 15 bp, Homo sapiens
ggaaacttaaatttt

SEQ ID NO: 138149 - DNA, 15 bp, Homo sapiens
tggaaacttaaattt

SEQ ID NO: 138150 - DNA, 15 bp, Homo sapiens
ctggaaacttaaatt

SEQ ID NO: 138151 - DNA, 15 bp, Homo sapiens
gctggaaacttaaat

SEQ ID NO: 138152 - DNA, 15 bp, Homo sapiens
ggctggaaacttaaa

SEQ ID NO: 138153 - DNA, 15 bp, Homo sapiens
cggctggaaacttaa

SEQ ID NO: 138154 - DNA, 15 bp, Homo sapiens
ccggctggaaactta

SEQ ID NO: 138155 - DNA, 15 bp, Homo sapiens
cccggctggaaactt

SEQ ID NO: 138156 - DNA, 15 bp, Homo sapiens
acccggctggaaact

SEQ ID NO: 138157 - DNA, 15 bp, Homo sapiens
cacccggctggaaac

SEQ ID NO: 138158 - DNA, 15 bp, Homo sapiens
gcacccggctggaaa

SEQ ID NO: 138159 - DNA, 15 bp, Homo sapiens
cgcacccggctggaa

SEQ ID NO: 138160 - DNA, 15 bp, Homo sapiens
acgcacccggctgga

SEQ ID NO: 138161 - DNA, 15 bp, Homo sapiens
aacgcacccggctgg

SEQ ID NO: 138162 - DNA, 15 bp, Homo sapiens
caacgcacccggctg

SEQ ID NO: 138163 - DNA, 15 bp, Homo sapiens
ccaacgcacccggct

SEQ ID NO: 138164 - DNA, 15 bp, Homo sapiens
gccaacgcacccggc

SEQ ID NO: 138165 - DNA, 15 bp, Homo sapiens
agccaacgcacccgg

SEQ ID NO: 138166 - DNA, 15 bp, Homo sapiens
gagccaacgcacccg

SEQ ID NO: 138167 - DNA, 15 bp, Homo sapiens
tgagccaacgcaccc

SEQ ID NO: 138168 - DNA, 15 bp, Homo sapiens
atgagccaacgcacc

SEQ ID NO: 138169 - DNA, 15 bp, Homo sapiens
catgagccaacgcac

SEQ ID NO: 138170 - DNA, 15 bp, Homo sapiens
gcatgagccaacgca

SEQ ID NO: 138171 - DNA, 15 bp, Homo sapiens
ggcatgagccaacgc

SEQ ID NO: 138172 - DNA, 15 bp, Homo sapiens
aggcatgagccaacg

SEQ ID NO: 138173 - DNA, 15 bp, Homo sapiens
caggcatgagccaac

SEQ ID NO: 138174 - DNA, 15 bp, Homo sapiens
acaggcatgagccaa

SEQ ID NO: 138175 - DNA, 15 bp, Homo sapiens
ccaaagtgttgggat

SEQ ID NO: 138176 - DNA, 15 bp, Homo sapiens
cccaaagtgttggga

SEQ ID NO: 138177 - DNA, 15 bp, Homo sapiens
tcccaaagtgttggg

SEQ ID NO: 138178 - DNA, 15 bp, Homo sapiens
ctcccaaagtgttgg

SEQ ID NO: 138179 - DNA, 15 bp, Homo sapiens
cctcccaaagtgttg

SEQ ID NO: 138180 - DNA, 15 bp, Homo sapiens
gcctcccaaagtgtt

SEQ ID NO: 138181 - DNA, 15 bp, Homo sapiens
ggcctcccaaagtgt

SEQ ID NO: 138182 - DNA, 15 bp, Homo sapiens
tctgcctcggcctcc

SEQ ID NO: 138183 - DNA, 15 bp, Homo sapiens
gtctgcctcggcctc

SEQ ID NO: 138184 - DNA, 15 bp, Homo sapiens
tgtctgcctcggcct

SEQ ID NO: 138185 - DNA, 15 bp, Homo sapiens
ctgtctgcctcggcc

SEQ ID NO: 138186 - DNA, 15 bp, Homo sapiens
tctgtctgcctcggc

SEQ ID NO: 138187 - DNA, 15 bp, Homo sapiens
atctgtctgcctcgg

SEQ ID NO: 138188 - DNA, 15 bp, Homo sapiens
gatctgtctgcctcg

SEQ ID NO: 138189 - DNA, 15 bp, Homo sapiens
tgatctgtctgcctc

SEQ ID NO: 138190 - DNA, 15 bp, Homo sapiens
gtgatctgtctgcct

SEQ ID NO: 138191 - DNA, 15 bp, Homo sapiens
cgtgatctgtctgcc

SEQ ID NO: 138192 - DNA, 15 bp, Homo sapiens
tcgtgatctgtctgc

SEQ ID NO: 138193 - DNA, 15 bp, Homo sapiens
ctcgtgatctgtctg

SEQ ID NO: 138194 - DNA, 15 bp, Homo sapiens
cctcgtgatctgtct

SEQ ID NO: 138195 - DNA, 15 bp, Homo sapiens
acctcgtgatctgtc

SEQ ID NO: 138196 - DNA, 15 bp, Homo sapiens
gacctcgtgatctgt

SEQ ID NO: 138197 - DNA, 15 bp, Homo sapiens
aggtctcgaactcct

SEQ ID NO: 138198 - DNA, 15 bp, Homo sapiens
caggtctcgaactcc

SEQ ID NO: 138199 - DNA, 15 bp, Homo sapiens
ccaggtctcgaactc

SEQ ID NO: 138200 - DNA, 15 bp, Homo sapiens
gccaggtctcgaact

SEQ ID NO: 138201 - DNA, 15 bp, Homo sapiens
ggccaggtctcgaac

SEQ ID NO: 138202 - DNA, 15 bp, Homo sapiens
tggccaggtctcgaa

SEQ ID NO: 138203 - DNA, 15 bp, Homo sapiens
ttggccaggtctcga

SEQ ID NO: 138204 - DNA, 15 bp, Homo sapiens
gttggccaggtctcg

SEQ ID NO: 138205 - DNA, 15 bp, Homo sapiens
tgttggccaggtctc

SEQ ID NO: 138206 - DNA, 15 bp, Homo sapiens
atgttggccaggtct

SEQ ID NO: 138207 - DNA, 15 bp, Homo sapiens
catgttggccaggtc

SEQ ID NO: 138208 - DNA, 15 bp, Homo sapiens
ccatgttggccaggt

SEQ ID NO: 138209 - DNA, 15 bp, Homo sapiens
cccatgttggccagg

SEQ ID NO: 138210 - DNA, 15 bp, Homo sapiens
ccccatgttggccag

SEQ ID NO: 138211 - DNA, 15 bp, Homo sapiens
tccccatgttggcca

SEQ ID NO: 138212 - DNA, 15 bp, Homo sapiens
ttccccatgttggcc

SEQ ID NO: 138213 - DNA, 15 bp, Homo sapiens
tttccccatgttggc

SEQ ID NO: 138214 - DNA, 15 bp, Homo sapiens
gtttccccatgttgg

SEQ ID NO: 138215 - DNA, 15 bp, Homo sapiens
ggtttccccatgttg

SEQ ID NO: 138216 - DNA, 15 bp, Homo sapiens
gggtttccccatgtt

SEQ ID NO: 138217 - DNA, 15 bp, Homo sapiens
agggtttccccatgt

SEQ ID NO: 138218 - DNA, 15 bp, Homo sapiens
gagggtttccccatg

SEQ ID NO: 138219 - DNA, 15 bp, Homo sapiens
agagggtttccccat

SEQ ID NO: 138220 - DNA, 15 bp, Homo sapiens
gagagggtttcccca

SEQ ID NO: 138221 - DNA, 15 bp, Homo sapiens
agagagggtttcccc

SEQ ID NO: 138222 - DNA, 15 bp, Homo sapiens
gagagagggtttccc

SEQ ID NO: 138223 - DNA, 15 bp, Homo sapiens
agagagagggtttcc

SEQ ID NO: 138224 - DNA, 15 bp, Homo sapiens
tagagagagggtttc

SEQ ID NO: 138225 - DNA, 15 bp, Homo sapiens
gtagagagagggttt

SEQ ID NO: 138226 - DNA, 15 bp, Homo sapiens
agtagagagagggtt

SEQ ID NO: 138227 - DNA, 15 bp, Homo sapiens
tagtagagagagggt

SEQ ID NO: 138228 - DNA, 15 bp, Homo sapiens
ttagtagagagaggg

SEQ ID NO: 138229 - DNA, 15 bp, Homo sapiens
tttagtagagagagg

SEQ ID NO: 138230 - DNA, 15 bp, Homo sapiens
ttttagtagagagag

SEQ ID NO: 138231 - DNA, 15 bp, Homo sapiens
tttttagtagagaga

SEQ ID NO: 138232 - DNA, 15 bp, Homo sapiens
atttttagtagagag

SEQ ID NO: 138233 - DNA, 15 bp, Homo sapiens
cttttgtatttttag

SEQ ID NO: 138234 - DNA, 15 bp, Homo sapiens
acttttgtattttta

SEQ ID NO: 138235 - DNA, 15 bp, Homo sapiens
tacttttgtattttt

SEQ ID NO: 138236 - DNA, 15 bp, Homo sapiens
ctacttttgtatttt

SEQ ID NO: 138237 - DNA, 15 bp, Homo sapiens
gctacttttgtattt

SEQ ID NO: 138238 - DNA, 15 bp, Homo sapiens
ggctacttttgtatt

SEQ ID NO: 138239 - DNA, 15 bp, Homo sapiens
cggctacttttgtat

SEQ ID NO: 138240 - DNA, 15 bp, Homo sapiens
ccggctacttttgta

SEQ ID NO: 138241 - DNA, 15 bp, Homo sapiens
cccggctacttttgt

SEQ ID NO: 138242 - DNA, 15 bp, Homo sapiens
acccggctacttttg

SEQ ID NO: 138243 - DNA, 15 bp, Homo sapiens
cacccggctactttt

SEQ ID NO: 138244 - DNA, 15 bp, Homo sapiens
acacccggctacttt

SEQ ID NO: 138245 - DNA, 15 bp, Homo sapiens
cacacccggctactt

SEQ ID NO: 138246 - DNA, 15 bp, Homo sapiens
ccacacccggctact

SEQ ID NO: 138247 - DNA, 15 bp, Homo sapiens
accacacccggctac

SEQ ID NO: 138248 - DNA, 15 bp, Homo sapiens
gtgccaccacacccg

SEQ ID NO: 138249 - DNA, 15 bp, Homo sapiens
tgtgtgccaccacac

SEQ ID NO: 138250 - DNA, 15 bp, Homo sapiens
gtgtgtgccaccaca

SEQ ID NO: 138251 - DNA, 15 bp, Homo sapiens
ggtgtgtgccaccac

SEQ ID NO: 138252 - DNA, 15 bp, Homo sapiens
aggtgtgtgccacca

SEQ ID NO: 138253 - DNA, 15 bp, Homo sapiens
taggtgtgtgccacc

SEQ ID NO: 138254 - DNA, 15 bp, Homo sapiens
ataggtgtgtgccac

SEQ ID NO: 138255 - DNA, 15 bp, Homo sapiens
tataggtgtgtgcca

SEQ ID NO: 138256 - DNA, 15 bp, Homo sapiens
ctataggtgtgtgcc

SEQ ID NO: 138257 - DNA, 15 bp, Homo sapiens
actataggtgtgtgc

SEQ ID NO: 138258 - DNA, 15 bp, Homo sapiens
gactataggtgtgtg

SEQ ID NO: 138259 - DNA, 15 bp, Homo sapiens
ggactataggtgtgt

SEQ ID NO: 138260 - DNA, 15 bp, Homo sapiens
gggactataggtgtg

SEQ ID NO: 138261 - DNA, 15 bp, Homo sapiens
tgggactataggtgt

SEQ ID NO: 138262 - DNA, 15 bp, Homo sapiens
gctgggactataggt

SEQ ID NO: 138263 - DNA, 15 bp, Homo sapiens
tgtagctgggactat

SEQ ID NO: 138264 - DNA, 15 bp, Homo sapiens
atgtagctgggacta

SEQ ID NO: 138265 - DNA, 15 bp, Homo sapiens
catgtagctgggact

SEQ ID NO: 138266 - DNA, 15 bp, Homo sapiens
ccatgtagctgggac

SEQ ID NO: 138267 - DNA, 15 bp, Homo sapiens
cccatgtagctggga

SEQ ID NO: 138268 - DNA, 15 bp, Homo sapiens
tcccatgtagctggg

SEQ ID NO: 138269 - DNA, 15 bp, Homo sapiens
ctcccatgtagctgg

SEQ ID NO: 138270 - DNA, 15 bp, Homo sapiens
cctcccatgtagctg

SEQ ID NO: 138271 - DNA, 15 bp, Homo sapiens
gcctcccatgtagct

SEQ ID NO: 138272 - DNA, 15 bp, Homo sapiens
agcctcccatgtagc

SEQ ID NO: 138273 - DNA, 15 bp, Homo sapiens
cagcctcccatgtag

SEQ ID NO: 138274 - DNA, 15 bp, Homo sapiens
tcagcctcccatgta

SEQ ID NO: 138275 - DNA, 15 bp, Homo sapiens
ctcagcctcccatgt

SEQ ID NO: 138276 - DNA, 15 bp, Homo sapiens
cctcagcctcccatg

SEQ ID NO: 138277 - DNA, 15 bp, Homo sapiens
gcctcagcctcccat

SEQ ID NO: 138278 - DNA, 15 bp, Homo sapiens
acaagtgattctcct

SEQ ID NO: 138279 - DNA, 15 bp, Homo sapiens
tacaagtgattctcc

SEQ ID NO: 138280 - DNA, 15 bp, Homo sapiens
gtacaagtgattctc

SEQ ID NO: 138281 - DNA, 15 bp, Homo sapiens
ggtacaagtgattct

SEQ ID NO: 138282 - DNA, 15 bp, Homo sapiens
aggtacaagtgattc

SEQ ID NO: 138283 - DNA, 15 bp, Homo sapiens
caggtacaagtgatt

SEQ ID NO: 138284 - DNA, 15 bp, Homo sapiens
ccaggtacaagtgat

SEQ ID NO: 138285 - DNA, 15 bp, Homo sapiens
cccaggtacaagtga

SEQ ID NO: 138286 - DNA, 15 bp, Homo sapiens
ccccaggtacaagtg

SEQ ID NO: 138287 - DNA, 15 bp, Homo sapiens
cccccaggtacaagt

SEQ ID NO: 138288 - DNA, 15 bp, Homo sapiens
gcccccaggtacaag

SEQ ID NO: 138289 - DNA, 15 bp, Homo sapiens
cgcccccaggtacaa

SEQ ID NO: 138290 - DNA, 15 bp, Homo sapiens
ccgcccccaggtaca

SEQ ID NO: 138291 - DNA, 15 bp, Homo sapiens
tccgcccccaggtac

SEQ ID NO: 138292 - DNA, 15 bp, Homo sapiens
ctccgcccccaggta

SEQ ID NO: 138293 - DNA, 15 bp, Homo sapiens
cctccgcccccaggt

SEQ ID NO: 138294 - DNA, 15 bp, Homo sapiens
acctccgcccccagg

SEQ ID NO: 138295 - DNA, 15 bp, Homo sapiens
aacctccgcccccag

SEQ ID NO: 138296 - DNA, 15 bp, Homo sapiens
caacctccgccccca

SEQ ID NO: 138297 - DNA, 15 bp, Homo sapiens
gcaacctccgccccc

SEQ ID NO: 138298 - DNA, 15 bp, Homo sapiens
tgcaacctccgcccc

SEQ ID NO: 138299 - DNA, 15 bp, Homo sapiens
ctgcaacctccgccc

SEQ ID NO: 138300 - DNA, 15 bp, Homo sapiens
gctgcaacctccgcc

SEQ ID NO: 138301 - DNA, 15 bp, Homo sapiens
cgctgcaacctccgc

SEQ ID NO: 138302 - DNA, 15 bp, Homo sapiens
tcgctgcaacctccg

SEQ ID NO: 138303 - DNA, 15 bp, Homo sapiens
ctcgctgcaacctcc

SEQ ID NO: 138304 - DNA, 15 bp, Homo sapiens
gctcgctgcaacctc

SEQ ID NO: 138305 - DNA, 15 bp, Homo sapiens
agctcgctgcaacct

SEQ ID NO: 138306 - DNA, 15 bp, Homo sapiens
cagctcgctgcaacc

SEQ ID NO: 138307 - DNA, 15 bp, Homo sapiens
tcagctcgctgcaac

SEQ ID NO: 138308 - DNA, 15 bp, Homo sapiens
ttcagctcgctgcaa

SEQ ID NO: 138309 - DNA, 15 bp, Homo sapiens
tttcagctcgctgca

SEQ ID NO: 138310 - DNA, 15 bp, Homo sapiens
ctttcagctcgctgc

SEQ ID NO: 138311 - DNA, 15 bp, Homo sapiens
gctttcagctcgctg

SEQ ID NO: 138312 - DNA, 15 bp, Homo sapiens
ggctttcagctcgct

SEQ ID NO: 138313 - DNA, 15 bp, Homo sapiens
tggctttcagctcgc

SEQ ID NO: 138314 - DNA, 15 bp, Homo sapiens
ctggctttcagctcg

SEQ ID NO: 138315 - DNA, 15 bp, Homo sapiens
cctggctttcagctc

SEQ ID NO: 138316 - DNA, 15 bp, Homo sapiens
tcctggctttcagct

SEQ ID NO: 138317 - DNA, 15 bp, Homo sapiens
atcctggctttcagc

SEQ ID NO: 138318 - DNA, 15 bp, Homo sapiens
gatcctggctttcag

SEQ ID NO: 138319 - DNA, 15 bp, Homo sapiens
cgatcctggctttca

SEQ ID NO: 138320 - DNA, 15 bp, Homo sapiens
acgatcctggctttc

SEQ ID NO: 138321 - DNA, 15 bp, Homo sapiens
cacgatcctggcttt

SEQ ID NO: 138322 - DNA, 15 bp, Homo sapiens
gcacgatcctggctt

SEQ ID NO: 138323 - DNA, 15 bp, Homo sapiens
ggcacgatcctggct

SEQ ID NO: 138324 - DNA, 15 bp, Homo sapiens
tggcacgatcctggc

SEQ ID NO: 138325 - DNA, 15 bp, Homo sapiens
gtggcacgatcctgg

SEQ ID NO: 138326 - DNA, 15 bp, Homo sapiens
agtggcacgatcctg

SEQ ID NO: 138327 - DNA, 15 bp, Homo sapiens
cagtggcacgatcct

SEQ ID NO: 138328 - DNA, 15 bp, Homo sapiens
gcagtggcacgatcc

SEQ ID NO: 138329 - DNA, 15 bp, Homo sapiens
gctctgtcgcccagg

SEQ ID NO: 138330 - DNA, 15 bp, Homo sapiens
gagagtcttgctctg

SEQ ID NO: 138331 - DNA, 15 bp, Homo sapiens
agagagtcttgctct

SEQ ID NO: 138332 - DNA, 15 bp, Homo sapiens
gagagagtcttgctc

SEQ ID NO: 138333 - DNA, 15 bp, Homo sapiens
agagagagtcttgct

SEQ ID NO: 138334 - DNA, 15 bp, Homo sapiens
gagagagagtcttgc

SEQ ID NO: 138335 - DNA, 15 bp, Homo sapiens
tgagagagagtcttg

SEQ ID NO: 138336 - DNA, 15 bp, Homo sapiens
ttgagagagagtctt

SEQ ID NO: 138337 - DNA, 15 bp, Homo sapiens
tttgagagagagtct

SEQ ID NO: 138338 - DNA, 15 bp, Homo sapiens
ttttgagagagagtc

SEQ ID NO: 138339 - DNA, 15 bp, Homo sapiens
tttttgagagagagt

SEQ ID NO: 138340 - DNA, 15 bp, Homo sapiens
ttttttgagagagag

SEQ ID NO: 138341 - DNA, 15 bp, Homo sapiens
tttttttgagagaga

SEQ ID NO: 138342 - DNA, 15 bp, Homo sapiens
ttttttttgagagag

SEQ ID NO: 138343 - DNA, 15 bp, Homo sapiens
tttttttttgagaga

SEQ ID NO: 138344 - DNA, 15 bp, Homo sapiens
gaaactttttttttt

SEQ ID NO: 138345 - DNA, 15 bp, Homo sapiens
ggaaacttttttttt

SEQ ID NO: 138346 - DNA, 15 bp, Homo sapiens
aggaaactttttttt

SEQ ID NO: 138347 - DNA, 15 bp, Homo sapiens
aaggaaacttttttt

SEQ ID NO: 138348 - DNA, 15 bp, Homo sapiens
taaggaaactttttt

SEQ ID NO: 138349 - DNA, 15 bp, Homo sapiens
ctaaggaaacttttt

SEQ ID NO: 138350 - DNA, 15 bp, Homo sapiens
tctaaggaaactttt

SEQ ID NO: 138351 - DNA, 15 bp, Homo sapiens
atctaaggaaacttt

SEQ ID NO: 138352 - DNA, 15 bp, Homo sapiens
gatctaaggaaactt

SEQ ID NO: 138353 - DNA, 15 bp, Homo sapiens
agatctaaggaaact

SEQ ID NO: 138354 - DNA, 15 bp, Homo sapiens
cagatctaaggaaac

SEQ ID NO: 138355 - DNA, 15 bp, Homo sapiens
acagatctaaggaaa

SEQ ID NO: 138356 - DNA, 15 bp, Homo sapiens
gacagatctaaggaa

SEQ ID NO: 138357 - DNA, 15 bp, Homo sapiens
agacagatctaagga

SEQ ID NO: 138358 - DNA, 15 bp, Homo sapiens
cagacagatctaagg

SEQ ID NO: 138359 - DNA, 15 bp, Homo sapiens
acagacagatctaag

SEQ ID NO: 138360 - DNA, 15 bp, Homo sapiens
gacagacagatctaa

SEQ ID NO: 138361 - DNA, 15 bp, Homo sapiens
ggacagacagatcta

SEQ ID NO: 138362 - DNA, 15 bp, Homo sapiens
aggacagacagatct

SEQ ID NO: 138363 - DNA, 15 bp, Homo sapiens
aaggacagacagatc

SEQ ID NO: 138364 - DNA, 15 bp, Homo sapiens
taaggacagacagat

SEQ ID NO: 138365 - DNA, 15 bp, Homo sapiens
ttaaggacagacaga

SEQ ID NO: 138366 - DNA, 15 bp, Homo sapiens
tttaaggacagacag

SEQ ID NO: 138367 - DNA, 15 bp, Homo sapiens
ttttaaggacagaca

SEQ ID NO: 138368 - DNA, 15 bp, Homo sapiens
gttttaaggacagac

SEQ ID NO: 138369 - DNA, 15 bp, Homo sapiens
ggttttaaggacaga

SEQ ID NO: 138370 - DNA, 15 bp, Homo sapiens
aggttttaaggacag

SEQ ID NO: 138371 - DNA, 15 bp, Homo sapiens
aaggttttaaggaca

SEQ ID NO: 138372 - DNA, 15 bp, Homo sapiens
caaggttttaaggac

SEQ ID NO: 138373 - DNA, 15 bp, Homo sapiens
acaaggttttaagga

SEQ ID NO: 138374 - DNA, 15 bp, Homo sapiens
aacaaggttttaagg

SEQ ID NO: 138375 - DNA, 15 bp, Homo sapiens
taacaaggttttaag

SEQ ID NO: 138376 - DNA, 15 bp, Homo sapiens
ttaacaaggttttaa

SEQ ID NO: 138377 - DNA, 15 bp, Homo sapiens
tttaacaaggtttta

SEQ ID NO: 138378 - DNA, 15 bp, Homo sapiens
ttttaacaaggtttt

SEQ ID NO: 138379 - DNA, 15 bp, Homo sapiens
tttttaacaaggttt

SEQ ID NO: 138380 - DNA, 15 bp, Homo sapiens
atttttaacaaggtt

SEQ ID NO: 138381 - DNA, 15 bp, Homo sapiens
tatttttaacaaggt

SEQ ID NO: 138382 - DNA, 15 bp, Homo sapiens
ctatttttaacaagg

SEQ ID NO: 138383 - DNA, 15 bp, Homo sapiens
tctatttttaacaag

SEQ ID NO: 138384 - DNA, 15 bp, Homo sapiens
ctctatttttaacaa

SEQ ID NO: 138385 - DNA, 15 bp, Homo sapiens
tctctatttttaaca

SEQ ID NO: 138386 - DNA, 15 bp, Homo sapiens
ttctctatttttaac

SEQ ID NO: 138387 - DNA, 15 bp, Homo sapiens
tttctctatttttaa

SEQ ID NO: 138388 - DNA, 15 bp, Homo sapiens
ctttctctattttta

SEQ ID NO: 138389 - DNA, 15 bp, Homo sapiens
cctttctctattttt

SEQ ID NO: 138390 - DNA, 15 bp, Homo sapiens
tcctttctctatttt

SEQ ID NO: 138391 - DNA, 15 bp, Homo sapiens
ctcctttctctattt

SEQ ID NO: 138392 - DNA, 15 bp, Homo sapiens
tctcctttctctatt

SEQ ID NO: 138393 - DNA, 15 bp, Homo sapiens
ttctcctttctctat

SEQ ID NO: 138394 - DNA, 15 bp, Homo sapiens
cttctcctttctcta

SEQ ID NO: 138395 - DNA, 15 bp, Homo sapiens
tcttctcctttctct

SEQ ID NO: 138396 - DNA, 15 bp, Homo sapiens
ctcttctcctttctc

SEQ ID NO: 138397 - DNA, 15 bp, Homo sapiens
tctcttctcctttct

SEQ ID NO: 138398 - DNA, 15 bp, Homo sapiens
ctctcttctcctttc

SEQ ID NO: 138399 - DNA, 15 bp, Homo sapiens
tctctcttctccttt

SEQ ID NO: 138400 - DNA, 15 bp, Homo sapiens
ttctctcttctcctt

SEQ ID NO: 138401 - DNA, 15 bp, Homo sapiens
tttctctcttctcct

SEQ ID NO: 138402 - DNA, 15 bp, Homo sapiens
ctttctctcttctcc

SEQ ID NO: 138403 - DNA, 15 bp, Homo sapiens
gctttctctcttctc

SEQ ID NO: 138404 - DNA, 15 bp, Homo sapiens
agctttctctcttct

SEQ ID NO: 138405 - DNA, 15 bp, Homo sapiens
aagctttctctcttc

SEQ ID NO: 138406 - DNA, 15 bp, Homo sapiens
caagctttctctctt

SEQ ID NO: 138407 - DNA, 15 bp, Homo sapiens
tcaagctttctctct

SEQ ID NO: 138408 - DNA, 15 bp, Homo sapiens
ctcaagctttctctc

SEQ ID NO: 138409 - DNA, 15 bp, Homo sapiens
cctcaagctttctct

SEQ ID NO: 138410 - DNA, 15 bp, Homo sapiens
tcctcaagctttctc

SEQ ID NO: 138411 - DNA, 15 bp, Homo sapiens
ctcctcaagctttct

SEQ ID NO: 138412 - DNA, 15 bp, Homo sapiens
tctcctcaagctttc

SEQ ID NO: 138413 - DNA, 15 bp, Homo sapiens
ttctcctcaagcttt

SEQ ID NO: 138414 - DNA, 15 bp, Homo sapiens
tttctcctcaagctt

SEQ ID NO: 138415 - DNA, 15 bp, Homo sapiens
atttctcctcaagct

SEQ ID NO: 138416 - DNA, 15 bp, Homo sapiens
tatttctcctcaagc

SEQ ID NO: 138417 - DNA, 15 bp, Homo sapiens
ctatttctcctcaag

SEQ ID NO: 138418 - DNA, 15 bp, Homo sapiens
tctatttctcctcaa

SEQ ID NO: 138419 - DNA, 15 bp, Homo sapiens
ttctatttctcctca

SEQ ID NO: 138420 - DNA, 15 bp, Homo sapiens
tttctatttctcctc

SEQ ID NO: 138421 - DNA, 15 bp, Homo sapiens
ctttctatttctcct

SEQ ID NO: 138422 - DNA, 15 bp, Homo sapiens
tctttctatttctcc

SEQ ID NO: 138423 - DNA, 15 bp, Homo sapiens
ctctttctatttctc

SEQ ID NO: 138424 - DNA, 15 bp, Homo sapiens
tctctttctatttct

SEQ ID NO: 138425 - DNA, 15 bp, Homo sapiens
ctctctttctatttc

SEQ ID NO: 138426 - DNA, 15 bp, Homo sapiens
tctctctttctattt

SEQ ID NO: 138427 - DNA, 15 bp, Homo sapiens
ctctctctttctatt

SEQ ID NO: 138428 - DNA, 15 bp, Homo sapiens
tctctctctttctat

SEQ ID NO: 138429 - DNA, 15 bp, Homo sapiens
ttctctctctttcta

SEQ ID NO: 138430 - DNA, 15 bp, Homo sapiens
cttctctctctttct

SEQ ID NO: 138431 - DNA, 15 bp, Homo sapiens
ccttctctctctttc

SEQ ID NO: 138432 - DNA, 15 bp, Homo sapiens
accttctctctcttt

SEQ ID NO: 138433 - DNA, 15 bp, Homo sapiens
caccttctctctctt

SEQ ID NO: 138434 - DNA, 15 bp, Homo sapiens
tcaccttctctctct

SEQ ID NO: 138435 - DNA, 15 bp, Homo sapiens
atcaccttctctctc

SEQ ID NO: 138436 - DNA, 15 bp, Homo sapiens
tatcaccttctctct

SEQ ID NO: 138437 - DNA, 15 bp, Homo sapiens
ttatcaccttctctc

SEQ ID NO: 138438 - DNA, 15 bp, Homo sapiens
attatcaccttctct

SEQ ID NO: 138439 - DNA, 15 bp, Homo sapiens
cattatcaccttctc

SEQ ID NO: 138440 - DNA, 15 bp, Homo sapiens
tcattatcaccttct

SEQ ID NO: 138441 - DNA, 15 bp, Homo sapiens
ctcattatcaccttc

SEQ ID NO: 138442 - DNA, 15 bp, Homo sapiens
actcattatcacctt

SEQ ID NO: 138443 - DNA, 15 bp, Homo sapiens
cactcattatcacct

SEQ ID NO: 138444 - DNA, 15 bp, Homo sapiens
tcactcattatcacc

SEQ ID NO: 138445 - DNA, 15 bp, Homo sapiens
ttcactcattatcac

SEQ ID NO: 138446 - DNA, 15 bp, Homo sapiens
tttcactcattatca

SEQ ID NO: 138447 - DNA, 15 bp, Homo sapiens
ctttcactcattatc

SEQ ID NO: 138448 - DNA, 15 bp, Homo sapiens
cctttcactcattat

SEQ ID NO: 138449 - DNA, 15 bp, Homo sapiens
tcctttcactcatta

SEQ ID NO: 138450 - DNA, 15 bp, Homo sapiens
ttcctttcactcatt

SEQ ID NO: 138451 - DNA, 15 bp, Homo sapiens
attcctttcactcat

SEQ ID NO: 138452 - DNA, 15 bp, Homo sapiens
cattcctttcactca

SEQ ID NO: 138453 - DNA, 15 bp, Homo sapiens
tcattcctttcactc

SEQ ID NO: 138454 - DNA, 15 bp, Homo sapiens
ttcattcctttcact

SEQ ID NO: 138455 - DNA, 15 bp, Homo sapiens
gttcattcctttcac

SEQ ID NO: 138456 - DNA, 15 bp, Homo sapiens
tgttcattcctttca

SEQ ID NO: 138457 - DNA, 15 bp, Homo sapiens
ttgttcattcctttc

SEQ ID NO: 138458 - DNA, 15 bp, Homo sapiens
attgttcattccttt

SEQ ID NO: 138459 - DNA, 15 bp, Homo sapiens
tattgttcattcctt

SEQ ID NO: 138460 - DNA, 15 bp, Homo sapiens
ttattgttcattcct

SEQ ID NO: 138461 - DNA, 15 bp, Homo sapiens
attattgttcattcc

SEQ ID NO: 138462 - DNA, 15 bp, Homo sapiens
tattattgttcattc

SEQ ID NO: 138463 - DNA, 15 bp, Homo sapiens
ttattattgttcatt

SEQ ID NO: 138464 - DNA, 15 bp, Homo sapiens
tttattattgttcat

SEQ ID NO: 138465 - DNA, 15 bp, Homo sapiens
ttttattattgttca

SEQ ID NO: 138466 - DNA, 15 bp, Homo sapiens
cttttattattgttc

SEQ ID NO: 138467 - DNA, 15 bp, Homo sapiens
tcttttattattgtt

SEQ ID NO: 138468 - DNA, 15 bp, Homo sapiens
ctcttttattattgt

SEQ ID NO: 138469 - DNA, 15 bp, Homo sapiens
cctcttttattattg

SEQ ID NO: 138470 - DNA, 15 bp, Homo sapiens
tcctcttttattatt

SEQ ID NO: 138471 - DNA, 15 bp, Homo sapiens
ttcctcttttattat

SEQ ID NO: 138472 - DNA, 15 bp, Homo sapiens
cttcctcttttatta

SEQ ID NO: 138473 - DNA, 15 bp, Homo sapiens
ccttcctcttttatt

SEQ ID NO: 138474 - DNA, 15 bp, Homo sapiens
tccttcctcttttat

SEQ ID NO: 138475 - DNA, 15 bp, Homo sapiens
gtccttcctctttta

SEQ ID NO: 138476 - DNA, 15 bp, Homo sapiens
tgtccttcctctttt

SEQ ID NO: 138477 - DNA, 15 bp, Homo sapiens
ttgtccttcctcttt

SEQ ID NO: 138478 - DNA, 15 bp, Homo sapiens
cttgtccttcctctt

SEQ ID NO: 138479 - DNA, 15 bp, Homo sapiens
tcttgtccttcctct

SEQ ID NO: 138480 - DNA, 15 bp, Homo sapiens
ctcttgtccttcctc

SEQ ID NO: 138481 - DNA, 15 bp, Homo sapiens
gctcttgtccttcct

SEQ ID NO: 138482 - DNA, 15 bp, Homo sapiens
ggctcttgtccttcc

SEQ ID NO: 138483 - DNA, 15 bp, Homo sapiens
tggctcttgtccttc

SEQ ID NO: 138484 - DNA, 15 bp, Homo sapiens
ctggctcttgtcctt

SEQ ID NO: 138485 - DNA, 15 bp, Homo sapiens
actggctcttgtcct

SEQ ID NO: 138486 - DNA, 15 bp, Homo sapiens
tactggctcttgtcc

SEQ ID NO: 138487 - DNA, 15 bp, Homo sapiens
atactggctcttgtc

SEQ ID NO: 138488 - DNA, 15 bp, Homo sapiens
catactggctcttgt

SEQ ID NO: 138489 - DNA, 15 bp, Homo sapiens
ccatactggctcttg

SEQ ID NO: 138490 - DNA, 15 bp, Homo sapiens
tccatactggctctt

SEQ ID NO: 138491 - DNA, 15 bp, Homo sapiens
ttccatactggctct

SEQ ID NO: 138492 - DNA, 15 bp, Homo sapiens
attccatactggctc

SEQ ID NO: 138493 - DNA, 15 bp, Homo sapiens
aattccatactggct

SEQ ID NO: 138494 - DNA, 15 bp, Homo sapiens
aaattccatactggc

SEQ ID NO: 138495 - DNA, 15 bp, Homo sapiens
aaaattccatactgg

SEQ ID NO: 138496 - DNA, 15 bp, Homo sapiens
aaaaattccatactg

SEQ ID NO: 138497 - DNA, 15 bp, Homo sapiens
taaaaattccatact

SEQ ID NO: 138498 - DNA, 15 bp, Homo sapiens
ataaaaattccatac

SEQ ID NO: 138499 - DNA, 15 bp, Homo sapiens
cataaaaattccata

SEQ ID NO: 138500 - DNA, 15 bp, Homo sapiens
tcataaaaattccat

SEQ ID NO: 138501 - DNA, 15 bp, Homo sapiens
atcataaaaattcca

SEQ ID NO: 138502 - DNA, 15 bp, Homo sapiens
catcataaaaattcc

SEQ ID NO: 138503 - DNA, 15 bp, Homo sapiens
tcatcataaaaattc

SEQ ID NO: 138504 - DNA, 15 bp, Homo sapiens
ttcatcataaaaatt

SEQ ID NO: 138505 - DNA, 15 bp, Homo sapiens
cttcatcataaaaat

SEQ ID NO: 138506 - DNA, 15 bp, Homo sapiens
tcttcatcataaaaa

SEQ ID NO: 138507 - DNA, 15 bp, Homo sapiens
ctcttcatcataaaa

SEQ ID NO: 138508 - DNA, 15 bp, Homo sapiens
gctcttcatcataaa

SEQ ID NO: 138509 - DNA, 15 bp, Homo sapiens
agctcttcatcataa

SEQ ID NO: 138510 - DNA, 15 bp, Homo sapiens
cagctcttcatcata

SEQ ID NO: 138511 - DNA, 15 bp, Homo sapiens
gcagctcttcatcat

SEQ ID NO: 138512 - DNA, 15 bp, Homo sapiens
agcagctcttcatca

SEQ ID NO: 138513 - DNA, 15 bp, Homo sapiens
cagcagctcttcatc

SEQ ID NO: 138514 - DNA, 15 bp, Homo sapiens
ccagcagctcttcat

SEQ ID NO: 138515 - DNA, 15 bp, Homo sapiens
cccagcagctcttca

SEQ ID NO: 138516 - DNA, 15 bp, Homo sapiens
acccagcagctcttc

SEQ ID NO: 138517 - DNA, 15 bp, Homo sapiens
cacccagcagctctt

SEQ ID NO: 138518 - DNA, 15 bp, Homo sapiens
gcacccagcagctct

SEQ ID NO: 138519 - DNA, 15 bp, Homo sapiens
tgcacccagcagctc

SEQ ID NO: 138520 - DNA, 15 bp, Homo sapiens
gtgcacccagcagct

SEQ ID NO: 138521 - DNA, 15 bp, Homo sapiens
tgtgcacccagcagc

SEQ ID NO: 138522 - DNA, 15 bp, Homo sapiens
ctgtgcacccagcag

SEQ ID NO: 138523 - DNA, 15 bp, Homo sapiens
actgtgcacccagca

SEQ ID NO: 138524 - DNA, 15 bp, Homo sapiens
aactgtgcacccagc

SEQ ID NO: 138525 - DNA, 15 bp, Homo sapiens
gaactgtgcacccag

SEQ ID NO: 138526 - DNA, 15 bp, Homo sapiens
tgaactgtgcaccca

SEQ ID NO: 138527 - DNA, 15 bp, Homo sapiens
atgaactgtgcaccc

SEQ ID NO: 138528 - DNA, 15 bp, Homo sapiens
catgaactgtgcacc

SEQ ID NO: 138529 - DNA, 15 bp, Homo sapiens
tcatgaactgtgcac

SEQ ID NO: 138530 - DNA, 15 bp, Homo sapiens
ctcatgaactgtgca

SEQ ID NO: 138531 - DNA, 15 bp, Homo sapiens
actcatgaactgtgc

SEQ ID NO: 138532 - DNA, 15 bp, Homo sapiens
gactcatgaactgtg

SEQ ID NO: 138533 - DNA, 15 bp, Homo sapiens
agactcatgaactgt

SEQ ID NO: 138534 - DNA, 15 bp, Homo sapiens
gagactcatgaactg

SEQ ID NO: 138535 - DNA, 15 bp, Homo sapiens
agagactcatgaact

SEQ ID NO: 138536 - DNA, 15 bp, Homo sapiens
aagagactcatgaac

SEQ ID NO: 138537 - DNA, 15 bp, Homo sapiens
aaagagactcatgaa

SEQ ID NO: 138538 - DNA, 15 bp, Homo sapiens
aaaagagactcatga

SEQ ID NO: 138539 - DNA, 15 bp, Homo sapiens
taaaagagactcatg

SEQ ID NO: 138540 - DNA, 15 bp, Homo sapiens
gtaaaagagactcat

SEQ ID NO: 138541 - DNA, 15 bp, Homo sapiens
agtaaaagagactca

SEQ ID NO: 138542 - DNA, 15 bp, Homo sapiens
aagtaaaagagactc

SEQ ID NO: 138543 - DNA, 15 bp, Homo sapiens
aaagtaaaagagact

SEQ ID NO: 138544 - DNA, 15 bp, Homo sapiens
aaaagtaaaagagac

SEQ ID NO: 138545 - DNA, 15 bp, Homo sapiens
taaaagtaaaagaga

SEQ ID NO: 138546 - DNA, 15 bp, Homo sapiens
ctaaaagtaaaagag

SEQ ID NO: 138547 - DNA, 15 bp, Homo sapiens
gctaaaagtaaaaga

SEQ ID NO: 138548 - DNA, 15 bp, Homo sapiens
tgctaaaagtaaaag

SEQ ID NO: 138549 - DNA, 15 bp, Homo sapiens
atgctaaaagtaaaa

SEQ ID NO: 138550 - DNA, 15 bp, Homo sapiens
aatgctaaaagtaaa

SEQ ID NO: 138551 - DNA, 15 bp, Homo sapiens
aaatgctaaaagtaa

SEQ ID NO: 138552 - DNA, 15 bp, Homo sapiens
gaaatgctaaaagta

SEQ ID NO: 138553 - DNA, 15 bp, Homo sapiens
agaaatgctaaaagt

SEQ ID NO: 138554 - DNA, 15 bp, Homo sapiens
gagaaatgctaaaag

SEQ ID NO: 138555 - DNA, 15 bp, Homo sapiens
agagaaatgctaaaa

SEQ ID NO: 138556 - DNA, 15 bp, Homo sapiens
aagagaaatgctaaa

SEQ ID NO: 138557 - DNA, 15 bp, Homo sapiens
caagagaaatgctaa

SEQ ID NO: 138558 - DNA, 15 bp, Homo sapiens
tcaagagaaatgcta

SEQ ID NO: 138559 - DNA, 15 bp, Homo sapiens
ttcaagagaaatgct

SEQ ID NO: 138560 - DNA, 15 bp, Homo sapiens
gttcaagagaaatgc

SEQ ID NO: 138561 - DNA, 15 bp, Homo sapiens
agttcaagagaaatg

SEQ ID NO: 138562 - DNA, 15 bp, Homo sapiens
aagttcaagagaaat

SEQ ID NO: 138563 - DNA, 15 bp, Homo sapiens
caagttcaagagaaa

SEQ ID NO: 138564 - DNA, 15 bp, Homo sapiens
tcaagttcaagagaa

SEQ ID NO: 138565 - DNA, 15 bp, Homo sapiens
ttcaagttcaagaga

SEQ ID NO: 138566 - DNA, 15 bp, Homo sapiens
attcaagttcaagag

SEQ ID NO: 138567 - DNA, 15 bp, Homo sapiens
tattcaagttcaaga

SEQ ID NO: 138568 - DNA, 15 bp, Homo sapiens
atattcaagttcaag

SEQ ID NO: 138569 - DNA, 15 bp, Homo sapiens
tatattcaagttcaa

SEQ ID NO: 138570 - DNA, 15 bp, Homo sapiens
atatattcaagttca

SEQ ID NO: 138571 - DNA, 15 bp, Homo sapiens
tatatattcaagttc

SEQ ID NO: 138572 - DNA, 15 bp, Homo sapiens
ttatatattcaagtt

SEQ ID NO: 138573 - DNA, 15 bp, Homo sapiens
tttatatattcaagt

SEQ ID NO: 138574 - DNA, 15 bp, Homo sapiens
ttttatatattcaag

SEQ ID NO: 138575 - DNA, 15 bp, Homo sapiens
attttatatattcaa

SEQ ID NO: 138576 - DNA, 15 bp, Homo sapiens
aattttatatattca

SEQ ID NO: 138577 - DNA, 15 bp, Homo sapiens
gaattttatatattc

SEQ ID NO: 138578 - DNA, 15 bp, Homo sapiens
ggaattttatatatt

SEQ ID NO: 138579 - DNA, 15 bp, Homo sapiens
aggaattttatatat

SEQ ID NO: 138580 - DNA, 15 bp, Homo sapiens
aaggaattttatata

SEQ ID NO: 138581 - DNA, 15 bp, Homo sapiens
aaaggaattttatat

SEQ ID NO: 138582 - DNA, 15 bp, Homo sapiens
aaaaggaattttata

SEQ ID NO: 138583 - DNA, 15 bp, Homo sapiens
taaaaggaattttat

SEQ ID NO: 138584 - DNA, 15 bp, Homo sapiens
ctaaaaggaatttta

SEQ ID NO: 138585 - DNA, 15 bp, Homo sapiens
tctaaaaggaatttt

SEQ ID NO: 138586 - DNA, 15 bp, Homo sapiens
ctctaaaaggaattt

SEQ ID NO: 138587 - DNA, 15 bp, Homo sapiens
tctctaaaaggaatt

SEQ ID NO: 138588 - DNA, 15 bp, Homo sapiens
ctctctaaaaggaat

SEQ ID NO: 138589 - DNA, 15 bp, Homo sapiens
actctctaaaaggaa

SEQ ID NO: 138590 - DNA, 15 bp, Homo sapiens
aactctctaaaagga

SEQ ID NO: 138591 - DNA, 15 bp, Homo sapiens
aaactctctaaaagg

SEQ ID NO: 138592 - DNA, 15 bp, Homo sapiens
aaaactctctaaaag

SEQ ID NO: 138593 - DNA, 15 bp, Homo sapiens
gaaaactctctaaaa

SEQ ID NO: 138594 - DNA, 15 bp, Homo sapiens
ggaaaactctctaaa

SEQ ID NO: 138595 - DNA, 15 bp, Homo sapiens
aggaaaactctctaa

SEQ ID NO: 138596 - DNA, 15 bp, Homo sapiens
caggaaaactctcta

SEQ ID NO: 138597 - DNA, 15 bp, Homo sapiens
gcaggaaaactctct

SEQ ID NO: 138598 - DNA, 15 bp, Homo sapiens
agcaggaaaactctc

SEQ ID NO: 138599 - DNA, 15 bp, Homo sapiens
tagcaggaaaactct

SEQ ID NO: 138600 - DNA, 15 bp, Homo sapiens
gtagcaggaaaactc

SEQ ID NO: 138601 - DNA, 15 bp, Homo sapiens
tgtagcaggaaaact

SEQ ID NO: 138602 - DNA, 15 bp, Homo sapiens
ctgtagcaggaaaac

SEQ ID NO: 138603 - DNA, 15 bp, Homo sapiens
actgtagcaggaaaa

SEQ ID NO: 138604 - DNA, 15 bp, Homo sapiens
tactgtagcaggaaa

SEQ ID NO: 138605 - DNA, 15 bp, Homo sapiens
ttactgtagcaggaa

SEQ ID NO: 138606 - DNA, 15 bp, Homo sapiens
tttactgtagcagga

SEQ ID NO: 138607 - DNA, 15 bp, Homo sapiens
ttttactgtagcagg

SEQ ID NO: 138608 - DNA, 15 bp, Homo sapiens
gttttactgtagcag

SEQ ID NO: 138609 - DNA, 15 bp, Homo sapiens
tgttttactgtagca

SEQ ID NO: 138610 - DNA, 15 bp, Homo sapiens
ttgttttactgtagc

SEQ ID NO: 138611 - DNA, 15 bp, Homo sapiens
tttgttttactgtag

SEQ ID NO: 138612 - DNA, 15 bp, Homo sapiens
atttgttttactgta

SEQ ID NO: 138613 - DNA, 15 bp, Homo sapiens
catttgttttactgt

SEQ ID NO: 138614 - DNA, 15 bp, Homo sapiens
gcatttgttttactg

SEQ ID NO: 138615 - DNA, 15 bp, Homo sapiens
tgcatttgttttact

SEQ ID NO: 138616 - DNA, 15 bp, Homo sapiens
ttgcatttgttttac

SEQ ID NO: 138617 - DNA, 15 bp, Homo sapiens
tttgcatttgtttta

SEQ ID NO: 138618 - DNA, 15 bp, Homo sapiens
ttttgcatttgtttt

SEQ ID NO: 138619 - DNA, 15 bp, Homo sapiens
tttttgcatttgttt

SEQ ID NO: 138620 - DNA, 15 bp, Homo sapiens
ttttttgcatttgtt

SEQ ID NO: 138621 - DNA, 15 bp, Homo sapiens
tttttttgcatttgt

SEQ ID NO: 138622 - DNA, 15 bp, Homo sapiens
ttttttttgcatttg

SEQ ID NO: 138623 - DNA, 15 bp, Homo sapiens
tttttttttgcattt

SEQ ID NO: 138624 - DNA, 15 bp, Homo sapiens
atttttttttgcatt

SEQ ID NO: 138625 - DNA, 15 bp, Homo sapiens
aatttttttttgcat

SEQ ID NO: 138626 - DNA, 15 bp, Homo sapiens
gaatttttttttgca

SEQ ID NO: 138627 - DNA, 15 bp, Homo sapiens
agaatttttttttgc

SEQ ID NO: 138628 - DNA, 15 bp, Homo sapiens
aagaatttttttttg

SEQ ID NO: 138629 - DNA, 15 bp, Homo sapiens
taagaattttttttt

SEQ ID NO: 138630 - DNA, 15 bp, Homo sapiens
gtaagaatttttttt

SEQ ID NO: 138631 - DNA, 15 bp, Homo sapiens
tgtaagaattttttt

SEQ ID NO: 138632 - DNA, 15 bp, Homo sapiens
gtgtaagaatttttt

SEQ ID NO: 138633 - DNA, 15 bp, Homo sapiens
tgtgtaagaattttt

SEQ ID NO: 138634 - DNA, 15 bp, Homo sapiens
ctgtgtaagaatttt

SEQ ID NO: 138635 - DNA, 15 bp, Homo sapiens
actgtgtaagaattt

SEQ ID NO: 138636 - DNA, 15 bp, Homo sapiens
aactgtgtaagaatt

SEQ ID NO: 138637 - DNA, 15 bp, Homo sapiens
gaactgtgtaagaat

SEQ ID NO: 138638 - DNA, 15 bp, Homo sapiens
tgaactgtgtaagaa

SEQ ID NO: 138639 - DNA, 15 bp, Homo sapiens
ctgaactgtgtaaga

SEQ ID NO: 138640 - DNA, 15 bp, Homo sapiens
actgaactgtgtaag

SEQ ID NO: 138641 - DNA, 15 bp, Homo sapiens
aactgaactgtgtaa

SEQ ID NO: 138642 - DNA, 15 bp, Homo sapiens
aaactgaactgtgta

SEQ ID NO: 138643 - DNA, 15 bp, Homo sapiens
gaaactgaactgtgt

SEQ ID NO: 138644 - DNA, 15 bp, Homo sapiens
agaaactgaactgtg

SEQ ID NO: 138645 - DNA, 15 bp, Homo sapiens
aagaaactgaactgt

SEQ ID NO: 138646 - DNA, 15 bp, Homo sapiens
gaagaaactgaactg

SEQ ID NO: 138647 - DNA, 15 bp, Homo sapiens
agaagaaactgaact

SEQ ID NO: 138648 - DNA, 15 bp, Homo sapiens
tagaagaaactgaac

SEQ ID NO: 138649 - DNA, 15 bp, Homo sapiens
ttagaagaaactgaa

SEQ ID NO: 138650 - DNA, 15 bp, Homo sapiens
tttagaagaaactga

SEQ ID NO: 138651 - DNA, 15 bp, Homo sapiens
ttttagaagaaactg

SEQ ID NO: 138652 - DNA, 15 bp, Homo sapiens
attttagaagaaact

SEQ ID NO: 138653 - DNA, 15 bp, Homo sapiens
gattttagaagaaac

SEQ ID NO: 138654 - DNA, 15 bp, Homo sapiens
tgattttagaagaaa

SEQ ID NO: 138655 - DNA, 15 bp, Homo sapiens
ttgattttagaagaa

SEQ ID NO: 138656 - DNA, 15 bp, Homo sapiens
cttgattttagaaga

SEQ ID NO: 138657 - DNA, 15 bp, Homo sapiens
tcttgattttagaag

SEQ ID NO: 138658 - DNA, 15 bp, Homo sapiens
gtcttgattttagaa

SEQ ID NO: 138659 - DNA, 15 bp, Homo sapiens
agtcttgattttaga

SEQ ID NO: 138660 - DNA, 15 bp, Homo sapiens
cagtcttgattttag

SEQ ID NO: 138661 - DNA, 15 bp, Homo sapiens
gcagtcttgatttta

SEQ ID NO: 138662 - DNA, 15 bp, Homo sapiens
ggcagtcttgatttt

SEQ ID NO: 138663 - DNA, 15 bp, Homo sapiens
aggcagtcttgattt

SEQ ID NO: 138664 - DNA, 15 bp, Homo sapiens
aaggcagtcttgatt

SEQ ID NO: 138665 - DNA, 15 bp, Homo sapiens
taaggcagtcttgat

SEQ ID NO: 138666 - DNA, 15 bp, Homo sapiens
ctaaggcagtcttga

SEQ ID NO: 138667 - DNA, 15 bp, Homo sapiens
tctaaggcagtcttg

SEQ ID NO: 138668 - DNA, 15 bp, Homo sapiens
ttctaaggcagtctt

SEQ ID NO: 138669 - DNA, 15 bp, Homo sapiens
tttctaaggcagtct

SEQ ID NO: 138670 - DNA, 15 bp, Homo sapiens
ttttctaaggcagtc

SEQ ID NO: 138671 - DNA, 15 bp, Homo sapiens
attttctaaggcagt

SEQ ID NO: 138672 - DNA, 15 bp, Homo sapiens
aattttctaaggcag

SEQ ID NO: 138673 - DNA, 15 bp, Homo sapiens
gaattttctaaggca

SEQ ID NO: 138674 - DNA, 15 bp, Homo sapiens
agaattttctaaggc

SEQ ID NO: 138675 - DNA, 15 bp, Homo sapiens
gagaattttctaagg

SEQ ID NO: 138676 - DNA, 15 bp, Homo sapiens
ggagaattttctaag

SEQ ID NO: 138677 - DNA, 15 bp, Homo sapiens
aggagaattttctaa

SEQ ID NO: 138678 - DNA, 15 bp, Homo sapiens
aaggagaattttcta

SEQ ID NO: 138679 - DNA, 15 bp, Homo sapiens
aaaggagaattttct

SEQ ID NO: 138680 - DNA, 15 bp, Homo sapiens
caaaggagaattttc

SEQ ID NO: 138681 - DNA, 15 bp, Homo sapiens
tcaaaggagaatttt

SEQ ID NO: 138682 - DNA, 15 bp, Homo sapiens
ctcaaaggagaattt

SEQ ID NO: 138683 - DNA, 15 bp, Homo sapiens
cctcaaaggagaatt

SEQ ID NO: 138684 - DNA, 15 bp, Homo sapiens
ccctcaaaggagaat

SEQ ID NO: 138685 - DNA, 15 bp, Homo sapiens
accctcaaaggagaa

SEQ ID NO: 138686 - DNA, 15 bp, Homo sapiens
taccctcaaaggaga

SEQ ID NO: 138687 - DNA, 15 bp, Homo sapiens
ttaccctcaaaggag

SEQ ID NO: 138688 - DNA, 15 bp, Homo sapiens
gttaccctcaaagga

SEQ ID NO: 138689 - DNA, 15 bp, Homo sapiens
tgttaccctcaaagg

SEQ ID NO: 138690 - DNA, 15 bp, Homo sapiens
ctgttaccctcaaag

SEQ ID NO: 138691 - DNA, 15 bp, Homo sapiens
cctgttaccctcaaa

SEQ ID NO: 138692 - DNA, 15 bp, Homo sapiens
acctgttaccctcaa

SEQ ID NO: 138693 - DNA, 15 bp, Homo sapiens
cacctgttaccctca

SEQ ID NO: 138694 - DNA, 15 bp, Homo sapiens
tcacctgttaccctc

SEQ ID NO: 138695 - DNA, 15 bp, Homo sapiens
gtcacctgttaccct

SEQ ID NO: 138696 - DNA, 15 bp, Homo sapiens
agtcacctgttaccc

SEQ ID NO: 138697 - DNA, 15 bp, Homo sapiens
tagtcacctgttacc

SEQ ID NO: 138698 - DNA, 15 bp, Homo sapiens
atagtcacctgttac

SEQ ID NO: 138699 - DNA, 15 bp, Homo sapiens
gatagtcacctgtta

SEQ ID NO: 138700 - DNA, 15 bp, Homo sapiens
agatagtcacctgtt

SEQ ID NO: 138701 - DNA, 15 bp, Homo sapiens
gagatagtcacctgt

SEQ ID NO: 138702 - DNA, 15 bp, Homo sapiens
agagatagtcacctg

SEQ ID NO: 138703 - DNA, 15 bp, Homo sapiens
gagagatagtcacct

SEQ ID NO: 138704 - DNA, 15 bp, Homo sapiens
agagagatagtcacc

SEQ ID NO: 138705 - DNA, 15 bp, Homo sapiens
cagagagatagtcac

SEQ ID NO: 138706 - DNA, 15 bp, Homo sapiens
acagagagatagtca

SEQ ID NO: 138707 - DNA, 15 bp, Homo sapiens
gacagagagatagtc

SEQ ID NO: 138708 - DNA, 15 bp, Homo sapiens
aagacagagagatag

SEQ ID NO: 138709 - DNA, 15 bp, Homo sapiens
taagacagagagata

SEQ ID NO: 138710 - DNA, 15 bp, Homo sapiens
ttaagacagagagat

SEQ ID NO: 138711 - DNA, 15 bp, Homo sapiens
tttaagacagagaga

SEQ ID NO: 138712 - DNA, 15 bp, Homo sapiens
ctttaagacagagag

SEQ ID NO: 138713 - DNA, 15 bp, Homo sapiens
actttaagacagaga

SEQ ID NO: 138714 - DNA, 15 bp, Homo sapiens
aactttaagacagag

SEQ ID NO: 138715 - DNA, 15 bp, Homo sapiens
gaactttaagacaga

SEQ ID NO: 138716 - DNA, 15 bp, Homo sapiens
agaactttaagacag

SEQ ID NO: 138717 - DNA, 15 bp, Homo sapiens
cagaactttaagaca

SEQ ID NO: 138718 - DNA, 15 bp, Homo sapiens
acagaactttaagac

SEQ ID NO: 138719 - DNA, 15 bp, Homo sapiens
gacagaactttaaga

SEQ ID NO: 138720 - DNA, 15 bp, Homo sapiens
tgacagaactttaag

SEQ ID NO: 138721 - DNA, 15 bp, Homo sapiens
atgacagaactttaa

SEQ ID NO: 138722 - DNA, 15 bp, Homo sapiens
catgacagaacttta

SEQ ID NO: 138723 - DNA, 15 bp, Homo sapiens
tcatgacagaacttt

SEQ ID NO: 138724 - DNA, 15 bp, Homo sapiens
ttcatgacagaactt

SEQ ID NO: 138725 - DNA, 15 bp, Homo sapiens
cttcatgacagaact

SEQ ID NO: 138726 - DNA, 15 bp, Homo sapiens
acttcatgacagaac

SEQ ID NO: 138727 - DNA, 15 bp, Homo sapiens
tacttcatgacagaa

SEQ ID NO: 138728 - DNA, 15 bp, Homo sapiens
gtacttcatgacaga

SEQ ID NO: 138729 - DNA, 15 bp, Homo sapiens
agtacttcatgacag

SEQ ID NO: 138730 - DNA, 15 bp, Homo sapiens
cagtacttcatgaca

SEQ ID NO: 138731 - DNA, 15 bp, Homo sapiens
acagtacttcatgac

SEQ ID NO: 138732 - DNA, 15 bp, Homo sapiens
aacagtacttcatga

SEQ ID NO: 138733 - DNA, 15 bp, Homo sapiens
taacagtacttcatg

SEQ ID NO: 138734 - DNA, 15 bp, Homo sapiens
ttaacagtacttcat

SEQ ID NO: 138735 - DNA, 15 bp, Homo sapiens
tttaacagtacttca

SEQ ID NO: 138736 - DNA, 15 bp, Homo sapiens
gtttaacagtacttc

SEQ ID NO: 138737 - DNA, 15 bp, Homo sapiens
ggtttaacagtactt

SEQ ID NO: 138738 - DNA, 15 bp, Homo sapiens
gggtttaacagtact

SEQ ID NO: 138739 - DNA, 15 bp, Homo sapiens
agggtttaacagtac

SEQ ID NO: 138740 - DNA, 15 bp, Homo sapiens
tagggtttaacagta

SEQ ID NO: 138741 - DNA, 15 bp, Homo sapiens
gtagggtttaacagt

SEQ ID NO: 138742 - DNA, 15 bp, Homo sapiens
ggtagggtttaacag

SEQ ID NO: 138743 - DNA, 15 bp, Homo sapiens
aggtagggtttaaca

SEQ ID NO: 138744 - DNA, 15 bp, Homo sapiens
aaggtagggtttaac

SEQ ID NO: 138745 - DNA, 15 bp, Homo sapiens
gaaggtagggtttaa

SEQ ID NO: 138746 - DNA, 15 bp, Homo sapiens
tgaaggtagggttta

SEQ ID NO: 138747 - DNA, 15 bp, Homo sapiens
atgaaggtagggttt

SEQ ID NO: 138748 - DNA, 15 bp, Homo sapiens
gatgaaggtagggtt

SEQ ID NO: 138749 - DNA, 15 bp, Homo sapiens
tgatgaaggtagggt

SEQ ID NO: 138750 - DNA, 15 bp, Homo sapiens
ttgatgaaggtaggg

SEQ ID NO: 138751 - DNA, 15 bp, Homo sapiens
tttgatgaaggtagg

SEQ ID NO: 138752 - DNA, 15 bp, Homo sapiens
gtttgatgaaggtag

SEQ ID NO: 138753 - DNA, 15 bp, Homo sapiens
ggtttgatgaaggta

SEQ ID NO: 138754 - DNA, 15 bp, Homo sapiens
tggtttgatgaaggt

SEQ ID NO: 138755 - DNA, 15 bp, Homo sapiens
ctggtttgatgaagg

SEQ ID NO: 138756 - DNA, 15 bp, Homo sapiens
cctggtttgatgaag

SEQ ID NO: 138757 - DNA, 15 bp, Homo sapiens
acctggtttgatgaa

SEQ ID NO: 138758 - DNA, 15 bp, Homo sapiens
gacctggtttgatga

SEQ ID NO: 138759 - DNA, 15 bp, Homo sapiens
agacctggtttgatg

SEQ ID NO: 138760 - DNA, 15 bp, Homo sapiens
tagacctggtttgat

SEQ ID NO: 138761 - DNA, 15 bp, Homo sapiens
atagacctggtttga

SEQ ID NO: 138762 - DNA, 15 bp, Homo sapiens
tatagacctggtttg

SEQ ID NO: 138763 - DNA, 15 bp, Homo sapiens
ttatagacctggttt

SEQ ID NO: 138764 - DNA, 15 bp, Homo sapiens
tttatagacctggtt

SEQ ID NO: 138765 - DNA, 15 bp, Homo sapiens
atttatagacctggt

SEQ ID NO: 138766 - DNA, 15 bp, Homo sapiens
tatttatagacctgg

SEQ ID NO: 138767 - DNA, 15 bp, Homo sapiens
gtatttatagacctg

SEQ ID NO: 138768 - DNA, 15 bp, Homo sapiens
tgtatttatagacct

SEQ ID NO: 138769 - DNA, 15 bp, Homo sapiens
ttgtatttatagacc

SEQ ID NO: 138770 - DNA, 15 bp, Homo sapiens
gttgtatttatagac

SEQ ID NO: 138771 - DNA, 15 bp, Homo sapiens
agttgtatttataga

SEQ ID NO: 138772 - DNA, 15 bp, Homo sapiens
cagttgtatttatag

SEQ ID NO: 138773 - DNA, 15 bp, Homo sapiens
acagttgtatttata

SEQ ID NO: 138774 - DNA, 15 bp, Homo sapiens
tacagttgtatttat

SEQ ID NO: 138775 - DNA, 15 bp, Homo sapiens
ttacagttgtattta

SEQ ID NO: 138776 - DNA, 15 bp, Homo sapiens
tttacagttgtattt

SEQ ID NO: 138777 - DNA, 15 bp, Homo sapiens
atttacagttgtatt

SEQ ID NO: 138778 - DNA, 15 bp, Homo sapiens
tatttacagttgtat

SEQ ID NO: 138779 - DNA, 15 bp, Homo sapiens
gtatttacagttgta

SEQ ID NO: 138780 - DNA, 15 bp, Homo sapiens
tgtatttacagttgt

SEQ ID NO: 138781 - DNA, 15 bp, Homo sapiens
ttgtatttacagttg

SEQ ID NO: 138782 - DNA, 15 bp, Homo sapiens
tttgtatttacagtt

SEQ ID NO: 138783 - DNA, 15 bp, Homo sapiens
ttttgtatttacagt

SEQ ID NO: 138784 - DNA, 15 bp, Homo sapiens
attttgtatttacag

SEQ ID NO: 138785 - DNA, 15 bp, Homo sapiens
aattttgtatttaca

SEQ ID NO: 138786 - DNA, 15 bp, Homo sapiens
taattttgtatttac

SEQ ID NO: 138787 - DNA, 15 bp, Homo sapiens
ttaattttgtattta

SEQ ID NO: 138788 - DNA, 15 bp, Homo sapiens
tttaattttgtattt

SEQ ID NO: 138789 - DNA, 15 bp, Homo sapiens
atttaattttgtatt

SEQ ID NO: 138790 - DNA, 15 bp, Homo sapiens
tatttaattttgtat

SEQ ID NO: 138791 - DNA, 15 bp, Homo sapiens
ctatttaattttgta

SEQ ID NO: 138792 - DNA, 15 bp, Homo sapiens
tctatttaattttgt

SEQ ID NO: 138793 - DNA, 15 bp, Homo sapiens
ttctatttaattttg

SEQ ID NO: 138794 - DNA, 15 bp, Homo sapiens
gttctatttaatttt

SEQ ID NO: 138795 - DNA, 15 bp, Homo sapiens
tgttctatttaattt

SEQ ID NO: 138796 - DNA, 15 bp, Homo sapiens
ctgttctatttaatt

SEQ ID NO: 138797 - DNA, 15 bp, Homo sapiens
actgttctatttaat

SEQ ID NO: 138798 - DNA, 15 bp, Homo sapiens
tactgttctatttaa

SEQ ID NO: 138799 - DNA, 15 bp, Homo sapiens
atactgttctattta

SEQ ID NO: 138800 - DNA, 15 bp, Homo sapiens
aatactgttctattt

SEQ ID NO: 138801 - DNA, 15 bp, Homo sapiens
aaatactgttctatt

SEQ ID NO: 138802 - DNA, 15 bp, Homo sapiens
aaaatactgttctat

SEQ ID NO: 138803 - DNA, 15 bp, Homo sapiens
gaaaatactgttcta

SEQ ID NO: 138804 - DNA, 15 bp, Homo sapiens
agaaaatactgttct

SEQ ID NO: 138805 - DNA, 15 bp, Homo sapiens
aagaaaatactgttc

SEQ ID NO: 138806 - DNA, 15 bp, Homo sapiens
aaagaaaatactgtt

SEQ ID NO: 138807 - DNA, 15 bp, Homo sapiens
taaagaaaatactgt

SEQ ID NO: 138808 - DNA, 15 bp, Homo sapiens
ataaagaaaatactg

SEQ ID NO: 138809 - DNA, 15 bp, Homo sapiens
tataaagaaaatact

SEQ ID NO: 138810 - DNA, 15 bp, Homo sapiens
ttataaagaaaatac

SEQ ID NO: 138811 - DNA, 15 bp, Homo sapiens
caattataaagaaaa

SEQ ID NO: 138812 - DNA, 15 bp, Homo sapiens
acaattataaagaaa

SEQ ID NO: 138813 - DNA, 15 bp, Homo sapiens
aacaattataaagaa

SEQ ID NO: 138814 - DNA, 15 bp, Homo sapiens
aaacaattataaaga

SEQ ID NO: 138815 - DNA, 15 bp, Homo sapiens
caaacaattataaag

SEQ ID NO: 138816 - DNA, 15 bp, Homo sapiens
ccaaacaattataaa

SEQ ID NO: 138817 - DNA, 15 bp, Homo sapiens
gccaaacaattataa

SEQ ID NO: 138818 - DNA, 15 bp, Homo sapiens
tgccaaacaattata

SEQ ID NO: 138819 - DNA, 15 bp, Homo sapiens
ctgccaaacaattat

SEQ ID NO: 138820 - DNA, 15 bp, Homo sapiens
actgccaaacaatta

SEQ ID NO: 138821 - DNA, 15 bp, Homo sapiens
tactgccaaacaatt

SEQ ID NO: 138822 - DNA, 15 bp, Homo sapiens
atactgccaaacaat

SEQ ID NO: 138823 - DNA, 15 bp, Homo sapiens
gatactgccaaacaa

SEQ ID NO: 138824 - DNA, 15 bp, Homo sapiens
tgatactgccaaaca

SEQ ID NO: 138825 - DNA, 15 bp, Homo sapiens
ctgatactgccaaac

SEQ ID NO: 138826 - DNA, 15 bp, Homo sapiens
actgatactgccaaa

SEQ ID NO: 138827 - DNA, 15 bp, Homo sapiens
aactgatactgccaa

SEQ ID NO: 138828 - DNA, 15 bp, Homo sapiens
aaactgatactgcca

SEQ ID NO: 138829 - DNA, 15 bp, Homo sapiens
taaactgatactgcc

SEQ ID NO: 138830 - DNA, 15 bp, Homo sapiens
ataaactgatactgc

SEQ ID NO: 138831 - DNA, 15 bp, Homo sapiens
tataaactgatactg

SEQ ID NO: 138832 - DNA, 15 bp, Homo sapiens
ttataaactgatact

SEQ ID NO: 138833 - DNA, 15 bp, Homo sapiens
attataaactgatac

SEQ ID NO: 138834 - DNA, 15 bp, Homo sapiens
tattataaactgata

SEQ ID NO: 138835 - DNA, 15 bp, Homo sapiens
ctattataaactgat

SEQ ID NO: 138836 - DNA, 15 bp, Homo sapiens
actattataaactga

SEQ ID NO: 138837 - DNA, 15 bp, Homo sapiens
tactattataaactg

SEQ ID NO: 138838 - DNA, 15 bp, Homo sapiens
ctactattataaact

SEQ ID NO: 138839 - DNA, 15 bp, Homo sapiens
tctactattataaac

SEQ ID NO: 138840 - DNA, 15 bp, Homo sapiens
atctactattataaa

SEQ ID NO: 138841 - DNA, 15 bp, Homo sapiens
tatctactattataa

SEQ ID NO: 138842 - DNA, 15 bp, Homo sapiens
atatctactattata

SEQ ID NO: 138843 - DNA, 15 bp, Homo sapiens
aatatctactattat

SEQ ID NO: 138844 - DNA, 15 bp, Homo sapiens
aaatatctactatta

SEQ ID NO: 138845 - DNA, 15 bp, Homo sapiens
aaaatatctactatt

SEQ ID NO: 138846 - DNA, 15 bp, Homo sapiens
aaaaatatctactat

SEQ ID NO: 138847 - DNA, 15 bp, Homo sapiens
aaaaaatatctacta

SEQ ID NO: 138848 - DNA, 15 bp, Homo sapiens
aaaaaaatatctact

SEQ ID NO: 138849 - DNA, 15 bp, Homo sapiens
caaaaaaatatctac

SEQ ID NO: 138850 - DNA, 15 bp, Homo sapiens
ccaaaaaaatatcta

SEQ ID NO: 138851 - DNA, 15 bp, Homo sapiens
cccaaaaaaatatct

SEQ ID NO: 138852 - DNA, 15 bp, Homo sapiens
tcccaaaaaaatatc

SEQ ID NO: 138853 - DNA, 15 bp, Homo sapiens
ctcccaaaaaaatat

SEQ ID NO: 138854 - DNA, 15 bp, Homo sapiens
actcccaaaaaaata

SEQ ID NO: 138855 - DNA, 15 bp, Homo sapiens
aactcccaaaaaaat

SEQ ID NO: 138856 - DNA, 15 bp, Homo sapiens
caactcccaaaaaaa

SEQ ID NO: 138857 - DNA, 15 bp, Homo sapiens
acaactcccaaaaaa

SEQ ID NO: 138858 - DNA, 15 bp, Homo sapiens
aacaactcccaaaaa

SEQ ID NO: 138859 - DNA, 15 bp, Homo sapiens
aaacaactcccaaaa

SEQ ID NO: 138860 - DNA, 15 bp, Homo sapiens
aaaacaactcccaaa

SEQ ID NO: 138861 - DNA, 15 bp, Homo sapiens
taaaacaactcccaa

SEQ ID NO: 138862 - DNA, 15 bp, Homo sapiens
ctaaaacaactccca

SEQ ID NO: 138863 - DNA, 15 bp, Homo sapiens
tctaaaacaactccc

SEQ ID NO: 138864 - DNA, 15 bp, Homo sapiens
ctctaaaacaactcc

SEQ ID NO: 138865 - DNA, 15 bp, Homo sapiens
gctctaaaacaactc

SEQ ID NO: 138866 - DNA, 15 bp, Homo sapiens
tgctctaaaacaact

SEQ ID NO: 138867 - DNA, 15 bp, Homo sapiens
gtgctctaaaacaac

SEQ ID NO: 138868 - DNA, 15 bp, Homo sapiens
agtgctctaaaacaa

SEQ ID NO: 138869 - DNA, 15 bp, Homo sapiens
cagtgctctaaaaca

SEQ ID NO: 138870 - DNA, 15 bp, Homo sapiens
tcagtgctctaaaac

SEQ ID NO: 138871 - DNA, 15 bp, Homo sapiens
ttcagtgctctaaaa

SEQ ID NO: 138872 - DNA, 15 bp, Homo sapiens
tttcagtgctctaaa

SEQ ID NO: 138873 - DNA, 15 bp, Homo sapiens
ttttcagtgctctaa

SEQ ID NO: 138874 - DNA, 15 bp, Homo sapiens
attttcagtgctcta

SEQ ID NO: 138875 - DNA, 15 bp, Homo sapiens
tattttcagtgctct

SEQ ID NO: 138876 - DNA, 15 bp, Homo sapiens
ttattttcagtgctc

SEQ ID NO: 138877 - DNA, 15 bp, Homo sapiens
cttattttcagtgct

SEQ ID NO: 138878 - DNA, 15 bp, Homo sapiens
tcttattttcagtgc

SEQ ID NO: 138879 - DNA, 15 bp, Homo sapiens
ctcttattttcagtg

SEQ ID NO: 138880 - DNA, 15 bp, Homo sapiens
actcttattttcagt

SEQ ID NO: 138881 - DNA, 15 bp, Homo sapiens
aactcttattttcag

SEQ ID NO: 138882 - DNA, 15 bp, Homo sapiens
gaactcttattttca

SEQ ID NO: 138883 - DNA, 15 bp, Homo sapiens
tgaactcttattttc

SEQ ID NO: 138884 - DNA, 15 bp, Homo sapiens
ttgaactcttatttt

SEQ ID NO: 138885 - DNA, 15 bp, Homo sapiens
cttgaactcttattt

SEQ ID NO: 138886 - DNA, 15 bp, Homo sapiens
tcttgaactcttatt

SEQ ID NO: 138887 - DNA, 15 bp, Homo sapiens
atcttgaactcttat

SEQ ID NO: 138888 - DNA, 15 bp, Homo sapiens
aatcttgaactctta

SEQ ID NO: 138889 - DNA, 15 bp, Homo sapiens
aaatcttgaactctt

SEQ ID NO: 138890 - DNA, 15 bp, Homo sapiens
aaaatcttgaactct

SEQ ID NO: 138891 - DNA, 15 bp, Homo sapiens
aaaaatcttgaactc

SEQ ID NO: 138892 - DNA, 15 bp, Homo sapiens
aaaaaatcttgaact

SEQ ID NO: 138893 - DNA, 15 bp, Homo sapiens
aaaaaaatcttgaac

SEQ ID NO: 138894 - DNA, 15 bp, Homo sapiens
aaaaaaaatcttgaa

SEQ ID NO: 138895 - DNA, 15 bp, Homo sapiens
aaaaaaaaatcttga

SEQ ID NO: 138896 - DNA, 15 bp, Homo sapiens
gaaaaaaaaatcttg

SEQ ID NO: 138897 - DNA, 15 bp, Homo sapiens
agaaaaaaaaatctt

SEQ ID NO: 138898 - DNA, 15 bp, Homo sapiens
gagaaaaaaaaatct

SEQ ID NO: 138899 - DNA, 15 bp, Homo sapiens
tgagaaaaaaaaatc

SEQ ID NO: 138900 - DNA, 15 bp, Homo sapiens
ttgagaaaaaaaaat

SEQ ID NO: 138901 - DNA, 15 bp, Homo sapiens
tttgagaaaaaaaaa

SEQ ID NO: 138902 - DNA, 15 bp, Homo sapiens
gtttgagaaaaaaaa

SEQ ID NO: 138903 - DNA, 15 bp, Homo sapiens
tgtttgagaaaaaaa

SEQ ID NO: 138904 - DNA, 15 bp, Homo sapiens
gtgtttgagaaaaaa

SEQ ID NO: 138905 - DNA, 15 bp, Homo sapiens
ggtgtttgagaaaaa

SEQ ID NO: 138906 - DNA, 15 bp, Homo sapiens
cggtgtttgagaaaa

SEQ ID NO: 138907 - DNA, 15 bp, Homo sapiens
acggtgtttgagaaa

SEQ ID NO: 138908 - DNA, 15 bp, Homo sapiens
aacggtgtttgagaa

SEQ ID NO: 138909 - DNA, 15 bp, Homo sapiens
aaacggtgtttgaga

SEQ ID NO: 138910 - DNA, 15 bp, Homo sapiens
gaaacggtgtttgag

SEQ ID NO: 138911 - DNA, 15 bp, Homo sapiens
tgaaacggtgtttga

SEQ ID NO: 138912 - DNA, 15 bp, Homo sapiens
ctgaaacggtgtttg

SEQ ID NO: 138913 - DNA, 15 bp, Homo sapiens
tctgaaacggtgttt

SEQ ID NO: 138914 - DNA, 15 bp, Homo sapiens
ttctgaaacggtgtt

SEQ ID NO: 138915 - DNA, 15 bp, Homo sapiens
tttctgaaacggtgt

SEQ ID NO: 138916 - DNA, 15 bp, Homo sapiens
atttctgaaacggtg

SEQ ID NO: 138917 - DNA, 15 bp, Homo sapiens
tatttctgaaacggt

SEQ ID NO: 138918 - DNA, 15 bp, Homo sapiens
atatttctgaaacgg

SEQ ID NO: 138919 - DNA, 15 bp, Homo sapiens
tatatttctgaaacg

SEQ ID NO: 138920 - DNA, 15 bp, Homo sapiens
atatatttctgaaac

SEQ ID NO: 138921 - DNA, 15 bp, Homo sapiens
gatatatttctgaaa

SEQ ID NO: 138922 - DNA, 15 bp, Homo sapiens
tgatatatttctgaa

SEQ ID NO: 138923 - DNA, 15 bp, Homo sapiens
ttgatatatttctga

SEQ ID NO: 138924 - DNA, 15 bp, Homo sapiens
attgatatatttctg

SEQ ID NO: 138925 - DNA, 15 bp, Homo sapiens
aattgatatatttct

SEQ ID NO: 138926 - DNA, 15 bp, Homo sapiens
caattgatatatttc

SEQ ID NO: 138927 - DNA, 15 bp, Homo sapiens
acaattgatatattt

SEQ ID NO: 138928 - DNA, 15 bp, Homo sapiens
tacaattgatatatt

SEQ ID NO: 138929 - DNA, 15 bp, Homo sapiens
atacaattgatatat

SEQ ID NO: 138930 - DNA, 15 bp, Homo sapiens
tatacaattgatata

SEQ ID NO: 138931 - DNA, 15 bp, Homo sapiens
ctatacaattgatat

SEQ ID NO: 138932 - DNA, 15 bp, Homo sapiens
cctatacaattgata

SEQ ID NO: 138933 - DNA, 15 bp, Homo sapiens
tcctatacaattgat

SEQ ID NO: 138934 - DNA, 15 bp, Homo sapiens
atcctatacaattga

SEQ ID NO: 138935 - DNA, 15 bp, Homo sapiens
catcctatacaattg

SEQ ID NO: 138936 - DNA, 15 bp, Homo sapiens
ccatcctatacaatt

SEQ ID NO: 138937 - DNA, 15 bp, Homo sapiens
gccatcctatacaat

SEQ ID NO: 138938 - DNA, 15 bp, Homo sapiens
tgccatcctatacaa

SEQ ID NO: 138939 - DNA, 15 bp, Homo sapiens
ctgccatcctataca

SEQ ID NO: 138940 - DNA, 15 bp, Homo sapiens
tctgccatcctatac

SEQ ID NO: 138941 - DNA, 15 bp, Homo sapiens
atctgccatcctata

SEQ ID NO: 138942 - DNA, 15 bp, Homo sapiens
catctgccatcctat

SEQ ID NO: 138943 - DNA, 15 bp, Homo sapiens
acatctgccatccta

SEQ ID NO: 138944 - DNA, 15 bp, Homo sapiens
tacatctgccatcct

SEQ ID NO: 138945 - DNA, 15 bp, Homo sapiens
atacatctgccatcc

SEQ ID NO: 138946 - DNA, 15 bp, Homo sapiens
tatacatctgccatc

SEQ ID NO: 138947 - DNA, 15 bp, Homo sapiens
atatacatctgccat

SEQ ID NO: 138948 - DNA, 15 bp, Homo sapiens
aatatacatctgcca

SEQ ID NO: 138949 - DNA, 15 bp, Homo sapiens
taatatacatctgcc

SEQ ID NO: 138950 - DNA, 15 bp, Homo sapiens
ttaatatacatctgc

SEQ ID NO: 138951 - DNA, 15 bp, Homo sapiens
tttaatatacatctg

SEQ ID NO: 138952 - DNA, 15 bp, Homo sapiens
ttttaatatacatct

SEQ ID NO: 138953 - DNA, 15 bp, Homo sapiens
attttaatatacatc

SEQ ID NO: 138954 - DNA, 15 bp, Homo sapiens
aattttaatatacat

SEQ ID NO: 138955 - DNA, 15 bp, Homo sapiens
gaattttaatataca

SEQ ID NO: 138956 - DNA, 15 bp, Homo sapiens
ggaattttaatatac

SEQ ID NO: 138957 - DNA, 15 bp, Homo sapiens
aggaattttaatata

SEQ ID NO: 138958 - DNA, 15 bp, Homo sapiens
aaggaattttaatat

SEQ ID NO: 138959 - DNA, 15 bp, Homo sapiens
gaaggaattttaata

SEQ ID NO: 138960 - DNA, 15 bp, Homo sapiens
tgaaggaattttaat

SEQ ID NO: 138961 - DNA, 15 bp, Homo sapiens
ttgaaggaattttaa

SEQ ID NO: 138962 - DNA, 15 bp, Homo sapiens
tttgaaggaatttta

SEQ ID NO: 138963 - DNA, 15 bp, Homo sapiens
ttttgaaggaatttt

SEQ ID NO: 138964 - DNA, 15 bp, Homo sapiens
attttgaaggaattt

SEQ ID NO: 138965 - DNA, 15 bp, Homo sapiens
cattttgaaggaatt

SEQ ID NO: 138966 - DNA, 15 bp, Homo sapiens
acattttgaaggaat

SEQ ID NO: 138967 - DNA, 15 bp, Homo sapiens
cacattttgaaggaa

SEQ ID NO: 138968 - DNA, 15 bp, Homo sapiens
acacattttgaagga

SEQ ID NO: 138969 - DNA, 15 bp, Homo sapiens
aacacattttgaagg

SEQ ID NO: 138970 - DNA, 15 bp, Homo sapiens
aaacacattttgaag

SEQ ID NO: 138971 - DNA, 15 bp, Homo sapiens
taaacacattttgaa

SEQ ID NO: 138972 - DNA, 15 bp, Homo sapiens
ataaacacattttga

SEQ ID NO: 138973 - DNA, 15 bp, Homo sapiens
gataaacacattttg

SEQ ID NO: 138974 - DNA, 15 bp, Homo sapiens
tgataaacacatttt

SEQ ID NO: 138975 - DNA, 15 bp, Homo sapiens
ctgataaacacattt

SEQ ID NO: 138976 - DNA, 15 bp, Homo sapiens
gctgataaacacatt

SEQ ID NO: 138977 - DNA, 15 bp, Homo sapiens
agctgataaacacat

SEQ ID NO: 138978 - DNA, 15 bp, Homo sapiens
aagctgataaacaca

SEQ ID NO: 138979 - DNA, 15 bp, Homo sapiens
caagctgataaacac

SEQ ID NO: 138980 - DNA, 15 bp, Homo sapiens
gcaagctgataaaca

SEQ ID NO: 138981 - DNA, 15 bp, Homo sapiens
ggcaagctgataaac

SEQ ID NO: 138982 - DNA, 15 bp, Homo sapiens
aggcaagctgataaa

SEQ ID NO: 138983 - DNA, 15 bp, Homo sapiens
aaggcaagctgataa

SEQ ID NO: 138984 - DNA, 15 bp, Homo sapiens
gaaggcaagctgata

SEQ ID NO: 138985 - DNA, 15 bp, Homo sapiens
agaaggcaagctgat

SEQ ID NO: 138986 - DNA, 15 bp, Homo sapiens
aagaaggcaagctga

SEQ ID NO: 138987 - DNA, 15 bp, Homo sapiens
gaagaaggcaagctg

SEQ ID NO: 138988 - DNA, 15 bp, Homo sapiens
agaagaaggcaagct

SEQ ID NO: 138989 - DNA, 15 bp, Homo sapiens
cagaagaaggcaagc

SEQ ID NO: 138990 - DNA, 15 bp, Homo sapiens
acagaagaaggcaag

SEQ ID NO: 138991 - DNA, 15 bp, Homo sapiens
aacagaagaaggcaa

SEQ ID NO: 138992 - DNA, 15 bp, Homo sapiens
aaacagaagaaggca

SEQ ID NO: 138993 - DNA, 15 bp, Homo sapiens
taaacagaagaaggc

SEQ ID NO: 138994 - DNA, 15 bp, Homo sapiens
ataaacagaagaagg

SEQ ID NO: 138995 - DNA, 15 bp, Homo sapiens
tataaacagaagaag

SEQ ID NO: 138996 - DNA, 15 bp, Homo sapiens
ctataaacagaagaa

SEQ ID NO: 138997 - DNA, 15 bp, Homo sapiens
tctataaacagaaga

SEQ ID NO: 138998 - DNA, 15 bp, Homo sapiens
gtctataaacagaag

SEQ ID NO: 138999 - DNA, 15 bp, Homo sapiens
agtctataaacagaa

SEQ ID NO: 139000 - DNA, 15 bp, Homo sapiens
aagtctataaacaga

SEQ ID NO: 139001 - DNA, 15 bp, Homo sapiens
taagtctataaacag

SEQ ID NO: 139002 - DNA, 15 bp, Homo sapiens
ataagtctataaaca

SEQ ID NO: 139003 - DNA, 15 bp, Homo sapiens
aataagtctataaac

SEQ ID NO: 139004 - DNA, 15 bp, Homo sapiens
aaataagtctataaa

SEQ ID NO: 139005 - DNA, 15 bp, Homo sapiens
caaataagtctataa

SEQ ID NO: 139006 - DNA, 15 bp, Homo sapiens
acaaataagtctata

SEQ ID NO: 139007 - DNA, 15 bp, Homo sapiens
cacaaataagtctat

SEQ ID NO: 139008 - DNA, 15 bp, Homo sapiens
tcacaaataagtcta

SEQ ID NO: 139009 - DNA, 15 bp, Homo sapiens
atcacaaataagtct

SEQ ID NO: 139010 - DNA, 15 bp, Homo sapiens
tatcacaaataagtc

SEQ ID NO: 139011 - DNA, 15 bp, Homo sapiens
gtatcacaaataagt

SEQ ID NO: 139012 - DNA, 15 bp, Homo sapiens
tgtatcacaaataag

SEQ ID NO: 139013 - DNA, 15 bp, Homo sapiens
atgtatcacaaataa

SEQ ID NO: 139014 - DNA, 15 bp, Homo sapiens
aatgtatcacaaata

SEQ ID NO: 139015 - DNA, 15 bp, Homo sapiens
aaatgtatcacaaat

SEQ ID NO: 139016 - DNA, 15 bp, Homo sapiens
caaatgtatcacaaa

SEQ ID NO: 139017 - DNA, 15 bp, Homo sapiens
tcaaatgtatcacaa

SEQ ID NO: 139018 - DNA, 15 bp, Homo sapiens
atcaaatgtatcaca

SEQ ID NO: 139019 - DNA, 15 bp, Homo sapiens
tatcaaatgtatcac

SEQ ID NO: 139020 - DNA, 15 bp, Homo sapiens
atatcaaatgtatca

SEQ ID NO: 139021 - DNA, 15 bp, Homo sapiens
tatatcaaatgtatc

SEQ ID NO: 139022 - DNA, 15 bp, Homo sapiens
atatatcaaatgtat

SEQ ID NO: 139023 - DNA, 15 bp, Homo sapiens
catatatcaaatgta

SEQ ID NO: 139024 - DNA, 15 bp, Homo sapiens
tcatatatcaaatgt

SEQ ID NO: 139025 - DNA, 15 bp, Homo sapiens
atcatatatcaaatg

SEQ ID NO: 139026 - DNA, 15 bp, Homo sapiens
tatcatatatcaaat

SEQ ID NO: 139027 - DNA, 15 bp, Homo sapiens
atatcatatatcaaa

SEQ ID NO: 139028 - DNA, 15 bp, Homo sapiens
aatatcatatatcaa

SEQ ID NO: 139029 - DNA, 15 bp, Homo sapiens
aaatatcatatatca

SEQ ID NO: 139030 - DNA, 15 bp, Homo sapiens
aaaatatcatatatc

SEQ ID NO: 139031 - DNA, 15 bp, Homo sapiens
aaaaatatcatatat

SEQ ID NO: 139032 - DNA, 15 bp, Homo sapiens
aaaaaatatcatata

SEQ ID NO: 139033 - DNA, 15 bp, Homo sapiens
gaaaaaatatcatat

SEQ ID NO: 139034 - DNA, 15 bp, Homo sapiens
agaaaaaatatcata

SEQ ID NO: 139035 - DNA, 15 bp, Homo sapiens
aagaaaaaatatcat

SEQ ID NO: 139036 - DNA, 15 bp, Homo sapiens
aaagaaaaaatatca

SEQ ID NO: 139037 - DNA, 15 bp, Homo sapiens
gaaagaaaaaatatc

SEQ ID NO: 139038 - DNA, 15 bp, Homo sapiens
agaaagaaaaaatat

SEQ ID NO: 139039 - DNA, 15 bp, Homo sapiens
gagaaagaaaaaata

SEQ ID NO: 139040 - DNA, 15 bp, Homo sapiens
ggagaaagaaaaaat

SEQ ID NO: 139041 - DNA, 15 bp, Homo sapiens
aggagaaagaaaaaa

SEQ ID NO: 139042 - DNA, 15 bp, Homo sapiens
caggagaaagaaaaa

SEQ ID NO: 139043 - DNA, 15 bp, Homo sapiens
tcaggagaaagaaaa

SEQ ID NO: 139044 - DNA, 15 bp, Homo sapiens
ctcaggagaaagaaa

SEQ ID NO: 139045 - DNA, 15 bp, Homo sapiens
cctcaggagaaagaa

SEQ ID NO: 139046 - DNA, 15 bp, Homo sapiens
ccctcaggagaaaga

SEQ ID NO: 139047 - DNA, 15 bp, Homo sapiens
accctcaggagaaag

SEQ ID NO: 139048 - DNA, 15 bp, Homo sapiens
aaccctcaggagaaa

SEQ ID NO: 139049 - DNA, 15 bp, Homo sapiens
taaccctcaggagaa

SEQ ID NO: 139050 - DNA, 15 bp, Homo sapiens
gtaaccctcaggaga

SEQ ID NO: 139051 - DNA, 15 bp, Homo sapiens
tgtaaccctcaggag

SEQ ID NO: 139052 - DNA, 15 bp, Homo sapiens
atgtaaccctcagga

SEQ ID NO: 139053 - DNA, 15 bp, Homo sapiens
catgtaaccctcagg

SEQ ID NO: 139054 - DNA, 15 bp, Homo sapiens
acatgtaaccctcag

SEQ ID NO: 139055 - DNA, 15 bp, Homo sapiens
aacatgtaaccctca

SEQ ID NO: 139056 - DNA, 15 bp, Homo sapiens
caacatgtaaccctc

SEQ ID NO: 139057 - DNA, 15 bp, Homo sapiens
ccaacatgtaaccct

SEQ ID NO: 139058 - DNA, 15 bp, Homo sapiens
cccaacatgtaaccc

SEQ ID NO: 139059 - DNA, 15 bp, Homo sapiens
tcccaacatgtaacc

SEQ ID NO: 139060 - DNA, 15 bp, Homo sapiens
atcccaacatgtaac

SEQ ID NO: 139061 - DNA, 15 bp, Homo sapiens
aatcccaacatgtaa

SEQ ID NO: 139062 - DNA, 15 bp, Homo sapiens
aaatcccaacatgta

SEQ ID NO: 139063 - DNA, 15 bp, Homo sapiens
aaaatcccaacatgt

SEQ ID NO: 139064 - DNA, 15 bp, Homo sapiens
aaaaatcccaacatg

SEQ ID NO: 139065 - DNA, 15 bp, Homo sapiens
aaaaaatcccaacat

SEQ ID NO: 139066 - DNA, 15 bp, Homo sapiens
aaaaaaatcccaaca

SEQ ID NO: 139067 - DNA, 15 bp, Homo sapiens
aaaaaaaatcccaac

SEQ ID NO: 139068 - DNA, 15 bp, Homo sapiens
aaaaaaaaatcccaa

SEQ ID NO: 139069 - DNA, 15 bp, Homo sapiens
gaaaaaaaaatccca

SEQ ID NO: 139070 - DNA, 15 bp, Homo sapiens
agaaaaaaaaatccc

SEQ ID NO: 139071 - DNA, 15 bp, Homo sapiens
aagaaaaaaaaatcc

SEQ ID NO: 139072 - DNA, 15 bp, Homo sapiens
aaagaaaaaaaaatc

SEQ ID NO: 139073 - DNA, 15 bp, Homo sapiens
ataaaagaaaaaaaa

SEQ ID NO: 139074 - DNA, 15 bp, Homo sapiens
tataaaagaaaaaaa

SEQ ID NO: 139075 - DNA, 15 bp, Homo sapiens
ttataaaagaaaaaa

SEQ ID NO: 139076 - DNA, 15 bp, Homo sapiens
attataaaagaaaaa

SEQ ID NO: 139077 - DNA, 15 bp, Homo sapiens
cattataaaagaaaa

SEQ ID NO: 139078 - DNA, 15 bp, Homo sapiens
gcattataaaagaaa

SEQ ID NO: 139079 - DNA, 15 bp, Homo sapiens
agcattataaaagaa

SEQ ID NO: 139080 - DNA, 15 bp, Homo sapiens
tagcattataaaaga

SEQ ID NO: 139081 - DNA, 15 bp, Homo sapiens
gtagcattataaaag

SEQ ID NO: 139082 - DNA, 15 bp, Homo sapiens
ggtagcattataaaa

SEQ ID NO: 139083 - DNA, 15 bp, Homo sapiens
gggtagcattataaa

SEQ ID NO: 139084 - DNA, 15 bp, Homo sapiens
agggtagcattataa

SEQ ID NO: 139085 - DNA, 15 bp, Homo sapiens
gagggtagcattata

SEQ ID NO: 139086 - DNA, 15 bp, Homo sapiens
tgagggtagcattat

SEQ ID NO: 139087 - DNA, 15 bp, Homo sapiens
ctgagggtagcatta

SEQ ID NO: 139088 - DNA, 15 bp, Homo sapiens
actgagggtagcatt

SEQ ID NO: 139089 - DNA, 15 bp, Homo sapiens
cactgagggtagcat

SEQ ID NO: 139090 - DNA, 15 bp, Homo sapiens
ccactgagggtagca

SEQ ID NO: 139091 - DNA, 15 bp, Homo sapiens
tccactgagggtagc

SEQ ID NO: 139092 - DNA, 15 bp, Homo sapiens
ttccactgagggtag

SEQ ID NO: 139093 - DNA, 15 bp, Homo sapiens
tttccactgagggta

SEQ ID NO: 139094 - DNA, 15 bp, Homo sapiens
ctttccactgagggt

SEQ ID NO: 139095 - DNA, 15 bp, Homo sapiens
cctttccactgaggg

SEQ ID NO: 139096 - DNA, 15 bp, Homo sapiens
ccctttccactgagg

SEQ ID NO: 139097 - DNA, 15 bp, Homo sapiens
accctttccactgag

SEQ ID NO: 139098 - DNA, 15 bp, Homo sapiens
gaccctttccactga

SEQ ID NO: 139099 - DNA, 15 bp, Homo sapiens
tgaccctttccactg

SEQ ID NO: 139100 - DNA, 15 bp, Homo sapiens
ttgaccctttccact

SEQ ID NO: 139101 - DNA, 15 bp, Homo sapiens
cttgaccctttccac

SEQ ID NO: 139102 - DNA, 15 bp, Homo sapiens
tcttgaccctttcca

SEQ ID NO: 139103 - DNA, 15 bp, Homo sapiens
ttcttgaccctttcc

SEQ ID NO: 139104 - DNA, 15 bp, Homo sapiens
gttcttgaccctttc

SEQ ID NO: 139105 - DNA, 15 bp, Homo sapiens
ggttcttgacccttt

SEQ ID NO: 139106 - DNA, 15 bp, Homo sapiens
tggttcttgaccctt

SEQ ID NO: 139107 - DNA, 15 bp, Homo sapiens
ctggttcttgaccct

SEQ ID NO: 139108 - DNA, 15 bp, Homo sapiens
actggttcttgaccc

SEQ ID NO: 139109 - DNA, 15 bp, Homo sapiens
cactggttcttgacc

SEQ ID NO: 139110 - DNA, 15 bp, Homo sapiens
ccactggttcttgac

SEQ ID NO: 139111 - DNA, 15 bp, Homo sapiens
cccactggttcttga

SEQ ID NO: 139112 - DNA, 15 bp, Homo sapiens
tcccactggttcttg

SEQ ID NO: 139113 - DNA, 15 bp, Homo sapiens
atcccactggttctt

SEQ ID NO: 139114 - DNA, 15 bp, Homo sapiens
catcccactggttct

SEQ ID NO: 139115 - DNA, 15 bp, Homo sapiens
ccatcccactggttc

SEQ ID NO: 139116 - DNA, 15 bp, Homo sapiens
gccatcccactggtt

SEQ ID NO: 139117 - DNA, 15 bp, Homo sapiens
tgccatcccactggt

SEQ ID NO: 139118 - DNA, 15 bp, Homo sapiens
gtgccatcccactgg

SEQ ID NO: 139119 - DNA, 15 bp, Homo sapiens
ggtgccatcccactg

SEQ ID NO: 139120 - DNA, 15 bp, Homo sapiens
gggtgccatcccact

SEQ ID NO: 139121 - DNA, 15 bp, Homo sapiens
tgggtgccatcccac

SEQ ID NO: 139122 - DNA, 15 bp, Homo sapiens
ctgggtgccatccca

SEQ ID NO: 139123 - DNA, 15 bp, Homo sapiens
gctgggtgccatccc

SEQ ID NO: 139124 - DNA, 15 bp, Homo sapiens
tgctgggtgccatcc

SEQ ID NO: 139125 - DNA, 15 bp, Homo sapiens
atgctgggtgccatc

SEQ ID NO: 139126 - DNA, 15 bp, Homo sapiens
catgctgggtgccat

SEQ ID NO: 139127 - DNA, 15 bp, Homo sapiens
ccatgctgggtgcca

SEQ ID NO: 139128 - DNA, 15 bp, Homo sapiens
gccatgctgggtgcc

SEQ ID NO: 139129 - DNA, 15 bp, Homo sapiens
cgccatgctgggtgc

SEQ ID NO: 139130 - DNA, 15 bp, Homo sapiens
acgccatgctgggtg

SEQ ID NO: 139131 - DNA, 15 bp, Homo sapiens
aacgccatgctgggt

SEQ ID NO: 139132 - DNA, 15 bp, Homo sapiens
caacgccatgctggg

SEQ ID NO: 139133 - DNA, 15 bp, Homo sapiens
tcaacgccatgctgg

SEQ ID NO: 139134 - DNA, 15 bp, Homo sapiens
ctcaacgccatgctg

SEQ ID NO: 139135 - DNA, 15 bp, Homo sapiens
gctcaacgccatgct

SEQ ID NO: 139136 - DNA, 15 bp, Homo sapiens
agctcaacgccatgc

SEQ ID NO: 139137 - DNA, 15 bp, Homo sapiens
tagctcaacgccatg

SEQ ID NO: 139138 - DNA, 15 bp, Homo sapiens
ttagctcaacgccat

SEQ ID NO: 139139 - DNA, 15 bp, Homo sapiens
cttagctcaacgcca

SEQ ID NO: 139140 - DNA, 15 bp, Homo sapiens
tcttagctcaacgcc

SEQ ID NO: 139141 - DNA, 15 bp, Homo sapiens
gtcttagctcaacgc

SEQ ID NO: 139142 - DNA, 15 bp, Homo sapiens
tgtcttagctcaacg

SEQ ID NO: 139143 - DNA, 15 bp, Homo sapiens
ctgtcttagctcaac

SEQ ID NO: 139144 - DNA, 15 bp, Homo sapiens
gctgtcttagctcaa

SEQ ID NO: 139145 - DNA, 15 bp, Homo sapiens
tgctgtcttagctca

SEQ ID NO: 139146 - DNA, 15 bp, Homo sapiens
ctgctgtcttagctc

SEQ ID NO: 139147 - DNA, 15 bp, Homo sapiens
gctgctgtcttagct

SEQ ID NO: 139148 - DNA, 15 bp, Homo sapiens
tgctgctgtcttagc

SEQ ID NO: 139149 - DNA, 15 bp, Homo sapiens
ctgctgctgtcttag

SEQ ID NO: 139150 - DNA, 15 bp, Homo sapiens
gctgctgctgtctta

SEQ ID NO: 139151 - DNA, 15 bp, Homo sapiens
agctgctgctgtctt

SEQ ID NO: 139152 - DNA, 15 bp, Homo sapiens
aagctgctgctgtct

SEQ ID NO: 139153 - DNA, 15 bp, Homo sapiens
caagctgctgctgtc

SEQ ID NO: 139154 - DNA, 15 bp, Homo sapiens
tcaagctgctgctgt

SEQ ID NO: 139155 - DNA, 15 bp, Homo sapiens
ctcaagctgctgctg

SEQ ID NO: 139156 - DNA, 15 bp, Homo sapiens
cctcaagctgctgct

SEQ ID NO: 139157 - DNA, 15 bp, Homo sapiens
tcctcaagctgctgc

SEQ ID NO: 139158 - DNA, 15 bp, Homo sapiens
gtcctcaagctgctg

SEQ ID NO: 139159 - DNA, 15 bp, Homo sapiens
tgtcctcaagctgct

SEQ ID NO: 139160 - DNA, 15 bp, Homo sapiens
atgtcctcaagctgc

SEQ ID NO: 139161 - DNA, 15 bp, Homo sapiens
catgtcctcaagctg

SEQ ID NO: 139162 - DNA, 15 bp, Homo sapiens
tcatgtcctcaagct

SEQ ID NO: 139163 - DNA, 15 bp, Homo sapiens
atcatgtcctcaagc

SEQ ID NO: 139164 - DNA, 15 bp, Homo sapiens
aatcatgtcctcaag

SEQ ID NO: 139165 - DNA, 15 bp, Homo sapiens
taatcatgtcctcaa

SEQ ID NO: 139166 - DNA, 15 bp, Homo sapiens
ataatcatgtcctca

SEQ ID NO: 139167 - DNA, 15 bp, Homo sapiens
aataatcatgtcctc

SEQ ID NO: 139168 - DNA, 15 bp, Homo sapiens
caataatcatgtcct

SEQ ID NO: 139169 - DNA, 15 bp, Homo sapiens
tcaataatcatgtcc

SEQ ID NO: 139170 - DNA, 15 bp, Homo sapiens
gtcaataatcatgtc

SEQ ID NO: 139171 - DNA, 15 bp, Homo sapiens
tgtcaataatcatgt

SEQ ID NO: 139172 - DNA, 15 bp, Homo sapiens
ctgtcaataatcatg

SEQ ID NO: 139173 - DNA, 15 bp, Homo sapiens
actgtcaataatcat

SEQ ID NO: 139174 - DNA, 15 bp, Homo sapiens
gactgtcaataatca

SEQ ID NO: 139175 - DNA, 15 bp, Homo sapiens
agactgtcaataatc

SEQ ID NO: 139176 - DNA, 15 bp, Homo sapiens
aagactgtcaataat

SEQ ID NO: 139177 - DNA, 15 bp, Homo sapiens
gaagactgtcaataa

SEQ ID NO: 139178 - DNA, 15 bp, Homo sapiens
tgaagactgtcaata

SEQ ID NO: 139179 - DNA, 15 bp, Homo sapiens
ctgaagactgtcaat

SEQ ID NO: 139180 - DNA, 15 bp, Homo sapiens
actgaagactgtcaa

SEQ ID NO: 139181 - DNA, 15 bp, Homo sapiens
cactgaagactgtca

SEQ ID NO: 139182 - DNA, 15 bp, Homo sapiens
ccactgaagactgtc

SEQ ID NO: 139183 - DNA, 15 bp, Homo sapiens
cccactgaagactgt

SEQ ID NO: 139184 - DNA, 15 bp, Homo sapiens
tcccactgaagactg

SEQ ID NO: 139185 - DNA, 15 bp, Homo sapiens
atcccactgaagact

SEQ ID NO: 139186 - DNA, 15 bp, Homo sapiens
catcccactgaagac

SEQ ID NO: 139187 - DNA, 15 bp, Homo sapiens
tcatcccactgaaga

SEQ ID NO: 139188 - DNA, 15 bp, Homo sapiens
gtcatcccactgaag

SEQ ID NO: 139189 - DNA, 15 bp, Homo sapiens
ggtcatcccactgaa

SEQ ID NO: 139190 - DNA, 15 bp, Homo sapiens
tggtcatcccactga

SEQ ID NO: 139191 - DNA, 15 bp, Homo sapiens
atggtcatcccactg

SEQ ID NO: 139192 - DNA, 15 bp, Homo sapiens
tatggtcatcccact

SEQ ID NO: 139193 - DNA, 15 bp, Homo sapiens
ctatggtcatcccac

SEQ ID NO: 139194 - DNA, 15 bp, Homo sapiens
cctatggtcatccca

SEQ ID NO: 139195 - DNA, 15 bp, Homo sapiens
ccctatggtcatccc

SEQ ID NO: 139196 - DNA, 15 bp, Homo sapiens
tccctatggtcatcc

SEQ ID NO: 139197 - DNA, 15 bp, Homo sapiens
ctccctatggtcatc

SEQ ID NO: 139198 - DNA, 15 bp, Homo sapiens
cctccctatggtcat

SEQ ID NO: 139199 - DNA, 15 bp, Homo sapiens
tcctccctatggtca

SEQ ID NO: 139200 - DNA, 15 bp, Homo sapiens
ctcctccctatggtc

SEQ ID NO: 139201 - DNA, 15 bp, Homo sapiens
tctcctccctatggt

SEQ ID NO: 139202 - DNA, 15 bp, Homo sapiens
gtctcctccctatgg

SEQ ID NO: 139203 - DNA, 15 bp, Homo sapiens
agtctcctccctatg

SEQ ID NO: 139204 - DNA, 15 bp, Homo sapiens
cagtctcctccctat

SEQ ID NO: 139205 - DNA, 15 bp, Homo sapiens
tcagtctcctcccta

SEQ ID NO: 139206 - DNA, 15 bp, Homo sapiens
ttcagtctcctccct

SEQ ID NO: 139207 - DNA, 15 bp, Homo sapiens
cttcagtctcctccc

SEQ ID NO: 139208 - DNA, 15 bp, Homo sapiens
tcttcagtctcctcc

SEQ ID NO: 139209 - DNA, 15 bp, Homo sapiens
ttcttcagtctcctc

SEQ ID NO: 139210 - DNA, 15 bp, Homo sapiens
gttcttcagtctcct

SEQ ID NO: 139211 - DNA, 15 bp, Homo sapiens
agttcttcagtctcc

SEQ ID NO: 139212 - DNA, 15 bp, Homo sapiens
cagttcttcagtctc

SEQ ID NO: 139213 - DNA, 15 bp, Homo sapiens
tcagttcttcagtct

SEQ ID NO: 139214 - DNA, 15 bp, Homo sapiens
atcagttcttcagtc

SEQ ID NO: 139215 - DNA, 15 bp, Homo sapiens
catcagttcttcagt

SEQ ID NO: 139216 - DNA, 15 bp, Homo sapiens
tcatcagttcttcag

SEQ ID NO: 139217 - DNA, 15 bp, Homo sapiens
ctcatcagttcttca

SEQ ID NO: 139218 - DNA, 15 bp, Homo sapiens
tctcatcagttcttc

SEQ ID NO: 139219 - DNA, 15 bp, Homo sapiens
ttctcatcagttctt

SEQ ID NO: 139220 - DNA, 15 bp, Homo sapiens
tttctcatcagttct

SEQ ID NO: 139221 - DNA, 15 bp, Homo sapiens
ttttctcatcagttc

SEQ ID NO: 139222 - DNA, 15 bp, Homo sapiens
attttctcatcagtt

SEQ ID NO: 139223 - DNA, 15 bp, Homo sapiens
tattttctcatcagt

SEQ ID NO: 139224 - DNA, 15 bp, Homo sapiens
atattttctcatcag

SEQ ID NO: 139225 - DNA, 15 bp, Homo sapiens
catattttctcatca

SEQ ID NO: 139226 - DNA, 15 bp, Homo sapiens
tcatattttctcatc

SEQ ID NO: 139227 - DNA, 15 bp, Homo sapiens
ctcatattttctcat

SEQ ID NO: 139228 - DNA, 15 bp, Homo sapiens
cctcatattttctca

SEQ ID NO: 139229 - DNA, 15 bp, Homo sapiens
gcctcatattttctc

SEQ ID NO: 139230 - DNA, 15 bp, Homo sapiens
agcctcatattttct

SEQ ID NO: 139231 - DNA, 15 bp, Homo sapiens
gagcctcatattttc

SEQ ID NO: 139232 - DNA, 15 bp, Homo sapiens
cgagcctcatatttt

SEQ ID NO: 139233 - DNA, 15 bp, Homo sapiens
tcgagcctcatattt

SEQ ID NO: 139234 - DNA, 15 bp, Homo sapiens
gtcgagcctcatatt

SEQ ID NO: 139235 - DNA, 15 bp, Homo sapiens
agtcgagcctcatat

SEQ ID NO: 139236 - DNA, 15 bp, Homo sapiens
gagtcgagcctcata

SEQ ID NO: 139237 - DNA, 15 bp, Homo sapiens
agagtcgagcctcat

SEQ ID NO: 139238 - DNA, 15 bp, Homo sapiens
tagagtcgagcctca

SEQ ID NO: 139239 - DNA, 15 bp, Homo sapiens
atagagtcgagcctc

SEQ ID NO: 139240 - DNA, 15 bp, Homo sapiens
tatagagtcgagcct

SEQ ID NO: 139241 - DNA, 15 bp, Homo sapiens
atatagagtcgagcc

SEQ ID NO: 139242 - DNA, 15 bp, Homo sapiens
aatatagagtcgagc

SEQ ID NO: 139243 - DNA, 15 bp, Homo sapiens
gaatatagagtcgag

SEQ ID NO: 139244 - DNA, 15 bp, Homo sapiens
agaatatagagtcga

SEQ ID NO: 139245 - DNA, 15 bp, Homo sapiens
aagaatatagagtcg

SEQ ID NO: 139246 - DNA, 15 bp, Homo sapiens
gaagaatatagagtc

SEQ ID NO: 139247 - DNA, 15 bp, Homo sapiens
tgaagaatatagagt

SEQ ID NO: 139248 - DNA, 15 bp, Homo sapiens
ctgaagaatatagag

SEQ ID NO: 139249 - DNA, 15 bp, Homo sapiens
gctgaagaatataga

SEQ ID NO: 139250 - DNA, 15 bp, Homo sapiens
tgctgaagaatatag

SEQ ID NO: 139251 - DNA, 15 bp, Homo sapiens
ttgctgaagaatata

SEQ ID NO: 139252 - DNA, 15 bp, Homo sapiens
cttgctgaagaatat

SEQ ID NO: 139253 - DNA, 15 bp, Homo sapiens
gcttgctgaagaata

SEQ ID NO: 139254 - DNA, 15 bp, Homo sapiens
ggcttgctgaagaat

SEQ ID NO: 139255 - DNA, 15 bp, Homo sapiens
gggcttgctgaagaa

SEQ ID NO: 139256 - DNA, 15 bp, Homo sapiens
cgggcttgctgaaga

SEQ ID NO: 139257 - DNA, 15 bp, Homo sapiens
tcgggcttgctgaag

SEQ ID NO: 139258 - DNA, 15 bp, Homo sapiens
gtcgggcttgctgaa

SEQ ID NO: 139259 - DNA, 15 bp, Homo sapiens
cgtcgggcttgctga

SEQ ID NO: 139260 - DNA, 15 bp, Homo sapiens
ccgtcgggcttgctg

SEQ ID NO: 139261 - DNA, 15 bp, Homo sapiens
cccgtcgggcttgct

SEQ ID NO: 139262 - DNA, 15 bp, Homo sapiens
tcccgtcgggcttgc

SEQ ID NO: 139263 - DNA, 15 bp, Homo sapiens
atcccgtcgggcttg

SEQ ID NO: 139264 - DNA, 15 bp, Homo sapiens
gatcccgtcgggctt

SEQ ID NO: 139265 - DNA, 15 bp, Homo sapiens
ggatcccgtcgggct

SEQ ID NO: 139266 - DNA, 15 bp, Homo sapiens
tggatcccgtcgggc

SEQ ID NO: 139267 - DNA, 15 bp, Homo sapiens
gtggatcccgtcggg

SEQ ID NO: 139268 - DNA, 15 bp, Homo sapiens
agtggatcccgtcgg

SEQ ID NO: 139269 - DNA, 15 bp, Homo sapiens
gagtggatcccgtcg

SEQ ID NO: 139270 - DNA, 15 bp, Homo sapiens
tgagtggatcccgtc

SEQ ID NO: 139271 - DNA, 15 bp, Homo sapiens
gtgagtggatcccgt

SEQ ID NO: 139272 - DNA, 15 bp, Homo sapiens
ggtgagtggatcccg

SEQ ID NO: 139273 - DNA, 15 bp, Homo sapiens
tggtgagtggatccc

SEQ ID NO: 139274 - DNA, 15 bp, Homo sapiens
ttggtgagtggatcc

SEQ ID NO: 139275 - DNA, 15 bp, Homo sapiens
tttggtgagtggatc

SEQ ID NO: 139276 - DNA, 15 bp, Homo sapiens
gtttggtgagtggat

SEQ ID NO: 139277 - DNA, 15 bp, Homo sapiens
tgtttggtgagtgga

SEQ ID NO: 139278 - DNA, 15 bp, Homo sapiens
ttgtttggtgagtgg

SEQ ID NO: 139279 - DNA, 15 bp, Homo sapiens
tttgtttggtgagtg

SEQ ID NO: 139280 - DNA, 15 bp, Homo sapiens
atttgtttggtgagt

SEQ ID NO: 139281 - DNA, 15 bp, Homo sapiens
aatttgtttggtgag

SEQ ID NO: 139282 - DNA, 15 bp, Homo sapiens
aaatttgtttggtga

SEQ ID NO: 139283 - DNA, 15 bp, Homo sapiens
gaaatttgtttggtg

SEQ ID NO: 139284 - DNA, 15 bp, Homo sapiens
agaaatttgtttggt

SEQ ID NO: 139285 - DNA, 15 bp, Homo sapiens
cagaaatttgtttgg

SEQ ID NO: 139286 - DNA, 15 bp, Homo sapiens
tcagaaatttgtttg

SEQ ID NO: 139287 - DNA, 15 bp, Homo sapiens
atcagaaatttgttt

SEQ ID NO: 139288 - DNA, 15 bp, Homo sapiens
tatcagaaatttgtt

SEQ ID NO: 139289 - DNA, 15 bp, Homo sapiens
ttatcagaaatttgt

SEQ ID NO: 139290 - DNA, 15 bp, Homo sapiens
gttatcagaaatttg

SEQ ID NO: 139291 - DNA, 15 bp, Homo sapiens
ggttatcagaaattt

SEQ ID NO: 139292 - DNA, 15 bp, Homo sapiens
tggttatcagaaatt

SEQ ID NO: 139293 - DNA, 15 bp, Homo sapiens
ttggttatcagaaat

SEQ ID NO: 139294 - DNA, 15 bp, Homo sapiens
cttggttatcagaaa

SEQ ID NO: 139295 - DNA, 15 bp, Homo sapiens
acttggttatcagaa

SEQ ID NO: 139296 - DNA, 15 bp, Homo sapiens
tacttggttatcaga

SEQ ID NO: 139297 - DNA, 15 bp, Homo sapiens
ttacttggttatcag

SEQ ID NO: 139298 - DNA, 15 bp, Homo sapiens
cttacttggttatca

SEQ ID NO: 139299 - DNA, 15 bp, Homo sapiens
tcttacttggttatc

SEQ ID NO: 139300 - DNA, 15 bp, Homo sapiens
gtcttacttggttat

SEQ ID NO: 139301 - DNA, 15 bp, Homo sapiens
agtcttacttggtta

SEQ ID NO: 139302 - DNA, 15 bp, Homo sapiens
gagtcttacttggtt

SEQ ID NO: 139303 - DNA, 15 bp, Homo sapiens
tgagtcttacttggt

SEQ ID NO: 139304 - DNA, 15 bp, Homo sapiens
atgagtcttacttgg

SEQ ID NO: 139305 - DNA, 15 bp, Homo sapiens
gatgagtcttacttg

SEQ ID NO: 139306 - DNA, 15 bp, Homo sapiens
tgatgagtcttactt

SEQ ID NO: 139307 - DNA, 15 bp, Homo sapiens
ctgatgagtcttact

SEQ ID NO: 139308 - DNA, 15 bp, Homo sapiens
tctgatgagtcttac

SEQ ID NO: 139309 - DNA, 15 bp, Homo sapiens
atctgatgagtctta

SEQ ID NO: 139310 - DNA, 15 bp, Homo sapiens
tatctgatgagtctt

SEQ ID NO: 139311 - DNA, 15 bp, Homo sapiens
atatctgatgagtct

SEQ ID NO: 139312 - DNA, 15 bp, Homo sapiens
aatatctgatgagtc

SEQ ID NO: 139313 - DNA, 15 bp, Homo sapiens
aaatatctgatgagt

SEQ ID NO: 139314 - DNA, 15 bp, Homo sapiens
aaaatatctgatgag

SEQ ID NO: 139315 - DNA, 15 bp, Homo sapiens
aaaaatatctgatga

SEQ ID NO: 139316 - DNA, 15 bp, Homo sapiens
aaaaaatatctgatg

SEQ ID NO: 139317 - DNA, 15 bp, Homo sapiens
caaaaaatatctgat

SEQ ID NO: 139318 - DNA, 15 bp, Homo sapiens
ccaaaaaatatctga

SEQ ID NO: 139319 - DNA, 15 bp, Homo sapiens
gccaaaaaatatctg

SEQ ID NO: 139320 - DNA, 15 bp, Homo sapiens
tgccaaaaaatatct

SEQ ID NO: 139321 - DNA, 15 bp, Homo sapiens
ctgccaaaaaatatc

SEQ ID NO: 139322 - DNA, 15 bp, Homo sapiens
actgccaaaaaatat

SEQ ID NO: 139323 - DNA, 15 bp, Homo sapiens
tactgccaaaaaata

SEQ ID NO: 139324 - DNA, 15 bp, Homo sapiens
atactgccaaaaaat

SEQ ID NO: 139325 - DNA, 15 bp, Homo sapiens
aatactgccaaaaaa

SEQ ID NO: 139326 - DNA, 15 bp, Homo sapiens
caatactgccaaaaa

SEQ ID NO: 139327 - DNA, 15 bp, Homo sapiens
acaatactgccaaaa

SEQ ID NO: 139328 - DNA, 15 bp, Homo sapiens
aacaatactgccaaa

SEQ ID NO: 139329 - DNA, 15 bp, Homo sapiens
aaacaatactgccaa

SEQ ID NO: 139330 - DNA, 15 bp, Homo sapiens
aaaacaatactgcca

SEQ ID NO: 139331 - DNA, 15 bp, Homo sapiens
caaaacaatactgcc

SEQ ID NO: 139332 - DNA, 15 bp, Homo sapiens
acaaaacaatactgc

SEQ ID NO: 139333 - DNA, 15 bp, Homo sapiens
aacaaaacaatactg

SEQ ID NO: 139334 - DNA, 15 bp, Homo sapiens
caacaaaacaatact

SEQ ID NO: 139335 - DNA, 15 bp, Homo sapiens
ccaacaaaacaatac

SEQ ID NO: 139336 - DNA, 15 bp, Homo sapiens
tccaacaaaacaata

SEQ ID NO: 139337 - DNA, 15 bp, Homo sapiens
atccaacaaaacaat

SEQ ID NO: 139338 - DNA, 15 bp, Homo sapiens
tatccaacaaaacaa

SEQ ID NO: 139339 - DNA, 15 bp, Homo sapiens
atatccaacaaaaca

SEQ ID NO: 139340 - DNA, 15 bp, Homo sapiens
tatatccaacaaaac

SEQ ID NO: 139341 - DNA, 15 bp, Homo sapiens
gtatatccaacaaaa

SEQ ID NO: 139342 - DNA, 15 bp, Homo sapiens
agtatatccaacaaa

SEQ ID NO: 139343 - DNA, 15 bp, Homo sapiens
aagtatatccaacaa

SEQ ID NO: 139344 - DNA, 15 bp, Homo sapiens
aaagtatatccaaca

SEQ ID NO: 139345 - DNA, 15 bp, Homo sapiens
aaaagtatatccaac

SEQ ID NO: 139346 - DNA, 15 bp, Homo sapiens
aaaaagtatatccaa

SEQ ID NO: 139347 - DNA, 15 bp, Homo sapiens
aaaaaagtatatcca

SEQ ID NO: 139348 - DNA, 15 bp, Homo sapiens
aaaaaaagtatatcc

SEQ ID NO: 139349 - DNA, 15 bp, Homo sapiens
gaaaaaaagtatatc

SEQ ID NO: 139350 - DNA, 15 bp, Homo sapiens
agaaaaaaagtatat

SEQ ID NO: 139351 - DNA, 15 bp, Homo sapiens
tagaaaaaaagtata

SEQ ID NO: 139352 - DNA, 15 bp, Homo sapiens
atagaaaaaaagtat

SEQ ID NO: 139353 - DNA, 15 bp, Homo sapiens
aatagaaaaaaagta

SEQ ID NO: 139354 - DNA, 15 bp, Homo sapiens
caatagaaaaaaagt

SEQ ID NO: 139355 - DNA, 15 bp, Homo sapiens
acaatagaaaaaaag

SEQ ID NO: 139356 - DNA, 15 bp, Homo sapiens
aacaatagaaaaaaa

SEQ ID NO: 139357 - DNA, 15 bp, Homo sapiens
gaacaatagaaaaaa

SEQ ID NO: 139358 - DNA, 15 bp, Homo sapiens
tgaacaatagaaaaa

SEQ ID NO: 139359 - DNA, 15 bp, Homo sapiens
gtgaacaatagaaaa

SEQ ID NO: 139360 - DNA, 15 bp, Homo sapiens
agtgaacaatagaaa

SEQ ID NO: 139361 - DNA, 15 bp, Homo sapiens
cagtgaacaatagaa

SEQ ID NO: 139362 - DNA, 15 bp, Homo sapiens
acagtgaacaataga

SEQ ID NO: 139363 - DNA, 15 bp, Homo sapiens
tacagtgaacaatag

SEQ ID NO: 139364 - DNA, 15 bp, Homo sapiens
ttacagtgaacaata

SEQ ID NO: 139365 - DNA, 15 bp, Homo sapiens
attacagtgaacaat

SEQ ID NO: 139366 - DNA, 15 bp, Homo sapiens
aattacagtgaacaa

SEQ ID NO: 139367 - DNA, 15 bp, Homo sapiens
gaattacagtgaaca

SEQ ID NO: 139368 - DNA, 15 bp, Homo sapiens
agaattacagtgaac

SEQ ID NO: 139369 - DNA, 15 bp, Homo sapiens
ttaagaattacagtg

SEQ ID NO: 139370 - DNA, 15 bp, Homo sapiens
gttaagaattacagt

SEQ ID NO: 139371 - DNA, 15 bp, Homo sapiens
tgttaagaattacag

SEQ ID NO: 139372 - DNA, 15 bp, Homo sapiens
ttgttaagaattaca

SEQ ID NO: 139373 - DNA, 15 bp, Homo sapiens
attgttaagaattac

SEQ ID NO: 139374 - DNA, 15 bp, Homo sapiens
tattgttaagaatta

SEQ ID NO: 139375 - DNA, 15 bp, Homo sapiens
ctattgttaagaatt

SEQ ID NO: 139376 - DNA, 15 bp, Homo sapiens
cctattgttaagaat

SEQ ID NO: 139377 - DNA, 15 bp, Homo sapiens
tcctattgttaagaa

SEQ ID NO: 139378 - DNA, 15 bp, Homo sapiens
gtcctattgttaaga

SEQ ID NO: 139379 - DNA, 15 bp, Homo sapiens
ggtcctattgttaag

SEQ ID NO: 139380 - DNA, 15 bp, Homo sapiens
gggtcctattgttaa

SEQ ID NO: 139381 - DNA, 15 bp, Homo sapiens
agggtcctattgtta

SEQ ID NO: 139382 - DNA, 15 bp, Homo sapiens
cagggtcctattgtt

SEQ ID NO: 139383 - DNA, 15 bp, Homo sapiens
gcagggtcctattgt

SEQ ID NO: 139384 - DNA, 15 bp, Homo sapiens
ggcagggtcctattg

SEQ ID NO: 139385 - DNA, 15 bp, Homo sapiens
tggcagggtcctatt

SEQ ID NO: 139386 - DNA, 15 bp, Homo sapiens
atggcagggtcctat

SEQ ID NO: 139387 - DNA, 15 bp, Homo sapiens
catggcagggtccta

SEQ ID NO: 139388 - DNA, 15 bp, Homo sapiens
acatggcagggtcct

SEQ ID NO: 139389 - DNA, 15 bp, Homo sapiens
aacatggcagggtcc

SEQ ID NO: 139390 - DNA, 15 bp, Homo sapiens
aaacatggcagggtc

SEQ ID NO: 139391 - DNA, 15 bp, Homo sapiens
aaaacatggcagggt

SEQ ID NO: 139392 - DNA, 15 bp, Homo sapiens
aaaaacatggcaggg

SEQ ID NO: 139393 - DNA, 15 bp, Homo sapiens
aaaaaacatggcagg

SEQ ID NO: 139394 - DNA, 15 bp, Homo sapiens
gaaaaaacatggcag

SEQ ID NO: 139395 - DNA, 15 bp, Homo sapiens
ggaaaaaacatggca

SEQ ID NO: 139396 - DNA, 15 bp, Homo sapiens
aggaaaaaacatggc

SEQ ID NO: 139397 - DNA, 15 bp, Homo sapiens
taggaaaaaacatgg

SEQ ID NO: 139398 - DNA, 15 bp, Homo sapiens
ttaggaaaaaacatg

SEQ ID NO: 139399 - DNA, 15 bp, Homo sapiens
cttaggaaaaaacat

SEQ ID NO: 139400 - DNA, 15 bp, Homo sapiens
acttaggaaaaaaca

SEQ ID NO: 139401 - DNA, 15 bp, Homo sapiens
aacttaggaaaaaac

SEQ ID NO: 139402 - DNA, 15 bp, Homo sapiens
gaacttaggaaaaaa

SEQ ID NO: 139403 - DNA, 15 bp, Homo sapiens
agaacttaggaaaaa

SEQ ID NO: 139404 - DNA, 15 bp, Homo sapiens
aagaacttaggaaaa

SEQ ID NO: 139405 - DNA, 15 bp, Homo sapiens
taagaacttaggaaa

SEQ ID NO: 139406 - DNA, 15 bp, Homo sapiens
ctaagaacttaggaa

SEQ ID NO: 139407 - DNA, 15 bp, Homo sapiens
tctaagaacttagga

SEQ ID NO: 139408 - DNA, 15 bp, Homo sapiens
ctctaagaacttagg

SEQ ID NO: 139409 - DNA, 15 bp, Homo sapiens
actctaagaacttag

SEQ ID NO: 139410 - DNA, 15 bp, Homo sapiens
cactctaagaactta

SEQ ID NO: 139411 - DNA, 15 bp, Homo sapiens
acactctaagaactt

SEQ ID NO: 139412 - DNA, 15 bp, Homo sapiens
gacactctaagaact

SEQ ID NO: 139413 - DNA, 15 bp, Homo sapiens
agacactctaagaac

SEQ ID NO: 139414 - DNA, 15 bp, Homo sapiens
tagacactctaagaa

SEQ ID NO: 139415 - DNA, 15 bp, Homo sapiens
ttagacactctaaga

SEQ ID NO: 139416 - DNA, 15 bp, Homo sapiens
attagacactctaag

SEQ ID NO: 139417 - DNA, 15 bp, Homo sapiens
cattagacactctaa

SEQ ID NO: 139418 - DNA, 15 bp, Homo sapiens
tcattagacactcta

SEQ ID NO: 139419 - DNA, 15 bp, Homo sapiens
ttcattagacactct

SEQ ID NO: 139420 - DNA, 15 bp, Homo sapiens
tttcattagacactc

SEQ ID NO: 139421 - DNA, 15 bp, Homo sapiens
atttcattagacact

SEQ ID NO: 139422 - DNA, 15 bp, Homo sapiens
aatttcattagacac

SEQ ID NO: 139423 - DNA, 15 bp, Homo sapiens
aaatttcattagaca

SEQ ID NO: 139424 - DNA, 15 bp, Homo sapiens
taaatttcattagac

SEQ ID NO: 139425 - DNA, 15 bp, Homo sapiens
ataaatttcattaga

SEQ ID NO: 139426 - DNA, 15 bp, Homo sapiens
tataaatttcattag

SEQ ID NO: 139427 - DNA, 15 bp, Homo sapiens
atataaatttcatta

SEQ ID NO: 139428 - DNA, 15 bp, Homo sapiens
catataaatttcatt

SEQ ID NO: 139429 - DNA, 15 bp, Homo sapiens
tcatataaatttcat

SEQ ID NO: 139430 - DNA, 15 bp, Homo sapiens
ttcatataaatttca

SEQ ID NO: 139431 - DNA, 15 bp, Homo sapiens
cttcatataaatttc

SEQ ID NO: 139432 - DNA, 15 bp, Homo sapiens
tcttcatataaattt

SEQ ID NO: 139433 - DNA, 15 bp, Homo sapiens
ttcttcatataaatt

SEQ ID NO: 139434 - DNA, 15 bp, Homo sapiens
attcttcatataaat

SEQ ID NO: 139435 - DNA, 15 bp, Homo sapiens
aattcttcatataaa

SEQ ID NO: 139436 - DNA, 15 bp, Homo sapiens
aaattcttcatataa

SEQ ID NO: 139437 - DNA, 15 bp, Homo sapiens
caaattcttcatata

SEQ ID NO: 139438 - DNA, 15 bp, Homo sapiens
tcaaattcttcatat

SEQ ID NO: 139439 - DNA, 15 bp, Homo sapiens
atcaaattcttcata

SEQ ID NO: 139440 - DNA, 15 bp, Homo sapiens
gatcaaattcttcat

SEQ ID NO: 139441 - DNA, 15 bp, Homo sapiens
agatcaaattcttca

SEQ ID NO: 139442 - DNA, 15 bp, Homo sapiens
cagatcaaattcttc

SEQ ID NO: 139443 - DNA, 15 bp, Homo sapiens
ccagatcaaattctt

SEQ ID NO: 139444 - DNA, 15 bp, Homo sapiens
tccagatcaaattct

SEQ ID NO: 139445 - DNA, 15 bp, Homo sapiens
ttccagatcaaattc

SEQ ID NO: 139446 - DNA, 15 bp, Homo sapiens
cttccagatcaaatt

SEQ ID NO: 139447 - DNA, 15 bp, Homo sapiens
tcttccagatcaaat

SEQ ID NO: 139448 - DNA, 15 bp, Homo sapiens
atcttccagatcaaa

SEQ ID NO: 139449 - DNA, 15 bp, Homo sapiens
aatcttccagatcaa

SEQ ID NO: 139450 - DNA, 15 bp, Homo sapiens
aaatcttccagatca

SEQ ID NO: 139451 - DNA, 15 bp, Homo sapiens
aaaatcttccagatc

SEQ ID NO: 139452 - DNA, 15 bp, Homo sapiens
aaaaatcttccagat

SEQ ID NO: 139453 - DNA, 15 bp, Homo sapiens
aaaaaatcttccaga

SEQ ID NO: 139454 - DNA, 15 bp, Homo sapiens
aaaaaaatcttccag

SEQ ID NO: 139455 - DNA, 15 bp, Homo sapiens
gaaaaaaatcttcca

SEQ ID NO: 139456 - DNA, 15 bp, Homo sapiens
cgaaaaaaatcttcc

SEQ ID NO: 139457 - DNA, 15 bp, Homo sapiens
tcgaaaaaaatcttc

SEQ ID NO: 139458 - DNA, 15 bp, Homo sapiens
ttcgaaaaaaatctt

SEQ ID NO: 139459 - DNA, 15 bp, Homo sapiens
tttcgaaaaaaatct

SEQ ID NO: 139460 - DNA, 15 bp, Homo sapiens
ttttcgaaaaaaatc

SEQ ID NO: 139461 - DNA, 15 bp, Homo sapiens
tttttcgaaaaaaat

SEQ ID NO: 139462 - DNA, 15 bp, Homo sapiens
atttttcgaaaaaaa

SEQ ID NO: 139463 - DNA, 15 bp, Homo sapiens
aatttttcgaaaaaa

SEQ ID NO: 139464 - DNA, 15 bp, Homo sapiens
aaatttttcgaaaaa

SEQ ID NO: 139465 - DNA, 15 bp, Homo sapiens
gaaatttttcgaaaa

SEQ ID NO: 139466 - DNA, 15 bp, Homo sapiens
agaaatttttcgaaa

SEQ ID NO: 139467 - DNA, 15 bp, Homo sapiens
cagaaatttttcgaa

SEQ ID NO: 139468 - DNA, 15 bp, Homo sapiens
ccagaaatttttcga

SEQ ID NO: 139469 - DNA, 15 bp, Homo sapiens
tccagaaatttttcg

SEQ ID NO: 139470 - DNA, 15 bp, Homo sapiens
ctccagaaatttttc

SEQ ID NO: 139471 - DNA, 15 bp, Homo sapiens
cctccagaaattttt

SEQ ID NO: 139472 - DNA, 15 bp, Homo sapiens
gcctccagaaatttt

SEQ ID NO: 139473 - DNA, 15 bp, Homo sapiens
tgcctccagaaattt

SEQ ID NO: 139474 - DNA, 15 bp, Homo sapiens
atgcctccagaaatt

SEQ ID NO: 139475 - DNA, 15 bp, Homo sapiens
tatgcctccagaaat

SEQ ID NO: 139476 - DNA, 15 bp, Homo sapiens
ttatgcctccagaaa

SEQ ID NO: 139477 - DNA, 15 bp, Homo sapiens
gttatgcctccagaa

SEQ ID NO: 139478 - DNA, 15 bp, Homo sapiens
tgttatgcctccaga

SEQ ID NO: 139479 - DNA, 15 bp, Homo sapiens
ttgttatgcctccag

SEQ ID NO: 139480 - DNA, 15 bp, Homo sapiens
cttgttatgcctcca

SEQ ID NO: 139481 - DNA, 15 bp, Homo sapiens
acttgttatgcctcc

SEQ ID NO: 139482 - DNA, 15 bp, Homo sapiens
tacttgttatgcctc

SEQ ID NO: 139483 - DNA, 15 bp, Homo sapiens
ttacttgttatgcct

SEQ ID NO: 139484 - DNA, 15 bp, Homo sapiens
cttacttgttatgcc

SEQ ID NO: 139485 - DNA, 15 bp, Homo sapiens
tcttacttgttatgc

SEQ ID NO: 139486 - DNA, 15 bp, Homo sapiens
ttcttacttgttatg

SEQ ID NO: 139487 - DNA, 15 bp, Homo sapiens
attcttacttgttat

SEQ ID NO: 139488 - DNA, 15 bp, Homo sapiens
tattcttacttgtta

SEQ ID NO: 139489 - DNA, 15 bp, Homo sapiens
atattcttacttgtt

SEQ ID NO: 139490 - DNA, 15 bp, Homo sapiens
catattcttacttgt

SEQ ID NO: 139491 - DNA, 15 bp, Homo sapiens
gcatattcttacttg

SEQ ID NO: 139492 - DNA, 15 bp, Homo sapiens
tgcatattcttactt

SEQ ID NO: 139493 - DNA, 15 bp, Homo sapiens
atgcatattcttact

SEQ ID NO: 139494 - DNA, 15 bp, Homo sapiens
catgcatattcttac

SEQ ID NO: 139495 - DNA, 15 bp, Homo sapiens
acatgcatattctta

SEQ ID NO: 139496 - DNA, 15 bp, Homo sapiens
gacatgcatattctt

SEQ ID NO: 139497 - DNA, 15 bp, Homo sapiens
agacatgcatattct

SEQ ID NO: 139498 - DNA, 15 bp, Homo sapiens
gagacatgcatattc

SEQ ID NO: 139499 - DNA, 15 bp, Homo sapiens
ggagacatgcatatt

SEQ ID NO: 139500 - DNA, 15 bp, Homo sapiens
cggagacatgcatat

SEQ ID NO: 139501 - DNA, 15 bp, Homo sapiens
tcggagacatgcata

SEQ ID NO: 139502 - DNA, 15 bp, Homo sapiens
ctcggagacatgcat

SEQ ID NO: 139503 - DNA, 15 bp, Homo sapiens
tctcggagacatgca

SEQ ID NO: 139504 - DNA, 15 bp, Homo sapiens
atctcggagacatgc

SEQ ID NO: 139505 - DNA, 15 bp, Homo sapiens
aatctcggagacatg

SEQ ID NO: 139506 - DNA, 15 bp, Homo sapiens
aaatctcggagacat

SEQ ID NO: 139507 - DNA, 15 bp, Homo sapiens
taaatctcggagaca

SEQ ID NO: 139508 - DNA, 15 bp, Homo sapiens
ataaatctcggagac

SEQ ID NO: 139509 - DNA, 15 bp, Homo sapiens
tataaatctcggaga

SEQ ID NO: 139510 - DNA, 15 bp, Homo sapiens
ctataaatctcggag

SEQ ID NO: 139511 - DNA, 15 bp, Homo sapiens
gctataaatctcgga

SEQ ID NO: 139512 - DNA, 15 bp, Homo sapiens
agctataaatctcgg

SEQ ID NO: 139513 - DNA, 15 bp, Homo sapiens
gagctataaatctcg

SEQ ID NO: 139514 - DNA, 15 bp, Homo sapiens
tgagctataaatctc

SEQ ID NO: 139515 - DNA, 15 bp, Homo sapiens
gtgagctataaatct

SEQ ID NO: 139516 - DNA, 15 bp, Homo sapiens
agtgagctataaatc

SEQ ID NO: 139517 - DNA, 15 bp, Homo sapiens
cagtgagctataaat

SEQ ID NO: 139518 - DNA, 15 bp, Homo sapiens
tcagtgagctataaa

SEQ ID NO: 139519 - DNA, 15 bp, Homo sapiens
gtcagtgagctataa

SEQ ID NO: 139520 - DNA, 15 bp, Homo sapiens
agtcagtgagctata

SEQ ID NO: 139521 - DNA, 15 bp, Homo sapiens
aagtcagtgagctat

SEQ ID NO: 139522 - DNA, 15 bp, Homo sapiens
aaagtcagtgagcta

SEQ ID NO: 139523 - DNA, 15 bp, Homo sapiens
aaaagtcagtgagct

SEQ ID NO: 139524 - DNA, 15 bp, Homo sapiens
aaaaagtcagtgagc

SEQ ID NO: 139525 - DNA, 15 bp, Homo sapiens
caaaaagtcagtgag

SEQ ID NO: 139526 - DNA, 15 bp, Homo sapiens
gcaaaaagtcagtga

SEQ ID NO: 139527 - DNA, 15 bp, Homo sapiens
tgcaaaaagtcagtg

SEQ ID NO: 139528 - DNA, 15 bp, Homo sapiens
ttgcaaaaagtcagt

SEQ ID NO: 139529 - DNA, 15 bp, Homo sapiens
cttgcaaaaagtcag

SEQ ID NO: 139530 - DNA, 15 bp, Homo sapiens
acttgcaaaaagtca

SEQ ID NO: 139531 - DNA, 15 bp, Homo sapiens
cacttgcaaaaagtc

SEQ ID NO: 139532 - DNA, 15 bp, Homo sapiens
tcacttgcaaaaagt

SEQ ID NO: 139533 - DNA, 15 bp, Homo sapiens
ttcacttgcaaaaag

SEQ ID NO: 139534 - DNA, 15 bp, Homo sapiens
tttcacttgcaaaaa

SEQ ID NO: 139535 - DNA, 15 bp, Homo sapiens
gtttcacttgcaaaa

SEQ ID NO: 139536 - DNA, 15 bp, Homo sapiens
tgtttcacttgcaaa

SEQ ID NO: 139537 - DNA, 15 bp, Homo sapiens
gtgtttcacttgcaa

SEQ ID NO: 139538 - DNA, 15 bp, Homo sapiens
tgtgtttcacttgca

SEQ ID NO: 139539 - DNA, 15 bp, Homo sapiens
gtgtgtttcacttgc

SEQ ID NO: 139540 - DNA, 15 bp, Homo sapiens
ggtgtgtttcacttg

SEQ ID NO: 139541 - DNA, 15 bp, Homo sapiens
gggtgtgtttcactt

SEQ ID NO: 139542 - DNA, 15 bp, Homo sapiens
agggtgtgtttcact

SEQ ID NO: 139543 - DNA, 15 bp, Homo sapiens
gagggtgtgtttcac

SEQ ID NO: 139544 - DNA, 15 bp, Homo sapiens
tgagggtgtgtttca

SEQ ID NO: 139545 - DNA, 15 bp, Homo sapiens
ttgagggtgtgtttc

SEQ ID NO: 139546 - DNA, 15 bp, Homo sapiens
tttgagggtgtgttt

SEQ ID NO: 139547 - DNA, 15 bp, Homo sapiens
atttgagggtgtgtt

SEQ ID NO: 139548 - DNA, 15 bp, Homo sapiens
gatttgagggtgtgt

SEQ ID NO: 139549 - DNA, 15 bp, Homo sapiens
tgatttgagggtgtg

SEQ ID NO: 139550 - DNA, 15 bp, Homo sapiens
ctgatttgagggtgt

SEQ ID NO: 139551 - DNA, 15 bp, Homo sapiens
gctgatttgagggtg

SEQ ID NO: 139552 - DNA, 15 bp, Homo sapiens
tgctgatttgagggt

SEQ ID NO: 139553 - DNA, 15 bp, Homo sapiens
atgctgatttgaggg

SEQ ID NO: 139554 - DNA, 15 bp, Homo sapiens
gatgctgatttgagg

SEQ ID NO: 139555 - DNA, 15 bp, Homo sapiens
agatgctgatttgag

SEQ ID NO: 139556 - DNA, 15 bp, Homo sapiens
tagatgctgatttga

SEQ ID NO: 139557 - DNA, 15 bp, Homo sapiens
ctagatgctgatttg

SEQ ID NO: 139558 - DNA, 15 bp, Homo sapiens
tctagatgctgattt

SEQ ID NO: 139559 - DNA, 15 bp, Homo sapiens
ttctagatgctgatt

SEQ ID NO: 139560 - DNA, 15 bp, Homo sapiens
tttctagatgctgat

SEQ ID NO: 139561 - DNA, 15 bp, Homo sapiens
ctttctagatgctga

SEQ ID NO: 139562 - DNA, 15 bp, Homo sapiens
tctttctagatgctg

SEQ ID NO: 139563 - DNA, 15 bp, Homo sapiens
ctctttctagatgct

SEQ ID NO: 139564 - DNA, 15 bp, Homo sapiens
tctctttctagatgc

SEQ ID NO: 139565 - DNA, 15 bp, Homo sapiens
ttctctttctagatg

SEQ ID NO: 139566 - DNA, 15 bp, Homo sapiens
gttctctttctagat

SEQ ID NO: 139567 - DNA, 15 bp, Homo sapiens
tgttctctttctaga

SEQ ID NO: 139568 - DNA, 15 bp, Homo sapiens
gtgttctctttctag

SEQ ID NO: 139569 - DNA, 15 bp, Homo sapiens
agtgttctctttcta

SEQ ID NO: 139570 - DNA, 15 bp, Homo sapiens
aagtgttctctttct

SEQ ID NO: 139571 - DNA, 15 bp, Homo sapiens
aaagtgttctctttc

SEQ ID NO: 139572 - DNA, 15 bp, Homo sapiens
gaaagtgttctcttt

SEQ ID NO: 139573 - DNA, 15 bp, Homo sapiens
tgaaagtgttctctt

SEQ ID NO: 139574 - DNA, 15 bp, Homo sapiens
ttgaaagtgttctct

SEQ ID NO: 139575 - DNA, 15 bp, Homo sapiens
cttgaaagtgttctc

SEQ ID NO: 139576 - DNA, 15 bp, Homo sapiens
tcttgaaagtgttct

SEQ ID NO: 139577 - DNA, 15 bp, Homo sapiens
atcttgaaagtgttc

SEQ ID NO: 139578 - DNA, 15 bp, Homo sapiens
aatcttgaaagtgtt

SEQ ID NO: 139579 - DNA, 15 bp, Homo sapiens
gaatcttgaaagtgt

SEQ ID NO: 139580 - DNA, 15 bp, Homo sapiens
ggaatcttgaaagtg

SEQ ID NO: 139581 - DNA, 15 bp, Homo sapiens
tggaatcttgaaagt

SEQ ID NO: 139582 - DNA, 15 bp, Homo sapiens
ctggaatcttgaaag

SEQ ID NO: 139583 - DNA, 15 bp, Homo sapiens
cctggaatcttgaaa

SEQ ID NO: 139584 - DNA, 15 bp, Homo sapiens
tcctggaatcttgaa

SEQ ID NO: 139585 - DNA, 15 bp, Homo sapiens
ttcctggaatcttga

SEQ ID NO: 139586 - DNA, 15 bp, Homo sapiens
gttcctggaatcttg

SEQ ID NO: 139587 - DNA, 15 bp, Homo sapiens
ggttcctggaatctt

SEQ ID NO: 139588 - DNA, 15 bp, Homo sapiens
gggttcctggaatct

SEQ ID NO: 139589 - DNA, 15 bp, Homo sapiens
agggttcctggaatc

SEQ ID NO: 139590 - DNA, 15 bp, Homo sapiens
gagggttcctggaat

SEQ ID NO: 139591 - DNA, 15 bp, Homo sapiens
agagggttcctggaa

SEQ ID NO: 139592 - DNA, 15 bp, Homo sapiens
aagagggttcctgga

SEQ ID NO: 139593 - DNA, 15 bp, Homo sapiens
aaagagggttcctgg

SEQ ID NO: 139594 - DNA, 15 bp, Homo sapiens
aaaagagggttcctg

SEQ ID NO: 139595 - DNA, 15 bp, Homo sapiens
caaaagagggttcct

SEQ ID NO: 139596 - DNA, 15 bp, Homo sapiens
gcaaaagagggttcc

SEQ ID NO: 139597 - DNA, 15 bp, Homo sapiens
agcaaaagagggttc

SEQ ID NO: 139598 - DNA, 15 bp, Homo sapiens
gagcaaaagagggtt

SEQ ID NO: 139599 - DNA, 15 bp, Homo sapiens
ggagcaaaagagggt

SEQ ID NO: 139600 - DNA, 15 bp, Homo sapiens
gggagcaaaagaggg

SEQ ID NO: 139601 - DNA, 15 bp, Homo sapiens
agggagcaaaagagg

SEQ ID NO: 139602 - DNA, 15 bp, Homo sapiens
aagggagcaaaagag

SEQ ID NO: 139603 - DNA, 15 bp, Homo sapiens
gaagggagcaaaaga

SEQ ID NO: 139604 - DNA, 15 bp, Homo sapiens
agaagggagcaaaag

SEQ ID NO: 139605 - DNA, 15 bp, Homo sapiens
cagaagggagcaaaa

SEQ ID NO: 139606 - DNA, 15 bp, Homo sapiens
acagaagggagcaaa

SEQ ID NO: 139607 - DNA, 15 bp, Homo sapiens
tacagaagggagcaa

SEQ ID NO: 139608 - DNA, 15 bp, Homo sapiens
gtacagaagggagca

SEQ ID NO: 139609 - DNA, 15 bp, Homo sapiens
agtacagaagggagc

SEQ ID NO: 139610 - DNA, 15 bp, Homo sapiens
cagtacagaagggag

SEQ ID NO: 139611 - DNA, 15 bp, Homo sapiens
acagtacagaaggga

SEQ ID NO: 139612 - DNA, 15 bp, Homo sapiens
tacagtacagaaggg

SEQ ID NO: 139613 - DNA, 15 bp, Homo sapiens
atacagtacagaagg

SEQ ID NO: 139614 - DNA, 15 bp, Homo sapiens
aatacagtacagaag

SEQ ID NO: 139615 - DNA, 15 bp, Homo sapiens
taatacagtacagaa

SEQ ID NO: 139616 - DNA, 15 bp, Homo sapiens
ctaatacagtacaga

SEQ ID NO: 139617 - DNA, 15 bp, Homo sapiens
actaatacagtacag

SEQ ID NO: 139618 - DNA, 15 bp, Homo sapiens
gactaatacagtaca

SEQ ID NO: 139619 - DNA, 15 bp, Homo sapiens
agactaatacagtac

SEQ ID NO: 139620 - DNA, 15 bp, Homo sapiens
cagactaatacagta

SEQ ID NO: 139621 - DNA, 15 bp, Homo sapiens
acagactaatacagt

SEQ ID NO: 139622 - DNA, 15 bp, Homo sapiens
aacagactaatacag

SEQ ID NO: 139623 - DNA, 15 bp, Homo sapiens
gtgagaacagactaa

SEQ ID NO: 139624 - DNA, 15 bp, Homo sapiens
tgtgagaacagacta

SEQ ID NO: 139625 - DNA, 15 bp, Homo sapiens
atgtgagaacagact

SEQ ID NO: 139626 - DNA, 15 bp, Homo sapiens
aatgtgagaacagac

SEQ ID NO: 139627 - DNA, 15 bp, Homo sapiens
caatgtgagaacaga

SEQ ID NO: 139628 - DNA, 15 bp, Homo sapiens
gcaatgtgagaacag

SEQ ID NO: 139629 - DNA, 15 bp, Homo sapiens
agcaatgtgagaaca

SEQ ID NO: 139630 - DNA, 15 bp, Homo sapiens
tagcaatgtgagaac

SEQ ID NO: 139631 - DNA, 15 bp, Homo sapiens
atagcaatgtgagaa

SEQ ID NO: 139632 - DNA, 15 bp, Homo sapiens
tatagcaatgtgaga

SEQ ID NO: 139633 - DNA, 15 bp, Homo sapiens
ttatagcaatgtgag

SEQ ID NO: 139634 - DNA, 15 bp, Homo sapiens
tttatagcaatgtga

SEQ ID NO: 139635 - DNA, 15 bp, Homo sapiens
atttatagcaatgtg

SEQ ID NO: 139636 - DNA, 15 bp, Homo sapiens
tatttatagcaatgt

SEQ ID NO: 139637 - DNA, 15 bp, Homo sapiens
ttatttatagcaatg

SEQ ID NO: 139638 - DNA, 15 bp, Homo sapiens
gttatttatagcaat

SEQ ID NO: 139639 - DNA, 15 bp, Homo sapiens
agttatttatagcaa

SEQ ID NO: 139640 - DNA, 15 bp, Homo sapiens
tagttatttatagca

SEQ ID NO: 139641 - DNA, 15 bp, Homo sapiens
gtagttatttatagc

SEQ ID NO: 139642 - DNA, 15 bp, Homo sapiens
ggtagttatttatag

SEQ ID NO: 139643 - DNA, 15 bp, Homo sapiens
aggtagttatttata

SEQ ID NO: 139644 - DNA, 15 bp, Homo sapiens
caggtagttatttat

SEQ ID NO: 139645 - DNA, 15 bp, Homo sapiens
tcaggtagttattta

SEQ ID NO: 139646 - DNA, 15 bp, Homo sapiens
ctcaggtagttattt

SEQ ID NO: 139647 - DNA, 15 bp, Homo sapiens
tctcaggtagttatt

SEQ ID NO: 139648 - DNA, 15 bp, Homo sapiens
gtctcaggtagttat

SEQ ID NO: 139649 - DNA, 15 bp, Homo sapiens
agtctcaggtagtta

SEQ ID NO: 139650 - DNA, 15 bp, Homo sapiens
cagtctcaggtagtt

SEQ ID NO: 139651 - DNA, 15 bp, Homo sapiens
tcagtctcaggtagt

SEQ ID NO: 139652 - DNA, 15 bp, Homo sapiens
ctcagtctcaggtag

SEQ ID NO: 139653 - DNA, 15 bp, Homo sapiens
actcagtctcaggta

SEQ ID NO: 139654 - DNA, 15 bp, Homo sapiens
tactcagtctcaggt

SEQ ID NO: 139655 - DNA, 15 bp, Homo sapiens
ttactcagtctcagg

SEQ ID NO: 139656 - DNA, 15 bp, Homo sapiens
attactcagtctcag

SEQ ID NO: 139657 - DNA, 15 bp, Homo sapiens
aattactcagtctca

SEQ ID NO: 139658 - DNA, 15 bp, Homo sapiens
aaattactcagtctc

SEQ ID NO: 139659 - DNA, 15 bp, Homo sapiens
taaattactcagtct

SEQ ID NO: 139660 - DNA, 15 bp, Homo sapiens
ataaattactcagtc

SEQ ID NO: 139661 - DNA, 15 bp, Homo sapiens
cataaattactcagt

SEQ ID NO: 139662 - DNA, 15 bp, Homo sapiens
tcataaattactcag

SEQ ID NO: 139663 - DNA, 15 bp, Homo sapiens
ttcataaattactca

SEQ ID NO: 139664 - DNA, 15 bp, Homo sapiens
cttcataaattactc

SEQ ID NO: 139665 - DNA, 15 bp, Homo sapiens
tcttcataaattact

SEQ ID NO: 139666 - DNA, 15 bp, Homo sapiens
ttcttcataaattac

SEQ ID NO: 139667 - DNA, 15 bp, Homo sapiens
tttcttcataaatta

SEQ ID NO: 139668 - DNA, 15 bp, Homo sapiens
ctttcttcataaatt

SEQ ID NO: 139669 - DNA, 15 bp, Homo sapiens
cctttcttcataaat

SEQ ID NO: 139670 - DNA, 15 bp, Homo sapiens
tcctttcttcataaa

SEQ ID NO: 139671 - DNA, 15 bp, Homo sapiens
ctcctttcttcataa

SEQ ID NO: 139672 - DNA, 15 bp, Homo sapiens
tctcctttcttcata

SEQ ID NO: 139673 - DNA, 15 bp, Homo sapiens
atctcctttcttcat

SEQ ID NO: 139674 - DNA, 15 bp, Homo sapiens
aatctcctttcttca

SEQ ID NO: 139675 - DNA, 15 bp, Homo sapiens
aaatctcctttcttc

SEQ ID NO: 139676 - DNA, 15 bp, Homo sapiens
taaatctcctttctt

SEQ ID NO: 139677 - DNA, 15 bp, Homo sapiens
ttaaatctcctttct

SEQ ID NO: 139678 - DNA, 15 bp, Homo sapiens
attaaatctcctttc

SEQ ID NO: 139679 - DNA, 15 bp, Homo sapiens
aattaaatctccttt

SEQ ID NO: 139680 - DNA, 15 bp, Homo sapiens
caattaaatctcctt

SEQ ID NO: 139681 - DNA, 15 bp, Homo sapiens
tcaattaaatctcct

SEQ ID NO: 139682 - DNA, 15 bp, Homo sapiens
gtcaattaaatctcc

SEQ ID NO: 139683 - DNA, 15 bp, Homo sapiens
agtcaattaaatctc

SEQ ID NO: 139684 - DNA, 15 bp, Homo sapiens
gagtcaattaaatct

SEQ ID NO: 139685 - DNA, 15 bp, Homo sapiens
tgagtcaattaaatc

SEQ ID NO: 139686 - DNA, 15 bp, Homo sapiens
gtgagtcaattaaat

SEQ ID NO: 139687 - DNA, 15 bp, Homo sapiens
tgtgagtcaattaaa

SEQ ID NO: 139688 - DNA, 15 bp, Homo sapiens
ctgtgagtcaattaa

SEQ ID NO: 139689 - DNA, 15 bp, Homo sapiens
actgtgagtcaatta

SEQ ID NO: 139690 - DNA, 15 bp, Homo sapiens
aactgtgagtcaatt

SEQ ID NO: 139691 - DNA, 15 bp, Homo sapiens
gaactgtgagtcaat

SEQ ID NO: 139692 - DNA, 15 bp, Homo sapiens
tgaactgtgagtcaa

SEQ ID NO: 139693 - DNA, 15 bp, Homo sapiens
atgaactgtgagtca

SEQ ID NO: 139694 - DNA, 15 bp, Homo sapiens
aatgaactgtgagtc

SEQ ID NO: 139695 - DNA, 15 bp, Homo sapiens
aaatgaactgtgagt

SEQ ID NO: 139696 - DNA, 15 bp, Homo sapiens
caaatgaactgtgag

SEQ ID NO: 139697 - DNA, 15 bp, Homo sapiens
tcaaatgaactgtga

SEQ ID NO: 139698 - DNA, 15 bp, Homo sapiens
ctcaaatgaactgtg

SEQ ID NO: 139699 - DNA, 15 bp, Homo sapiens
cctcaaatgaactgt

SEQ ID NO: 139700 - DNA, 15 bp, Homo sapiens
ccctcaaatgaactg

SEQ ID NO: 139701 - DNA, 15 bp, Homo sapiens
gccctcaaatgaact

SEQ ID NO: 139702 - DNA, 15 bp, Homo sapiens
agccctcaaatgaac

SEQ ID NO: 139703 - DNA, 15 bp, Homo sapiens
tagccctcaaatgaa

SEQ ID NO: 139704 - DNA, 15 bp, Homo sapiens
gtagccctcaaatga

SEQ ID NO: 139705 - DNA, 15 bp, Homo sapiens
agtagccctcaaatg

SEQ ID NO: 139706 - DNA, 15 bp, Homo sapiens
cagtagccctcaaat

SEQ ID NO: 139707 - DNA, 15 bp, Homo sapiens
acagtagccctcaaa

SEQ ID NO: 139708 - DNA, 15 bp, Homo sapiens
tacagtagccctcaa

SEQ ID NO: 139709 - DNA, 15 bp, Homo sapiens
ctacagtagccctca

SEQ ID NO: 139710 - DNA, 15 bp, Homo sapiens
actacagtagccctc

SEQ ID NO: 139711 - DNA, 15 bp, Homo sapiens
cactacagtagccct

SEQ ID NO: 139712 - DNA, 15 bp, Homo sapiens
tcactacagtagccc

SEQ ID NO: 139713 - DNA, 15 bp, Homo sapiens
ttcactacagtagcc

SEQ ID NO: 139714 - DNA, 15 bp, Homo sapiens
cttcactacagtagc

SEQ ID NO: 139715 - DNA, 15 bp, Homo sapiens
gcttcactacagtag

SEQ ID NO: 139716 - DNA, 15 bp, Homo sapiens
tgcttcactacagta

SEQ ID NO: 139717 - DNA, 15 bp, Homo sapiens
atgcttcactacagt

SEQ ID NO: 139718 - DNA, 15 bp, Homo sapiens
catgcttcactacag

SEQ ID NO: 139719 - DNA, 15 bp, Homo sapiens
tcatgcttcactaca

SEQ ID NO: 139720 - DNA, 15 bp, Homo sapiens
gtcatgcttcactac

SEQ ID NO: 139721 - DNA, 15 bp, Homo sapiens
agtcatgcttcacta

SEQ ID NO: 139722 - DNA, 15 bp, Homo sapiens
cagtcatgcttcact

SEQ ID NO: 139723 - DNA, 15 bp, Homo sapiens
ccagtcatgcttcac

SEQ ID NO: 139724 - DNA, 15 bp, Homo sapiens
cccagtcatgcttca

SEQ ID NO: 139725 - DNA, 15 bp, Homo sapiens
tcccagtcatgcttc

SEQ ID NO: 139726 - DNA, 15 bp, Homo sapiens
ctcccagtcatgctt

SEQ ID NO: 139727 - DNA, 15 bp, Homo sapiens
cctcccagtcatgct

SEQ ID NO: 139728 - DNA, 15 bp, Homo sapiens
acctcccagtcatgc

SEQ ID NO: 139729 - DNA, 15 bp, Homo sapiens
tacctcccagtcatg

SEQ ID NO: 139730 - DNA, 15 bp, Homo sapiens
gtacctcccagtcat

SEQ ID NO: 139731 - DNA, 15 bp, Homo sapiens
ggtacctcccagtca

SEQ ID NO: 139732 - DNA, 15 bp, Homo sapiens
tggtacctcccagtc

SEQ ID NO: 139733 - DNA, 15 bp, Homo sapiens
ctggtacctcccagt

SEQ ID NO: 139734 - DNA, 15 bp, Homo sapiens
cctggtacctcccag

SEQ ID NO: 139735 - DNA, 15 bp, Homo sapiens
tcctggtacctccca

SEQ ID NO: 139736 - DNA, 15 bp, Homo sapiens
ttcctggtacctccc

SEQ ID NO: 139737 - DNA, 15 bp, Homo sapiens
tttcctggtacctcc

SEQ ID NO: 139738 - DNA, 15 bp, Homo sapiens
gtttcctggtacctc

SEQ ID NO: 139739 - DNA, 15 bp, Homo sapiens
agtttcctggtacct

SEQ ID NO: 139740 - DNA, 15 bp, Homo sapiens
aagtttcctggtacc

SEQ ID NO: 139741 - DNA, 15 bp, Homo sapiens
taagtttcctggtac

SEQ ID NO: 139742 - DNA, 15 bp, Homo sapiens
ttaagtttcctggta

SEQ ID NO: 139743 - DNA, 15 bp, Homo sapiens
tttaagtttcctggt

SEQ ID NO: 139744 - DNA, 15 bp, Homo sapiens
ttttaagtttcctgg

SEQ ID NO: 139745 - DNA, 15 bp, Homo sapiens
attttaagtttcctg

SEQ ID NO: 139746 - DNA, 15 bp, Homo sapiens
gattttaagtttcct

SEQ ID NO: 139747 - DNA, 15 bp, Homo sapiens
tgattttaagtttcc

SEQ ID NO: 139748 - DNA, 15 bp, Homo sapiens
atgattttaagtttc

SEQ ID NO: 139749 - DNA, 15 bp, Homo sapiens
catgattttaagttt

SEQ ID NO: 139750 - DNA, 15 bp, Homo sapiens
ccatgattttaagtt

SEQ ID NO: 139751 - DNA, 15 bp, Homo sapiens
accatgattttaagt

SEQ ID NO: 139752 - DNA, 15 bp, Homo sapiens
caccatgattttaag

SEQ ID NO: 139753 - DNA, 15 bp, Homo sapiens
ccaccatgattttaa

SEQ ID NO: 139754 - DNA, 15 bp, Homo sapiens
tccaccatgatttta

SEQ ID NO: 139755 - DNA, 15 bp, Homo sapiens
ttccaccatgatttt

SEQ ID NO: 139756 - DNA, 15 bp, Homo sapiens
cttccaccatgattt

SEQ ID NO: 139757 - DNA, 15 bp, Homo sapiens
gccttccaccatgat

SEQ ID NO: 139758 - DNA, 15 bp, Homo sapiens
tgccttccaccatga

SEQ ID NO: 139759 - DNA, 15 bp, Homo sapiens
ttgccttccaccatg

SEQ ID NO: 139760 - DNA, 15 bp, Homo sapiens
tttgccttccaccat

SEQ ID NO: 139761 - DNA, 15 bp, Homo sapiens
ctttgccttccacca

SEQ ID NO: 139762 - DNA, 15 bp, Homo sapiens
cctttgccttccacc

SEQ ID NO: 139763 - DNA, 15 bp, Homo sapiens
ccctttgccttccac

SEQ ID NO: 139764 - DNA, 15 bp, Homo sapiens
cccctttgccttcca

SEQ ID NO: 139765 - DNA, 15 bp, Homo sapiens
tcccctttgccttcc

SEQ ID NO: 139766 - DNA, 15 bp, Homo sapiens
ttcccctttgccttc

SEQ ID NO: 139767 - DNA, 15 bp, Homo sapiens
cttcccctttgcctt

SEQ ID NO: 139768 - DNA, 15 bp, Homo sapiens
gcttcccctttgcct

SEQ ID NO: 139769 - DNA, 15 bp, Homo sapiens
tgcttcccctttgcc

SEQ ID NO: 139770 - DNA, 15 bp, Homo sapiens
ctgcttcccctttgc

SEQ ID NO: 139771 - DNA, 15 bp, Homo sapiens
cctgcttcccctttg

SEQ ID NO: 139772 - DNA, 15 bp, Homo sapiens
gcctgcttccccttt

SEQ ID NO: 139773 - DNA, 15 bp, Homo sapiens
tgcctgcttcccctt

SEQ ID NO: 139774 - DNA, 15 bp, Homo sapiens
gtgcctgcttcccct

SEQ ID NO: 139775 - DNA, 15 bp, Homo sapiens
ggtgcctgcttcccc

SEQ ID NO: 139776 - DNA, 15 bp, Homo sapiens
aggtgcctgcttccc

SEQ ID NO: 139777 - DNA, 15 bp, Homo sapiens
aaggtgcctgcttcc

SEQ ID NO: 139778 - DNA, 15 bp, Homo sapiens
gaaggtgcctgcttc

SEQ ID NO: 139779 - DNA, 15 bp, Homo sapiens
agaaggtgcctgctt

SEQ ID NO: 139780 - DNA, 15 bp, Homo sapiens
aagaaggtgcctgct

SEQ ID NO: 139781 - DNA, 15 bp, Homo sapiens
aaagaaggtgcctgc

SEQ ID NO: 139782 - DNA, 15 bp, Homo sapiens
taaagaaggtgcctg

SEQ ID NO: 139783 - DNA, 15 bp, Homo sapiens
gtaaagaaggtgcct

SEQ ID NO: 139784 - DNA, 15 bp, Homo sapiens
tgtaaagaaggtgcc

SEQ ID NO: 139785 - DNA, 15 bp, Homo sapiens
ttgtaaagaaggtgc

SEQ ID NO: 139786 - DNA, 15 bp, Homo sapiens
cttgtaaagaaggtg

SEQ ID NO: 139787 - DNA, 15 bp, Homo sapiens
ccttgtaaagaaggt

SEQ ID NO: 139788 - DNA, 15 bp, Homo sapiens
gccttgtaaagaagg

SEQ ID NO: 139789 - DNA, 15 bp, Homo sapiens
tgccttgtaaagaag

SEQ ID NO: 139790 - DNA, 15 bp, Homo sapiens
ctgccttgtaaagaa

SEQ ID NO: 139791 - DNA, 15 bp, Homo sapiens
gctgccttgtaaaga

SEQ ID NO: 139792 - DNA, 15 bp, Homo sapiens
tgctgccttgtaaag

SEQ ID NO: 139793 - DNA, 15 bp, Homo sapiens
ttgctgccttgtaaa

SEQ ID NO: 139794 - DNA, 15 bp, Homo sapiens
cttgctgccttgtaa

SEQ ID NO: 139795 - DNA, 15 bp, Homo sapiens
tcttgctgccttgta

SEQ ID NO: 139796 - DNA, 15 bp, Homo sapiens
gtcttgctgccttgt

SEQ ID NO: 139797 - DNA, 15 bp, Homo sapiens
tgtcttgctgccttg

SEQ ID NO: 139798 - DNA, 15 bp, Homo sapiens
ctgtcttgctgcctt

SEQ ID NO: 139799 - DNA, 15 bp, Homo sapiens
tctgtcttgctgcct

SEQ ID NO: 139800 - DNA, 15 bp, Homo sapiens
ctctgtcttgctgcc

SEQ ID NO: 139801 - DNA, 15 bp, Homo sapiens
tctctgtcttgctgc

SEQ ID NO: 139802 - DNA, 15 bp, Homo sapiens
ctctctgtcttgctg

SEQ ID NO: 139803 - DNA, 15 bp, Homo sapiens
tctctctgtcttgct

SEQ ID NO: 139804 - DNA, 15 bp, Homo sapiens
ctctctctgtcttgc

SEQ ID NO: 139805 - DNA, 15 bp, Homo sapiens
tctctctctgtcttg

SEQ ID NO: 139806 - DNA, 15 bp, Homo sapiens
atctctctctgtctt

SEQ ID NO: 139807 - DNA, 15 bp, Homo sapiens
tatctctctctgtct

SEQ ID NO: 139808 - DNA, 15 bp, Homo sapiens
ctatctctctctgtc

SEQ ID NO: 139809 - DNA, 15 bp, Homo sapiens
tctatctctctctgt

SEQ ID NO: 139810 - DNA, 15 bp, Homo sapiens
ttctatctctctctg

SEQ ID NO: 139811 - DNA, 15 bp, Homo sapiens
cttctatctctctct

SEQ ID NO: 139812 - DNA, 15 bp, Homo sapiens
ccttctatctctctc

SEQ ID NO: 139813 - DNA, 15 bp, Homo sapiens
cccttctatctctct

SEQ ID NO: 139814 - DNA, 15 bp, Homo sapiens
tcccttctatctctc

SEQ ID NO: 139815 - DNA, 15 bp, Homo sapiens
ctcccttctatctct

SEQ ID NO: 139816 - DNA, 15 bp, Homo sapiens
tctcccttctatctc

SEQ ID NO: 139817 - DNA, 15 bp, Homo sapiens
ttctcccttctatct

SEQ ID NO: 139818 - DNA, 15 bp, Homo sapiens
cttctcccttctatc

SEQ ID NO: 139819 - DNA, 15 bp, Homo sapiens
acttctcccttctat

SEQ ID NO: 139820 - DNA, 15 bp, Homo sapiens
cacttctcccttcta

SEQ ID NO: 139821 - DNA, 15 bp, Homo sapiens
gcacttctcccttct

SEQ ID NO: 139822 - DNA, 15 bp, Homo sapiens
ggcacttctcccttc

SEQ ID NO: 139823 - DNA, 15 bp, Homo sapiens
tggcacttctccctt

SEQ ID NO: 139824 - DNA, 15 bp, Homo sapiens
gtggcacttctccct

SEQ ID NO: 139825 - DNA, 15 bp, Homo sapiens
tgtggcacttctccc

SEQ ID NO: 139826 - DNA, 15 bp, Homo sapiens
gtgtggcacttctcc

SEQ ID NO: 139827 - DNA, 15 bp, Homo sapiens
tgtgtggcacttctc

SEQ ID NO: 139828 - DNA, 15 bp, Homo sapiens
atgtgtggcacttct

SEQ ID NO: 139829 - DNA, 15 bp, Homo sapiens
aatgtgtggcacttc

SEQ ID NO: 139830 - DNA, 15 bp, Homo sapiens
aaatgtgtggcactt

SEQ ID NO: 139831 - DNA, 15 bp, Homo sapiens
aaaatgtgtggcact

SEQ ID NO: 139832 - DNA, 15 bp, Homo sapiens
taaaatgtgtggcac

SEQ ID NO: 139833 - DNA, 15 bp, Homo sapiens
ataaaatgtgtggca

SEQ ID NO: 139834 - DNA, 15 bp, Homo sapiens
aataaaatgtgtggc

SEQ ID NO: 139835 - DNA, 15 bp, Homo sapiens
aaataaaatgtgtgg

SEQ ID NO: 139836 - DNA, 15 bp, Homo sapiens
taaataaaatgtgtg

SEQ ID NO: 139837 - DNA, 15 bp, Homo sapiens
ataaataaaatgtgt

SEQ ID NO: 139838 - DNA, 15 bp, Homo sapiens
aataaataaaatgtg

SEQ ID NO: 139839 - DNA, 15 bp, Homo sapiens
ccaataaataaataa

SEQ ID NO: 139840 - DNA, 15 bp, Homo sapiens
tccaataaataaata

SEQ ID NO: 139841 - DNA, 15 bp, Homo sapiens
ctccaataaataaat

SEQ ID NO: 139842 - DNA, 15 bp, Homo sapiens
tctccaataaataaa

SEQ ID NO: 139843 - DNA, 15 bp, Homo sapiens
gtctccaataaataa

SEQ ID NO: 139844 - DNA, 15 bp, Homo sapiens
tgtctccaataaata

SEQ ID NO: 139845 - DNA, 15 bp, Homo sapiens
atgtctccaataaat

SEQ ID NO: 139846 - DNA, 15 bp, Homo sapiens
aatgtctccaataaa

SEQ ID NO: 139847 - DNA, 15 bp, Homo sapiens
caatgtctccaataa

SEQ ID NO: 139848 - DNA, 15 bp, Homo sapiens
acaatgtctccaata

SEQ ID NO: 139849 - DNA, 15 bp, Homo sapiens
gacaatgtctccaat

SEQ ID NO: 139850 - DNA, 15 bp, Homo sapiens
agacaatgtctccaa

SEQ ID NO: 139851 - DNA, 15 bp, Homo sapiens
gagacaatgtctcca

SEQ ID NO: 139852 - DNA, 15 bp, Homo sapiens
tgagacaatgtctcc

SEQ ID NO: 139853 - DNA, 15 bp, Homo sapiens
gtgagacaatgtctc

SEQ ID NO: 139854 - DNA, 15 bp, Homo sapiens
agtgagacaatgtct

SEQ ID NO: 139855 - DNA, 15 bp, Homo sapiens
gagtgagacaatgtc

SEQ ID NO: 139856 - DNA, 15 bp, Homo sapiens
agagtgagacaatgt

SEQ ID NO: 139857 - DNA, 15 bp, Homo sapiens
cagagtgagacaatg

SEQ ID NO: 139858 - DNA, 15 bp, Homo sapiens
gcagagtgagacaat

SEQ ID NO: 139859 - DNA, 15 bp, Homo sapiens
ggcagagtgagacaa

SEQ ID NO: 139860 - DNA, 15 bp, Homo sapiens
cggcagagtgagaca

SEQ ID NO: 139861 - DNA, 15 bp, Homo sapiens
gcggcagagtgagac

SEQ ID NO: 139862 - DNA, 15 bp, Homo sapiens
ggcggcagagtgaga

SEQ ID NO: 139863 - DNA, 15 bp, Homo sapiens
gggcggcagagtgag

SEQ ID NO: 139864 - DNA, 15 bp, Homo sapiens
tgggcggcagagtga

SEQ ID NO: 139865 - DNA, 15 bp, Homo sapiens
ctgggcggcagagtg

SEQ ID NO: 139866 - DNA, 15 bp, Homo sapiens
cctgggcggcagagt

SEQ ID NO: 139867 - DNA, 15 bp, Homo sapiens
cagcctgggcggcag

SEQ ID NO: 139868 - DNA, 15 bp, Homo sapiens
ccagcctgggcggca

SEQ ID NO: 139869 - DNA, 15 bp, Homo sapiens
tccagcctgggcggc

SEQ ID NO: 139870 - DNA, 15 bp, Homo sapiens
ttccagcctgggcgg

SEQ ID NO: 139871 - DNA, 15 bp, Homo sapiens
attccagcctgggcg

SEQ ID NO: 139872 - DNA, 15 bp, Homo sapiens
gccactgcattccag

SEQ ID NO: 139873 - DNA, 15 bp, Homo sapiens
tgccactgcattcca

SEQ ID NO: 139874 - DNA, 15 bp, Homo sapiens
gtgccactgcattcc

SEQ ID NO: 139875 - DNA, 15 bp, Homo sapiens
agtgccactgcattc

SEQ ID NO: 139876 - DNA, 15 bp, Homo sapiens
tagtgccactgcatt

SEQ ID NO: 139877 - DNA, 15 bp, Homo sapiens
atagtgccactgcat

SEQ ID NO: 139878 - DNA, 15 bp, Homo sapiens
gatagtgccactgca

SEQ ID NO: 139879 - DNA, 15 bp, Homo sapiens
agatagtgccactgc

SEQ ID NO: 139880 - DNA, 15 bp, Homo sapiens
gagatagtgccactg

SEQ ID NO: 139881 - DNA, 15 bp, Homo sapiens
tgagatagtgccact

SEQ ID NO: 139882 - DNA, 15 bp, Homo sapiens
ctgagatagtgccac

SEQ ID NO: 139883 - DNA, 15 bp, Homo sapiens
gctgagatagtgcca

SEQ ID NO: 139884 - DNA, 15 bp, Homo sapiens
agctgagatagtgcc

SEQ ID NO: 139885 - DNA, 15 bp, Homo sapiens
gagctgagatagtgc

SEQ ID NO: 139886 - DNA, 15 bp, Homo sapiens
tgagctgagatagtg

SEQ ID NO: 139887 - DNA, 15 bp, Homo sapiens
atgagctgagatagt

SEQ ID NO: 139888 - DNA, 15 bp, Homo sapiens
aatgagctgagatag

SEQ ID NO: 139889 - DNA, 15 bp, Homo sapiens
caatgagctgagata

SEQ ID NO: 139890 - DNA, 15 bp, Homo sapiens
gcaatgagctgagat

SEQ ID NO: 139891 - DNA, 15 bp, Homo sapiens
tgcaatgagctgaga

SEQ ID NO: 139892 - DNA, 15 bp, Homo sapiens
ttgcaatgagctgag

SEQ ID NO: 139893 - DNA, 15 bp, Homo sapiens
gttgcaatgagctga

SEQ ID NO: 139894 - DNA, 15 bp, Homo sapiens
tgttgcaatgagctg

SEQ ID NO: 139895 - DNA, 15 bp, Homo sapiens
ctgttgcaatgagct

SEQ ID NO: 139896 - DNA, 15 bp, Homo sapiens
gctgttgcaatgagc

SEQ ID NO: 139897 - DNA, 15 bp, Homo sapiens
ggctgttgcaatgag

SEQ ID NO: 139898 - DNA, 15 bp, Homo sapiens
tggctgttgcaatga

SEQ ID NO: 139899 - DNA, 15 bp, Homo sapiens
gtggctgttgcaatg

SEQ ID NO: 139900 - DNA, 15 bp, Homo sapiens
ggtggctgttgcaat

SEQ ID NO: 139901 - DNA, 15 bp, Homo sapiens
aggtggctgttgcaa

SEQ ID NO: 139902 - DNA, 15 bp, Homo sapiens
gaggtggctgttgca

SEQ ID NO: 139903 - DNA, 15 bp, Homo sapiens
agaggtggctgttgc

SEQ ID NO: 139904 - DNA, 15 bp, Homo sapiens
aagaggtggctgttg

SEQ ID NO: 139905 - DNA, 15 bp, Homo sapiens
caagaggtggctgtt

SEQ ID NO: 139906 - DNA, 15 bp, Homo sapiens
ccaagaggtggctgt

SEQ ID NO: 139907 - DNA, 15 bp, Homo sapiens
cccaagaggtggctg

SEQ ID NO: 139908 - DNA, 15 bp, Homo sapiens
acccaagaggtggct

SEQ ID NO: 139909 - DNA, 15 bp, Homo sapiens
aacccaagaggtggc

SEQ ID NO: 139910 - DNA, 15 bp, Homo sapiens
gaacccaagaggtgg

SEQ ID NO: 139911 - DNA, 15 bp, Homo sapiens
ggaacccaagaggtg

SEQ ID NO: 139912 - DNA, 15 bp, Homo sapiens
tggaacccaagaggt

SEQ ID NO: 139913 - DNA, 15 bp, Homo sapiens
ctggaacccaagagg

SEQ ID NO: 139914 - DNA, 15 bp, Homo sapiens
gctggaacccaagag

SEQ ID NO: 139915 - DNA, 15 bp, Homo sapiens
cgctggaacccaaga

SEQ ID NO: 139916 - DNA, 15 bp, Homo sapiens
tcgctggaacccaag

SEQ ID NO: 139917 - DNA, 15 bp, Homo sapiens
atcgctggaacccaa

SEQ ID NO: 139918 - DNA, 15 bp, Homo sapiens
aatcgctggaaccca

SEQ ID NO: 139919 - DNA, 15 bp, Homo sapiens
gaatcgctggaaccc

SEQ ID NO: 139920 - DNA, 15 bp, Homo sapiens
agaatcgctggaacc

SEQ ID NO: 139921 - DNA, 15 bp, Homo sapiens
aagaatcgctggaac

SEQ ID NO: 139922 - DNA, 15 bp, Homo sapiens
caagaatcgctggaa

SEQ ID NO: 139923 - DNA, 15 bp, Homo sapiens
gcaagaatcgctgga

SEQ ID NO: 139924 - DNA, 15 bp, Homo sapiens
ggcaagaatcgctgg

SEQ ID NO: 139925 - DNA, 15 bp, Homo sapiens
aggcaagaatcgctg

SEQ ID NO: 139926 - DNA, 15 bp, Homo sapiens
gaggcaagaatcgct

SEQ ID NO: 139927 - DNA, 15 bp, Homo sapiens
tgaggcaagaatcgc

SEQ ID NO: 139928 - DNA, 15 bp, Homo sapiens
ctgaggcaagaatcg

SEQ ID NO: 139929 - DNA, 15 bp, Homo sapiens
gctgaggcaagaatc

SEQ ID NO: 139930 - DNA, 15 bp, Homo sapiens
ggctgaggcaagaat

SEQ ID NO: 139931 - DNA, 15 bp, Homo sapiens
aggctgaggcaagaa

SEQ ID NO: 139932 - DNA, 15 bp, Homo sapiens
aaggctgaggcaaga

SEQ ID NO: 139933 - DNA, 15 bp, Homo sapiens
gaaggctgaggcaag

SEQ ID NO: 139934 - DNA, 15 bp, Homo sapiens
ggaaggctgaggcaa

SEQ ID NO: 139935 - DNA, 15 bp, Homo sapiens
tggaaggctgaggca

SEQ ID NO: 139936 - DNA, 15 bp, Homo sapiens
ttggaaggctgaggc

SEQ ID NO: 139937 - DNA, 15 bp, Homo sapiens
cttggaaggctgagg

SEQ ID NO: 139938 - DNA, 15 bp, Homo sapiens
acttggaaggctgag

SEQ ID NO: 139939 - DNA, 15 bp, Homo sapiens
tacttggaaggctga

SEQ ID NO: 139940 - DNA, 15 bp, Homo sapiens
ctacttggaaggctg

SEQ ID NO: 139941 - DNA, 15 bp, Homo sapiens
gctacttggaaggct

SEQ ID NO: 139942 - DNA, 15 bp, Homo sapiens
agctacttggaaggc

SEQ ID NO: 139943 - DNA, 15 bp, Homo sapiens
cagctacttggaagg

SEQ ID NO: 139944 - DNA, 15 bp, Homo sapiens
ccagctacttggaag

SEQ ID NO: 139945 - DNA, 15 bp, Homo sapiens
cccagctacttggaa

SEQ ID NO: 139946 - DNA, 15 bp, Homo sapiens
tcccagctacttgga

SEQ ID NO: 139947 - DNA, 15 bp, Homo sapiens
catcccagctacttg

SEQ ID NO: 139948 - DNA, 15 bp, Homo sapiens
tcatcccagctactt

SEQ ID NO: 139949 - DNA, 15 bp, Homo sapiens
gtcatcccagctact

SEQ ID NO: 139950 - DNA, 15 bp, Homo sapiens
tgtcatcccagctac

SEQ ID NO: 139951 - DNA, 15 bp, Homo sapiens
ctgtcatcccagcta

SEQ ID NO: 139952 - DNA, 15 bp, Homo sapiens
cctgtcatcccagct

SEQ ID NO: 139953 - DNA, 15 bp, Homo sapiens
gcctgtcatcccagc

SEQ ID NO: 139954 - DNA, 15 bp, Homo sapiens
cgcctgtcatcccag

SEQ ID NO: 139955 - DNA, 15 bp, Homo sapiens
acgcctgtcatccca

SEQ ID NO: 139956 - DNA, 15 bp, Homo sapiens
cacgcctgtcatccc

SEQ ID NO: 139957 - DNA, 15 bp, Homo sapiens
gcacgcctgtcatcc

SEQ ID NO: 139958 - DNA, 15 bp, Homo sapiens
tgcacgcctgtcatc

SEQ ID NO: 139959 - DNA, 15 bp, Homo sapiens
gtgcacgcctgtcat

SEQ ID NO: 139960 - DNA, 15 bp, Homo sapiens
ggtgcacgcctgtca

SEQ ID NO: 139961 - DNA, 15 bp, Homo sapiens
tggtgcacgcctgtc

SEQ ID NO: 139962 - DNA, 15 bp, Homo sapiens
gtggtgcacgcctgt

SEQ ID NO: 139963 - DNA, 15 bp, Homo sapiens
ggtggtgcacgcctg

SEQ ID NO: 139964 - DNA, 15 bp, Homo sapiens
tggtggtgcacgcct

SEQ ID NO: 139965 - DNA, 15 bp, Homo sapiens
atggtggtgcacgcc

SEQ ID NO: 139966 - DNA, 15 bp, Homo sapiens
catggtggtgcacgc

SEQ ID NO: 139967 - DNA, 15 bp, Homo sapiens
gcatggtggtgcacg

SEQ ID NO: 139968 - DNA, 15 bp, Homo sapiens
ggcatggtggtgcac

SEQ ID NO: 139969 - DNA, 15 bp, Homo sapiens
gggcatggtggtgca

SEQ ID NO: 139970 - DNA, 15 bp, Homo sapiens
tgggcatggtggtgc

SEQ ID NO: 139971 - DNA, 15 bp, Homo sapiens
ctgggcatggtggtg

SEQ ID NO: 139972 - DNA, 15 bp, Homo sapiens
gctgggcatggtggt

SEQ ID NO: 139973 - DNA, 15 bp, Homo sapiens
gaaaatacaaaaatt

SEQ ID NO: 139974 - DNA, 15 bp, Homo sapiens
agaaaatacaaaaat

SEQ ID NO: 139975 - DNA, 15 bp, Homo sapiens
acagaaaatacaaaa

SEQ ID NO: 139976 - DNA, 15 bp, Homo sapiens
tacagaaaatacaaa

SEQ ID NO: 139977 - DNA, 15 bp, Homo sapiens
ctacagaaaatacaa

SEQ ID NO: 139978 - DNA, 15 bp, Homo sapiens
tctacagaaaataca

SEQ ID NO: 139979 - DNA, 15 bp, Homo sapiens
ctctacagaaaatac

SEQ ID NO: 139980 - DNA, 15 bp, Homo sapiens
tctctacagaaaata

SEQ ID NO: 139981 - DNA, 15 bp, Homo sapiens
gtctctacagaaaat

SEQ ID NO: 139982 - DNA, 15 bp, Homo sapiens
cgtctctacagaaaa

SEQ ID NO: 139983 - DNA, 15 bp, Homo sapiens
ccgtctctacagaaa

SEQ ID NO: 139984 - DNA, 15 bp, Homo sapiens
cccgtctctacagaa

SEQ ID NO: 139985 - DNA, 15 bp, Homo sapiens
ccccgtctctacaga

SEQ ID NO: 139986 - DNA, 15 bp, Homo sapiens
accccgtctctacag

SEQ ID NO: 139987 - DNA, 15 bp, Homo sapiens
aaccccgtctctaca

SEQ ID NO: 139988 - DNA, 15 bp, Homo sapiens
gaaccccgtctctac

SEQ ID NO: 139989 - DNA, 15 bp, Homo sapiens
ggaaccccgtctcta

SEQ ID NO: 139990 - DNA, 15 bp, Homo sapiens
cggaaccccgtctct

SEQ ID NO: 139991 - DNA, 15 bp, Homo sapiens
gcggaaccccgtctc

SEQ ID NO: 139992 - DNA, 15 bp, Homo sapiens
ggcggaaccccgtct

SEQ ID NO: 139993 - DNA, 15 bp, Homo sapiens
tggcggaaccccgtc

SEQ ID NO: 139994 - DNA, 15 bp, Homo sapiens
atggcggaaccccgt

SEQ ID NO: 139995 - DNA, 15 bp, Homo sapiens
catggcggaaccccg

SEQ ID NO: 139996 - DNA, 15 bp, Homo sapiens
acatggcggaacccc

SEQ ID NO: 139997 - DNA, 15 bp, Homo sapiens
aacatggcggaaccc

SEQ ID NO: 139998 - DNA, 15 bp, Homo sapiens
caacatggcggaacc

SEQ ID NO: 139999 - DNA, 15 bp, Homo sapiens
gcaacatggcggaac

SEQ ID NO: 140000 - DNA, 15 bp, Homo sapiens
ggcaacatggcggaa

SEQ ID NO: 140001 - DNA, 15 bp, Homo sapiens
gggcaacatggcgga

SEQ ID NO: 140002 - DNA, 15 bp, Homo sapiens
tgggcaacatggcgg

SEQ ID NO: 140003 - DNA, 15 bp, Homo sapiens
ctgggcaacatggcg

SEQ ID NO: 140004 - DNA, 15 bp, Homo sapiens
aagcctgggcaacat

SEQ ID NO: 140005 - DNA, 15 bp, Homo sapiens
caagcctgggcaaca

SEQ ID NO: 140006 - DNA, 15 bp, Homo sapiens
acaagcctgggcaac

SEQ ID NO: 140007 - DNA, 15 bp, Homo sapiens
gacaagcctgggcaa

SEQ ID NO: 140008 - DNA, 15 bp, Homo sapiens
agacaagcctgggca

SEQ ID NO: 140009 - DNA, 15 bp, Homo sapiens
cagacaagcctgggc

SEQ ID NO: 140010 - DNA, 15 bp, Homo sapiens
gcagacaagcctggg

SEQ ID NO: 140011 - DNA, 15 bp, Homo sapiens
tgcagacaagcctgg

SEQ ID NO: 140012 - DNA, 15 bp, Homo sapiens
ttgcagacaagcctg

SEQ ID NO: 140013 - DNA, 15 bp, Homo sapiens
attgcagacaagcct

SEQ ID NO: 140014 - DNA, 15 bp, Homo sapiens
aattgcagacaagcc

SEQ ID NO: 140015 - DNA, 15 bp, Homo sapiens
gaattgcagacaagc

SEQ ID NO: 140016 - DNA, 15 bp, Homo sapiens
ggaattgcagacaag

SEQ ID NO: 140017 - DNA, 15 bp, Homo sapiens
aggaattgcagacaa

SEQ ID NO: 140018 - DNA, 15 bp, Homo sapiens
caggaattgcagaca

SEQ ID NO: 140019 - DNA, 15 bp, Homo sapiens
tcaggaattgcagac

SEQ ID NO: 140020 - DNA, 15 bp, Homo sapiens
ctcaggaattgcaga

SEQ ID NO: 140021 - DNA, 15 bp, Homo sapiens
gctcaggaattgcag

SEQ ID NO: 140022 - DNA, 15 bp, Homo sapiens
agctcaggaattgca

SEQ ID NO: 140023 - DNA, 15 bp, Homo sapiens
gagctcaggaattgc

SEQ ID NO: 140024 - DNA, 15 bp, Homo sapiens
tgagctcaggaattg

SEQ ID NO: 140025 - DNA, 15 bp, Homo sapiens
ttgagctcaggaatt

SEQ ID NO: 140026 - DNA, 15 bp, Homo sapiens
cttgagctcaggaat

SEQ ID NO: 140027 - DNA, 15 bp, Homo sapiens
acttgagctcaggaa

SEQ ID NO: 140028 - DNA, 15 bp, Homo sapiens
tacttgagctcagga

SEQ ID NO: 140029 - DNA, 15 bp, Homo sapiens
ttacttgagctcagg

SEQ ID NO: 140030 - DNA, 15 bp, Homo sapiens
attacttgagctcag

SEQ ID NO: 140031 - DNA, 15 bp, Homo sapiens
gattacttgagctca

SEQ ID NO: 140032 - DNA, 15 bp, Homo sapiens
agattacttgagctc

SEQ ID NO: 140033 - DNA, 15 bp, Homo sapiens
cagattacttgagct

SEQ ID NO: 140034 - DNA, 15 bp, Homo sapiens
gcagattacttgagc

SEQ ID NO: 140035 - DNA, 15 bp, Homo sapiens
agcagattacttgag

SEQ ID NO: 140036 - DNA, 15 bp, Homo sapiens
gagcagattacttga

SEQ ID NO: 140037 - DNA, 15 bp, Homo sapiens
tgagcagattacttg

SEQ ID NO: 140038 - DNA, 15 bp, Homo sapiens
gtgagcagattactt

SEQ ID NO: 140039 - DNA, 15 bp, Homo sapiens
agtgagcagattact

SEQ ID NO: 140040 - DNA, 15 bp, Homo sapiens
aagtgagcagattac

SEQ ID NO: 140041 - DNA, 15 bp, Homo sapiens
aaagtgagcagatta

SEQ ID NO: 140042 - DNA, 15 bp, Homo sapiens
caaagtgagcagatt

SEQ ID NO: 140043 - DNA, 15 bp, Homo sapiens
ccaaagtgagcagat

SEQ ID NO: 140044 - DNA, 15 bp, Homo sapiens
gccaaagtgagcaga

SEQ ID NO: 140045 - DNA, 15 bp, Homo sapiens
ggccaaagtgagcag

SEQ ID NO: 140046 - DNA, 15 bp, Homo sapiens
aggccaaagtgagca

SEQ ID NO: 140047 - DNA, 15 bp, Homo sapiens
gaggccaaagtgagc

SEQ ID NO: 140048 - DNA, 15 bp, Homo sapiens
ggaggccaaagtgag

SEQ ID NO: 140049 - DNA, 15 bp, Homo sapiens
gggaggccaaagtga

SEQ ID NO: 140050 - DNA, 15 bp, Homo sapiens
tgggaggccaaagtg

SEQ ID NO: 140051 - DNA, 15 bp, Homo sapiens
ttgggaggccaaagt

SEQ ID NO: 140052 - DNA, 15 bp, Homo sapiens
cttgggaggccaaag

SEQ ID NO: 140053 - DNA, 15 bp, Homo sapiens
acttgggaggccaaa

SEQ ID NO: 140054 - DNA, 15 bp, Homo sapiens
acacttgggaggcca

SEQ ID NO: 140055 - DNA, 15 bp, Homo sapiens
gacacttgggaggcc

SEQ ID NO: 140056 - DNA, 15 bp, Homo sapiens
tgacacttgggaggc

SEQ ID NO: 140057 - DNA, 15 bp, Homo sapiens
gtgacacttgggagg

SEQ ID NO: 140058 - DNA, 15 bp, Homo sapiens
tgtgacacttgggag

SEQ ID NO: 140059 - DNA, 15 bp, Homo sapiens
gtgtgacacttggga

SEQ ID NO: 140060 - DNA, 15 bp, Homo sapiens
tgtgtgacacttggg

SEQ ID NO: 140061 - DNA, 15 bp, Homo sapiens
gtgtgtgacacttgg

SEQ ID NO: 140062 - DNA, 15 bp, Homo sapiens
agtgtgtgacacttg

SEQ ID NO: 140063 - DNA, 15 bp, Homo sapiens
cagtgtgtgacactt

SEQ ID NO: 140064 - DNA, 15 bp, Homo sapiens
acagtgtgtgacact

SEQ ID NO: 140065 - DNA, 15 bp, Homo sapiens
aacagtgtgtgacac

SEQ ID NO: 140066 - DNA, 15 bp, Homo sapiens
taacagtgtgtgaca

SEQ ID NO: 140067 - DNA, 15 bp, Homo sapiens
ttaacagtgtgtgac

SEQ ID NO: 140068 - DNA, 15 bp, Homo sapiens
tttaacagtgtgtga

SEQ ID NO: 140069 - DNA, 15 bp, Homo sapiens
gtttaacagtgtgtg

SEQ ID NO: 140070 - DNA, 15 bp, Homo sapiens
ggtttaacagtgtgt

SEQ ID NO: 140071 - DNA, 15 bp, Homo sapiens
tggtttaacagtgtg

SEQ ID NO: 140072 - DNA, 15 bp, Homo sapiens
atggtttaacagtgt

SEQ ID NO: 140073 - DNA, 15 bp, Homo sapiens
gatggtttaacagtg

SEQ ID NO: 140074 - DNA, 15 bp, Homo sapiens
agatggtttaacagt

SEQ ID NO: 140075 - DNA, 15 bp, Homo sapiens
cagatggtttaacag

SEQ ID NO: 140076 - DNA, 15 bp, Homo sapiens
tcagatggtttaaca

SEQ ID NO: 140077 - DNA, 15 bp, Homo sapiens
atcagatggtttaac

SEQ ID NO: 140078 - DNA, 15 bp, Homo sapiens
gatcagatggtttaa

SEQ ID NO: 140079 - DNA, 15 bp, Homo sapiens
agatcagatggttta

SEQ ID NO: 140080 - DNA, 15 bp, Homo sapiens
aagatcagatggttt

SEQ ID NO: 140081 - DNA, 15 bp, Homo sapiens
caagatcagatggtt

SEQ ID NO: 140082 - DNA, 15 bp, Homo sapiens
acaagatcagatggt

SEQ ID NO: 140083 - DNA, 15 bp, Homo sapiens
cacaagatcagatgg

SEQ ID NO: 140084 - DNA, 15 bp, Homo sapiens
tcacaagatcagatg

SEQ ID NO: 140085 - DNA, 15 bp, Homo sapiens
ctcacaagatcagat

SEQ ID NO: 140086 - DNA, 15 bp, Homo sapiens
tctcacaagatcaga

SEQ ID NO: 140087 - DNA, 15 bp, Homo sapiens
ttctcacaagatcag

SEQ ID NO: 140088 - DNA, 15 bp, Homo sapiens
gttctcacaagatca

SEQ ID NO: 140089 - DNA, 15 bp, Homo sapiens
agttctcacaagatc

SEQ ID NO: 140090 - DNA, 15 bp, Homo sapiens
gagttctcacaagat

SEQ ID NO: 140091 - DNA, 15 bp, Homo sapiens
tgagttctcacaaga

SEQ ID NO: 140092 - DNA, 15 bp, Homo sapiens
gtgagttctcacaag

SEQ ID NO: 140093 - DNA, 15 bp, Homo sapiens
agtgagttctcacaa

SEQ ID NO: 140094 - DNA, 15 bp, Homo sapiens
tagtgagttctcaca

SEQ ID NO: 140095 - DNA, 15 bp, Homo sapiens
atagtgagttctcac

SEQ ID NO: 140096 - DNA, 15 bp, Homo sapiens
gatagtgagttctca

SEQ ID NO: 140097 - DNA, 15 bp, Homo sapiens
tgatagtgagttctc

SEQ ID NO: 140098 - DNA, 15 bp, Homo sapiens
gtgatagtgagttct

SEQ ID NO: 140099 - DNA, 15 bp, Homo sapiens
tgtgatagtgagttc

SEQ ID NO: 140100 - DNA, 15 bp, Homo sapiens
ttgtgatagtgagtt

SEQ ID NO: 140101 - DNA, 15 bp, Homo sapiens
gtgctgttcttgtga

SEQ ID NO: 140102 - DNA, 15 bp, Homo sapiens
tgtgctgttcttgtg

SEQ ID NO: 140103 - DNA, 15 bp, Homo sapiens
ctgtgctgttcttgt

SEQ ID NO: 140104 - DNA, 15 bp, Homo sapiens
cctgtgctgttcttg

SEQ ID NO: 140105 - DNA, 15 bp, Homo sapiens
ccctgtgctgttctt

SEQ ID NO: 140106 - DNA, 15 bp, Homo sapiens
cccctgtgctgttct

SEQ ID NO: 140107 - DNA, 15 bp, Homo sapiens
tcccctgtgctgttc

SEQ ID NO: 140108 - DNA, 15 bp, Homo sapiens
ttcccctgtgctgtt

SEQ ID NO: 140109 - DNA, 15 bp, Homo sapiens
tttcccctgtgctgt

SEQ ID NO: 140110 - DNA, 15 bp, Homo sapiens
atttcccctgtgctg

SEQ ID NO: 140111 - DNA, 15 bp, Homo sapiens
aatttcccctgtgct

SEQ ID NO: 140112 - DNA, 15 bp, Homo sapiens
gaatttcccctgtgc

SEQ ID NO: 140113 - DNA, 15 bp, Homo sapiens
tgaatttcccctgtg

SEQ ID NO: 140114 - DNA, 15 bp, Homo sapiens
atgaatttcccctgt

SEQ ID NO: 140115 - DNA, 15 bp, Homo sapiens
gatgaatttcccctg

SEQ ID NO: 140116 - DNA, 15 bp, Homo sapiens
ggatgaatttcccct

SEQ ID NO: 140117 - DNA, 15 bp, Homo sapiens
gggatgaatttcccc

SEQ ID NO: 140118 - DNA, 15 bp, Homo sapiens
ggggatgaatttccc

SEQ ID NO: 140119 - DNA, 15 bp, Homo sapiens
tggggatgaatttcc

SEQ ID NO: 140120 - DNA, 15 bp, Homo sapiens
atggggatgaatttc

SEQ ID NO: 140121 - DNA, 15 bp, Homo sapiens
catggggatgaattt

SEQ ID NO: 140122 - DNA, 15 bp, Homo sapiens
tcatggggatgaatt

SEQ ID NO: 140123 - DNA, 15 bp, Homo sapiens
atcatggggatgaat

SEQ ID NO: 140124 - DNA, 15 bp, Homo sapiens
gatcatggggatgaa

SEQ ID NO: 140125 - DNA, 15 bp, Homo sapiens
ggatcatggggatga

SEQ ID NO: 140126 - DNA, 15 bp, Homo sapiens
tggatcatggggatg

SEQ ID NO: 140127 - DNA, 15 bp, Homo sapiens
ctggatcatggggat

SEQ ID NO: 140128 - DNA, 15 bp, Homo sapiens
actggatcatgggga

SEQ ID NO: 140129 - DNA, 15 bp, Homo sapiens
gactggatcatgggg

SEQ ID NO: 140130 - DNA, 15 bp, Homo sapiens
tgactggatcatggg

SEQ ID NO: 140131 - DNA, 15 bp, Homo sapiens
gtgactggatcatgg

SEQ ID NO: 140132 - DNA, 15 bp, Homo sapiens
ggtgactggatcatg

SEQ ID NO: 140133 - DNA, 15 bp, Homo sapiens
aggtgactggatcat

SEQ ID NO: 140134 - DNA, 15 bp, Homo sapiens
gaggtgactggatca

SEQ ID NO: 140135 - DNA, 15 bp, Homo sapiens
ggaggtgactggatc

SEQ ID NO: 140136 - DNA, 15 bp, Homo sapiens
gggaggtgactggat

SEQ ID NO: 140137 - DNA, 15 bp, Homo sapiens
tgggaggtgactgga

SEQ ID NO: 140138 - DNA, 15 bp, Homo sapiens
gtgggaggtgactgg

SEQ ID NO: 140139 - DNA, 15 bp, Homo sapiens
ggtgggaggtgactg

SEQ ID NO: 140140 - DNA, 15 bp, Homo sapiens
tggtgggaggtgact

SEQ ID NO: 140141 - DNA, 15 bp, Homo sapiens
ctggtgggaggtgac

SEQ ID NO: 140142 - DNA, 15 bp, Homo sapiens
cctggtgggaggtga

SEQ ID NO: 140143 - DNA, 15 bp, Homo sapiens
gcctggtgggaggtg

SEQ ID NO: 140144 - DNA, 15 bp, Homo sapiens
agcctggtgggaggt

SEQ ID NO: 140145 - DNA, 15 bp, Homo sapiens
gagcctggtgggagg

SEQ ID NO: 140146 - DNA, 15 bp, Homo sapiens
ggagcctggtgggag

SEQ ID NO: 140147 - DNA, 15 bp, Homo sapiens
aggagcctggtggga

SEQ ID NO: 140148 - DNA, 15 bp, Homo sapiens
gaggagcctggtggg

SEQ ID NO: 140149 - DNA, 15 bp, Homo sapiens
ggaggagcctggtgg

SEQ ID NO: 140150 - DNA, 15 bp, Homo sapiens
aggaggagcctggtg

SEQ ID NO: 140151 - DNA, 15 bp, Homo sapiens
aaggaggagcctggt

SEQ ID NO: 140152 - DNA, 15 bp, Homo sapiens
gaaggaggagcctgg

SEQ ID NO: 140153 - DNA, 15 bp, Homo sapiens
cgaaggaggagcctg

SEQ ID NO: 140154 - DNA, 15 bp, Homo sapiens
tcgaaggaggagcct

SEQ ID NO: 140155 - DNA, 15 bp, Homo sapiens
atcgaaggaggagcc

SEQ ID NO: 140156 - DNA, 15 bp, Homo sapiens
aatcgaaggaggagc

SEQ ID NO: 140157 - DNA, 15 bp, Homo sapiens
caatcgaaggaggag

SEQ ID NO: 140158 - DNA, 15 bp, Homo sapiens
ccaatcgaaggagga

SEQ ID NO: 140159 - DNA, 15 bp, Homo sapiens
tccaatcgaaggagg

SEQ ID NO: 140160 - DNA, 15 bp, Homo sapiens
gtccaatcgaaggag

SEQ ID NO: 140161 - DNA, 15 bp, Homo sapiens
tgtccaatcgaagga

SEQ ID NO: 140162 - DNA, 15 bp, Homo sapiens
atgtccaatcgaagg

SEQ ID NO: 140163 - DNA, 15 bp, Homo sapiens
catgtccaatcgaag

SEQ ID NO: 140164 - DNA, 15 bp, Homo sapiens
tcatgtccaatcgaa

SEQ ID NO: 140165 - DNA, 15 bp, Homo sapiens
ctcatgtccaatcga

SEQ ID NO: 140166 - DNA, 15 bp, Homo sapiens
tctcatgtccaatcg

SEQ ID NO: 140167 - DNA, 15 bp, Homo sapiens
atctcatgtccaatc

SEQ ID NO: 140168 - DNA, 15 bp, Homo sapiens
aatctcatgtccaat

SEQ ID NO: 140169 - DNA, 15 bp, Homo sapiens
aaatctcatgtccaa

SEQ ID NO: 140170 - DNA, 15 bp, Homo sapiens
caaatctcatgtcca

SEQ ID NO: 140171 - DNA, 15 bp, Homo sapiens
ccaaatctcatgtcc

SEQ ID NO: 140172 - DNA, 15 bp, Homo sapiens
cccaaatctcatgtc

SEQ ID NO: 140173 - DNA, 15 bp, Homo sapiens
acccaaatctcatgt

SEQ ID NO: 140174 - DNA, 15 bp, Homo sapiens
cacccaaatctcatg

SEQ ID NO: 140175 - DNA, 15 bp, Homo sapiens
tttgtgtccccaccc

SEQ ID NO: 140176 - DNA, 15 bp, Homo sapiens
atttgtgtccccacc

SEQ ID NO: 140177 - DNA, 15 bp, Homo sapiens
gatttgtgtccccac

SEQ ID NO: 140178 - DNA, 15 bp, Homo sapiens
ggatttgtgtcccca

SEQ ID NO: 140179 - DNA, 15 bp, Homo sapiens
tggatttgtgtcccc

SEQ ID NO: 140180 - DNA, 15 bp, Homo sapiens
ttggatttgtgtccc

SEQ ID NO: 140181 - DNA, 15 bp, Homo sapiens
tttggatttgtgtcc

SEQ ID NO: 140182 - DNA, 15 bp, Homo sapiens
gtttggatttgtgtc

SEQ ID NO: 140183 - DNA, 15 bp, Homo sapiens
ggtttggatttgtgt

SEQ ID NO: 140184 - DNA, 15 bp, Homo sapiens
tggtttggatttgtg

SEQ ID NO: 140185 - DNA, 15 bp, Homo sapiens
atggtttggatttgt

SEQ ID NO: 140186 - DNA, 15 bp, Homo sapiens
tatggtttggatttg

SEQ ID NO: 140187 - DNA, 15 bp, Homo sapiens
atatggtttggattt

SEQ ID NO: 140188 - DNA, 15 bp, Homo sapiens
aatatggtttggatt

SEQ ID NO: 140189 - DNA, 15 bp, Homo sapiens
taatatggtttggat

SEQ ID NO: 140190 - DNA, 15 bp, Homo sapiens
gtaatatggtttgga

SEQ ID NO: 140191 - DNA, 15 bp, Homo sapiens
agtaatatggtttgg

SEQ ID NO: 140192 - DNA, 15 bp, Homo sapiens
aagtaatatggtttg

SEQ ID NO: 140193 - DNA, 15 bp, Homo sapiens
taagtaatatggttt

SEQ ID NO: 140194 - DNA, 15 bp, Homo sapiens
gtaagtaatatggtt

SEQ ID NO: 140195 - DNA, 15 bp, Homo sapiens
agtaagtaatatggt

SEQ ID NO: 140196 - DNA, 15 bp, Homo sapiens
aagtaagtaatatgg

SEQ ID NO: 140197 - DNA, 15 bp, Homo sapiens
taagtaagtaatatg

SEQ ID NO: 140198 - DNA, 15 bp, Homo sapiens
gtaagtaagtaatat

SEQ ID NO: 140199 - DNA, 15 bp, Homo sapiens
ggtaagtaagtaata

SEQ ID NO: 140200 - DNA, 15 bp, Homo sapiens
gggtaagtaagtaat

SEQ ID NO: 140201 - DNA, 15 bp, Homo sapiens
agggtaagtaagtaa

SEQ ID NO: 140202 - DNA, 15 bp, Homo sapiens
cagggtaagtaagta

SEQ ID NO: 140203 - DNA, 15 bp, Homo sapiens
tcagggtaagtaagt

SEQ ID NO: 140204 - DNA, 15 bp, Homo sapiens
ttcagggtaagtaag

SEQ ID NO: 140205 - DNA, 15 bp, Homo sapiens
cttcagggtaagtaa

SEQ ID NO: 140206 - DNA, 15 bp, Homo sapiens
ccttcagggtaagta

SEQ ID NO: 140207 - DNA, 15 bp, Homo sapiens
accttcagggtaagt

SEQ ID NO: 140208 - DNA, 15 bp, Homo sapiens
aaccttcagggtaag

SEQ ID NO: 140209 - DNA, 15 bp, Homo sapiens
taaccttcagggtaa

SEQ ID NO: 140210 - DNA, 15 bp, Homo sapiens
ataaccttcagggta

SEQ ID NO: 140211 - DNA, 15 bp, Homo sapiens
aataaccttcagggt

SEQ ID NO: 140212 - DNA, 15 bp, Homo sapiens
aaataaccttcaggg

SEQ ID NO: 140213 - DNA, 15 bp, Homo sapiens
aaaataaccttcagg

SEQ ID NO: 140214 - DNA, 15 bp, Homo sapiens
aaaaataaccttcag

SEQ ID NO: 140215 - DNA, 15 bp, Homo sapiens
taaaaataaccttca

SEQ ID NO: 140216 - DNA, 15 bp, Homo sapiens
ataaaaataaccttc

SEQ ID NO: 140217 - DNA, 15 bp, Homo sapiens
aataaaaataacctt

SEQ ID NO: 140218 - DNA, 15 bp, Homo sapiens
taataaaaataacct

SEQ ID NO: 140219 - DNA, 15 bp, Homo sapiens
ttaataaaaataacc

SEQ ID NO: 140220 - DNA, 15 bp, Homo sapiens
attaataaaaataac

SEQ ID NO: 140221 - DNA, 15 bp, Homo sapiens
tattaataaaaataa

SEQ ID NO: 140222 - DNA, 15 bp, Homo sapiens
ttattaataaaaata

SEQ ID NO: 140223 - DNA, 15 bp, Homo sapiens
cttattaataaaaat

SEQ ID NO: 140224 - DNA, 15 bp, Homo sapiens
acttattaataaaaa

SEQ ID NO: 140225 - DNA, 15 bp, Homo sapiens
aacttattaataaaa

SEQ ID NO: 140226 - DNA, 15 bp, Homo sapiens
aaacttattaataaa

SEQ ID NO: 140227 - DNA, 15 bp, Homo sapiens
aaaacttattaataa

SEQ ID NO: 140228 - DNA, 15 bp, Homo sapiens
aaaaacttattaata

SEQ ID NO: 140229 - DNA, 15 bp, Homo sapiens
gaaaaacttattaat

SEQ ID NO: 140230 - DNA, 15 bp, Homo sapiens
ggaaaaacttattaa

SEQ ID NO: 140231 - DNA, 15 bp, Homo sapiens
tggaaaaacttatta

SEQ ID NO: 140232 - DNA, 15 bp, Homo sapiens
ttggaaaaacttatt

SEQ ID NO: 140233 - DNA, 15 bp, Homo sapiens
cttggaaaaacttat

SEQ ID NO: 140234 - DNA, 15 bp, Homo sapiens
tcttggaaaaactta

SEQ ID NO: 140235 - DNA, 15 bp, Homo sapiens
gtcttggaaaaactt

SEQ ID NO: 140236 - DNA, 15 bp, Homo sapiens
agtcttggaaaaact

SEQ ID NO: 140237 - DNA, 15 bp, Homo sapiens
aagtcttggaaaaac

SEQ ID NO: 140238 - DNA, 15 bp, Homo sapiens
aaagtcttggaaaaa

SEQ ID NO: 140239 - DNA, 15 bp, Homo sapiens
gaaagtcttggaaaa

SEQ ID NO: 140240 - DNA, 15 bp, Homo sapiens
tgaaagtcttggaaa

SEQ ID NO: 140241 - DNA, 15 bp, Homo sapiens
atgaaagtcttggaa

SEQ ID NO: 140242 - DNA, 15 bp, Homo sapiens
aatgaaagtcttgga

SEQ ID NO: 140243 - DNA, 15 bp, Homo sapiens
aaatgaaagtcttgg

SEQ ID NO: 140244 - DNA, 15 bp, Homo sapiens
caaatgaaagtcttg

SEQ ID NO: 140245 - DNA, 15 bp, Homo sapiens
tcaaatgaaagtctt

SEQ ID NO: 140246 - DNA, 15 bp, Homo sapiens
ctcaaatgaaagtct

SEQ ID NO: 140247 - DNA, 15 bp, Homo sapiens
cctcaaatgaaagtc

SEQ ID NO: 140248 - DNA, 15 bp, Homo sapiens
tcctcaaatgaaagt

SEQ ID NO: 140249 - DNA, 15 bp, Homo sapiens
gtcctcaaatgaaag

SEQ ID NO: 140250 - DNA, 15 bp, Homo sapiens
agtcctcaaatgaaa

SEQ ID NO: 140251 - DNA, 15 bp, Homo sapiens
tagtcctcaaatgaa

SEQ ID NO: 140252 - DNA, 15 bp, Homo sapiens
gtagtcctcaaatga

SEQ ID NO: 140253 - DNA, 15 bp, Homo sapiens
agtagtcctcaaatg

SEQ ID NO: 140254 - DNA, 15 bp, Homo sapiens
tagtagtcctcaaat

SEQ ID NO: 140255 - DNA, 15 bp, Homo sapiens
atagtagtcctcaaa

SEQ ID NO: 140256 - DNA, 15 bp, Homo sapiens
tatagtagtcctcaa

SEQ ID NO: 140257 - DNA, 15 bp, Homo sapiens
ctatagtagtcctca

SEQ ID NO: 140258 - DNA, 15 bp, Homo sapiens
actatagtagtcctc

SEQ ID NO: 140259 - DNA, 15 bp, Homo sapiens
cactatagtagtcct

SEQ ID NO: 140260 - DNA, 15 bp, Homo sapiens
tcactatagtagtcc

SEQ ID NO: 140261 - DNA, 15 bp, Homo sapiens
ttcactatagtagtc

SEQ ID NO: 140262 - DNA, 15 bp, Homo sapiens
gttcactatagtagt

SEQ ID NO: 140263 - DNA, 15 bp, Homo sapiens
tgttcactatagtag

SEQ ID NO: 140264 - DNA, 15 bp, Homo sapiens
ttgttcactatagta

SEQ ID NO: 140265 - DNA, 15 bp, Homo sapiens
tttgttcactatagt

SEQ ID NO: 140266 - DNA, 15 bp, Homo sapiens
atttgttcactatag

SEQ ID NO: 140267 - DNA, 15 bp, Homo sapiens
gatttgttcactata

SEQ ID NO: 140268 - DNA, 15 bp, Homo sapiens
tgatttgttcactat

SEQ ID NO: 140269 - DNA, 15 bp, Homo sapiens
ctgatttgttcacta

SEQ ID NO: 140270 - DNA, 15 bp, Homo sapiens
tctgatttgttcact

SEQ ID NO: 140271 - DNA, 15 bp, Homo sapiens
atctgatttgttcac

SEQ ID NO: 140272 - DNA, 15 bp, Homo sapiens
tatctgatttgttca

SEQ ID NO: 140273 - DNA, 15 bp, Homo sapiens
ttatctgatttgttc

SEQ ID NO: 140274 - DNA, 15 bp, Homo sapiens
cttatctgatttgtt

SEQ ID NO: 140275 - DNA, 15 bp, Homo sapiens
acttatctgatttgt

SEQ ID NO: 140276 - DNA, 15 bp, Homo sapiens
tacttatctgatttg

SEQ ID NO: 140277 - DNA, 15 bp, Homo sapiens
ttacttatctgattt

SEQ ID NO: 140278 - DNA, 15 bp, Homo sapiens
cttacttatctgatt

SEQ ID NO: 140279 - DNA, 15 bp, Homo sapiens
acttacttatctgat

SEQ ID NO: 140280 - DNA, 15 bp, Homo sapiens
aacttacttatctga

SEQ ID NO: 140281 - DNA, 15 bp, Homo sapiens
aaacttacttatctg

SEQ ID NO: 140282 - DNA, 15 bp, Homo sapiens
taaacttacttatct

SEQ ID NO: 140283 - DNA, 15 bp, Homo sapiens
ctaaacttacttatc

SEQ ID NO: 140284 - DNA, 15 bp, Homo sapiens
actaaacttacttat

SEQ ID NO: 140285 - DNA, 15 bp, Homo sapiens
aactaaacttactta

SEQ ID NO: 140286 - DNA, 15 bp, Homo sapiens
aaactaaacttactt

SEQ ID NO: 140287 - DNA, 15 bp, Homo sapiens
gaaactaaacttact

SEQ ID NO: 140288 - DNA, 15 bp, Homo sapiens
ggaaactaaacttac

SEQ ID NO: 140289 - DNA, 15 bp, Homo sapiens
aggaaactaaactta

SEQ ID NO: 140290 - DNA, 15 bp, Homo sapiens
aaggaaactaaactt

SEQ ID NO: 140291 - DNA, 15 bp, Homo sapiens
aaaggaaactaaact

SEQ ID NO: 140292 - DNA, 15 bp, Homo sapiens
taaaggaaactaaac

SEQ ID NO: 140293 - DNA, 15 bp, Homo sapiens
ttaaaggaaactaaa

SEQ ID NO: 140294 - DNA, 15 bp, Homo sapiens
attaaaggaaactaa

SEQ ID NO: 140295 - DNA, 15 bp, Homo sapiens
cattaaaggaaacta

SEQ ID NO: 140296 - DNA, 15 bp, Homo sapiens
tcattaaaggaaact

SEQ ID NO: 140297 - DNA, 15 bp, Homo sapiens
gtcattaaaggaaac

SEQ ID NO: 140298 - DNA, 15 bp, Homo sapiens
agtcattaaaggaaa

SEQ ID NO: 140299 - DNA, 15 bp, Homo sapiens
aagtcattaaaggaa

SEQ ID NO: 140300 - DNA, 15 bp, Homo sapiens
aaagtcattaaagga

SEQ ID NO: 140301 - DNA, 15 bp, Homo sapiens
aaaagtcattaaagg

SEQ ID NO: 140302 - DNA, 15 bp, Homo sapiens
aaaaagtcattaaag

SEQ ID NO: 140303 - DNA, 15 bp, Homo sapiens
taaaaagtcattaaa

SEQ ID NO: 140304 - DNA, 15 bp, Homo sapiens
ttaaaaagtcattaa

SEQ ID NO: 140305 - DNA, 15 bp, Homo sapiens
gttaaaaagtcatta

SEQ ID NO: 140306 - DNA, 15 bp, Homo sapiens
ggttaaaaagtcatt

SEQ ID NO: 140307 - DNA, 15 bp, Homo sapiens
tggttaaaaagtcat

SEQ ID NO: 140308 - DNA, 15 bp, Homo sapiens
ttggttaaaaagtca

SEQ ID NO: 140309 - DNA, 15 bp, Homo sapiens
tttggttaaaaagtc

SEQ ID NO: 140310 - DNA, 15 bp, Homo sapiens
gtttggttaaaaagt

SEQ ID NO: 140311 - DNA, 15 bp, Homo sapiens
agtttggttaaaaag

SEQ ID NO: 140312 - DNA, 15 bp, Homo sapiens
cagtttggttaaaaa

SEQ ID NO: 140313 - DNA, 15 bp, Homo sapiens
acagtttggttaaaa

SEQ ID NO: 140314 - DNA, 15 bp, Homo sapiens
aacagtttggttaaa

SEQ ID NO: 140315 - DNA, 15 bp, Homo sapiens
aaacagtttggttaa

SEQ ID NO: 140316 - DNA, 15 bp, Homo sapiens
aaaacagtttggtta

SEQ ID NO: 140317 - DNA, 15 bp, Homo sapiens
taaaacagtttggtt

SEQ ID NO: 140318 - DNA, 15 bp, Homo sapiens
ataaaacagtttggt

SEQ ID NO: 140319 - DNA, 15 bp, Homo sapiens
gataaaacagtttgg

SEQ ID NO: 140320 - DNA, 15 bp, Homo sapiens
tgataaaacagtttg

SEQ ID NO: 140321 - DNA, 15 bp, Homo sapiens
ttgataaaacagttt

SEQ ID NO: 140322 - DNA, 15 bp, Homo sapiens
attgataaaacagtt

SEQ ID NO: 140323 - DNA, 15 bp, Homo sapiens
aattgataaaacagt

SEQ ID NO: 140324 - DNA, 15 bp, Homo sapiens
aaattgataaaacag

SEQ ID NO: 140325 - DNA, 15 bp, Homo sapiens
gaaattgataaaaca

SEQ ID NO: 140326 - DNA, 15 bp, Homo sapiens
cgaaattgataaaac

SEQ ID NO: 140327 - DNA, 15 bp, Homo sapiens
tacgaaattgataaa

SEQ ID NO: 140328 - DNA, 15 bp, Homo sapiens
ttacgaaattgataa

SEQ ID NO: 140329 - DNA, 15 bp, Homo sapiens
attacgaaattgata

SEQ ID NO: 140330 - DNA, 15 bp, Homo sapiens
tattacgaaattgat

SEQ ID NO: 140331 - DNA, 15 bp, Homo sapiens
ctattacgaaattga

SEQ ID NO: 140332 - DNA, 15 bp, Homo sapiens
gctattacgaaattg

SEQ ID NO: 140333 - DNA, 15 bp, Homo sapiens
tgctattacgaaatt

SEQ ID NO: 140334 - DNA, 15 bp, Homo sapiens
ctgctattacgaaat

SEQ ID NO: 140335 - DNA, 15 bp, Homo sapiens
tctgctattacgaaa

SEQ ID NO: 140336 - DNA, 15 bp, Homo sapiens
gtctgctattacgaa

SEQ ID NO: 140337 - DNA, 15 bp, Homo sapiens
tgtctgctattacga

SEQ ID NO: 140338 - DNA, 15 bp, Homo sapiens
atgtctgctattacg

SEQ ID NO: 140339 - DNA, 15 bp, Homo sapiens
gatgtctgctattac

SEQ ID NO: 140340 - DNA, 15 bp, Homo sapiens
agatgtctgctatta

SEQ ID NO: 140341 - DNA, 15 bp, Homo sapiens
aagatgtctgctatt

SEQ ID NO: 140342 - DNA, 15 bp, Homo sapiens
aaagatgtctgctat

SEQ ID NO: 140343 - DNA, 15 bp, Homo sapiens
aaaagatgtctgcta

SEQ ID NO: 140344 - DNA, 15 bp, Homo sapiens
aaaaagatgtctgct

SEQ ID NO: 140345 - DNA, 15 bp, Homo sapiens
aaaaaagatgtctgc

SEQ ID NO: 140346 - DNA, 15 bp, Homo sapiens
caaaaaagatgtctg

SEQ ID NO: 140347 - DNA, 15 bp, Homo sapiens
acaaaaaagatgtct

SEQ ID NO: 140348 - DNA, 15 bp, Homo sapiens
gacaaaaaagatgtc

SEQ ID NO: 140349 - DNA, 15 bp, Homo sapiens
tgacaaaaaagatgt

SEQ ID NO: 140350 - DNA, 15 bp, Homo sapiens
atgacaaaaaagatg

SEQ ID NO: 140351 - DNA, 15 bp, Homo sapiens
gatgacaaaaaagat

SEQ ID NO: 140352 - DNA, 15 bp, Homo sapiens
tgatgacaaaaaaga

SEQ ID NO: 140353 - DNA, 15 bp, Homo sapiens
ctgatgacaaaaaag

SEQ ID NO: 140354 - DNA, 15 bp, Homo sapiens
actgatgacaaaaaa

SEQ ID NO: 140355 - DNA, 15 bp, Homo sapiens
aactgatgacaaaaa

SEQ ID NO: 140356 - DNA, 15 bp, Homo sapiens
gaactgatgacaaaa

SEQ ID NO: 140357 - DNA, 15 bp, Homo sapiens
tgaactgatgacaaa

SEQ ID NO: 140358 - DNA, 15 bp, Homo sapiens
ctgaactgatgacaa

SEQ ID NO: 140359 - DNA, 15 bp, Homo sapiens
actgaactgatgaca

SEQ ID NO: 140360 - DNA, 15 bp, Homo sapiens
aactgaactgatgac

SEQ ID NO: 140361 - DNA, 15 bp, Homo sapiens
taactgaactgatga

SEQ ID NO: 140362 - DNA, 15 bp, Homo sapiens
ataactgaactgatg

SEQ ID NO: 140363 - DNA, 15 bp, Homo sapiens
tataactgaactgat

SEQ ID NO: 140364 - DNA, 15 bp, Homo sapiens
ctataactgaactga

SEQ ID NO: 140365 - DNA, 15 bp, Homo sapiens
tctataactgaactg

SEQ ID NO: 140366 - DNA, 15 bp, Homo sapiens
ctctataactgaact

SEQ ID NO: 140367 - DNA, 15 bp, Homo sapiens
actctataactgaac

SEQ ID NO: 140368 - DNA, 15 bp, Homo sapiens
aactctataactgaa

SEQ ID NO: 140369 - DNA, 15 bp, Homo sapiens
caactctataactga

SEQ ID NO: 140370 - DNA, 15 bp, Homo sapiens
tcaactctataactg

SEQ ID NO: 140371 - DNA, 15 bp, Homo sapiens
atcaactctataact

SEQ ID NO: 140372 - DNA, 15 bp, Homo sapiens
tatcaactctataac

SEQ ID NO: 140373 - DNA, 15 bp, Homo sapiens
ttatcaactctataa

SEQ ID NO: 140374 - DNA, 15 bp, Homo sapiens
attatcaactctata

SEQ ID NO: 140375 - DNA, 15 bp, Homo sapiens
tattatcaactctat

SEQ ID NO: 140376 - DNA, 15 bp, Homo sapiens
atattatcaactcta

SEQ ID NO: 140377 - DNA, 15 bp, Homo sapiens
aatattatcaactct

SEQ ID NO: 140378 - DNA, 15 bp, Homo sapiens
caatattatcaactc

SEQ ID NO: 140379 - DNA, 15 bp, Homo sapiens
tcaatattatcaact

SEQ ID NO: 140380 - DNA, 15 bp, Homo sapiens
ttcaatattatcaac

SEQ ID NO: 140381 - DNA, 15 bp, Homo sapiens
gttcaatattatcaa

SEQ ID NO: 140382 - DNA, 15 bp, Homo sapiens
tgttcaatattatca

SEQ ID NO: 140383 - DNA, 15 bp, Homo sapiens
ttgttcaatattatc

SEQ ID NO: 140384 - DNA, 15 bp, Homo sapiens
gttgttcaatattat

SEQ ID NO: 140385 - DNA, 15 bp, Homo sapiens
agttgttcaatatta

SEQ ID NO: 140386 - DNA, 15 bp, Homo sapiens
tagttgttcaatatt

SEQ ID NO: 140387 - DNA, 15 bp, Homo sapiens
atagttgttcaatat

SEQ ID NO: 140388 - DNA, 15 bp, Homo sapiens
catagttgttcaata

SEQ ID NO: 140389 - DNA, 15 bp, Homo sapiens
ccatagttgttcaat

SEQ ID NO: 140390 - DNA, 15 bp, Homo sapiens
accatagttgttcaa

SEQ ID NO: 140391 - DNA, 15 bp, Homo sapiens
taccatagttgttca

SEQ ID NO: 140392 - DNA, 15 bp, Homo sapiens
ataccatagttgttc

SEQ ID NO: 140393 - DNA, 15 bp, Homo sapiens
aataccatagttgtt

SEQ ID NO: 140394 - DNA, 15 bp, Homo sapiens
aaataccatagttgt

SEQ ID NO: 140395 - DNA, 15 bp, Homo sapiens
aaaataccatagttg

SEQ ID NO: 140396 - DNA, 15 bp, Homo sapiens
aaaaataccatagtt

SEQ ID NO: 140397 - DNA, 15 bp, Homo sapiens
taaaaataccatagt

SEQ ID NO: 140398 - DNA, 15 bp, Homo sapiens
ttaaaaataccatag

SEQ ID NO: 140399 - DNA, 15 bp, Homo sapiens
tttaaaaataccata

SEQ ID NO: 140400 - DNA, 15 bp, Homo sapiens
ttttaaaaataccat

SEQ ID NO: 140401 - DNA, 15 bp, Homo sapiens
cttttaaaaatacca

SEQ ID NO: 140402 - DNA, 15 bp, Homo sapiens
acttttaaaaatacc

SEQ ID NO: 140403 - DNA, 15 bp, Homo sapiens
cacttttaaaaatac

SEQ ID NO: 140404 - DNA, 15 bp, Homo sapiens
gcacttttaaaaata

SEQ ID NO: 140405 - DNA, 15 bp, Homo sapiens
agcacttttaaaaat

SEQ ID NO: 140406 - DNA, 15 bp, Homo sapiens
aagcacttttaaaaa

SEQ ID NO: 140407 - DNA, 15 bp, Homo sapiens
aaagcacttttaaaa

SEQ ID NO: 140408 - DNA, 15 bp, Homo sapiens
aaaagcacttttaaa

SEQ ID NO: 140409 - DNA, 15 bp, Homo sapiens
taaaagcacttttaa

SEQ ID NO: 140410 - DNA, 15 bp, Homo sapiens
ttaaaagcactttta

SEQ ID NO: 140411 - DNA, 15 bp, Homo sapiens
cttaaaagcactttt

SEQ ID NO: 140412 - DNA, 15 bp, Homo sapiens
tcttaaaagcacttt

SEQ ID NO: 140413 - DNA, 15 bp, Homo sapiens
atcttaaaagcactt

SEQ ID NO: 140414 - DNA, 15 bp, Homo sapiens
aatcttaaaagcact

SEQ ID NO: 140415 - DNA, 15 bp, Homo sapiens
gaatcttaaaagcac

SEQ ID NO: 140416 - DNA, 15 bp, Homo sapiens
agaatcttaaaagca

SEQ ID NO: 140417 - DNA, 15 bp, Homo sapiens
gagaatcttaaaagc

SEQ ID NO: 140418 - DNA, 15 bp, Homo sapiens
agagaatcttaaaag

SEQ ID NO: 140419 - DNA, 15 bp, Homo sapiens
cagagaatcttaaaa

SEQ ID NO: 140420 - DNA, 15 bp, Homo sapiens
acagagaatcttaaa

SEQ ID NO: 140421 - DNA, 15 bp, Homo sapiens
tacagagaatcttaa

SEQ ID NO: 140422 - DNA, 15 bp, Homo sapiens
atacagagaatctta

SEQ ID NO: 140423 - DNA, 15 bp, Homo sapiens
tatacagagaatctt

SEQ ID NO: 140424 - DNA, 15 bp, Homo sapiens
ttatacagagaatct

SEQ ID NO: 140425 - DNA, 15 bp, Homo sapiens
tttatacagagaatc

SEQ ID NO: 140426 - DNA, 15 bp, Homo sapiens
ttttatacagagaat

SEQ ID NO: 140427 - DNA, 15 bp, Homo sapiens
attttatacagagaa

SEQ ID NO: 140428 - DNA, 15 bp, Homo sapiens
aattttatacagaga

SEQ ID NO: 140429 - DNA, 15 bp, Homo sapiens
taattttatacagag

SEQ ID NO: 140430 - DNA, 15 bp, Homo sapiens
ataattttatacaga

SEQ ID NO: 140431 - DNA, 15 bp, Homo sapiens
tataattttatacag

SEQ ID NO: 140432 - DNA, 15 bp, Homo sapiens
ttataattttataca

SEQ ID NO: 140433 - DNA, 15 bp, Homo sapiens
tttataattttatac

SEQ ID NO: 140434 - DNA, 15 bp, Homo sapiens
ttttataattttata

SEQ ID NO: 140435 - DNA, 15 bp, Homo sapiens
attttataattttat

SEQ ID NO: 140436 - DNA, 15 bp, Homo sapiens
tattttataatttta

SEQ ID NO: 140437 - DNA, 15 bp, Homo sapiens
atattttataatttt

SEQ ID NO: 140438 - DNA, 15 bp, Homo sapiens
aatattttataattt

SEQ ID NO: 140439 - DNA, 15 bp, Homo sapiens
gaatattttataatt

SEQ ID NO: 140440 - DNA, 15 bp, Homo sapiens
agaatattttataat

SEQ ID NO: 140441 - DNA, 15 bp, Homo sapiens
aagaatattttataa

SEQ ID NO: 140442 - DNA, 15 bp, Homo sapiens
caagaatattttata

SEQ ID NO: 140443 - DNA, 15 bp, Homo sapiens
tcaagaatattttat

SEQ ID NO: 140444 - DNA, 15 bp, Homo sapiens
ttcaagaatatttta

SEQ ID NO: 140445 - DNA, 15 bp, Homo sapiens
attcaagaatatttt

SEQ ID NO: 140446 - DNA, 15 bp, Homo sapiens
aattcaagaatattt

SEQ ID NO: 140447 - DNA, 15 bp, Homo sapiens
caattcaagaatatt

SEQ ID NO: 140448 - DNA, 15 bp, Homo sapiens
ccaattcaagaatat

SEQ ID NO: 140449 - DNA, 15 bp, Homo sapiens
tccaattcaagaata

SEQ ID NO: 140450 - DNA, 15 bp, Homo sapiens
ctccaattcaagaat

SEQ ID NO: 140451 - DNA, 15 bp, Homo sapiens
cctccaattcaagaa

SEQ ID NO: 140452 - DNA, 15 bp, Homo sapiens
acctccaattcaaga

SEQ ID NO: 140453 - DNA, 15 bp, Homo sapiens
aacctccaattcaag

SEQ ID NO: 140454 - DNA, 15 bp, Homo sapiens
aaacctccaattcaa

SEQ ID NO: 140455 - DNA, 15 bp, Homo sapiens
aaaacctccaattca

SEQ ID NO: 140456 - DNA, 15 bp, Homo sapiens
taaaacctccaattc

SEQ ID NO: 140457 - DNA, 15 bp, Homo sapiens
ctaaaacctccaatt

SEQ ID NO: 140458 - DNA, 15 bp, Homo sapiens
actaaaacctccaat

SEQ ID NO: 140459 - DNA, 15 bp, Homo sapiens
aactaaaacctccaa

SEQ ID NO: 140460 - DNA, 15 bp, Homo sapiens
caactaaaacctcca

SEQ ID NO: 140461 - DNA, 15 bp, Homo sapiens
acaactaaaacctcc

SEQ ID NO: 140462 - DNA, 15 bp, Homo sapiens
cacaactaaaacctc

SEQ ID NO: 140463 - DNA, 15 bp, Homo sapiens
tcacaactaaaacct

SEQ ID NO: 140464 - DNA, 15 bp, Homo sapiens
ctcacaactaaaacc

SEQ ID NO: 140465 - DNA, 15 bp, Homo sapiens
cctcacaactaaaac

SEQ ID NO: 140466 - DNA, 15 bp, Homo sapiens
acctcacaactaaaa

SEQ ID NO: 140467 - DNA, 15 bp, Homo sapiens
aacctcacaactaaa

SEQ ID NO: 140468 - DNA, 15 bp, Homo sapiens
taacctcacaactaa

SEQ ID NO: 140469 - DNA, 15 bp, Homo sapiens
ataacctcacaacta

SEQ ID NO: 140470 - DNA, 15 bp, Homo sapiens
tataacctcacaact

SEQ ID NO: 140471 - DNA, 15 bp, Homo sapiens
ctataacctcacaac

SEQ ID NO: 140472 - DNA, 15 bp, Homo sapiens
actataacctcacaa

SEQ ID NO: 140473 - DNA, 15 bp, Homo sapiens
aactataacctcaca

SEQ ID NO: 140474 - DNA, 15 bp, Homo sapiens
aaactataacctcac

SEQ ID NO: 140475 - DNA, 15 bp, Homo sapiens
caaactataacctca

SEQ ID NO: 140476 - DNA, 15 bp, Homo sapiens
ccaaactataacctc

SEQ ID NO: 140477 - DNA, 15 bp, Homo sapiens
accaaactataacct

SEQ ID NO: 140478 - DNA, 15 bp, Homo sapiens
taccaaactataacc

SEQ ID NO: 140479 - DNA, 15 bp, Homo sapiens
ataccaaactataac

SEQ ID NO: 140480 - DNA, 15 bp, Homo sapiens
tataccaaactataa

SEQ ID NO: 140481 - DNA, 15 bp, Homo sapiens
ttataccaaactata

SEQ ID NO: 140482 - DNA, 15 bp, Homo sapiens
gttataccaaactat

SEQ ID NO: 140483 - DNA, 15 bp, Homo sapiens
tgttataccaaacta

SEQ ID NO: 140484 - DNA, 15 bp, Homo sapiens
atgttataccaaact

SEQ ID NO: 140485 - DNA, 15 bp, Homo sapiens
aatgttataccaaac

SEQ ID NO: 140486 - DNA, 15 bp, Homo sapiens
aaatgttataccaaa

SEQ ID NO: 140487 - DNA, 15 bp, Homo sapiens
taaatgttataccaa

SEQ ID NO: 140488 - DNA, 15 bp, Homo sapiens
ataaatgttatacca

SEQ ID NO: 140489 - DNA, 15 bp, Homo sapiens
aataaatgttatacc

SEQ ID NO: 140490 - DNA, 15 bp, Homo sapiens
aaataaatgttatac

SEQ ID NO: 140491 - DNA, 15 bp, Homo sapiens
caaataaatgttata

SEQ ID NO: 140492 - DNA, 15 bp, Homo sapiens
gcaaataaatgttat

SEQ ID NO: 140493 - DNA, 15 bp, Homo sapiens
ggcaaataaatgtta

SEQ ID NO: 140494 - DNA, 15 bp, Homo sapiens
gggcaaataaatgtt

SEQ ID NO: 140495 - DNA, 15 bp, Homo sapiens
agggcaaataaatgt

SEQ ID NO: 140496 - DNA, 15 bp, Homo sapiens
aagggcaaataaatg

SEQ ID NO: 140497 - DNA, 15 bp, Homo sapiens
gaagggcaaataaat

SEQ ID NO: 140498 - DNA, 15 bp, Homo sapiens
tgaagggcaaataaa

SEQ ID NO: 140499 - DNA, 15 bp, Homo sapiens
ctgaagggcaaataa

SEQ ID NO: 140500 - DNA, 15 bp, Homo sapiens
gctgaagggcaaata

SEQ ID NO: 140501 - DNA, 15 bp, Homo sapiens
agctgaagggcaaat

SEQ ID NO: 140502 - DNA, 15 bp, Homo sapiens
tagctgaagggcaaa

SEQ ID NO: 140503 - DNA, 15 bp, Homo sapiens
ctagctgaagggcaa

SEQ ID NO: 140504 - DNA, 15 bp, Homo sapiens
gctagctgaagggca

SEQ ID NO: 140505 - DNA, 15 bp, Homo sapiens
ggctagctgaagggc

SEQ ID NO: 140506 - DNA, 15 bp, Homo sapiens
aggctagctgaaggg

SEQ ID NO: 140507 - DNA, 15 bp, Homo sapiens
taggctagctgaagg

SEQ ID NO: 140508 - DNA, 15 bp, Homo sapiens
ttaggctagctgaag

SEQ ID NO: 140509 - DNA, 15 bp, Homo sapiens
cttaggctagctgaa

SEQ ID NO: 140510 - DNA, 15 bp, Homo sapiens
tcttaggctagctga

SEQ ID NO: 140511 - DNA, 15 bp, Homo sapiens
atcttaggctagctg

SEQ ID NO: 140512 - DNA, 15 bp, Homo sapiens
catcttaggctagct

SEQ ID NO: 140513 - DNA, 15 bp, Homo sapiens
ccatcttaggctagc

SEQ ID NO: 140514 - DNA, 15 bp, Homo sapiens
tccatcttaggctag

SEQ ID NO: 140515 - DNA, 15 bp, Homo sapiens
ttccatcttaggcta

SEQ ID NO: 140516 - DNA, 15 bp, Homo sapiens
cttccatcttaggct

SEQ ID NO: 140517 - DNA, 15 bp, Homo sapiens
acttccatcttaggc

SEQ ID NO: 140518 - DNA, 15 bp, Homo sapiens
cacttccatcttagg

SEQ ID NO: 140519 - DNA, 15 bp, Homo sapiens
acacttccatcttag

SEQ ID NO: 140520 - DNA, 15 bp, Homo sapiens
tacacttccatctta

SEQ ID NO: 140521 - DNA, 15 bp, Homo sapiens
atacacttccatctt

SEQ ID NO: 140522 - DNA, 15 bp, Homo sapiens
tatacacttccatct

SEQ ID NO: 140523 - DNA, 15 bp, Homo sapiens
atatacacttccatc

SEQ ID NO: 140524 - DNA, 15 bp, Homo sapiens
aatatacacttccat

SEQ ID NO: 140525 - DNA, 15 bp, Homo sapiens
aaatatacacttcca

SEQ ID NO: 140526 - DNA, 15 bp, Homo sapiens
caaatatacacttcc

SEQ ID NO: 140527 - DNA, 15 bp, Homo sapiens
acaaatatacacttc

SEQ ID NO: 140528 - DNA, 15 bp, Homo sapiens
cacaaatatacactt

SEQ ID NO: 140529 - DNA, 15 bp, Homo sapiens
tcacaaatatacact

SEQ ID NO: 140530 - DNA, 15 bp, Homo sapiens
ttcacaaatatacac

SEQ ID NO: 140531 - DNA, 15 bp, Homo sapiens
cttcacaaatataca

SEQ ID NO: 140532 - DNA, 15 bp, Homo sapiens
tcttcacaaatatac

SEQ ID NO: 140533 - DNA, 15 bp, Homo sapiens
ttcttcacaaatata

SEQ ID NO: 140534 - DNA, 15 bp, Homo sapiens
attcttcacaaatat

SEQ ID NO: 140535 - DNA, 15 bp, Homo sapiens
aattcttcacaaata

SEQ ID NO: 140536 - DNA, 15 bp, Homo sapiens
aaattcttcacaaat

SEQ ID NO: 140537 - DNA, 15 bp, Homo sapiens
taaattcttcacaaa

SEQ ID NO: 140538 - DNA, 15 bp, Homo sapiens
ttaaattcttcacaa

SEQ ID NO: 140539 - DNA, 15 bp, Homo sapiens
cttaaattcttcaca

SEQ ID NO: 140540 - DNA, 15 bp, Homo sapiens
tcttaaattcttcac

SEQ ID NO: 140541 - DNA, 15 bp, Homo sapiens
ttcttaaattcttca

SEQ ID NO: 140542 - DNA, 15 bp, Homo sapiens
tttcttaaattcttc

SEQ ID NO: 140543 - DNA, 15 bp, Homo sapiens
ctttcttaaattctt

SEQ ID NO: 140544 - DNA, 15 bp, Homo sapiens
actttcttaaattct

SEQ ID NO: 140545 - DNA, 15 bp, Homo sapiens
tactttcttaaattc

SEQ ID NO: 140546 - DNA, 15 bp, Homo sapiens
atactttcttaaatt

SEQ ID NO: 140547 - DNA, 15 bp, Homo sapiens
tatactttcttaaat

SEQ ID NO: 140548 - DNA, 15 bp, Homo sapiens
atatactttcttaaa

SEQ ID NO: 140549 - DNA, 15 bp, Homo sapiens
catatactttcttaa

SEQ ID NO: 140550 - DNA, 15 bp, Homo sapiens
acatatactttctta

SEQ ID NO: 140551 - DNA, 15 bp, Homo sapiens
tacatatactttctt

SEQ ID NO: 140552 - DNA, 15 bp, Homo sapiens
ctacatatactttct

SEQ ID NO: 140553 - DNA, 15 bp, Homo sapiens
tctacatatactttc

SEQ ID NO: 140554 - DNA, 15 bp, Homo sapiens
ttctacatatacttt

SEQ ID NO: 140555 - DNA, 15 bp, Homo sapiens
tttctacatatactt

SEQ ID NO: 140556 - DNA, 15 bp, Homo sapiens
ttttctacatatact

SEQ ID NO: 140557 - DNA, 15 bp, Homo sapiens
gttttctacatatac

SEQ ID NO: 140558 - DNA, 15 bp, Homo sapiens
tgttttctacatata

SEQ ID NO: 140559 - DNA, 15 bp, Homo sapiens
ttgttttctacatat

SEQ ID NO: 140560 - DNA, 15 bp, Homo sapiens
attgttttctacata

SEQ ID NO: 140561 - DNA, 15 bp, Homo sapiens
gattgttttctacat

SEQ ID NO: 140562 - DNA, 15 bp, Homo sapiens
cgattgttttctaca

SEQ ID NO: 140563 - DNA, 15 bp, Homo sapiens
tcgattgttttctac

SEQ ID NO: 140564 - DNA, 15 bp, Homo sapiens
ttcgattgttttcta

SEQ ID NO: 140565 - DNA, 15 bp, Homo sapiens
tttcgattgttttct

SEQ ID NO: 140566 - DNA, 15 bp, Homo sapiens
ttttcgattgttttc

SEQ ID NO: 140567 - DNA, 15 bp, Homo sapiens
attttcgattgtttt

SEQ ID NO: 140568 - DNA, 15 bp, Homo sapiens
cattttcgattgttt

SEQ ID NO: 140569 - DNA, 15 bp, Homo sapiens
acattttcgattgtt

SEQ ID NO: 140570 - DNA, 15 bp, Homo sapiens
cacattttcgattgt

SEQ ID NO: 140571 - DNA, 15 bp, Homo sapiens
ccacattttcgattg

SEQ ID NO: 140572 - DNA, 15 bp, Homo sapiens
tccacattttcgatt

SEQ ID NO: 140573 - DNA, 15 bp, Homo sapiens
ttccacattttcgat

SEQ ID NO: 140574 - DNA, 15 bp, Homo sapiens
cttccacattttcga

SEQ ID NO: 140575 - DNA, 15 bp, Homo sapiens
acttccacattttcg

SEQ ID NO: 140576 - DNA, 15 bp, Homo sapiens
tacttccacattttc

SEQ ID NO: 140577 - DNA, 15 bp, Homo sapiens
atacttccacatttt

SEQ ID NO: 140578 - DNA, 15 bp, Homo sapiens
catacttccacattt

SEQ ID NO: 140579 - DNA, 15 bp, Homo sapiens
acatacttccacatt

SEQ ID NO: 140580 - DNA, 15 bp, Homo sapiens
aacatacttccacat

SEQ ID NO: 140581 - DNA, 15 bp, Homo sapiens
aaacatacttccaca

SEQ ID NO: 140582 - DNA, 15 bp, Homo sapiens
aaaacatacttccac

SEQ ID NO: 140583 - DNA, 15 bp, Homo sapiens
aaaaacatacttcca

SEQ ID NO: 140584 - DNA, 15 bp, Homo sapiens
taaaaacatacttcc

SEQ ID NO: 140585 - DNA, 15 bp, Homo sapiens
ataaaaacatacttc

SEQ ID NO: 140586 - DNA, 15 bp, Homo sapiens
aataaaaacatactt

SEQ ID NO: 140587 - DNA, 15 bp, Homo sapiens
gaataaaaacatact

SEQ ID NO: 140588 - DNA, 15 bp, Homo sapiens
agaataaaaacatac

SEQ ID NO: 140589 - DNA, 15 bp, Homo sapiens
gagaataaaaacata

SEQ ID NO: 140590 - DNA, 15 bp, Homo sapiens
ggagaataaaaacat

SEQ ID NO: 140591 - DNA, 15 bp, Homo sapiens
tggagaataaaaaca

SEQ ID NO: 140592 - DNA, 15 bp, Homo sapiens
gtggagaataaaaac

SEQ ID NO: 140593 - DNA, 15 bp, Homo sapiens
tgtggagaataaaaa

SEQ ID NO: 140594 - DNA, 15 bp, Homo sapiens
ttgtggagaataaaa

SEQ ID NO: 140595 - DNA, 15 bp, Homo sapiens
tttgtggagaataaa

SEQ ID NO: 140596 - DNA, 15 bp, Homo sapiens
atttgtggagaataa

SEQ ID NO: 140597 - DNA, 15 bp, Homo sapiens
catttgtggagaata

SEQ ID NO: 140598 - DNA, 15 bp, Homo sapiens
gcatttgtggagaat

SEQ ID NO: 140599 - DNA, 15 bp, Homo sapiens
tgcatttgtggagaa

SEQ ID NO: 140600 - DNA, 15 bp, Homo sapiens
ctgcatttgtggaga

SEQ ID NO: 140601 - DNA, 15 bp, Homo sapiens
tctgcatttgtggag

SEQ ID NO: 140602 - DNA, 15 bp, Homo sapiens
gtctgcatttgtgga

SEQ ID NO: 140603 - DNA, 15 bp, Homo sapiens
agtctgcatttgtgg

SEQ ID NO: 140604 - DNA, 15 bp, Homo sapiens
aagtctgcatttgtg

SEQ ID NO: 140605 - DNA, 15 bp, Homo sapiens
aaagtctgcatttgt

SEQ ID NO: 140606 - DNA, 15 bp, Homo sapiens
taaagtctgcatttg

SEQ ID NO: 140607 - DNA, 15 bp, Homo sapiens
gtaaagtctgcattt

SEQ ID NO: 140608 - DNA, 15 bp, Homo sapiens
agtaaagtctgcatt

SEQ ID NO: 140609 - DNA, 15 bp, Homo sapiens
aagtaaagtctgcat

SEQ ID NO: 140610 - DNA, 15 bp, Homo sapiens
caagtaaagtctgca

SEQ ID NO: 140611 - DNA, 15 bp, Homo sapiens
ccaagtaaagtctgc

SEQ ID NO: 140612 - DNA, 15 bp, Homo sapiens
accaagtaaagtctg

SEQ ID NO: 140613 - DNA, 15 bp, Homo sapiens
aaccaagtaaagtct

SEQ ID NO: 140614 - DNA, 15 bp, Homo sapiens
taaccaagtaaagtc

SEQ ID NO: 140615 - DNA, 15 bp, Homo sapiens
gtaaccaagtaaagt

SEQ ID NO: 140616 - DNA, 15 bp, Homo sapiens
tgtaaccaagtaaag

SEQ ID NO: 140617 - DNA, 15 bp, Homo sapiens
ctgtaaccaagtaaa

SEQ ID NO: 140618 - DNA, 15 bp, Homo sapiens
actgtaaccaagtaa

SEQ ID NO: 140619 - DNA, 15 bp, Homo sapiens
aactgtaaccaagta

SEQ ID NO: 140620 - DNA, 15 bp, Homo sapiens
aaactgtaaccaagt

SEQ ID NO: 140621 - DNA, 15 bp, Homo sapiens
aaaactgtaaccaag

SEQ ID NO: 140622 - DNA, 15 bp, Homo sapiens
taaaactgtaaccaa

SEQ ID NO: 140623 - DNA, 15 bp, Homo sapiens
ttaaaactgtaacca

SEQ ID NO: 140624 - DNA, 15 bp, Homo sapiens
tttaaaactgtaacc

SEQ ID NO: 140625 - DNA, 15 bp, Homo sapiens
ttttaaaactgtaac

SEQ ID NO: 140626 - DNA, 15 bp, Homo sapiens
cttttaaaactgtaa

SEQ ID NO: 140627 - DNA, 15 bp, Homo sapiens
gcttttaaaactgta

SEQ ID NO: 140628 - DNA, 15 bp, Homo sapiens
tgcttttaaaactgt

SEQ ID NO: 140629 - DNA, 15 bp, Homo sapiens
ttgcttttaaaactg

SEQ ID NO: 140630 - DNA, 15 bp, Homo sapiens
cttgcttttaaaact

SEQ ID NO: 140631 - DNA, 15 bp, Homo sapiens
acttgcttttaaaac

SEQ ID NO: 140632 - DNA, 15 bp, Homo sapiens
cacttgcttttaaaa

SEQ ID NO: 140633 - DNA, 15 bp, Homo sapiens
ccacttgcttttaaa

SEQ ID NO: 140634 - DNA, 15 bp, Homo sapiens
gccacttgcttttaa

SEQ ID NO: 140635 - DNA, 15 bp, Homo sapiens
ggccacttgctttta

SEQ ID NO: 140636 - DNA, 15 bp, Homo sapiens
tggccacttgctttt

SEQ ID NO: 140637 - DNA, 15 bp, Homo sapiens
ctggccacttgcttt

SEQ ID NO: 140638 - DNA, 15 bp, Homo sapiens
actggccacttgctt

SEQ ID NO: 140639 - DNA, 15 bp, Homo sapiens
aactggccacttgct

SEQ ID NO: 140640 - DNA, 15 bp, Homo sapiens
taactggccacttgc

SEQ ID NO: 140641 - DNA, 15 bp, Homo sapiens
ataactggccacttg

SEQ ID NO: 140642 - DNA, 15 bp, Homo sapiens
tataactggccactt

SEQ ID NO: 140643 - DNA, 15 bp, Homo sapiens
atataactggccact

SEQ ID NO: 140644 - DNA, 15 bp, Homo sapiens
catataactggccac

SEQ ID NO: 140645 - DNA, 15 bp, Homo sapiens
gcatataactggcca

SEQ ID NO: 140646 - DNA, 15 bp, Homo sapiens
tgcatataactggcc

SEQ ID NO: 140647 - DNA, 15 bp, Homo sapiens
atgcatataactggc

SEQ ID NO: 140648 - DNA, 15 bp, Homo sapiens
aatgcatataactgg

SEQ ID NO: 140649 - DNA, 15 bp, Homo sapiens
aaatgcatataactg

SEQ ID NO: 140650 - DNA, 15 bp, Homo sapiens
gaaatgcatataact

SEQ ID NO: 140651 - DNA, 15 bp, Homo sapiens
agaaatgcatataac

SEQ ID NO: 140652 - DNA, 15 bp, Homo sapiens
cagaaatgcatataa

SEQ ID NO: 140653 - DNA, 15 bp, Homo sapiens
ccagaaatgcatata

SEQ ID NO: 140654 - DNA, 15 bp, Homo sapiens
tccagaaatgcatat

SEQ ID NO: 140655 - DNA, 15 bp, Homo sapiens
atccagaaatgcata

SEQ ID NO: 140656 - DNA, 15 bp, Homo sapiens
gatccagaaatgcat

SEQ ID NO: 140657 - DNA, 15 bp, Homo sapiens
tgatccagaaatgca

SEQ ID NO: 140658 - DNA, 15 bp, Homo sapiens
atgatccagaaatgc

SEQ ID NO: 140659 - DNA, 15 bp, Homo sapiens
aatgatccagaaatg

SEQ ID NO: 140660 - DNA, 15 bp, Homo sapiens
gaatgatccagaaat

SEQ ID NO: 140661 - DNA, 15 bp, Homo sapiens
agaatgatccagaaa

SEQ ID NO: 140662 - DNA, 15 bp, Homo sapiens
cagaatgatccagaa

SEQ ID NO: 140663 - DNA, 15 bp, Homo sapiens
acagaatgatccaga

SEQ ID NO: 140664 - DNA, 15 bp, Homo sapiens
cacagaatgatccag

SEQ ID NO: 140665 - DNA, 15 bp, Homo sapiens
acacagaatgatcca

SEQ ID NO: 140666 - DNA, 15 bp, Homo sapiens
cacacagaatgatcc

SEQ ID NO: 140667 - DNA, 15 bp, Homo sapiens
acacacagaatgatc

SEQ ID NO: 140668 - DNA, 15 bp, Homo sapiens
aacacacagaatgat

SEQ ID NO: 140669 - DNA, 15 bp, Homo sapiens
aaacacacagaatga

SEQ ID NO: 140670 - DNA, 15 bp, Homo sapiens
caaacacacagaatg

SEQ ID NO: 140671 - DNA, 15 bp, Homo sapiens
acaaacacacagaat

SEQ ID NO: 140672 - DNA, 15 bp, Homo sapiens
cacaaacacacagaa

SEQ ID NO: 140673 - DNA, 15 bp, Homo sapiens
tcacaaacacacaga

SEQ ID NO: 140674 - DNA, 15 bp, Homo sapiens
atcacaaacacacag

SEQ ID NO: 140675 - DNA, 15 bp, Homo sapiens
tatcacaaacacaca

SEQ ID NO: 140676 - DNA, 15 bp, Homo sapiens
gtatcacaaacacac

SEQ ID NO: 140677 - DNA, 15 bp, Homo sapiens
agtatcacaaacaca

SEQ ID NO: 140678 - DNA, 15 bp, Homo sapiens
cagtatcacaaacac

SEQ ID NO: 140679 - DNA, 15 bp, Homo sapiens
gcagtatcacaaaca

SEQ ID NO: 140680 - DNA, 15 bp, Homo sapiens
agcagtatcacaaac

SEQ ID NO: 140681 - DNA, 15 bp, Homo sapiens
cagcagtatcacaaa

SEQ ID NO: 140682 - DNA, 15 bp, Homo sapiens
tcagcagtatcacaa

SEQ ID NO: 140683 - DNA, 15 bp, Homo sapiens
gtcagcagtatcaca

SEQ ID NO: 140684 - DNA, 15 bp, Homo sapiens
agtcagcagtatcac

SEQ ID NO: 140685 - DNA, 15 bp, Homo sapiens
cagtcagcagtatca

SEQ ID NO: 140686 - DNA, 15 bp, Homo sapiens
acagtcagcagtatc

SEQ ID NO: 140687 - DNA, 15 bp, Homo sapiens
aacagtcagcagtat

SEQ ID NO: 140688 - DNA, 15 bp, Homo sapiens
aaacagtcagcagta

SEQ ID NO: 140689 - DNA, 15 bp, Homo sapiens
gaaacagtcagcagt

SEQ ID NO: 140690 - DNA, 15 bp, Homo sapiens
ggaaacagtcagcag

SEQ ID NO: 140691 - DNA, 15 bp, Homo sapiens
tggaaacagtcagca

SEQ ID NO: 140692 - DNA, 15 bp, Homo sapiens
gtggaaacagtcagc

SEQ ID NO: 140693 - DNA, 15 bp, Homo sapiens
ggtggaaacagtcag

SEQ ID NO: 140694 - DNA, 15 bp, Homo sapiens
tggtggaaacagtca

SEQ ID NO: 140695 - DNA, 15 bp, Homo sapiens
ttggtggaaacagtc

SEQ ID NO: 140696 - DNA, 15 bp, Homo sapiens
tttggtggaaacagt

SEQ ID NO: 140697 - DNA, 15 bp, Homo sapiens
atttggtggaaacag

SEQ ID NO: 140698 - DNA, 15 bp, Homo sapiens
catttggtggaaaca

SEQ ID NO: 140699 - DNA, 15 bp, Homo sapiens
tcatttggtggaaac

SEQ ID NO: 140700 - DNA, 15 bp, Homo sapiens
gtcatttggtggaaa

SEQ ID NO: 140701 - DNA, 15 bp, Homo sapiens
agtcatttggtggaa

SEQ ID NO: 140702 - DNA, 15 bp, Homo sapiens
gagtcatttggtgga

SEQ ID NO: 140703 - DNA, 15 bp, Homo sapiens
ggagtcatttggtgg

SEQ ID NO: 140704 - DNA, 15 bp, Homo sapiens
gggagtcatttggtg

SEQ ID NO: 140705 - DNA, 15 bp, Homo sapiens
tgggagtcatttggt

SEQ ID NO: 140706 - DNA, 15 bp, Homo sapiens
ttgggagtcatttgg

SEQ ID NO: 140707 - DNA, 15 bp, Homo sapiens
cttgggagtcatttg

SEQ ID NO: 140708 - DNA, 15 bp, Homo sapiens
acttgggagtcattt

SEQ ID NO: 140709 - DNA, 15 bp, Homo sapiens
tacttgggagtcatt

SEQ ID NO: 140710 - DNA, 15 bp, Homo sapiens
ttacttgggagtcat

SEQ ID NO: 140711 - DNA, 15 bp, Homo sapiens
attacttgggagtca

SEQ ID NO: 140712 - DNA, 15 bp, Homo sapiens
tattacttgggagtc

SEQ ID NO: 140713 - DNA, 15 bp, Homo sapiens
ctattacttgggagt

SEQ ID NO: 140714 - DNA, 15 bp, Homo sapiens
actattacttgggag

SEQ ID NO: 140715 - DNA, 15 bp, Homo sapiens
cactattacttggga

SEQ ID NO: 140716 - DNA, 15 bp, Homo sapiens
tcactattacttggg

SEQ ID NO: 140717 - DNA, 15 bp, Homo sapiens
ttcactattacttgg

SEQ ID NO: 140718 - DNA, 15 bp, Homo sapiens
cttcactattacttg

SEQ ID NO: 140719 - DNA, 15 bp, Homo sapiens
gcttcactattactt

SEQ ID NO: 140720 - DNA, 15 bp, Homo sapiens
ggcttcactattact

SEQ ID NO: 140721 - DNA, 15 bp, Homo sapiens
gggcttcactattac

SEQ ID NO: 140722 - DNA, 15 bp, Homo sapiens
ggggcttcactatta

SEQ ID NO: 140723 - DNA, 15 bp, Homo sapiens
aggggcttcactatt

SEQ ID NO: 140724 - DNA, 15 bp, Homo sapiens
caggggcttcactat

SEQ ID NO: 140725 - DNA, 15 bp, Homo sapiens
ccaggggcttcacta

SEQ ID NO: 140726 - DNA, 15 bp, Homo sapiens
gccaggggcttcact

SEQ ID NO: 140727 - DNA, 15 bp, Homo sapiens
ggccaggggcttcac

SEQ ID NO: 140728 - DNA, 15 bp, Homo sapiens
gggccaggggcttca

SEQ ID NO: 140729 - DNA, 15 bp, Homo sapiens
ggggccaggggcttc

SEQ ID NO: 140730 - DNA, 15 bp, Homo sapiens
aggggccaggggctt

SEQ ID NO: 140731 - DNA, 15 bp, Homo sapiens
aaggggccaggggct

SEQ ID NO: 140732 - DNA, 15 bp, Homo sapiens
taaggggccaggggc

SEQ ID NO: 140733 - DNA, 15 bp, Homo sapiens
ttaaggggccagggg

SEQ ID NO: 140734 - DNA, 15 bp, Homo sapiens
gttaaggggccaggg

SEQ ID NO: 140735 - DNA, 15 bp, Homo sapiens
agttaaggggccagg

SEQ ID NO: 140736 - DNA, 15 bp, Homo sapiens
tagttaaggggccag

SEQ ID NO: 140737 - DNA, 15 bp, Homo sapiens
ctagttaaggggcca

SEQ ID NO: 140738 - DNA, 15 bp, Homo sapiens
tctagttaaggggcc

SEQ ID NO: 140739 - DNA, 15 bp, Homo sapiens
ctctagttaaggggc

SEQ ID NO: 140740 - DNA, 15 bp, Homo sapiens
cctctagttaagggg

SEQ ID NO: 140741 - DNA, 15 bp, Homo sapiens
tcctctagttaaggg

SEQ ID NO: 140742 - DNA, 15 bp, Homo sapiens
ttcctctagttaagg

SEQ ID NO: 140743 - DNA, 15 bp, Homo sapiens
attcctctagttaag

SEQ ID NO: 140744 - DNA, 15 bp, Homo sapiens
tattcctctagttaa

SEQ ID NO: 140745 - DNA, 15 bp, Homo sapiens
gtattcctctagtta

SEQ ID NO: 140746 - DNA, 15 bp, Homo sapiens
tgtattcctctagtt

SEQ ID NO: 140747 - DNA, 15 bp, Homo sapiens
ttgtattcctctagt

SEQ ID NO: 140748 - DNA, 15 bp, Homo sapiens
attgtattcctctag

SEQ ID NO: 140749 - DNA, 15 bp, Homo sapiens
aattgtattcctcta

SEQ ID NO: 140750 - DNA, 15 bp, Homo sapiens
taattgtattcctct

SEQ ID NO: 140751 - DNA, 15 bp, Homo sapiens
ttaattgtattcctc

SEQ ID NO: 140752 - DNA, 15 bp, Homo sapiens
tttaattgtattcct

SEQ ID NO: 140753 - DNA, 15 bp, Homo sapiens
ttttaattgtattcc

SEQ ID NO: 140754 - DNA, 15 bp, Homo sapiens
cttttaattgtattc

SEQ ID NO: 140755 - DNA, 15 bp, Homo sapiens
acttttaattgtatt

SEQ ID NO: 140756 - DNA, 15 bp, Homo sapiens
cacttttaattgtat

SEQ ID NO: 140757 - DNA, 15 bp, Homo sapiens
tcacttttaattgta

SEQ ID NO: 140758 - DNA, 15 bp, Homo sapiens
atcacttttaattgt

SEQ ID NO: 140759 - DNA, 15 bp, Homo sapiens
catcacttttaattg

SEQ ID NO: 140760 - DNA, 15 bp, Homo sapiens
acatcacttttaatt

SEQ ID NO: 140761 - DNA, 15 bp, Homo sapiens
gacatcacttttaat

SEQ ID NO: 140762 - DNA, 15 bp, Homo sapiens
tgacatcacttttaa

SEQ ID NO: 140763 - DNA, 15 bp, Homo sapiens
ctgacatcactttta

SEQ ID NO: 140764 - DNA, 15 bp, Homo sapiens
actgacatcactttt

SEQ ID NO: 140765 - DNA, 15 bp, Homo sapiens
cactgacatcacttt

SEQ ID NO: 140766 - DNA, 15 bp, Homo sapiens
acactgacatcactt

SEQ ID NO: 140767 - DNA, 15 bp, Homo sapiens
aacactgacatcact

SEQ ID NO: 140768 - DNA, 15 bp, Homo sapiens
aaacactgacatcac

SEQ ID NO: 140769 - DNA, 15 bp, Homo sapiens
gaaacactgacatca

SEQ ID NO: 140770 - DNA, 15 bp, Homo sapiens
tgaaacactgacatc

SEQ ID NO: 140771 - DNA, 15 bp, Homo sapiens
ctgaaacactgacat

SEQ ID NO: 140772 - DNA, 15 bp, Homo sapiens
actgaaacactgaca

SEQ ID NO: 140773 - DNA, 15 bp, Homo sapiens
aactgaaacactgac

SEQ ID NO: 140774 - DNA, 15 bp, Homo sapiens
taactgaaacactga

SEQ ID NO: 140775 - DNA, 15 bp, Homo sapiens
ataactgaaacactg

SEQ ID NO: 140776 - DNA, 15 bp, Homo sapiens
gataactgaaacact

SEQ ID NO: 140777 - DNA, 15 bp, Homo sapiens
tgataactgaaacac

SEQ ID NO: 140778 - DNA, 15 bp, Homo sapiens
atgataactgaaaca

SEQ ID NO: 140779 - DNA, 15 bp, Homo sapiens
tatgataactgaaac

SEQ ID NO: 140780 - DNA, 15 bp, Homo sapiens
atatgataactgaaa

SEQ ID NO: 140781 - DNA, 15 bp, Homo sapiens
aatatgataactgaa

SEQ ID NO: 140782 - DNA, 15 bp, Homo sapiens
taatatgataactga

SEQ ID NO: 140783 - DNA, 15 bp, Homo sapiens
ctaatatgataactg

SEQ ID NO: 140784 - DNA, 15 bp, Homo sapiens
tctaatatgataact

SEQ ID NO: 140785 - DNA, 15 bp, Homo sapiens
ttctaatatgataac

SEQ ID NO: 140786 - DNA, 15 bp, Homo sapiens
gttctaatatgataa

SEQ ID NO: 140787 - DNA, 15 bp, Homo sapiens
tgttctaatatgata

SEQ ID NO: 140788 - DNA, 15 bp, Homo sapiens
atgttctaatatgat

SEQ ID NO: 140789 - DNA, 15 bp, Homo sapiens
aatgttctaatatga

SEQ ID NO: 140790 - DNA, 15 bp, Homo sapiens
taatgttctaatatg

SEQ ID NO: 140791 - DNA, 15 bp, Homo sapiens
ataatgttctaatat

SEQ ID NO: 140792 - DNA, 15 bp, Homo sapiens
aataatgttctaata

SEQ ID NO: 140793 - DNA, 15 bp, Homo sapiens
aaataatgttctaat

SEQ ID NO: 140794 - DNA, 15 bp, Homo sapiens
aaaataatgttctaa

SEQ ID NO: 140795 - DNA, 15 bp, Homo sapiens
aaaaataatgttcta

SEQ ID NO: 140796 - DNA, 15 bp, Homo sapiens
aaaaaataatgttct

SEQ ID NO: 140797 - DNA, 15 bp, Homo sapiens
taaaaaataatgttc

SEQ ID NO: 140798 - DNA, 15 bp, Homo sapiens
ttaaaaaataatgtt

SEQ ID NO: 140799 - DNA, 15 bp, Homo sapiens
attaaaaaataatgt

SEQ ID NO: 140800 - DNA, 15 bp, Homo sapiens
gattaaaaaataatg

SEQ ID NO: 140801 - DNA, 15 bp, Homo sapiens
tgattaaaaaataat

SEQ ID NO: 140802 - DNA, 15 bp, Homo sapiens
ctgattaaaaaataa

SEQ ID NO: 140803 - DNA, 15 bp, Homo sapiens
gctgattaaaaaata

SEQ ID NO: 140804 - DNA, 15 bp, Homo sapiens
tgctgattaaaaaat

SEQ ID NO: 140805 - DNA, 15 bp, Homo sapiens
ctgctgattaaaaaa

SEQ ID NO: 140806 - DNA, 15 bp, Homo sapiens
actgctgattaaaaa

SEQ ID NO: 140807 - DNA, 15 bp, Homo sapiens
cactgctgattaaaa

SEQ ID NO: 140808 - DNA, 15 bp, Homo sapiens
acactgctgattaaa

SEQ ID NO: 140809 - DNA, 15 bp, Homo sapiens
cacactgctgattaa

SEQ ID NO: 140810 - DNA, 15 bp, Homo sapiens
tcacactgctgatta

SEQ ID NO: 140811 - DNA, 15 bp, Homo sapiens
atcacactgctgatt

SEQ ID NO: 140812 - DNA, 15 bp, Homo sapiens
aatcacactgctgat

SEQ ID NO: 140813 - DNA, 15 bp, Homo sapiens
gaatcacactgctga

SEQ ID NO: 140814 - DNA, 15 bp, Homo sapiens
agaatcacactgctg

SEQ ID NO: 140815 - DNA, 15 bp, Homo sapiens
aagaatcacactgct

SEQ ID NO: 140816 - DNA, 15 bp, Homo sapiens
aaagaatcacactgc

SEQ ID NO: 140817 - DNA, 15 bp, Homo sapiens
aaaagaatcacactg

SEQ ID NO: 140818 - DNA, 15 bp, Homo sapiens
gaaaagaatcacact

SEQ ID NO: 140819 - DNA, 15 bp, Homo sapiens
agaaaagaatcacac

SEQ ID NO: 140820 - DNA, 15 bp, Homo sapiens
aagaaaagaatcaca

SEQ ID NO: 140821 - DNA, 15 bp, Homo sapiens
gaagaaaagaatcac

SEQ ID NO: 140822 - DNA, 15 bp, Homo sapiens
agaagaaaagaatca

SEQ ID NO: 140823 - DNA, 15 bp, Homo sapiens
cagaagaaaagaatc

SEQ ID NO: 140824 - DNA, 15 bp, Homo sapiens
tcagaagaaaagaat

SEQ ID NO: 140825 - DNA, 15 bp, Homo sapiens
ttcagaagaaaagaa

SEQ ID NO: 140826 - DNA, 15 bp, Homo sapiens
tttcagaagaaaaga

SEQ ID NO: 140827 - DNA, 15 bp, Homo sapiens
gtttcagaagaaaag

SEQ ID NO: 140828 - DNA, 15 bp, Homo sapiens
ggtttcagaagaaaa

SEQ ID NO: 140829 - DNA, 15 bp, Homo sapiens
aggtttcagaagaaa

SEQ ID NO: 140830 - DNA, 15 bp, Homo sapiens
aaggtttcagaagaa

SEQ ID NO: 140831 - DNA, 15 bp, Homo sapiens
taaggtttcagaaga

SEQ ID NO: 140832 - DNA, 15 bp, Homo sapiens
ctaaggtttcagaag

SEQ ID NO: 140833 - DNA, 15 bp, Homo sapiens
cctaaggtttcagaa

SEQ ID NO: 140834 - DNA, 15 bp, Homo sapiens
gcctaaggtttcaga

SEQ ID NO: 140835 - DNA, 15 bp, Homo sapiens
agcctaaggtttcag

SEQ ID NO: 140836 - DNA, 15 bp, Homo sapiens
cagcctaaggtttca

SEQ ID NO: 140837 - DNA, 15 bp, Homo sapiens
tcagcctaaggtttc

SEQ ID NO: 140838 - DNA, 15 bp, Homo sapiens
atcagcctaaggttt

SEQ ID NO: 140839 - DNA, 15 bp, Homo sapiens
aatcagcctaaggtt

SEQ ID NO: 140840 - DNA, 15 bp, Homo sapiens
aaatcagcctaaggt

SEQ ID NO: 140841 - DNA, 15 bp, Homo sapiens
taaatcagcctaagg

SEQ ID NO: 140842 - DNA, 15 bp, Homo sapiens
ttaaatcagcctaag

SEQ ID NO: 140843 - DNA, 15 bp, Homo sapiens
tttaaatcagcctaa

SEQ ID NO: 140844 - DNA, 15 bp, Homo sapiens
ttttaaatcagccta

SEQ ID NO: 140845 - DNA, 15 bp, Homo sapiens
attttaaatcagcct

SEQ ID NO: 140846 - DNA, 15 bp, Homo sapiens
gattttaaatcagcc

SEQ ID NO: 140847 - DNA, 15 bp, Homo sapiens
agattttaaatcagc

SEQ ID NO: 140848 - DNA, 15 bp, Homo sapiens
aagattttaaatcag

SEQ ID NO: 140849 - DNA, 15 bp, Homo sapiens
gaagattttaaatca

SEQ ID NO: 140850 - DNA, 15 bp, Homo sapiens
ggaagattttaaatc

SEQ ID NO: 140851 - DNA, 15 bp, Homo sapiens
gggaagattttaaat

SEQ ID NO: 140852 - DNA, 15 bp, Homo sapiens
tgggaagattttaaa

SEQ ID NO: 140853 - DNA, 15 bp, Homo sapiens
ttgggaagattttaa

SEQ ID NO: 140854 - DNA, 15 bp, Homo sapiens
attgggaagatttta

SEQ ID NO: 140855 - DNA, 15 bp, Homo sapiens
aattgggaagatttt

SEQ ID NO: 140856 - DNA, 15 bp, Homo sapiens
caattgggaagattt

SEQ ID NO: 140857 - DNA, 15 bp, Homo sapiens
gcaattgggaagatt

SEQ ID NO: 140858 - DNA, 15 bp, Homo sapiens
agcaattgggaagat

SEQ ID NO: 140859 - DNA, 15 bp, Homo sapiens
tagcaattgggaaga

SEQ ID NO: 140860 - DNA, 15 bp, Homo sapiens
gtagcaattgggaag

SEQ ID NO: 140861 - DNA, 15 bp, Homo sapiens
tgtagcaattgggaa

SEQ ID NO: 140862 - DNA, 15 bp, Homo sapiens
ttgtagcaattggga

SEQ ID NO: 140863 - DNA, 15 bp, Homo sapiens
tttgtagcaattggg

SEQ ID NO: 140864 - DNA, 15 bp, Homo sapiens
ttttgtagcaattgg

SEQ ID NO: 140865 - DNA, 15 bp, Homo sapiens
tttttgtagcaattg

SEQ ID NO: 140866 - DNA, 15 bp, Homo sapiens
ctttttgtagcaatt

SEQ ID NO: 140867 - DNA, 15 bp, Homo sapiens
gctttttgtagcaat

SEQ ID NO: 140868 - DNA, 15 bp, Homo sapiens
tgctttttgtagcaa

SEQ ID NO: 140869 - DNA, 15 bp, Homo sapiens
atgctttttgtagca

SEQ ID NO: 140870 - DNA, 15 bp, Homo sapiens
aatgctttttgtagc

SEQ ID NO: 140871 - DNA, 15 bp, Homo sapiens
taatgctttttgtag

SEQ ID NO: 140872 - DNA, 15 bp, Homo sapiens
ataatgctttttgta

SEQ ID NO: 140873 - DNA, 15 bp, Homo sapiens
tataatgctttttgt

SEQ ID NO: 140874 - DNA, 15 bp, Homo sapiens
atataatgctttttg

SEQ ID NO: 140875 - DNA, 15 bp, Homo sapiens
aatataatgcttttt

SEQ ID NO: 140876 - DNA, 15 bp, Homo sapiens
taatataatgctttt

SEQ ID NO: 140877 - DNA, 15 bp, Homo sapiens
ttaatataatgcttt

SEQ ID NO: 140878 - DNA, 15 bp, Homo sapiens
tttaatataatgctt

SEQ ID NO: 140879 - DNA, 15 bp, Homo sapiens
ctttaatataatgct

SEQ ID NO: 140880 - DNA, 15 bp, Homo sapiens
cctttaatataatgc

SEQ ID NO: 140881 - DNA, 15 bp, Homo sapiens
acctttaatataatg

SEQ ID NO: 140882 - DNA, 15 bp, Homo sapiens
aacctttaatataat

SEQ ID NO: 140883 - DNA, 15 bp, Homo sapiens
aaacctttaatataa

SEQ ID NO: 140884 - DNA, 15 bp, Homo sapiens
gaaacctttaatata

SEQ ID NO: 140885 - DNA, 15 bp, Homo sapiens
tgaaacctttaatat

SEQ ID NO: 140886 - DNA, 15 bp, Homo sapiens
ctgaaacctttaata

SEQ ID NO: 140887 - DNA, 15 bp, Homo sapiens
actgaaacctttaat

SEQ ID NO: 140888 - DNA, 15 bp, Homo sapiens
aactgaaacctttaa

SEQ ID NO: 140889 - DNA, 15 bp, Homo sapiens
caactgaaaccttta

SEQ ID NO: 140890 - DNA, 15 bp, Homo sapiens
acaactgaaaccttt

SEQ ID NO: 140891 - DNA, 15 bp, Homo sapiens
gacaactgaaacctt

SEQ ID NO: 140892 - DNA, 15 bp, Homo sapiens
tgacaactgaaacct

SEQ ID NO: 140893 - DNA, 15 bp, Homo sapiens
atgacaactgaaacc

SEQ ID NO: 140894 - DNA, 15 bp, Homo sapiens
aatgacaactgaaac

SEQ ID NO: 140895 - DNA, 15 bp, Homo sapiens
aaatgacaactgaaa

SEQ ID NO: 140896 - DNA, 15 bp, Homo sapiens
taaatgacaactgaa

SEQ ID NO: 140897 - DNA, 15 bp, Homo sapiens
ctaaatgacaactga

SEQ ID NO: 140898 - DNA, 15 bp, Homo sapiens
tctaaatgacaactg

SEQ ID NO: 140899 - DNA, 15 bp, Homo sapiens
atctaaatgacaact

SEQ ID NO: 140900 - DNA, 15 bp, Homo sapiens
aatctaaatgacaac

SEQ ID NO: 140901 - DNA, 15 bp, Homo sapiens
aaatctaaatgacaa

SEQ ID NO: 140902 - DNA, 15 bp, Homo sapiens
gaaatctaaatgaca

SEQ ID NO: 140903 - DNA, 15 bp, Homo sapiens
tgaaatctaaatgac

SEQ ID NO: 140904 - DNA, 15 bp, Homo sapiens
atgaaatctaaatga

SEQ ID NO: 140905 - DNA, 15 bp, Homo sapiens
catgaaatctaaatg

SEQ ID NO: 140906 - DNA, 15 bp, Homo sapiens
ccatgaaatctaaat

SEQ ID NO: 140907 - DNA, 15 bp, Homo sapiens
accatgaaatctaaa

SEQ ID NO: 140908 - DNA, 15 bp, Homo sapiens
caccatgaaatctaa

SEQ ID NO: 140909 - DNA, 15 bp, Homo sapiens
tcaccatgaaatcta

SEQ ID NO: 140910 - DNA, 15 bp, Homo sapiens
ctcaccatgaaatct

SEQ ID NO: 140911 - DNA, 15 bp, Homo sapiens
actcaccatgaaatc

SEQ ID NO: 140912 - DNA, 15 bp, Homo sapiens
tactcaccatgaaat

SEQ ID NO: 140913 - DNA, 15 bp, Homo sapiens
gtactcaccatgaaa

SEQ ID NO: 140914 - DNA, 15 bp, Homo sapiens
ggtactcaccatgaa

SEQ ID NO: 140915 - DNA, 15 bp, Homo sapiens
aggtactcaccatga

SEQ ID NO: 140916 - DNA, 15 bp, Homo sapiens
aaggtactcaccatg

SEQ ID NO: 140917 - DNA, 15 bp, Homo sapiens
caaggtactcaccat

SEQ ID NO: 140918 - DNA, 15 bp, Homo sapiens
tcaaggtactcacca

SEQ ID NO: 140919 - DNA, 15 bp, Homo sapiens
atcaaggtactcacc

SEQ ID NO: 140920 - DNA, 15 bp, Homo sapiens
gatcaaggtactcac

SEQ ID NO: 140921 - DNA, 15 bp, Homo sapiens
ggatcaaggtactca

SEQ ID NO: 140922 - DNA, 15 bp, Homo sapiens
tggatcaaggtactc

SEQ ID NO: 140923 - DNA, 15 bp, Homo sapiens
ctggatcaaggtact

SEQ ID NO: 140924 - DNA, 15 bp, Homo sapiens
tctggatcaaggtac

SEQ ID NO: 140925 - DNA, 15 bp, Homo sapiens
ctctggatcaaggta

SEQ ID NO: 140926 - DNA, 15 bp, Homo sapiens
tctctggatcaaggt

SEQ ID NO: 140927 - DNA, 15 bp, Homo sapiens
gtctctggatcaagg

SEQ ID NO: 140928 - DNA, 15 bp, Homo sapiens
agtctctggatcaag

SEQ ID NO: 140929 - DNA, 15 bp, Homo sapiens
gagtctctggatcaa

SEQ ID NO: 140930 - DNA, 15 bp, Homo sapiens
agagtctctggatca

SEQ ID NO: 140931 - DNA, 15 bp, Homo sapiens
gagagtctctggatc

SEQ ID NO: 140932 - DNA, 15 bp, Homo sapiens
tgagagtctctggat

SEQ ID NO: 140933 - DNA, 15 bp, Homo sapiens
ctgagagtctctgga

SEQ ID NO: 140934 - DNA, 15 bp, Homo sapiens
tctgagagtctctgg

SEQ ID NO: 140935 - DNA, 15 bp, Homo sapiens
ctctgagagtctctg

SEQ ID NO: 140936 - DNA, 15 bp, Homo sapiens
cctctgagagtctct

SEQ ID NO: 140937 - DNA, 15 bp, Homo sapiens
gcctctgagagtctc

SEQ ID NO: 140938 - DNA, 15 bp, Homo sapiens
agcctctgagagtct

SEQ ID NO: 140939 - DNA, 15 bp, Homo sapiens
cagcctctgagagtc

SEQ ID NO: 140940 - DNA, 15 bp, Homo sapiens
tcagcctctgagagt

SEQ ID NO: 140941 - DNA, 15 bp, Homo sapiens
ttcagcctctgagag

SEQ ID NO: 140942 - DNA, 15 bp, Homo sapiens
tttcagcctctgaga

SEQ ID NO: 140943 - DNA, 15 bp, Homo sapiens
ttttcagcctctgag

SEQ ID NO: 140944 - DNA, 15 bp, Homo sapiens
tttttcagcctctga

SEQ ID NO: 140945 - DNA, 15 bp, Homo sapiens
gtttttcagcctctg

SEQ ID NO: 140946 - DNA, 15 bp, Homo sapiens
agtttttcagcctct

SEQ ID NO: 140947 - DNA, 15 bp, Homo sapiens
tagtttttcagcctc

SEQ ID NO: 140948 - DNA, 15 bp, Homo sapiens
atagtttttcagcct

SEQ ID NO: 140949 - DNA, 15 bp, Homo sapiens
catagtttttcagcc

SEQ ID NO: 140950 - DNA, 15 bp, Homo sapiens
acatagtttttcagc

SEQ ID NO: 140951 - DNA, 15 bp, Homo sapiens
gacatagtttttcag

SEQ ID NO: 140952 - DNA, 15 bp, Homo sapiens
tgacatagtttttca

SEQ ID NO: 140953 - DNA, 15 bp, Homo sapiens
ttgacatagtttttc

SEQ ID NO: 140954 - DNA, 15 bp, Homo sapiens
tttgacatagttttt

SEQ ID NO: 140955 - DNA, 15 bp, Homo sapiens
ctttgacatagtttt

SEQ ID NO: 140956 - DNA, 15 bp, Homo sapiens
tctttgacatagttt

SEQ ID NO: 140957 - DNA, 15 bp, Homo sapiens
ttctttgacatagtt

SEQ ID NO: 140958 - DNA, 15 bp, Homo sapiens
gttctttgacatagt

SEQ ID NO: 140959 - DNA, 15 bp, Homo sapiens
ggttctttgacatag

SEQ ID NO: 140960 - DNA, 15 bp, Homo sapiens
tggttctttgacata

SEQ ID NO: 140961 - DNA, 15 bp, Homo sapiens
ttggttctttgacat

SEQ ID NO: 140962 - DNA, 15 bp, Homo sapiens
attggttctttgaca

SEQ ID NO: 140963 - DNA, 15 bp, Homo sapiens
cattggttctttgac

SEQ ID NO: 140964 - DNA, 15 bp, Homo sapiens
gcattggttctttga

SEQ ID NO: 140965 - DNA, 15 bp, Homo sapiens
ggcattggttctttg

SEQ ID NO: 140966 - DNA, 15 bp, Homo sapiens
tggcattggttcttt

SEQ ID NO: 140967 - DNA, 15 bp, Homo sapiens
ctggcattggttctt

SEQ ID NO: 140968 - DNA, 15 bp, Homo sapiens
actggcattggttct

SEQ ID NO: 140969 - DNA, 15 bp, Homo sapiens
cactggcattggttc

SEQ ID NO: 140970 - DNA, 15 bp, Homo sapiens
ccactggcattggtt

SEQ ID NO: 140971 - DNA, 15 bp, Homo sapiens
tccactggcattggt

SEQ ID NO: 140972 - DNA, 15 bp, Homo sapiens
gtccactggcattgg

SEQ ID NO: 140973 - DNA, 15 bp, Homo sapiens
tgtccactggcattg

SEQ ID NO: 140974 - DNA, 15 bp, Homo sapiens
ttgtccactggcatt

SEQ ID NO: 140975 - DNA, 15 bp, Homo sapiens
tttgtccactggcat

SEQ ID NO: 140976 - DNA, 15 bp, Homo sapiens
atttgtccactggca

SEQ ID NO: 140977 - DNA, 15 bp, Homo sapiens
aatttgtccactggc

SEQ ID NO: 140978 - DNA, 15 bp, Homo sapiens
gaatttgtccactgg

SEQ ID NO: 140979 - DNA, 15 bp, Homo sapiens
tgaatttgtccactg

SEQ ID NO: 140980 - DNA, 15 bp, Homo sapiens
ctgaatttgtccact

SEQ ID NO: 140981 - DNA, 15 bp, Homo sapiens
gctgaatttgtccac

SEQ ID NO: 140982 - DNA, 15 bp, Homo sapiens
tgctgaatttgtcca

SEQ ID NO: 140983 - DNA, 15 bp, Homo sapiens
atgctgaatttgtcc

SEQ ID NO: 140984 - DNA, 15 bp, Homo sapiens
gatgctgaatttgtc

SEQ ID NO: 140985 - DNA, 15 bp, Homo sapiens
tgatgctgaatttgt

SEQ ID NO: 140986 - DNA, 15 bp, Homo sapiens
ctgatgctgaatttg

SEQ ID NO: 140987 - DNA, 15 bp, Homo sapiens
actgatgctgaattt

SEQ ID NO: 140988 - DNA, 15 bp, Homo sapiens
aactgatgctgaatt

SEQ ID NO: 140989 - DNA, 15 bp, Homo sapiens
aaactgatgctgaat

SEQ ID NO: 140990 - DNA, 15 bp, Homo sapiens
caaactgatgctgaa

SEQ ID NO: 140991 - DNA, 15 bp, Homo sapiens
ccaaactgatgctga

SEQ ID NO: 140992 - DNA, 15 bp, Homo sapiens
gccaaactgatgctg

SEQ ID NO: 140993 - DNA, 15 bp, Homo sapiens
agccaaactgatgct

SEQ ID NO: 140994 - DNA, 15 bp, Homo sapiens
tagccaaactgatgc

SEQ ID NO: 140995 - DNA, 15 bp, Homo sapiens
atagccaaactgatg

SEQ ID NO: 140996 - DNA, 15 bp, Homo sapiens
aatagccaaactgat

SEQ ID NO: 140997 - DNA, 15 bp, Homo sapiens
gaatagccaaactga

SEQ ID NO: 140998 - DNA, 15 bp, Homo sapiens
tgaatagccaaactg

SEQ ID NO: 140999 - DNA, 15 bp, Homo sapiens
ttgaatagccaaact

SEQ ID NO: 141000 - DNA, 15 bp, Homo sapiens
cttgaatagccaaac

SEQ ID NO: 141001 - DNA, 15 bp, Homo sapiens
gcttgaatagccaaa

SEQ ID NO: 141002 - DNA, 15 bp, Homo sapiens
tgcttgaatagccaa

SEQ ID NO: 141003 - DNA, 15 bp, Homo sapiens
ttgcttgaatagcca

SEQ ID NO: 141004 - DNA, 15 bp, Homo sapiens
tttgcttgaatagcc

SEQ ID NO: 141005 - DNA, 15 bp, Homo sapiens
gtttgcttgaatagc

SEQ ID NO: 141006 - DNA, 15 bp, Homo sapiens
agtttgcttgaatag

SEQ ID NO: 141007 - DNA, 15 bp, Homo sapiens
gagtttgcttgaata

SEQ ID NO: 141008 - DNA, 15 bp, Homo sapiens
agagtttgcttgaat

SEQ ID NO: 141009 - DNA, 15 bp, Homo sapiens
gagagtttgcttgaa

SEQ ID NO: 141010 - DNA, 15 bp, Homo sapiens
tgagagtttgcttga

SEQ ID NO: 141011 - DNA, 15 bp, Homo sapiens
ctgagagtttgcttg

SEQ ID NO: 141012 - DNA, 15 bp, Homo sapiens
actgagagtttgctt

SEQ ID NO: 141013 - DNA, 15 bp, Homo sapiens
tactgagagtttgct

SEQ ID NO: 141014 - DNA, 15 bp, Homo sapiens
ttactgagagtttgc

SEQ ID NO: 141015 - DNA, 15 bp, Homo sapiens
tttactgagagtttg

SEQ ID NO: 141016 - DNA, 15 bp, Homo sapiens
gtttactgagagttt

SEQ ID NO: 141017 - DNA, 15 bp, Homo sapiens
ggtttactgagagtt

SEQ ID NO: 141018 - DNA, 15 bp, Homo sapiens
aggtttactgagagt

SEQ ID NO: 141019 - DNA, 15 bp, Homo sapiens
aaggtttactgagag

SEQ ID NO: 141020 - DNA, 15 bp, Homo sapiens
caaggtttactgaga

SEQ ID NO: 141021 - DNA, 15 bp, Homo sapiens
gcaaggtttactgag

SEQ ID NO: 141022 - DNA, 15 bp, Homo sapiens
agcaaggtttactga

SEQ ID NO: 141023 - DNA, 15 bp, Homo sapiens
aagcaaggtttactg

SEQ ID NO: 141024 - DNA, 15 bp, Homo sapiens
caagcaaggtttact

SEQ ID NO: 141025 - DNA, 15 bp, Homo sapiens
ccaagcaaggtttac

SEQ ID NO: 141026 - DNA, 15 bp, Homo sapiens
gccaagcaaggttta

SEQ ID NO: 141027 - DNA, 15 bp, Homo sapiens
tgccaagcaaggttt

SEQ ID NO: 141028 - DNA, 15 bp, Homo sapiens
ctgccaagcaaggtt

SEQ ID NO: 141029 - DNA, 15 bp, Homo sapiens
gctgccaagcaaggt

SEQ ID NO: 141030 - DNA, 15 bp, Homo sapiens
agctgccaagcaagg

SEQ ID NO: 141031 - DNA, 15 bp, Homo sapiens
aagctgccaagcaag

SEQ ID NO: 141032 - DNA, 15 bp, Homo sapiens
caagctgccaagcaa

SEQ ID NO: 141033 - DNA, 15 bp, Homo sapiens
tcaagctgccaagca

SEQ ID NO: 141034 - DNA, 15 bp, Homo sapiens
atcaagctgccaagc

SEQ ID NO: 141035 - DNA, 15 bp, Homo sapiens
gatcaagctgccaag

SEQ ID NO: 141036 - DNA, 15 bp, Homo sapiens
ggatcaagctgccaa

SEQ ID NO: 141037 - DNA, 15 bp, Homo sapiens
tggatcaagctgcca

SEQ ID NO: 141038 - DNA, 15 bp, Homo sapiens
atggatcaagctgcc

SEQ ID NO: 141039 - DNA, 15 bp, Homo sapiens
aatggatcaagctgc

SEQ ID NO: 141040 - DNA, 15 bp, Homo sapiens
gaatggatcaagctg

SEQ ID NO: 141041 - DNA, 15 bp, Homo sapiens
tgaatggatcaagct

SEQ ID NO: 141042 - DNA, 15 bp, Homo sapiens
ttgaatggatcaagc

SEQ ID NO: 141043 - DNA, 15 bp, Homo sapiens
cttgaatggatcaag

SEQ ID NO: 141044 - DNA, 15 bp, Homo sapiens
acttgaatggatcaa

SEQ ID NO: 141045 - DNA, 15 bp, Homo sapiens
cacttgaatggatca

SEQ ID NO: 141046 - DNA, 15 bp, Homo sapiens
ccacttgaatggatc

SEQ ID NO: 141047 - DNA, 15 bp, Homo sapiens
accacttgaatggat

SEQ ID NO: 141048 - DNA, 15 bp, Homo sapiens
aaccacttgaatgga

SEQ ID NO: 141049 - DNA, 15 bp, Homo sapiens
taaccacttgaatgg

SEQ ID NO: 141050 - DNA, 15 bp, Homo sapiens
ataaccacttgaatg

SEQ ID NO: 141051 - DNA, 15 bp, Homo sapiens
gataaccacttgaat

SEQ ID NO: 141052 - DNA, 15 bp, Homo sapiens
agataaccacttgaa

SEQ ID NO: 141053 - DNA, 15 bp, Homo sapiens
aagataaccacttga

SEQ ID NO: 141054 - DNA, 15 bp, Homo sapiens
aaagataaccacttg

SEQ ID NO: 141055 - DNA, 15 bp, Homo sapiens
caaagataaccactt

SEQ ID NO: 141056 - DNA, 15 bp, Homo sapiens
acaaagataaccact

SEQ ID NO: 141057 - DNA, 15 bp, Homo sapiens
tacaaagataaccac

SEQ ID NO: 141058 - DNA, 15 bp, Homo sapiens
ttacaaagataacca

SEQ ID NO: 141059 - DNA, 15 bp, Homo sapiens
tttacaaagataacc

SEQ ID NO: 141060 - DNA, 15 bp, Homo sapiens
gtttacaaagataac

SEQ ID NO: 141061 - DNA, 15 bp, Homo sapiens
tgtttacaaagataa

SEQ ID NO: 141062 - DNA, 15 bp, Homo sapiens
gtgtttacaaagata

SEQ ID NO: 141063 - DNA, 15 bp, Homo sapiens
tgtgtttacaaagat

SEQ ID NO: 141064 - DNA, 15 bp, Homo sapiens
gtgtgtttacaaaga

SEQ ID NO: 141065 - DNA, 15 bp, Homo sapiens
ggtgtgtttacaaag

SEQ ID NO: 141066 - DNA, 15 bp, Homo sapiens
aggtgtgtttacaaa

SEQ ID NO: 141067 - DNA, 15 bp, Homo sapiens
aaggtgtgtttacaa

SEQ ID NO: 141068 - DNA, 15 bp, Homo sapiens
caaggtgtgtttaca

SEQ ID NO: 141069 - DNA, 15 bp, Homo sapiens
acaaggtgtgtttac

SEQ ID NO: 141070 - DNA, 15 bp, Homo sapiens
cacaaggtgtgttta

SEQ ID NO: 141071 - DNA, 15 bp, Homo sapiens
tcacaaggtgtgttt

SEQ ID NO: 141072 - DNA, 15 bp, Homo sapiens
atcacaaggtgtgtt

SEQ ID NO: 141073 - DNA, 15 bp, Homo sapiens
gatcacaaggtgtgt

SEQ ID NO: 141074 - DNA, 15 bp, Homo sapiens
ggatcacaaggtgtg

SEQ ID NO: 141075 - DNA, 15 bp, Homo sapiens
tggatcacaaggtgt

SEQ ID NO: 141076 - DNA, 15 bp, Homo sapiens
ctggatcacaaggtg

SEQ ID NO: 141077 - DNA, 15 bp, Homo sapiens
cctggatcacaaggt

SEQ ID NO: 141078 - DNA, 15 bp, Homo sapiens
ccctggatcacaagg

SEQ ID NO: 141079 - DNA, 15 bp, Homo sapiens
cccctggatcacaag

SEQ ID NO: 141080 - DNA, 15 bp, Homo sapiens
gcccctggatcacaa

SEQ ID NO: 141081 - DNA, 15 bp, Homo sapiens
tgcccctggatcaca

SEQ ID NO: 141082 - DNA, 15 bp, Homo sapiens
ttgcccctggatcac

SEQ ID NO: 141083 - DNA, 15 bp, Homo sapiens
cttgcccctggatca

SEQ ID NO: 141084 - DNA, 15 bp, Homo sapiens
tcttgcccctggatc

SEQ ID NO: 141085 - DNA, 15 bp, Homo sapiens
ctcttgcccctggat

SEQ ID NO: 141086 - DNA, 15 bp, Homo sapiens
tctcttgcccctgga

SEQ ID NO: 141087 - DNA, 15 bp, Homo sapiens
atctcttgcccctgg

SEQ ID NO: 141088 - DNA, 15 bp, Homo sapiens
catctcttgcccctg

SEQ ID NO: 141089 - DNA, 15 bp, Homo sapiens
ccatctcttgcccct

SEQ ID NO: 141090 - DNA, 15 bp, Homo sapiens
tccatctcttgcccc

SEQ ID NO: 141091 - DNA, 15 bp, Homo sapiens
ttccatctcttgccc

SEQ ID NO: 141092 - DNA, 15 bp, Homo sapiens
cttccatctcttgcc

SEQ ID NO: 141093 - DNA, 15 bp, Homo sapiens
tcttccatctcttgc

SEQ ID NO: 141094 - DNA, 15 bp, Homo sapiens
gtcttccatctcttg

SEQ ID NO: 141095 - DNA, 15 bp, Homo sapiens
cgtcttccatctctt

SEQ ID NO: 141096 - DNA, 15 bp, Homo sapiens
acgtcttccatctct

SEQ ID NO: 141097 - DNA, 15 bp, Homo sapiens
gacgtcttccatctc

SEQ ID NO: 141098 - DNA, 15 bp, Homo sapiens
ggacgtcttccatct

SEQ ID NO: 141099 - DNA, 15 bp, Homo sapiens
tggacgtcttccatc

SEQ ID NO: 141100 - DNA, 15 bp, Homo sapiens
atggacgtcttccat

SEQ ID NO: 141101 - DNA, 15 bp, Homo sapiens
catggacgtcttcca

SEQ ID NO: 141102 - DNA, 15 bp, Homo sapiens
acatggacgtcttcc

SEQ ID NO: 141103 - DNA, 15 bp, Homo sapiens
aacatggacgtcttc

SEQ ID NO: 141104 - DNA, 15 bp, Homo sapiens
caacatggacgtctt

SEQ ID NO: 141105 - DNA, 15 bp, Homo sapiens
acaacatggacgtct

SEQ ID NO: 141106 - DNA, 15 bp, Homo sapiens
aacaacatggacgtc

SEQ ID NO: 141107 - DNA, 15 bp, Homo sapiens
caacaacatggacgt

SEQ ID NO: 141108 - DNA, 15 bp, Homo sapiens
tcaacaacatggacg

SEQ ID NO: 141109 - DNA, 15 bp, Homo sapiens
atcaacaacatggac

SEQ ID NO: 141110 - DNA, 15 bp, Homo sapiens
aatcaacaacatgga

SEQ ID NO: 141111 - DNA, 15 bp, Homo sapiens
gaatcaacaacatgg

SEQ ID NO: 141112 - DNA, 15 bp, Homo sapiens
agaatcaacaacatg

SEQ ID NO: 141113 - DNA, 15 bp, Homo sapiens
aagaatcaacaacat

SEQ ID NO: 141114 - DNA, 15 bp, Homo sapiens
gaagaatcaacaaca

SEQ ID NO: 141115 - DNA, 15 bp, Homo sapiens
tgaagaatcaacaac

SEQ ID NO: 141116 - DNA, 15 bp, Homo sapiens
gtgaagaatcaacaa

SEQ ID NO: 141117 - DNA, 15 bp, Homo sapiens
cgtgaagaatcaaca

SEQ ID NO: 141118 - DNA, 15 bp, Homo sapiens
acgtgaagaatcaac

SEQ ID NO: 141119 - DNA, 15 bp, Homo sapiens
aacgtgaagaatcaa

SEQ ID NO: 141120 - DNA, 15 bp, Homo sapiens
aaacgtgaagaatca

SEQ ID NO: 141121 - DNA, 15 bp, Homo sapiens
gaaacgtgaagaatc

SEQ ID NO: 141122 - DNA, 15 bp, Homo sapiens
agaaacgtgaagaat

SEQ ID NO: 141123 - DNA, 15 bp, Homo sapiens
gagaaacgtgaagaa

SEQ ID NO: 141124 - DNA, 15 bp, Homo sapiens
ggagaaacgtgaaga

SEQ ID NO: 141125 - DNA, 15 bp, Homo sapiens
tggagaaacgtgaag

SEQ ID NO: 141126 - DNA, 15 bp, Homo sapiens
ctggagaaacgtgaa

SEQ ID NO: 141127 - DNA, 15 bp, Homo sapiens
cctggagaaacgtga

SEQ ID NO: 141128 - DNA, 15 bp, Homo sapiens
gcctggagaaacgtg

SEQ ID NO: 141129 - DNA, 15 bp, Homo sapiens
tgcctggagaaacgt

SEQ ID NO: 141130 - DNA, 15 bp, Homo sapiens
atgcctggagaaacg

SEQ ID NO: 141131 - DNA, 15 bp, Homo sapiens
catgcctggagaaac

SEQ ID NO: 141132 - DNA, 15 bp, Homo sapiens
acatgcctggagaaa

SEQ ID NO: 141133 - DNA, 15 bp, Homo sapiens
tacatgcctggagaa

SEQ ID NO: 141134 - DNA, 15 bp, Homo sapiens
atacatgcctggaga

SEQ ID NO: 141135 - DNA, 15 bp, Homo sapiens
catacatgcctggag

SEQ ID NO: 141136 - DNA, 15 bp, Homo sapiens
gcatacatgcctgga

SEQ ID NO: 141137 - DNA, 15 bp, Homo sapiens
tgcatacatgcctgg

SEQ ID NO: 141138 - DNA, 15 bp, Homo sapiens
ctgcatacatgcctg

SEQ ID NO: 141139 - DNA, 15 bp, Homo sapiens
cctgcatacatgcct

SEQ ID NO: 141140 - DNA, 15 bp, Homo sapiens
tcctgcatacatgcc

SEQ ID NO: 141141 - DNA, 15 bp, Homo sapiens
ttcctgcatacatgc

SEQ ID NO: 141142 - DNA, 15 bp, Homo sapiens
gttcctgcatacatg

SEQ ID NO: 141143 - DNA, 15 bp, Homo sapiens
agttcctgcatacat

SEQ ID NO: 141144 - DNA, 15 bp, Homo sapiens
cagttcctgcataca

SEQ ID NO: 141145 - DNA, 15 bp, Homo sapiens
acagttcctgcatac

SEQ ID NO: 141146 - DNA, 15 bp, Homo sapiens
gacagttcctgcata

SEQ ID NO: 141147 - DNA, 15 bp, Homo sapiens
agacagttcctgcat

SEQ ID NO: 141148 - DNA, 15 bp, Homo sapiens
gagacagttcctgca

SEQ ID NO: 141149 - DNA, 15 bp, Homo sapiens
agagacagttcctgc

SEQ ID NO: 141150 - DNA, 15 bp, Homo sapiens
cagagacagttcctg

SEQ ID NO: 141151 - DNA, 15 bp, Homo sapiens
acagagacagttcct

SEQ ID NO: 141152 - DNA, 15 bp, Homo sapiens
tacagagacagttcc

SEQ ID NO: 141153 - DNA, 15 bp, Homo sapiens
atacagagacagttc

SEQ ID NO: 141154 - DNA, 15 bp, Homo sapiens
aatacagagacagtt

SEQ ID NO: 141155 - DNA, 15 bp, Homo sapiens
gaatacagagacagt

SEQ ID NO: 141156 - DNA, 15 bp, Homo sapiens
tgaatacagagacag

SEQ ID NO: 141157 - DNA, 15 bp, Homo sapiens
aataaccttttgaaa

SEQ ID NO: 141158 - DNA, 15 bp, Homo sapiens
aaataaccttttgaa

SEQ ID NO: 141159 - DNA, 15 bp, Homo sapiens
taaataaccttttga

SEQ ID NO: 141160 - DNA, 15 bp, Homo sapiens
ttaaataaccttttg

SEQ ID NO: 141161 - DNA, 15 bp, Homo sapiens
tttaaataacctttt

SEQ ID NO: 141162 - DNA, 15 bp, Homo sapiens
atttaaataaccttt

SEQ ID NO: 141163 - DNA, 15 bp, Homo sapiens
tatttaaataacctt

SEQ ID NO: 141164 - DNA, 15 bp, Homo sapiens
atatttaaataacct

SEQ ID NO: 141165 - DNA, 15 bp, Homo sapiens
aatatttaaataacc

SEQ ID NO: 141166 - DNA, 15 bp, Homo sapiens
caatatttaaataac

SEQ ID NO: 141167 - DNA, 15 bp, Homo sapiens
acaatatttaaataa

SEQ ID NO: 141168 - DNA, 15 bp, Homo sapiens
cacaatatttaaata

SEQ ID NO: 141169 - DNA, 15 bp, Homo sapiens
acacaatatttaaat

SEQ ID NO: 141170 - DNA, 15 bp, Homo sapiens
tacacaatatttaaa

SEQ ID NO: 141171 - DNA, 15 bp, Homo sapiens
atacacaatatttaa

SEQ ID NO: 141172 - DNA, 15 bp, Homo sapiens
tatacacaatattta

SEQ ID NO: 141173 - DNA, 15 bp, Homo sapiens
ctatacacaatattt

SEQ ID NO: 141174 - DNA, 15 bp, Homo sapiens
actatacacaatatt

SEQ ID NO: 141175 - DNA, 15 bp, Homo sapiens
tactatacacaatat

SEQ ID NO: 141176 - DNA, 15 bp, Homo sapiens
ttactatacacaata

SEQ ID NO: 141177 - DNA, 15 bp, Homo sapiens
tttactatacacaat

SEQ ID NO: 141178 - DNA, 15 bp, Homo sapiens
ctttactatacacaa

SEQ ID NO: 141179 - DNA, 15 bp, Homo sapiens
tctttactatacaca

SEQ ID NO: 141180 - DNA, 15 bp, Homo sapiens
gtctttactatacac

SEQ ID NO: 141181 - DNA, 15 bp, Homo sapiens
agtctttactataca

SEQ ID NO: 141182 - DNA, 15 bp, Homo sapiens
cagtctttactatac

SEQ ID NO: 141183 - DNA, 15 bp, Homo sapiens
tcagtctttactata

SEQ ID NO: 141184 - DNA, 15 bp, Homo sapiens
atcagtctttactat

SEQ ID NO: 141185 - DNA, 15 bp, Homo sapiens
aatcagtctttacta

SEQ ID NO: 141186 - DNA, 15 bp, Homo sapiens
aaatcagtctttact

SEQ ID NO: 141187 - DNA, 15 bp, Homo sapiens
aaaatcagtctttac

SEQ ID NO: 141188 - DNA, 15 bp, Homo sapiens
caaaatcagtcttta

SEQ ID NO: 141189 - DNA, 15 bp, Homo sapiens
acaaaatcagtcttt

SEQ ID NO: 141190 - DNA, 15 bp, Homo sapiens
tacaaaatcagtctt

SEQ ID NO: 141191 - DNA, 15 bp, Homo sapiens
ttacaaaatcagtct

SEQ ID NO: 141192 - DNA, 15 bp, Homo sapiens
gttacaaaatcagtc

SEQ ID NO: 141193 - DNA, 15 bp, Homo sapiens
agttacaaaatcagt

SEQ ID NO: 141194 - DNA, 15 bp, Homo sapiens
tagttacaaaatcag

SEQ ID NO: 141195 - DNA, 15 bp, Homo sapiens
atagttacaaaatca

SEQ ID NO: 141196 - DNA, 15 bp, Homo sapiens
aatagttacaaaatc

SEQ ID NO: 141197 - DNA, 15 bp, Homo sapiens
gaatagttacaaaat

SEQ ID NO: 141198 - DNA, 15 bp, Homo sapiens
agaatagttacaaaa

SEQ ID NO: 141199 - DNA, 15 bp, Homo sapiens
cagaatagttacaaa

SEQ ID NO: 141200 - DNA, 15 bp, Homo sapiens
tcagaatagttacaa

SEQ ID NO: 141201 - DNA, 15 bp, Homo sapiens
ttcagaatagttaca

SEQ ID NO: 141202 - DNA, 15 bp, Homo sapiens
tttcagaatagttac

SEQ ID NO: 141203 - DNA, 15 bp, Homo sapiens
ttttcagaatagtta

SEQ ID NO: 141204 - DNA, 15 bp, Homo sapiens
gttttcagaatagtt

SEQ ID NO: 141205 - DNA, 15 bp, Homo sapiens
tgttttcagaatagt

SEQ ID NO: 141206 - DNA, 15 bp, Homo sapiens
ctgttttcagaatag

SEQ ID NO: 141207 - DNA, 15 bp, Homo sapiens
cctgttttcagaata

SEQ ID NO: 141208 - DNA, 15 bp, Homo sapiens
acctgttttcagaat

SEQ ID NO: 141209 - DNA, 15 bp, Homo sapiens
aacctgttttcagaa

SEQ ID NO: 141210 - DNA, 15 bp, Homo sapiens
taacctgttttcaga

SEQ ID NO: 141211 - DNA, 15 bp, Homo sapiens
ttaacctgttttcag

SEQ ID NO: 141212 - DNA, 15 bp, Homo sapiens
cttaacctgttttca

SEQ ID NO: 141213 - DNA, 15 bp, Homo sapiens
acttaacctgttttc

SEQ ID NO: 141214 - DNA, 15 bp, Homo sapiens
aacttaacctgtttt

SEQ ID NO: 141215 - DNA, 15 bp, Homo sapiens
aaacttaacctgttt

SEQ ID NO: 141216 - DNA, 15 bp, Homo sapiens
gaaacttaacctgtt

SEQ ID NO: 141217 - DNA, 15 bp, Homo sapiens
tgaaacttaacctgt

SEQ ID NO: 141218 - DNA, 15 bp, Homo sapiens
ttgaaacttaacctg

SEQ ID NO: 141219 - DNA, 15 bp, Homo sapiens
tttgaaacttaacct

SEQ ID NO: 141220 - DNA, 15 bp, Homo sapiens
ttttgaaacttaacc

SEQ ID NO: 141221 - DNA, 15 bp, Homo sapiens
tttttgaaacttaac

SEQ ID NO: 141222 - DNA, 15 bp, Homo sapiens
atttttgaaacttaa

SEQ ID NO: 141223 - DNA, 15 bp, Homo sapiens
aatttttgaaactta

SEQ ID NO: 141224 - DNA, 15 bp, Homo sapiens
aaatttttgaaactt

SEQ ID NO: 141225 - DNA, 15 bp, Homo sapiens
taaatttttgaaact

SEQ ID NO: 141226 - DNA, 15 bp, Homo sapiens
ttaaatttttgaaac

SEQ ID NO: 141227 - DNA, 15 bp, Homo sapiens
attaaatttttgaaa

SEQ ID NO: 141228 - DNA, 15 bp, Homo sapiens
aattaaatttttgaa

SEQ ID NO: 141229 - DNA, 15 bp, Homo sapiens
aaattaaatttttga

SEQ ID NO: 141230 - DNA, 15 bp, Homo sapiens
aaaattaaatttttg

SEQ ID NO: 141231 - DNA, 15 bp, Homo sapiens
caaaattaaattttt

SEQ ID NO: 141232 - DNA, 15 bp, Homo sapiens
tcaaaattaaatttt

SEQ ID NO: 141233 - DNA, 15 bp, Homo sapiens
atcaaaattaaattt

SEQ ID NO: 141234 - DNA, 15 bp, Homo sapiens
aatcaaaattaaatt

SEQ ID NO: 141235 - DNA, 15 bp, Homo sapiens
caatcaaaattaaat

SEQ ID NO: 141236 - DNA, 15 bp, Homo sapiens
tcaatcaaaattaaa

SEQ ID NO: 141237 - DNA, 15 bp, Homo sapiens
gtcaatcaaaattaa

SEQ ID NO: 141238 - DNA, 15 bp, Homo sapiens
agtcaatcaaaatta

SEQ ID NO: 141239 - DNA, 15 bp, Homo sapiens
aagtcaatcaaaatt

SEQ ID NO: 141240 - DNA, 15 bp, Homo sapiens
aaagtcaatcaaaat

SEQ ID NO: 141241 - DNA, 15 bp, Homo sapiens
gaaagtcaatcaaaa

SEQ ID NO: 141242 - DNA, 15 bp, Homo sapiens
ggaaagtcaatcaaa

SEQ ID NO: 141243 - DNA, 15 bp, Homo sapiens
tggaaagtcaatcaa

SEQ ID NO: 141244 - DNA, 15 bp, Homo sapiens
ttggaaagtcaatca

SEQ ID NO: 141245 - DNA, 15 bp, Homo sapiens
cttggaaagtcaatc

SEQ ID NO: 141246 - DNA, 15 bp, Homo sapiens
acttggaaagtcaat

SEQ ID NO: 141247 - DNA, 15 bp, Homo sapiens
tacttggaaagtcaa

SEQ ID NO: 141248 - DNA, 15 bp, Homo sapiens
ttacttggaaagtca

SEQ ID NO: 141249 - DNA, 15 bp, Homo sapiens
attacttggaaagtc

SEQ ID NO: 141250 - DNA, 15 bp, Homo sapiens
aattacttggaaagt

SEQ ID NO: 141251 - DNA, 15 bp, Homo sapiens
aaattacttggaaag

SEQ ID NO: 141252 - DNA, 15 bp, Homo sapiens
aaaattacttggaaa

SEQ ID NO: 141253 - DNA, 15 bp, Homo sapiens
caaaattacttggaa

SEQ ID NO: 141254 - DNA, 15 bp, Homo sapiens
acaaaattacttgga

SEQ ID NO: 141255 - DNA, 15 bp, Homo sapiens
aacaaaattacttgg

SEQ ID NO: 141256 - DNA, 15 bp, Homo sapiens
caacaaaattacttg

SEQ ID NO: 141257 - DNA, 15 bp, Homo sapiens
acaacaaaattactt

SEQ ID NO: 141258 - DNA, 15 bp, Homo sapiens
tacaacaaaattact

SEQ ID NO: 141259 - DNA, 15 bp, Homo sapiens
atacaacaaaattac

SEQ ID NO: 141260 - DNA, 15 bp, Homo sapiens
tatacaacaaaatta

SEQ ID NO: 141261 - DNA, 15 bp, Homo sapiens
atatacaacaaaatt

SEQ ID NO: 141262 - DNA, 15 bp, Homo sapiens
aatatacaacaaaat

SEQ ID NO: 141263 - DNA, 15 bp, Homo sapiens
aaatatacaacaaaa

SEQ ID NO: 141264 - DNA, 15 bp, Homo sapiens
caaatatacaacaaa

SEQ ID NO: 141265 - DNA, 15 bp, Homo sapiens
ccaaatatacaacaa

SEQ ID NO: 141266 - DNA, 15 bp, Homo sapiens
tccaaatatacaaca

SEQ ID NO: 141267 - DNA, 15 bp, Homo sapiens
ttccaaatatacaac

SEQ ID NO: 141268 - DNA, 15 bp, Homo sapiens
cttccaaatatacaa

SEQ ID NO: 141269 - DNA, 15 bp, Homo sapiens
gcttccaaatataca

SEQ ID NO: 141270 - DNA, 15 bp, Homo sapiens
agcttccaaatatac

SEQ ID NO: 141271 - DNA, 15 bp, Homo sapiens
aagcttccaaatata

SEQ ID NO: 141272 - DNA, 15 bp, Homo sapiens
gaagcttccaaatat

SEQ ID NO: 141273 - DNA, 15 bp, Homo sapiens
agaagcttccaaata

SEQ ID NO: 141274 - DNA, 15 bp, Homo sapiens
tagaagcttccaaat

SEQ ID NO: 141275 - DNA, 15 bp, Homo sapiens
atagaagcttccaaa

SEQ ID NO: 141276 - DNA, 15 bp, Homo sapiens
aatagaagcttccaa

SEQ ID NO: 141277 - DNA, 15 bp, Homo sapiens
taatagaagcttcca

SEQ ID NO: 141278 - DNA, 15 bp, Homo sapiens
ataatagaagcttcc

SEQ ID NO: 141279 - DNA, 15 bp, Homo sapiens
tataatagaagcttc

SEQ ID NO: 141280 - DNA, 15 bp, Homo sapiens
atataatagaagctt

SEQ ID NO: 141281 - DNA, 15 bp, Homo sapiens
gatataatagaagct

SEQ ID NO: 141282 - DNA, 15 bp, Homo sapiens
agatataatagaagc

SEQ ID NO: 141283 - DNA, 15 bp, Homo sapiens
cagatataatagaag

SEQ ID NO: 141284 - DNA, 15 bp, Homo sapiens
acagatataatagaa

SEQ ID NO: 141285 - DNA, 15 bp, Homo sapiens
aacagatataataga

SEQ ID NO: 141286 - DNA, 15 bp, Homo sapiens
taacagatataatag

SEQ ID NO: 141287 - DNA, 15 bp, Homo sapiens
ataacagatataata

SEQ ID NO: 141288 - DNA, 15 bp, Homo sapiens
aataacagatataat

SEQ ID NO: 141289 - DNA, 15 bp, Homo sapiens
taataacagatataa

SEQ ID NO: 141290 - DNA, 15 bp, Homo sapiens
gtaataacagatata

SEQ ID NO: 141291 - DNA, 15 bp, Homo sapiens
agtaataacagatat

SEQ ID NO: 141292 - DNA, 15 bp, Homo sapiens
aagtaataacagata

SEQ ID NO: 141293 - DNA, 15 bp, Homo sapiens
aaagtaataacagat

SEQ ID NO: 141294 - DNA, 15 bp, Homo sapiens
aaaagtaataacaga

SEQ ID NO: 141295 - DNA, 15 bp, Homo sapiens
aaaaagtaataacag

SEQ ID NO: 141296 - DNA, 15 bp, Homo sapiens
gaaaaagtaataaca

SEQ ID NO: 141297 - DNA, 15 bp, Homo sapiens
tgaaaaagtaataac

SEQ ID NO: 141298 - DNA, 15 bp, Homo sapiens
ctgaaaaagtaataa

SEQ ID NO: 141299 - DNA, 15 bp, Homo sapiens
actgaaaaagtaata

SEQ ID NO: 141300 - DNA, 15 bp, Homo sapiens
tactgaaaaagtaat

SEQ ID NO: 141301 - DNA, 15 bp, Homo sapiens
ttactgaaaaagtaa

SEQ ID NO: 141302 - DNA, 15 bp, Homo sapiens
attactgaaaaagta

SEQ ID NO: 141303 - DNA, 15 bp, Homo sapiens
cattactgaaaaagt

SEQ ID NO: 141304 - DNA, 15 bp, Homo sapiens
tcattactgaaaaag

SEQ ID NO: 141305 - DNA, 15 bp, Homo sapiens
atcattactgaaaaa

SEQ ID NO: 141306 - DNA, 15 bp, Homo sapiens
catcattactgaaaa

SEQ ID NO: 141307 - DNA, 15 bp, Homo sapiens
acatcattactgaaa

SEQ ID NO: 141308 - DNA, 15 bp, Homo sapiens
aacatcattactgaa

SEQ ID NO: 141309 - DNA, 15 bp, Homo sapiens
aaacatcattactga

SEQ ID NO: 141310 - DNA, 15 bp, Homo sapiens
taaacatcattactg

SEQ ID NO: 141311 - DNA, 15 bp, Homo sapiens
ataaacatcattact

SEQ ID NO: 141312 - DNA, 15 bp, Homo sapiens
aataaacatcattac

SEQ ID NO: 141313 - DNA, 15 bp, Homo sapiens
caataaacatcatta

SEQ ID NO: 141314 - DNA, 15 bp, Homo sapiens
acaataaacatcatt

SEQ ID NO: 141315 - DNA, 15 bp, Homo sapiens
gacaataaacatcat

SEQ ID NO: 141316 - DNA, 15 bp, Homo sapiens
ggacaataaacatca

SEQ ID NO: 141317 - DNA, 15 bp, Homo sapiens
gggacaataaacatc

SEQ ID NO: 141318 - DNA, 15 bp, Homo sapiens
agggacaataaacat

SEQ ID NO: 141319 - DNA, 15 bp, Homo sapiens
tagggacaataaaca

SEQ ID NO: 141320 - DNA, 15 bp, Homo sapiens
atagggacaataaac

SEQ ID NO: 141321 - DNA, 15 bp, Homo sapiens
tatagggacaataaa

SEQ ID NO: 141322 - DNA, 15 bp, Homo sapiens
ctatagggacaataa

SEQ ID NO: 141323 - DNA, 15 bp, Homo sapiens
tctatagggacaata

SEQ ID NO: 141324 - DNA, 15 bp, Homo sapiens
atctatagggacaat

SEQ ID NO: 141325 - DNA, 15 bp, Homo sapiens
aatctatagggacaa

SEQ ID NO: 141326 - DNA, 15 bp, Homo sapiens
taatctatagggaca

SEQ ID NO: 141327 - DNA, 15 bp, Homo sapiens
ttaatctatagggac

SEQ ID NO: 141328 - DNA, 15 bp, Homo sapiens
attaatctataggga

SEQ ID NO: 141329 - DNA, 15 bp, Homo sapiens
tattaatctataggg

SEQ ID NO: 141330 - DNA, 15 bp, Homo sapiens
ttattaatctatagg

SEQ ID NO: 141331 - DNA, 15 bp, Homo sapiens
tttattaatctatag

SEQ ID NO: 141332 - DNA, 15 bp, Homo sapiens
ttttattaatctata

SEQ ID NO: 141333 - DNA, 15 bp, Homo sapiens
tttttattaatctat

SEQ ID NO: 141334 - DNA, 15 bp, Homo sapiens
atttttattaatcta

SEQ ID NO: 141335 - DNA, 15 bp, Homo sapiens
catttttattaatct

SEQ ID NO: 141336 - DNA, 15 bp, Homo sapiens
tcatttttattaatc

SEQ ID NO: 141337 - DNA, 15 bp, Homo sapiens
ttcatttttattaat

SEQ ID NO: 141338 - DNA, 15 bp, Homo sapiens
cttcatttttattaa

SEQ ID NO: 141339 - DNA, 15 bp, Homo sapiens
gcttcatttttatta

SEQ ID NO: 141340 - DNA, 15 bp, Homo sapiens
agcttcatttttatt

SEQ ID NO: 141341 - DNA, 15 bp, Homo sapiens
aagcttcatttttat

SEQ ID NO: 141342 - DNA, 15 bp, Homo sapiens
aaagcttcattttta

SEQ ID NO: 141343 - DNA, 15 bp, Homo sapiens
aaaagcttcattttt

SEQ ID NO: 141344 - DNA, 15 bp, Homo sapiens
aaaaagcttcatttt

SEQ ID NO: 141345 - DNA, 15 bp, Homo sapiens
aaaaaagcttcattt

SEQ ID NO: 141346 - DNA, 15 bp, Homo sapiens
gaaaaaagcttcatt

SEQ ID NO: 141347 - DNA, 15 bp, Homo sapiens
tgaaaaaagcttcat

SEQ ID NO: 141348 - DNA, 15 bp, Homo sapiens
ctgaaaaaagcttca

SEQ ID NO: 141349 - DNA, 15 bp, Homo sapiens
gctgaaaaaagcttc

SEQ ID NO: 141350 - DNA, 15 bp, Homo sapiens
tgctgaaaaaagctt

SEQ ID NO: 141351 - DNA, 15 bp, Homo sapiens
atgctgaaaaaagct

SEQ ID NO: 141352 - DNA, 15 bp, Homo sapiens
aatgctgaaaaaagc

SEQ ID NO: 141353 - DNA, 15 bp, Homo sapiens
aaatgctgaaaaaag

SEQ ID NO: 141354 - DNA, 15 bp, Homo sapiens
taaatgctgaaaaaa

SEQ ID NO: 141355 - DNA, 15 bp, Homo sapiens
ataaatgctgaaaaa

SEQ ID NO: 141356 - DNA, 15 bp, Homo sapiens
aataaatgctgaaaa

SEQ ID NO: 141357 - DNA, 15 bp, Homo sapiens
gaataaatgctgaaa

SEQ ID NO: 141358 - DNA, 15 bp, Homo sapiens
agaataaatgctgaa

SEQ ID NO: 141359 - DNA, 15 bp, Homo sapiens
aagaataaatgctga

SEQ ID NO: 141360 - DNA, 15 bp, Homo sapiens
aaagaataaatgctg

SEQ ID NO: 141361 - DNA, 15 bp, Homo sapiens
caaagaataaatgct

SEQ ID NO: 141362 - DNA, 15 bp, Homo sapiens
acaaagaataaatgc

SEQ ID NO: 141363 - DNA, 15 bp, Homo sapiens
gacaaagaataaatg

SEQ ID NO: 141364 - DNA, 15 bp, Homo sapiens
ggacaaagaataaat

SEQ ID NO: 141365 - DNA, 15 bp, Homo sapiens
tggacaaagaataaa

SEQ ID NO: 141366 - DNA, 15 bp, Homo sapiens
ttggacaaagaataa

SEQ ID NO: 141367 - DNA, 15 bp, Homo sapiens
attggacaaagaata

SEQ ID NO: 141368 - DNA, 15 bp, Homo sapiens
aattggacaaagaat

SEQ ID NO: 141369 - DNA, 15 bp, Homo sapiens
aaattggacaaagaa

SEQ ID NO: 141370 - DNA, 15 bp, Homo sapiens
caaattggacaaaga

SEQ ID NO: 141371 - DNA, 15 bp, Homo sapiens
ccaaattggacaaag

SEQ ID NO: 141372 - DNA, 15 bp, Homo sapiens
accaaattggacaaa

SEQ ID NO: 141373 - DNA, 15 bp, Homo sapiens
gaccaaattggacaa

SEQ ID NO: 141374 - DNA, 15 bp, Homo sapiens
tgaccaaattggaca

SEQ ID NO: 141375 - DNA, 15 bp, Homo sapiens
ttgaccaaattggac

SEQ ID NO: 141376 - DNA, 15 bp, Homo sapiens
attgaccaaattgga

SEQ ID NO: 141377 - DNA, 15 bp, Homo sapiens
aattgaccaaattgg

SEQ ID NO: 141378 - DNA, 15 bp, Homo sapiens
gaattgaccaaattg

SEQ ID NO: 141379 - DNA, 15 bp, Homo sapiens
ggaattgaccaaatt

SEQ ID NO: 141380 - DNA, 15 bp, Homo sapiens
aggaattgaccaaat

SEQ ID NO: 141381 - DNA, 15 bp, Homo sapiens
aaggaattgaccaaa

SEQ ID NO: 141382 - DNA, 15 bp, Homo sapiens
aaaggaattgaccaa

SEQ ID NO: 141383 - DNA, 15 bp, Homo sapiens
aaaaggaattgacca

SEQ ID NO: 141384 - DNA, 15 bp, Homo sapiens
taaaaggaattgacc

SEQ ID NO: 141385 - DNA, 15 bp, Homo sapiens
ttaaaaggaattgac

SEQ ID NO: 141386 - DNA, 15 bp, Homo sapiens
gttaaaaggaattga

SEQ ID NO: 141387 - DNA, 15 bp, Homo sapiens
tgttaaaaggaattg

SEQ ID NO: 141388 - DNA, 15 bp, Homo sapiens
ctgttaaaaggaatt

SEQ ID NO: 141389 - DNA, 15 bp, Homo sapiens
actgttaaaaggaat

SEQ ID NO: 141390 - DNA, 15 bp, Homo sapiens
cactgttaaaaggaa

SEQ ID NO: 141391 - DNA, 15 bp, Homo sapiens
tcactgttaaaagga

SEQ ID NO: 141392 - DNA, 15 bp, Homo sapiens
atcactgttaaaagg

SEQ ID NO: 141393 - DNA, 15 bp, Homo sapiens
gatcactgttaaaag

SEQ ID NO: 141394 - DNA, 15 bp, Homo sapiens
tgatcactgttaaaa

SEQ ID NO: 141395 - DNA, 15 bp, Homo sapiens
ctgatcactgttaaa

SEQ ID NO: 141396 - DNA, 15 bp, Homo sapiens
actgatcactgttaa

SEQ ID NO: 141397 - DNA, 15 bp, Homo sapiens
tactgatcactgtta

SEQ ID NO: 141398 - DNA, 15 bp, Homo sapiens
ctactgatcactgtt

SEQ ID NO: 141399 - DNA, 15 bp, Homo sapiens
tctactgatcactgt

SEQ ID NO: 141400 - DNA, 15 bp, Homo sapiens
ttctactgatcactg

SEQ ID NO: 141401 - DNA, 15 bp, Homo sapiens
cttctactgatcact

SEQ ID NO: 141402 - DNA, 15 bp, Homo sapiens
tcttctactgatcac

SEQ ID NO: 141403 - DNA, 15 bp, Homo sapiens
atcttctactgatca

SEQ ID NO: 141404 - DNA, 15 bp, Homo sapiens
tatcttctactgatc

SEQ ID NO: 141405 - DNA, 15 bp, Homo sapiens
gtatcttctactgat

SEQ ID NO: 141406 - DNA, 15 bp, Homo sapiens
agtatcttctactga

SEQ ID NO: 141407 - DNA, 15 bp, Homo sapiens
aagtatcttctactg

SEQ ID NO: 141408 - DNA, 15 bp, Homo sapiens
taagtatcttctact

SEQ ID NO: 141409 - DNA, 15 bp, Homo sapiens
ataagtatcttctac

SEQ ID NO: 141410 - DNA, 15 bp, Homo sapiens
tataagtatcttcta

SEQ ID NO: 141411 - DNA, 15 bp, Homo sapiens
atataagtatcttct

SEQ ID NO: 141412 - DNA, 15 bp, Homo sapiens
aatataagtatcttc

SEQ ID NO: 141413 - DNA, 15 bp, Homo sapiens
caatataagtatctt

SEQ ID NO: 141414 - DNA, 15 bp, Homo sapiens
ccaatataagtatct

SEQ ID NO: 141415 - DNA, 15 bp, Homo sapiens
cccaatataagtatc

SEQ ID NO: 141416 - DNA, 15 bp, Homo sapiens
tcccaatataagtat

SEQ ID NO: 141417 - DNA, 15 bp, Homo sapiens
atcccaatataagta

SEQ ID NO: 141418 - DNA, 15 bp, Homo sapiens
aatcccaatataagt

SEQ ID NO: 141419 - DNA, 15 bp, Homo sapiens
caatcccaatataag

SEQ ID NO: 141420 - DNA, 15 bp, Homo sapiens
acaatcccaatataa

SEQ ID NO: 141421 - DNA, 15 bp, Homo sapiens
aacaatcccaatata

SEQ ID NO: 141422 - DNA, 15 bp, Homo sapiens
aaacaatcccaatat

SEQ ID NO: 141423 - DNA, 15 bp, Homo sapiens
gaaacaatcccaata

SEQ ID NO: 141424 - DNA, 15 bp, Homo sapiens
tgaaacaatcccaat

SEQ ID NO: 141425 - DNA, 15 bp, Homo sapiens
atgaaacaatcccaa

SEQ ID NO: 141426 - DNA, 15 bp, Homo sapiens
tatgaaacaatccca

SEQ ID NO: 141427 - DNA, 15 bp, Homo sapiens
ttatgaaacaatccc

SEQ ID NO: 141428 - DNA, 15 bp, Homo sapiens
cttatgaaacaatcc

SEQ ID NO: 141429 - DNA, 15 bp, Homo sapiens
ccttatgaaacaatc

SEQ ID NO: 141430 - DNA, 15 bp, Homo sapiens
gccttatgaaacaat

SEQ ID NO: 141431 - DNA, 15 bp, Homo sapiens
ggccttatgaaacaa

SEQ ID NO: 141432 - DNA, 15 bp, Homo sapiens
aggccttatgaaaca

SEQ ID NO: 141433 - DNA, 15 bp, Homo sapiens
caggccttatgaaac

SEQ ID NO: 141434 - DNA, 15 bp, Homo sapiens
tcaggccttatgaaa

SEQ ID NO: 141435 - DNA, 15 bp, Homo sapiens
atcaggccttatgaa

SEQ ID NO: 141436 - DNA, 15 bp, Homo sapiens
tatcaggccttatga

SEQ ID NO: 141437 - DNA, 15 bp, Homo sapiens
atatcaggccttatg

SEQ ID NO: 141438 - DNA, 15 bp, Homo sapiens
gatatcaggccttat

SEQ ID NO: 141439 - DNA, 15 bp, Homo sapiens
tgatatcaggcctta

SEQ ID NO: 141440 - DNA, 15 bp, Homo sapiens
ctgatatcaggcctt

SEQ ID NO: 141441 - DNA, 15 bp, Homo sapiens
gctgatatcaggcct

SEQ ID NO: 141442 - DNA, 15 bp, Homo sapiens
ggctgatatcaggcc

SEQ ID NO: 141443 - DNA, 15 bp, Homo sapiens
tggctgatatcaggc

SEQ ID NO: 141444 - DNA, 15 bp, Homo sapiens
ctggctgatatcagg

SEQ ID NO: 141445 - DNA, 15 bp, Homo sapiens
cctggctgatatcag

SEQ ID NO: 141446 - DNA, 15 bp, Homo sapiens
gcctggctgatatca

SEQ ID NO: 141447 - DNA, 15 bp, Homo sapiens
agcctggctgatatc

SEQ ID NO: 141448 - DNA, 15 bp, Homo sapiens
gagcctggctgatat

SEQ ID NO: 141449 - DNA, 15 bp, Homo sapiens
tgagcctggctgata

SEQ ID NO: 141450 - DNA, 15 bp, Homo sapiens
ttgagcctggctgat

SEQ ID NO: 141451 - DNA, 15 bp, Homo sapiens
gttgagcctggctga

SEQ ID NO: 141452 - DNA, 15 bp, Homo sapiens
ggttgagcctggctg

SEQ ID NO: 141453 - DNA, 15 bp, Homo sapiens
aggttgagcctggct

SEQ ID NO: 141454 - DNA, 15 bp, Homo sapiens
aaggttgagcctggc

SEQ ID NO: 141455 - DNA, 15 bp, Homo sapiens
gaaggttgagcctgg

SEQ ID NO: 141456 - DNA, 15 bp, Homo sapiens
tgaaggttgagcctg

SEQ ID NO: 141457 - DNA, 15 bp, Homo sapiens
ttgaaggttgagcct

SEQ ID NO: 141458 - DNA, 15 bp, Homo sapiens
cttgaaggttgagcc

SEQ ID NO: 141459 - DNA, 15 bp, Homo sapiens
gcttgaaggttgagc

SEQ ID NO: 141460 - DNA, 15 bp, Homo sapiens
agcttgaaggttgag

SEQ ID NO: 141461 - DNA, 15 bp, Homo sapiens
gagcttgaaggttga

SEQ ID NO: 141462 - DNA, 15 bp, Homo sapiens
agagcttgaaggttg

SEQ ID NO: 141463 - DNA, 15 bp, Homo sapiens
aagagcttgaaggtt

SEQ ID NO: 141464 - DNA, 15 bp, Homo sapiens
taagagcttgaaggt

SEQ ID NO: 141465 - DNA, 15 bp, Homo sapiens
ttaagagcttgaagg

SEQ ID NO: 141466 - DNA, 15 bp, Homo sapiens
tttaagagcttgaag

SEQ ID NO: 141467 - DNA, 15 bp, Homo sapiens
ttttaagagcttgaa

SEQ ID NO: 141468 - DNA, 15 bp, Homo sapiens
tttttaagagcttga

SEQ ID NO: 141469 - DNA, 15 bp, Homo sapiens
atttttaagagcttg

SEQ ID NO: 141470 - DNA, 15 bp, Homo sapiens
catttttaagagctt

SEQ ID NO: 141471 - DNA, 15 bp, Homo sapiens
tcatttttaagagct

SEQ ID NO: 141472 - DNA, 15 bp, Homo sapiens
ttcatttttaagagc

SEQ ID NO: 141473 - DNA, 15 bp, Homo sapiens
attcatttttaagag

SEQ ID NO: 141474 - DNA, 15 bp, Homo sapiens
cattcatttttaaga

SEQ ID NO: 141475 - DNA, 15 bp, Homo sapiens
gcattcatttttaag

SEQ ID NO: 141476 - DNA, 15 bp, Homo sapiens
agcattcatttttaa

SEQ ID NO: 141477 - DNA, 15 bp, Homo sapiens
cagcattcattttta

SEQ ID NO: 141478 - DNA, 15 bp, Homo sapiens
acagcattcattttt

SEQ ID NO: 141479 - DNA, 15 bp, Homo sapiens
tacagcattcatttt

SEQ ID NO: 141480 - DNA, 15 bp, Homo sapiens
ctacagcattcattt

SEQ ID NO: 141481 - DNA, 15 bp, Homo sapiens
gctacagcattcatt

SEQ ID NO: 141482 - DNA, 15 bp, Homo sapiens
tgctacagcattcat

SEQ ID NO: 141483 - DNA, 15 bp, Homo sapiens
ctgctacagcattca

SEQ ID NO: 141484 - DNA, 15 bp, Homo sapiens
gctgctacagcattc

SEQ ID NO: 141485 - DNA, 15 bp, Homo sapiens
agctgctacagcatt

SEQ ID NO: 141486 - DNA, 15 bp, Homo sapiens
cagctgctacagcat

SEQ ID NO: 141487 - DNA, 15 bp, Homo sapiens
acagctgctacagca

SEQ ID NO: 141488 - DNA, 15 bp, Homo sapiens
gacagctgctacagc

SEQ ID NO: 141489 - DNA, 15 bp, Homo sapiens
tgacagctgctacag

SEQ ID NO: 141490 - DNA, 15 bp, Homo sapiens
atgacagctgctaca

SEQ ID NO: 141491 - DNA, 15 bp, Homo sapiens
aatgacagctgctac

SEQ ID NO: 141492 - DNA, 15 bp, Homo sapiens
gaatgacagctgcta

SEQ ID NO: 141493 - DNA, 15 bp, Homo sapiens
ggaatgacagctgct

SEQ ID NO: 141494 - DNA, 15 bp, Homo sapiens
gggaatgacagctgc

SEQ ID NO: 141495 - DNA, 15 bp, Homo sapiens
cgggaatgacagctg

SEQ ID NO: 141496 - DNA, 15 bp, Homo sapiens
tcgggaatgacagct

SEQ ID NO: 141497 - DNA, 15 bp, Homo sapiens
ttcgggaatgacagc

SEQ ID NO: 141498 - DNA, 15 bp, Homo sapiens
attcgggaatgacag

SEQ ID NO: 141499 - DNA, 15 bp, Homo sapiens
cattcgggaatgaca

SEQ ID NO: 141500 - DNA, 15 bp, Homo sapiens
tcattcgggaatgac

SEQ ID NO: 141501 - DNA, 15 bp, Homo sapiens
ttcattcgggaatga

SEQ ID NO: 141502 - DNA, 15 bp, Homo sapiens
attcattcgggaatg

SEQ ID NO: 141503 - DNA, 15 bp, Homo sapiens
cattcattcgggaat

SEQ ID NO: 141504 - DNA, 15 bp, Homo sapiens
ccattcattcgggaa

SEQ ID NO: 141505 - DNA, 15 bp, Homo sapiens
cccattcattcggga

SEQ ID NO: 141506 - DNA, 15 bp, Homo sapiens
gcccattcattcggg

SEQ ID NO: 141507 - DNA, 15 bp, Homo sapiens
agcccattcattcgg

SEQ ID NO: 141508 - DNA, 15 bp, Homo sapiens
aagcccattcattcg

SEQ ID NO: 141509 - DNA, 15 bp, Homo sapiens
taagcccattcattc

SEQ ID NO: 141510 - DNA, 15 bp, Homo sapiens
ctaagcccattcatt

SEQ ID NO: 141511 - DNA, 15 bp, Homo sapiens
cctaagcccattcat

SEQ ID NO: 141512 - DNA, 15 bp, Homo sapiens
acctaagcccattca

SEQ ID NO: 141513 - DNA, 15 bp, Homo sapiens
cacctaagcccattc

SEQ ID NO: 141514 - DNA, 15 bp, Homo sapiens
tcacctaagcccatt

SEQ ID NO: 141515 - DNA, 15 bp, Homo sapiens
ttcacctaagcccat

SEQ ID NO: 141516 - DNA, 15 bp, Homo sapiens
tttcacctaagccca

SEQ ID NO: 141517 - DNA, 15 bp, Homo sapiens
ttttcacctaagccc

SEQ ID NO: 141518 - DNA, 15 bp, Homo sapiens
cttttcacctaagcc

SEQ ID NO: 141519 - DNA, 15 bp, Homo sapiens
acttttcacctaagc

SEQ ID NO: 141520 - DNA, 15 bp, Homo sapiens
tacttttcacctaag

SEQ ID NO: 141521 - DNA, 15 bp, Homo sapiens
gtacttttcacctaa

SEQ ID NO: 141522 - DNA, 15 bp, Homo sapiens
tgtacttttcaccta

SEQ ID NO: 141523 - DNA, 15 bp, Homo sapiens
ctgtacttttcacct

SEQ ID NO: 141524 - DNA, 15 bp, Homo sapiens
cctgtacttttcacc

SEQ ID NO: 141525 - DNA, 15 bp, Homo sapiens
acctgtacttttcac

SEQ ID NO: 141526 - DNA, 15 bp, Homo sapiens
tacctgtacttttca

SEQ ID NO: 141527 - DNA, 15 bp, Homo sapiens
ctacctgtacttttc

SEQ ID NO: 141528 - DNA, 15 bp, Homo sapiens
gctacctgtactttt

SEQ ID NO: 141529 - DNA, 15 bp, Homo sapiens
ggctacctgtacttt

SEQ ID NO: 141530 - DNA, 15 bp, Homo sapiens
aggctacctgtactt

SEQ ID NO: 141531 - DNA, 15 bp, Homo sapiens
aaggctacctgtact

SEQ ID NO: 141532 - DNA, 15 bp, Homo sapiens
taaggctacctgtac

SEQ ID NO: 141533 - DNA, 15 bp, Homo sapiens
ataaggctacctgta

SEQ ID NO: 141534 - DNA, 15 bp, Homo sapiens
gataaggctacctgt

SEQ ID NO: 141535 - DNA, 15 bp, Homo sapiens
ggataaggctacctg

SEQ ID NO: 141536 - DNA, 15 bp, Homo sapiens
aggataaggctacct

SEQ ID NO: 141537 - DNA, 15 bp, Homo sapiens
gaggataaggctacc

SEQ ID NO: 141538 - DNA, 15 bp, Homo sapiens
ggaggataaggctac

SEQ ID NO: 141539 - DNA, 15 bp, Homo sapiens
aggaggataaggcta

SEQ ID NO: 141540 - DNA, 15 bp, Homo sapiens
taggaggataaggct

SEQ ID NO: 141541 - DNA, 15 bp, Homo sapiens
ctaggaggataaggc

SEQ ID NO: 141542 - DNA, 15 bp, Homo sapiens
gctaggaggataagg

SEQ ID NO: 141543 - DNA, 15 bp, Homo sapiens
tgctaggaggataag

SEQ ID NO: 141544 - DNA, 15 bp, Homo sapiens
atgctaggaggataa

SEQ ID NO: 141545 - DNA, 15 bp, Homo sapiens
catgctaggaggata

SEQ ID NO: 141546 - DNA, 15 bp, Homo sapiens
gcatgctaggaggat

SEQ ID NO: 141547 - DNA, 15 bp, Homo sapiens
ggcatgctaggagga

SEQ ID NO: 141548 - DNA, 15 bp, Homo sapiens
gggcatgctaggagg

SEQ ID NO: 141549 - DNA, 15 bp, Homo sapiens
tgggcatgctaggag

SEQ ID NO: 141550 - DNA, 15 bp, Homo sapiens
gtgggcatgctagga

SEQ ID NO: 141551 - DNA, 15 bp, Homo sapiens
ggtgggcatgctagg

SEQ ID NO: 141552 - DNA, 15 bp, Homo sapiens
tggtgggcatgctag

SEQ ID NO: 141553 - DNA, 15 bp, Homo sapiens
ttggtgggcatgcta

SEQ ID NO: 141554 - DNA, 15 bp, Homo sapiens
attggtgggcatgct

SEQ ID NO: 141555 - DNA, 15 bp, Homo sapiens
tattggtgggcatgc

SEQ ID NO: 141556 - DNA, 15 bp, Homo sapiens
atattggtgggcatg

SEQ ID NO: 141557 - DNA, 15 bp, Homo sapiens
catattggtgggcat

SEQ ID NO: 141558 - DNA, 15 bp, Homo sapiens
tcatattggtgggca

SEQ ID NO: 141559 - DNA, 15 bp, Homo sapiens
ctcatattggtgggc

SEQ ID NO: 141560 - DNA, 15 bp, Homo sapiens
cctcatattggtggg

SEQ ID NO: 141561 - DNA, 15 bp, Homo sapiens
acctcatattggtgg

SEQ ID NO: 141562 - DNA, 15 bp, Homo sapiens
aacctcatattggtg

SEQ ID NO: 141563 - DNA, 15 bp, Homo sapiens
gaacctcatattggt

SEQ ID NO: 141564 - DNA, 15 bp, Homo sapiens
tgaacctcatattgg

SEQ ID NO: 141565 - DNA, 15 bp, Homo sapiens
ctgaacctcatattg

SEQ ID NO: 141566 - DNA, 15 bp, Homo sapiens
tctgaacctcatatt

SEQ ID NO: 141567 - DNA, 15 bp, Homo sapiens
ctctgaacctcatat

SEQ ID NO: 141568 - DNA, 15 bp, Homo sapiens
tctctgaacctcata

SEQ ID NO: 141569 - DNA, 15 bp, Homo sapiens
atctctgaacctcat

SEQ ID NO: 141570 - DNA, 15 bp, Homo sapiens
aatctctgaacctca

SEQ ID NO: 141571 - DNA, 15 bp, Homo sapiens
aaatctctgaacctc

SEQ ID NO: 141572 - DNA, 15 bp, Homo sapiens
caaatctctgaacct

SEQ ID NO: 141573 - DNA, 15 bp, Homo sapiens
ccaaatctctgaacc

SEQ ID NO: 141574 - DNA, 15 bp, Homo sapiens
cccaaatctctgaac

SEQ ID NO: 141575 - DNA, 15 bp, Homo sapiens
acccaaatctctgaa

SEQ ID NO: 141576 - DNA, 15 bp, Homo sapiens
gacccaaatctctga

SEQ ID NO: 141577 - DNA, 15 bp, Homo sapiens
tgacccaaatctctg

SEQ ID NO: 141578 - DNA, 15 bp, Homo sapiens
ctgacccaaatctct

SEQ ID NO: 141579 - DNA, 15 bp, Homo sapiens
actgacccaaatctc

SEQ ID NO: 141580 - DNA, 15 bp, Homo sapiens
gactgacccaaatct

SEQ ID NO: 141581 - DNA, 15 bp, Homo sapiens
tgactgacccaaatc

SEQ ID NO: 141582 - DNA, 15 bp, Homo sapiens
ttgactgacccaaat

SEQ ID NO: 141583 - DNA, 15 bp, Homo sapiens
gttgactgacccaaa

SEQ ID NO: 141584 - DNA, 15 bp, Homo sapiens
agttgactgacccaa

SEQ ID NO: 141585 - DNA, 15 bp, Homo sapiens
aagttgactgaccca

SEQ ID NO: 141586 - DNA, 15 bp, Homo sapiens
caagttgactgaccc

SEQ ID NO: 141587 - DNA, 15 bp, Homo sapiens
tcaagttgactgacc

SEQ ID NO: 141588 - DNA, 15 bp, Homo sapiens
atcaagttgactgac

SEQ ID NO: 141589 - DNA, 15 bp, Homo sapiens
aatcaagttgactga

SEQ ID NO: 141590 - DNA, 15 bp, Homo sapiens
aaatcaagttgactg

SEQ ID NO: 141591 - DNA, 15 bp, Homo sapiens
taaatcaagttgact

SEQ ID NO: 141592 - DNA, 15 bp, Homo sapiens
ataaatcaagttgac

SEQ ID NO: 141593 - DNA, 15 bp, Homo sapiens
gataaatcaagttga

SEQ ID NO: 141594 - DNA, 15 bp, Homo sapiens
ggataaatcaagttg

SEQ ID NO: 141595 - DNA, 15 bp, Homo sapiens
aggataaatcaagtt

SEQ ID NO: 141596 - DNA, 15 bp, Homo sapiens
gaggataaatcaagt

SEQ ID NO: 141597 - DNA, 15 bp, Homo sapiens
agaggataaatcaag

SEQ ID NO: 141598 - DNA, 15 bp, Homo sapiens
gagaggataaatcaa

SEQ ID NO: 141599 - DNA, 15 bp, Homo sapiens
cgagaggataaatca

SEQ ID NO: 141600 - DNA, 15 bp, Homo sapiens
ccgagaggataaatc

SEQ ID NO: 141601 - DNA, 15 bp, Homo sapiens
tccgagaggataaat

SEQ ID NO: 141602 - DNA, 15 bp, Homo sapiens
ttccgagaggataaa

SEQ ID NO: 141603 - DNA, 15 bp, Homo sapiens
cttccgagaggataa

SEQ ID NO: 141604 - DNA, 15 bp, Homo sapiens
gcttccgagaggata

SEQ ID NO: 141605 - DNA, 15 bp, Homo sapiens
agcttccgagaggat

SEQ ID NO: 141606 - DNA, 15 bp, Homo sapiens
aagcttccgagagga

SEQ ID NO: 141607 - DNA, 15 bp, Homo sapiens
taagcttccgagagg

SEQ ID NO: 141608 - DNA, 15 bp, Homo sapiens
gtaagcttccgagag

SEQ ID NO: 141609 - DNA, 15 bp, Homo sapiens
agtaagcttccgaga

SEQ ID NO: 141610 - DNA, 15 bp, Homo sapiens
aagtaagcttccgag

SEQ ID NO: 141611 - DNA, 15 bp, Homo sapiens
gaagtaagcttccga

SEQ ID NO: 141612 - DNA, 15 bp, Homo sapiens
agaagtaagcttccg

SEQ ID NO: 141613 - DNA, 15 bp, Homo sapiens
aagaagtaagcttcc

SEQ ID NO: 141614 - DNA, 15 bp, Homo sapiens
aaagaagtaagcttc

SEQ ID NO: 141615 - DNA, 15 bp, Homo sapiens
gaaagaagtaagctt

SEQ ID NO: 141616 - DNA, 15 bp, Homo sapiens
ggaaagaagtaagct

SEQ ID NO: 141617 - DNA, 15 bp, Homo sapiens
gggaaagaagtaagc

SEQ ID NO: 141618 - DNA, 15 bp, Homo sapiens
agggaaagaagtaag

SEQ ID NO: 141619 - DNA, 15 bp, Homo sapiens
cagggaaagaagtaa

SEQ ID NO: 141620 - DNA, 15 bp, Homo sapiens
tcagggaaagaagta

SEQ ID NO: 141621 - DNA, 15 bp, Homo sapiens
ttcagggaaagaagt

SEQ ID NO: 141622 - DNA, 15 bp, Homo sapiens
tttcagggaaagaag

SEQ ID NO: 141623 - DNA, 15 bp, Homo sapiens
ttttcagggaaagaa

SEQ ID NO: 141624 - DNA, 15 bp, Homo sapiens
gattttcagggaaag

SEQ ID NO: 141625 - DNA, 15 bp, Homo sapiens
tgattttcagggaaa

SEQ ID NO: 141626 - DNA, 15 bp, Homo sapiens
gtgattttcagggaa

SEQ ID NO: 141627 - DNA, 15 bp, Homo sapiens
ggtgattttcaggga

SEQ ID NO: 141628 - DNA, 15 bp, Homo sapiens
aggtgattttcaggg

SEQ ID NO: 141629 - DNA, 15 bp, Homo sapiens
aaggtgattttcagg

SEQ ID NO: 141630 - DNA, 15 bp, Homo sapiens
aaaggtgattttcag

SEQ ID NO: 141631 - DNA, 15 bp, Homo sapiens
taaaggtgattttca

SEQ ID NO: 141632 - DNA, 15 bp, Homo sapiens
ataaaggtgattttc

SEQ ID NO: 141633 - DNA, 15 bp, Homo sapiens
aataaaggtgatttt

SEQ ID NO: 141634 - DNA, 15 bp, Homo sapiens
aaataaaggtgattt

SEQ ID NO: 141635 - DNA, 15 bp, Homo sapiens
aaaataaaggtgatt

SEQ ID NO: 141636 - DNA, 15 bp, Homo sapiens
aaaaataaaggtgat

SEQ ID NO: 141637 - DNA, 15 bp, Homo sapiens
gaaaaataaaggtga

SEQ ID NO: 141638 - DNA, 15 bp, Homo sapiens
tgaaaaataaaggtg

SEQ ID NO: 141639 - DNA, 15 bp, Homo sapiens
ttgaaaaataaaggt

SEQ ID NO: 141640 - DNA, 15 bp, Homo sapiens
gttgaaaaataaagg

SEQ ID NO: 141641 - DNA, 15 bp, Homo sapiens
agttgaaaaataaag

SEQ ID NO: 141642 - DNA, 15 bp, Homo sapiens
aagttgaaaaataaa

SEQ ID NO: 141643 - DNA, 15 bp, Homo sapiens
caagttgaaaaataa

SEQ ID NO: 141644 - DNA, 15 bp, Homo sapiens
acaagttgaaaaata

SEQ ID NO: 141645 - DNA, 15 bp, Homo sapiens
aacaagttgaaaaat

SEQ ID NO: 141646 - DNA, 15 bp, Homo sapiens
aaacaagttgaaaaa

SEQ ID NO: 141647 - DNA, 15 bp, Homo sapiens
aaaacaagttgaaaa

SEQ ID NO: 141648 - DNA, 15 bp, Homo sapiens
caaaacaagttgaaa

SEQ ID NO: 141649 - DNA, 15 bp, Homo sapiens
acaaaacaagttgaa

SEQ ID NO: 141650 - DNA, 15 bp, Homo sapiens
aacaaaacaagttga

SEQ ID NO: 141651 - DNA, 15 bp, Homo sapiens
aaacaaaacaagttg

SEQ ID NO: 141652 - DNA, 15 bp, Homo sapiens
taaacaaaacaagtt

SEQ ID NO: 141653 - DNA, 15 bp, Homo sapiens
ataaacaaaacaagt

SEQ ID NO: 141654 - DNA, 15 bp, Homo sapiens
aataaacaaaacaag

SEQ ID NO: 141655 - DNA, 15 bp, Homo sapiens
aaataaacaaaacaa

SEQ ID NO: 141656 - DNA, 15 bp, Homo sapiens
aaaataaacaaaaca

SEQ ID NO: 141657 - DNA, 15 bp, Homo sapiens
gaaaataaacaaaac

SEQ ID NO: 141658 - DNA, 15 bp, Homo sapiens
agaaaataaacaaaa

SEQ ID NO: 141659 - DNA, 15 bp, Homo sapiens
aagaaaataaacaaa

SEQ ID NO: 141660 - DNA, 15 bp, Homo sapiens
aaagaaaataaacaa

SEQ ID NO: 141661 - DNA, 15 bp, Homo sapiens
caaagaaaataaaca

SEQ ID NO: 141662 - DNA, 15 bp, Homo sapiens
gcaaagaaaataaac

SEQ ID NO: 141663 - DNA, 15 bp, Homo sapiens
agcaaagaaaataaa

SEQ ID NO: 141664 - DNA, 15 bp, Homo sapiens
tagcaaagaaaataa

SEQ ID NO: 141665 - DNA, 15 bp, Homo sapiens
ctagcaaagaaaata

SEQ ID NO: 141666 - DNA, 15 bp, Homo sapiens
cctagcaaagaaaat

SEQ ID NO: 141667 - DNA, 15 bp, Homo sapiens
tcctagcaaagaaaa

SEQ ID NO: 141668 - DNA, 15 bp, Homo sapiens
atcctagcaaagaaa

SEQ ID NO: 141669 - DNA, 15 bp, Homo sapiens
aatcctagcaaagaa

SEQ ID NO: 141670 - DNA, 15 bp, Homo sapiens
aaatcctagcaaaga

SEQ ID NO: 141671 - DNA, 15 bp, Homo sapiens
caaatcctagcaaag

SEQ ID NO: 141672 - DNA, 15 bp, Homo sapiens
tcaaatcctagcaaa

SEQ ID NO: 141673 - DNA, 15 bp, Homo sapiens
atcaaatcctagcaa

SEQ ID NO: 141674 - DNA, 15 bp, Homo sapiens
aatcaaatcctagca

SEQ ID NO: 141675 - DNA, 15 bp, Homo sapiens
aaatcaaatcctagc

SEQ ID NO: 141676 - DNA, 15 bp, Homo sapiens
aaaatcaaatcctag

SEQ ID NO: 141677 - DNA, 15 bp, Homo sapiens
aaaaatcaaatccta

SEQ ID NO: 141678 - DNA, 15 bp, Homo sapiens
taaaaatcaaatcct

SEQ ID NO: 141679 - DNA, 15 bp, Homo sapiens
ctaaaaatcaaatcc

SEQ ID NO: 141680 - DNA, 15 bp, Homo sapiens
actaaaaatcaaatc

SEQ ID NO: 141681 - DNA, 15 bp, Homo sapiens
aactaaaaatcaaat

SEQ ID NO: 141682 - DNA, 15 bp, Homo sapiens
aaactaaaaatcaaa

SEQ ID NO: 141683 - DNA, 15 bp, Homo sapiens
aaaactaaaaatcaa

SEQ ID NO: 141684 - DNA, 15 bp, Homo sapiens
gaaaactaaaaatca

SEQ ID NO: 141685 - DNA, 15 bp, Homo sapiens
ggaaaactaaaaatc

SEQ ID NO: 141686 - DNA, 15 bp, Homo sapiens
gggaaaactaaaaat

SEQ ID NO: 141687 - DNA, 15 bp, Homo sapiens
agggaaaactaaaaa

SEQ ID NO: 141688 - DNA, 15 bp, Homo sapiens
aagggaaaactaaaa

SEQ ID NO: 141689 - DNA, 15 bp, Homo sapiens
gaagggaaaactaaa

SEQ ID NO: 141690 - DNA, 15 bp, Homo sapiens
ggaagggaaaactaa

SEQ ID NO: 141691 - DNA, 15 bp, Homo sapiens
tggaagggaaaacta

SEQ ID NO: 141692 - DNA, 15 bp, Homo sapiens
ttggaagggaaaact

SEQ ID NO: 141693 - DNA, 15 bp, Homo sapiens
cttggaagggaaaac

SEQ ID NO: 141694 - DNA, 15 bp, Homo sapiens
gcttggaagggaaaa

SEQ ID NO: 141695 - DNA, 15 bp, Homo sapiens
agcttggaagggaaa

SEQ ID NO: 141696 - DNA, 15 bp, Homo sapiens
cagcttggaagggaa

SEQ ID NO: 141697 - DNA, 15 bp, Homo sapiens
ccagcttggaaggga

SEQ ID NO: 141698 - DNA, 15 bp, Homo sapiens
cccagcttggaaggg

SEQ ID NO: 141699 - DNA, 15 bp, Homo sapiens
tcccagcttggaagg

SEQ ID NO: 141700 - DNA, 15 bp, Homo sapiens
ttcccagcttggaag

SEQ ID NO: 141701 - DNA, 15 bp, Homo sapiens
attcccagcttggaa

SEQ ID NO: 141702 - DNA, 15 bp, Homo sapiens
tattcccagcttgga

SEQ ID NO: 141703 - DNA, 15 bp, Homo sapiens
ttattcccagcttgg

SEQ ID NO: 141704 - DNA, 15 bp, Homo sapiens
tttattcccagcttg

SEQ ID NO: 141705 - DNA, 15 bp, Homo sapiens
ctttattcccagctt

SEQ ID NO: 141706 - DNA, 15 bp, Homo sapiens
gctttattcccagct

SEQ ID NO: 141707 - DNA, 15 bp, Homo sapiens
agctttattcccagc

SEQ ID NO: 141708 - DNA, 15 bp, Homo sapiens
cagctttattcccag

SEQ ID NO: 141709 - DNA, 15 bp, Homo sapiens
ccagctttattccca

SEQ ID NO: 141710 - DNA, 15 bp, Homo sapiens
gccagctttattccc

SEQ ID NO: 141711 - DNA, 15 bp, Homo sapiens
ggccagctttattcc

SEQ ID NO: 141712 - DNA, 15 bp, Homo sapiens
tggccagctttattc

SEQ ID NO: 141713 - DNA, 15 bp, Homo sapiens
ttggccagctttatt

SEQ ID NO: 141714 - DNA, 15 bp, Homo sapiens
tttggccagctttat

SEQ ID NO: 141715 - DNA, 15 bp, Homo sapiens
ttttggccagcttta

SEQ ID NO: 141716 - DNA, 15 bp, Homo sapiens
tttttggccagcttt

SEQ ID NO: 141717 - DNA, 15 bp, Homo sapiens
ctttttggccagctt

SEQ ID NO: 141718 - DNA, 15 bp, Homo sapiens
tctttttggccagct

SEQ ID NO: 141719 - DNA, 15 bp, Homo sapiens
ctctttttggccagc

SEQ ID NO: 141720 - DNA, 15 bp, Homo sapiens
tctctttttggccag

SEQ ID NO: 141721 - DNA, 15 bp, Homo sapiens
ttctctttttggcca

SEQ ID NO: 141722 - DNA, 15 bp, Homo sapiens
cttctctttttggcc

SEQ ID NO: 141723 - DNA, 15 bp, Homo sapiens
ccttctctttttggc

SEQ ID NO: 141724 - DNA, 15 bp, Homo sapiens
cccttctctttttgg

SEQ ID NO: 141725 - DNA, 15 bp, Homo sapiens
acccttctctttttg

SEQ ID NO: 141726 - DNA, 15 bp, Homo sapiens
tacccttctcttttt

SEQ ID NO: 141727 - DNA, 15 bp, Homo sapiens
ttacccttctctttt

SEQ ID NO: 141728 - DNA, 15 bp, Homo sapiens
tttacccttctcttt

SEQ ID NO: 141729 - DNA, 15 bp, Homo sapiens
ttttacccttctctt

SEQ ID NO: 141730 - DNA, 15 bp, Homo sapiens
tttttacccttctct

SEQ ID NO: 141731 - DNA, 15 bp, Homo sapiens
atttttacccttctc

SEQ ID NO: 141732 - DNA, 15 bp, Homo sapiens
aatttttacccttct

SEQ ID NO: 141733 - DNA, 15 bp, Homo sapiens
taatttttacccttc

SEQ ID NO: 141734 - DNA, 15 bp, Homo sapiens
ataatttttaccctt

SEQ ID NO: 141735 - DNA, 15 bp, Homo sapiens
tataatttttaccct

SEQ ID NO: 141736 - DNA, 15 bp, Homo sapiens
ctataatttttaccc

SEQ ID NO: 141737 - DNA, 15 bp, Homo sapiens
actataatttttacc

SEQ ID NO: 141738 - DNA, 15 bp, Homo sapiens
gactataatttttac

SEQ ID NO: 141739 - DNA, 15 bp, Homo sapiens
agactataattttta

SEQ ID NO: 141740 - DNA, 15 bp, Homo sapiens
aagactataattttt

SEQ ID NO: 141741 - DNA, 15 bp, Homo sapiens
gaagactataatttt

SEQ ID NO: 141742 - DNA, 15 bp, Homo sapiens
agaagactataattt

SEQ ID NO: 141743 - DNA, 15 bp, Homo sapiens
tagaagactataatt

SEQ ID NO: 141744 - DNA, 15 bp, Homo sapiens
atagaagactataat

SEQ ID NO: 141745 - DNA, 15 bp, Homo sapiens
tatagaagactataa

SEQ ID NO: 141746 - DNA, 15 bp, Homo sapiens
atatagaagactata

SEQ ID NO: 141747 - DNA, 15 bp, Homo sapiens
aatatagaagactat

SEQ ID NO: 141748 - DNA, 15 bp, Homo sapiens
aaatatagaagacta

SEQ ID NO: 141749 - DNA, 15 bp, Homo sapiens
aaaatatagaagact

SEQ ID NO: 141750 - DNA, 15 bp, Homo sapiens
gaaaatatagaagac

SEQ ID NO: 141751 - DNA, 15 bp, Homo sapiens
ggaaaatatagaaga

SEQ ID NO: 141752 - DNA, 15 bp, Homo sapiens
aggaaaatatagaag

SEQ ID NO: 141753 - DNA, 15 bp, Homo sapiens
gaggaaaatatagaa

SEQ ID NO: 141754 - DNA, 15 bp, Homo sapiens
agaggaaaatataga

SEQ ID NO: 141755 - DNA, 15 bp, Homo sapiens
aagaggaaaatatag

SEQ ID NO: 141756 - DNA, 15 bp, Homo sapiens
gaagaggaaaatata

SEQ ID NO: 141757 - DNA, 15 bp, Homo sapiens
agaagaggaaaatat

SEQ ID NO: 141758 - DNA, 15 bp, Homo sapiens
cagaagaggaaaata

SEQ ID NO: 141759 - DNA, 15 bp, Homo sapiens
acagaagaggaaaat

SEQ ID NO: 141760 - DNA, 15 bp, Homo sapiens
aacagaagaggaaaa

SEQ ID NO: 141761 - DNA, 15 bp, Homo sapiens
taacagaagaggaaa

SEQ ID NO: 141762 - DNA, 15 bp, Homo sapiens
gtaacagaagaggaa

SEQ ID NO: 141763 - DNA, 15 bp, Homo sapiens
cgtaacagaagagga

SEQ ID NO: 141764 - DNA, 15 bp, Homo sapiens
acgtaacagaagagg

SEQ ID NO: 141765 - DNA, 15 bp, Homo sapiens
aacgtaacagaagag

SEQ ID NO: 141766 - DNA, 15 bp, Homo sapiens
caacgtaacagaaga

SEQ ID NO: 141767 - DNA, 15 bp, Homo sapiens
acaacgtaacagaag

SEQ ID NO: 141768 - DNA, 15 bp, Homo sapiens
aacaacgtaacagaa

SEQ ID NO: 141769 - DNA, 15 bp, Homo sapiens
aaacaacgtaacaga

SEQ ID NO: 141770 - DNA, 15 bp, Homo sapiens
aaaacaacgtaacag

SEQ ID NO: 141771 - DNA, 15 bp, Homo sapiens
taaaacaacgtaaca

SEQ ID NO: 141772 - DNA, 15 bp, Homo sapiens
ttaaaacaacgtaac

SEQ ID NO: 141773 - DNA, 15 bp, Homo sapiens
attaaaacaacgtaa

SEQ ID NO: 141774 - DNA, 15 bp, Homo sapiens
tattaaaacaacgta

SEQ ID NO: 141775 - DNA, 15 bp, Homo sapiens
atattaaaacaacgt

SEQ ID NO: 141776 - DNA, 15 bp, Homo sapiens
aatattaaaacaacg

SEQ ID NO: 141777 - DNA, 15 bp, Homo sapiens
aaatattaaaacaac

SEQ ID NO: 141778 - DNA, 15 bp, Homo sapiens
gaaatattaaaacaa

SEQ ID NO: 141779 - DNA, 15 bp, Homo sapiens
tgaaatattaaaaca

SEQ ID NO: 141780 - DNA, 15 bp, Homo sapiens
ttgaaatattaaaac

SEQ ID NO: 141781 - DNA, 15 bp, Homo sapiens
cttgaaatattaaaa

SEQ ID NO: 141782 - DNA, 15 bp, Homo sapiens
acttgaaatattaaa

SEQ ID NO: 141783 - DNA, 15 bp, Homo sapiens
tacttgaaatattaa

SEQ ID NO: 141784 - DNA, 15 bp, Homo sapiens
atacttgaaatatta

SEQ ID NO: 141785 - DNA, 15 bp, Homo sapiens
gatacttgaaatatt

SEQ ID NO: 141786 - DNA, 15 bp, Homo sapiens
tgatacttgaaatat

SEQ ID NO: 141787 - DNA, 15 bp, Homo sapiens
atgatacttgaaata

SEQ ID NO: 141788 - DNA, 15 bp, Homo sapiens
aatgatacttgaaat

SEQ ID NO: 141789 - DNA, 15 bp, Homo sapiens
aaatgatacttgaaa

SEQ ID NO: 141790 - DNA, 15 bp, Homo sapiens
aaaatgatacttgaa

SEQ ID NO: 141791 - DNA, 15 bp, Homo sapiens
taaaatgatacttga

SEQ ID NO: 141792 - DNA, 15 bp, Homo sapiens
ataaaatgatacttg

SEQ ID NO: 141793 - DNA, 15 bp, Homo sapiens
aataaaatgatactt

SEQ ID NO: 141794 - DNA, 15 bp, Homo sapiens
taataaaatgatact

SEQ ID NO: 141795 - DNA, 15 bp, Homo sapiens
gtaataaaatgatac

SEQ ID NO: 141796 - DNA, 15 bp, Homo sapiens
agtaataaaatgata

SEQ ID NO: 141797 - DNA, 15 bp, Homo sapiens
aagtaataaaatgat

SEQ ID NO: 141798 - DNA, 15 bp, Homo sapiens
aaagtaataaaatga

SEQ ID NO: 141799 - DNA, 15 bp, Homo sapiens
aaaagtaataaaatg

SEQ ID NO: 141800 - DNA, 15 bp, Homo sapiens
aaaaagtaataaaat

SEQ ID NO: 141801 - DNA, 15 bp, Homo sapiens
aaaaaagtaataaaa

SEQ ID NO: 141802 - DNA, 15 bp, Homo sapiens
aaaaaaagtaataaa

SEQ ID NO: 141803 - DNA, 15 bp, Homo sapiens
taaaaaaagtaataa

SEQ ID NO: 141804 - DNA, 15 bp, Homo sapiens
ttaaaaaaagtaata

SEQ ID NO: 141805 - DNA, 15 bp, Homo sapiens
tttaaaaaaagtaat

SEQ ID NO: 141806 - DNA, 15 bp, Homo sapiens
ttttaaaaaaagtaa

SEQ ID NO: 141807 - DNA, 15 bp, Homo sapiens
tttttaaaaaaagta

SEQ ID NO: 141808 - DNA, 15 bp, Homo sapiens
ttgttttttaaaaaa

SEQ ID NO: 141809 - DNA, 15 bp, Homo sapiens
attgttttttaaaaa

SEQ ID NO: 141810 - DNA, 15 bp, Homo sapiens
aattgttttttaaaa

SEQ ID NO: 141811 - DNA, 15 bp, Homo sapiens
caattgttttttaaa

SEQ ID NO: 141812 - DNA, 15 bp, Homo sapiens
gcaattgttttttaa

SEQ ID NO: 141813 - DNA, 15 bp, Homo sapiens
ggcaattgtttttta

SEQ ID NO: 141814 - DNA, 15 bp, Homo sapiens
tggcaattgtttttt

SEQ ID NO: 141815 - DNA, 15 bp, Homo sapiens
ttggcaattgttttt

SEQ ID NO: 141816 - DNA, 15 bp, Homo sapiens
gttggcaattgtttt

SEQ ID NO: 141817 - DNA, 15 bp, Homo sapiens
tgttggcaattgttt

SEQ ID NO: 141818 - DNA, 15 bp, Homo sapiens
ttgttggcaattgtt

SEQ ID NO: 141819 - DNA, 15 bp, Homo sapiens
attgttggcaattgt

SEQ ID NO: 141820 - DNA, 15 bp, Homo sapiens
cattgttggcaattg

SEQ ID NO: 141821 - DNA, 15 bp, Homo sapiens
acattgttggcaatt

SEQ ID NO: 141822 - DNA, 15 bp, Homo sapiens
gacattgttggcaat

SEQ ID NO: 141823 - DNA, 15 bp, Homo sapiens
agacattgttggcaa

SEQ ID NO: 141824 - DNA, 15 bp, Homo sapiens
aagacattgttggca

SEQ ID NO: 141825 - DNA, 15 bp, Homo sapiens
aaagacattgttggc

SEQ ID NO: 141826 - DNA, 15 bp, Homo sapiens
caaagacattgttgg

SEQ ID NO: 141827 - DNA, 15 bp, Homo sapiens
acaaagacattgttg

SEQ ID NO: 141828 - DNA, 15 bp, Homo sapiens
cacaaagacattgtt

SEQ ID NO: 141829 - DNA, 15 bp, Homo sapiens
tcacaaagacattgt

SEQ ID NO: 141830 - DNA, 15 bp, Homo sapiens
atcacaaagacattg

SEQ ID NO: 141831 - DNA, 15 bp, Homo sapiens
tatcacaaagacatt

SEQ ID NO: 141832 - DNA, 15 bp, Homo sapiens
ttatcacaaagacat

SEQ ID NO: 141833 - DNA, 15 bp, Homo sapiens
tttatcacaaagaca

SEQ ID NO: 141834 - DNA, 15 bp, Homo sapiens
atttatcacaaagac

SEQ ID NO: 141835 - DNA, 15 bp, Homo sapiens
catttatcacaaaga

SEQ ID NO: 141836 - DNA, 15 bp, Homo sapiens
gcatttatcacaaag

SEQ ID NO: 141837 - DNA, 15 bp, Homo sapiens
ggcatttatcacaaa

SEQ ID NO: 141838 - DNA, 15 bp, Homo sapiens
aggcatttatcacaa

SEQ ID NO: 141839 - DNA, 15 bp, Homo sapiens
taggcatttatcaca

SEQ ID NO: 141840 - DNA, 15 bp, Homo sapiens
ataggcatttatcac

SEQ ID NO: 141841 - DNA, 15 bp, Homo sapiens
cataggcatttatca

SEQ ID NO: 141842 - DNA, 15 bp, Homo sapiens
tcataggcatttatc

SEQ ID NO: 141843 - DNA, 15 bp, Homo sapiens
ttcataggcatttat

SEQ ID NO: 141844 - DNA, 15 bp, Homo sapiens
attcataggcattta

SEQ ID NO: 141845 - DNA, 15 bp, Homo sapiens
cattcataggcattt

SEQ ID NO: 141846 - DNA, 15 bp, Homo sapiens
acattcataggcatt

SEQ ID NO: 141847 - DNA, 15 bp, Homo sapiens
aacattcataggcat

SEQ ID NO: 141848 - DNA, 15 bp, Homo sapiens
taacattcataggca

SEQ ID NO: 141849 - DNA, 15 bp, Homo sapiens
ttaacattcataggc

SEQ ID NO: 141850 - DNA, 15 bp, Homo sapiens
attaacattcatagg

SEQ ID NO: 141851 - DNA, 15 bp, Homo sapiens
cattaacattcatag

SEQ ID NO: 141852 - DNA, 15 bp, Homo sapiens
acattaacattcata

SEQ ID NO: 141853 - DNA, 15 bp, Homo sapiens
aacattaacattcat

SEQ ID NO: 141854 - DNA, 15 bp, Homo sapiens
aaacattaacattca

SEQ ID NO: 141855 - DNA, 15 bp, Homo sapiens
aaaacattaacattc

SEQ ID NO: 141856 - DNA, 15 bp, Homo sapiens
gaaaacattaacatt

SEQ ID NO: 141857 - DNA, 15 bp, Homo sapiens
tgaaaacattaacat

SEQ ID NO: 141858 - DNA, 15 bp, Homo sapiens
atgaaaacattaaca

SEQ ID NO: 141859 - DNA, 15 bp, Homo sapiens
aatgaaaacattaac

SEQ ID NO: 141860 - DNA, 15 bp, Homo sapiens
aaatgaaaacattaa

SEQ ID NO: 141861 - DNA, 15 bp, Homo sapiens
aaaatgaaaacatta

SEQ ID NO: 141862 - DNA, 15 bp, Homo sapiens
caaaatgaaaacatt

SEQ ID NO: 141863 - DNA, 15 bp, Homo sapiens
acaaaatgaaaacat

SEQ ID NO: 141864 - DNA, 15 bp, Homo sapiens
tacaaaatgaaaaca

SEQ ID NO: 141865 - DNA, 15 bp, Homo sapiens
ttacaaaatgaaaac

SEQ ID NO: 141866 - DNA, 15 bp, Homo sapiens
tttacaaaatgaaaa

SEQ ID NO: 141867 - DNA, 15 bp, Homo sapiens
atttacaaaatgaaa

SEQ ID NO: 141868 - DNA, 15 bp, Homo sapiens
tatttacaaaatgaa

SEQ ID NO: 141869 - DNA, 15 bp, Homo sapiens
atatttacaaaatga

SEQ ID NO: 141870 - DNA, 15 bp, Homo sapiens
gatatttacaaaatg

SEQ ID NO: 141871 - DNA, 15 bp, Homo sapiens
tgatatttacaaaat

SEQ ID NO: 141872 - DNA, 15 bp, Homo sapiens
ttgatatttacaaaa

SEQ ID NO: 141873 - DNA, 15 bp, Homo sapiens
tttgatatttacaaa

SEQ ID NO: 141874 - DNA, 15 bp, Homo sapiens
gtttgatatttacaa

SEQ ID NO: 141875 - DNA, 15 bp, Homo sapiens
agtttgatatttaca

SEQ ID NO: 141876 - DNA, 15 bp, Homo sapiens
gagtttgatatttac

SEQ ID NO: 141877 - DNA, 15 bp, Homo sapiens
tgagtttgatattta

SEQ ID NO: 141878 - DNA, 15 bp, Homo sapiens
ttgagtttgatattt

SEQ ID NO: 141879 - DNA, 15 bp, Homo sapiens
cttgagtttgatatt

SEQ ID NO: 141880 - DNA, 15 bp, Homo sapiens
gcttgagtttgatat

SEQ ID NO: 141881 - DNA, 15 bp, Homo sapiens
tgcttgagtttgata

SEQ ID NO: 141882 - DNA, 15 bp, Homo sapiens
atgcttgagtttgat

SEQ ID NO: 141883 - DNA, 15 bp, Homo sapiens
catgcttgagtttga

SEQ ID NO: 141884 - DNA, 15 bp, Homo sapiens
gcatgcttgagtttg

SEQ ID NO: 141885 - DNA, 15 bp, Homo sapiens
cgcatgcttgagttt

SEQ ID NO: 141886 - DNA, 15 bp, Homo sapiens
ccgcatgcttgagtt

SEQ ID NO: 141887 - DNA, 15 bp, Homo sapiens
tccgcatgcttgagt

SEQ ID NO: 141888 - DNA, 15 bp, Homo sapiens
atccgcatgcttgag

SEQ ID NO: 141889 - DNA, 15 bp, Homo sapiens
tatccgcatgcttga

SEQ ID NO: 141890 - DNA, 15 bp, Homo sapiens
atatccgcatgcttg

SEQ ID NO: 141891 - DNA, 15 bp, Homo sapiens
aatatccgcatgctt

SEQ ID NO: 141892 - DNA, 15 bp, Homo sapiens
aaatatccgcatgct

SEQ ID NO: 141893 - DNA, 15 bp, Homo sapiens
aaaatatccgcatgc

SEQ ID NO: 141894 - DNA, 15 bp, Homo sapiens
gaaaatatccgcatg

SEQ ID NO: 141895 - DNA, 15 bp, Homo sapiens
agaaaatatccgcat

SEQ ID NO: 141896 - DNA, 15 bp, Homo sapiens
gagaaaatatccgca

SEQ ID NO: 141897 - DNA, 15 bp, Homo sapiens
tgagaaaatatccgc

SEQ ID NO: 141898 - DNA, 15 bp, Homo sapiens
ctgagaaaatatccg

SEQ ID NO: 141899 - DNA, 15 bp, Homo sapiens
gctgagaaaatatcc

SEQ ID NO: 141900 - DNA, 15 bp, Homo sapiens
tgctgagaaaatatc

SEQ ID NO: 141901 - DNA, 15 bp, Homo sapiens
gtgctgagaaaatat

SEQ ID NO: 141902 - DNA, 15 bp, Homo sapiens
tgtgctgagaaaata

SEQ ID NO: 141903 - DNA, 15 bp, Homo sapiens
atgtgctgagaaaat

SEQ ID NO: 141904 - DNA, 15 bp, Homo sapiens
aatgtgctgagaaaa

SEQ ID NO: 141905 - DNA, 15 bp, Homo sapiens
aaatgtgctgagaaa

SEQ ID NO: 141906 - DNA, 15 bp, Homo sapiens
taaatgtgctgagaa

SEQ ID NO: 141907 - DNA, 15 bp, Homo sapiens
ctaaatgtgctgaga

SEQ ID NO: 141908 - DNA, 15 bp, Homo sapiens
gctaaatgtgctgag

SEQ ID NO: 141909 - DNA, 15 bp, Homo sapiens
agctaaatgtgctga

SEQ ID NO: 141910 - DNA, 15 bp, Homo sapiens
gagctaaatgtgctg

SEQ ID NO: 141911 - DNA, 15 bp, Homo sapiens
ggagctaaatgtgct

SEQ ID NO: 141912 - DNA, 15 bp, Homo sapiens
tggagctaaatgtgc

SEQ ID NO: 141913 - DNA, 15 bp, Homo sapiens
atggagctaaatgtg

SEQ ID NO: 141914 - DNA, 15 bp, Homo sapiens
tatggagctaaatgt

SEQ ID NO: 141915 - DNA, 15 bp, Homo sapiens
atatggagctaaatg

SEQ ID NO: 141916 - DNA, 15 bp, Homo sapiens
gatatggagctaaat

SEQ ID NO: 141917 - DNA, 15 bp, Homo sapiens
tgatatggagctaaa

SEQ ID NO: 141918 - DNA, 15 bp, Homo sapiens
ttgatatggagctaa

SEQ ID NO: 141919 - DNA, 15 bp, Homo sapiens
tttgatatggagcta

SEQ ID NO: 141920 - DNA, 15 bp, Homo sapiens
gtttgatatggagct

SEQ ID NO: 141921 - DNA, 15 bp, Homo sapiens
tgtttgatatggagc

SEQ ID NO: 141922 - DNA, 15 bp, Homo sapiens
ttgtttgatatggag

SEQ ID NO: 141923 - DNA, 15 bp, Homo sapiens
tttgtttgatatgga

SEQ ID NO: 141924 - DNA, 15 bp, Homo sapiens
gtttgtttgatatgg

SEQ ID NO: 141925 - DNA, 15 bp, Homo sapiens
agtttgtttgatatg

SEQ ID NO: 141926 - DNA, 15 bp, Homo sapiens
tagtttgtttgatat

SEQ ID NO: 141927 - DNA, 15 bp, Homo sapiens
ttagtttgtttgata

SEQ ID NO: 141928 - DNA, 15 bp, Homo sapiens
tttagtttgtttgat

SEQ ID NO: 141929 - DNA, 15 bp, Homo sapiens
ctttagtttgtttga

SEQ ID NO: 141930 - DNA, 15 bp, Homo sapiens
tctttagtttgtttg

SEQ ID NO: 141931 - DNA, 15 bp, Homo sapiens
ctctttagtttgttt

SEQ ID NO: 141932 - DNA, 15 bp, Homo sapiens
gctctttagtttgtt

SEQ ID NO: 141933 - DNA, 15 bp, Homo sapiens
ggctctttagtttgt

SEQ ID NO: 141934 - DNA, 15 bp, Homo sapiens
tggctctttagtttg

SEQ ID NO: 141935 - DNA, 15 bp, Homo sapiens
ttggctctttagttt

SEQ ID NO: 141936 - DNA, 15 bp, Homo sapiens
attggctctttagtt

SEQ ID NO: 141937 - DNA, 15 bp, Homo sapiens
cattggctctttagt

SEQ ID NO: 141938 - DNA, 15 bp, Homo sapiens
gcattggctctttag

SEQ ID NO: 141939 - DNA, 15 bp, Homo sapiens
ggcattggctcttta

SEQ ID NO: 141940 - DNA, 15 bp, Homo sapiens
gggcattggctcttt

SEQ ID NO: 141941 - DNA, 15 bp, Homo sapiens
tgggcattggctctt

SEQ ID NO: 141942 - DNA, 15 bp, Homo sapiens
gtgggcattggctct

SEQ ID NO: 141943 - DNA, 15 bp, Homo sapiens
tgtgggcattggctc

SEQ ID NO: 141944 - DNA, 15 bp, Homo sapiens
ctgtgggcattggct

SEQ ID NO: 141945 - DNA, 15 bp, Homo sapiens
tctgtgggcattggc

SEQ ID NO: 141946 - DNA, 15 bp, Homo sapiens
ttctgtgggcattgg

SEQ ID NO: 141947 - DNA, 15 bp, Homo sapiens
tttctgtgggcattg

SEQ ID NO: 141948 - DNA, 15 bp, Homo sapiens
gtttctgtgggcatt

SEQ ID NO: 141949 - DNA, 15 bp, Homo sapiens
tgtttctgtgggcat

SEQ ID NO: 141950 - DNA, 15 bp, Homo sapiens
ttgtttctgtgggca

SEQ ID NO: 141951 - DNA, 15 bp, Homo sapiens
attgtttctgtgggc

SEQ ID NO: 141952 - DNA, 15 bp, Homo sapiens
cattgtttctgtggg

SEQ ID NO: 141953 - DNA, 15 bp, Homo sapiens
gcattgtttctgtgg

SEQ ID NO: 141954 - DNA, 15 bp, Homo sapiens
ggcattgtttctgtg

SEQ ID NO: 141955 - DNA, 15 bp, Homo sapiens
gggcattgtttctgt

SEQ ID NO: 141956 - DNA, 15 bp, Homo sapiens
tgggcattgtttctg

SEQ ID NO: 141957 - DNA, 15 bp, Homo sapiens
gtgggcattgtttct

SEQ ID NO: 141958 - DNA, 15 bp, Homo sapiens
tgtgggcattgtttc

SEQ ID NO: 141959 - DNA, 15 bp, Homo sapiens
ctgtgggcattgttt

SEQ ID NO: 141960 - DNA, 15 bp, Homo sapiens
actgtgggcattgtt

SEQ ID NO: 141961 - DNA, 15 bp, Homo sapiens
gactgtgggcattgt

SEQ ID NO: 141962 - DNA, 15 bp, Homo sapiens
agactgtgggcattg

SEQ ID NO: 141963 - DNA, 15 bp, Homo sapiens
aagactgtgggcatt

SEQ ID NO: 141964 - DNA, 15 bp, Homo sapiens
aaagactgtgggcat

SEQ ID NO: 141965 - DNA, 15 bp, Homo sapiens
caaagactgtgggca

SEQ ID NO: 141966 - DNA, 15 bp, Homo sapiens
acaaagactgtgggc

SEQ ID NO: 141967 - DNA, 15 bp, Homo sapiens
aacaaagactgtggg

SEQ ID NO: 141968 - DNA, 15 bp, Homo sapiens
aaacaaagactgtgg

SEQ ID NO: 141969 - DNA, 15 bp, Homo sapiens
aaaacaaagactgtg

SEQ ID NO: 141970 - DNA, 15 bp, Homo sapiens
aaaaacaaagactgt

SEQ ID NO: 141971 - DNA, 15 bp, Homo sapiens
caaaaacaaagactg

SEQ ID NO: 141972 - DNA, 15 bp, Homo sapiens
acaaaaacaaagact

SEQ ID NO: 141973 - DNA, 15 bp, Homo sapiens
aacaaaaacaaagac

SEQ ID NO: 141974 - DNA, 15 bp, Homo sapiens
aaacaaaaacaaaga

SEQ ID NO: 141975 - DNA, 15 bp, Homo sapiens
aaaacaaaaacaaag

SEQ ID NO: 141976 - DNA, 15 bp, Homo sapiens
gaaaacaaaaacaaa

SEQ ID NO: 141977 - DNA, 15 bp, Homo sapiens
tgaaaacaaaaacaa

SEQ ID NO: 141978 - DNA, 15 bp, Homo sapiens
atgaaaacaaaaaca

SEQ ID NO: 141979 - DNA, 15 bp, Homo sapiens
aatgaaaacaaaaac

SEQ ID NO: 141980 - DNA, 15 bp, Homo sapiens
aaatgaaaacaaaaa

SEQ ID NO: 141981 - DNA, 15 bp, Homo sapiens
caaatgaaaacaaaa

SEQ ID NO: 141982 - DNA, 15 bp, Homo sapiens
acaaatgaaaacaaa

SEQ ID NO: 141983 - DNA, 15 bp, Homo sapiens
aacaaatgaaaacaa

SEQ ID NO: 141984 - DNA, 15 bp, Homo sapiens
aaacaaatgaaaaca

SEQ ID NO: 141985 - DNA, 15 bp, Homo sapiens
gaaacaaatgaaaac

SEQ ID NO: 141986 - DNA, 15 bp, Homo sapiens
agaaacaaatgaaaa

SEQ ID NO: 141987 - DNA, 15 bp, Homo sapiens
aagaaacaaatgaaa

SEQ ID NO: 141988 - DNA, 15 bp, Homo sapiens
aaagaaacaaatgaa

SEQ ID NO: 141989 - DNA, 15 bp, Homo sapiens
aaaagaaacaaatga

SEQ ID NO: 141990 - DNA, 15 bp, Homo sapiens
aaaaagaaacaaatg

SEQ ID NO: 141991 - DNA, 15 bp, Homo sapiens
gaaaaagaaacaaat

SEQ ID NO: 141992 - DNA, 15 bp, Homo sapiens
ggaaaaagaaacaaa

SEQ ID NO: 141993 - DNA, 15 bp, Homo sapiens
tggaaaaagaaacaa

SEQ ID NO: 141994 - DNA, 15 bp, Homo sapiens
atggaaaaagaaaca

SEQ ID NO: 141995 - DNA, 15 bp, Homo sapiens
aatggaaaaagaaac

SEQ ID NO: 141996 - DNA, 15 bp, Homo sapiens
taatggaaaaagaaa

SEQ ID NO: 141997 - DNA, 15 bp, Homo sapiens
ttaatggaaaaagaa

SEQ ID NO: 141998 - DNA, 15 bp, Homo sapiens
attaatggaaaaaga

SEQ ID NO: 141999 - DNA, 15 bp, Homo sapiens
aattaatggaaaaag

SEQ ID NO: 142000 - DNA, 15 bp, Homo sapiens
caattaatggaaaaa

SEQ ID NO: 142001 - DNA, 15 bp, Homo sapiens
tcaattaatggaaaa

SEQ ID NO: 142002 - DNA, 15 bp, Homo sapiens
atcaattaatggaaa

SEQ ID NO: 142003 - DNA, 15 bp, Homo sapiens
aatcaattaatggaa

SEQ ID NO: 142004 - DNA, 15 bp, Homo sapiens
taatcaattaatgga

SEQ ID NO: 142005 - DNA, 15 bp, Homo sapiens
ttaatcaattaatgg

SEQ ID NO: 142006 - DNA, 15 bp, Homo sapiens
attaatcaattaatg

SEQ ID NO: 142007 - DNA, 15 bp, Homo sapiens
gattaatcaattaat

SEQ ID NO: 142008 - DNA, 15 bp, Homo sapiens
tgattaatcaattaa

SEQ ID NO: 142009 - DNA, 15 bp, Homo sapiens
ttgattaatcaatta

SEQ ID NO: 142010 - DNA, 15 bp, Homo sapiens
gttgattaatcaatt

SEQ ID NO: 142011 - DNA, 15 bp, Homo sapiens
ggttgattaatcaat

SEQ ID NO: 142012 - DNA, 15 bp, Homo sapiens
tggttgattaatcaa

SEQ ID NO: 142013 - DNA, 15 bp, Homo sapiens
ctggttgattaatca

SEQ ID NO: 142014 - DNA, 15 bp, Homo sapiens
actggttgattaatc

SEQ ID NO: 142015 - DNA, 15 bp, Homo sapiens
aactggttgattaat

SEQ ID NO: 142016 - DNA, 15 bp, Homo sapiens
taactggttgattaa

SEQ ID NO: 142017 - DNA, 15 bp, Homo sapiens
ttaactggttgatta

SEQ ID NO: 142018 - DNA, 15 bp, Homo sapiens
tttaactggttgatt

SEQ ID NO: 142019 - DNA, 15 bp, Homo sapiens
gtttaactggttgat

SEQ ID NO: 142020 - DNA, 15 bp, Homo sapiens
tgtttaactggttga

SEQ ID NO: 142021 - DNA, 15 bp, Homo sapiens
ttgtttaactggttg

SEQ ID NO: 142022 - DNA, 15 bp, Homo sapiens
cttgtttaactggtt

SEQ ID NO: 142023 - DNA, 15 bp, Homo sapiens
acttgtttaactggt

SEQ ID NO: 142024 - DNA, 15 bp, Homo sapiens
tacttgtttaactgg

SEQ ID NO: 142025 - DNA, 15 bp, Homo sapiens
atacttgtttaactg

SEQ ID NO: 142026 - DNA, 15 bp, Homo sapiens
aatacttgtttaact

SEQ ID NO: 142027 - DNA, 15 bp, Homo sapiens
aaatacttgtttaac

SEQ ID NO: 142028 - DNA, 15 bp, Homo sapiens
taaatacttgtttaa

SEQ ID NO: 142029 - DNA, 15 bp, Homo sapiens
ataaatacttgttta

SEQ ID NO: 142030 - DNA, 15 bp, Homo sapiens
aataaatacttgttt

SEQ ID NO: 142031 - DNA, 15 bp, Homo sapiens
aaataaatacttgtt

SEQ ID NO: 142032 - DNA, 15 bp, Homo sapiens
taaataaatacttgt

SEQ ID NO: 142033 - DNA, 15 bp, Homo sapiens
ctaaataaatacttg

SEQ ID NO: 142034 - DNA, 15 bp, Homo sapiens
gctaaataaatactt

SEQ ID NO: 142035 - DNA, 15 bp, Homo sapiens
agctaaataaatact

SEQ ID NO: 142036 - DNA, 15 bp, Homo sapiens
aagctaaataaatac

SEQ ID NO: 142037 - DNA, 15 bp, Homo sapiens
gaagctaaataaata

SEQ ID NO: 142038 - DNA, 15 bp, Homo sapiens
ggaagctaaataaat

SEQ ID NO: 142039 - DNA, 15 bp, Homo sapiens
aggaagctaaataaa

SEQ ID NO: 142040 - DNA, 15 bp, Homo sapiens
taggaagctaaataa

SEQ ID NO: 142041 - DNA, 15 bp, Homo sapiens
ataggaagctaaata

SEQ ID NO: 142042 - DNA, 15 bp, Homo sapiens
aataggaagctaaat

SEQ ID NO: 142043 - DNA, 15 bp, Homo sapiens
caaataggaagctaa

SEQ ID NO: 142044 - DNA, 15 bp, Homo sapiens
gcaaataggaagcta

SEQ ID NO: 142045 - DNA, 15 bp, Homo sapiens
ggcaaataggaagct

SEQ ID NO: 142046 - DNA, 15 bp, Homo sapiens
tggcaaataggaagc

SEQ ID NO: 142047 - DNA, 15 bp, Homo sapiens
ttggcaaataggaag

SEQ ID NO: 142048 - DNA, 15 bp, Homo sapiens
cttggcaaataggaa

SEQ ID NO: 142049 - DNA, 15 bp, Homo sapiens
gcttggcaaatagga

SEQ ID NO: 142050 - DNA, 15 bp, Homo sapiens
agcttggcaaatagg

SEQ ID NO: 142051 - DNA, 15 bp, Homo sapiens
gagcttggcaaatag

SEQ ID NO: 142052 - DNA, 15 bp, Homo sapiens
agagcttggcaaata

SEQ ID NO: 142053 - DNA, 15 bp, Homo sapiens
cagagcttggcaaat

SEQ ID NO: 142054 - DNA, 15 bp, Homo sapiens
acagagcttggcaaa

SEQ ID NO: 142055 - DNA, 15 bp, Homo sapiens
cacagagcttggcaa

SEQ ID NO: 142056 - DNA, 15 bp, Homo sapiens
tcacagagcttggca

SEQ ID NO: 142057 - DNA, 15 bp, Homo sapiens
gtcacagagcttggc

SEQ ID NO: 142058 - DNA, 15 bp, Homo sapiens
ggtcacagagcttgg

SEQ ID NO: 142059 - DNA, 15 bp, Homo sapiens
tggtcacagagcttg

SEQ ID NO: 142060 - DNA, 15 bp, Homo sapiens
ctggtcacagagctt

SEQ ID NO: 142061 - DNA, 15 bp, Homo sapiens
gctggtcacagagct

SEQ ID NO: 142062 - DNA, 15 bp, Homo sapiens
ggctggtcacagagc

SEQ ID NO: 142063 - DNA, 15 bp, Homo sapiens
gggctggtcacagag

SEQ ID NO: 142064 - DNA, 15 bp, Homo sapiens
agggctggtcacaga

SEQ ID NO: 142065 - DNA, 15 bp, Homo sapiens
tagggctggtcacag

SEQ ID NO: 142066 - DNA, 15 bp, Homo sapiens
ttagggctggtcaca

SEQ ID NO: 142067 - DNA, 15 bp, Homo sapiens
tttagggctggtcac

SEQ ID NO: 142068 - DNA, 15 bp, Homo sapiens
ctttagggctggtca

SEQ ID NO: 142069 - DNA, 15 bp, Homo sapiens
tctttagggctggtc

SEQ ID NO: 142070 - DNA, 15 bp, Homo sapiens
atctttagggctggt

SEQ ID NO: 142071 - DNA, 15 bp, Homo sapiens
aatctttagggctgg

SEQ ID NO: 142072 - DNA, 15 bp, Homo sapiens
gaatctttagggctg

SEQ ID NO: 142073 - DNA, 15 bp, Homo sapiens
tgaatctttagggct

SEQ ID NO: 142074 - DNA, 15 bp, Homo sapiens
ttgaatctttagggc

SEQ ID NO: 142075 - DNA, 15 bp, Homo sapiens
gttgaatctttaggg

SEQ ID NO: 142076 - DNA, 15 bp, Homo sapiens
ggttgaatctttagg

SEQ ID NO: 142077 - DNA, 15 bp, Homo sapiens
tggttgaatctttag

SEQ ID NO: 142078 - DNA, 15 bp, Homo sapiens
atggttgaatcttta

SEQ ID NO: 142079 - DNA, 15 bp, Homo sapiens
tatggttgaatcttt

SEQ ID NO: 142080 - DNA, 15 bp, Homo sapiens
ttatggttgaatctt

SEQ ID NO: 142081 - DNA, 15 bp, Homo sapiens
tttatggttgaatct

SEQ ID NO: 142082 - DNA, 15 bp, Homo sapiens
atttatggttgaatc

SEQ ID NO: 142083 - DNA, 15 bp, Homo sapiens
tatttatggttgaat

SEQ ID NO: 142084 - DNA, 15 bp, Homo sapiens
gtatttatggttgaa

SEQ ID NO: 142085 - DNA, 15 bp, Homo sapiens
tgtatttatggttga

SEQ ID NO: 142086 - DNA, 15 bp, Homo sapiens
gtgtatttatggttg

SEQ ID NO: 142087 - DNA, 15 bp, Homo sapiens
ggtgtatttatggtt

SEQ ID NO: 142088 - DNA, 15 bp, Homo sapiens
aggtgtatttatggt

SEQ ID NO: 142089 - DNA, 15 bp, Homo sapiens
gaggtgtatttatgg

SEQ ID NO: 142090 - DNA, 15 bp, Homo sapiens
tgaggtgtatttatg

SEQ ID NO: 142091 - DNA, 15 bp, Homo sapiens
atgaggtgtatttat

SEQ ID NO: 142092 - DNA, 15 bp, Homo sapiens
aatgaggtgtattta

SEQ ID NO: 142093 - DNA, 15 bp, Homo sapiens
gaatgaggtgtattt

SEQ ID NO: 142094 - DNA, 15 bp, Homo sapiens
ggaatgaggtgtatt

SEQ ID NO: 142095 - DNA, 15 bp, Homo sapiens
aggaatgaggtgtat

SEQ ID NO: 142096 - DNA, 15 bp, Homo sapiens
caggaatgaggtgta

SEQ ID NO: 142097 - DNA, 15 bp, Homo sapiens
gcaggaatgaggtgt

SEQ ID NO: 142098 - DNA, 15 bp, Homo sapiens
agcaggaatgaggtg

SEQ ID NO: 142099 - DNA, 15 bp, Homo sapiens
gagcaggaatgaggt

SEQ ID NO: 142100 - DNA, 15 bp, Homo sapiens
ggagcaggaatgagg

SEQ ID NO: 142101 - DNA, 15 bp, Homo sapiens
gggagcaggaatgag

SEQ ID NO: 142102 - DNA, 15 bp, Homo sapiens
tgggagcaggaatga

SEQ ID NO: 142103 - DNA, 15 bp, Homo sapiens
ctgggagcaggaatg

SEQ ID NO: 142104 - DNA, 15 bp, Homo sapiens
cctgggagcaggaat

SEQ ID NO: 142105 - DNA, 15 bp, Homo sapiens
tcctgggagcaggaa

SEQ ID NO: 142106 - DNA, 15 bp, Homo sapiens
ttcctgggagcagga

SEQ ID NO: 142107 - DNA, 15 bp, Homo sapiens
cttcctgggagcagg

SEQ ID NO: 142108 - DNA, 15 bp, Homo sapiens
gcttcctgggagcag

SEQ ID NO: 142109 - DNA, 15 bp, Homo sapiens
agcttcctgggagca

SEQ ID NO: 142110 - DNA, 15 bp, Homo sapiens
cagcttcctgggagc

SEQ ID NO: 142111 - DNA, 15 bp, Homo sapiens
tcagcttcctgggag

SEQ ID NO: 142112 - DNA, 15 bp, Homo sapiens
gtcagcttcctggga

SEQ ID NO: 142113 - DNA, 15 bp, Homo sapiens
tgtcagcttcctggg

SEQ ID NO: 142114 - DNA, 15 bp, Homo sapiens
atgtcagcttcctgg

SEQ ID NO: 142115 - DNA, 15 bp, Homo sapiens
aatgtcagcttcctg

SEQ ID NO: 142116 - DNA, 15 bp, Homo sapiens
caatgtcagcttcct

SEQ ID NO: 142117 - DNA, 15 bp, Homo sapiens
gcaatgtcagcttcc

SEQ ID NO: 142118 - DNA, 15 bp, Homo sapiens
tgcaatgtcagcttc

SEQ ID NO: 142119 - DNA, 15 bp, Homo sapiens
atgcaatgtcagctt

SEQ ID NO: 142120 - DNA, 15 bp, Homo sapiens
tatgcaatgtcagct

SEQ ID NO: 142121 - DNA, 15 bp, Homo sapiens
ctatgcaatgtcagc

SEQ ID NO: 142122 - DNA, 15 bp, Homo sapiens
cctatgcaatgtcag

SEQ ID NO: 142123 - DNA, 15 bp, Homo sapiens
ccctatgcaatgtca

SEQ ID NO: 142124 - DNA, 15 bp, Homo sapiens
cccctatgcaatgtc

SEQ ID NO: 142125 - DNA, 15 bp, Homo sapiens
ccccctatgcaatgt

SEQ ID NO: 142126 - DNA, 15 bp, Homo sapiens
tccccctatgcaatg

SEQ ID NO: 142127 - DNA, 15 bp, Homo sapiens
ctccccctatgcaat

SEQ ID NO: 142128 - DNA, 15 bp, Homo sapiens
gctccccctatgcaa

SEQ ID NO: 142129 - DNA, 15 bp, Homo sapiens
ggctccccctatgca

SEQ ID NO: 142130 - DNA, 15 bp, Homo sapiens
aggctccccctatgc

SEQ ID NO: 142131 - DNA, 15 bp, Homo sapiens
caggctccccctatg

SEQ ID NO: 142132 - DNA, 15 bp, Homo sapiens
gcaggctccccctat

SEQ ID NO: 142133 - DNA, 15 bp, Homo sapiens
tgcaggctcccccta

SEQ ID NO: 142134 - DNA, 15 bp, Homo sapiens
ttgcaggctccccct

SEQ ID NO: 142135 - DNA, 15 bp, Homo sapiens
attgcaggctccccc

SEQ ID NO: 142136 - DNA, 15 bp, Homo sapiens
cattgcaggctcccc

SEQ ID NO: 142137 - DNA, 15 bp, Homo sapiens
acattgcaggctccc

SEQ ID NO: 142138 - DNA, 15 bp, Homo sapiens
tacattgcaggctcc

SEQ ID NO: 142139 - DNA, 15 bp, Homo sapiens
gtacattgcaggctc

SEQ ID NO: 142140 - DNA, 15 bp, Homo sapiens
cgtacattgcaggct

SEQ ID NO: 142141 - DNA, 15 bp, Homo sapiens
acgtacattgcaggc

SEQ ID NO: 142142 - DNA, 15 bp, Homo sapiens
tacgtacattgcagg

SEQ ID NO: 142143 - DNA, 15 bp, Homo sapiens
ttacgtacattgcag

SEQ ID NO: 142144 - DNA, 15 bp, Homo sapiens
cttacgtacattgca

SEQ ID NO: 142145 - DNA, 15 bp, Homo sapiens
acttacgtacattgc

SEQ ID NO: 142146 - DNA, 15 bp, Homo sapiens
cacttacgtacattg

SEQ ID NO: 142147 - DNA, 15 bp, Homo sapiens
ccacttacgtacatt

SEQ ID NO: 142148 - DNA, 15 bp, Homo sapiens
accacttacgtacat

SEQ ID NO: 142149 - DNA, 15 bp, Homo sapiens
taccacttacgtaca

SEQ ID NO: 142150 - DNA, 15 bp, Homo sapiens
ttaccacttacgtac

SEQ ID NO: 142151 - DNA, 15 bp, Homo sapiens
tttaccacttacgta

SEQ ID NO: 142152 - DNA, 15 bp, Homo sapiens
atttaccacttacgt

SEQ ID NO: 142153 - DNA, 15 bp, Homo sapiens
tatttaccacttacg

SEQ ID NO: 142154 - DNA, 15 bp, Homo sapiens
ctatttaccacttac

SEQ ID NO: 142155 - DNA, 15 bp, Homo sapiens
cctatttaccactta

SEQ ID NO: 142156 - DNA, 15 bp, Homo sapiens
tcctatttaccactt

SEQ ID NO: 142157 - DNA, 15 bp, Homo sapiens
ttcctatttaccact

SEQ ID NO: 142158 - DNA, 15 bp, Homo sapiens
tttcctatttaccac

SEQ ID NO: 142159 - DNA, 15 bp, Homo sapiens
ttttcctatttacca

SEQ ID NO: 142160 - DNA, 15 bp, Homo sapiens
attttcctatttacc

SEQ ID NO: 142161 - DNA, 15 bp, Homo sapiens
tattttcctatttac

SEQ ID NO: 142162 - DNA, 15 bp, Homo sapiens
ttattttcctattta

SEQ ID NO: 142163 - DNA, 15 bp, Homo sapiens
attattttcctattt

SEQ ID NO: 142164 - DNA, 15 bp, Homo sapiens
tattattttcctatt

SEQ ID NO: 142165 - DNA, 15 bp, Homo sapiens
gtattattttcctat

SEQ ID NO: 142166 - DNA, 15 bp, Homo sapiens
tgtattattttccta

SEQ ID NO: 142167 - DNA, 15 bp, Homo sapiens
atgtattattttcct

SEQ ID NO: 142168 - DNA, 15 bp, Homo sapiens
tatgtattattttcc

SEQ ID NO: 142169 - DNA, 15 bp, Homo sapiens
ttatgtattattttc

SEQ ID NO: 142170 - DNA, 15 bp, Homo sapiens
attatgtattatttt

SEQ ID NO: 142171 - DNA, 15 bp, Homo sapiens
aattatgtattattt

SEQ ID NO: 142172 - DNA, 15 bp, Homo sapiens
taattatgtattatt

SEQ ID NO: 142173 - DNA, 15 bp, Homo sapiens
ataattatgtattat

SEQ ID NO: 142174 - DNA, 15 bp, Homo sapiens
tataattatgtatta

SEQ ID NO: 142175 - DNA, 15 bp, Homo sapiens
ctataattatgtatt

SEQ ID NO: 142176 - DNA, 15 bp, Homo sapiens
cctataattatgtat

SEQ ID NO: 142177 - DNA, 15 bp, Homo sapiens
tcctataattatgta

SEQ ID NO: 142178 - DNA, 15 bp, Homo sapiens
ctcctataattatgt

SEQ ID NO: 142179 - DNA, 15 bp, Homo sapiens
cctcctataattatg

SEQ ID NO: 142180 - DNA, 15 bp, Homo sapiens
acctcctataattat

SEQ ID NO: 142181 - DNA, 15 bp, Homo sapiens
aacctcctataatta

SEQ ID NO: 142182 - DNA, 15 bp, Homo sapiens
caacctcctataatt

SEQ ID NO: 142183 - DNA, 15 bp, Homo sapiens
acaacctcctataat

SEQ ID NO: 142184 - DNA, 15 bp, Homo sapiens
aacaacctcctataa

SEQ ID NO: 142185 - DNA, 15 bp, Homo sapiens
aaacaacctcctata

SEQ ID NO: 142186 - DNA, 15 bp, Homo sapiens
aaaacaacctcctat

SEQ ID NO: 142187 - DNA, 15 bp, Homo sapiens
caaaacaacctccta

SEQ ID NO: 142188 - DNA, 15 bp, Homo sapiens
ccaaaacaacctcct

SEQ ID NO: 142189 - DNA, 15 bp, Homo sapiens
tccaaaacaacctcc

SEQ ID NO: 142190 - DNA, 15 bp, Homo sapiens
ctccaaaacaacctc

SEQ ID NO: 142191 - DNA, 15 bp, Homo sapiens
cctccaaaacaacct

SEQ ID NO: 142192 - DNA, 15 bp, Homo sapiens
acctccaaaacaacc

SEQ ID NO: 142193 - DNA, 15 bp, Homo sapiens
tacctccaaaacaac

SEQ ID NO: 142194 - DNA, 15 bp, Homo sapiens
ttacctccaaaacaa

SEQ ID NO: 142195 - DNA, 15 bp, Homo sapiens
cttacctccaaaaca

SEQ ID NO: 142196 - DNA, 15 bp, Homo sapiens
tcttacctccaaaac

SEQ ID NO: 142197 - DNA, 15 bp, Homo sapiens
ctcttacctccaaaa

SEQ ID NO: 142198 - DNA, 15 bp, Homo sapiens
tctcttacctccaaa

SEQ ID NO: 142199 - DNA, 15 bp, Homo sapiens
ttctcttacctccaa

SEQ ID NO: 142200 - DNA, 15 bp, Homo sapiens
tttctcttacctcca

SEQ ID NO: 142201 - DNA, 15 bp, Homo sapiens
atttctcttacctcc

SEQ ID NO: 142202 - DNA, 15 bp, Homo sapiens
aatttctcttacctc

SEQ ID NO: 142203 - DNA, 15 bp, Homo sapiens
taatttctcttacct

SEQ ID NO: 142204 - DNA, 15 bp, Homo sapiens
ttaatttctcttacc

SEQ ID NO: 142205 - DNA, 15 bp, Homo sapiens
tttaatttctcttac

SEQ ID NO: 142206 - DNA, 15 bp, Homo sapiens
ctttaatttctctta

SEQ ID NO: 142207 - DNA, 15 bp, Homo sapiens
tctttaatttctctt

SEQ ID NO: 142208 - DNA, 15 bp, Homo sapiens
ctctttaatttctct

SEQ ID NO: 142209 - DNA, 15 bp, Homo sapiens
cctctttaatttctc

SEQ ID NO: 142210 - DNA, 15 bp, Homo sapiens
acctctttaatttct

SEQ ID NO: 142211 - DNA, 15 bp, Homo sapiens
cacctctttaatttc

SEQ ID NO: 142212 - DNA, 15 bp, Homo sapiens
gcacctctttaattt

SEQ ID NO: 142213 - DNA, 15 bp, Homo sapiens
agcacctctttaatt

SEQ ID NO: 142214 - DNA, 15 bp, Homo sapiens
tagcacctctttaat

SEQ ID NO: 142215 - DNA, 15 bp, Homo sapiens
atagcacctctttaa

SEQ ID NO: 142216 - DNA, 15 bp, Homo sapiens
catagcacctcttta

SEQ ID NO: 142217 - DNA, 15 bp, Homo sapiens
acatagcacctcttt

SEQ ID NO: 142218 - DNA, 15 bp, Homo sapiens
tacatagcacctctt

SEQ ID NO: 142219 - DNA, 15 bp, Homo sapiens
ttacatagcacctct

SEQ ID NO: 142220 - DNA, 15 bp, Homo sapiens
cttacatagcacctc

SEQ ID NO: 142221 - DNA, 15 bp, Homo sapiens
tcttacatagcacct

SEQ ID NO: 142222 - DNA, 15 bp, Homo sapiens
ctcttacatagcacc

SEQ ID NO: 142223 - DNA, 15 bp, Homo sapiens
tctcttacatagcac

SEQ ID NO: 142224 - DNA, 15 bp, Homo sapiens
ctctcttacatagca

SEQ ID NO: 142225 - DNA, 15 bp, Homo sapiens
cctctcttacatagc

SEQ ID NO: 142226 - DNA, 15 bp, Homo sapiens
ccctctcttacatag

SEQ ID NO: 142227 - DNA, 15 bp, Homo sapiens
tccctctcttacata

SEQ ID NO: 142228 - DNA, 15 bp, Homo sapiens
gtccctctcttacat

SEQ ID NO: 142229 - DNA, 15 bp, Homo sapiens
agtccctctcttaca

SEQ ID NO: 142230 - DNA, 15 bp, Homo sapiens
aagtccctctcttac

SEQ ID NO: 142231 - DNA, 15 bp, Homo sapiens
taagtccctctctta

SEQ ID NO: 142232 - DNA, 15 bp, Homo sapiens
ttaagtccctctctt

SEQ ID NO: 142233 - DNA, 15 bp, Homo sapiens
gttaagtccctctct

SEQ ID NO: 142234 - DNA, 15 bp, Homo sapiens
agttaagtccctctc

SEQ ID NO: 142235 - DNA, 15 bp, Homo sapiens
cagttaagtccctct

SEQ ID NO: 142236 - DNA, 15 bp, Homo sapiens
tcagttaagtccctc

SEQ ID NO: 142237 - DNA, 15 bp, Homo sapiens
ctcagttaagtccct

SEQ ID NO: 142238 - DNA, 15 bp, Homo sapiens
cctcagttaagtccc

SEQ ID NO: 142239 - DNA, 15 bp, Homo sapiens
gcctcagttaagtcc

SEQ ID NO: 142240 - DNA, 15 bp, Homo sapiens
tgcctcagttaagtc

SEQ ID NO: 142241 - DNA, 15 bp, Homo sapiens
ttgcctcagttaagt

SEQ ID NO: 142242 - DNA, 15 bp, Homo sapiens
tttgcctcagttaag

SEQ ID NO: 142243 - DNA, 15 bp, Homo sapiens
atttgcctcagttaa

SEQ ID NO: 142244 - DNA, 15 bp, Homo sapiens
aatttgcctcagtta

SEQ ID NO: 142245 - DNA, 15 bp, Homo sapiens
aaatttgcctcagtt

SEQ ID NO: 142246 - DNA, 15 bp, Homo sapiens
taaatttgcctcagt

SEQ ID NO: 142247 - DNA, 15 bp, Homo sapiens
ctaaatttgcctcag

SEQ ID NO: 142248 - DNA, 15 bp, Homo sapiens
tctaaatttgcctca

SEQ ID NO: 142249 - DNA, 15 bp, Homo sapiens
ttctaaatttgcctc

SEQ ID NO: 142250 - DNA, 15 bp, Homo sapiens
tttctaaatttgcct

SEQ ID NO: 142251 - DNA, 15 bp, Homo sapiens
ctttctaaatttgcc

SEQ ID NO: 142252 - DNA, 15 bp, Homo sapiens
gctttctaaatttgc

SEQ ID NO: 142253 - DNA, 15 bp, Homo sapiens
tgctttctaaatttg

SEQ ID NO: 142254 - DNA, 15 bp, Homo sapiens
atgctttctaaattt

SEQ ID NO: 142255 - DNA, 15 bp, Homo sapiens
tatgctttctaaatt

SEQ ID NO: 142256 - DNA, 15 bp, Homo sapiens
ttatgctttctaaat

SEQ ID NO: 142257 - DNA, 15 bp, Homo sapiens
gttatgctttctaaa

SEQ ID NO: 142258 - DNA, 15 bp, Homo sapiens
agttatgctttctaa

SEQ ID NO: 142259 - DNA, 15 bp, Homo sapiens
aagttatgctttcta

SEQ ID NO: 142260 - DNA, 15 bp, Homo sapiens
caagttatgctttct

SEQ ID NO: 142261 - DNA, 15 bp, Homo sapiens
ccaagttatgctttc

SEQ ID NO: 142262 - DNA, 15 bp, Homo sapiens
accaagttatgcttt

SEQ ID NO: 142263 - DNA, 15 bp, Homo sapiens
caccaagttatgctt

SEQ ID NO: 142264 - DNA, 15 bp, Homo sapiens
ccaccaagttatgct

SEQ ID NO: 142265 - DNA, 15 bp, Homo sapiens
gccaccaagttatgc

SEQ ID NO: 142266 - DNA, 15 bp, Homo sapiens
tgccaccaagttatg

SEQ ID NO: 142267 - DNA, 15 bp, Homo sapiens
atgccaccaagttat

SEQ ID NO: 142268 - DNA, 15 bp, Homo sapiens
aatgccaccaagtta

SEQ ID NO: 142269 - DNA, 15 bp, Homo sapiens
aaatgccaccaagtt

SEQ ID NO: 142270 - DNA, 15 bp, Homo sapiens
caaatgccaccaagt

SEQ ID NO: 142271 - DNA, 15 bp, Homo sapiens
tcaaatgccaccaag

SEQ ID NO: 142272 - DNA, 15 bp, Homo sapiens
ctcaaatgccaccaa

SEQ ID NO: 142273 - DNA, 15 bp, Homo sapiens
gctcaaatgccacca

SEQ ID NO: 142274 - DNA, 15 bp, Homo sapiens
agctcaaatgccacc

SEQ ID NO: 142275 - DNA, 15 bp, Homo sapiens
cagctcaaatgccac

SEQ ID NO: 142276 - DNA, 15 bp, Homo sapiens
ccagctcaaatgcca

SEQ ID NO: 142277 - DNA, 15 bp, Homo sapiens
accagctcaaatgcc

SEQ ID NO: 142278 - DNA, 15 bp, Homo sapiens
aaccagctcaaatgc

SEQ ID NO: 142279 - DNA, 15 bp, Homo sapiens
gaaccagctcaaatg

SEQ ID NO: 142280 - DNA, 15 bp, Homo sapiens
agaaccagctcaaat

SEQ ID NO: 142281 - DNA, 15 bp, Homo sapiens
cagaaccagctcaaa

SEQ ID NO: 142282 - DNA, 15 bp, Homo sapiens
tcagaaccagctcaa

SEQ ID NO: 142283 - DNA, 15 bp, Homo sapiens
ttcagaaccagctca

SEQ ID NO: 142284 - DNA, 15 bp, Homo sapiens
cttcagaaccagctc

SEQ ID NO: 142285 - DNA, 15 bp, Homo sapiens
ccttcagaaccagct

SEQ ID NO: 142286 - DNA, 15 bp, Homo sapiens
accttcagaaccagc

SEQ ID NO: 142287 - DNA, 15 bp, Homo sapiens
aaccttcagaaccag

SEQ ID NO: 142288 - DNA, 15 bp, Homo sapiens
taaccttcagaacca

SEQ ID NO: 142289 - DNA, 15 bp, Homo sapiens
ttaaccttcagaacc

SEQ ID NO: 142290 - DNA, 15 bp, Homo sapiens
cttaaccttcagaac

SEQ ID NO: 142291 - DNA, 15 bp, Homo sapiens
tcttaaccttcagaa

SEQ ID NO: 142292 - DNA, 15 bp, Homo sapiens
ttcttaaccttcaga

SEQ ID NO: 142293 - DNA, 15 bp, Homo sapiens
cttcttaaccttcag

SEQ ID NO: 142294 - DNA, 15 bp, Homo sapiens
ccttcttaaccttca

SEQ ID NO: 142295 - DNA, 15 bp, Homo sapiens
tccttcttaaccttc

SEQ ID NO: 142296 - DNA, 15 bp, Homo sapiens
ttccttcttaacctt

SEQ ID NO: 142297 - DNA, 15 bp, Homo sapiens
gttccttcttaacct

SEQ ID NO: 142298 - DNA, 15 bp, Homo sapiens
ggttccttcttaacc

SEQ ID NO: 142299 - DNA, 15 bp, Homo sapiens
tggttccttcttaac

SEQ ID NO: 142300 - DNA, 15 bp, Homo sapiens
atggttccttcttaa

SEQ ID NO: 142301 - DNA, 15 bp, Homo sapiens
gatggttccttctta

SEQ ID NO: 142302 - DNA, 15 bp, Homo sapiens
agatggttccttctt

SEQ ID NO: 142303 - DNA, 15 bp, Homo sapiens
cagatggttccttct

SEQ ID NO: 142304 - DNA, 15 bp, Homo sapiens
tcagatggttccttc

SEQ ID NO: 142305 - DNA, 15 bp, Homo sapiens
ttcagatggttcctt

SEQ ID NO: 142306 - DNA, 15 bp, Homo sapiens
cttcagatggttcct

SEQ ID NO: 142307 - DNA, 15 bp, Homo sapiens
tcttcagatggttcc

SEQ ID NO: 142308 - DNA, 15 bp, Homo sapiens
ttcttcagatggttc

SEQ ID NO: 142309 - DNA, 15 bp, Homo sapiens
tttcttcagatggtt

SEQ ID NO: 142310 - DNA, 15 bp, Homo sapiens
ttttcttcagatggt

SEQ ID NO: 142311 - DNA, 15 bp, Homo sapiens
attttcttcagatgg

SEQ ID NO: 142312 - DNA, 15 bp, Homo sapiens
aattttcttcagatg

SEQ ID NO: 142313 - DNA, 15 bp, Homo sapiens
taattttcttcagat

SEQ ID NO: 142314 - DNA, 15 bp, Homo sapiens
gtaattttcttcaga

SEQ ID NO: 142315 - DNA, 15 bp, Homo sapiens
tgtaattttcttcag

SEQ ID NO: 142316 - DNA, 15 bp, Homo sapiens
ctgtaattttcttca

SEQ ID NO: 142317 - DNA, 15 bp, Homo sapiens
tctgtaattttcttc

SEQ ID NO: 142318 - DNA, 15 bp, Homo sapiens
ctctgtaattttctt

SEQ ID NO: 142319 - DNA, 15 bp, Homo sapiens
actctgtaattttct

SEQ ID NO: 142320 - DNA, 15 bp, Homo sapiens
cactctgtaattttc

SEQ ID NO: 142321 - DNA, 15 bp, Homo sapiens
tcactctgtaatttt

SEQ ID NO: 142322 - DNA, 15 bp, Homo sapiens
ttcactctgtaattt

SEQ ID NO: 142323 - DNA, 15 bp, Homo sapiens
gttcactctgtaatt

SEQ ID NO: 142324 - DNA, 15 bp, Homo sapiens
tgttcactctgtaat

SEQ ID NO: 142325 - DNA, 15 bp, Homo sapiens
ctgttcactctgtaa

SEQ ID NO: 142326 - DNA, 15 bp, Homo sapiens
gctgttcactctgta

SEQ ID NO: 142327 - DNA, 15 bp, Homo sapiens
tgctgttcactctgt

SEQ ID NO: 142328 - DNA, 15 bp, Homo sapiens
ttgctgttcactctg

SEQ ID NO: 142329 - DNA, 15 bp, Homo sapiens
tttgctgttcactct

SEQ ID NO: 142330 - DNA, 15 bp, Homo sapiens
atttgctgttcactc

SEQ ID NO: 142331 - DNA, 15 bp, Homo sapiens
tatttgctgttcact

SEQ ID NO: 142332 - DNA, 15 bp, Homo sapiens
atatttgctgttcac

SEQ ID NO: 142333 - DNA, 15 bp, Homo sapiens
tatatttgctgttca

SEQ ID NO: 142334 - DNA, 15 bp, Homo sapiens
ttatatttgctgttc

SEQ ID NO: 142335 - DNA, 15 bp, Homo sapiens
tttatatttgctgtt

SEQ ID NO: 142336 - DNA, 15 bp, Homo sapiens
ttttatatttgctgt

SEQ ID NO: 142337 - DNA, 15 bp, Homo sapiens
cttttatatttgctg

SEQ ID NO: 142338 - DNA, 15 bp, Homo sapiens
acttttatatttgct

SEQ ID NO: 142339 - DNA, 15 bp, Homo sapiens
gacttttatatttgc

SEQ ID NO: 142340 - DNA, 15 bp, Homo sapiens
tgacttttatatttg

SEQ ID NO: 142341 - DNA, 15 bp, Homo sapiens
atgacttttatattt

SEQ ID NO: 142342 - DNA, 15 bp, Homo sapiens
catgacttttatatt

SEQ ID NO: 142343 - DNA, 15 bp, Homo sapiens
tcatgacttttatat

SEQ ID NO: 142344 - DNA, 15 bp, Homo sapiens
ctcatgacttttata

SEQ ID NO: 142345 - DNA, 15 bp, Homo sapiens
cctcatgacttttat

SEQ ID NO: 142346 - DNA, 15 bp, Homo sapiens
gcctcatgactttta

SEQ ID NO: 142347 - DNA, 15 bp, Homo sapiens
tgcctcatgactttt

SEQ ID NO: 142348 - DNA, 15 bp, Homo sapiens
ctgcctcatgacttt

SEQ ID NO: 142349 - DNA, 15 bp, Homo sapiens
cctgcctcatgactt

SEQ ID NO: 142350 - DNA, 15 bp, Homo sapiens
tcctgcctcatgact

SEQ ID NO: 142351 - DNA, 15 bp, Homo sapiens
ttcctgcctcatgac

SEQ ID NO: 142352 - DNA, 15 bp, Homo sapiens
tttcctgcctcatga

SEQ ID NO: 142353 - DNA, 15 bp, Homo sapiens
ctttcctgcctcatg

SEQ ID NO: 142354 - DNA, 15 bp, Homo sapiens
tctttcctgcctcat

SEQ ID NO: 142355 - DNA, 15 bp, Homo sapiens
ctctttcctgcctca

SEQ ID NO: 142356 - DNA, 15 bp, Homo sapiens
gctctttcctgcctc

SEQ ID NO: 142357 - DNA, 15 bp, Homo sapiens
tgctctttcctgcct

SEQ ID NO: 142358 - DNA, 15 bp, Homo sapiens
gtgctctttcctgcc

SEQ ID NO: 142359 - DNA, 15 bp, Homo sapiens
tgtgctctttcctgc

SEQ ID NO: 142360 - DNA, 15 bp, Homo sapiens
ctgtgctctttcctg

SEQ ID NO: 142361 - DNA, 15 bp, Homo sapiens
gctgtgctctttcct

SEQ ID NO: 142362 - DNA, 15 bp, Homo sapiens
tgctgtgctctttcc

SEQ ID NO: 142363 - DNA, 15 bp, Homo sapiens
atgctgtgctctttc

SEQ ID NO: 142364 - DNA, 15 bp, Homo sapiens
catgctgtgctcttt

SEQ ID NO: 142365 - DNA, 15 bp, Homo sapiens
acatgctgtgctctt

SEQ ID NO: 142366 - DNA, 15 bp, Homo sapiens
cacatgctgtgctct

SEQ ID NO: 142367 - DNA, 15 bp, Homo sapiens
ccacatgctgtgctc

SEQ ID NO: 142368 - DNA, 15 bp, Homo sapiens
accacatgctgtgct

SEQ ID NO: 142369 - DNA, 15 bp, Homo sapiens
aaccacatgctgtgc

SEQ ID NO: 142370 - DNA, 15 bp, Homo sapiens
caaccacatgctgtg

SEQ ID NO: 142371 - DNA, 15 bp, Homo sapiens
gcaaccacatgctgt

SEQ ID NO: 142372 - DNA, 15 bp, Homo sapiens
tgcaaccacatgctg

SEQ ID NO: 142373 - DNA, 15 bp, Homo sapiens
ttgcaaccacatgct

SEQ ID NO: 142374 - DNA, 15 bp, Homo sapiens
attgcaaccacatgc

SEQ ID NO: 142375 - DNA, 15 bp, Homo sapiens
tattgcaaccacatg

SEQ ID NO: 142376 - DNA, 15 bp, Homo sapiens
atattgcaaccacat

SEQ ID NO: 142377 - DNA, 15 bp, Homo sapiens
tatattgcaaccaca

SEQ ID NO: 142378 - DNA, 15 bp, Homo sapiens
ttatattgcaaccac

SEQ ID NO: 142379 - DNA, 15 bp, Homo sapiens
attatattgcaacca

SEQ ID NO: 142380 - DNA, 15 bp, Homo sapiens
cattatattgcaacc

SEQ ID NO: 142381 - DNA, 15 bp, Homo sapiens
tcattatattgcaac

SEQ ID NO: 142382 - DNA, 15 bp, Homo sapiens
ttcattatattgcaa

SEQ ID NO: 142383 - DNA, 15 bp, Homo sapiens
attcattatattgca

SEQ ID NO: 142384 - DNA, 15 bp, Homo sapiens
tattcattatattgc

SEQ ID NO: 142385 - DNA, 15 bp, Homo sapiens
atattcattatattg

SEQ ID NO: 142386 - DNA, 15 bp, Homo sapiens
catattcattatatt

SEQ ID NO: 142387 - DNA, 15 bp, Homo sapiens
tcatattcattatat

SEQ ID NO: 142388 - DNA, 15 bp, Homo sapiens
atcatattcattata

SEQ ID NO: 142389 - DNA, 15 bp, Homo sapiens
catcatattcattat

SEQ ID NO: 142390 - DNA, 15 bp, Homo sapiens
ccatcatattcatta

SEQ ID NO: 142391 - DNA, 15 bp, Homo sapiens
accatcatattcatt

SEQ ID NO: 142392 - DNA, 15 bp, Homo sapiens
taccatcatattcat

SEQ ID NO: 142393 - DNA, 15 bp, Homo sapiens
ttaccatcatattca

SEQ ID NO: 142394 - DNA, 15 bp, Homo sapiens
cttaccatcatattc

SEQ ID NO: 142395 - DNA, 15 bp, Homo sapiens
tcttaccatcatatt

SEQ ID NO: 142396 - DNA, 15 bp, Homo sapiens
ctcttaccatcatat

SEQ ID NO: 142397 - DNA, 15 bp, Homo sapiens
gctcttaccatcata

SEQ ID NO: 142398 - DNA, 15 bp, Homo sapiens
agctcttaccatcat

SEQ ID NO: 142399 - DNA, 15 bp, Homo sapiens
aagctcttaccatca

SEQ ID NO: 142400 - DNA, 15 bp, Homo sapiens
caagctcttaccatc

SEQ ID NO: 142401 - DNA, 15 bp, Homo sapiens
tcaagctcttaccat

SEQ ID NO: 142402 - DNA, 15 bp, Homo sapiens
ctcaagctcttacca

SEQ ID NO: 142403 - DNA, 15 bp, Homo sapiens
tctcaagctcttacc

SEQ ID NO: 142404 - DNA, 15 bp, Homo sapiens
atctcaagctcttac

SEQ ID NO: 142405 - DNA, 15 bp, Homo sapiens
catctcaagctctta

SEQ ID NO: 142406 - DNA, 15 bp, Homo sapiens
gcatctcaagctctt

SEQ ID NO: 142407 - DNA, 15 bp, Homo sapiens
cgcatctcaagctct

SEQ ID NO: 142408 - DNA, 15 bp, Homo sapiens
ccgcatctcaagctc

SEQ ID NO: 142409 - DNA, 15 bp, Homo sapiens
accgcatctcaagct

SEQ ID NO: 142410 - DNA, 15 bp, Homo sapiens
taccgcatctcaagc

SEQ ID NO: 142411 - DNA, 15 bp, Homo sapiens
ctaccgcatctcaag

SEQ ID NO: 142412 - DNA, 15 bp, Homo sapiens
cctaccgcatctcaa

SEQ ID NO: 142413 - DNA, 15 bp, Homo sapiens
tcctaccgcatctca

SEQ ID NO: 142414 - DNA, 15 bp, Homo sapiens
ctcctaccgcatctc

SEQ ID NO: 142415 - DNA, 15 bp, Homo sapiens
tctcctaccgcatct

SEQ ID NO: 142416 - DNA, 15 bp, Homo sapiens
ctctcctaccgcatc

SEQ ID NO: 142417 - DNA, 15 bp, Homo sapiens
cctctcctaccgcat

SEQ ID NO: 142418 - DNA, 15 bp, Homo sapiens
tcctctcctaccgca

SEQ ID NO: 142419 - DNA, 15 bp, Homo sapiens
ttcctctcctaccgc

SEQ ID NO: 142420 - DNA, 15 bp, Homo sapiens
cttcctctcctaccg

SEQ ID NO: 142421 - DNA, 15 bp, Homo sapiens
ccttcctctcctacc

SEQ ID NO: 142422 - DNA, 15 bp, Homo sapiens
gccttcctctcctac

SEQ ID NO: 142423 - DNA, 15 bp, Homo sapiens
tgccttcctctccta

SEQ ID NO: 142424 - DNA, 15 bp, Homo sapiens
ctgccttcctctcct

SEQ ID NO: 142425 - DNA, 15 bp, Homo sapiens
tctgccttcctctcc

SEQ ID NO: 142426 - DNA, 15 bp, Homo sapiens
ctctgccttcctctc

SEQ ID NO: 142427 - DNA, 15 bp, Homo sapiens
cctctgccttcctct

SEQ ID NO: 142428 - DNA, 15 bp, Homo sapiens
gcctctgccttcctc

SEQ ID NO: 142429 - DNA, 15 bp, Homo sapiens
ggcctctgccttcct

SEQ ID NO: 142430 - DNA, 15 bp, Homo sapiens
tggcctctgccttcc

SEQ ID NO: 142431 - DNA, 15 bp, Homo sapiens
ctggcctctgccttc

SEQ ID NO: 142432 - DNA, 15 bp, Homo sapiens
tctggcctctgcctt

SEQ ID NO: 142433 - DNA, 15 bp, Homo sapiens
atctggcctctgcct

SEQ ID NO: 142434 - DNA, 15 bp, Homo sapiens
gatctggcctctgcc

SEQ ID NO: 142435 - DNA, 15 bp, Homo sapiens
tgatctggcctctgc

SEQ ID NO: 142436 - DNA, 15 bp, Homo sapiens
atgatctggcctctg

SEQ ID NO: 142437 - DNA, 15 bp, Homo sapiens
catgatctggcctct

SEQ ID NO: 142438 - DNA, 15 bp, Homo sapiens
gcatgatctggcctc

SEQ ID NO: 142439 - DNA, 15 bp, Homo sapiens
agcatgatctggcct

SEQ ID NO: 142440 - DNA, 15 bp, Homo sapiens
cagcatgatctggcc

SEQ ID NO: 142441 - DNA, 15 bp, Homo sapiens
tcagcatgatctggc

SEQ ID NO: 142442 - DNA, 15 bp, Homo sapiens
ctcagcatgatctgg

SEQ ID NO: 142443 - DNA, 15 bp, Homo sapiens
gctcagcatgatctg

SEQ ID NO: 142444 - DNA, 15 bp, Homo sapiens
agctcagcatgatct

SEQ ID NO: 142445 - DNA, 15 bp, Homo sapiens
aagctcagcatgatc

SEQ ID NO: 142446 - DNA, 15 bp, Homo sapiens
aaagctcagcatgat

SEQ ID NO: 142447 - DNA, 15 bp, Homo sapiens
caaagctcagcatga

SEQ ID NO: 142448 - DNA, 15 bp, Homo sapiens
acaaagctcagcatg

SEQ ID NO: 142449 - DNA, 15 bp, Homo sapiens
tacaaagctcagcat

SEQ ID NO: 142450 - DNA, 15 bp, Homo sapiens
ttacaaagctcagca

SEQ ID NO: 142451 - DNA, 15 bp, Homo sapiens
cttacaaagctcagc

SEQ ID NO: 142452 - DNA, 15 bp, Homo sapiens
tcttacaaagctcag

SEQ ID NO: 142453 - DNA, 15 bp, Homo sapiens
gtcttacaaagctca

SEQ ID NO: 142454 - DNA, 15 bp, Homo sapiens
tgtcttacaaagctc

SEQ ID NO: 142455 - DNA, 15 bp, Homo sapiens
atgtcttacaaagct

SEQ ID NO: 142456 - DNA, 15 bp, Homo sapiens
catgtcttacaaagc

SEQ ID NO: 142457 - DNA, 15 bp, Homo sapiens
ccatgtcttacaaag

SEQ ID NO: 142458 - DNA, 15 bp, Homo sapiens
cccatgtcttacaaa

SEQ ID NO: 142459 - DNA, 15 bp, Homo sapiens
ccccatgtcttacaa

SEQ ID NO: 142460 - DNA, 15 bp, Homo sapiens
accccatgtcttaca

SEQ ID NO: 142461 - DNA, 15 bp, Homo sapiens
taccccatgtcttac

SEQ ID NO: 142462 - DNA, 15 bp, Homo sapiens
ataccccatgtctta

SEQ ID NO: 142463 - DNA, 15 bp, Homo sapiens
aataccccatgtctt

SEQ ID NO: 142464 - DNA, 15 bp, Homo sapiens
taataccccatgtct

SEQ ID NO: 142465 - DNA, 15 bp, Homo sapiens
ctaataccccatgtc

SEQ ID NO: 142466 - DNA, 15 bp, Homo sapiens
actaataccccatgt

SEQ ID NO: 142467 - DNA, 15 bp, Homo sapiens
gactaataccccatg

SEQ ID NO: 142468 - DNA, 15 bp, Homo sapiens
ggactaataccccat

SEQ ID NO: 142469 - DNA, 15 bp, Homo sapiens
cggactaatacccca

SEQ ID NO: 142470 - DNA, 15 bp, Homo sapiens
acggactaatacccc

SEQ ID NO: 142471 - DNA, 15 bp, Homo sapiens
aacggactaataccc

SEQ ID NO: 142472 - DNA, 15 bp, Homo sapiens
aaacggactaatacc

SEQ ID NO: 142473 - DNA, 15 bp, Homo sapiens
atgaaaacggactaa

SEQ ID NO: 142474 - DNA, 15 bp, Homo sapiens
tatgaaaacggacta

SEQ ID NO: 142475 - DNA, 15 bp, Homo sapiens
gtatgaaaacggact

SEQ ID NO: 142476 - DNA, 15 bp, Homo sapiens
agtatgaaaacggac

SEQ ID NO: 142477 - DNA, 15 bp, Homo sapiens
cagtatgaaaacgga

SEQ ID NO: 142478 - DNA, 15 bp, Homo sapiens
gcagtatgaaaacgg

SEQ ID NO: 142479 - DNA, 15 bp, Homo sapiens
ggcagtatgaaaacg

SEQ ID NO: 142480 - DNA, 15 bp, Homo sapiens
tggcagtatgaaaac

SEQ ID NO: 142481 - DNA, 15 bp, Homo sapiens
atggcagtatgaaaa

SEQ ID NO: 142482 - DNA, 15 bp, Homo sapiens
tatggcagtatgaaa

SEQ ID NO: 142483 - DNA, 15 bp, Homo sapiens
ttatggcagtatgaa

SEQ ID NO: 142484 - DNA, 15 bp, Homo sapiens
tttatggcagtatga

SEQ ID NO: 142485 - DNA, 15 bp, Homo sapiens
ctttatggcagtatg

SEQ ID NO: 142486 - DNA, 15 bp, Homo sapiens
tctttatggcagtat

SEQ ID NO: 142487 - DNA, 15 bp, Homo sapiens
ttctttatggcagta

SEQ ID NO: 142488 - DNA, 15 bp, Homo sapiens
gttctttatggcagt

SEQ ID NO: 142489 - DNA, 15 bp, Homo sapiens
agttctttatggcag

SEQ ID NO: 142490 - DNA, 15 bp, Homo sapiens
cagttctttatggca

SEQ ID NO: 142491 - DNA, 15 bp, Homo sapiens
gcagttctttatggc

SEQ ID NO: 142492 - DNA, 15 bp, Homo sapiens
ggcagttctttatgg

SEQ ID NO: 142493 - DNA, 15 bp, Homo sapiens
aggcagttctttatg

SEQ ID NO: 142494 - DNA, 15 bp, Homo sapiens
caggcagttctttat

SEQ ID NO: 142495 - DNA, 15 bp, Homo sapiens
tcaggcagttcttta

SEQ ID NO: 142496 - DNA, 15 bp, Homo sapiens
ctcaggcagttcttt

SEQ ID NO: 142497 - DNA, 15 bp, Homo sapiens
tctcaggcagttctt

SEQ ID NO: 142498 - DNA, 15 bp, Homo sapiens
gtctcaggcagttct

SEQ ID NO: 142499 - DNA, 15 bp, Homo sapiens
agtctcaggcagttc

SEQ ID NO: 142500 - DNA, 15 bp, Homo sapiens
cagtctcaggcagtt

SEQ ID NO: 142501 - DNA, 15 bp, Homo sapiens
ccagtctcaggcagt

SEQ ID NO: 142502 - DNA, 15 bp, Homo sapiens
cccagtctcaggcag

SEQ ID NO: 142503 - DNA, 15 bp, Homo sapiens
acccagtctcaggca

SEQ ID NO: 142504 - DNA, 15 bp, Homo sapiens
tacccagtctcaggc

SEQ ID NO: 142505 - DNA, 15 bp, Homo sapiens
actctttcctttata

SEQ ID NO: 142506 - DNA, 15 bp, Homo sapiens
aactctttcctttat

SEQ ID NO: 142507 - DNA, 15 bp, Homo sapiens
aaactctttccttta

SEQ ID NO: 142508 - DNA, 15 bp, Homo sapiens
aaaactctttccttt

SEQ ID NO: 142509 - DNA, 15 bp, Homo sapiens
taaaactctttcctt

SEQ ID NO: 142510 - DNA, 15 bp, Homo sapiens
ttaaaactctttcct

SEQ ID NO: 142511 - DNA, 15 bp, Homo sapiens
gttaaaactctttcc

SEQ ID NO: 142512 - DNA, 15 bp, Homo sapiens
agttaaaactctttc

SEQ ID NO: 142513 - DNA, 15 bp, Homo sapiens
cagttaaaactcttt

SEQ ID NO: 142514 - DNA, 15 bp, Homo sapiens
tcagttaaaactctt

SEQ ID NO: 142515 - DNA, 15 bp, Homo sapiens
gtcagttaaaactct

SEQ ID NO: 142516 - DNA, 15 bp, Homo sapiens
agtcagttaaaactc

SEQ ID NO: 142517 - DNA, 15 bp, Homo sapiens
aagtcagttaaaact

SEQ ID NO: 142518 - DNA, 15 bp, Homo sapiens
taagtcagttaaaac

SEQ ID NO: 142519 - DNA, 15 bp, Homo sapiens
ataagtcagttaaaa

SEQ ID NO: 142520 - DNA, 15 bp, Homo sapiens
tataagtcagttaaa

SEQ ID NO: 142521 - DNA, 15 bp, Homo sapiens
ctataagtcagttaa

SEQ ID NO: 142522 - DNA, 15 bp, Homo sapiens
actataagtcagtta

SEQ ID NO: 142523 - DNA, 15 bp, Homo sapiens
aactataagtcagtt

SEQ ID NO: 142524 - DNA, 15 bp, Homo sapiens
gaactataagtcagt

SEQ ID NO: 142525 - DNA, 15 bp, Homo sapiens
tgaactataagtcag

SEQ ID NO: 142526 - DNA, 15 bp, Homo sapiens
ctgaactataagtca

SEQ ID NO: 142527 - DNA, 15 bp, Homo sapiens
gctgaactataagtc

SEQ ID NO: 142528 - DNA, 15 bp, Homo sapiens
tgctgaactataagt

SEQ ID NO: 142529 - DNA, 15 bp, Homo sapiens
atgctgaactataag

SEQ ID NO: 142530 - DNA, 15 bp, Homo sapiens
catgctgaactataa

SEQ ID NO: 142531 - DNA, 15 bp, Homo sapiens
ccatgctgaactata

SEQ ID NO: 142532 - DNA, 15 bp, Homo sapiens
tgccatgctgaacta

SEQ ID NO: 142533 - DNA, 15 bp, Homo sapiens
ctgccatgctgaact

SEQ ID NO: 142534 - DNA, 15 bp, Homo sapiens
cctgccatgctgaac

SEQ ID NO: 142535 - DNA, 15 bp, Homo sapiens
ccctgccatgctgaa

SEQ ID NO: 142536 - DNA, 15 bp, Homo sapiens
cccctgccatgctga

SEQ ID NO: 142537 - DNA, 15 bp, Homo sapiens
tcccctgccatgctg

SEQ ID NO: 142538 - DNA, 15 bp, Homo sapiens
ctcccctgccatgct

SEQ ID NO: 142539 - DNA, 15 bp, Homo sapiens
tctcccctgccatgc

SEQ ID NO: 142540 - DNA, 15 bp, Homo sapiens
gtctcccctgccatg

SEQ ID NO: 142541 - DNA, 15 bp, Homo sapiens
ggtctcccctgccat

SEQ ID NO: 142542 - DNA, 15 bp, Homo sapiens
aggtctcccctgcca

SEQ ID NO: 142543 - DNA, 15 bp, Homo sapiens
gaggtctcccctgcc

SEQ ID NO: 142544 - DNA, 15 bp, Homo sapiens
tgaggtctcccctgc

SEQ ID NO: 142545 - DNA, 15 bp, Homo sapiens
ctgaggtctcccctg

SEQ ID NO: 142546 - DNA, 15 bp, Homo sapiens
cctgaggtctcccct

SEQ ID NO: 142547 - DNA, 15 bp, Homo sapiens
tcctgaggtctcccc

SEQ ID NO: 142548 - DNA, 15 bp, Homo sapiens
ttcctgaggtctccc

SEQ ID NO: 142549 - DNA, 15 bp, Homo sapiens
tttcctgaggtctcc

SEQ ID NO: 142550 - DNA, 15 bp, Homo sapiens
gtttcctgaggtctc

SEQ ID NO: 142551 - DNA, 15 bp, Homo sapiens
agtttcctgaggtct

SEQ ID NO: 142552 - DNA, 15 bp, Homo sapiens
aagtttcctgaggtc

SEQ ID NO: 142553 - DNA, 15 bp, Homo sapiens
taagtttcctgaggt

SEQ ID NO: 142554 - DNA, 15 bp, Homo sapiens
gtaagtttcctgagg

SEQ ID NO: 142555 - DNA, 15 bp, Homo sapiens
tgtaagtttcctgag

SEQ ID NO: 142556 - DNA, 15 bp, Homo sapiens
ttgtaagtttcctga

SEQ ID NO: 142557 - DNA, 15 bp, Homo sapiens
attgtaagtttcctg

SEQ ID NO: 142558 - DNA, 15 bp, Homo sapiens
gattgtaagtttcct

SEQ ID NO: 142559 - DNA, 15 bp, Homo sapiens
tgattgtaagtttcc

SEQ ID NO: 142560 - DNA, 15 bp, Homo sapiens
atgattgtaagtttc

SEQ ID NO: 142561 - DNA, 15 bp, Homo sapiens
catgattgtaagttt

SEQ ID NO: 142562 - DNA, 15 bp, Homo sapiens
ccatgattgtaagtt

SEQ ID NO: 142563 - DNA, 15 bp, Homo sapiens
gccatgattgtaagt

SEQ ID NO: 142564 - DNA, 15 bp, Homo sapiens
cgccatgattgtaag

SEQ ID NO: 142565 - DNA, 15 bp, Homo sapiens
ccgccatgattgtaa

SEQ ID NO: 142566 - DNA, 15 bp, Homo sapiens
tccgccatgattgta

SEQ ID NO: 142567 - DNA, 15 bp, Homo sapiens
ttccgccatgattgt

SEQ ID NO: 142568 - DNA, 15 bp, Homo sapiens
cttccgccatgattg

SEQ ID NO: 142569 - DNA, 15 bp, Homo sapiens
ccttccgccatgatt

SEQ ID NO: 142570 - DNA, 15 bp, Homo sapiens
accttccgccatgat

SEQ ID NO: 142571 - DNA, 15 bp, Homo sapiens
caccttccgccatga

SEQ ID NO: 142572 - DNA, 15 bp, Homo sapiens
tcaccttccgccatg

SEQ ID NO: 142573 - DNA, 15 bp, Homo sapiens
ttcaccttccgccat

SEQ ID NO: 142574 - DNA, 15 bp, Homo sapiens
cttcaccttccgcca

SEQ ID NO: 142575 - DNA, 15 bp, Homo sapiens
ccttcaccttccgcc

SEQ ID NO: 142576 - DNA, 15 bp, Homo sapiens
cccttcaccttccgc

SEQ ID NO: 142577 - DNA, 15 bp, Homo sapiens
ccccttcaccttccg

SEQ ID NO: 142578 - DNA, 15 bp, Homo sapiens
tccccttcaccttcc

SEQ ID NO: 142579 - DNA, 15 bp, Homo sapiens
ttccccttcaccttc

SEQ ID NO: 142580 - DNA, 15 bp, Homo sapiens
cttccccttcacctt

SEQ ID NO: 142581 - DNA, 15 bp, Homo sapiens
gcttccccttcacct

SEQ ID NO: 142582 - DNA, 15 bp, Homo sapiens
tgcttccccttcacc

SEQ ID NO: 142583 - DNA, 15 bp, Homo sapiens
ttgcttccccttcac

SEQ ID NO: 142584 - DNA, 15 bp, Homo sapiens
cttgcttccccttca

SEQ ID NO: 142585 - DNA, 15 bp, Homo sapiens
ccttgcttccccttc

SEQ ID NO: 142586 - DNA, 15 bp, Homo sapiens
gccttgcttcccctt

SEQ ID NO: 142587 - DNA, 15 bp, Homo sapiens
tgccttgcttcccct

SEQ ID NO: 142588 - DNA, 15 bp, Homo sapiens
gtgccttgcttcccc

SEQ ID NO: 142589 - DNA, 15 bp, Homo sapiens
ggtgccttgcttccc

SEQ ID NO: 142590 - DNA, 15 bp, Homo sapiens
aggtgccttgcttcc

SEQ ID NO: 142591 - DNA, 15 bp, Homo sapiens
aaggtgccttgcttc

SEQ ID NO: 142592 - DNA, 15 bp, Homo sapiens
gaaggtgccttgctt

SEQ ID NO: 142593 - DNA, 15 bp, Homo sapiens
agaaggtgccttgct

SEQ ID NO: 142594 - DNA, 15 bp, Homo sapiens
aagaaggtgccttgc

SEQ ID NO: 142595 - DNA, 15 bp, Homo sapiens
gaagaaggtgccttg

SEQ ID NO: 142596 - DNA, 15 bp, Homo sapiens
tgaagaaggtgcctt

SEQ ID NO: 142597 - DNA, 15 bp, Homo sapiens
gtgaagaaggtgcct

SEQ ID NO: 142598 - DNA, 15 bp, Homo sapiens
tgtgaagaaggtgcc

SEQ ID NO: 142599 - DNA, 15 bp, Homo sapiens
ttgtgaagaaggtgc

SEQ ID NO: 142600 - DNA, 15 bp, Homo sapiens
cttgtgaagaaggtg

SEQ ID NO: 142601 - DNA, 15 bp, Homo sapiens
ccttgtgaagaaggt

SEQ ID NO: 142602 - DNA, 15 bp, Homo sapiens
accttgtgaagaagg

SEQ ID NO: 142603 - DNA, 15 bp, Homo sapiens
caccttgtgaagaag

SEQ ID NO: 142604 - DNA, 15 bp, Homo sapiens
ccaccttgtgaagaa

SEQ ID NO: 142605 - DNA, 15 bp, Homo sapiens
gccaccttgtgaaga

SEQ ID NO: 142606 - DNA, 15 bp, Homo sapiens
tgccaccttgtgaag

SEQ ID NO: 142607 - DNA, 15 bp, Homo sapiens
ctgccaccttgtgaa

SEQ ID NO: 142608 - DNA, 15 bp, Homo sapiens
cctgccaccttgtga

SEQ ID NO: 142609 - DNA, 15 bp, Homo sapiens
tcctgccaccttgtg

SEQ ID NO: 142610 - DNA, 15 bp, Homo sapiens
ttcctgccaccttgt

SEQ ID NO: 142611 - DNA, 15 bp, Homo sapiens
cttcctgccaccttg

SEQ ID NO: 142612 - DNA, 15 bp, Homo sapiens
tcttcctgccacctt

SEQ ID NO: 142613 - DNA, 15 bp, Homo sapiens
ctcttcctgccacct

SEQ ID NO: 142614 - DNA, 15 bp, Homo sapiens
tctcttcctgccacc

SEQ ID NO: 142615 - DNA, 15 bp, Homo sapiens
ttctcttcctgccac

SEQ ID NO: 142616 - DNA, 15 bp, Homo sapiens
attctcttcctgcca

SEQ ID NO: 142617 - DNA, 15 bp, Homo sapiens
aattctcttcctgcc

SEQ ID NO: 142618 - DNA, 15 bp, Homo sapiens
caattctcttcctgc

SEQ ID NO: 142619 - DNA, 15 bp, Homo sapiens
gcaattctcttcctg

SEQ ID NO: 142620 - DNA, 15 bp, Homo sapiens
agcaattctcttcct

SEQ ID NO: 142621 - DNA, 15 bp, Homo sapiens
cagcaattctcttcc

SEQ ID NO: 142622 - DNA, 15 bp, Homo sapiens
tcagcaattctcttc

SEQ ID NO: 142623 - DNA, 15 bp, Homo sapiens
ctcagcaattctctt

SEQ ID NO: 142624 - DNA, 15 bp, Homo sapiens
actcagcaattctct

SEQ ID NO: 142625 - DNA, 15 bp, Homo sapiens
cactcagcaattctc

SEQ ID NO: 142626 - DNA, 15 bp, Homo sapiens
tcactcagcaattct

SEQ ID NO: 142627 - DNA, 15 bp, Homo sapiens
ttcactcagcaattc

SEQ ID NO: 142628 - DNA, 15 bp, Homo sapiens
cttcactcagcaatt

SEQ ID NO: 142629 - DNA, 15 bp, Homo sapiens
ccttcactcagcaat

SEQ ID NO: 142630 - DNA, 15 bp, Homo sapiens
cccttcactcagcaa

SEQ ID NO: 142631 - DNA, 15 bp, Homo sapiens
ccccttcactcagca

SEQ ID NO: 142632 - DNA, 15 bp, Homo sapiens
cccccttcactcagc

SEQ ID NO: 142633 - DNA, 15 bp, Homo sapiens
tcccccttcactcag

SEQ ID NO: 142634 - DNA, 15 bp, Homo sapiens
ttcccccttcactca

SEQ ID NO: 142635 - DNA, 15 bp, Homo sapiens
cttcccccttcactc

SEQ ID NO: 142636 - DNA, 15 bp, Homo sapiens
tcttcccccttcact

SEQ ID NO: 142637 - DNA, 15 bp, Homo sapiens
ctcttcccccttcac

SEQ ID NO: 142638 - DNA, 15 bp, Homo sapiens
gctcttcccccttca

SEQ ID NO: 142639 - DNA, 15 bp, Homo sapiens
agctcttcccccttc

SEQ ID NO: 142640 - DNA, 15 bp, Homo sapiens
gagctcttccccctt

SEQ ID NO: 142641 - DNA, 15 bp, Homo sapiens
ggagctcttccccct

SEQ ID NO: 142642 - DNA, 15 bp, Homo sapiens
aggagctcttccccc

SEQ ID NO: 142643 - DNA, 15 bp, Homo sapiens
aaggagctcttcccc

SEQ ID NO: 142644 - DNA, 15 bp, Homo sapiens
taaggagctcttccc

SEQ ID NO: 142645 - DNA, 15 bp, Homo sapiens
ataaggagctcttcc

SEQ ID NO: 142646 - DNA, 15 bp, Homo sapiens
tataaggagctcttc

SEQ ID NO: 142647 - DNA, 15 bp, Homo sapiens
ttataaggagctctt

SEQ ID NO: 142648 - DNA, 15 bp, Homo sapiens
tttataaggagctct

SEQ ID NO: 142649 - DNA, 15 bp, Homo sapiens
ttttataaggagctc

SEQ ID NO: 142650 - DNA, 15 bp, Homo sapiens
gttttataaggagct

SEQ ID NO: 142651 - DNA, 15 bp, Homo sapiens
agttttataaggagc

SEQ ID NO: 142652 - DNA, 15 bp, Homo sapiens
tagttttataaggag

SEQ ID NO: 142653 - DNA, 15 bp, Homo sapiens
atagttttataagga

SEQ ID NO: 142654 - DNA, 15 bp, Homo sapiens
gatagttttataagg

SEQ ID NO: 142655 - DNA, 15 bp, Homo sapiens
tgatagttttataag

SEQ ID NO: 142656 - DNA, 15 bp, Homo sapiens
ctgatagttttataa

SEQ ID NO: 142657 - DNA, 15 bp, Homo sapiens
tctgatagttttata

SEQ ID NO: 142658 - DNA, 15 bp, Homo sapiens
atctgatagttttat

SEQ ID NO: 142659 - DNA, 15 bp, Homo sapiens
gatctgatagtttta

SEQ ID NO: 142660 - DNA, 15 bp, Homo sapiens
agatctgatagtttt

SEQ ID NO: 142661 - DNA, 15 bp, Homo sapiens
aagatctgatagttt

SEQ ID NO: 142662 - DNA, 15 bp, Homo sapiens
caagatctgatagtt

SEQ ID NO: 142663 - DNA, 15 bp, Homo sapiens
acaagatctgatagt

SEQ ID NO: 142664 - DNA, 15 bp, Homo sapiens
cacaagatctgatag

SEQ ID NO: 142665 - DNA, 15 bp, Homo sapiens
tcacaagatctgata

SEQ ID NO: 142666 - DNA, 15 bp, Homo sapiens
ttcacaagatctgat

SEQ ID NO: 142667 - DNA, 15 bp, Homo sapiens
tttcacaagatctga

SEQ ID NO: 142668 - DNA, 15 bp, Homo sapiens
ttttcacaagatctg

SEQ ID NO: 142669 - DNA, 15 bp, Homo sapiens
gttttcacaagatct

SEQ ID NO: 142670 - DNA, 15 bp, Homo sapiens
agttttcacaagatc

SEQ ID NO: 142671 - DNA, 15 bp, Homo sapiens
gagttttcacaagat

SEQ ID NO: 142672 - DNA, 15 bp, Homo sapiens
tgagttttcacaaga

SEQ ID NO: 142673 - DNA, 15 bp, Homo sapiens
gtgagttttcacaag

SEQ ID NO: 142674 - DNA, 15 bp, Homo sapiens
agtgagttttcacaa

SEQ ID NO: 142675 - DNA, 15 bp, Homo sapiens
gagtgagttttcaca

SEQ ID NO: 142676 - DNA, 15 bp, Homo sapiens
tgagtgagttttcac

SEQ ID NO: 142677 - DNA, 15 bp, Homo sapiens
atgagtgagttttca

SEQ ID NO: 142678 - DNA, 15 bp, Homo sapiens
aatgagtgagttttc

SEQ ID NO: 142679 - DNA, 15 bp, Homo sapiens
taatgagtgagtttt

SEQ ID NO: 142680 - DNA, 15 bp, Homo sapiens
ataatgagtgagttt

SEQ ID NO: 142681 - DNA, 15 bp, Homo sapiens
gataatgagtgagtt

SEQ ID NO: 142682 - DNA, 15 bp, Homo sapiens
tgataatgagtgagt

SEQ ID NO: 142683 - DNA, 15 bp, Homo sapiens
gtgataatgagtgag

SEQ ID NO: 142684 - DNA, 15 bp, Homo sapiens
cgtgataatgagtga

SEQ ID NO: 142685 - DNA, 15 bp, Homo sapiens
tcgtgataatgagtg

SEQ ID NO: 142686 - DNA, 15 bp, Homo sapiens
ctcgtgataatgagt

SEQ ID NO: 142687 - DNA, 15 bp, Homo sapiens
tctcgtgataatgag

SEQ ID NO: 142688 - DNA, 15 bp, Homo sapiens
ttctcgtgataatga

SEQ ID NO: 142689 - DNA, 15 bp, Homo sapiens
gttctcgtgataatg

SEQ ID NO: 142690 - DNA, 15 bp, Homo sapiens
tgttctcgtgataat

SEQ ID NO: 142691 - DNA, 15 bp, Homo sapiens
ttgttctcgtgataa

SEQ ID NO: 142692 - DNA, 15 bp, Homo sapiens
gttgttctcgtgata

SEQ ID NO: 142693 - DNA, 15 bp, Homo sapiens
tgttgttctcgtgat

SEQ ID NO: 142694 - DNA, 15 bp, Homo sapiens
atgttgttctcgtga

SEQ ID NO: 142695 - DNA, 15 bp, Homo sapiens
catgttgttctcgtg

SEQ ID NO: 142696 - DNA, 15 bp, Homo sapiens
ccatgttgttctcgt

SEQ ID NO: 142697 - DNA, 15 bp, Homo sapiens
cccatgttgttctcg

SEQ ID NO: 142698 - DNA, 15 bp, Homo sapiens
ccccatgttgttctc

SEQ ID NO: 142699 - DNA, 15 bp, Homo sapiens
cccccatgttgttct

SEQ ID NO: 142700 - DNA, 15 bp, Homo sapiens
tcccccatgttgttc

SEQ ID NO: 142701 - DNA, 15 bp, Homo sapiens
ttcccccatgttgtt

SEQ ID NO: 142702 - DNA, 15 bp, Homo sapiens
tttcccccatgttgt

SEQ ID NO: 142703 - DNA, 15 bp, Homo sapiens
gtttcccccatgttg

SEQ ID NO: 142704 - DNA, 15 bp, Homo sapiens
ggtttcccccatgtt

SEQ ID NO: 142705 - DNA, 15 bp, Homo sapiens
tggtttcccccatgt

SEQ ID NO: 142706 - DNA, 15 bp, Homo sapiens
atggtttcccccatg

SEQ ID NO: 142707 - DNA, 15 bp, Homo sapiens
gatggtttcccccat

SEQ ID NO: 142708 - DNA, 15 bp, Homo sapiens
ggatggtttccccca

SEQ ID NO: 142709 - DNA, 15 bp, Homo sapiens
gggatggtttccccc

SEQ ID NO: 142710 - DNA, 15 bp, Homo sapiens
ggggatggtttcccc

SEQ ID NO: 142711 - DNA, 15 bp, Homo sapiens
tggggatggtttccc

SEQ ID NO: 142712 - DNA, 15 bp, Homo sapiens
atggggatggtttcc

SEQ ID NO: 142713 - DNA, 15 bp, Homo sapiens
aatggggatggtttc

SEQ ID NO: 142714 - DNA, 15 bp, Homo sapiens
taatggggatggttt

SEQ ID NO: 142715 - DNA, 15 bp, Homo sapiens
ataatggggatggtt

SEQ ID NO: 142716 - DNA, 15 bp, Homo sapiens
gataatggggatggt

SEQ ID NO: 142717 - DNA, 15 bp, Homo sapiens
ggataatggggatgg

SEQ ID NO: 142718 - DNA, 15 bp, Homo sapiens
tggataatggggatg

SEQ ID NO: 142719 - DNA, 15 bp, Homo sapiens
ttggataatggggat

SEQ ID NO: 142720 - DNA, 15 bp, Homo sapiens
attggataatgggga

SEQ ID NO: 142721 - DNA, 15 bp, Homo sapiens
aattggataatgggg

SEQ ID NO: 142722 - DNA, 15 bp, Homo sapiens
taattggataatggg

SEQ ID NO: 142723 - DNA, 15 bp, Homo sapiens
ataattggataatgg

SEQ ID NO: 142724 - DNA, 15 bp, Homo sapiens
cataattggataatg

SEQ ID NO: 142725 - DNA, 15 bp, Homo sapiens
acataattggataat

SEQ ID NO: 142726 - DNA, 15 bp, Homo sapiens
gacataattggataa

SEQ ID NO: 142727 - DNA, 15 bp, Homo sapiens
ggacataattggata

SEQ ID NO: 142728 - DNA, 15 bp, Homo sapiens
tggacataattggat

SEQ ID NO: 142729 - DNA, 15 bp, Homo sapiens
gtggacataattgga

SEQ ID NO: 142730 - DNA, 15 bp, Homo sapiens
ggtggacataattgg

SEQ ID NO: 142731 - DNA, 15 bp, Homo sapiens
aggtggacataattg

SEQ ID NO: 142732 - DNA, 15 bp, Homo sapiens
caggtggacataatt

SEQ ID NO: 142733 - DNA, 15 bp, Homo sapiens
ccaggtggacataat

SEQ ID NO: 142734 - DNA, 15 bp, Homo sapiens
accaggtggacataa

SEQ ID NO: 142735 - DNA, 15 bp, Homo sapiens
gaccaggtggacata

SEQ ID NO: 142736 - DNA, 15 bp, Homo sapiens
agaccaggtggacat

SEQ ID NO: 142737 - DNA, 15 bp, Homo sapiens
gagaccaggtggaca

SEQ ID NO: 142738 - DNA, 15 bp, Homo sapiens
agagaccaggtggac

SEQ ID NO: 142739 - DNA, 15 bp, Homo sapiens
gagagaccaggtgga

SEQ ID NO: 142740 - DNA, 15 bp, Homo sapiens
ggagagaccaggtgg

SEQ ID NO: 142741 - DNA, 15 bp, Homo sapiens
gggagagaccaggtg

SEQ ID NO: 142742 - DNA, 15 bp, Homo sapiens
agggagagaccaggt

SEQ ID NO: 142743 - DNA, 15 bp, Homo sapiens
aagggagagaccagg

SEQ ID NO: 142744 - DNA, 15 bp, Homo sapiens
caagggagagaccag

SEQ ID NO: 142745 - DNA, 15 bp, Homo sapiens
tcaagggagagacca

SEQ ID NO: 142746 - DNA, 15 bp, Homo sapiens
gtcaagggagagacc

SEQ ID NO: 142747 - DNA, 15 bp, Homo sapiens
tgtcaagggagagac

SEQ ID NO: 142748 - DNA, 15 bp, Homo sapiens
gtgtcaagggagaga

SEQ ID NO: 142749 - DNA, 15 bp, Homo sapiens
tgtgtcaagggagag

SEQ ID NO: 142750 - DNA, 15 bp, Homo sapiens
atgtgtcaagggaga

SEQ ID NO: 142751 - DNA, 15 bp, Homo sapiens
catgtgtcaagggag

SEQ ID NO: 142752 - DNA, 15 bp, Homo sapiens
ccatgtgtcaaggga

SEQ ID NO: 142753 - DNA, 15 bp, Homo sapiens
cccatgtgtcaaggg

SEQ ID NO: 142754 - DNA, 15 bp, Homo sapiens
ccccatgtgtcaagg

SEQ ID NO: 142755 - DNA, 15 bp, Homo sapiens
tccccatgtgtcaag

SEQ ID NO: 142756 - DNA, 15 bp, Homo sapiens
atccccatgtgtcaa

SEQ ID NO: 142757 - DNA, 15 bp, Homo sapiens
tatccccatgtgtca

SEQ ID NO: 142758 - DNA, 15 bp, Homo sapiens
atatccccatgtgtc

SEQ ID NO: 142759 - DNA, 15 bp, Homo sapiens
tatatccccatgtgt

SEQ ID NO: 142760 - DNA, 15 bp, Homo sapiens
ctatatccccatgtg

SEQ ID NO: 142761 - DNA, 15 bp, Homo sapiens
cctatatccccatgt

SEQ ID NO: 142762 - DNA, 15 bp, Homo sapiens
ccctatatccccatg

SEQ ID NO: 142763 - DNA, 15 bp, Homo sapiens
cccctatatccccat

SEQ ID NO: 142764 - DNA, 15 bp, Homo sapiens
acccctatatcccca

SEQ ID NO: 142765 - DNA, 15 bp, Homo sapiens
aacccctatatcccc

SEQ ID NO: 142766 - DNA, 15 bp, Homo sapiens
taacccctatatccc

SEQ ID NO: 142767 - DNA, 15 bp, Homo sapiens
ataacccctatatcc

SEQ ID NO: 142768 - DNA, 15 bp, Homo sapiens
tataacccctatatc

SEQ ID NO: 142769 - DNA, 15 bp, Homo sapiens
ttataacccctatat

SEQ ID NO: 142770 - DNA, 15 bp, Homo sapiens
attataacccctata

SEQ ID NO: 142771 - DNA, 15 bp, Homo sapiens
aattataacccctat

SEQ ID NO: 142772 - DNA, 15 bp, Homo sapiens
gaattataaccccta

SEQ ID NO: 142773 - DNA, 15 bp, Homo sapiens
tgaattataacccct

SEQ ID NO: 142774 - DNA, 15 bp, Homo sapiens
ttgaattataacccc

SEQ ID NO: 142775 - DNA, 15 bp, Homo sapiens
cttgaattataaccc

SEQ ID NO: 142776 - DNA, 15 bp, Homo sapiens
ccttgaattataacc

SEQ ID NO: 142777 - DNA, 15 bp, Homo sapiens
accttgaattataac

SEQ ID NO: 142778 - DNA, 15 bp, Homo sapiens
caccttgaattataa

SEQ ID NO: 142779 - DNA, 15 bp, Homo sapiens
tcaccttgaattata

SEQ ID NO: 142780 - DNA, 15 bp, Homo sapiens
ctcaccttgaattat

SEQ ID NO: 142781 - DNA, 15 bp, Homo sapiens
tctcaccttgaatta

SEQ ID NO: 142782 - DNA, 15 bp, Homo sapiens
atctcaccttgaatt

SEQ ID NO: 142783 - DNA, 15 bp, Homo sapiens
aatctcaccttgaat

SEQ ID NO: 142784 - DNA, 15 bp, Homo sapiens
aaatctcaccttgaa

SEQ ID NO: 142785 - DNA, 15 bp, Homo sapiens
caaatctcaccttga

SEQ ID NO: 142786 - DNA, 15 bp, Homo sapiens
ccaaatctcaccttg

SEQ ID NO: 142787 - DNA, 15 bp, Homo sapiens
cccaaatctcacctt

SEQ ID NO: 142788 - DNA, 15 bp, Homo sapiens
acccaaatctcacct

SEQ ID NO: 142789 - DNA, 15 bp, Homo sapiens
cacccaaatctcacc

SEQ ID NO: 142790 - DNA, 15 bp, Homo sapiens
acacccaaatctcac

SEQ ID NO: 142791 - DNA, 15 bp, Homo sapiens
cacacccaaatctca

SEQ ID NO: 142792 - DNA, 15 bp, Homo sapiens
ccacacccaaatctc

SEQ ID NO: 142793 - DNA, 15 bp, Homo sapiens
tccacacccaaatct

SEQ ID NO: 142794 - DNA, 15 bp, Homo sapiens
atccacacccaaatc

SEQ ID NO: 142795 - DNA, 15 bp, Homo sapiens
tatccacacccaaat

SEQ ID NO: 142796 - DNA, 15 bp, Homo sapiens
gtatccacacccaaa

SEQ ID NO: 142797 - DNA, 15 bp, Homo sapiens
tgtatccacacccaa

SEQ ID NO: 142798 - DNA, 15 bp, Homo sapiens
ttgtatccacaccca

SEQ ID NO: 142799 - DNA, 15 bp, Homo sapiens
tttgtatccacaccc

SEQ ID NO: 142800 - DNA, 15 bp, Homo sapiens
ttttgtatccacacc

SEQ ID NO: 142801 - DNA, 15 bp, Homo sapiens
gttttgtatccacac

SEQ ID NO: 142802 - DNA, 15 bp, Homo sapiens
ggttttgtatccaca

SEQ ID NO: 142803 - DNA, 15 bp, Homo sapiens
aggttttgtatccac

SEQ ID NO: 142804 - DNA, 15 bp, Homo sapiens
taggttttgtatcca

SEQ ID NO: 142805 - DNA, 15 bp, Homo sapiens
ttaggttttgtatcc

SEQ ID NO: 142806 - DNA, 15 bp, Homo sapiens
attaggttttgtatc

SEQ ID NO: 142807 - DNA, 15 bp, Homo sapiens
gattaggttttgtat

SEQ ID NO: 142808 - DNA, 15 bp, Homo sapiens
tgattaggttttgta

SEQ ID NO: 142809 - DNA, 15 bp, Homo sapiens
atgattaggttttgt

SEQ ID NO: 142810 - DNA, 15 bp, Homo sapiens
tatgattaggttttg

SEQ ID NO: 142811 - DNA, 15 bp, Homo sapiens
atatgattaggtttt

SEQ ID NO: 142812 - DNA, 15 bp, Homo sapiens
gatatgattaggttt

SEQ ID NO: 142813 - DNA, 15 bp, Homo sapiens
tgatatgattaggtt

SEQ ID NO: 142814 - DNA, 15 bp, Homo sapiens
gtgatatgattaggt

SEQ ID NO: 142815 - DNA, 15 bp, Homo sapiens
tgtgatatgattagg

SEQ ID NO: 142816 - DNA, 15 bp, Homo sapiens
atgtgatatgattag

SEQ ID NO: 142817 - DNA, 15 bp, Homo sapiens
catgtgatatgatta

SEQ ID NO: 142818 - DNA, 15 bp, Homo sapiens
ccatgtgatatgatt

SEQ ID NO: 142819 - DNA, 15 bp, Homo sapiens
cccatgtgatatgat

SEQ ID NO: 142820 - DNA, 15 bp, Homo sapiens
tcccatgtgatatga

SEQ ID NO: 142821 - DNA, 15 bp, Homo sapiens
ttcccatgtgatatg

SEQ ID NO: 142822 - DNA, 15 bp, Homo sapiens
cttcccatgtgatat

SEQ ID NO: 142823 - DNA, 15 bp, Homo sapiens
ccttcccatgtgata

SEQ ID NO: 142824 - DNA, 15 bp, Homo sapiens
tccttcccatgtgat

SEQ ID NO: 142825 - DNA, 15 bp, Homo sapiens
ctccttcccatgtga

SEQ ID NO: 142826 - DNA, 15 bp, Homo sapiens
actccttcccatgtg

SEQ ID NO: 142827 - DNA, 15 bp, Homo sapiens
aactccttcccatgt

SEQ ID NO: 142828 - DNA, 15 bp, Homo sapiens
aaactccttcccatg

SEQ ID NO: 142829 - DNA, 15 bp, Homo sapiens
caaactccttcccat

SEQ ID NO: 142830 - DNA, 15 bp, Homo sapiens
ccaaactccttccca

SEQ ID NO: 142831 - DNA, 15 bp, Homo sapiens
tccaaactccttccc

SEQ ID NO: 142832 - DNA, 15 bp, Homo sapiens
atccaaactccttcc

SEQ ID NO: 142833 - DNA, 15 bp, Homo sapiens
tatccaaactccttc

SEQ ID NO: 142834 - DNA, 15 bp, Homo sapiens
atatccaaactcctt

SEQ ID NO: 142835 - DNA, 15 bp, Homo sapiens
aatatccaaactcct

SEQ ID NO: 142836 - DNA, 15 bp, Homo sapiens
taatatccaaactcc

SEQ ID NO: 142837 - DNA, 15 bp, Homo sapiens
ttaatatccaaactc

SEQ ID NO: 142838 - DNA, 15 bp, Homo sapiens
tttaatatccaaact

SEQ ID NO: 142839 - DNA, 15 bp, Homo sapiens
ttttaatatccaaac

SEQ ID NO: 142840 - DNA, 15 bp, Homo sapiens
cttttaatatccaaa

SEQ ID NO: 142841 - DNA, 15 bp, Homo sapiens
acttttaatatccaa

SEQ ID NO: 142842 - DNA, 15 bp, Homo sapiens
tacttttaatatcca

SEQ ID NO: 142843 - DNA, 15 bp, Homo sapiens
gtacttttaatatcc

SEQ ID NO: 142844 - DNA, 15 bp, Homo sapiens
tgtacttttaatatc

SEQ ID NO: 142845 - DNA, 15 bp, Homo sapiens
ttgtacttttaatat

SEQ ID NO: 142846 - DNA, 15 bp, Homo sapiens
attgtacttttaata

SEQ ID NO: 142847 - DNA, 15 bp, Homo sapiens
tattgtacttttaat

SEQ ID NO: 142848 - DNA, 15 bp, Homo sapiens
ctattgtacttttaa

SEQ ID NO: 142849 - DNA, 15 bp, Homo sapiens
tctattgtactttta

SEQ ID NO: 142850 - DNA, 15 bp, Homo sapiens
ttctattgtactttt

SEQ ID NO: 142851 - DNA, 15 bp, Homo sapiens
tttctattgtacttt

SEQ ID NO: 142852 - DNA, 15 bp, Homo sapiens
ctttctattgtactt

SEQ ID NO: 142853 - DNA, 15 bp, Homo sapiens
gctttctattgtact

SEQ ID NO: 142854 - DNA, 15 bp, Homo sapiens
agctttctattgtac

SEQ ID NO: 142855 - DNA, 15 bp, Homo sapiens
tagctttctattgta

SEQ ID NO: 142856 - DNA, 15 bp, Homo sapiens
atagctttctattgt

SEQ ID NO: 142857 - DNA, 15 bp, Homo sapiens
aatagctttctattg

SEQ ID NO: 142858 - DNA, 15 bp, Homo sapiens
caatagctttctatt

SEQ ID NO: 142859 - DNA, 15 bp, Homo sapiens
ccaatagctttctat

SEQ ID NO: 142860 - DNA, 15 bp, Homo sapiens
tccaatagctttcta

SEQ ID NO: 142861 - DNA, 15 bp, Homo sapiens
ttccaatagctttct

SEQ ID NO: 142862 - DNA, 15 bp, Homo sapiens
attccaatagctttc

SEQ ID NO: 142863 - DNA, 15 bp, Homo sapiens
aattccaatagcttt

SEQ ID NO: 142864 - DNA, 15 bp, Homo sapiens
caattccaatagctt

SEQ ID NO: 142865 - DNA, 15 bp, Homo sapiens
acaattccaatagct

SEQ ID NO: 142866 - DNA, 15 bp, Homo sapiens
aacaattccaatagc

SEQ ID NO: 142867 - DNA, 15 bp, Homo sapiens
taacaattccaatag

SEQ ID NO: 142868 - DNA, 15 bp, Homo sapiens
ttaacaattccaata

SEQ ID NO: 142869 - DNA, 15 bp, Homo sapiens
cttaacaattccaat

SEQ ID NO: 142870 - DNA, 15 bp, Homo sapiens
ccttaacaattccaa

SEQ ID NO: 142871 - DNA, 15 bp, Homo sapiens
tccttaacaattcca

SEQ ID NO: 142872 - DNA, 15 bp, Homo sapiens
ttccttaacaattcc

SEQ ID NO: 142873 - DNA, 15 bp, Homo sapiens
cttccttaacaattc

SEQ ID NO: 142874 - DNA, 15 bp, Homo sapiens
ccttccttaacaatt

SEQ ID NO: 142875 - DNA, 15 bp, Homo sapiens
cccttccttaacaat

SEQ ID NO: 142876 - DNA, 15 bp, Homo sapiens
tcccttccttaacaa

SEQ ID NO: 142877 - DNA, 15 bp, Homo sapiens
ctcccttccttaaca

SEQ ID NO: 142878 - DNA, 15 bp, Homo sapiens
actcccttccttaac

SEQ ID NO: 142879 - DNA, 15 bp, Homo sapiens
cactcccttccttaa

SEQ ID NO: 142880 - DNA, 15 bp, Homo sapiens
tcactcccttcctta

SEQ ID NO: 142881 - DNA, 15 bp, Homo sapiens
gtcactcccttcctt

SEQ ID NO: 142882 - DNA, 15 bp, Homo sapiens
tgtcactcccttcct

SEQ ID NO: 142883 - DNA, 15 bp, Homo sapiens
gtgtcactcccttcc

SEQ ID NO: 142884 - DNA, 15 bp, Homo sapiens
agtgtcactcccttc

SEQ ID NO: 142885 - DNA, 15 bp, Homo sapiens
cagtgtcactccctt

SEQ ID NO: 142886 - DNA, 15 bp, Homo sapiens
acagtgtcactccct

SEQ ID NO: 142887 - DNA, 15 bp, Homo sapiens
gacagtgtcactccc

SEQ ID NO: 142888 - DNA, 15 bp, Homo sapiens
agacagtgtcactcc

SEQ ID NO: 142889 - DNA, 15 bp, Homo sapiens
tagacagtgtcactc

SEQ ID NO: 142890 - DNA, 15 bp, Homo sapiens
ttagacagtgtcact

SEQ ID NO: 142891 - DNA, 15 bp, Homo sapiens
attagacagtgtcac

SEQ ID NO: 142892 - DNA, 15 bp, Homo sapiens
cattagacagtgtca

SEQ ID NO: 142893 - DNA, 15 bp, Homo sapiens
acattagacagtgtc

SEQ ID NO: 142894 - DNA, 15 bp, Homo sapiens
cacattagacagtgt

SEQ ID NO: 142895 - DNA, 15 bp, Homo sapiens
acacattagacagtg

SEQ ID NO: 142896 - DNA, 15 bp, Homo sapiens
tacacattagacagt

SEQ ID NO: 142897 - DNA, 15 bp, Homo sapiens
atacacattagacag

SEQ ID NO: 142898 - DNA, 15 bp, Homo sapiens
tatacacattagaca

SEQ ID NO: 142899 - DNA, 15 bp, Homo sapiens
atatacacattagac

SEQ ID NO: 142900 - DNA, 15 bp, Homo sapiens
tatatacacattaga

SEQ ID NO: 142901 - DNA, 15 bp, Homo sapiens
atatatacacattag

SEQ ID NO: 142902 - DNA, 15 bp, Homo sapiens
tatatatacacatta

SEQ ID NO: 142903 - DNA, 15 bp, Homo sapiens
atatatatacacatt

SEQ ID NO: 142904 - DNA, 15 bp, Homo sapiens
aatatatatacacat

SEQ ID NO: 142905 - DNA, 15 bp, Homo sapiens
taatatatatacaca

SEQ ID NO: 142906 - DNA, 15 bp, Homo sapiens
ttaatatatatacac

SEQ ID NO: 142907 - DNA, 15 bp, Homo sapiens
tttaatatatataca

SEQ ID NO: 142908 - DNA, 15 bp, Homo sapiens
ttttaatatatatac

SEQ ID NO: 142909 - DNA, 15 bp, Homo sapiens
attttaatatatata

SEQ ID NO: 142910 - DNA, 15 bp, Homo sapiens
aattttaatatatat

SEQ ID NO: 142911 - DNA, 15 bp, Homo sapiens
aaattttaatatata

SEQ ID NO: 142912 - DNA, 15 bp, Homo sapiens
taaattttaatatat

SEQ ID NO: 142913 - DNA, 15 bp, Homo sapiens
ttaaattttaatata

SEQ ID NO: 142914 - DNA, 15 bp, Homo sapiens
attaaattttaatat

SEQ ID NO: 142915 - DNA, 15 bp, Homo sapiens
gattaaattttaata

SEQ ID NO: 142916 - DNA, 15 bp, Homo sapiens
agattaaattttaat

SEQ ID NO: 142917 - DNA, 15 bp, Homo sapiens
gagattaaattttaa

SEQ ID NO: 142918 - DNA, 15 bp, Homo sapiens
agagattaaatttta

SEQ ID NO: 142919 - DNA, 15 bp, Homo sapiens
gagagattaaatttt

SEQ ID NO: 142920 - DNA, 15 bp, Homo sapiens
agagagattaaattt

SEQ ID NO: 142921 - DNA, 15 bp, Homo sapiens
cagagagattaaatt

SEQ ID NO: 142922 - DNA, 15 bp, Homo sapiens
ccagagagattaaat

SEQ ID NO: 142923 - DNA, 15 bp, Homo sapiens
tccagagagattaaa

SEQ ID NO: 142924 - DNA, 15 bp, Homo sapiens
atccagagagattaa

SEQ ID NO: 142925 - DNA, 15 bp, Homo sapiens
gatccagagagatta

SEQ ID NO: 142926 - DNA, 15 bp, Homo sapiens
agatccagagagatt

SEQ ID NO: 142927 - DNA, 15 bp, Homo sapiens
aagatccagagagat

SEQ ID NO: 142928 - DNA, 15 bp, Homo sapiens
taagatccagagaga

SEQ ID NO: 142929 - DNA, 15 bp, Homo sapiens
ataagatccagagag

SEQ ID NO: 142930 - DNA, 15 bp, Homo sapiens
cataagatccagaga

SEQ ID NO: 142931 - DNA, 15 bp, Homo sapiens
acataagatccagag

SEQ ID NO: 142932 - DNA, 15 bp, Homo sapiens
cacataagatccaga

SEQ ID NO: 142933 - DNA, 15 bp, Homo sapiens
ccacataagatccag

SEQ ID NO: 142934 - DNA, 15 bp, Homo sapiens
tccacataagatcca

SEQ ID NO: 142935 - DNA, 15 bp, Homo sapiens
atccacataagatcc

SEQ ID NO: 142936 - DNA, 15 bp, Homo sapiens
tatccacataagatc

SEQ ID NO: 142937 - DNA, 15 bp, Homo sapiens
ttatccacataagat

SEQ ID NO: 142938 - DNA, 15 bp, Homo sapiens
attatccacataaga

SEQ ID NO: 142939 - DNA, 15 bp, Homo sapiens
tattatccacataag

SEQ ID NO: 142940 - DNA, 15 bp, Homo sapiens
ctattatccacataa

SEQ ID NO: 142941 - DNA, 15 bp, Homo sapiens
cctattatccacata

SEQ ID NO: 142942 - DNA, 15 bp, Homo sapiens
acctattatccacat

SEQ ID NO: 142943 - DNA, 15 bp, Homo sapiens
aacctattatccaca

SEQ ID NO: 142944 - DNA, 15 bp, Homo sapiens
caacctattatccac

SEQ ID NO: 142945 - DNA, 15 bp, Homo sapiens
gcaacctattatcca

SEQ ID NO: 142946 - DNA, 15 bp, Homo sapiens
agcaacctattatcc

SEQ ID NO: 142947 - DNA, 15 bp, Homo sapiens
tagcaacctattatc

SEQ ID NO: 142948 - DNA, 15 bp, Homo sapiens
ctagcaacctattat

SEQ ID NO: 142949 - DNA, 15 bp, Homo sapiens
actagcaacctatta

SEQ ID NO: 142950 - DNA, 15 bp, Homo sapiens
cactagcaacctatt

SEQ ID NO: 142951 - DNA, 15 bp, Homo sapiens
ccactagcaacctat

SEQ ID NO: 142952 - DNA, 15 bp, Homo sapiens
cccactagcaaccta

SEQ ID NO: 142953 - DNA, 15 bp, Homo sapiens
acccactagcaacct

SEQ ID NO: 142954 - DNA, 15 bp, Homo sapiens
tacccactagcaacc

SEQ ID NO: 142955 - DNA, 15 bp, Homo sapiens
atacccactagcaac

SEQ ID NO: 142956 - DNA, 15 bp, Homo sapiens
tatacccactagcaa

SEQ ID NO: 142957 - DNA, 15 bp, Homo sapiens
ctatacccactagca

SEQ ID NO: 142958 - DNA, 15 bp, Homo sapiens
actatacccactagc

SEQ ID NO: 142959 - DNA, 15 bp, Homo sapiens
tactatacccactag

SEQ ID NO: 142960 - DNA, 15 bp, Homo sapiens
ctactatacccacta

SEQ ID NO: 142961 - DNA, 15 bp, Homo sapiens
tctactatacccact

SEQ ID NO: 142962 - DNA, 15 bp, Homo sapiens
ttctactatacccac

SEQ ID NO: 142963 - DNA, 15 bp, Homo sapiens
attctactataccca

SEQ ID NO: 142964 - DNA, 15 bp, Homo sapiens
tattctactataccc

SEQ ID NO: 142965 - DNA, 15 bp, Homo sapiens
ttattctactatacc

SEQ ID NO: 142966 - DNA, 15 bp, Homo sapiens
attattctactatac

SEQ ID NO: 142967 - DNA, 15 bp, Homo sapiens
aattattctactata

SEQ ID NO: 142968 - DNA, 15 bp, Homo sapiens
caattattctactat

SEQ ID NO: 142969 - DNA, 15 bp, Homo sapiens
gcaattattctacta

SEQ ID NO: 142970 - DNA, 15 bp, Homo sapiens
cgcaattattctact

SEQ ID NO: 142971 - DNA, 15 bp, Homo sapiens
tcgcaattattctac

SEQ ID NO: 142972 - DNA, 15 bp, Homo sapiens
ttcgcaattattcta

SEQ ID NO: 142973 - DNA, 15 bp, Homo sapiens
cttcgcaattattct

SEQ ID NO: 142974 - DNA, 15 bp, Homo sapiens
tcttcgcaattattc

SEQ ID NO: 142975 - DNA, 15 bp, Homo sapiens
atcttcgcaattatt

SEQ ID NO: 142976 - DNA, 15 bp, Homo sapiens
gatcttcgcaattat

SEQ ID NO: 142977 - DNA, 15 bp, Homo sapiens
tgatcttcgcaatta

SEQ ID NO: 142978 - DNA, 15 bp, Homo sapiens
ctgatcttcgcaatt

SEQ ID NO: 142979 - DNA, 15 bp, Homo sapiens
tctgatcttcgcaat

SEQ ID NO: 142980 - DNA, 15 bp, Homo sapiens
ttctgatcttcgcaa

SEQ ID NO: 142981 - DNA, 15 bp, Homo sapiens
tttctgatcttcgca

SEQ ID NO: 142982 - DNA, 15 bp, Homo sapiens
ctttctgatcttcgc

SEQ ID NO: 142983 - DNA, 15 bp, Homo sapiens
cctttctgatcttcg

SEQ ID NO: 142984 - DNA, 15 bp, Homo sapiens
tcctttctgatcttc

SEQ ID NO: 142985 - DNA, 15 bp, Homo sapiens
ttcctttctgatctt

SEQ ID NO: 142986 - DNA, 15 bp, Homo sapiens
cttcctttctgatct

SEQ ID NO: 142987 - DNA, 15 bp, Homo sapiens
acttcctttctgatc

SEQ ID NO: 142988 - DNA, 15 bp, Homo sapiens
cacttcctttctgat

SEQ ID NO: 142989 - DNA, 15 bp, Homo sapiens
tcacttcctttctga

SEQ ID NO: 142990 - DNA, 15 bp, Homo sapiens
atcacttcctttctg

SEQ ID NO: 142991 - DNA, 15 bp, Homo sapiens
catcacttcctttct

SEQ ID NO: 142992 - DNA, 15 bp, Homo sapiens
ccatcacttcctttc

SEQ ID NO: 142993 - DNA, 15 bp, Homo sapiens
accatcacttccttt

SEQ ID NO: 142994 - DNA, 15 bp, Homo sapiens
aaccatcacttcctt

SEQ ID NO: 142995 - DNA, 15 bp, Homo sapiens
caaccatcacttcct

SEQ ID NO: 142996 - DNA, 15 bp, Homo sapiens
acaaccatcacttcc

SEQ ID NO: 142997 - DNA, 15 bp, Homo sapiens
cacaaccatcacttc

SEQ ID NO: 142998 - DNA, 15 bp, Homo sapiens
ccacaaccatcactt

SEQ ID NO: 142999 - DNA, 15 bp, Homo sapiens
accacaaccatcact

SEQ ID NO: 143000 - DNA, 15 bp, Homo sapiens
gaccacaaccatcac

SEQ ID NO: 143001 - DNA, 15 bp, Homo sapiens
ggaccacaaccatca

SEQ ID NO: 143002 - DNA, 15 bp, Homo sapiens
tggaccacaaccatc

SEQ ID NO: 143003 - DNA, 15 bp, Homo sapiens
ttggaccacaaccat

SEQ ID NO: 143004 - DNA, 15 bp, Homo sapiens
gttggaccacaacca

SEQ ID NO: 143005 - DNA, 15 bp, Homo sapiens
agttggaccacaacc

SEQ ID NO: 143006 - DNA, 15 bp, Homo sapiens
cagttggaccacaac

SEQ ID NO: 143007 - DNA, 15 bp, Homo sapiens
ccagttggaccacaa

SEQ ID NO: 143008 - DNA, 15 bp, Homo sapiens
cccagttggaccaca

SEQ ID NO: 143009 - DNA, 15 bp, Homo sapiens
tcccagttggaccac

SEQ ID NO: 143010 - DNA, 15 bp, Homo sapiens
gtcccagttggacca

SEQ ID NO: 143011 - DNA, 15 bp, Homo sapiens
tgtcccagttggacc

SEQ ID NO: 143012 - DNA, 15 bp, Homo sapiens
atgtcccagttggac

SEQ ID NO: 143013 - DNA, 15 bp, Homo sapiens
catgtcccagttgga

SEQ ID NO: 143014 - DNA, 15 bp, Homo sapiens
ccatgtcccagttgg

SEQ ID NO: 143015 - DNA, 15 bp, Homo sapiens
accatgtcccagttg

SEQ ID NO: 143016 - DNA, 15 bp, Homo sapiens
caccatgtcccagtt

SEQ ID NO: 143017 - DNA, 15 bp, Homo sapiens
ccaccatgtcccagt

SEQ ID NO: 143018 - DNA, 15 bp, Homo sapiens
accaccatgtcccag

SEQ ID NO: 143019 - DNA, 15 bp, Homo sapiens
gaccaccatgtccca

SEQ ID NO: 143020 - DNA, 15 bp, Homo sapiens
ggaccaccatgtccc

SEQ ID NO: 143021 - DNA, 15 bp, Homo sapiens
gggaccaccatgtcc

SEQ ID NO: 143022 - DNA, 15 bp, Homo sapiens
ggggaccaccatgtc

SEQ ID NO: 143023 - DNA, 15 bp, Homo sapiens
cggggaccaccatgt

SEQ ID NO: 143024 - DNA, 15 bp, Homo sapiens
acggggaccaccatg

SEQ ID NO: 143025 - DNA, 15 bp, Homo sapiens
cacggggaccaccat

SEQ ID NO: 143026 - DNA, 15 bp, Homo sapiens
ccacggggaccacca

SEQ ID NO: 143027 - DNA, 15 bp, Homo sapiens
gccacggggaccacc

SEQ ID NO: 143028 - DNA, 15 bp, Homo sapiens
agccacggggaccac

SEQ ID NO: 143029 - DNA, 15 bp, Homo sapiens
tagccacggggacca

SEQ ID NO: 143030 - DNA, 15 bp, Homo sapiens
gtagccacggggacc

SEQ ID NO: 143031 - DNA, 15 bp, Homo sapiens
agtagccacggggac

SEQ ID NO: 143032 - DNA, 15 bp, Homo sapiens
cagtagccacgggga

SEQ ID NO: 143033 - DNA, 15 bp, Homo sapiens
acagtagccacgggg

SEQ ID NO: 143034 - DNA, 15 bp, Homo sapiens
tacagtagccacggg

SEQ ID NO: 143035 - DNA, 15 bp, Homo sapiens
atacagtagccacgg

SEQ ID NO: 143036 - DNA, 15 bp, Homo sapiens
catacagtagccacg

SEQ ID NO: 143037 - DNA, 15 bp, Homo sapiens
gcatacagtagccac

SEQ ID NO: 143038 - DNA, 15 bp, Homo sapiens
ggcatacagtagcca

SEQ ID NO: 143039 - DNA, 15 bp, Homo sapiens
tggcatacagtagcc

SEQ ID NO: 143040 - DNA, 15 bp, Homo sapiens
ctggcatacagtagc

SEQ ID NO: 143041 - DNA, 15 bp, Homo sapiens
gctggcatacagtag

SEQ ID NO: 143042 - DNA, 15 bp, Homo sapiens
tgctggcatacagta

SEQ ID NO: 143043 - DNA, 15 bp, Homo sapiens
ttgctggcatacagt

SEQ ID NO: 143044 - DNA, 15 bp, Homo sapiens
attgctggcatacag

SEQ ID NO: 143045 - DNA, 15 bp, Homo sapiens
cattgctggcataca

SEQ ID NO: 143046 - DNA, 15 bp, Homo sapiens
tcattgctggcatac

SEQ ID NO: 143047 - DNA, 15 bp, Homo sapiens
atcattgctggcata

SEQ ID NO: 143048 - DNA, 15 bp, Homo sapiens
catcattgctggcat

SEQ ID NO: 143049 - DNA, 15 bp, Homo sapiens
ccatcattgctggca

SEQ ID NO: 143050 - DNA, 15 bp, Homo sapiens
tccatcattgctggc

SEQ ID NO: 143051 - DNA, 15 bp, Homo sapiens
ttccatcattgctgg

SEQ ID NO: 143052 - DNA, 15 bp, Homo sapiens
tttccatcattgctg

SEQ ID NO: 143053 - DNA, 15 bp, Homo sapiens
atttccatcattgct

SEQ ID NO: 143054 - DNA, 15 bp, Homo sapiens
tatttccatcattgc

SEQ ID NO: 143055 - DNA, 15 bp, Homo sapiens
ttatttccatcattg

SEQ ID NO: 143056 - DNA, 15 bp, Homo sapiens
cttatttccatcatt

SEQ ID NO: 143057 - DNA, 15 bp, Homo sapiens
tcttatttccatcat

SEQ ID NO: 143058 - DNA, 15 bp, Homo sapiens
atcttatttccatca

SEQ ID NO: 143059 - DNA, 15 bp, Homo sapiens
catcttatttccatc

SEQ ID NO: 143060 - DNA, 15 bp, Homo sapiens
acatcttatttccat

SEQ ID NO: 143061 - DNA, 15 bp, Homo sapiens
aacatcttatttcca

SEQ ID NO: 143062 - DNA, 15 bp, Homo sapiens
taacatcttatttcc

SEQ ID NO: 143063 - DNA, 15 bp, Homo sapiens
ctaacatcttatttc

SEQ ID NO: 143064 - DNA, 15 bp, Homo sapiens
tctaacatcttattt

SEQ ID NO: 143065 - DNA, 15 bp, Homo sapiens
atctaacatcttatt

SEQ ID NO: 143066 - DNA, 15 bp, Homo sapiens
aatctaacatcttat

SEQ ID NO: 143067 - DNA, 15 bp, Homo sapiens
aaatctaacatctta

SEQ ID NO: 143068 - DNA, 15 bp, Homo sapiens
caaatctaacatctt

SEQ ID NO: 143069 - DNA, 15 bp, Homo sapiens
gcaaatctaacatct

SEQ ID NO: 143070 - DNA, 15 bp, Homo sapiens
cgcaaatctaacatc

SEQ ID NO: 143071 - DNA, 15 bp, Homo sapiens
tcgcaaatctaacat

SEQ ID NO: 143072 - DNA, 15 bp, Homo sapiens
atcgcaaatctaaca

SEQ ID NO: 143073 - DNA, 15 bp, Homo sapiens
tatcgcaaatctaac

SEQ ID NO: 143074 - DNA, 15 bp, Homo sapiens
atatcgcaaatctaa

SEQ ID NO: 143075 - DNA, 15 bp, Homo sapiens
catatcgcaaatcta

SEQ ID NO: 143076 - DNA, 15 bp, Homo sapiens
gcatatcgcaaatct

SEQ ID NO: 143077 - DNA, 15 bp, Homo sapiens
ggcatatcgcaaatc

SEQ ID NO: 143078 - DNA, 15 bp, Homo sapiens
aggcatatcgcaaat

SEQ ID NO: 143079 - DNA, 15 bp, Homo sapiens
aaggcatatcgcaaa

SEQ ID NO: 143080 - DNA, 15 bp, Homo sapiens
caaggcatatcgcaa

SEQ ID NO: 143081 - DNA, 15 bp, Homo sapiens
ccaaggcatatcgca

SEQ ID NO: 143082 - DNA, 15 bp, Homo sapiens
tccaaggcatatcgc

SEQ ID NO: 143083 - DNA, 15 bp, Homo sapiens
ttccaaggcatatcg

SEQ ID NO: 143084 - DNA, 15 bp, Homo sapiens
cttccaaggcatatc

SEQ ID NO: 143085 - DNA, 15 bp, Homo sapiens
acttccaaggcatat

SEQ ID NO: 143086 - DNA, 15 bp, Homo sapiens
tacttccaaggcata

SEQ ID NO: 143087 - DNA, 15 bp, Homo sapiens
ctacttccaaggcat

SEQ ID NO: 143088 - DNA, 15 bp, Homo sapiens
tctacttccaaggca

SEQ ID NO: 143089 - DNA, 15 bp, Homo sapiens
ttctacttccaaggc

SEQ ID NO: 143090 - DNA, 15 bp, Homo sapiens
tttctacttccaagg

SEQ ID NO: 143091 - DNA, 15 bp, Homo sapiens
ttttctacttccaag

SEQ ID NO: 143092 - DNA, 15 bp, Homo sapiens
cttttctacttccaa

SEQ ID NO: 143093 - DNA, 15 bp, Homo sapiens
tcttttctacttcca

SEQ ID NO: 143094 - DNA, 15 bp, Homo sapiens
gtcttttctacttcc

SEQ ID NO: 143095 - DNA, 15 bp, Homo sapiens
tgtcttttctacttc

SEQ ID NO: 143096 - DNA, 15 bp, Homo sapiens
atgtcttttctactt

SEQ ID NO: 143097 - DNA, 15 bp, Homo sapiens
aatgtcttttctact

SEQ ID NO: 143098 - DNA, 15 bp, Homo sapiens
aaatgtcttttctac

SEQ ID NO: 143099 - DNA, 15 bp, Homo sapiens
aaaatgtcttttcta

SEQ ID NO: 143100 - DNA, 15 bp, Homo sapiens
caaaatgtcttttct

SEQ ID NO: 143101 - DNA, 15 bp, Homo sapiens
ccaaaatgtcttttc

SEQ ID NO: 143102 - DNA, 15 bp, Homo sapiens
accaaaatgtctttt

SEQ ID NO: 143103 - DNA, 15 bp, Homo sapiens
caccaaaatgtcttt

SEQ ID NO: 143104 - DNA, 15 bp, Homo sapiens
ccaccaaaatgtctt

SEQ ID NO: 143105 - DNA, 15 bp, Homo sapiens
tccaccaaaatgtct

SEQ ID NO: 143106 - DNA, 15 bp, Homo sapiens
atccaccaaaatgtc

SEQ ID NO: 143107 - DNA, 15 bp, Homo sapiens
aatccaccaaaatgt

SEQ ID NO: 143108 - DNA, 15 bp, Homo sapiens
taatccaccaaaatg

SEQ ID NO: 143109 - DNA, 15 bp, Homo sapiens
ctaatccaccaaaat

SEQ ID NO: 143110 - DNA, 15 bp, Homo sapiens
tctaatccaccaaaa

SEQ ID NO: 143111 - DNA, 15 bp, Homo sapiens
atctaatccaccaaa

SEQ ID NO: 143112 - DNA, 15 bp, Homo sapiens
tatctaatccaccaa

SEQ ID NO: 143113 - DNA, 15 bp, Homo sapiens
atatctaatccacca

SEQ ID NO: 143114 - DNA, 15 bp, Homo sapiens
tatatctaatccacc

SEQ ID NO: 143115 - DNA, 15 bp, Homo sapiens
atatatctaatccac

SEQ ID NO: 143116 - DNA, 15 bp, Homo sapiens
catatatctaatcca

SEQ ID NO: 143117 - DNA, 15 bp, Homo sapiens
gcatatatctaatcc

SEQ ID NO: 143118 - DNA, 15 bp, Homo sapiens
ggcatatatctaatc

SEQ ID NO: 143119 - DNA, 15 bp, Homo sapiens
aggcatatatctaat

SEQ ID NO: 143120 - DNA, 15 bp, Homo sapiens
aaggcatatatctaa

SEQ ID NO: 143121 - DNA, 15 bp, Homo sapiens
taaggcatatatcta

SEQ ID NO: 143122 - DNA, 15 bp, Homo sapiens
ttaaggcatatatct

SEQ ID NO: 143123 - DNA, 15 bp, Homo sapiens
cttaaggcatatatc

SEQ ID NO: 143124 - DNA, 15 bp, Homo sapiens
ccttaaggcatatat

SEQ ID NO: 143125 - DNA, 15 bp, Homo sapiens
cccttaaggcatata

SEQ ID NO: 143126 - DNA, 15 bp, Homo sapiens
gcccttaaggcatat

SEQ ID NO: 143127 - DNA, 15 bp, Homo sapiens
agcccttaaggcata

SEQ ID NO: 143128 - DNA, 15 bp, Homo sapiens
aagcccttaaggcat

SEQ ID NO: 143129 - DNA, 15 bp, Homo sapiens
caagcccttaaggca

SEQ ID NO: 143130 - DNA, 15 bp, Homo sapiens
ccaagcccttaaggc

SEQ ID NO: 143131 - DNA, 15 bp, Homo sapiens
tccaagcccttaagg

SEQ ID NO: 143132 - DNA, 15 bp, Homo sapiens
ttccaagcccttaag

SEQ ID NO: 143133 - DNA, 15 bp, Homo sapiens
tttccaagcccttaa

SEQ ID NO: 143134 - DNA, 15 bp, Homo sapiens
gtttccaagccctta

SEQ ID NO: 143135 - DNA, 15 bp, Homo sapiens
tgtttccaagccctt

SEQ ID NO: 143136 - DNA, 15 bp, Homo sapiens
ttgtttccaagccct

SEQ ID NO: 143137 - DNA, 15 bp, Homo sapiens
attgtttccaagccc

SEQ ID NO: 143138 - DNA, 15 bp, Homo sapiens
gattgtttccaagcc

SEQ ID NO: 143139 - DNA, 15 bp, Homo sapiens
ggattgtttccaagc

SEQ ID NO: 143140 - DNA, 15 bp, Homo sapiens
tggattgtttccaag

SEQ ID NO: 143141 - DNA, 15 bp, Homo sapiens
ttggattgtttccaa

SEQ ID NO: 143142 - DNA, 15 bp, Homo sapiens
cttggattgtttcca

SEQ ID NO: 143143 - DNA, 15 bp, Homo sapiens
tcttggattgtttcc

SEQ ID NO: 143144 - DNA, 15 bp, Homo sapiens
atcttggattgtttc

SEQ ID NO: 143145 - DNA, 15 bp, Homo sapiens
catcttggattgttt

SEQ ID NO: 143146 - DNA, 15 bp, Homo sapiens
ccatcttggattgtt

SEQ ID NO: 143147 - DNA, 15 bp, Homo sapiens
accatcttggattgt

SEQ ID NO: 143148 - DNA, 15 bp, Homo sapiens
taccatcttggattg

SEQ ID NO: 143149 - DNA, 15 bp, Homo sapiens
ataccatcttggatt

SEQ ID NO: 143150 - DNA, 15 bp, Homo sapiens
aataccatcttggat

SEQ ID NO: 143151 - DNA, 15 bp, Homo sapiens
aaataccatcttgga

SEQ ID NO: 143152 - DNA, 15 bp, Homo sapiens
aaaataccatcttgg

SEQ ID NO: 143153 - DNA, 15 bp, Homo sapiens
caaaataccatcttg

SEQ ID NO: 143154 - DNA, 15 bp, Homo sapiens
acaaaataccatctt

SEQ ID NO: 143155 - DNA, 15 bp, Homo sapiens
tacaaaataccatct

SEQ ID NO: 143156 - DNA, 15 bp, Homo sapiens
ttacaaaataccatc

SEQ ID NO: 143157 - DNA, 15 bp, Homo sapiens
tttacaaaataccat

SEQ ID NO: 143158 - DNA, 15 bp, Homo sapiens
ttttacaaaatacca

SEQ ID NO: 143159 - DNA, 15 bp, Homo sapiens
cttttacaaaatacc

SEQ ID NO: 143160 - DNA, 15 bp, Homo sapiens
ccttttacaaaatac

SEQ ID NO: 143161 - DNA, 15 bp, Homo sapiens
tccttttacaaaata

SEQ ID NO: 143162 - DNA, 15 bp, Homo sapiens
atccttttacaaaat

SEQ ID NO: 143163 - DNA, 15 bp, Homo sapiens
catccttttacaaaa

SEQ ID NO: 143164 - DNA, 15 bp, Homo sapiens
tcatccttttacaaa

SEQ ID NO: 143165 - DNA, 15 bp, Homo sapiens
ctcatccttttacaa

SEQ ID NO: 143166 - DNA, 15 bp, Homo sapiens
actcatccttttaca

SEQ ID NO: 143167 - DNA, 15 bp, Homo sapiens
cactcatccttttac

SEQ ID NO: 143168 - DNA, 15 bp, Homo sapiens
ccactcatcctttta

SEQ ID NO: 143169 - DNA, 15 bp, Homo sapiens
accactcatcctttt

SEQ ID NO: 143170 - DNA, 15 bp, Homo sapiens
caccactcatccttt

SEQ ID NO: 143171 - DNA, 15 bp, Homo sapiens
ccaccactcatcctt

SEQ ID NO: 143172 - DNA, 15 bp, Homo sapiens
accaccactcatcct

SEQ ID NO: 143173 - DNA, 15 bp, Homo sapiens
taccaccactcatcc

SEQ ID NO: 143174 - DNA, 15 bp, Homo sapiens
gtaccaccactcatc

SEQ ID NO: 143175 - DNA, 15 bp, Homo sapiens
ggtaccaccactcat

SEQ ID NO: 143176 - DNA, 15 bp, Homo sapiens
tggtaccaccactca

SEQ ID NO: 143177 - DNA, 15 bp, Homo sapiens
atggtaccaccactc

SEQ ID NO: 143178 - DNA, 15 bp, Homo sapiens
aatggtaccaccact

SEQ ID NO: 143179 - DNA, 15 bp, Homo sapiens
gaatggtaccaccac

SEQ ID NO: 143180 - DNA, 15 bp, Homo sapiens
tgaatggtaccacca

SEQ ID NO: 143181 - DNA, 15 bp, Homo sapiens
gtgaatggtaccacc

SEQ ID NO: 143182 - DNA, 15 bp, Homo sapiens
ggtgaatggtaccac

SEQ ID NO: 143183 - DNA, 15 bp, Homo sapiens
cggtgaatggtacca

SEQ ID NO: 143184 - DNA, 15 bp, Homo sapiens
tcggtgaatggtacc

SEQ ID NO: 143185 - DNA, 15 bp, Homo sapiens
ttcggtgaatggtac

SEQ ID NO: 143186 - DNA, 15 bp, Homo sapiens
attcggtgaatggta

SEQ ID NO: 143187 - DNA, 15 bp, Homo sapiens
aattcggtgaatggt

SEQ ID NO: 143188 - DNA, 15 bp, Homo sapiens
caattcggtgaatgg

SEQ ID NO: 143189 - DNA, 15 bp, Homo sapiens
ccaattcggtgaatg

SEQ ID NO: 143190 - DNA, 15 bp, Homo sapiens
cccaattcggtgaat

SEQ ID NO: 143191 - DNA, 15 bp, Homo sapiens
tcccaattcggtgaa

SEQ ID NO: 143192 - DNA, 15 bp, Homo sapiens
ttcccaattcggtga

SEQ ID NO: 143193 - DNA, 15 bp, Homo sapiens
tttcccaattcggtg

SEQ ID NO: 143194 - DNA, 15 bp, Homo sapiens
ctttcccaattcggt

SEQ ID NO: 143195 - DNA, 15 bp, Homo sapiens
cctttcccaattcgg

SEQ ID NO: 143196 - DNA, 15 bp, Homo sapiens
tcctttcccaattcg

SEQ ID NO: 143197 - DNA, 15 bp, Homo sapiens
atcctttcccaattc

SEQ ID NO: 143198 - DNA, 15 bp, Homo sapiens
catcctttcccaatt

SEQ ID NO: 143199 - DNA, 15 bp, Homo sapiens
acatcctttcccaat

SEQ ID NO: 143200 - DNA, 15 bp, Homo sapiens
cacatcctttcccaa

SEQ ID NO: 143201 - DNA, 15 bp, Homo sapiens
ccacatcctttccca

SEQ ID NO: 143202 - DNA, 15 bp, Homo sapiens
cccacatcctttccc

SEQ ID NO: 143203 - DNA, 15 bp, Homo sapiens
tcccacatcctttcc

SEQ ID NO: 143204 - DNA, 15 bp, Homo sapiens
ctcccacatcctttc

SEQ ID NO: 143205 - DNA, 15 bp, Homo sapiens
actcccacatccttt

SEQ ID NO: 143206 - DNA, 15 bp, Homo sapiens
aactcccacatcctt

SEQ ID NO: 143207 - DNA, 15 bp, Homo sapiens
aaactcccacatcct

SEQ ID NO: 143208 - DNA, 15 bp, Homo sapiens
aaaactcccacatcc

SEQ ID NO: 143209 - DNA, 15 bp, Homo sapiens
caaaactcccacatc

SEQ ID NO: 143210 - DNA, 15 bp, Homo sapiens
ccaaaactcccacat

SEQ ID NO: 143211 - DNA, 15 bp, Homo sapiens
tccaaaactcccaca

SEQ ID NO: 143212 - DNA, 15 bp, Homo sapiens
ttccaaaactcccac

SEQ ID NO: 143213 - DNA, 15 bp, Homo sapiens
cttccaaaactccca

SEQ ID NO: 143214 - DNA, 15 bp, Homo sapiens
tcttccaaaactccc

SEQ ID NO: 143215 - DNA, 15 bp, Homo sapiens
ttcttccaaaactcc

SEQ ID NO: 143216 - DNA, 15 bp, Homo sapiens
gttcttccaaaactc

SEQ ID NO: 143217 - DNA, 15 bp, Homo sapiens
tgttcttccaaaact

SEQ ID NO: 143218 - DNA, 15 bp, Homo sapiens
ttgttcttccaaaac

SEQ ID NO: 143219 - DNA, 15 bp, Homo sapiens
tttgttcttccaaaa

SEQ ID NO: 143220 - DNA, 15 bp, Homo sapiens
ttttgttcttccaaa

SEQ ID NO: 143221 - DNA, 15 bp, Homo sapiens
tttttgttcttccaa

SEQ ID NO: 143222 - DNA, 15 bp, Homo sapiens
atttttgttcttcca

SEQ ID NO: 143223 - DNA, 15 bp, Homo sapiens
aatttttgttcttcc

SEQ ID NO: 143224 - DNA, 15 bp, Homo sapiens
caatttttgttcttc

SEQ ID NO: 143225 - DNA, 15 bp, Homo sapiens
gcaatttttgttctt

SEQ ID NO: 143226 - DNA, 15 bp, Homo sapiens
tgcaatttttgttct

SEQ ID NO: 143227 - DNA, 15 bp, Homo sapiens
ttgcaatttttgttc

SEQ ID NO: 143228 - DNA, 15 bp, Homo sapiens
cttgcaatttttgtt

SEQ ID NO: 143229 - DNA, 15 bp, Homo sapiens
acttgcaatttttgt

SEQ ID NO: 143230 - DNA, 15 bp, Homo sapiens
aacttgcaatttttg

SEQ ID NO: 143231 - DNA, 15 bp, Homo sapiens
caacttgcaattttt

SEQ ID NO: 143232 - DNA, 15 bp, Homo sapiens
ccaacttgcaatttt

SEQ ID NO: 143233 - DNA, 15 bp, Homo sapiens
tccaacttgcaattt

SEQ ID NO: 143234 - DNA, 15 bp, Homo sapiens
atccaacttgcaatt

SEQ ID NO: 143235 - DNA, 15 bp, Homo sapiens
aatccaacttgcaat

SEQ ID NO: 143236 - DNA, 15 bp, Homo sapiens
aaatccaacttgcaa

SEQ ID NO: 143237 - DNA, 15 bp, Homo sapiens
aaaatccaacttgca

SEQ ID NO: 143238 - DNA, 15 bp, Homo sapiens
caaaatccaacttgc

SEQ ID NO: 143239 - DNA, 15 bp, Homo sapiens
acaaaatccaacttg

SEQ ID NO: 143240 - DNA, 15 bp, Homo sapiens
aacaaaatccaactt

SEQ ID NO: 143241 - DNA, 15 bp, Homo sapiens
taacaaaatccaact

SEQ ID NO: 143242 - DNA, 15 bp, Homo sapiens
ttaacaaaatccaac

SEQ ID NO: 143243 - DNA, 15 bp, Homo sapiens
cttaacaaaatccaa

SEQ ID NO: 143244 - DNA, 15 bp, Homo sapiens
acttaacaaaatcca

SEQ ID NO: 143245 - DNA, 15 bp, Homo sapiens
aacttaacaaaatcc

SEQ ID NO: 143246 - DNA, 15 bp, Homo sapiens
aaacttaacaaaatc

SEQ ID NO: 143247 - DNA, 15 bp, Homo sapiens
caaacttaacaaaat

SEQ ID NO: 143248 - DNA, 15 bp, Homo sapiens
tcaaacttaacaaaa

SEQ ID NO: 143249 - DNA, 15 bp, Homo sapiens
ctcaaacttaacaaa

SEQ ID NO: 143250 - DNA, 15 bp, Homo sapiens
tctcaaacttaacaa

SEQ ID NO: 143251 - DNA, 15 bp, Homo sapiens
atctcaaacttaaca

SEQ ID NO: 143252 - DNA, 15 bp, Homo sapiens
catctcaaacttaac

SEQ ID NO: 143253 - DNA, 15 bp, Homo sapiens
gcatctcaaacttaa

SEQ ID NO: 143254 - DNA, 15 bp, Homo sapiens
ggcatctcaaactta

SEQ ID NO: 143255 - DNA, 15 bp, Homo sapiens
aggcatctcaaactt

SEQ ID NO: 143256 - DNA, 15 bp, Homo sapiens
caggcatctcaaact

SEQ ID NO: 143257 - DNA, 15 bp, Homo sapiens
acaggcatctcaaac

SEQ ID NO: 143258 - DNA, 15 bp, Homo sapiens
aacaggcatctcaaa

SEQ ID NO: 143259 - DNA, 15 bp, Homo sapiens
taacaggcatctcaa

SEQ ID NO: 143260 - DNA, 15 bp, Homo sapiens
ctaacaggcatctca

SEQ ID NO: 143261 - DNA, 15 bp, Homo sapiens
tctaacaggcatctc

SEQ ID NO: 143262 - DNA, 15 bp, Homo sapiens
atctaacaggcatct

SEQ ID NO: 143263 - DNA, 15 bp, Homo sapiens
tatctaacaggcatc

SEQ ID NO: 143264 - DNA, 15 bp, Homo sapiens
atatctaacaggcat

SEQ ID NO: 143265 - DNA, 15 bp, Homo sapiens
gatatctaacaggca

SEQ ID NO: 143266 - DNA, 15 bp, Homo sapiens
agatatctaacaggc

SEQ ID NO: 143267 - DNA, 15 bp, Homo sapiens
tagatatctaacagg

SEQ ID NO: 143268 - DNA, 15 bp, Homo sapiens
ttagatatctaacag

SEQ ID NO: 143269 - DNA, 15 bp, Homo sapiens
cttagatatctaaca

SEQ ID NO: 143270 - DNA, 15 bp, Homo sapiens
acttagatatctaac

SEQ ID NO: 143271 - DNA, 15 bp, Homo sapiens
tacttagatatctaa

SEQ ID NO: 143272 - DNA, 15 bp, Homo sapiens
atacttagatatcta

SEQ ID NO: 143273 - DNA, 15 bp, Homo sapiens
tatacttagatatct

SEQ ID NO: 143274 - DNA, 15 bp, Homo sapiens
atatacttagatatc

SEQ ID NO: 143275 - DNA, 15 bp, Homo sapiens
tatatacttagatat

SEQ ID NO: 143276 - DNA, 15 bp, Homo sapiens
ctatatacttagata

SEQ ID NO: 143277 - DNA, 15 bp, Homo sapiens
cctatatacttagat

SEQ ID NO: 143278 - DNA, 15 bp, Homo sapiens
acctatatacttaga

SEQ ID NO: 143279 - DNA, 15 bp, Homo sapiens
aacctatatacttag

SEQ ID NO: 143280 - DNA, 15 bp, Homo sapiens
taacctatatactta

SEQ ID NO: 143281 - DNA, 15 bp, Homo sapiens
ttaacctatatactt

SEQ ID NO: 143282 - DNA, 15 bp, Homo sapiens
tttaacctatatact

SEQ ID NO: 143283 - DNA, 15 bp, Homo sapiens
atttaacctatatac

SEQ ID NO: 143284 - DNA, 15 bp, Homo sapiens
tatttaacctatata

SEQ ID NO: 143285 - DNA, 15 bp, Homo sapiens
ctatttaacctatat

SEQ ID NO: 143286 - DNA, 15 bp, Homo sapiens
cctatttaacctata

SEQ ID NO: 143287 - DNA, 15 bp, Homo sapiens
gcctatttaacctat

SEQ ID NO: 143288 - DNA, 15 bp, Homo sapiens
tgcctatttaaccta

SEQ ID NO: 143289 - DNA, 15 bp, Homo sapiens
ttgcctatttaacct

SEQ ID NO: 143290 - DNA, 15 bp, Homo sapiens
attgcctatttaacc

SEQ ID NO: 143291 - DNA, 15 bp, Homo sapiens
aattgcctatttaac

SEQ ID NO: 143292 - DNA, 15 bp, Homo sapiens
taattgcctatttaa

SEQ ID NO: 143293 - DNA, 15 bp, Homo sapiens
ataattgcctattta

SEQ ID NO: 143294 - DNA, 15 bp, Homo sapiens
cataattgcctattt

SEQ ID NO: 143295 - DNA, 15 bp, Homo sapiens
acataattgcctatt

SEQ ID NO: 143296 - DNA, 15 bp, Homo sapiens
tacataattgcctat

SEQ ID NO: 143297 - DNA, 15 bp, Homo sapiens
atacataattgccta

SEQ ID NO: 143298 - DNA, 15 bp, Homo sapiens
catacataattgcct

SEQ ID NO: 143299 - DNA, 15 bp, Homo sapiens
acatacataattgcc

SEQ ID NO: 143300 - DNA, 15 bp, Homo sapiens
aacatacataattgc

SEQ ID NO: 143301 - DNA, 15 bp, Homo sapiens
taacatacataattg

SEQ ID NO: 143302 - DNA, 15 bp, Homo sapiens
ttaacatacataatt

SEQ ID NO: 143303 - DNA, 15 bp, Homo sapiens
attaacatacataat

SEQ ID NO: 143304 - DNA, 15 bp, Homo sapiens
gattaacatacataa

SEQ ID NO: 143305 - DNA, 15 bp, Homo sapiens
agattaacatacata

SEQ ID NO: 143306 - DNA, 15 bp, Homo sapiens
cagattaacatacat

SEQ ID NO: 143307 - DNA, 15 bp, Homo sapiens
ccagattaacataca

SEQ ID NO: 143308 - DNA, 15 bp, Homo sapiens
tccagattaacatac

SEQ ID NO: 143309 - DNA, 15 bp, Homo sapiens
ttccagattaacata

SEQ ID NO: 143310 - DNA, 15 bp, Homo sapiens
gttccagattaacat

SEQ ID NO: 143311 - DNA, 15 bp, Homo sapiens
agttccagattaaca

SEQ ID NO: 143312 - DNA, 15 bp, Homo sapiens
gagttccagattaac

SEQ ID NO: 143313 - DNA, 15 bp, Homo sapiens
tgagttccagattaa

SEQ ID NO: 143314 - DNA, 15 bp, Homo sapiens
ctgagttccagatta

SEQ ID NO: 143315 - DNA, 15 bp, Homo sapiens
tctgagttccagatt

SEQ ID NO: 143316 - DNA, 15 bp, Homo sapiens
atctgagttccagat

SEQ ID NO: 143317 - DNA, 15 bp, Homo sapiens
catctgagttccaga

SEQ ID NO: 143318 - DNA, 15 bp, Homo sapiens
acatctgagttccag

SEQ ID NO: 143319 - DNA, 15 bp, Homo sapiens
aacatctgagttcca

SEQ ID NO: 143320 - DNA, 15 bp, Homo sapiens
gaacatctgagttcc

SEQ ID NO: 143321 - DNA, 15 bp, Homo sapiens
agaacatctgagttc

SEQ ID NO: 143322 - DNA, 15 bp, Homo sapiens
cagaacatctgagtt

SEQ ID NO: 143323 - DNA, 15 bp, Homo sapiens
ccagaacatctgagt

SEQ ID NO: 143324 - DNA, 15 bp, Homo sapiens
tccagaacatctgag

SEQ ID NO: 143325 - DNA, 15 bp, Homo sapiens
gtccagaacatctga

SEQ ID NO: 143326 - DNA, 15 bp, Homo sapiens
ggtccagaacatctg

SEQ ID NO: 143327 - DNA, 15 bp, Homo sapiens
aggtccagaacatct

SEQ ID NO: 143328 - DNA, 15 bp, Homo sapiens
gaggtccagaacatc

SEQ ID NO: 143329 - DNA, 15 bp, Homo sapiens
tgaggtccagaacat

SEQ ID NO: 143330 - DNA, 15 bp, Homo sapiens
ctgaggtccagaaca

SEQ ID NO: 143331 - DNA, 15 bp, Homo sapiens
tctgaggtccagaac

SEQ ID NO: 143332 - DNA, 15 bp, Homo sapiens
atctgaggtccagaa

SEQ ID NO: 143333 - DNA, 15 bp, Homo sapiens
tatctgaggtccaga

SEQ ID NO: 143334 - DNA, 15 bp, Homo sapiens
atatctgaggtccag

SEQ ID NO: 143335 - DNA, 15 bp, Homo sapiens
catatctgaggtcca

SEQ ID NO: 143336 - DNA, 15 bp, Homo sapiens
tcatatctgaggtcc

SEQ ID NO: 143337 - DNA, 15 bp, Homo sapiens
ttcatatctgaggtc

SEQ ID NO: 143338 - DNA, 15 bp, Homo sapiens
attcatatctgaggt

SEQ ID NO: 143339 - DNA, 15 bp, Homo sapiens
aattcatatctgagg

SEQ ID NO: 143340 - DNA, 15 bp, Homo sapiens
caattcatatctgag

SEQ ID NO: 143341 - DNA, 15 bp, Homo sapiens
tcaattcatatctga

SEQ ID NO: 143342 - DNA, 15 bp, Homo sapiens
ctcaattcatatctg

SEQ ID NO: 143343 - DNA, 15 bp, Homo sapiens
tctcaattcatatct

SEQ ID NO: 143344 - DNA, 15 bp, Homo sapiens
ctctcaattcatatc

SEQ ID NO: 143345 - DNA, 15 bp, Homo sapiens
actctcaattcatat

SEQ ID NO: 143346 - DNA, 15 bp, Homo sapiens
aactctcaattcata

SEQ ID NO: 143347 - DNA, 15 bp, Homo sapiens
gaactctcaattcat

SEQ ID NO: 143348 - DNA, 15 bp, Homo sapiens
agaactctcaattca

SEQ ID NO: 143349 - DNA, 15 bp, Homo sapiens
gagaactctcaattc

SEQ ID NO: 143350 - DNA, 15 bp, Homo sapiens
tgagaactctcaatt

SEQ ID NO: 143351 - DNA, 15 bp, Homo sapiens
ctgagaactctcaat

SEQ ID NO: 143352 - DNA, 15 bp, Homo sapiens
gctgagaactctcaa

SEQ ID NO: 143353 - DNA, 15 bp, Homo sapiens
tgctgagaactctca

SEQ ID NO: 143354 - DNA, 15 bp, Homo sapiens
atgctgagaactctc

SEQ ID NO: 143355 - DNA, 15 bp, Homo sapiens
aatgctgagaactct

SEQ ID NO: 143356 - DNA, 15 bp, Homo sapiens
gaatgctgagaactc

SEQ ID NO: 143357 - DNA, 15 bp, Homo sapiens
tgaatgctgagaact

SEQ ID NO: 143358 - DNA, 15 bp, Homo sapiens
gtgaatgctgagaac

SEQ ID NO: 143359 - DNA, 15 bp, Homo sapiens
tgtgaatgctgagaa

SEQ ID NO: 143360 - DNA, 15 bp, Homo sapiens
atgtgaatgctgaga

SEQ ID NO: 143361 - DNA, 15 bp, Homo sapiens
aatgtgaatgctgag

SEQ ID NO: 143362 - DNA, 15 bp, Homo sapiens
caatgtgaatgctga

SEQ ID NO: 143363 - DNA, 15 bp, Homo sapiens
ccaatgtgaatgctg

SEQ ID NO: 143364 - DNA, 15 bp, Homo sapiens
tccaatgtgaatgct

SEQ ID NO: 143365 - DNA, 15 bp, Homo sapiens
ctccaatgtgaatgc

SEQ ID NO: 143366 - DNA, 15 bp, Homo sapiens
cctccaatgtgaatg

SEQ ID NO: 143367 - DNA, 15 bp, Homo sapiens
acctccaatgtgaat

SEQ ID NO: 143368 - DNA, 15 bp, Homo sapiens
aacctccaatgtgaa

SEQ ID NO: 143369 - DNA, 15 bp, Homo sapiens
caacctccaatgtga

SEQ ID NO: 143370 - DNA, 15 bp, Homo sapiens
tcaacctccaatgtg

SEQ ID NO: 143371 - DNA, 15 bp, Homo sapiens
ttcaacctccaatgt

SEQ ID NO: 143372 - DNA, 15 bp, Homo sapiens
gttcaacctccaatg

SEQ ID NO: 143373 - DNA, 15 bp, Homo sapiens
tgttcaacctccaat

SEQ ID NO: 143374 - DNA, 15 bp, Homo sapiens
atgttcaacctccaa

SEQ ID NO: 143375 - DNA, 15 bp, Homo sapiens
catgttcaacctcca

SEQ ID NO: 143376 - DNA, 15 bp, Homo sapiens
acatgttcaacctcc

SEQ ID NO: 143377 - DNA, 15 bp, Homo sapiens
cacatgttcaacctc

SEQ ID NO: 143378 - DNA, 15 bp, Homo sapiens
ccacatgttcaacct

SEQ ID NO: 143379 - DNA, 15 bp, Homo sapiens
cccacatgttcaacc

SEQ ID NO: 143380 - DNA, 15 bp, Homo sapiens
tcccacatgttcaac

SEQ ID NO: 143381 - DNA, 15 bp, Homo sapiens
gtcccacatgttcaa

SEQ ID NO: 143382 - DNA, 15 bp, Homo sapiens
agtcccacatgttca

SEQ ID NO: 143383 - DNA, 15 bp, Homo sapiens
cagtcccacatgttc

SEQ ID NO: 143384 - DNA, 15 bp, Homo sapiens
ccagtcccacatgtt

SEQ ID NO: 143385 - DNA, 15 bp, Homo sapiens
tccagtcccacatgt

SEQ ID NO: 143386 - DNA, 15 bp, Homo sapiens
atccagtcccacatg

SEQ ID NO: 143387 - DNA, 15 bp, Homo sapiens
catccagtcccacat

SEQ ID NO: 143388 - DNA, 15 bp, Homo sapiens
tcatccagtcccaca

SEQ ID NO: 143389 - DNA, 15 bp, Homo sapiens
ctcatccagtcccac

SEQ ID NO: 143390 - DNA, 15 bp, Homo sapiens
tctcatccagtccca

SEQ ID NO: 143391 - DNA, 15 bp, Homo sapiens
atctcatccagtccc

SEQ ID NO: 143392 - DNA, 15 bp, Homo sapiens
gatctcatccagtcc

SEQ ID NO: 143393 - DNA, 15 bp, Homo sapiens
tgatctcatccagtc

SEQ ID NO: 143394 - DNA, 15 bp, Homo sapiens
gtgatctcatccagt

SEQ ID NO: 143395 - DNA, 15 bp, Homo sapiens
ggtgatctcatccag

SEQ ID NO: 143396 - DNA, 15 bp, Homo sapiens
tggtgatctcatcca

SEQ ID NO: 143397 - DNA, 15 bp, Homo sapiens
ctggtgatctcatcc

SEQ ID NO: 143398 - DNA, 15 bp, Homo sapiens
cctggtgatctcatc

SEQ ID NO: 143399 - DNA, 15 bp, Homo sapiens
ccctggtgatctcat

SEQ ID NO: 143400 - DNA, 15 bp, Homo sapiens
tccctggtgatctca

SEQ ID NO: 143401 - DNA, 15 bp, Homo sapiens
ttccctggtgatctc

SEQ ID NO: 143402 - DNA, 15 bp, Homo sapiens
cttccctggtgatct

SEQ ID NO: 143403 - DNA, 15 bp, Homo sapiens
ccttccctggtgatc

SEQ ID NO: 143404 - DNA, 15 bp, Homo sapiens
tccttccctggtgat

SEQ ID NO: 143405 - DNA, 15 bp, Homo sapiens
ctccttccctggtga

SEQ ID NO: 143406 - DNA, 15 bp, Homo sapiens
actccttccctggtg

SEQ ID NO: 143407 - DNA, 15 bp, Homo sapiens
cactccttccctggt

SEQ ID NO: 143408 - DNA, 15 bp, Homo sapiens
tcactccttccctgg

SEQ ID NO: 143409 - DNA, 15 bp, Homo sapiens
ttcactccttccctg

SEQ ID NO: 143410 - DNA, 15 bp, Homo sapiens
cttcactccttccct

SEQ ID NO: 143411 - DNA, 15 bp, Homo sapiens
tcttcactccttccc

SEQ ID NO: 143412 - DNA, 15 bp, Homo sapiens
atcttcactccttcc

SEQ ID NO: 143413 - DNA, 15 bp, Homo sapiens
catcttcactccttc

SEQ ID NO: 143414 - DNA, 15 bp, Homo sapiens
tcatcttcactcctt

SEQ ID NO: 143415 - DNA, 15 bp, Homo sapiens
ttcatcttcactcct

SEQ ID NO: 143416 - DNA, 15 bp, Homo sapiens
cttcatcttcactcc

SEQ ID NO: 143417 - DNA, 15 bp, Homo sapiens
tcttcatcttcactc

SEQ ID NO: 143418 - DNA, 15 bp, Homo sapiens
ttcttcatcttcact

SEQ ID NO: 143419 - DNA, 15 bp, Homo sapiens
cttcttcatcttcac

SEQ ID NO: 143420 - DNA, 15 bp, Homo sapiens
tcttcttcatcttca

SEQ ID NO: 143421 - DNA, 15 bp, Homo sapiens
ctcttcttcatcttc

SEQ ID NO: 143422 - DNA, 15 bp, Homo sapiens
tctcttcttcatctt

SEQ ID NO: 143423 - DNA, 15 bp, Homo sapiens
ctctcttcttcatct

SEQ ID NO: 143424 - DNA, 15 bp, Homo sapiens
cctctcttcttcatc

SEQ ID NO: 143425 - DNA, 15 bp, Homo sapiens
ccctctcttcttcat

SEQ ID NO: 143426 - DNA, 15 bp, Homo sapiens
cccctctcttcttca

SEQ ID NO: 143427 - DNA, 15 bp, Homo sapiens
acccctctcttcttc

SEQ ID NO: 143428 - DNA, 15 bp, Homo sapiens
tacccctctcttctt

SEQ ID NO: 143429 - DNA, 15 bp, Homo sapiens
atacccctctcttct

SEQ ID NO: 143430 - DNA, 15 bp, Homo sapiens
catacccctctcttc

SEQ ID NO: 143431 - DNA, 15 bp, Homo sapiens
gcatacccctctctt

SEQ ID NO: 143432 - DNA, 15 bp, Homo sapiens
agcatacccctctct

SEQ ID NO: 143433 - DNA, 15 bp, Homo sapiens
aagcatacccctctc

SEQ ID NO: 143434 - DNA, 15 bp, Homo sapiens
taagcatacccctct

SEQ ID NO: 143435 - DNA, 15 bp, Homo sapiens
ttaagcatacccctc

SEQ ID NO: 143436 - DNA, 15 bp, Homo sapiens
gttaagcatacccct

SEQ ID NO: 143437 - DNA, 15 bp, Homo sapiens
agttaagcatacccc

SEQ ID NO: 143438 - DNA, 15 bp, Homo sapiens
cagttaagcataccc

SEQ ID NO: 143439 - DNA, 15 bp, Homo sapiens
tcagttaagcatacc

SEQ ID NO: 143440 - DNA, 15 bp, Homo sapiens
ctcagttaagcatac

SEQ ID NO: 143441 - DNA, 15 bp, Homo sapiens
actcagttaagcata

SEQ ID NO: 143442 - DNA, 15 bp, Homo sapiens
gactcagttaagcat

SEQ ID NO: 143443 - DNA, 15 bp, Homo sapiens
ggactcagttaagca

SEQ ID NO: 143444 - DNA, 15 bp, Homo sapiens
tggactcagttaagc

SEQ ID NO: 143445 - DNA, 15 bp, Homo sapiens
atggactcagttaag

SEQ ID NO: 143446 - DNA, 15 bp, Homo sapiens
tatggactcagttaa

SEQ ID NO: 143447 - DNA, 15 bp, Homo sapiens
ttatggactcagtta

SEQ ID NO: 143448 - DNA, 15 bp, Homo sapiens
cttatggactcagtt

SEQ ID NO: 143449 - DNA, 15 bp, Homo sapiens
ccttatggactcagt

SEQ ID NO: 143450 - DNA, 15 bp, Homo sapiens
gccttatggactcag

SEQ ID NO: 143451 - DNA, 15 bp, Homo sapiens
ggccttatggactca

SEQ ID NO: 143452 - DNA, 15 bp, Homo sapiens
aggccttatggactc

SEQ ID NO: 143453 - DNA, 15 bp, Homo sapiens
taggccttatggact

SEQ ID NO: 143454 - DNA, 15 bp, Homo sapiens
ctaggccttatggac

SEQ ID NO: 143455 - DNA, 15 bp, Homo sapiens
cctaggccttatgga

SEQ ID NO: 143456 - DNA, 15 bp, Homo sapiens
ccctaggccttatgg

SEQ ID NO: 143457 - DNA, 15 bp, Homo sapiens
accctaggccttatg

SEQ ID NO: 143458 - DNA, 15 bp, Homo sapiens
aaccctaggccttat

SEQ ID NO: 143459 - DNA, 15 bp, Homo sapiens
aaaccctaggcctta

SEQ ID NO: 143460 - DNA, 15 bp, Homo sapiens
caaaccctaggcctt

SEQ ID NO: 143461 - DNA, 15 bp, Homo sapiens
ccaaaccctaggcct

SEQ ID NO: 143462 - DNA, 15 bp, Homo sapiens
accaaaccctaggcc

SEQ ID NO: 143463 - DNA, 15 bp, Homo sapiens
caccaaaccctaggc

SEQ ID NO: 143464 - DNA, 15 bp, Homo sapiens
tcaccaaaccctagg

SEQ ID NO: 143465 - DNA, 15 bp, Homo sapiens
atcaccaaaccctag

SEQ ID NO: 143466 - DNA, 15 bp, Homo sapiens
aatcaccaaacccta

SEQ ID NO: 143467 - DNA, 15 bp, Homo sapiens
caatcaccaaaccct

SEQ ID NO: 143468 - DNA, 15 bp, Homo sapiens
tcaatcaccaaaccc

SEQ ID NO: 143469 - DNA, 15 bp, Homo sapiens
ttcaatcaccaaacc

SEQ ID NO: 143470 - DNA, 15 bp, Homo sapiens
gttcaatcaccaaac

SEQ ID NO: 143471 - DNA, 15 bp, Homo sapiens
tgttcaatcaccaaa

SEQ ID NO: 143472 - DNA, 15 bp, Homo sapiens
ttgttcaatcaccaa

SEQ ID NO: 143473 - DNA, 15 bp, Homo sapiens
tttgttcaatcacca

SEQ ID NO: 143474 - DNA, 15 bp, Homo sapiens
ttttgttcaatcacc

SEQ ID NO: 143475 - DNA, 15 bp, Homo sapiens
tttttgttcaatcac

SEQ ID NO: 143476 - DNA, 15 bp, Homo sapiens
ttttttgttcaatca

SEQ ID NO: 143477 - DNA, 15 bp, Homo sapiens
cttttttgttcaatc

SEQ ID NO: 143478 - DNA, 15 bp, Homo sapiens
ccttttttgttcaat

SEQ ID NO: 143479 - DNA, 15 bp, Homo sapiens
tccttttttgttcaa

SEQ ID NO: 143480 - DNA, 15 bp, Homo sapiens
ctccttttttgttca

SEQ ID NO: 143481 - DNA, 15 bp, Homo sapiens
cctccttttttgttc

SEQ ID NO: 143482 - DNA, 15 bp, Homo sapiens
tcctccttttttgtt

SEQ ID NO: 143483 - DNA, 15 bp, Homo sapiens
ttcctccttttttgt

SEQ ID NO: 143484 - DNA, 15 bp, Homo sapiens
cttcctccttttttg

SEQ ID NO: 143485 - DNA, 15 bp, Homo sapiens
ccttcctcctttttt

SEQ ID NO: 143486 - DNA, 15 bp, Homo sapiens
tccttcctccttttt

SEQ ID NO: 143487 - DNA, 15 bp, Homo sapiens
ctccttcctcctttt

SEQ ID NO: 143488 - DNA, 15 bp, Homo sapiens
gctccttcctccttt

SEQ ID NO: 143489 - DNA, 15 bp, Homo sapiens
tgctccttcctcctt

SEQ ID NO: 143490 - DNA, 15 bp, Homo sapiens
ttgctccttcctcct

SEQ ID NO: 143491 - DNA, 15 bp, Homo sapiens
tttgctccttcctcc

SEQ ID NO: 143492 - DNA, 15 bp, Homo sapiens
ttttgctccttcctc

SEQ ID NO: 143493 - DNA, 15 bp, Homo sapiens
cttttgctccttcct

SEQ ID NO: 143494 - DNA, 15 bp, Homo sapiens
ccttttgctccttcc

SEQ ID NO: 143495 - DNA, 15 bp, Homo sapiens
cccttttgctccttc

SEQ ID NO: 143496 - DNA, 15 bp, Homo sapiens
tcccttttgctcctt

SEQ ID NO: 143497 - DNA, 15 bp, Homo sapiens
gtcccttttgctcct

SEQ ID NO: 143498 - DNA, 15 bp, Homo sapiens
agtcccttttgctcc

SEQ ID NO: 143499 - DNA, 15 bp, Homo sapiens
gagtcccttttgctc

SEQ ID NO: 143500 - DNA, 15 bp, Homo sapiens
tgagtcccttttgct

SEQ ID NO: 143501 - DNA, 15 bp, Homo sapiens
ctgagtcccttttgc

SEQ ID NO: 143502 - DNA, 15 bp, Homo sapiens
tctgagtcccttttg

SEQ ID NO: 143503 - DNA, 15 bp, Homo sapiens
ttctgagtccctttt

SEQ ID NO: 143504 - DNA, 15 bp, Homo sapiens
tttctgagtcccttt

SEQ ID NO: 143505 - DNA, 15 bp, Homo sapiens
ttttctgagtccctt

SEQ ID NO: 143506 - DNA, 15 bp, Homo sapiens
tttttctgagtccct

SEQ ID NO: 143507 - DNA, 15 bp, Homo sapiens
ttttttctgagtccc

SEQ ID NO: 143508 - DNA, 15 bp, Homo sapiens
attttttctgagtcc

SEQ ID NO: 143509 - DNA, 15 bp, Homo sapiens
aattttttctgagtc

SEQ ID NO: 143510 - DNA, 15 bp, Homo sapiens
aaattttttctgagt

SEQ ID NO: 143511 - DNA, 15 bp, Homo sapiens
gaaattttttctgag

SEQ ID NO: 143512 - DNA, 15 bp, Homo sapiens
ggaaattttttctga

SEQ ID NO: 143513 - DNA, 15 bp, Homo sapiens
tggaaattttttctg

SEQ ID NO: 143514 - DNA, 15 bp, Homo sapiens
ttggaaattttttct

SEQ ID NO: 143515 - DNA, 15 bp, Homo sapiens
attggaaattttttc

SEQ ID NO: 143516 - DNA, 15 bp, Homo sapiens
cattggaaatttttt

SEQ ID NO: 143517 - DNA, 15 bp, Homo sapiens
tcattggaaattttt

SEQ ID NO: 143518 - DNA, 15 bp, Homo sapiens
ttcattggaaatttt

SEQ ID NO: 143519 - DNA, 15 bp, Homo sapiens
cttcattggaaattt

SEQ ID NO: 143520 - DNA, 15 bp, Homo sapiens
acttcattggaaatt

SEQ ID NO: 143521 - DNA, 15 bp, Homo sapiens
cacttcattggaaat

SEQ ID NO: 143522 - DNA, 15 bp, Homo sapiens
tcacttcattggaaa

SEQ ID NO: 143523 - DNA, 15 bp, Homo sapiens
ttcacttcattggaa

SEQ ID NO: 143524 - DNA, 15 bp, Homo sapiens
tttcacttcattgga

SEQ ID NO: 143525 - DNA, 15 bp, Homo sapiens
ttttcacttcattgg

SEQ ID NO: 143526 - DNA, 15 bp, Homo sapiens
tttttcacttcattg

SEQ ID NO: 143527 - DNA, 15 bp, Homo sapiens
ttttttcacttcatt

SEQ ID NO: 143528 - DNA, 15 bp, Homo sapiens
gttttttcacttcat

SEQ ID NO: 143529 - DNA, 15 bp, Homo sapiens
cgttttttcacttca

SEQ ID NO: 143530 - DNA, 15 bp, Homo sapiens
gcgttttttcacttc

SEQ ID NO: 143531 - DNA, 15 bp, Homo sapiens
tgcgttttttcactt

SEQ ID NO: 143532 - DNA, 15 bp, Homo sapiens
ctgcgttttttcact

SEQ ID NO: 143533 - DNA, 15 bp, Homo sapiens
tctgcgttttttcac

SEQ ID NO: 143534 - DNA, 15 bp, Homo sapiens
atctgcgttttttca

SEQ ID NO: 143535 - DNA, 15 bp, Homo sapiens
aatctgcgttttttc

SEQ ID NO: 143536 - DNA, 15 bp, Homo sapiens
aaatctgcgtttttt

SEQ ID NO: 143537 - DNA, 15 bp, Homo sapiens
caaatctgcgttttt

SEQ ID NO: 143538 - DNA, 15 bp, Homo sapiens
acaaatctgcgtttt

SEQ ID NO: 143539 - DNA, 15 bp, Homo sapiens
gacaaatctgcgttt

SEQ ID NO: 143540 - DNA, 15 bp, Homo sapiens
tgacaaatctgcgtt

SEQ ID NO: 143541 - DNA, 15 bp, Homo sapiens
atgacaaatctgcgt

SEQ ID NO: 143542 - DNA, 15 bp, Homo sapiens
catgacaaatctgcg

SEQ ID NO: 143543 - DNA, 15 bp, Homo sapiens
acatgacaaatctgc

SEQ ID NO: 143544 - DNA, 15 bp, Homo sapiens
aacatgacaaatctg

SEQ ID NO: 143545 - DNA, 15 bp, Homo sapiens
gaacatgacaaatct

SEQ ID NO: 143546 - DNA, 15 bp, Homo sapiens
tgaacatgacaaatc

SEQ ID NO: 143547 - DNA, 15 bp, Homo sapiens
ctgaacatgacaaat

SEQ ID NO: 143548 - DNA, 15 bp, Homo sapiens
tctgaacatgacaaa

SEQ ID NO: 143549 - DNA, 15 bp, Homo sapiens
ttctgaacatgacaa

SEQ ID NO: 143550 - DNA, 15 bp, Homo sapiens
tttctgaacatgaca

SEQ ID NO: 143551 - DNA, 15 bp, Homo sapiens
atttctgaacatgac

SEQ ID NO: 143552 - DNA, 15 bp, Homo sapiens
tatttctgaacatga

SEQ ID NO: 143553 - DNA, 15 bp, Homo sapiens
ctatttctgaacatg

SEQ ID NO: 143554 - DNA, 15 bp, Homo sapiens
tctatttctgaacat

SEQ ID NO: 143555 - DNA, 15 bp, Homo sapiens
ctctatttctgaaca

SEQ ID NO: 143556 - DNA, 15 bp, Homo sapiens
cctctatttctgaac

SEQ ID NO: 143557 - DNA, 15 bp, Homo sapiens
ccctctatttctgaa

SEQ ID NO: 143558 - DNA, 15 bp, Homo sapiens
tccctctatttctga

SEQ ID NO: 143559 - DNA, 15 bp, Homo sapiens
ctccctctatttctg

SEQ ID NO: 143560 - DNA, 15 bp, Homo sapiens
cctccctctatttct

SEQ ID NO: 143561 - DNA, 15 bp, Homo sapiens
tcctccctctatttc

SEQ ID NO: 143562 - DNA, 15 bp, Homo sapiens
ctcctccctctattt

SEQ ID NO: 143563 - DNA, 15 bp, Homo sapiens
tctcctccctctatt

SEQ ID NO: 143564 - DNA, 15 bp, Homo sapiens
ttctcctccctctat

SEQ ID NO: 143565 - DNA, 15 bp, Homo sapiens
attctcctccctcta

SEQ ID NO: 143566 - DNA, 15 bp, Homo sapiens
tattctcctccctct

SEQ ID NO: 143567 - DNA, 15 bp, Homo sapiens
atattctcctccctc

SEQ ID NO: 143568 - DNA, 15 bp, Homo sapiens
gatattctcctccct

SEQ ID NO: 143569 - DNA, 15 bp, Homo sapiens
agatattctcctccc

SEQ ID NO: 143570 - DNA, 15 bp, Homo sapiens
gagatattctcctcc

SEQ ID NO: 143571 - DNA, 15 bp, Homo sapiens
agagatattctcctc

SEQ ID NO: 143572 - DNA, 15 bp, Homo sapiens
aagagatattctcct

SEQ ID NO: 143573 - DNA, 15 bp, Homo sapiens
taagagatattctcc

SEQ ID NO: 143574 - DNA, 15 bp, Homo sapiens
ctaagagatattctc

SEQ ID NO: 143575 - DNA, 15 bp, Homo sapiens
tctaagagatattct

SEQ ID NO: 143576 - DNA, 15 bp, Homo sapiens
ctctaagagatattc

SEQ ID NO: 143577 - DNA, 15 bp, Homo sapiens
cctctaagagatatt

SEQ ID NO: 143578 - DNA, 15 bp, Homo sapiens
tcctctaagagatat

SEQ ID NO: 143579 - DNA, 15 bp, Homo sapiens
ttcctctaagagata

SEQ ID NO: 143580 - DNA, 15 bp, Homo sapiens
tttcctctaagagat

SEQ ID NO: 143581 - DNA, 15 bp, Homo sapiens
atttcctctaagaga

SEQ ID NO: 143582 - DNA, 15 bp, Homo sapiens
catttcctctaagag

SEQ ID NO: 143583 - DNA, 15 bp, Homo sapiens
ccatttcctctaaga

SEQ ID NO: 143584 - DNA, 15 bp, Homo sapiens
tccatttcctctaag

SEQ ID NO: 143585 - DNA, 15 bp, Homo sapiens
ctccatttcctctaa

SEQ ID NO: 143586 - DNA, 15 bp, Homo sapiens
tctccatttcctcta

SEQ ID NO: 143587 - DNA, 15 bp, Homo sapiens
ctctccatttcctct

SEQ ID NO: 143588 - DNA, 15 bp, Homo sapiens
tctctccatttcctc

SEQ ID NO: 143589 - DNA, 15 bp, Homo sapiens
ctctctccatttcct

SEQ ID NO: 143590 - DNA, 15 bp, Homo sapiens
cctctctccatttcc

SEQ ID NO: 143591 - DNA, 15 bp, Homo sapiens
tcctctctccatttc

SEQ ID NO: 143592 - DNA, 15 bp, Homo sapiens
ctcctctctccattt

SEQ ID NO: 143593 - DNA, 15 bp, Homo sapiens
tctcctctctccatt

SEQ ID NO: 143594 - DNA, 15 bp, Homo sapiens
ttctcctctctccat

SEQ ID NO: 143595 - DNA, 15 bp, Homo sapiens
attctcctctctcca

SEQ ID NO: 143596 - DNA, 15 bp, Homo sapiens
cattctcctctctcc

SEQ ID NO: 143597 - DNA, 15 bp, Homo sapiens
acattctcctctctc

SEQ ID NO: 143598 - DNA, 15 bp, Homo sapiens
aacattctcctctct

SEQ ID NO: 143599 - DNA, 15 bp, Homo sapiens
aaacattctcctctc

SEQ ID NO: 143600 - DNA, 15 bp, Homo sapiens
gaaacattctcctct

SEQ ID NO: 143601 - DNA, 15 bp, Homo sapiens
agaaacattctcctc

SEQ ID NO: 143602 - DNA, 15 bp, Homo sapiens
tagaaacattctcct

SEQ ID NO: 143603 - DNA, 15 bp, Homo sapiens
ttagaaacattctcc

SEQ ID NO: 143604 - DNA, 15 bp, Homo sapiens
cttagaaacattctc

SEQ ID NO: 143605 - DNA, 15 bp, Homo sapiens
tcttagaaacattct

SEQ ID NO: 143606 - DNA, 15 bp, Homo sapiens
ttcttagaaacattc

SEQ ID NO: 143607 - DNA, 15 bp, Homo sapiens
tttcttagaaacatt

SEQ ID NO: 143608 - DNA, 15 bp, Homo sapiens
ctttcttagaaacat

SEQ ID NO: 143609 - DNA, 15 bp, Homo sapiens
tctttcttagaaaca

SEQ ID NO: 143610 - DNA, 15 bp, Homo sapiens
ttctttcttagaaac

SEQ ID NO: 143611 - DNA, 15 bp, Homo sapiens
attctttcttagaaa

SEQ ID NO: 143612 - DNA, 15 bp, Homo sapiens
cattctttcttagaa

SEQ ID NO: 143613 - DNA, 15 bp, Homo sapiens
tcattctttcttaga

SEQ ID NO: 143614 - DNA, 15 bp, Homo sapiens
atcattctttcttag

SEQ ID NO: 143615 - DNA, 15 bp, Homo sapiens
gatcattctttctta

SEQ ID NO: 143616 - DNA, 15 bp, Homo sapiens
agatcattctttctt

SEQ ID NO: 143617 - DNA, 15 bp, Homo sapiens
tagatcattctttct

SEQ ID NO: 143618 - DNA, 15 bp, Homo sapiens
gtagatcattctttc

SEQ ID NO: 143619 - DNA, 15 bp, Homo sapiens
agtagatcattcttt

SEQ ID NO: 143620 - DNA, 15 bp, Homo sapiens
cagtagatcattctt

SEQ ID NO: 143621 - DNA, 15 bp, Homo sapiens
ccagtagatcattct

SEQ ID NO: 143622 - DNA, 15 bp, Homo sapiens
tccagtagatcattc

SEQ ID NO: 143623 - DNA, 15 bp, Homo sapiens
atccagtagatcatt

SEQ ID NO: 143624 - DNA, 15 bp, Homo sapiens
aatccagtagatcat

SEQ ID NO: 143625 - DNA, 15 bp, Homo sapiens
caatccagtagatca

SEQ ID NO: 143626 - DNA, 15 bp, Homo sapiens
tcaatccagtagatc

SEQ ID NO: 143627 - DNA, 15 bp, Homo sapiens
ttcaatccagtagat

SEQ ID NO: 143628 - DNA, 15 bp, Homo sapiens
attcaatccagtaga

SEQ ID NO: 143629 - DNA, 15 bp, Homo sapiens
aattcaatccagtag

SEQ ID NO: 143630 - DNA, 15 bp, Homo sapiens
caattcaatccagta

SEQ ID NO: 143631 - DNA, 15 bp, Homo sapiens
ccaattcaatccagt

SEQ ID NO: 143632 - DNA, 15 bp, Homo sapiens
cccaattcaatccag

SEQ ID NO: 143633 - DNA, 15 bp, Homo sapiens
gcccaattcaatcca

SEQ ID NO: 143634 - DNA, 15 bp, Homo sapiens
agcccaattcaatcc

SEQ ID NO: 143635 - DNA, 15 bp, Homo sapiens
cagcccaattcaatc

SEQ ID NO: 143636 - DNA, 15 bp, Homo sapiens
tcagcccaattcaat

SEQ ID NO: 143637 - DNA, 15 bp, Homo sapiens
ttcagcccaattcaa

SEQ ID NO: 143638 - DNA, 15 bp, Homo sapiens
attcagcccaattca

SEQ ID NO: 143639 - DNA, 15 bp, Homo sapiens
tattcagcccaattc

SEQ ID NO: 143640 - DNA, 15 bp, Homo sapiens
ttattcagcccaatt

SEQ ID NO: 143641 - DNA, 15 bp, Homo sapiens
gttattcagcccaat

SEQ ID NO: 143642 - DNA, 15 bp, Homo sapiens
ggttattcagcccaa

SEQ ID NO: 143643 - DNA, 15 bp, Homo sapiens
tggttattcagccca

SEQ ID NO: 143644 - DNA, 15 bp, Homo sapiens
ttggttattcagccc

SEQ ID NO: 143645 - DNA, 15 bp, Homo sapiens
tttggttattcagcc

SEQ ID NO: 143646 - DNA, 15 bp, Homo sapiens
atttggttattcagc

SEQ ID NO: 143647 - DNA, 15 bp, Homo sapiens
tatttggttattcag

SEQ ID NO: 143648 - DNA, 15 bp, Homo sapiens
ctatttggttattca

SEQ ID NO: 143649 - DNA, 15 bp, Homo sapiens
cctatttggttattc

SEQ ID NO: 143650 - DNA, 15 bp, Homo sapiens
tcctatttggttatt

SEQ ID NO: 143651 - DNA, 15 bp, Homo sapiens
atcctatttggttat

SEQ ID NO: 143652 - DNA, 15 bp, Homo sapiens
catcctatttggtta

SEQ ID NO: 143653 - DNA, 15 bp, Homo sapiens
tcatcctatttggtt

SEQ ID NO: 143654 - DNA, 15 bp, Homo sapiens
gtcatcctatttggt

SEQ ID NO: 143655 - DNA, 15 bp, Homo sapiens
tgtcatcctatttgg

SEQ ID NO: 143656 - DNA, 15 bp, Homo sapiens
gtgtcatcctatttg

SEQ ID NO: 143657 - DNA, 15 bp, Homo sapiens
tgtgtcatcctattt

SEQ ID NO: 143658 - DNA, 15 bp, Homo sapiens
ctgtgtcatcctatt

SEQ ID NO: 143659 - DNA, 15 bp, Homo sapiens
gctgtgtcatcctat

SEQ ID NO: 143660 - DNA, 15 bp, Homo sapiens
tgctgtgtcatccta

SEQ ID NO: 143661 - DNA, 15 bp, Homo sapiens
gtgctgtgtcatcct

SEQ ID NO: 143662 - DNA, 15 bp, Homo sapiens
tgtgctgtgtcatcc

SEQ ID NO: 143663 - DNA, 15 bp, Homo sapiens
gtgtgctgtgtcatc

SEQ ID NO: 143664 - DNA, 15 bp, Homo sapiens
agtgtgctgtgtcat

SEQ ID NO: 143665 - DNA, 15 bp, Homo sapiens
tagtgtgctgtgtca

SEQ ID NO: 143666 - DNA, 15 bp, Homo sapiens
atagtgtgctgtgtc

SEQ ID NO: 143667 - DNA, 15 bp, Homo sapiens
aatagtgtgctgtgt

SEQ ID NO: 143668 - DNA, 15 bp, Homo sapiens
aaatagtgtgctgtg

SEQ ID NO: 143669 - DNA, 15 bp, Homo sapiens
aaaatagtgtgctgt

SEQ ID NO: 143670 - DNA, 15 bp, Homo sapiens
caaaatagtgtgctg

SEQ ID NO: 143671 - DNA, 15 bp, Homo sapiens
ccaaaatagtgtgct

SEQ ID NO: 143672 - DNA, 15 bp, Homo sapiens
accaaaatagtgtgc

SEQ ID NO: 143673 - DNA, 15 bp, Homo sapiens
taccaaaatagtgtg

SEQ ID NO: 143674 - DNA, 15 bp, Homo sapiens
ttaccaaaatagtgt

SEQ ID NO: 143675 - DNA, 15 bp, Homo sapiens
attaccaaaatagtg

SEQ ID NO: 143676 - DNA, 15 bp, Homo sapiens
aattaccaaaatagt

SEQ ID NO: 143677 - DNA, 15 bp, Homo sapiens
gaattaccaaaatag

SEQ ID NO: 143678 - DNA, 15 bp, Homo sapiens
ggaattaccaaaata

SEQ ID NO: 143679 - DNA, 15 bp, Homo sapiens
tggaattaccaaaat

SEQ ID NO: 143680 - DNA, 15 bp, Homo sapiens
gtggaattaccaaaa

SEQ ID NO: 143681 - DNA, 15 bp, Homo sapiens
tgtggaattaccaaa

SEQ ID NO: 143682 - DNA, 15 bp, Homo sapiens
ctgtggaattaccaa

SEQ ID NO: 143683 - DNA, 15 bp, Homo sapiens
gctgtggaattacca

SEQ ID NO: 143684 - DNA, 15 bp, Homo sapiens
agctgtggaattacc

SEQ ID NO: 143685 - DNA, 15 bp, Homo sapiens
aagctgtggaattac

SEQ ID NO: 143686 - DNA, 15 bp, Homo sapiens
caagctgtggaatta

SEQ ID NO: 143687 - DNA, 15 bp, Homo sapiens
ccaagctgtggaatt

SEQ ID NO: 143688 - DNA, 15 bp, Homo sapiens
tccaagctgtggaat

SEQ ID NO: 143689 - DNA, 15 bp, Homo sapiens
gtccaagctgtggaa

SEQ ID NO: 143690 - DNA, 15 bp, Homo sapiens
tgtccaagctgtgga

SEQ ID NO: 143691 - DNA, 15 bp, Homo sapiens
atgtccaagctgtgg

SEQ ID NO: 143692 - DNA, 15 bp, Homo sapiens
aatgtccaagctgtg

SEQ ID NO: 143693 - DNA, 15 bp, Homo sapiens
gaatgtccaagctgt

SEQ ID NO: 143694 - DNA, 15 bp, Homo sapiens
ggaatgtccaagctg

SEQ ID NO: 143695 - DNA, 15 bp, Homo sapiens
aggaatgtccaagct

SEQ ID NO: 143696 - DNA, 15 bp, Homo sapiens
caggaatgtccaagc

SEQ ID NO: 143697 - DNA, 15 bp, Homo sapiens
ccaggaatgtccaag

SEQ ID NO: 143698 - DNA, 15 bp, Homo sapiens
accaggaatgtccaa

SEQ ID NO: 143699 - DNA, 15 bp, Homo sapiens
caccaggaatgtcca

SEQ ID NO: 143700 - DNA, 15 bp, Homo sapiens
tcaccaggaatgtcc

SEQ ID NO: 143701 - DNA, 15 bp, Homo sapiens
atcaccaggaatgtc

SEQ ID NO: 143702 - DNA, 15 bp, Homo sapiens
aatcaccaggaatgt

SEQ ID NO: 143703 - DNA, 15 bp, Homo sapiens
aaatcaccaggaatg

SEQ ID NO: 143704 - DNA, 15 bp, Homo sapiens
aaaatcaccaggaat

SEQ ID NO: 143705 - DNA, 15 bp, Homo sapiens
caaaatcaccaggaa

SEQ ID NO: 143706 - DNA, 15 bp, Homo sapiens
ccaaaatcaccagga

SEQ ID NO: 143707 - DNA, 15 bp, Homo sapiens
tccaaaatcaccagg

SEQ ID NO: 143708 - DNA, 15 bp, Homo sapiens
ttccaaaatcaccag

SEQ ID NO: 143709 - DNA, 15 bp, Homo sapiens
tttccaaaatcacca

SEQ ID NO: 143710 - DNA, 15 bp, Homo sapiens
ctttccaaaatcacc

SEQ ID NO: 143711 - DNA, 15 bp, Homo sapiens
tctttccaaaatcac

SEQ ID NO: 143712 - DNA, 15 bp, Homo sapiens
ctctttccaaaatca

SEQ ID NO: 143713 - DNA, 15 bp, Homo sapiens
gctctttccaaaatc

SEQ ID NO: 143714 - DNA, 15 bp, Homo sapiens
tgctctttccaaaat

SEQ ID NO: 143715 - DNA, 15 bp, Homo sapiens
ttgctctttccaaaa

SEQ ID NO: 143716 - DNA, 15 bp, Homo sapiens
attgctctttccaaa

SEQ ID NO: 143717 - DNA, 15 bp, Homo sapiens
aattgctctttccaa

SEQ ID NO: 143718 - DNA, 15 bp, Homo sapiens
aaattgctctttcca

SEQ ID NO: 143719 - DNA, 15 bp, Homo sapiens
caaattgctctttcc

SEQ ID NO: 143720 - DNA, 15 bp, Homo sapiens
ccaaattgctctttc

SEQ ID NO: 143721 - DNA, 15 bp, Homo sapiens
tccaaattgctcttt

SEQ ID NO: 143722 - DNA, 15 bp, Homo sapiens
ctccaaattgctctt

SEQ ID NO: 143723 - DNA, 15 bp, Homo sapiens
cctccaaattgctct

SEQ ID NO: 143724 - DNA, 15 bp, Homo sapiens
tcctccaaattgctc

SEQ ID NO: 143725 - DNA, 15 bp, Homo sapiens
ttcctccaaattgct

SEQ ID NO: 143726 - DNA, 15 bp, Homo sapiens
cttcctccaaattgc

SEQ ID NO: 143727 - DNA, 15 bp, Homo sapiens
acttcctccaaattg

SEQ ID NO: 143728 - DNA, 15 bp, Homo sapiens
tacttcctccaaatt

SEQ ID NO: 143729 - DNA, 15 bp, Homo sapiens
ttacttcctccaaat

SEQ ID NO: 143730 - DNA, 15 bp, Homo sapiens
attacttcctccaaa

SEQ ID NO: 143731 - DNA, 15 bp, Homo sapiens
cattacttcctccaa

SEQ ID NO: 143732 - DNA, 15 bp, Homo sapiens
acattacttcctcca

SEQ ID NO: 143733 - DNA, 15 bp, Homo sapiens
cacattacttcctcc

SEQ ID NO: 143734 - DNA, 15 bp, Homo sapiens
ccacattacttcctc

SEQ ID NO: 143735 - DNA, 15 bp, Homo sapiens
gccacattacttcct

SEQ ID NO: 143736 - DNA, 15 bp, Homo sapiens
agccacattacttcc

SEQ ID NO: 143737 - DNA, 15 bp, Homo sapiens
cagccacattacttc

SEQ ID NO: 143738 - DNA, 15 bp, Homo sapiens
ccagccacattactt

SEQ ID NO: 143739 - DNA, 15 bp, Homo sapiens
tccagccacattact

SEQ ID NO: 143740 - DNA, 15 bp, Homo sapiens
ttccagccacattac

SEQ ID NO: 143741 - DNA, 15 bp, Homo sapiens
cttccagccacatta

SEQ ID NO: 143742 - DNA, 15 bp, Homo sapiens
gcttccagccacatt

SEQ ID NO: 143743 - DNA, 15 bp, Homo sapiens
agcttccagccacat

SEQ ID NO: 143744 - DNA, 15 bp, Homo sapiens
tagcttccagccaca

SEQ ID NO: 143745 - DNA, 15 bp, Homo sapiens
ctagcttccagccac

SEQ ID NO: 143746 - DNA, 15 bp, Homo sapiens
tctagcttccagcca

SEQ ID NO: 143747 - DNA, 15 bp, Homo sapiens
ctctagcttccagcc

SEQ ID NO: 143748 - DNA, 15 bp, Homo sapiens
tctctagcttccagc

SEQ ID NO: 143749 - DNA, 15 bp, Homo sapiens
ctctctagcttccag

SEQ ID NO: 143750 - DNA, 15 bp, Homo sapiens
actctctagcttcca

SEQ ID NO: 143751 - DNA, 15 bp, Homo sapiens
cactctctagcttcc

SEQ ID NO: 143752 - DNA, 15 bp, Homo sapiens
tcactctctagcttc

SEQ ID NO: 143753 - DNA, 15 bp, Homo sapiens
ctcactctctagctt

SEQ ID NO: 143754 - DNA, 15 bp, Homo sapiens
tctcactctctagct

SEQ ID NO: 143755 - DNA, 15 bp, Homo sapiens
atctcactctctagc

SEQ ID NO: 143756 - DNA, 15 bp, Homo sapiens
catctcactctctag

SEQ ID NO: 143757 - DNA, 15 bp, Homo sapiens
tcatctcactctcta

SEQ ID NO: 143758 - DNA, 15 bp, Homo sapiens
ttcatctcactctct

SEQ ID NO: 143759 - DNA, 15 bp, Homo sapiens
cttcatctcactctc

SEQ ID NO: 143760 - DNA, 15 bp, Homo sapiens
ccttcatctcactct

SEQ ID NO: 143761 - DNA, 15 bp, Homo sapiens
accttcatctcactc

SEQ ID NO: 143762 - DNA, 15 bp, Homo sapiens
caccttcatctcact

SEQ ID NO: 143763 - DNA, 15 bp, Homo sapiens
tcaccttcatctcac

SEQ ID NO: 143764 - DNA, 15 bp, Homo sapiens
ttcaccttcatctca

SEQ ID NO: 143765 - DNA, 15 bp, Homo sapiens
cttcaccttcatctc

SEQ ID NO: 143766 - DNA, 15 bp, Homo sapiens
tcttcaccttcatct

SEQ ID NO: 143767 - DNA, 15 bp, Homo sapiens
ttcttcaccttcatc

SEQ ID NO: 143768 - DNA, 15 bp, Homo sapiens
cttcttcaccttcat

SEQ ID NO: 143769 - DNA, 15 bp, Homo sapiens
acttcttcaccttca

SEQ ID NO: 143770 - DNA, 15 bp, Homo sapiens
tacttcttcaccttc

SEQ ID NO: 143771 - DNA, 15 bp, Homo sapiens
ctacttcttcacctt

SEQ ID NO: 143772 - DNA, 15 bp, Homo sapiens
tctacttcttcacct

SEQ ID NO: 143773 - DNA, 15 bp, Homo sapiens
ttctacttcttcacc

SEQ ID NO: 143774 - DNA, 15 bp, Homo sapiens
tttctacttcttcac

SEQ ID NO: 143775 - DNA, 15 bp, Homo sapiens
gtttctacttcttca

SEQ ID NO: 143776 - DNA, 15 bp, Homo sapiens
tgtttctacttcttc

SEQ ID NO: 143777 - DNA, 15 bp, Homo sapiens
ctgtttctacttctt

SEQ ID NO: 143778 - DNA, 15 bp, Homo sapiens
actgtttctacttct

SEQ ID NO: 143779 - DNA, 15 bp, Homo sapiens
aactgtttctacttc

SEQ ID NO: 143780 - DNA, 15 bp, Homo sapiens
aaactgtttctactt

SEQ ID NO: 143781 - DNA, 15 bp, Homo sapiens
caaactgtttctact

SEQ ID NO: 143782 - DNA, 15 bp, Homo sapiens
acaaactgtttctac

SEQ ID NO: 143783 - DNA, 15 bp, Homo sapiens
cacaaactgtttcta

SEQ ID NO: 143784 - DNA, 15 bp, Homo sapiens
ccacaaactgtttct

SEQ ID NO: 143785 - DNA, 15 bp, Homo sapiens
tccacaaactgtttc

SEQ ID NO: 143786 - DNA, 15 bp, Homo sapiens
ttccacaaactgttt

SEQ ID NO: 143787 - DNA, 15 bp, Homo sapiens
tttccacaaactgtt

SEQ ID NO: 143788 - DNA, 15 bp, Homo sapiens
gtttccacaaactgt

SEQ ID NO: 143789 - DNA, 15 bp, Homo sapiens
tgtttccacaaactg

SEQ ID NO: 143790 - DNA, 15 bp, Homo sapiens
ttgtttccacaaact

SEQ ID NO: 143791 - DNA, 15 bp, Homo sapiens
gttgtttccacaaac

SEQ ID NO: 143792 - DNA, 15 bp, Homo sapiens
agttgtttccacaaa

SEQ ID NO: 143793 - DNA, 15 bp, Homo sapiens
aagttgtttccacaa

SEQ ID NO: 143794 - DNA, 15 bp, Homo sapiens
aaagttgtttccaca

SEQ ID NO: 143795 - DNA, 15 bp, Homo sapiens
taaagttgtttccac

SEQ ID NO: 143796 - DNA, 15 bp, Homo sapiens
ctaaagttgtttcca

SEQ ID NO: 143797 - DNA, 15 bp, Homo sapiens
tctaaagttgtttcc

SEQ ID NO: 143798 - DNA, 15 bp, Homo sapiens
ctctaaagttgtttc

SEQ ID NO: 143799 - DNA, 15 bp, Homo sapiens
tctctaaagttgttt

SEQ ID NO: 143800 - DNA, 15 bp, Homo sapiens
ttctctaaagttgtt

SEQ ID NO: 143801 - DNA, 15 bp, Homo sapiens
cttctctaaagttgt

SEQ ID NO: 143802 - DNA, 15 bp, Homo sapiens
acttctctaaagttg

SEQ ID NO: 143803 - DNA, 15 bp, Homo sapiens
aacttctctaaagtt

SEQ ID NO: 143804 - DNA, 15 bp, Homo sapiens
aaacttctctaaagt

SEQ ID NO: 143805 - DNA, 15 bp, Homo sapiens
caaacttctctaaag

SEQ ID NO: 143806 - DNA, 15 bp, Homo sapiens
acaaacttctctaaa

SEQ ID NO: 143807 - DNA, 15 bp, Homo sapiens
cacaaacttctctaa

SEQ ID NO: 143808 - DNA, 15 bp, Homo sapiens
acacaaacttctcta

SEQ ID NO: 143809 - DNA, 15 bp, Homo sapiens
cacacaaacttctct

SEQ ID NO: 143810 - DNA, 15 bp, Homo sapiens
tcacacaaacttctc

SEQ ID NO: 143811 - DNA, 15 bp, Homo sapiens
ttcacacaaacttct

SEQ ID NO: 143812 - DNA, 15 bp, Homo sapiens
cttcacacaaacttc

SEQ ID NO: 143813 - DNA, 15 bp, Homo sapiens
tcttcacacaaactt

SEQ ID NO: 143814 - DNA, 15 bp, Homo sapiens
ctcttcacacaaact

SEQ ID NO: 143815 - DNA, 15 bp, Homo sapiens
cctcttcacacaaac

SEQ ID NO: 143816 - DNA, 15 bp, Homo sapiens
ccctcttcacacaaa

SEQ ID NO: 143817 - DNA, 15 bp, Homo sapiens
tccctcttcacacaa

SEQ ID NO: 143818 - DNA, 15 bp, Homo sapiens
gtccctcttcacaca

SEQ ID NO: 143819 - DNA, 15 bp, Homo sapiens
tgtccctcttcacac

SEQ ID NO: 143820 - DNA, 15 bp, Homo sapiens
ctgtccctcttcaca

SEQ ID NO: 143821 - DNA, 15 bp, Homo sapiens
tctgtccctcttcac

SEQ ID NO: 143822 - DNA, 15 bp, Homo sapiens
ctctgtccctcttca

SEQ ID NO: 143823 - DNA, 15 bp, Homo sapiens
tctctgtccctcttc

SEQ ID NO: 143824 - DNA, 15 bp, Homo sapiens
atctctgtccctctt

SEQ ID NO: 143825 - DNA, 15 bp, Homo sapiens
aatctctgtccctct

SEQ ID NO: 143826 - DNA, 15 bp, Homo sapiens
aaatctctgtccctc

SEQ ID NO: 143827 - DNA, 15 bp, Homo sapiens
aaaatctctgtccct

SEQ ID NO: 143828 - DNA, 15 bp, Homo sapiens
taaaatctctgtccc

SEQ ID NO: 143829 - DNA, 15 bp, Homo sapiens
ctaaaatctctgtcc

SEQ ID NO: 143830 - DNA, 15 bp, Homo sapiens
cctaaaatctctgtc

SEQ ID NO: 143831 - DNA, 15 bp, Homo sapiens
acctaaaatctctgt

SEQ ID NO: 143832 - DNA, 15 bp, Homo sapiens
tacctaaaatctctg

SEQ ID NO: 143833 - DNA, 15 bp, Homo sapiens
ctacctaaaatctct

SEQ ID NO: 143834 - DNA, 15 bp, Homo sapiens
actacctaaaatctc

SEQ ID NO: 143835 - DNA, 15 bp, Homo sapiens
cactacctaaaatct

SEQ ID NO: 143836 - DNA, 15 bp, Homo sapiens
gcactacctaaaatc

SEQ ID NO: 143837 - DNA, 15 bp, Homo sapiens
agcactacctaaaat

SEQ ID NO: 143838 - DNA, 15 bp, Homo sapiens
aagcactacctaaaa

SEQ ID NO: 143839 - DNA, 15 bp, Homo sapiens
taagcactacctaaa

SEQ ID NO: 143840 - DNA, 15 bp, Homo sapiens
ctaagcactacctaa

SEQ ID NO: 143841 - DNA, 15 bp, Homo sapiens
actaagcactaccta

SEQ ID NO: 143842 - DNA, 15 bp, Homo sapiens
cactaagcactacct

SEQ ID NO: 143843 - DNA, 15 bp, Homo sapiens
acactaagcactacc

SEQ ID NO: 143844 - DNA, 15 bp, Homo sapiens
cacactaagcactac

SEQ ID NO: 143845 - DNA, 15 bp, Homo sapiens
ccacactaagcacta

SEQ ID NO: 143846 - DNA, 15 bp, Homo sapiens
cccacactaagcact

SEQ ID NO: 143847 - DNA, 15 bp, Homo sapiens
ccccacactaagcac

SEQ ID NO: 143848 - DNA, 15 bp, Homo sapiens
cccccacactaagca

SEQ ID NO: 143849 - DNA, 15 bp, Homo sapiens
gcccccacactaagc

SEQ ID NO: 143850 - DNA, 15 bp, Homo sapiens
agcccccacactaag

SEQ ID NO: 143851 - DNA, 15 bp, Homo sapiens
cagcccccacactaa

SEQ ID NO: 143852 - DNA, 15 bp, Homo sapiens
acagcccccacacta

SEQ ID NO: 143853 - DNA, 15 bp, Homo sapiens
tacagcccccacact

SEQ ID NO: 143854 - DNA, 15 bp, Homo sapiens
ttacagcccccacac

SEQ ID NO: 143855 - DNA, 15 bp, Homo sapiens
cttacagcccccaca

SEQ ID NO: 143856 - DNA, 15 bp, Homo sapiens
ccttacagcccccac

SEQ ID NO: 143857 - DNA, 15 bp, Homo sapiens
accttacagccccca

SEQ ID NO: 143858 - DNA, 15 bp, Homo sapiens
aaccttacagccccc

SEQ ID NO: 143859 - DNA, 15 bp, Homo sapiens
taaccttacagcccc

SEQ ID NO: 143860 - DNA, 15 bp, Homo sapiens
ttaaccttacagccc

SEQ ID NO: 143861 - DNA, 15 bp, Homo sapiens
cttaaccttacagcc

SEQ ID NO: 143862 - DNA, 15 bp, Homo sapiens
tcttaaccttacagc

SEQ ID NO: 143863 - DNA, 15 bp, Homo sapiens
ctcttaaccttacag

SEQ ID NO: 143864 - DNA, 15 bp, Homo sapiens
tctcttaaccttaca

SEQ ID NO: 143865 - DNA, 15 bp, Homo sapiens
ctctcttaaccttac

SEQ ID NO: 143866 - DNA, 15 bp, Homo sapiens
actctcttaacctta

SEQ ID NO: 143867 - DNA, 15 bp, Homo sapiens
gactctcttaacctt

SEQ ID NO: 143868 - DNA, 15 bp, Homo sapiens
cgactctcttaacct

SEQ ID NO: 143869 - DNA, 15 bp, Homo sapiens
tcgactctcttaacc

SEQ ID NO: 143870 - DNA, 15 bp, Homo sapiens
atcgactctcttaac

SEQ ID NO: 143871 - DNA, 15 bp, Homo sapiens
aatcgactctcttaa

SEQ ID NO: 143872 - DNA, 15 bp, Homo sapiens
caatcgactctctta

SEQ ID NO: 143873 - DNA, 15 bp, Homo sapiens
tcaatcgactctctt

SEQ ID NO: 143874 - DNA, 15 bp, Homo sapiens
gtcaatcgactctct

SEQ ID NO: 143875 - DNA, 15 bp, Homo sapiens
agtcaatcgactctc

SEQ ID NO: 143876 - DNA, 15 bp, Homo sapiens
aagtcaatcgactct

SEQ ID NO: 143877 - DNA, 15 bp, Homo sapiens
aaagtcaatcgactc

SEQ ID NO: 143878 - DNA, 15 bp, Homo sapiens
aaaagtcaatcgact

SEQ ID NO: 143879 - DNA, 15 bp, Homo sapiens
gaaaagtcaatcgac

SEQ ID NO: 143880 - DNA, 15 bp, Homo sapiens
agaaaagtcaatcga

SEQ ID NO: 143881 - DNA, 15 bp, Homo sapiens
cagaaaagtcaatcg

SEQ ID NO: 143882 - DNA, 15 bp, Homo sapiens
acagaaaagtcaatc

SEQ ID NO: 143883 - DNA, 15 bp, Homo sapiens
aacagaaaagtcaat

SEQ ID NO: 143884 - DNA, 15 bp, Homo sapiens
taacagaaaagtcaa

SEQ ID NO: 143885 - DNA, 15 bp, Homo sapiens
ttaacagaaaagtca

SEQ ID NO: 143886 - DNA, 15 bp, Homo sapiens
tttaacagaaaagtc

SEQ ID NO: 143887 - DNA, 15 bp, Homo sapiens
ttttaacagaaaagt

SEQ ID NO: 143888 - DNA, 15 bp, Homo sapiens
attttaacagaaaag

SEQ ID NO: 143889 - DNA, 15 bp, Homo sapiens
cattttaacagaaaa

SEQ ID NO: 143890 - DNA, 15 bp, Homo sapiens
ccattttaacagaaa

SEQ ID NO: 143891 - DNA, 15 bp, Homo sapiens
tccattttaacagaa

SEQ ID NO: 143892 - DNA, 15 bp, Homo sapiens
atccattttaacaga

SEQ ID NO: 143893 - DNA, 15 bp, Homo sapiens
aatccattttaacag

SEQ ID NO: 143894 - DNA, 15 bp, Homo sapiens
taatccattttaaca

SEQ ID NO: 143895 - DNA, 15 bp, Homo sapiens
ataatccattttaac

SEQ ID NO: 143896 - DNA, 15 bp, Homo sapiens
tataatccattttaa

SEQ ID NO: 143897 - DNA, 15 bp, Homo sapiens
ctataatccatttta

SEQ ID NO: 143898 - DNA, 15 bp, Homo sapiens
actataatccatttt

SEQ ID NO: 143899 - DNA, 15 bp, Homo sapiens
tactataatccattt

SEQ ID NO: 143900 - DNA, 15 bp, Homo sapiens
ttactataatccatt

SEQ ID NO: 143901 - DNA, 15 bp, Homo sapiens
tttactataatccat

SEQ ID NO: 143902 - DNA, 15 bp, Homo sapiens
ctttactataatcca

SEQ ID NO: 143903 - DNA, 15 bp, Homo sapiens
gctttactataatcc

SEQ ID NO: 143904 - DNA, 15 bp, Homo sapiens
tgctttactataatc

SEQ ID NO: 143905 - DNA, 15 bp, Homo sapiens
atgctttactataat

SEQ ID NO: 143906 - DNA, 15 bp, Homo sapiens
catgctttactataa

SEQ ID NO: 143907 - DNA, 15 bp, Homo sapiens
acatgctttactata

SEQ ID NO: 143908 - DNA, 15 bp, Homo sapiens
aacatgctttactat

SEQ ID NO: 143909 - DNA, 15 bp, Homo sapiens
aaacatgctttacta

SEQ ID NO: 143910 - DNA, 15 bp, Homo sapiens
caaacatgctttact

SEQ ID NO: 143911 - DNA, 15 bp, Homo sapiens
acaaacatgctttac

SEQ ID NO: 143912 - DNA, 15 bp, Homo sapiens
cacaaacatgcttta

SEQ ID NO: 143913 - DNA, 15 bp, Homo sapiens
acacaaacatgcttt

SEQ ID NO: 143914 - DNA, 15 bp, Homo sapiens
cacacaaacatgctt

SEQ ID NO: 143915 - DNA, 15 bp, Homo sapiens
gcacacaaacatgct

SEQ ID NO: 143916 - DNA, 15 bp, Homo sapiens
ggcacacaaacatgc

SEQ ID NO: 143917 - DNA, 15 bp, Homo sapiens
aggcacacaaacatg

SEQ ID NO: 143918 - DNA, 15 bp, Homo sapiens
taggcacacaaacat

SEQ ID NO: 143919 - DNA, 15 bp, Homo sapiens
ataggcacacaaaca

SEQ ID NO: 143920 - DNA, 15 bp, Homo sapiens
cataggcacacaaac

SEQ ID NO: 143921 - DNA, 15 bp, Homo sapiens
tcataggcacacaaa

SEQ ID NO: 143922 - DNA, 15 bp, Homo sapiens
ctcataggcacacaa

SEQ ID NO: 143923 - DNA, 15 bp, Homo sapiens
tctcataggcacaca

SEQ ID NO: 143924 - DNA, 15 bp, Homo sapiens
ttctcataggcacac

SEQ ID NO: 143925 - DNA, 15 bp, Homo sapiens
attctcataggcaca

SEQ ID NO: 143926 - DNA, 15 bp, Homo sapiens
cattctcataggcac

SEQ ID NO: 143927 - DNA, 15 bp, Homo sapiens
tcattctcataggca

SEQ ID NO: 143928 - DNA, 15 bp, Homo sapiens
gtcattctcataggc

SEQ ID NO: 143929 - DNA, 15 bp, Homo sapiens
ggtcattctcatagg

SEQ ID NO: 143930 - DNA, 15 bp, Homo sapiens
gggtcattctcatag

SEQ ID NO: 143931 - DNA, 15 bp, Homo sapiens
tgggtcattctcata

SEQ ID NO: 143932 - DNA, 15 bp, Homo sapiens
gtgggtcattctcat

SEQ ID NO: 143933 - DNA, 15 bp, Homo sapiens
agtgggtcattctca

SEQ ID NO: 143934 - DNA, 15 bp, Homo sapiens
tagtgggtcattctc

SEQ ID NO: 143935 - DNA, 15 bp, Homo sapiens
ctagtgggtcattct

SEQ ID NO: 143936 - DNA, 15 bp, Homo sapiens
tctagtgggtcattc

SEQ ID NO: 143937 - DNA, 15 bp, Homo sapiens
atctagtgggtcatt

SEQ ID NO: 143938 - DNA, 15 bp, Homo sapiens
catctagtgggtcat

SEQ ID NO: 143939 - DNA, 15 bp, Homo sapiens
tcatctagtgggtca

SEQ ID NO: 143940 - DNA, 15 bp, Homo sapiens
ctcatctagtgggtc

SEQ ID NO: 143941 - DNA, 15 bp, Homo sapiens
tctcatctagtgggt

SEQ ID NO: 143942 - DNA, 15 bp, Homo sapiens
ctctcatctagtggg

SEQ ID NO: 143943 - DNA, 15 bp, Homo sapiens
tctctcatctagtgg

SEQ ID NO: 143944 - DNA, 15 bp, Homo sapiens
gtctctcatctagtg

SEQ ID NO: 143945 - DNA, 15 bp, Homo sapiens
agtctctcatctagt

SEQ ID NO: 143946 - DNA, 15 bp, Homo sapiens
cagtctctcatctag

SEQ ID NO: 143947 - DNA, 15 bp, Homo sapiens
tcagtctctcatcta

SEQ ID NO: 143948 - DNA, 15 bp, Homo sapiens
atcagtctctcatct

SEQ ID NO: 143949 - DNA, 15 bp, Homo sapiens
catcagtctctcatc

SEQ ID NO: 143950 - DNA, 15 bp, Homo sapiens
tcatcagtctctcat

SEQ ID NO: 143951 - DNA, 15 bp, Homo sapiens
atcatcagtctctca

SEQ ID NO: 143952 - DNA, 15 bp, Homo sapiens
aatcatcagtctctc

SEQ ID NO: 143953 - DNA, 15 bp, Homo sapiens
taatcatcagtctct

SEQ ID NO: 143954 - DNA, 15 bp, Homo sapiens
ttaatcatcagtctc

SEQ ID NO: 143955 - DNA, 15 bp, Homo sapiens
tttaatcatcagtct

SEQ ID NO: 143956 - DNA, 15 bp, Homo sapiens
atttaatcatcagtc

SEQ ID NO: 143957 - DNA, 15 bp, Homo sapiens
catttaatcatcagt

SEQ ID NO: 143958 - DNA, 15 bp, Homo sapiens
gcatttaatcatcag

SEQ ID NO: 143959 - DNA, 15 bp, Homo sapiens
tgcatttaatcatca

SEQ ID NO: 143960 - DNA, 15 bp, Homo sapiens
ctgcatttaatcatc

SEQ ID NO: 143961 - DNA, 15 bp, Homo sapiens
tctgcatttaatcat

SEQ ID NO: 143962 - DNA, 15 bp, Homo sapiens
ctctgcatttaatca

SEQ ID NO: 143963 - DNA, 15 bp, Homo sapiens
cctctgcatttaatc

SEQ ID NO: 143964 - DNA, 15 bp, Homo sapiens
ccctctgcatttaat

SEQ ID NO: 143965 - DNA, 15 bp, Homo sapiens
cccctctgcatttaa

SEQ ID NO: 143966 - DNA, 15 bp, Homo sapiens
tcccctctgcattta

SEQ ID NO: 143967 - DNA, 15 bp, Homo sapiens
gtcccctctgcattt

SEQ ID NO: 143968 - DNA, 15 bp, Homo sapiens
tgtcccctctgcatt

SEQ ID NO: 143969 - DNA, 15 bp, Homo sapiens
ttgtcccctctgcat

SEQ ID NO: 143970 - DNA, 15 bp, Homo sapiens
tttgtcccctctgca

SEQ ID NO: 143971 - DNA, 15 bp, Homo sapiens
ctttgtcccctctgc

SEQ ID NO: 143972 - DNA, 15 bp, Homo sapiens
cctttgtcccctctg

SEQ ID NO: 143973 - DNA, 15 bp, Homo sapiens
tcctttgtcccctct

SEQ ID NO: 143974 - DNA, 15 bp, Homo sapiens
ttcctttgtcccctc

SEQ ID NO: 143975 - DNA, 15 bp, Homo sapiens
cttcctttgtcccct

SEQ ID NO: 143976 - DNA, 15 bp, Homo sapiens
ccttcctttgtcccc

SEQ ID NO: 143977 - DNA, 15 bp, Homo sapiens
tccttcctttgtccc

SEQ ID NO: 143978 - DNA, 15 bp, Homo sapiens
ctccttcctttgtcc

SEQ ID NO: 143979 - DNA, 15 bp, Homo sapiens
cctccttcctttgtc

SEQ ID NO: 143980 - DNA, 15 bp, Homo sapiens
tcctccttcctttgt

SEQ ID NO: 143981 - DNA, 15 bp, Homo sapiens
gtcctccttcctttg

SEQ ID NO: 143982 - DNA, 15 bp, Homo sapiens
tgtcctccttccttt

SEQ ID NO: 143983 - DNA, 15 bp, Homo sapiens
ctgtcctccttcctt

SEQ ID NO: 143984 - DNA, 15 bp, Homo sapiens
cctgtcctccttcct

SEQ ID NO: 143985 - DNA, 15 bp, Homo sapiens
tcctgtcctccttcc

SEQ ID NO: 143986 - DNA, 15 bp, Homo sapiens
ttcctgtcctccttc

SEQ ID NO: 143987 - DNA, 15 bp, Homo sapiens
cttcctgtcctcctt

SEQ ID NO: 143988 - DNA, 15 bp, Homo sapiens
ccttcctgtcctcct

SEQ ID NO: 143989 - DNA, 15 bp, Homo sapiens
gccttcctgtcctcc

SEQ ID NO: 143990 - DNA, 15 bp, Homo sapiens
agccttcctgtcctc

SEQ ID NO: 143991 - DNA, 15 bp, Homo sapiens
aagccttcctgtcct

SEQ ID NO: 143992 - DNA, 15 bp, Homo sapiens
aaagccttcctgtcc

SEQ ID NO: 143993 - DNA, 15 bp, Homo sapiens
caaagccttcctgtc

SEQ ID NO: 143994 - DNA, 15 bp, Homo sapiens
tcaaagccttcctgt

SEQ ID NO: 143995 - DNA, 15 bp, Homo sapiens
ctcaaagccttcctg

SEQ ID NO: 143996 - DNA, 15 bp, Homo sapiens
tctcaaagccttcct

SEQ ID NO: 143997 - DNA, 15 bp, Homo sapiens
ttctcaaagccttcc

SEQ ID NO: 143998 - DNA, 15 bp, Homo sapiens
cttctcaaagccttc

SEQ ID NO: 143999 - DNA, 15 bp, Homo sapiens
tcttctcaaagcctt

SEQ ID NO: 144000 - DNA, 15 bp, Homo sapiens
atcttctcaaagcct

SEQ ID NO: 144001 - DNA, 15 bp, Homo sapiens
tatcttctcaaagcc

SEQ ID NO: 144002 - DNA, 15 bp, Homo sapiens
ttatcttctcaaagc

SEQ ID NO: 144003 - DNA, 15 bp, Homo sapiens
cttatcttctcaaag

SEQ ID NO: 144004 - DNA, 15 bp, Homo sapiens
tcttatcttctcaaa

SEQ ID NO: 144005 - DNA, 15 bp, Homo sapiens
ttcttatcttctcaa

SEQ ID NO: 144006 - DNA, 15 bp, Homo sapiens
tttcttatcttctca

SEQ ID NO: 144007 - DNA, 15 bp, Homo sapiens
ctttcttatcttctc

SEQ ID NO: 144008 - DNA, 15 bp, Homo sapiens
actttcttatcttct

SEQ ID NO: 144009 - DNA, 15 bp, Homo sapiens
cactttcttatcttc

SEQ ID NO: 144010 - DNA, 15 bp, Homo sapiens
tcactttcttatctt

SEQ ID NO: 144011 - DNA, 15 bp, Homo sapiens
ctcactttcttatct

SEQ ID NO: 144012 - DNA, 15 bp, Homo sapiens
tctcactttcttatc

SEQ ID NO: 144013 - DNA, 15 bp, Homo sapiens
atctcactttcttat

SEQ ID NO: 144014 - DNA, 15 bp, Homo sapiens
aatctcactttctta

SEQ ID NO: 144015 - DNA, 15 bp, Homo sapiens
aaatctcactttctt

SEQ ID NO: 144016 - DNA, 15 bp, Homo sapiens
taaatctcactttct

SEQ ID NO: 144017 - DNA, 15 bp, Homo sapiens
ctaaatctcactttc

SEQ ID NO: 144018 - DNA, 15 bp, Homo sapiens
tctaaatctcacttt

SEQ ID NO: 144019 - DNA, 15 bp, Homo sapiens
ctctaaatctcactt

SEQ ID NO: 144020 - DNA, 15 bp, Homo sapiens
tctctaaatctcact

SEQ ID NO: 144021 - DNA, 15 bp, Homo sapiens
ttctctaaatctcac

SEQ ID NO: 144022 - DNA, 15 bp, Homo sapiens
attctctaaatctca

SEQ ID NO: 144023 - DNA, 15 bp, Homo sapiens
aattctctaaatctc

SEQ ID NO: 144024 - DNA, 15 bp, Homo sapiens
caattctctaaatct

SEQ ID NO: 144025 - DNA, 15 bp, Homo sapiens
ccaattctctaaatc

SEQ ID NO: 144026 - DNA, 15 bp, Homo sapiens
cccaattctctaaat

SEQ ID NO: 144027 - DNA, 15 bp, Homo sapiens
acccaattctctaaa

SEQ ID NO: 144028 - DNA, 15 bp, Homo sapiens
aacccaattctctaa

SEQ ID NO: 144029 - DNA, 15 bp, Homo sapiens
aaacccaattctcta

SEQ ID NO: 144030 - DNA, 15 bp, Homo sapiens
caaacccaattctct

SEQ ID NO: 144031 - DNA, 15 bp, Homo sapiens
ccaaacccaattctc

SEQ ID NO: 144032 - DNA, 15 bp, Homo sapiens
accaaacccaattct

SEQ ID NO: 144033 - DNA, 15 bp, Homo sapiens
taccaaacccaattc

SEQ ID NO: 144034 - DNA, 15 bp, Homo sapiens
ttaccaaacccaatt

SEQ ID NO: 144035 - DNA, 15 bp, Homo sapiens
cttaccaaacccaat

SEQ ID NO: 144036 - DNA, 15 bp, Homo sapiens
tcttaccaaacccaa

SEQ ID NO: 144037 - DNA, 15 bp, Homo sapiens
ttcttaccaaaccca

SEQ ID NO: 144038 - DNA, 15 bp, Homo sapiens
gttcttaccaaaccc

SEQ ID NO: 144039 - DNA, 15 bp, Homo sapiens
agttcttaccaaacc

SEQ ID NO: 144040 - DNA, 15 bp, Homo sapiens
cagttcttaccaaac

SEQ ID NO: 144041 - DNA, 15 bp, Homo sapiens
ccagttcttaccaaa

SEQ ID NO: 144042 - DNA, 15 bp, Homo sapiens
tccagttcttaccaa

SEQ ID NO: 144043 - DNA, 15 bp, Homo sapiens
ttccagttcttacca

SEQ ID NO: 144044 - DNA, 15 bp, Homo sapiens
attccagttcttacc

SEQ ID NO: 144045 - DNA, 15 bp, Homo sapiens
cattccagttcttac

SEQ ID NO: 144046 - DNA, 15 bp, Homo sapiens
gcattccagttctta

SEQ ID NO: 144047 - DNA, 15 bp, Homo sapiens
tgcattccagttctt

SEQ ID NO: 144048 - DNA, 15 bp, Homo sapiens
atgcattccagttct

SEQ ID NO: 144049 - DNA, 15 bp, Homo sapiens
aatgcattccagttc

SEQ ID NO: 144050 - DNA, 15 bp, Homo sapiens
aaatgcattccagtt

SEQ ID NO: 144051 - DNA, 15 bp, Homo sapiens
aaaatgcattccagt

SEQ ID NO: 144052 - DNA, 15 bp, Homo sapiens
aaaaatgcattccag

SEQ ID NO: 144053 - DNA, 15 bp, Homo sapiens
gaaaaatgcattcca

SEQ ID NO: 144054 - DNA, 15 bp, Homo sapiens
tgaaaaatgcattcc

SEQ ID NO: 144055 - DNA, 15 bp, Homo sapiens
atgaaaaatgcattc

SEQ ID NO: 144056 - DNA, 15 bp, Homo sapiens
ataatgaaaaatgca

SEQ ID NO: 144057 - DNA, 15 bp, Homo sapiens
cataatgaaaaatgc

SEQ ID NO: 144058 - DNA, 15 bp, Homo sapiens
tcataatgaaaaatg

SEQ ID NO: 144059 - DNA, 15 bp, Homo sapiens
gtcataatgaaaaat

SEQ ID NO: 144060 - DNA, 15 bp, Homo sapiens
ggtcataatgaaaaa

SEQ ID NO: 144061 - DNA, 15 bp, Homo sapiens
tggtcataatgaaaa

SEQ ID NO: 144062 - DNA, 15 bp, Homo sapiens
ctggtcataatgaaa

SEQ ID NO: 144063 - DNA, 15 bp, Homo sapiens
tctggtcataatgaa

SEQ ID NO: 144064 - DNA, 15 bp, Homo sapiens
ttctggtcataatga

SEQ ID NO: 144065 - DNA, 15 bp, Homo sapiens
tttctggtcataatg

SEQ ID NO: 144066 - DNA, 15 bp, Homo sapiens
ttttctggtcataat

SEQ ID NO: 144067 - DNA, 15 bp, Homo sapiens
cttttctggtcataa

SEQ ID NO: 144068 - DNA, 15 bp, Homo sapiens
acttttctggtcata

SEQ ID NO: 144069 - DNA, 15 bp, Homo sapiens
gacttttctggtcat

SEQ ID NO: 144070 - DNA, 15 bp, Homo sapiens
tgacttttctggtca

SEQ ID NO: 144071 - DNA, 15 bp, Homo sapiens
ttgacttttctggtc

SEQ ID NO: 144072 - DNA, 15 bp, Homo sapiens
gttgacttttctggt

SEQ ID NO: 144073 - DNA, 15 bp, Homo sapiens
cgttgacttttctgg

SEQ ID NO: 144074 - DNA, 15 bp, Homo sapiens
tcgttgacttttctg

SEQ ID NO: 144075 - DNA, 15 bp, Homo sapiens
ctcgttgacttttct

SEQ ID NO: 144076 - DNA, 15 bp, Homo sapiens
tctcgttgacttttc

SEQ ID NO: 144077 - DNA, 15 bp, Homo sapiens
ttctcgttgactttt

SEQ ID NO: 144078 - DNA, 15 bp, Homo sapiens
cttctcgttgacttt

SEQ ID NO: 144079 - DNA, 15 bp, Homo sapiens
ccttctcgttgactt

SEQ ID NO: 144080 - DNA, 15 bp, Homo sapiens
accttctcgttgact

SEQ ID NO: 144081 - DNA, 15 bp, Homo sapiens
caccttctcgttgac

SEQ ID NO: 144082 - DNA, 15 bp, Homo sapiens
tcaccttctcgttga

SEQ ID NO: 144083 - DNA, 15 bp, Homo sapiens
ctcaccttctcgttg

SEQ ID NO: 144084 - DNA, 15 bp, Homo sapiens
actcaccttctcgtt

SEQ ID NO: 144085 - DNA, 15 bp, Homo sapiens
aactcaccttctcgt

SEQ ID NO: 144086 - DNA, 15 bp, Homo sapiens
aaactcaccttctcg

SEQ ID NO: 144087 - DNA, 15 bp, Homo sapiens
taaactcaccttctc

SEQ ID NO: 144088 - DNA, 15 bp, Homo sapiens
ctaaactcaccttct

SEQ ID NO: 144089 - DNA, 15 bp, Homo sapiens
tctaaactcaccttc

SEQ ID NO: 144090 - DNA, 15 bp, Homo sapiens
atctaaactcacctt

SEQ ID NO: 144091 - DNA, 15 bp, Homo sapiens
catctaaactcacct

SEQ ID NO: 144092 - DNA, 15 bp, Homo sapiens
acatctaaactcacc

SEQ ID NO: 144093 - DNA, 15 bp, Homo sapiens
tacatctaaactcac

SEQ ID NO: 144094 - DNA, 15 bp, Homo sapiens
gtacatctaaactca

SEQ ID NO: 144095 - DNA, 15 bp, Homo sapiens
cgtacatctaaactc

SEQ ID NO: 144096 - DNA, 15 bp, Homo sapiens
acgtacatctaaact

SEQ ID NO: 144097 - DNA, 15 bp, Homo sapiens
cacgtacatctaaac

SEQ ID NO: 144098 - DNA, 15 bp, Homo sapiens
tcacgtacatctaaa

SEQ ID NO: 144099 - DNA, 15 bp, Homo sapiens
ttcacgtacatctaa

SEQ ID NO: 144100 - DNA, 15 bp, Homo sapiens
gttcacgtacatcta

SEQ ID NO: 144101 - DNA, 15 bp, Homo sapiens
agttcacgtacatct

SEQ ID NO: 144102 - DNA, 15 bp, Homo sapiens
tagttcacgtacatc

SEQ ID NO: 144103 - DNA, 15 bp, Homo sapiens
ctagttcacgtacat

SEQ ID NO: 144104 - DNA, 15 bp, Homo sapiens
tctagttcacgtaca

SEQ ID NO: 144105 - DNA, 15 bp, Homo sapiens
gtctagttcacgtac

SEQ ID NO: 144106 - DNA, 15 bp, Homo sapiens
ggtctagttcacgta

SEQ ID NO: 144107 - DNA, 15 bp, Homo sapiens
tggtctagttcacgt

SEQ ID NO: 144108 - DNA, 15 bp, Homo sapiens
atggtctagttcacg

SEQ ID NO: 144109 - DNA, 15 bp, Homo sapiens
aatggtctagttcac

SEQ ID NO: 144110 - DNA, 15 bp, Homo sapiens
taatggtctagttca

SEQ ID NO: 144111 - DNA, 15 bp, Homo sapiens
ctaatggtctagttc

SEQ ID NO: 144112 - DNA, 15 bp, Homo sapiens
actaatggtctagtt

SEQ ID NO: 144113 - DNA, 15 bp, Homo sapiens
cactaatggtctagt

SEQ ID NO: 144114 - DNA, 15 bp, Homo sapiens
ccactaatggtctag

SEQ ID NO: 144115 - DNA, 15 bp, Homo sapiens
accactaatggtcta

SEQ ID NO: 144116 - DNA, 15 bp, Homo sapiens
caccactaatggtct

SEQ ID NO: 144117 - DNA, 15 bp, Homo sapiens
ccaccactaatggtc

SEQ ID NO: 144118 - DNA, 15 bp, Homo sapiens
tccaccactaatggt

SEQ ID NO: 144119 - DNA, 15 bp, Homo sapiens
ttccaccactaatgg

SEQ ID NO: 144120 - DNA, 15 bp, Homo sapiens
cttccaccactaatg

SEQ ID NO: 144121 - DNA, 15 bp, Homo sapiens
tcttccaccactaat

SEQ ID NO: 144122 - DNA, 15 bp, Homo sapiens
atcttccaccactaa

SEQ ID NO: 144123 - DNA, 15 bp, Homo sapiens
catcttccaccacta

SEQ ID NO: 144124 - DNA, 15 bp, Homo sapiens
tcatcttccaccact

SEQ ID NO: 144125 - DNA, 15 bp, Homo sapiens
ttcatcttccaccac

SEQ ID NO: 144126 - DNA, 15 bp, Homo sapiens
tttcatcttccacca

SEQ ID NO: 144127 - DNA, 15 bp, Homo sapiens
ctttcatcttccacc

SEQ ID NO: 144128 - DNA, 15 bp, Homo sapiens
cctttcatcttccac

SEQ ID NO: 144129 - DNA, 15 bp, Homo sapiens
acctttcatcttcca

SEQ ID NO: 144130 - DNA, 15 bp, Homo sapiens
aacctttcatcttcc

SEQ ID NO: 144131 - DNA, 15 bp, Homo sapiens
gaacctttcatcttc

SEQ ID NO: 144132 - DNA, 15 bp, Homo sapiens
agaacctttcatctt

SEQ ID NO: 144133 - DNA, 15 bp, Homo sapiens
gagaacctttcatct

SEQ ID NO: 144134 - DNA, 15 bp, Homo sapiens
ggagaacctttcatc

SEQ ID NO: 144135 - DNA, 15 bp, Homo sapiens
tggagaacctttcat

SEQ ID NO: 144136 - DNA, 15 bp, Homo sapiens
atggagaacctttca

SEQ ID NO: 144137 - DNA, 15 bp, Homo sapiens
catggagaacctttc

SEQ ID NO: 144138 - DNA, 15 bp, Homo sapiens
gcatggagaaccttt

SEQ ID NO: 144139 - DNA, 15 bp, Homo sapiens
tgcatggagaacctt

SEQ ID NO: 144140 - DNA, 15 bp, Homo sapiens
ttgcatggagaacct

SEQ ID NO: 144141 - DNA, 15 bp, Homo sapiens
cttgcatggagaacc

SEQ ID NO: 144142 - DNA, 15 bp, Homo sapiens
tcttgcatggagaac

SEQ ID NO: 144143 - DNA, 15 bp, Homo sapiens
ttcttgcatggagaa

SEQ ID NO: 144144 - DNA, 15 bp, Homo sapiens
gttcttgcatggaga

SEQ ID NO: 144145 - DNA, 15 bp, Homo sapiens
agttcttgcatggag

SEQ ID NO: 144146 - DNA, 15 bp, Homo sapiens
cagttcttgcatgga

SEQ ID NO: 144147 - DNA, 15 bp, Homo sapiens
tcagttcttgcatgg

SEQ ID NO: 144148 - DNA, 15 bp, Homo sapiens
ctcagttcttgcatg

SEQ ID NO: 144149 - DNA, 15 bp, Homo sapiens
gctcagttcttgcat

SEQ ID NO: 144150 - DNA, 15 bp, Homo sapiens
agctcagttcttgca

SEQ ID NO: 144151 - DNA, 15 bp, Homo sapiens
aagctcagttcttgc

SEQ ID NO: 144152 - DNA, 15 bp, Homo sapiens
aaagctcagttcttg

SEQ ID NO: 144153 - DNA, 15 bp, Homo sapiens
taaagctcagttctt

SEQ ID NO: 144154 - DNA, 15 bp, Homo sapiens
ataaagctcagttct

SEQ ID NO: 144155 - DNA, 15 bp, Homo sapiens
cataaagctcagttc

SEQ ID NO: 144156 - DNA, 15 bp, Homo sapiens
tcataaagctcagtt

SEQ ID NO: 144157 - DNA, 15 bp, Homo sapiens
atcataaagctcagt

SEQ ID NO: 144158 - DNA, 15 bp, Homo sapiens
gatcataaagctcag

SEQ ID NO: 144159 - DNA, 15 bp, Homo sapiens
agatcataaagctca

SEQ ID NO: 144160 - DNA, 15 bp, Homo sapiens
tagatcataaagctc

SEQ ID NO: 144161 - DNA, 15 bp, Homo sapiens
atagatcataaagct

SEQ ID NO: 144162 - DNA, 15 bp, Homo sapiens
gatagatcataaagc

SEQ ID NO: 144163 - DNA, 15 bp, Homo sapiens
cgatagatcataaag

SEQ ID NO: 144164 - DNA, 15 bp, Homo sapiens
tcgatagatcataaa

SEQ ID NO: 144165 - DNA, 15 bp, Homo sapiens
ctcgatagatcataa

SEQ ID NO: 144166 - DNA, 15 bp, Homo sapiens
gctcgatagatcata

SEQ ID NO: 144167 - DNA, 15 bp, Homo sapiens
tgctcgatagatcat

SEQ ID NO: 144168 - DNA, 15 bp, Homo sapiens
gtgctcgatagatca

SEQ ID NO: 144169 - DNA, 15 bp, Homo sapiens
tgtgctcgatagatc

SEQ ID NO: 144170 - DNA, 15 bp, Homo sapiens
atgtgctcgatagat

SEQ ID NO: 144171 - DNA, 15 bp, Homo sapiens
aatgtgctcgataga

SEQ ID NO: 144172 - DNA, 15 bp, Homo sapiens
caatgtgctcgatag

SEQ ID NO: 144173 - DNA, 15 bp, Homo sapiens
acaatgtgctcgata

SEQ ID NO: 144174 - DNA, 15 bp, Homo sapiens
gacaatgtgctcgat

SEQ ID NO: 144175 - DNA, 15 bp, Homo sapiens
tgacaatgtgctcga

SEQ ID NO: 144176 - DNA, 15 bp, Homo sapiens
ctgacaatgtgctcg

SEQ ID NO: 144177 - DNA, 15 bp, Homo sapiens
actgacaatgtgctc

SEQ ID NO: 144178 - DNA, 15 bp, Homo sapiens
cactgacaatgtgct

SEQ ID NO: 144179 - DNA, 15 bp, Homo sapiens
tcactgacaatgtgc

SEQ ID NO: 144180 - DNA, 15 bp, Homo sapiens
ttcactgacaatgtg

SEQ ID NO: 144181 - DNA, 15 bp, Homo sapiens
cttcactgacaatgt

SEQ ID NO: 144182 - DNA, 15 bp, Homo sapiens
acttcactgacaatg

SEQ ID NO: 144183 - DNA, 15 bp, Homo sapiens
aacttcactgacaat

SEQ ID NO: 144184 - DNA, 15 bp, Homo sapiens
caacttcactgacaa

SEQ ID NO: 144185 - DNA, 15 bp, Homo sapiens
ccaacttcactgaca

SEQ ID NO: 144186 - DNA, 15 bp, Homo sapiens
tccaacttcactgac

SEQ ID NO: 144187 - DNA, 15 bp, Homo sapiens
ctccaacttcactga

SEQ ID NO: 144188 - DNA, 15 bp, Homo sapiens
cctccaacttcactg

SEQ ID NO: 144189 - DNA, 15 bp, Homo sapiens
acctccaacttcact

SEQ ID NO: 144190 - DNA, 15 bp, Homo sapiens
tacctccaacttcac

SEQ ID NO: 144191 - DNA, 15 bp, Homo sapiens
ctacctccaacttca

SEQ ID NO: 144192 - DNA, 15 bp, Homo sapiens
cctacctccaacttc

SEQ ID NO: 144193 - DNA, 15 bp, Homo sapiens
tcctacctccaactt

SEQ ID NO: 144194 - DNA, 15 bp, Homo sapiens
gtcctacctccaact

SEQ ID NO: 144195 - DNA, 15 bp, Homo sapiens
agtcctacctccaac

SEQ ID NO: 144196 - DNA, 15 bp, Homo sapiens
tagtcctacctccaa

SEQ ID NO: 144197 - DNA, 15 bp, Homo sapiens
ttagtcctacctcca

SEQ ID NO: 144198 - DNA, 15 bp, Homo sapiens
cttagtcctacctcc

SEQ ID NO: 144199 - DNA, 15 bp, Homo sapiens
tcttagtcctacctc

SEQ ID NO: 144200 - DNA, 15 bp, Homo sapiens
ctcttagtcctacct

SEQ ID NO: 144201 - DNA, 15 bp, Homo sapiens
tctcttagtcctacc

SEQ ID NO: 144202 - DNA, 15 bp, Homo sapiens
ttctcttagtcctac

SEQ ID NO: 144203 - DNA, 15 bp, Homo sapiens
cttctcttagtccta

SEQ ID NO: 144204 - DNA, 15 bp, Homo sapiens
acttctcttagtcct

SEQ ID NO: 144205 - DNA, 15 bp, Homo sapiens
aacttctcttagtcc

SEQ ID NO: 144206 - DNA, 15 bp, Homo sapiens
caacttctcttagtc

SEQ ID NO: 144207 - DNA, 15 bp, Homo sapiens
ccaacttctcttagt

SEQ ID NO: 144208 - DNA, 15 bp, Homo sapiens
tccaacttctcttag

SEQ ID NO: 144209 - DNA, 15 bp, Homo sapiens
ttccaacttctctta

SEQ ID NO: 144210 - DNA, 15 bp, Homo sapiens
cttccaacttctctt

SEQ ID NO: 144211 - DNA, 15 bp, Homo sapiens
tcttccaacttctct

SEQ ID NO: 144212 - DNA, 15 bp, Homo sapiens
ctcttccaacttctc

SEQ ID NO: 144213 - DNA, 15 bp, Homo sapiens
tctcttccaacttct

SEQ ID NO: 144214 - DNA, 15 bp, Homo sapiens
ctctcttccaacttc

SEQ ID NO: 144215 - DNA, 15 bp, Homo sapiens
tctctcttccaactt

SEQ ID NO: 144216 - DNA, 15 bp, Homo sapiens
ctctctcttccaact

SEQ ID NO: 144217 - DNA, 15 bp, Homo sapiens
cctctctcttccaac

SEQ ID NO: 144218 - DNA, 15 bp, Homo sapiens
tcctctctcttccaa

SEQ ID NO: 144219 - DNA, 15 bp, Homo sapiens
atcctctctcttcca

SEQ ID NO: 144220 - DNA, 15 bp, Homo sapiens
aatcctctctcttcc

SEQ ID NO: 144221 - DNA, 15 bp, Homo sapiens
caatcctctctcttc

SEQ ID NO: 144222 - DNA, 15 bp, Homo sapiens
ccaatcctctctctt

SEQ ID NO: 144223 - DNA, 15 bp, Homo sapiens
cccaatcctctctct

SEQ ID NO: 144224 - DNA, 15 bp, Homo sapiens
acccaatcctctctc

SEQ ID NO: 144225 - DNA, 15 bp, Homo sapiens
cacccaatcctctct

SEQ ID NO: 144226 - DNA, 15 bp, Homo sapiens
acacccaatcctctc

SEQ ID NO: 144227 - DNA, 15 bp, Homo sapiens
tacacccaatcctct

SEQ ID NO: 144228 - DNA, 15 bp, Homo sapiens
ttacacccaatcctc

SEQ ID NO: 144229 - DNA, 15 bp, Homo sapiens
cttacacccaatcct

SEQ ID NO: 144230 - DNA, 15 bp, Homo sapiens
acttacacccaatcc

SEQ ID NO: 144231 - DNA, 15 bp, Homo sapiens
aacttacacccaatc

SEQ ID NO: 144232 - DNA, 15 bp, Homo sapiens
gaacttacacccaat

SEQ ID NO: 144233 - DNA, 15 bp, Homo sapiens
tgaacttacacccaa

SEQ ID NO: 144234 - DNA, 15 bp, Homo sapiens
ctgaacttacaccca

SEQ ID NO: 144235 - DNA, 15 bp, Homo sapiens
tctgaacttacaccc

SEQ ID NO: 144236 - DNA, 15 bp, Homo sapiens
atctgaacttacacc

SEQ ID NO: 144237 - DNA, 15 bp, Homo sapiens
gatctgaacttacac

SEQ ID NO: 144238 - DNA, 15 bp, Homo sapiens
agatctgaacttaca

SEQ ID NO: 144239 - DNA, 15 bp, Homo sapiens
aagatctgaacttac

SEQ ID NO: 144240 - DNA, 15 bp, Homo sapiens
aaagatctgaactta

SEQ ID NO: 144241 - DNA, 15 bp, Homo sapiens
caaagatctgaactt

SEQ ID NO: 144242 - DNA, 15 bp, Homo sapiens
acaaagatctgaact

SEQ ID NO: 144243 - DNA, 15 bp, Homo sapiens
cacaaagatctgaac

SEQ ID NO: 144244 - DNA, 15 bp, Homo sapiens
tcacaaagatctgaa

SEQ ID NO: 144245 - DNA, 15 bp, Homo sapiens
ctcacaaagatctga

SEQ ID NO: 144246 - DNA, 15 bp, Homo sapiens
actcacaaagatctg

SEQ ID NO: 144247 - DNA, 15 bp, Homo sapiens
cactcacaaagatct

SEQ ID NO: 144248 - DNA, 15 bp, Homo sapiens
ccactcacaaagatc

SEQ ID NO: 144249 - DNA, 15 bp, Homo sapiens
cccactcacaaagat

SEQ ID NO: 144250 - DNA, 15 bp, Homo sapiens
tcccactcacaaaga

SEQ ID NO: 144251 - DNA, 15 bp, Homo sapiens
atcccactcacaaag

SEQ ID NO: 144252 - DNA, 15 bp, Homo sapiens
catcccactcacaaa

SEQ ID NO: 144253 - DNA, 15 bp, Homo sapiens
ccatcccactcacaa

SEQ ID NO: 144254 - DNA, 15 bp, Homo sapiens
tccatcccactcaca

SEQ ID NO: 144255 - DNA, 15 bp, Homo sapiens
ctccatcccactcac

SEQ ID NO: 144256 - DNA, 15 bp, Homo sapiens
tctccatcccactca

SEQ ID NO: 144257 - DNA, 15 bp, Homo sapiens
ctctccatcccactc

SEQ ID NO: 144258 - DNA, 15 bp, Homo sapiens
actctccatcccact

SEQ ID NO: 144259 - DNA, 15 bp, Homo sapiens
aactctccatcccac

SEQ ID NO: 144260 - DNA, 15 bp, Homo sapiens
aaactctccatccca

SEQ ID NO: 144261 - DNA, 15 bp, Homo sapiens
gaaactctccatccc

SEQ ID NO: 144262 - DNA, 15 bp, Homo sapiens
ggaaactctccatcc

SEQ ID NO: 144263 - DNA, 15 bp, Homo sapiens
aggaaactctccatc

SEQ ID NO: 144264 - DNA, 15 bp, Homo sapiens
taggaaactctccat

SEQ ID NO: 144265 - DNA, 15 bp, Homo sapiens
ctaggaaactctcca

SEQ ID NO: 144266 - DNA, 15 bp, Homo sapiens
cctaggaaactctcc

SEQ ID NO: 144267 - DNA, 15 bp, Homo sapiens
ccctaggaaactctc

SEQ ID NO: 144268 - DNA, 15 bp, Homo sapiens
accctaggaaactct

SEQ ID NO: 144269 - DNA, 15 bp, Homo sapiens
taccctaggaaactc

SEQ ID NO: 144270 - DNA, 15 bp, Homo sapiens
ttaccctaggaaact

SEQ ID NO: 144271 - DNA, 15 bp, Homo sapiens
tttaccctaggaaac

SEQ ID NO: 144272 - DNA, 15 bp, Homo sapiens
atttaccctaggaaa

SEQ ID NO: 144273 - DNA, 15 bp, Homo sapiens
tatttaccctaggaa

SEQ ID NO: 144274 - DNA, 15 bp, Homo sapiens
atatttaccctagga

SEQ ID NO: 144275 - DNA, 15 bp, Homo sapiens
tatatttaccctagg

SEQ ID NO: 144276 - DNA, 15 bp, Homo sapiens
atatatttaccctag

SEQ ID NO: 144277 - DNA, 15 bp, Homo sapiens
catatatttacccta

SEQ ID NO: 144278 - DNA, 15 bp, Homo sapiens
ccatatatttaccct

SEQ ID NO: 144279 - DNA, 15 bp, Homo sapiens
accatatatttaccc

SEQ ID NO: 144280 - DNA, 15 bp, Homo sapiens
taccatatatttacc

SEQ ID NO: 144281 - DNA, 15 bp, Homo sapiens
ataccatatatttac

SEQ ID NO: 144282 - DNA, 15 bp, Homo sapiens
aataccatatattta

SEQ ID NO: 144283 - DNA, 15 bp, Homo sapiens
caataccatatattt

SEQ ID NO: 144284 - DNA, 15 bp, Homo sapiens
gcaataccatatatt

SEQ ID NO: 144285 - DNA, 15 bp, Homo sapiens
agcaataccatatat

SEQ ID NO: 144286 - DNA, 15 bp, Homo sapiens
cagcaataccatata

SEQ ID NO: 144287 - DNA, 15 bp, Homo sapiens
ccagcaataccatat

SEQ ID NO: 144288 - DNA, 15 bp, Homo sapiens
cccagcaataccata

SEQ ID NO: 144289 - DNA, 15 bp, Homo sapiens
gcccagcaataccat

SEQ ID NO: 144290 - DNA, 15 bp, Homo sapiens
tgcccagcaatacca

SEQ ID NO: 144291 - DNA, 15 bp, Homo sapiens
ctgcccagcaatacc

SEQ ID NO: 144292 - DNA, 15 bp, Homo sapiens
actgcccagcaatac

SEQ ID NO: 144293 - DNA, 15 bp, Homo sapiens
tactgcccagcaata

SEQ ID NO: 144294 - DNA, 15 bp, Homo sapiens
ttactgcccagcaat

SEQ ID NO: 144295 - DNA, 15 bp, Homo sapiens
attactgcccagcaa

SEQ ID NO: 144296 - DNA, 15 bp, Homo sapiens
cattactgcccagca

SEQ ID NO: 144297 - DNA, 15 bp, Homo sapiens
tcattactgcccagc

SEQ ID NO: 144298 - DNA, 15 bp, Homo sapiens
ctcattactgcccag

SEQ ID NO: 144299 - DNA, 15 bp, Homo sapiens
actcattactgccca

SEQ ID NO: 144300 - DNA, 15 bp, Homo sapiens
cactcattactgccc

SEQ ID NO: 144301 - DNA, 15 bp, Homo sapiens
gcactcattactgcc

SEQ ID NO: 144302 - DNA, 15 bp, Homo sapiens
ggcactcattactgc

SEQ ID NO: 144303 - DNA, 15 bp, Homo sapiens
aggcactcattactg

SEQ ID NO: 144304 - DNA, 15 bp, Homo sapiens
taggcactcattact

SEQ ID NO: 144305 - DNA, 15 bp, Homo sapiens
ataggcactcattac

SEQ ID NO: 144306 - DNA, 15 bp, Homo sapiens
aataggcactcatta

SEQ ID NO: 144307 - DNA, 15 bp, Homo sapiens
aaataggcactcatt

SEQ ID NO: 144308 - DNA, 15 bp, Homo sapiens
caaataggcactcat

SEQ ID NO: 144309 - DNA, 15 bp, Homo sapiens
acaaataggcactca

SEQ ID NO: 144310 - DNA, 15 bp, Homo sapiens
cacaaataggcactc

SEQ ID NO: 144311 - DNA, 15 bp, Homo sapiens
ccacaaataggcact

SEQ ID NO: 144312 - DNA, 15 bp, Homo sapiens
accacaaataggcac

SEQ ID NO: 144313 - DNA, 15 bp, Homo sapiens
aaccacaaataggca

SEQ ID NO: 144314 - DNA, 15 bp, Homo sapiens
aaaccacaaataggc

SEQ ID NO: 144315 - DNA, 15 bp, Homo sapiens
taaaccacaaatagg

SEQ ID NO: 144316 - DNA, 15 bp, Homo sapiens
ataaaccacaaatag

SEQ ID NO: 144317 - DNA, 15 bp, Homo sapiens
tataaaccacaaata

SEQ ID NO: 144318 - DNA, 15 bp, Homo sapiens
atataaaccacaaat

SEQ ID NO: 144319 - DNA, 15 bp, Homo sapiens
aatataaaccacaaa

SEQ ID NO: 144320 - DNA, 15 bp, Homo sapiens
taatataaaccacaa

SEQ ID NO: 144321 - DNA, 15 bp, Homo sapiens
ataatataaaccaca

SEQ ID NO: 144322 - DNA, 15 bp, Homo sapiens
aataatataaaccac

SEQ ID NO: 144323 - DNA, 15 bp, Homo sapiens
taataatataaacca

SEQ ID NO: 144324 - DNA, 15 bp, Homo sapiens
ttaataatataaacc

SEQ ID NO: 144325 - DNA, 15 bp, Homo sapiens
tttaataatataaac

SEQ ID NO: 144326 - DNA, 15 bp, Homo sapiens
atttaataatataaa

SEQ ID NO: 144327 - DNA, 15 bp, Homo sapiens
catttaataatataa

SEQ ID NO: 144328 - DNA, 15 bp, Homo sapiens
acatttaataatata

SEQ ID NO: 144329 - DNA, 15 bp, Homo sapiens
tacatttaataatat

SEQ ID NO: 144330 - DNA, 15 bp, Homo sapiens
ttacatttaataata

SEQ ID NO: 144331 - DNA, 15 bp, Homo sapiens
cttacatttaataat

SEQ ID NO: 144332 - DNA, 15 bp, Homo sapiens
ccttacatttaataa

SEQ ID NO: 144333 - DNA, 15 bp, Homo sapiens
tccttacatttaata

SEQ ID NO: 144334 - DNA, 15 bp, Homo sapiens
ttccttacatttaat

SEQ ID NO: 144335 - DNA, 15 bp, Homo sapiens
tttccttacatttaa

SEQ ID NO: 144336 - DNA, 15 bp, Homo sapiens
ctttccttacattta

SEQ ID NO: 144337 - DNA, 15 bp, Homo sapiens
cctttccttacattt

SEQ ID NO: 144338 - DNA, 15 bp, Homo sapiens
acctttccttacatt

SEQ ID NO: 144339 - DNA, 15 bp, Homo sapiens
tacctttccttacat

SEQ ID NO: 144340 - DNA, 15 bp, Homo sapiens
ctacctttccttaca

SEQ ID NO: 144341 - DNA, 15 bp, Homo sapiens
gctacctttccttac

SEQ ID NO: 144342 - DNA, 15 bp, Homo sapiens
ggctacctttcctta

SEQ ID NO: 144343 - DNA, 15 bp, Homo sapiens
gggctacctttcctt

SEQ ID NO: 144344 - DNA, 15 bp, Homo sapiens
agggctacctttcct

SEQ ID NO: 144345 - DNA, 15 bp, Homo sapiens
cagggctacctttcc

SEQ ID NO: 144346 - DNA, 15 bp, Homo sapiens
acagggctacctttc

SEQ ID NO: 144347 - DNA, 15 bp, Homo sapiens
aacagggctaccttt

SEQ ID NO: 144348 - DNA, 15 bp, Homo sapiens
caacagggctacctt

SEQ ID NO: 144349 - DNA, 15 bp, Homo sapiens
tcaacagggctacct

SEQ ID NO: 144350 - DNA, 15 bp, Homo sapiens
ttcaacagggctacc

SEQ ID NO: 144351 - DNA, 15 bp, Homo sapiens
gttcaacagggctac

SEQ ID NO: 144352 - DNA, 15 bp, Homo sapiens
agttcaacagggcta

SEQ ID NO: 144353 - DNA, 15 bp, Homo sapiens
tagttcaacagggct

SEQ ID NO: 144354 - DNA, 15 bp, Homo sapiens
gtagttcaacagggc

SEQ ID NO: 144355 - DNA, 15 bp, Homo sapiens
agtagttcaacaggg

SEQ ID NO: 144356 - DNA, 15 bp, Homo sapiens
gagtagttcaacagg

SEQ ID NO: 144357 - DNA, 15 bp, Homo sapiens
agagtagttcaacag

SEQ ID NO: 144358 - DNA, 15 bp, Homo sapiens
aagagtagttcaaca

SEQ ID NO: 144359 - DNA, 15 bp, Homo sapiens
aaagagtagttcaac

SEQ ID NO: 144360 - DNA, 15 bp, Homo sapiens
taaagagtagttcaa

SEQ ID NO: 144361 - DNA, 15 bp, Homo sapiens
ttaaagagtagttca

SEQ ID NO: 144362 - DNA, 15 bp, Homo sapiens
attaaagagtagttc

SEQ ID NO: 144363 - DNA, 15 bp, Homo sapiens
tattaaagagtagtt

SEQ ID NO: 144364 - DNA, 15 bp, Homo sapiens
ctattaaagagtagt

SEQ ID NO: 144365 - DNA, 15 bp, Homo sapiens
gctattaaagagtag

SEQ ID NO: 144366 - DNA, 15 bp, Homo sapiens
tgctattaaagagta

SEQ ID NO: 144367 - DNA, 15 bp, Homo sapiens
atgctattaaagagt

SEQ ID NO: 144368 - DNA, 15 bp, Homo sapiens
aatgctattaaagag

SEQ ID NO: 144369 - DNA, 15 bp, Homo sapiens
gaatgctattaaaga

SEQ ID NO: 144370 - DNA, 15 bp, Homo sapiens
tgaatgctattaaag

SEQ ID NO: 144371 - DNA, 15 bp, Homo sapiens
atgaatgctattaaa

SEQ ID NO: 144372 - DNA, 15 bp, Homo sapiens
gatgaatgctattaa

SEQ ID NO: 144373 - DNA, 15 bp, Homo sapiens
agatgaatgctatta

SEQ ID NO: 144374 - DNA, 15 bp, Homo sapiens
tagatgaatgctatt

SEQ ID NO: 144375 - DNA, 15 bp, Homo sapiens
gtagatgaatgctat

SEQ ID NO: 144376 - DNA, 15 bp, Homo sapiens
agtagatgaatgcta

SEQ ID NO: 144377 - DNA, 15 bp, Homo sapiens
gagtagatgaatgct

SEQ ID NO: 144378 - DNA, 15 bp, Homo sapiens
tgagtagatgaatgc

SEQ ID NO: 144379 - DNA, 15 bp, Homo sapiens
ttgagtagatgaatg

SEQ ID NO: 144380 - DNA, 15 bp, Homo sapiens
attgagtagatgaat

SEQ ID NO: 144381 - DNA, 15 bp, Homo sapiens
cattgagtagatgaa

SEQ ID NO: 144382 - DNA, 15 bp, Homo sapiens
tcattgagtagatga

SEQ ID NO: 144383 - DNA, 15 bp, Homo sapiens
ctcattgagtagatg

SEQ ID NO: 144384 - DNA, 15 bp, Homo sapiens
cctcattgagtagat

SEQ ID NO: 144385 - DNA, 15 bp, Homo sapiens
gcctcattgagtaga

SEQ ID NO: 144386 - DNA, 15 bp, Homo sapiens
tgcctcattgagtag

SEQ ID NO: 144387 - DNA, 15 bp, Homo sapiens
ttgcctcattgagta

SEQ ID NO: 144388 - DNA, 15 bp, Homo sapiens
attgcctcattgagt

SEQ ID NO: 144389 - DNA, 15 bp, Homo sapiens
cattgcctcattgag

SEQ ID NO: 144390 - DNA, 15 bp, Homo sapiens
tcattgcctcattga

SEQ ID NO: 144391 - DNA, 15 bp, Homo sapiens
ttcattgcctcattg

SEQ ID NO: 144392 - DNA, 15 bp, Homo sapiens
cttcattgcctcatt

SEQ ID NO: 144393 - DNA, 15 bp, Homo sapiens
tcttcattgcctcat

SEQ ID NO: 144394 - DNA, 15 bp, Homo sapiens
ttcttcattgcctca

SEQ ID NO: 144395 - DNA, 15 bp, Homo sapiens
cttcttcattgcctc

SEQ ID NO: 144396 - DNA, 15 bp, Homo sapiens
tcttcttcattgcct

SEQ ID NO: 144397 - DNA, 15 bp, Homo sapiens
ttcttcttcattgcc

SEQ ID NO: 144398 - DNA, 15 bp, Homo sapiens
attcttcttcattgc

SEQ ID NO: 144399 - DNA, 15 bp, Homo sapiens
cattcttcttcattg

SEQ ID NO: 144400 - DNA, 15 bp, Homo sapiens
gcattcttcttcatt

SEQ ID NO: 144401 - DNA, 15 bp, Homo sapiens
tgcattcttcttcat

SEQ ID NO: 144402 - DNA, 15 bp, Homo sapiens
ctgcattcttcttca

SEQ ID NO: 144403 - DNA, 15 bp, Homo sapiens
tctgcattcttcttc

SEQ ID NO: 144404 - DNA, 15 bp, Homo sapiens
atctgcattcttctt

SEQ ID NO: 144405 - DNA, 15 bp, Homo sapiens
catctgcattcttct

SEQ ID NO: 144406 - DNA, 15 bp, Homo sapiens
ccatctgcattcttc

SEQ ID NO: 144407 - DNA, 15 bp, Homo sapiens
tccatctgcattctt

SEQ ID NO: 144408 - DNA, 15 bp, Homo sapiens
ttccatctgcattct

SEQ ID NO: 144409 - DNA, 15 bp, Homo sapiens
cttccatctgcattc

SEQ ID NO: 144410 - DNA, 15 bp, Homo sapiens
acttccatctgcatt

SEQ ID NO: 144411 - DNA, 15 bp, Homo sapiens
cacttccatctgcat

SEQ ID NO: 144412 - DNA, 15 bp, Homo sapiens
ccacttccatctgca

SEQ ID NO: 144413 - DNA, 15 bp, Homo sapiens
cccacttccatctgc

SEQ ID NO: 144414 - DNA, 15 bp, Homo sapiens
tcccacttccatctg

SEQ ID NO: 144415 - DNA, 15 bp, Homo sapiens
ctcccacttccatct

SEQ ID NO: 144416 - DNA, 15 bp, Homo sapiens
tctcccacttccatc

SEQ ID NO: 144417 - DNA, 15 bp, Homo sapiens
ttctcccacttccat

SEQ ID NO: 144418 - DNA, 15 bp, Homo sapiens
tttctcccacttcca

SEQ ID NO: 144419 - DNA, 15 bp, Homo sapiens
ctttctcccacttcc

SEQ ID NO: 144420 - DNA, 15 bp, Homo sapiens
tctttctcccacttc

SEQ ID NO: 144421 - DNA, 15 bp, Homo sapiens
atctttctcccactt

SEQ ID NO: 144422 - DNA, 15 bp, Homo sapiens
catctttctcccact

SEQ ID NO: 144423 - DNA, 15 bp, Homo sapiens
ccatctttctcccac

SEQ ID NO: 144424 - DNA, 15 bp, Homo sapiens
tccatctttctccca

SEQ ID NO: 144425 - DNA, 15 bp, Homo sapiens
ctccatctttctccc

SEQ ID NO: 144426 - DNA, 15 bp, Homo sapiens
gctccatctttctcc

SEQ ID NO: 144427 - DNA, 15 bp, Homo sapiens
tgctccatctttctc

SEQ ID NO: 144428 - DNA, 15 bp, Homo sapiens
ctgctccatctttct

SEQ ID NO: 144429 - DNA, 15 bp, Homo sapiens
cctgctccatctttc

SEQ ID NO: 144430 - DNA, 15 bp, Homo sapiens
ccctgctccatcttt

SEQ ID NO: 144431 - DNA, 15 bp, Homo sapiens
tccctgctccatctt

SEQ ID NO: 144432 - DNA, 15 bp, Homo sapiens
ttccctgctccatct

SEQ ID NO: 144433 - DNA, 15 bp, Homo sapiens
cttccctgctccatc

SEQ ID NO: 144434 - DNA, 15 bp, Homo sapiens
tcttccctgctccat

SEQ ID NO: 144435 - DNA, 15 bp, Homo sapiens
ctcttccctgctcca

SEQ ID NO: 144436 - DNA, 15 bp, Homo sapiens
actcttccctgctcc

SEQ ID NO: 144437 - DNA, 15 bp, Homo sapiens
tactcttccctgctc

SEQ ID NO: 144438 - DNA, 15 bp, Homo sapiens
ttactcttccctgct

SEQ ID NO: 144439 - DNA, 15 bp, Homo sapiens
cttactcttccctgc

SEQ ID NO: 144440 - DNA, 15 bp, Homo sapiens
tcttactcttccctg

SEQ ID NO: 144441 - DNA, 15 bp, Homo sapiens
atcttactcttccct

SEQ ID NO: 144442 - DNA, 15 bp, Homo sapiens
gatcttactcttccc

SEQ ID NO: 144443 - DNA, 15 bp, Homo sapiens
agatcttactcttcc

SEQ ID NO: 144444 - DNA, 15 bp, Homo sapiens
aagatcttactcttc

SEQ ID NO: 144445 - DNA, 15 bp, Homo sapiens
aaagatcttactctt

SEQ ID NO: 144446 - DNA, 15 bp, Homo sapiens
caaagatcttactct

SEQ ID NO: 144447 - DNA, 15 bp, Homo sapiens
ccaaagatcttactc

SEQ ID NO: 144448 - DNA, 15 bp, Homo sapiens
tccaaagatcttact

SEQ ID NO: 144449 - DNA, 15 bp, Homo sapiens
ttccaaagatcttac

SEQ ID NO: 144450 - DNA, 15 bp, Homo sapiens
tttccaaagatctta

SEQ ID NO: 144451 - DNA, 15 bp, Homo sapiens
atttccaaagatctt

SEQ ID NO: 144452 - DNA, 15 bp, Homo sapiens
catttccaaagatct

SEQ ID NO: 144453 - DNA, 15 bp, Homo sapiens
tcatttccaaagatc

SEQ ID NO: 144454 - DNA, 15 bp, Homo sapiens
ctcatttccaaagat

SEQ ID NO: 144455 - DNA, 15 bp, Homo sapiens
tctcatttccaaaga

SEQ ID NO: 144456 - DNA, 15 bp, Homo sapiens
ctctcatttccaaag

SEQ ID NO: 144457 - DNA, 15 bp, Homo sapiens
cctctcatttccaaa

SEQ ID NO: 144458 - DNA, 15 bp, Homo sapiens
tcctctcatttccaa

SEQ ID NO: 144459 - DNA, 15 bp, Homo sapiens
ctcctctcatttcca

SEQ ID NO: 144460 - DNA, 15 bp, Homo sapiens
tctcctctcatttcc

SEQ ID NO: 144461 - DNA, 15 bp, Homo sapiens
ttctcctctcatttc

SEQ ID NO: 144462 - DNA, 15 bp, Homo sapiens
tgttctcctctcatt

SEQ ID NO: 144463 - DNA, 15 bp, Homo sapiens
ctgttctcctctcat

SEQ ID NO: 144464 - DNA, 15 bp, Homo sapiens
cctgttctcctctca

SEQ ID NO: 144465 - DNA, 15 bp, Homo sapiens
tcctgttctcctctc

SEQ ID NO: 144466 - DNA, 15 bp, Homo sapiens
atcctgttctcctct

SEQ ID NO: 144467 - DNA, 15 bp, Homo sapiens
aatcctgttctcctc

SEQ ID NO: 144468 - DNA, 15 bp, Homo sapiens
caatcctgttctcct

SEQ ID NO: 144469 - DNA, 15 bp, Homo sapiens
gcaatcctgttctcc

SEQ ID NO: 144470 - DNA, 15 bp, Homo sapiens
ggcaatcctgttctc

SEQ ID NO: 144471 - DNA, 15 bp, Homo sapiens
aggcaatcctgttct

SEQ ID NO: 144472 - DNA, 15 bp, Homo sapiens
caggcaatcctgttc

SEQ ID NO: 144473 - DNA, 15 bp, Homo sapiens
acaggcaatcctgtt

SEQ ID NO: 144474 - DNA, 15 bp, Homo sapiens
cacaggcaatcctgt

SEQ ID NO: 144475 - DNA, 15 bp, Homo sapiens
ccacaggcaatcctg

SEQ ID NO: 144476 - DNA, 15 bp, Homo sapiens
accacaggcaatcct

SEQ ID NO: 144477 - DNA, 15 bp, Homo sapiens
gaccacaggcaatcc

SEQ ID NO: 144478 - DNA, 15 bp, Homo sapiens
ggaccacaggcaatc

SEQ ID NO: 144479 - DNA, 15 bp, Homo sapiens
tggaccacaggcaat

SEQ ID NO: 144480 - DNA, 15 bp, Homo sapiens
atggaccacaggcaa

SEQ ID NO: 144481 - DNA, 15 bp, Homo sapiens
tatggaccacaggca

SEQ ID NO: 144482 - DNA, 15 bp, Homo sapiens
ttatggaccacaggc

SEQ ID NO: 144483 - DNA, 15 bp, Homo sapiens
attatggaccacagg

SEQ ID NO: 144484 - DNA, 15 bp, Homo sapiens
tattatggaccacag

SEQ ID NO: 144485 - DNA, 15 bp, Homo sapiens
ctattatggaccaca

SEQ ID NO: 144486 - DNA, 15 bp, Homo sapiens
actattatggaccac

SEQ ID NO: 144487 - DNA, 15 bp, Homo sapiens
cactattatggacca

SEQ ID NO: 144488 - DNA, 15 bp, Homo sapiens
acactattatggacc

SEQ ID NO: 144489 - DNA, 15 bp, Homo sapiens
gacactattatggac

SEQ ID NO: 144490 - DNA, 15 bp, Homo sapiens
agacactattatgga

SEQ ID NO: 144491 - DNA, 15 bp, Homo sapiens
tagacactattatgg

SEQ ID NO: 144492 - DNA, 15 bp, Homo sapiens
ttagacactattatg

SEQ ID NO: 144493 - DNA, 15 bp, Homo sapiens
attagacactattat

SEQ ID NO: 144494 - DNA, 15 bp, Homo sapiens
cattagacactatta

SEQ ID NO: 144495 - DNA, 15 bp, Homo sapiens
acattagacactatt

SEQ ID NO: 144496 - DNA, 15 bp, Homo sapiens
cacattagacactat

SEQ ID NO: 144497 - DNA, 15 bp, Homo sapiens
acacattagacacta

SEQ ID NO: 144498 - DNA, 15 bp, Homo sapiens
gacacattagacact

SEQ ID NO: 144499 - DNA, 15 bp, Homo sapiens
ggacacattagacac

SEQ ID NO: 144500 - DNA, 15 bp, Homo sapiens
gggacacattagaca

SEQ ID NO: 144501 - DNA, 15 bp, Homo sapiens
agggacacattagac

SEQ ID NO: 144502 - DNA, 15 bp, Homo sapiens
aagggacacattaga

SEQ ID NO: 144503 - DNA, 15 bp, Homo sapiens
aaagggacacattag

SEQ ID NO: 144504 - DNA, 15 bp, Homo sapiens
gaaagggacacatta

SEQ ID NO: 144505 - DNA, 15 bp, Homo sapiens
agaaagggacacatt

SEQ ID NO: 144506 - DNA, 15 bp, Homo sapiens
gagaaagggacacat

SEQ ID NO: 144507 - DNA, 15 bp, Homo sapiens
agagaaagggacaca

SEQ ID NO: 144508 - DNA, 15 bp, Homo sapiens
cagagaaagggacac

SEQ ID NO: 144509 - DNA, 15 bp, Homo sapiens
ccagagaaagggaca

SEQ ID NO: 144510 - DNA, 15 bp, Homo sapiens
cccagagaaagggac

SEQ ID NO: 144511 - DNA, 15 bp, Homo sapiens
acccagagaaaggga

SEQ ID NO: 144512 - DNA, 15 bp, Homo sapiens
cacccagagaaaggg

SEQ ID NO: 144513 - DNA, 15 bp, Homo sapiens
ccacccagagaaagg

SEQ ID NO: 144514 - DNA, 15 bp, Homo sapiens
accacccagagaaag

SEQ ID NO: 144515 - DNA, 15 bp, Homo sapiens
caccacccagagaaa

SEQ ID NO: 144516 - DNA, 15 bp, Homo sapiens
acaccacccagagaa

SEQ ID NO: 144517 - DNA, 15 bp, Homo sapiens
gacaccacccagaga

SEQ ID NO: 144518 - DNA, 15 bp, Homo sapiens
tgacaccacccagag

SEQ ID NO: 144519 - DNA, 15 bp, Homo sapiens
atgacaccacccaga

SEQ ID NO: 144520 - DNA, 15 bp, Homo sapiens
aatgacaccacccag

SEQ ID NO: 144521 - DNA, 15 bp, Homo sapiens
gaatgacaccaccca

SEQ ID NO: 144522 - DNA, 15 bp, Homo sapiens
ggaatgacaccaccc

SEQ ID NO: 144523 - DNA, 15 bp, Homo sapiens
aggaatgacaccacc

SEQ ID NO: 144524 - DNA, 15 bp, Homo sapiens
gaggaatgacaccac

SEQ ID NO: 144525 - DNA, 15 bp, Homo sapiens
tgaggaatgacacca

SEQ ID NO: 144526 - DNA, 15 bp, Homo sapiens
gtgaggaatgacacc

SEQ ID NO: 144527 - DNA, 15 bp, Homo sapiens
agtgaggaatgacac

SEQ ID NO: 144528 - DNA, 15 bp, Homo sapiens
tagtgaggaatgaca

SEQ ID NO: 144529 - DNA, 15 bp, Homo sapiens
ctagtgaggaatgac

SEQ ID NO: 144530 - DNA, 15 bp, Homo sapiens
tctagtgaggaatga

SEQ ID NO: 144531 - DNA, 15 bp, Homo sapiens
ctctagtgaggaatg

SEQ ID NO: 144532 - DNA, 15 bp, Homo sapiens
gctctagtgaggaat

SEQ ID NO: 144533 - DNA, 15 bp, Homo sapiens
agctctagtgaggaa

SEQ ID NO: 144534 - DNA, 15 bp, Homo sapiens
tagctctagtgagga

SEQ ID NO: 144535 - DNA, 15 bp, Homo sapiens
atagctctagtgagg

SEQ ID NO: 144536 - DNA, 15 bp, Homo sapiens
catagctctagtgag

SEQ ID NO: 144537 - DNA, 15 bp, Homo sapiens
ccatagctctagtga

SEQ ID NO: 144538 - DNA, 15 bp, Homo sapiens
gccatagctctagtg

SEQ ID NO: 144539 - DNA, 15 bp, Homo sapiens
agccatagctctagt

SEQ ID NO: 144540 - DNA, 15 bp, Homo sapiens
aagccatagctctag

SEQ ID NO: 144541 - DNA, 15 bp, Homo sapiens
caagccatagctcta

SEQ ID NO: 144542 - DNA, 15 bp, Homo sapiens
ccaagccatagctct

SEQ ID NO: 144543 - DNA, 15 bp, Homo sapiens
gccaagccatagctc

SEQ ID NO: 144544 - DNA, 15 bp, Homo sapiens
tgccaagccatagct

SEQ ID NO: 144545 - DNA, 15 bp, Homo sapiens
ttgccaagccatagc

SEQ ID NO: 144546 - DNA, 15 bp, Homo sapiens
tttgccaagccatag

SEQ ID NO: 144547 - DNA, 15 bp, Homo sapiens
gtttgccaagccata

SEQ ID NO: 144548 - DNA, 15 bp, Homo sapiens
tgtttgccaagccat

SEQ ID NO: 144549 - DNA, 15 bp, Homo sapiens
ctgtttgccaagcca

SEQ ID NO: 144550 - DNA, 15 bp, Homo sapiens
tctgtttgccaagcc

SEQ ID NO: 144551 - DNA, 15 bp, Homo sapiens
gtctgtttgccaagc

SEQ ID NO: 144552 - DNA, 15 bp, Homo sapiens
ggtctgtttgccaag

SEQ ID NO: 144553 - DNA, 15 bp, Homo sapiens
aggtctgtttgccaa

SEQ ID NO: 144554 - DNA, 15 bp, Homo sapiens
aaggtctgtttgcca

SEQ ID NO: 144555 - DNA, 15 bp, Homo sapiens
taaggtctgtttgcc

SEQ ID NO: 144556 - DNA, 15 bp, Homo sapiens
ttaaggtctgtttgc

SEQ ID NO: 144557 - DNA, 15 bp, Homo sapiens
cttaaggtctgtttg

SEQ ID NO: 144558 - DNA, 15 bp, Homo sapiens
acttaaggtctgttt

SEQ ID NO: 144559 - DNA, 15 bp, Homo sapiens
aacttaaggtctgtt

SEQ ID NO: 144560 - DNA, 15 bp, Homo sapiens
caacttaaggtctgt

SEQ ID NO: 144561 - DNA, 15 bp, Homo sapiens
ccaacttaaggtctg

SEQ ID NO: 144562 - DNA, 15 bp, Homo sapiens
tccaacttaaggtct

SEQ ID NO: 144563 - DNA, 15 bp, Homo sapiens
atccaacttaaggtc

SEQ ID NO: 144564 - DNA, 15 bp, Homo sapiens
aatccaacttaaggt

SEQ ID NO: 144565 - DNA, 15 bp, Homo sapiens
aaatccaacttaagg

SEQ ID NO: 144566 - DNA, 15 bp, Homo sapiens
gaaatccaacttaag

SEQ ID NO: 144567 - DNA, 15 bp, Homo sapiens
tgaaatccaacttaa

SEQ ID NO: 144568 - DNA, 15 bp, Homo sapiens
ttgaaatccaactta

SEQ ID NO: 144569 - DNA, 15 bp, Homo sapiens
tttgaaatccaactt

SEQ ID NO: 144570 - DNA, 15 bp, Homo sapiens
gtttgaaatccaact

SEQ ID NO: 144571 - DNA, 15 bp, Homo sapiens
agtttgaaatccaac

SEQ ID NO: 144572 - DNA, 15 bp, Homo sapiens
aagtttgaaatccaa

SEQ ID NO: 144573 - DNA, 15 bp, Homo sapiens
gaagtttgaaatcca

SEQ ID NO: 144574 - DNA, 15 bp, Homo sapiens
tgaagtttgaaatcc

SEQ ID NO: 144575 - DNA, 15 bp, Homo sapiens
gtgaagtttgaaatc

SEQ ID NO: 144576 - DNA, 15 bp, Homo sapiens
agtgaagtttgaaat

SEQ ID NO: 144577 - DNA, 15 bp, Homo sapiens
aagtgaagtttgaaa

SEQ ID NO: 144578 - DNA, 15 bp, Homo sapiens
gaagtgaagtttgaa

SEQ ID NO: 144579 - DNA, 15 bp, Homo sapiens
ggaagtgaagtttga

SEQ ID NO: 144580 - DNA, 15 bp, Homo sapiens
aggaagtgaagtttg

SEQ ID NO: 144581 - DNA, 15 bp, Homo sapiens
gaggaagtgaagttt

SEQ ID NO: 144582 - DNA, 15 bp, Homo sapiens
tgaggaagtgaagtt

SEQ ID NO: 144583 - DNA, 15 bp, Homo sapiens
atgaggaagtgaagt

SEQ ID NO: 144584 - DNA, 15 bp, Homo sapiens
aatgaggaagtgaag

SEQ ID NO: 144585 - DNA, 15 bp, Homo sapiens
caatgaggaagtgaa

SEQ ID NO: 144586 - DNA, 15 bp, Homo sapiens
tcaatgaggaagtga

SEQ ID NO: 144587 - DNA, 15 bp, Homo sapiens
ctcaatgaggaagtg

SEQ ID NO: 144588 - DNA, 15 bp, Homo sapiens
cctcaatgaggaagt

SEQ ID NO: 144589 - DNA, 15 bp, Homo sapiens
gcctcaatgaggaag

SEQ ID NO: 144590 - DNA, 15 bp, Homo sapiens
tgcctcaatgaggaa

SEQ ID NO: 144591 - DNA, 15 bp, Homo sapiens
ctgcctcaatgagga

SEQ ID NO: 144592 - DNA, 15 bp, Homo sapiens
actgcctcaatgagg

SEQ ID NO: 144593 - DNA, 15 bp, Homo sapiens
cactgcctcaatgag

SEQ ID NO: 144594 - DNA, 15 bp, Homo sapiens
ccactgcctcaatga

SEQ ID NO: 144595 - DNA, 15 bp, Homo sapiens
accactgcctcaatg

SEQ ID NO: 144596 - DNA, 15 bp, Homo sapiens
gaccactgcctcaat

SEQ ID NO: 144597 - DNA, 15 bp, Homo sapiens
tgaccactgcctcaa

SEQ ID NO: 144598 - DNA, 15 bp, Homo sapiens
ttgaccactgcctca

SEQ ID NO: 144599 - DNA, 15 bp, Homo sapiens
gttgaccactgcctc

SEQ ID NO: 144600 - DNA, 15 bp, Homo sapiens
ggttgaccactgcct

SEQ ID NO: 144601 - DNA, 15 bp, Homo sapiens
aggttgaccactgcc

SEQ ID NO: 144602 - DNA, 15 bp, Homo sapiens
gaggttgaccactgc

SEQ ID NO: 144603 - DNA, 15 bp, Homo sapiens
agaggttgaccactg

SEQ ID NO: 144604 - DNA, 15 bp, Homo sapiens
tagaggttgaccact

SEQ ID NO: 144605 - DNA, 15 bp, Homo sapiens
atagaggttgaccac

SEQ ID NO: 144606 - DNA, 15 bp, Homo sapiens
tatagaggttgacca

SEQ ID NO: 144607 - DNA, 15 bp, Homo sapiens
atatagaggttgacc

SEQ ID NO: 144608 - DNA, 15 bp, Homo sapiens
tatatagaggttgac

SEQ ID NO: 144609 - DNA, 15 bp, Homo sapiens
gtatatagaggttga

SEQ ID NO: 144610 - DNA, 15 bp, Homo sapiens
tgtatatagaggttg

SEQ ID NO: 144611 - DNA, 15 bp, Homo sapiens
ctgtatatagaggtt

SEQ ID NO: 144612 - DNA, 15 bp, Homo sapiens
actgtatatagaggt

SEQ ID NO: 144613 - DNA, 15 bp, Homo sapiens
cactgtatatagagg

SEQ ID NO: 144614 - DNA, 15 bp, Homo sapiens
gcactgtatatagag

SEQ ID NO: 144615 - DNA, 15 bp, Homo sapiens
ggcactgtatataga

SEQ ID NO: 144616 - DNA, 15 bp, Homo sapiens
gggcactgtatatag

SEQ ID NO: 144617 - DNA, 15 bp, Homo sapiens
ggggcactgtatata

SEQ ID NO: 144618 - DNA, 15 bp, Homo sapiens
aggggcactgtatat

SEQ ID NO: 144619 - DNA, 15 bp, Homo sapiens
caggggcactgtata

SEQ ID NO: 144620 - DNA, 15 bp, Homo sapiens
tcaggggcactgtat

SEQ ID NO: 144621 - DNA, 15 bp, Homo sapiens
ttcaggggcactgta

SEQ ID NO: 144622 - DNA, 15 bp, Homo sapiens
gttcaggggcactgt

SEQ ID NO: 144623 - DNA, 15 bp, Homo sapiens
ggttcaggggcactg

SEQ ID NO: 144624 - DNA, 15 bp, Homo sapiens
aggttcaggggcact

SEQ ID NO: 144625 - DNA, 15 bp, Homo sapiens
caggttcaggggcac

SEQ ID NO: 144626 - DNA, 15 bp, Homo sapiens
tcaggttcaggggca

SEQ ID NO: 144627 - DNA, 15 bp, Homo sapiens
ttcaggttcaggggc

SEQ ID NO: 144628 - DNA, 15 bp, Homo sapiens
cttcaggttcagggg

SEQ ID NO: 144629 - DNA, 15 bp, Homo sapiens
gcttcaggttcaggg

SEQ ID NO: 144630 - DNA, 15 bp, Homo sapiens
agcttcaggttcagg

SEQ ID NO: 144631 - DNA, 15 bp, Homo sapiens
gagcttcaggttcag

SEQ ID NO: 144632 - DNA, 15 bp, Homo sapiens
tgagcttcaggttca

SEQ ID NO: 144633 - DNA, 15 bp, Homo sapiens
ctgagcttcaggttc

SEQ ID NO: 144634 - DNA, 15 bp, Homo sapiens
actgagcttcaggtt

SEQ ID NO: 144635 - DNA, 15 bp, Homo sapiens
tactgagcttcaggt

SEQ ID NO: 144636 - DNA, 15 bp, Homo sapiens
atactgagcttcagg

SEQ ID NO: 144637 - DNA, 15 bp, Homo sapiens
tatactgagcttcag

SEQ ID NO: 144638 - DNA, 15 bp, Homo sapiens
ctatactgagcttca

SEQ ID NO: 144639 - DNA, 15 bp, Homo sapiens
cctatactgagcttc

SEQ ID NO: 144640 - DNA, 15 bp, Homo sapiens
tcctatactgagctt

SEQ ID NO: 144641 - DNA, 15 bp, Homo sapiens
ttcctatactgagct

SEQ ID NO: 144642 - DNA, 15 bp, Homo sapiens
gttcctatactgagc

SEQ ID NO: 144643 - DNA, 15 bp, Homo sapiens
tgttcctatactgag

SEQ ID NO: 144644 - DNA, 15 bp, Homo sapiens
ctgttcctatactga

SEQ ID NO: 144645 - DNA, 15 bp, Homo sapiens
tctgttcctatactg

SEQ ID NO: 144646 - DNA, 15 bp, Homo sapiens
ctctgttcctatact

SEQ ID NO: 144647 - DNA, 15 bp, Homo sapiens
actctgttcctatac

SEQ ID NO: 144648 - DNA, 15 bp, Homo sapiens
cactctgttcctata

SEQ ID NO: 144649 - DNA, 15 bp, Homo sapiens
ccactctgttcctat

SEQ ID NO: 144650 - DNA, 15 bp, Homo sapiens
tccactctgttccta

SEQ ID NO: 144651 - DNA, 15 bp, Homo sapiens
atccactctgttcct

SEQ ID NO: 144652 - DNA, 15 bp, Homo sapiens
tatccactctgttcc

SEQ ID NO: 144653 - DNA, 15 bp, Homo sapiens
gtatccactctgttc

SEQ ID NO: 144654 - DNA, 15 bp, Homo sapiens
tgtatccactctgtt

SEQ ID NO: 144655 - DNA, 15 bp, Homo sapiens
atgtatccactctgt

SEQ ID NO: 144656 - DNA, 15 bp, Homo sapiens
catgtatccactctg

SEQ ID NO: 144657 - DNA, 15 bp, Homo sapiens
acatgtatccactct

SEQ ID NO: 144658 - DNA, 15 bp, Homo sapiens
cacatgtatccactc

SEQ ID NO: 144659 - DNA, 15 bp, Homo sapiens
acacatgtatccact

SEQ ID NO: 144660 - DNA, 15 bp, Homo sapiens
aacacatgtatccac

SEQ ID NO: 144661 - DNA, 15 bp, Homo sapiens
caacacatgtatcca

SEQ ID NO: 144662 - DNA, 15 bp, Homo sapiens
acaacacatgtatcc

SEQ ID NO: 144663 - DNA, 15 bp, Homo sapiens
cacaacacatgtatc

SEQ ID NO: 144664 - DNA, 15 bp, Homo sapiens
gcacaacacatgtat

SEQ ID NO: 144665 - DNA, 15 bp, Homo sapiens
agcacaacacatgta

SEQ ID NO: 144666 - DNA, 15 bp, Homo sapiens
aagcacaacacatgt

SEQ ID NO: 144667 - DNA, 15 bp, Homo sapiens
aaagcacaacacatg

SEQ ID NO: 144668 - DNA, 15 bp, Homo sapiens
gaaagcacaacacat

SEQ ID NO: 144669 - DNA, 15 bp, Homo sapiens
agaaagcacaacaca

SEQ ID NO: 144670 - DNA, 15 bp, Homo sapiens
tagaaagcacaacac

SEQ ID NO: 144671 - DNA, 15 bp, Homo sapiens
gtagaaagcacaaca

SEQ ID NO: 144672 - DNA, 15 bp, Homo sapiens
tgtagaaagcacaac

SEQ ID NO: 144673 - DNA, 15 bp, Homo sapiens
ctgtagaaagcacaa

SEQ ID NO: 144674 - DNA, 15 bp, Homo sapiens
actgtagaaagcaca

SEQ ID NO: 144675 - DNA, 15 bp, Homo sapiens
cactgtagaaagcac

SEQ ID NO: 144676 - DNA, 15 bp, Homo sapiens
ccactgtagaaagca

SEQ ID NO: 144677 - DNA, 15 bp, Homo sapiens
cccactgtagaaagc

SEQ ID NO: 144678 - DNA, 15 bp, Homo sapiens
tcccactgtagaaag

SEQ ID NO: 144679 - DNA, 15 bp, Homo sapiens
atcccactgtagaaa

SEQ ID NO: 144680 - DNA, 15 bp, Homo sapiens
aatcccactgtagaa

SEQ ID NO: 144681 - DNA, 15 bp, Homo sapiens
aaatcccactgtaga

SEQ ID NO: 144682 - DNA, 15 bp, Homo sapiens
aaaatcccactgtag

SEQ ID NO: 144683 - DNA, 15 bp, Homo sapiens
caaaatcccactgta

SEQ ID NO: 144684 - DNA, 15 bp, Homo sapiens
gcaaaatcccactgt

SEQ ID NO: 144685 - DNA, 15 bp, Homo sapiens
ggcaaaatcccactg

SEQ ID NO: 144686 - DNA, 15 bp, Homo sapiens
aggcaaaatcccact

SEQ ID NO: 144687 - DNA, 15 bp, Homo sapiens
caggcaaaatcccac

SEQ ID NO: 144688 - DNA, 15 bp, Homo sapiens
ccaggcaaaatccca

SEQ ID NO: 144689 - DNA, 15 bp, Homo sapiens
tccaggcaaaatccc

SEQ ID NO: 144690 - DNA, 15 bp, Homo sapiens
ttccaggcaaaatcc

SEQ ID NO: 144691 - DNA, 15 bp, Homo sapiens
cttccaggcaaaatc

SEQ ID NO: 144692 - DNA, 15 bp, Homo sapiens
tcttccaggcaaaat

SEQ ID NO: 144693 - DNA, 15 bp, Homo sapiens
atcttccaggcaaaa

SEQ ID NO: 144694 - DNA, 15 bp, Homo sapiens
catcttccaggcaaa

SEQ ID NO: 144695 - DNA, 15 bp, Homo sapiens
ccatcttccaggcaa

SEQ ID NO: 144696 - DNA, 15 bp, Homo sapiens
cccatcttccaggca

SEQ ID NO: 144697 - DNA, 15 bp, Homo sapiens
acccatcttccaggc

SEQ ID NO: 144698 - DNA, 15 bp, Homo sapiens
cacccatcttccagg

SEQ ID NO: 144699 - DNA, 15 bp, Homo sapiens
tcacccatcttccag

SEQ ID NO: 144700 - DNA, 15 bp, Homo sapiens
ttcacccatcttcca

SEQ ID NO: 144701 - DNA, 15 bp, Homo sapiens
gttcacccatcttcc

SEQ ID NO: 144702 - DNA, 15 bp, Homo sapiens
tgttcacccatcttc

SEQ ID NO: 144703 - DNA, 15 bp, Homo sapiens
ttgttcacccatctt

SEQ ID NO: 144704 - DNA, 15 bp, Homo sapiens
attgttcacccatct

SEQ ID NO: 144705 - DNA, 15 bp, Homo sapiens
tattgttcacccatc

SEQ ID NO: 144706 - DNA, 15 bp, Homo sapiens
ttattgttcacccat

SEQ ID NO: 144707 - DNA, 15 bp, Homo sapiens
gttattgttcaccca

SEQ ID NO: 144708 - DNA, 15 bp, Homo sapiens
ggttattgttcaccc

SEQ ID NO: 144709 - DNA, 15 bp, Homo sapiens
aggttattgttcacc

SEQ ID NO: 144710 - DNA, 15 bp, Homo sapiens
caggttattgttcac

SEQ ID NO: 144711 - DNA, 15 bp, Homo sapiens
ccaggttattgttca

SEQ ID NO: 144712 - DNA, 15 bp, Homo sapiens
tccaggttattgttc

SEQ ID NO: 144713 - DNA, 15 bp, Homo sapiens
ctccaggttattgtt

SEQ ID NO: 144714 - DNA, 15 bp, Homo sapiens
cctccaggttattgt

SEQ ID NO: 144715 - DNA, 15 bp, Homo sapiens
acctccaggttattg

SEQ ID NO: 144716 - DNA, 15 bp, Homo sapiens
tacctccaggttatt

SEQ ID NO: 144717 - DNA, 15 bp, Homo sapiens
ctacctccaggttat

SEQ ID NO: 144718 - DNA, 15 bp, Homo sapiens
gctacctccaggtta

SEQ ID NO: 144719 - DNA, 15 bp, Homo sapiens
tgctacctccaggtt

SEQ ID NO: 144720 - DNA, 15 bp, Homo sapiens
ctgctacctccaggt

SEQ ID NO: 144721 - DNA, 15 bp, Homo sapiens
actgctacctccagg

SEQ ID NO: 144722 - DNA, 15 bp, Homo sapiens
cactgctacctccag

SEQ ID NO: 144723 - DNA, 15 bp, Homo sapiens
ccactgctacctcca

SEQ ID NO: 144724 - DNA, 15 bp, Homo sapiens
cccactgctacctcc

SEQ ID NO: 144725 - DNA, 15 bp, Homo sapiens
ccccactgctacctc

SEQ ID NO: 144726 - DNA, 15 bp, Homo sapiens
tccccactgctacct

SEQ ID NO: 144727 - DNA, 15 bp, Homo sapiens
ctccccactgctacc

SEQ ID NO: 144728 - DNA, 15 bp, Homo sapiens
gctccccactgctac

SEQ ID NO: 144729 - DNA, 15 bp, Homo sapiens
tgctccccactgcta

SEQ ID NO: 144730 - DNA, 15 bp, Homo sapiens
ctgctccccactgct

SEQ ID NO: 144731 - DNA, 15 bp, Homo sapiens
cctgctccccactgc

SEQ ID NO: 144732 - DNA, 15 bp, Homo sapiens
ccctgctccccactg

SEQ ID NO: 144733 - DNA, 15 bp, Homo sapiens
tccctgctccccact

SEQ ID NO: 144734 - DNA, 15 bp, Homo sapiens
ctccctgctccccac

SEQ ID NO: 144735 - DNA, 15 bp, Homo sapiens
cctccctgctcccca

SEQ ID NO: 144736 - DNA, 15 bp, Homo sapiens
tcctccctgctcccc

SEQ ID NO: 144737 - DNA, 15 bp, Homo sapiens
gtcctccctgctccc

SEQ ID NO: 144738 - DNA, 15 bp, Homo sapiens
ggtcctccctgctcc

SEQ ID NO: 144739 - DNA, 15 bp, Homo sapiens
gggtcctccctgctc

SEQ ID NO: 144740 - DNA, 15 bp, Homo sapiens
agggtcctccctgct

SEQ ID NO: 144741 - DNA, 15 bp, Homo sapiens
aagggtcctccctgc

SEQ ID NO: 144742 - DNA, 15 bp, Homo sapiens
taagggtcctccctg

SEQ ID NO: 144743 - DNA, 15 bp, Homo sapiens
ataagggtcctccct

SEQ ID NO: 144744 - DNA, 15 bp, Homo sapiens
aataagggtcctccc

SEQ ID NO: 144745 - DNA, 15 bp, Homo sapiens
gaataagggtcctcc

SEQ ID NO: 144746 - DNA, 15 bp, Homo sapiens
ggaataagggtcctc

SEQ ID NO: 144747 - DNA, 15 bp, Homo sapiens
tggaataagggtcct

SEQ ID NO: 144748 - DNA, 15 bp, Homo sapiens
ctggaataagggtcc

SEQ ID NO: 144749 - DNA, 15 bp, Homo sapiens
gctggaataagggtc

SEQ ID NO: 144750 - DNA, 15 bp, Homo sapiens
agctggaataagggt

SEQ ID NO: 144751 - DNA, 15 bp, Homo sapiens
aagctggaataaggg

SEQ ID NO: 144752 - DNA, 15 bp, Homo sapiens
gaagctggaataagg

SEQ ID NO: 144753 - DNA, 15 bp, Homo sapiens
agaagctggaataag

SEQ ID NO: 144754 - DNA, 15 bp, Homo sapiens
gagaagctggaataa

SEQ ID NO: 144755 - DNA, 15 bp, Homo sapiens
tgagaagctggaata

SEQ ID NO: 144756 - DNA, 15 bp, Homo sapiens
ttgagaagctggaat

SEQ ID NO: 144757 - DNA, 15 bp, Homo sapiens
tttgagaagctggaa

SEQ ID NO: 144758 - DNA, 15 bp, Homo sapiens
gtttgagaagctgga

SEQ ID NO: 144759 - DNA, 15 bp, Homo sapiens
agtttgagaagctgg

SEQ ID NO: 144760 - DNA, 15 bp, Homo sapiens
cagtttgagaagctg

SEQ ID NO: 144761 - DNA, 15 bp, Homo sapiens
tcagtttgagaagct

SEQ ID NO: 144762 - DNA, 15 bp, Homo sapiens
ctcagtttgagaagc

SEQ ID NO: 144763 - DNA, 15 bp, Homo sapiens
cctcagtttgagaag

SEQ ID NO: 144764 - DNA, 15 bp, Homo sapiens
gcctcagtttgagaa

SEQ ID NO: 144765 - DNA, 15 bp, Homo sapiens
tgcctcagtttgaga

SEQ ID NO: 144766 - DNA, 15 bp, Homo sapiens
atgcctcagtttgag

SEQ ID NO: 144767 - DNA, 15 bp, Homo sapiens
tatgcctcagtttga

SEQ ID NO: 144768 - DNA, 15 bp, Homo sapiens
ttatgcctcagtttg

SEQ ID NO: 144769 - DNA, 15 bp, Homo sapiens
tttatgcctcagttt

SEQ ID NO: 144770 - DNA, 15 bp, Homo sapiens
ctttatgcctcagtt

SEQ ID NO: 144771 - DNA, 15 bp, Homo sapiens
cctttatgcctcagt

SEQ ID NO: 144772 - DNA, 15 bp, Homo sapiens
tcctttatgcctcag

SEQ ID NO: 144773 - DNA, 15 bp, Homo sapiens
atcctttatgcctca

SEQ ID NO: 144774 - DNA, 15 bp, Homo sapiens
gatcctttatgcctc

SEQ ID NO: 144775 - DNA, 15 bp, Homo sapiens
agatcctttatgcct

SEQ ID NO: 144776 - DNA, 15 bp, Homo sapiens
cagatcctttatgcc

SEQ ID NO: 144777 - DNA, 15 bp, Homo sapiens
tcagatcctttatgc

SEQ ID NO: 144778 - DNA, 15 bp, Homo sapiens
ctcagatcctttatg

SEQ ID NO: 144779 - DNA, 15 bp, Homo sapiens
tctcagatcctttat

SEQ ID NO: 144780 - DNA, 15 bp, Homo sapiens
ctctcagatccttta

SEQ ID NO: 144781 - DNA, 15 bp, Homo sapiens
tctctcagatccttt

SEQ ID NO: 144782 - DNA, 15 bp, Homo sapiens
ttctctcagatcctt

SEQ ID NO: 144783 - DNA, 15 bp, Homo sapiens
tttctctcagatcct

SEQ ID NO: 144784 - DNA, 15 bp, Homo sapiens
ttttctctcagatcc

SEQ ID NO: 144785 - DNA, 15 bp, Homo sapiens
tttttctctcagatc

SEQ ID NO: 144786 - DNA, 15 bp, Homo sapiens
ctttttctctcagat

SEQ ID NO: 144787 - DNA, 15 bp, Homo sapiens
cctttttctctcaga

SEQ ID NO: 144788 - DNA, 15 bp, Homo sapiens
tcctttttctctcag

SEQ ID NO: 144789 - DNA, 15 bp, Homo sapiens
ttcctttttctctca

SEQ ID NO: 144790 - DNA, 15 bp, Homo sapiens
tttcctttttctctc

SEQ ID NO: 144791 - DNA, 15 bp, Homo sapiens
ttttcctttttctct

SEQ ID NO: 144792 - DNA, 15 bp, Homo sapiens
cttttcctttttctc

SEQ ID NO: 144793 - DNA, 15 bp, Homo sapiens
tcttttcctttttct

SEQ ID NO: 144794 - DNA, 15 bp, Homo sapiens
gtcttttcctttttc

SEQ ID NO: 144795 - DNA, 15 bp, Homo sapiens
agtcttttccttttt

SEQ ID NO: 144796 - DNA, 15 bp, Homo sapiens
aagtcttttcctttt

SEQ ID NO: 144797 - DNA, 15 bp, Homo sapiens
gaagtcttttccttt

SEQ ID NO: 144798 - DNA, 15 bp, Homo sapiens
tgaagtcttttcctt

SEQ ID NO: 144799 - DNA, 15 bp, Homo sapiens
atgaagtcttttcct

SEQ ID NO: 144800 - DNA, 15 bp, Homo sapiens
catgaagtcttttcc

SEQ ID NO: 144801 - DNA, 15 bp, Homo sapiens
tcatgaagtcttttc

SEQ ID NO: 144802 - DNA, 15 bp, Homo sapiens
ttcatgaagtctttt

SEQ ID NO: 144803 - DNA, 15 bp, Homo sapiens
tttcatgaagtcttt

SEQ ID NO: 144804 - DNA, 15 bp, Homo sapiens
ttttcatgaagtctt

SEQ ID NO: 144805 - DNA, 15 bp, Homo sapiens
cttttcatgaagtct

SEQ ID NO: 144806 - DNA, 15 bp, Homo sapiens
acttttcatgaagtc

SEQ ID NO: 144807 - DNA, 15 bp, Homo sapiens
aacttttcatgaagt

SEQ ID NO: 144808 - DNA, 15 bp, Homo sapiens
aaacttttcatgaag

SEQ ID NO: 144809 - DNA, 15 bp, Homo sapiens
caaacttttcatgaa

SEQ ID NO: 144810 - DNA, 15 bp, Homo sapiens
gcaaacttttcatga

SEQ ID NO: 144811 - DNA, 15 bp, Homo sapiens
tgcaaacttttcatg

SEQ ID NO: 144812 - DNA, 15 bp, Homo sapiens
ctgcaaacttttcat

SEQ ID NO: 144813 - DNA, 15 bp, Homo sapiens
cctgcaaacttttca

SEQ ID NO: 144814 - DNA, 15 bp, Homo sapiens
ccctgcaaacttttc

SEQ ID NO: 144815 - DNA, 15 bp, Homo sapiens
tccctgcaaactttt

SEQ ID NO: 144816 - DNA, 15 bp, Homo sapiens
ttccctgcaaacttt

SEQ ID NO: 144817 - DNA, 15 bp, Homo sapiens
gttccctgcaaactt

SEQ ID NO: 144818 - DNA, 15 bp, Homo sapiens
ggttccctgcaaact

SEQ ID NO: 144819 - DNA, 15 bp, Homo sapiens
gggttccctgcaaac

SEQ ID NO: 144820 - DNA, 15 bp, Homo sapiens
ggggttccctgcaaa

SEQ ID NO: 144821 - DNA, 15 bp, Homo sapiens
tggggttccctgcaa

SEQ ID NO: 144822 - DNA, 15 bp, Homo sapiens
atggggttccctgca

SEQ ID NO: 144823 - DNA, 15 bp, Homo sapiens
catggggttccctgc

SEQ ID NO: 144824 - DNA, 15 bp, Homo sapiens
gcatggggttccctg

SEQ ID NO: 144825 - DNA, 15 bp, Homo sapiens
tgcatggggttccct

SEQ ID NO: 144826 - DNA, 15 bp, Homo sapiens
ctgcatggggttccc

SEQ ID NO: 144827 - DNA, 15 bp, Homo sapiens
actgcatggggttcc

SEQ ID NO: 144828 - DNA, 15 bp, Homo sapiens
tactgcatggggttc

SEQ ID NO: 144829 - DNA, 15 bp, Homo sapiens
ctactgcatggggtt

SEQ ID NO: 144830 - DNA, 15 bp, Homo sapiens
gctactgcatggggt

SEQ ID NO: 144831 - DNA, 15 bp, Homo sapiens
agctactgcatgggg

SEQ ID NO: 144832 - DNA, 15 bp, Homo sapiens
gagctactgcatggg

SEQ ID NO: 144833 - DNA, 15 bp, Homo sapiens
tgagctactgcatgg

SEQ ID NO: 144834 - DNA, 15 bp, Homo sapiens
atgagctactgcatg

SEQ ID NO: 144835 - DNA, 15 bp, Homo sapiens
catgagctactgcat

SEQ ID NO: 144836 - DNA, 15 bp, Homo sapiens
acatgagctactgca

SEQ ID NO: 144837 - DNA, 15 bp, Homo sapiens
gacatgagctactgc

SEQ ID NO: 144838 - DNA, 15 bp, Homo sapiens
agacatgagctactg

SEQ ID NO: 144839 - DNA, 15 bp, Homo sapiens
cagacatgagctact

SEQ ID NO: 144840 - DNA, 15 bp, Homo sapiens
acagacatgagctac

SEQ ID NO: 144841 - DNA, 15 bp, Homo sapiens
tacagacatgagcta

SEQ ID NO: 144842 - DNA, 15 bp, Homo sapiens
ttacagacatgagct

SEQ ID NO: 144843 - DNA, 15 bp, Homo sapiens
attacagacatgagc

SEQ ID NO: 144844 - DNA, 15 bp, Homo sapiens
gattacagacatgag

SEQ ID NO: 144845 - DNA, 15 bp, Homo sapiens
ggattacagacatga

SEQ ID NO: 144846 - DNA, 15 bp, Homo sapiens
tggattacagacatg

SEQ ID NO: 144847 - DNA, 15 bp, Homo sapiens
ctggattacagacat

SEQ ID NO: 144848 - DNA, 15 bp, Homo sapiens
gctggattacagaca

SEQ ID NO: 144849 - DNA, 15 bp, Homo sapiens
tgctggattacagac

SEQ ID NO: 144850 - DNA, 15 bp, Homo sapiens
gtgctggattacaga

SEQ ID NO: 144851 - DNA, 15 bp, Homo sapiens
agtgctggattacag

SEQ ID NO: 144852 - DNA, 15 bp, Homo sapiens
aagtgctggattaca

SEQ ID NO: 144853 - DNA, 15 bp, Homo sapiens
aaagtgctggattac

SEQ ID NO: 144854 - DNA, 15 bp, Homo sapiens
caaagtgctggatta

SEQ ID NO: 144855 - DNA, 15 bp, Homo sapiens
ccaaagtgctggatt

SEQ ID NO: 144856 - DNA, 15 bp, Homo sapiens
cccaaagtgctggat

SEQ ID NO: 144857 - DNA, 15 bp, Homo sapiens
tcccaaagtgctgga

SEQ ID NO: 144858 - DNA, 15 bp, Homo sapiens
tcacctgcctcagcc

SEQ ID NO: 144859 - DNA, 15 bp, Homo sapiens
ttcacctgcctcagc

SEQ ID NO: 144860 - DNA, 15 bp, Homo sapiens
attcacctgcctcag

SEQ ID NO: 144861 - DNA, 15 bp, Homo sapiens
gattcacctgcctca

SEQ ID NO: 144862 - DNA, 15 bp, Homo sapiens
cgattcacctgcctc

SEQ ID NO: 144863 - DNA, 15 bp, Homo sapiens
gcgattcacctgcct

SEQ ID NO: 144864 - DNA, 15 bp, Homo sapiens
agcgattcacctgcc

SEQ ID NO: 144865 - DNA, 15 bp, Homo sapiens
aagcgattcacctgc

SEQ ID NO: 144866 - DNA, 15 bp, Homo sapiens
caagcgattcacctg

SEQ ID NO: 144867 - DNA, 15 bp, Homo sapiens
tcaagcgattcacct

SEQ ID NO: 144868 - DNA, 15 bp, Homo sapiens
ctcaagcgattcacc

SEQ ID NO: 144869 - DNA, 15 bp, Homo sapiens
actcaagcgattcac

SEQ ID NO: 144870 - DNA, 15 bp, Homo sapiens
gactcaagcgattca

SEQ ID NO: 144871 - DNA, 15 bp, Homo sapiens
ggactcaagcgattc

SEQ ID NO: 144872 - DNA, 15 bp, Homo sapiens
tggactcaagcgatt

SEQ ID NO: 144873 - DNA, 15 bp, Homo sapiens
ctggactcaagcgat

SEQ ID NO: 144874 - DNA, 15 bp, Homo sapiens
cctggactcaagcga

SEQ ID NO: 144875 - DNA, 15 bp, Homo sapiens
tcctggactcaagcg

SEQ ID NO: 144876 - DNA, 15 bp, Homo sapiens
ggaactcctggactc

SEQ ID NO: 144877 - DNA, 15 bp, Homo sapiens
tggaactcctggact

SEQ ID NO: 144878 - DNA, 15 bp, Homo sapiens
ctggaactcctggac

SEQ ID NO: 144879 - DNA, 15 bp, Homo sapiens
tctggaactcctgga

SEQ ID NO: 144880 - DNA, 15 bp, Homo sapiens
gtctggaactcctgg

SEQ ID NO: 144881 - DNA, 15 bp, Homo sapiens
agtctggaactcctg

SEQ ID NO: 144882 - DNA, 15 bp, Homo sapiens
tagtctggaactcct

SEQ ID NO: 144883 - DNA, 15 bp, Homo sapiens
ctagtctggaactcc

SEQ ID NO: 144884 - DNA, 15 bp, Homo sapiens
gctagtctggaactc

SEQ ID NO: 144885 - DNA, 15 bp, Homo sapiens
ggctagtctggaact

SEQ ID NO: 144886 - DNA, 15 bp, Homo sapiens
aggctagtctggaac

SEQ ID NO: 144887 - DNA, 15 bp, Homo sapiens
caggctagtctggaa

SEQ ID NO: 144888 - DNA, 15 bp, Homo sapiens
ccaggctagtctgga

SEQ ID NO: 144889 - DNA, 15 bp, Homo sapiens
cccaggctagtctgg

SEQ ID NO: 144890 - DNA, 15 bp, Homo sapiens
tcccaggctagtctg

SEQ ID NO: 144891 - DNA, 15 bp, Homo sapiens
ttcccaggctagtct

SEQ ID NO: 144892 - DNA, 15 bp, Homo sapiens
tttcccaggctagtc

SEQ ID NO: 144893 - DNA, 15 bp, Homo sapiens
atttcccaggctagt

SEQ ID NO: 144894 - DNA, 15 bp, Homo sapiens
tatttcccaggctag

SEQ ID NO: 144895 - DNA, 15 bp, Homo sapiens
atatttcccaggcta

SEQ ID NO: 144896 - DNA, 15 bp, Homo sapiens
catatttcccaggct

SEQ ID NO: 144897 - DNA, 15 bp, Homo sapiens
ccatatttcccaggc

SEQ ID NO: 144898 - DNA, 15 bp, Homo sapiens
gccatatttcccagg

SEQ ID NO: 144899 - DNA, 15 bp, Homo sapiens
tgccatatttcccag

SEQ ID NO: 144900 - DNA, 15 bp, Homo sapiens
ttgccatatttccca

SEQ ID NO: 144901 - DNA, 15 bp, Homo sapiens
tttgccatatttccc

SEQ ID NO: 144902 - DNA, 15 bp, Homo sapiens
ttttgccatatttcc

SEQ ID NO: 144903 - DNA, 15 bp, Homo sapiens
gttttgccatatttc

SEQ ID NO: 144904 - DNA, 15 bp, Homo sapiens
ggttttgccatattt

SEQ ID NO: 144905 - DNA, 15 bp, Homo sapiens
aggttttgccatatt

SEQ ID NO: 144906 - DNA, 15 bp, Homo sapiens
gaggttttgccatat

SEQ ID NO: 144907 - DNA, 15 bp, Homo sapiens
tgaggttttgccata

SEQ ID NO: 144908 - DNA, 15 bp, Homo sapiens
atgaggttttgccat

SEQ ID NO: 144909 - DNA, 15 bp, Homo sapiens
gatgaggttttgcca

SEQ ID NO: 144910 - DNA, 15 bp, Homo sapiens
agatgaggttttgcc

SEQ ID NO: 144911 - DNA, 15 bp, Homo sapiens
gagatgaggttttgc

SEQ ID NO: 144912 - DNA, 15 bp, Homo sapiens
agagatgaggttttg

SEQ ID NO: 144913 - DNA, 15 bp, Homo sapiens
tagagatgaggtttt

SEQ ID NO: 144914 - DNA, 15 bp, Homo sapiens
tgtagagatgaggtt

SEQ ID NO: 144915 - DNA, 15 bp, Homo sapiens
ttgtagagatgaggt

SEQ ID NO: 144916 - DNA, 15 bp, Homo sapiens
tttgtagagatgagg

SEQ ID NO: 144917 - DNA, 15 bp, Homo sapiens
ttttgtagagatgag

SEQ ID NO: 144918 - DNA, 15 bp, Homo sapiens
tttttgtagagatga

SEQ ID NO: 144919 - DNA, 15 bp, Homo sapiens
agctgatttttgtat

SEQ ID NO: 144920 - DNA, 15 bp, Homo sapiens
cagctgatttttgta

SEQ ID NO: 144921 - DNA, 15 bp, Homo sapiens
ccagctgatttttgt

SEQ ID NO: 144922 - DNA, 15 bp, Homo sapiens
cccagctgatttttg

SEQ ID NO: 144923 - DNA, 15 bp, Homo sapiens
caccacacccagctg

SEQ ID NO: 144924 - DNA, 15 bp, Homo sapiens
tcaccacacccagct

SEQ ID NO: 144925 - DNA, 15 bp, Homo sapiens
gtcaccacacccagc

SEQ ID NO: 144926 - DNA, 15 bp, Homo sapiens
tgtcaccacacccag

SEQ ID NO: 144927 - DNA, 15 bp, Homo sapiens
gtgtcaccacaccca

SEQ ID NO: 144928 - DNA, 15 bp, Homo sapiens
tgtgtcaccacaccc

SEQ ID NO: 144929 - DNA, 15 bp, Homo sapiens
atgtgtcaccacacc

SEQ ID NO: 144930 - DNA, 15 bp, Homo sapiens
catgtgtcaccacac

SEQ ID NO: 144931 - DNA, 15 bp, Homo sapiens
gcatgtgtcaccaca

SEQ ID NO: 144932 - DNA, 15 bp, Homo sapiens
ggcatgtgtcaccac

SEQ ID NO: 144933 - DNA, 15 bp, Homo sapiens
aggcatgtgtcacca

SEQ ID NO: 144934 - DNA, 15 bp, Homo sapiens
caggcatgtgtcacc

SEQ ID NO: 144935 - DNA, 15 bp, Homo sapiens
acaggcatgtgtcac

SEQ ID NO: 144936 - DNA, 15 bp, Homo sapiens
cacaggcatgtgtca

SEQ ID NO: 144937 - DNA, 15 bp, Homo sapiens
ccacaggcatgtgtc

SEQ ID NO: 144938 - DNA, 15 bp, Homo sapiens
accacaggcatgtgt

SEQ ID NO: 144939 - DNA, 15 bp, Homo sapiens
gaccacaggcatgtg

SEQ ID NO: 144940 - DNA, 15 bp, Homo sapiens
ggaccacaggcatgt

SEQ ID NO: 144941 - DNA, 15 bp, Homo sapiens
tagtagctgggacca

SEQ ID NO: 144942 - DNA, 15 bp, Homo sapiens
ctagtagctgggacc

SEQ ID NO: 144943 - DNA, 15 bp, Homo sapiens
acctcagcctcccta

SEQ ID NO: 144944 - DNA, 15 bp, Homo sapiens
cacctcagcctccct

SEQ ID NO: 144945 - DNA, 15 bp, Homo sapiens
accacctcagcctcc

SEQ ID NO: 144946 - DNA, 15 bp, Homo sapiens
taccacctcagcctc

SEQ ID NO: 144947 - DNA, 15 bp, Homo sapiens
ctaccacctcagcct

SEQ ID NO: 144948 - DNA, 15 bp, Homo sapiens
cctaccacctcagcc

SEQ ID NO: 144949 - DNA, 15 bp, Homo sapiens
acctaccacctcagc

SEQ ID NO: 144950 - DNA, 15 bp, Homo sapiens
aacctaccacctcag

SEQ ID NO: 144951 - DNA, 15 bp, Homo sapiens
gaacctaccacctca

SEQ ID NO: 144952 - DNA, 15 bp, Homo sapiens
cgaacctaccacctc

SEQ ID NO: 144953 - DNA, 15 bp, Homo sapiens
tcgaacctaccacct

SEQ ID NO: 144954 - DNA, 15 bp, Homo sapiens
atcgaacctaccacc

SEQ ID NO: 144955 - DNA, 15 bp, Homo sapiens
aatcgaacctaccac

SEQ ID NO: 144956 - DNA, 15 bp, Homo sapiens
caatcgaacctacca

SEQ ID NO: 144957 - DNA, 15 bp, Homo sapiens
tcaatcgaacctacc

SEQ ID NO: 144958 - DNA, 15 bp, Homo sapiens
ctcaatcgaacctac

SEQ ID NO: 144959 - DNA, 15 bp, Homo sapiens
gctcaatcgaaccta

SEQ ID NO: 144960 - DNA, 15 bp, Homo sapiens
ggctcaatcgaacct

SEQ ID NO: 144961 - DNA, 15 bp, Homo sapiens
aggctcaatcgaacc

SEQ ID NO: 144962 - DNA, 15 bp, Homo sapiens
taggctcaatcgaac

SEQ ID NO: 144963 - DNA, 15 bp, Homo sapiens
ctaggctcaatcgaa

SEQ ID NO: 144964 - DNA, 15 bp, Homo sapiens
cctaggctcaatcga

SEQ ID NO: 144965 - DNA, 15 bp, Homo sapiens
tcctaggctcaatcg

SEQ ID NO: 144966 - DNA, 15 bp, Homo sapiens
ctcctaggctcaatc

SEQ ID NO: 144967 - DNA, 15 bp, Homo sapiens
cctcctaggctcaat

SEQ ID NO: 144968 - DNA, 15 bp, Homo sapiens
acctcctaggctcaa

SEQ ID NO: 144969 - DNA, 15 bp, Homo sapiens
cacctcctaggctca

SEQ ID NO: 144970 - DNA, 15 bp, Homo sapiens
ccacctcctaggctc

SEQ ID NO: 144971 - DNA, 15 bp, Homo sapiens
tccacctcctaggct

SEQ ID NO: 144972 - DNA, 15 bp, Homo sapiens
ctccacctcctaggc

SEQ ID NO: 144973 - DNA, 15 bp, Homo sapiens
tctccacctcctagg

SEQ ID NO: 144974 - DNA, 15 bp, Homo sapiens
atctccacctcctag

SEQ ID NO: 144975 - DNA, 15 bp, Homo sapiens
aatctccacctccta

SEQ ID NO: 144976 - DNA, 15 bp, Homo sapiens
caatctccacctcct

SEQ ID NO: 144977 - DNA, 15 bp, Homo sapiens
gcaatctccacctcc

SEQ ID NO: 144978 - DNA, 15 bp, Homo sapiens
tgcaatctccacctc

SEQ ID NO: 144979 - DNA, 15 bp, Homo sapiens
ctgcaatctccacct

SEQ ID NO: 144980 - DNA, 15 bp, Homo sapiens
actgcaatctccacc

SEQ ID NO: 144981 - DNA, 15 bp, Homo sapiens
cactgcaatctccac

SEQ ID NO: 144982 - DNA, 15 bp, Homo sapiens
tcactgcaatctcca

SEQ ID NO: 144983 - DNA, 15 bp, Homo sapiens
ctcactgcaatctcc

SEQ ID NO: 144984 - DNA, 15 bp, Homo sapiens
acagctcactgcaat

SEQ ID NO: 144985 - DNA, 15 bp, Homo sapiens
gtgatcacagctcac

SEQ ID NO: 144986 - DNA, 15 bp, Homo sapiens
tgtgatcacagctca

SEQ ID NO: 144987 - DNA, 15 bp, Homo sapiens
gtgtgatcacagctc

SEQ ID NO: 144988 - DNA, 15 bp, Homo sapiens
ggtgtgatcacagct

SEQ ID NO: 144989 - DNA, 15 bp, Homo sapiens
tggtgtgatcacagc

SEQ ID NO: 144990 - DNA, 15 bp, Homo sapiens
gtggtgtgatcacag

SEQ ID NO: 144991 - DNA, 15 bp, Homo sapiens
agtggtgtgatcaca

SEQ ID NO: 144992 - DNA, 15 bp, Homo sapiens
cagtggtgtgatcac

SEQ ID NO: 144993 - DNA, 15 bp, Homo sapiens
gcagtggtgtgatca

SEQ ID NO: 144994 - DNA, 15 bp, Homo sapiens
ccaaggctggagtgc

SEQ ID NO: 144995 - DNA, 15 bp, Homo sapiens
gccaaggctggagtg

SEQ ID NO: 144996 - DNA, 15 bp, Homo sapiens
cgccaaggctggagt

SEQ ID NO: 144997 - DNA, 15 bp, Homo sapiens
tcgccaaggctggag

SEQ ID NO: 144998 - DNA, 15 bp, Homo sapiens
gtcgccaaggctgga

SEQ ID NO: 144999 - DNA, 15 bp, Homo sapiens
tgtcgccaaggctgg

SEQ ID NO: 145000 - DNA, 15 bp, Homo sapiens
ctgtcgccaaggctg

SEQ ID NO: 145001 - DNA, 15 bp, Homo sapiens
tctgtcgccaaggct

SEQ ID NO: 145002 - DNA, 15 bp, Homo sapiens
ttctgtcgccaaggc

SEQ ID NO: 145003 - DNA, 15 bp, Homo sapiens
gttctgtcgccaagg

SEQ ID NO: 145004 - DNA, 15 bp, Homo sapiens
ggttctgtcgccaag

SEQ ID NO: 145005 - DNA, 15 bp, Homo sapiens
tggttctgtcgccaa

SEQ ID NO: 145006 - DNA, 15 bp, Homo sapiens
ctggttctgtcgcca

SEQ ID NO: 145007 - DNA, 15 bp, Homo sapiens
tctggttctgtcgcc

SEQ ID NO: 145008 - DNA, 15 bp, Homo sapiens
gtctggttctgtcgc

SEQ ID NO: 145009 - DNA, 15 bp, Homo sapiens
agtctggttctgtcg

SEQ ID NO: 145010 - DNA, 15 bp, Homo sapiens
gagtctggttctgtc

SEQ ID NO: 145011 - DNA, 15 bp, Homo sapiens
agagtctggttctgt

SEQ ID NO: 145012 - DNA, 15 bp, Homo sapiens
cagagtctggttctg

SEQ ID NO: 145013 - DNA, 15 bp, Homo sapiens
ccagagtctggttct

SEQ ID NO: 145014 - DNA, 15 bp, Homo sapiens
tccagagtctggttc

SEQ ID NO: 145015 - DNA, 15 bp, Homo sapiens
ttccagagtctggtt

SEQ ID NO: 145016 - DNA, 15 bp, Homo sapiens
tttccagagtctggt

SEQ ID NO: 145017 - DNA, 15 bp, Homo sapiens
ttttccagagtctgg

SEQ ID NO: 145018 - DNA, 15 bp, Homo sapiens
tttttccagagtctg

SEQ ID NO: 145019 - DNA, 15 bp, Homo sapiens
ttttttccagagtct

SEQ ID NO: 145020 - DNA, 15 bp, Homo sapiens
gttttttccagagtc

SEQ ID NO: 145021 - DNA, 15 bp, Homo sapiens
tgttttttccagagt

SEQ ID NO: 145022 - DNA, 15 bp, Homo sapiens
ttgttttttccagag

SEQ ID NO: 145023 - DNA, 15 bp, Homo sapiens
tttgttttttccaga

SEQ ID NO: 145024 - DNA, 15 bp, Homo sapiens
ttttgttttttccag

SEQ ID NO: 145025 - DNA, 15 bp, Homo sapiens
tttttgttttttcca

SEQ ID NO: 145026 - DNA, 15 bp, Homo sapiens
ctttttgttttttcc

SEQ ID NO: 145027 - DNA, 15 bp, Homo sapiens
actttttgttttttc

SEQ ID NO: 145028 - DNA, 15 bp, Homo sapiens
aactttttgtttttt

SEQ ID NO: 145029 - DNA, 15 bp, Homo sapiens
aaactttttgttttt

SEQ ID NO: 145030 - DNA, 15 bp, Homo sapiens
caaactttttgtttt

SEQ ID NO: 145031 - DNA, 15 bp, Homo sapiens
gcaaactttttgttt

SEQ ID NO: 145032 - DNA, 15 bp, Homo sapiens
tgcaaactttttgtt

SEQ ID NO: 145033 - DNA, 15 bp, Homo sapiens
ctgcaaactttttgt

SEQ ID NO: 145034 - DNA, 15 bp, Homo sapiens
cctgcaaactttttg

SEQ ID NO: 145035 - DNA, 15 bp, Homo sapiens
tcctgcaaacttttt

SEQ ID NO: 145036 - DNA, 15 bp, Homo sapiens
ctcctgcaaactttt

SEQ ID NO: 145037 - DNA, 15 bp, Homo sapiens
tctcctgcaaacttt

SEQ ID NO: 145038 - DNA, 15 bp, Homo sapiens
ttctcctgcaaactt

SEQ ID NO: 145039 - DNA, 15 bp, Homo sapiens
tttctcctgcaaact

SEQ ID NO: 145040 - DNA, 15 bp, Homo sapiens
atttctcctgcaaac

SEQ ID NO: 145041 - DNA, 15 bp, Homo sapiens
tatttctcctgcaaa

SEQ ID NO: 145042 - DNA, 15 bp, Homo sapiens
ttatttctcctgcaa

SEQ ID NO: 145043 - DNA, 15 bp, Homo sapiens
attatttctcctgca

SEQ ID NO: 145044 - DNA, 15 bp, Homo sapiens
cattatttctcctgc

SEQ ID NO: 145045 - DNA, 15 bp, Homo sapiens
ccattatttctcctg

SEQ ID NO: 145046 - DNA, 15 bp, Homo sapiens
gccattatttctcct

SEQ ID NO: 145047 - DNA, 15 bp, Homo sapiens
ggccattatttctcc

SEQ ID NO: 145048 - DNA, 15 bp, Homo sapiens
gggccattatttctc

SEQ ID NO: 145049 - DNA, 15 bp, Homo sapiens
agggccattatttct

SEQ ID NO: 145050 - DNA, 15 bp, Homo sapiens
tagggccattatttc

SEQ ID NO: 145051 - DNA, 15 bp, Homo sapiens
atagggccattattt

SEQ ID NO: 145052 - DNA, 15 bp, Homo sapiens
catagggccattatt

SEQ ID NO: 145053 - DNA, 15 bp, Homo sapiens
ccatagggccattat

SEQ ID NO: 145054 - DNA, 15 bp, Homo sapiens
tccatagggccatta

SEQ ID NO: 145055 - DNA, 15 bp, Homo sapiens
ttccatagggccatt

SEQ ID NO: 145056 - DNA, 15 bp, Homo sapiens
tttccatagggccat

SEQ ID NO: 145057 - DNA, 15 bp, Homo sapiens
gtttccatagggcca

SEQ ID NO: 145058 - DNA, 15 bp, Homo sapiens
agtttccatagggcc

SEQ ID NO: 145059 - DNA, 15 bp, Homo sapiens
cagtttccatagggc

SEQ ID NO: 145060 - DNA, 15 bp, Homo sapiens
ccagtttccataggg

SEQ ID NO: 145061 - DNA, 15 bp, Homo sapiens
accagtttccatagg

SEQ ID NO: 145062 - DNA, 15 bp, Homo sapiens
aaccagtttccatag

SEQ ID NO: 145063 - DNA, 15 bp, Homo sapiens
aaaccagtttccata

SEQ ID NO: 145064 - DNA, 15 bp, Homo sapiens
tgaaaccagtttcca

SEQ ID NO: 145065 - DNA, 15 bp, Homo sapiens
ctgaaaccagtttcc

SEQ ID NO: 145066 - DNA, 15 bp, Homo sapiens
actgaaaccagtttc

SEQ ID NO: 145067 - DNA, 15 bp, Homo sapiens
cactgaaaccagttt

SEQ ID NO: 145068 - DNA, 15 bp, Homo sapiens
tcactgaaaccagtt

SEQ ID NO: 145069 - DNA, 15 bp, Homo sapiens
ttcactgaaaccagt

SEQ ID NO: 145070 - DNA, 15 bp, Homo sapiens
cttcactgaaaccag

SEQ ID NO: 145071 - DNA, 15 bp, Homo sapiens
tcttcactgaaacca

SEQ ID NO: 145072 - DNA, 15 bp, Homo sapiens
gtcttcactgaaacc

SEQ ID NO: 145073 - DNA, 15 bp, Homo sapiens
tgtcttcactgaaac

SEQ ID NO: 145074 - DNA, 15 bp, Homo sapiens
ttgtcttcactgaaa

SEQ ID NO: 145075 - DNA, 15 bp, Homo sapiens
tttgtcttcactgaa

SEQ ID NO: 145076 - DNA, 15 bp, Homo sapiens
ttttgtcttcactga

SEQ ID NO: 145077 - DNA, 15 bp, Homo sapiens
tttttgtcttcactg

SEQ ID NO: 145078 - DNA, 15 bp, Homo sapiens
ctttttgtcttcact

SEQ ID NO: 145079 - DNA, 15 bp, Homo sapiens
cctttttgtcttcac

SEQ ID NO: 145080 - DNA, 15 bp, Homo sapiens
ccctttttgtcttca

SEQ ID NO: 145081 - DNA, 15 bp, Homo sapiens
tccctttttgtcttc

SEQ ID NO: 145082 - DNA, 15 bp, Homo sapiens
atccctttttgtctt

SEQ ID NO: 145083 - DNA, 15 bp, Homo sapiens
aatccctttttgtct

SEQ ID NO: 145084 - DNA, 15 bp, Homo sapiens
caatccctttttgtc

SEQ ID NO: 145085 - DNA, 15 bp, Homo sapiens
ccaatccctttttgt

SEQ ID NO: 145086 - DNA, 15 bp, Homo sapiens
gccaatccctttttg

SEQ ID NO: 145087 - DNA, 15 bp, Homo sapiens
ggccaatcccttttt

SEQ ID NO: 145088 - DNA, 15 bp, Homo sapiens
aggccaatccctttt

SEQ ID NO: 145089 - DNA, 15 bp, Homo sapiens
caggccaatcccttt

SEQ ID NO: 145090 - DNA, 15 bp, Homo sapiens
ccaggccaatccctt

SEQ ID NO: 145091 - DNA, 15 bp, Homo sapiens
cccaggccaatccct

SEQ ID NO: 145092 - DNA, 15 bp, Homo sapiens
ccccaggccaatccc

SEQ ID NO: 145093 - DNA, 15 bp, Homo sapiens
tccccaggccaatcc

SEQ ID NO: 145094 - DNA, 15 bp, Homo sapiens
ctccccaggccaatc

SEQ ID NO: 145095 - DNA, 15 bp, Homo sapiens
tctccccaggccaat

SEQ ID NO: 145096 - DNA, 15 bp, Homo sapiens
atctccccaggccaa

SEQ ID NO: 145097 - DNA, 15 bp, Homo sapiens
catctccccaggcca

SEQ ID NO: 145098 - DNA, 15 bp, Homo sapiens
ccatctccccaggcc

SEQ ID NO: 145099 - DNA, 15 bp, Homo sapiens
tccatctccccaggc

SEQ ID NO: 145100 - DNA, 15 bp, Homo sapiens
ttccatctccccagg

SEQ ID NO: 145101 - DNA, 15 bp, Homo sapiens
cttccatctccccag

SEQ ID NO: 145102 - DNA, 15 bp, Homo sapiens
ccttccatctcccca

SEQ ID NO: 145103 - DNA, 15 bp, Homo sapiens
accttccatctcccc

SEQ ID NO: 145104 - DNA, 15 bp, Homo sapiens
taccttccatctccc

SEQ ID NO: 145105 - DNA, 15 bp, Homo sapiens
gtaccttccatctcc

SEQ ID NO: 145106 - DNA, 15 bp, Homo sapiens
tgtaccttccatctc

SEQ ID NO: 145107 - DNA, 15 bp, Homo sapiens
ctgtaccttccatct

SEQ ID NO: 145108 - DNA, 15 bp, Homo sapiens
gctgtaccttccatc

SEQ ID NO: 145109 - DNA, 15 bp, Homo sapiens
tgctgtaccttccat

SEQ ID NO: 145110 - DNA, 15 bp, Homo sapiens
ctgctgtaccttcca

SEQ ID NO: 145111 - DNA, 15 bp, Homo sapiens
tctgctgtaccttcc

SEQ ID NO: 145112 - DNA, 15 bp, Homo sapiens
ctctgctgtaccttc

SEQ ID NO: 145113 - DNA, 15 bp, Homo sapiens
actctgctgtacctt

SEQ ID NO: 145114 - DNA, 15 bp, Homo sapiens
gactctgctgtacct

SEQ ID NO: 145115 - DNA, 15 bp, Homo sapiens
agactctgctgtacc

SEQ ID NO: 145116 - DNA, 15 bp, Homo sapiens
cagactctgctgtac

SEQ ID NO: 145117 - DNA, 15 bp, Homo sapiens
gcagactctgctgta

SEQ ID NO: 145118 - DNA, 15 bp, Homo sapiens
agcagactctgctgt

SEQ ID NO: 145119 - DNA, 15 bp, Homo sapiens
cagcagactctgctg

SEQ ID NO: 145120 - DNA, 15 bp, Homo sapiens
tcagcagactctgct

SEQ ID NO: 145121 - DNA, 15 bp, Homo sapiens
atcagcagactctgc

SEQ ID NO: 145122 - DNA, 15 bp, Homo sapiens
gatcagcagactctg

SEQ ID NO: 145123 - DNA, 15 bp, Homo sapiens
ggatcagcagactct

SEQ ID NO: 145124 - DNA, 15 bp, Homo sapiens
aggatcagcagactc

SEQ ID NO: 145125 - DNA, 15 bp, Homo sapiens
taggatcagcagact

SEQ ID NO: 145126 - DNA, 15 bp, Homo sapiens
aaaacgtaaattatt

SEQ ID NO: 145127 - DNA, 15 bp, Homo sapiens
taaaacgtaaattat

SEQ ID NO: 145128 - DNA, 15 bp, Homo sapiens
ctaaaacgtaaatta

SEQ ID NO: 145129 - DNA, 15 bp, Homo sapiens
cctaaaacgtaaatt

SEQ ID NO: 145130 - DNA, 15 bp, Homo sapiens
tcctaaaacgtaaat

SEQ ID NO: 145131 - DNA, 15 bp, Homo sapiens
atcctaaaacgtaaa

SEQ ID NO: 145132 - DNA, 15 bp, Homo sapiens
aatcctaaaacgtaa

SEQ ID NO: 145133 - DNA, 15 bp, Homo sapiens
taatcctaaaacgta

SEQ ID NO: 145134 - DNA, 15 bp, Homo sapiens
ataatcctaaaacgt

SEQ ID NO: 145135 - DNA, 15 bp, Homo sapiens
aataatcctaaaacg

SEQ ID NO: 145136 - DNA, 15 bp, Homo sapiens
taataatcctaaaac

SEQ ID NO: 145137 - DNA, 15 bp, Homo sapiens
gtaataatcctaaaa

SEQ ID NO: 145138 - DNA, 15 bp, Homo sapiens
tgtaataatcctaaa

SEQ ID NO: 145139 - DNA, 15 bp, Homo sapiens
gtgtaataatcctaa

SEQ ID NO: 145140 - DNA, 15 bp, Homo sapiens
agtgtaataatccta

SEQ ID NO: 145141 - DNA, 15 bp, Homo sapiens
aagtgtaataatcct

SEQ ID NO: 145142 - DNA, 15 bp, Homo sapiens
aaagtgtaataatcc

SEQ ID NO: 145143 - DNA, 15 bp, Homo sapiens
aaaagtgtaataatc

SEQ ID NO: 145144 - DNA, 15 bp, Homo sapiens
taaaagtgtaataat

SEQ ID NO: 145145 - DNA, 15 bp, Homo sapiens
ataaaagtgtaataa

SEQ ID NO: 145146 - DNA, 15 bp, Homo sapiens
gataaaagtgtaata

SEQ ID NO: 145147 - DNA, 15 bp, Homo sapiens
agataaaagtgtaat

SEQ ID NO: 145148 - DNA, 15 bp, Homo sapiens
gagataaaagtgtaa

SEQ ID NO: 145149 - DNA, 15 bp, Homo sapiens
ggagataaaagtgta

SEQ ID NO: 145150 - DNA, 15 bp, Homo sapiens
aggagataaaagtgt

SEQ ID NO: 145151 - DNA, 15 bp, Homo sapiens
taggagataaaagtg

SEQ ID NO: 145152 - DNA, 15 bp, Homo sapiens
ataggagataaaagt

SEQ ID NO: 145153 - DNA, 15 bp, Homo sapiens
cataggagataaaag

SEQ ID NO: 145154 - DNA, 15 bp, Homo sapiens
acataggagataaaa

SEQ ID NO: 145155 - DNA, 15 bp, Homo sapiens
aacataggagataaa

SEQ ID NO: 145156 - DNA, 15 bp, Homo sapiens
aaacataggagataa

SEQ ID NO: 145157 - DNA, 15 bp, Homo sapiens
caaacataggagata

SEQ ID NO: 145158 - DNA, 15 bp, Homo sapiens
gcaaacataggagat

SEQ ID NO: 145159 - DNA, 15 bp, Homo sapiens
agcaaacataggaga

SEQ ID NO: 145160 - DNA, 15 bp, Homo sapiens
aagcaaacataggag

SEQ ID NO: 145161 - DNA, 15 bp, Homo sapiens
aaagcaaacatagga

SEQ ID NO: 145162 - DNA, 15 bp, Homo sapiens
aaaagcaaacatagg

SEQ ID NO: 145163 - DNA, 15 bp, Homo sapiens
taaaagcaaacatag

SEQ ID NO: 145164 - DNA, 15 bp, Homo sapiens
ctaaaagcaaacata

SEQ ID NO: 145165 - DNA, 15 bp, Homo sapiens
gctaaaagcaaacat

SEQ ID NO: 145166 - DNA, 15 bp, Homo sapiens
ggctaaaagcaaaca

SEQ ID NO: 145167 - DNA, 15 bp, Homo sapiens
aggctaaaagcaaac

SEQ ID NO: 145168 - DNA, 15 bp, Homo sapiens
gaggctaaaagcaaa

SEQ ID NO: 145169 - DNA, 15 bp, Homo sapiens
tgaggctaaaagcaa

SEQ ID NO: 145170 - DNA, 15 bp, Homo sapiens
atgaggctaaaagca

SEQ ID NO: 145171 - DNA, 15 bp, Homo sapiens
aatgaggctaaaagc

SEQ ID NO: 145172 - DNA, 15 bp, Homo sapiens
aaatgaggctaaaag

SEQ ID NO: 145173 - DNA, 15 bp, Homo sapiens
aaaatgaggctaaaa

SEQ ID NO: 145174 - DNA, 15 bp, Homo sapiens
gaaaatgaggctaaa

SEQ ID NO: 145175 - DNA, 15 bp, Homo sapiens
tgaaaatgaggctaa

SEQ ID NO: 145176 - DNA, 15 bp, Homo sapiens
atgaaaatgaggcta

SEQ ID NO: 145177 - DNA, 15 bp, Homo sapiens
gatgaaaatgaggct

SEQ ID NO: 145178 - DNA, 15 bp, Homo sapiens
cgatgaaaatgaggc

SEQ ID NO: 145179 - DNA, 15 bp, Homo sapiens
acgatgaaaatgagg

SEQ ID NO: 145180 - DNA, 15 bp, Homo sapiens
gacgatgaaaatgag

SEQ ID NO: 145181 - DNA, 15 bp, Homo sapiens
agacgatgaaaatga

SEQ ID NO: 145182 - DNA, 15 bp, Homo sapiens
aagacgatgaaaatg

SEQ ID NO: 145183 - DNA, 15 bp, Homo sapiens
caagacgatgaaaat

SEQ ID NO: 145184 - DNA, 15 bp, Homo sapiens
acaagacgatgaaaa

SEQ ID NO: 145185 - DNA, 15 bp, Homo sapiens
aacaagacgatgaaa

SEQ ID NO: 145186 - DNA, 15 bp, Homo sapiens
gaacaagacgatgaa

SEQ ID NO: 145187 - DNA, 15 bp, Homo sapiens
ggaacaagacgatga

SEQ ID NO: 145188 - DNA, 15 bp, Homo sapiens
tggaacaagacgatg

SEQ ID NO: 145189 - DNA, 15 bp, Homo sapiens
atggaacaagacgat

SEQ ID NO: 145190 - DNA, 15 bp, Homo sapiens
tatggaacaagacga

SEQ ID NO: 145191 - DNA, 15 bp, Homo sapiens
ctatggaacaagacg

SEQ ID NO: 145192 - DNA, 15 bp, Homo sapiens
tctatggaacaagac

SEQ ID NO: 145193 - DNA, 15 bp, Homo sapiens
atctatggaacaaga

SEQ ID NO: 145194 - DNA, 15 bp, Homo sapiens
catctatggaacaag

SEQ ID NO: 145195 - DNA, 15 bp, Homo sapiens
gcatctatggaacaa

SEQ ID NO: 145196 - DNA, 15 bp, Homo sapiens
tgcatctatggaaca

SEQ ID NO: 145197 - DNA, 15 bp, Homo sapiens
ctgcatctatggaac

SEQ ID NO: 145198 - DNA, 15 bp, Homo sapiens
tctgcatctatggaa

SEQ ID NO: 145199 - DNA, 15 bp, Homo sapiens
gtctgcatctatgga

SEQ ID NO: 145200 - DNA, 15 bp, Homo sapiens
agtctgcatctatgg

SEQ ID NO: 145201 - DNA, 15 bp, Homo sapiens
aagtctgcatctatg

SEQ ID NO: 145202 - DNA, 15 bp, Homo sapiens
aaagtctgcatctat

SEQ ID NO: 145203 - DNA, 15 bp, Homo sapiens
caaagtctgcatcta

SEQ ID NO: 145204 - DNA, 15 bp, Homo sapiens
tcaaagtctgcatct

SEQ ID NO: 145205 - DNA, 15 bp, Homo sapiens
atcaaagtctgcatc

SEQ ID NO: 145206 - DNA, 15 bp, Homo sapiens
aatcaaagtctgcat

SEQ ID NO: 145207 - DNA, 15 bp, Homo sapiens
taatcaaagtctgca

SEQ ID NO: 145208 - DNA, 15 bp, Homo sapiens
ataatcaaagtctgc

SEQ ID NO: 145209 - DNA, 15 bp, Homo sapiens
tataatcaaagtctg

SEQ ID NO: 145210 - DNA, 15 bp, Homo sapiens
ctataatcaaagtct

SEQ ID NO: 145211 - DNA, 15 bp, Homo sapiens
tctataatcaaagtc

SEQ ID NO: 145212 - DNA, 15 bp, Homo sapiens
atctataatcaaagt

SEQ ID NO: 145213 - DNA, 15 bp, Homo sapiens
aatctataatcaaag

SEQ ID NO: 145214 - DNA, 15 bp, Homo sapiens
caatctataatcaaa

SEQ ID NO: 145215 - DNA, 15 bp, Homo sapiens
acaatctataatcaa

SEQ ID NO: 145216 - DNA, 15 bp, Homo sapiens
aacaatctataatca

SEQ ID NO: 145217 - DNA, 15 bp, Homo sapiens
aaacaatctataatc

SEQ ID NO: 145218 - DNA, 15 bp, Homo sapiens
aaaacaatctataat

SEQ ID NO: 145219 - DNA, 15 bp, Homo sapiens
taaaacaatctataa

SEQ ID NO: 145220 - DNA, 15 bp, Homo sapiens
ctaaaacaatctata

SEQ ID NO: 145221 - DNA, 15 bp, Homo sapiens
tctaaaacaatctat

SEQ ID NO: 145222 - DNA, 15 bp, Homo sapiens
atctaaaacaatcta

SEQ ID NO: 145223 - DNA, 15 bp, Homo sapiens
aatctaaaacaatct

SEQ ID NO: 145224 - DNA, 15 bp, Homo sapiens
aaatctaaaacaatc

SEQ ID NO: 145225 - DNA, 15 bp, Homo sapiens
aaaatctaaaacaat

SEQ ID NO: 145226 - DNA, 15 bp, Homo sapiens
gaaaatctaaaacaa

SEQ ID NO: 145227 - DNA, 15 bp, Homo sapiens
agaaaatctaaaaca

SEQ ID NO: 145228 - DNA, 15 bp, Homo sapiens
gagaaaatctaaaac

SEQ ID NO: 145229 - DNA, 15 bp, Homo sapiens
ggagaaaatctaaaa

SEQ ID NO: 145230 - DNA, 15 bp, Homo sapiens
aggagaaaatctaaa

SEQ ID NO: 145231 - DNA, 15 bp, Homo sapiens
caggagaaaatctaa

SEQ ID NO: 145232 - DNA, 15 bp, Homo sapiens
acaggagaaaatcta

SEQ ID NO: 145233 - DNA, 15 bp, Homo sapiens
cacaggagaaaatct

SEQ ID NO: 145234 - DNA, 15 bp, Homo sapiens
gcacaggagaaaatc

SEQ ID NO: 145235 - DNA, 15 bp, Homo sapiens
ggcacaggagaaaat

SEQ ID NO: 145236 - DNA, 15 bp, Homo sapiens
gggcacaggagaaaa

SEQ ID NO: 145237 - DNA, 15 bp, Homo sapiens
tgggcacaggagaaa

SEQ ID NO: 145238 - DNA, 15 bp, Homo sapiens
ctgggcacaggagaa

SEQ ID NO: 145239 - DNA, 15 bp, Homo sapiens
gctgggcacaggaga

SEQ ID NO: 145240 - DNA, 15 bp, Homo sapiens
agctgggcacaggag

SEQ ID NO: 145241 - DNA, 15 bp, Homo sapiens
cagctgggcacagga

SEQ ID NO: 145242 - DNA, 15 bp, Homo sapiens
gcagctgggcacagg

SEQ ID NO: 145243 - DNA, 15 bp, Homo sapiens
tgcagctgggcacag

SEQ ID NO: 145244 - DNA, 15 bp, Homo sapiens
atgcagctgggcaca

SEQ ID NO: 145245 - DNA, 15 bp, Homo sapiens
catgcagctgggcac

SEQ ID NO: 145246 - DNA, 15 bp, Homo sapiens
gcatgcagctgggca

SEQ ID NO: 145247 - DNA, 15 bp, Homo sapiens
agcatgcagctgggc

SEQ ID NO: 145248 - DNA, 15 bp, Homo sapiens
aagcatgcagctggg

SEQ ID NO: 145249 - DNA, 15 bp, Homo sapiens
taagcatgcagctgg

SEQ ID NO: 145250 - DNA, 15 bp, Homo sapiens
ctaagcatgcagctg

SEQ ID NO: 145251 - DNA, 15 bp, Homo sapiens
gctaagcatgcagct

SEQ ID NO: 145252 - DNA, 15 bp, Homo sapiens
tgctaagcatgcagc

SEQ ID NO: 145253 - DNA, 15 bp, Homo sapiens
gtgctaagcatgcag

SEQ ID NO: 145254 - DNA, 15 bp, Homo sapiens
agtgctaagcatgca

SEQ ID NO: 145255 - DNA, 15 bp, Homo sapiens
cagtgctaagcatgc

SEQ ID NO: 145256 - DNA, 15 bp, Homo sapiens
acagtgctaagcatg

SEQ ID NO: 145257 - DNA, 15 bp, Homo sapiens
cacagtgctaagcat

SEQ ID NO: 145258 - DNA, 15 bp, Homo sapiens
acacagtgctaagca

SEQ ID NO: 145259 - DNA, 15 bp, Homo sapiens
aacacagtgctaagc

SEQ ID NO: 145260 - DNA, 15 bp, Homo sapiens
aaacacagtgctaag

SEQ ID NO: 145261 - DNA, 15 bp, Homo sapiens
caaacacagtgctaa

SEQ ID NO: 145262 - DNA, 15 bp, Homo sapiens
tcaaacacagtgcta

SEQ ID NO: 145263 - DNA, 15 bp, Homo sapiens
ctcaaacacagtgct

SEQ ID NO: 145264 - DNA, 15 bp, Homo sapiens
cctcaaacacagtgc

SEQ ID NO: 145265 - DNA, 15 bp, Homo sapiens
ccctcaaacacagtg

SEQ ID NO: 145266 - DNA, 15 bp, Homo sapiens
cccctcaaacacagt

SEQ ID NO: 145267 - DNA, 15 bp, Homo sapiens
acccctcaaacacag

SEQ ID NO: 145268 - DNA, 15 bp, Homo sapiens
cacccctcaaacaca

SEQ ID NO: 145269 - DNA, 15 bp, Homo sapiens
tcacccctcaaacac

SEQ ID NO: 145270 - DNA, 15 bp, Homo sapiens
ttcacccctcaaaca

SEQ ID NO: 145271 - DNA, 15 bp, Homo sapiens
attcacccctcaaac

SEQ ID NO: 145272 - DNA, 15 bp, Homo sapiens
cattcacccctcaaa

SEQ ID NO: 145273 - DNA, 15 bp, Homo sapiens
gcattcacccctcaa

SEQ ID NO: 145274 - DNA, 15 bp, Homo sapiens
ggcattcacccctca

SEQ ID NO: 145275 - DNA, 15 bp, Homo sapiens
aggcattcacccctc

SEQ ID NO: 145276 - DNA, 15 bp, Homo sapiens
taggcattcacccct

SEQ ID NO: 145277 - DNA, 15 bp, Homo sapiens
ataggcattcacccc

SEQ ID NO: 145278 - DNA, 15 bp, Homo sapiens
gataggcattcaccc

SEQ ID NO: 145279 - DNA, 15 bp, Homo sapiens
agataggcattcacc

SEQ ID NO: 145280 - DNA, 15 bp, Homo sapiens
gagataggcattcac

SEQ ID NO: 145281 - DNA, 15 bp, Homo sapiens
tgagataggcattca

SEQ ID NO: 145282 - DNA, 15 bp, Homo sapiens
atgagataggcattc

SEQ ID NO: 145283 - DNA, 15 bp, Homo sapiens
catgagataggcatt

SEQ ID NO: 145284 - DNA, 15 bp, Homo sapiens
ccatgagataggcat

SEQ ID NO: 145285 - DNA, 15 bp, Homo sapiens
cccatgagataggca

SEQ ID NO: 145286 - DNA, 15 bp, Homo sapiens
ccccatgagataggc

SEQ ID NO: 145287 - DNA, 15 bp, Homo sapiens
tccccatgagatagg

SEQ ID NO: 145288 - DNA, 15 bp, Homo sapiens
gtccccatgagatag

SEQ ID NO: 145289 - DNA, 15 bp, Homo sapiens
agtccccatgagata

SEQ ID NO: 145290 - DNA, 15 bp, Homo sapiens
aagtccccatgagat

SEQ ID NO: 145291 - DNA, 15 bp, Homo sapiens
gaagtccccatgaga

SEQ ID NO: 145292 - DNA, 15 bp, Homo sapiens
tgaagtccccatgag

SEQ ID NO: 145293 - DNA, 15 bp, Homo sapiens
atgaagtccccatga

SEQ ID NO: 145294 - DNA, 15 bp, Homo sapiens
gatgaagtccccatg

SEQ ID NO: 145295 - DNA, 15 bp, Homo sapiens
agatgaagtccccat

SEQ ID NO: 145296 - DNA, 15 bp, Homo sapiens
cagatgaagtcccca

SEQ ID NO: 145297 - DNA, 15 bp, Homo sapiens
gcagatgaagtcccc

SEQ ID NO: 145298 - DNA, 15 bp, Homo sapiens
agcagatgaagtccc

SEQ ID NO: 145299 - DNA, 15 bp, Homo sapiens
cagcagatgaagtcc

SEQ ID NO: 145300 - DNA, 15 bp, Homo sapiens
ccagcagatgaagtc

SEQ ID NO: 145301 - DNA, 15 bp, Homo sapiens
accagcagatgaagt

SEQ ID NO: 145302 - DNA, 15 bp, Homo sapiens
aaccagcagatgaag

SEQ ID NO: 145303 - DNA, 15 bp, Homo sapiens
gaaccagcagatgaa

SEQ ID NO: 145304 - DNA, 15 bp, Homo sapiens
agaaccagcagatga

SEQ ID NO: 145305 - DNA, 15 bp, Homo sapiens
tagaaccagcagatg

SEQ ID NO: 145306 - DNA, 15 bp, Homo sapiens
ctagaaccagcagat

SEQ ID NO: 145307 - DNA, 15 bp, Homo sapiens
cctagaaccagcaga

SEQ ID NO: 145308 - DNA, 15 bp, Homo sapiens
tcctagaaccagcag

SEQ ID NO: 145309 - DNA, 15 bp, Homo sapiens
gtcctagaaccagca

SEQ ID NO: 145310 - DNA, 15 bp, Homo sapiens
tgtcctagaaccagc

SEQ ID NO: 145311 - DNA, 15 bp, Homo sapiens
ctgtcctagaaccag

SEQ ID NO: 145312 - DNA, 15 bp, Homo sapiens
cctgtcctagaacca

SEQ ID NO: 145313 - DNA, 15 bp, Homo sapiens
tcctgtcctagaacc

SEQ ID NO: 145314 - DNA, 15 bp, Homo sapiens
ttcctgtcctagaac

SEQ ID NO: 145315 - DNA, 15 bp, Homo sapiens
attcctgtcctagaa

SEQ ID NO: 145316 - DNA, 15 bp, Homo sapiens
aattcctgtcctaga

SEQ ID NO: 145317 - DNA, 15 bp, Homo sapiens
taattcctgtcctag

SEQ ID NO: 145318 - DNA, 15 bp, Homo sapiens
ataattcctgtccta

SEQ ID NO: 145319 - DNA, 15 bp, Homo sapiens
tataattcctgtcct

SEQ ID NO: 145320 - DNA, 15 bp, Homo sapiens
ctataattcctgtcc

SEQ ID NO: 145321 - DNA, 15 bp, Homo sapiens
gctataattcctgtc

SEQ ID NO: 145322 - DNA, 15 bp, Homo sapiens
agctataattcctgt

SEQ ID NO: 145323 - DNA, 15 bp, Homo sapiens
aagctataattcctg

SEQ ID NO: 145324 - DNA, 15 bp, Homo sapiens
gaagctataattcct

SEQ ID NO: 145325 - DNA, 15 bp, Homo sapiens
tgaagctataattcc

SEQ ID NO: 145326 - DNA, 15 bp, Homo sapiens
atgaagctataattc

SEQ ID NO: 145327 - DNA, 15 bp, Homo sapiens
tatgaagctataatt

SEQ ID NO: 145328 - DNA, 15 bp, Homo sapiens
gtatgaagctataat

SEQ ID NO: 145329 - DNA, 15 bp, Homo sapiens
agtatgaagctataa

SEQ ID NO: 145330 - DNA, 15 bp, Homo sapiens
aagtatgaagctata

SEQ ID NO: 145331 - DNA, 15 bp, Homo sapiens
taagtatgaagctat

SEQ ID NO: 145332 - DNA, 15 bp, Homo sapiens
ataagtatgaagcta

SEQ ID NO: 145333 - DNA, 15 bp, Homo sapiens
aataagtatgaagct

SEQ ID NO: 145334 - DNA, 15 bp, Homo sapiens
aaataagtatgaagc

SEQ ID NO: 145335 - DNA, 15 bp, Homo sapiens
taaataagtatgaag

SEQ ID NO: 145336 - DNA, 15 bp, Homo sapiens
ttaaataagtatgaa

SEQ ID NO: 145337 - DNA, 15 bp, Homo sapiens
attaaataagtatga

SEQ ID NO: 145338 - DNA, 15 bp, Homo sapiens
tattaaataagtatg

SEQ ID NO: 145339 - DNA, 15 bp, Homo sapiens
ttattaaataagtat

SEQ ID NO: 145340 - DNA, 15 bp, Homo sapiens
gttattaaataagta

SEQ ID NO: 145341 - DNA, 15 bp, Homo sapiens
tgttattaaataagt

SEQ ID NO: 145342 - DNA, 15 bp, Homo sapiens
ttgttattaaataag

SEQ ID NO: 145343 - DNA, 15 bp, Homo sapiens
gttgttattaaataa

SEQ ID NO: 145344 - DNA, 15 bp, Homo sapiens
agttgttattaaata

SEQ ID NO: 145345 - DNA, 15 bp, Homo sapiens
aagttgttattaaat

SEQ ID NO: 145346 - DNA, 15 bp, Homo sapiens
aaagttgttattaaa

SEQ ID NO: 145347 - DNA, 15 bp, Homo sapiens
gaaagttgttattaa

SEQ ID NO: 145348 - DNA, 15 bp, Homo sapiens
agaaagttgttatta

SEQ ID NO: 145349 - DNA, 15 bp, Homo sapiens
aagaaagttgttatt

SEQ ID NO: 145350 - DNA, 15 bp, Homo sapiens
caagaaagttgttat

SEQ ID NO: 145351 - DNA, 15 bp, Homo sapiens
ccaagaaagttgtta

SEQ ID NO: 145352 - DNA, 15 bp, Homo sapiens
gccaagaaagttgtt

SEQ ID NO: 145353 - DNA, 15 bp, Homo sapiens
tgccaagaaagttgt

SEQ ID NO: 145354 - DNA, 15 bp, Homo sapiens
atgccaagaaagttg

SEQ ID NO: 145355 - DNA, 15 bp, Homo sapiens
tatgccaagaaagtt

SEQ ID NO: 145356 - DNA, 15 bp, Homo sapiens
atatgccaagaaagt

SEQ ID NO: 145357 - DNA, 15 bp, Homo sapiens
tatatgccaagaaag

SEQ ID NO: 145358 - DNA, 15 bp, Homo sapiens
ttatatgccaagaaa

SEQ ID NO: 145359 - DNA, 15 bp, Homo sapiens
attatatgccaagaa

SEQ ID NO: 145360 - DNA, 15 bp, Homo sapiens
aattatatgccaaga

SEQ ID NO: 145361 - DNA, 15 bp, Homo sapiens
gaattatatgccaag

SEQ ID NO: 145362 - DNA, 15 bp, Homo sapiens
tgaattatatgccaa

SEQ ID NO: 145363 - DNA, 15 bp, Homo sapiens
gtgaattatatgcca

SEQ ID NO: 145364 - DNA, 15 bp, Homo sapiens
tgtgaattatatgcc

SEQ ID NO: 145365 - DNA, 15 bp, Homo sapiens
atgtgaattatatgc

SEQ ID NO: 145366 - DNA, 15 bp, Homo sapiens
tatgtgaattatatg

SEQ ID NO: 145367 - DNA, 15 bp, Homo sapiens
gtatgtgaattatat

SEQ ID NO: 145368 - DNA, 15 bp, Homo sapiens
agtatgtgaattata

SEQ ID NO: 145369 - DNA, 15 bp, Homo sapiens
cagtatgtgaattat

SEQ ID NO: 145370 - DNA, 15 bp, Homo sapiens
acagtatgtgaatta

SEQ ID NO: 145371 - DNA, 15 bp, Homo sapiens
tacagtatgtgaatt

SEQ ID NO: 145372 - DNA, 15 bp, Homo sapiens
gtacagtatgtgaat

SEQ ID NO: 145373 - DNA, 15 bp, Homo sapiens
tgtacagtatgtgaa

SEQ ID NO: 145374 - DNA, 15 bp, Homo sapiens
ctgtacagtatgtga

SEQ ID NO: 145375 - DNA, 15 bp, Homo sapiens
actgtacagtatgtg

SEQ ID NO: 145376 - DNA, 15 bp, Homo sapiens
aactgtacagtatgt

SEQ ID NO: 145377 - DNA, 15 bp, Homo sapiens
gaactgtacagtatg

SEQ ID NO: 145378 - DNA, 15 bp, Homo sapiens
tgaactgtacagtat

SEQ ID NO: 145379 - DNA, 15 bp, Homo sapiens
atgaactgtacagta

SEQ ID NO: 145380 - DNA, 15 bp, Homo sapiens
aatgaactgtacagt

SEQ ID NO: 145381 - DNA, 15 bp, Homo sapiens
gaatgaactgtacag

SEQ ID NO: 145382 - DNA, 15 bp, Homo sapiens
tgaatgaactgtaca

SEQ ID NO: 145383 - DNA, 15 bp, Homo sapiens
atgaatgaactgtac

SEQ ID NO: 145384 - DNA, 15 bp, Homo sapiens
aatgaatgaactgta

SEQ ID NO: 145385 - DNA, 15 bp, Homo sapiens
aaatgaatgaactgt

SEQ ID NO: 145386 - DNA, 15 bp, Homo sapiens
taaatgaatgaactg

SEQ ID NO: 145387 - DNA, 15 bp, Homo sapiens
ttaaatgaatgaact

SEQ ID NO: 145388 - DNA, 15 bp, Homo sapiens
tttaaatgaatgaac

SEQ ID NO: 145389 - DNA, 15 bp, Homo sapiens
atttaaatgaatgaa

SEQ ID NO: 145390 - DNA, 15 bp, Homo sapiens
aatttaaatgaatga

SEQ ID NO: 145391 - DNA, 15 bp, Homo sapiens
aaatttaaatgaatg

SEQ ID NO: 145392 - DNA, 15 bp, Homo sapiens
aaaatttaaatgaat

SEQ ID NO: 145393 - DNA, 15 bp, Homo sapiens
taaaatttaaatgaa

SEQ ID NO: 145394 - DNA, 15 bp, Homo sapiens
gtaaaatttaaatga

SEQ ID NO: 145395 - DNA, 15 bp, Homo sapiens
tgtaaaatttaaatg

SEQ ID NO: 145396 - DNA, 15 bp, Homo sapiens
ttgtaaaatttaaat

SEQ ID NO: 145397 - DNA, 15 bp, Homo sapiens
attgtaaaatttaaa

SEQ ID NO: 145398 - DNA, 15 bp, Homo sapiens
aattgtaaaatttaa

SEQ ID NO: 145399 - DNA, 15 bp, Homo sapiens
gaattgtaaaattta

SEQ ID NO: 145400 - DNA, 15 bp, Homo sapiens
tgaattgtaaaattt

SEQ ID NO: 145401 - DNA, 15 bp, Homo sapiens
atgaattgtaaaatt

SEQ ID NO: 145402 - DNA, 15 bp, Homo sapiens
aatgaattgtaaaat

SEQ ID NO: 145403 - DNA, 15 bp, Homo sapiens
aaatgaattgtaaaa

SEQ ID NO: 145404 - DNA, 15 bp, Homo sapiens
caaatgaattgtaaa

SEQ ID NO: 145405 - DNA, 15 bp, Homo sapiens
acaaatgaattgtaa

SEQ ID NO: 145406 - DNA, 15 bp, Homo sapiens
aacaaatgaattgta

SEQ ID NO: 145407 - DNA, 15 bp, Homo sapiens
aaacaaatgaattgt

SEQ ID NO: 145408 - DNA, 15 bp, Homo sapiens
gaaacaaatgaattg

SEQ ID NO: 145409 - DNA, 15 bp, Homo sapiens
agaaacaaatgaatt

SEQ ID NO: 145410 - DNA, 15 bp, Homo sapiens
tagaaacaaatgaat

SEQ ID NO: 145411 - DNA, 15 bp, Homo sapiens
ctagaaacaaatgaa

SEQ ID NO: 145412 - DNA, 15 bp, Homo sapiens
actagaaacaaatga

SEQ ID NO: 145413 - DNA, 15 bp, Homo sapiens
gactagaaacaaatg

SEQ ID NO: 145414 - DNA, 15 bp, Homo sapiens
agactagaaacaaat

SEQ ID NO: 145415 - DNA, 15 bp, Homo sapiens
tagactagaaacaaa

SEQ ID NO: 145416 - DNA, 15 bp, Homo sapiens
atagactagaaacaa

SEQ ID NO: 145417 - DNA, 15 bp, Homo sapiens
aatagactagaaaca

SEQ ID NO: 145418 - DNA, 15 bp, Homo sapiens
gaatagactagaaac

SEQ ID NO: 145419 - DNA, 15 bp, Homo sapiens
tgaatagactagaaa

SEQ ID NO: 145420 - DNA, 15 bp, Homo sapiens
gtgaatagactagaa

SEQ ID NO: 145421 - DNA, 15 bp, Homo sapiens
cgtgaatagactaga

SEQ ID NO: 145422 - DNA, 15 bp, Homo sapiens
tcgtgaatagactag

SEQ ID NO: 145423 - DNA, 15 bp, Homo sapiens
atcgtgaatagacta

SEQ ID NO: 145424 - DNA, 15 bp, Homo sapiens
aatcgtgaatagact

SEQ ID NO: 145425 - DNA, 15 bp, Homo sapiens
caatcgtgaatagac

SEQ ID NO: 145426 - DNA, 15 bp, Homo sapiens
acaatcgtgaataga

SEQ ID NO: 145427 - DNA, 15 bp, Homo sapiens
tacaatcgtgaatag

SEQ ID NO: 145428 - DNA, 15 bp, Homo sapiens
gtacaatcgtgaata

SEQ ID NO: 145429 - DNA, 15 bp, Homo sapiens
cgtacaatcgtgaat

SEQ ID NO: 145430 - DNA, 15 bp, Homo sapiens
tcgtacaatcgtgaa

SEQ ID NO: 145431 - DNA, 15 bp, Homo sapiens
gtcgtacaatcgtga

SEQ ID NO: 145432 - DNA, 15 bp, Homo sapiens
ggtcgtacaatcgtg

SEQ ID NO: 145433 - DNA, 15 bp, Homo sapiens
tggtcgtacaatcgt

SEQ ID NO: 145434 - DNA, 15 bp, Homo sapiens
atggtcgtacaatcg

SEQ ID NO: 145435 - DNA, 15 bp, Homo sapiens
gatggtcgtacaatc

SEQ ID NO: 145436 - DNA, 15 bp, Homo sapiens
tgatggtcgtacaat

SEQ ID NO: 145437 - DNA, 15 bp, Homo sapiens
gtgatggtcgtacaa

SEQ ID NO: 145438 - DNA, 15 bp, Homo sapiens
ggtgatggtcgtaca

SEQ ID NO: 145439 - DNA, 15 bp, Homo sapiens
tggtgatggtcgtac

SEQ ID NO: 145440 - DNA, 15 bp, Homo sapiens
gtggtgatggtcgta

SEQ ID NO: 145441 - DNA, 15 bp, Homo sapiens
tgtggtgatggtcgt

SEQ ID NO: 145442 - DNA, 15 bp, Homo sapiens
ttgtggtgatggtcg

SEQ ID NO: 145443 - DNA, 15 bp, Homo sapiens
attgtggtgatggtc

SEQ ID NO: 145444 - DNA, 15 bp, Homo sapiens
gattgtggtgatggt

SEQ ID NO: 145445 - DNA, 15 bp, Homo sapiens
tgattgtggtgatgg

SEQ ID NO: 145446 - DNA, 15 bp, Homo sapiens
ttgattgtggtgatg

SEQ ID NO: 145447 - DNA, 15 bp, Homo sapiens
cttgattgtggtgat

SEQ ID NO: 145448 - DNA, 15 bp, Homo sapiens
acttgattgtggtga

SEQ ID NO: 145449 - DNA, 15 bp, Homo sapiens
aacttgattgtggtg

SEQ ID NO: 145450 - DNA, 15 bp, Homo sapiens
taacttgattgtggt

SEQ ID NO: 145451 - DNA, 15 bp, Homo sapiens
ctaacttgattgtgg

SEQ ID NO: 145452 - DNA, 15 bp, Homo sapiens
tctaacttgattgtg

SEQ ID NO: 145453 - DNA, 15 bp, Homo sapiens
ttctaacttgattgt

SEQ ID NO: 145454 - DNA, 15 bp, Homo sapiens
gttctaacttgattg

SEQ ID NO: 145455 - DNA, 15 bp, Homo sapiens
tgttctaacttgatt

SEQ ID NO: 145456 - DNA, 15 bp, Homo sapiens
atgttctaacttgat

SEQ ID NO: 145457 - DNA, 15 bp, Homo sapiens
aatgttctaacttga

SEQ ID NO: 145458 - DNA, 15 bp, Homo sapiens
aaatgttctaacttg

SEQ ID NO: 145459 - DNA, 15 bp, Homo sapiens
aaaatgttctaactt

SEQ ID NO: 145460 - DNA, 15 bp, Homo sapiens
gaaaatgttctaact

SEQ ID NO: 145461 - DNA, 15 bp, Homo sapiens
tgaaaatgttctaac

SEQ ID NO: 145462 - DNA, 15 bp, Homo sapiens
atgaaaatgttctaa

SEQ ID NO: 145463 - DNA, 15 bp, Homo sapiens
aatgaaaatgttcta

SEQ ID NO: 145464 - DNA, 15 bp, Homo sapiens
taatgaaaatgttct

SEQ ID NO: 145465 - DNA, 15 bp, Homo sapiens
gtaatgaaaatgttc

SEQ ID NO: 145466 - DNA, 15 bp, Homo sapiens
ggtaatgaaaatgtt

SEQ ID NO: 145467 - DNA, 15 bp, Homo sapiens
aggtaatgaaaatgt

SEQ ID NO: 145468 - DNA, 15 bp, Homo sapiens
gaggtaatgaaaatg

SEQ ID NO: 145469 - DNA, 15 bp, Homo sapiens
tgaggtaatgaaaat

SEQ ID NO: 145470 - DNA, 15 bp, Homo sapiens
ctgaggtaatgaaaa

SEQ ID NO: 145471 - DNA, 15 bp, Homo sapiens
tctgaggtaatgaaa

SEQ ID NO: 145472 - DNA, 15 bp, Homo sapiens
ttctgaggtaatgaa

SEQ ID NO: 145473 - DNA, 15 bp, Homo sapiens
tttctgaggtaatga

SEQ ID NO: 145474 - DNA, 15 bp, Homo sapiens
ctttctgaggtaatg

SEQ ID NO: 145475 - DNA, 15 bp, Homo sapiens
tctttctgaggtaat

SEQ ID NO: 145476 - DNA, 15 bp, Homo sapiens
ttctttctgaggtaa

SEQ ID NO: 145477 - DNA, 15 bp, Homo sapiens
tttctttctgaggta

SEQ ID NO: 145478 - DNA, 15 bp, Homo sapiens
gtttctttctgaggt

SEQ ID NO: 145479 - DNA, 15 bp, Homo sapiens
ggtttctttctgagg

SEQ ID NO: 145480 - DNA, 15 bp, Homo sapiens
gggtttctttctgag

SEQ ID NO: 145481 - DNA, 15 bp, Homo sapiens
ggggtttctttctga

SEQ ID NO: 145482 - DNA, 15 bp, Homo sapiens
aggggtttctttctg

SEQ ID NO: 145483 - DNA, 15 bp, Homo sapiens
aaggggtttctttct

SEQ ID NO: 145484 - DNA, 15 bp, Homo sapiens
gaaggggtttctttc

SEQ ID NO: 145485 - DNA, 15 bp, Homo sapiens
ggaaggggtttcttt

SEQ ID NO: 145486 - DNA, 15 bp, Homo sapiens
gggaaggggtttctt

SEQ ID NO: 145487 - DNA, 15 bp, Homo sapiens
agggaaggggtttct

SEQ ID NO: 145488 - DNA, 15 bp, Homo sapiens
aagggaaggggtttc

SEQ ID NO: 145489 - DNA, 15 bp, Homo sapiens
aaagggaaggggttt

SEQ ID NO: 145490 - DNA, 15 bp, Homo sapiens
taaagggaaggggtt

SEQ ID NO: 145491 - DNA, 15 bp, Homo sapiens
gtaaagggaaggggt

SEQ ID NO: 145492 - DNA, 15 bp, Homo sapiens
agtaaagggaagggg

SEQ ID NO: 145493 - DNA, 15 bp, Homo sapiens
tagtaaagggaaggg

SEQ ID NO: 145494 - DNA, 15 bp, Homo sapiens
ctagtaaagggaagg

SEQ ID NO: 145495 - DNA, 15 bp, Homo sapiens
gctagtaaagggaag

SEQ ID NO: 145496 - DNA, 15 bp, Homo sapiens
tgctagtaaagggaa

SEQ ID NO: 145497 - DNA, 15 bp, Homo sapiens
ttgctagtaaaggga

SEQ ID NO: 145498 - DNA, 15 bp, Homo sapiens
attgctagtaaaggg

SEQ ID NO: 145499 - DNA, 15 bp, Homo sapiens
aattgctagtaaagg

SEQ ID NO: 145500 - DNA, 15 bp, Homo sapiens
aaattgctagtaaag

SEQ ID NO: 145501 - DNA, 15 bp, Homo sapiens
gaaattgctagtaaa

SEQ ID NO: 145502 - DNA, 15 bp, Homo sapiens
ggaaattgctagtaa

SEQ ID NO: 145503 - DNA, 15 bp, Homo sapiens
gggaaattgctagta

SEQ ID NO: 145504 - DNA, 15 bp, Homo sapiens
tgggaaattgctagt

SEQ ID NO: 145505 - DNA, 15 bp, Homo sapiens
atgggaaattgctag

SEQ ID NO: 145506 - DNA, 15 bp, Homo sapiens
aatgggaaattgcta

SEQ ID NO: 145507 - DNA, 15 bp, Homo sapiens
gaatgggaaattgct

SEQ ID NO: 145508 - DNA, 15 bp, Homo sapiens
ggaatgggaaattgc

SEQ ID NO: 145509 - DNA, 15 bp, Homo sapiens
aggaatgggaaattg

SEQ ID NO: 145510 - DNA, 15 bp, Homo sapiens
gaggaatgggaaatt

SEQ ID NO: 145511 - DNA, 15 bp, Homo sapiens
ggaggaatgggaaat

SEQ ID NO: 145512 - DNA, 15 bp, Homo sapiens
gggaggaatgggaaa

SEQ ID NO: 145513 - DNA, 15 bp, Homo sapiens
ggggaggaatgggaa

SEQ ID NO: 145514 - DNA, 15 bp, Homo sapiens
cggggaggaatggga

SEQ ID NO: 145515 - DNA, 15 bp, Homo sapiens
gcggggaggaatggg

SEQ ID NO: 145516 - DNA, 15 bp, Homo sapiens
ggcggggaggaatgg

SEQ ID NO: 145517 - DNA, 15 bp, Homo sapiens
tggcggggaggaatg

SEQ ID NO: 145518 - DNA, 15 bp, Homo sapiens
ttggcggggaggaat

SEQ ID NO: 145519 - DNA, 15 bp, Homo sapiens
attggcggggaggaa

SEQ ID NO: 145520 - DNA, 15 bp, Homo sapiens
aattggcggggagga

SEQ ID NO: 145521 - DNA, 15 bp, Homo sapiens
gaattggcggggagg

SEQ ID NO: 145522 - DNA, 15 bp, Homo sapiens
ggaattggcggggag

SEQ ID NO: 145523 - DNA, 15 bp, Homo sapiens
gggaattggcgggga

SEQ ID NO: 145524 - DNA, 15 bp, Homo sapiens
agggaattggcgggg

SEQ ID NO: 145525 - DNA, 15 bp, Homo sapiens
gagggaattggcggg

SEQ ID NO: 145526 - DNA, 15 bp, Homo sapiens
ggagggaattggcgg

SEQ ID NO: 145527 - DNA, 15 bp, Homo sapiens
gggagggaattggcg

SEQ ID NO: 145528 - DNA, 15 bp, Homo sapiens
ggggagggaattggc

SEQ ID NO: 145529 - DNA, 15 bp, Homo sapiens
aggggagggaattgg

SEQ ID NO: 145530 - DNA, 15 bp, Homo sapiens
gaggggagggaattg

SEQ ID NO: 145531 - DNA, 15 bp, Homo sapiens
agaggggagggaatt

SEQ ID NO: 145532 - DNA, 15 bp, Homo sapiens
cagaggggagggaat

SEQ ID NO: 145533 - DNA, 15 bp, Homo sapiens
tcagaggggagggaa

SEQ ID NO: 145534 - DNA, 15 bp, Homo sapiens
ttcagaggggaggga

SEQ ID NO: 145535 - DNA, 15 bp, Homo sapiens
gttcagaggggaggg

SEQ ID NO: 145536 - DNA, 15 bp, Homo sapiens
tgttcagaggggagg

SEQ ID NO: 145537 - DNA, 15 bp, Homo sapiens
ttgttcagaggggag

SEQ ID NO: 145538 - DNA, 15 bp, Homo sapiens
attgttcagagggga

SEQ ID NO: 145539 - DNA, 15 bp, Homo sapiens
gattgttcagagggg

SEQ ID NO: 145540 - DNA, 15 bp, Homo sapiens
tgattgttcagaggg

SEQ ID NO: 145541 - DNA, 15 bp, Homo sapiens
gtgattgttcagagg

SEQ ID NO: 145542 - DNA, 15 bp, Homo sapiens
agtgattgttcagag

SEQ ID NO: 145543 - DNA, 15 bp, Homo sapiens
tagtgattgttcaga

SEQ ID NO: 145544 - DNA, 15 bp, Homo sapiens
ttagtgattgttcag

SEQ ID NO: 145545 - DNA, 15 bp, Homo sapiens
attagtgattgttca

SEQ ID NO: 145546 - DNA, 15 bp, Homo sapiens
gattagtgattgttc

SEQ ID NO: 145547 - DNA, 15 bp, Homo sapiens
agattagtgattgtt

SEQ ID NO: 145548 - DNA, 15 bp, Homo sapiens
tagattagtgattgt

SEQ ID NO: 145549 - DNA, 15 bp, Homo sapiens
atagattagtgattg

SEQ ID NO: 145550 - DNA, 15 bp, Homo sapiens
aatagattagtgatt

SEQ ID NO: 145551 - DNA, 15 bp, Homo sapiens
aaatagattagtgat

SEQ ID NO: 145552 - DNA, 15 bp, Homo sapiens
gaaatagattagtga

SEQ ID NO: 145553 - DNA, 15 bp, Homo sapiens
agaaatagattagtg

SEQ ID NO: 145554 - DNA, 15 bp, Homo sapiens
tagaaatagattagt

SEQ ID NO: 145555 - DNA, 15 bp, Homo sapiens
atagaaatagattag

SEQ ID NO: 145556 - DNA, 15 bp, Homo sapiens
gatagaaatagatta

SEQ ID NO: 145557 - DNA, 15 bp, Homo sapiens
agatagaaatagatt

SEQ ID NO: 145558 - DNA, 15 bp, Homo sapiens
tagatagaaatagat

SEQ ID NO: 145559 - DNA, 15 bp, Homo sapiens
atagatagaaataga

SEQ ID NO: 145560 - DNA, 15 bp, Homo sapiens
aatagatagaaatag

SEQ ID NO: 145561 - DNA, 15 bp, Homo sapiens
aaatagatagaaata

SEQ ID NO: 145562 - DNA, 15 bp, Homo sapiens
caaatagatagaaat

SEQ ID NO: 145563 - DNA, 15 bp, Homo sapiens
gcaaatagatagaaa

SEQ ID NO: 145564 - DNA, 15 bp, Homo sapiens
ggcaaatagatagaa

SEQ ID NO: 145565 - DNA, 15 bp, Homo sapiens
tggcaaatagataga

SEQ ID NO: 145566 - DNA, 15 bp, Homo sapiens
ttggcaaatagatag

SEQ ID NO: 145567 - DNA, 15 bp, Homo sapiens
tttggcaaatagata

SEQ ID NO: 145568 - DNA, 15 bp, Homo sapiens
atttggcaaatagat

SEQ ID NO: 145569 - DNA, 15 bp, Homo sapiens
tatttggcaaataga

SEQ ID NO: 145570 - DNA, 15 bp, Homo sapiens
gtatttggcaaatag

SEQ ID NO: 145571 - DNA, 15 bp, Homo sapiens
ggtatttggcaaata

SEQ ID NO: 145572 - DNA, 15 bp, Homo sapiens
aggtatttggcaaat

SEQ ID NO: 145573 - DNA, 15 bp, Homo sapiens
aaggtatttggcaaa

SEQ ID NO: 145574 - DNA, 15 bp, Homo sapiens
taaggtatttggcaa

SEQ ID NO: 145575 - DNA, 15 bp, Homo sapiens
ttaaggtatttggca

SEQ ID NO: 145576 - DNA, 15 bp, Homo sapiens
gttaaggtatttggc

SEQ ID NO: 145577 - DNA, 15 bp, Homo sapiens
tgttaaggtatttgg

SEQ ID NO: 145578 - DNA, 15 bp, Homo sapiens
atgttaaggtatttg

SEQ ID NO: 145579 - DNA, 15 bp, Homo sapiens
aatgttaaggtattt

SEQ ID NO: 145580 - DNA, 15 bp, Homo sapiens
aaatgttaaggtatt

SEQ ID NO: 145581 - DNA, 15 bp, Homo sapiens
aaaatgttaaggtat

SEQ ID NO: 145582 - DNA, 15 bp, Homo sapiens
taaaatgttaaggta

SEQ ID NO: 145583 - DNA, 15 bp, Homo sapiens
ataaaatgttaaggt

SEQ ID NO: 145584 - DNA, 15 bp, Homo sapiens
tataaaatgttaagg

SEQ ID NO: 145585 - DNA, 15 bp, Homo sapiens
gtataaaatgttaag

SEQ ID NO: 145586 - DNA, 15 bp, Homo sapiens
agtataaaatgttaa

SEQ ID NO: 145587 - DNA, 15 bp, Homo sapiens
gagtataaaatgtta

SEQ ID NO: 145588 - DNA, 15 bp, Homo sapiens
agagtataaaatgtt

SEQ ID NO: 145589 - DNA, 15 bp, Homo sapiens
tagagtataaaatgt

SEQ ID NO: 145590 - DNA, 15 bp, Homo sapiens
atagagtataaaatg

SEQ ID NO: 145591 - DNA, 15 bp, Homo sapiens
gatagagtataaaat

SEQ ID NO: 145592 - DNA, 15 bp, Homo sapiens
ggatagagtataaaa

SEQ ID NO: 145593 - DNA, 15 bp, Homo sapiens
aggatagagtataaa

SEQ ID NO: 145594 - DNA, 15 bp, Homo sapiens
aaggatagagtataa

SEQ ID NO: 145595 - DNA, 15 bp, Homo sapiens
aaaggatagagtata

SEQ ID NO: 145596 - DNA, 15 bp, Homo sapiens
caaaggatagagtat

SEQ ID NO: 145597 - DNA, 15 bp, Homo sapiens
tcaaaggatagagta

SEQ ID NO: 145598 - DNA, 15 bp, Homo sapiens
ttcaaaggatagagt

SEQ ID NO: 145599 - DNA, 15 bp, Homo sapiens
attcaaaggatagag

SEQ ID NO: 145600 - DNA, 15 bp, Homo sapiens
tattcaaaggataga

SEQ ID NO: 145601 - DNA, 15 bp, Homo sapiens
atattcaaaggatag

SEQ ID NO: 145602 - DNA, 15 bp, Homo sapiens
catattcaaaggata

SEQ ID NO: 145603 - DNA, 15 bp, Homo sapiens
acatattcaaaggat

SEQ ID NO: 145604 - DNA, 15 bp, Homo sapiens
aacatattcaaagga

SEQ ID NO: 145605 - DNA, 15 bp, Homo sapiens
gaacatattcaaagg

SEQ ID NO: 145606 - DNA, 15 bp, Homo sapiens
agaacatattcaaag

SEQ ID NO: 145607 - DNA, 15 bp, Homo sapiens
gagaacatattcaaa

SEQ ID NO: 145608 - DNA, 15 bp, Homo sapiens
ggagaacatattcaa

SEQ ID NO: 145609 - DNA, 15 bp, Homo sapiens
tggagaacatattca

SEQ ID NO: 145610 - DNA, 15 bp, Homo sapiens
gtggagaacatattc

SEQ ID NO: 145611 - DNA, 15 bp, Homo sapiens
agtggagaacatatt

SEQ ID NO: 145612 - DNA, 15 bp, Homo sapiens
aagtggagaacatat

SEQ ID NO: 145613 - DNA, 15 bp, Homo sapiens
aaagtggagaacata

SEQ ID NO: 145614 - DNA, 15 bp, Homo sapiens
aaaagtggagaacat

SEQ ID NO: 145615 - DNA, 15 bp, Homo sapiens
caaaagtggagaaca

SEQ ID NO: 145616 - DNA, 15 bp, Homo sapiens
ccaaaagtggagaac

SEQ ID NO: 145617 - DNA, 15 bp, Homo sapiens
gccaaaagtggagaa

SEQ ID NO: 145618 - DNA, 15 bp, Homo sapiens
agccaaaagtggaga

SEQ ID NO: 145619 - DNA, 15 bp, Homo sapiens
aagccaaaagtggag

SEQ ID NO: 145620 - DNA, 15 bp, Homo sapiens
aaagccaaaagtgga

SEQ ID NO: 145621 - DNA, 15 bp, Homo sapiens
taaagccaaaagtgg

SEQ ID NO: 145622 - DNA, 15 bp, Homo sapiens
gtaaagccaaaagtg

SEQ ID NO: 145623 - DNA, 15 bp, Homo sapiens
tgtaaagccaaaagt

SEQ ID NO: 145624 - DNA, 15 bp, Homo sapiens
gtgtaaagccaaaag

SEQ ID NO: 145625 - DNA, 15 bp, Homo sapiens
tgtgtaaagccaaaa

SEQ ID NO: 145626 - DNA, 15 bp, Homo sapiens
ctgtgtaaagccaaa

SEQ ID NO: 145627 - DNA, 15 bp, Homo sapiens
tctgtgtaaagccaa

SEQ ID NO: 145628 - DNA, 15 bp, Homo sapiens
atctgtgtaaagcca

SEQ ID NO: 145629 - DNA, 15 bp, Homo sapiens
tatctgtgtaaagcc

SEQ ID NO: 145630 - DNA, 15 bp, Homo sapiens
atatctgtgtaaagc

SEQ ID NO: 145631 - DNA, 15 bp, Homo sapiens
catatctgtgtaaag

SEQ ID NO: 145632 - DNA, 15 bp, Homo sapiens
ccatatctgtgtaaa

SEQ ID NO: 145633 - DNA, 15 bp, Homo sapiens
accatatctgtgtaa

SEQ ID NO: 145634 - DNA, 15 bp, Homo sapiens
caccatatctgtgta

SEQ ID NO: 145635 - DNA, 15 bp, Homo sapiens
tcaccatatctgtgt

SEQ ID NO: 145636 - DNA, 15 bp, Homo sapiens
gtcaccatatctgtg

SEQ ID NO: 145637 - DNA, 15 bp, Homo sapiens
tgtcaccatatctgt

SEQ ID NO: 145638 - DNA, 15 bp, Homo sapiens
atgtcaccatatctg

SEQ ID NO: 145639 - DNA, 15 bp, Homo sapiens
aatgtcaccatatct

SEQ ID NO: 145640 - DNA, 15 bp, Homo sapiens
caatgtcaccatatc

SEQ ID NO: 145641 - DNA, 15 bp, Homo sapiens
acaatgtcaccatat

SEQ ID NO: 145642 - DNA, 15 bp, Homo sapiens
aacaatgtcaccata

SEQ ID NO: 145643 - DNA, 15 bp, Homo sapiens
taacaatgtcaccat

SEQ ID NO: 145644 - DNA, 15 bp, Homo sapiens
ctaacaatgtcacca

SEQ ID NO: 145645 - DNA, 15 bp, Homo sapiens
gctaacaatgtcacc

SEQ ID NO: 145646 - DNA, 15 bp, Homo sapiens
ggctaacaatgtcac

SEQ ID NO: 145647 - DNA, 15 bp, Homo sapiens
aggctaacaatgtca

SEQ ID NO: 145648 - DNA, 15 bp, Homo sapiens
gaggctaacaatgtc

SEQ ID NO: 145649 - DNA, 15 bp, Homo sapiens
tgaggctaacaatgt

SEQ ID NO: 145650 - DNA, 15 bp, Homo sapiens
gtgaggctaacaatg

SEQ ID NO: 145651 - DNA, 15 bp, Homo sapiens
ggtgaggctaacaat

SEQ ID NO: 145652 - DNA, 15 bp, Homo sapiens
tggtgaggctaacaa

SEQ ID NO: 145653 - DNA, 15 bp, Homo sapiens
ctggtgaggctaaca

SEQ ID NO: 145654 - DNA, 15 bp, Homo sapiens
tctggtgaggctaac

SEQ ID NO: 145655 - DNA, 15 bp, Homo sapiens
ctctggtgaggctaa

SEQ ID NO: 145656 - DNA, 15 bp, Homo sapiens
cctctggtgaggcta

SEQ ID NO: 145657 - DNA, 15 bp, Homo sapiens
ccctctggtgaggct

SEQ ID NO: 145658 - DNA, 15 bp, Homo sapiens
tccctctggtgaggc

SEQ ID NO: 145659 - DNA, 15 bp, Homo sapiens
ctccctctggtgagg

SEQ ID NO: 145660 - DNA, 15 bp, Homo sapiens
cctccctctggtgag

SEQ ID NO: 145661 - DNA, 15 bp, Homo sapiens
gcctccctctggtga

SEQ ID NO: 145662 - DNA, 15 bp, Homo sapiens
tgcctccctctggtg

SEQ ID NO: 145663 - DNA, 15 bp, Homo sapiens
ctgcctccctctggt

SEQ ID NO: 145664 - DNA, 15 bp, Homo sapiens
actgcctccctctgg

SEQ ID NO: 145665 - DNA, 15 bp, Homo sapiens
cactgcctccctctg

SEQ ID NO: 145666 - DNA, 15 bp, Homo sapiens
acactgcctccctct

SEQ ID NO: 145667 - DNA, 15 bp, Homo sapiens
tacactgcctccctc

SEQ ID NO: 145668 - DNA, 15 bp, Homo sapiens
ctacactgcctccct

SEQ ID NO: 145669 - DNA, 15 bp, Homo sapiens
tctacactgcctccc

SEQ ID NO: 145670 - DNA, 15 bp, Homo sapiens
atctacactgcctcc

SEQ ID NO: 145671 - DNA, 15 bp, Homo sapiens
aatctacactgcctc

SEQ ID NO: 145672 - DNA, 15 bp, Homo sapiens
gaatctacactgcct

SEQ ID NO: 145673 - DNA, 15 bp, Homo sapiens
agaatctacactgcc

SEQ ID NO: 145674 - DNA, 15 bp, Homo sapiens
gagaatctacactgc

SEQ ID NO: 145675 - DNA, 15 bp, Homo sapiens
tgagaatctacactg

SEQ ID NO: 145676 - DNA, 15 bp, Homo sapiens
ctgagaatctacact

SEQ ID NO: 145677 - DNA, 15 bp, Homo sapiens
actgagaatctacac

SEQ ID NO: 145678 - DNA, 15 bp, Homo sapiens
tactgagaatctaca

SEQ ID NO: 145679 - DNA, 15 bp, Homo sapiens
atactgagaatctac

SEQ ID NO: 145680 - DNA, 15 bp, Homo sapiens
catactgagaatcta

SEQ ID NO: 145681 - DNA, 15 bp, Homo sapiens
ccatactgagaatct

SEQ ID NO: 145682 - DNA, 15 bp, Homo sapiens
tccatactgagaatc

SEQ ID NO: 145683 - DNA, 15 bp, Homo sapiens
gtccatactgagaat

SEQ ID NO: 145684 - DNA, 15 bp, Homo sapiens
ggtccatactgagaa

SEQ ID NO: 145685 - DNA, 15 bp, Homo sapiens
aggtccatactgaga

SEQ ID NO: 145686 - DNA, 15 bp, Homo sapiens
caggtccatactgag

SEQ ID NO: 145687 - DNA, 15 bp, Homo sapiens
gcaggtccatactga

SEQ ID NO: 145688 - DNA, 15 bp, Homo sapiens
tgcaggtccatactg

SEQ ID NO: 145689 - DNA, 15 bp, Homo sapiens
ctgcaggtccatact

SEQ ID NO: 145690 - DNA, 15 bp, Homo sapiens
cctgcaggtccatac

SEQ ID NO: 145691 - DNA, 15 bp, Homo sapiens
ccctgcaggtccata

SEQ ID NO: 145692 - DNA, 15 bp, Homo sapiens
tccctgcaggtccat

SEQ ID NO: 145693 - DNA, 15 bp, Homo sapiens
ttccctgcaggtcca

SEQ ID NO: 145694 - DNA, 15 bp, Homo sapiens
tttccctgcaggtcc

SEQ ID NO: 145695 - DNA, 15 bp, Homo sapiens
ttttccctgcaggtc

SEQ ID NO: 145696 - DNA, 15 bp, Homo sapiens
tttttccctgcaggt

SEQ ID NO: 145697 - DNA, 15 bp, Homo sapiens
ttttttccctgcagg

SEQ ID NO: 145698 - DNA, 15 bp, Homo sapiens
cttttttccctgcag

SEQ ID NO: 145699 - DNA, 15 bp, Homo sapiens
tcttttttccctgca

SEQ ID NO: 145700 - DNA, 15 bp, Homo sapiens
atcttttttccctgc

SEQ ID NO: 145701 - DNA, 15 bp, Homo sapiens
tatcttttttccctg

SEQ ID NO: 145702 - DNA, 15 bp, Homo sapiens
gtatcttttttccct

SEQ ID NO: 145703 - DNA, 15 bp, Homo sapiens
tgtatcttttttccc

SEQ ID NO: 145704 - DNA, 15 bp, Homo sapiens
ctgtatcttttttcc

SEQ ID NO: 145705 - DNA, 15 bp, Homo sapiens
cctgtatcttttttc

SEQ ID NO: 145706 - DNA, 15 bp, Homo sapiens
gcctgtatctttttt

SEQ ID NO: 145707 - DNA, 15 bp, Homo sapiens
tgcctgtatcttttt

SEQ ID NO: 145708 - DNA, 15 bp, Homo sapiens
ctgcctgtatctttt

SEQ ID NO: 145709 - DNA, 15 bp, Homo sapiens
tctgcctgtatcttt

SEQ ID NO: 145710 - DNA, 15 bp, Homo sapiens
ttctgcctgtatctt

SEQ ID NO: 145711 - DNA, 15 bp, Homo sapiens
cttctgcctgtatct

SEQ ID NO: 145712 - DNA, 15 bp, Homo sapiens
acttctgcctgtatc

SEQ ID NO: 145713 - DNA, 15 bp, Homo sapiens
gacttctgcctgtat

SEQ ID NO: 145714 - DNA, 15 bp, Homo sapiens
ggacttctgcctgta

SEQ ID NO: 145715 - DNA, 15 bp, Homo sapiens
tggacttctgcctgt

SEQ ID NO: 145716 - DNA, 15 bp, Homo sapiens
gtggacttctgcctg

SEQ ID NO: 145717 - DNA, 15 bp, Homo sapiens
tgtggacttctgcct

SEQ ID NO: 145718 - DNA, 15 bp, Homo sapiens
ctgtggacttctgcc

SEQ ID NO: 145719 - DNA, 15 bp, Homo sapiens
tctgtggacttctgc

SEQ ID NO: 145720 - DNA, 15 bp, Homo sapiens
ttctgtggacttctg

SEQ ID NO: 145721 - DNA, 15 bp, Homo sapiens
gttctgtggacttct

SEQ ID NO: 145722 - DNA, 15 bp, Homo sapiens
tgttctgtggacttc

SEQ ID NO: 145723 - DNA, 15 bp, Homo sapiens
gtgttctgtggactt

SEQ ID NO: 145724 - DNA, 15 bp, Homo sapiens
agtgttctgtggact

SEQ ID NO: 145725 - DNA, 15 bp, Homo sapiens
cagtgttctgtggac

SEQ ID NO: 145726 - DNA, 15 bp, Homo sapiens
gcagtgttctgtgga

SEQ ID NO: 145727 - DNA, 15 bp, Homo sapiens
ggcagtgttctgtgg

SEQ ID NO: 145728 - DNA, 15 bp, Homo sapiens
aggcagtgttctgtg

SEQ ID NO: 145729 - DNA, 15 bp, Homo sapiens
caggcagtgttctgt

SEQ ID NO: 145730 - DNA, 15 bp, Homo sapiens
tcaggcagtgttctg

SEQ ID NO: 145731 - DNA, 15 bp, Homo sapiens
atcaggcagtgttct

SEQ ID NO: 145732 - DNA, 15 bp, Homo sapiens
catcaggcagtgttc

SEQ ID NO: 145733 - DNA, 15 bp, Homo sapiens
tcatcaggcagtgtt

SEQ ID NO: 145734 - DNA, 15 bp, Homo sapiens
ttcatcaggcagtgt

SEQ ID NO: 145735 - DNA, 15 bp, Homo sapiens
gttcatcaggcagtg

SEQ ID NO: 145736 - DNA, 15 bp, Homo sapiens
tgttcatcaggcagt

SEQ ID NO: 145737 - DNA, 15 bp, Homo sapiens
gtgttcatcaggcag

SEQ ID NO: 145738 - DNA, 15 bp, Homo sapiens
tgtgttcatcaggca

SEQ ID NO: 145739 - DNA, 15 bp, Homo sapiens
ctgtgttcatcaggc

SEQ ID NO: 145740 - DNA, 15 bp, Homo sapiens
actgtgttcatcagg

SEQ ID NO: 145741 - DNA, 15 bp, Homo sapiens
aactgtgttcatcag

SEQ ID NO: 145742 - DNA, 15 bp, Homo sapiens
gaactgtgttcatca

SEQ ID NO: 145743 - DNA, 15 bp, Homo sapiens
agaactgtgttcatc

SEQ ID NO: 145744 - DNA, 15 bp, Homo sapiens
tagaactgtgttcat

SEQ ID NO: 145745 - DNA, 15 bp, Homo sapiens
atagaactgtgttca

SEQ ID NO: 145746 - DNA, 15 bp, Homo sapiens
tatagaactgtgttc

SEQ ID NO: 145747 - DNA, 15 bp, Homo sapiens
ttatagaactgtgtt

SEQ ID NO: 145748 - DNA, 15 bp, Homo sapiens
cttatagaactgtgt

SEQ ID NO: 145749 - DNA, 15 bp, Homo sapiens
tcttatagaactgtg

SEQ ID NO: 145750 - DNA, 15 bp, Homo sapiens
gtcttatagaactgt

SEQ ID NO: 145751 - DNA, 15 bp, Homo sapiens
ggtcttatagaactg

SEQ ID NO: 145752 - DNA, 15 bp, Homo sapiens
gggtcttatagaact

SEQ ID NO: 145753 - DNA, 15 bp, Homo sapiens
tgggtcttatagaac

SEQ ID NO: 145754 - DNA, 15 bp, Homo sapiens
ttgggtcttatagaa

SEQ ID NO: 145755 - DNA, 15 bp, Homo sapiens
attgggtcttataga

SEQ ID NO: 145756 - DNA, 15 bp, Homo sapiens
tattgggtcttatag

SEQ ID NO: 145757 - DNA, 15 bp, Homo sapiens
ttattgggtcttata

SEQ ID NO: 145758 - DNA, 15 bp, Homo sapiens
tttattgggtcttat

SEQ ID NO: 145759 - DNA, 15 bp, Homo sapiens
ctttattgggtctta

SEQ ID NO: 145760 - DNA, 15 bp, Homo sapiens
actttattgggtctt

SEQ ID NO: 145761 - DNA, 15 bp, Homo sapiens
gactttattgggtct

SEQ ID NO: 145762 - DNA, 15 bp, Homo sapiens
cgactttattgggtc

SEQ ID NO: 145763 - DNA, 15 bp, Homo sapiens
ccgactttattgggt

SEQ ID NO: 145764 - DNA, 15 bp, Homo sapiens
gccgactttattggg

SEQ ID NO: 145765 - DNA, 15 bp, Homo sapiens
tgccgactttattgg

SEQ ID NO: 145766 - DNA, 15 bp, Homo sapiens
ttgccgactttattg

SEQ ID NO: 145767 - DNA, 15 bp, Homo sapiens
tttgccgactttatt

SEQ ID NO: 145768 - DNA, 15 bp, Homo sapiens
ctttgccgactttat

SEQ ID NO: 145769 - DNA, 15 bp, Homo sapiens
gctttgccgacttta

SEQ ID NO: 145770 - DNA, 15 bp, Homo sapiens
tgctttgccgacttt

SEQ ID NO: 145771 - DNA, 15 bp, Homo sapiens
gtgctttgccgactt

SEQ ID NO: 145772 - DNA, 15 bp, Homo sapiens
agtgctttgccgact

SEQ ID NO: 145773 - DNA, 15 bp, Homo sapiens
cagtgctttgccgac

SEQ ID NO: 145774 - DNA, 15 bp, Homo sapiens
gcagtgctttgccga

SEQ ID NO: 145775 - DNA, 15 bp, Homo sapiens
agcagtgctttgccg

SEQ ID NO: 145776 - DNA, 15 bp, Homo sapiens
aagcagtgctttgcc

SEQ ID NO: 145777 - DNA, 15 bp, Homo sapiens
caagcagtgctttgc

SEQ ID NO: 145778 - DNA, 15 bp, Homo sapiens
tcaagcagtgctttg

SEQ ID NO: 145779 - DNA, 15 bp, Homo sapiens
atcaagcagtgcttt

SEQ ID NO: 145780 - DNA, 15 bp, Homo sapiens
tatcaagcagtgctt

SEQ ID NO: 145781 - DNA, 15 bp, Homo sapiens
ttatcaagcagtgct

SEQ ID NO: 145782 - DNA, 15 bp, Homo sapiens
tttatcaagcagtgc

SEQ ID NO: 145783 - DNA, 15 bp, Homo sapiens
gtttatcaagcagtg

SEQ ID NO: 145784 - DNA, 15 bp, Homo sapiens
tgtttatcaagcagt

SEQ ID NO: 145785 - DNA, 15 bp, Homo sapiens
gtgtttatcaagcag

SEQ ID NO: 145786 - DNA, 15 bp, Homo sapiens
ggtgtttatcaagca

SEQ ID NO: 145787 - DNA, 15 bp, Homo sapiens
cggtgtttatcaagc

SEQ ID NO: 145788 - DNA, 15 bp, Homo sapiens
acggtgtttatcaag

SEQ ID NO: 145789 - DNA, 15 bp, Homo sapiens
aacggtgtttatcaa

SEQ ID NO: 145790 - DNA, 15 bp, Homo sapiens
gaacggtgtttatca

SEQ ID NO: 145791 - DNA, 15 bp, Homo sapiens
agaacggtgtttatc

SEQ ID NO: 145792 - DNA, 15 bp, Homo sapiens
cagaacggtgtttat

SEQ ID NO: 145793 - DNA, 15 bp, Homo sapiens
acagaacggtgttta

SEQ ID NO: 145794 - DNA, 15 bp, Homo sapiens
tacagaacggtgttt

SEQ ID NO: 145795 - DNA, 15 bp, Homo sapiens
ttacagaacggtgtt

SEQ ID NO: 145796 - DNA, 15 bp, Homo sapiens
cttacagaacggtgt

SEQ ID NO: 145797 - DNA, 15 bp, Homo sapiens
tcttacagaacggtg

SEQ ID NO: 145798 - DNA, 15 bp, Homo sapiens
gtcttacagaacggt

SEQ ID NO: 145799 - DNA, 15 bp, Homo sapiens
tgtcttacagaacgg

SEQ ID NO: 145800 - DNA, 15 bp, Homo sapiens
gtgtcttacagaacg

SEQ ID NO: 145801 - DNA, 15 bp, Homo sapiens
tgtgtcttacagaac

SEQ ID NO: 145802 - DNA, 15 bp, Homo sapiens
ttgtgtcttacagaa

SEQ ID NO: 145803 - DNA, 15 bp, Homo sapiens
attgtgtcttacaga

SEQ ID NO: 145804 - DNA, 15 bp, Homo sapiens
tattgtgtcttacag

SEQ ID NO: 145805 - DNA, 15 bp, Homo sapiens
atattgtgtcttaca

SEQ ID NO: 145806 - DNA, 15 bp, Homo sapiens
tatattgtgtcttac

SEQ ID NO: 145807 - DNA, 15 bp, Homo sapiens
ctatattgtgtctta

SEQ ID NO: 145808 - DNA, 15 bp, Homo sapiens
cctatattgtgtctt

SEQ ID NO: 145809 - DNA, 15 bp, Homo sapiens
tcctatattgtgtct

SEQ ID NO: 145810 - DNA, 15 bp, Homo sapiens
gtcctatattgtgtc

SEQ ID NO: 145811 - DNA, 15 bp, Homo sapiens
agtcctatattgtgt

SEQ ID NO: 145812 - DNA, 15 bp, Homo sapiens
aagtcctatattgtg

SEQ ID NO: 145813 - DNA, 15 bp, Homo sapiens
aaagtcctatattgt

SEQ ID NO: 145814 - DNA, 15 bp, Homo sapiens
taaagtcctatattg

SEQ ID NO: 145815 - DNA, 15 bp, Homo sapiens
ttaaagtcctatatt

SEQ ID NO: 145816 - DNA, 15 bp, Homo sapiens
tttaaagtcctatat

SEQ ID NO: 145817 - DNA, 15 bp, Homo sapiens
atttaaagtcctata

SEQ ID NO: 145818 - DNA, 15 bp, Homo sapiens
gatttaaagtcctat

SEQ ID NO: 145819 - DNA, 15 bp, Homo sapiens
cgatttaaagtccta

SEQ ID NO: 145820 - DNA, 15 bp, Homo sapiens
acgatttaaagtcct

SEQ ID NO: 145821 - DNA, 15 bp, Homo sapiens
aacgatttaaagtcc

SEQ ID NO: 145822 - DNA, 15 bp, Homo sapiens
caacgatttaaagtc

SEQ ID NO: 145823 - DNA, 15 bp, Homo sapiens
acaacgatttaaagt

SEQ ID NO: 145824 - DNA, 15 bp, Homo sapiens
tacaacgatttaaag

SEQ ID NO: 145825 - DNA, 15 bp, Homo sapiens
ttacaacgatttaaa

SEQ ID NO: 145826 - DNA, 15 bp, Homo sapiens
gttacaacgatttaa

SEQ ID NO: 145827 - DNA, 15 bp, Homo sapiens
tgttacaacgattta

SEQ ID NO: 145828 - DNA, 15 bp, Homo sapiens
atgttacaacgattt

SEQ ID NO: 145829 - DNA, 15 bp, Homo sapiens
catgttacaacgatt

SEQ ID NO: 145830 - DNA, 15 bp, Homo sapiens
tcatgttacaacgat

SEQ ID NO: 145831 - DNA, 15 bp, Homo sapiens
ttcatgttacaacga

SEQ ID NO: 145832 - DNA, 15 bp, Homo sapiens
cttcatgttacaacg

SEQ ID NO: 145833 - DNA, 15 bp, Homo sapiens
ccttcatgttacaac

SEQ ID NO: 145834 - DNA, 15 bp, Homo sapiens
tccttcatgttacaa

SEQ ID NO: 145835 - DNA, 15 bp, Homo sapiens
gtccttcatgttaca

SEQ ID NO: 145836 - DNA, 15 bp, Homo sapiens
agtccttcatgttac

SEQ ID NO: 145837 - DNA, 15 bp, Homo sapiens
tagtccttcatgtta

SEQ ID NO: 145838 - DNA, 15 bp, Homo sapiens
ttagtccttcatgtt

SEQ ID NO: 145839 - DNA, 15 bp, Homo sapiens
cttagtccttcatgt

SEQ ID NO: 145840 - DNA, 15 bp, Homo sapiens
tcttagtccttcatg

SEQ ID NO: 145841 - DNA, 15 bp, Homo sapiens
ttcttagtccttcat

SEQ ID NO: 145842 - DNA, 15 bp, Homo sapiens
tttcttagtccttca

SEQ ID NO: 145843 - DNA, 15 bp, Homo sapiens
ctttcttagtccttc

SEQ ID NO: 145844 - DNA, 15 bp, Homo sapiens
cctttcttagtcctt

SEQ ID NO: 145845 - DNA, 15 bp, Homo sapiens
gcctttcttagtcct

SEQ ID NO: 145846 - DNA, 15 bp, Homo sapiens
tgcctttcttagtcc

SEQ ID NO: 145847 - DNA, 15 bp, Homo sapiens
ttgcctttcttagtc

SEQ ID NO: 145848 - DNA, 15 bp, Homo sapiens
tttgcctttcttagt

SEQ ID NO: 145849 - DNA, 15 bp, Homo sapiens
atttgcctttcttag

SEQ ID NO: 145850 - DNA, 15 bp, Homo sapiens
catttgcctttctta

SEQ ID NO: 145851 - DNA, 15 bp, Homo sapiens
tcatttgcctttctt

SEQ ID NO: 145852 - DNA, 15 bp, Homo sapiens
ttcatttgcctttct

SEQ ID NO: 145853 - DNA, 15 bp, Homo sapiens
cttcatttgcctttc

SEQ ID NO: 145854 - DNA, 15 bp, Homo sapiens
acttcatttgccttt

SEQ ID NO: 145855 - DNA, 15 bp, Homo sapiens
tacttcatttgcctt

SEQ ID NO: 145856 - DNA, 15 bp, Homo sapiens
ttacttcatttgcct

SEQ ID NO: 145857 - DNA, 15 bp, Homo sapiens
tttacttcatttgcc

SEQ ID NO: 145858 - DNA, 15 bp, Homo sapiens
ctttacttcatttgc

SEQ ID NO: 145859 - DNA, 15 bp, Homo sapiens
cctttacttcatttg

SEQ ID NO: 145860 - DNA, 15 bp, Homo sapiens
tcctttacttcattt

SEQ ID NO: 145861 - DNA, 15 bp, Homo sapiens
ctcctttacttcatt

SEQ ID NO: 145862 - DNA, 15 bp, Homo sapiens
cctcctttacttcat

SEQ ID NO: 145863 - DNA, 15 bp, Homo sapiens
tcctcctttacttca

SEQ ID NO: 145864 - DNA, 15 bp, Homo sapiens
ttcctcctttacttc

SEQ ID NO: 145865 - DNA, 15 bp, Homo sapiens
tttcctcctttactt

SEQ ID NO: 145866 - DNA, 15 bp, Homo sapiens
ttttcctcctttact

SEQ ID NO: 145867 - DNA, 15 bp, Homo sapiens
tttttcctcctttac

SEQ ID NO: 145868 - DNA, 15 bp, Homo sapiens
gtttttcctccttta

SEQ ID NO: 145869 - DNA, 15 bp, Homo sapiens
tgtttttcctccttt

SEQ ID NO: 145870 - DNA, 15 bp, Homo sapiens
ttgtttttcctcctt

SEQ ID NO: 145871 - DNA, 15 bp, Homo sapiens
tttgtttttcctcct

SEQ ID NO: 145872 - DNA, 15 bp, Homo sapiens
atttgtttttcctcc

SEQ ID NO: 145873 - DNA, 15 bp, Homo sapiens
tatttgtttttcctc

SEQ ID NO: 145874 - DNA, 15 bp, Homo sapiens
gtatttgtttttcct

SEQ ID NO: 145875 - DNA, 15 bp, Homo sapiens
agtatttgtttttcc

SEQ ID NO: 145876 - DNA, 15 bp, Homo sapiens
aagtatttgtttttc

SEQ ID NO: 145877 - DNA, 15 bp, Homo sapiens
caagtatttgttttt

SEQ ID NO: 145878 - DNA, 15 bp, Homo sapiens
tcaagtatttgtttt

SEQ ID NO: 145879 - DNA, 15 bp, Homo sapiens
ttcaagtatttgttt

SEQ ID NO: 145880 - DNA, 15 bp, Homo sapiens
tttcaagtatttgtt

SEQ ID NO: 145881 - DNA, 15 bp, Homo sapiens
ttttcaagtatttgt

SEQ ID NO: 145882 - DNA, 15 bp, Homo sapiens
attttcaagtatttg

SEQ ID NO: 145883 - DNA, 15 bp, Homo sapiens
tattttcaagtattt

SEQ ID NO: 145884 - DNA, 15 bp, Homo sapiens
gtattttcaagtatt

SEQ ID NO: 145885 - DNA, 15 bp, Homo sapiens
agtattttcaagtat

SEQ ID NO: 145886 - DNA, 15 bp, Homo sapiens
cagtattttcaagta

SEQ ID NO: 145887 - DNA, 15 bp, Homo sapiens
gcagtattttcaagt

SEQ ID NO: 145888 - DNA, 15 bp, Homo sapiens
tgcagtattttcaag

SEQ ID NO: 145889 - DNA, 15 bp, Homo sapiens
atgcagtattttcaa

SEQ ID NO: 145890 - DNA, 15 bp, Homo sapiens
aatgcagtattttca

SEQ ID NO: 145891 - DNA, 15 bp, Homo sapiens
aaatgcagtattttc

SEQ ID NO: 145892 - DNA, 15 bp, Homo sapiens
gaaatgcagtatttt

SEQ ID NO: 145893 - DNA, 15 bp, Homo sapiens
agaaatgcagtattt

SEQ ID NO: 145894 - DNA, 15 bp, Homo sapiens
aagaaatgcagtatt

SEQ ID NO: 145895 - DNA, 15 bp, Homo sapiens
aaagaaatgcagtat

SEQ ID NO: 145896 - DNA, 15 bp, Homo sapiens
aaaagaaatgcagta

SEQ ID NO: 145897 - DNA, 15 bp, Homo sapiens
taaaagaaatgcagt

SEQ ID NO: 145898 - DNA, 15 bp, Homo sapiens
ttaaaagaaatgcag

SEQ ID NO: 145899 - DNA, 15 bp, Homo sapiens
tttaaaagaaatgca

SEQ ID NO: 145900 - DNA, 15 bp, Homo sapiens
ctttaaaagaaatgc

SEQ ID NO: 145901 - DNA, 15 bp, Homo sapiens
tctttaaaagaaatg

SEQ ID NO: 145902 - DNA, 15 bp, Homo sapiens
ttctttaaaagaaat

SEQ ID NO: 145903 - DNA, 15 bp, Homo sapiens
attctttaaaagaaa

SEQ ID NO: 145904 - DNA, 15 bp, Homo sapiens
gattctttaaaagaa

SEQ ID NO: 145905 - DNA, 15 bp, Homo sapiens
tgattctttaaaaga

SEQ ID NO: 145906 - DNA, 15 bp, Homo sapiens
atgattctttaaaag

SEQ ID NO: 145907 - DNA, 15 bp, Homo sapiens
catgattctttaaaa

SEQ ID NO: 145908 - DNA, 15 bp, Homo sapiens
tcatgattctttaaa

SEQ ID NO: 145909 - DNA, 15 bp, Homo sapiens
gtcatgattctttaa

SEQ ID NO: 145910 - DNA, 15 bp, Homo sapiens
tgtcatgattcttta

SEQ ID NO: 145911 - DNA, 15 bp, Homo sapiens
ttgtcatgattcttt

SEQ ID NO: 145912 - DNA, 15 bp, Homo sapiens
gttgtcatgattctt

SEQ ID NO: 145913 - DNA, 15 bp, Homo sapiens
tgttgtcatgattct

SEQ ID NO: 145914 - DNA, 15 bp, Homo sapiens
atgttgtcatgattc

SEQ ID NO: 145915 - DNA, 15 bp, Homo sapiens
aatgttgtcatgatt

SEQ ID NO: 145916 - DNA, 15 bp, Homo sapiens
taatgttgtcatgat

SEQ ID NO: 145917 - DNA, 15 bp, Homo sapiens
ctaatgttgtcatga

SEQ ID NO: 145918 - DNA, 15 bp, Homo sapiens
tctaatgttgtcatg

SEQ ID NO: 145919 - DNA, 15 bp, Homo sapiens
gtctaatgttgtcat

SEQ ID NO: 145920 - DNA, 15 bp, Homo sapiens
tgtctaatgttgtca

SEQ ID NO: 145921 - DNA, 15 bp, Homo sapiens
ctgtctaatgttgtc

SEQ ID NO: 145922 - DNA, 15 bp, Homo sapiens
tctgtctaatgttgt

SEQ ID NO: 145923 - DNA, 15 bp, Homo sapiens
ctctgtctaatgttg

SEQ ID NO: 145924 - DNA, 15 bp, Homo sapiens
cctctgtctaatgtt

SEQ ID NO: 145925 - DNA, 15 bp, Homo sapiens
acctctgtctaatgt

SEQ ID NO: 145926 - DNA, 15 bp, Homo sapiens
cacctctgtctaatg

SEQ ID NO: 145927 - DNA, 15 bp, Homo sapiens
tcacctctgtctaat

SEQ ID NO: 145928 - DNA, 15 bp, Homo sapiens
ttcacctctgtctaa

SEQ ID NO: 145929 - DNA, 15 bp, Homo sapiens
tttcacctctgtcta

SEQ ID NO: 145930 - DNA, 15 bp, Homo sapiens
atttcacctctgtct

SEQ ID NO: 145931 - DNA, 15 bp, Homo sapiens
aatttcacctctgtc

SEQ ID NO: 145932 - DNA, 15 bp, Homo sapiens
caatttcacctctgt

SEQ ID NO: 145933 - DNA, 15 bp, Homo sapiens
gcaatttcacctctg

SEQ ID NO: 145934 - DNA, 15 bp, Homo sapiens
tgcaatttcacctct

SEQ ID NO: 145935 - DNA, 15 bp, Homo sapiens
ctgcaatttcacctc

SEQ ID NO: 145936 - DNA, 15 bp, Homo sapiens
gctgcaatttcacct

SEQ ID NO: 145937 - DNA, 15 bp, Homo sapiens
tgctgcaatttcacc

SEQ ID NO: 145938 - DNA, 15 bp, Homo sapiens
atgctgcaatttcac

SEQ ID NO: 145939 - DNA, 15 bp, Homo sapiens
aatgctgcaatttca

SEQ ID NO: 145940 - DNA, 15 bp, Homo sapiens
taatgctgcaatttc

SEQ ID NO: 145941 - DNA, 15 bp, Homo sapiens
ctaatgctgcaattt

SEQ ID NO: 145942 - DNA, 15 bp, Homo sapiens
gctaatgctgcaatt

SEQ ID NO: 145943 - DNA, 15 bp, Homo sapiens
ggctaatgctgcaat

SEQ ID NO: 145944 - DNA, 15 bp, Homo sapiens
gggctaatgctgcaa

SEQ ID NO: 145945 - DNA, 15 bp, Homo sapiens
cgggctaatgctgca

SEQ ID NO: 145946 - DNA, 15 bp, Homo sapiens
ccgggctaatgctgc

SEQ ID NO: 145947 - DNA, 15 bp, Homo sapiens
accgggctaatgctg

SEQ ID NO: 145948 - DNA, 15 bp, Homo sapiens
aaccgggctaatgct

SEQ ID NO: 145949 - DNA, 15 bp, Homo sapiens
taaccgggctaatgc

SEQ ID NO: 145950 - DNA, 15 bp, Homo sapiens
gtaaccgggctaatg

SEQ ID NO: 145951 - DNA, 15 bp, Homo sapiens
ggtaaccgggctaat

SEQ ID NO: 145952 - DNA, 15 bp, Homo sapiens
tggtaaccgggctaa

SEQ ID NO: 145953 - DNA, 15 bp, Homo sapiens
ctggtaaccgggcta

SEQ ID NO: 145954 - DNA, 15 bp, Homo sapiens
actggtaaccgggct

SEQ ID NO: 145955 - DNA, 15 bp, Homo sapiens
aactggtaaccgggc

SEQ ID NO: 145956 - DNA, 15 bp, Homo sapiens
aaactggtaaccggg

SEQ ID NO: 145957 - DNA, 15 bp, Homo sapiens
caaactggtaaccgg

SEQ ID NO: 145958 - DNA, 15 bp, Homo sapiens
tcaaactggtaaccg

SEQ ID NO: 145959 - DNA, 15 bp, Homo sapiens
ctcaaactggtaacc

SEQ ID NO: 145960 - DNA, 15 bp, Homo sapiens
gctcaaactggtaac

SEQ ID NO: 145961 - DNA, 15 bp, Homo sapiens
tgctcaaactggtaa

SEQ ID NO: 145962 - DNA, 15 bp, Homo sapiens
ctgctcaaactggta

SEQ ID NO: 145963 - DNA, 15 bp, Homo sapiens
cctgctcaaactggt

SEQ ID NO: 145964 - DNA, 15 bp, Homo sapiens
tcctgctcaaactgg

SEQ ID NO: 145965 - DNA, 15 bp, Homo sapiens
gtcctgctcaaactg

SEQ ID NO: 145966 - DNA, 15 bp, Homo sapiens
tgtcctgctcaaact

SEQ ID NO: 145967 - DNA, 15 bp, Homo sapiens
gtgtcctgctcaaac

SEQ ID NO: 145968 - DNA, 15 bp, Homo sapiens
agtgtcctgctcaaa

SEQ ID NO: 145969 - DNA, 15 bp, Homo sapiens
cagtgtcctgctcaa

SEQ ID NO: 145970 - DNA, 15 bp, Homo sapiens
tcagtgtcctgctca

SEQ ID NO: 145971 - DNA, 15 bp, Homo sapiens
atcagtgtcctgctc

SEQ ID NO: 145972 - DNA, 15 bp, Homo sapiens
tatcagtgtcctgct

SEQ ID NO: 145973 - DNA, 15 bp, Homo sapiens
ttatcagtgtcctgc

SEQ ID NO: 145974 - DNA, 15 bp, Homo sapiens
attatcagtgtcctg

SEQ ID NO: 145975 - DNA, 15 bp, Homo sapiens
cattatcagtgtcct

SEQ ID NO: 145976 - DNA, 15 bp, Homo sapiens
tcattatcagtgtcc

SEQ ID NO: 145977 - DNA, 15 bp, Homo sapiens
ctcattatcagtgtc

SEQ ID NO: 145978 - DNA, 15 bp, Homo sapiens
gctcattatcagtgt

SEQ ID NO: 145979 - DNA, 15 bp, Homo sapiens
tgctcattatcagtg

SEQ ID NO: 145980 - DNA, 15 bp, Homo sapiens
ttgctcattatcagt

SEQ ID NO: 145981 - DNA, 15 bp, Homo sapiens
gttgctcattatcag

SEQ ID NO: 145982 - DNA, 15 bp, Homo sapiens
tgttgctcattatca

SEQ ID NO: 145983 - DNA, 15 bp, Homo sapiens
atgttgctcattatc

SEQ ID NO: 145984 - DNA, 15 bp, Homo sapiens
gatgttgctcattat

SEQ ID NO: 145985 - DNA, 15 bp, Homo sapiens
agatgttgctcatta

SEQ ID NO: 145986 - DNA, 15 bp, Homo sapiens
cagatgttgctcatt

SEQ ID NO: 145987 - DNA, 15 bp, Homo sapiens
ccagatgttgctcat

SEQ ID NO: 145988 - DNA, 15 bp, Homo sapiens
cccagatgttgctca

SEQ ID NO: 145989 - DNA, 15 bp, Homo sapiens
acccagatgttgctc

SEQ ID NO: 145990 - DNA, 15 bp, Homo sapiens
aacccagatgttgct

SEQ ID NO: 145991 - DNA, 15 bp, Homo sapiens
gaacccagatgttgc

SEQ ID NO: 145992 - DNA, 15 bp, Homo sapiens
agaacccagatgttg

SEQ ID NO: 145993 - DNA, 15 bp, Homo sapiens
tagaacccagatgtt

SEQ ID NO: 145994 - DNA, 15 bp, Homo sapiens
atagaacccagatgt

SEQ ID NO: 145995 - DNA, 15 bp, Homo sapiens
aatagaacccagatg

SEQ ID NO: 145996 - DNA, 15 bp, Homo sapiens
aaatagaacccagat

SEQ ID NO: 145997 - DNA, 15 bp, Homo sapiens
gaaatagaacccaga

SEQ ID NO: 145998 - DNA, 15 bp, Homo sapiens
agaaatagaacccag

SEQ ID NO: 145999 - DNA, 15 bp, Homo sapiens
cagaaatagaaccca

SEQ ID NO: 146000 - DNA, 15 bp, Homo sapiens
ccagaaatagaaccc

SEQ ID NO: 146001 - DNA, 15 bp, Homo sapiens
gccagaaatagaacc

SEQ ID NO: 146002 - DNA, 15 bp, Homo sapiens
agccagaaatagaac

SEQ ID NO: 146003 - DNA, 15 bp, Homo sapiens
cagccagaaatagaa

SEQ ID NO: 146004 - DNA, 15 bp, Homo sapiens
acagccagaaataga

SEQ ID NO: 146005 - DNA, 15 bp, Homo sapiens
cacagccagaaatag

SEQ ID NO: 146006 - DNA, 15 bp, Homo sapiens
gcacagccagaaata

SEQ ID NO: 146007 - DNA, 15 bp, Homo sapiens
agcacagccagaaat

SEQ ID NO: 146008 - DNA, 15 bp, Homo sapiens
gagcacagccagaaa

SEQ ID NO: 146009 - DNA, 15 bp, Homo sapiens
agagcacagccagaa

SEQ ID NO: 146010 - DNA, 15 bp, Homo sapiens
aagagcacagccaga

SEQ ID NO: 146011 - DNA, 15 bp, Homo sapiens
aaagagcacagccag

SEQ ID NO: 146012 - DNA, 15 bp, Homo sapiens
caaagagcacagcca

SEQ ID NO: 146013 - DNA, 15 bp, Homo sapiens
tcaaagagcacagcc

SEQ ID NO: 146014 - DNA, 15 bp, Homo sapiens
gtcaaagagcacagc

SEQ ID NO: 146015 - DNA, 15 bp, Homo sapiens
ggtcaaagagcacag

SEQ ID NO: 146016 - DNA, 15 bp, Homo sapiens
gggtcaaagagcaca

SEQ ID NO: 146017 - DNA, 15 bp, Homo sapiens
tgggtcaaagagcac

SEQ ID NO: 146018 - DNA, 15 bp, Homo sapiens
ctgggtcaaagagca

SEQ ID NO: 146019 - DNA, 15 bp, Homo sapiens
actgggtcaaagagc

SEQ ID NO: 146020 - DNA, 15 bp, Homo sapiens
gactgggtcaaagag

SEQ ID NO: 146021 - DNA, 15 bp, Homo sapiens
tgactgggtcaaaga

SEQ ID NO: 146022 - DNA, 15 bp, Homo sapiens
atgactgggtcaaag

SEQ ID NO: 146023 - DNA, 15 bp, Homo sapiens
aatgactgggtcaaa

SEQ ID NO: 146024 - DNA, 15 bp, Homo sapiens
aaatgactgggtcaa

SEQ ID NO: 146025 - DNA, 15 bp, Homo sapiens
taaatgactgggtca

SEQ ID NO: 146026 - DNA, 15 bp, Homo sapiens
ttaaatgactgggtc

SEQ ID NO: 146027 - DNA, 15 bp, Homo sapiens
attaaatgactgggt

SEQ ID NO: 146028 - DNA, 15 bp, Homo sapiens
gattaaatgactggg

SEQ ID NO: 146029 - DNA, 15 bp, Homo sapiens
tgattaaatgactgg

SEQ ID NO: 146030 - DNA, 15 bp, Homo sapiens
atgattaaatgactg

SEQ ID NO: 146031 - DNA, 15 bp, Homo sapiens
gatgattaaatgact

SEQ ID NO: 146032 - DNA, 15 bp, Homo sapiens
ggatgattaaatgac

SEQ ID NO: 146033 - DNA, 15 bp, Homo sapiens
tggatgattaaatga

SEQ ID NO: 146034 - DNA, 15 bp, Homo sapiens
ctggatgattaaatg

SEQ ID NO: 146035 - DNA, 15 bp, Homo sapiens
cctggatgattaaat

SEQ ID NO: 146036 - DNA, 15 bp, Homo sapiens
ccctggatgattaaa

SEQ ID NO: 146037 - DNA, 15 bp, Homo sapiens
accctggatgattaa

SEQ ID NO: 146038 - DNA, 15 bp, Homo sapiens
aaccctggatgatta

SEQ ID NO: 146039 - DNA, 15 bp, Homo sapiens
taaccctggatgatt

SEQ ID NO: 146040 - DNA, 15 bp, Homo sapiens
ataaccctggatgat

SEQ ID NO: 146041 - DNA, 15 bp, Homo sapiens
aataaccctggatga

SEQ ID NO: 146042 - DNA, 15 bp, Homo sapiens
aaataaccctggatg

SEQ ID NO: 146043 - DNA, 15 bp, Homo sapiens
aaaataaccctggat

SEQ ID NO: 146044 - DNA, 15 bp, Homo sapiens
caaaataaccctgga

SEQ ID NO: 146045 - DNA, 15 bp, Homo sapiens
gcaaaataaccctgg

SEQ ID NO: 146046 - DNA, 15 bp, Homo sapiens
tgcaaaataaccctg

SEQ ID NO: 146047 - DNA, 15 bp, Homo sapiens
gtgcaaaataaccct

SEQ ID NO: 146048 - DNA, 15 bp, Homo sapiens
tgtgcaaaataaccc

SEQ ID NO: 146049 - DNA, 15 bp, Homo sapiens
atgtgcaaaataacc

SEQ ID NO: 146050 - DNA, 15 bp, Homo sapiens
gatgtgcaaaataac

SEQ ID NO: 146051 - DNA, 15 bp, Homo sapiens
agatgtgcaaaataa

SEQ ID NO: 146052 - DNA, 15 bp, Homo sapiens
gagatgtgcaaaata

SEQ ID NO: 146053 - DNA, 15 bp, Homo sapiens
ggagatgtgcaaaat

SEQ ID NO: 146054 - DNA, 15 bp, Homo sapiens
aggagatgtgcaaaa

SEQ ID NO: 146055 - DNA, 15 bp, Homo sapiens
caggagatgtgcaaa

SEQ ID NO: 146056 - DNA, 15 bp, Homo sapiens
tcaggagatgtgcaa

SEQ ID NO: 146057 - DNA, 15 bp, Homo sapiens
atcaggagatgtgca

SEQ ID NO: 146058 - DNA, 15 bp, Homo sapiens
tatcaggagatgtgc

SEQ ID NO: 146059 - DNA, 15 bp, Homo sapiens
ctatcaggagatgtg

SEQ ID NO: 146060 - DNA, 15 bp, Homo sapiens
actatcaggagatgt

SEQ ID NO: 146061 - DNA, 15 bp, Homo sapiens
tactatcaggagatg

SEQ ID NO: 146062 - DNA, 15 bp, Homo sapiens
gtactatcaggagat

SEQ ID NO: 146063 - DNA, 15 bp, Homo sapiens
agtactatcaggaga

SEQ ID NO: 146064 - DNA, 15 bp, Homo sapiens
aagtactatcaggag

SEQ ID NO: 146065 - DNA, 15 bp, Homo sapiens
aaagtactatcagga

SEQ ID NO: 146066 - DNA, 15 bp, Homo sapiens
taaagtactatcagg

SEQ ID NO: 146067 - DNA, 15 bp, Homo sapiens
gtaaagtactatcag

SEQ ID NO: 146068 - DNA, 15 bp, Homo sapiens
ggtaaagtactatca

SEQ ID NO: 146069 - DNA, 15 bp, Homo sapiens
gggtaaagtactatc

SEQ ID NO: 146070 - DNA, 15 bp, Homo sapiens
ggggtaaagtactat

SEQ ID NO: 146071 - DNA, 15 bp, Homo sapiens
tggggtaaagtacta

SEQ ID NO: 146072 - DNA, 15 bp, Homo sapiens
ctggggtaaagtact

SEQ ID NO: 146073 - DNA, 15 bp, Homo sapiens
actggggtaaagtac

SEQ ID NO: 146074 - DNA, 15 bp, Homo sapiens
aactggggtaaagta

SEQ ID NO: 146075 - DNA, 15 bp, Homo sapiens
caactggggtaaagt

SEQ ID NO: 146076 - DNA, 15 bp, Homo sapiens
tcaactggggtaaag

SEQ ID NO: 146077 - DNA, 15 bp, Homo sapiens
atcaactggggtaaa

SEQ ID NO: 146078 - DNA, 15 bp, Homo sapiens
tatcaactggggtaa

SEQ ID NO: 146079 - DNA, 15 bp, Homo sapiens
atatcaactggggta

SEQ ID NO: 146080 - DNA, 15 bp, Homo sapiens
aatatcaactggggt

SEQ ID NO: 146081 - DNA, 15 bp, Homo sapiens
aaatatcaactgggg

SEQ ID NO: 146082 - DNA, 15 bp, Homo sapiens
caaatatcaactggg

SEQ ID NO: 146083 - DNA, 15 bp, Homo sapiens
gcaaatatcaactgg

SEQ ID NO: 146084 - DNA, 15 bp, Homo sapiens
tgcaaatatcaactg

SEQ ID NO: 146085 - DNA, 15 bp, Homo sapiens
ttgcaaatatcaact

SEQ ID NO: 146086 - DNA, 15 bp, Homo sapiens
attgcaaatatcaac

SEQ ID NO: 146087 - DNA, 15 bp, Homo sapiens
cattgcaaatatcaa

SEQ ID NO: 146088 - DNA, 15 bp, Homo sapiens
tcattgcaaatatca

SEQ ID NO: 146089 - DNA, 15 bp, Homo sapiens
atcattgcaaatatc

SEQ ID NO: 146090 - DNA, 15 bp, Homo sapiens
catcattgcaaatat

SEQ ID NO: 146091 - DNA, 15 bp, Homo sapiens
acatcattgcaaata

SEQ ID NO: 146092 - DNA, 15 bp, Homo sapiens
aacatcattgcaaat

SEQ ID NO: 146093 - DNA, 15 bp, Homo sapiens
gaacatcattgcaaa

SEQ ID NO: 146094 - DNA, 15 bp, Homo sapiens
tgaacatcattgcaa

SEQ ID NO: 146095 - DNA, 15 bp, Homo sapiens
ctgaacatcattgca

SEQ ID NO: 146096 - DNA, 15 bp, Homo sapiens
cctgaacatcattgc

SEQ ID NO: 146097 - DNA, 15 bp, Homo sapiens
gcctgaacatcattg

SEQ ID NO: 146098 - DNA, 15 bp, Homo sapiens
agcctgaacatcatt

SEQ ID NO: 146099 - DNA, 15 bp, Homo sapiens
cagcctgaacatcat

SEQ ID NO: 146100 - DNA, 15 bp, Homo sapiens
gcagcctgaacatca

SEQ ID NO: 146101 - DNA, 15 bp, Homo sapiens
tgcagcctgaacatc

SEQ ID NO: 146102 - DNA, 15 bp, Homo sapiens
ctgcagcctgaacat

SEQ ID NO: 146103 - DNA, 15 bp, Homo sapiens
actgcagcctgaaca

SEQ ID NO: 146104 - DNA, 15 bp, Homo sapiens
tactgcagcctgaac

SEQ ID NO: 146105 - DNA, 15 bp, Homo sapiens
ctactgcagcctgaa

SEQ ID NO: 146106 - DNA, 15 bp, Homo sapiens
tctactgcagcctga

SEQ ID NO: 146107 - DNA, 15 bp, Homo sapiens
ctctactgcagcctg

SEQ ID NO: 146108 - DNA, 15 bp, Homo sapiens
tctctactgcagcct

SEQ ID NO: 146109 - DNA, 15 bp, Homo sapiens
ttctctactgcagcc

SEQ ID NO: 146110 - DNA, 15 bp, Homo sapiens
attctctactgcagc

SEQ ID NO: 146111 - DNA, 15 bp, Homo sapiens
tattctctactgcag

SEQ ID NO: 146112 - DNA, 15 bp, Homo sapiens
atattctctactgca

SEQ ID NO: 146113 - DNA, 15 bp, Homo sapiens
catattctctactgc

SEQ ID NO: 146114 - DNA, 15 bp, Homo sapiens
acatattctctactg

SEQ ID NO: 146115 - DNA, 15 bp, Homo sapiens
gacatattctctact

SEQ ID NO: 146116 - DNA, 15 bp, Homo sapiens
agacatattctctac

SEQ ID NO: 146117 - DNA, 15 bp, Homo sapiens
gagacatattctcta

SEQ ID NO: 146118 - DNA, 15 bp, Homo sapiens
tgagacatattctct

SEQ ID NO: 146119 - DNA, 15 bp, Homo sapiens
ttgagacatattctc

SEQ ID NO: 146120 - DNA, 15 bp, Homo sapiens
cttgagacatattct

SEQ ID NO: 146121 - DNA, 15 bp, Homo sapiens
acttgagacatattc

SEQ ID NO: 146122 - DNA, 15 bp, Homo sapiens
cacttgagacatatt

SEQ ID NO: 146123 - DNA, 15 bp, Homo sapiens
acacttgagacatat

SEQ ID NO: 146124 - DNA, 15 bp, Homo sapiens
cacacttgagacata

SEQ ID NO: 146125 - DNA, 15 bp, Homo sapiens
acacacttgagacat

SEQ ID NO: 146126 - DNA, 15 bp, Homo sapiens
cacacacttgagaca

SEQ ID NO: 146127 - DNA, 15 bp, Homo sapiens
acacacacttgagac

SEQ ID NO: 146128 - DNA, 15 bp, Homo sapiens
tacacacacttgaga

SEQ ID NO: 146129 - DNA, 15 bp, Homo sapiens
atacacacacttgag

SEQ ID NO: 146130 - DNA, 15 bp, Homo sapiens
tatacacacacttga

SEQ ID NO: 146131 - DNA, 15 bp, Homo sapiens
atatacacacacttg

SEQ ID NO: 146132 - DNA, 15 bp, Homo sapiens
tatatacacacactt

SEQ ID NO: 146133 - DNA, 15 bp, Homo sapiens
atatatacacacact

SEQ ID NO: 146134 - DNA, 15 bp, Homo sapiens
atgtgtatatatata

SEQ ID NO: 146135 - DNA, 15 bp, Homo sapiens
tatgtgtatatatat

SEQ ID NO: 146136 - DNA, 15 bp, Homo sapiens
ctatgtgtatatata

SEQ ID NO: 146137 - DNA, 15 bp, Homo sapiens
tctatgtgtatatat

SEQ ID NO: 146138 - DNA, 15 bp, Homo sapiens
ttctatgtgtatata

SEQ ID NO: 146139 - DNA, 15 bp, Homo sapiens
gttctatgtgtatat

SEQ ID NO: 146140 - DNA, 15 bp, Homo sapiens
ggttctatgtgtata

SEQ ID NO: 146141 - DNA, 15 bp, Homo sapiens
gggttctatgtgtat

SEQ ID NO: 146142 - DNA, 15 bp, Homo sapiens
ggggttctatgtgta

SEQ ID NO: 146143 - DNA, 15 bp, Homo sapiens
tggggttctatgtgt

SEQ ID NO: 146144 - DNA, 15 bp, Homo sapiens
ttggggttctatgtg

SEQ ID NO: 146145 - DNA, 15 bp, Homo sapiens
tttggggttctatgt

SEQ ID NO: 146146 - DNA, 15 bp, Homo sapiens
ttttggggttctatg

SEQ ID NO: 146147 - DNA, 15 bp, Homo sapiens
attttggggttctat

SEQ ID NO: 146148 - DNA, 15 bp, Homo sapiens
aattttggggttcta

SEQ ID NO: 146149 - DNA, 15 bp, Homo sapiens
taattttggggttct

SEQ ID NO: 146150 - DNA, 15 bp, Homo sapiens
ataattttggggttc

SEQ ID NO: 146151 - DNA, 15 bp, Homo sapiens
cataattttggggtt

SEQ ID NO: 146152 - DNA, 15 bp, Homo sapiens
acataattttggggt

SEQ ID NO: 146153 - DNA, 15 bp, Homo sapiens
tacataattttgggg

SEQ ID NO: 146154 - DNA, 15 bp, Homo sapiens
gtacataattttggg

SEQ ID NO: 146155 - DNA, 15 bp, Homo sapiens
agtacataattttgg

SEQ ID NO: 146156 - DNA, 15 bp, Homo sapiens
cagtacataattttg

SEQ ID NO: 146157 - DNA, 15 bp, Homo sapiens
ccagtacataatttt

SEQ ID NO: 146158 - DNA, 15 bp, Homo sapiens
tccagtacataattt

SEQ ID NO: 146159 - DNA, 15 bp, Homo sapiens
atccagtacataatt

SEQ ID NO: 146160 - DNA, 15 bp, Homo sapiens
aatccagtacataat

SEQ ID NO: 146161 - DNA, 15 bp, Homo sapiens
aaatccagtacataa

SEQ ID NO: 146162 - DNA, 15 bp, Homo sapiens
aaaatccagtacata

SEQ ID NO: 146163 - DNA, 15 bp, Homo sapiens
aaaaatccagtacat

SEQ ID NO: 146164 - DNA, 15 bp, Homo sapiens
taaaaatccagtaca

SEQ ID NO: 146165 - DNA, 15 bp, Homo sapiens
ataaaaatccagtac

SEQ ID NO: 146166 - DNA, 15 bp, Homo sapiens
tataaaaatccagta

SEQ ID NO: 146167 - DNA, 15 bp, Homo sapiens
atataaaaatccagt

SEQ ID NO: 146168 - DNA, 15 bp, Homo sapiens
catataaaaatccag

SEQ ID NO: 146169 - DNA, 15 bp, Homo sapiens
tcatataaaaatcca

SEQ ID NO: 146170 - DNA, 15 bp, Homo sapiens
atcatataaaaatcc

SEQ ID NO: 146171 - DNA, 15 bp, Homo sapiens
tatcatataaaaatc

SEQ ID NO: 146172 - DNA, 15 bp, Homo sapiens
atatcatataaaaat

SEQ ID NO: 146173 - DNA, 15 bp, Homo sapiens
tatatcatataaaaa

SEQ ID NO: 146174 - DNA, 15 bp, Homo sapiens
ttatatcatataaaa

SEQ ID NO: 146175 - DNA, 15 bp, Homo sapiens
attatatcatataaa

SEQ ID NO: 146176 - DNA, 15 bp, Homo sapiens
aattatatcatataa

SEQ ID NO: 146177 - DNA, 15 bp, Homo sapiens
taattatatcatata

SEQ ID NO: 146178 - DNA, 15 bp, Homo sapiens
ataattatatcatat

SEQ ID NO: 146179 - DNA, 15 bp, Homo sapiens
cataattatatcata

SEQ ID NO: 146180 - DNA, 15 bp, Homo sapiens
ccataattatatcat

SEQ ID NO: 146181 - DNA, 15 bp, Homo sapiens
gccataattatatca

SEQ ID NO: 146182 - DNA, 15 bp, Homo sapiens
ggccataattatatc

SEQ ID NO: 146183 - DNA, 15 bp, Homo sapiens
aggccataattatat

SEQ ID NO: 146184 - DNA, 15 bp, Homo sapiens
gaggccataattata

SEQ ID NO: 146185 - DNA, 15 bp, Homo sapiens
tgaggccataattat

SEQ ID NO: 146186 - DNA, 15 bp, Homo sapiens
atgaggccataatta

SEQ ID NO: 146187 - DNA, 15 bp, Homo sapiens
tatgaggccataatt

SEQ ID NO: 146188 - DNA, 15 bp, Homo sapiens
atatgaggccataat

SEQ ID NO: 146189 - DNA, 15 bp, Homo sapiens
aatatgaggccataa

SEQ ID NO: 146190 - DNA, 15 bp, Homo sapiens
aaatatgaggccata

SEQ ID NO: 146191 - DNA, 15 bp, Homo sapiens
gaaatatgaggccat

SEQ ID NO: 146192 - DNA, 15 bp, Homo sapiens
ggaaatatgaggcca

SEQ ID NO: 146193 - DNA, 15 bp, Homo sapiens
aggaaatatgaggcc

SEQ ID NO: 146194 - DNA, 15 bp, Homo sapiens
taggaaatatgaggc

SEQ ID NO: 146195 - DNA, 15 bp, Homo sapiens
ataggaaatatgagg

SEQ ID NO: 146196 - DNA, 15 bp, Homo sapiens
aataggaaatatgag

SEQ ID NO: 146197 - DNA, 15 bp, Homo sapiens
gaataggaaatatga

SEQ ID NO: 146198 - DNA, 15 bp, Homo sapiens
tgaataggaaatatg

SEQ ID NO: 146199 - DNA, 15 bp, Homo sapiens
atgaataggaaatat

SEQ ID NO: 146200 - DNA, 15 bp, Homo sapiens
tatgaataggaaata

SEQ ID NO: 146201 - DNA, 15 bp, Homo sapiens
ttatgaataggaaat

SEQ ID NO: 146202 - DNA, 15 bp, Homo sapiens
tttatgaataggaaa

SEQ ID NO: 146203 - DNA, 15 bp, Homo sapiens
ttttatgaataggaa

SEQ ID NO: 146204 - DNA, 15 bp, Homo sapiens
attttatgaatagga

SEQ ID NO: 146205 - DNA, 15 bp, Homo sapiens
aattttatgaatagg

SEQ ID NO: 146206 - DNA, 15 bp, Homo sapiens
taattttatgaatag

SEQ ID NO: 146207 - DNA, 15 bp, Homo sapiens
ttaattttatgaata

SEQ ID NO: 146208 - DNA, 15 bp, Homo sapiens
tttaattttatgaat

SEQ ID NO: 146209 - DNA, 15 bp, Homo sapiens
ttttaattttatgaa

SEQ ID NO: 146210 - DNA, 15 bp, Homo sapiens
gttttaattttatga

SEQ ID NO: 146211 - DNA, 15 bp, Homo sapiens
tgttttaattttatg

SEQ ID NO: 146212 - DNA, 15 bp, Homo sapiens
ctgttttaattttat

SEQ ID NO: 146213 - DNA, 15 bp, Homo sapiens
gctgttttaatttta

SEQ ID NO: 146214 - DNA, 15 bp, Homo sapiens
agctgttttaatttt

SEQ ID NO: 146215 - DNA, 15 bp, Homo sapiens
aagctgttttaattt

SEQ ID NO: 146216 - DNA, 15 bp, Homo sapiens
aaagctgttttaatt

SEQ ID NO: 146217 - DNA, 15 bp, Homo sapiens
taaagctgttttaat

SEQ ID NO: 146218 - DNA, 15 bp, Homo sapiens
ataaagctgttttaa

SEQ ID NO: 146219 - DNA, 15 bp, Homo sapiens
cataaagctgtttta

SEQ ID NO: 146220 - DNA, 15 bp, Homo sapiens
ccataaagctgtttt

SEQ ID NO: 146221 - DNA, 15 bp, Homo sapiens
gccataaagctgttt

SEQ ID NO: 146222 - DNA, 15 bp, Homo sapiens
tgccataaagctgtt

SEQ ID NO: 146223 - DNA, 15 bp, Homo sapiens
ttgccataaagctgt

SEQ ID NO: 146224 - DNA, 15 bp, Homo sapiens
tttgccataaagctg

SEQ ID NO: 146225 - DNA, 15 bp, Homo sapiens
atttgccataaagct

SEQ ID NO: 146226 - DNA, 15 bp, Homo sapiens
tatttgccataaagc

SEQ ID NO: 146227 - DNA, 15 bp, Homo sapiens
gtatttgccataaag

SEQ ID NO: 146228 - DNA, 15 bp, Homo sapiens
tgtatttgccataaa

SEQ ID NO: 146229 - DNA, 15 bp, Homo sapiens
ttgtatttgccataa

SEQ ID NO: 146230 - DNA, 15 bp, Homo sapiens
attgtatttgccata

SEQ ID NO: 146231 - DNA, 15 bp, Homo sapiens
cattgtatttgccat

SEQ ID NO: 146232 - DNA, 15 bp, Homo sapiens
tcattgtatttgcca

SEQ ID NO: 146233 - DNA, 15 bp, Homo sapiens
ctcattgtatttgcc

SEQ ID NO: 146234 - DNA, 15 bp, Homo sapiens
tctcattgtatttgc

SEQ ID NO: 146235 - DNA, 15 bp, Homo sapiens
atctcattgtatttg

SEQ ID NO: 146236 - DNA, 15 bp, Homo sapiens
gatctcattgtattt

SEQ ID NO: 146237 - DNA, 15 bp, Homo sapiens
tgatctcattgtatt

SEQ ID NO: 146238 - DNA, 15 bp, Homo sapiens
atgatctcattgtat

SEQ ID NO: 146239 - DNA, 15 bp, Homo sapiens
catgatctcattgta

SEQ ID NO: 146240 - DNA, 15 bp, Homo sapiens
tcatgatctcattgt

SEQ ID NO: 146241 - DNA, 15 bp, Homo sapiens
ttcatgatctcattg

SEQ ID NO: 146242 - DNA, 15 bp, Homo sapiens
cttcatgatctcatt

SEQ ID NO: 146243 - DNA, 15 bp, Homo sapiens
tcttcatgatctcat

SEQ ID NO: 146244 - DNA, 15 bp, Homo sapiens
atcttcatgatctca

SEQ ID NO: 146245 - DNA, 15 bp, Homo sapiens
catcttcatgatctc

SEQ ID NO: 146246 - DNA, 15 bp, Homo sapiens
gcatcttcatgatct

SEQ ID NO: 146247 - DNA, 15 bp, Homo sapiens
agcatcttcatgatc

SEQ ID NO: 146248 - DNA, 15 bp, Homo sapiens
cagcatcttcatgat

SEQ ID NO: 146249 - DNA, 15 bp, Homo sapiens
acagcatcttcatga

SEQ ID NO: 146250 - DNA, 15 bp, Homo sapiens
gacagcatcttcatg

SEQ ID NO: 146251 - DNA, 15 bp, Homo sapiens
agacagcatcttcat

SEQ ID NO: 146252 - DNA, 15 bp, Homo sapiens
tagacagcatcttca

SEQ ID NO: 146253 - DNA, 15 bp, Homo sapiens
ttagacagcatcttc

SEQ ID NO: 146254 - DNA, 15 bp, Homo sapiens
cttagacagcatctt

SEQ ID NO: 146255 - DNA, 15 bp, Homo sapiens
ccttagacagcatct

SEQ ID NO: 146256 - DNA, 15 bp, Homo sapiens
cccttagacagcatc

SEQ ID NO: 146257 - DNA, 15 bp, Homo sapiens
ccccttagacagcat

SEQ ID NO: 146258 - DNA, 15 bp, Homo sapiens
tccccttagacagca

SEQ ID NO: 146259 - DNA, 15 bp, Homo sapiens
ttccccttagacagc

SEQ ID NO: 146260 - DNA, 15 bp, Homo sapiens
tttccccttagacag

SEQ ID NO: 146261 - DNA, 15 bp, Homo sapiens
atttccccttagaca

SEQ ID NO: 146262 - DNA, 15 bp, Homo sapiens
catttccccttagac

SEQ ID NO: 146263 - DNA, 15 bp, Homo sapiens
acatttccccttaga

SEQ ID NO: 146264 - DNA, 15 bp, Homo sapiens
cacatttccccttag

SEQ ID NO: 146265 - DNA, 15 bp, Homo sapiens
ccacatttcccctta

SEQ ID NO: 146266 - DNA, 15 bp, Homo sapiens
gccacatttcccctt

SEQ ID NO: 146267 - DNA, 15 bp, Homo sapiens
tgccacatttcccct

SEQ ID NO: 146268 - DNA, 15 bp, Homo sapiens
ttgccacatttcccc

SEQ ID NO: 146269 - DNA, 15 bp, Homo sapiens
attgccacatttccc

SEQ ID NO: 146270 - DNA, 15 bp, Homo sapiens
aattgccacatttcc

SEQ ID NO: 146271 - DNA, 15 bp, Homo sapiens
aaattgccacatttc

SEQ ID NO: 146272 - DNA, 15 bp, Homo sapiens
caaattgccacattt

SEQ ID NO: 146273 - DNA, 15 bp, Homo sapiens
ccaaattgccacatt

SEQ ID NO: 146274 - DNA, 15 bp, Homo sapiens
tccaaattgccacat

SEQ ID NO: 146275 - DNA, 15 bp, Homo sapiens
ttccaaattgccaca

SEQ ID NO: 146276 - DNA, 15 bp, Homo sapiens
attccaaattgccac

SEQ ID NO: 146277 - DNA, 15 bp, Homo sapiens
cattccaaattgcca

SEQ ID NO: 146278 - DNA, 15 bp, Homo sapiens
acattccaaattgcc

SEQ ID NO: 146279 - DNA, 15 bp, Homo sapiens
aacattccaaattgc

SEQ ID NO: 146280 - DNA, 15 bp, Homo sapiens
gaacattccaaattg

SEQ ID NO: 146281 - DNA, 15 bp, Homo sapiens
tgaacattccaaatt

SEQ ID NO: 146282 - DNA, 15 bp, Homo sapiens
ctgaacattccaaat

SEQ ID NO: 146283 - DNA, 15 bp, Homo sapiens
actgaacattccaaa

SEQ ID NO: 146284 - DNA, 15 bp, Homo sapiens
tactgaacattccaa

SEQ ID NO: 146285 - DNA, 15 bp, Homo sapiens
ctactgaacattcca

SEQ ID NO: 146286 - DNA, 15 bp, Homo sapiens
actactgaacattcc

SEQ ID NO: 146287 - DNA, 15 bp, Homo sapiens
gactactgaacattc

SEQ ID NO: 146288 - DNA, 15 bp, Homo sapiens
tgactactgaacatt

SEQ ID NO: 146289 - DNA, 15 bp, Homo sapiens
ttgactactgaacat

SEQ ID NO: 146290 - DNA, 15 bp, Homo sapiens
attgactactgaaca

SEQ ID NO: 146291 - DNA, 15 bp, Homo sapiens
aattgactactgaac

SEQ ID NO: 146292 - DNA, 15 bp, Homo sapiens
taattgactactgaa

SEQ ID NO: 146293 - DNA, 15 bp, Homo sapiens
gtaattgactactga

SEQ ID NO: 146294 - DNA, 15 bp, Homo sapiens
tgtaattgactactg

SEQ ID NO: 146295 - DNA, 15 bp, Homo sapiens
ctgtaattgactact

SEQ ID NO: 146296 - DNA, 15 bp, Homo sapiens
tctgtaattgactac

SEQ ID NO: 146297 - DNA, 15 bp, Homo sapiens
gtctgtaattgacta

SEQ ID NO: 146298 - DNA, 15 bp, Homo sapiens
agtctgtaattgact

SEQ ID NO: 146299 - DNA, 15 bp, Homo sapiens
aagtctgtaattgac

SEQ ID NO: 146300 - DNA, 15 bp, Homo sapiens
aaagtctgtaattga

SEQ ID NO: 146301 - DNA, 15 bp, Homo sapiens
aaaagtctgtaattg

SEQ ID NO: 146302 - DNA, 15 bp, Homo sapiens
taaaagtctgtaatt

SEQ ID NO: 146303 - DNA, 15 bp, Homo sapiens
ttaaaagtctgtaat

SEQ ID NO: 146304 - DNA, 15 bp, Homo sapiens
attaaaagtctgtaa

SEQ ID NO: 146305 - DNA, 15 bp, Homo sapiens
aattaaaagtctgta

SEQ ID NO: 146306 - DNA, 15 bp, Homo sapiens
aaattaaaagtctgt

SEQ ID NO: 146307 - DNA, 15 bp, Homo sapiens
aaaattaaaagtctg

SEQ ID NO: 146308 - DNA, 15 bp, Homo sapiens
aaaaattaaaagtct

SEQ ID NO: 146309 - DNA, 15 bp, Homo sapiens
aaaaaattaaaagtc

SEQ ID NO: 146310 - DNA, 15 bp, Homo sapiens
taaaaaattaaaagt

SEQ ID NO: 146311 - DNA, 15 bp, Homo sapiens
ataaaaaattaaaag

SEQ ID NO: 146312 - DNA, 15 bp, Homo sapiens
aataaaaaattaaaa

SEQ ID NO: 146313 - DNA, 15 bp, Homo sapiens
gaataaaaaattaaa

SEQ ID NO: 146314 - DNA, 15 bp, Homo sapiens
tgaataaaaaattaa

SEQ ID NO: 146315 - DNA, 15 bp, Homo sapiens
gtgaataaaaaatta

SEQ ID NO: 146316 - DNA, 15 bp, Homo sapiens
agtgaataaaaaatt

SEQ ID NO: 146317 - DNA, 15 bp, Homo sapiens
aagtgaataaaaaat

SEQ ID NO: 146318 - DNA, 15 bp, Homo sapiens
taagtgaataaaaaa

SEQ ID NO: 146319 - DNA, 15 bp, Homo sapiens
ctaagtgaataaaaa

SEQ ID NO: 146320 - DNA, 15 bp, Homo sapiens
gctaagtgaataaaa

SEQ ID NO: 146321 - DNA, 15 bp, Homo sapiens
agctaagtgaataaa

SEQ ID NO: 146322 - DNA, 15 bp, Homo sapiens
cagctaagtgaataa

SEQ ID NO: 146323 - DNA, 15 bp, Homo sapiens
acagctaagtgaata

SEQ ID NO: 146324 - DNA, 15 bp, Homo sapiens
aacagctaagtgaat

SEQ ID NO: 146325 - DNA, 15 bp, Homo sapiens
aaacagctaagtgaa

SEQ ID NO: 146326 - DNA, 15 bp, Homo sapiens
taaacagctaagtga

SEQ ID NO: 146327 - DNA, 15 bp, Homo sapiens
ttaaacagctaagtg

SEQ ID NO: 146328 - DNA, 15 bp, Homo sapiens
attaaacagctaagt

SEQ ID NO: 146329 - DNA, 15 bp, Homo sapiens
aattaaacagctaag

SEQ ID NO: 146330 - DNA, 15 bp, Homo sapiens
taattaaacagctaa

SEQ ID NO: 146331 - DNA, 15 bp, Homo sapiens
ctaattaaacagcta

SEQ ID NO: 146332 - DNA, 15 bp, Homo sapiens
tctaattaaacagct

SEQ ID NO: 146333 - DNA, 15 bp, Homo sapiens
gtctaattaaacagc

SEQ ID NO: 146334 - DNA, 15 bp, Homo sapiens
tgtctaattaaacag

SEQ ID NO: 146335 - DNA, 15 bp, Homo sapiens
ttgtctaattaaaca

SEQ ID NO: 146336 - DNA, 15 bp, Homo sapiens
tttgtctaattaaac

SEQ ID NO: 146337 - DNA, 15 bp, Homo sapiens
atttgtctaattaaa

SEQ ID NO: 146338 - DNA, 15 bp, Homo sapiens
gatttgtctaattaa

SEQ ID NO: 146339 - DNA, 15 bp, Homo sapiens
ggatttgtctaatta

SEQ ID NO: 146340 - DNA, 15 bp, Homo sapiens
aggatttgtctaatt

SEQ ID NO: 146341 - DNA, 15 bp, Homo sapiens
taggatttgtctaat

SEQ ID NO: 146342 - DNA, 15 bp, Homo sapiens
ttaggatttgtctaa

SEQ ID NO: 146343 - DNA, 15 bp, Homo sapiens
gttaggatttgtcta

SEQ ID NO: 146344 - DNA, 15 bp, Homo sapiens
ggttaggatttgtct

SEQ ID NO: 146345 - DNA, 15 bp, Homo sapiens
aggttaggatttgtc

SEQ ID NO: 146346 - DNA, 15 bp, Homo sapiens
taggttaggatttgt

SEQ ID NO: 146347 - DNA, 15 bp, Homo sapiens
ataggttaggatttg

SEQ ID NO: 146348 - DNA, 15 bp, Homo sapiens
aataggttaggattt

SEQ ID NO: 146349 - DNA, 15 bp, Homo sapiens
gaataggttaggatt

SEQ ID NO: 146350 - DNA, 15 bp, Homo sapiens
ggaataggttaggat

SEQ ID NO: 146351 - DNA, 15 bp, Homo sapiens
tggaataggttagga

SEQ ID NO: 146352 - DNA, 15 bp, Homo sapiens
atggaataggttagg

SEQ ID NO: 146353 - DNA, 15 bp, Homo sapiens
aatggaataggttag

SEQ ID NO: 146354 - DNA, 15 bp, Homo sapiens
aaatggaataggtta

SEQ ID NO: 146355 - DNA, 15 bp, Homo sapiens
gaaatggaataggtt

SEQ ID NO: 146356 - DNA, 15 bp, Homo sapiens
agaaatggaataggt

SEQ ID NO: 146357 - DNA, 15 bp, Homo sapiens
tagaaatggaatagg

SEQ ID NO: 146358 - DNA, 15 bp, Homo sapiens
ttagaaatggaatag

SEQ ID NO: 146359 - DNA, 15 bp, Homo sapiens
attagaaatggaata

SEQ ID NO: 146360 - DNA, 15 bp, Homo sapiens
cattagaaatggaat

SEQ ID NO: 146361 - DNA, 15 bp, Homo sapiens
ccattagaaatggaa

SEQ ID NO: 146362 - DNA, 15 bp, Homo sapiens
gccattagaaatgga

SEQ ID NO: 146363 - DNA, 15 bp, Homo sapiens
agccattagaaatgg

SEQ ID NO: 146364 - DNA, 15 bp, Homo sapiens
aagccattagaaatg

SEQ ID NO: 146365 - DNA, 15 bp, Homo sapiens
aaagccattagaaat

SEQ ID NO: 146366 - DNA, 15 bp, Homo sapiens
gaaagccattagaaa

SEQ ID NO: 146367 - DNA, 15 bp, Homo sapiens
ggaaagccattagaa

SEQ ID NO: 146368 - DNA, 15 bp, Homo sapiens
aggaaagccattaga

SEQ ID NO: 146369 - DNA, 15 bp, Homo sapiens
aaggaaagccattag

SEQ ID NO: 146370 - DNA, 15 bp, Homo sapiens
gaaggaaagccatta

SEQ ID NO: 146371 - DNA, 15 bp, Homo sapiens
agaaggaaagccatt

SEQ ID NO: 146372 - DNA, 15 bp, Homo sapiens
tagaaggaaagccat

SEQ ID NO: 146373 - DNA, 15 bp, Homo sapiens
ctagaaggaaagcca

SEQ ID NO: 146374 - DNA, 15 bp, Homo sapiens
cctagaaggaaagcc

SEQ ID NO: 146375 - DNA, 15 bp, Homo sapiens
gcctagaaggaaagc

SEQ ID NO: 146376 - DNA, 15 bp, Homo sapiens
tgcctagaaggaaag

SEQ ID NO: 146377 - DNA, 15 bp, Homo sapiens
ctgcctagaaggaaa

SEQ ID NO: 146378 - DNA, 15 bp, Homo sapiens
cctgcctagaaggaa

SEQ ID NO: 146379 - DNA, 15 bp, Homo sapiens
gcctgcctagaagga

SEQ ID NO: 146380 - DNA, 15 bp, Homo sapiens
tgcctgcctagaagg

SEQ ID NO: 146381 - DNA, 15 bp, Homo sapiens
ctgcctgcctagaag

SEQ ID NO: 146382 - DNA, 15 bp, Homo sapiens
tctgcctgcctagaa

SEQ ID NO: 146383 - DNA, 15 bp, Homo sapiens
atctgcctgcctaga

SEQ ID NO: 146384 - DNA, 15 bp, Homo sapiens
catctgcctgcctag

SEQ ID NO: 146385 - DNA, 15 bp, Homo sapiens
tcatctgcctgccta

SEQ ID NO: 146386 - DNA, 15 bp, Homo sapiens
ctcatctgcctgcct

SEQ ID NO: 146387 - DNA, 15 bp, Homo sapiens
tctcatctgcctgcc

SEQ ID NO: 146388 - DNA, 15 bp, Homo sapiens
ttctcatctgcctgc

SEQ ID NO: 146389 - DNA, 15 bp, Homo sapiens
attctcatctgcctg

SEQ ID NO: 146390 - DNA, 15 bp, Homo sapiens
gattctcatctgcct

SEQ ID NO: 146391 - DNA, 15 bp, Homo sapiens
ggattctcatctgcc

SEQ ID NO: 146392 - DNA, 15 bp, Homo sapiens
tggattctcatctgc

SEQ ID NO: 146393 - DNA, 15 bp, Homo sapiens
gtggattctcatctg

SEQ ID NO: 146394 - DNA, 15 bp, Homo sapiens
agtggattctcatct

SEQ ID NO: 146395 - DNA, 15 bp, Homo sapiens
cagtggattctcatc

SEQ ID NO: 146396 - DNA, 15 bp, Homo sapiens
ccagtggattctcat

SEQ ID NO: 146397 - DNA, 15 bp, Homo sapiens
tccagtggattctca

SEQ ID NO: 146398 - DNA, 15 bp, Homo sapiens
atccagtggattctc

SEQ ID NO: 146399 - DNA, 15 bp, Homo sapiens
gatccagtggattct

SEQ ID NO: 146400 - DNA, 15 bp, Homo sapiens
cgatccagtggattc

SEQ ID NO: 146401 - DNA, 15 bp, Homo sapiens
gcgatccagtggatt

SEQ ID NO: 146402 - DNA, 15 bp, Homo sapiens
agcgatccagtggat

SEQ ID NO: 146403 - DNA, 15 bp, Homo sapiens
gagcgatccagtgga

SEQ ID NO: 146404 - DNA, 15 bp, Homo sapiens
agagcgatccagtgg

SEQ ID NO: 146405 - DNA, 15 bp, Homo sapiens
cagagcgatccagtg

SEQ ID NO: 146406 - DNA, 15 bp, Homo sapiens
gcagagcgatccagt

SEQ ID NO: 146407 - DNA, 15 bp, Homo sapiens
agcagagcgatccag

SEQ ID NO: 146408 - DNA, 15 bp, Homo sapiens
aagcagagcgatcca

SEQ ID NO: 146409 - DNA, 15 bp, Homo sapiens
aaagcagagcgatcc

SEQ ID NO: 146410 - DNA, 15 bp, Homo sapiens
aaaagcagagcgatc

SEQ ID NO: 146411 - DNA, 15 bp, Homo sapiens
taaaagcagagcgat

SEQ ID NO: 146412 - DNA, 15 bp, Homo sapiens
ctaaaagcagagcga

SEQ ID NO: 146413 - DNA, 15 bp, Homo sapiens
cctaaaagcagagcg

SEQ ID NO: 146414 - DNA, 15 bp, Homo sapiens
ccctaaaagcagagc

SEQ ID NO: 146415 - DNA, 15 bp, Homo sapiens
accctaaaagcagag

SEQ ID NO: 146416 - DNA, 15 bp, Homo sapiens
caccctaaaagcaga

SEQ ID NO: 146417 - DNA, 15 bp, Homo sapiens
acaccctaaaagcag

SEQ ID NO: 146418 - DNA, 15 bp, Homo sapiens
gacaccctaaaagca

SEQ ID NO: 146419 - DNA, 15 bp, Homo sapiens
agacaccctaaaagc

SEQ ID NO: 146420 - DNA, 15 bp, Homo sapiens
aagacaccctaaaag

SEQ ID NO: 146421 - DNA, 15 bp, Homo sapiens
taagacaccctaaaa

SEQ ID NO: 146422 - DNA, 15 bp, Homo sapiens
ctaagacaccctaaa

SEQ ID NO: 146423 - DNA, 15 bp, Homo sapiens
actaagacaccctaa

SEQ ID NO: 146424 - DNA, 15 bp, Homo sapiens
gactaagacacccta

SEQ ID NO: 146425 - DNA, 15 bp, Homo sapiens
tgactaagacaccct

SEQ ID NO: 146426 - DNA, 15 bp, Homo sapiens
atgactaagacaccc

SEQ ID NO: 146427 - DNA, 15 bp, Homo sapiens
tatgactaagacacc

SEQ ID NO: 146428 - DNA, 15 bp, Homo sapiens
atatgactaagacac

SEQ ID NO: 146429 - DNA, 15 bp, Homo sapiens
tatatgactaagaca

SEQ ID NO: 146430 - DNA, 15 bp, Homo sapiens
ttatatgactaagac

SEQ ID NO: 146431 - DNA, 15 bp, Homo sapiens
gttatatgactaaga

SEQ ID NO: 146432 - DNA, 15 bp, Homo sapiens
ggttatatgactaag

SEQ ID NO: 146433 - DNA, 15 bp, Homo sapiens
gggttatatgactaa

SEQ ID NO: 146434 - DNA, 15 bp, Homo sapiens
ggggttatatgacta

SEQ ID NO: 146435 - DNA, 15 bp, Homo sapiens
aggggttatatgact

SEQ ID NO: 146436 - DNA, 15 bp, Homo sapiens
caggggttatatgac

SEQ ID NO: 146437 - DNA, 15 bp, Homo sapiens
gcaggggttatatga

SEQ ID NO: 146438 - DNA, 15 bp, Homo sapiens
tgcaggggttatatg

SEQ ID NO: 146439 - DNA, 15 bp, Homo sapiens
ttgcaggggttatat

SEQ ID NO: 146440 - DNA, 15 bp, Homo sapiens
cttgcaggggttata

SEQ ID NO: 146441 - DNA, 15 bp, Homo sapiens
acttgcaggggttat

SEQ ID NO: 146442 - DNA, 15 bp, Homo sapiens
tacttgcaggggtta

SEQ ID NO: 146443 - DNA, 15 bp, Homo sapiens
atacttgcaggggtt

SEQ ID NO: 146444 - DNA, 15 bp, Homo sapiens
aatacttgcaggggt

SEQ ID NO: 146445 - DNA, 15 bp, Homo sapiens
aaatacttgcagggg

SEQ ID NO: 146446 - DNA, 15 bp, Homo sapiens
aaaatacttgcaggg

SEQ ID NO: 146447 - DNA, 15 bp, Homo sapiens
aaaaatacttgcagg

SEQ ID NO: 146448 - DNA, 15 bp, Homo sapiens
aaaaaatacttgcag

SEQ ID NO: 146449 - DNA, 15 bp, Homo sapiens
caaaaaatacttgca

SEQ ID NO: 146450 - DNA, 15 bp, Homo sapiens
acaaaaaatacttgc

SEQ ID NO: 146451 - DNA, 15 bp, Homo sapiens
aacaaaaaatacttg

SEQ ID NO: 146452 - DNA, 15 bp, Homo sapiens
aaacaaaaaatactt

SEQ ID NO: 146453 - DNA, 15 bp, Homo sapiens
aaaacaaaaaatact

SEQ ID NO: 146454 - DNA, 15 bp, Homo sapiens
caaaacaaaaaatac

SEQ ID NO: 146455 - DNA, 15 bp, Homo sapiens
gcaaaacaaaaaata

SEQ ID NO: 146456 - DNA, 15 bp, Homo sapiens
agcaaaacaaaaaat

SEQ ID NO: 146457 - DNA, 15 bp, Homo sapiens
aagcaaaacaaaaaa

SEQ ID NO: 146458 - DNA, 15 bp, Homo sapiens
aaagcaaaacaaaaa

SEQ ID NO: 146459 - DNA, 15 bp, Homo sapiens
taaagcaaaacaaaa

SEQ ID NO: 146460 - DNA, 15 bp, Homo sapiens
ataaagcaaaacaaa

SEQ ID NO: 146461 - DNA, 15 bp, Homo sapiens
aataaagcaaaacaa

SEQ ID NO: 146462 - DNA, 15 bp, Homo sapiens
aaataaagcaaaaca

SEQ ID NO: 146463 - DNA, 15 bp, Homo sapiens
aaaataaagcaaaac

SEQ ID NO: 146464 - DNA, 15 bp, Homo sapiens
aaaaataaagcaaaa

SEQ ID NO: 146465 - DNA, 15 bp, Homo sapiens
caaaaataaagcaaa

SEQ ID NO: 146466 - DNA, 15 bp, Homo sapiens
acaaaaataaagcaa

SEQ ID NO: 146467 - DNA, 15 bp, Homo sapiens
aacaaaaataaagca

SEQ ID NO: 146468 - DNA, 15 bp, Homo sapiens
caacaaaaataaagc

SEQ ID NO: 146469 - DNA, 15 bp, Homo sapiens
acaacaaaaataaag

SEQ ID NO: 146470 - DNA, 15 bp, Homo sapiens
aacaacaaaaataaa

SEQ ID NO: 146471 - DNA, 15 bp, Homo sapiens
aaacaacaaaaataa

SEQ ID NO: 146472 - DNA, 15 bp, Homo sapiens
aaaacaacaaaaata

SEQ ID NO: 146473 - DNA, 15 bp, Homo sapiens
caaaacaacaaaaat

SEQ ID NO: 146474 - DNA, 15 bp, Homo sapiens
acaaaacaacaaaaa

SEQ ID NO: 146475 - DNA, 15 bp, Homo sapiens
aacaaaacaacaaaa

SEQ ID NO: 146476 - DNA, 15 bp, Homo sapiens
aaacaaaacaacaaa

SEQ ID NO: 146477 - DNA, 15 bp, Homo sapiens
aaaacaaaacaacaa

SEQ ID NO: 146478 - DNA, 15 bp, Homo sapiens
caaaacaaaacaaca

SEQ ID NO: 146479 - DNA, 15 bp, Homo sapiens
acaaaacaaaacaac

SEQ ID NO: 146480 - DNA, 15 bp, Homo sapiens
taaaacaaaacaaaa

SEQ ID NO: 146481 - DNA, 15 bp, Homo sapiens
ctaaaacaaaacaaa

SEQ ID NO: 146482 - DNA, 15 bp, Homo sapiens
cctaaaacaaaacaa

SEQ ID NO: 146483 - DNA, 15 bp, Homo sapiens
acctaaaacaaaaca

SEQ ID NO: 146484 - DNA, 15 bp, Homo sapiens
cacctaaaacaaaac

SEQ ID NO: 146485 - DNA, 15 bp, Homo sapiens
tcacctaaaacaaaa

SEQ ID NO: 146486 - DNA, 15 bp, Homo sapiens
atcacctaaaacaaa

SEQ ID NO: 146487 - DNA, 15 bp, Homo sapiens
aatcacctaaaacaa

SEQ ID NO: 146488 - DNA, 15 bp, Homo sapiens
aaatcacctaaaaca

SEQ ID NO: 146489 - DNA, 15 bp, Homo sapiens
aaaatcacctaaaac

SEQ ID NO: 146490 - DNA, 15 bp, Homo sapiens
caaaatcacctaaaa

SEQ ID NO: 146491 - DNA, 15 bp, Homo sapiens
ccaaaatcacctaaa

SEQ ID NO: 146492 - DNA, 15 bp, Homo sapiens
cccaaaatcacctaa

SEQ ID NO: 146493 - DNA, 15 bp, Homo sapiens
gcccaaaatcaccta

SEQ ID NO: 146494 - DNA, 15 bp, Homo sapiens
agcccaaaatcacct

SEQ ID NO: 146495 - DNA, 15 bp, Homo sapiens
cagcccaaaatcacc

SEQ ID NO: 146496 - DNA, 15 bp, Homo sapiens
tcagcccaaaatcac

SEQ ID NO: 146497 - DNA, 15 bp, Homo sapiens
ctcagcccaaaatca

SEQ ID NO: 146498 - DNA, 15 bp, Homo sapiens
tctcagcccaaaatc

SEQ ID NO: 146499 - DNA, 15 bp, Homo sapiens
atctcagcccaaaat

SEQ ID NO: 146500 - DNA, 15 bp, Homo sapiens
gatctcagcccaaaa

SEQ ID NO: 146501 - DNA, 15 bp, Homo sapiens
agatctcagcccaaa

SEQ ID NO: 146502 - DNA, 15 bp, Homo sapiens
cagatctcagcccaa

SEQ ID NO: 146503 - DNA, 15 bp, Homo sapiens
acagatctcagccca

SEQ ID NO: 146504 - DNA, 15 bp, Homo sapiens
gacagatctcagccc

SEQ ID NO: 146505 - DNA, 15 bp, Homo sapiens
agacagatctcagcc

SEQ ID NO: 146506 - DNA, 15 bp, Homo sapiens
cagacagatctcagc

SEQ ID NO: 146507 - DNA, 15 bp, Homo sapiens
ccagacagatctcag

SEQ ID NO: 146508 - DNA, 15 bp, Homo sapiens
cccagacagatctca

SEQ ID NO: 146509 - DNA, 15 bp, Homo sapiens
ccccagacagatctc

SEQ ID NO: 146510 - DNA, 15 bp, Homo sapiens
cccccagacagatct

SEQ ID NO: 146511 - DNA, 15 bp, Homo sapiens
acccccagacagatc

SEQ ID NO: 146512 - DNA, 15 bp, Homo sapiens
cacccccagacagat

SEQ ID NO: 146513 - DNA, 15 bp, Homo sapiens
tcacccccagacaga

SEQ ID NO: 146514 - DNA, 15 bp, Homo sapiens
atcacccccagacag

SEQ ID NO: 146515 - DNA, 15 bp, Homo sapiens
aatcacccccagaca

SEQ ID NO: 146516 - DNA, 15 bp, Homo sapiens
aaatcacccccagac

SEQ ID NO: 146517 - DNA, 15 bp, Homo sapiens
aaaatcacccccaga

SEQ ID NO: 146518 - DNA, 15 bp, Homo sapiens
aaaaatcacccccag

SEQ ID NO: 146519 - DNA, 15 bp, Homo sapiens
aaaaaatcaccccca

SEQ ID NO: 146520 - DNA, 15 bp, Homo sapiens
taaaaaatcaccccc

SEQ ID NO: 146521 - DNA, 15 bp, Homo sapiens
ctaaaaaatcacccc

SEQ ID NO: 146522 - DNA, 15 bp, Homo sapiens
gctaaaaaatcaccc

SEQ ID NO: 146523 - DNA, 15 bp, Homo sapiens
tgctaaaaaatcacc

SEQ ID NO: 146524 - DNA, 15 bp, Homo sapiens
gtgctaaaaaatcac

SEQ ID NO: 146525 - DNA, 15 bp, Homo sapiens
agtgctaaaaaatca

SEQ ID NO: 146526 - DNA, 15 bp, Homo sapiens
aagtgctaaaaaatc

SEQ ID NO: 146527 - DNA, 15 bp, Homo sapiens
taagtgctaaaaaat

SEQ ID NO: 146528 - DNA, 15 bp, Homo sapiens
ttaagtgctaaaaaa

SEQ ID NO: 146529 - DNA, 15 bp, Homo sapiens
attaagtgctaaaaa

SEQ ID NO: 146530 - DNA, 15 bp, Homo sapiens
cattaagtgctaaaa

SEQ ID NO: 146531 - DNA, 15 bp, Homo sapiens
acattaagtgctaaa

SEQ ID NO: 146532 - DNA, 15 bp, Homo sapiens
tacattaagtgctaa

SEQ ID NO: 146533 - DNA, 15 bp, Homo sapiens
atacattaagtgcta

SEQ ID NO: 146534 - DNA, 15 bp, Homo sapiens
catacattaagtgct

SEQ ID NO: 146535 - DNA, 15 bp, Homo sapiens
ccatacattaagtgc

SEQ ID NO: 146536 - DNA, 15 bp, Homo sapiens
cccatacattaagtg

SEQ ID NO: 146537 - DNA, 15 bp, Homo sapiens
gcccatacattaagt

SEQ ID NO: 146538 - DNA, 15 bp, Homo sapiens
agcccatacattaag

SEQ ID NO: 146539 - DNA, 15 bp, Homo sapiens
cagcccatacattaa

SEQ ID NO: 146540 - DNA, 15 bp, Homo sapiens
acagcccatacatta

SEQ ID NO: 146541 - DNA, 15 bp, Homo sapiens
aacagcccatacatt

SEQ ID NO: 146542 - DNA, 15 bp, Homo sapiens
caacagcccatacat

SEQ ID NO: 146543 - DNA, 15 bp, Homo sapiens
acaacagcccataca

SEQ ID NO: 146544 - DNA, 15 bp, Homo sapiens
gacaacagcccatac

SEQ ID NO: 146545 - DNA, 15 bp, Homo sapiens
tgacaacagcccata

SEQ ID NO: 146546 - DNA, 15 bp, Homo sapiens
atgacaacagcccat

SEQ ID NO: 146547 - DNA, 15 bp, Homo sapiens
gatgacaacagccca

SEQ ID NO: 146548 - DNA, 15 bp, Homo sapiens
tgatgacaacagccc

SEQ ID NO: 146549 - DNA, 15 bp, Homo sapiens
ctgatgacaacagcc

SEQ ID NO: 146550 - DNA, 15 bp, Homo sapiens
tctgatgacaacagc

SEQ ID NO: 146551 - DNA, 15 bp, Homo sapiens
ctctgatgacaacag

SEQ ID NO: 146552 - DNA, 15 bp, Homo sapiens
actctgatgacaaca

SEQ ID NO: 146553 - DNA, 15 bp, Homo sapiens
gactctgatgacaac

SEQ ID NO: 146554 - DNA, 15 bp, Homo sapiens
tgactctgatgacaa

SEQ ID NO: 146555 - DNA, 15 bp, Homo sapiens
ctgactctgatgaca

SEQ ID NO: 146556 - DNA, 15 bp, Homo sapiens
cctgactctgatgac

SEQ ID NO: 146557 - DNA, 15 bp, Homo sapiens
acctgactctgatga

SEQ ID NO: 146558 - DNA, 15 bp, Homo sapiens
cacctgactctgatg

SEQ ID NO: 146559 - DNA, 15 bp, Homo sapiens
acacctgactctgat

SEQ ID NO: 146560 - DNA, 15 bp, Homo sapiens
tacacctgactctga

SEQ ID NO: 146561 - DNA, 15 bp, Homo sapiens
gtacacctgactctg

SEQ ID NO: 146562 - DNA, 15 bp, Homo sapiens
ggtacacctgactct

SEQ ID NO: 146563 - DNA, 15 bp, Homo sapiens
gggtacacctgactc

SEQ ID NO: 146564 - DNA, 15 bp, Homo sapiens
agggtacacctgact

SEQ ID NO: 146565 - DNA, 15 bp, Homo sapiens
aagggtacacctgac

SEQ ID NO: 146566 - DNA, 15 bp, Homo sapiens
gaagggtacacctga

SEQ ID NO: 146567 - DNA, 15 bp, Homo sapiens
agaagggtacacctg

SEQ ID NO: 146568 - DNA, 15 bp, Homo sapiens
cagaagggtacacct

SEQ ID NO: 146569 - DNA, 15 bp, Homo sapiens
gcagaagggtacacc

SEQ ID NO: 146570 - DNA, 15 bp, Homo sapiens
agcagaagggtacac

SEQ ID NO: 146571 - DNA, 15 bp, Homo sapiens
gagcagaagggtaca

SEQ ID NO: 146572 - DNA, 15 bp, Homo sapiens
agagcagaagggtac

SEQ ID NO: 146573 - DNA, 15 bp, Homo sapiens
aagagcagaagggta

SEQ ID NO: 146574 - DNA, 15 bp, Homo sapiens
gaagagcagaagggt

SEQ ID NO: 146575 - DNA, 15 bp, Homo sapiens
agaagagcagaaggg

SEQ ID NO: 146576 - DNA, 15 bp, Homo sapiens
tgagaagagcagaag

SEQ ID NO: 146577 - DNA, 15 bp, Homo sapiens
ttgagaagagcagaa

SEQ ID NO: 146578 - DNA, 15 bp, Homo sapiens
cttgagaagagcaga

SEQ ID NO: 146579 - DNA, 15 bp, Homo sapiens
tcttgagaagagcag

SEQ ID NO: 146580 - DNA, 15 bp, Homo sapiens
atcttgagaagagca

SEQ ID NO: 146581 - DNA, 15 bp, Homo sapiens
aatcttgagaagagc

SEQ ID NO: 146582 - DNA, 15 bp, Homo sapiens
aaatcttgagaagag

SEQ ID NO: 146583 - DNA, 15 bp, Homo sapiens
taaatcttgagaaga

SEQ ID NO: 146584 - DNA, 15 bp, Homo sapiens
ataaatcttgagaag

SEQ ID NO: 146585 - DNA, 15 bp, Homo sapiens
tataaatcttgagaa

SEQ ID NO: 146586 - DNA, 15 bp, Homo sapiens
ttataaatcttgaga

SEQ ID NO: 146587 - DNA, 15 bp, Homo sapiens
gttataaatcttgag

SEQ ID NO: 146588 - DNA, 15 bp, Homo sapiens
tgttataaatcttga

SEQ ID NO: 146589 - DNA, 15 bp, Homo sapiens
ctgttataaatcttg

SEQ ID NO: 146590 - DNA, 15 bp, Homo sapiens
cctgttataaatctt

SEQ ID NO: 146591 - DNA, 15 bp, Homo sapiens
ccctgttataaatct

SEQ ID NO: 146592 - DNA, 15 bp, Homo sapiens
accctgttataaatc

SEQ ID NO: 146593 - DNA, 15 bp, Homo sapiens
gaccctgttataaat

SEQ ID NO: 146594 - DNA, 15 bp, Homo sapiens
agaccctgttataaa

SEQ ID NO: 146595 - DNA, 15 bp, Homo sapiens
gagaccctgttataa

SEQ ID NO: 146596 - DNA, 15 bp, Homo sapiens
ggagaccctgttata

SEQ ID NO: 146597 - DNA, 15 bp, Homo sapiens
aggagaccctgttat

SEQ ID NO: 146598 - DNA, 15 bp, Homo sapiens
caggagaccctgtta

SEQ ID NO: 146599 - DNA, 15 bp, Homo sapiens
acaggagaccctgtt

SEQ ID NO: 146600 - DNA, 15 bp, Homo sapiens
aacaggagaccctgt

SEQ ID NO: 146601 - DNA, 15 bp, Homo sapiens
gaacaggagaccctg

SEQ ID NO: 146602 - DNA, 15 bp, Homo sapiens
tgaacaggagaccct

SEQ ID NO: 146603 - DNA, 15 bp, Homo sapiens
gtgaacaggagaccc

SEQ ID NO: 146604 - DNA, 15 bp, Homo sapiens
agtgaacaggagacc

SEQ ID NO: 146605 - DNA, 15 bp, Homo sapiens
tagtgaacaggagac

SEQ ID NO: 146606 - DNA, 15 bp, Homo sapiens
ttagtgaacaggaga

SEQ ID NO: 146607 - DNA, 15 bp, Homo sapiens
attagtgaacaggag

SEQ ID NO: 146608 - DNA, 15 bp, Homo sapiens
aattagtgaacagga

SEQ ID NO: 146609 - DNA, 15 bp, Homo sapiens
gaattagtgaacagg

SEQ ID NO: 146610 - DNA, 15 bp, Homo sapiens
tgaattagtgaacag

SEQ ID NO: 146611 - DNA, 15 bp, Homo sapiens
gtgaattagtgaaca

SEQ ID NO: 146612 - DNA, 15 bp, Homo sapiens
tgtgaattagtgaac

SEQ ID NO: 146613 - DNA, 15 bp, Homo sapiens
ctgtgaattagtgaa

SEQ ID NO: 146614 - DNA, 15 bp, Homo sapiens
tctgtgaattagtga

SEQ ID NO: 146615 - DNA, 15 bp, Homo sapiens
ctctgtgaattagtg

SEQ ID NO: 146616 - DNA, 15 bp, Homo sapiens
gctctgtgaattagt

SEQ ID NO: 146617 - DNA, 15 bp, Homo sapiens
tgctctgtgaattag

SEQ ID NO: 146618 - DNA, 15 bp, Homo sapiens
gtgctctgtgaatta

SEQ ID NO: 146619 - DNA, 15 bp, Homo sapiens
tgtgctctgtgaatt

SEQ ID NO: 146620 - DNA, 15 bp, Homo sapiens
ctgtgctctgtgaat

SEQ ID NO: 146621 - DNA, 15 bp, Homo sapiens
gctgtgctctgtgaa

SEQ ID NO: 146622 - DNA, 15 bp, Homo sapiens
agctgtgctctgtga

SEQ ID NO: 146623 - DNA, 15 bp, Homo sapiens
tagctgtgctctgtg

SEQ ID NO: 146624 - DNA, 15 bp, Homo sapiens
ctagctgtgctctgt

SEQ ID NO: 146625 - DNA, 15 bp, Homo sapiens
tctagctgtgctctg

SEQ ID NO: 146626 - DNA, 15 bp, Homo sapiens
ctctagctgtgctct

SEQ ID NO: 146627 - DNA, 15 bp, Homo sapiens
gctctagctgtgctc

SEQ ID NO: 146628 - DNA, 15 bp, Homo sapiens
agctctagctgtgct

SEQ ID NO: 146629 - DNA, 15 bp, Homo sapiens
cagctctagctgtgc

SEQ ID NO: 146630 - DNA, 15 bp, Homo sapiens
gcagctctagctgtg

SEQ ID NO: 146631 - DNA, 15 bp, Homo sapiens
tgcagctctagctgt

SEQ ID NO: 146632 - DNA, 15 bp, Homo sapiens
atgcagctctagctg

SEQ ID NO: 146633 - DNA, 15 bp, Homo sapiens
aatgcagctctagct

SEQ ID NO: 146634 - DNA, 15 bp, Homo sapiens
aaatgcagctctagc

SEQ ID NO: 146635 - DNA, 15 bp, Homo sapiens
taaatgcagctctag

SEQ ID NO: 146636 - DNA, 15 bp, Homo sapiens
ataaatgcagctcta

SEQ ID NO: 146637 - DNA, 15 bp, Homo sapiens
aataaatgcagctct

SEQ ID NO: 146638 - DNA, 15 bp, Homo sapiens
caataaatgcagctc

SEQ ID NO: 146639 - DNA, 15 bp, Homo sapiens
ccaataaatgcagct

SEQ ID NO: 146640 - DNA, 15 bp, Homo sapiens
cccaataaatgcagc

SEQ ID NO: 146641 - DNA, 15 bp, Homo sapiens
acccaataaatgcag

SEQ ID NO: 146642 - DNA, 15 bp, Homo sapiens
tacccaataaatgca

SEQ ID NO: 146643 - DNA, 15 bp, Homo sapiens
ctacccaataaatgc

SEQ ID NO: 146644 - DNA, 15 bp, Homo sapiens
actacccaataaatg

SEQ ID NO: 146645 - DNA, 15 bp, Homo sapiens
cactacccaataaat

SEQ ID NO: 146646 - DNA, 15 bp, Homo sapiens
tcactacccaataaa

SEQ ID NO: 146647 - DNA, 15 bp, Homo sapiens
ttcactacccaataa

SEQ ID NO: 146648 - DNA, 15 bp, Homo sapiens
gttcactacccaata

SEQ ID NO: 146649 - DNA, 15 bp, Homo sapiens
tgttcactacccaat

SEQ ID NO: 146650 - DNA, 15 bp, Homo sapiens
atgttcactacccaa

SEQ ID NO: 146651 - DNA, 15 bp, Homo sapiens
tatgttcactaccca

SEQ ID NO: 146652 - DNA, 15 bp, Homo sapiens
atatgttcactaccc

SEQ ID NO: 146653 - DNA, 15 bp, Homo sapiens
gatatgttcactacc

SEQ ID NO: 146654 - DNA, 15 bp, Homo sapiens
ggatatgttcactac

SEQ ID NO: 146655 - DNA, 15 bp, Homo sapiens
gggatatgttcacta

SEQ ID NO: 146656 - DNA, 15 bp, Homo sapiens
agggatatgttcact

SEQ ID NO: 146657 - DNA, 15 bp, Homo sapiens
gagggatatgttcac

SEQ ID NO: 146658 - DNA, 15 bp, Homo sapiens
agagggatatgttca

SEQ ID NO: 146659 - DNA, 15 bp, Homo sapiens
aagagggatatgttc

SEQ ID NO: 146660 - DNA, 15 bp, Homo sapiens
aaagagggatatgtt

SEQ ID NO: 146661 - DNA, 15 bp, Homo sapiens
taaagagggatatgt

SEQ ID NO: 146662 - DNA, 15 bp, Homo sapiens
ctaaagagggatatg

SEQ ID NO: 146663 - DNA, 15 bp, Homo sapiens
tctaaagagggatat

SEQ ID NO: 146664 - DNA, 15 bp, Homo sapiens
ctctaaagagggata

SEQ ID NO: 146665 - DNA, 15 bp, Homo sapiens
tctctaaagagggat

SEQ ID NO: 146666 - DNA, 15 bp, Homo sapiens
gtctctaaagaggga

SEQ ID NO: 146667 - DNA, 15 bp, Homo sapiens
cgtctctaaagaggg

SEQ ID NO: 146668 - DNA, 15 bp, Homo sapiens
ccgtctctaaagagg

SEQ ID NO: 146669 - DNA, 15 bp, Homo sapiens
accgtctctaaagag

SEQ ID NO: 146670 - DNA, 15 bp, Homo sapiens
caccgtctctaaaga

SEQ ID NO: 146671 - DNA, 15 bp, Homo sapiens
tcaccgtctctaaag

SEQ ID NO: 146672 - DNA, 15 bp, Homo sapiens
ttcaccgtctctaaa

SEQ ID NO: 146673 - DNA, 15 bp, Homo sapiens
attcaccgtctctaa

SEQ ID NO: 146674 - DNA, 15 bp, Homo sapiens
cattcaccgtctcta

SEQ ID NO: 146675 - DNA, 15 bp, Homo sapiens
gcattcaccgtctct

SEQ ID NO: 146676 - DNA, 15 bp, Homo sapiens
agcattcaccgtctc

SEQ ID NO: 146677 - DNA, 15 bp, Homo sapiens
gagcattcaccgtct

SEQ ID NO: 146678 - DNA, 15 bp, Homo sapiens
agagcattcaccgtc

SEQ ID NO: 146679 - DNA, 15 bp, Homo sapiens
cagagcattcaccgt

SEQ ID NO: 146680 - DNA, 15 bp, Homo sapiens
acagagcattcaccg

SEQ ID NO: 146681 - DNA, 15 bp, Homo sapiens
aacagagcattcacc

SEQ ID NO: 146682 - DNA, 15 bp, Homo sapiens
gaacagagcattcac

SEQ ID NO: 146683 - DNA, 15 bp, Homo sapiens
agaacagagcattca

SEQ ID NO: 146684 - DNA, 15 bp, Homo sapiens
gagaacagagcattc

SEQ ID NO: 146685 - DNA, 15 bp, Homo sapiens
agagaacagagcatt

SEQ ID NO: 146686 - DNA, 15 bp, Homo sapiens
gagagaacagagcat

SEQ ID NO: 146687 - DNA, 15 bp, Homo sapiens
agagagaacagagca

SEQ ID NO: 146688 - DNA, 15 bp, Homo sapiens
aagagagaacagagc

SEQ ID NO: 146689 - DNA, 15 bp, Homo sapiens
taagagagaacagag

SEQ ID NO: 146690 - DNA, 15 bp, Homo sapiens
ttaagagagaacaga

SEQ ID NO: 146691 - DNA, 15 bp, Homo sapiens
attaagagagaacag

SEQ ID NO: 146692 - DNA, 15 bp, Homo sapiens
tattaagagagaaca

SEQ ID NO: 146693 - DNA, 15 bp, Homo sapiens
ctattaagagagaac

SEQ ID NO: 146694 - DNA, 15 bp, Homo sapiens
tctattaagagagaa

SEQ ID NO: 146695 - DNA, 15 bp, Homo sapiens
ttctattaagagaga

SEQ ID NO: 146696 - DNA, 15 bp, Homo sapiens
tttctattaagagag

SEQ ID NO: 146697 - DNA, 15 bp, Homo sapiens
gtttctattaagaga

SEQ ID NO: 146698 - DNA, 15 bp, Homo sapiens
ggtttctattaagag

SEQ ID NO: 146699 - DNA, 15 bp, Homo sapiens
tggtttctattaaga

SEQ ID NO: 146700 - DNA, 15 bp, Homo sapiens
ctggtttctattaag

SEQ ID NO: 146701 - DNA, 15 bp, Homo sapiens
gctggtttctattaa

SEQ ID NO: 146702 - DNA, 15 bp, Homo sapiens
agctggtttctatta

SEQ ID NO: 146703 - DNA, 15 bp, Homo sapiens
tagctggtttctatt

SEQ ID NO: 146704 - DNA, 15 bp, Homo sapiens
gtagctggtttctat

SEQ ID NO: 146705 - DNA, 15 bp, Homo sapiens
tgtagctggtttcta

SEQ ID NO: 146706 - DNA, 15 bp, Homo sapiens
ctgtagctggtttct

SEQ ID NO: 146707 - DNA, 15 bp, Homo sapiens
cctgtagctggtttc

SEQ ID NO: 146708 - DNA, 15 bp, Homo sapiens
ccctgtagctggttt

SEQ ID NO: 146709 - DNA, 15 bp, Homo sapiens
gccctgtagctggtt

SEQ ID NO: 146710 - DNA, 15 bp, Homo sapiens
tgccctgtagctggt

SEQ ID NO: 146711 - DNA, 15 bp, Homo sapiens
atgccctgtagctgg

SEQ ID NO: 146712 - DNA, 15 bp, Homo sapiens
catgccctgtagctg

SEQ ID NO: 146713 - DNA, 15 bp, Homo sapiens
gcatgccctgtagct

SEQ ID NO: 146714 - DNA, 15 bp, Homo sapiens
tgcatgccctgtagc

SEQ ID NO: 146715 - DNA, 15 bp, Homo sapiens
gtgcatgccctgtag

SEQ ID NO: 146716 - DNA, 15 bp, Homo sapiens
ggtgcatgccctgta

SEQ ID NO: 146717 - DNA, 15 bp, Homo sapiens
cggtgcatgccctgt

SEQ ID NO: 146718 - DNA, 15 bp, Homo sapiens
acggtgcatgccctg

SEQ ID NO: 146719 - DNA, 15 bp, Homo sapiens
cacggtgcatgccct

SEQ ID NO: 146720 - DNA, 15 bp, Homo sapiens
ccacggtgcatgccc

SEQ ID NO: 146721 - DNA, 15 bp, Homo sapiens
accacggtgcatgcc

SEQ ID NO: 146722 - DNA, 15 bp, Homo sapiens
caccacggtgcatgc

SEQ ID NO: 146723 - DNA, 15 bp, Homo sapiens
ccaccacggtgcatg

SEQ ID NO: 146724 - DNA, 15 bp, Homo sapiens
accaccacggtgcat

SEQ ID NO: 146725 - DNA, 15 bp, Homo sapiens
caccaccacggtgca

SEQ ID NO: 146726 - DNA, 15 bp, Homo sapiens
ccaccaccacggtgc

SEQ ID NO: 146727 - DNA, 15 bp, Homo sapiens
gccaccaccacggtg

SEQ ID NO: 146728 - DNA, 15 bp, Homo sapiens
tgccaccaccacggt

SEQ ID NO: 146729 - DNA, 15 bp, Homo sapiens
ctgccaccaccacgg

SEQ ID NO: 146730 - DNA, 15 bp, Homo sapiens
actgccaccaccacg

SEQ ID NO: 146731 - DNA, 15 bp, Homo sapiens
cactgccaccaccac

SEQ ID NO: 146732 - DNA, 15 bp, Homo sapiens
tcactgccaccacca

SEQ ID NO: 146733 - DNA, 15 bp, Homo sapiens
atcactgccaccacc

SEQ ID NO: 146734 - DNA, 15 bp, Homo sapiens
tatcactgccaccac

SEQ ID NO: 146735 - DNA, 15 bp, Homo sapiens
atatcactgccacca

SEQ ID NO: 146736 - DNA, 15 bp, Homo sapiens
catatcactgccacc

SEQ ID NO: 146737 - DNA, 15 bp, Homo sapiens
acatatcactgccac

SEQ ID NO: 146738 - DNA, 15 bp, Homo sapiens
aacatatcactgcca

SEQ ID NO: 146739 - DNA, 15 bp, Homo sapiens
caacatatcactgcc

SEQ ID NO: 146740 - DNA, 15 bp, Homo sapiens
tcaacatatcactgc

SEQ ID NO: 146741 - DNA, 15 bp, Homo sapiens
ttcaacatatcactg

SEQ ID NO: 146742 - DNA, 15 bp, Homo sapiens
attcaacatatcact

SEQ ID NO: 146743 - DNA, 15 bp, Homo sapiens
gattcaacatatcac

SEQ ID NO: 146744 - DNA, 15 bp, Homo sapiens
ggattcaacatatca

SEQ ID NO: 146745 - DNA, 15 bp, Homo sapiens
gggattcaacatatc

SEQ ID NO: 146746 - DNA, 15 bp, Homo sapiens
agggattcaacatat

SEQ ID NO: 146747 - DNA, 15 bp, Homo sapiens
cagggattcaacata

SEQ ID NO: 146748 - DNA, 15 bp, Homo sapiens
acagggattcaacat

SEQ ID NO: 146749 - DNA, 15 bp, Homo sapiens
aacagggattcaaca

SEQ ID NO: 146750 - DNA, 15 bp, Homo sapiens
gaacagggattcaac

SEQ ID NO: 146751 - DNA, 15 bp, Homo sapiens
ggaacagggattcaa

SEQ ID NO: 146752 - DNA, 15 bp, Homo sapiens
gggaacagggattca

SEQ ID NO: 146753 - DNA, 15 bp, Homo sapiens
tgggaacagggattc

SEQ ID NO: 146754 - DNA, 15 bp, Homo sapiens
ctgggaacagggatt

SEQ ID NO: 146755 - DNA, 15 bp, Homo sapiens
cctgggaacagggat

SEQ ID NO: 146756 - DNA, 15 bp, Homo sapiens
ccctgggaacaggga

SEQ ID NO: 146757 - DNA, 15 bp, Homo sapiens
cccctgggaacaggg

SEQ ID NO: 146758 - DNA, 15 bp, Homo sapiens
tcccctgggaacagg

SEQ ID NO: 146759 - DNA, 15 bp, Homo sapiens
atcccctgggaacag

SEQ ID NO: 146760 - DNA, 15 bp, Homo sapiens
catcccctgggaaca

SEQ ID NO: 146761 - DNA, 15 bp, Homo sapiens
acatcccctgggaac

SEQ ID NO: 146762 - DNA, 15 bp, Homo sapiens
gacatcccctgggaa

SEQ ID NO: 146763 - DNA, 15 bp, Homo sapiens
ggacatcccctggga

SEQ ID NO: 146764 - DNA, 15 bp, Homo sapiens
cggacatcccctggg

SEQ ID NO: 146765 - DNA, 15 bp, Homo sapiens
gcggacatcccctgg

SEQ ID NO: 146766 - DNA, 15 bp, Homo sapiens
agcggacatcccctg

SEQ ID NO: 146767 - DNA, 15 bp, Homo sapiens
aagcggacatcccct

SEQ ID NO: 146768 - DNA, 15 bp, Homo sapiens
aaagcggacatcccc

SEQ ID NO: 146769 - DNA, 15 bp, Homo sapiens
gaaagcggacatccc

SEQ ID NO: 146770 - DNA, 15 bp, Homo sapiens
agaaagcggacatcc

SEQ ID NO: 146771 - DNA, 15 bp, Homo sapiens
tagaaagcggacatc

SEQ ID NO: 146772 - DNA, 15 bp, Homo sapiens
atagaaagcggacat

SEQ ID NO: 146773 - DNA, 15 bp, Homo sapiens
gatagaaagcggaca

SEQ ID NO: 146774 - DNA, 15 bp, Homo sapiens
agatagaaagcggac

SEQ ID NO: 146775 - DNA, 15 bp, Homo sapiens
cagatagaaagcgga

SEQ ID NO: 146776 - DNA, 15 bp, Homo sapiens
gcagatagaaagcgg

SEQ ID NO: 146777 - DNA, 15 bp, Homo sapiens
tgcagatagaaagcg

SEQ ID NO: 146778 - DNA, 15 bp, Homo sapiens
ctgcagatagaaagc

SEQ ID NO: 146779 - DNA, 15 bp, Homo sapiens
gctgcagatagaaag

SEQ ID NO: 146780 - DNA, 15 bp, Homo sapiens
agctgcagatagaaa

SEQ ID NO: 146781 - DNA, 15 bp, Homo sapiens
aagctgcagatagaa

SEQ ID NO: 146782 - DNA, 15 bp, Homo sapiens
aaagctgcagataga

SEQ ID NO: 146783 - DNA, 15 bp, Homo sapiens
taaagctgcagatag

SEQ ID NO: 146784 - DNA, 15 bp, Homo sapiens
ttaaagctgcagata

SEQ ID NO: 146785 - DNA, 15 bp, Homo sapiens
attaaagctgcagat

SEQ ID NO: 146786 - DNA, 15 bp, Homo sapiens
cattaaagctgcaga

SEQ ID NO: 146787 - DNA, 15 bp, Homo sapiens
acattaaagctgcag

SEQ ID NO: 146788 - DNA, 15 bp, Homo sapiens
aacattaaagctgca

SEQ ID NO: 146789 - DNA, 15 bp, Homo sapiens
aaacattaaagctgc

SEQ ID NO: 146790 - DNA, 15 bp, Homo sapiens
gaaacattaaagctg

SEQ ID NO: 146791 - DNA, 15 bp, Homo sapiens
tgaaacattaaagct

SEQ ID NO: 146792 - DNA, 15 bp, Homo sapiens
gtgaaacattaaagc

SEQ ID NO: 146793 - DNA, 15 bp, Homo sapiens
agtgaaacattaaag

SEQ ID NO: 146794 - DNA, 15 bp, Homo sapiens
aagtgaaacattaaa

SEQ ID NO: 146795 - DNA, 15 bp, Homo sapiens
taagtgaaacattaa

SEQ ID NO: 146796 - DNA, 15 bp, Homo sapiens
ttaagtgaaacatta

SEQ ID NO: 146797 - DNA, 15 bp, Homo sapiens
attaagtgaaacatt

SEQ ID NO: 146798 - DNA, 15 bp, Homo sapiens
tattaagtgaaacat

SEQ ID NO: 146799 - DNA, 15 bp, Homo sapiens
atattaagtgaaaca

SEQ ID NO: 146800 - DNA, 15 bp, Homo sapiens
gatattaagtgaaac

SEQ ID NO: 146801 - DNA, 15 bp, Homo sapiens
ggatattaagtgaaa

SEQ ID NO: 146802 - DNA, 15 bp, Homo sapiens
aggatattaagtgaa

SEQ ID NO: 146803 - DNA, 15 bp, Homo sapiens
gaggatattaagtga

SEQ ID NO: 146804 - DNA, 15 bp, Homo sapiens
agaggatattaagtg

SEQ ID NO: 146805 - DNA, 15 bp, Homo sapiens
aagaggatattaagt

SEQ ID NO: 146806 - DNA, 15 bp, Homo sapiens
aaagaggatattaag

SEQ ID NO: 146807 - DNA, 15 bp, Homo sapiens
caaagaggatattaa

SEQ ID NO: 146808 - DNA, 15 bp, Homo sapiens
ccaaagaggatatta

SEQ ID NO: 146809 - DNA, 15 bp, Homo sapiens
gccaaagaggatatt

SEQ ID NO: 146810 - DNA, 15 bp, Homo sapiens
agccaaagaggatat

SEQ ID NO: 146811 - DNA, 15 bp, Homo sapiens
tagccaaagaggata

SEQ ID NO: 146812 - DNA, 15 bp, Homo sapiens
gtagccaaagaggat

SEQ ID NO: 146813 - DNA, 15 bp, Homo sapiens
agtagccaaagagga

SEQ ID NO: 146814 - DNA, 15 bp, Homo sapiens
cagtagccaaagagg

SEQ ID NO: 146815 - DNA, 15 bp, Homo sapiens
tcagtagccaaagag

SEQ ID NO: 146816 - DNA, 15 bp, Homo sapiens
ctcagtagccaaaga

SEQ ID NO: 146817 - DNA, 15 bp, Homo sapiens
gctcagtagccaaag

SEQ ID NO: 146818 - DNA, 15 bp, Homo sapiens
cgctcagtagccaaa

SEQ ID NO: 146819 - DNA, 15 bp, Homo sapiens
gcgctcagtagccaa

SEQ ID NO: 146820 - DNA, 15 bp, Homo sapiens
tgcgctcagtagcca

SEQ ID NO: 146821 - DNA, 15 bp, Homo sapiens
gtgcgctcagtagcc

SEQ ID NO: 146822 - DNA, 15 bp, Homo sapiens
agtgcgctcagtagc

SEQ ID NO: 146823 - DNA, 15 bp, Homo sapiens
gagtgcgctcagtag

SEQ ID NO: 146824 - DNA, 15 bp, Homo sapiens
ggagtgcgctcagta

SEQ ID NO: 146825 - DNA, 15 bp, Homo sapiens
aggagtgcgctcagt

SEQ ID NO: 146826 - DNA, 15 bp, Homo sapiens
gaggagtgcgctcag

SEQ ID NO: 146827 - DNA, 15 bp, Homo sapiens
agaggagtgcgctca

SEQ ID NO: 146828 - DNA, 15 bp, Homo sapiens
gagaggagtgcgctc

SEQ ID NO: 146829 - DNA, 15 bp, Homo sapiens
ggagaggagtgcgct

SEQ ID NO: 146830 - DNA, 15 bp, Homo sapiens
gggagaggagtgcgc

SEQ ID NO: 146831 - DNA, 15 bp, Homo sapiens
cgggagaggagtgcg

SEQ ID NO: 146832 - DNA, 15 bp, Homo sapiens
gcgggagaggagtgc

SEQ ID NO: 146833 - DNA, 15 bp, Homo sapiens
tgcgggagaggagtg

SEQ ID NO: 146834 - DNA, 15 bp, Homo sapiens
ctgcgggagaggagt

SEQ ID NO: 146835 - DNA, 15 bp, Homo sapiens
gctgcgggagaggag

SEQ ID NO: 146836 - DNA, 15 bp, Homo sapiens
ggctgcgggagagga

SEQ ID NO: 146837 - DNA, 15 bp, Homo sapiens
cggctgcgggagagg

SEQ ID NO: 146838 - DNA, 15 bp, Homo sapiens
ccggctgcgggagag

SEQ ID NO: 146839 - DNA, 15 bp, Homo sapiens
gccggctgcgggaga

SEQ ID NO: 146840 - DNA, 15 bp, Homo sapiens
tgccggctgcgggag

SEQ ID NO: 146841 - DNA, 15 bp, Homo sapiens
ctgccggctgcggga

SEQ ID NO: 146842 - DNA, 15 bp, Homo sapiens
gctgccggctgcggg

SEQ ID NO: 146843 - DNA, 15 bp, Homo sapiens
cgctgccggctgcgg

SEQ ID NO: 146844 - DNA, 15 bp, Homo sapiens
gcgctgccggctgcg

SEQ ID NO: 146845 - DNA, 15 bp, Homo sapiens
agcgctgccggctgc

SEQ ID NO: 146846 - DNA, 15 bp, Homo sapiens
aagcgctgccggctg

SEQ ID NO: 146847 - DNA, 15 bp, Homo sapiens
caagcgctgccggct

SEQ ID NO: 146848 - DNA, 15 bp, Homo sapiens
ccaagcgctgccggc

SEQ ID NO: 146849 - DNA, 15 bp, Homo sapiens
gccaagcgctgccgg

SEQ ID NO: 146850 - DNA, 15 bp, Homo sapiens
agccaagcgctgccg

SEQ ID NO: 146851 - DNA, 15 bp, Homo sapiens
cagccaagcgctgcc

SEQ ID NO: 146852 - DNA, 15 bp, Homo sapiens
gcagccaagcgctgc

SEQ ID NO: 146853 - DNA, 15 bp, Homo sapiens
agcagccaagcgctg

SEQ ID NO: 146854 - DNA, 15 bp, Homo sapiens
gagcagccaagcgct

SEQ ID NO: 146855 - DNA, 15 bp, Homo sapiens
cgagcagccaagcgc

SEQ ID NO: 146856 - DNA, 15 bp, Homo sapiens
tcgagcagccaagcg

SEQ ID NO: 146857 - DNA, 15 bp, Homo sapiens
gtcgagcagccaagc

SEQ ID NO: 146858 - DNA, 15 bp, Homo sapiens
tgtcgagcagccaag

SEQ ID NO: 146859 - DNA, 15 bp, Homo sapiens
ttgtcgagcagccaa

SEQ ID NO: 146860 - DNA, 15 bp, Homo sapiens
gttgtcgagcagcca

SEQ ID NO: 146861 - DNA, 15 bp, Homo sapiens
agttgtcgagcagcc

SEQ ID NO: 146862 - DNA, 15 bp, Homo sapiens
aagttgtcgagcagc

SEQ ID NO: 146863 - DNA, 15 bp, Homo sapiens
gaagttgtcgagcag

SEQ ID NO: 146864 - DNA, 15 bp, Homo sapiens
ggaagttgtcgagca

SEQ ID NO: 146865 - DNA, 15 bp, Homo sapiens
aggaagttgtcgagc

SEQ ID NO: 146866 - DNA, 15 bp, Homo sapiens
aaggaagttgtcgag

SEQ ID NO: 146867 - DNA, 15 bp, Homo sapiens
gaaggaagttgtcga

SEQ ID NO: 146868 - DNA, 15 bp, Homo sapiens
tgaaggaagttgtcg

SEQ ID NO: 146869 - DNA, 15 bp, Homo sapiens
atgaaggaagttgtc

SEQ ID NO: 146870 - DNA, 15 bp, Homo sapiens
aatgaaggaagttgt

SEQ ID NO: 146871 - DNA, 15 bp, Homo sapiens
aaatgaaggaagttg

SEQ ID NO: 146872 - DNA, 15 bp, Homo sapiens
gaaatgaaggaagtt

SEQ ID NO: 146873 - DNA, 15 bp, Homo sapiens
agaaatgaaggaagt

SEQ ID NO: 146874 - DNA, 15 bp, Homo sapiens
cagaaatgaaggaag

SEQ ID NO: 146875 - DNA, 15 bp, Homo sapiens
ccagaaatgaaggaa

SEQ ID NO: 146876 - DNA, 15 bp, Homo sapiens
gccagaaatgaagga

SEQ ID NO: 146877 - DNA, 15 bp, Homo sapiens
ggccagaaatgaagg

SEQ ID NO: 146878 - DNA, 15 bp, Homo sapiens
tggccagaaatgaag

SEQ ID NO: 146879 - DNA, 15 bp, Homo sapiens
atggccagaaatgaa

SEQ ID NO: 146880 - DNA, 15 bp, Homo sapiens
catggccagaaatga

SEQ ID NO: 146881 - DNA, 15 bp, Homo sapiens
gcatggccagaaatg

SEQ ID NO: 146882 - DNA, 15 bp, Homo sapiens
ggcatggccagaaat

SEQ ID NO: 146883 - DNA, 15 bp, Homo sapiens
cggcatggccagaaa

SEQ ID NO: 146884 - DNA, 15 bp, Homo sapiens
ccggcatggccagaa

SEQ ID NO: 146885 - DNA, 15 bp, Homo sapiens
cccggcatggccaga

SEQ ID NO: 146886 - DNA, 15 bp, Homo sapiens
gcccggcatggccag

SEQ ID NO: 146887 - DNA, 15 bp, Homo sapiens
agcccggcatggcca

SEQ ID NO: 146888 - DNA, 15 bp, Homo sapiens
cagcccggcatggcc

SEQ ID NO: 146889 - DNA, 15 bp, Homo sapiens
tcagcccggcatggc

SEQ ID NO: 146890 - DNA, 15 bp, Homo sapiens
ctcagcccggcatgg

SEQ ID NO: 146891 - DNA, 15 bp, Homo sapiens
gctcagcccggcatg

SEQ ID NO: 146892 - DNA, 15 bp, Homo sapiens
tgctcagcccggcat

SEQ ID NO: 146893 - DNA, 15 bp, Homo sapiens
ttgctcagcccggca

SEQ ID NO: 146894 - DNA, 15 bp, Homo sapiens
cttgctcagcccggc

SEQ ID NO: 146895 - DNA, 15 bp, Homo sapiens
acttgctcagcccgg

SEQ ID NO: 146896 - DNA, 15 bp, Homo sapiens
cacttgctcagcccg

SEQ ID NO: 146897 - DNA, 15 bp, Homo sapiens
gcacttgctcagccc

SEQ ID NO: 146898 - DNA, 15 bp, Homo sapiens
agcacttgctcagcc

SEQ ID NO: 146899 - DNA, 15 bp, Homo sapiens
cagcacttgctcagc

SEQ ID NO: 146900 - DNA, 15 bp, Homo sapiens
gcagcacttgctcag

SEQ ID NO: 146901 - DNA, 15 bp, Homo sapiens
ggcagcacttgctca

SEQ ID NO: 146902 - DNA, 15 bp, Homo sapiens
aggcagcacttgctc

SEQ ID NO: 146903 - DNA, 15 bp, Homo sapiens
caggcagcacttgct

SEQ ID NO: 146904 - DNA, 15 bp, Homo sapiens
acaggcagcacttgc

SEQ ID NO: 146905 - DNA, 15 bp, Homo sapiens
cacaggcagcacttg

SEQ ID NO: 146906 - DNA, 15 bp, Homo sapiens
tcacaggcagcactt

SEQ ID NO: 146907 - DNA, 15 bp, Homo sapiens
ctcacaggcagcact

SEQ ID NO: 146908 - DNA, 15 bp, Homo sapiens
gctcacaggcagcac

SEQ ID NO: 146909 - DNA, 15 bp, Homo sapiens
tgctcacaggcagca

SEQ ID NO: 146910 - DNA, 15 bp, Homo sapiens
atgctcacaggcagc

SEQ ID NO: 146911 - DNA, 15 bp, Homo sapiens
gatgctcacaggcag

SEQ ID NO: 146912 - DNA, 15 bp, Homo sapiens
agatgctcacaggca

SEQ ID NO: 146913 - DNA, 15 bp, Homo sapiens
cagatgctcacaggc

SEQ ID NO: 146914 - DNA, 15 bp, Homo sapiens
gcagatgctcacagg

SEQ ID NO: 146915 - DNA, 15 bp, Homo sapiens
agcagatgctcacag

SEQ ID NO: 146916 - DNA, 15 bp, Homo sapiens
cagcagatgctcaca

SEQ ID NO: 146917 - DNA, 15 bp, Homo sapiens
ccagcagatgctcac

SEQ ID NO: 146918 - DNA, 15 bp, Homo sapiens
cccagcagatgctca

SEQ ID NO: 146919 - DNA, 15 bp, Homo sapiens
ccccagcagatgctc

SEQ ID NO: 146920 - DNA, 15 bp, Homo sapiens
cccccagcagatgct

SEQ ID NO: 146921 - DNA, 15 bp, Homo sapiens
ccccccagcagatgc

SEQ ID NO: 146922 - DNA, 15 bp, Homo sapiens
gccccccagcagatg

SEQ ID NO: 146923 - DNA, 15 bp, Homo sapiens
agccccccagcagat

SEQ ID NO: 146924 - DNA, 15 bp, Homo sapiens
aagccccccagcaga

SEQ ID NO: 146925 - DNA, 15 bp, Homo sapiens
aaagccccccagcag

SEQ ID NO: 146926 - DNA, 15 bp, Homo sapiens
gaaagccccccagca

SEQ ID NO: 146927 - DNA, 15 bp, Homo sapiens
agaaagccccccagc

SEQ ID NO: 146928 - DNA, 15 bp, Homo sapiens
gagaaagccccccag

SEQ ID NO: 146929 - DNA, 15 bp, Homo sapiens
agagaaagcccccca

SEQ ID NO: 146930 - DNA, 15 bp, Homo sapiens
cagagaaagcccccc

SEQ ID NO: 146931 - DNA, 15 bp, Homo sapiens
acagagaaagccccc

SEQ ID NO: 146932 - DNA, 15 bp, Homo sapiens
cacagagaaagcccc

SEQ ID NO: 146933 - DNA, 15 bp, Homo sapiens
ccacagagaaagccc

SEQ ID NO: 146934 - DNA, 15 bp, Homo sapiens
gccacagagaaagcc

SEQ ID NO: 146935 - DNA, 15 bp, Homo sapiens
cgccacagagaaagc

SEQ ID NO: 146936 - DNA, 15 bp, Homo sapiens
acgccacagagaaag

SEQ ID NO: 146937 - DNA, 15 bp, Homo sapiens
aacgccacagagaaa

SEQ ID NO: 146938 - DNA, 15 bp, Homo sapiens
aaacgccacagagaa

SEQ ID NO: 146939 - DNA, 15 bp, Homo sapiens
caaacgccacagaga

SEQ ID NO: 146940 - DNA, 15 bp, Homo sapiens
acaaacgccacagag

SEQ ID NO: 146941 - DNA, 15 bp, Homo sapiens
gacaaacgccacaga

SEQ ID NO: 146942 - DNA, 15 bp, Homo sapiens
agacaaacgccacag

SEQ ID NO: 146943 - DNA, 15 bp, Homo sapiens
cagacaaacgccaca

SEQ ID NO: 146944 - DNA, 15 bp, Homo sapiens
acagacaaacgccac

SEQ ID NO: 146945 - DNA, 15 bp, Homo sapiens
cacagacaaacgcca

SEQ ID NO: 146946 - DNA, 15 bp, Homo sapiens
acacagacaaacgcc

SEQ ID NO: 146947 - DNA, 15 bp, Homo sapiens
aacacagacaaacgc

SEQ ID NO: 146948 - DNA, 15 bp, Homo sapiens
aaacacagacaaacg

SEQ ID NO: 146949 - DNA, 15 bp, Homo sapiens
aaaacacagacaaac

SEQ ID NO: 146950 - DNA, 15 bp, Homo sapiens
aaaaacacagacaaa

SEQ ID NO: 146951 - DNA, 15 bp, Homo sapiens
aaaaaacacagacaa

SEQ ID NO: 146952 - DNA, 15 bp, Homo sapiens
taaaaaacacagaca

SEQ ID NO: 146953 - DNA, 15 bp, Homo sapiens
ttaaaaaacacagac

SEQ ID NO: 146954 - DNA, 15 bp, Homo sapiens
tttaaaaaacacaga

SEQ ID NO: 146955 - DNA, 15 bp, Homo sapiens
atttaaaaaacacag

SEQ ID NO: 146956 - DNA, 15 bp, Homo sapiens
aatttaaaaaacaca

SEQ ID NO: 146957 - DNA, 15 bp, Homo sapiens
caatttaaaaaacac

SEQ ID NO: 146958 - DNA, 15 bp, Homo sapiens
tcaatttaaaaaaca

SEQ ID NO: 146959 - DNA, 15 bp, Homo sapiens
ctcaatttaaaaaac

SEQ ID NO: 146960 - DNA, 15 bp, Homo sapiens
tctcaatttaaaaaa

SEQ ID NO: 146961 - DNA, 15 bp, Homo sapiens
ttctcaatttaaaaa

SEQ ID NO: 146962 - DNA, 15 bp, Homo sapiens
cttctcaatttaaaa

SEQ ID NO: 146963 - DNA, 15 bp, Homo sapiens
acttctcaatttaaa

SEQ ID NO: 146964 - DNA, 15 bp, Homo sapiens
aacttctcaatttaa

SEQ ID NO: 146965 - DNA, 15 bp, Homo sapiens
caacttctcaattta

SEQ ID NO: 146966 - DNA, 15 bp, Homo sapiens
tcaacttctcaattt

SEQ ID NO: 146967 - DNA, 15 bp, Homo sapiens
ttcaacttctcaatt

SEQ ID NO: 146968 - DNA, 15 bp, Homo sapiens
cttcaacttctcaat

SEQ ID NO: 146969 - DNA, 15 bp, Homo sapiens
ccttcaacttctcaa

SEQ ID NO: 146970 - DNA, 15 bp, Homo sapiens
tccttcaacttctca

SEQ ID NO: 146971 - DNA, 15 bp, Homo sapiens
ttccttcaacttctc

SEQ ID NO: 146972 - DNA, 15 bp, Homo sapiens
attccttcaacttct

SEQ ID NO: 146973 - DNA, 15 bp, Homo sapiens
tattccttcaacttc

SEQ ID NO: 146974 - DNA, 15 bp, Homo sapiens
gtattccttcaactt

SEQ ID NO: 146975 - DNA, 15 bp, Homo sapiens
ggtattccttcaact

SEQ ID NO: 146976 - DNA, 15 bp, Homo sapiens
tggtattccttcaac

SEQ ID NO: 146977 - DNA, 15 bp, Homo sapiens
ctggtattccttcaa

SEQ ID NO: 146978 - DNA, 15 bp, Homo sapiens
gctggtattccttca

SEQ ID NO: 146979 - DNA, 15 bp, Homo sapiens
ggctggtattccttc

SEQ ID NO: 146980 - DNA, 15 bp, Homo sapiens
aggctggtattcctt

SEQ ID NO: 146981 - DNA, 15 bp, Homo sapiens
gaggctggtattcct

SEQ ID NO: 146982 - DNA, 15 bp, Homo sapiens
ggaggctggtattcc

SEQ ID NO: 146983 - DNA, 15 bp, Homo sapiens
aggaggctggtattc

SEQ ID NO: 146984 - DNA, 15 bp, Homo sapiens
aaggaggctggtatt

SEQ ID NO: 146985 - DNA, 15 bp, Homo sapiens
aaaggaggctggtat

SEQ ID NO: 146986 - DNA, 15 bp, Homo sapiens
aaaaggaggctggta

SEQ ID NO: 146987 - DNA, 15 bp, Homo sapiens
aaaaaggaggctggt

SEQ ID NO: 146988 - DNA, 15 bp, Homo sapiens
gaaaaaggaggctgg

SEQ ID NO: 146989 - DNA, 15 bp, Homo sapiens
ggaaaaaggaggctg

SEQ ID NO: 146990 - DNA, 15 bp, Homo sapiens
aggaaaaaggaggct

SEQ ID NO: 146991 - DNA, 15 bp, Homo sapiens
taggaaaaaggaggc

SEQ ID NO: 146992 - DNA, 15 bp, Homo sapiens
ctaggaaaaaggagg

SEQ ID NO: 146993 - DNA, 15 bp, Homo sapiens
tctaggaaaaaggag

SEQ ID NO: 146994 - DNA, 15 bp, Homo sapiens
ttctaggaaaaagga

SEQ ID NO: 146995 - DNA, 15 bp, Homo sapiens
gttctaggaaaaagg

SEQ ID NO: 146996 - DNA, 15 bp, Homo sapiens
ggttctaggaaaaag

SEQ ID NO: 146997 - DNA, 15 bp, Homo sapiens
aggttctaggaaaaa

SEQ ID NO: 146998 - DNA, 15 bp, Homo sapiens
taggttctaggaaaa

SEQ ID NO: 146999 - DNA, 15 bp, Homo sapiens
ttaggttctaggaaa

SEQ ID NO: 147000 - DNA, 15 bp, Homo sapiens
gttaggttctaggaa

SEQ ID NO: 147001 - DNA, 15 bp, Homo sapiens
ggttaggttctagga

SEQ ID NO: 147002 - DNA, 15 bp, Homo sapiens
gggttaggttctagg

SEQ ID NO: 147003 - DNA, 15 bp, Homo sapiens
ggggttaggttctag

SEQ ID NO: 147004 - DNA, 15 bp, Homo sapiens
gggggttaggttcta

SEQ ID NO: 147005 - DNA, 15 bp, Homo sapiens
agggggttaggttct

SEQ ID NO: 147006 - DNA, 15 bp, Homo sapiens
cagggggttaggttc

SEQ ID NO: 147007 - DNA, 15 bp, Homo sapiens
acagggggttaggtt

SEQ ID NO: 147008 - DNA, 15 bp, Homo sapiens
tacagggggttaggt

SEQ ID NO: 147009 - DNA, 15 bp, Homo sapiens
atacagggggttagg

SEQ ID NO: 147010 - DNA, 15 bp, Homo sapiens
gatacagggggttag

SEQ ID NO: 147011 - DNA, 15 bp, Homo sapiens
agatacagggggtta

SEQ ID NO: 147012 - DNA, 15 bp, Homo sapiens
aagatacagggggtt

SEQ ID NO: 147013 - DNA, 15 bp, Homo sapiens
aaagatacagggggt

SEQ ID NO: 147014 - DNA, 15 bp, Homo sapiens
gaaagatacaggggg

SEQ ID NO: 147015 - DNA, 15 bp, Homo sapiens
tgaaagatacagggg

SEQ ID NO: 147016 - DNA, 15 bp, Homo sapiens
ttgaaagatacaggg

SEQ ID NO: 147017 - DNA, 15 bp, Homo sapiens
tttgaaagatacagg

SEQ ID NO: 147018 - DNA, 15 bp, Homo sapiens
atttgaaagatacag

SEQ ID NO: 147019 - DNA, 15 bp, Homo sapiens
catttgaaagataca

SEQ ID NO: 147020 - DNA, 15 bp, Homo sapiens
gcatttgaaagatac

SEQ ID NO: 147021 - DNA, 15 bp, Homo sapiens
agcatttgaaagata

SEQ ID NO: 147022 - DNA, 15 bp, Homo sapiens
aagcatttgaaagat

SEQ ID NO: 147023 - DNA, 15 bp, Homo sapiens
aaagcatttgaaaga

SEQ ID NO: 147024 - DNA, 15 bp, Homo sapiens
gaaagcatttgaaag

SEQ ID NO: 147025 - DNA, 15 bp, Homo sapiens
ggaaagcatttgaaa

SEQ ID NO: 147026 - DNA, 15 bp, Homo sapiens
aggaaagcatttgaa

SEQ ID NO: 147027 - DNA, 15 bp, Homo sapiens
caggaaagcatttga

SEQ ID NO: 147028 - DNA, 15 bp, Homo sapiens
ccaggaaagcatttg

SEQ ID NO: 147029 - DNA, 15 bp, Homo sapiens
tccaggaaagcattt

SEQ ID NO: 147030 - DNA, 15 bp, Homo sapiens
ttccaggaaagcatt

SEQ ID NO: 147031 - DNA, 15 bp, Homo sapiens
tttccaggaaagcat

SEQ ID NO: 147032 - DNA, 15 bp, Homo sapiens
gtttccaggaaagca

SEQ ID NO: 147033 - DNA, 15 bp, Homo sapiens
cgtttccaggaaagc

SEQ ID NO: 147034 - DNA, 15 bp, Homo sapiens
tcgtttccaggaaag

SEQ ID NO: 147035 - DNA, 15 bp, Homo sapiens
ctcgtttccaggaaa

SEQ ID NO: 147036 - DNA, 15 bp, Homo sapiens
gctcgtttccaggaa

SEQ ID NO: 147037 - DNA, 15 bp, Homo sapiens
tgctcgtttccagga

SEQ ID NO: 147038 - DNA, 15 bp, Homo sapiens
atgctcgtttccagg

SEQ ID NO: 147039 - DNA, 15 bp, Homo sapiens
catgctcgtttccag

SEQ ID NO: 147040 - DNA, 15 bp, Homo sapiens
gcatgctcgtttcca

SEQ ID NO: 147041 - DNA, 15 bp, Homo sapiens
agcatgctcgtttcc

SEQ ID NO: 147042 - DNA, 15 bp, Homo sapiens
gagcatgctcgtttc

SEQ ID NO: 147043 - DNA, 15 bp, Homo sapiens
tgagcatgctcgttt

SEQ ID NO: 147044 - DNA, 15 bp, Homo sapiens
ctgagcatgctcgtt

SEQ ID NO: 147045 - DNA, 15 bp, Homo sapiens
tctgagcatgctcgt

SEQ ID NO: 147046 - DNA, 15 bp, Homo sapiens
ctctgagcatgctcg

SEQ ID NO: 147047 - DNA, 15 bp, Homo sapiens
tctctgagcatgctc

SEQ ID NO: 147048 - DNA, 15 bp, Homo sapiens
ttctctgagcatgct

SEQ ID NO: 147049 - DNA, 15 bp, Homo sapiens
gttctctgagcatgc

SEQ ID NO: 147050 - DNA, 15 bp, Homo sapiens
agttctctgagcatg

SEQ ID NO: 147051 - DNA, 15 bp, Homo sapiens
cagttctctgagcat

SEQ ID NO: 147052 - DNA, 15 bp, Homo sapiens
tcagttctctgagca

SEQ ID NO: 147053 - DNA, 15 bp, Homo sapiens
gtcagttctctgagc

SEQ ID NO: 147054 - DNA, 15 bp, Homo sapiens
tgtcagttctctgag

SEQ ID NO: 147055 - DNA, 15 bp, Homo sapiens
ttgtcagttctctga

SEQ ID NO: 147056 - DNA, 15 bp, Homo sapiens
tttgtcagttctctg

SEQ ID NO: 147057 - DNA, 15 bp, Homo sapiens
atttgtcagttctct

SEQ ID NO: 147058 - DNA, 15 bp, Homo sapiens
gatttgtcagttctc

SEQ ID NO: 147059 - DNA, 15 bp, Homo sapiens
tgatttgtcagttct

SEQ ID NO: 147060 - DNA, 15 bp, Homo sapiens
atgatttgtcagttc

SEQ ID NO: 147061 - DNA, 15 bp, Homo sapiens
aatgatttgtcagtt

SEQ ID NO: 147062 - DNA, 15 bp, Homo sapiens
caatgatttgtcagt

SEQ ID NO: 147063 - DNA, 15 bp, Homo sapiens
acaatgatttgtcag

SEQ ID NO: 147064 - DNA, 15 bp, Homo sapiens
gacaatgatttgtca

SEQ ID NO: 147065 - DNA, 15 bp, Homo sapiens
ggacaatgatttgtc

SEQ ID NO: 147066 - DNA, 15 bp, Homo sapiens
tggacaatgatttgt

SEQ ID NO: 147067 - DNA, 15 bp, Homo sapiens
ctggacaatgatttg

SEQ ID NO: 147068 - DNA, 15 bp, Homo sapiens
actggacaatgattt

SEQ ID NO: 147069 - DNA, 15 bp, Homo sapiens
cactggacaatgatt

SEQ ID NO: 147070 - DNA, 15 bp, Homo sapiens
tcactggacaatgat

SEQ ID NO: 147071 - DNA, 15 bp, Homo sapiens
gtcactggacaatga

SEQ ID NO: 147072 - DNA, 15 bp, Homo sapiens
ggtcactggacaatg

SEQ ID NO: 147073 - DNA, 15 bp, Homo sapiens
cggtcactggacaat

SEQ ID NO: 147074 - DNA, 15 bp, Homo sapiens
ccggtcactggacaa

SEQ ID NO: 147075 - DNA, 15 bp, Homo sapiens
cccggtcactggaca

SEQ ID NO: 147076 - DNA, 15 bp, Homo sapiens
tcccggtcactggac

SEQ ID NO: 147077 - DNA, 15 bp, Homo sapiens
ctcccggtcactgga

SEQ ID NO: 147078 - DNA, 15 bp, Homo sapiens
cctcccggtcactgg

SEQ ID NO: 147079 - DNA, 15 bp, Homo sapiens
tcctcccggtcactg

SEQ ID NO: 147080 - DNA, 15 bp, Homo sapiens
ttcctcccggtcact

SEQ ID NO: 147081 - DNA, 15 bp, Homo sapiens
tttcctcccggtcac

SEQ ID NO: 147082 - DNA, 15 bp, Homo sapiens
atttcctcccggtca

SEQ ID NO: 147083 - DNA, 15 bp, Homo sapiens
catttcctcccggtc

SEQ ID NO: 147084 - DNA, 15 bp, Homo sapiens
tcatttcctcccggt

SEQ ID NO: 147085 - DNA, 15 bp, Homo sapiens
atcatttcctcccgg

SEQ ID NO: 147086 - DNA, 15 bp, Homo sapiens
gatcatttcctcccg

SEQ ID NO: 147087 - DNA, 15 bp, Homo sapiens
cgatcatttcctccc

SEQ ID NO: 147088 - DNA, 15 bp, Homo sapiens
acgatcatttcctcc

SEQ ID NO: 147089 - DNA, 15 bp, Homo sapiens
aacgatcatttcctc

SEQ ID NO: 147090 - DNA, 15 bp, Homo sapiens
caacgatcatttcct

SEQ ID NO: 147091 - DNA, 15 bp, Homo sapiens
gcaacgatcatttcc

SEQ ID NO: 147092 - DNA, 15 bp, Homo sapiens
agcaacgatcatttc

SEQ ID NO: 147093 - DNA, 15 bp, Homo sapiens
gagcaacgatcattt

SEQ ID NO: 147094 - DNA, 15 bp, Homo sapiens
agagcaacgatcatt

SEQ ID NO: 147095 - DNA, 15 bp, Homo sapiens
aagagcaacgatcat

SEQ ID NO: 147096 - DNA, 15 bp, Homo sapiens
gaagagcaacgatca

SEQ ID NO: 147097 - DNA, 15 bp, Homo sapiens
tgaagagcaacgatc

SEQ ID NO: 147098 - DNA, 15 bp, Homo sapiens
atgaagagcaacgat

SEQ ID NO: 147099 - DNA, 15 bp, Homo sapiens
aatgaagagcaacga

SEQ ID NO: 147100 - DNA, 15 bp, Homo sapiens
aaatgaagagcaacg

SEQ ID NO: 147101 - DNA, 15 bp, Homo sapiens
taaatgaagagcaac

SEQ ID NO: 147102 - DNA, 15 bp, Homo sapiens
ataaatgaagagcaa

SEQ ID NO: 147103 - DNA, 15 bp, Homo sapiens
tataaatgaagagca

SEQ ID NO: 147104 - DNA, 15 bp, Homo sapiens
ttataaatgaagagc

SEQ ID NO: 147105 - DNA, 15 bp, Homo sapiens
attataaatgaagag

SEQ ID NO: 147106 - DNA, 15 bp, Homo sapiens
cattataaatgaaga

SEQ ID NO: 147107 - DNA, 15 bp, Homo sapiens
gcattataaatgaag

SEQ ID NO: 147108 - DNA, 15 bp, Homo sapiens
tgcattataaatgaa

SEQ ID NO: 147109 - DNA, 15 bp, Homo sapiens
ttgcattataaatga

SEQ ID NO: 147110 - DNA, 15 bp, Homo sapiens
tttgcattataaatg

SEQ ID NO: 147111 - DNA, 15 bp, Homo sapiens
atttgcattataaat

SEQ ID NO: 147112 - DNA, 15 bp, Homo sapiens
aatttgcattataaa

SEQ ID NO: 147113 - DNA, 15 bp, Homo sapiens
gaatttgcattataa

SEQ ID NO: 147114 - DNA, 15 bp, Homo sapiens
agaatttgcattata

SEQ ID NO: 147115 - DNA, 15 bp, Homo sapiens
cagaatttgcattat

SEQ ID NO: 147116 - DNA, 15 bp, Homo sapiens
tcagaatttgcatta

SEQ ID NO: 147117 - DNA, 15 bp, Homo sapiens
ctcagaatttgcatt

SEQ ID NO: 147118 - DNA, 15 bp, Homo sapiens
cctcagaatttgcat

SEQ ID NO: 147119 - DNA, 15 bp, Homo sapiens
acctcagaatttgca

SEQ ID NO: 147120 - DNA, 15 bp, Homo sapiens
cacctcagaatttgc

SEQ ID NO: 147121 - DNA, 15 bp, Homo sapiens
acacctcagaatttg

SEQ ID NO: 147122 - DNA, 15 bp, Homo sapiens
gacacctcagaattt

SEQ ID NO: 147123 - DNA, 15 bp, Homo sapiens
agacacctcagaatt

SEQ ID NO: 147124 - DNA, 15 bp, Homo sapiens
gagacacctcagaat

SEQ ID NO: 147125 - DNA, 15 bp, Homo sapiens
ggagacacctcagaa

SEQ ID NO: 147126 - DNA, 15 bp, Homo sapiens
tggagacacctcaga

SEQ ID NO: 147127 - DNA, 15 bp, Homo sapiens
ctggagacacctcag

SEQ ID NO: 147128 - DNA, 15 bp, Homo sapiens
tctggagacacctca

SEQ ID NO: 147129 - DNA, 15 bp, Homo sapiens
ttctggagacacctc

SEQ ID NO: 147130 - DNA, 15 bp, Homo sapiens
cttctggagacacct

SEQ ID NO: 147131 - DNA, 15 bp, Homo sapiens
acttctggagacacc

SEQ ID NO: 147132 - DNA, 15 bp, Homo sapiens
cacttctggagacac

SEQ ID NO: 147133 - DNA, 15 bp, Homo sapiens
acacttctggagaca

SEQ ID NO: 147134 - DNA, 15 bp, Homo sapiens
cacacttctggagac

SEQ ID NO: 147135 - DNA, 15 bp, Homo sapiens
ccacacttctggaga

SEQ ID NO: 147136 - DNA, 15 bp, Homo sapiens
accacacttctggag

SEQ ID NO: 147137 - DNA, 15 bp, Homo sapiens
taccacacttctgga

SEQ ID NO: 147138 - DNA, 15 bp, Homo sapiens
ttaccacacttctgg

SEQ ID NO: 147139 - DNA, 15 bp, Homo sapiens
tttaccacacttctg

SEQ ID NO: 147140 - DNA, 15 bp, Homo sapiens
gtttaccacacttct

SEQ ID NO: 147141 - DNA, 15 bp, Homo sapiens
agtttaccacacttc

SEQ ID NO: 147142 - DNA, 15 bp, Homo sapiens
aagtttaccacactt

SEQ ID NO: 147143 - DNA, 15 bp, Homo sapiens
taagtttaccacact

SEQ ID NO: 147144 - DNA, 15 bp, Homo sapiens
ttaagtttaccacac

SEQ ID NO: 147145 - DNA, 15 bp, Homo sapiens
tttaagtttaccaca

SEQ ID NO: 147146 - DNA, 15 bp, Homo sapiens
ttttaagtttaccac

SEQ ID NO: 147147 - DNA, 15 bp, Homo sapiens
attttaagtttacca

SEQ ID NO: 147148 - DNA, 15 bp, Homo sapiens
cattttaagtttacc

SEQ ID NO: 147149 - DNA, 15 bp, Homo sapiens
tcattttaagtttac

SEQ ID NO: 147150 - DNA, 15 bp, Homo sapiens
atcattttaagttta

SEQ ID NO: 147151 - DNA, 15 bp, Homo sapiens
catcattttaagttt

SEQ ID NO: 147152 - DNA, 15 bp, Homo sapiens
ccatcattttaagtt

SEQ ID NO: 147153 - DNA, 15 bp, Homo sapiens
gccatcattttaagt

SEQ ID NO: 147154 - DNA, 15 bp, Homo sapiens
agccatcattttaag

SEQ ID NO: 147155 - DNA, 15 bp, Homo sapiens
cagccatcattttaa

SEQ ID NO: 147156 - DNA, 15 bp, Homo sapiens
acagccatcatttta

SEQ ID NO: 147157 - DNA, 15 bp, Homo sapiens
cacagccatcatttt

SEQ ID NO: 147158 - DNA, 15 bp, Homo sapiens
ccacagccatcattt

SEQ ID NO: 147159 - DNA, 15 bp, Homo sapiens
accacagccatcatt

SEQ ID NO: 147160 - DNA, 15 bp, Homo sapiens
caccacagccatcat

SEQ ID NO: 147161 - DNA, 15 bp, Homo sapiens
tcaccacagccatca

SEQ ID NO: 147162 - DNA, 15 bp, Homo sapiens
ctcaccacagccatc

SEQ ID NO: 147163 - DNA, 15 bp, Homo sapiens
tctcaccacagccat

SEQ ID NO: 147164 - DNA, 15 bp, Homo sapiens
ttctcaccacagcca

SEQ ID NO: 147165 - DNA, 15 bp, Homo sapiens
gttctcaccacagcc

SEQ ID NO: 147166 - DNA, 15 bp, Homo sapiens
cgttctcaccacagc

SEQ ID NO: 147167 - DNA, 15 bp, Homo sapiens
acgttctcaccacag

SEQ ID NO: 147168 - DNA, 15 bp, Homo sapiens
gacgttctcaccaca

SEQ ID NO: 147169 - DNA, 15 bp, Homo sapiens
agacgttctcaccac

SEQ ID NO: 147170 - DNA, 15 bp, Homo sapiens
gagacgttctcacca

SEQ ID NO: 147171 - DNA, 15 bp, Homo sapiens
agagacgttctcacc

SEQ ID NO: 147172 - DNA, 15 bp, Homo sapiens
cagagacgttctcac

SEQ ID NO: 147173 - DNA, 15 bp, Homo sapiens
gcagagacgttctca

SEQ ID NO: 147174 - DNA, 15 bp, Homo sapiens
tgcagagacgttctc

SEQ ID NO: 147175 - DNA, 15 bp, Homo sapiens
ctgcagagacgttct

SEQ ID NO: 147176 - DNA, 15 bp, Homo sapiens
tctgcagagacgttc

SEQ ID NO: 147177 - DNA, 15 bp, Homo sapiens
ttctgcagagacgtt

SEQ ID NO: 147178 - DNA, 15 bp, Homo sapiens
tttctgcagagacgt

SEQ ID NO: 147179 - DNA, 15 bp, Homo sapiens
ctttctgcagagacg

SEQ ID NO: 147180 - DNA, 15 bp, Homo sapiens
actttctgcagagac

SEQ ID NO: 147181 - DNA, 15 bp, Homo sapiens
aactttctgcagaga

SEQ ID NO: 147182 - DNA, 15 bp, Homo sapiens
caactttctgcagag

SEQ ID NO: 147183 - DNA, 15 bp, Homo sapiens
acaactttctgcaga

SEQ ID NO: 147184 - DNA, 15 bp, Homo sapiens
cacaactttctgcag

SEQ ID NO: 147185 - DNA, 15 bp, Homo sapiens
ccacaactttctgca

SEQ ID NO: 147186 - DNA, 15 bp, Homo sapiens
accacaactttctgc

SEQ ID NO: 147187 - DNA, 15 bp, Homo sapiens
aaccacaactttctg

SEQ ID NO: 147188 - DNA, 15 bp, Homo sapiens
aaaccacaactttct

SEQ ID NO: 147189 - DNA, 15 bp, Homo sapiens
aaaaccacaactttc

SEQ ID NO: 147190 - DNA, 15 bp, Homo sapiens
caaaaccacaacttt

SEQ ID NO: 147191 - DNA, 15 bp, Homo sapiens
acaaaaccacaactt

SEQ ID NO: 147192 - DNA, 15 bp, Homo sapiens
aacaaaaccacaact

SEQ ID NO: 147193 - DNA, 15 bp, Homo sapiens
caacaaaaccacaac

SEQ ID NO: 147194 - DNA, 15 bp, Homo sapiens
gcaacaaaaccacaa

SEQ ID NO: 147195 - DNA, 15 bp, Homo sapiens
tgcaacaaaaccaca

SEQ ID NO: 147196 - DNA, 15 bp, Homo sapiens
atgcaacaaaaccac

SEQ ID NO: 147197 - DNA, 15 bp, Homo sapiens
gatgcaacaaaacca

SEQ ID NO: 147198 - DNA, 15 bp, Homo sapiens
cgatgcaacaaaacc

SEQ ID NO: 147199 - DNA, 15 bp, Homo sapiens
gcgatgcaacaaaac

SEQ ID NO: 147200 - DNA, 15 bp, Homo sapiens
agcgatgcaacaaaa

SEQ ID NO: 147201 - DNA, 15 bp, Homo sapiens
aagcgatgcaacaaa

SEQ ID NO: 147202 - DNA, 15 bp, Homo sapiens
taagcgatgcaacaa

SEQ ID NO: 147203 - DNA, 15 bp, Homo sapiens
gtaagcgatgcaaca

SEQ ID NO: 147204 - DNA, 15 bp, Homo sapiens
tgtaagcgatgcaac

SEQ ID NO: 147205 - DNA, 15 bp, Homo sapiens
ttgtaagcgatgcaa

SEQ ID NO: 147206 - DNA, 15 bp, Homo sapiens
tttgtaagcgatgca

SEQ ID NO: 147207 - DNA, 15 bp, Homo sapiens
ctttgtaagcgatgc

SEQ ID NO: 147208 - DNA, 15 bp, Homo sapiens
cctttgtaagcgatg

SEQ ID NO: 147209 - DNA, 15 bp, Homo sapiens
tcctttgtaagcgat

SEQ ID NO: 147210 - DNA, 15 bp, Homo sapiens
atcctttgtaagcga

SEQ ID NO: 147211 - DNA, 15 bp, Homo sapiens
catcctttgtaagcg

SEQ ID NO: 147212 - DNA, 15 bp, Homo sapiens
ccatcctttgtaagc

SEQ ID NO: 147213 - DNA, 15 bp, Homo sapiens
gccatcctttgtaag

SEQ ID NO: 147214 - DNA, 15 bp, Homo sapiens
tgccatcctttgtaa

SEQ ID NO: 147215 - DNA, 15 bp, Homo sapiens
ctgccatcctttgta

SEQ ID NO: 147216 - DNA, 15 bp, Homo sapiens
actgccatcctttgt

SEQ ID NO: 147217 - DNA, 15 bp, Homo sapiens
aactgccatcctttg

SEQ ID NO: 147218 - DNA, 15 bp, Homo sapiens
aaactgccatccttt

SEQ ID NO: 147219 - DNA, 15 bp, Homo sapiens
gaaactgccatcctt

SEQ ID NO: 147220 - DNA, 15 bp, Homo sapiens
agaaactgccatcct

SEQ ID NO: 147221 - DNA, 15 bp, Homo sapiens
aagaaactgccatcc

SEQ ID NO: 147222 - DNA, 15 bp, Homo sapiens
gaagaaactgccatc

SEQ ID NO: 147223 - DNA, 15 bp, Homo sapiens
agaagaaactgccat

SEQ ID NO: 147224 - DNA, 15 bp, Homo sapiens
gagaagaaactgcca

SEQ ID NO: 147225 - DNA, 15 bp, Homo sapiens
ggagaagaaactgcc

SEQ ID NO: 147226 - DNA, 15 bp, Homo sapiens
aggagaagaaactgc

SEQ ID NO: 147227 - DNA, 15 bp, Homo sapiens
gaggagaagaaactg

SEQ ID NO: 147228 - DNA, 15 bp, Homo sapiens
cgaggagaagaaact

SEQ ID NO: 147229 - DNA, 15 bp, Homo sapiens
ccgaggagaagaaac

SEQ ID NO: 147230 - DNA, 15 bp, Homo sapiens
accgaggagaagaaa

SEQ ID NO: 147231 - DNA, 15 bp, Homo sapiens
taccgaggagaagaa

SEQ ID NO: 147232 - DNA, 15 bp, Homo sapiens
ataccgaggagaaga

SEQ ID NO: 147233 - DNA, 15 bp, Homo sapiens
gataccgaggagaag

SEQ ID NO: 147234 - DNA, 15 bp, Homo sapiens
tgataccgaggagaa

SEQ ID NO: 147235 - DNA, 15 bp, Homo sapiens
ctgataccgaggaga

SEQ ID NO: 147236 - DNA, 15 bp, Homo sapiens
tctgataccgaggag

SEQ ID NO: 147237 - DNA, 15 bp, Homo sapiens
ttctgataccgagga

SEQ ID NO: 147238 - DNA, 15 bp, Homo sapiens
cttctgataccgagg

SEQ ID NO: 147239 - DNA, 15 bp, Homo sapiens
gcttctgataccgag

SEQ ID NO: 147240 - DNA, 15 bp, Homo sapiens
agcttctgataccga

SEQ ID NO: 147241 - DNA, 15 bp, Homo sapiens
gagcttctgataccg

SEQ ID NO: 147242 - DNA, 15 bp, Homo sapiens
agagcttctgatacc

SEQ ID NO: 147243 - DNA, 15 bp, Homo sapiens
cagagcttctgatac

SEQ ID NO: 147244 - DNA, 15 bp, Homo sapiens
acagagcttctgata

SEQ ID NO: 147245 - DNA, 15 bp, Homo sapiens
tacagagcttctgat

SEQ ID NO: 147246 - DNA, 15 bp, Homo sapiens
ttacagagcttctga

SEQ ID NO: 147247 - DNA, 15 bp, Homo sapiens
cttacagagcttctg

SEQ ID NO: 147248 - DNA, 15 bp, Homo sapiens
ccttacagagcttct

SEQ ID NO: 147249 - DNA, 15 bp, Homo sapiens
accttacagagcttc

SEQ ID NO: 147250 - DNA, 15 bp, Homo sapiens
taccttacagagctt

SEQ ID NO: 147251 - DNA, 15 bp, Homo sapiens
ttaccttacagagct

SEQ ID NO: 147252 - DNA, 15 bp, Homo sapiens
gttaccttacagagc

SEQ ID NO: 147253 - DNA, 15 bp, Homo sapiens
agttaccttacagag

SEQ ID NO: 147254 - DNA, 15 bp, Homo sapiens
cagttaccttacaga

SEQ ID NO: 147255 - DNA, 15 bp, Homo sapiens
tcagttaccttacag

SEQ ID NO: 147256 - DNA, 15 bp, Homo sapiens
ctcagttaccttaca

SEQ ID NO: 147257 - DNA, 15 bp, Homo sapiens
actcagttaccttac

SEQ ID NO: 147258 - DNA, 15 bp, Homo sapiens
cactcagttacctta

SEQ ID NO: 147259 - DNA, 15 bp, Homo sapiens
tcactcagttacctt

SEQ ID NO: 147260 - DNA, 15 bp, Homo sapiens
atcactcagttacct

SEQ ID NO: 147261 - DNA, 15 bp, Homo sapiens
aatcactcagttacc

SEQ ID NO: 147262 - DNA, 15 bp, Homo sapiens
caatcactcagttac

SEQ ID NO: 147263 - DNA, 15 bp, Homo sapiens
tcaatcactcagtta

SEQ ID NO: 147264 - DNA, 15 bp, Homo sapiens
ttcaatcactcagtt

SEQ ID NO: 147265 - DNA, 15 bp, Homo sapiens
tttcaatcactcagt

SEQ ID NO: 147266 - DNA, 15 bp, Homo sapiens
ttttcaatcactcag

SEQ ID NO: 147267 - DNA, 15 bp, Homo sapiens
attttcaatcactca

SEQ ID NO: 147268 - DNA, 15 bp, Homo sapiens
tattttcaatcactc

SEQ ID NO: 147269 - DNA, 15 bp, Homo sapiens
ttattttcaatcact

SEQ ID NO: 147270 - DNA, 15 bp, Homo sapiens
cttattttcaatcac

SEQ ID NO: 147271 - DNA, 15 bp, Homo sapiens
ccttattttcaatca

SEQ ID NO: 147272 - DNA, 15 bp, Homo sapiens
tccttattttcaatc

SEQ ID NO: 147273 - DNA, 15 bp, Homo sapiens
atccttattttcaat

SEQ ID NO: 147274 - DNA, 15 bp, Homo sapiens
gatccttattttcaa

SEQ ID NO: 147275 - DNA, 15 bp, Homo sapiens
agatccttattttca

SEQ ID NO: 147276 - DNA, 15 bp, Homo sapiens
gagatccttattttc

SEQ ID NO: 147277 - DNA, 15 bp, Homo sapiens
cgagatccttatttt

SEQ ID NO: 147278 - DNA, 15 bp, Homo sapiens
ccgagatccttattt

SEQ ID NO: 147279 - DNA, 15 bp, Homo sapiens
cccgagatccttatt

SEQ ID NO: 147280 - DNA, 15 bp, Homo sapiens
acccgagatccttat

SEQ ID NO: 147281 - DNA, 15 bp, Homo sapiens
cacccgagatcctta

SEQ ID NO: 147282 - DNA, 15 bp, Homo sapiens
acacccgagatcctt

SEQ ID NO: 147283 - DNA, 15 bp, Homo sapiens
gacacccgagatcct

SEQ ID NO: 147284 - DNA, 15 bp, Homo sapiens
agacacccgagatcc

SEQ ID NO: 147285 - DNA, 15 bp, Homo sapiens
cagacacccgagatc

SEQ ID NO: 147286 - DNA, 15 bp, Homo sapiens
tcagacacccgagat

SEQ ID NO: 147287 - DNA, 15 bp, Homo sapiens
gtcagacacccgaga

SEQ ID NO: 147288 - DNA, 15 bp, Homo sapiens
tgtcagacacccgag

SEQ ID NO: 147289 - DNA, 15 bp, Homo sapiens
ctgtcagacacccga

SEQ ID NO: 147290 - DNA, 15 bp, Homo sapiens
actgtcagacacccg

SEQ ID NO: 147291 - DNA, 15 bp, Homo sapiens
aactgtcagacaccc

SEQ ID NO: 147292 - DNA, 15 bp, Homo sapiens
gaactgtcagacacc

SEQ ID NO: 147293 - DNA, 15 bp, Homo sapiens
agaactgtcagacac

SEQ ID NO: 147294 - DNA, 15 bp, Homo sapiens
tagaactgtcagaca

SEQ ID NO: 147295 - DNA, 15 bp, Homo sapiens
gtagaactgtcagac

SEQ ID NO: 147296 - DNA, 15 bp, Homo sapiens
agtagaactgtcaga

SEQ ID NO: 147297 - DNA, 15 bp, Homo sapiens
cagtagaactgtcag

SEQ ID NO: 147298 - DNA, 15 bp, Homo sapiens
acagtagaactgtca

SEQ ID NO: 147299 - DNA, 15 bp, Homo sapiens
aacagtagaactgtc

SEQ ID NO: 147300 - DNA, 15 bp, Homo sapiens
aaacagtagaactgt

SEQ ID NO: 147301 - DNA, 15 bp, Homo sapiens
gaaacagtagaactg

SEQ ID NO: 147302 - DNA, 15 bp, Homo sapiens
agaaacagtagaact

SEQ ID NO: 147303 - DNA, 15 bp, Homo sapiens
gagaaacagtagaac

SEQ ID NO: 147304 - DNA, 15 bp, Homo sapiens
tgagaaacagtagaa

SEQ ID NO: 147305 - DNA, 15 bp, Homo sapiens
ctgagaaacagtaga

SEQ ID NO: 147306 - DNA, 15 bp, Homo sapiens
cctgagaaacagtag

SEQ ID NO: 147307 - DNA, 15 bp, Homo sapiens
gcctgagaaacagta

SEQ ID NO: 147308 - DNA, 15 bp, Homo sapiens
agcctgagaaacagt

SEQ ID NO: 147309 - DNA, 15 bp, Homo sapiens
gagcctgagaaacag

SEQ ID NO: 147310 - DNA, 15 bp, Homo sapiens
agagcctgagaaaca

SEQ ID NO: 147311 - DNA, 15 bp, Homo sapiens
tagagcctgagaaac

SEQ ID NO: 147312 - DNA, 15 bp, Homo sapiens
ttagagcctgagaaa

SEQ ID NO: 147313 - DNA, 15 bp, Homo sapiens
tttagagcctgagaa

SEQ ID NO: 147314 - DNA, 15 bp, Homo sapiens
ttttagagcctgaga

SEQ ID NO: 147315 - DNA, 15 bp, Homo sapiens
tttttagagcctgag

SEQ ID NO: 147316 - DNA, 15 bp, Homo sapiens
gtttttagagcctga

SEQ ID NO: 147317 - DNA, 15 bp, Homo sapiens
agtttttagagcctg

SEQ ID NO: 147318 - DNA, 15 bp, Homo sapiens
tagtttttagagcct

SEQ ID NO: 147319 - DNA, 15 bp, Homo sapiens
ttagtttttagagcc

SEQ ID NO: 147320 - DNA, 15 bp, Homo sapiens
attagtttttagagc

SEQ ID NO: 147321 - DNA, 15 bp, Homo sapiens
gattagtttttagag

SEQ ID NO: 147322 - DNA, 15 bp, Homo sapiens
agattagtttttaga

SEQ ID NO: 147323 - DNA, 15 bp, Homo sapiens
aagattagtttttag

SEQ ID NO: 147324 - DNA, 15 bp, Homo sapiens
aaagattagttttta

SEQ ID NO: 147325 - DNA, 15 bp, Homo sapiens
gaaagattagttttt

SEQ ID NO: 147326 - DNA, 15 bp, Homo sapiens
tgaaagattagtttt

SEQ ID NO: 147327 - DNA, 15 bp, Homo sapiens
ctgaaagattagttt

SEQ ID NO: 147328 - DNA, 15 bp, Homo sapiens
cctgaaagattagtt

SEQ ID NO: 147329 - DNA, 15 bp, Homo sapiens
acctgaaagattagt

SEQ ID NO: 147330 - DNA, 15 bp, Homo sapiens
aacctgaaagattag

SEQ ID NO: 147331 - DNA, 15 bp, Homo sapiens
gaacctgaaagatta

SEQ ID NO: 147332 - DNA, 15 bp, Homo sapiens
agaacctgaaagatt

SEQ ID NO: 147333 - DNA, 15 bp, Homo sapiens
aagaacctgaaagat

SEQ ID NO: 147334 - DNA, 15 bp, Homo sapiens
taagaacctgaaaga

SEQ ID NO: 147335 - DNA, 15 bp, Homo sapiens
ataagaacctgaaag

SEQ ID NO: 147336 - DNA, 15 bp, Homo sapiens
gataagaacctgaaa

SEQ ID NO: 147337 - DNA, 15 bp, Homo sapiens
tgataagaacctgaa

SEQ ID NO: 147338 - DNA, 15 bp, Homo sapiens
ttgataagaacctga

SEQ ID NO: 147339 - DNA, 15 bp, Homo sapiens
cttgataagaacctg

SEQ ID NO: 147340 - DNA, 15 bp, Homo sapiens
ccttgataagaacct

SEQ ID NO: 147341 - DNA, 15 bp, Homo sapiens
tccttgataagaacc

SEQ ID NO: 147342 - DNA, 15 bp, Homo sapiens
ttccttgataagaac

SEQ ID NO: 147343 - DNA, 15 bp, Homo sapiens
tttccttgataagaa

SEQ ID NO: 147344 - DNA, 15 bp, Homo sapiens
ctttccttgataaga

SEQ ID NO: 147345 - DNA, 15 bp, Homo sapiens
tctttccttgataag

SEQ ID NO: 147346 - DNA, 15 bp, Homo sapiens
atctttccttgataa

SEQ ID NO: 147347 - DNA, 15 bp, Homo sapiens
aatctttccttgata

SEQ ID NO: 147348 - DNA, 15 bp, Homo sapiens
gaatctttccttgat

SEQ ID NO: 147349 - DNA, 15 bp, Homo sapiens
ggaatctttccttga

SEQ ID NO: 147350 - DNA, 15 bp, Homo sapiens
gggaatctttccttg

SEQ ID NO: 147351 - DNA, 15 bp, Homo sapiens
agggaatctttcctt

SEQ ID NO: 147352 - DNA, 15 bp, Homo sapiens
aagggaatctttcct

SEQ ID NO: 147353 - DNA, 15 bp, Homo sapiens
aaagggaatctttcc

SEQ ID NO: 147354 - DNA, 15 bp, Homo sapiens
gaaagggaatctttc

SEQ ID NO: 147355 - DNA, 15 bp, Homo sapiens
agaaagggaatcttt

SEQ ID NO: 147356 - DNA, 15 bp, Homo sapiens
aagaaagggaatctt

SEQ ID NO: 147357 - DNA, 15 bp, Homo sapiens
taagaaagggaatct

SEQ ID NO: 147358 - DNA, 15 bp, Homo sapiens
ctaagaaagggaatc

SEQ ID NO: 147359 - DNA, 15 bp, Homo sapiens
actaagaaagggaat

SEQ ID NO: 147360 - DNA, 15 bp, Homo sapiens
tactaagaaagggaa

SEQ ID NO: 147361 - DNA, 15 bp, Homo sapiens
ttactaagaaaggga

SEQ ID NO: 147362 - DNA, 15 bp, Homo sapiens
gttactaagaaaggg

SEQ ID NO: 147363 - DNA, 15 bp, Homo sapiens
agttactaagaaagg

SEQ ID NO: 147364 - DNA, 15 bp, Homo sapiens
cagttactaagaaag

SEQ ID NO: 147365 - DNA, 15 bp, Homo sapiens
tcagttactaagaaa

SEQ ID NO: 147366 - DNA, 15 bp, Homo sapiens
atcagttactaagaa

SEQ ID NO: 147367 - DNA, 15 bp, Homo sapiens
aatcagttactaaga

SEQ ID NO: 147368 - DNA, 15 bp, Homo sapiens
caatcagttactaag

SEQ ID NO: 147369 - DNA, 15 bp, Homo sapiens
acaatcagttactaa

SEQ ID NO: 147370 - DNA, 15 bp, Homo sapiens
cacaatcagttacta

SEQ ID NO: 147371 - DNA, 15 bp, Homo sapiens
tcacaatcagttact

SEQ ID NO: 147372 - DNA, 15 bp, Homo sapiens
ttcacaatcagttac

SEQ ID NO: 147373 - DNA, 15 bp, Homo sapiens
tttcacaatcagtta

SEQ ID NO: 147374 - DNA, 15 bp, Homo sapiens
ctttcacaatcagtt

SEQ ID NO: 147375 - DNA, 15 bp, Homo sapiens
gctttcacaatcagt

SEQ ID NO: 147376 - DNA, 15 bp, Homo sapiens
agctttcacaatcag

SEQ ID NO: 147377 - DNA, 15 bp, Homo sapiens
cagctttcacaatca

SEQ ID NO: 147378 - DNA, 15 bp, Homo sapiens
acagctttcacaatc

SEQ ID NO: 147379 - DNA, 15 bp, Homo sapiens
aacagctttcacaat

SEQ ID NO: 147380 - DNA, 15 bp, Homo sapiens
taacagctttcacaa

SEQ ID NO: 147381 - DNA, 15 bp, Homo sapiens
ttaacagctttcaca

SEQ ID NO: 147382 - DNA, 15 bp, Homo sapiens
tttaacagctttcac

SEQ ID NO: 147383 - DNA, 15 bp, Homo sapiens
ctttaacagctttca

SEQ ID NO: 147384 - DNA, 15 bp, Homo sapiens
actttaacagctttc

SEQ ID NO: 147385 - DNA, 15 bp, Homo sapiens
cactttaacagcttt

SEQ ID NO: 147386 - DNA, 15 bp, Homo sapiens
tcactttaacagctt

SEQ ID NO: 147387 - DNA, 15 bp, Homo sapiens
ttcactttaacagct

SEQ ID NO: 147388 - DNA, 15 bp, Homo sapiens
attcactttaacagc

SEQ ID NO: 147389 - DNA, 15 bp, Homo sapiens
aattcactttaacag

SEQ ID NO: 147390 - DNA, 15 bp, Homo sapiens
caattcactttaaca

SEQ ID NO: 147391 - DNA, 15 bp, Homo sapiens
gcaattcactttaac

SEQ ID NO: 147392 - DNA, 15 bp, Homo sapiens
tgcaattcactttaa

SEQ ID NO: 147393 - DNA, 15 bp, Homo sapiens
atgcaattcacttta

SEQ ID NO: 147394 - DNA, 15 bp, Homo sapiens
tatgcaattcacttt

SEQ ID NO: 147395 - DNA, 15 bp, Homo sapiens
ttatgcaattcactt

SEQ ID NO: 147396 - DNA, 15 bp, Homo sapiens
attatgcaattcact

SEQ ID NO: 147397 - DNA, 15 bp, Homo sapiens
aattatgcaattcac

SEQ ID NO: 147398 - DNA, 15 bp, Homo sapiens
taattatgcaattca

SEQ ID NO: 147399 - DNA, 15 bp, Homo sapiens
gtaattatgcaattc

SEQ ID NO: 147400 - DNA, 15 bp, Homo sapiens
tgtaattatgcaatt

SEQ ID NO: 147401 - DNA, 15 bp, Homo sapiens
atgtaattatgcaat

SEQ ID NO: 147402 - DNA, 15 bp, Homo sapiens
aatgtaattatgcaa

SEQ ID NO: 147403 - DNA, 15 bp, Homo sapiens
aaatgtaattatgca

SEQ ID NO: 147404 - DNA, 15 bp, Homo sapiens
aaaatgtaattatgc

SEQ ID NO: 147405 - DNA, 15 bp, Homo sapiens
caaaatgtaattatg

SEQ ID NO: 147406 - DNA, 15 bp, Homo sapiens
acaaaatgtaattat

SEQ ID NO: 147407 - DNA, 15 bp, Homo sapiens
aacaaaatgtaatta

SEQ ID NO: 147408 - DNA, 15 bp, Homo sapiens
aaacaaaatgtaatt

SEQ ID NO: 147409 - DNA, 15 bp, Homo sapiens
taaacaaaatgtaat

SEQ ID NO: 147410 - DNA, 15 bp, Homo sapiens
ttaaacaaaatgtaa

SEQ ID NO: 147411 - DNA, 15 bp, Homo sapiens
tttaaacaaaatgta

SEQ ID NO: 147412 - DNA, 15 bp, Homo sapiens
ttttaaacaaaatgt

SEQ ID NO: 147413 - DNA, 15 bp, Homo sapiens
tttttaaacaaaatg

SEQ ID NO: 147414 - DNA, 15 bp, Homo sapiens
atttttaaacaaaat

SEQ ID NO: 147415 - DNA, 15 bp, Homo sapiens
gatttttaaacaaaa

SEQ ID NO: 147416 - DNA, 15 bp, Homo sapiens
agatttttaaacaaa

SEQ ID NO: 147417 - DNA, 15 bp, Homo sapiens
tagatttttaaacaa

SEQ ID NO: 147418 - DNA, 15 bp, Homo sapiens
ttagatttttaaaca

SEQ ID NO: 147419 - DNA, 15 bp, Homo sapiens
tttagatttttaaac

SEQ ID NO: 147420 - DNA, 15 bp, Homo sapiens
ttttagatttttaaa

SEQ ID NO: 147421 - DNA, 15 bp, Homo sapiens
gttttagatttttaa

SEQ ID NO: 147422 - DNA, 15 bp, Homo sapiens
tgttttagattttta

SEQ ID NO: 147423 - DNA, 15 bp, Homo sapiens
ctgttttagattttt

SEQ ID NO: 147424 - DNA, 15 bp, Homo sapiens
cctgttttagatttt

SEQ ID NO: 147425 - DNA, 15 bp, Homo sapiens
acctgttttagattt

SEQ ID NO: 147426 - DNA, 15 bp, Homo sapiens
aacctgttttagatt

SEQ ID NO: 147427 - DNA, 15 bp, Homo sapiens
aaacctgttttagat

SEQ ID NO: 147428 - DNA, 15 bp, Homo sapiens
aaaacctgttttaga

SEQ ID NO: 147429 - DNA, 15 bp, Homo sapiens
taaaacctgttttag

SEQ ID NO: 147430 - DNA, 15 bp, Homo sapiens
ctaaaacctgtttta

SEQ ID NO: 147431 - DNA, 15 bp, Homo sapiens
actaaaacctgtttt

SEQ ID NO: 147432 - DNA, 15 bp, Homo sapiens
aactaaaacctgttt

SEQ ID NO: 147433 - DNA, 15 bp, Homo sapiens
aaactaaaacctgtt

SEQ ID NO: 147434 - DNA, 15 bp, Homo sapiens
aaaactaaaacctgt

SEQ ID NO: 147435 - DNA, 15 bp, Homo sapiens
taaaactaaaacctg

SEQ ID NO: 147436 - DNA, 15 bp, Homo sapiens
ctaaaactaaaacct

SEQ ID NO: 147437 - DNA, 15 bp, Homo sapiens
actaaaactaaaacc

SEQ ID NO: 147438 - DNA, 15 bp, Homo sapiens
tactaaaactaaaac

SEQ ID NO: 147439 - DNA, 15 bp, Homo sapiens
gtactaaaactaaaa

SEQ ID NO: 147440 - DNA, 15 bp, Homo sapiens
tgtactaaaactaaa

SEQ ID NO: 147441 - DNA, 15 bp, Homo sapiens
atgtactaaaactaa

SEQ ID NO: 147442 - DNA, 15 bp, Homo sapiens
tatgtactaaaacta

SEQ ID NO: 147443 - DNA, 15 bp, Homo sapiens
ctatgtactaaaact

SEQ ID NO: 147444 - DNA, 15 bp, Homo sapiens
actatgtactaaaac

SEQ ID NO: 147445 - DNA, 15 bp, Homo sapiens
aactatgtactaaaa

SEQ ID NO: 147446 - DNA, 15 bp, Homo sapiens
aaactatgtactaaa

SEQ ID NO: 147447 - DNA, 15 bp, Homo sapiens
gaaactatgtactaa

SEQ ID NO: 147448 - DNA, 15 bp, Homo sapiens
agaaactatgtacta

SEQ ID NO: 147449 - DNA, 15 bp, Homo sapiens
aagaaactatgtact

SEQ ID NO: 147450 - DNA, 15 bp, Homo sapiens
aaagaaactatgtac

SEQ ID NO: 147451 - DNA, 15 bp, Homo sapiens
aaaagaaactatgta

SEQ ID NO: 147452 - DNA, 15 bp, Homo sapiens
caaaagaaactatgt

SEQ ID NO: 147453 - DNA, 15 bp, Homo sapiens
gcaaaagaaactatg

SEQ ID NO: 147454 - DNA, 15 bp, Homo sapiens
tgcaaaagaaactat

SEQ ID NO: 147455 - DNA, 15 bp, Homo sapiens
ttgcaaaagaaacta

SEQ ID NO: 147456 - DNA, 15 bp, Homo sapiens
attgcaaaagaaact

SEQ ID NO: 147457 - DNA, 15 bp, Homo sapiens
aattgcaaaagaaac

SEQ ID NO: 147458 - DNA, 15 bp, Homo sapiens
caattgcaaaagaaa

SEQ ID NO: 147459 - DNA, 15 bp, Homo sapiens
tcaattgcaaaagaa

SEQ ID NO: 147460 - DNA, 15 bp, Homo sapiens
gtcaattgcaaaaga

SEQ ID NO: 147461 - DNA, 15 bp, Homo sapiens
tgtcaattgcaaaag

SEQ ID NO: 147462 - DNA, 15 bp, Homo sapiens
gtgtcaattgcaaaa

SEQ ID NO: 147463 - DNA, 15 bp, Homo sapiens
tgtgtcaattgcaaa

SEQ ID NO: 147464 - DNA, 15 bp, Homo sapiens
ttgtgtcaattgcaa

SEQ ID NO: 147465 - DNA, 15 bp, Homo sapiens
attgtgtcaattgca

SEQ ID NO: 147466 - DNA, 15 bp, Homo sapiens
gattgtgtcaattgc

SEQ ID NO: 147467 - DNA, 15 bp, Homo sapiens
agattgtgtcaattg

SEQ ID NO: 147468 - DNA, 15 bp, Homo sapiens
aagattgtgtcaatt

SEQ ID NO: 147469 - DNA, 15 bp, Homo sapiens
caagattgtgtcaat

SEQ ID NO: 147470 - DNA, 15 bp, Homo sapiens
acaagattgtgtcaa

SEQ ID NO: 147471 - DNA, 15 bp, Homo sapiens
gacaagattgtgtca

SEQ ID NO: 147472 - DNA, 15 bp, Homo sapiens
agacaagattgtgtc

SEQ ID NO: 147473 - DNA, 15 bp, Homo sapiens
aagacaagattgtgt

SEQ ID NO: 147474 - DNA, 15 bp, Homo sapiens
gaagacaagattgtg

SEQ ID NO: 147475 - DNA, 15 bp, Homo sapiens
agaagacaagattgt

SEQ ID NO: 147476 - DNA, 15 bp, Homo sapiens
cagaagacaagattg

SEQ ID NO: 147477 - DNA, 15 bp, Homo sapiens
tcagaagacaagatt

SEQ ID NO: 147478 - DNA, 15 bp, Homo sapiens
ctcagaagacaagat

SEQ ID NO: 147479 - DNA, 15 bp, Homo sapiens
tctcagaagacaaga

SEQ ID NO: 147480 - DNA, 15 bp, Homo sapiens
atctcagaagacaag

SEQ ID NO: 147481 - DNA, 15 bp, Homo sapiens
catctcagaagacaa

SEQ ID NO: 147482 - DNA, 15 bp, Homo sapiens
ccatctcagaagaca

SEQ ID NO: 147483 - DNA, 15 bp, Homo sapiens
cccatctcagaagac

SEQ ID NO: 147484 - DNA, 15 bp, Homo sapiens
gcccatctcagaaga

SEQ ID NO: 147485 - DNA, 15 bp, Homo sapiens
agcccatctcagaag

SEQ ID NO: 147486 - DNA, 15 bp, Homo sapiens
tagcccatctcagaa

SEQ ID NO: 147487 - DNA, 15 bp, Homo sapiens
ctagcccatctcaga

SEQ ID NO: 147488 - DNA, 15 bp, Homo sapiens
actagcccatctcag

SEQ ID NO: 147489 - DNA, 15 bp, Homo sapiens
cactagcccatctca

SEQ ID NO: 147490 - DNA, 15 bp, Homo sapiens
tcactagcccatctc

SEQ ID NO: 147491 - DNA, 15 bp, Homo sapiens
ttcactagcccatct

SEQ ID NO: 147492 - DNA, 15 bp, Homo sapiens
tttcactagcccatc

SEQ ID NO: 147493 - DNA, 15 bp, Homo sapiens
atttcactagcccat

SEQ ID NO: 147494 - DNA, 15 bp, Homo sapiens
catttcactagccca

SEQ ID NO: 147495 - DNA, 15 bp, Homo sapiens
acatttcactagccc

SEQ ID NO: 147496 - DNA, 15 bp, Homo sapiens
aacatttcactagcc

SEQ ID NO: 147497 - DNA, 15 bp, Homo sapiens
aaacatttcactagc

SEQ ID NO: 147498 - DNA, 15 bp, Homo sapiens
caaacatttcactag

SEQ ID NO: 147499 - DNA, 15 bp, Homo sapiens
ccaaacatttcacta

SEQ ID NO: 147500 - DNA, 15 bp, Homo sapiens
tccaaacatttcact

SEQ ID NO: 147501 - DNA, 15 bp, Homo sapiens
ctccaaacatttcac

SEQ ID NO: 147502 - DNA, 15 bp, Homo sapiens
tctccaaacatttca

SEQ ID NO: 147503 - DNA, 15 bp, Homo sapiens
ttctccaaacatttc

SEQ ID NO: 147504 - DNA, 15 bp, Homo sapiens
tttctccaaacattt

SEQ ID NO: 147505 - DNA, 15 bp, Homo sapiens
ttttctccaaacatt

SEQ ID NO: 147506 - DNA, 15 bp, Homo sapiens
attttctccaaacat

SEQ ID NO: 147507 - DNA, 15 bp, Homo sapiens
tattttctccaaaca

SEQ ID NO: 147508 - DNA, 15 bp, Homo sapiens
atattttctccaaac

SEQ ID NO: 147509 - DNA, 15 bp, Homo sapiens
catattttctccaaa

SEQ ID NO: 147510 - DNA, 15 bp, Homo sapiens
tcatattttctccaa

SEQ ID NO: 147511 - DNA, 15 bp, Homo sapiens
atcatattttctcca

SEQ ID NO: 147512 - DNA, 15 bp, Homo sapiens
catcatattttctcc

SEQ ID NO: 147513 - DNA, 15 bp, Homo sapiens
gcatcatattttctc

SEQ ID NO: 147514 - DNA, 15 bp, Homo sapiens
tgcatcatattttct

SEQ ID NO: 147515 - DNA, 15 bp, Homo sapiens
ttgcatcatattttc

SEQ ID NO: 147516 - DNA, 15 bp, Homo sapiens
tttgcatcatatttt

SEQ ID NO: 147517 - DNA, 15 bp, Homo sapiens
ttttgcatcatattt

SEQ ID NO: 147518 - DNA, 15 bp, Homo sapiens
gttttgcatcatatt

SEQ ID NO: 147519 - DNA, 15 bp, Homo sapiens
agttttgcatcatat

SEQ ID NO: 147520 - DNA, 15 bp, Homo sapiens
tagttttgcatcata

SEQ ID NO: 147521 - DNA, 15 bp, Homo sapiens
gtagttttgcatcat

SEQ ID NO: 147522 - DNA, 15 bp, Homo sapiens
agtagttttgcatca

SEQ ID NO: 147523 - DNA, 15 bp, Homo sapiens
tagtagttttgcatc

SEQ ID NO: 147524 - DNA, 15 bp, Homo sapiens
gtagtagttttgcat

SEQ ID NO: 147525 - DNA, 15 bp, Homo sapiens
tgtagtagttttgca

SEQ ID NO: 147526 - DNA, 15 bp, Homo sapiens
atgtagtagttttgc

SEQ ID NO: 147527 - DNA, 15 bp, Homo sapiens
aatgtagtagttttg

SEQ ID NO: 147528 - DNA, 15 bp, Homo sapiens
gaatgtagtagtttt

SEQ ID NO: 147529 - DNA, 15 bp, Homo sapiens
tgaatgtagtagttt

SEQ ID NO: 147530 - DNA, 15 bp, Homo sapiens
atgaatgtagtagtt

SEQ ID NO: 147531 - DNA, 15 bp, Homo sapiens
aatgaatgtagtagt

SEQ ID NO: 147532 - DNA, 15 bp, Homo sapiens
taatgaatgtagtag

SEQ ID NO: 147533 - DNA, 15 bp, Homo sapiens
ttaatgaatgtagta

SEQ ID NO: 147534 - DNA, 15 bp, Homo sapiens
cttaatgaatgtagt

SEQ ID NO: 147535 - DNA, 15 bp, Homo sapiens
tcttaatgaatgtag

SEQ ID NO: 147536 - DNA, 15 bp, Homo sapiens
gtcttaatgaatgta

SEQ ID NO: 147537 - DNA, 15 bp, Homo sapiens
ggtcttaatgaatgt

SEQ ID NO: 147538 - DNA, 15 bp, Homo sapiens
aggtcttaatgaatg

SEQ ID NO: 147539 - DNA, 15 bp, Homo sapiens
caggtcttaatgaat

SEQ ID NO: 147540 - DNA, 15 bp, Homo sapiens
acaggtcttaatgaa

SEQ ID NO: 147541 - DNA, 15 bp, Homo sapiens
aacaggtcttaatga

SEQ ID NO: 147542 - DNA, 15 bp, Homo sapiens
taacaggtcttaatg

SEQ ID NO: 147543 - DNA, 15 bp, Homo sapiens
gtaacaggtcttaat

SEQ ID NO: 147544 - DNA, 15 bp, Homo sapiens
ggtaacaggtcttaa

SEQ ID NO: 147545 - DNA, 15 bp, Homo sapiens
aggtaacaggtctta

SEQ ID NO: 147546 - DNA, 15 bp, Homo sapiens
gaggtaacaggtctt

SEQ ID NO: 147547 - DNA, 15 bp, Homo sapiens
agaggtaacaggtct

SEQ ID NO: 147548 - DNA, 15 bp, Homo sapiens
gagaggtaacaggtc

SEQ ID NO: 147549 - DNA, 15 bp, Homo sapiens
agagaggtaacaggt

SEQ ID NO: 147550 - DNA, 15 bp, Homo sapiens
cagagaggtaacagg

SEQ ID NO: 147551 - DNA, 15 bp, Homo sapiens
ccagagaggtaacag

SEQ ID NO: 147552 - DNA, 15 bp, Homo sapiens
accagagaggtaaca

SEQ ID NO: 147553 - DNA, 15 bp, Homo sapiens
taccagagaggtaac

SEQ ID NO: 147554 - DNA, 15 bp, Homo sapiens
gtaccagagaggtaa

SEQ ID NO: 147555 - DNA, 15 bp, Homo sapiens
agtaccagagaggta

SEQ ID NO: 147556 - DNA, 15 bp, Homo sapiens
aagtaccagagaggt

SEQ ID NO: 147557 - DNA, 15 bp, Homo sapiens
aaagtaccagagagg

SEQ ID NO: 147558 - DNA, 15 bp, Homo sapiens
caaagtaccagagag

SEQ ID NO: 147559 - DNA, 15 bp, Homo sapiens
gcaaagtaccagaga

SEQ ID NO: 147560 - DNA, 15 bp, Homo sapiens
tgcaaagtaccagag

SEQ ID NO: 147561 - DNA, 15 bp, Homo sapiens
ctgcaaagtaccaga

SEQ ID NO: 147562 - DNA, 15 bp, Homo sapiens
actgcaaagtaccag

SEQ ID NO: 147563 - DNA, 15 bp, Homo sapiens
tactgcaaagtacca

SEQ ID NO: 147564 - DNA, 15 bp, Homo sapiens
atactgcaaagtacc

SEQ ID NO: 147565 - DNA, 15 bp, Homo sapiens
gatactgcaaagtac

SEQ ID NO: 147566 - DNA, 15 bp, Homo sapiens
agatactgcaaagta

SEQ ID NO: 147567 - DNA, 15 bp, Homo sapiens
aagatactgcaaagt

SEQ ID NO: 147568 - DNA, 15 bp, Homo sapiens
taagatactgcaaag

SEQ ID NO: 147569 - DNA, 15 bp, Homo sapiens
ttaagatactgcaaa

SEQ ID NO: 147570 - DNA, 15 bp, Homo sapiens
attaagatactgcaa

SEQ ID NO: 147571 - DNA, 15 bp, Homo sapiens
tattaagatactgca

SEQ ID NO: 147572 - DNA, 15 bp, Homo sapiens
ctattaagatactgc

SEQ ID NO: 147573 - DNA, 15 bp, Homo sapiens
actattaagatactg

SEQ ID NO: 147574 - DNA, 15 bp, Homo sapiens
cactattaagatact

SEQ ID NO: 147575 - DNA, 15 bp, Homo sapiens
tcactattaagatac

SEQ ID NO: 147576 - DNA, 15 bp, Homo sapiens
ttcactattaagata

SEQ ID NO: 147577 - DNA, 15 bp, Homo sapiens
attcactattaagat

SEQ ID NO: 147578 - DNA, 15 bp, Homo sapiens
cattcactattaaga

SEQ ID NO: 147579 - DNA, 15 bp, Homo sapiens
ccattcactattaag

SEQ ID NO: 147580 - DNA, 15 bp, Homo sapiens
gccattcactattaa

SEQ ID NO: 147581 - DNA, 15 bp, Homo sapiens
tgccattcactatta

SEQ ID NO: 147582 - DNA, 15 bp, Homo sapiens
gtgccattcactatt

SEQ ID NO: 147583 - DNA, 15 bp, Homo sapiens
tgtgccattcactat

SEQ ID NO: 147584 - DNA, 15 bp, Homo sapiens
atgtgccattcacta

SEQ ID NO: 147585 - DNA, 15 bp, Homo sapiens
aatgtgccattcact

SEQ ID NO: 147586 - DNA, 15 bp, Homo sapiens
taatgtgccattcac

SEQ ID NO: 147587 - DNA, 15 bp, Homo sapiens
ttaatgtgccattca

SEQ ID NO: 147588 - DNA, 15 bp, Homo sapiens
attaatgtgccattc

SEQ ID NO: 147589 - DNA, 15 bp, Homo sapiens
gattaatgtgccatt

SEQ ID NO: 147590 - DNA, 15 bp, Homo sapiens
agattaatgtgccat

SEQ ID NO: 147591 - DNA, 15 bp, Homo sapiens
aagattaatgtgcca

SEQ ID NO: 147592 - DNA, 15 bp, Homo sapiens
taagattaatgtgcc

SEQ ID NO: 147593 - DNA, 15 bp, Homo sapiens
ataagattaatgtgc

SEQ ID NO: 147594 - DNA, 15 bp, Homo sapiens
cataagattaatgtg

SEQ ID NO: 147595 - DNA, 15 bp, Homo sapiens
acataagattaatgt

SEQ ID NO: 147596 - DNA, 15 bp, Homo sapiens
tacataagattaatg

SEQ ID NO: 147597 - DNA, 15 bp, Homo sapiens
ttacataagattaat

SEQ ID NO: 147598 - DNA, 15 bp, Homo sapiens
tttacataagattaa

SEQ ID NO: 147599 - DNA, 15 bp, Homo sapiens
atttacataagatta

SEQ ID NO: 147600 - DNA, 15 bp, Homo sapiens
aatttacataagatt

SEQ ID NO: 147601 - DNA, 15 bp, Homo sapiens
aaatttacataagat

SEQ ID NO: 147602 - DNA, 15 bp, Homo sapiens
aaaatttacataaga

SEQ ID NO: 147603 - DNA, 15 bp, Homo sapiens
taaaatttacataag

SEQ ID NO: 147604 - DNA, 15 bp, Homo sapiens
ctaaaatttacataa

SEQ ID NO: 147605 - DNA, 15 bp, Homo sapiens
actaaaatttacata

SEQ ID NO: 147606 - DNA, 15 bp, Homo sapiens
tactaaaatttacat

SEQ ID NO: 147607 - DNA, 15 bp, Homo sapiens
ttactaaaatttaca

SEQ ID NO: 147608 - DNA, 15 bp, Homo sapiens
tttactaaaatttac

SEQ ID NO: 147609 - DNA, 15 bp, Homo sapiens
ttttactaaaattta

SEQ ID NO: 147610 - DNA, 15 bp, Homo sapiens
attttactaaaattt

SEQ ID NO: 147611 - DNA, 15 bp, Homo sapiens
aattttactaaaatt

SEQ ID NO: 147612 - DNA, 15 bp, Homo sapiens
taattttactaaaat

SEQ ID NO: 147613 - DNA, 15 bp, Homo sapiens
ttaattttactaaaa

SEQ ID NO: 147614 - DNA, 15 bp, Homo sapiens
tttaattttactaaa

SEQ ID NO: 147615 - DNA, 15 bp, Homo sapiens
ttttaattttactaa

SEQ ID NO: 147616 - DNA, 15 bp, Homo sapiens
cttttaattttacta

SEQ ID NO: 147617 - DNA, 15 bp, Homo sapiens
tcttttaattttact

SEQ ID NO: 147618 - DNA, 15 bp, Homo sapiens
ttcttttaattttac

SEQ ID NO: 147619 - DNA, 15 bp, Homo sapiens
cttcttttaatttta

SEQ ID NO: 147620 - DNA, 15 bp, Homo sapiens
tcttcttttaatttt

SEQ ID NO: 147621 - DNA, 15 bp, Homo sapiens
ctcttcttttaattt

SEQ ID NO: 147622 - DNA, 15 bp, Homo sapiens
actcttcttttaatt

SEQ ID NO: 147623 - DNA, 15 bp, Homo sapiens
cactcttcttttaat

SEQ ID NO: 147624 - DNA, 15 bp, Homo sapiens
gcactcttcttttaa

SEQ ID NO: 147625 - DNA, 15 bp, Homo sapiens
ggcactcttctttta

SEQ ID NO: 147626 - DNA, 15 bp, Homo sapiens
tggcactcttctttt

SEQ ID NO: 147627 - DNA, 15 bp, Homo sapiens
ttggcactcttcttt

SEQ ID NO: 147628 - DNA, 15 bp, Homo sapiens
tttggcactcttctt

SEQ ID NO: 147629 - DNA, 15 bp, Homo sapiens
atttggcactcttct

SEQ ID NO: 147630 - DNA, 15 bp, Homo sapiens
tatttggcactcttc

SEQ ID NO: 147631 - DNA, 15 bp, Homo sapiens
ttatttggcactctt

SEQ ID NO: 147632 - DNA, 15 bp, Homo sapiens
attatttggcactct

SEQ ID NO: 147633 - DNA, 15 bp, Homo sapiens
gattatttggcactc

SEQ ID NO: 147634 - DNA, 15 bp, Homo sapiens
agattatttggcact

SEQ ID NO: 147635 - DNA, 15 bp, Homo sapiens
aagattatttggcac

SEQ ID NO: 147636 - DNA, 15 bp, Homo sapiens
aaagattatttggca

SEQ ID NO: 147637 - DNA, 15 bp, Homo sapiens
gaaagattatttggc

SEQ ID NO: 147638 - DNA, 15 bp, Homo sapiens
tgaaagattatttgg

SEQ ID NO: 147639 - DNA, 15 bp, Homo sapiens
ctgaaagattatttg

SEQ ID NO: 147640 - DNA, 15 bp, Homo sapiens
actgaaagattattt

SEQ ID NO: 147641 - DNA, 15 bp, Homo sapiens
tactgaaagattatt

SEQ ID NO: 147642 - DNA, 15 bp, Homo sapiens
ctactgaaagattat

SEQ ID NO: 147643 - DNA, 15 bp, Homo sapiens
tctactgaaagatta

SEQ ID NO: 147644 - DNA, 15 bp, Homo sapiens
atctactgaaagatt

SEQ ID NO: 147645 - DNA, 15 bp, Homo sapiens
aatctactgaaagat

SEQ ID NO: 147646 - DNA, 15 bp, Homo sapiens
aaatctactgaaaga

SEQ ID NO: 147647 - DNA, 15 bp, Homo sapiens
aaaatctactgaaag

SEQ ID NO: 147648 - DNA, 15 bp, Homo sapiens
aaaaatctactgaaa

SEQ ID NO: 147649 - DNA, 15 bp, Homo sapiens
taaaaatctactgaa

SEQ ID NO: 147650 - DNA, 15 bp, Homo sapiens
ttaaaaatctactga

SEQ ID NO: 147651 - DNA, 15 bp, Homo sapiens
tttaaaaatctactg

SEQ ID NO: 147652 - DNA, 15 bp, Homo sapiens
ttttaaaaatctact

SEQ ID NO: 147653 - DNA, 15 bp, Homo sapiens
tttttaaaaatctac

SEQ ID NO: 147654 - DNA, 15 bp, Homo sapiens
ttttttaaaaatcta

SEQ ID NO: 147655 - DNA, 15 bp, Homo sapiens
attttttaaaaatct

SEQ ID NO: 147656 - DNA, 15 bp, Homo sapiens
cattttttaaaaatc

SEQ ID NO: 147657 - DNA, 15 bp, Homo sapiens
acattttttaaaaat

SEQ ID NO: 147658 - DNA, 15 bp, Homo sapiens
gaacattttttaaaa

SEQ ID NO: 147659 - DNA, 15 bp, Homo sapiens
ggaacattttttaaa

SEQ ID NO: 147660 - DNA, 15 bp, Homo sapiens
tggaacattttttaa

SEQ ID NO: 147661 - DNA, 15 bp, Homo sapiens
atggaacatttttta

SEQ ID NO: 147662 - DNA, 15 bp, Homo sapiens
aatggaacatttttt

SEQ ID NO: 147663 - DNA, 15 bp, Homo sapiens
caatggaacattttt

SEQ ID NO: 147664 - DNA, 15 bp, Homo sapiens
acaatggaacatttt

SEQ ID NO: 147665 - DNA, 15 bp, Homo sapiens
aacaatggaacattt

SEQ ID NO: 147666 - DNA, 15 bp, Homo sapiens
aaacaatggaacatt

SEQ ID NO: 147667 - DNA, 15 bp, Homo sapiens
aaaacaatggaacat

SEQ ID NO: 147668 - DNA, 15 bp, Homo sapiens
taaaacaatggaaca

SEQ ID NO: 147669 - DNA, 15 bp, Homo sapiens
ataaaacaatggaac

SEQ ID NO: 147670 - DNA, 15 bp, Homo sapiens
tataaaacaatggaa

SEQ ID NO: 147671 - DNA, 15 bp, Homo sapiens
ctataaaacaatgga

SEQ ID NO: 147672 - DNA, 15 bp, Homo sapiens
gctataaaacaatgg

SEQ ID NO: 147673 - DNA, 15 bp, Homo sapiens
agctataaaacaatg

SEQ ID NO: 147674 - DNA, 15 bp, Homo sapiens
tagctataaaacaat

SEQ ID NO: 147675 - DNA, 15 bp, Homo sapiens
ttagctataaaacaa

SEQ ID NO: 147676 - DNA, 15 bp, Homo sapiens
aattagctataaaac

SEQ ID NO: 147677 - DNA, 15 bp, Homo sapiens
caattagctataaaa

SEQ ID NO: 147678 - DNA, 15 bp, Homo sapiens
gcaattagctataaa

SEQ ID NO: 147679 - DNA, 15 bp, Homo sapiens
agcaattagctataa

SEQ ID NO: 147680 - DNA, 15 bp, Homo sapiens
aagcaattagctata

SEQ ID NO: 147681 - DNA, 15 bp, Homo sapiens
aaagcaattagctat

SEQ ID NO: 147682 - DNA, 15 bp, Homo sapiens
aaaagcaattagcta

SEQ ID NO: 147683 - DNA, 15 bp, Homo sapiens
aaaaagcaattagct

SEQ ID NO: 147684 - DNA, 15 bp, Homo sapiens
gaaaaagcaattagc

SEQ ID NO: 147685 - DNA, 15 bp, Homo sapiens
tgaaaaagcaattag

SEQ ID NO: 147686 - DNA, 15 bp, Homo sapiens
ttgaaaaagcaatta

SEQ ID NO: 147687 - DNA, 15 bp, Homo sapiens
attgaaaaagcaatt

SEQ ID NO: 147688 - DNA, 15 bp, Homo sapiens
aattgaaaaagcaat

SEQ ID NO: 147689 - DNA, 15 bp, Homo sapiens
taattgaaaaagcaa

SEQ ID NO: 147690 - DNA, 15 bp, Homo sapiens
ttaattgaaaaagca

SEQ ID NO: 147691 - DNA, 15 bp, Homo sapiens
tttaattgaaaaagc

SEQ ID NO: 147692 - DNA, 15 bp, Homo sapiens
ttttaattgaaaaag

SEQ ID NO: 147693 - DNA, 15 bp, Homo sapiens
gttttaattgaaaaa

SEQ ID NO: 147694 - DNA, 15 bp, Homo sapiens
tgttttaattgaaaa

SEQ ID NO: 147695 - DNA, 15 bp, Homo sapiens
ttgttttaattgaaa

SEQ ID NO: 147696 - DNA, 15 bp, Homo sapiens
attgttttaattgaa

SEQ ID NO: 147697 - DNA, 15 bp, Homo sapiens
aattgttttaattga

SEQ ID NO: 147698 - DNA, 15 bp, Homo sapiens
taattgttttaattg

SEQ ID NO: 147699 - DNA, 15 bp, Homo sapiens
ttaattgttttaatt

SEQ ID NO: 147700 - DNA, 15 bp, Homo sapiens
tttaattgttttaat

SEQ ID NO: 147701 - DNA, 15 bp, Homo sapiens
ttttaattgttttaa

SEQ ID NO: 147702 - DNA, 15 bp, Homo sapiens
cttttaattgtttta

SEQ ID NO: 147703 - DNA, 15 bp, Homo sapiens
tcttttaattgtttt

SEQ ID NO: 147704 - DNA, 15 bp, Homo sapiens
gtcttttaattgttt

SEQ ID NO: 147705 - DNA, 15 bp, Homo sapiens
tgtcttttaattgtt

SEQ ID NO: 147706 - DNA, 15 bp, Homo sapiens
atgtcttttaattgt

SEQ ID NO: 147707 - DNA, 15 bp, Homo sapiens
aatgtcttttaattg

SEQ ID NO: 147708 - DNA, 15 bp, Homo sapiens
aaatgtcttttaatt

SEQ ID NO: 147709 - DNA, 15 bp, Homo sapiens
aaaatgtcttttaat

SEQ ID NO: 147710 - DNA, 15 bp, Homo sapiens
taaaatgtcttttaa

SEQ ID NO: 147711 - DNA, 15 bp, Homo sapiens
ttaaaatgtctttta

SEQ ID NO: 147712 - DNA, 15 bp, Homo sapiens
tttaaaatgtctttt

SEQ ID NO: 147713 - DNA, 15 bp, Homo sapiens
tttttaaaatgtctt

SEQ ID NO: 147714 - DNA, 15 bp, Homo sapiens
ttttttaaaatgtct

SEQ ID NO: 147715 - DNA, 15 bp, Homo sapiens
tttttttaaaatgtc

SEQ ID NO: 147716 - DNA, 15 bp, Homo sapiens
atttttttaaaatgt

SEQ ID NO: 147717 - DNA, 15 bp, Homo sapiens
catttttttaaaatg

SEQ ID NO: 147718 - DNA, 15 bp, Homo sapiens
tcatttttttaaaat

SEQ ID NO: 147719 - DNA, 15 bp, Homo sapiens
atcatttttttaaaa

SEQ ID NO: 147720 - DNA, 15 bp, Homo sapiens
gatcatttttttaaa

SEQ ID NO: 147721 - DNA, 15 bp, Homo sapiens
tgatcatttttttaa

SEQ ID NO: 147722 - DNA, 15 bp, Homo sapiens
ctgatcattttttta

SEQ ID NO: 147723 - DNA, 15 bp, Homo sapiens
tctgatcattttttt

SEQ ID NO: 147724 - DNA, 15 bp, Homo sapiens
gtctgatcatttttt

SEQ ID NO: 147725 - DNA, 15 bp, Homo sapiens
agtctgatcattttt

SEQ ID NO: 147726 - DNA, 15 bp, Homo sapiens
cagtctgatcatttt

SEQ ID NO: 147727 - DNA, 15 bp, Homo sapiens
tcagtctgatcattt

SEQ ID NO: 147728 - DNA, 15 bp, Homo sapiens
ttcagtctgatcatt

SEQ ID NO: 147729 - DNA, 15 bp, Homo sapiens
attcagtctgatcat

SEQ ID NO: 147730 - DNA, 15 bp, Homo sapiens
aattcagtctgatca

SEQ ID NO: 147731 - DNA, 15 bp, Homo sapiens
aaattcagtctgatc

SEQ ID NO: 147732 - DNA, 15 bp, Homo sapiens
gaaattcagtctgat

SEQ ID NO: 147733 - DNA, 15 bp, Homo sapiens
tgaaattcagtctga

SEQ ID NO: 147734 - DNA, 15 bp, Homo sapiens
atgaaattcagtctg

SEQ ID NO: 147735 - DNA, 15 bp, Homo sapiens
gatgaaattcagtct

SEQ ID NO: 147736 - DNA, 15 bp, Homo sapiens
tgatgaaattcagtc

SEQ ID NO: 147737 - DNA, 15 bp, Homo sapiens
atgatgaaattcagt

SEQ ID NO: 147738 - DNA, 15 bp, Homo sapiens
tatgatgaaattcag

SEQ ID NO: 147739 - DNA, 15 bp, Homo sapiens
ttatgatgaaattca

SEQ ID NO: 147740 - DNA, 15 bp, Homo sapiens
tttatgatgaaattc

SEQ ID NO: 147741 - DNA, 15 bp, Homo sapiens
ttttatgatgaaatt

SEQ ID NO: 147742 - DNA, 15 bp, Homo sapiens
gttttatgatgaaat

SEQ ID NO: 147743 - DNA, 15 bp, Homo sapiens
tgttttatgatgaaa

SEQ ID NO: 147744 - DNA, 15 bp, Homo sapiens
atgttttatgatgaa

SEQ ID NO: 147745 - DNA, 15 bp, Homo sapiens
gatgttttatgatga

SEQ ID NO: 147746 - DNA, 15 bp, Homo sapiens
ggatgttttatgatg

SEQ ID NO: 147747 - DNA, 15 bp, Homo sapiens
gggatgttttatgat

SEQ ID NO: 147748 - DNA, 15 bp, Homo sapiens
ggggatgttttatga

SEQ ID NO: 147749 - DNA, 15 bp, Homo sapiens
aggggatgttttatg

SEQ ID NO: 147750 - DNA, 15 bp, Homo sapiens
taggggatgttttat

SEQ ID NO: 147751 - DNA, 15 bp, Homo sapiens
ataggggatgtttta

SEQ ID NO: 147752 - DNA, 15 bp, Homo sapiens
tataggggatgtttt

SEQ ID NO: 147753 - DNA, 15 bp, Homo sapiens
atataggggatgttt

SEQ ID NO: 147754 - DNA, 15 bp, Homo sapiens
aatataggggatgtt

SEQ ID NO: 147755 - DNA, 15 bp, Homo sapiens
gaatataggggatgt

SEQ ID NO: 147756 - DNA, 15 bp, Homo sapiens
agaatataggggatg

SEQ ID NO: 147757 - DNA, 15 bp, Homo sapiens
aagaatataggggat

SEQ ID NO: 147758 - DNA, 15 bp, Homo sapiens
taagaatatagggga

SEQ ID NO: 147759 - DNA, 15 bp, Homo sapiens
ttaagaatatagggg

SEQ ID NO: 147760 - DNA, 15 bp, Homo sapiens
tttaagaatataggg

SEQ ID NO: 147761 - DNA, 15 bp, Homo sapiens
atttaagaatatagg

SEQ ID NO: 147762 - DNA, 15 bp, Homo sapiens
gatttaagaatatag

SEQ ID NO: 147763 - DNA, 15 bp, Homo sapiens
agatttaagaatata

SEQ ID NO: 147764 - DNA, 15 bp, Homo sapiens
gagatttaagaatat

SEQ ID NO: 147765 - DNA, 15 bp, Homo sapiens
ggagatttaagaata

SEQ ID NO: 147766 - DNA, 15 bp, Homo sapiens
tggagatttaagaat

SEQ ID NO: 147767 - DNA, 15 bp, Homo sapiens
atggagatttaagaa

SEQ ID NO: 147768 - DNA, 15 bp, Homo sapiens
tatggagatttaaga

SEQ ID NO: 147769 - DNA, 15 bp, Homo sapiens
atatggagatttaag

SEQ ID NO: 147770 - DNA, 15 bp, Homo sapiens
tatatggagatttaa

SEQ ID NO: 147771 - DNA, 15 bp, Homo sapiens
atatatggagattta

SEQ ID NO: 147772 - DNA, 15 bp, Homo sapiens
aatatatggagattt

SEQ ID NO: 147773 - DNA, 15 bp, Homo sapiens
taatatatggagatt

SEQ ID NO: 147774 - DNA, 15 bp, Homo sapiens
ataatatatggagat

SEQ ID NO: 147775 - DNA, 15 bp, Homo sapiens
tataatatatggaga

SEQ ID NO: 147776 - DNA, 15 bp, Homo sapiens
ctataatatatggag

SEQ ID NO: 147777 - DNA, 15 bp, Homo sapiens
actataatatatgga

SEQ ID NO: 147778 - DNA, 15 bp, Homo sapiens
aactataatatatgg

SEQ ID NO: 147779 - DNA, 15 bp, Homo sapiens
taactataatatatg

SEQ ID NO: 147780 - DNA, 15 bp, Homo sapiens
gtaactataatatat

SEQ ID NO: 147781 - DNA, 15 bp, Homo sapiens
tgtaactataatata

SEQ ID NO: 147782 - DNA, 15 bp, Homo sapiens
gtgtaactataatat

SEQ ID NO: 147783 - DNA, 15 bp, Homo sapiens
agtgtaactataata

SEQ ID NO: 147784 - DNA, 15 bp, Homo sapiens
aagtgtaactataat

SEQ ID NO: 147785 - DNA, 15 bp, Homo sapiens
caagtgtaactataa

SEQ ID NO: 147786 - DNA, 15 bp, Homo sapiens
tcaagtgtaactata

SEQ ID NO: 147787 - DNA, 15 bp, Homo sapiens
ttcaagtgtaactat

SEQ ID NO: 147788 - DNA, 15 bp, Homo sapiens
cttcaagtgtaacta

SEQ ID NO: 147789 - DNA, 15 bp, Homo sapiens
tcttcaagtgtaact

SEQ ID NO: 147790 - DNA, 15 bp, Homo sapiens
ttcttcaagtgtaac

SEQ ID NO: 147791 - DNA, 15 bp, Homo sapiens
attcttcaagtgtaa

SEQ ID NO: 147792 - DNA, 15 bp, Homo sapiens
aattcttcaagtgta

SEQ ID NO: 147793 - DNA, 15 bp, Homo sapiens
aaattcttcaagtgt

SEQ ID NO: 147794 - DNA, 15 bp, Homo sapiens
taaattcttcaagtg

SEQ ID NO: 147795 - DNA, 15 bp, Homo sapiens
ttaaattcttcaagt

SEQ ID NO: 147796 - DNA, 15 bp, Homo sapiens
attaaattcttcaag

SEQ ID NO: 147797 - DNA, 15 bp, Homo sapiens
aattaaattcttcaa

SEQ ID NO: 147798 - DNA, 15 bp, Homo sapiens
aaattaaattcttca

SEQ ID NO: 147799 - DNA, 15 bp, Homo sapiens
gaaattaaattcttc

SEQ ID NO: 147800 - DNA, 15 bp, Homo sapiens
tgaaattaaattctt

SEQ ID NO: 147801 - DNA, 15 bp, Homo sapiens
gtgaaattaaattct

SEQ ID NO: 147802 - DNA, 15 bp, Homo sapiens
agtgaaattaaattc

SEQ ID NO: 147803 - DNA, 15 bp, Homo sapiens
aagtgaaattaaatt

SEQ ID NO: 147804 - DNA, 15 bp, Homo sapiens
caagtgaaattaaat

SEQ ID NO: 147805 - DNA, 15 bp, Homo sapiens
ccaagtgaaattaaa

SEQ ID NO: 147806 - DNA, 15 bp, Homo sapiens
tccaagtgaaattaa

SEQ ID NO: 147807 - DNA, 15 bp, Homo sapiens
atccaagtgaaatta

SEQ ID NO: 147808 - DNA, 15 bp, Homo sapiens
catccaagtgaaatt

SEQ ID NO: 147809 - DNA, 15 bp, Homo sapiens
ccatccaagtgaaat

SEQ ID NO: 147810 - DNA, 15 bp, Homo sapiens
tccatccaagtgaaa

SEQ ID NO: 147811 - DNA, 15 bp, Homo sapiens
atccatccaagtgaa

SEQ ID NO: 147812 - DNA, 15 bp, Homo sapiens
catccatccaagtga

SEQ ID NO: 147813 - DNA, 15 bp, Homo sapiens
tcatccatccaagtg

SEQ ID NO: 147814 - DNA, 15 bp, Homo sapiens
ttcatccatccaagt

SEQ ID NO: 147815 - DNA, 15 bp, Homo sapiens
attcatccatccaag

SEQ ID NO: 147816 - DNA, 15 bp, Homo sapiens
aattcatccatccaa

SEQ ID NO: 147817 - DNA, 15 bp, Homo sapiens
taattcatccatcca

SEQ ID NO: 147818 - DNA, 15 bp, Homo sapiens
ttaattcatccatcc

SEQ ID NO: 147819 - DNA, 15 bp, Homo sapiens
cttaattcatccatc

SEQ ID NO: 147820 - DNA, 15 bp, Homo sapiens
acttaattcatccat

SEQ ID NO: 147821 - DNA, 15 bp, Homo sapiens
tacttaattcatcca

SEQ ID NO: 147822 - DNA, 15 bp, Homo sapiens
ctacttaattcatcc

SEQ ID NO: 147823 - DNA, 15 bp, Homo sapiens
tctacttaattcatc

SEQ ID NO: 147824 - DNA, 15 bp, Homo sapiens
gtctacttaattcat

SEQ ID NO: 147825 - DNA, 15 bp, Homo sapiens
agtctacttaattca

SEQ ID NO: 147826 - DNA, 15 bp, Homo sapiens
aagtctacttaattc

SEQ ID NO: 147827 - DNA, 15 bp, Homo sapiens
taagtctacttaatt

SEQ ID NO: 147828 - DNA, 15 bp, Homo sapiens
gtaagtctacttaat

SEQ ID NO: 147829 - DNA, 15 bp, Homo sapiens
agtaagtctacttaa

SEQ ID NO: 147830 - DNA, 15 bp, Homo sapiens
cagtaagtctactta

SEQ ID NO: 147831 - DNA, 15 bp, Homo sapiens
ccagtaagtctactt

SEQ ID NO: 147832 - DNA, 15 bp, Homo sapiens
tccagtaagtctact

SEQ ID NO: 147833 - DNA, 15 bp, Homo sapiens
ctccagtaagtctac

SEQ ID NO: 147834 - DNA, 15 bp, Homo sapiens
tctccagtaagtcta

SEQ ID NO: 147835 - DNA, 15 bp, Homo sapiens
gtctccagtaagtct

SEQ ID NO: 147836 - DNA, 15 bp, Homo sapiens
tgtctccagtaagtc

SEQ ID NO: 147837 - DNA, 15 bp, Homo sapiens
ttgtctccagtaagt

SEQ ID NO: 147838 - DNA, 15 bp, Homo sapiens
gttgtctccagtaag

SEQ ID NO: 147839 - DNA, 15 bp, Homo sapiens
agttgtctccagtaa

SEQ ID NO: 147840 - DNA, 15 bp, Homo sapiens
aagttgtctccagta

SEQ ID NO: 147841 - DNA, 15 bp, Homo sapiens
caagttgtctccagt

SEQ ID NO: 147842 - DNA, 15 bp, Homo sapiens
acaagttgtctccag

SEQ ID NO: 147843 - DNA, 15 bp, Homo sapiens
aacaagttgtctcca

SEQ ID NO: 147844 - DNA, 15 bp, Homo sapiens
aaacaagttgtctcc

SEQ ID NO: 147845 - DNA, 15 bp, Homo sapiens
caaacaagttgtctc

SEQ ID NO: 147846 - DNA, 15 bp, Homo sapiens
tcaaacaagttgtct

SEQ ID NO: 147847 - DNA, 15 bp, Homo sapiens
gtcaaacaagttgtc

SEQ ID NO: 147848 - DNA, 15 bp, Homo sapiens
tgtcaaacaagttgt

SEQ ID NO: 147849 - DNA, 15 bp, Homo sapiens
ctgtcaaacaagttg

SEQ ID NO: 147850 - DNA, 15 bp, Homo sapiens
actgtcaaacaagtt

SEQ ID NO: 147851 - DNA, 15 bp, Homo sapiens
aactgtcaaacaagt

SEQ ID NO: 147852 - DNA, 15 bp, Homo sapiens
caactgtcaaacaag

SEQ ID NO: 147853 - DNA, 15 bp, Homo sapiens
gcaactgtcaaacaa

SEQ ID NO: 147854 - DNA, 15 bp, Homo sapiens
tgcaactgtcaaaca

SEQ ID NO: 147855 - DNA, 15 bp, Homo sapiens
ttgcaactgtcaaac

SEQ ID NO: 147856 - DNA, 15 bp, Homo sapiens
tttgcaactgtcaaa

SEQ ID NO: 147857 - DNA, 15 bp, Homo sapiens
atttgcaactgtcaa

SEQ ID NO: 147858 - DNA, 15 bp, Homo sapiens
aatttgcaactgtca

SEQ ID NO: 147859 - DNA, 15 bp, Homo sapiens
aaatttgcaactgtc

SEQ ID NO: 147860 - DNA, 15 bp, Homo sapiens
gaaatttgcaactgt

SEQ ID NO: 147861 - DNA, 15 bp, Homo sapiens
agaaatttgcaactg

SEQ ID NO: 147862 - DNA, 15 bp, Homo sapiens
tagaaatttgcaact

SEQ ID NO: 147863 - DNA, 15 bp, Homo sapiens
ttagaaatttgcaac

SEQ ID NO: 147864 - DNA, 15 bp, Homo sapiens
attagaaatttgcaa

SEQ ID NO: 147865 - DNA, 15 bp, Homo sapiens
tattagaaatttgca

SEQ ID NO: 147866 - DNA, 15 bp, Homo sapiens
gtattagaaatttgc

SEQ ID NO: 147867 - DNA, 15 bp, Homo sapiens
agtattagaaatttg

SEQ ID NO: 147868 - DNA, 15 bp, Homo sapiens
tagtattagaaattt

SEQ ID NO: 147869 - DNA, 15 bp, Homo sapiens
gtagtattagaaatt

SEQ ID NO: 147870 - DNA, 15 bp, Homo sapiens
cgtagtattagaaat

SEQ ID NO: 147871 - DNA, 15 bp, Homo sapiens
acgtagtattagaaa

SEQ ID NO: 147872 - DNA, 15 bp, Homo sapiens
gacgtagtattagaa

SEQ ID NO: 147873 - DNA, 15 bp, Homo sapiens
tgacgtagtattaga

SEQ ID NO: 147874 - DNA, 15 bp, Homo sapiens
atgacgtagtattag

SEQ ID NO: 147875 - DNA, 15 bp, Homo sapiens
gatgacgtagtatta

SEQ ID NO: 147876 - DNA, 15 bp, Homo sapiens
ggatgacgtagtatt

SEQ ID NO: 147877 - DNA, 15 bp, Homo sapiens
gggatgacgtagtat

SEQ ID NO: 147878 - DNA, 15 bp, Homo sapiens
cgggatgacgtagta

SEQ ID NO: 147879 - DNA, 15 bp, Homo sapiens
tcgggatgacgtagt

SEQ ID NO: 147880 - DNA, 15 bp, Homo sapiens
ttcgggatgacgtag

SEQ ID NO: 147881 - DNA, 15 bp, Homo sapiens
gttcgggatgacgta

SEQ ID NO: 147882 - DNA, 15 bp, Homo sapiens
tgttcgggatgacgt

SEQ ID NO: 147883 - DNA, 15 bp, Homo sapiens
atgttcgggatgacg

SEQ ID NO: 147884 - DNA, 15 bp, Homo sapiens
tatgttcgggatgac

SEQ ID NO: 147885 - DNA, 15 bp, Homo sapiens
ttatgttcgggatga

SEQ ID NO: 147886 - DNA, 15 bp, Homo sapiens
tttatgttcgggatg

SEQ ID NO: 147887 - DNA, 15 bp, Homo sapiens
gtttatgttcgggat

SEQ ID NO: 147888 - DNA, 15 bp, Homo sapiens
ggtttatgttcggga

SEQ ID NO: 147889 - DNA, 15 bp, Homo sapiens
tggtttatgttcggg

SEQ ID NO: 147890 - DNA, 15 bp, Homo sapiens
atggtttatgttcgg

SEQ ID NO: 147891 - DNA, 15 bp, Homo sapiens
aatggtttatgttcg

SEQ ID NO: 147892 - DNA, 15 bp, Homo sapiens
gaatggtttatgttc

SEQ ID NO: 147893 - DNA, 15 bp, Homo sapiens
tgaatggtttatgtt

SEQ ID NO: 147894 - DNA, 15 bp, Homo sapiens
ttgaatggtttatgt

SEQ ID NO: 147895 - DNA, 15 bp, Homo sapiens
attgaatggtttatg

SEQ ID NO: 147896 - DNA, 15 bp, Homo sapiens
gattgaatggtttat

SEQ ID NO: 147897 - DNA, 15 bp, Homo sapiens
tgattgaatggttta

SEQ ID NO: 147898 - DNA, 15 bp, Homo sapiens
ctgattgaatggttt

SEQ ID NO: 147899 - DNA, 15 bp, Homo sapiens
gctgattgaatggtt

SEQ ID NO: 147900 - DNA, 15 bp, Homo sapiens
agctgattgaatggt

SEQ ID NO: 147901 - DNA, 15 bp, Homo sapiens
cagctgattgaatgg

SEQ ID NO: 147902 - DNA, 15 bp, Homo sapiens
gcagctgattgaatg

SEQ ID NO: 147903 - DNA, 15 bp, Homo sapiens
agcagctgattgaat

SEQ ID NO: 147904 - DNA, 15 bp, Homo sapiens
cagcagctgattgaa

SEQ ID NO: 147905 - DNA, 15 bp, Homo sapiens
acagcagctgattga

SEQ ID NO: 147906 - DNA, 15 bp, Homo sapiens
tacagcagctgattg

SEQ ID NO: 147907 - DNA, 15 bp, Homo sapiens
atacagcagctgatt

SEQ ID NO: 147908 - DNA, 15 bp, Homo sapiens
aatacagcagctgat

SEQ ID NO: 147909 - DNA, 15 bp, Homo sapiens
aaatacagcagctga

SEQ ID NO: 147910 - DNA, 15 bp, Homo sapiens
aaaatacagcagctg

SEQ ID NO: 147911 - DNA, 15 bp, Homo sapiens
aaaaatacagcagct

SEQ ID NO: 147912 - DNA, 15 bp, Homo sapiens
aaaaaatacagcagc

SEQ ID NO: 147913 - DNA, 15 bp, Homo sapiens
aaaaaaatacagcag

SEQ ID NO: 147914 - DNA, 15 bp, Homo sapiens
taaaaaaatacagca

SEQ ID NO: 147915 - DNA, 15 bp, Homo sapiens
ttaaaaaaatacagc

SEQ ID NO: 147916 - DNA, 15 bp, Homo sapiens
cttaaaaaaatacag

SEQ ID NO: 147917 - DNA, 15 bp, Homo sapiens
acttaaaaaaataca

SEQ ID NO: 147918 - DNA, 15 bp, Homo sapiens
gacttaaaaaaatac

SEQ ID NO: 147919 - DNA, 15 bp, Homo sapiens
tgacttaaaaaaata

SEQ ID NO: 147920 - DNA, 15 bp, Homo sapiens
ctgacttaaaaaaat

SEQ ID NO: 147921 - DNA, 15 bp, Homo sapiens
gctgacttaaaaaaa

SEQ ID NO: 147922 - DNA, 15 bp, Homo sapiens
agctgacttaaaaaa

SEQ ID NO: 147923 - DNA, 15 bp, Homo sapiens
cagctgacttaaaaa

SEQ ID NO: 147924 - DNA, 15 bp, Homo sapiens
acagctgacttaaaa

SEQ ID NO: 147925 - DNA, 15 bp, Homo sapiens
aacagctgacttaaa

SEQ ID NO: 147926 - DNA, 15 bp, Homo sapiens
taacagctgacttaa

SEQ ID NO: 147927 - DNA, 15 bp, Homo sapiens
ataacagctgactta

SEQ ID NO: 147928 - DNA, 15 bp, Homo sapiens
tataacagctgactt

SEQ ID NO: 147929 - DNA, 15 bp, Homo sapiens
atataacagctgact

SEQ ID NO: 147930 - DNA, 15 bp, Homo sapiens
catataacagctgac

SEQ ID NO: 147931 - DNA, 15 bp, Homo sapiens
acatataacagctga

SEQ ID NO: 147932 - DNA, 15 bp, Homo sapiens
aacatataacagctg

SEQ ID NO: 147933 - DNA, 15 bp, Homo sapiens
aaacatataacagct

SEQ ID NO: 147934 - DNA, 15 bp, Homo sapiens
caaacatataacagc

SEQ ID NO: 147935 - DNA, 15 bp, Homo sapiens
tcaaacatataacag

SEQ ID NO: 147936 - DNA, 15 bp, Homo sapiens
atcaaacatataaca

SEQ ID NO: 147937 - DNA, 15 bp, Homo sapiens
gatcaaacatataac

SEQ ID NO: 147938 - DNA, 15 bp, Homo sapiens
tgatcaaacatataa

SEQ ID NO: 147939 - DNA, 15 bp, Homo sapiens
atgatcaaacatata

SEQ ID NO: 147940 - DNA, 15 bp, Homo sapiens
tatgatcaaacatat

SEQ ID NO: 147941 - DNA, 15 bp, Homo sapiens
ctatgatcaaacata

SEQ ID NO: 147942 - DNA, 15 bp, Homo sapiens
actatgatcaaacat

SEQ ID NO: 147943 - DNA, 15 bp, Homo sapiens
aactatgatcaaaca

SEQ ID NO: 147944 - DNA, 15 bp, Homo sapiens
aaactatgatcaaac

SEQ ID NO: 147945 - DNA, 15 bp, Homo sapiens
aaaactatgatcaaa

SEQ ID NO: 147946 - DNA, 15 bp, Homo sapiens
caaaactatgatcaa

SEQ ID NO: 147947 - DNA, 15 bp, Homo sapiens
acaaaactatgatca

SEQ ID NO: 147948 - DNA, 15 bp, Homo sapiens
aacaaaactatgatc

SEQ ID NO: 147949 - DNA, 15 bp, Homo sapiens
aaacaaaactatgat

SEQ ID NO: 147950 - DNA, 15 bp, Homo sapiens
aaaacaaaactatga

SEQ ID NO: 147951 - DNA, 15 bp, Homo sapiens
taaaacaaaactatg

SEQ ID NO: 147952 - DNA, 15 bp, Homo sapiens
ataaaacaaaactat

SEQ ID NO: 147953 - DNA, 15 bp, Homo sapiens
aataaaacaaaacta

SEQ ID NO: 147954 - DNA, 15 bp, Homo sapiens
gaataaaacaaaact

SEQ ID NO: 147955 - DNA, 15 bp, Homo sapiens
tgaataaaacaaaac

SEQ ID NO: 147956 - DNA, 15 bp, Homo sapiens
ttgaataaaacaaaa

SEQ ID NO: 147957 - DNA, 15 bp, Homo sapiens
tttgaataaaacaaa

SEQ ID NO: 147958 - DNA, 15 bp, Homo sapiens
gtttgaataaaacaa

SEQ ID NO: 147959 - DNA, 15 bp, Homo sapiens
agtttgaataaaaca

SEQ ID NO: 147960 - DNA, 15 bp, Homo sapiens
tagtttgaataaaac

SEQ ID NO: 147961 - DNA, 15 bp, Homo sapiens
atagtttgaataaaa

SEQ ID NO: 147962 - DNA, 15 bp, Homo sapiens
catagtttgaataaa

SEQ ID NO: 147963 - DNA, 15 bp, Homo sapiens
acatagtttgaataa

SEQ ID NO: 147964 - DNA, 15 bp, Homo sapiens
aacatagtttgaata

SEQ ID NO: 147965 - DNA, 15 bp, Homo sapiens
caacatagtttgaat

SEQ ID NO: 147966 - DNA, 15 bp, Homo sapiens
tcaacatagtttgaa

SEQ ID NO: 147967 - DNA, 15 bp, Homo sapiens
atcaacatagtttga

SEQ ID NO: 147968 - DNA, 15 bp, Homo sapiens
tatcaacatagtttg

SEQ ID NO: 147969 - DNA, 15 bp, Homo sapiens
gtatcaacatagttt

SEQ ID NO: 147970 - DNA, 15 bp, Homo sapiens
agtatcaacatagtt

SEQ ID NO: 147971 - DNA, 15 bp, Homo sapiens
tagtatcaacatagt

SEQ ID NO: 147972 - DNA, 15 bp, Homo sapiens
atagtatcaacatag

SEQ ID NO: 147973 - DNA, 15 bp, Homo sapiens
catagtatcaacata

SEQ ID NO: 147974 - DNA, 15 bp, Homo sapiens
acatagtatcaacat

SEQ ID NO: 147975 - DNA, 15 bp, Homo sapiens
gacatagtatcaaca

SEQ ID NO: 147976 - DNA, 15 bp, Homo sapiens
tgacatagtatcaac

SEQ ID NO: 147977 - DNA, 15 bp, Homo sapiens
atgacatagtatcaa

SEQ ID NO: 147978 - DNA, 15 bp, Homo sapiens
aatgacatagtatca

SEQ ID NO: 147979 - DNA, 15 bp, Homo sapiens
taatgacatagtatc

SEQ ID NO: 147980 - DNA, 15 bp, Homo sapiens
gtaatgacatagtat

SEQ ID NO: 147981 - DNA, 15 bp, Homo sapiens
agtaatgacatagta

SEQ ID NO: 147982 - DNA, 15 bp, Homo sapiens
aagtaatgacatagt

SEQ ID NO: 147983 - DNA, 15 bp, Homo sapiens
aaagtaatgacatag

SEQ ID NO: 147984 - DNA, 15 bp, Homo sapiens
aaaagtaatgacata

SEQ ID NO: 147985 - DNA, 15 bp, Homo sapiens
caaaagtaatgacat

SEQ ID NO: 147986 - DNA, 15 bp, Homo sapiens
acaaaagtaatgaca

SEQ ID NO: 147987 - DNA, 15 bp, Homo sapiens
gacaaaagtaatgac

SEQ ID NO: 147988 - DNA, 15 bp, Homo sapiens
tgacaaaagtaatga

SEQ ID NO: 147989 - DNA, 15 bp, Homo sapiens
ttgacaaaagtaatg

SEQ ID NO: 147990 - DNA, 15 bp, Homo sapiens
tttgacaaaagtaat

SEQ ID NO: 147991 - DNA, 15 bp, Homo sapiens
ttttgacaaaagtaa

SEQ ID NO: 147992 - DNA, 15 bp, Homo sapiens
attttgacaaaagta

SEQ ID NO: 147993 - DNA, 15 bp, Homo sapiens
aattttgacaaaagt

SEQ ID NO: 147994 - DNA, 15 bp, Homo sapiens
taattttgacaaaag

SEQ ID NO: 147995 - DNA, 15 bp, Homo sapiens
ctaattttgacaaaa

SEQ ID NO: 147996 - DNA, 15 bp, Homo sapiens
tctaattttgacaaa

SEQ ID NO: 147997 - DNA, 15 bp, Homo sapiens
ctctaattttgacaa

SEQ ID NO: 147998 - DNA, 15 bp, Homo sapiens
actctaattttgaca

SEQ ID NO: 147999 - DNA, 15 bp, Homo sapiens
cactctaattttgac

SEQ ID NO: 148000 - DNA, 15 bp, Homo sapiens
acactctaattttga

SEQ ID NO: 148001 - DNA, 15 bp, Homo sapiens
aacactctaattttg

SEQ ID NO: 148002 - DNA, 15 bp, Homo sapiens
aaacactctaatttt

SEQ ID NO: 148003 - DNA, 15 bp, Homo sapiens
aaaacactctaattt

SEQ ID NO: 148004 - DNA, 15 bp, Homo sapiens
caaaacactctaatt

SEQ ID NO: 148005 - DNA, 15 bp, Homo sapiens
tcaaaacactctaat

SEQ ID NO: 148006 - DNA, 15 bp, Homo sapiens
atcaaaacactctaa

SEQ ID NO: 148007 - DNA, 15 bp, Homo sapiens
tatcaaaacactcta

SEQ ID NO: 148008 - DNA, 15 bp, Homo sapiens
atatcaaaacactct

SEQ ID NO: 148009 - DNA, 15 bp, Homo sapiens
tatatcaaaacactc

SEQ ID NO: 148010 - DNA, 15 bp, Homo sapiens
ttatatcaaaacact

SEQ ID NO: 148011 - DNA, 15 bp, Homo sapiens
tttatatcaaaacac

SEQ ID NO: 148012 - DNA, 15 bp, Homo sapiens
ttttatatcaaaaca

SEQ ID NO: 148013 - DNA, 15 bp, Homo sapiens
cttttatatcaaaac

SEQ ID NO: 148014 - DNA, 15 bp, Homo sapiens
ccttttatatcaaaa

SEQ ID NO: 148015 - DNA, 15 bp, Homo sapiens
tccttttatatcaaa

SEQ ID NO: 148016 - DNA, 15 bp, Homo sapiens
ctccttttatatcaa

SEQ ID NO: 148017 - DNA, 15 bp, Homo sapiens
tctccttttatatca

SEQ ID NO: 148018 - DNA, 15 bp, Homo sapiens
ctctccttttatatc

SEQ ID NO: 148019 - DNA, 15 bp, Homo sapiens
tctctccttttatat

SEQ ID NO: 148020 - DNA, 15 bp, Homo sapiens
ctctctccttttata

SEQ ID NO: 148021 - DNA, 15 bp, Homo sapiens
actctctccttttat

SEQ ID NO: 148022 - DNA, 15 bp, Homo sapiens
aactctctcctttta

SEQ ID NO: 148023 - DNA, 15 bp, Homo sapiens
taactctctcctttt

SEQ ID NO: 148024 - DNA, 15 bp, Homo sapiens
ataactctctccttt

SEQ ID NO: 148025 - DNA, 15 bp, Homo sapiens
tataactctctcctt

SEQ ID NO: 148026 - DNA, 15 bp, Homo sapiens
ttataactctctcct

SEQ ID NO: 148027 - DNA, 15 bp, Homo sapiens
attataactctctcc

SEQ ID NO: 148028 - DNA, 15 bp, Homo sapiens
tattataactctctc

SEQ ID NO: 148029 - DNA, 15 bp, Homo sapiens
ctattataactctct

SEQ ID NO: 148030 - DNA, 15 bp, Homo sapiens
gctattataactctc

SEQ ID NO: 148031 - DNA, 15 bp, Homo sapiens
tgctattataactct

SEQ ID NO: 148032 - DNA, 15 bp, Homo sapiens
ttgctattataactc

SEQ ID NO: 148033 - DNA, 15 bp, Homo sapiens
attgctattataact

SEQ ID NO: 148034 - DNA, 15 bp, Homo sapiens
aattgctattataac

SEQ ID NO: 148035 - DNA, 15 bp, Homo sapiens
aaattgctattataa

SEQ ID NO: 148036 - DNA, 15 bp, Homo sapiens
aaaattgctattata

SEQ ID NO: 148037 - DNA, 15 bp, Homo sapiens
aaaaattgctattat

SEQ ID NO: 148038 - DNA, 15 bp, Homo sapiens
taaaaattgctatta

SEQ ID NO: 148039 - DNA, 15 bp, Homo sapiens
gtaaaaattgctatt

SEQ ID NO: 148040 - DNA, 15 bp, Homo sapiens
tgtaaaaattgctat

SEQ ID NO: 148041 - DNA, 15 bp, Homo sapiens
gtgtaaaaattgcta

SEQ ID NO: 148042 - DNA, 15 bp, Homo sapiens
agtgtaaaaattgct

SEQ ID NO: 148043 - DNA, 15 bp, Homo sapiens
tagtgtaaaaattgc

SEQ ID NO: 148044 - DNA, 15 bp, Homo sapiens
gtagtgtaaaaattg

SEQ ID NO: 148045 - DNA, 15 bp, Homo sapiens
ggtagtgtaaaaatt

SEQ ID NO: 148046 - DNA, 15 bp, Homo sapiens
cggtagtgtaaaaat

SEQ ID NO: 148047 - DNA, 15 bp, Homo sapiens
gcggtagtgtaaaaa

SEQ ID NO: 148048 - DNA, 15 bp, Homo sapiens
tgcggtagtgtaaaa

SEQ ID NO: 148049 - DNA, 15 bp, Homo sapiens
ctgcggtagtgtaaa

SEQ ID NO: 148050 - DNA, 15 bp, Homo sapiens
actgcggtagtgtaa

SEQ ID NO: 148051 - DNA, 15 bp, Homo sapiens
tactgcggtagtgta

SEQ ID NO: 148052 - DNA, 15 bp, Homo sapiens
gtactgcggtagtgt

SEQ ID NO: 148053 - DNA, 15 bp, Homo sapiens
agtactgcggtagtg

SEQ ID NO: 148054 - DNA, 15 bp, Homo sapiens
tagtactgcggtagt

SEQ ID NO: 148055 - DNA, 15 bp, Homo sapiens
atagtactgcggtag

SEQ ID NO: 148056 - DNA, 15 bp, Homo sapiens
tatagtactgcggta

SEQ ID NO: 148057 - DNA, 15 bp, Homo sapiens
atatagtactgcggt

SEQ ID NO: 148058 - DNA, 15 bp, Homo sapiens
aatatagtactgcgg

SEQ ID NO: 148059 - DNA, 15 bp, Homo sapiens
gaatatagtactgcg

SEQ ID NO: 148060 - DNA, 15 bp, Homo sapiens
ggaatatagtactgc

SEQ ID NO: 148061 - DNA, 15 bp, Homo sapiens
aggaatatagtactg

SEQ ID NO: 148062 - DNA, 15 bp, Homo sapiens
gaggaatatagtact

SEQ ID NO: 148063 - DNA, 15 bp, Homo sapiens
ggaggaatatagtac

SEQ ID NO: 148064 - DNA, 15 bp, Homo sapiens
aggaggaatatagta

SEQ ID NO: 148065 - DNA, 15 bp, Homo sapiens
aaggaggaatatagt

SEQ ID NO: 148066 - DNA, 15 bp, Homo sapiens
gaaggaggaatatag

SEQ ID NO: 148067 - DNA, 15 bp, Homo sapiens
ggaaggaggaatata

SEQ ID NO: 148068 - DNA, 15 bp, Homo sapiens
aggaaggaggaatat

SEQ ID NO: 148069 - DNA, 15 bp, Homo sapiens
taggaaggaggaata

SEQ ID NO: 148070 - DNA, 15 bp, Homo sapiens
ataggaaggaggaat

SEQ ID NO: 148071 - DNA, 15 bp, Homo sapiens
gataggaaggaggaa

SEQ ID NO: 148072 - DNA, 15 bp, Homo sapiens
tgataggaaggagga

SEQ ID NO: 148073 - DNA, 15 bp, Homo sapiens
atgataggaaggagg

SEQ ID NO: 148074 - DNA, 15 bp, Homo sapiens
tatgataggaaggag

SEQ ID NO: 148075 - DNA, 15 bp, Homo sapiens
atatgataggaagga

SEQ ID NO: 148076 - DNA, 15 bp, Homo sapiens
aatatgataggaagg

SEQ ID NO: 148077 - DNA, 15 bp, Homo sapiens
aaatatgataggaag

SEQ ID NO: 148078 - DNA, 15 bp, Homo sapiens
aaaatatgataggaa

SEQ ID NO: 148079 - DNA, 15 bp, Homo sapiens
aaaaatatgatagga

SEQ ID NO: 148080 - DNA, 15 bp, Homo sapiens
taaaaatatgatagg

SEQ ID NO: 148081 - DNA, 15 bp, Homo sapiens
ctaaaaatatgatag

SEQ ID NO: 148082 - DNA, 15 bp, Homo sapiens
actaaaaatatgata

SEQ ID NO: 148083 - DNA, 15 bp, Homo sapiens
tactaaaaatatgat

SEQ ID NO: 148084 - DNA, 15 bp, Homo sapiens
gtactaaaaatatga

SEQ ID NO: 148085 - DNA, 15 bp, Homo sapiens
ggtactaaaaatatg

SEQ ID NO: 148086 - DNA, 15 bp, Homo sapiens
cggtactaaaaatat

SEQ ID NO: 148087 - DNA, 15 bp, Homo sapiens
acggtactaaaaata

SEQ ID NO: 148088 - DNA, 15 bp, Homo sapiens
aacggtactaaaaat

SEQ ID NO: 148089 - DNA, 15 bp, Homo sapiens
gaacggtactaaaaa

SEQ ID NO: 148090 - DNA, 15 bp, Homo sapiens
agaacggtactaaaa

SEQ ID NO: 148091 - DNA, 15 bp, Homo sapiens
gagaacggtactaaa

SEQ ID NO: 148092 - DNA, 15 bp, Homo sapiens
tgagaacggtactaa

SEQ ID NO: 148093 - DNA, 15 bp, Homo sapiens
ttgagaacggtacta

SEQ ID NO: 148094 - DNA, 15 bp, Homo sapiens
cttgagaacggtact

SEQ ID NO: 148095 - DNA, 15 bp, Homo sapiens
tcttgagaacggtac

SEQ ID NO: 148096 - DNA, 15 bp, Homo sapiens
ttcttgagaacggta

SEQ ID NO: 148097 - DNA, 15 bp, Homo sapiens
attcttgagaacggt

SEQ ID NO: 148098 - DNA, 15 bp, Homo sapiens
cattcttgagaacgg

SEQ ID NO: 148099 - DNA, 15 bp, Homo sapiens
acattcttgagaacg

SEQ ID NO: 148100 - DNA, 15 bp, Homo sapiens
tacattcttgagaac

SEQ ID NO: 148101 - DNA, 15 bp, Homo sapiens
atacattcttgagaa

SEQ ID NO: 148102 - DNA, 15 bp, Homo sapiens
gatacattcttgaga

SEQ ID NO: 148103 - DNA, 15 bp, Homo sapiens
agatacattcttgag

SEQ ID NO: 148104 - DNA, 15 bp, Homo sapiens
aagatacattcttga

SEQ ID NO: 148105 - DNA, 15 bp, Homo sapiens
caagatacattcttg

SEQ ID NO: 148106 - DNA, 15 bp, Homo sapiens
acaagatacattctt

SEQ ID NO: 148107 - DNA, 15 bp, Homo sapiens
aacaagatacattct

SEQ ID NO: 148108 - DNA, 15 bp, Homo sapiens
caacaagatacattc

SEQ ID NO: 148109 - DNA, 15 bp, Homo sapiens
gcaacaagatacatt

SEQ ID NO: 148110 - DNA, 15 bp, Homo sapiens
agcaacaagatacat

SEQ ID NO: 148111 - DNA, 15 bp, Homo sapiens
gagcaacaagataca

SEQ ID NO: 148112 - DNA, 15 bp, Homo sapiens
agagcaacaagatac

SEQ ID NO: 148113 - DNA, 15 bp, Homo sapiens
cagagcaacaagata

SEQ ID NO: 148114 - DNA, 15 bp, Homo sapiens
acagagcaacaagat

SEQ ID NO: 148115 - DNA, 15 bp, Homo sapiens
aacagagcaacaaga

SEQ ID NO: 148116 - DNA, 15 bp, Homo sapiens
taacagagcaacaag

SEQ ID NO: 148117 - DNA, 15 bp, Homo sapiens
ctaacagagcaacaa

SEQ ID NO: 148118 - DNA, 15 bp, Homo sapiens
gctaacagagcaaca

SEQ ID NO: 148119 - DNA, 15 bp, Homo sapiens
agctaacagagcaac

SEQ ID NO: 148120 - DNA, 15 bp, Homo sapiens
cagctaacagagcaa

SEQ ID NO: 148121 - DNA, 15 bp, Homo sapiens
gcagctaacagagca

SEQ ID NO: 148122 - DNA, 15 bp, Homo sapiens
ggcagctaacagagc

SEQ ID NO: 148123 - DNA, 15 bp, Homo sapiens
gggcagctaacagag

SEQ ID NO: 148124 - DNA, 15 bp, Homo sapiens
tgggcagctaacaga

SEQ ID NO: 148125 - DNA, 15 bp, Homo sapiens
ttgggcagctaacag

SEQ ID NO: 148126 - DNA, 15 bp, Homo sapiens
tttgggcagctaaca

SEQ ID NO: 148127 - DNA, 15 bp, Homo sapiens
gtttgggcagctaac

SEQ ID NO: 148128 - DNA, 15 bp, Homo sapiens
agtttgggcagctaa

SEQ ID NO: 148129 - DNA, 15 bp, Homo sapiens
gagtttgggcagcta

SEQ ID NO: 148130 - DNA, 15 bp, Homo sapiens
tgagtttgggcagct

SEQ ID NO: 148131 - DNA, 15 bp, Homo sapiens
atgagtttgggcagc

SEQ ID NO: 148132 - DNA, 15 bp, Homo sapiens
aatgagtttgggcag

SEQ ID NO: 148133 - DNA, 15 bp, Homo sapiens
aaatgagtttgggca

SEQ ID NO: 148134 - DNA, 15 bp, Homo sapiens
caaatgagtttgggc

SEQ ID NO: 148135 - DNA, 15 bp, Homo sapiens
acaaatgagtttggg

SEQ ID NO: 148136 - DNA, 15 bp, Homo sapiens
cacaaatgagtttgg

SEQ ID NO: 148137 - DNA, 15 bp, Homo sapiens
tcacaaatgagtttg

SEQ ID NO: 148138 - DNA, 15 bp, Homo sapiens
atcacaaatgagttt

SEQ ID NO: 148139 - DNA, 15 bp, Homo sapiens
gatcacaaatgagtt

SEQ ID NO: 148140 - DNA, 15 bp, Homo sapiens
tgatcacaaatgagt

SEQ ID NO: 148141 - DNA, 15 bp, Homo sapiens
ttgatcacaaatgag

SEQ ID NO: 148142 - DNA, 15 bp, Homo sapiens
tttgatcacaaatga

SEQ ID NO: 148143 - DNA, 15 bp, Homo sapiens
ttttgatcacaaatg

SEQ ID NO: 148144 - DNA, 15 bp, Homo sapiens
gttttgatcacaaat

SEQ ID NO: 148145 - DNA, 15 bp, Homo sapiens
tgttttgatcacaaa

SEQ ID NO: 148146 - DNA, 15 bp, Homo sapiens
ttgttttgatcacaa

SEQ ID NO: 148147 - DNA, 15 bp, Homo sapiens
gttgttttgatcaca

SEQ ID NO: 148148 - DNA, 15 bp, Homo sapiens
agttgttttgatcac

SEQ ID NO: 148149 - DNA, 15 bp, Homo sapiens
cagttgttttgatca

SEQ ID NO: 148150 - DNA, 15 bp, Homo sapiens
gcagttgttttgatc

SEQ ID NO: 148151 - DNA, 15 bp, Homo sapiens
ggcagttgttttgat

SEQ ID NO: 148152 - DNA, 15 bp, Homo sapiens
aggcagttgttttga

SEQ ID NO: 148153 - DNA, 15 bp, Homo sapiens
gaggcagttgttttg

SEQ ID NO: 148154 - DNA, 15 bp, Homo sapiens
agaggcagttgtttt

SEQ ID NO: 148155 - DNA, 15 bp, Homo sapiens
tagaggcagttgttt

SEQ ID NO: 148156 - DNA, 15 bp, Homo sapiens
ttagaggcagttgtt

SEQ ID NO: 148157 - DNA, 15 bp, Homo sapiens
cttagaggcagttgt

SEQ ID NO: 148158 - DNA, 15 bp, Homo sapiens
tcttagaggcagttg

SEQ ID NO: 148159 - DNA, 15 bp, Homo sapiens
ttcttagaggcagtt

SEQ ID NO: 148160 - DNA, 15 bp, Homo sapiens
tttcttagaggcagt

SEQ ID NO: 148161 - DNA, 15 bp, Homo sapiens
ttttcttagaggcag

SEQ ID NO: 148162 - DNA, 15 bp, Homo sapiens
attttcttagaggca

SEQ ID NO: 148163 - DNA, 15 bp, Homo sapiens
tattttcttagaggc

SEQ ID NO: 148164 - DNA, 15 bp, Homo sapiens
atattttcttagagg

SEQ ID NO: 148165 - DNA, 15 bp, Homo sapiens
aatattttcttagag

SEQ ID NO: 148166 - DNA, 15 bp, Homo sapiens
taatattttcttaga

SEQ ID NO: 148167 - DNA, 15 bp, Homo sapiens
ataatattttcttag

SEQ ID NO: 148168 - DNA, 15 bp, Homo sapiens
aataatattttctta

SEQ ID NO: 148169 - DNA, 15 bp, Homo sapiens
aaataatattttctt

SEQ ID NO: 148170 - DNA, 15 bp, Homo sapiens
aaaataatattttct

SEQ ID NO: 148171 - DNA, 15 bp, Homo sapiens
aaaaataatattttc

SEQ ID NO: 148172 - DNA, 15 bp, Homo sapiens
gaaaaataatatttt

SEQ ID NO: 148173 - DNA, 15 bp, Homo sapiens
agaaaaataatattt

SEQ ID NO: 148174 - DNA, 15 bp, Homo sapiens
cagaaaaataatatt

SEQ ID NO: 148175 - DNA, 15 bp, Homo sapiens
tcagaaaaataatat

SEQ ID NO: 148176 - DNA, 15 bp, Homo sapiens
atcagaaaaataata

SEQ ID NO: 148177 - DNA, 15 bp, Homo sapiens
catcagaaaaataat

SEQ ID NO: 148178 - DNA, 15 bp, Homo sapiens
tcatcagaaaaataa

SEQ ID NO: 148179 - DNA, 15 bp, Homo sapiens
atcatcagaaaaata

SEQ ID NO: 148180 - DNA, 15 bp, Homo sapiens
tatcatcagaaaaat

SEQ ID NO: 148181 - DNA, 15 bp, Homo sapiens
atatcatcagaaaaa

SEQ ID NO: 148182 - DNA, 15 bp, Homo sapiens
tatatcatcagaaaa

SEQ ID NO: 148183 - DNA, 15 bp, Homo sapiens
gtatatcatcagaaa

SEQ ID NO: 148184 - DNA, 15 bp, Homo sapiens
tgtatatcatcagaa

SEQ ID NO: 148185 - DNA, 15 bp, Homo sapiens
ctgtatatcatcaga

SEQ ID NO: 148186 - DNA, 15 bp, Homo sapiens
actgtatatcatcag

SEQ ID NO: 148187 - DNA, 15 bp, Homo sapiens
tactgtatatcatca

SEQ ID NO: 148188 - DNA, 15 bp, Homo sapiens
atactgtatatcatc

SEQ ID NO: 148189 - DNA, 15 bp, Homo sapiens
catactgtatatcat

SEQ ID NO: 148190 - DNA, 15 bp, Homo sapiens
ccatactgtatatca

SEQ ID NO: 148191 - DNA, 15 bp, Homo sapiens
gccatactgtatatc

SEQ ID NO: 148192 - DNA, 15 bp, Homo sapiens
tgccatactgtatat

SEQ ID NO: 148193 - DNA, 15 bp, Homo sapiens
atgccatactgtata

SEQ ID NO: 148194 - DNA, 15 bp, Homo sapiens
catgccatactgtat

SEQ ID NO: 148195 - DNA, 15 bp, Homo sapiens
acatgccatactgta

SEQ ID NO: 148196 - DNA, 15 bp, Homo sapiens
gacatgccatactgt

SEQ ID NO: 148197 - DNA, 15 bp, Homo sapiens
ggacatgccatactg

SEQ ID NO: 148198 - DNA, 15 bp, Homo sapiens
tggacatgccatact

SEQ ID NO: 148199 - DNA, 15 bp, Homo sapiens
ctggacatgccatac

SEQ ID NO: 148200 - DNA, 15 bp, Homo sapiens
cctggacatgccata

SEQ ID NO: 148201 - DNA, 15 bp, Homo sapiens
gcctggacatgccat

SEQ ID NO: 148202 - DNA, 15 bp, Homo sapiens
tgcctggacatgcca

SEQ ID NO: 148203 - DNA, 15 bp, Homo sapiens
atgcctggacatgcc

SEQ ID NO: 148204 - DNA, 15 bp, Homo sapiens
gatgcctggacatgc

SEQ ID NO: 148205 - DNA, 15 bp, Homo sapiens
agatgcctggacatg

SEQ ID NO: 148206 - DNA, 15 bp, Homo sapiens
tagatgcctggacat

SEQ ID NO: 148207 - DNA, 15 bp, Homo sapiens
ctagatgcctggaca

SEQ ID NO: 148208 - DNA, 15 bp, Homo sapiens
tctagatgcctggac

SEQ ID NO: 148209 - DNA, 15 bp, Homo sapiens
atctagatgcctgga

SEQ ID NO: 148210 - DNA, 15 bp, Homo sapiens
catctagatgcctgg

SEQ ID NO: 148211 - DNA, 15 bp, Homo sapiens
tcatctagatgcctg

SEQ ID NO: 148212 - DNA, 15 bp, Homo sapiens
atcatctagatgcct

SEQ ID NO: 148213 - DNA, 15 bp, Homo sapiens
catcatctagatgcc

SEQ ID NO: 148214 - DNA, 15 bp, Homo sapiens
gcatcatctagatgc

SEQ ID NO: 148215 - DNA, 15 bp, Homo sapiens
agcatcatctagatg

SEQ ID NO: 148216 - DNA, 15 bp, Homo sapiens
aagcatcatctagat

SEQ ID NO: 148217 - DNA, 15 bp, Homo sapiens
taagcatcatctaga

SEQ ID NO: 148218 - DNA, 15 bp, Homo sapiens
ataagcatcatctag

SEQ ID NO: 148219 - DNA, 15 bp, Homo sapiens
tataagcatcatcta

SEQ ID NO: 148220 - DNA, 15 bp, Homo sapiens
atataagcatcatct

SEQ ID NO: 148221 - DNA, 15 bp, Homo sapiens
catataagcatcatc

SEQ ID NO: 148222 - DNA, 15 bp, Homo sapiens
ccatataagcatcat

SEQ ID NO: 148223 - DNA, 15 bp, Homo sapiens
gccatataagcatca

SEQ ID NO: 148224 - DNA, 15 bp, Homo sapiens
tgccatataagcatc

SEQ ID NO: 148225 - DNA, 15 bp, Homo sapiens
ctgccatataagcat

SEQ ID NO: 148226 - DNA, 15 bp, Homo sapiens
gctgccatataagca

SEQ ID NO: 148227 - DNA, 15 bp, Homo sapiens
tgctgccatataagc

SEQ ID NO: 148228 - DNA, 15 bp, Homo sapiens
ctgctgccatataag

SEQ ID NO: 148229 - DNA, 15 bp, Homo sapiens
tctgctgccatataa

SEQ ID NO: 148230 - DNA, 15 bp, Homo sapiens
atctgctgccatata

SEQ ID NO: 148231 - DNA, 15 bp, Homo sapiens
aatctgctgccatat

SEQ ID NO: 148232 - DNA, 15 bp, Homo sapiens
caatctgctgccata

SEQ ID NO: 148233 - DNA, 15 bp, Homo sapiens
tcaatctgctgccat

SEQ ID NO: 148234 - DNA, 15 bp, Homo sapiens
ctcaatctgctgcca

SEQ ID NO: 148235 - DNA, 15 bp, Homo sapiens
cctcaatctgctgcc

SEQ ID NO: 148236 - DNA, 15 bp, Homo sapiens
acctcaatctgctgc

SEQ ID NO: 148237 - DNA, 15 bp, Homo sapiens
cacctcaatctgctg

SEQ ID NO: 148238 - DNA, 15 bp, Homo sapiens
ccacctcaatctgct

SEQ ID NO: 148239 - DNA, 15 bp, Homo sapiens
cccacctcaatctgc

SEQ ID NO: 148240 - DNA, 15 bp, Homo sapiens
tcccacctcaatctg

SEQ ID NO: 148241 - DNA, 15 bp, Homo sapiens
ttcccacctcaatct

SEQ ID NO: 148242 - DNA, 15 bp, Homo sapiens
cttcccacctcaatc

SEQ ID NO: 148243 - DNA, 15 bp, Homo sapiens
gcttcccacctcaat

SEQ ID NO: 148244 - DNA, 15 bp, Homo sapiens
tgcttcccacctcaa

SEQ ID NO: 148245 - DNA, 15 bp, Homo sapiens
ctgcttcccacctca

SEQ ID NO: 148246 - DNA, 15 bp, Homo sapiens
actgcttcccacctc

SEQ ID NO: 148247 - DNA, 15 bp, Homo sapiens
tactgcttcccacct

SEQ ID NO: 148248 - DNA, 15 bp, Homo sapiens
atactgcttcccacc

SEQ ID NO: 148249 - DNA, 15 bp, Homo sapiens
aatactgcttcccac

SEQ ID NO: 148250 - DNA, 15 bp, Homo sapiens
gaatactgcttccca

SEQ ID NO: 148251 - DNA, 15 bp, Homo sapiens
ggaatactgcttccc

SEQ ID NO: 148252 - DNA, 15 bp, Homo sapiens
tggaatactgcttcc

SEQ ID NO: 148253 - DNA, 15 bp, Homo sapiens
atggaatactgcttc

SEQ ID NO: 148254 - DNA, 15 bp, Homo sapiens
aatggaatactgctt

SEQ ID NO: 148255 - DNA, 15 bp, Homo sapiens
taatggaatactgct

SEQ ID NO: 148256 - DNA, 15 bp, Homo sapiens
ttaatggaatactgc

SEQ ID NO: 148257 - DNA, 15 bp, Homo sapiens
gttaatggaatactg

SEQ ID NO: 148258 - DNA, 15 bp, Homo sapiens
agttaatggaatact

SEQ ID NO: 148259 - DNA, 15 bp, Homo sapiens
aagttaatggaatac

SEQ ID NO: 148260 - DNA, 15 bp, Homo sapiens
aaagttaatggaata

SEQ ID NO: 148261 - DNA, 15 bp, Homo sapiens
taaagttaatggaat

SEQ ID NO: 148262 - DNA, 15 bp, Homo sapiens
ataaagttaatggaa

SEQ ID NO: 148263 - DNA, 15 bp, Homo sapiens
aataaagttaatgga

SEQ ID NO: 148264 - DNA, 15 bp, Homo sapiens
taataaagttaatgg

SEQ ID NO: 148265 - DNA, 15 bp, Homo sapiens
ataataaagttaatg

SEQ ID NO: 148266 - DNA, 15 bp, Homo sapiens
tataataaagttaat

SEQ ID NO: 148267 - DNA, 15 bp, Homo sapiens
atataataaagttaa

SEQ ID NO: 148268 - DNA, 15 bp, Homo sapiens
gatataataaagtta

SEQ ID NO: 148269 - DNA, 15 bp, Homo sapiens
tgatataataaagtt

SEQ ID NO: 148270 - DNA, 15 bp, Homo sapiens
gtgatataataaagt

SEQ ID NO: 148271 - DNA, 15 bp, Homo sapiens
tgtgatataataaag

SEQ ID NO: 148272 - DNA, 15 bp, Homo sapiens
gtgtgatataataaa

SEQ ID NO: 148273 - DNA, 15 bp, Homo sapiens
agtgtgatataataa

SEQ ID NO: 148274 - DNA, 15 bp, Homo sapiens
cagtgtgatataata

SEQ ID NO: 148275 - DNA, 15 bp, Homo sapiens
acagtgtgatataat

SEQ ID NO: 148276 - DNA, 15 bp, Homo sapiens
tacagtgtgatataa

SEQ ID NO: 148277 - DNA, 15 bp, Homo sapiens
ttacagtgtgatata

SEQ ID NO: 148278 - DNA, 15 bp, Homo sapiens
attacagtgtgatat

SEQ ID NO: 148279 - DNA, 15 bp, Homo sapiens
aattacagtgtgata

SEQ ID NO: 148280 - DNA, 15 bp, Homo sapiens
aaattacagtgtgat

SEQ ID NO: 148281 - DNA, 15 bp, Homo sapiens
gaaattacagtgtga

SEQ ID NO: 148282 - DNA, 15 bp, Homo sapiens
agaaattacagtgtg

SEQ ID NO: 148283 - DNA, 15 bp, Homo sapiens
aagaaattacagtgt

SEQ ID NO: 148284 - DNA, 15 bp, Homo sapiens
taagaaattacagtg

SEQ ID NO: 148285 - DNA, 15 bp, Homo sapiens
gtaagaaattacagt

SEQ ID NO: 148286 - DNA, 15 bp, Homo sapiens
tgtaagaaattacag

SEQ ID NO: 148287 - DNA, 15 bp, Homo sapiens
ttgtaagaaattaca

SEQ ID NO: 148288 - DNA, 15 bp, Homo sapiens
attgtaagaaattac

SEQ ID NO: 148289 - DNA, 15 bp, Homo sapiens
aattgtaagaaatta

SEQ ID NO: 148290 - DNA, 15 bp, Homo sapiens
aaattgtaagaaatt

SEQ ID NO: 148291 - DNA, 15 bp, Homo sapiens
caaattgtaagaaat

SEQ ID NO: 148292 - DNA, 15 bp, Homo sapiens
ccaaattgtaagaaa

SEQ ID NO: 148293 - DNA, 15 bp, Homo sapiens
gccaaattgtaagaa

SEQ ID NO: 148294 - DNA, 15 bp, Homo sapiens
ggccaaattgtaaga

SEQ ID NO: 148295 - DNA, 15 bp, Homo sapiens
tggccaaattgtaag

SEQ ID NO: 148296 - DNA, 15 bp, Homo sapiens
ttggccaaattgtaa

SEQ ID NO: 148297 - DNA, 15 bp, Homo sapiens
attggccaaattgta

SEQ ID NO: 148298 - DNA, 15 bp, Homo sapiens
aattggccaaattgt

SEQ ID NO: 148299 - DNA, 15 bp, Homo sapiens
taattggccaaattg

SEQ ID NO: 148300 - DNA, 15 bp, Homo sapiens
ctaattggccaaatt

SEQ ID NO: 148301 - DNA, 15 bp, Homo sapiens
tctaattggccaaat

SEQ ID NO: 148302 - DNA, 15 bp, Homo sapiens
atctaattggccaaa

SEQ ID NO: 148303 - DNA, 15 bp, Homo sapiens
tatctaattggccaa

SEQ ID NO: 148304 - DNA, 15 bp, Homo sapiens
atatctaattggcca

SEQ ID NO: 148305 - DNA, 15 bp, Homo sapiens
tatatctaattggcc

SEQ ID NO: 148306 - DNA, 15 bp, Homo sapiens
atatatctaattggc

SEQ ID NO: 148307 - DNA, 15 bp, Homo sapiens
aatatatctaattgg

SEQ ID NO: 148308 - DNA, 15 bp, Homo sapiens
caatatatctaattg

SEQ ID NO: 148309 - DNA, 15 bp, Homo sapiens
gcaatatatctaatt

SEQ ID NO: 148310 - DNA, 15 bp, Homo sapiens
agcaatatatctaat

SEQ ID NO: 148311 - DNA, 15 bp, Homo sapiens
cagcaatatatctaa

SEQ ID NO: 148312 - DNA, 15 bp, Homo sapiens
acagcaatatatcta

SEQ ID NO: 148313 - DNA, 15 bp, Homo sapiens
gacagcaatatatct

SEQ ID NO: 148314 - DNA, 15 bp, Homo sapiens
agacagcaatatatc

SEQ ID NO: 148315 - DNA, 15 bp, Homo sapiens
cagacagcaatatat

SEQ ID NO: 148316 - DNA, 15 bp, Homo sapiens
ccagacagcaatata

SEQ ID NO: 148317 - DNA, 15 bp, Homo sapiens
tccagacagcaatat

SEQ ID NO: 148318 - DNA, 15 bp, Homo sapiens
ttccagacagcaata

SEQ ID NO: 148319 - DNA, 15 bp, Homo sapiens
tttccagacagcaat

SEQ ID NO: 148320 - DNA, 15 bp, Homo sapiens
gtttccagacagcaa

SEQ ID NO: 148321 - DNA, 15 bp, Homo sapiens
agtttccagacagca

SEQ ID NO: 148322 - DNA, 15 bp, Homo sapiens
aagtttccagacagc

SEQ ID NO: 148323 - DNA, 15 bp, Homo sapiens
aaagtttccagacag

SEQ ID NO: 148324 - DNA, 15 bp, Homo sapiens
aaaagtttccagaca

SEQ ID NO: 148325 - DNA, 15 bp, Homo sapiens
aaaaagtttccagac

SEQ ID NO: 148326 - DNA, 15 bp, Homo sapiens
aaaaaagtttccaga

SEQ ID NO: 148327 - DNA, 15 bp, Homo sapiens
aaaaaaagtttccag

SEQ ID NO: 148328 - DNA, 15 bp, Homo sapiens
aaaaaaaagtttcca

SEQ ID NO: 148329 - DNA, 15 bp, Homo sapiens
gaaaaaaaaaaagtt

SEQ ID NO: 148330 - DNA, 15 bp, Homo sapiens
ggaaaaaaaaaaagt

SEQ ID NO: 148331 - DNA, 15 bp, Homo sapiens
cggaaaaaaaaaaag

SEQ ID NO: 148332 - DNA, 15 bp, Homo sapiens
ccggaaaaaaaaaaa

SEQ ID NO: 148333 - DNA, 15 bp, Homo sapiens
tccggaaaaaaaaaa

SEQ ID NO: 148334 - DNA, 15 bp, Homo sapiens
ttccggaaaaaaaaa

SEQ ID NO: 148335 - DNA, 15 bp, Homo sapiens
cttccggaaaaaaaa

SEQ ID NO: 148336 - DNA, 15 bp, Homo sapiens
acttccggaaaaaaa

SEQ ID NO: 148337 - DNA, 15 bp, Homo sapiens
aacttccggaaaaaa

SEQ ID NO: 148338 - DNA, 15 bp, Homo sapiens
aaacttccggaaaaa

SEQ ID NO: 148339 - DNA, 15 bp, Homo sapiens
aaaacttccggaaaa

SEQ ID NO: 148340 - DNA, 15 bp, Homo sapiens
caaaacttccggaaa

SEQ ID NO: 148341 - DNA, 15 bp, Homo sapiens
ccaaaacttccggaa

SEQ ID NO: 148342 - DNA, 15 bp, Homo sapiens
cccaaaacttccgga

SEQ ID NO: 148343 - DNA, 15 bp, Homo sapiens
tcccaaaacttccgg

SEQ ID NO: 148344 - DNA, 15 bp, Homo sapiens
ctcccaaaacttccg

SEQ ID NO: 148345 - DNA, 15 bp, Homo sapiens
tctcccaaaacttcc

SEQ ID NO: 148346 - DNA, 15 bp, Homo sapiens
gtctcccaaaacttc

SEQ ID NO: 148347 - DNA, 15 bp, Homo sapiens
tgtctcccaaaactt

SEQ ID NO: 148348 - DNA, 15 bp, Homo sapiens
ctgtctcccaaaact

SEQ ID NO: 148349 - DNA, 15 bp, Homo sapiens
tctgtctcccaaaac

SEQ ID NO: 148350 - DNA, 15 bp, Homo sapiens
atctgtctcccaaaa

SEQ ID NO: 148351 - DNA, 15 bp, Homo sapiens
aatctgtctcccaaa

SEQ ID NO: 148352 - DNA, 15 bp, Homo sapiens
gaatctgtctcccaa

SEQ ID NO: 148353 - DNA, 15 bp, Homo sapiens
tgaatctgtctccca

SEQ ID NO: 148354 - DNA, 15 bp, Homo sapiens
ctgaatctgtctccc

SEQ ID NO: 148355 - DNA, 15 bp, Homo sapiens
cctgaatctgtctcc

SEQ ID NO: 148356 - DNA, 15 bp, Homo sapiens
acctgaatctgtctc

SEQ ID NO: 148357 - DNA, 15 bp, Homo sapiens
tacctgaatctgtct

SEQ ID NO: 148358 - DNA, 15 bp, Homo sapiens
ctacctgaatctgtc

SEQ ID NO: 148359 - DNA, 15 bp, Homo sapiens
actacctgaatctgt

SEQ ID NO: 148360 - DNA, 15 bp, Homo sapiens
cactacctgaatctg

SEQ ID NO: 148361 - DNA, 15 bp, Homo sapiens
ccactacctgaatct

SEQ ID NO: 148362 - DNA, 15 bp, Homo sapiens
cccactacctgaatc

SEQ ID NO: 148363 - DNA, 15 bp, Homo sapiens
ccccactacctgaat

SEQ ID NO: 148364 - DNA, 15 bp, Homo sapiens
accccactacctgaa

SEQ ID NO: 148365 - DNA, 15 bp, Homo sapiens
taccccactacctga

SEQ ID NO: 148366 - DNA, 15 bp, Homo sapiens
ataccccactacctg

SEQ ID NO: 148367 - DNA, 15 bp, Homo sapiens
aataccccactacct

SEQ ID NO: 148368 - DNA, 15 bp, Homo sapiens
gaataccccactacc

SEQ ID NO: 148369 - DNA, 15 bp, Homo sapiens
agaataccccactac

SEQ ID NO: 148370 - DNA, 15 bp, Homo sapiens
aagaataccccacta

SEQ ID NO: 148371 - DNA, 15 bp, Homo sapiens
aaagaataccccact

SEQ ID NO: 148372 - DNA, 15 bp, Homo sapiens
aaaagaataccccac

SEQ ID NO: 148373 - DNA, 15 bp, Homo sapiens
gaaaagaatacccca

SEQ ID NO: 148374 - DNA, 15 bp, Homo sapiens
tgaaaagaatacccc

SEQ ID NO: 148375 - DNA, 15 bp, Homo sapiens
ctgaaaagaataccc

SEQ ID NO: 148376 - DNA, 15 bp, Homo sapiens
tctgaaaagaatacc

SEQ ID NO: 148377 - DNA, 15 bp, Homo sapiens
ttctgaaaagaatac

SEQ ID NO: 148378 - DNA, 15 bp, Homo sapiens
tttctgaaaagaata

SEQ ID NO: 148379 - DNA, 15 bp, Homo sapiens
atttctgaaaagaat

SEQ ID NO: 148380 - DNA, 15 bp, Homo sapiens
tatttctgaaaagaa

SEQ ID NO: 148381 - DNA, 15 bp, Homo sapiens
gtatttctgaaaaga

SEQ ID NO: 148382 - DNA, 15 bp, Homo sapiens
agtatttctgaaaag

SEQ ID NO: 148383 - DNA, 15 bp, Homo sapiens
aagtatttctgaaaa

SEQ ID NO: 148384 - DNA, 15 bp, Homo sapiens
taagtatttctgaaa

SEQ ID NO: 148385 - DNA, 15 bp, Homo sapiens
gtaagtatttctgaa

SEQ ID NO: 148386 - DNA, 15 bp, Homo sapiens
tgtaagtatttctga

SEQ ID NO: 148387 - DNA, 15 bp, Homo sapiens
ttgtaagtatttctg

SEQ ID NO: 148388 - DNA, 15 bp, Homo sapiens
cttgtaagtatttct

SEQ ID NO: 148389 - DNA, 15 bp, Homo sapiens
tcttgtaagtatttc

SEQ ID NO: 148390 - DNA, 15 bp, Homo sapiens
ctcttgtaagtattt

SEQ ID NO: 148391 - DNA, 15 bp, Homo sapiens
actcttgtaagtatt

SEQ ID NO: 148392 - DNA, 15 bp, Homo sapiens
aactcttgtaagtat

SEQ ID NO: 148393 - DNA, 15 bp, Homo sapiens
aaactcttgtaagta

SEQ ID NO: 148394 - DNA, 15 bp, Homo sapiens
aaaactcttgtaagt

SEQ ID NO: 148395 - DNA, 15 bp, Homo sapiens
taaaactcttgtaag

SEQ ID NO: 148396 - DNA, 15 bp, Homo sapiens
ataaaactcttgtaa

SEQ ID NO: 148397 - DNA, 15 bp, Homo sapiens
aataaaactcttgta

SEQ ID NO: 148398 - DNA, 15 bp, Homo sapiens
aaataaaactcttgt

SEQ ID NO: 148399 - DNA, 15 bp, Homo sapiens
caaataaaactcttg

SEQ ID NO: 148400 - DNA, 15 bp, Homo sapiens
gcaaataaaactctt

SEQ ID NO: 148401 - DNA, 15 bp, Homo sapiens
tgcaaataaaactct

SEQ ID NO: 148402 - DNA, 15 bp, Homo sapiens
atgcaaataaaactc

SEQ ID NO: 148403 - DNA, 15 bp, Homo sapiens
tatgcaaataaaact

SEQ ID NO: 148404 - DNA, 15 bp, Homo sapiens
ttatgcaaataaaac

SEQ ID NO: 148405 - DNA, 15 bp, Homo sapiens
cttatgcaaataaaa

SEQ ID NO: 148406 - DNA, 15 bp, Homo sapiens
tcttatgcaaataaa

SEQ ID NO: 148407 - DNA, 15 bp, Homo sapiens
ttcttatgcaaataa

SEQ ID NO: 148408 - DNA, 15 bp, Homo sapiens
cttcttatgcaaata

SEQ ID NO: 148409 - DNA, 15 bp, Homo sapiens
taacttcttatgcaa

SEQ ID NO: 148410 - DNA, 15 bp, Homo sapiens
ttaacttcttatgca

SEQ ID NO: 148411 - DNA, 15 bp, Homo sapiens
attaacttcttatgc

SEQ ID NO: 148412 - DNA, 15 bp, Homo sapiens
aattaacttcttatg

SEQ ID NO: 148413 - DNA, 15 bp, Homo sapiens
taattaacttcttat

SEQ ID NO: 148414 - DNA, 15 bp, Homo sapiens
ttaattaacttctta

SEQ ID NO: 148415 - DNA, 15 bp, Homo sapiens
tttaattaacttctt

SEQ ID NO: 148416 - DNA, 15 bp, Homo sapiens
ttttaattaacttct

SEQ ID NO: 148417 - DNA, 15 bp, Homo sapiens
gttttaattaacttc

SEQ ID NO: 148418 - DNA, 15 bp, Homo sapiens
agttttaattaactt

SEQ ID NO: 148419 - DNA, 15 bp, Homo sapiens
aagttttaattaact

SEQ ID NO: 148420 - DNA, 15 bp, Homo sapiens
taagttttaattaac

SEQ ID NO: 148421 - DNA, 15 bp, Homo sapiens
ttaagttttaattaa

SEQ ID NO: 148422 - DNA, 15 bp, Homo sapiens
attaagttttaatta

SEQ ID NO: 148423 - DNA, 15 bp, Homo sapiens
cattaagttttaatt

SEQ ID NO: 148424 - DNA, 15 bp, Homo sapiens
ccattaagttttaat

SEQ ID NO: 148425 - DNA, 15 bp, Homo sapiens
tccattaagttttaa

SEQ ID NO: 148426 - DNA, 15 bp, Homo sapiens
ctccattaagtttta

SEQ ID NO: 148427 - DNA, 15 bp, Homo sapiens
gctccattaagtttt

SEQ ID NO: 148428 - DNA, 15 bp, Homo sapiens
agctccattaagttt

SEQ ID NO: 148429 - DNA, 15 bp, Homo sapiens
aagctccattaagtt

SEQ ID NO: 148430 - DNA, 15 bp, Homo sapiens
taagctccattaagt

SEQ ID NO: 148431 - DNA, 15 bp, Homo sapiens
ttaagctccattaag

SEQ ID NO: 148432 - DNA, 15 bp, Homo sapiens
attaagctccattaa

SEQ ID NO: 148433 - DNA, 15 bp, Homo sapiens
aattaagctccatta

SEQ ID NO: 148434 - DNA, 15 bp, Homo sapiens
taattaagctccatt

SEQ ID NO: 148435 - DNA, 15 bp, Homo sapiens
ttaattaagctccat

SEQ ID NO: 148436 - DNA, 15 bp, Homo sapiens
attaattaagctcca

SEQ ID NO: 148437 - DNA, 15 bp, Homo sapiens
aattaattaagctcc

SEQ ID NO: 148438 - DNA, 15 bp, Homo sapiens
gaattaattaagctc

SEQ ID NO: 148439 - DNA, 15 bp, Homo sapiens
tgaattaattaagct

SEQ ID NO: 148440 - DNA, 15 bp, Homo sapiens
ctgaattaattaagc

SEQ ID NO: 148441 - DNA, 15 bp, Homo sapiens
actgaattaattaag

SEQ ID NO: 148442 - DNA, 15 bp, Homo sapiens
aactgaattaattaa

SEQ ID NO: 148443 - DNA, 15 bp, Homo sapiens
taactgaattaatta

SEQ ID NO: 148444 - DNA, 15 bp, Homo sapiens
gtaactgaattaatt

SEQ ID NO: 148445 - DNA, 15 bp, Homo sapiens
tgtaactgaattaat

SEQ ID NO: 148446 - DNA, 15 bp, Homo sapiens
ttgtaactgaattaa

SEQ ID NO: 148447 - DNA, 15 bp, Homo sapiens
tttgtaactgaatta

SEQ ID NO: 148448 - DNA, 15 bp, Homo sapiens
ctttgtaactgaatt

SEQ ID NO: 148449 - DNA, 15 bp, Homo sapiens
tctttgtaactgaat

SEQ ID NO: 148450 - DNA, 15 bp, Homo sapiens
atctttgtaactgaa

SEQ ID NO: 148451 - DNA, 15 bp, Homo sapiens
aatctttgtaactga

SEQ ID NO: 148452 - DNA, 15 bp, Homo sapiens
aaatctttgtaactg

SEQ ID NO: 148453 - DNA, 15 bp, Homo sapiens
caaatctttgtaact

SEQ ID NO: 148454 - DNA, 15 bp, Homo sapiens
acaaatctttgtaac

SEQ ID NO: 148455 - DNA, 15 bp, Homo sapiens
tacaaatctttgtaa

SEQ ID NO: 148456 - DNA, 15 bp, Homo sapiens
ttacaaatctttgta

SEQ ID NO: 148457 - DNA, 15 bp, Homo sapiens
tttacaaatctttgt

SEQ ID NO: 148458 - DNA, 15 bp, Homo sapiens
gtttacaaatctttg

SEQ ID NO: 148459 - DNA, 15 bp, Homo sapiens
ggtttacaaatcttt

SEQ ID NO: 148460 - DNA, 15 bp, Homo sapiens
aggtttacaaatctt

SEQ ID NO: 148461 - DNA, 15 bp, Homo sapiens
taggtttacaaatct

SEQ ID NO: 148462 - DNA, 15 bp, Homo sapiens
ctaggtttacaaatc

SEQ ID NO: 148463 - DNA, 15 bp, Homo sapiens
actaggtttacaaat

SEQ ID NO: 148464 - DNA, 15 bp, Homo sapiens
aactaggtttacaaa

SEQ ID NO: 148465 - DNA, 15 bp, Homo sapiens
taactaggtttacaa

SEQ ID NO: 148466 - DNA, 15 bp, Homo sapiens
ataactaggtttaca

SEQ ID NO: 148467 - DNA, 15 bp, Homo sapiens
aataactaggtttac

SEQ ID NO: 148468 - DNA, 15 bp, Homo sapiens
aaataactaggttta

SEQ ID NO: 148469 - DNA, 15 bp, Homo sapiens
gaaataactaggttt

SEQ ID NO: 148470 - DNA, 15 bp, Homo sapiens
tgaaataactaggtt

SEQ ID NO: 148471 - DNA, 15 bp, Homo sapiens
ttgaaataactaggt

SEQ ID NO: 148472 - DNA, 15 bp, Homo sapiens
attgaaataactagg

SEQ ID NO: 148473 - DNA, 15 bp, Homo sapiens
cattgaaataactag

SEQ ID NO: 148474 - DNA, 15 bp, Homo sapiens
acattgaaataacta

SEQ ID NO: 148475 - DNA, 15 bp, Homo sapiens
cacattgaaataact

SEQ ID NO: 148476 - DNA, 15 bp, Homo sapiens
acacattgaaataac

SEQ ID NO: 148477 - DNA, 15 bp, Homo sapiens
aacacattgaaataa

SEQ ID NO: 148478 - DNA, 15 bp, Homo sapiens
caacacattgaaata

SEQ ID NO: 148479 - DNA, 15 bp, Homo sapiens
acaacacattgaaat

SEQ ID NO: 148480 - DNA, 15 bp, Homo sapiens
cacaacacattgaaa

SEQ ID NO: 148481 - DNA, 15 bp, Homo sapiens
acacaacacattgaa

SEQ ID NO: 148482 - DNA, 15 bp, Homo sapiens
aacacaacacattga

SEQ ID NO: 148483 - DNA, 15 bp, Homo sapiens
aaacacaacacattg

SEQ ID NO: 148484 - DNA, 15 bp, Homo sapiens
aaaacacaacacatt

SEQ ID NO: 148485 - DNA, 15 bp, Homo sapiens
caaaacacaacacat

SEQ ID NO: 148486 - DNA, 15 bp, Homo sapiens
gcaaaacacaacaca

SEQ ID NO: 148487 - DNA, 15 bp, Homo sapiens
agcaaaacacaacac

SEQ ID NO: 148488 - DNA, 15 bp, Homo sapiens
gagcaaaacacaaca

SEQ ID NO: 148489 - DNA, 15 bp, Homo sapiens
agagcaaaacacaac

SEQ ID NO: 148490 - DNA, 15 bp, Homo sapiens
tagagcaaaacacaa

SEQ ID NO: 148491 - DNA, 15 bp, Homo sapiens
gtagagcaaaacaca

SEQ ID NO: 148492 - DNA, 15 bp, Homo sapiens
agtagagcaaaacac

SEQ ID NO: 148493 - DNA, 15 bp, Homo sapiens
aagtagagcaaaaca

SEQ ID NO: 148494 - DNA, 15 bp, Homo sapiens
gaagtagagcaaaac

SEQ ID NO: 148495 - DNA, 15 bp, Homo sapiens
tgaagtagagcaaaa

SEQ ID NO: 148496 - DNA, 15 bp, Homo sapiens
ctgaagtagagcaaa

SEQ ID NO: 148497 - DNA, 15 bp, Homo sapiens
actgaagtagagcaa

SEQ ID NO: 148498 - DNA, 15 bp, Homo sapiens
cactgaagtagagca

SEQ ID NO: 148499 - DNA, 15 bp, Homo sapiens
ccactgaagtagagc

SEQ ID NO: 148500 - DNA, 15 bp, Homo sapiens
tccactgaagtagag

SEQ ID NO: 148501 - DNA, 15 bp, Homo sapiens
atccactgaagtaga

SEQ ID NO: 148502 - DNA, 15 bp, Homo sapiens
tatccactgaagtag

SEQ ID NO: 148503 - DNA, 15 bp, Homo sapiens
ttatccactgaagta

SEQ ID NO: 148504 - DNA, 15 bp, Homo sapiens
cttatccactgaagt

SEQ ID NO: 148505 - DNA, 15 bp, Homo sapiens
acttatccactgaag

SEQ ID NO: 148506 - DNA, 15 bp, Homo sapiens
aacttatccactgaa

SEQ ID NO: 148507 - DNA, 15 bp, Homo sapiens
aaacttatccactga

SEQ ID NO: 148508 - DNA, 15 bp, Homo sapiens
taaacttatccactg

SEQ ID NO: 148509 - DNA, 15 bp, Homo sapiens
ataaacttatccact

SEQ ID NO: 148510 - DNA, 15 bp, Homo sapiens
aataaacttatccac

SEQ ID NO: 148511 - DNA, 15 bp, Homo sapiens
gaataaacttatcca

SEQ ID NO: 148512 - DNA, 15 bp, Homo sapiens
agaataaacttatcc

SEQ ID NO: 148513 - DNA, 15 bp, Homo sapiens
cagaataaacttatc

SEQ ID NO: 148514 - DNA, 15 bp, Homo sapiens
ccagaataaacttat

SEQ ID NO: 148515 - DNA, 15 bp, Homo sapiens
accagaataaactta

SEQ ID NO: 148516 - DNA, 15 bp, Homo sapiens
taccagaataaactt

SEQ ID NO: 148517 - DNA, 15 bp, Homo sapiens
ttaccagaataaact

SEQ ID NO: 148518 - DNA, 15 bp, Homo sapiens
tttaccagaataaac

SEQ ID NO: 148519 - DNA, 15 bp, Homo sapiens
ttttaccagaataaa

SEQ ID NO: 148520 - DNA, 15 bp, Homo sapiens
gttttaccagaataa

SEQ ID NO: 148521 - DNA, 15 bp, Homo sapiens
tgttttaccagaata

SEQ ID NO: 148522 - DNA, 15 bp, Homo sapiens
atgttttaccagaat

SEQ ID NO: 148523 - DNA, 15 bp, Homo sapiens
aatgttttaccagaa

SEQ ID NO: 148524 - DNA, 15 bp, Homo sapiens
aaatgttttaccaga

SEQ ID NO: 148525 - DNA, 15 bp, Homo sapiens
taaatgttttaccag

SEQ ID NO: 148526 - DNA, 15 bp, Homo sapiens
ataaatgttttacca

SEQ ID NO: 148527 - DNA, 15 bp, Homo sapiens
cataaatgttttacc

SEQ ID NO: 148528 - DNA, 15 bp, Homo sapiens
acataaatgttttac

SEQ ID NO: 148529 - DNA, 15 bp, Homo sapiens
aacataaatgtttta

SEQ ID NO: 148530 - DNA, 15 bp, Homo sapiens
aaacataaatgtttt

SEQ ID NO: 148531 - DNA, 15 bp, Homo sapiens
aaaacataaatgttt

SEQ ID NO: 148532 - DNA, 15 bp, Homo sapiens
aaaaacataaatgtt

SEQ ID NO: 148533 - DNA, 15 bp, Homo sapiens
gaaaaacataaatgt

SEQ ID NO: 148534 - DNA, 15 bp, Homo sapiens
tgaaaaacataaatg

SEQ ID NO: 148535 - DNA, 15 bp, Homo sapiens
atgaaaaacataaat

SEQ ID NO: 148536 - DNA, 15 bp, Homo sapiens
catgaaaaacataaa

SEQ ID NO: 148537 - DNA, 15 bp, Homo sapiens
tcatgaaaaacataa

SEQ ID NO: 148538 - DNA, 15 bp, Homo sapiens
ttcatgaaaaacata

SEQ ID NO: 148539 - DNA, 15 bp, Homo sapiens
tttcatgaaaaacat

SEQ ID NO: 148540 - DNA, 15 bp, Homo sapiens
ttttcatgaaaaaca

SEQ ID NO: 148541 - DNA, 15 bp, Homo sapiens
cttttcatgaaaaac

SEQ ID NO: 148542 - DNA, 15 bp, Homo sapiens
ccttttcatgaaaaa

SEQ ID NO: 148543 - DNA, 15 bp, Homo sapiens
gccttttcatgaaaa

SEQ ID NO: 148544 - DNA, 15 bp, Homo sapiens
tgccttttcatgaaa

SEQ ID NO: 148545 - DNA, 15 bp, Homo sapiens
ttgccttttcatgaa

SEQ ID NO: 148546 - DNA, 15 bp, Homo sapiens
attgccttttcatga

SEQ ID NO: 148547 - DNA, 15 bp, Homo sapiens
aattgccttttcatg

SEQ ID NO: 148548 - DNA, 15 bp, Homo sapiens
aaattgccttttcat

SEQ ID NO: 148549 - DNA, 15 bp, Homo sapiens
aaaattgccttttca

SEQ ID NO: 148550 - DNA, 15 bp, Homo sapiens
caaaattgccttttc

SEQ ID NO: 148551 - DNA, 15 bp, Homo sapiens
tcaaaattgcctttt

SEQ ID NO: 148552 - DNA, 15 bp, Homo sapiens
atcaaaattgccttt

SEQ ID NO: 148553 - DNA, 15 bp, Homo sapiens
tatcaaaattgcctt

SEQ ID NO: 148554 - DNA, 15 bp, Homo sapiens
ttatcaaaattgcct

SEQ ID NO: 148555 - DNA, 15 bp, Homo sapiens
attatcaaaattgcc

SEQ ID NO: 148556 - DNA, 15 bp, Homo sapiens
tattatcaaaattgc

SEQ ID NO: 148557 - DNA, 15 bp, Homo sapiens
ctattatcaaaattg

SEQ ID NO: 148558 - DNA, 15 bp, Homo sapiens
tctattatcaaaatt

SEQ ID NO: 148559 - DNA, 15 bp, Homo sapiens
atctattatcaaaat

SEQ ID NO: 148560 - DNA, 15 bp, Homo sapiens
tatctattatcaaaa

SEQ ID NO: 148561 - DNA, 15 bp, Homo sapiens
ttatctattatcaaa

SEQ ID NO: 148562 - DNA, 15 bp, Homo sapiens
cttatctattatcaa

SEQ ID NO: 148563 - DNA, 15 bp, Homo sapiens
tcttatctattatca

SEQ ID NO: 148564 - DNA, 15 bp, Homo sapiens
ttcttatctattatc

SEQ ID NO: 148565 - DNA, 15 bp, Homo sapiens
tttcttatctattat

SEQ ID NO: 148566 - DNA, 15 bp, Homo sapiens
ttttcttatctatta

SEQ ID NO: 148567 - DNA, 15 bp, Homo sapiens
cttttcttatctatt

SEQ ID NO: 148568 - DNA, 15 bp, Homo sapiens
gcttttcttatctat

SEQ ID NO: 148569 - DNA, 15 bp, Homo sapiens
agcttttcttatcta

SEQ ID NO: 148570 - DNA, 15 bp, Homo sapiens
gagcttttcttatct

SEQ ID NO: 148571 - DNA, 15 bp, Homo sapiens
tgagcttttcttatc

SEQ ID NO: 148572 - DNA, 15 bp, Homo sapiens
atgagcttttcttat

SEQ ID NO: 148573 - DNA, 15 bp, Homo sapiens
aatgagcttttctta

SEQ ID NO: 148574 - DNA, 15 bp, Homo sapiens
gaatgagcttttctt

SEQ ID NO: 148575 - DNA, 15 bp, Homo sapiens
tgaatgagcttttct

SEQ ID NO: 148576 - DNA, 15 bp, Homo sapiens
gtgaatgagcttttc

SEQ ID NO: 148577 - DNA, 15 bp, Homo sapiens
agtgaatgagctttt

SEQ ID NO: 148578 - DNA, 15 bp, Homo sapiens
tagtgaatgagcttt

SEQ ID NO: 148579 - DNA, 15 bp, Homo sapiens
ttagtgaatgagctt

SEQ ID NO: 148580 - DNA, 15 bp, Homo sapiens
attagtgaatgagct

SEQ ID NO: 148581 - DNA, 15 bp, Homo sapiens
aattagtgaatgagc

SEQ ID NO: 148582 - DNA, 15 bp, Homo sapiens
gaattagtgaatgag

SEQ ID NO: 148583 - DNA, 15 bp, Homo sapiens
tgaattagtgaatga

SEQ ID NO: 148584 - DNA, 15 bp, Homo sapiens
atgaattagtgaatg

SEQ ID NO: 148585 - DNA, 15 bp, Homo sapiens
catgaattagtgaat

SEQ ID NO: 148586 - DNA, 15 bp, Homo sapiens
gcatgaattagtgaa

SEQ ID NO: 148587 - DNA, 15 bp, Homo sapiens
agcatgaattagtga

SEQ ID NO: 148588 - DNA, 15 bp, Homo sapiens
tagcatgaattagtg

SEQ ID NO: 148589 - DNA, 15 bp, Homo sapiens
atagcatgaattagt

SEQ ID NO: 148590 - DNA, 15 bp, Homo sapiens
aatagcatgaattag

SEQ ID NO: 148591 - DNA, 15 bp, Homo sapiens
aaatagcatgaatta

SEQ ID NO: 148592 - DNA, 15 bp, Homo sapiens
taaatagcatgaatt

SEQ ID NO: 148593 - DNA, 15 bp, Homo sapiens
ttaaatagcatgaat

SEQ ID NO: 148594 - DNA, 15 bp, Homo sapiens
attaaatagcatgaa

SEQ ID NO: 148595 - DNA, 15 bp, Homo sapiens
aattaaatagcatga

SEQ ID NO: 148596 - DNA, 15 bp, Homo sapiens
aaattaaatagcatg

SEQ ID NO: 148597 - DNA, 15 bp, Homo sapiens
aaaattaaatagcat

SEQ ID NO: 148598 - DNA, 15 bp, Homo sapiens
aaaaattaaatagca

SEQ ID NO: 148599 - DNA, 15 bp, Homo sapiens
aaaaaattaaatagc

SEQ ID NO: 148600 - DNA, 15 bp, Homo sapiens
aaaaaaattaaatag

SEQ ID NO: 148601 - DNA, 15 bp, Homo sapiens
taaaaaaattaaata

SEQ ID NO: 148602 - DNA, 15 bp, Homo sapiens
ttaaaaaaattaaat

SEQ ID NO: 148603 - DNA, 15 bp, Homo sapiens
gttaaaaaaattaaa

SEQ ID NO: 148604 - DNA, 15 bp, Homo sapiens
agttaaaaaaattaa

SEQ ID NO: 148605 - DNA, 15 bp, Homo sapiens
tagttaaaaaaatta

SEQ ID NO: 148606 - DNA, 15 bp, Homo sapiens
gtagttaaaaaaatt

SEQ ID NO: 148607 - DNA, 15 bp, Homo sapiens
ggtagttaaaaaaat

SEQ ID NO: 148608 - DNA, 15 bp, Homo sapiens
tggtagttaaaaaaa

SEQ ID NO: 148609 - DNA, 15 bp, Homo sapiens
ctggtagttaaaaaa

SEQ ID NO: 148610 - DNA, 15 bp, Homo sapiens
actggtagttaaaaa

SEQ ID NO: 148611 - DNA, 15 bp, Homo sapiens
tactggtagttaaaa

SEQ ID NO: 148612 - DNA, 15 bp, Homo sapiens
atactggtagttaaa

SEQ ID NO: 148613 - DNA, 15 bp, Homo sapiens
catactggtagttaa

SEQ ID NO: 148614 - DNA, 15 bp, Homo sapiens
tcatactggtagtta

SEQ ID NO: 148615 - DNA, 15 bp, Homo sapiens
ttcatactggtagtt

SEQ ID NO: 148616 - DNA, 15 bp, Homo sapiens
attcatactggtagt

SEQ ID NO: 148617 - DNA, 15 bp, Homo sapiens
cattcatactggtag

SEQ ID NO: 148618 - DNA, 15 bp, Homo sapiens
acattcatactggta

SEQ ID NO: 148619 - DNA, 15 bp, Homo sapiens
tacattcatactggt

SEQ ID NO: 148620 - DNA, 15 bp, Homo sapiens
atacattcatactgg

SEQ ID NO: 148621 - DNA, 15 bp, Homo sapiens
tatacattcatactg

SEQ ID NO: 148622 - DNA, 15 bp, Homo sapiens
ttatacattcatact

SEQ ID NO: 148623 - DNA, 15 bp, Homo sapiens
tttatacattcatac

SEQ ID NO: 148624 - DNA, 15 bp, Homo sapiens
ctttatacattcata

SEQ ID NO: 148625 - DNA, 15 bp, Homo sapiens
gctttatacattcat

SEQ ID NO: 148626 - DNA, 15 bp, Homo sapiens
agctttatacattca

SEQ ID NO: 148627 - DNA, 15 bp, Homo sapiens
aagctttatacattc

SEQ ID NO: 148628 - DNA, 15 bp, Homo sapiens
aaagctttatacatt

SEQ ID NO: 148629 - DNA, 15 bp, Homo sapiens
gaaagctttatacat

SEQ ID NO: 148630 - DNA, 15 bp, Homo sapiens
agaaagctttataca

SEQ ID NO: 148631 - DNA, 15 bp, Homo sapiens
aagaaagctttatac

SEQ ID NO: 148632 - DNA, 15 bp, Homo sapiens
aaagaaagctttata

SEQ ID NO: 148633 - DNA, 15 bp, Homo sapiens
aaaagaaagctttat

SEQ ID NO: 148634 - DNA, 15 bp, Homo sapiens
aaaaagaaagcttta

SEQ ID NO: 148635 - DNA, 15 bp, Homo sapiens
aaaaaagaaagcttt

SEQ ID NO: 148636 - DNA, 15 bp, Homo sapiens
aaaaaaagaaagctt

SEQ ID NO: 148637 - DNA, 15 bp, Homo sapiens
aaaaaaaagaaagct

SEQ ID NO: 148638 - DNA, 15 bp, Homo sapiens
taaaaaaaagaaagc

SEQ ID NO: 148639 - DNA, 15 bp, Homo sapiens
ttaaaaaaaagaaag

SEQ ID NO: 148640 - DNA, 15 bp, Homo sapiens
cttaaaaaaaagaaa

SEQ ID NO: 148641 - DNA, 15 bp, Homo sapiens
tcttaaaaaaaagaa

SEQ ID NO: 148642 - DNA, 15 bp, Homo sapiens
ctcttaaaaaaaaga

SEQ ID NO: 148643 - DNA, 15 bp, Homo sapiens
gctcttaaaaaaaag

SEQ ID NO: 148644 - DNA, 15 bp, Homo sapiens
tgctcttaaaaaaaa

SEQ ID NO: 148645 - DNA, 15 bp, Homo sapiens
ctgctcttaaaaaaa

SEQ ID NO: 148646 - DNA, 15 bp, Homo sapiens
cctgctcttaaaaaa

SEQ ID NO: 148647 - DNA, 15 bp, Homo sapiens
ccctgctcttaaaaa

SEQ ID NO: 148648 - DNA, 15 bp, Homo sapiens
accctgctcttaaaa

SEQ ID NO: 148649 - DNA, 15 bp, Homo sapiens
gaccctgctcttaaa

SEQ ID NO: 148650 - DNA, 15 bp, Homo sapiens
tgaccctgctcttaa

SEQ ID NO: 148651 - DNA, 15 bp, Homo sapiens
atgaccctgctctta

SEQ ID NO: 148652 - DNA, 15 bp, Homo sapiens
aatgaccctgctctt

SEQ ID NO: 148653 - DNA, 15 bp, Homo sapiens
aaatgaccctgctct

SEQ ID NO: 148654 - DNA, 15 bp, Homo sapiens
aaaatgaccctgctc

SEQ ID NO: 148655 - DNA, 15 bp, Homo sapiens
gaaaatgaccctgct

SEQ ID NO: 148656 - DNA, 15 bp, Homo sapiens
ggaaaatgaccctgc

SEQ ID NO: 148657 - DNA, 15 bp, Homo sapiens
aggaaaatgaccctg

SEQ ID NO: 148658 - DNA, 15 bp, Homo sapiens
caggaaaatgaccct

SEQ ID NO: 148659 - DNA, 15 bp, Homo sapiens
tcaggaaaatgaccc

SEQ ID NO: 148660 - DNA, 15 bp, Homo sapiens
atcaggaaaatgacc

SEQ ID NO: 148661 - DNA, 15 bp, Homo sapiens
gatcaggaaaatgac

SEQ ID NO: 148662 - DNA, 15 bp, Homo sapiens
ggatcaggaaaatga

SEQ ID NO: 148663 - DNA, 15 bp, Homo sapiens
cggatcaggaaaatg

SEQ ID NO: 148664 - DNA, 15 bp, Homo sapiens
acggatcaggaaaat

SEQ ID NO: 148665 - DNA, 15 bp, Homo sapiens
aacggatcaggaaaa

SEQ ID NO: 148666 - DNA, 15 bp, Homo sapiens
aaacggatcaggaaa

SEQ ID NO: 148667 - DNA, 15 bp, Homo sapiens
caaacggatcaggaa

SEQ ID NO: 148668 - DNA, 15 bp, Homo sapiens
acaaacggatcagga

SEQ ID NO: 148669 - DNA, 15 bp, Homo sapiens
cacaaacggatcagg

SEQ ID NO: 148670 - DNA, 15 bp, Homo sapiens
acacaaacggatcag

SEQ ID NO: 148671 - DNA, 15 bp, Homo sapiens
cacacaaacggatca

SEQ ID NO: 148672 - DNA, 15 bp, Homo sapiens
acacacaaacggatc

SEQ ID NO: 148673 - DNA, 15 bp, Homo sapiens
cacacacaaacggat

SEQ ID NO: 148674 - DNA, 15 bp, Homo sapiens
acacacacaaacgga

SEQ ID NO: 148675 - DNA, 15 bp, Homo sapiens
tacacacacaaacgg

SEQ ID NO: 148676 - DNA, 15 bp, Homo sapiens
gtacacacacaaacg

SEQ ID NO: 148677 - DNA, 15 bp, Homo sapiens
agtacacacacaaac

SEQ ID NO: 148678 - DNA, 15 bp, Homo sapiens
aagtacacacacaaa

SEQ ID NO: 148679 - DNA, 15 bp, Homo sapiens
aaagtacacacacaa

SEQ ID NO: 148680 - DNA, 15 bp, Homo sapiens
gaaagtacacacaca

SEQ ID NO: 148681 - DNA, 15 bp, Homo sapiens
tgaaagtacacacac

SEQ ID NO: 148682 - DNA, 15 bp, Homo sapiens
gtgaaagtacacaca

SEQ ID NO: 148683 - DNA, 15 bp, Homo sapiens
tgtgaaagtacacac

SEQ ID NO: 148684 - DNA, 15 bp, Homo sapiens
ttgtgaaagtacaca

SEQ ID NO: 148685 - DNA, 15 bp, Homo sapiens
tttgtgaaagtacac

SEQ ID NO: 148686 - DNA, 15 bp, Homo sapiens
ttttgtgaaagtaca

SEQ ID NO: 148687 - DNA, 15 bp, Homo sapiens
gttttgtgaaagtac

SEQ ID NO: 148688 - DNA, 15 bp, Homo sapiens
ggttttgtgaaagta

SEQ ID NO: 148689 - DNA, 15 bp, Homo sapiens
tggttttgtgaaagt

SEQ ID NO: 148690 - DNA, 15 bp, Homo sapiens
ttggttttgtgaaag

SEQ ID NO: 148691 - DNA, 15 bp, Homo sapiens
tttggttttgtgaaa

SEQ ID NO: 148692 - DNA, 15 bp, Homo sapiens
atttggttttgtgaa

SEQ ID NO: 148693 - DNA, 15 bp, Homo sapiens
tatttggttttgtga

SEQ ID NO: 148694 - DNA, 15 bp, Homo sapiens
atatttggttttgtg

SEQ ID NO: 148695 - DNA, 15 bp, Homo sapiens
aatatttggttttgt

SEQ ID NO: 148696 - DNA, 15 bp, Homo sapiens
aaatatttggttttg

SEQ ID NO: 148697 - DNA, 15 bp, Homo sapiens
aaaatatttggtttt

SEQ ID NO: 148698 - DNA, 15 bp, Homo sapiens
aaaaatatttggttt

SEQ ID NO: 148699 - DNA, 15 bp, Homo sapiens
gaaaaatatttggtt

SEQ ID NO: 148700 - DNA, 15 bp, Homo sapiens
agaaaaatatttggt

SEQ ID NO: 148701 - DNA, 15 bp, Homo sapiens
tagaaaaatatttgg

SEQ ID NO: 148702 - DNA, 15 bp, Homo sapiens
ttagaaaaatatttg

SEQ ID NO: 148703 - DNA, 15 bp, Homo sapiens
tttagaaaaatattt

SEQ ID NO: 148704 - DNA, 15 bp, Homo sapiens
ctttagaaaaatatt

SEQ ID NO: 148705 - DNA, 15 bp, Homo sapiens
actttagaaaaatat

SEQ ID NO: 148706 - DNA, 15 bp, Homo sapiens
gactttagaaaaata

SEQ ID NO: 148707 - DNA, 15 bp, Homo sapiens
cgactttagaaaaat

SEQ ID NO: 148708 - DNA, 15 bp, Homo sapiens
tcgactttagaaaaa

SEQ ID NO: 148709 - DNA, 15 bp, Homo sapiens
ttcgactttagaaaa

SEQ ID NO: 148710 - DNA, 15 bp, Homo sapiens
cttcgactttagaaa

SEQ ID NO: 148711 - DNA, 15 bp, Homo sapiens
ccttcgactttagaa

SEQ ID NO: 148712 - DNA, 15 bp, Homo sapiens
accttcgactttaga

SEQ ID NO: 148713 - DNA, 15 bp, Homo sapiens
taccttcgactttag

SEQ ID NO: 148714 - DNA, 15 bp, Homo sapiens
ataccttcgacttta

SEQ ID NO: 148715 - DNA, 15 bp, Homo sapiens
aataccttcgacttt

SEQ ID NO: 148716 - DNA, 15 bp, Homo sapiens
taataccttcgactt

SEQ ID NO: 148717 - DNA, 15 bp, Homo sapiens
ttaataccttcgact

SEQ ID NO: 148718 - DNA, 15 bp, Homo sapiens
cttaataccttcgac

SEQ ID NO: 148719 - DNA, 15 bp, Homo sapiens
acttaataccttcga

SEQ ID NO: 148720 - DNA, 15 bp, Homo sapiens
aacttaataccttcg

SEQ ID NO: 148721 - DNA, 15 bp, Homo sapiens
taacttaataccttc

SEQ ID NO: 148722 - DNA, 15 bp, Homo sapiens
ctaacttaatacctt

SEQ ID NO: 148723 - DNA, 15 bp, Homo sapiens
actaacttaatacct

SEQ ID NO: 148724 - DNA, 15 bp, Homo sapiens
cactaacttaatacc

SEQ ID NO: 148725 - DNA, 15 bp, Homo sapiens
gcactaacttaatac

SEQ ID NO: 148726 - DNA, 15 bp, Homo sapiens
tgcactaacttaata

SEQ ID NO: 148727 - DNA, 15 bp, Homo sapiens
ttgcactaacttaat

SEQ ID NO: 148728 - DNA, 15 bp, Homo sapiens
tttgcactaacttaa

SEQ ID NO: 148729 - DNA, 15 bp, Homo sapiens
ttttgcactaactta

SEQ ID NO: 148730 - DNA, 15 bp, Homo sapiens
cttttgcactaactt

SEQ ID NO: 148731 - DNA, 15 bp, Homo sapiens
tcttttgcactaact

SEQ ID NO: 148732 - DNA, 15 bp, Homo sapiens
atcttttgcactaac

SEQ ID NO: 148733 - DNA, 15 bp, Homo sapiens
catcttttgcactaa

SEQ ID NO: 148734 - DNA, 15 bp, Homo sapiens
tcatcttttgcacta

SEQ ID NO: 148735 - DNA, 15 bp, Homo sapiens
ttcatcttttgcact

SEQ ID NO: 148736 - DNA, 15 bp, Homo sapiens
tttcatcttttgcac

SEQ ID NO: 148737 - DNA, 15 bp, Homo sapiens
gtttcatcttttgca

SEQ ID NO: 148738 - DNA, 15 bp, Homo sapiens
tgtttcatcttttgc

SEQ ID NO: 148739 - DNA, 15 bp, Homo sapiens
ctgtttcatcttttg

SEQ ID NO: 148740 - DNA, 15 bp, Homo sapiens
gctgtttcatctttt

SEQ ID NO: 148741 - DNA, 15 bp, Homo sapiens
tgctgtttcatcttt

SEQ ID NO: 148742 - DNA, 15 bp, Homo sapiens
ctgctgtttcatctt

SEQ ID NO: 148743 - DNA, 15 bp, Homo sapiens
tctgctgtttcatct

SEQ ID NO: 148744 - DNA, 15 bp, Homo sapiens
ttctgctgtttcatc

SEQ ID NO: 148745 - DNA, 15 bp, Homo sapiens
cttctgctgtttcat

SEQ ID NO: 148746 - DNA, 15 bp, Homo sapiens
acttctgctgtttca

SEQ ID NO: 148747 - DNA, 15 bp, Homo sapiens
gacttctgctgtttc

SEQ ID NO: 148748 - DNA, 15 bp, Homo sapiens
tgacttctgctgttt

SEQ ID NO: 148749 - DNA, 15 bp, Homo sapiens
ttgacttctgctgtt

SEQ ID NO: 148750 - DNA, 15 bp, Homo sapiens
cttgacttctgctgt

SEQ ID NO: 148751 - DNA, 15 bp, Homo sapiens
acttgacttctgctg

SEQ ID NO: 148752 - DNA, 15 bp, Homo sapiens
tacttgacttctgct

SEQ ID NO: 148753 - DNA, 15 bp, Homo sapiens
atacttgacttctgc

SEQ ID NO: 148754 - DNA, 15 bp, Homo sapiens
aatacttgacttctg

SEQ ID NO: 148755 - DNA, 15 bp, Homo sapiens
caatacttgacttct

SEQ ID NO: 148756 - DNA, 15 bp, Homo sapiens
ccaatacttgacttc

SEQ ID NO: 148757 - DNA, 15 bp, Homo sapiens
tccaatacttgactt

SEQ ID NO: 148758 - DNA, 15 bp, Homo sapiens
ctccaatacttgact

SEQ ID NO: 148759 - DNA, 15 bp, Homo sapiens
tctccaatacttgac

SEQ ID NO: 148760 - DNA, 15 bp, Homo sapiens
ttctccaatacttga

SEQ ID NO: 148761 - DNA, 15 bp, Homo sapiens
tttctccaatacttg

SEQ ID NO: 148762 - DNA, 15 bp, Homo sapiens
ctttctccaatactt

SEQ ID NO: 148763 - DNA, 15 bp, Homo sapiens
actttctccaatact

SEQ ID NO: 148764 - DNA, 15 bp, Homo sapiens
aactttctccaatac

SEQ ID NO: 148765 - DNA, 15 bp, Homo sapiens
caactttctccaata

SEQ ID NO: 148766 - DNA, 15 bp, Homo sapiens
gcaactttctccaat

SEQ ID NO: 148767 - DNA, 15 bp, Homo sapiens
agcaactttctccaa

SEQ ID NO: 148768 - DNA, 15 bp, Homo sapiens
tagcaactttctcca

SEQ ID NO: 148769 - DNA, 15 bp, Homo sapiens
ttagcaactttctcc

SEQ ID NO: 148770 - DNA, 15 bp, Homo sapiens
attagcaactttctc

SEQ ID NO: 148771 - DNA, 15 bp, Homo sapiens
aattagcaactttct

SEQ ID NO: 148772 - DNA, 15 bp, Homo sapiens
taattagcaactttc

SEQ ID NO: 148773 - DNA, 15 bp, Homo sapiens
ctaattagcaacttt

SEQ ID NO: 148774 - DNA, 15 bp, Homo sapiens
actaattagcaactt

SEQ ID NO: 148775 - DNA, 15 bp, Homo sapiens
aactaattagcaact

SEQ ID NO: 148776 - DNA, 15 bp, Homo sapiens
aaactaattagcaac

SEQ ID NO: 148777 - DNA, 15 bp, Homo sapiens
caaactaattagcaa

SEQ ID NO: 148778 - DNA, 15 bp, Homo sapiens
gcaaactaattagca

SEQ ID NO: 148779 - DNA, 15 bp, Homo sapiens
agcaaactaattagc

SEQ ID NO: 148780 - DNA, 15 bp, Homo sapiens
tagcaaactaattag

SEQ ID NO: 148781 - DNA, 15 bp, Homo sapiens
ttagcaaactaatta

SEQ ID NO: 148782 - DNA, 15 bp, Homo sapiens
attagcaaactaatt

SEQ ID NO: 148783 - DNA, 15 bp, Homo sapiens
aattagcaaactaat

SEQ ID NO: 148784 - DNA, 15 bp, Homo sapiens
gaattagcaaactaa

SEQ ID NO: 148785 - DNA, 15 bp, Homo sapiens
agaattagcaaacta

SEQ ID NO: 148786 - DNA, 15 bp, Homo sapiens
tagaattagcaaact

SEQ ID NO: 148787 - DNA, 15 bp, Homo sapiens
gtagaattagcaaac

SEQ ID NO: 148788 - DNA, 15 bp, Homo sapiens
ggtagaattagcaaa

SEQ ID NO: 148789 - DNA, 15 bp, Homo sapiens
cggtagaattagcaa

SEQ ID NO: 148790 - DNA, 15 bp, Homo sapiens
gcggtagaattagca

SEQ ID NO: 148791 - DNA, 15 bp, Homo sapiens
tgcggtagaattagc

SEQ ID NO: 148792 - DNA, 15 bp, Homo sapiens
ttgcggtagaattag

SEQ ID NO: 148793 - DNA, 15 bp, Homo sapiens
tttgcggtagaatta

SEQ ID NO: 148794 - DNA, 15 bp, Homo sapiens
atttgcggtagaatt

SEQ ID NO: 148795 - DNA, 15 bp, Homo sapiens
tatttgcggtagaat

SEQ ID NO: 148796 - DNA, 15 bp, Homo sapiens
ctatttgcggtagaa

SEQ ID NO: 148797 - DNA, 15 bp, Homo sapiens
cctatttgcggtaga

SEQ ID NO: 148798 - DNA, 15 bp, Homo sapiens
gcctatttgcggtag

SEQ ID NO: 148799 - DNA, 15 bp, Homo sapiens
tgcctatttgcggta

SEQ ID NO: 148800 - DNA, 15 bp, Homo sapiens
gtgcctatttgcggt

SEQ ID NO: 148801 - DNA, 15 bp, Homo sapiens
tgtgcctatttgcgg

SEQ ID NO: 148802 - DNA, 15 bp, Homo sapiens
ttgtgcctatttgcg

SEQ ID NO: 148803 - DNA, 15 bp, Homo sapiens
cttgtgcctatttgc

SEQ ID NO: 148804 - DNA, 15 bp, Homo sapiens
acttgtgcctatttg

SEQ ID NO: 148805 - DNA, 15 bp, Homo sapiens
aacttgtgcctattt

SEQ ID NO: 148806 - DNA, 15 bp, Homo sapiens
taacttgtgcctatt

SEQ ID NO: 148807 - DNA, 15 bp, Homo sapiens
ttaacttgtgcctat

SEQ ID NO: 148808 - DNA, 15 bp, Homo sapiens
cttaacttgtgccta

SEQ ID NO: 148809 - DNA, 15 bp, Homo sapiens
acttaacttgtgcct

SEQ ID NO: 148810 - DNA, 15 bp, Homo sapiens
gacttaacttgtgcc

SEQ ID NO: 148811 - DNA, 15 bp, Homo sapiens
tgacttaacttgtgc

SEQ ID NO: 148812 - DNA, 15 bp, Homo sapiens
gtgacttaacttgtg

SEQ ID NO: 148813 - DNA, 15 bp, Homo sapiens
agtgacttaacttgt

SEQ ID NO: 148814 - DNA, 15 bp, Homo sapiens
cagtgacttaacttg

SEQ ID NO: 148815 - DNA, 15 bp, Homo sapiens
tcagtgacttaactt

SEQ ID NO: 148816 - DNA, 15 bp, Homo sapiens
ttcagtgacttaact

SEQ ID NO: 148817 - DNA, 15 bp, Homo sapiens
cttcagtgacttaac

SEQ ID NO: 148818 - DNA, 15 bp, Homo sapiens
acttcagtgacttaa

SEQ ID NO: 148819 - DNA, 15 bp, Homo sapiens
gacttcagtgactta

SEQ ID NO: 148820 - DNA, 15 bp, Homo sapiens
tgacttcagtgactt

SEQ ID NO: 148821 - DNA, 15 bp, Homo sapiens
atgacttcagtgact

SEQ ID NO: 148822 - DNA, 15 bp, Homo sapiens
aatgacttcagtgac

SEQ ID NO: 148823 - DNA, 15 bp, Homo sapiens
caatgacttcagtga

SEQ ID NO: 148824 - DNA, 15 bp, Homo sapiens
ccaatgacttcagtg

SEQ ID NO: 148825 - DNA, 15 bp, Homo sapiens
tccaatgacttcagt

SEQ ID NO: 148826 - DNA, 15 bp, Homo sapiens
atccaatgacttcag

SEQ ID NO: 148827 - DNA, 15 bp, Homo sapiens
tatccaatgacttca

SEQ ID NO: 148828 - DNA, 15 bp, Homo sapiens
ttatccaatgacttc

SEQ ID NO: 148829 - DNA, 15 bp, Homo sapiens
tttatccaatgactt

SEQ ID NO: 148830 - DNA, 15 bp, Homo sapiens
atttatccaatgact

SEQ ID NO: 148831 - DNA, 15 bp, Homo sapiens
aatttatccaatgac

SEQ ID NO: 148832 - DNA, 15 bp, Homo sapiens
taatttatccaatga

SEQ ID NO: 148833 - DNA, 15 bp, Homo sapiens
gtaatttatccaatg

SEQ ID NO: 148834 - DNA, 15 bp, Homo sapiens
ggtaatttatccaat

SEQ ID NO: 148835 - DNA, 15 bp, Homo sapiens
tggtaatttatccaa

SEQ ID NO: 148836 - DNA, 15 bp, Homo sapiens
atggtaatttatcca

SEQ ID NO: 148837 - DNA, 15 bp, Homo sapiens
gatggtaatttatcc

SEQ ID NO: 148838 - DNA, 15 bp, Homo sapiens
tgatggtaatttatc

SEQ ID NO: 148839 - DNA, 15 bp, Homo sapiens
ctgatggtaatttat

SEQ ID NO: 148840 - DNA, 15 bp, Homo sapiens
tctgatggtaattta

SEQ ID NO: 148841 - DNA, 15 bp, Homo sapiens
ttctgatggtaattt

SEQ ID NO: 148842 - DNA, 15 bp, Homo sapiens
cttctgatggtaatt

SEQ ID NO: 148843 - DNA, 15 bp, Homo sapiens
acttctgatggtaat

SEQ ID NO: 148844 - DNA, 15 bp, Homo sapiens
cacttctgatggtaa

SEQ ID NO: 148845 - DNA, 15 bp, Homo sapiens
gcacttctgatggta

SEQ ID NO: 148846 - DNA, 15 bp, Homo sapiens
agcacttctgatggt

SEQ ID NO: 148847 - DNA, 15 bp, Homo sapiens
aagcacttctgatgg

SEQ ID NO: 148848 - DNA, 15 bp, Homo sapiens
aaagcacttctgatg

SEQ ID NO: 148849 - DNA, 15 bp, Homo sapiens
aaaagcacttctgat

SEQ ID NO: 148850 - DNA, 15 bp, Homo sapiens
aaaaagcacttctga

SEQ ID NO: 148851 - DNA, 15 bp, Homo sapiens
caaaaagcacttctg

SEQ ID NO: 148852 - DNA, 15 bp, Homo sapiens
ccaaaaagcacttct

SEQ ID NO: 148853 - DNA, 15 bp, Homo sapiens
cccaaaaagcacttc

SEQ ID NO: 148854 - DNA, 15 bp, Homo sapiens
tcccaaaaagcactt

SEQ ID NO: 148855 - DNA, 15 bp, Homo sapiens
ttcccaaaaagcact

SEQ ID NO: 148856 - DNA, 15 bp, Homo sapiens
cttcccaaaaagcac

SEQ ID NO: 148857 - DNA, 15 bp, Homo sapiens
tcttcccaaaaagca

SEQ ID NO: 148858 - DNA, 15 bp, Homo sapiens
gtcttcccaaaaagc

SEQ ID NO: 148859 - DNA, 15 bp, Homo sapiens
agtcttcccaaaaag

SEQ ID NO: 148860 - DNA, 15 bp, Homo sapiens
aagtcttcccaaaaa

SEQ ID NO: 148861 - DNA, 15 bp, Homo sapiens
gaagtcttcccaaaa

SEQ ID NO: 148862 - DNA, 15 bp, Homo sapiens
agaagtcttcccaaa

SEQ ID NO: 148863 - DNA, 15 bp, Homo sapiens
aagaagtcttcccaa

SEQ ID NO: 148864 - DNA, 15 bp, Homo sapiens
caagaagtcttccca

SEQ ID NO: 148865 - DNA, 15 bp, Homo sapiens
tcaagaagtcttccc

SEQ ID NO: 148866 - DNA, 15 bp, Homo sapiens
atcaagaagtcttcc

SEQ ID NO: 148867 - DNA, 15 bp, Homo sapiens
aatcaagaagtcttc

SEQ ID NO: 148868 - DNA, 15 bp, Homo sapiens
aaatcaagaagtctt

SEQ ID NO: 148869 - DNA, 15 bp, Homo sapiens
taaatcaagaagtct

SEQ ID NO: 148870 - DNA, 15 bp, Homo sapiens
ataaatcaagaagtc

SEQ ID NO: 148871 - DNA, 15 bp, Homo sapiens
tataaatcaagaagt

SEQ ID NO: 148872 - DNA, 15 bp, Homo sapiens
ttataaatcaagaag

SEQ ID NO: 148873 - DNA, 15 bp, Homo sapiens
attataaatcaagaa

SEQ ID NO: 148874 - DNA, 15 bp, Homo sapiens
aattataaatcaaga

SEQ ID NO: 148875 - DNA, 15 bp, Homo sapiens
aaattataaatcaag

SEQ ID NO: 148876 - DNA, 15 bp, Homo sapiens
gaaattataaatcaa

SEQ ID NO: 148877 - DNA, 15 bp, Homo sapiens
ggaaattataaatca

SEQ ID NO: 148878 - DNA, 15 bp, Homo sapiens
aggaaattataaatc

SEQ ID NO: 148879 - DNA, 15 bp, Homo sapiens
taggaaattataaat

SEQ ID NO: 148880 - DNA, 15 bp, Homo sapiens
ttaggaaattataaa

SEQ ID NO: 148881 - DNA, 15 bp, Homo sapiens
tttaggaaattataa

SEQ ID NO: 148882 - DNA, 15 bp, Homo sapiens
ctttaggaaattata

SEQ ID NO: 148883 - DNA, 15 bp, Homo sapiens
tctttaggaaattat

SEQ ID NO: 148884 - DNA, 15 bp, Homo sapiens
atctttaggaaatta

SEQ ID NO: 148885 - DNA, 15 bp, Homo sapiens
tatctttaggaaatt

SEQ ID NO: 148886 - DNA, 15 bp, Homo sapiens
gtatctttaggaaat

SEQ ID NO: 148887 - DNA, 15 bp, Homo sapiens
ggtatctttaggaaa

SEQ ID NO: 148888 - DNA, 15 bp, Homo sapiens
tggtatctttaggaa

SEQ ID NO: 148889 - DNA, 15 bp, Homo sapiens
atggtatctttagga

SEQ ID NO: 148890 - DNA, 15 bp, Homo sapiens
catggtatctttagg

SEQ ID NO: 148891 - DNA, 15 bp, Homo sapiens
tcatggtatctttag

SEQ ID NO: 148892 - DNA, 15 bp, Homo sapiens
ttcatggtatcttta

SEQ ID NO: 148893 - DNA, 15 bp, Homo sapiens
tttcatggtatcttt

SEQ ID NO: 148894 - DNA, 15 bp, Homo sapiens
ttttcatggtatctt

SEQ ID NO: 148895 - DNA, 15 bp, Homo sapiens
attttcatggtatct

SEQ ID NO: 148896 - DNA, 15 bp, Homo sapiens
aattttcatggtatc

SEQ ID NO: 148897 - DNA, 15 bp, Homo sapiens
aaattttcatggtat

SEQ ID NO: 148898 - DNA, 15 bp, Homo sapiens
taaattttcatggta

SEQ ID NO: 148899 - DNA, 15 bp, Homo sapiens
ttaaattttcatggt

SEQ ID NO: 148900 - DNA, 15 bp, Homo sapiens
tttaaattttcatgg

SEQ ID NO: 148901 - DNA, 15 bp, Homo sapiens
atttaaattttcatg

SEQ ID NO: 148902 - DNA, 15 bp, Homo sapiens
catttaaattttcat

SEQ ID NO: 148903 - DNA, 15 bp, Homo sapiens
acatttaaattttca

SEQ ID NO: 148904 - DNA, 15 bp, Homo sapiens
aacatttaaattttc

SEQ ID NO: 148905 - DNA, 15 bp, Homo sapiens
aaacatttaaatttt

SEQ ID NO: 148906 - DNA, 15 bp, Homo sapiens
taaacatttaaattt

SEQ ID NO: 148907 - DNA, 15 bp, Homo sapiens
ctaaacatttaaatt

SEQ ID NO: 148908 - DNA, 15 bp, Homo sapiens
tctaaacatttaaat

SEQ ID NO: 148909 - DNA, 15 bp, Homo sapiens
ttctaaacatttaaa

SEQ ID NO: 148910 - DNA, 15 bp, Homo sapiens
attctaaacatttaa

SEQ ID NO: 148911 - DNA, 15 bp, Homo sapiens
tattctaaacattta

SEQ ID NO: 148912 - DNA, 15 bp, Homo sapiens
ttattctaaacattt

SEQ ID NO: 148913 - DNA, 15 bp, Homo sapiens
tttattctaaacatt

SEQ ID NO: 148914 - DNA, 15 bp, Homo sapiens
atttattctaaacat

SEQ ID NO: 148915 - DNA, 15 bp, Homo sapiens
catttattctaaaca

SEQ ID NO: 148916 - DNA, 15 bp, Homo sapiens
acatttattctaaac

SEQ ID NO: 148917 - DNA, 15 bp, Homo sapiens
aacatttattctaaa

SEQ ID NO: 148918 - DNA, 15 bp, Homo sapiens
taacatttattctaa

SEQ ID NO: 148919 - DNA, 15 bp, Homo sapiens
gtaacatttattcta

SEQ ID NO: 148920 - DNA, 15 bp, Homo sapiens
agtaacatttattct

SEQ ID NO: 148921 - DNA, 15 bp, Homo sapiens
aagtaacatttattc

SEQ ID NO: 148922 - DNA, 15 bp, Homo sapiens
taagtaacatttatt

SEQ ID NO: 148923 - DNA, 15 bp, Homo sapiens
ataagtaacatttat

SEQ ID NO: 148924 - DNA, 15 bp, Homo sapiens
aataagtaacattta

SEQ ID NO: 148925 - DNA, 15 bp, Homo sapiens
aaataagtaacattt

SEQ ID NO: 148926 - DNA, 15 bp, Homo sapiens
gaaataagtaacatt

SEQ ID NO: 148927 - DNA, 15 bp, Homo sapiens
tgaaataagtaacat

SEQ ID NO: 148928 - DNA, 15 bp, Homo sapiens
atgaaataagtaaca

SEQ ID NO: 148929 - DNA, 15 bp, Homo sapiens
aatgaaataagtaac

SEQ ID NO: 148930 - DNA, 15 bp, Homo sapiens
aaatgaaataagtaa

SEQ ID NO: 148931 - DNA, 15 bp, Homo sapiens
taaatgaaataagta

SEQ ID NO: 148932 - DNA, 15 bp, Homo sapiens
ctaaatgaaataagt

SEQ ID NO: 148933 - DNA, 15 bp, Homo sapiens
tctaaatgaaataag

SEQ ID NO: 148934 - DNA, 15 bp, Homo sapiens
ctctaaatgaaataa

SEQ ID NO: 148935 - DNA, 15 bp, Homo sapiens
tctctaaatgaaata

SEQ ID NO: 148936 - DNA, 15 bp, Homo sapiens
ttctctaaatgaaat

SEQ ID NO: 148937 - DNA, 15 bp, Homo sapiens
attctctaaatgaaa

SEQ ID NO: 148938 - DNA, 15 bp, Homo sapiens
aattctctaaatgaa

SEQ ID NO: 148939 - DNA, 15 bp, Homo sapiens
taattctctaaatga

SEQ ID NO: 148940 - DNA, 15 bp, Homo sapiens
ttaattctctaaatg

SEQ ID NO: 148941 - DNA, 15 bp, Homo sapiens
tttaattctctaaat

SEQ ID NO: 148942 - DNA, 15 bp, Homo sapiens
ttttaattctctaaa

SEQ ID NO: 148943 - DNA, 15 bp, Homo sapiens
attttaattctctaa

SEQ ID NO: 148944 - DNA, 15 bp, Homo sapiens
aattttaattctcta

SEQ ID NO: 148945 - DNA, 15 bp, Homo sapiens
aaattttaattctct

SEQ ID NO: 148946 - DNA, 15 bp, Homo sapiens
taaattttaattctc

SEQ ID NO: 148947 - DNA, 15 bp, Homo sapiens
gtaaattttaattct

SEQ ID NO: 148948 - DNA, 15 bp, Homo sapiens
tgtaaattttaattc

SEQ ID NO: 148949 - DNA, 15 bp, Homo sapiens
atgtaaattttaatt

SEQ ID NO: 148950 - DNA, 15 bp, Homo sapiens
aatgtaaattttaat

SEQ ID NO: 148951 - DNA, 15 bp, Homo sapiens
taatgtaaattttaa

SEQ ID NO: 148952 - DNA, 15 bp, Homo sapiens
ataatgtaaatttta

SEQ ID NO: 148953 - DNA, 15 bp, Homo sapiens
aataatgtaaatttt

SEQ ID NO: 148954 - DNA, 15 bp, Homo sapiens
aaataatgtaaattt

SEQ ID NO: 148955 - DNA, 15 bp, Homo sapiens
caaataatgtaaatt

SEQ ID NO: 148956 - DNA, 15 bp, Homo sapiens
gcaaataatgtaaat

SEQ ID NO: 148957 - DNA, 15 bp, Homo sapiens
agcaaataatgtaaa

SEQ ID NO: 148958 - DNA, 15 bp, Homo sapiens
cagcaaataatgtaa

SEQ ID NO: 148959 - DNA, 15 bp, Homo sapiens
acagcaaataatgta

SEQ ID NO: 148960 - DNA, 15 bp, Homo sapiens
aacagcaaataatgt

SEQ ID NO: 148961 - DNA, 15 bp, Homo sapiens
caacagcaaataatg

SEQ ID NO: 148962 - DNA, 15 bp, Homo sapiens
tcaacagcaaataat

SEQ ID NO: 148963 - DNA, 15 bp, Homo sapiens
ttcaacagcaaataa

SEQ ID NO: 148964 - DNA, 15 bp, Homo sapiens
tttcaacagcaaata

SEQ ID NO: 148965 - DNA, 15 bp, Homo sapiens
atttcaacagcaaat

SEQ ID NO: 148966 - DNA, 15 bp, Homo sapiens
tatttcaacagcaaa

SEQ ID NO: 148967 - DNA, 15 bp, Homo sapiens
gtatttcaacagcaa

SEQ ID NO: 148968 - DNA, 15 bp, Homo sapiens
agtatttcaacagca

SEQ ID NO: 148969 - DNA, 15 bp, Homo sapiens
tagtatttcaacagc

SEQ ID NO: 148970 - DNA, 15 bp, Homo sapiens
atagtatttcaacag

SEQ ID NO: 148971 - DNA, 15 bp, Homo sapiens
gatagtatttcaaca

SEQ ID NO: 148972 - DNA, 15 bp, Homo sapiens
agatagtatttcaac

SEQ ID NO: 148973 - DNA, 15 bp, Homo sapiens
aagatagtatttcaa

SEQ ID NO: 148974 - DNA, 15 bp, Homo sapiens
gaagatagtatttca

SEQ ID NO: 148975 - DNA, 15 bp, Homo sapiens
ggaagatagtatttc

SEQ ID NO: 148976 - DNA, 15 bp, Homo sapiens
tggaagatagtattt

SEQ ID NO: 148977 - DNA, 15 bp, Homo sapiens
gtggaagatagtatt

SEQ ID NO: 148978 - DNA, 15 bp, Homo sapiens
cgtggaagatagtat

SEQ ID NO: 148979 - DNA, 15 bp, Homo sapiens
acgtggaagatagta

SEQ ID NO: 148980 - DNA, 15 bp, Homo sapiens
tacgtggaagatagt

SEQ ID NO: 148981 - DNA, 15 bp, Homo sapiens
atacgtggaagatag

SEQ ID NO: 148982 - DNA, 15 bp, Homo sapiens
aatacgtggaagata

SEQ ID NO: 148983 - DNA, 15 bp, Homo sapiens
gaatacgtggaagat

SEQ ID NO: 148984 - DNA, 15 bp, Homo sapiens
agaatacgtggaaga

SEQ ID NO: 148985 - DNA, 15 bp, Homo sapiens
aagaatacgtggaag

SEQ ID NO: 148986 - DNA, 15 bp, Homo sapiens
aaagaatacgtggaa

SEQ ID NO: 148987 - DNA, 15 bp, Homo sapiens
gaaagaatacgtgga

SEQ ID NO: 148988 - DNA, 15 bp, Homo sapiens
ggaaagaatacgtgg

SEQ ID NO: 148989 - DNA, 15 bp, Homo sapiens
gggaaagaatacgtg

SEQ ID NO: 148990 - DNA, 15 bp, Homo sapiens
tgggaaagaatacgt

SEQ ID NO: 148991 - DNA, 15 bp, Homo sapiens
atgggaaagaatacg

SEQ ID NO: 148992 - DNA, 15 bp, Homo sapiens
tatgggaaagaatac

SEQ ID NO: 148993 - DNA, 15 bp, Homo sapiens
atatgggaaagaata

SEQ ID NO: 148994 - DNA, 15 bp, Homo sapiens
catatgggaaagaat

SEQ ID NO: 148995 - DNA, 15 bp, Homo sapiens
gcatatgggaaagaa

SEQ ID NO: 148996 - DNA, 15 bp, Homo sapiens
tgcatatgggaaaga

SEQ ID NO: 148997 - DNA, 15 bp, Homo sapiens
ttgcatatgggaaag

SEQ ID NO: 148998 - DNA, 15 bp, Homo sapiens
tttgcatatgggaaa

SEQ ID NO: 148999 - DNA, 15 bp, Homo sapiens
ttttgcatatgggaa

SEQ ID NO: 149000 - DNA, 15 bp, Homo sapiens
attttgcatatggga

SEQ ID NO: 149001 - DNA, 15 bp, Homo sapiens
aattttgcatatggg

SEQ ID NO: 149002 - DNA, 15 bp, Homo sapiens
taattttgcatatgg

SEQ ID NO: 149003 - DNA, 15 bp, Homo sapiens
ttaattttgcatatg

SEQ ID NO: 149004 - DNA, 15 bp, Homo sapiens
gttaattttgcatat

SEQ ID NO: 149005 - DNA, 15 bp, Homo sapiens
tgttaattttgcata

SEQ ID NO: 149006 - DNA, 15 bp, Homo sapiens
ttgttaattttgcat

SEQ ID NO: 149007 - DNA, 15 bp, Homo sapiens
gttgttaattttgca

SEQ ID NO: 149008 - DNA, 15 bp, Homo sapiens
agttgttaattttgc

SEQ ID NO: 149009 - DNA, 15 bp, Homo sapiens
cagttgttaattttg

SEQ ID NO: 149010 - DNA, 15 bp, Homo sapiens
gcagttgttaatttt

SEQ ID NO: 149011 - DNA, 15 bp, Homo sapiens
ggcagttgttaattt

SEQ ID NO: 149012 - DNA, 15 bp, Homo sapiens
aggcagttgttaatt

SEQ ID NO: 149013 - DNA, 15 bp, Homo sapiens
caggcagttgttaat

SEQ ID NO: 149014 - DNA, 15 bp, Homo sapiens
tcaggcagttgttaa

SEQ ID NO: 149015 - DNA, 15 bp, Homo sapiens
atcaggcagttgtta

SEQ ID NO: 149016 - DNA, 15 bp, Homo sapiens
aatcaggcagttgtt

SEQ ID NO: 149017 - DNA, 15 bp, Homo sapiens
taatcaggcagttgt

SEQ ID NO: 149018 - DNA, 15 bp, Homo sapiens
ttaatcaggcagttg

SEQ ID NO: 149019 - DNA, 15 bp, Homo sapiens
gttaatcaggcagtt

SEQ ID NO: 149020 - DNA, 15 bp, Homo sapiens
cgttaatcaggcagt

SEQ ID NO: 149021 - DNA, 15 bp, Homo sapiens
gcgttaatcaggcag

SEQ ID NO: 149022 - DNA, 15 bp, Homo sapiens
tgcgttaatcaggca

SEQ ID NO: 149023 - DNA, 15 bp, Homo sapiens
ttgcgttaatcaggc

SEQ ID NO: 149024 - DNA, 15 bp, Homo sapiens
attgcgttaatcagg

SEQ ID NO: 149025 - DNA, 15 bp, Homo sapiens
cattgcgttaatcag

SEQ ID NO: 149026 - DNA, 15 bp, Homo sapiens
tcattgcgttaatca

SEQ ID NO: 149027 - DNA, 15 bp, Homo sapiens
ctcattgcgttaatc

SEQ ID NO: 149028 - DNA, 15 bp, Homo sapiens
tctcattgcgttaat

SEQ ID NO: 149029 - DNA, 15 bp, Homo sapiens
ttctcattgcgttaa

SEQ ID NO: 149030 - DNA, 15 bp, Homo sapiens
tttctcattgcgtta

SEQ ID NO: 149031 - DNA, 15 bp, Homo sapiens
atttctcattgcgtt

SEQ ID NO: 149032 - DNA, 15 bp, Homo sapiens
catttctcattgcgt

SEQ ID NO: 149033 - DNA, 15 bp, Homo sapiens
acatttctcattgcg

SEQ ID NO: 149034 - DNA, 15 bp, Homo sapiens
tacatttctcattgc

SEQ ID NO: 149035 - DNA, 15 bp, Homo sapiens
gtacatttctcattg

SEQ ID NO: 149036 - DNA, 15 bp, Homo sapiens
tgtacatttctcatt

SEQ ID NO: 149037 - DNA, 15 bp, Homo sapiens
ttgtacatttctcat

SEQ ID NO: 149038 - DNA, 15 bp, Homo sapiens
attgtacatttctca

SEQ ID NO: 149039 - DNA, 15 bp, Homo sapiens
aattgtacatttctc

SEQ ID NO: 149040 - DNA, 15 bp, Homo sapiens
gaattgtacatttct

SEQ ID NO: 149041 - DNA, 15 bp, Homo sapiens
ggaattgtacatttc

SEQ ID NO: 149042 - DNA, 15 bp, Homo sapiens
tggaattgtacattt

SEQ ID NO: 149043 - DNA, 15 bp, Homo sapiens
ctggaattgtacatt

SEQ ID NO: 149044 - DNA, 15 bp, Homo sapiens
actggaattgtacat

SEQ ID NO: 149045 - DNA, 15 bp, Homo sapiens
tactggaattgtaca

SEQ ID NO: 149046 - DNA, 15 bp, Homo sapiens
gtactggaattgtac

SEQ ID NO: 149047 - DNA, 15 bp, Homo sapiens
tgtactggaattgta

SEQ ID NO: 149048 - DNA, 15 bp, Homo sapiens
atgtactggaattgt

SEQ ID NO: 149049 - DNA, 15 bp, Homo sapiens
aatgtactggaattg

SEQ ID NO: 149050 - DNA, 15 bp, Homo sapiens
caatgtactggaatt

SEQ ID NO: 149051 - DNA, 15 bp, Homo sapiens
gcaatgtactggaat

SEQ ID NO: 149052 - DNA, 15 bp, Homo sapiens
tgcaatgtactggaa

SEQ ID NO: 149053 - DNA, 15 bp, Homo sapiens
ctgcaatgtactgga

SEQ ID NO: 149054 - DNA, 15 bp, Homo sapiens
gctgcaatgtactgg

SEQ ID NO: 149055 - DNA, 15 bp, Homo sapiens
tgctgcaatgtactg

SEQ ID NO: 149056 - DNA, 15 bp, Homo sapiens
ctgctgcaatgtact

SEQ ID NO: 149057 - DNA, 15 bp, Homo sapiens
cctgctgcaatgtac

SEQ ID NO: 149058 - DNA, 15 bp, Homo sapiens
acctgctgcaatgta

SEQ ID NO: 149059 - DNA, 15 bp, Homo sapiens
cacctgctgcaatgt

SEQ ID NO: 149060 - DNA, 15 bp, Homo sapiens
acacctgctgcaatg

SEQ ID NO: 149061 - DNA, 15 bp, Homo sapiens
gacacctgctgcaat

SEQ ID NO: 149062 - DNA, 15 bp, Homo sapiens
tgacacctgctgcaa

SEQ ID NO: 149063 - DNA, 15 bp, Homo sapiens
ctgacacctgctgca

SEQ ID NO: 149064 - DNA, 15 bp, Homo sapiens
actgacacctgctgc

SEQ ID NO: 149065 - DNA, 15 bp, Homo sapiens
tactgacacctgctg

SEQ ID NO: 149066 - DNA, 15 bp, Homo sapiens
atactgacacctgct

SEQ ID NO: 149067 - DNA, 15 bp, Homo sapiens
tatactgacacctgc

SEQ ID NO: 149068 - DNA, 15 bp, Homo sapiens
ttatactgacacctg

SEQ ID NO: 149069 - DNA, 15 bp, Homo sapiens
cttatactgacacct

SEQ ID NO: 149070 - DNA, 15 bp, Homo sapiens
ccttatactgacacc

SEQ ID NO: 149071 - DNA, 15 bp, Homo sapiens
gccttatactgacac

SEQ ID NO: 149072 - DNA, 15 bp, Homo sapiens
tgccttatactgaca

SEQ ID NO: 149073 - DNA, 15 bp, Homo sapiens
ctgccttatactgac

SEQ ID NO: 149074 - DNA, 15 bp, Homo sapiens
actgccttatactga

SEQ ID NO: 149075 - DNA, 15 bp, Homo sapiens
cactgccttatactg

SEQ ID NO: 149076 - DNA, 15 bp, Homo sapiens
tcactgccttatact

SEQ ID NO: 149077 - DNA, 15 bp, Homo sapiens
gtcactgccttatac

SEQ ID NO: 149078 - DNA, 15 bp, Homo sapiens
tgtcactgccttata

SEQ ID NO: 149079 - DNA, 15 bp, Homo sapiens
atgtcactgccttat

SEQ ID NO: 149080 - DNA, 15 bp, Homo sapiens
tatgtcactgcctta

SEQ ID NO: 149081 - DNA, 15 bp, Homo sapiens
ctatgtcactgcctt

SEQ ID NO: 149082 - DNA, 15 bp, Homo sapiens
cctatgtcactgcct

SEQ ID NO: 149083 - DNA, 15 bp, Homo sapiens
tcctatgtcactgcc

SEQ ID NO: 149084 - DNA, 15 bp, Homo sapiens
ctcctatgtcactgc

SEQ ID NO: 149085 - DNA, 15 bp, Homo sapiens
tctcctatgtcactg

SEQ ID NO: 149086 - DNA, 15 bp, Homo sapiens
atctcctatgtcact

SEQ ID NO: 149087 - DNA, 15 bp, Homo sapiens
aatctcctatgtcac

SEQ ID NO: 149088 - DNA, 15 bp, Homo sapiens
aaatctcctatgtca

SEQ ID NO: 149089 - DNA, 15 bp, Homo sapiens
aaaatctcctatgtc

SEQ ID NO: 149090 - DNA, 15 bp, Homo sapiens
caaaatctcctatgt

SEQ ID NO: 149091 - DNA, 15 bp, Homo sapiens
gcaaaatctcctatg

SEQ ID NO: 149092 - DNA, 15 bp, Homo sapiens
ggcaaaatctcctat

SEQ ID NO: 149093 - DNA, 15 bp, Homo sapiens
aggcaaaatctccta

SEQ ID NO: 149094 - DNA, 15 bp, Homo sapiens
taggcaaaatctcct

SEQ ID NO: 149095 - DNA, 15 bp, Homo sapiens
ttaggcaaaatctcc

SEQ ID NO: 149096 - DNA, 15 bp, Homo sapiens
tttaggcaaaatctc

SEQ ID NO: 149097 - DNA, 15 bp, Homo sapiens
ctttaggcaaaatct

SEQ ID NO: 149098 - DNA, 15 bp, Homo sapiens
tctttaggcaaaatc

SEQ ID NO: 149099 - DNA, 15 bp, Homo sapiens
ttctttaggcaaaat

SEQ ID NO: 149100 - DNA, 15 bp, Homo sapiens
gttctttaggcaaaa

SEQ ID NO: 149101 - DNA, 15 bp, Homo sapiens
agttctttaggcaaa

SEQ ID NO: 149102 - DNA, 15 bp, Homo sapiens
cagttctttaggcaa

SEQ ID NO: 149103 - DNA, 15 bp, Homo sapiens
ccagttctttaggca

SEQ ID NO: 149104 - DNA, 15 bp, Homo sapiens
tccagttctttaggc

SEQ ID NO: 149105 - DNA, 15 bp, Homo sapiens
ttccagttctttagg

SEQ ID NO: 149106 - DNA, 15 bp, Homo sapiens
tttccagttctttag

SEQ ID NO: 149107 - DNA, 15 bp, Homo sapiens
atttccagttcttta

SEQ ID NO: 149108 - DNA, 15 bp, Homo sapiens
gatttccagttcttt

SEQ ID NO: 149109 - DNA, 15 bp, Homo sapiens
ggatttccagttctt

SEQ ID NO: 149110 - DNA, 15 bp, Homo sapiens
tggatttccagttct

SEQ ID NO: 149111 - DNA, 15 bp, Homo sapiens
ctggatttccagttc

SEQ ID NO: 149112 - DNA, 15 bp, Homo sapiens
tctggatttccagtt

SEQ ID NO: 149113 - DNA, 15 bp, Homo sapiens
atctggatttccagt

SEQ ID NO: 149114 - DNA, 15 bp, Homo sapiens
aatctggatttccag

SEQ ID NO: 149115 - DNA, 15 bp, Homo sapiens
taatctggatttcca

SEQ ID NO: 149116 - DNA, 15 bp, Homo sapiens
ctaatctggatttcc

SEQ ID NO: 149117 - DNA, 15 bp, Homo sapiens
cctaatctggatttc

SEQ ID NO: 149118 - DNA, 15 bp, Homo sapiens
tcctaatctggattt

SEQ ID NO: 149119 - DNA, 15 bp, Homo sapiens
ttcctaatctggatt

SEQ ID NO: 149120 - DNA, 15 bp, Homo sapiens
cttcctaatctggat

SEQ ID NO: 149121 - DNA, 15 bp, Homo sapiens
gcttcctaatctgga

SEQ ID NO: 149122 - DNA, 15 bp, Homo sapiens
cgcttcctaatctgg

SEQ ID NO: 149123 - DNA, 15 bp, Homo sapiens
ccgcttcctaatctg

SEQ ID NO: 149124 - DNA, 15 bp, Homo sapiens
gccgcttcctaatct

SEQ ID NO: 149125 - DNA, 15 bp, Homo sapiens
tgccgcttcctaatc

SEQ ID NO: 149126 - DNA, 15 bp, Homo sapiens
gtgccgcttcctaat

SEQ ID NO: 149127 - DNA, 15 bp, Homo sapiens
tgtgccgcttcctaa

SEQ ID NO: 149128 - DNA, 15 bp, Homo sapiens
ttgtgccgcttccta

SEQ ID NO: 149129 - DNA, 15 bp, Homo sapiens
attgtgccgcttcct

SEQ ID NO: 149130 - DNA, 15 bp, Homo sapiens
aattgtgccgcttcc

SEQ ID NO: 149131 - DNA, 15 bp, Homo sapiens
taattgtgccgcttc

SEQ ID NO: 149132 - DNA, 15 bp, Homo sapiens
gtaattgtgccgctt

SEQ ID NO: 149133 - DNA, 15 bp, Homo sapiens
agtaattgtgccgct

SEQ ID NO: 149134 - DNA, 15 bp, Homo sapiens
tagtaattgtgccgc

SEQ ID NO: 149135 - DNA, 15 bp, Homo sapiens
atagtaattgtgccg

SEQ ID NO: 149136 - DNA, 15 bp, Homo sapiens
catagtaattgtgcc

SEQ ID NO: 149137 - DNA, 15 bp, Homo sapiens
tcatagtaattgtgc

SEQ ID NO: 149138 - DNA, 15 bp, Homo sapiens
ttcatagtaattgtg

SEQ ID NO: 149139 - DNA, 15 bp, Homo sapiens
tttcatagtaattgt

SEQ ID NO: 149140 - DNA, 15 bp, Homo sapiens
atttcatagtaattg

SEQ ID NO: 149141 - DNA, 15 bp, Homo sapiens
tatttcatagtaatt

SEQ ID NO: 149142 - DNA, 15 bp, Homo sapiens
ttatttcatagtaat

SEQ ID NO: 149143 - DNA, 15 bp, Homo sapiens
tttatttcatagtaa

SEQ ID NO: 149144 - DNA, 15 bp, Homo sapiens
atttatttcatagta

SEQ ID NO: 149145 - DNA, 15 bp, Homo sapiens
tatttatttcatagt

SEQ ID NO: 149146 - DNA, 15 bp, Homo sapiens
ttatttatttcatag

SEQ ID NO: 149147 - DNA, 15 bp, Homo sapiens
tttatttatttcata

SEQ ID NO: 149148 - DNA, 15 bp, Homo sapiens
gtttatttatttcat

SEQ ID NO: 149149 - DNA, 15 bp, Homo sapiens
agtttatttatttca

SEQ ID NO: 149150 - DNA, 15 bp, Homo sapiens
tagtttatttatttc

SEQ ID NO: 149151 - DNA, 15 bp, Homo sapiens
ctagtttatttattt

SEQ ID NO: 149152 - DNA, 15 bp, Homo sapiens
actagtttatttatt

SEQ ID NO: 149153 - DNA, 15 bp, Homo sapiens
tactagtttatttat

SEQ ID NO: 149154 - DNA, 15 bp, Homo sapiens
ttactagtttattta

SEQ ID NO: 149155 - DNA, 15 bp, Homo sapiens
gttactagtttattt

SEQ ID NO: 149156 - DNA, 15 bp, Homo sapiens
tgttactagtttatt

SEQ ID NO: 149157 - DNA, 15 bp, Homo sapiens
ctgttactagtttat

SEQ ID NO: 149158 - DNA, 15 bp, Homo sapiens
tctgttactagttta

SEQ ID NO: 149159 - DNA, 15 bp, Homo sapiens
atctgttactagttt

SEQ ID NO: 149160 - DNA, 15 bp, Homo sapiens
tatctgttactagtt

SEQ ID NO: 149161 - DNA, 15 bp, Homo sapiens
ttatctgttactagt

SEQ ID NO: 149162 - DNA, 15 bp, Homo sapiens
tttatctgttactag

SEQ ID NO: 149163 - DNA, 15 bp, Homo sapiens
atttatctgttacta

SEQ ID NO: 149164 - DNA, 15 bp, Homo sapiens
aatttatctgttact

SEQ ID NO: 149165 - DNA, 15 bp, Homo sapiens
aaatttatctgttac

SEQ ID NO: 149166 - DNA, 15 bp, Homo sapiens
aaaatttatctgtta

SEQ ID NO: 149167 - DNA, 15 bp, Homo sapiens
taaaatttatctgtt

SEQ ID NO: 149168 - DNA, 15 bp, Homo sapiens
ataaaatttatctgt

SEQ ID NO: 149169 - DNA, 15 bp, Homo sapiens
aataaaatttatctg

SEQ ID NO: 149170 - DNA, 15 bp, Homo sapiens
aaataaaatttatct

SEQ ID NO: 149171 - DNA, 15 bp, Homo sapiens
caaataaaatttatc

SEQ ID NO: 149172 - DNA, 15 bp, Homo sapiens
acaaataaaatttat

SEQ ID NO: 149173 - DNA, 15 bp, Homo sapiens
cacaaataaaattta

SEQ ID NO: 149174 - DNA, 15 bp, Homo sapiens
acacaaataaaattt

SEQ ID NO: 149175 - DNA, 15 bp, Homo sapiens
cacacaaataaaatt

SEQ ID NO: 149176 - DNA, 15 bp, Homo sapiens
ccacacaaataaaat

SEQ ID NO: 149177 - DNA, 15 bp, Homo sapiens
accacacaaataaaa

SEQ ID NO: 149178 - DNA, 15 bp, Homo sapiens
aaccacacaaataaa

SEQ ID NO: 149179 - DNA, 15 bp, Homo sapiens
taaccacacaaataa

SEQ ID NO: 149180 - DNA, 15 bp, Homo sapiens
ataaccacacaaata

SEQ ID NO: 149181 - DNA, 15 bp, Homo sapiens
tataaccacacaaat

SEQ ID NO: 149182 - DNA, 15 bp, Homo sapiens
atataaccacacaaa

SEQ ID NO: 149183 - DNA, 15 bp, Homo sapiens
aatataaccacacaa

SEQ ID NO: 149184 - DNA, 15 bp, Homo sapiens
aaatataaccacaca

SEQ ID NO: 149185 - DNA, 15 bp, Homo sapiens
aaaatataaccacac

SEQ ID NO: 149186 - DNA, 15 bp, Homo sapiens
caaaatataaccaca

SEQ ID NO: 149187 - DNA, 15 bp, Homo sapiens
tcaaaatataaccac

SEQ ID NO: 149188 - DNA, 15 bp, Homo sapiens
ttcaaaatataacca

SEQ ID NO: 149189 - DNA, 15 bp, Homo sapiens
tttcaaaatataacc

SEQ ID NO: 149190 - DNA, 15 bp, Homo sapiens
ttttcaaaatataac

SEQ ID NO: 149191 - DNA, 15 bp, Homo sapiens
gttttcaaaatataa

SEQ ID NO: 149192 - DNA, 15 bp, Homo sapiens
agttttcaaaatata

SEQ ID NO: 149193 - DNA, 15 bp, Homo sapiens
cagttttcaaaatat

SEQ ID NO: 149194 - DNA, 15 bp, Homo sapiens
tcagttttcaaaata

SEQ ID NO: 149195 - DNA, 15 bp, Homo sapiens
atcagttttcaaaat

SEQ ID NO: 149196 - DNA, 15 bp, Homo sapiens
gatcagttttcaaaa

SEQ ID NO: 149197 - DNA, 15 bp, Homo sapiens
agatcagttttcaaa

SEQ ID NO: 149198 - DNA, 15 bp, Homo sapiens
tagatcagttttcaa

SEQ ID NO: 149199 - DNA, 15 bp, Homo sapiens
ttagatcagttttca

SEQ ID NO: 149200 - DNA, 15 bp, Homo sapiens
cttagatcagttttc

SEQ ID NO: 149201 - DNA, 15 bp, Homo sapiens
acttagatcagtttt

SEQ ID NO: 149202 - DNA, 15 bp, Homo sapiens
aacttagatcagttt

SEQ ID NO: 149203 - DNA, 15 bp, Homo sapiens
taacttagatcagtt

SEQ ID NO: 149204 - DNA, 15 bp, Homo sapiens
ataacttagatcagt

SEQ ID NO: 149205 - DNA, 15 bp, Homo sapiens
aataacttagatcag

SEQ ID NO: 149206 - DNA, 15 bp, Homo sapiens
caataacttagatca

SEQ ID NO: 149207 - DNA, 15 bp, Homo sapiens
tcaataacttagatc

SEQ ID NO: 149208 - DNA, 15 bp, Homo sapiens
ctcaataacttagat

SEQ ID NO: 149209 - DNA, 15 bp, Homo sapiens
gctcaataacttaga

SEQ ID NO: 149210 - DNA, 15 bp, Homo sapiens
agctcaataacttag

SEQ ID NO: 149211 - DNA, 15 bp, Homo sapiens
tagctcaataactta

SEQ ID NO: 149212 - DNA, 15 bp, Homo sapiens
atagctcaataactt

SEQ ID NO: 149213 - DNA, 15 bp, Homo sapiens
tatagctcaataact

SEQ ID NO: 149214 - DNA, 15 bp, Homo sapiens
atatagctcaataac

SEQ ID NO: 149215 - DNA, 15 bp, Homo sapiens
aatatagctcaataa

SEQ ID NO: 149216 - DNA, 15 bp, Homo sapiens
taatatagctcaata

SEQ ID NO: 149217 - DNA, 15 bp, Homo sapiens
ttaatatagctcaat

SEQ ID NO: 149218 - DNA, 15 bp, Homo sapiens
attaatatagctcaa

SEQ ID NO: 149219 - DNA, 15 bp, Homo sapiens
cattaatatagctca

SEQ ID NO: 149220 - DNA, 15 bp, Homo sapiens
acattaatatagctc

SEQ ID NO: 149221 - DNA, 15 bp, Homo sapiens
tacattaatatagct

SEQ ID NO: 149222 - DNA, 15 bp, Homo sapiens
ttacattaatatagc

SEQ ID NO: 149223 - DNA, 15 bp, Homo sapiens
attacattaatatag

SEQ ID NO: 149224 - DNA, 15 bp, Homo sapiens
cattacattaatata

SEQ ID NO: 149225 - DNA, 15 bp, Homo sapiens
tcattacattaatat

SEQ ID NO: 149226 - DNA, 15 bp, Homo sapiens
ttcattacattaata

SEQ ID NO: 149227 - DNA, 15 bp, Homo sapiens
tttcattacattaat

SEQ ID NO: 149228 - DNA, 15 bp, Homo sapiens
atttcattacattaa

SEQ ID NO: 149229 - DNA, 15 bp, Homo sapiens
catttcattacatta

SEQ ID NO: 149230 - DNA, 15 bp, Homo sapiens
tcatttcattacatt

SEQ ID NO: 149231 - DNA, 15 bp, Homo sapiens
ttcatttcattacat

SEQ ID NO: 149232 - DNA, 15 bp, Homo sapiens
tttcatttcattaca

SEQ ID NO: 149233 - DNA, 15 bp, Homo sapiens
ttttcatttcattac

SEQ ID NO: 149234 - DNA, 15 bp, Homo sapiens
attttcatttcatta

SEQ ID NO: 149235 - DNA, 15 bp, Homo sapiens
aattttcatttcatt

SEQ ID NO: 149236 - DNA, 15 bp, Homo sapiens
aaattttcatttcat

SEQ ID NO: 149237 - DNA, 15 bp, Homo sapiens
taaattttcatttca

SEQ ID NO: 149238 - DNA, 15 bp, Homo sapiens
ctaaattttcatttc

SEQ ID NO: 149239 - DNA, 15 bp, Homo sapiens
actaaattttcattt

SEQ ID NO: 149240 - DNA, 15 bp, Homo sapiens
aactaaattttcatt

SEQ ID NO: 149241 - DNA, 15 bp, Homo sapiens
caactaaattttcat

SEQ ID NO: 149242 - DNA, 15 bp, Homo sapiens
tacaactaaattttc

SEQ ID NO: 149243 - DNA, 15 bp, Homo sapiens
ctacaactaaatttt

SEQ ID NO: 149244 - DNA, 15 bp, Homo sapiens
tctacaactaaattt

SEQ ID NO: 149245 - DNA, 15 bp, Homo sapiens
gtctacaactaaatt

SEQ ID NO: 149246 - DNA, 15 bp, Homo sapiens
agtctacaactaaat

SEQ ID NO: 149247 - DNA, 15 bp, Homo sapiens
aagtctacaactaaa

SEQ ID NO: 149248 - DNA, 15 bp, Homo sapiens
taagtctacaactaa

SEQ ID NO: 149249 - DNA, 15 bp, Homo sapiens
ttaagtctacaacta

SEQ ID NO: 149250 - DNA, 15 bp, Homo sapiens
tttaagtctacaact

SEQ ID NO: 149251 - DNA, 15 bp, Homo sapiens
atttaagtctacaac

SEQ ID NO: 149252 - DNA, 15 bp, Homo sapiens
tatttaagtctacaa

SEQ ID NO: 149253 - DNA, 15 bp, Homo sapiens
atatttaagtctaca

SEQ ID NO: 149254 - DNA, 15 bp, Homo sapiens
aatatttaagtctac

SEQ ID NO: 149255 - DNA, 15 bp, Homo sapiens
taatatttaagtcta

SEQ ID NO: 149256 - DNA, 15 bp, Homo sapiens
ttaatatttaagtct

SEQ ID NO: 149257 - DNA, 15 bp, Homo sapiens
gttaatatttaagtc

SEQ ID NO: 149258 - DNA, 15 bp, Homo sapiens
tgttaatatttaagt

SEQ ID NO: 149259 - DNA, 15 bp, Homo sapiens
ctgttaatatttaag

SEQ ID NO: 149260 - DNA, 15 bp, Homo sapiens
actgttaatatttaa

SEQ ID NO: 149261 - DNA, 15 bp, Homo sapiens
aactgttaatattta

SEQ ID NO: 149262 - DNA, 15 bp, Homo sapiens
caactgttaatattt

SEQ ID NO: 149263 - DNA, 15 bp, Homo sapiens
gcaactgttaatatt

SEQ ID NO: 149264 - DNA, 15 bp, Homo sapiens
ggcaactgttaatat

SEQ ID NO: 149265 - DNA, 15 bp, Homo sapiens
tggcaactgttaata

SEQ ID NO: 149266 - DNA, 15 bp, Homo sapiens
atggcaactgttaat

SEQ ID NO: 149267 - DNA, 15 bp, Homo sapiens
gatggcaactgttaa

SEQ ID NO: 149268 - DNA, 15 bp, Homo sapiens
agatggcaactgtta

SEQ ID NO: 149269 - DNA, 15 bp, Homo sapiens
gagatggcaactgtt

SEQ ID NO: 149270 - DNA, 15 bp, Homo sapiens
tgagatggcaactgt

SEQ ID NO: 149271 - DNA, 15 bp, Homo sapiens
ttgagatggcaactg

SEQ ID NO: 149272 - DNA, 15 bp, Homo sapiens
tttgagatggcaact

SEQ ID NO: 149273 - DNA, 15 bp, Homo sapiens
atttgagatggcaac

SEQ ID NO: 149274 - DNA, 15 bp, Homo sapiens
tatttgagatggcaa

SEQ ID NO: 149275 - DNA, 15 bp, Homo sapiens
atatttgagatggca

SEQ ID NO: 149276 - DNA, 15 bp, Homo sapiens
aatatttgagatggc

SEQ ID NO: 149277 - DNA, 15 bp, Homo sapiens
caatatttgagatgg

SEQ ID NO: 149278 - DNA, 15 bp, Homo sapiens
tcaatatttgagatg

SEQ ID NO: 149279 - DNA, 15 bp, Homo sapiens
atcaatatttgagat

SEQ ID NO: 149280 - DNA, 15 bp, Homo sapiens
tatcaatatttgaga

SEQ ID NO: 149281 - DNA, 15 bp, Homo sapiens
ctatcaatatttgag

SEQ ID NO: 149282 - DNA, 15 bp, Homo sapiens
tctatcaatatttga

SEQ ID NO: 149283 - DNA, 15 bp, Homo sapiens
ctctatcaatatttg

SEQ ID NO: 149284 - DNA, 15 bp, Homo sapiens
cctctatcaatattt

SEQ ID NO: 149285 - DNA, 15 bp, Homo sapiens
acctctatcaatatt

SEQ ID NO: 149286 - DNA, 15 bp, Homo sapiens
tacctctatcaatat

SEQ ID NO: 149287 - DNA, 15 bp, Homo sapiens
ctacctctatcaata

SEQ ID NO: 149288 - DNA, 15 bp, Homo sapiens
gctacctctatcaat

SEQ ID NO: 149289 - DNA, 15 bp, Homo sapiens
agctacctctatcaa

SEQ ID NO: 149290 - DNA, 15 bp, Homo sapiens
tagctacctctatca

SEQ ID NO: 149291 - DNA, 15 bp, Homo sapiens
atagctacctctatc

SEQ ID NO: 149292 - DNA, 15 bp, Homo sapiens
tatagctacctctat

SEQ ID NO: 149293 - DNA, 15 bp, Homo sapiens
gtatagctacctcta

SEQ ID NO: 149294 - DNA, 15 bp, Homo sapiens
ggtatagctacctct

SEQ ID NO: 149295 - DNA, 15 bp, Homo sapiens
tggtatagctacctc

SEQ ID NO: 149296 - DNA, 15 bp, Homo sapiens
ttggtatagctacct

SEQ ID NO: 149297 - DNA, 15 bp, Homo sapiens
gttggtatagctacc

SEQ ID NO: 149298 - DNA, 15 bp, Homo sapiens
ggttggtatagctac

SEQ ID NO: 149299 - DNA, 15 bp, Homo sapiens
tggttggtatagcta

SEQ ID NO: 149300 - DNA, 15 bp, Homo sapiens
ttggttggtatagct

SEQ ID NO: 149301 - DNA, 15 bp, Homo sapiens
tttggttggtatagc

SEQ ID NO: 149302 - DNA, 15 bp, Homo sapiens
ttttggttggtatag

SEQ ID NO: 149303 - DNA, 15 bp, Homo sapiens
tttttggttggtata

SEQ ID NO: 149304 - DNA, 15 bp, Homo sapiens
atttttggttggtat

SEQ ID NO: 149305 - DNA, 15 bp, Homo sapiens
tatttttggttggta

SEQ ID NO: 149306 - DNA, 15 bp, Homo sapiens
gtatttttggttggt

SEQ ID NO: 149307 - DNA, 15 bp, Homo sapiens
agtatttttggttgg

SEQ ID NO: 149308 - DNA, 15 bp, Homo sapiens
aagtatttttggttg

SEQ ID NO: 149309 - DNA, 15 bp, Homo sapiens
taagtatttttggtt

SEQ ID NO: 149310 - DNA, 15 bp, Homo sapiens
ttaagtatttttggt

SEQ ID NO: 149311 - DNA, 15 bp, Homo sapiens
attaagtatttttgg

SEQ ID NO: 149312 - DNA, 15 bp, Homo sapiens
aattaagtatttttg

SEQ ID NO: 149313 - DNA, 15 bp, Homo sapiens
caattaagtattttt

SEQ ID NO: 149314 - DNA, 15 bp, Homo sapiens
acaattaagtatttt

SEQ ID NO: 149315 - DNA, 15 bp, Homo sapiens
tacaattaagtattt

SEQ ID NO: 149316 - DNA, 15 bp, Homo sapiens
atacaattaagtatt

SEQ ID NO: 149317 - DNA, 15 bp, Homo sapiens
aatacaattaagtat

SEQ ID NO: 149318 - DNA, 15 bp, Homo sapiens
aaatacaattaagta

SEQ ID NO: 149319 - DNA, 15 bp, Homo sapiens
aaaatacaattaagt

SEQ ID NO: 149320 - DNA, 15 bp, Homo sapiens
taaaatacaattaag

SEQ ID NO: 149321 - DNA, 15 bp, Homo sapiens
ttaaaatacaattaa

SEQ ID NO: 149322 - DNA, 15 bp, Homo sapiens
attaaaatacaatta

SEQ ID NO: 149323 - DNA, 15 bp, Homo sapiens
aattaaaatacaatt

SEQ ID NO: 149324 - DNA, 15 bp, Homo sapiens
taattaaaatacaat

SEQ ID NO: 149325 - DNA, 15 bp, Homo sapiens
ataattaaaatacaa

SEQ ID NO: 149326 - DNA, 15 bp, Homo sapiens
gataattaaaataca

SEQ ID NO: 149327 - DNA, 15 bp, Homo sapiens
tgataattaaaatac

SEQ ID NO: 149328 - DNA, 15 bp, Homo sapiens
ttgataattaaaata

SEQ ID NO: 149329 - DNA, 15 bp, Homo sapiens
attgataattaaaat

SEQ ID NO: 149330 - DNA, 15 bp, Homo sapiens
tattgataattaaaa

SEQ ID NO: 149331 - DNA, 15 bp, Homo sapiens
ctattgataattaaa

SEQ ID NO: 149332 - DNA, 15 bp, Homo sapiens
actattgataattaa

SEQ ID NO: 149333 - DNA, 15 bp, Homo sapiens
gactattgataatta

SEQ ID NO: 149334 - DNA, 15 bp, Homo sapiens
ggactattgataatt

SEQ ID NO: 149335 - DNA, 15 bp, Homo sapiens
tggactattgataat

SEQ ID NO: 149336 - DNA, 15 bp, Homo sapiens
atggactattgataa

SEQ ID NO: 149337 - DNA, 15 bp, Homo sapiens
catggactattgata

SEQ ID NO: 149338 - DNA, 15 bp, Homo sapiens
acatggactattgat

SEQ ID NO: 149339 - DNA, 15 bp, Homo sapiens
cacatggactattga

SEQ ID NO: 149340 - DNA, 15 bp, Homo sapiens
acacatggactattg

SEQ ID NO: 149341 - DNA, 15 bp, Homo sapiens
gacacatggactatt

SEQ ID NO: 149342 - DNA, 15 bp, Homo sapiens
tgacacatggactat

SEQ ID NO: 149343 - DNA, 15 bp, Homo sapiens
atgacacatggacta

SEQ ID NO: 149344 - DNA, 15 bp, Homo sapiens
tatgacacatggact

SEQ ID NO: 149345 - DNA, 15 bp, Homo sapiens
gtatgacacatggac

SEQ ID NO: 149346 - DNA, 15 bp, Homo sapiens
ggtatgacacatgga

SEQ ID NO: 149347 - DNA, 15 bp, Homo sapiens
aggtatgacacatgg

SEQ ID NO: 149348 - DNA, 15 bp, Homo sapiens
taggtatgacacatg

SEQ ID NO: 149349 - DNA, 15 bp, Homo sapiens
ttaggtatgacacat

SEQ ID NO: 149350 - DNA, 15 bp, Homo sapiens
tttaggtatgacaca

SEQ ID NO: 149351 - DNA, 15 bp, Homo sapiens
ttttaggtatgacac

SEQ ID NO: 149352 - DNA, 15 bp, Homo sapiens
cttttaggtatgaca

SEQ ID NO: 149353 - DNA, 15 bp, Homo sapiens
acttttaggtatgac

SEQ ID NO: 149354 - DNA, 15 bp, Homo sapiens
aacttttaggtatga

SEQ ID NO: 149355 - DNA, 15 bp, Homo sapiens
aaacttttaggtatg

SEQ ID NO: 149356 - DNA, 15 bp, Homo sapiens
taaacttttaggtat

SEQ ID NO: 149357 - DNA, 15 bp, Homo sapiens
ttaaacttttaggta

SEQ ID NO: 149358 - DNA, 15 bp, Homo sapiens
tttaaacttttaggt

SEQ ID NO: 149359 - DNA, 15 bp, Homo sapiens
atttaaacttttagg

SEQ ID NO: 149360 - DNA, 15 bp, Homo sapiens
catttaaacttttag

SEQ ID NO: 149361 - DNA, 15 bp, Homo sapiens
ccatttaaactttta

SEQ ID NO: 149362 - DNA, 15 bp, Homo sapiens
cccatttaaactttt

SEQ ID NO: 149363 - DNA, 15 bp, Homo sapiens
acccatttaaacttt

SEQ ID NO: 149364 - DNA, 15 bp, Homo sapiens
aacccatttaaactt

SEQ ID NO: 149365 - DNA, 15 bp, Homo sapiens
aaacccatttaaact

SEQ ID NO: 149366 - DNA, 15 bp, Homo sapiens
caaacccatttaaac

SEQ ID NO: 149367 - DNA, 15 bp, Homo sapiens
tcaaacccatttaaa

SEQ ID NO: 149368 - DNA, 15 bp, Homo sapiens
gtcaaacccatttaa

SEQ ID NO: 149369 - DNA, 15 bp, Homo sapiens
tgtcaaacccattta

SEQ ID NO: 149370 - DNA, 15 bp, Homo sapiens
atgtcaaacccattt

SEQ ID NO: 149371 - DNA, 15 bp, Homo sapiens
aatgtcaaacccatt

SEQ ID NO: 149372 - DNA, 15 bp, Homo sapiens
aaatgtcaaacccat

SEQ ID NO: 149373 - DNA, 15 bp, Homo sapiens
taaatgtcaaaccca

SEQ ID NO: 149374 - DNA, 15 bp, Homo sapiens
ataaatgtcaaaccc

SEQ ID NO: 149375 - DNA, 15 bp, Homo sapiens
aataaatgtcaaacc

SEQ ID NO: 149376 - DNA, 15 bp, Homo sapiens
aaataaatgtcaaac

SEQ ID NO: 149377 - DNA, 15 bp, Homo sapiens
caaataaatgtcaaa

SEQ ID NO: 149378 - DNA, 15 bp, Homo sapiens
gcaaataaatgtcaa

SEQ ID NO: 149379 - DNA, 15 bp, Homo sapiens
agcaaataaatgtca

SEQ ID NO: 149380 - DNA, 15 bp, Homo sapiens
aagcaaataaatgtc

SEQ ID NO: 149381 - DNA, 15 bp, Homo sapiens
aaagcaaataaatgt

SEQ ID NO: 149382 - DNA, 15 bp, Homo sapiens
taaagcaaataaatg

SEQ ID NO: 149383 - DNA, 15 bp, Homo sapiens
ttaaagcaaataaat

SEQ ID NO: 149384 - DNA, 15 bp, Homo sapiens
cttaaagcaaataaa

SEQ ID NO: 149385 - DNA, 15 bp, Homo sapiens
tcttaaagcaaataa

SEQ ID NO: 149386 - DNA, 15 bp, Homo sapiens
gtcttaaagcaaata

SEQ ID NO: 149387 - DNA, 15 bp, Homo sapiens
tgtcttaaagcaaat

SEQ ID NO: 149388 - DNA, 15 bp, Homo sapiens
gtgtcttaaagcaaa

SEQ ID NO: 149389 - DNA, 15 bp, Homo sapiens
agtgtcttaaagcaa

SEQ ID NO: 149390 - DNA, 15 bp, Homo sapiens
cagtgtcttaaagca

SEQ ID NO: 149391 - DNA, 15 bp, Homo sapiens
acagtgtcttaaagc

SEQ ID NO: 149392 - DNA, 15 bp, Homo sapiens
tacagtgtcttaaag

SEQ ID NO: 149393 - DNA, 15 bp, Homo sapiens
ttacagtgtcttaaa

SEQ ID NO: 149394 - DNA, 15 bp, Homo sapiens
tttacagtgtcttaa

SEQ ID NO: 149395 - DNA, 15 bp, Homo sapiens
atttacagtgtctta

SEQ ID NO: 149396 - DNA, 15 bp, Homo sapiens
aatttacagtgtctt

SEQ ID NO: 149397 - DNA, 15 bp, Homo sapiens
gaatttacagtgtct

SEQ ID NO: 149398 - DNA, 15 bp, Homo sapiens
ggaatttacagtgtc

SEQ ID NO: 149399 - DNA, 15 bp, Homo sapiens
gggaatttacagtgt

SEQ ID NO: 149400 - DNA, 15 bp, Homo sapiens
agggaatttacagtg

SEQ ID NO: 149401 - DNA, 15 bp, Homo sapiens
aagggaatttacagt

SEQ ID NO: 149402 - DNA, 15 bp, Homo sapiens
gaagggaatttacag

SEQ ID NO: 149403 - DNA, 15 bp, Homo sapiens
ggaagggaatttaca

SEQ ID NO: 149404 - DNA, 15 bp, Homo sapiens
gggaagggaatttac

SEQ ID NO: 149405 - DNA, 15 bp, Homo sapiens
tgggaagggaattta

SEQ ID NO: 149406 - DNA, 15 bp, Homo sapiens
atgggaagggaattt

SEQ ID NO: 149407 - DNA, 15 bp, Homo sapiens
aatgggaagggaatt

SEQ ID NO: 149408 - DNA, 15 bp, Homo sapiens
taatgggaagggaat

SEQ ID NO: 149409 - DNA, 15 bp, Homo sapiens
ttaatgggaagggaa

SEQ ID NO: 149410 - DNA, 15 bp, Homo sapiens
tttaatgggaaggga

SEQ ID NO: 149411 - DNA, 15 bp, Homo sapiens
atttaatgggaaggg

SEQ ID NO: 149412 - DNA, 15 bp, Homo sapiens
aatttaatgggaagg

SEQ ID NO: 149413 - DNA, 15 bp, Homo sapiens
caatttaatgggaag

SEQ ID NO: 149414 - DNA, 15 bp, Homo sapiens
acaatttaatgggaa

SEQ ID NO: 149415 - DNA, 15 bp, Homo sapiens
tacaatttaatggga

SEQ ID NO: 149416 - DNA, 15 bp, Homo sapiens
ttacaatttaatggg

SEQ ID NO: 149417 - DNA, 15 bp, Homo sapiens
tttacaatttaatgg

SEQ ID NO: 149418 - DNA, 15 bp, Homo sapiens
atttacaatttaatg

SEQ ID NO: 149419 - DNA, 15 bp, Homo sapiens
catttacaatttaat

SEQ ID NO: 149420 - DNA, 15 bp, Homo sapiens
gcatttacaatttaa

SEQ ID NO: 149421 - DNA, 15 bp, Homo sapiens
agcatttacaattta

SEQ ID NO: 149422 - DNA, 15 bp, Homo sapiens
cagcatttacaattt

SEQ ID NO: 149423 - DNA, 15 bp, Homo sapiens
acagcatttacaatt

SEQ ID NO: 149424 - DNA, 15 bp, Homo sapiens
gacagcatttacaat

SEQ ID NO: 149425 - DNA, 15 bp, Homo sapiens
agacagcatttacaa

SEQ ID NO: 149426 - DNA, 15 bp, Homo sapiens
aagacagcatttaca

SEQ ID NO: 149427 - DNA, 15 bp, Homo sapiens
caagacagcatttac

SEQ ID NO: 149428 - DNA, 15 bp, Homo sapiens
tcaagacagcattta

SEQ ID NO: 149429 - DNA, 15 bp, Homo sapiens
gtcaagacagcattt

SEQ ID NO: 149430 - DNA, 15 bp, Homo sapiens
agtcaagacagcatt

SEQ ID NO: 149431 - DNA, 15 bp, Homo sapiens
aagtcaagacagcat

SEQ ID NO: 149432 - DNA, 15 bp, Homo sapiens
aaagtcaagacagca

SEQ ID NO: 149433 - DNA, 15 bp, Homo sapiens
gaaagtcaagacagc

SEQ ID NO: 149434 - DNA, 15 bp, Homo sapiens
agaaagtcaagacag

SEQ ID NO: 149435 - DNA, 15 bp, Homo sapiens
gagaaagtcaagaca

SEQ ID NO: 149436 - DNA, 15 bp, Homo sapiens
ggagaaagtcaagac

SEQ ID NO: 149437 - DNA, 15 bp, Homo sapiens
aggagaaagtcaaga

SEQ ID NO: 149438 - DNA, 15 bp, Homo sapiens
aaggagaaagtcaag

SEQ ID NO: 149439 - DNA, 15 bp, Homo sapiens
taaggagaaagtcaa

SEQ ID NO: 149440 - DNA, 15 bp, Homo sapiens
ataaggagaaagtca

SEQ ID NO: 149441 - DNA, 15 bp, Homo sapiens
aataaggagaaagtc

SEQ ID NO: 149442 - DNA, 15 bp, Homo sapiens
gaataaggagaaagt

SEQ ID NO: 149443 - DNA, 15 bp, Homo sapiens
ggaataaggagaaag

SEQ ID NO: 149444 - DNA, 15 bp, Homo sapiens
aggaataaggagaaa

SEQ ID NO: 149445 - DNA, 15 bp, Homo sapiens
gaggaataaggagaa

SEQ ID NO: 149446 - DNA, 15 bp, Homo sapiens
ggaggaataaggaga

SEQ ID NO: 149447 - DNA, 15 bp, Homo sapiens
gggaggaataaggag

SEQ ID NO: 149448 - DNA, 15 bp, Homo sapiens
tgggaggaataagga

SEQ ID NO: 149449 - DNA, 15 bp, Homo sapiens
gtgggaggaataagg

SEQ ID NO: 149450 - DNA, 15 bp, Homo sapiens
tgtgggaggaataag

SEQ ID NO: 149451 - DNA, 15 bp, Homo sapiens
atgtgggaggaataa

SEQ ID NO: 149452 - DNA, 15 bp, Homo sapiens
aatgtgggaggaata

SEQ ID NO: 149453 - DNA, 15 bp, Homo sapiens
gaatgtgggaggaat

SEQ ID NO: 149454 - DNA, 15 bp, Homo sapiens
agaatgtgggaggaa

SEQ ID NO: 149455 - DNA, 15 bp, Homo sapiens
gagaatgtgggagga

SEQ ID NO: 149456 - DNA, 15 bp, Homo sapiens
agagaatgtgggagg

SEQ ID NO: 149457 - DNA, 15 bp, Homo sapiens
tagagaatgtgggag

SEQ ID NO: 149458 - DNA, 15 bp, Homo sapiens
ttagagaatgtggga

SEQ ID NO: 149459 - DNA, 15 bp, Homo sapiens
tttagagaatgtggg

SEQ ID NO: 149460 - DNA, 15 bp, Homo sapiens
atttagagaatgtgg

SEQ ID NO: 149461 - DNA, 15 bp, Homo sapiens
aatttagagaatgtg

SEQ ID NO: 149462 - DNA, 15 bp, Homo sapiens
aaatttagagaatgt

SEQ ID NO: 149463 - DNA, 15 bp, Homo sapiens
taaatttagagaatg

SEQ ID NO: 149464 - DNA, 15 bp, Homo sapiens
ctaaatttagagaat

SEQ ID NO: 149465 - DNA, 15 bp, Homo sapiens
actaaatttagagaa

SEQ ID NO: 149466 - DNA, 15 bp, Homo sapiens
aactaaatttagaga

SEQ ID NO: 149467 - DNA, 15 bp, Homo sapiens
aaactaaatttagag

SEQ ID NO: 149468 - DNA, 15 bp, Homo sapiens
gaaactaaatttaga

SEQ ID NO: 149469 - DNA, 15 bp, Homo sapiens
agaaactaaatttag

SEQ ID NO: 149470 - DNA, 15 bp, Homo sapiens
aagaaactaaattta

SEQ ID NO: 149471 - DNA, 15 bp, Homo sapiens
taagaaactaaattt

SEQ ID NO: 149472 - DNA, 15 bp, Homo sapiens
ctaagaaactaaatt

SEQ ID NO: 149473 - DNA, 15 bp, Homo sapiens
tctaagaaactaaat

SEQ ID NO: 149474 - DNA, 15 bp, Homo sapiens
ttctaagaaactaaa

SEQ ID NO: 149475 - DNA, 15 bp, Homo sapiens
tttctaagaaactaa

SEQ ID NO: 149476 - DNA, 15 bp, Homo sapiens
ttttctaagaaacta

SEQ ID NO: 149477 - DNA, 15 bp, Homo sapiens
tttttctaagaaact

SEQ ID NO: 149478 - DNA, 15 bp, Homo sapiens
ttttttctaagaaac

SEQ ID NO: 149479 - DNA, 15 bp, Homo sapiens
tttttttctaagaaa

SEQ ID NO: 149480 - DNA, 15 bp, Homo sapiens
atttttttctaagaa

SEQ ID NO: 149481 - DNA, 15 bp, Homo sapiens
catttttttctaaga

SEQ ID NO: 149482 - DNA, 15 bp, Homo sapiens
gcatttttttctaag

SEQ ID NO: 149483 - DNA, 15 bp, Homo sapiens
agcatttttttctaa

SEQ ID NO: 149484 - DNA, 15 bp, Homo sapiens
aagcatttttttcta

SEQ ID NO: 149485 - DNA, 15 bp, Homo sapiens
aaagcatttttttct

SEQ ID NO: 149486 - DNA, 15 bp, Homo sapiens
taaagcatttttttc

SEQ ID NO: 149487 - DNA, 15 bp, Homo sapiens
ttaaagcattttttt

SEQ ID NO: 149488 - DNA, 15 bp, Homo sapiens
cttaaagcatttttt

SEQ ID NO: 149489 - DNA, 15 bp, Homo sapiens
acttaaagcattttt

SEQ ID NO: 149490 - DNA, 15 bp, Homo sapiens
aacttaaagcatttt

SEQ ID NO: 149491 - DNA, 15 bp, Homo sapiens
aaacttaaagcattt

SEQ ID NO: 149492 - DNA, 15 bp, Homo sapiens
caaacttaaagcatt

SEQ ID NO: 149493 - DNA, 15 bp, Homo sapiens
acaaacttaaagcat

SEQ ID NO: 149494 - DNA, 15 bp, Homo sapiens
cacaaacttaaagca

SEQ ID NO: 149495 - DNA, 15 bp, Homo sapiens
acacaaacttaaagc

SEQ ID NO: 149496 - DNA, 15 bp, Homo sapiens
tacacaaacttaaag

SEQ ID NO: 149497 - DNA, 15 bp, Homo sapiens
atacacaaacttaaa

SEQ ID NO: 149498 - DNA, 15 bp, Homo sapiens
gatacacaaacttaa

SEQ ID NO: 149499 - DNA, 15 bp, Homo sapiens
agatacacaaactta

SEQ ID NO: 149500 - DNA, 15 bp, Homo sapiens
gagatacacaaactt

SEQ ID NO: 149501 - DNA, 15 bp, Homo sapiens
ggagatacacaaact

SEQ ID NO: 149502 - DNA, 15 bp, Homo sapiens
tggagatacacaaac

SEQ ID NO: 149503 - DNA, 15 bp, Homo sapiens
atggagatacacaaa

SEQ ID NO: 149504 - DNA, 15 bp, Homo sapiens
tatggagatacacaa

SEQ ID NO: 149505 - DNA, 15 bp, Homo sapiens
ttatggagatacaca

SEQ ID NO: 149506 - DNA, 15 bp, Homo sapiens
tttatggagatacac

SEQ ID NO: 149507 - DNA, 15 bp, Homo sapiens
ttttatggagataca

SEQ ID NO: 149508 - DNA, 15 bp, Homo sapiens
tttttatggagatac

SEQ ID NO: 149509 - DNA, 15 bp, Homo sapiens
atttttatggagata

SEQ ID NO: 149510 - DNA, 15 bp, Homo sapiens
tatttttatggagat

SEQ ID NO: 149511 - DNA, 15 bp, Homo sapiens
gtatttttatggaga

SEQ ID NO: 149512 - DNA, 15 bp, Homo sapiens
tgtatttttatggag

SEQ ID NO: 149513 - DNA, 15 bp, Homo sapiens
ctgtatttttatgga

SEQ ID NO: 149514 - DNA, 15 bp, Homo sapiens
tctgtatttttatgg

SEQ ID NO: 149515 - DNA, 15 bp, Homo sapiens
ttctgtatttttatg

SEQ ID NO: 149516 - DNA, 15 bp, Homo sapiens
tttctgtatttttat

SEQ ID NO: 149517 - DNA, 15 bp, Homo sapiens
gtttctgtattttta

SEQ ID NO: 149518 - DNA, 15 bp, Homo sapiens
tgtttctgtattttt

SEQ ID NO: 149519 - DNA, 15 bp, Homo sapiens
ctgtttctgtatttt

SEQ ID NO: 149520 - DNA, 15 bp, Homo sapiens
actgtttctgtattt

SEQ ID NO: 149521 - DNA, 15 bp, Homo sapiens
gactgtttctgtatt

SEQ ID NO: 149522 - DNA, 15 bp, Homo sapiens
agactgtttctgtat

SEQ ID NO: 149523 - DNA, 15 bp, Homo sapiens
tagactgtttctgta

SEQ ID NO: 149524 - DNA, 15 bp, Homo sapiens
atagactgtttctgt

SEQ ID NO: 149525 - DNA, 15 bp, Homo sapiens
aatagactgtttctg

SEQ ID NO: 149526 - DNA, 15 bp, Homo sapiens
caatagactgtttct

SEQ ID NO: 149527 - DNA, 15 bp, Homo sapiens
acaatagactgtttc

SEQ ID NO: 149528 - DNA, 15 bp, Homo sapiens
tacaatagactgttt

SEQ ID NO: 149529 - DNA, 15 bp, Homo sapiens
ttacaatagactgtt

SEQ ID NO: 149530 - DNA, 15 bp, Homo sapiens
tttacaatagactgt

SEQ ID NO: 149531 - DNA, 15 bp, Homo sapiens
atttacaatagactg

SEQ ID NO: 149532 - DNA, 15 bp, Homo sapiens
tatttacaatagact

SEQ ID NO: 149533 - DNA, 15 bp, Homo sapiens
gtatttacaatagac

SEQ ID NO: 149534 - DNA, 15 bp, Homo sapiens
tgtatttacaataga

SEQ ID NO: 149535 - DNA, 15 bp, Homo sapiens
atgtatttacaatag

SEQ ID NO: 149536 - DNA, 15 bp, Homo sapiens
catgtatttacaata

SEQ ID NO: 149537 - DNA, 15 bp, Homo sapiens
acatgtatttacaat

SEQ ID NO: 149538 - DNA, 15 bp, Homo sapiens
tacatgtatttacaa

SEQ ID NO: 149539 - DNA, 15 bp, Homo sapiens
ctacatgtatttaca

SEQ ID NO: 149540 - DNA, 15 bp, Homo sapiens
tctacatgtatttac

SEQ ID NO: 149541 - DNA, 15 bp, Homo sapiens
ctctacatgtattta

SEQ ID NO: 149542 - DNA, 15 bp, Homo sapiens
tctctacatgtattt

SEQ ID NO: 149543 - DNA, 15 bp, Homo sapiens
gtctctacatgtatt

SEQ ID NO: 149544 - DNA, 15 bp, Homo sapiens
ggtctctacatgtat

SEQ ID NO: 149545 - DNA, 15 bp, Homo sapiens
tggtctctacatgta

SEQ ID NO: 149546 - DNA, 15 bp, Homo sapiens
ttggtctctacatgt

SEQ ID NO: 149547 - DNA, 15 bp, Homo sapiens
tttggtctctacatg

SEQ ID NO: 149548 - DNA, 15 bp, Homo sapiens
ttttggtctctacat

SEQ ID NO: 149549 - DNA, 15 bp, Homo sapiens
attttggtctctaca

SEQ ID NO: 149550 - DNA, 15 bp, Homo sapiens
cattttggtctctac

SEQ ID NO: 149551 - DNA, 15 bp, Homo sapiens
tcattttggtctcta

SEQ ID NO: 149552 - DNA, 15 bp, Homo sapiens
ttcattttggtctct

SEQ ID NO: 149553 - DNA, 15 bp, Homo sapiens
attcattttggtctc

SEQ ID NO: 149554 - DNA, 15 bp, Homo sapiens
cattcattttggtct

SEQ ID NO: 149555 - DNA, 15 bp, Homo sapiens
tcattcattttggtc

SEQ ID NO: 149556 - DNA, 15 bp, Homo sapiens
ctcattcattttggt

SEQ ID NO: 149557 - DNA, 15 bp, Homo sapiens
tctcattcattttgg

SEQ ID NO: 149558 - DNA, 15 bp, Homo sapiens
ttctcattcattttg

SEQ ID NO: 149559 - DNA, 15 bp, Homo sapiens
attctcattcatttt

SEQ ID NO: 149560 - DNA, 15 bp, Homo sapiens
tattctcattcattt

SEQ ID NO: 149561 - DNA, 15 bp, Homo sapiens
ttattctcattcatt

SEQ ID NO: 149562 - DNA, 15 bp, Homo sapiens
tttattctcattcat

SEQ ID NO: 149563 - DNA, 15 bp, Homo sapiens
ttttattctcattca

SEQ ID NO: 149564 - DNA, 15 bp, Homo sapiens
attttattctcattc

SEQ ID NO: 149565 - DNA, 15 bp, Homo sapiens
cattttattctcatt

SEQ ID NO: 149566 - DNA, 15 bp, Homo sapiens
acattttattctcat

SEQ ID NO: 149567 - DNA, 15 bp, Homo sapiens
cacattttattctca

SEQ ID NO: 149568 - DNA, 15 bp, Homo sapiens
ccacattttattctc

SEQ ID NO: 149569 - DNA, 15 bp, Homo sapiens
gccacattttattct

SEQ ID NO: 149570 - DNA, 15 bp, Homo sapiens
tgccacattttattc

SEQ ID NO: 149571 - DNA, 15 bp, Homo sapiens
atgccacattttatt

SEQ ID NO: 149572 - DNA, 15 bp, Homo sapiens
tatgccacattttat

SEQ ID NO: 149573 - DNA, 15 bp, Homo sapiens
ttatgccacatttta

SEQ ID NO: 149574 - DNA, 15 bp, Homo sapiens
attatgccacatttt

SEQ ID NO: 149575 - DNA, 15 bp, Homo sapiens
gattatgccacattt

SEQ ID NO: 149576 - DNA, 15 bp, Homo sapiens
agattatgccacatt

SEQ ID NO: 149577 - DNA, 15 bp, Homo sapiens
cagattatgccacat

SEQ ID NO: 149578 - DNA, 15 bp, Homo sapiens
tcagattatgccaca

SEQ ID NO: 149579 - DNA, 15 bp, Homo sapiens
ctcagattatgccac

SEQ ID NO: 149580 - DNA, 15 bp, Homo sapiens
cctcagattatgcca

SEQ ID NO: 149581 - DNA, 15 bp, Homo sapiens
ccctcagattatgcc

SEQ ID NO: 149582 - DNA, 15 bp, Homo sapiens
tccctcagattatgc

SEQ ID NO: 149583 - DNA, 15 bp, Homo sapiens
ttccctcagattatg

SEQ ID NO: 149584 - DNA, 15 bp, Homo sapiens
tttccctcagattat

SEQ ID NO: 149585 - DNA, 15 bp, Homo sapiens
atttccctcagatta

SEQ ID NO: 149586 - DNA, 15 bp, Homo sapiens
aatttccctcagatt

SEQ ID NO: 149587 - DNA, 15 bp, Homo sapiens
aaatttccctcagat

SEQ ID NO: 149588 - DNA, 15 bp, Homo sapiens
caaatttccctcaga

SEQ ID NO: 149589 - DNA, 15 bp, Homo sapiens
tcaaatttccctcag

SEQ ID NO: 149590 - DNA, 15 bp, Homo sapiens
gtcaaatttccctca

SEQ ID NO: 149591 - DNA, 15 bp, Homo sapiens
agtcaaatttccctc

SEQ ID NO: 149592 - DNA, 15 bp, Homo sapiens
tagtcaaatttccct

SEQ ID NO: 149593 - DNA, 15 bp, Homo sapiens
atagtcaaatttccc

SEQ ID NO: 149594 - DNA, 15 bp, Homo sapiens
aatagtcaaatttcc

SEQ ID NO: 149595 - DNA, 15 bp, Homo sapiens
aaatagtcaaatttc

SEQ ID NO: 149596 - DNA, 15 bp, Homo sapiens
taaatagtcaaattt

SEQ ID NO: 149597 - DNA, 15 bp, Homo sapiens
ttaaatagtcaaatt

SEQ ID NO: 149598 - DNA, 15 bp, Homo sapiens
tttaaatagtcaaat

SEQ ID NO: 149599 - DNA, 15 bp, Homo sapiens
ttttaaatagtcaaa

SEQ ID NO: 149600 - DNA, 15 bp, Homo sapiens
attttaaatagtcaa

SEQ ID NO: 149601 - DNA, 15 bp, Homo sapiens
aattttaaatagtca

SEQ ID NO: 149602 - DNA, 15 bp, Homo sapiens
gaattttaaatagtc

SEQ ID NO: 149603 - DNA, 15 bp, Homo sapiens
tgaattttaaatagt

SEQ ID NO: 149604 - DNA, 15 bp, Homo sapiens
atgaattttaaatag

SEQ ID NO: 149605 - DNA, 15 bp, Homo sapiens
tatgaattttaaata

SEQ ID NO: 149606 - DNA, 15 bp, Homo sapiens
atatgaattttaaat

SEQ ID NO: 149607 - DNA, 15 bp, Homo sapiens
aatatgaattttaaa

SEQ ID NO: 149608 - DNA, 15 bp, Homo sapiens
caatatgaattttaa

SEQ ID NO: 149609 - DNA, 15 bp, Homo sapiens
ccaatatgaatttta

SEQ ID NO: 149610 - DNA, 15 bp, Homo sapiens
gccaatatgaatttt

SEQ ID NO: 149611 - DNA, 15 bp, Homo sapiens
tgccaatatgaattt

SEQ ID NO: 149612 - DNA, 15 bp, Homo sapiens
atgccaatatgaatt

SEQ ID NO: 149613 - DNA, 15 bp, Homo sapiens
aatgccaatatgaat

SEQ ID NO: 149614 - DNA, 15 bp, Homo sapiens
aaatgccaatatgaa

SEQ ID NO: 149615 - DNA, 15 bp, Homo sapiens
aaaatgccaatatga

SEQ ID NO: 149616 - DNA, 15 bp, Homo sapiens
caaaatgccaatatg

SEQ ID NO: 149617 - DNA, 15 bp, Homo sapiens
tcaaaatgccaatat

SEQ ID NO: 149618 - DNA, 15 bp, Homo sapiens
ttcaaaatgccaata

SEQ ID NO: 149619 - DNA, 15 bp, Homo sapiens
tttcaaaatgccaat

SEQ ID NO: 149620 - DNA, 15 bp, Homo sapiens
atttcaaaatgccaa

SEQ ID NO: 149621 - DNA, 15 bp, Homo sapiens
aatttcaaaatgcca

SEQ ID NO: 149622 - DNA, 15 bp, Homo sapiens
gaatttcaaaatgcc

SEQ ID NO: 149623 - DNA, 15 bp, Homo sapiens
tgaatttcaaaatgc

SEQ ID NO: 149624 - DNA, 15 bp, Homo sapiens
ctgaatttcaaaatg

SEQ ID NO: 149625 - DNA, 15 bp, Homo sapiens
actgaatttcaaaat

SEQ ID NO: 149626 - DNA, 15 bp, Homo sapiens
cactgaatttcaaaa

SEQ ID NO: 149627 - DNA, 15 bp, Homo sapiens
acactgaatttcaaa

SEQ ID NO: 149628 - DNA, 15 bp, Homo sapiens
gacactgaatttcaa

SEQ ID NO: 149629 - DNA, 15 bp, Homo sapiens
agacactgaatttca

SEQ ID NO: 149630 - DNA, 15 bp, Homo sapiens
cagacactgaatttc

SEQ ID NO: 149631 - DNA, 15 bp, Homo sapiens
tcagacactgaattt

SEQ ID NO: 149632 - DNA, 15 bp, Homo sapiens
ttcagacactgaatt

SEQ ID NO: 149633 - DNA, 15 bp, Homo sapiens
attcagacactgaat

SEQ ID NO: 149634 - DNA, 15 bp, Homo sapiens
tattcagacactgaa

SEQ ID NO: 149635 - DNA, 15 bp, Homo sapiens
atattcagacactga

SEQ ID NO: 149636 - DNA, 15 bp, Homo sapiens
aatattcagacactg

SEQ ID NO: 149637 - DNA, 15 bp, Homo sapiens
aaatattcagacact

SEQ ID NO: 149638 - DNA, 15 bp, Homo sapiens
aaaatattcagacac

SEQ ID NO: 149639 - DNA, 15 bp, Homo sapiens
aaaaatattcagaca

SEQ ID NO: 149640 - DNA, 15 bp, Homo sapiens
taaaaatattcagac

SEQ ID NO: 149641 - DNA, 15 bp, Homo sapiens
ataaaaatattcaga

SEQ ID NO: 149642 - DNA, 15 bp, Homo sapiens
gataaaaatattcag

SEQ ID NO: 149643 - DNA, 15 bp, Homo sapiens
agataaaaatattca

SEQ ID NO: 149644 - DNA, 15 bp, Homo sapiens
aagataaaaatattc

SEQ ID NO: 149645 - DNA, 15 bp, Homo sapiens
gaagataaaaatatt

SEQ ID NO: 149646 - DNA, 15 bp, Homo sapiens
agaagataaaaatat

SEQ ID NO: 149647 - DNA, 15 bp, Homo sapiens
aagaagataaaaata

SEQ ID NO: 149648 - DNA, 15 bp, Homo sapiens
aaagaagataaaaat

SEQ ID NO: 149649 - DNA, 15 bp, Homo sapiens
aaaagaagataaaaa

SEQ ID NO: 149650 - DNA, 15 bp, Homo sapiens
taaaagaagataaaa

SEQ ID NO: 149651 - DNA, 15 bp, Homo sapiens
ttaaaagaagataaa

SEQ ID NO: 149652 - DNA, 15 bp, Homo sapiens
tttaaaagaagataa

SEQ ID NO: 149653 - DNA, 15 bp, Homo sapiens
atttaaaagaagata

SEQ ID NO: 149654 - DNA, 15 bp, Homo sapiens
aatttaaaagaagat

SEQ ID NO: 149655 - DNA, 15 bp, Homo sapiens
gaatttaaaagaaga

SEQ ID NO: 149656 - DNA, 15 bp, Homo sapiens
ggaatttaaaagaag

SEQ ID NO: 149657 - DNA, 15 bp, Homo sapiens
aggaatttaaaagaa

SEQ ID NO: 149658 - DNA, 15 bp, Homo sapiens
gaggaatttaaaaga

SEQ ID NO: 149659 - DNA, 15 bp, Homo sapiens
agaggaatttaaaag

SEQ ID NO: 149660 - DNA, 15 bp, Homo sapiens
aagaggaatttaaaa

SEQ ID NO: 149661 - DNA, 15 bp, Homo sapiens
caagaggaatttaaa

SEQ ID NO: 149662 - DNA, 15 bp, Homo sapiens
tcaagaggaatttaa

SEQ ID NO: 149663 - DNA, 15 bp, Homo sapiens
ctcaagaggaattta

SEQ ID NO: 149664 - DNA, 15 bp, Homo sapiens
cctcaagaggaattt

SEQ ID NO: 149665 - DNA, 15 bp, Homo sapiens
tcctcaagaggaatt

SEQ ID NO: 149666 - DNA, 15 bp, Homo sapiens
atcctcaagaggaat

SEQ ID NO: 149667 - DNA, 15 bp, Homo sapiens
gatcctcaagaggaa

SEQ ID NO: 149668 - DNA, 15 bp, Homo sapiens
tgatcctcaagagga

SEQ ID NO: 149669 - DNA, 15 bp, Homo sapiens
atgatcctcaagagg

SEQ ID NO: 149670 - DNA, 15 bp, Homo sapiens
aatgatcctcaagag

SEQ ID NO: 149671 - DNA, 15 bp, Homo sapiens
gaatgatcctcaaga

SEQ ID NO: 149672 - DNA, 15 bp, Homo sapiens
agaatgatcctcaag

SEQ ID NO: 149673 - DNA, 15 bp, Homo sapiens
aagaatgatcctcaa

SEQ ID NO: 149674 - DNA, 15 bp, Homo sapiens
aaagaatgatcctca

SEQ ID NO: 149675 - DNA, 15 bp, Homo sapiens
aaaagaatgatcctc

SEQ ID NO: 149676 - DNA, 15 bp, Homo sapiens
aaaaagaatgatcct

SEQ ID NO: 149677 - DNA, 15 bp, Homo sapiens
taaaaagaatgatcc

SEQ ID NO: 149678 - DNA, 15 bp, Homo sapiens
ataaaaagaatgatc

SEQ ID NO: 149679 - DNA, 15 bp, Homo sapiens
cataaaaagaatgat

SEQ ID NO: 149680 - DNA, 15 bp, Homo sapiens
acataaaaagaatga

SEQ ID NO: 149681 - DNA, 15 bp, Homo sapiens
tacataaaaagaatg

SEQ ID NO: 149682 - DNA, 15 bp, Homo sapiens
aatacataaaaagaa

SEQ ID NO: 149683 - DNA, 15 bp, Homo sapiens
taatacataaaaaga

SEQ ID NO: 149684 - DNA, 15 bp, Homo sapiens
ataatacataaaaag

SEQ ID NO: 149685 - DNA, 15 bp, Homo sapiens
aataatacataaaaa

SEQ ID NO: 149686 - DNA, 15 bp, Homo sapiens
aaataatacataaaa

SEQ ID NO: 149687 - DNA, 15 bp, Homo sapiens
caaataatacataaa

SEQ ID NO: 149688 - DNA, 15 bp, Homo sapiens
acaaataatacataa

SEQ ID NO: 149689 - DNA, 15 bp, Homo sapiens
aacaaataatacata

SEQ ID NO: 149690 - DNA, 15 bp, Homo sapiens
aaacaaataatacat

SEQ ID NO: 149691 - DNA, 15 bp, Homo sapiens
taaacaaataataca

SEQ ID NO: 149692 - DNA, 15 bp, Homo sapiens
ctaaacaaataatac

SEQ ID NO: 149693 - DNA, 15 bp, Homo sapiens
actaaacaaataata

SEQ ID NO: 149694 - DNA, 15 bp, Homo sapiens
gactaaacaaataat

SEQ ID NO: 149695 - DNA, 15 bp, Homo sapiens
agactaaacaaataa

SEQ ID NO: 149696 - DNA, 15 bp, Homo sapiens
aagactaaacaaata

SEQ ID NO: 149697 - DNA, 15 bp, Homo sapiens
aaagactaaacaaat

SEQ ID NO: 149698 - DNA, 15 bp, Homo sapiens
aaaagactaaacaaa

SEQ ID NO: 149699 - DNA, 15 bp, Homo sapiens
caaaagactaaacaa

SEQ ID NO: 149700 - DNA, 15 bp, Homo sapiens
acaaaagactaaaca

SEQ ID NO: 149701 - DNA, 15 bp, Homo sapiens
aacaaaagactaaac

SEQ ID NO: 149702 - DNA, 15 bp, Homo sapiens
taacaaaagactaaa

SEQ ID NO: 149703 - DNA, 15 bp, Homo sapiens
ctaacaaaagactaa

SEQ ID NO: 149704 - DNA, 15 bp, Homo sapiens
tctaacaaaagacta

SEQ ID NO: 149705 - DNA, 15 bp, Homo sapiens
gtctaacaaaagact

SEQ ID NO: 149706 - DNA, 15 bp, Homo sapiens
agtctaacaaaagac

SEQ ID NO: 149707 - DNA, 15 bp, Homo sapiens
aagtctaacaaaaga

SEQ ID NO: 149708 - DNA, 15 bp, Homo sapiens
aaagtctaacaaaag

SEQ ID NO: 149709 - DNA, 15 bp, Homo sapiens
aaaagtctaacaaaa

SEQ ID NO: 149710 - DNA, 15 bp, Homo sapiens
gaaaagtctaacaaa

SEQ ID NO: 149711 - DNA, 15 bp, Homo sapiens
ggaaaagtctaacaa

SEQ ID NO: 149712 - DNA, 15 bp, Homo sapiens
gggaaaagtctaaca

SEQ ID NO: 149713 - DNA, 15 bp, Homo sapiens
agggaaaagtctaac

SEQ ID NO: 149714 - DNA, 15 bp, Homo sapiens
gagggaaaagtctaa

SEQ ID NO: 149715 - DNA, 15 bp, Homo sapiens
agagggaaaagtcta

SEQ ID NO: 149716 - DNA, 15 bp, Homo sapiens
cagagggaaaagtct

SEQ ID NO: 149717 - DNA, 15 bp, Homo sapiens
acagagggaaaagtc

SEQ ID NO: 149718 - DNA, 15 bp, Homo sapiens
cacagagggaaaagt

SEQ ID NO: 149719 - DNA, 15 bp, Homo sapiens
ccacagagggaaaag

SEQ ID NO: 149720 - DNA, 15 bp, Homo sapiens
gccacagagggaaaa

SEQ ID NO: 149721 - DNA, 15 bp, Homo sapiens
tgccacagagggaaa

SEQ ID NO: 149722 - DNA, 15 bp, Homo sapiens
ctgccacagagggaa

SEQ ID NO: 149723 - DNA, 15 bp, Homo sapiens
gctgccacagaggga

SEQ ID NO: 149724 - DNA, 15 bp, Homo sapiens
agctgccacagaggg

SEQ ID NO: 149725 - DNA, 15 bp, Homo sapiens
gagctgccacagagg

SEQ ID NO: 149726 - DNA, 15 bp, Homo sapiens
cgagctgccacagag

SEQ ID NO: 149727 - DNA, 15 bp, Homo sapiens
acgagctgccacaga

SEQ ID NO: 149728 - DNA, 15 bp, Homo sapiens
gacgagctgccacag

SEQ ID NO: 149729 - DNA, 15 bp, Homo sapiens
agacgagctgccaca

SEQ ID NO: 149730 - DNA, 15 bp, Homo sapiens
aagacgagctgccac

SEQ ID NO: 149731 - DNA, 15 bp, Homo sapiens
aaagacgagctgcca

SEQ ID NO: 149732 - DNA, 15 bp, Homo sapiens
aaaagacgagctgcc

SEQ ID NO: 149733 - DNA, 15 bp, Homo sapiens
gaaaagacgagctgc

SEQ ID NO: 149734 - DNA, 15 bp, Homo sapiens
agaaaagacgagctg

SEQ ID NO: 149735 - DNA, 15 bp, Homo sapiens
cagaaaagacgagct

SEQ ID NO: 149736 - DNA, 15 bp, Homo sapiens
gcagaaaagacgagc

SEQ ID NO: 149737 - DNA, 15 bp, Homo sapiens
agcagaaaagacgag

SEQ ID NO: 149738 - DNA, 15 bp, Homo sapiens
aagcagaaaagacga

SEQ ID NO: 149739 - DNA, 15 bp, Homo sapiens
taagcagaaaagacg

SEQ ID NO: 149740 - DNA, 15 bp, Homo sapiens
ataagcagaaaagac

SEQ ID NO: 149741 - DNA, 15 bp, Homo sapiens
aataagcagaaaaga

SEQ ID NO: 149742 - DNA, 15 bp, Homo sapiens
aaataagcagaaaag

SEQ ID NO: 149743 - DNA, 15 bp, Homo sapiens
aaaataagcagaaaa

SEQ ID NO: 149744 - DNA, 15 bp, Homo sapiens
gaaaataagcagaaa

SEQ ID NO: 149745 - DNA, 15 bp, Homo sapiens
tgaaaataagcagaa

SEQ ID NO: 149746 - DNA, 15 bp, Homo sapiens
atgaaaataagcaga

SEQ ID NO: 149747 - DNA, 15 bp, Homo sapiens
tatgaaaataagcag

SEQ ID NO: 149748 - DNA, 15 bp, Homo sapiens
gtatgaaaataagca

SEQ ID NO: 149749 - DNA, 15 bp, Homo sapiens
agtatgaaaataagc

SEQ ID NO: 149750 - DNA, 15 bp, Homo sapiens
aagtatgaaaataag

SEQ ID NO: 149751 - DNA, 15 bp, Homo sapiens
gaagtatgaaaataa

SEQ ID NO: 149752 - DNA, 15 bp, Homo sapiens
agaagtatgaaaata

SEQ ID NO: 149753 - DNA, 15 bp, Homo sapiens
gagaagtatgaaaat

SEQ ID NO: 149754 - DNA, 15 bp, Homo sapiens
agagaagtatgaaaa

SEQ ID NO: 149755 - DNA, 15 bp, Homo sapiens
aagagaagtatgaaa

SEQ ID NO: 149756 - DNA, 15 bp, Homo sapiens
caagagaagtatgaa

SEQ ID NO: 149757 - DNA, 15 bp, Homo sapiens
acaagagaagtatga

SEQ ID NO: 149758 - DNA, 15 bp, Homo sapiens
aacaagagaagtatg

SEQ ID NO: 149759 - DNA, 15 bp, Homo sapiens
aaacaagagaagtat

SEQ ID NO: 149760 - DNA, 15 bp, Homo sapiens
caaacaagagaagta

SEQ ID NO: 149761 - DNA, 15 bp, Homo sapiens
acaaacaagagaagt

SEQ ID NO: 149762 - DNA, 15 bp, Homo sapiens
gacaaacaagagaag

SEQ ID NO: 149763 - DNA, 15 bp, Homo sapiens
tgacaaacaagagaa

SEQ ID NO: 149764 - DNA, 15 bp, Homo sapiens
ctgacaaacaagaga

SEQ ID NO: 149765 - DNA, 15 bp, Homo sapiens
tctgacaaacaagag

SEQ ID NO: 149766 - DNA, 15 bp, Homo sapiens
ttctgacaaacaaga

SEQ ID NO: 149767 - DNA, 15 bp, Homo sapiens
cttctgacaaacaag

SEQ ID NO: 149768 - DNA, 15 bp, Homo sapiens
tcttctgacaaacaa

SEQ ID NO: 149769 - DNA, 15 bp, Homo sapiens
atcttctgacaaaca

SEQ ID NO: 149770 - DNA, 15 bp, Homo sapiens
tatcttctgacaaac

SEQ ID NO: 149771 - DNA, 15 bp, Homo sapiens
ctatcttctgacaaa

SEQ ID NO: 149772 - DNA, 15 bp, Homo sapiens
actatcttctgacaa

SEQ ID NO: 149773 - DNA, 15 bp, Homo sapiens
cactatcttctgaca

SEQ ID NO: 149774 - DNA, 15 bp, Homo sapiens
acactatcttctgac

SEQ ID NO: 149775 - DNA, 15 bp, Homo sapiens
cacactatcttctga

SEQ ID NO: 149776 - DNA, 15 bp, Homo sapiens
acacactatcttctg

SEQ ID NO: 149777 - DNA, 15 bp, Homo sapiens
cacacactatcttct

SEQ ID NO: 149778 - DNA, 15 bp, Homo sapiens
acacacactatcttc

SEQ ID NO: 149779 - DNA, 15 bp, Homo sapiens
cacacacactatctt

SEQ ID NO: 149780 - DNA, 15 bp, Homo sapiens
acacacacactatct

SEQ ID NO: 149781 - DNA, 15 bp, Homo sapiens
aacacacacactatc

SEQ ID NO: 149782 - DNA, 15 bp, Homo sapiens
taacacacacactat

SEQ ID NO: 149783 - DNA, 15 bp, Homo sapiens
gtaacacacacacta

SEQ ID NO: 149784 - DNA, 15 bp, Homo sapiens
tgtaacacacacact

SEQ ID NO: 149785 - DNA, 15 bp, Homo sapiens
gtgtaacacacacac

SEQ ID NO: 149786 - DNA, 15 bp, Homo sapiens
cgtgtaacacacaca

SEQ ID NO: 149787 - DNA, 15 bp, Homo sapiens
tcgtgtaacacacac

SEQ ID NO: 149788 - DNA, 15 bp, Homo sapiens
ctcgtgtaacacaca

SEQ ID NO: 149789 - DNA, 15 bp, Homo sapiens
actcgtgtaacacac

SEQ ID NO: 149790 - DNA, 15 bp, Homo sapiens
tactcgtgtaacaca

SEQ ID NO: 149791 - DNA, 15 bp, Homo sapiens
ctactcgtgtaacac

SEQ ID NO: 149792 - DNA, 15 bp, Homo sapiens
tctactcgtgtaaca

SEQ ID NO: 149793 - DNA, 15 bp, Homo sapiens
atctactcgtgtaac

SEQ ID NO: 149794 - DNA, 15 bp, Homo sapiens
tatctactcgtgtaa

SEQ ID NO: 149795 - DNA, 15 bp, Homo sapiens
gtatctactcgtgta

SEQ ID NO: 149796 - DNA, 15 bp, Homo sapiens
agtatctactcgtgt

SEQ ID NO: 149797 - DNA, 15 bp, Homo sapiens
aagtatctactcgtg

SEQ ID NO: 149798 - DNA, 15 bp, Homo sapiens
caagtatctactcgt

SEQ ID NO: 149799 - DNA, 15 bp, Homo sapiens
acaagtatctactcg

SEQ ID NO: 149800 - DNA, 15 bp, Homo sapiens
cacaagtatctactc

SEQ ID NO: 149801 - DNA, 15 bp, Homo sapiens
acacaagtatctact

SEQ ID NO: 149802 - DNA, 15 bp, Homo sapiens
tacacaagtatctac

SEQ ID NO: 149803 - DNA, 15 bp, Homo sapiens
ctacacaagtatcta

SEQ ID NO: 149804 - DNA, 15 bp, Homo sapiens
tctacacaagtatct

SEQ ID NO: 149805 - DNA, 15 bp, Homo sapiens
ttctacacaagtatc

SEQ ID NO: 149806 - DNA, 15 bp, Homo sapiens
attctacacaagtat

SEQ ID NO: 149807 - DNA, 15 bp, Homo sapiens
tattctacacaagta

SEQ ID NO: 149808 - DNA, 15 bp, Homo sapiens
atattctacacaagt

SEQ ID NO: 149809 - DNA, 15 bp, Homo sapiens
aatattctacacaag

SEQ ID NO: 149810 - DNA, 15 bp, Homo sapiens
gaatattctacacaa

SEQ ID NO: 149811 - DNA, 15 bp, Homo sapiens
agaatattctacaca

SEQ ID NO: 149812 - DNA, 15 bp, Homo sapiens
gagaatattctacac

SEQ ID NO: 149813 - DNA, 15 bp, Homo sapiens
tgagaatattctaca

SEQ ID NO: 149814 - DNA, 15 bp, Homo sapiens
atgagaatattctac

SEQ ID NO: 149815 - DNA, 15 bp, Homo sapiens
aatgagaatattcta

SEQ ID NO: 149816 - DNA, 15 bp, Homo sapiens
aaatgagaatattct

SEQ ID NO: 149817 - DNA, 15 bp, Homo sapiens
aaaatgagaatattc

SEQ ID NO: 149818 - DNA, 15 bp, Homo sapiens
caaaatgagaatatt

SEQ ID NO: 149819 - DNA, 15 bp, Homo sapiens
acaaaatgagaatat

SEQ ID NO: 149820 - DNA, 15 bp, Homo sapiens
cacaaaatgagaata

SEQ ID NO: 149821 - DNA, 15 bp, Homo sapiens
ccacaaaatgagaat

SEQ ID NO: 149822 - DNA, 15 bp, Homo sapiens
cccacaaaatgagaa

SEQ ID NO: 149823 - DNA, 15 bp, Homo sapiens
acccacaaaatgaga

SEQ ID NO: 149824 - DNA, 15 bp, Homo sapiens
aacccacaaaatgag

SEQ ID NO: 149825 - DNA, 15 bp, Homo sapiens
aaacccacaaaatga

SEQ ID NO: 149826 - DNA, 15 bp, Homo sapiens
aaaacccacaaaatg

SEQ ID NO: 149827 - DNA, 15 bp, Homo sapiens
gaaaacccacaaaat

SEQ ID NO: 149828 - DNA, 15 bp, Homo sapiens
agaaaacccacaaaa

SEQ ID NO: 149829 - DNA, 15 bp, Homo sapiens
aagaaaacccacaaa

SEQ ID NO: 149830 - DNA, 15 bp, Homo sapiens
caagaaaacccacaa

SEQ ID NO: 149831 - DNA, 15 bp, Homo sapiens
acaagaaaacccaca

SEQ ID NO: 149832 - DNA, 15 bp, Homo sapiens
tacaagaaaacccac

SEQ ID NO: 149833 - DNA, 15 bp, Homo sapiens
atacaagaaaaccca

SEQ ID NO: 149834 - DNA, 15 bp, Homo sapiens
catacaagaaaaccc

SEQ ID NO: 149835 - DNA, 15 bp, Homo sapiens
acatacaagaaaacc

SEQ ID NO: 149836 - DNA, 15 bp, Homo sapiens
aacatacaagaaaac

SEQ ID NO: 149837 - DNA, 15 bp, Homo sapiens
aaacatacaagaaaa

SEQ ID NO: 149838 - DNA, 15 bp, Homo sapiens
gaaacatacaagaaa

SEQ ID NO: 149839 - DNA, 15 bp, Homo sapiens
tgaaacatacaagaa

SEQ ID NO: 149840 - DNA, 15 bp, Homo sapiens
ttgaaacatacaaga

SEQ ID NO: 149841 - DNA, 15 bp, Homo sapiens
tttgaaacatacaag

SEQ ID NO: 149842 - DNA, 15 bp, Homo sapiens
ctttgaaacatacaa

SEQ ID NO: 149843 - DNA, 15 bp, Homo sapiens
tctttgaaacataca

SEQ ID NO: 149844 - DNA, 15 bp, Homo sapiens
ctctttgaaacatac

SEQ ID NO: 149845 - DNA, 15 bp, Homo sapiens
tctctttgaaacata

SEQ ID NO: 149846 - DNA, 15 bp, Homo sapiens
ttctctttgaaacat

SEQ ID NO: 149847 - DNA, 15 bp, Homo sapiens
cttctctttgaaaca

SEQ ID NO: 149848 - DNA, 15 bp, Homo sapiens
ccttctctttgaaac

SEQ ID NO: 149849 - DNA, 15 bp, Homo sapiens
cccttctctttgaaa

SEQ ID NO: 149850 - DNA, 15 bp, Homo sapiens
tcccttctctttgaa

SEQ ID NO: 149851 - DNA, 15 bp, Homo sapiens
ctcccttctctttga

SEQ ID NO: 149852 - DNA, 15 bp, Homo sapiens
cctcccttctctttg

SEQ ID NO: 149853 - DNA, 15 bp, Homo sapiens
tcctcccttctcttt

SEQ ID NO: 149854 - DNA, 15 bp, Homo sapiens
ttcctcccttctctt

SEQ ID NO: 149855 - DNA, 15 bp, Homo sapiens
attcctcccttctct

SEQ ID NO: 149856 - DNA, 15 bp, Homo sapiens
cattcctcccttctc

SEQ ID NO: 149857 - DNA, 15 bp, Homo sapiens
tcattcctcccttct

SEQ ID NO: 149858 - DNA, 15 bp, Homo sapiens
ttcattcctcccttc

SEQ ID NO: 149859 - DNA, 15 bp, Homo sapiens
tttcattcctccctt

SEQ ID NO: 149860 - DNA, 15 bp, Homo sapiens
ttttcattcctccct

SEQ ID NO: 149861 - DNA, 15 bp, Homo sapiens
tttttcattcctccc

SEQ ID NO: 149862 - DNA, 15 bp, Homo sapiens
ttttttcattcctcc

SEQ ID NO: 149863 - DNA, 15 bp, Homo sapiens
cttttttcattcctc

SEQ ID NO: 149864 - DNA, 15 bp, Homo sapiens
ccttttttcattcct

SEQ ID NO: 149865 - DNA, 15 bp, Homo sapiens
gccttttttcattcc

SEQ ID NO: 149866 - DNA, 15 bp, Homo sapiens
tgccttttttcattc

SEQ ID NO: 149867 - DNA, 15 bp, Homo sapiens
atgccttttttcatt

SEQ ID NO: 149868 - DNA, 15 bp, Homo sapiens
catgccttttttcat

SEQ ID NO: 149869 - DNA, 15 bp, Homo sapiens
acatgccttttttca

SEQ ID NO: 149870 - DNA, 15 bp, Homo sapiens
gacatgccttttttc

SEQ ID NO: 149871 - DNA, 15 bp, Homo sapiens
tgacatgcctttttt

SEQ ID NO: 149872 - DNA, 15 bp, Homo sapiens
gtgacatgccttttt

SEQ ID NO: 149873 - DNA, 15 bp, Homo sapiens
tgtgacatgcctttt

SEQ ID NO: 149874 - DNA, 15 bp, Homo sapiens
ctgtgacatgccttt

SEQ ID NO: 149875 - DNA, 15 bp, Homo sapiens
gctgtgacatgcctt

SEQ ID NO: 149876 - DNA, 15 bp, Homo sapiens
agctgtgacatgcct

SEQ ID NO: 149877 - DNA, 15 bp, Homo sapiens
gagctgtgacatgcc

SEQ ID NO: 149878 - DNA, 15 bp, Homo sapiens
agagctgtgacatgc

SEQ ID NO: 149879 - DNA, 15 bp, Homo sapiens
gagagctgtgacatg

SEQ ID NO: 149880 - DNA, 15 bp, Homo sapiens
tgagagctgtgacat

SEQ ID NO: 149881 - DNA, 15 bp, Homo sapiens
ctgagagctgtgaca

SEQ ID NO: 149882 - DNA, 15 bp, Homo sapiens
tctgagagctgtgac

SEQ ID NO: 149883 - DNA, 15 bp, Homo sapiens
ctctgagagctgtga

SEQ ID NO: 149884 - DNA, 15 bp, Homo sapiens
actctgagagctgtg

SEQ ID NO: 149885 - DNA, 15 bp, Homo sapiens
aactctgagagctgt

SEQ ID NO: 149886 - DNA, 15 bp, Homo sapiens
taactctgagagctg

SEQ ID NO: 149887 - DNA, 15 bp, Homo sapiens
ttaactctgagagct

SEQ ID NO: 149888 - DNA, 15 bp, Homo sapiens
tttaactctgagagc

SEQ ID NO: 149889 - DNA, 15 bp, Homo sapiens
ttttaactctgagag

SEQ ID NO: 149890 - DNA, 15 bp, Homo sapiens
attttaactctgaga

SEQ ID NO: 149891 - DNA, 15 bp, Homo sapiens
tattttaactctgag

SEQ ID NO: 149892 - DNA, 15 bp, Homo sapiens
atattttaactctga

SEQ ID NO: 149893 - DNA, 15 bp, Homo sapiens
tatattttaactctg

SEQ ID NO: 149894 - DNA, 15 bp, Homo sapiens
gtatattttaactct

SEQ ID NO: 149895 - DNA, 15 bp, Homo sapiens
agtatattttaactc

SEQ ID NO: 149896 - DNA, 15 bp, Homo sapiens
gagtatattttaact

SEQ ID NO: 149897 - DNA, 15 bp, Homo sapiens
ggagtatattttaac

SEQ ID NO: 149898 - DNA, 15 bp, Homo sapiens
gggagtatattttaa

SEQ ID NO: 149899 - DNA, 15 bp, Homo sapiens
ggggagtatatttta

SEQ ID NO: 149900 - DNA, 15 bp, Homo sapiens
aggggagtatatttt

SEQ ID NO: 149901 - DNA, 15 bp, Homo sapiens
gaggggagtatattt

SEQ ID NO: 149902 - DNA, 15 bp, Homo sapiens
ggaggggagtatatt

SEQ ID NO: 149903 - DNA, 15 bp, Homo sapiens
gggaggggagtatat

SEQ ID NO: 149904 - DNA, 15 bp, Homo sapiens
tgggaggggagtata

SEQ ID NO: 149905 - DNA, 15 bp, Homo sapiens
gtgggaggggagtat

SEQ ID NO: 149906 - DNA, 15 bp, Homo sapiens
tgtgggaggggagta

SEQ ID NO: 149907 - DNA, 15 bp, Homo sapiens
ttgtgggaggggagt

SEQ ID NO: 149908 - DNA, 15 bp, Homo sapiens
attgtgggaggggag

SEQ ID NO: 149909 - DNA, 15 bp, Homo sapiens
gattgtgggagggga

SEQ ID NO: 149910 - DNA, 15 bp, Homo sapiens
agattgtgggagggg

SEQ ID NO: 149911 - DNA, 15 bp, Homo sapiens
tagattgtgggaggg

SEQ ID NO: 149912 - DNA, 15 bp, Homo sapiens
atagattgtgggagg

SEQ ID NO: 149913 - DNA, 15 bp, Homo sapiens
aatagattgtgggag

SEQ ID NO: 149914 - DNA, 15 bp, Homo sapiens
aaatagattgtggga

SEQ ID NO: 149915 - DNA, 15 bp, Homo sapiens
taaatagattgtggg

SEQ ID NO: 149916 - DNA, 15 bp, Homo sapiens
gtaaatagattgtgg

SEQ ID NO: 149917 - DNA, 15 bp, Homo sapiens
tgtaaatagattgtg

SEQ ID NO: 149918 - DNA, 15 bp, Homo sapiens
gtgtaaatagattgt

SEQ ID NO: 149919 - DNA, 15 bp, Homo sapiens
tgtgtaaatagattg

SEQ ID NO: 149920 - DNA, 15 bp, Homo sapiens
atgtgtaaatagatt

SEQ ID NO: 149921 - DNA, 15 bp, Homo sapiens
aatgtgtaaatagat

SEQ ID NO: 149922 - DNA, 15 bp, Homo sapiens
gaatgtgtaaataga

SEQ ID NO: 149923 - DNA, 15 bp, Homo sapiens
tgaatgtgtaaatag

SEQ ID NO: 149924 - DNA, 15 bp, Homo sapiens
gtgaatgtgtaaata

SEQ ID NO: 149925 - DNA, 15 bp, Homo sapiens
cgtgaatgtgtaaat

SEQ ID NO: 149926 - DNA, 15 bp, Homo sapiens
acgtgaatgtgtaaa

SEQ ID NO: 149927 - DNA, 15 bp, Homo sapiens
cacgtgaatgtgtaa

SEQ ID NO: 149928 - DNA, 15 bp, Homo sapiens
acacgtgaatgtgta

SEQ ID NO: 149929 - DNA, 15 bp, Homo sapiens
tacacgtgaatgtgt

SEQ ID NO: 149930 - DNA, 15 bp, Homo sapiens
atacacgtgaatgtg

SEQ ID NO: 149931 - DNA, 15 bp, Homo sapiens
aatacacgtgaatgt

SEQ ID NO: 149932 - DNA, 15 bp, Homo sapiens
aaatacacgtgaatg

SEQ ID NO: 149933 - DNA, 15 bp, Homo sapiens
aaaatacacgtgaat

SEQ ID NO: 149934 - DNA, 15 bp, Homo sapiens
aaaaatacacgtgaa

SEQ ID NO: 149935 - DNA, 15 bp, Homo sapiens
aaaaaatacacgtga

SEQ ID NO: 149936 - DNA, 15 bp, Homo sapiens
caaaaaatacacgtg

SEQ ID NO: 149937 - DNA, 15 bp, Homo sapiens
gcaaaaaatacacgt

SEQ ID NO: 149938 - DNA, 15 bp, Homo sapiens
ggcaaaaaatacacg

SEQ ID NO: 149939 - DNA, 15 bp, Homo sapiens
aggcaaaaaatacac

SEQ ID NO: 149940 - DNA, 15 bp, Homo sapiens
aaggcaaaaaataca

SEQ ID NO: 149941 - DNA, 15 bp, Homo sapiens
aaaggcaaaaaatac

SEQ ID NO: 149942 - DNA, 15 bp, Homo sapiens
taaaggcaaaaaata

SEQ ID NO: 149943 - DNA, 15 bp, Homo sapiens
ttaaaggcaaaaaat

SEQ ID NO: 149944 - DNA, 15 bp, Homo sapiens
tttaaaggcaaaaaa

SEQ ID NO: 149945 - DNA, 15 bp, Homo sapiens
ttttaaaggcaaaaa

SEQ ID NO: 149946 - DNA, 15 bp, Homo sapiens
tttttaaaggcaaaa

SEQ ID NO: 149947 - DNA, 15 bp, Homo sapiens
atttttaaaggcaaa

SEQ ID NO: 149948 - DNA, 15 bp, Homo sapiens
tatttttaaaggcaa

SEQ ID NO: 149949 - DNA, 15 bp, Homo sapiens
atatttttaaaggca

SEQ ID NO: 149950 - DNA, 15 bp, Homo sapiens
aatatttttaaaggc

SEQ ID NO: 149951 - DNA, 15 bp, Homo sapiens
aaatatttttaaagg

SEQ ID NO: 149952 - DNA, 15 bp, Homo sapiens
gaaatatttttaaag

SEQ ID NO: 149953 - DNA, 15 bp, Homo sapiens
agaaatatttttaaa

SEQ ID NO: 149954 - DNA, 15 bp, Homo sapiens
aagaaatatttttaa

SEQ ID NO: 149955 - DNA, 15 bp, Homo sapiens
gaagaaatattttta

SEQ ID NO: 149956 - DNA, 15 bp, Homo sapiens
gagaagaaatatttt

SEQ ID NO: 149957 - DNA, 15 bp, Homo sapiens
cgagaagaaatattt

SEQ ID NO: 149958 - DNA, 15 bp, Homo sapiens
ccgagaagaaatatt

SEQ ID NO: 149959 - DNA, 15 bp, Homo sapiens
accgagaagaaatat

SEQ ID NO: 149960 - DNA, 15 bp, Homo sapiens
aaccgagaagaaata

SEQ ID NO: 149961 - DNA, 15 bp, Homo sapiens
taaccgagaagaaat

SEQ ID NO: 149962 - DNA, 15 bp, Homo sapiens
ataaccgagaagaaa

SEQ ID NO: 149963 - DNA, 15 bp, Homo sapiens
tataaccgagaagaa

SEQ ID NO: 149964 - DNA, 15 bp, Homo sapiens
gtataaccgagaaga

SEQ ID NO: 149965 - DNA, 15 bp, Homo sapiens
tgtataaccgagaag

SEQ ID NO: 149966 - DNA, 15 bp, Homo sapiens
atgtataaccgagaa

SEQ ID NO: 149967 - DNA, 15 bp, Homo sapiens
gatgtataaccgaga

SEQ ID NO: 149968 - DNA, 15 bp, Homo sapiens
ggatgtataaccgag

SEQ ID NO: 149969 - DNA, 15 bp, Homo sapiens
tggatgtataaccga

SEQ ID NO: 149970 - DNA, 15 bp, Homo sapiens
ttggatgtataaccg

SEQ ID NO: 149971 - DNA, 15 bp, Homo sapiens
attggatgtataacc

SEQ ID NO: 149972 - DNA, 15 bp, Homo sapiens
tattggatgtataac

SEQ ID NO: 149973 - DNA, 15 bp, Homo sapiens
ttattggatgtataa

SEQ ID NO: 149974 - DNA, 15 bp, Homo sapiens
tttattggatgtata

SEQ ID NO: 149975 - DNA, 15 bp, Homo sapiens
ttttattggatgtat

SEQ ID NO: 149976 - DNA, 15 bp, Homo sapiens
attttattggatgta

SEQ ID NO: 149977 - DNA, 15 bp, Homo sapiens
aattttattggatgt

SEQ ID NO: 149978 - DNA, 15 bp, Homo sapiens
aaattttattggatg

SEQ ID NO: 149979 - DNA, 15 bp, Homo sapiens
caaattttattggat

SEQ ID NO: 149980 - DNA, 15 bp, Homo sapiens
tcaaattttattgga

SEQ ID NO: 149981 - DNA, 15 bp, Homo sapiens
ctcaaattttattgg

SEQ ID NO: 149982 - DNA, 15 bp, Homo sapiens
gctcaaattttattg

SEQ ID NO: 149983 - DNA, 15 bp, Homo sapiens
tgctcaaattttatt

SEQ ID NO: 149984 - DNA, 15 bp, Homo sapiens
ctgctcaaattttat

SEQ ID NO: 149985 - DNA, 15 bp, Homo sapiens
cctgctcaaatttta

SEQ ID NO: 149986 - DNA, 15 bp, Homo sapiens
tcctgctcaaatttt

SEQ ID NO: 149987 - DNA, 15 bp, Homo sapiens
ttcctgctcaaattt

SEQ ID NO: 149988 - DNA, 15 bp, Homo sapiens
cttcctgctcaaatt

SEQ ID NO: 149989 - DNA, 15 bp, Homo sapiens
gcttcctgctcaaat

SEQ ID NO: 149990 - DNA, 15 bp, Homo sapiens
tgcttcctgctcaaa

SEQ ID NO: 149991 - DNA, 15 bp, Homo sapiens
ttgcttcctgctcaa

SEQ ID NO: 149992 - DNA, 15 bp, Homo sapiens
tttgcttcctgctca

SEQ ID NO: 149993 - DNA, 15 bp, Homo sapiens
ttttgcttcctgctc

SEQ ID NO: 149994 - DNA, 15 bp, Homo sapiens
tttttgcttcctgct

SEQ ID NO: 149995 - DNA, 15 bp, Homo sapiens
gtttttgcttcctgc

SEQ ID NO: 149996 - DNA, 15 bp, Homo sapiens
cgtttttgcttcctg

SEQ ID NO: 149997 - DNA, 15 bp, Homo sapiens
acgtttttgcttcct

SEQ ID NO: 149998 - DNA, 15 bp, Homo sapiens
tacgtttttgcttcc

SEQ ID NO: 149999 - DNA, 15 bp, Homo sapiens
ttacgtttttgcttc

SEQ ID NO: 150000 - DNA, 15 bp, Homo sapiens
cttacgtttttgctt

SEQ ID NO: 150001 - DNA, 15 bp, Homo sapiens
acttacgtttttgct

SEQ ID NO: 150002 - DNA, 15 bp, Homo sapiens
cacttacgtttttgc

SEQ ID NO: 150003 - DNA, 15 bp, Homo sapiens
gcacttacgtttttg

SEQ ID NO: 150004 - DNA, 15 bp, Homo sapiens
agcacttacgttttt

SEQ ID NO: 150005 - DNA, 15 bp, Homo sapiens
cagcacttacgtttt

SEQ ID NO: 150006 - DNA, 15 bp, Homo sapiens
gcagcacttacgttt

SEQ ID NO: 150007 - DNA, 15 bp, Homo sapiens
agcagcacttacgtt

SEQ ID NO: 150008 - DNA, 15 bp, Homo sapiens
aagcagcacttacgt

SEQ ID NO: 150009 - DNA, 15 bp, Homo sapiens
taagcagcacttacg

SEQ ID NO: 150010 - DNA, 15 bp, Homo sapiens
gtaagcagcacttac

SEQ ID NO: 150011 - DNA, 15 bp, Homo sapiens
agtaagcagcactta

SEQ ID NO: 150012 - DNA, 15 bp, Homo sapiens
aagtaagcagcactt

SEQ ID NO: 150013 - DNA, 15 bp, Homo sapiens
caagtaagcagcact

SEQ ID NO: 150014 - DNA, 15 bp, Homo sapiens
ccaagtaagcagcac

SEQ ID NO: 150015 - DNA, 15 bp, Homo sapiens
tccaagtaagcagca

SEQ ID NO: 150016 - DNA, 15 bp, Homo sapiens
ctccaagtaagcagc

SEQ ID NO: 150017 - DNA, 15 bp, Homo sapiens
tctccaagtaagcag

SEQ ID NO: 150018 - DNA, 15 bp, Homo sapiens
atctccaagtaagca

SEQ ID NO: 150019 - DNA, 15 bp, Homo sapiens
tatctccaagtaagc

SEQ ID NO: 150020 - DNA, 15 bp, Homo sapiens
atatctccaagtaag

SEQ ID NO: 150021 - DNA, 15 bp, Homo sapiens
tatatctccaagtaa

SEQ ID NO: 150022 - DNA, 15 bp, Homo sapiens
ttatatctccaagta

SEQ ID NO: 150023 - DNA, 15 bp, Homo sapiens
attatatctccaagt

SEQ ID NO: 150024 - DNA, 15 bp, Homo sapiens
aattatatctccaag

SEQ ID NO: 150025 - DNA, 15 bp, Homo sapiens
taattatatctccaa

SEQ ID NO: 150026 - DNA, 15 bp, Homo sapiens
ctaattatatctcca

SEQ ID NO: 150027 - DNA, 15 bp, Homo sapiens
gctaattatatctcc

SEQ ID NO: 150028 - DNA, 15 bp, Homo sapiens
tgctaattatatctc

SEQ ID NO: 150029 - DNA, 15 bp, Homo sapiens
ctgctaattatatct

SEQ ID NO: 150030 - DNA, 15 bp, Homo sapiens
gctgctaattatatc

SEQ ID NO: 150031 - DNA, 15 bp, Homo sapiens
tgctgctaattatat

SEQ ID NO: 150032 - DNA, 15 bp, Homo sapiens
atgctgctaattata

SEQ ID NO: 150033 - DNA, 15 bp, Homo sapiens
aatgctgctaattat

SEQ ID NO: 150034 - DNA, 15 bp, Homo sapiens
caatgctgctaatta

SEQ ID NO: 150035 - DNA, 15 bp, Homo sapiens
tcaatgctgctaatt

SEQ ID NO: 150036 - DNA, 15 bp, Homo sapiens
ttcaatgctgctaat

SEQ ID NO: 150037 - DNA, 15 bp, Homo sapiens
tttcaatgctgctaa

SEQ ID NO: 150038 - DNA, 15 bp, Homo sapiens
atttcaatgctgcta

SEQ ID NO: 150039 - DNA, 15 bp, Homo sapiens
aatttcaatgctgct

SEQ ID NO: 150040 - DNA, 15 bp, Homo sapiens
caatttcaatgctgc

SEQ ID NO: 150041 - DNA, 15 bp, Homo sapiens
gcaatttcaatgctg

SEQ ID NO: 150042 - DNA, 15 bp, Homo sapiens
ggcaatttcaatgct

SEQ ID NO: 150043 - DNA, 15 bp, Homo sapiens
gggcaatttcaatgc

SEQ ID NO: 150044 - DNA, 15 bp, Homo sapiens
agggcaatttcaatg

SEQ ID NO: 150045 - DNA, 15 bp, Homo sapiens
cagggcaatttcaat

SEQ ID NO: 150046 - DNA, 15 bp, Homo sapiens
tcagggcaatttcaa

SEQ ID NO: 150047 - DNA, 15 bp, Homo sapiens
atcagggcaatttca

SEQ ID NO: 150048 - DNA, 15 bp, Homo sapiens
catcagggcaatttc

SEQ ID NO: 150049 - DNA, 15 bp, Homo sapiens
tcatcagggcaattt

SEQ ID NO: 150050 - DNA, 15 bp, Homo sapiens
gtcatcagggcaatt

SEQ ID NO: 150051 - DNA, 15 bp, Homo sapiens
ggtcatcagggcaat

SEQ ID NO: 150052 - DNA, 15 bp, Homo sapiens
aggtcatcagggcaa

SEQ ID NO: 150053 - DNA, 15 bp, Homo sapiens
taggtcatcagggca

SEQ ID NO: 150054 - DNA, 15 bp, Homo sapiens
ttaggtcatcagggc

SEQ ID NO: 150055 - DNA, 15 bp, Homo sapiens
tttaggtcatcaggg

SEQ ID NO: 150056 - DNA, 15 bp, Homo sapiens
ttttaggtcatcagg

SEQ ID NO: 150057 - DNA, 15 bp, Homo sapiens
attttaggtcatcag

SEQ ID NO: 150058 - DNA, 15 bp, Homo sapiens
gattttaggtcatca

SEQ ID NO: 150059 - DNA, 15 bp, Homo sapiens
tgattttaggtcatc

SEQ ID NO: 150060 - DNA, 15 bp, Homo sapiens
gtgattttaggtcat

SEQ ID NO: 150061 - DNA, 15 bp, Homo sapiens
ggtgattttaggtca

SEQ ID NO: 150062 - DNA, 15 bp, Homo sapiens
gggtgattttaggtc

SEQ ID NO: 150063 - DNA, 15 bp, Homo sapiens
agggtgattttaggt

SEQ ID NO: 150064 - DNA, 15 bp, Homo sapiens
tagggtgattttagg

SEQ ID NO: 150065 - DNA, 15 bp, Homo sapiens
gtagggtgattttag

SEQ ID NO: 150066 - DNA, 15 bp, Homo sapiens
tgtagggtgatttta

SEQ ID NO: 150067 - DNA, 15 bp, Homo sapiens
gtgtagggtgatttt

SEQ ID NO: 150068 - DNA, 15 bp, Homo sapiens
agtgtagggtgattt

SEQ ID NO: 150069 - DNA, 15 bp, Homo sapiens
cagtgtagggtgatt

SEQ ID NO: 150070 - DNA, 15 bp, Homo sapiens
ccagtgtagggtgat

SEQ ID NO: 150071 - DNA, 15 bp, Homo sapiens
tccagtgtagggtga

SEQ ID NO: 150072 - DNA, 15 bp, Homo sapiens
atccagtgtagggtg

SEQ ID NO: 150073 - DNA, 15 bp, Homo sapiens
catccagtgtagggt

SEQ ID NO: 150074 - DNA, 15 bp, Homo sapiens
gcatccagtgtaggg

SEQ ID NO: 150075 - DNA, 15 bp, Homo sapiens
agcatccagtgtagg

SEQ ID NO: 150076 - DNA, 15 bp, Homo sapiens
tagcatccagtgtag

SEQ ID NO: 150077 - DNA, 15 bp, Homo sapiens
ttagcatccagtgta

SEQ ID NO: 150078 - DNA, 15 bp, Homo sapiens
attagcatccagtgt

SEQ ID NO: 150079 - DNA, 15 bp, Homo sapiens
aattagcatccagtg

SEQ ID NO: 150080 - DNA, 15 bp, Homo sapiens
aaattagcatccagt

SEQ ID NO: 150081 - DNA, 15 bp, Homo sapiens
aaaattagcatccag

SEQ ID NO: 150082 - DNA, 15 bp, Homo sapiens
gaaaattagcatcca

SEQ ID NO: 150083 - DNA, 15 bp, Homo sapiens
agaaaattagcatcc

SEQ ID NO: 150084 - DNA, 15 bp, Homo sapiens
gagaaaattagcatc

SEQ ID NO: 150085 - DNA, 15 bp, Homo sapiens
tgagaaaattagcat

SEQ ID NO: 150086 - DNA, 15 bp, Homo sapiens
ctgagaaaattagca

SEQ ID NO: 150087 - DNA, 15 bp, Homo sapiens
tctgagaaaattagc

SEQ ID NO: 150088 - DNA, 15 bp, Homo sapiens
atctgagaaaattag

SEQ ID NO: 150089 - DNA, 15 bp, Homo sapiens
tatctgagaaaatta

SEQ ID NO: 150090 - DNA, 15 bp, Homo sapiens
atatctgagaaaatt

SEQ ID NO: 150091 - DNA, 15 bp, Homo sapiens
catatctgagaaaat

SEQ ID NO: 150092 - DNA, 15 bp, Homo sapiens
ccatatctgagaaaa

SEQ ID NO: 150093 - DNA, 15 bp, Homo sapiens
accatatctgagaaa

SEQ ID NO: 150094 - DNA, 15 bp, Homo sapiens
aaccatatctgagaa

SEQ ID NO: 150095 - DNA, 15 bp, Homo sapiens
aaaccatatctgaga

SEQ ID NO: 150096 - DNA, 15 bp, Homo sapiens
aaaaccatatctgag

SEQ ID NO: 150097 - DNA, 15 bp, Homo sapiens
caaaaccatatctga

SEQ ID NO: 150098 - DNA, 15 bp, Homo sapiens
acaaaaccatatctg

SEQ ID NO: 150099 - DNA, 15 bp, Homo sapiens
aacaaaaccatatct

SEQ ID NO: 150100 - DNA, 15 bp, Homo sapiens
aaacaaaaccatatc

SEQ ID NO: 150101 - DNA, 15 bp, Homo sapiens
caaacaaaaccatat

SEQ ID NO: 150102 - DNA, 15 bp, Homo sapiens
gcaaacaaaaccata

SEQ ID NO: 150103 - DNA, 15 bp, Homo sapiens
agcaaacaaaaccat

SEQ ID NO: 150104 - DNA, 15 bp, Homo sapiens
aagcaaacaaaacca

SEQ ID NO: 150105 - DNA, 15 bp, Homo sapiens
taagcaaacaaaacc

SEQ ID NO: 150106 - DNA, 15 bp, Homo sapiens
ctaagcaaacaaaac

SEQ ID NO: 150107 - DNA, 15 bp, Homo sapiens
actaagcaaacaaaa

SEQ ID NO: 150108 - DNA, 15 bp, Homo sapiens
aactaagcaaacaaa

SEQ ID NO: 150109 - DNA, 15 bp, Homo sapiens
aaactaagcaaacaa

SEQ ID NO: 150110 - DNA, 15 bp, Homo sapiens
gaaactaagcaaaca

SEQ ID NO: 150111 - DNA, 15 bp, Homo sapiens
agaaactaagcaaac

SEQ ID NO: 150112 - DNA, 15 bp, Homo sapiens
aagaaactaagcaaa

SEQ ID NO: 150113 - DNA, 15 bp, Homo sapiens
aaagaaactaagcaa

SEQ ID NO: 150114 - DNA, 15 bp, Homo sapiens
taaagaaactaagca

SEQ ID NO: 150115 - DNA, 15 bp, Homo sapiens
ttaaagaaactaagc

SEQ ID NO: 150116 - DNA, 15 bp, Homo sapiens
tttaaagaaactaag

SEQ ID NO: 150117 - DNA, 15 bp, Homo sapiens
ttttaaagaaactaa

SEQ ID NO: 150118 - DNA, 15 bp, Homo sapiens
attttaaagaaacta

SEQ ID NO: 150119 - DNA, 15 bp, Homo sapiens
aattttaaagaaact

SEQ ID NO: 150120 - DNA, 15 bp, Homo sapiens
aaattttaaagaaac

SEQ ID NO: 150121 - DNA, 15 bp, Homo sapiens
aaaattttaaagaaa

SEQ ID NO: 150122 - DNA, 15 bp, Homo sapiens
gaaaattttaaagaa

SEQ ID NO: 150123 - DNA, 15 bp, Homo sapiens
tgaaaattttaaaga

SEQ ID NO: 150124 - DNA, 15 bp, Homo sapiens
atgaaaattttaaag

SEQ ID NO: 150125 - DNA, 15 bp, Homo sapiens
catgaaaattttaaa

SEQ ID NO: 150126 - DNA, 15 bp, Homo sapiens
gcatgaaaattttaa

SEQ ID NO: 150127 - DNA, 15 bp, Homo sapiens
ggcatgaaaatttta

SEQ ID NO: 150128 - DNA, 15 bp, Homo sapiens
aggcatgaaaatttt

SEQ ID NO: 150129 - DNA, 15 bp, Homo sapiens
taggcatgaaaattt

SEQ ID NO: 150130 - DNA, 15 bp, Homo sapiens
ataggcatgaaaatt

SEQ ID NO: 150131 - DNA, 15 bp, Homo sapiens
tataggcatgaaaat

SEQ ID NO: 150132 - DNA, 15 bp, Homo sapiens
ttataggcatgaaaa

SEQ ID NO: 150133 - DNA, 15 bp, Homo sapiens
tttataggcatgaaa

SEQ ID NO: 150134 - DNA, 15 bp, Homo sapiens
ttttataggcatgaa

SEQ ID NO: 150135 - DNA, 15 bp, Homo sapiens
attttataggcatga

SEQ ID NO: 150136 - DNA, 15 bp, Homo sapiens
tattttataggcatg

SEQ ID NO: 150137 - DNA, 15 bp, Homo sapiens
ttattttataggcat

SEQ ID NO: 150138 - DNA, 15 bp, Homo sapiens
attattttataggca

SEQ ID NO: 150139 - DNA, 15 bp, Homo sapiens
aattattttataggc

SEQ ID NO: 150140 - DNA, 15 bp, Homo sapiens
aaattattttatagg

SEQ ID NO: 150141 - DNA, 15 bp, Homo sapiens
aaaattattttatag

SEQ ID NO: 150142 - DNA, 15 bp, Homo sapiens
aaaaattattttata

SEQ ID NO: 150143 - DNA, 15 bp, Homo sapiens
gaaaaattattttat

SEQ ID NO: 150144 - DNA, 15 bp, Homo sapiens
agaaaaattatttta

SEQ ID NO: 150145 - DNA, 15 bp, Homo sapiens
aagaaaaattatttt

SEQ ID NO: 150146 - DNA, 15 bp, Homo sapiens
aaagaaaaattattt

SEQ ID NO: 150147 - DNA, 15 bp, Homo sapiens
aaaagaaaaattatt

SEQ ID NO: 150148 - DNA, 15 bp, Homo sapiens
taaaagaaaaattat

SEQ ID NO: 150149 - DNA, 15 bp, Homo sapiens
ctaaaagaaaaatta

SEQ ID NO: 150150 - DNA, 15 bp, Homo sapiens
actaaaagaaaaatt

SEQ ID NO: 150151 - DNA, 15 bp, Homo sapiens
tactaaaagaaaaat

SEQ ID NO: 150152 - DNA, 15 bp, Homo sapiens
ctactaaaagaaaaa

SEQ ID NO: 150153 - DNA, 15 bp, Homo sapiens
tctactaaaagaaaa

SEQ ID NO: 150154 - DNA, 15 bp, Homo sapiens
ctctactaaaagaaa

SEQ ID NO: 150155 - DNA, 15 bp, Homo sapiens
gctctactaaaagaa

SEQ ID NO: 150156 - DNA, 15 bp, Homo sapiens
tgctctactaaaaga

SEQ ID NO: 150157 - DNA, 15 bp, Homo sapiens
gtgctctactaaaag

SEQ ID NO: 150158 - DNA, 15 bp, Homo sapiens
tgtgctctactaaaa

SEQ ID NO: 150159 - DNA, 15 bp, Homo sapiens
ctgtgctctactaaa

SEQ ID NO: 150160 - DNA, 15 bp, Homo sapiens
actgtgctctactaa

SEQ ID NO: 150161 - DNA, 15 bp, Homo sapiens
tactgtgctctacta

SEQ ID NO: 150162 - DNA, 15 bp, Homo sapiens
ctactgtgctctact

SEQ ID NO: 150163 - DNA, 15 bp, Homo sapiens
tctactgtgctctac

SEQ ID NO: 150164 - DNA, 15 bp, Homo sapiens
ttctactgtgctcta

SEQ ID NO: 150165 - DNA, 15 bp, Homo sapiens
tttctactgtgctct

SEQ ID NO: 150166 - DNA, 15 bp, Homo sapiens
ttttctactgtgctc

SEQ ID NO: 150167 - DNA, 15 bp, Homo sapiens
tttttctactgtgct

SEQ ID NO: 150168 - DNA, 15 bp, Homo sapiens
ttttttctactgtgc

SEQ ID NO: 150169 - DNA, 15 bp, Homo sapiens
tttttttctactgtg

SEQ ID NO: 150170 - DNA, 15 bp, Homo sapiens
ctttttttctactgt

SEQ ID NO: 150171 - DNA, 15 bp, Homo sapiens
gctttttttctactg

SEQ ID NO: 150172 - DNA, 15 bp, Homo sapiens
agctttttttctact

SEQ ID NO: 150173 - DNA, 15 bp, Homo sapiens
cagctttttttctac

SEQ ID NO: 150174 - DNA, 15 bp, Homo sapiens
tcagctttttttcta

SEQ ID NO: 150175 - DNA, 15 bp, Homo sapiens
atcagctttttttct

SEQ ID NO: 150176 - DNA, 15 bp, Homo sapiens
catcagctttttttc

SEQ ID NO: 150177 - DNA, 15 bp, Homo sapiens
acatcagcttttttt

SEQ ID NO: 150178 - DNA, 15 bp, Homo sapiens
tacatcagctttttt

SEQ ID NO: 150179 - DNA, 15 bp, Homo sapiens
ttacatcagcttttt

SEQ ID NO: 150180 - DNA, 15 bp, Homo sapiens
tttacatcagctttt

SEQ ID NO: 150181 - DNA, 15 bp, Homo sapiens
atttacatcagcttt

SEQ ID NO: 150182 - DNA, 15 bp, Homo sapiens
catttacatcagctt

SEQ ID NO: 150183 - DNA, 15 bp, Homo sapiens
tcatttacatcagct

SEQ ID NO: 150184 - DNA, 15 bp, Homo sapiens
atcatttacatcagc

SEQ ID NO: 150185 - DNA, 15 bp, Homo sapiens
aatcatttacatcag

SEQ ID NO: 150186 - DNA, 15 bp, Homo sapiens
aaatcatttacatca

SEQ ID NO: 150187 - DNA, 15 bp, Homo sapiens
caaatcatttacatc

SEQ ID NO: 150188 - DNA, 15 bp, Homo sapiens
tcaaatcatttacat

SEQ ID NO: 150189 - DNA, 15 bp, Homo sapiens
ttcaaatcatttaca

SEQ ID NO: 150190 - DNA, 15 bp, Homo sapiens
tttcaaatcatttac

SEQ ID NO: 150191 - DNA, 15 bp, Homo sapiens
ttttcaaatcattta

SEQ ID NO: 150192 - DNA, 15 bp, Homo sapiens
tttttcaaatcattt

SEQ ID NO: 150193 - DNA, 15 bp, Homo sapiens
atttttcaaatcatt

SEQ ID NO: 150194 - DNA, 15 bp, Homo sapiens
tatttttcaaatcat

SEQ ID NO: 150195 - DNA, 15 bp, Homo sapiens
ttatttttcaaatca

SEQ ID NO: 150196 - DNA, 15 bp, Homo sapiens
attatttttcaaatc

SEQ ID NO: 150197 - DNA, 15 bp, Homo sapiens
tattatttttcaaat

SEQ ID NO: 150198 - DNA, 15 bp, Homo sapiens
atattatttttcaaa

SEQ ID NO: 150199 - DNA, 15 bp, Homo sapiens
aatattatttttcaa

SEQ ID NO: 150200 - DNA, 15 bp, Homo sapiens
caatattatttttca

SEQ ID NO: 150201 - DNA, 15 bp, Homo sapiens
tcaatattatttttc

SEQ ID NO: 150202 - DNA, 15 bp, Homo sapiens
ttcaatattattttt

SEQ ID NO: 150203 - DNA, 15 bp, Homo sapiens
attcaatattatttt

SEQ ID NO: 150204 - DNA, 15 bp, Homo sapiens
aattcaatattattt

SEQ ID NO: 150205 - DNA, 15 bp, Homo sapiens
aaattcaatattatt

SEQ ID NO: 150206 - DNA, 15 bp, Homo sapiens
taaattcaatattat

SEQ ID NO: 150207 - DNA, 15 bp, Homo sapiens
ttaaattcaatatta

SEQ ID NO: 150208 - DNA, 15 bp, Homo sapiens
attaaattcaatatt

SEQ ID NO: 150209 - DNA, 15 bp, Homo sapiens
aattaaattcaatat

SEQ ID NO: 150210 - DNA, 15 bp, Homo sapiens
aaattaaattcaata

SEQ ID NO: 150211 - DNA, 15 bp, Homo sapiens
caaattaaattcaat

SEQ ID NO: 150212 - DNA, 15 bp, Homo sapiens
acaaattaaattcaa

SEQ ID NO: 150213 - DNA, 15 bp, Homo sapiens
aacaaattaaattca

SEQ ID NO: 150214 - DNA, 15 bp, Homo sapiens
aaacaaattaaattc

SEQ ID NO: 150215 - DNA, 15 bp, Homo sapiens
aaaacaaattaaatt

SEQ ID NO: 150216 - DNA, 15 bp, Homo sapiens
aaaaacaaattaaat

SEQ ID NO: 150217 - DNA, 15 bp, Homo sapiens
taaaaacaaattaaa

SEQ ID NO: 150218 - DNA, 15 bp, Homo sapiens
ataaaaacaaattaa

SEQ ID NO: 150219 - DNA, 15 bp, Homo sapiens
aataaaaacaaatta

SEQ ID NO: 150220 - DNA, 15 bp, Homo sapiens
caataaaaacaaatt

SEQ ID NO: 150221 - DNA, 15 bp, Homo sapiens
acaataaaaacaaat

SEQ ID NO: 150222 - DNA, 15 bp, Homo sapiens
aacaataaaaacaaa

SEQ ID NO: 150223 - DNA, 15 bp, Homo sapiens
taacaataaaaacaa

SEQ ID NO: 150224 - DNA, 15 bp, Homo sapiens
gtaacaataaaaaca

SEQ ID NO: 150225 - DNA, 15 bp, Homo sapiens
cgtaacaataaaaac

SEQ ID NO: 150226 - DNA, 15 bp, Homo sapiens
acgtaacaataaaaa

SEQ ID NO: 150227 - DNA, 15 bp, Homo sapiens
cacgtaacaataaaa

SEQ ID NO: 150228 - DNA, 15 bp, Homo sapiens
tcacgtaacaataaa

SEQ ID NO: 150229 - DNA, 15 bp, Homo sapiens
atcacgtaacaataa

SEQ ID NO: 150230 - DNA, 15 bp, Homo sapiens
aatcacgtaacaata

SEQ ID NO: 150231 - DNA, 15 bp, Homo sapiens
taatcacgtaacaat

SEQ ID NO: 150232 - DNA, 15 bp, Homo sapiens
gtaatcacgtaacaa

SEQ ID NO: 150233 - DNA, 15 bp, Homo sapiens
agtaatcacgtaaca

SEQ ID NO: 150234 - DNA, 15 bp, Homo sapiens
aagtaatcacgtaac

SEQ ID NO: 150235 - DNA, 15 bp, Homo sapiens
aaagtaatcacgtaa

SEQ ID NO: 150236 - DNA, 15 bp, Homo sapiens
caaagtaatcacgta

SEQ ID NO: 150237 - DNA, 15 bp, Homo sapiens
ccaaagtaatcacgt

SEQ ID NO: 150238 - DNA, 15 bp, Homo sapiens
cccaaagtaatcacg

SEQ ID NO: 150239 - DNA, 15 bp, Homo sapiens
ccccaaagtaatcac

SEQ ID NO: 150240 - DNA, 15 bp, Homo sapiens
accccaaagtaatca

SEQ ID NO: 150241 - DNA, 15 bp, Homo sapiens
caccccaaagtaatc

SEQ ID NO: 150242 - DNA, 15 bp, Homo sapiens
acaccccaaagtaat

SEQ ID NO: 150243 - DNA, 15 bp, Homo sapiens
aacaccccaaagtaa

SEQ ID NO: 150244 - DNA, 15 bp, Homo sapiens
aaacaccccaaagta

SEQ ID NO: 150245 - DNA, 15 bp, Homo sapiens
aaaacaccccaaagt

SEQ ID NO: 150246 - DNA, 15 bp, Homo sapiens
taaaacaccccaaag

SEQ ID NO: 150247 - DNA, 15 bp, Homo sapiens
ataaaacaccccaaa

SEQ ID NO: 150248 - DNA, 15 bp, Homo sapiens
tataaaacaccccaa

SEQ ID NO: 150249 - DNA, 15 bp, Homo sapiens
atataaaacacccca

SEQ ID NO: 150250 - DNA, 15 bp, Homo sapiens
gatataaaacacccc

SEQ ID NO: 150251 - DNA, 15 bp, Homo sapiens
tgatataaaacaccc

SEQ ID NO: 150252 - DNA, 15 bp, Homo sapiens
atgatataaaacacc

SEQ ID NO: 150253 - DNA, 15 bp, Homo sapiens
catgatataaaacac

SEQ ID NO: 150254 - DNA, 15 bp, Homo sapiens
tcatgatataaaaca

SEQ ID NO: 150255 - DNA, 15 bp, Homo sapiens
ttcatgatataaaac

SEQ ID NO: 150256 - DNA, 15 bp, Homo sapiens
cttcatgatataaaa

SEQ ID NO: 150257 - DNA, 15 bp, Homo sapiens
acttcatgatataaa

SEQ ID NO: 150258 - DNA, 15 bp, Homo sapiens
gacttcatgatataa

SEQ ID NO: 150259 - DNA, 15 bp, Homo sapiens
agacttcatgatata

SEQ ID NO: 150260 - DNA, 15 bp, Homo sapiens
aagacttcatgatat

SEQ ID NO: 150261 - DNA, 15 bp, Homo sapiens
aaagacttcatgata

SEQ ID NO: 150262 - DNA, 15 bp, Homo sapiens
taaagacttcatgat

SEQ ID NO: 150263 - DNA, 15 bp, Homo sapiens
ctaaagacttcatga

SEQ ID NO: 150264 - DNA, 15 bp, Homo sapiens
tctaaagacttcatg

SEQ ID NO: 150265 - DNA, 15 bp, Homo sapiens
atctaaagacttcat

SEQ ID NO: 150266 - DNA, 15 bp, Homo sapiens
aatctaaagacttca

SEQ ID NO: 150267 - DNA, 15 bp, Homo sapiens
taatctaaagacttc

SEQ ID NO: 150268 - DNA, 15 bp, Homo sapiens
ctaatctaaagactt

SEQ ID NO: 150269 - DNA, 15 bp, Homo sapiens
tctaatctaaagact

SEQ ID NO: 150270 - DNA, 15 bp, Homo sapiens
ttctaatctaaagac

SEQ ID NO: 150271 - DNA, 15 bp, Homo sapiens
gttctaatctaaaga

SEQ ID NO: 150272 - DNA, 15 bp, Homo sapiens
agttctaatctaaag

SEQ ID NO: 150273 - DNA, 15 bp, Homo sapiens
cagttctaatctaaa

SEQ ID NO: 150274 - DNA, 15 bp, Homo sapiens
ccagttctaatctaa

SEQ ID NO: 150275 - DNA, 15 bp, Homo sapiens
cccagttctaatcta

SEQ ID NO: 150276 - DNA, 15 bp, Homo sapiens
acccagttctaatct

SEQ ID NO: 150277 - DNA, 15 bp, Homo sapiens
aacccagttctaatc

SEQ ID NO: 150278 - DNA, 15 bp, Homo sapiens
taacccagttctaat

SEQ ID NO: 150279 - DNA, 15 bp, Homo sapiens
ataacccagttctaa

SEQ ID NO: 150280 - DNA, 15 bp, Homo sapiens
aataacccagttcta

SEQ ID NO: 150281 - DNA, 15 bp, Homo sapiens
aaataacccagttct

SEQ ID NO: 150282 - DNA, 15 bp, Homo sapiens
caaataacccagttc

SEQ ID NO: 150283 - DNA, 15 bp, Homo sapiens
acaaataacccagtt

SEQ ID NO: 150284 - DNA, 15 bp, Homo sapiens
cacaaataacccagt

SEQ ID NO: 150285 - DNA, 15 bp, Homo sapiens
acacaaataacccag

SEQ ID NO: 150286 - DNA, 15 bp, Homo sapiens
aacacaaataaccca

SEQ ID NO: 150287 - DNA, 15 bp, Homo sapiens
taacacaaataaccc

SEQ ID NO: 150288 - DNA, 15 bp, Homo sapiens
ttaacacaaataacc

SEQ ID NO: 150289 - DNA, 15 bp, Homo sapiens
attaacacaaataac

SEQ ID NO: 150290 - DNA, 15 bp, Homo sapiens
cattaacacaaataa

SEQ ID NO: 150291 - DNA, 15 bp, Homo sapiens
acattaacacaaata

SEQ ID NO: 150292 - DNA, 15 bp, Homo sapiens
aacattaacacaaat

SEQ ID NO: 150293 - DNA, 15 bp, Homo sapiens
taacattaacacaaa

SEQ ID NO: 150294 - DNA, 15 bp, Homo sapiens
ttaacattaacacaa

SEQ ID NO: 150295 - DNA, 15 bp, Homo sapiens
tttaacattaacaca

SEQ ID NO: 150296 - DNA, 15 bp, Homo sapiens
atttaacattaacac

SEQ ID NO: 150297 - DNA, 15 bp, Homo sapiens
gatttaacattaaca

SEQ ID NO: 150298 - DNA, 15 bp, Homo sapiens
tgatttaacattaac

SEQ ID NO: 150299 - DNA, 15 bp, Homo sapiens
ctgatttaacattaa

SEQ ID NO: 150300 - DNA, 15 bp, Homo sapiens
tctgatttaacatta

SEQ ID NO: 150301 - DNA, 15 bp, Homo sapiens
tcttctgatttaaca

SEQ ID NO: 150302 - DNA, 15 bp, Homo sapiens
ctcttctgatttaac

SEQ ID NO: 150303 - DNA, 15 bp, Homo sapiens
tctcttctgatttaa

SEQ ID NO: 150304 - DNA, 15 bp, Homo sapiens
atctcttctgattta

SEQ ID NO: 150305 - DNA, 15 bp, Homo sapiens
aatctcttctgattt

SEQ ID NO: 150306 - DNA, 15 bp, Homo sapiens
aaatctcttctgatt

SEQ ID NO: 150307 - DNA, 15 bp, Homo sapiens
aaaatctcttctgat

SEQ ID NO: 150308 - DNA, 15 bp, Homo sapiens
aaaaatctcttctga

SEQ ID NO: 150309 - DNA, 15 bp, Homo sapiens
caaaaatctcttctg

SEQ ID NO: 150310 - DNA, 15 bp, Homo sapiens
acaaaaatctcttct

SEQ ID NO: 150311 - DNA, 15 bp, Homo sapiens
tacaaaaatctcttc

SEQ ID NO: 150312 - DNA, 15 bp, Homo sapiens
ttacaaaaatctctt

SEQ ID NO: 150313 - DNA, 15 bp, Homo sapiens
cttacaaaaatctct

SEQ ID NO: 150314 - DNA, 15 bp, Homo sapiens
acttacaaaaatctc

SEQ ID NO: 150315 - DNA, 15 bp, Homo sapiens
gacttacaaaaatct

SEQ ID NO: 150316 - DNA, 15 bp, Homo sapiens
ggacttacaaaaatc

SEQ ID NO: 150317 - DNA, 15 bp, Homo sapiens
aggacttacaaaaat

SEQ ID NO: 150318 - DNA, 15 bp, Homo sapiens
gaggacttacaaaaa

SEQ ID NO: 150319 - DNA, 15 bp, Homo sapiens
ggaggacttacaaaa

SEQ ID NO: 150320 - DNA, 15 bp, Homo sapiens
aggaggacttacaaa

SEQ ID NO: 150321 - DNA, 15 bp, Homo sapiens
aaggaggacttacaa

SEQ ID NO: 150322 - DNA, 15 bp, Homo sapiens
taaggaggacttaca

SEQ ID NO: 150323 - DNA, 15 bp, Homo sapiens
ataaggaggacttac

SEQ ID NO: 150324 - DNA, 15 bp, Homo sapiens
aataaggaggactta

SEQ ID NO: 150325 - DNA, 15 bp, Homo sapiens
aaataaggaggactt

SEQ ID NO: 150326 - DNA, 15 bp, Homo sapiens
aaaataaggaggact

SEQ ID NO: 150327 - DNA, 15 bp, Homo sapiens
aaaaataaggaggac

SEQ ID NO: 150328 - DNA, 15 bp, Homo sapiens
aaaaaataaggagga

SEQ ID NO: 150329 - DNA, 15 bp, Homo sapiens
aaaaaaataaggagg

SEQ ID NO: 150330 - DNA, 15 bp, Homo sapiens
gaaaaaaataaggag

SEQ ID NO: 150331 - DNA, 15 bp, Homo sapiens
agaaaaaaataagga

SEQ ID NO: 150332 - DNA, 15 bp, Homo sapiens
aagaaaaaaataagg

SEQ ID NO: 150333 - DNA, 15 bp, Homo sapiens
taagaaaaaaataag

SEQ ID NO: 150334 - DNA, 15 bp, Homo sapiens
ctaagaaaaaaataa

SEQ ID NO: 150335 - DNA, 15 bp, Homo sapiens
actaagaaaaaaata

SEQ ID NO: 150336 - DNA, 15 bp, Homo sapiens
cactaagaaaaaaat

SEQ ID NO: 150337 - DNA, 15 bp, Homo sapiens
gcactaagaaaaaaa

SEQ ID NO: 150338 - DNA, 15 bp, Homo sapiens
ggcactaagaaaaaa

SEQ ID NO: 150339 - DNA, 15 bp, Homo sapiens
tggcactaagaaaaa

SEQ ID NO: 150340 - DNA, 15 bp, Homo sapiens
ttggcactaagaaaa

SEQ ID NO: 150341 - DNA, 15 bp, Homo sapiens
attggcactaagaaa

SEQ ID NO: 150342 - DNA, 15 bp, Homo sapiens
aattggcactaagaa

SEQ ID NO: 150343 - DNA, 15 bp, Homo sapiens
aaattggcactaaga

SEQ ID NO: 150344 - DNA, 15 bp, Homo sapiens
gaaattggcactaag

SEQ ID NO: 150345 - DNA, 15 bp, Homo sapiens
agaaattggcactaa

SEQ ID NO: 150346 - DNA, 15 bp, Homo sapiens
cagaaattggcacta

SEQ ID NO: 150347 - DNA, 15 bp, Homo sapiens
acagaaattggcact

SEQ ID NO: 150348 - DNA, 15 bp, Homo sapiens
tacagaaattggcac

SEQ ID NO: 150349 - DNA, 15 bp, Homo sapiens
ttacagaaattggca

SEQ ID NO: 150350 - DNA, 15 bp, Homo sapiens
tttacagaaattggc

SEQ ID NO: 150351 - DNA, 15 bp, Homo sapiens
ttttacagaaattgg

SEQ ID NO: 150352 - DNA, 15 bp, Homo sapiens
attttacagaaattg

SEQ ID NO: 150353 - DNA, 15 bp, Homo sapiens
tattttacagaaatt

SEQ ID NO: 150354 - DNA, 15 bp, Homo sapiens
atattttacagaaat

SEQ ID NO: 150355 - DNA, 15 bp, Homo sapiens
aatattttacagaaa

SEQ ID NO: 150356 - DNA, 15 bp, Homo sapiens
aaatattttacagaa

SEQ ID NO: 150357 - DNA, 15 bp, Homo sapiens
taaatattttacaga

SEQ ID NO: 150358 - DNA, 15 bp, Homo sapiens
ctaaatattttacag

SEQ ID NO: 150359 - DNA, 15 bp, Homo sapiens
gctaaatattttaca

SEQ ID NO: 150360 - DNA, 15 bp, Homo sapiens
tgctaaatattttac

SEQ ID NO: 150361 - DNA, 15 bp, Homo sapiens
ttgctaaatatttta

SEQ ID NO: 150362 - DNA, 15 bp, Homo sapiens
attgctaaatatttt

SEQ ID NO: 150363 - DNA, 15 bp, Homo sapiens
aattgctaaatattt

SEQ ID NO: 150364 - DNA, 15 bp, Homo sapiens
caattgctaaatatt

SEQ ID NO: 150365 - DNA, 15 bp, Homo sapiens
tcaattgctaaatat

SEQ ID NO: 150366 - DNA, 15 bp, Homo sapiens
ctcaattgctaaata

SEQ ID NO: 150367 - DNA, 15 bp, Homo sapiens
cctcaattgctaaat

SEQ ID NO: 150368 - DNA, 15 bp, Homo sapiens
ccctcaattgctaaa

SEQ ID NO: 150369 - DNA, 15 bp, Homo sapiens
gccctcaattgctaa

SEQ ID NO: 150370 - DNA, 15 bp, Homo sapiens
tgccctcaattgcta

SEQ ID NO: 150371 - DNA, 15 bp, Homo sapiens
atgccctcaattgct

SEQ ID NO: 150372 - DNA, 15 bp, Homo sapiens
catgccctcaattgc

SEQ ID NO: 150373 - DNA, 15 bp, Homo sapiens
ccatgccctcaattg

SEQ ID NO: 150374 - DNA, 15 bp, Homo sapiens
accatgccctcaatt

SEQ ID NO: 150375 - DNA, 15 bp, Homo sapiens
taccatgccctcaat

SEQ ID NO: 150376 - DNA, 15 bp, Homo sapiens
ttaccatgccctcaa

SEQ ID NO: 150377 - DNA, 15 bp, Homo sapiens
tttaccatgccctca

SEQ ID NO: 150378 - DNA, 15 bp, Homo sapiens
ttttaccatgccctc

SEQ ID NO: 150379 - DNA, 15 bp, Homo sapiens
tttttaccatgccct

SEQ ID NO: 150380 - DNA, 15 bp, Homo sapiens
ctttttaccatgccc

SEQ ID NO: 150381 - DNA, 15 bp, Homo sapiens
gctttttaccatgcc

SEQ ID NO: 150382 - DNA, 15 bp, Homo sapiens
tgctttttaccatgc

SEQ ID NO: 150383 - DNA, 15 bp, Homo sapiens
ctgctttttaccatg

SEQ ID NO: 150384 - DNA, 15 bp, Homo sapiens
actgctttttaccat

SEQ ID NO: 150385 - DNA, 15 bp, Homo sapiens
aactgctttttacca

SEQ ID NO: 150386 - DNA, 15 bp, Homo sapiens
aaactgctttttacc

SEQ ID NO: 150387 - DNA, 15 bp, Homo sapiens
gaaactgctttttac

SEQ ID NO: 150388 - DNA, 15 bp, Homo sapiens
ggaaactgcttttta

SEQ ID NO: 150389 - DNA, 15 bp, Homo sapiens
aggaaactgcttttt

SEQ ID NO: 150390 - DNA, 15 bp, Homo sapiens
caggaaactgctttt

SEQ ID NO: 150391 - DNA, 15 bp, Homo sapiens
acaggaaactgcttt

SEQ ID NO: 150392 - DNA, 15 bp, Homo sapiens
tacaggaaactgctt

SEQ ID NO: 150393 - DNA, 15 bp, Homo sapiens
ttacaggaaactgct

SEQ ID NO: 150394 - DNA, 15 bp, Homo sapiens
tttacaggaaactgc

SEQ ID NO: 150395 - DNA, 15 bp, Homo sapiens
ctttacaggaaactg

SEQ ID NO: 150396 - DNA, 15 bp, Homo sapiens
actttacaggaaact

SEQ ID NO: 150397 - DNA, 15 bp, Homo sapiens
tactttacaggaaac

SEQ ID NO: 150398 - DNA, 15 bp, Homo sapiens
ctactttacaggaaa

SEQ ID NO: 150399 - DNA, 15 bp, Homo sapiens
tctactttacaggaa

SEQ ID NO: 150400 - DNA, 15 bp, Homo sapiens
atctactttacagga

SEQ ID NO: 150401 - DNA, 15 bp, Homo sapiens
aatctactttacagg

SEQ ID NO: 150402 - DNA, 15 bp, Homo sapiens
caatctactttacag

SEQ ID NO: 150403 - DNA, 15 bp, Homo sapiens
ccaatctactttaca

SEQ ID NO: 150404 - DNA, 15 bp, Homo sapiens
cccaatctactttac

SEQ ID NO: 150405 - DNA, 15 bp, Homo sapiens
tcccaatctacttta

SEQ ID NO: 150406 - DNA, 15 bp, Homo sapiens
atcccaatctacttt

SEQ ID NO: 150407 - DNA, 15 bp, Homo sapiens
tatcccaatctactt

SEQ ID NO: 150408 - DNA, 15 bp, Homo sapiens
atatcccaatctact

SEQ ID NO: 150409 - DNA, 15 bp, Homo sapiens
catatcccaatctac

SEQ ID NO: 150410 - DNA, 15 bp, Homo sapiens
tcatatcccaatcta

SEQ ID NO: 150411 - DNA, 15 bp, Homo sapiens
ttcatatcccaatct

SEQ ID NO: 150412 - DNA, 15 bp, Homo sapiens
gttcatatcccaatc

SEQ ID NO: 150413 - DNA, 15 bp, Homo sapiens
tgttcatatcccaat

SEQ ID NO: 150414 - DNA, 15 bp, Homo sapiens
atgttcatatcccaa

SEQ ID NO: 150415 - DNA, 15 bp, Homo sapiens
aatgttcatatccca

SEQ ID NO: 150416 - DNA, 15 bp, Homo sapiens
taatgttcatatccc

SEQ ID NO: 150417 - DNA, 15 bp, Homo sapiens
ataatgttcatatcc

SEQ ID NO: 150418 - DNA, 15 bp, Homo sapiens
tataatgttcatatc

SEQ ID NO: 150419 - DNA, 15 bp, Homo sapiens
ctataatgttcatat

SEQ ID NO: 150420 - DNA, 15 bp, Homo sapiens
tctataatgttcata

SEQ ID NO: 150421 - DNA, 15 bp, Homo sapiens
ttctataatgttcat

SEQ ID NO: 150422 - DNA, 15 bp, Homo sapiens
tttctataatgttca

SEQ ID NO: 150423 - DNA, 15 bp, Homo sapiens
ttttctataatgttc

SEQ ID NO: 150424 - DNA, 15 bp, Homo sapiens
tttttctataatgtt

SEQ ID NO: 150425 - DNA, 15 bp, Homo sapiens
atttttctataatgt

SEQ ID NO: 150426 - DNA, 15 bp, Homo sapiens
catttttctataatg

SEQ ID NO: 150427 - DNA, 15 bp, Homo sapiens
tcatttttctataat

SEQ ID NO: 150428 - DNA, 15 bp, Homo sapiens
ctcatttttctataa

SEQ ID NO: 150429 - DNA, 15 bp, Homo sapiens
tctcatttttctata

SEQ ID NO: 150430 - DNA, 15 bp, Homo sapiens
ttctcatttttctat

SEQ ID NO: 150431 - DNA, 15 bp, Homo sapiens
tttctcatttttcta

SEQ ID NO: 150432 - DNA, 15 bp, Homo sapiens
ttttctcatttttct

SEQ ID NO: 150433 - DNA, 15 bp, Homo sapiens
tttttctcatttttc

SEQ ID NO: 150434 - DNA, 15 bp, Homo sapiens
atttttctcattttt

SEQ ID NO: 150435 - DNA, 15 bp, Homo sapiens
aatttttctcatttt

SEQ ID NO: 150436 - DNA, 15 bp, Homo sapiens
aaatttttctcattt

SEQ ID NO: 150437 - DNA, 15 bp, Homo sapiens
taaatttttctcatt

SEQ ID NO: 150438 - DNA, 15 bp, Homo sapiens
ttaaatttttctcat

SEQ ID NO: 150439 - DNA, 15 bp, Homo sapiens
tttaaatttttctca

SEQ ID NO: 150440 - DNA, 15 bp, Homo sapiens
ttttaaatttttctc

SEQ ID NO: 150441 - DNA, 15 bp, Homo sapiens
tttttaaatttttct

SEQ ID NO: 150442 - DNA, 15 bp, Homo sapiens
atttttaaatttttc

SEQ ID NO: 150443 - DNA, 15 bp, Homo sapiens
atatttttaaatttt

SEQ ID NO: 150444 - DNA, 15 bp, Homo sapiens
aatatttttaaattt

SEQ ID NO: 150445 - DNA, 15 bp, Homo sapiens
aaatatttttaaatt

SEQ ID NO: 150446 - DNA, 15 bp, Homo sapiens
cactaaatattttta

SEQ ID NO: 150447 - DNA, 15 bp, Homo sapiens
gcactaaatattttt

SEQ ID NO: 150448 - DNA, 15 bp, Homo sapiens
agcactaaatatttt

SEQ ID NO: 150449 - DNA, 15 bp, Homo sapiens
cagcactaaatattt

SEQ ID NO: 150450 - DNA, 15 bp, Homo sapiens
acagcactaaatatt

SEQ ID NO: 150451 - DNA, 15 bp, Homo sapiens
tacagcactaaatat

SEQ ID NO: 150452 - DNA, 15 bp, Homo sapiens
ttacagcactaaata

SEQ ID NO: 150453 - DNA, 15 bp, Homo sapiens
tttacagcactaaat

SEQ ID NO: 150454 - DNA, 15 bp, Homo sapiens
atttacagcactaaa

SEQ ID NO: 150455 - DNA, 15 bp, Homo sapiens
aatttacagcactaa

SEQ ID NO: 150456 - DNA, 15 bp, Homo sapiens
caatttacagcacta

SEQ ID NO: 150457 - DNA, 15 bp, Homo sapiens
tcaatttacagcact

SEQ ID NO: 150458 - DNA, 15 bp, Homo sapiens
gtcaatttacagcac

SEQ ID NO: 150459 - DNA, 15 bp, Homo sapiens
agtcaatttacagca

SEQ ID NO: 150460 - DNA, 15 bp, Homo sapiens
gagtcaatttacagc

SEQ ID NO: 150461 - DNA, 15 bp, Homo sapiens
ggagtcaatttacag

SEQ ID NO: 150462 - DNA, 15 bp, Homo sapiens
aggagtcaatttaca

SEQ ID NO: 150463 - DNA, 15 bp, Homo sapiens
aaggagtcaatttac

SEQ ID NO: 150464 - DNA, 15 bp, Homo sapiens
gaaggagtcaattta

SEQ ID NO: 150465 - DNA, 15 bp, Homo sapiens
cgaaggagtcaattt

SEQ ID NO: 150466 - DNA, 15 bp, Homo sapiens
acgaaggagtcaatt

SEQ ID NO: 150467 - DNA, 15 bp, Homo sapiens
cacgaaggagtcaat

SEQ ID NO: 150468 - DNA, 15 bp, Homo sapiens
tcacgaaggagtcaa

SEQ ID NO: 150469 - DNA, 15 bp, Homo sapiens
gtcacgaaggagtca

SEQ ID NO: 150470 - DNA, 15 bp, Homo sapiens
agtcacgaaggagtc

SEQ ID NO: 150471 - DNA, 15 bp, Homo sapiens
gagtcacgaaggagt

SEQ ID NO: 150472 - DNA, 15 bp, Homo sapiens
tgagtcacgaaggag

SEQ ID NO: 150473 - DNA, 15 bp, Homo sapiens
ttgagtcacgaagga

SEQ ID NO: 150474 - DNA, 15 bp, Homo sapiens
cttgagtcacgaagg

SEQ ID NO: 150475 - DNA, 15 bp, Homo sapiens
gcttgagtcacgaag

SEQ ID NO: 150476 - DNA, 15 bp, Homo sapiens
tgcttgagtcacgaa

SEQ ID NO: 150477 - DNA, 15 bp, Homo sapiens
atgcttgagtcacga

SEQ ID NO: 150478 - DNA, 15 bp, Homo sapiens
aatgcttgagtcacg

SEQ ID NO: 150479 - DNA, 15 bp, Homo sapiens
aaatgcttgagtcac

SEQ ID NO: 150480 - DNA, 15 bp, Homo sapiens
aaaatgcttgagtca

SEQ ID NO: 150481 - DNA, 15 bp, Homo sapiens
taaaatgcttgagtc

SEQ ID NO: 150482 - DNA, 15 bp, Homo sapiens
ctaaaatgcttgagt

SEQ ID NO: 150483 - DNA, 15 bp, Homo sapiens
tctaaaatgcttgag

SEQ ID NO: 150484 - DNA, 15 bp, Homo sapiens
ttctaaaatgcttga

SEQ ID NO: 150485 - DNA, 15 bp, Homo sapiens
tttctaaaatgcttg

SEQ ID NO: 150486 - DNA, 15 bp, Homo sapiens
ttttctaaaatgctt

SEQ ID NO: 150487 - DNA, 15 bp, Homo sapiens
attttctaaaatgct

SEQ ID NO: 150488 - DNA, 15 bp, Homo sapiens
cattttctaaaatgc

SEQ ID NO: 150489 - DNA, 15 bp, Homo sapiens
acattttctaaaatg

SEQ ID NO: 150490 - DNA, 15 bp, Homo sapiens
aacattttctaaaat

SEQ ID NO: 150491 - DNA, 15 bp, Homo sapiens
caacattttctaaaa

SEQ ID NO: 150492 - DNA, 15 bp, Homo sapiens
tcaacattttctaaa

SEQ ID NO: 150493 - DNA, 15 bp, Homo sapiens
atcaacattttctaa

SEQ ID NO: 150494 - DNA, 15 bp, Homo sapiens
aatcaacattttcta

SEQ ID NO: 150495 - DNA, 15 bp, Homo sapiens
aaatcaacattttct

SEQ ID NO: 150496 - DNA, 15 bp, Homo sapiens
taaatcaacattttc

SEQ ID NO: 150497 - DNA, 15 bp, Homo sapiens
ttaaatcaacatttt

SEQ ID NO: 150498 - DNA, 15 bp, Homo sapiens
cttaaatcaacattt

SEQ ID NO: 150499 - DNA, 15 bp, Homo sapiens
acttaaatcaacatt

SEQ ID NO: 150500 - DNA, 15 bp, Homo sapiens
cacttaaatcaacat

SEQ ID NO: 150501 - DNA, 15 bp, Homo sapiens
tcacttaaatcaaca

SEQ ID NO: 150502 - DNA, 15 bp, Homo sapiens
atcacttaaatcaac

SEQ ID NO: 150503 - DNA, 15 bp, Homo sapiens
tatcacttaaatcaa

SEQ ID NO: 150504 - DNA, 15 bp, Homo sapiens
atatcacttaaatca

SEQ ID NO: 150505 - DNA, 15 bp, Homo sapiens
tatatcacttaaatc

SEQ ID NO: 150506 - DNA, 15 bp, Homo sapiens
ttatatcacttaaat

SEQ ID NO: 150507 - DNA, 15 bp, Homo sapiens
gttatatcacttaaa

SEQ ID NO: 150508 - DNA, 15 bp, Homo sapiens
agttatatcacttaa

SEQ ID NO: 150509 - DNA, 15 bp, Homo sapiens
aagttatatcactta

SEQ ID NO: 150510 - DNA, 15 bp, Homo sapiens
gaagttatatcactt

SEQ ID NO: 150511 - DNA, 15 bp, Homo sapiens
agaagttatatcact

SEQ ID NO: 150512 - DNA, 15 bp, Homo sapiens
tagaagttatatcac

SEQ ID NO: 150513 - DNA, 15 bp, Homo sapiens
atagaagttatatca

SEQ ID NO: 150514 - DNA, 15 bp, Homo sapiens
aatagaagttatatc

SEQ ID NO: 150515 - DNA, 15 bp, Homo sapiens
aaatagaagttatat

SEQ ID NO: 150516 - DNA, 15 bp, Homo sapiens
caaatagaagttata

SEQ ID NO: 150517 - DNA, 15 bp, Homo sapiens
gcaaatagaagttat

SEQ ID NO: 150518 - DNA, 15 bp, Homo sapiens
agcaaatagaagtta

SEQ ID NO: 150519 - DNA, 15 bp, Homo sapiens
aagcaaatagaagtt

SEQ ID NO: 150520 - DNA, 15 bp, Homo sapiens
caagcaaatagaagt

SEQ ID NO: 150521 - DNA, 15 bp, Homo sapiens
tcaagcaaatagaag

SEQ ID NO: 150522 - DNA, 15 bp, Homo sapiens
ttcaagcaaatagaa

SEQ ID NO: 150523 - DNA, 15 bp, Homo sapiens
attcaagcaaataga

SEQ ID NO: 150524 - DNA, 15 bp, Homo sapiens
cattcaagcaaatag

SEQ ID NO: 150525 - DNA, 15 bp, Homo sapiens
acattcaagcaaata

SEQ ID NO: 150526 - DNA, 15 bp, Homo sapiens
tacattcaagcaaat

SEQ ID NO: 150527 - DNA, 15 bp, Homo sapiens
atacattcaagcaaa

SEQ ID NO: 150528 - DNA, 15 bp, Homo sapiens
tatacattcaagcaa

SEQ ID NO: 150529 - DNA, 15 bp, Homo sapiens
atatacattcaagca

SEQ ID NO: 150530 - DNA, 15 bp, Homo sapiens
catatacattcaagc

SEQ ID NO: 150531 - DNA, 15 bp, Homo sapiens
acatatacattcaag

SEQ ID NO: 150532 - DNA, 15 bp, Homo sapiens
tacatatacattcaa

SEQ ID NO: 150533 - DNA, 15 bp, Homo sapiens
ttacatatacattca

SEQ ID NO: 150534 - DNA, 15 bp, Homo sapiens
tttacatatacattc

SEQ ID NO: 150535 - DNA, 15 bp, Homo sapiens
atttacatatacatt

SEQ ID NO: 150536 - DNA, 15 bp, Homo sapiens
gatttacatatacat

SEQ ID NO: 150537 - DNA, 15 bp, Homo sapiens
tgatttacatataca

SEQ ID NO: 150538 - DNA, 15 bp, Homo sapiens
atgatttacatatac

SEQ ID NO: 150539 - DNA, 15 bp, Homo sapiens
aatgatttacatata

SEQ ID NO: 150540 - DNA, 15 bp, Homo sapiens
aaatgatttacatat

SEQ ID NO: 150541 - DNA, 15 bp, Homo sapiens
aaaatgatttacata

SEQ ID NO: 150542 - DNA, 15 bp, Homo sapiens
taaaatgatttacat

SEQ ID NO: 150543 - DNA, 15 bp, Homo sapiens
ctaaaatgatttaca

SEQ ID NO: 150544 - DNA, 15 bp, Homo sapiens
actaaaatgatttac

SEQ ID NO: 150545 - DNA, 15 bp, Homo sapiens
aactaaaatgattta

SEQ ID NO: 150546 - DNA, 15 bp, Homo sapiens
aaactaaaatgattt

SEQ ID NO: 150547 - DNA, 15 bp, Homo sapiens
taaactaaaatgatt

SEQ ID NO: 150548 - DNA, 15 bp, Homo sapiens
ttaaactaaaatgat

SEQ ID NO: 150549 - DNA, 15 bp, Homo sapiens
cttaaactaaaatga

SEQ ID NO: 150550 - DNA, 15 bp, Homo sapiens
acttaaactaaaatg

SEQ ID NO: 150551 - DNA, 15 bp, Homo sapiens
cacttaaactaaaat

SEQ ID NO: 150552 - DNA, 15 bp, Homo sapiens
ccacttaaactaaaa

SEQ ID NO: 150553 - DNA, 15 bp, Homo sapiens
accacttaaactaaa

SEQ ID NO: 150554 - DNA, 15 bp, Homo sapiens
aaccacttaaactaa

SEQ ID NO: 150555 - DNA, 15 bp, Homo sapiens
aaaccacttaaacta

SEQ ID NO: 150556 - DNA, 15 bp, Homo sapiens
aaaaccacttaaact

SEQ ID NO: 150557 - DNA, 15 bp, Homo sapiens
taaaaccacttaaac

SEQ ID NO: 150558 - DNA, 15 bp, Homo sapiens
ctaaaaccacttaaa

SEQ ID NO: 150559 - DNA, 15 bp, Homo sapiens
actaaaaccacttaa

SEQ ID NO: 150560 - DNA, 15 bp, Homo sapiens
gactaaaaccactta

SEQ ID NO: 150561 - DNA, 15 bp, Homo sapiens
tgactaaaaccactt

SEQ ID NO: 150562 - DNA, 15 bp, Homo sapiens
gtgactaaaaccact

SEQ ID NO: 150563 - DNA, 15 bp, Homo sapiens
ggtgactaaaaccac

SEQ ID NO: 150564 - DNA, 15 bp, Homo sapiens
gggtgactaaaacca

SEQ ID NO: 150565 - DNA, 15 bp, Homo sapiens
ggggtgactaaaacc

SEQ ID NO: 150566 - DNA, 15 bp, Homo sapiens
gggggtgactaaaac

SEQ ID NO: 150567 - DNA, 15 bp, Homo sapiens
ggggggtgactaaaa

SEQ ID NO: 150568 - DNA, 15 bp, Homo sapiens
tggggggtgactaaa

SEQ ID NO: 150569 - DNA, 15 bp, Homo sapiens
ttggggggtgactaa

SEQ ID NO: 150570 - DNA, 15 bp, Homo sapiens
tttggggggtgacta

SEQ ID NO: 150571 - DNA, 15 bp, Homo sapiens
gtttggggggtgact

SEQ ID NO: 150572 - DNA, 15 bp, Homo sapiens
agtttggggggtgac

SEQ ID NO: 150573 - DNA, 15 bp, Homo sapiens
tagtttggggggtga

SEQ ID NO: 150574 - DNA, 15 bp, Homo sapiens
atagtttggggggtg

SEQ ID NO: 150575 - DNA, 15 bp, Homo sapiens
aatagtttggggggt

SEQ ID NO: 150576 - DNA, 15 bp, Homo sapiens
gaatagtttgggggg

SEQ ID NO: 150577 - DNA, 15 bp, Homo sapiens
agaatagtttggggg

SEQ ID NO: 150578 - DNA, 15 bp, Homo sapiens
cagaatagtttgggg

SEQ ID NO: 150579 - DNA, 15 bp, Homo sapiens
tcagaatagtttggg

SEQ ID NO: 150580 - DNA, 15 bp, Homo sapiens
atcagaatagtttgg

SEQ ID NO: 150581 - DNA, 15 bp, Homo sapiens
gatcagaatagtttg

SEQ ID NO: 150582 - DNA, 15 bp, Homo sapiens
tgatcagaatagttt

SEQ ID NO: 150583 - DNA, 15 bp, Homo sapiens
atgatcagaatagtt

SEQ ID NO: 150584 - DNA, 15 bp, Homo sapiens
tatgatcagaatagt

SEQ ID NO: 150585 - DNA, 15 bp, Homo sapiens
atatgatcagaatag

SEQ ID NO: 150586 - DNA, 15 bp, Homo sapiens
aatatgatcagaata

SEQ ID NO: 150587 - DNA, 15 bp, Homo sapiens
aaatatgatcagaat

SEQ ID NO: 150588 - DNA, 15 bp, Homo sapiens
gaaatatgatcagaa

SEQ ID NO: 150589 - DNA, 15 bp, Homo sapiens
agaaatatgatcaga

SEQ ID NO: 150590 - DNA, 15 bp, Homo sapiens
aagaaatatgatcag

SEQ ID NO: 150591 - DNA, 15 bp, Homo sapiens
gaagaaatatgatca

SEQ ID NO: 150592 - DNA, 15 bp, Homo sapiens
tgaagaaatatgatc

SEQ ID NO: 150593 - DNA, 15 bp, Homo sapiens
ctgaagaaatatgat

SEQ ID NO: 150594 - DNA, 15 bp, Homo sapiens
gctgaagaaatatga

SEQ ID NO: 150595 - DNA, 15 bp, Homo sapiens
tgctgaagaaatatg

SEQ ID NO: 150596 - DNA, 15 bp, Homo sapiens
ttgctgaagaaatat

SEQ ID NO: 150597 - DNA, 15 bp, Homo sapiens
tttgctgaagaaata

SEQ ID NO: 150598 - DNA, 15 bp, Homo sapiens
ttttgctgaagaaat

SEQ ID NO: 150599 - DNA, 15 bp, Homo sapiens
tttttgctgaagaaa

SEQ ID NO: 150600 - DNA, 15 bp, Homo sapiens
atttttgctgaagaa

SEQ ID NO: 150601 - DNA, 15 bp, Homo sapiens
gatttttgctgaaga

SEQ ID NO: 150602 - DNA, 15 bp, Homo sapiens
agatttttgctgaag

SEQ ID NO: 150603 - DNA, 15 bp, Homo sapiens
aagatttttgctgaa

SEQ ID NO: 150604 - DNA, 15 bp, Homo sapiens
aaagatttttgctga

SEQ ID NO: 150605 - DNA, 15 bp, Homo sapiens
aaaagatttttgctg

SEQ ID NO: 150606 - DNA, 15 bp, Homo sapiens
taaaagatttttgct

SEQ ID NO: 150607 - DNA, 15 bp, Homo sapiens
ttaaaagatttttgc

SEQ ID NO: 150608 - DNA, 15 bp, Homo sapiens
tttaaaagatttttg

SEQ ID NO: 150609 - DNA, 15 bp, Homo sapiens
gtttaaaagattttt

SEQ ID NO: 150610 - DNA, 15 bp, Homo sapiens
tgtttaaaagatttt

SEQ ID NO: 150611 - DNA, 15 bp, Homo sapiens
atgtttaaaagattt

SEQ ID NO: 150612 - DNA, 15 bp, Homo sapiens
gatgtttaaaagatt

SEQ ID NO: 150613 - DNA, 15 bp, Homo sapiens
agatgtttaaaagat

SEQ ID NO: 150614 - DNA, 15 bp, Homo sapiens
tagatgtttaaaaga

SEQ ID NO: 150615 - DNA, 15 bp, Homo sapiens
ctagatgtttaaaag

SEQ ID NO: 150616 - DNA, 15 bp, Homo sapiens
gctagatgtttaaaa

SEQ ID NO: 150617 - DNA, 15 bp, Homo sapiens
agctagatgtttaaa

SEQ ID NO: 150618 - DNA, 15 bp, Homo sapiens
cagctagatgtttaa

SEQ ID NO: 150619 - DNA, 15 bp, Homo sapiens
acagctagatgttta

SEQ ID NO: 150620 - DNA, 15 bp, Homo sapiens
tacagctagatgttt

SEQ ID NO: 150621 - DNA, 15 bp, Homo sapiens
atacagctagatgtt

SEQ ID NO: 150622 - DNA, 15 bp, Homo sapiens
tatacagctagatgt

SEQ ID NO: 150623 - DNA, 15 bp, Homo sapiens
atatacagctagatg

SEQ ID NO: 150624 - DNA, 15 bp, Homo sapiens
tatatacagctagat

SEQ ID NO: 150625 - DNA, 15 bp, Homo sapiens
ctatatacagctaga

SEQ ID NO: 150626 - DNA, 15 bp, Homo sapiens
tctatatacagctag

SEQ ID NO: 150627 - DNA, 15 bp, Homo sapiens
atctatatacagcta

SEQ ID NO: 150628 - DNA, 15 bp, Homo sapiens
catctatatacagct

SEQ ID NO: 150629 - DNA, 15 bp, Homo sapiens
acatctatatacagc

SEQ ID NO: 150630 - DNA, 15 bp, Homo sapiens
cacatctatatacag

SEQ ID NO: 150631 - DNA, 15 bp, Homo sapiens
acacatctatataca

SEQ ID NO: 150632 - DNA, 15 bp, Homo sapiens
tacacatctatatac

SEQ ID NO: 150633 - DNA, 15 bp, Homo sapiens
atacacatctatata

SEQ ID NO: 150634 - DNA, 15 bp, Homo sapiens
aatacacatctatat

SEQ ID NO: 150635 - DNA, 15 bp, Homo sapiens
gaatacacatctata

SEQ ID NO: 150636 - DNA, 15 bp, Homo sapiens
tgaatacacatctat

SEQ ID NO: 150637 - DNA, 15 bp, Homo sapiens
atgaatacacatcta

SEQ ID NO: 150638 - DNA, 15 bp, Homo sapiens
aatgaatacacatct

SEQ ID NO: 150639 - DNA, 15 bp, Homo sapiens
aaatgaatacacatc

SEQ ID NO: 150640 - DNA, 15 bp, Homo sapiens
taaatgaatacacat

SEQ ID NO: 150641 - DNA, 15 bp, Homo sapiens
ttaaatgaatacaca

SEQ ID NO: 150642 - DNA, 15 bp, Homo sapiens
tttaaatgaatacac

SEQ ID NO: 150643 - DNA, 15 bp, Homo sapiens
ttttaaatgaataca

SEQ ID NO: 150644 - DNA, 15 bp, Homo sapiens
tttttaaatgaatac

SEQ ID NO: 150645 - DNA, 15 bp, Homo sapiens
atttttaaatgaata

SEQ ID NO: 150646 - DNA, 15 bp, Homo sapiens
aatttttaaatgaat

SEQ ID NO: 150647 - DNA, 15 bp, Homo sapiens
taatttttaaatgaa

SEQ ID NO: 150648 - DNA, 15 bp, Homo sapiens
ataatttttaaatga

SEQ ID NO: 150649 - DNA, 15 bp, Homo sapiens
tataatttttaaatg

SEQ ID NO: 150650 - DNA, 15 bp, Homo sapiens
gtataatttttaaat

SEQ ID NO: 150651 - DNA, 15 bp, Homo sapiens
tgtataatttttaaa

SEQ ID NO: 150652 - DNA, 15 bp, Homo sapiens
atgtataatttttaa

SEQ ID NO: 150653 - DNA, 15 bp, Homo sapiens
tatgtataattttta

SEQ ID NO: 150654 - DNA, 15 bp, Homo sapiens
atatgtataattttt

SEQ ID NO: 150655 - DNA, 15 bp, Homo sapiens
tatatgtataatttt

SEQ ID NO: 150656 - DNA, 15 bp, Homo sapiens
atatatgtataattt

SEQ ID NO: 150657 - DNA, 15 bp, Homo sapiens
catatatgtataatt

SEQ ID NO: 150658 - DNA, 15 bp, Homo sapiens
gcatatatgtataat

SEQ ID NO: 150659 - DNA, 15 bp, Homo sapiens
ggcatatatgtataa

SEQ ID NO: 150660 - DNA, 15 bp, Homo sapiens
tggcatatatgtata

SEQ ID NO: 150661 - DNA, 15 bp, Homo sapiens
atggcatatatgtat

SEQ ID NO: 150662 - DNA, 15 bp, Homo sapiens
catggcatatatgta

SEQ ID NO: 150663 - DNA, 15 bp, Homo sapiens
ccatggcatatatgt

SEQ ID NO: 150664 - DNA, 15 bp, Homo sapiens
accatggcatatatg

SEQ ID NO: 150665 - DNA, 15 bp, Homo sapiens
caccatggcatatat

SEQ ID NO: 150666 - DNA, 15 bp, Homo sapiens
tcaccatggcatata

SEQ ID NO: 150667 - DNA, 15 bp, Homo sapiens
ttcaccatggcatat

SEQ ID NO: 150668 - DNA, 15 bp, Homo sapiens
tttcaccatggcata

SEQ ID NO: 150669 - DNA, 15 bp, Homo sapiens
atttcaccatggcat

SEQ ID NO: 150670 - DNA, 15 bp, Homo sapiens
gatttcaccatggca

SEQ ID NO: 150671 - DNA, 15 bp, Homo sapiens
tgatttcaccatggc

SEQ ID NO: 150672 - DNA, 15 bp, Homo sapiens
atgatttcaccatgg

SEQ ID NO: 150673 - DNA, 15 bp, Homo sapiens
catgatttcaccatg

SEQ ID NO: 150674 - DNA, 15 bp, Homo sapiens
acatgatttcaccat

SEQ ID NO: 150675 - DNA, 15 bp, Homo sapiens
tacatgatttcacca

SEQ ID NO: 150676 - DNA, 15 bp, Homo sapiens
atacatgatttcacc

SEQ ID NO: 150677 - DNA, 15 bp, Homo sapiens
aatacatgatttcac

SEQ ID NO: 150678 - DNA, 15 bp, Homo sapiens
taatacatgatttca

SEQ ID NO: 150679 - DNA, 15 bp, Homo sapiens
ttaatacatgatttc

SEQ ID NO: 150680 - DNA, 15 bp, Homo sapiens
tttaatacatgattt

SEQ ID NO: 150681 - DNA, 15 bp, Homo sapiens
atttaatacatgatt

SEQ ID NO: 150682 - DNA, 15 bp, Homo sapiens
tatttaatacatgat

SEQ ID NO: 150683 - DNA, 15 bp, Homo sapiens
atatttaatacatga

SEQ ID NO: 150684 - DNA, 15 bp, Homo sapiens
aatatttaatacatg

SEQ ID NO: 150685 - DNA, 15 bp, Homo sapiens
taatatttaatacat

SEQ ID NO: 150686 - DNA, 15 bp, Homo sapiens
ctaatatttaataca

SEQ ID NO: 150687 - DNA, 15 bp, Homo sapiens
actaatatttaatac

SEQ ID NO: 150688 - DNA, 15 bp, Homo sapiens
tactaatatttaata

SEQ ID NO: 150689 - DNA, 15 bp, Homo sapiens
ctactaatatttaat

SEQ ID NO: 150690 - DNA, 15 bp, Homo sapiens
actactaatatttaa

SEQ ID NO: 150691 - DNA, 15 bp, Homo sapiens
cactactaatattta

SEQ ID NO: 150692 - DNA, 15 bp, Homo sapiens
acactactaatattt

SEQ ID NO: 150693 - DNA, 15 bp, Homo sapiens
tacactactaatatt

SEQ ID NO: 150694 - DNA, 15 bp, Homo sapiens
atacactactaatat

SEQ ID NO: 150695 - DNA, 15 bp, Homo sapiens
tatacactactaata

SEQ ID NO: 150696 - DNA, 15 bp, Homo sapiens
ttatacactactaat

SEQ ID NO: 150697 - DNA, 15 bp, Homo sapiens
attatacactactaa

SEQ ID NO: 150698 - DNA, 15 bp, Homo sapiens
aattatacactacta

SEQ ID NO: 150699 - DNA, 15 bp, Homo sapiens
aaattatacactact

SEQ ID NO: 150700 - DNA, 15 bp, Homo sapiens
aaaattatacactac

SEQ ID NO: 150701 - DNA, 15 bp, Homo sapiens
caaaattatacacta

SEQ ID NO: 150702 - DNA, 15 bp, Homo sapiens
acaaaattatacact

SEQ ID NO: 150703 - DNA, 15 bp, Homo sapiens
aacaaaattatacac

SEQ ID NO: 150704 - DNA, 15 bp, Homo sapiens
gaacaaaattataca

SEQ ID NO: 150705 - DNA, 15 bp, Homo sapiens
agaacaaaattatac

SEQ ID NO: 150706 - DNA, 15 bp, Homo sapiens
aagaacaaaattata

SEQ ID NO: 150707 - DNA, 15 bp, Homo sapiens
taagaacaaaattat

SEQ ID NO: 150708 - DNA, 15 bp, Homo sapiens
gtaagaacaaaatta

SEQ ID NO: 150709 - DNA, 15 bp, Homo sapiens
agtaagaacaaaatt

SEQ ID NO: 150710 - DNA, 15 bp, Homo sapiens
aagtaagaacaaaat

SEQ ID NO: 150711 - DNA, 15 bp, Homo sapiens
aaagtaagaacaaaa

SEQ ID NO: 150712 - DNA, 15 bp, Homo sapiens
gaaagtaagaacaaa

SEQ ID NO: 150713 - DNA, 15 bp, Homo sapiens
agaaagtaagaacaa

SEQ ID NO: 150714 - DNA, 15 bp, Homo sapiens
tagaaagtaagaaca

SEQ ID NO: 150715 - DNA, 15 bp, Homo sapiens
gtagaaagtaagaac

SEQ ID NO: 150716 - DNA, 15 bp, Homo sapiens
agtagaaagtaagaa

SEQ ID NO: 150717 - DNA, 15 bp, Homo sapiens
cagtagaaagtaaga

SEQ ID NO: 150718 - DNA, 15 bp, Homo sapiens
acagtagaaagtaag

SEQ ID NO: 150719 - DNA, 15 bp, Homo sapiens
aacagtagaaagtaa

SEQ ID NO: 150720 - DNA, 15 bp, Homo sapiens
caacagtagaaagta

SEQ ID NO: 150721 - DNA, 15 bp, Homo sapiens
gcaacagtagaaagt

SEQ ID NO: 150722 - DNA, 15 bp, Homo sapiens
ggcaacagtagaaag

SEQ ID NO: 150723 - DNA, 15 bp, Homo sapiens
aggcaacagtagaaa

SEQ ID NO: 150724 - DNA, 15 bp, Homo sapiens
aaggcaacagtagaa

SEQ ID NO: 150725 - DNA, 15 bp, Homo sapiens
aaaggcaacagtaga

SEQ ID NO: 150726 - DNA, 15 bp, Homo sapiens
aaaaggcaacagtag

SEQ ID NO: 150727 - DNA, 15 bp, Homo sapiens
aaaaaggcaacagta

SEQ ID NO: 150728 - DNA, 15 bp, Homo sapiens
caaaaaggcaacagt

SEQ ID NO: 150729 - DNA, 15 bp, Homo sapiens
acaaaaaggcaacag

SEQ ID NO: 150730 - DNA, 15 bp, Homo sapiens
tacaaaaaggcaaca

SEQ ID NO: 150731 - DNA, 15 bp, Homo sapiens
gtacaaaaaggcaac

SEQ ID NO: 150732 - DNA, 15 bp, Homo sapiens
ggtacaaaaaggcaa

SEQ ID NO: 150733 - DNA, 15 bp, Homo sapiens
tggtacaaaaaggca

SEQ ID NO: 150734 - DNA, 15 bp, Homo sapiens
gtggtacaaaaaggc

SEQ ID NO: 150735 - DNA, 15 bp, Homo sapiens
tgtggtacaaaaagg

SEQ ID NO: 150736 - DNA, 15 bp, Homo sapiens
ctgtggtacaaaaag

SEQ ID NO: 150737 - DNA, 15 bp, Homo sapiens
actgtggtacaaaaa

SEQ ID NO: 150738 - DNA, 15 bp, Homo sapiens
aactgtggtacaaaa

SEQ ID NO: 150739 - DNA, 15 bp, Homo sapiens
caactgtggtacaaa

SEQ ID NO: 150740 - DNA, 15 bp, Homo sapiens
tcaactgtggtacaa

SEQ ID NO: 150741 - DNA, 15 bp, Homo sapiens
atcaactgtggtaca

SEQ ID NO: 150742 - DNA, 15 bp, Homo sapiens
aatcaactgtggtac

SEQ ID NO: 150743 - DNA, 15 bp, Homo sapiens
gaatcaactgtggta

SEQ ID NO: 150744 - DNA, 15 bp, Homo sapiens
agaatcaactgtggt

SEQ ID NO: 150745 - DNA, 15 bp, Homo sapiens
aagaatcaactgtgg

SEQ ID NO: 150746 - DNA, 15 bp, Homo sapiens
aaagaatcaactgtg

SEQ ID NO: 150747 - DNA, 15 bp, Homo sapiens
aaaagaatcaactgt

SEQ ID NO: 150748 - DNA, 15 bp, Homo sapiens
aaaaagaatcaactg

SEQ ID NO: 150749 - DNA, 15 bp, Homo sapiens
gaaaaagaatcaact

SEQ ID NO: 150750 - DNA, 15 bp, Homo sapiens
agaaaaagaatcaac

SEQ ID NO: 150751 - DNA, 15 bp, Homo sapiens
gagaaaaagaatcaa

SEQ ID NO: 150752 - DNA, 15 bp, Homo sapiens
agagaaaaagaatca

SEQ ID NO: 150753 - DNA, 15 bp, Homo sapiens
tagagaaaaagaatc

SEQ ID NO: 150754 - DNA, 15 bp, Homo sapiens
atagagaaaaagaat

SEQ ID NO: 150755 - DNA, 15 bp, Homo sapiens
catagagaaaaagaa

SEQ ID NO: 150756 - DNA, 15 bp, Homo sapiens
acatagagaaaaaga

SEQ ID NO: 150757 - DNA, 15 bp, Homo sapiens
cacatagagaaaaag

SEQ ID NO: 150758 - DNA, 15 bp, Homo sapiens
ccacatagagaaaaa

SEQ ID NO: 150759 - DNA, 15 bp, Homo sapiens
accacatagagaaaa

SEQ ID NO: 150760 - DNA, 15 bp, Homo sapiens
taccacatagagaaa

SEQ ID NO: 150761 - DNA, 15 bp, Homo sapiens
ataccacatagagaa

SEQ ID NO: 150762 - DNA, 15 bp, Homo sapiens
tataccacatagaga

SEQ ID NO: 150763 - DNA, 15 bp, Homo sapiens
gtataccacatagag

SEQ ID NO: 150764 - DNA, 15 bp, Homo sapiens
tgtataccacataga

SEQ ID NO: 150765 - DNA, 15 bp, Homo sapiens
gtgtataccacatag

SEQ ID NO: 150766 - DNA, 15 bp, Homo sapiens
tgtgtataccacata

SEQ ID NO: 150767 - DNA, 15 bp, Homo sapiens
ttgtgtataccacat

SEQ ID NO: 150768 - DNA, 15 bp, Homo sapiens
gttgtgtataccaca

SEQ ID NO: 150769 - DNA, 15 bp, Homo sapiens
tgttgtgtataccac

SEQ ID NO: 150770 - DNA, 15 bp, Homo sapiens
gtgttgtgtatacca

SEQ ID NO: 150771 - DNA, 15 bp, Homo sapiens
cgtgttgtgtatacc

SEQ ID NO: 150772 - DNA, 15 bp, Homo sapiens
tcgtgttgtgtatac

SEQ ID NO: 150773 - DNA, 15 bp, Homo sapiens
atcgtgttgtgtata

SEQ ID NO: 150774 - DNA, 15 bp, Homo sapiens
aatcgtgttgtgtat

SEQ ID NO: 150775 - DNA, 15 bp, Homo sapiens
aaatcgtgttgtgta

SEQ ID NO: 150776 - DNA, 15 bp, Homo sapiens
aaaatcgtgttgtgt

SEQ ID NO: 150777 - DNA, 15 bp, Homo sapiens
caaaatcgtgttgtg

SEQ ID NO: 150778 - DNA, 15 bp, Homo sapiens
ccaaaatcgtgttgt

SEQ ID NO: 150779 - DNA, 15 bp, Homo sapiens
accaaaatcgtgttg

SEQ ID NO: 150780 - DNA, 15 bp, Homo sapiens
caccaaaatcgtgtt

SEQ ID NO: 150781 - DNA, 15 bp, Homo sapiens
tcaccaaaatcgtgt

SEQ ID NO: 150782 - DNA, 15 bp, Homo sapiens
gtcaccaaaatcgtg

SEQ ID NO: 150783 - DNA, 15 bp, Homo sapiens
agtcaccaaaatcgt

SEQ ID NO: 150784 - DNA, 15 bp, Homo sapiens
tagtcaccaaaatcg

SEQ ID NO: 150785 - DNA, 15 bp, Homo sapiens
ctagtcaccaaaatc

SEQ ID NO: 150786 - DNA, 15 bp, Homo sapiens
actagtcaccaaaat

SEQ ID NO: 150787 - DNA, 15 bp, Homo sapiens
gactagtcaccaaaa

SEQ ID NO: 150788 - DNA, 15 bp, Homo sapiens
tgactagtcaccaaa

SEQ ID NO: 150789 - DNA, 15 bp, Homo sapiens
atgactagtcaccaa

SEQ ID NO: 150790 - DNA, 15 bp, Homo sapiens
aatgactagtcacca

SEQ ID NO: 150791 - DNA, 15 bp, Homo sapiens
aaatgactagtcacc

SEQ ID NO: 150792 - DNA, 15 bp, Homo sapiens
taaatgactagtcac

SEQ ID NO: 150793 - DNA, 15 bp, Homo sapiens
gtaaatgactagtca

SEQ ID NO: 150794 - DNA, 15 bp, Homo sapiens
tgtaaatgactagtc

SEQ ID NO: 150795 - DNA, 15 bp, Homo sapiens
atgtaaatgactagt

SEQ ID NO: 150796 - DNA, 15 bp, Homo sapiens
tatgtaaatgactag

SEQ ID NO: 150797 - DNA, 15 bp, Homo sapiens
gtatgtaaatgacta

SEQ ID NO: 150798 - DNA, 15 bp, Homo sapiens
tgtatgtaaatgact

SEQ ID NO: 150799 - DNA, 15 bp, Homo sapiens
ctgtatgtaaatgac

SEQ ID NO: 150800 - DNA, 15 bp, Homo sapiens
tctgtatgtaaatga

SEQ ID NO: 150801 - DNA, 15 bp, Homo sapiens
ctctgtatgtaaatg

SEQ ID NO: 150802 - DNA, 15 bp, Homo sapiens
actctgtatgtaaat

SEQ ID NO: 150803 - DNA, 15 bp, Homo sapiens
cactctgtatgtaaa

SEQ ID NO: 150804 - DNA, 15 bp, Homo sapiens
tcactctgtatgtaa

SEQ ID NO: 150805 - DNA, 15 bp, Homo sapiens
ttcactctgtatgta

SEQ ID NO: 150806 - DNA, 15 bp, Homo sapiens
tttcactctgtatgt

SEQ ID NO: 150807 - DNA, 15 bp, Homo sapiens
gtttcactctgtatg

SEQ ID NO: 150808 - DNA, 15 bp, Homo sapiens
agtttcactctgtat

SEQ ID NO: 150809 - DNA, 15 bp, Homo sapiens
tagtttcactctgta

SEQ ID NO: 150810 - DNA, 15 bp, Homo sapiens
atagtttcactctgt

SEQ ID NO: 150811 - DNA, 15 bp, Homo sapiens
catagtttcactctg

SEQ ID NO: 150812 - DNA, 15 bp, Homo sapiens
ccatagtttcactct

SEQ ID NO: 150813 - DNA, 15 bp, Homo sapiens
gccatagtttcactc

SEQ ID NO: 150814 - DNA, 15 bp, Homo sapiens
agccatagtttcact

SEQ ID NO: 150815 - DNA, 15 bp, Homo sapiens
tagccatagtttcac

SEQ ID NO: 150816 - DNA, 15 bp, Homo sapiens
atagccatagtttca

SEQ ID NO: 150817 - DNA, 15 bp, Homo sapiens
aatagccatagtttc

SEQ ID NO: 150818 - DNA, 15 bp, Homo sapiens
gaatagccatagttt

SEQ ID NO: 150819 - DNA, 15 bp, Homo sapiens
agaatagccatagtt

SEQ ID NO: 150820 - DNA, 15 bp, Homo sapiens
aagaatagccatagt

SEQ ID NO: 150821 - DNA, 15 bp, Homo sapiens
taagaatagccatag

SEQ ID NO: 150822 - DNA, 15 bp, Homo sapiens
ctaagaatagccata

SEQ ID NO: 150823 - DNA, 15 bp, Homo sapiens
gctaagaatagccat

SEQ ID NO: 150824 - DNA, 15 bp, Homo sapiens
ggctaagaatagcca

SEQ ID NO: 150825 - DNA, 15 bp, Homo sapiens
aggctaagaatagcc

SEQ ID NO: 150826 - DNA, 15 bp, Homo sapiens
caggctaagaatagc

SEQ ID NO: 150827 - DNA, 15 bp, Homo sapiens
ccaggctaagaatag

SEQ ID NO: 150828 - DNA, 15 bp, Homo sapiens
gccaggctaagaata

SEQ ID NO: 150829 - DNA, 15 bp, Homo sapiens
ggccaggctaagaat

SEQ ID NO: 150830 - DNA, 15 bp, Homo sapiens
aggccaggctaagaa

SEQ ID NO: 150831 - DNA, 15 bp, Homo sapiens
aaggccaggctaaga

SEQ ID NO: 150832 - DNA, 15 bp, Homo sapiens
gaaggccaggctaag

SEQ ID NO: 150833 - DNA, 15 bp, Homo sapiens
agaaggccaggctaa

SEQ ID NO: 150834 - DNA, 15 bp, Homo sapiens
tagaaggccaggcta

SEQ ID NO: 150835 - DNA, 15 bp, Homo sapiens
ctagaaggccaggct

SEQ ID NO: 150836 - DNA, 15 bp, Homo sapiens
cctagaaggccaggc

SEQ ID NO: 150837 - DNA, 15 bp, Homo sapiens
ccctagaaggccagg

SEQ ID NO: 150838 - DNA, 15 bp, Homo sapiens
cccctagaaggccag

SEQ ID NO: 150839 - DNA, 15 bp, Homo sapiens
ccccctagaaggcca

SEQ ID NO: 150840 - DNA, 15 bp, Homo sapiens
gccccctagaaggcc

SEQ ID NO: 150841 - DNA, 15 bp, Homo sapiens
agccccctagaaggc

SEQ ID NO: 150842 - DNA, 15 bp, Homo sapiens
aagccccctagaagg

SEQ ID NO: 150843 - DNA, 15 bp, Homo sapiens
caagccccctagaag

SEQ ID NO: 150844 - DNA, 15 bp, Homo sapiens
tcaagccccctagaa

SEQ ID NO: 150845 - DNA, 15 bp, Homo sapiens
ctcaagccccctaga

SEQ ID NO: 150846 - DNA, 15 bp, Homo sapiens
gctcaagccccctag

SEQ ID NO: 150847 - DNA, 15 bp, Homo sapiens
agctcaagcccccta

SEQ ID NO: 150848 - DNA, 15 bp, Homo sapiens
aagctcaagccccct

SEQ ID NO: 150849 - DNA, 15 bp, Homo sapiens
aaagctcaagccccc

SEQ ID NO: 150850 - DNA, 15 bp, Homo sapiens
gaaagctcaagcccc

SEQ ID NO: 150851 - DNA, 15 bp, Homo sapiens
tgaaagctcaagccc

SEQ ID NO: 150852 - DNA, 15 bp, Homo sapiens
ctgaaagctcaagcc

SEQ ID NO: 150853 - DNA, 15 bp, Homo sapiens
actgaaagctcaagc

SEQ ID NO: 150854 - DNA, 15 bp, Homo sapiens
cactgaaagctcaag

SEQ ID NO: 150855 - DNA, 15 bp, Homo sapiens
acactgaaagctcaa

SEQ ID NO: 150856 - DNA, 15 bp, Homo sapiens
cacactgaaagctca

SEQ ID NO: 150857 - DNA, 15 bp, Homo sapiens
ccacactgaaagctc

SEQ ID NO: 150858 - DNA, 15 bp, Homo sapiens
accacactgaaagct

SEQ ID NO: 150859 - DNA, 15 bp, Homo sapiens
caccacactgaaagc

SEQ ID NO: 150860 - DNA, 15 bp, Homo sapiens
gcaccacactgaaag

SEQ ID NO: 150861 - DNA, 15 bp, Homo sapiens
agcaccacactgaaa

SEQ ID NO: 150862 - DNA, 15 bp, Homo sapiens
cagcaccacactgaa

SEQ ID NO: 150863 - DNA, 15 bp, Homo sapiens
tcagcaccacactga

SEQ ID NO: 150864 - DNA, 15 bp, Homo sapiens
atcagcaccacactg

SEQ ID NO: 150865 - DNA, 15 bp, Homo sapiens
gatcagcaccacact

SEQ ID NO: 150866 - DNA, 15 bp, Homo sapiens
agatcagcaccacac

SEQ ID NO: 150867 - DNA, 15 bp, Homo sapiens
gagatcagcaccaca

SEQ ID NO: 150868 - DNA, 15 bp, Homo sapiens
tgagatcagcaccac

SEQ ID NO: 150869 - DNA, 15 bp, Homo sapiens
ttgagatcagcacca

SEQ ID NO: 150870 - DNA, 15 bp, Homo sapiens
tttgagatcagcacc

SEQ ID NO: 150871 - DNA, 15 bp, Homo sapiens
ctttgagatcagcac

SEQ ID NO: 150872 - DNA, 15 bp, Homo sapiens
actttgagatcagca

SEQ ID NO: 150873 - DNA, 15 bp, Homo sapiens
gactttgagatcagc

SEQ ID NO: 150874 - DNA, 15 bp, Homo sapiens
agactttgagatcag

SEQ ID NO: 150875 - DNA, 15 bp, Homo sapiens
aagactttgagatca

SEQ ID NO: 150876 - DNA, 15 bp, Homo sapiens
gaagactttgagatc

SEQ ID NO: 150877 - DNA, 15 bp, Homo sapiens
ggaagactttgagat

SEQ ID NO: 150878 - DNA, 15 bp, Homo sapiens
gggaagactttgaga

SEQ ID NO: 150879 - DNA, 15 bp, Homo sapiens
ggggaagactttgag

SEQ ID NO: 150880 - DNA, 15 bp, Homo sapiens
cggggaagactttga

SEQ ID NO: 150881 - DNA, 15 bp, Homo sapiens
ccggggaagactttg

SEQ ID NO: 150882 - DNA, 15 bp, Homo sapiens
tccggggaagacttt

SEQ ID NO: 150883 - DNA, 15 bp, Homo sapiens
ttccggggaagactt

SEQ ID NO: 150884 - DNA, 15 bp, Homo sapiens
attccggggaagact

SEQ ID NO: 150885 - DNA, 15 bp, Homo sapiens
tattccggggaagac

SEQ ID NO: 150886 - DNA, 15 bp, Homo sapiens
gtattccggggaaga

SEQ ID NO: 150887 - DNA, 15 bp, Homo sapiens
agtattccggggaag

SEQ ID NO: 150888 - DNA, 15 bp, Homo sapiens
cagtattccggggaa

SEQ ID NO: 150889 - DNA, 15 bp, Homo sapiens
acagtattccgggga

SEQ ID NO: 150890 - DNA, 15 bp, Homo sapiens
cacagtattccgggg

SEQ ID NO: 150891 - DNA, 15 bp, Homo sapiens
acacagtattccggg

SEQ ID NO: 150892 - DNA, 15 bp, Homo sapiens
gacacagtattccgg

SEQ ID NO: 150893 - DNA, 15 bp, Homo sapiens
agacacagtattccg

SEQ ID NO: 150894 - DNA, 15 bp, Homo sapiens
aagacacagtattcc

SEQ ID NO: 150895 - DNA, 15 bp, Homo sapiens
gaagacacagtattc

SEQ ID NO: 150896 - DNA, 15 bp, Homo sapiens
agaagacacagtatt

SEQ ID NO: 150897 - DNA, 15 bp, Homo sapiens
cagaagacacagtat

SEQ ID NO: 150898 - DNA, 15 bp, Homo sapiens
acagaagacacagta

SEQ ID NO: 150899 - DNA, 15 bp, Homo sapiens
cacagaagacacagt

SEQ ID NO: 150900 - DNA, 15 bp, Homo sapiens
ccacagaagacacag

SEQ ID NO: 150901 - DNA, 15 bp, Homo sapiens
accacagaagacaca

SEQ ID NO: 150902 - DNA, 15 bp, Homo sapiens
taccacagaagacac

SEQ ID NO: 150903 - DNA, 15 bp, Homo sapiens
ataccacagaagaca

SEQ ID NO: 150904 - DNA, 15 bp, Homo sapiens
aataccacagaagac

SEQ ID NO: 150905 - DNA, 15 bp, Homo sapiens
taataccacagaaga

SEQ ID NO: 150906 - DNA, 15 bp, Homo sapiens
ttaataccacagaag

SEQ ID NO: 150907 - DNA, 15 bp, Homo sapiens
tttaataccacagaa

SEQ ID NO: 150908 - DNA, 15 bp, Homo sapiens
ctttaataccacaga

SEQ ID NO: 150909 - DNA, 15 bp, Homo sapiens
gctttaataccacag

SEQ ID NO: 150910 - DNA, 15 bp, Homo sapiens
tgctttaataccaca

SEQ ID NO: 150911 - DNA, 15 bp, Homo sapiens
ttgctttaataccac

SEQ ID NO: 150912 - DNA, 15 bp, Homo sapiens
gttgctttaatacca

SEQ ID NO: 150913 - DNA, 15 bp, Homo sapiens
agttgctttaatacc

SEQ ID NO: 150914 - DNA, 15 bp, Homo sapiens
tagttgctttaatac

SEQ ID NO: 150915 - DNA, 15 bp, Homo sapiens
gtagttgctttaata

SEQ ID NO: 150916 - DNA, 15 bp, Homo sapiens
agtagttgctttaat

SEQ ID NO: 150917 - DNA, 15 bp, Homo sapiens
aagtagttgctttaa

SEQ ID NO: 150918 - DNA, 15 bp, Homo sapiens
gaagtagttgcttta

SEQ ID NO: 150919 - DNA, 15 bp, Homo sapiens
agaagtagttgcttt

SEQ ID NO: 150920 - DNA, 15 bp, Homo sapiens
cagaagtagttgctt

SEQ ID NO: 150921 - DNA, 15 bp, Homo sapiens
tcagaagtagttgct

SEQ ID NO: 150922 - DNA, 15 bp, Homo sapiens
ttcagaagtagttgc

SEQ ID NO: 150923 - DNA, 15 bp, Homo sapiens
attcagaagtagttg

SEQ ID NO: 150924 - DNA, 15 bp, Homo sapiens
tattcagaagtagtt

SEQ ID NO: 150925 - DNA, 15 bp, Homo sapiens
atattcagaagtagt

SEQ ID NO: 150926 - DNA, 15 bp, Homo sapiens
aatattcagaagtag

SEQ ID NO: 150927 - DNA, 15 bp, Homo sapiens
gaatattcagaagta

SEQ ID NO: 150928 - DNA, 15 bp, Homo sapiens
agaatattcagaagt

SEQ ID NO: 150929 - DNA, 15 bp, Homo sapiens
cagaatattcagaag

SEQ ID NO: 150930 - DNA, 15 bp, Homo sapiens
acagaatattcagaa

SEQ ID NO: 150931 - DNA, 15 bp, Homo sapiens
cacagaatattcaga

SEQ ID NO: 150932 - DNA, 15 bp, Homo sapiens
tcacagaatattcag

SEQ ID NO: 150933 - DNA, 15 bp, Homo sapiens
ttcacagaatattca

SEQ ID NO: 150934 - DNA, 15 bp, Homo sapiens
tttcacagaatattc

SEQ ID NO: 150935 - DNA, 15 bp, Homo sapiens
ttttcacagaatatt

SEQ ID NO: 150936 - DNA, 15 bp, Homo sapiens
tttttcacagaatat

SEQ ID NO: 150937 - DNA, 15 bp, Homo sapiens
atttttcacagaata

SEQ ID NO: 150938 - DNA, 15 bp, Homo sapiens
tatttttcacagaat

SEQ ID NO: 150939 - DNA, 15 bp, Homo sapiens
ctatttttcacagaa

SEQ ID NO: 150940 - DNA, 15 bp, Homo sapiens
tctatttttcacaga

SEQ ID NO: 150941 - DNA, 15 bp, Homo sapiens
ttctatttttcacag

SEQ ID NO: 150942 - DNA, 15 bp, Homo sapiens
cttctatttttcaca

SEQ ID NO: 150943 - DNA, 15 bp, Homo sapiens
tcttctatttttcac

SEQ ID NO: 150944 - DNA, 15 bp, Homo sapiens
ctcttctatttttca

SEQ ID NO: 150945 - DNA, 15 bp, Homo sapiens
tctcttctatttttc

SEQ ID NO: 150946 - DNA, 15 bp, Homo sapiens
gtctcttctattttt

SEQ ID NO: 150947 - DNA, 15 bp, Homo sapiens
ggtctcttctatttt

SEQ ID NO: 150948 - DNA, 15 bp, Homo sapiens
tggtctcttctattt

SEQ ID NO: 150949 - DNA, 15 bp, Homo sapiens
ctggtctcttctatt

SEQ ID NO: 150950 - DNA, 15 bp, Homo sapiens
tctggtctcttctat

SEQ ID NO: 150951 - DNA, 15 bp, Homo sapiens
ttctggtctcttcta

SEQ ID NO: 150952 - DNA, 15 bp, Homo sapiens
cttctggtctcttct

SEQ ID NO: 150953 - DNA, 15 bp, Homo sapiens
tcttctggtctcttc

SEQ ID NO: 150954 - DNA, 15 bp, Homo sapiens
atcttctggtctctt

SEQ ID NO: 150955 - DNA, 15 bp, Homo sapiens
aatcttctggtctct

SEQ ID NO: 150956 - DNA, 15 bp, Homo sapiens
gaatcttctggtctc

SEQ ID NO: 150957 - DNA, 15 bp, Homo sapiens
ggaatcttctggtct

SEQ ID NO: 150958 - DNA, 15 bp, Homo sapiens
tggaatcttctggtc

SEQ ID NO: 150959 - DNA, 15 bp, Homo sapiens
gtggaatcttctggt

SEQ ID NO: 150960 - DNA, 15 bp, Homo sapiens
ggtggaatcttctgg

SEQ ID NO: 150961 - DNA, 15 bp, Homo sapiens
aggtggaatcttctg

SEQ ID NO: 150962 - DNA, 15 bp, Homo sapiens
caggtggaatcttct

SEQ ID NO: 150963 - DNA, 15 bp, Homo sapiens
ccaggtggaatcttc

SEQ ID NO: 150964 - DNA, 15 bp, Homo sapiens
cccaggtggaatctt

SEQ ID NO: 150965 - DNA, 15 bp, Homo sapiens
tcccaggtggaatct

SEQ ID NO: 150966 - DNA, 15 bp, Homo sapiens
ttcccaggtggaatc

SEQ ID NO: 150967 - DNA, 15 bp, Homo sapiens
cttcccaggtggaat

SEQ ID NO: 150968 - DNA, 15 bp, Homo sapiens
acttcccaggtggaa

SEQ ID NO: 150969 - DNA, 15 bp, Homo sapiens
gacttcccaggtgga

SEQ ID NO: 150970 - DNA, 15 bp, Homo sapiens
tgacttcccaggtgg

SEQ ID NO: 150971 - DNA, 15 bp, Homo sapiens
gtgacttcccaggtg

SEQ ID NO: 150972 - DNA, 15 bp, Homo sapiens
cgtgacttcccaggt

SEQ ID NO: 150973 - DNA, 15 bp, Homo sapiens
tcgtgacttcccagg

SEQ ID NO: 150974 - DNA, 15 bp, Homo sapiens
atcgtgacttcccag

SEQ ID NO: 150975 - DNA, 15 bp, Homo sapiens
aatcgtgacttccca

SEQ ID NO: 150976 - DNA, 15 bp, Homo sapiens
caatcgtgacttccc

SEQ ID NO: 150977 - DNA, 15 bp, Homo sapiens
tcaatcgtgacttcc

SEQ ID NO: 150978 - DNA, 15 bp, Homo sapiens
gtcaatcgtgacttc

SEQ ID NO: 150979 - DNA, 15 bp, Homo sapiens
ggtcaatcgtgactt

SEQ ID NO: 150980 - DNA, 15 bp, Homo sapiens
tggtcaatcgtgact

SEQ ID NO: 150981 - DNA, 15 bp, Homo sapiens
ctggtcaatcgtgac

SEQ ID NO: 150982 - DNA, 15 bp, Homo sapiens
actggtcaatcgtga

SEQ ID NO: 150983 - DNA, 15 bp, Homo sapiens
cactggtcaatcgtg

SEQ ID NO: 150984 - DNA, 15 bp, Homo sapiens
tcactggtcaatcgt

SEQ ID NO: 150985 - DNA, 15 bp, Homo sapiens
atcactggtcaatcg

SEQ ID NO: 150986 - DNA, 15 bp, Homo sapiens
catcactggtcaatc

SEQ ID NO: 150987 - DNA, 15 bp, Homo sapiens
acatcactggtcaat

SEQ ID NO: 150988 - DNA, 15 bp, Homo sapiens
gacatcactggtcaa

SEQ ID NO: 150989 - DNA, 15 bp, Homo sapiens
agacatcactggtca

SEQ ID NO: 150990 - DNA, 15 bp, Homo sapiens
tagacatcactggtc

SEQ ID NO: 150991 - DNA, 15 bp, Homo sapiens
gtagacatcactggt

SEQ ID NO: 150992 - DNA, 15 bp, Homo sapiens
tgtagacatcactgg

SEQ ID NO: 150993 - DNA, 15 bp, Homo sapiens
ttgtagacatcactg

SEQ ID NO: 150994 - DNA, 15 bp, Homo sapiens
tttgtagacatcact

SEQ ID NO: 150995 - DNA, 15 bp, Homo sapiens
ttttgtagacatcac

SEQ ID NO: 150996 - DNA, 15 bp, Homo sapiens
cttttgtagacatca

SEQ ID NO: 150997 - DNA, 15 bp, Homo sapiens
ccttttgtagacatc

SEQ ID NO: 150998 - DNA, 15 bp, Homo sapiens
gccttttgtagacat

SEQ ID NO: 150999 - DNA, 15 bp, Homo sapiens
agccttttgtagaca

SEQ ID NO: 151000 - DNA, 15 bp, Homo sapiens
aagccttttgtagac

SEQ ID NO: 151001 - DNA, 15 bp, Homo sapiens
caagccttttgtaga

SEQ ID NO: 151002 - DNA, 15 bp, Homo sapiens
gcaagccttttgtag

SEQ ID NO: 151003 - DNA, 15 bp, Homo sapiens
agcaagccttttgta

SEQ ID NO: 151004 - DNA, 15 bp, Homo sapiens
aagcaagccttttgt

SEQ ID NO: 151005 - DNA, 15 bp, Homo sapiens
aaagcaagccttttg

SEQ ID NO: 151006 - DNA, 15 bp, Homo sapiens
caaagcaagcctttt

SEQ ID NO: 151007 - DNA, 15 bp, Homo sapiens
acaaagcaagccttt

SEQ ID NO: 151008 - DNA, 15 bp, Homo sapiens
cacaaagcaagcctt

SEQ ID NO: 151009 - DNA, 15 bp, Homo sapiens
ccacaaagcaagcct

SEQ ID NO: 151010 - DNA, 15 bp, Homo sapiens
gccacaaagcaagcc

SEQ ID NO: 151011 - DNA, 15 bp, Homo sapiens
agccacaaagcaagc

SEQ ID NO: 151012 - DNA, 15 bp, Homo sapiens
cagccacaaagcaag

SEQ ID NO: 151013 - DNA, 15 bp, Homo sapiens
acagccacaaagcaa

SEQ ID NO: 151014 - DNA, 15 bp, Homo sapiens
cacagccacaaagca

SEQ ID NO: 151015 - DNA, 15 bp, Homo sapiens
acacagccacaaagc

SEQ ID NO: 151016 - DNA, 15 bp, Homo sapiens
cacacagccacaaag

SEQ ID NO: 151017 - DNA, 15 bp, Homo sapiens
acacacagccacaaa

SEQ ID NO: 151018 - DNA, 15 bp, Homo sapiens
cacacacagccacaa

SEQ ID NO: 151019 - DNA, 15 bp, Homo sapiens
acacacacagccaca

SEQ ID NO: 151020 - DNA, 15 bp, Homo sapiens
cacacacacagccac

SEQ ID NO: 151021 - DNA, 15 bp, Homo sapiens
acacacacacagcca

SEQ ID NO: 151022 - DNA, 15 bp, Homo sapiens
cacacacacacagcc

SEQ ID NO: 151023 - DNA, 15 bp, Homo sapiens
acacacacacacagc

SEQ ID NO: 151024 - DNA, 15 bp, Homo sapiens
aacacacacacacag

SEQ ID NO: 151025 - DNA, 15 bp, Homo sapiens
aaacacacacacaca

SEQ ID NO: 151026 - DNA, 15 bp, Homo sapiens
aaaacacacacacac

SEQ ID NO: 151027 - DNA, 15 bp, Homo sapiens
gaaaacacacacaca

SEQ ID NO: 151028 - DNA, 15 bp, Homo sapiens
tgaaaacacacacac

SEQ ID NO: 151029 - DNA, 15 bp, Homo sapiens
catgaaaacacacac

SEQ ID NO: 151030 - DNA, 15 bp, Homo sapiens
acatgaaaacacaca

SEQ ID NO: 151031 - DNA, 15 bp, Homo sapiens
cacatgaaaacacac

SEQ ID NO: 151032 - DNA, 15 bp, Homo sapiens
acacatgaaaacaca

SEQ ID NO: 151033 - DNA, 15 bp, Homo sapiens
cacacatgaaaacac

SEQ ID NO: 151034 - DNA, 15 bp, Homo sapiens
ccacacatgaaaaca

SEQ ID NO: 151035 - DNA, 15 bp, Homo sapiens
tccacacatgaaaac

SEQ ID NO: 151036 - DNA, 15 bp, Homo sapiens
gtccacacatgaaaa

SEQ ID NO: 151037 - DNA, 15 bp, Homo sapiens
cgtccacacatgaaa

SEQ ID NO: 151038 - DNA, 15 bp, Homo sapiens
acgtccacacatgaa

SEQ ID NO: 151039 - DNA, 15 bp, Homo sapiens
cacgtccacacatga

SEQ ID NO: 151040 - DNA, 15 bp, Homo sapiens
ccacgtccacacatg

SEQ ID NO: 151041 - DNA, 15 bp, Homo sapiens
tccacgtccacacat

SEQ ID NO: 151042 - DNA, 15 bp, Homo sapiens
gtccacgtccacaca

SEQ ID NO: 151043 - DNA, 15 bp, Homo sapiens
tgtccacgtccacac

SEQ ID NO: 151044 - DNA, 15 bp, Homo sapiens
ttgtccacgtccaca

SEQ ID NO: 151045 - DNA, 15 bp, Homo sapiens
gttgtccacgtccac

SEQ ID NO: 151046 - DNA, 15 bp, Homo sapiens
tgttgtccacgtcca

SEQ ID NO: 151047 - DNA, 15 bp, Homo sapiens
gtgttgtccacgtcc

SEQ ID NO: 151048 - DNA, 15 bp, Homo sapiens
tgtgttgtccacgtc

SEQ ID NO: 151049 - DNA, 15 bp, Homo sapiens
ctgtgttgtccacgt

SEQ ID NO: 151050 - DNA, 15 bp, Homo sapiens
tctgtgttgtccacg

SEQ ID NO: 151051 - DNA, 15 bp, Homo sapiens
ttctgtgttgtccac

SEQ ID NO: 151052 - DNA, 15 bp, Homo sapiens
gttctgtgttgtcca

SEQ ID NO: 151053 - DNA, 15 bp, Homo sapiens
agttctgtgttgtcc

SEQ ID NO: 151054 - DNA, 15 bp, Homo sapiens
tagttctgtgttgtc

SEQ ID NO: 151055 - DNA, 15 bp, Homo sapiens
atagttctgtgttgt

SEQ ID NO: 151056 - DNA, 15 bp, Homo sapiens
catagttctgtgttg

SEQ ID NO: 151057 - DNA, 15 bp, Homo sapiens
acatagttctgtgtt

SEQ ID NO: 151058 - DNA, 15 bp, Homo sapiens
tacatagttctgtgt

SEQ ID NO: 151059 - DNA, 15 bp, Homo sapiens
ctacatagttctgtg

SEQ ID NO: 151060 - DNA, 15 bp, Homo sapiens
actacatagttctgt

SEQ ID NO: 151061 - DNA, 15 bp, Homo sapiens
aactacatagttctg

SEQ ID NO: 151062 - DNA, 15 bp, Homo sapiens
caactacatagttct

SEQ ID NO: 151063 - DNA, 15 bp, Homo sapiens
gcaactacatagttc

SEQ ID NO: 151064 - DNA, 15 bp, Homo sapiens
agcaactacatagtt

SEQ ID NO: 151065 - DNA, 15 bp, Homo sapiens
aagcaactacatagt

SEQ ID NO: 151066 - DNA, 15 bp, Homo sapiens
caagcaactacatag

SEQ ID NO: 151067 - DNA, 15 bp, Homo sapiens
acaagcaactacata

SEQ ID NO: 151068 - DNA, 15 bp, Homo sapiens
tacaagcaactacat

SEQ ID NO: 151069 - DNA, 15 bp, Homo sapiens
ctacaagcaactaca

SEQ ID NO: 151070 - DNA, 15 bp, Homo sapiens
actacaagcaactac

SEQ ID NO: 151071 - DNA, 15 bp, Homo sapiens
cactacaagcaacta

SEQ ID NO: 151072 - DNA, 15 bp, Homo sapiens
gcactacaagcaact

SEQ ID NO: 151073 - DNA, 15 bp, Homo sapiens
agcactacaagcaac

SEQ ID NO: 151074 - DNA, 15 bp, Homo sapiens
tagcactacaagcaa

SEQ ID NO: 151075 - DNA, 15 bp, Homo sapiens
ttagcactacaagca

SEQ ID NO: 151076 - DNA, 15 bp, Homo sapiens
attagcactacaagc

SEQ ID NO: 151077 - DNA, 15 bp, Homo sapiens
cattagcactacaag

SEQ ID NO: 151078 - DNA, 15 bp, Homo sapiens
tcattagcactacaa

SEQ ID NO: 151079 - DNA, 15 bp, Homo sapiens
ctcattagcactaca

SEQ ID NO: 151080 - DNA, 15 bp, Homo sapiens
actcattagcactac

SEQ ID NO: 151081 - DNA, 15 bp, Homo sapiens
tactcattagcacta

SEQ ID NO: 151082 - DNA, 15 bp, Homo sapiens
ttactcattagcact

SEQ ID NO: 151083 - DNA, 15 bp, Homo sapiens
tttactcattagcac

SEQ ID NO: 151084 - DNA, 15 bp, Homo sapiens
atttactcattagca

SEQ ID NO: 151085 - DNA, 15 bp, Homo sapiens
tatttactcattagc

SEQ ID NO: 151086 - DNA, 15 bp, Homo sapiens
ctatttactcattag

SEQ ID NO: 151087 - DNA, 15 bp, Homo sapiens
tctatttactcatta

SEQ ID NO: 151088 - DNA, 15 bp, Homo sapiens
atctatttactcatt

SEQ ID NO: 151089 - DNA, 15 bp, Homo sapiens
tatctatttactcat

SEQ ID NO: 151090 - DNA, 15 bp, Homo sapiens
ttatctatttactca

SEQ ID NO: 151091 - DNA, 15 bp, Homo sapiens
attatctatttactc

SEQ ID NO: 151092 - DNA, 15 bp, Homo sapiens
cattatctatttact

SEQ ID NO: 151093 - DNA, 15 bp, Homo sapiens
tcattatctatttac

SEQ ID NO: 151094 - DNA, 15 bp, Homo sapiens
ttcattatctattta

SEQ ID NO: 151095 - DNA, 15 bp, Homo sapiens
gttcattatctattt

SEQ ID NO: 151096 - DNA, 15 bp, Homo sapiens
tgttcattatctatt

SEQ ID NO: 151097 - DNA, 15 bp, Homo sapiens
atgttcattatctat

SEQ ID NO: 151098 - DNA, 15 bp, Homo sapiens
catgttcattatcta

SEQ ID NO: 151099 - DNA, 15 bp, Homo sapiens
tcatgttcattatct

SEQ ID NO: 151100 - DNA, 15 bp, Homo sapiens
ttcatgttcattatc

SEQ ID NO: 151101 - DNA, 15 bp, Homo sapiens
cttcatgttcattat

SEQ ID NO: 151102 - DNA, 15 bp, Homo sapiens
ccttcatgttcatta

SEQ ID NO: 151103 - DNA, 15 bp, Homo sapiens
gccttcatgttcatt

SEQ ID NO: 151104 - DNA, 15 bp, Homo sapiens
tgccttcatgttcat

SEQ ID NO: 151105 - DNA, 15 bp, Homo sapiens
gtgccttcatgttca

SEQ ID NO: 151106 - DNA, 15 bp, Homo sapiens
tgtgccttcatgttc

SEQ ID NO: 151107 - DNA, 15 bp, Homo sapiens
atgtgccttcatgtt

SEQ ID NO: 151108 - DNA, 15 bp, Homo sapiens
aatgtgccttcatgt

SEQ ID NO: 151109 - DNA, 15 bp, Homo sapiens
taatgtgccttcatg

SEQ ID NO: 151110 - DNA, 15 bp, Homo sapiens
ttaatgtgccttcat

SEQ ID NO: 151111 - DNA, 15 bp, Homo sapiens
attaatgtgccttca

SEQ ID NO: 151112 - DNA, 15 bp, Homo sapiens
gattaatgtgccttc

SEQ ID NO: 151113 - DNA, 15 bp, Homo sapiens
agattaatgtgcctt

SEQ ID NO: 151114 - DNA, 15 bp, Homo sapiens
gagattaatgtgcct

SEQ ID NO: 151115 - DNA, 15 bp, Homo sapiens
agagattaatgtgcc

SEQ ID NO: 151116 - DNA, 15 bp, Homo sapiens
gagagattaatgtgc

SEQ ID NO: 151117 - DNA, 15 bp, Homo sapiens
tgagagattaatgtg

SEQ ID NO: 151118 - DNA, 15 bp, Homo sapiens
ctgagagattaatgt

SEQ ID NO: 151119 - DNA, 15 bp, Homo sapiens
gctgagagattaatg

SEQ ID NO: 151120 - DNA, 15 bp, Homo sapiens
tgctgagagattaat

SEQ ID NO: 151121 - DNA, 15 bp, Homo sapiens
ctgctgagagattaa

SEQ ID NO: 151122 - DNA, 15 bp, Homo sapiens
cctgctgagagatta

SEQ ID NO: 151123 - DNA, 15 bp, Homo sapiens
acctgctgagagatt

SEQ ID NO: 151124 - DNA, 15 bp, Homo sapiens
aacctgctgagagat

SEQ ID NO: 151125 - DNA, 15 bp, Homo sapiens
aaacctgctgagaga

SEQ ID NO: 151126 - DNA, 15 bp, Homo sapiens
aaaacctgctgagag

SEQ ID NO: 151127 - DNA, 15 bp, Homo sapiens
aaaaacctgctgaga

SEQ ID NO: 151128 - DNA, 15 bp, Homo sapiens
taaaaacctgctgag

SEQ ID NO: 151129 - DNA, 15 bp, Homo sapiens
ataaaaacctgctga

SEQ ID NO: 151130 - DNA, 15 bp, Homo sapiens
cataaaaacctgctg

SEQ ID NO: 151131 - DNA, 15 bp, Homo sapiens
acataaaaacctgct

SEQ ID NO: 151132 - DNA, 15 bp, Homo sapiens
aacataaaaacctgc

SEQ ID NO: 151133 - DNA, 15 bp, Homo sapiens
gaacataaaaacctg

SEQ ID NO: 151134 - DNA, 15 bp, Homo sapiens
tgaacataaaaacct

SEQ ID NO: 151135 - DNA, 15 bp, Homo sapiens
gtgaacataaaaacc

SEQ ID NO: 151136 - DNA, 15 bp, Homo sapiens
agtgaacataaaaac

SEQ ID NO: 151137 - DNA, 15 bp, Homo sapiens
cagtgaacataaaaa

SEQ ID NO: 151138 - DNA, 15 bp, Homo sapiens
tcagtgaacataaaa

SEQ ID NO: 151139 - DNA, 15 bp, Homo sapiens
atcagtgaacataaa

SEQ ID NO: 151140 - DNA, 15 bp, Homo sapiens
catcagtgaacataa

SEQ ID NO: 151141 - DNA, 15 bp, Homo sapiens
tcatcagtgaacata

SEQ ID NO: 151142 - DNA, 15 bp, Homo sapiens
ttcatcagtgaacat

SEQ ID NO: 151143 - DNA, 15 bp, Homo sapiens
cttcatcagtgaaca

SEQ ID NO: 151144 - DNA, 15 bp, Homo sapiens
acttcatcagtgaac

SEQ ID NO: 151145 - DNA, 15 bp, Homo sapiens
tacttcatcagtgaa

SEQ ID NO: 151146 - DNA, 15 bp, Homo sapiens
ttacttcatcagtga

SEQ ID NO: 151147 - DNA, 15 bp, Homo sapiens
cttacttcatcagtg

SEQ ID NO: 151148 - DNA, 15 bp, Homo sapiens
ccttacttcatcagt

SEQ ID NO: 151149 - DNA, 15 bp, Homo sapiens
accttacttcatcag

SEQ ID NO: 151150 - DNA, 15 bp, Homo sapiens
gaccttacttcatca

SEQ ID NO: 151151 - DNA, 15 bp, Homo sapiens
tgaccttacttcatc

SEQ ID NO: 151152 - DNA, 15 bp, Homo sapiens
gtgaccttacttcat

SEQ ID NO: 151153 - DNA, 15 bp, Homo sapiens
tgtgaccttacttca

SEQ ID NO: 151154 - DNA, 15 bp, Homo sapiens
atgtgaccttacttc

SEQ ID NO: 151155 - DNA, 15 bp, Homo sapiens
tatgtgaccttactt

SEQ ID NO: 151156 - DNA, 15 bp, Homo sapiens
atatgtgaccttact

SEQ ID NO: 151157 - DNA, 15 bp, Homo sapiens
aatatgtgaccttac

SEQ ID NO: 151158 - DNA, 15 bp, Homo sapiens
taatatgtgacctta

SEQ ID NO: 151159 - DNA, 15 bp, Homo sapiens
ataatatgtgacctt

SEQ ID NO: 151160 - DNA, 15 bp, Homo sapiens
aataatatgtgacct

SEQ ID NO: 151161 - DNA, 15 bp, Homo sapiens
aaataatatgtgacc

SEQ ID NO: 151162 - DNA, 15 bp, Homo sapiens
aaaataatatgtgac

SEQ ID NO: 151163 - DNA, 15 bp, Homo sapiens
aaaaataatatgtga

SEQ ID NO: 151164 - DNA, 15 bp, Homo sapiens
gaaaaataatatgtg

SEQ ID NO: 151165 - DNA, 15 bp, Homo sapiens
tgaaaaataatatgt

SEQ ID NO: 151166 - DNA, 15 bp, Homo sapiens
atgaaaaataatatg

SEQ ID NO: 151167 - DNA, 15 bp, Homo sapiens
gatgaaaaataatat

SEQ ID NO: 151168 - DNA, 15 bp, Homo sapiens
agatgaaaaataata

SEQ ID NO: 151169 - DNA, 15 bp, Homo sapiens
tagatgaaaaataat

SEQ ID NO: 151170 - DNA, 15 bp, Homo sapiens
gtagatgaaaaataa

SEQ ID NO: 151171 - DNA, 15 bp, Homo sapiens
tgtagatgaaaaata

SEQ ID NO: 151172 - DNA, 15 bp, Homo sapiens
atgtagatgaaaaat

SEQ ID NO: 151173 - DNA, 15 bp, Homo sapiens
catgtagatgaaaaa

SEQ ID NO: 151174 - DNA, 15 bp, Homo sapiens
acatgtagatgaaaa

SEQ ID NO: 151175 - DNA, 15 bp, Homo sapiens
tacatgtagatgaaa

SEQ ID NO: 151176 - DNA, 15 bp, Homo sapiens
gtacatgtagatgaa

SEQ ID NO: 151177 - DNA, 15 bp, Homo sapiens
tgtacatgtagatga

SEQ ID NO: 151178 - DNA, 15 bp, Homo sapiens
ctgtacatgtagatg

SEQ ID NO: 151179 - DNA, 15 bp, Homo sapiens
gctgtacatgtagat

SEQ ID NO: 151180 - DNA, 15 bp, Homo sapiens
agctgtacatgtaga

SEQ ID NO: 151181 - DNA, 15 bp, Homo sapiens
gagctgtacatgtag

SEQ ID NO: 151182 - DNA, 15 bp, Homo sapiens
ggagctgtacatgta

SEQ ID NO: 151183 - DNA, 15 bp, Homo sapiens
gggagctgtacatgt

SEQ ID NO: 151184 - DNA, 15 bp, Homo sapiens
agggagctgtacatg

SEQ ID NO: 151185 - DNA, 15 bp, Homo sapiens
cagggagctgtacat

SEQ ID NO: 151186 - DNA, 15 bp, Homo sapiens
acagggagctgtaca

SEQ ID NO: 151187 - DNA, 15 bp, Homo sapiens
tacagggagctgtac

SEQ ID NO: 151188 - DNA, 15 bp, Homo sapiens
atacagggagctgta

SEQ ID NO: 151189 - DNA, 15 bp, Homo sapiens
aatacagggagctgt

SEQ ID NO: 151190 - DNA, 15 bp, Homo sapiens
aaatacagggagctg

SEQ ID NO: 151191 - DNA, 15 bp, Homo sapiens
taaatacagggagct

SEQ ID NO: 151192 - DNA, 15 bp, Homo sapiens
ctaaatacagggagc

SEQ ID NO: 151193 - DNA, 15 bp, Homo sapiens
tctaaatacagggag

SEQ ID NO: 151194 - DNA, 15 bp, Homo sapiens
ctctaaatacaggga

SEQ ID NO: 151195 - DNA, 15 bp, Homo sapiens
cctctaaatacaggg

SEQ ID NO: 151196 - DNA, 15 bp, Homo sapiens
acctctaaatacagg

SEQ ID NO: 151197 - DNA, 15 bp, Homo sapiens
tacctctaaatacag

SEQ ID NO: 151198 - DNA, 15 bp, Homo sapiens
ctacctctaaataca

SEQ ID NO: 151199 - DNA, 15 bp, Homo sapiens
actacctctaaatac

SEQ ID NO: 151200 - DNA, 15 bp, Homo sapiens
aactacctctaaata

SEQ ID NO: 151201 - DNA, 15 bp, Homo sapiens
taactacctctaaat

SEQ ID NO: 151202 - DNA, 15 bp, Homo sapiens
ttaactacctctaaa

SEQ ID NO: 151203 - DNA, 15 bp, Homo sapiens
cttaactacctctaa

SEQ ID NO: 151204 - DNA, 15 bp, Homo sapiens
ccttaactacctcta

SEQ ID NO: 151205 - DNA, 15 bp, Homo sapiens
accttaactacctct

SEQ ID NO: 151206 - DNA, 15 bp, Homo sapiens
aaccttaactacctc

SEQ ID NO: 151207 - DNA, 15 bp, Homo sapiens
caaccttaactacct

SEQ ID NO: 151208 - DNA, 15 bp, Homo sapiens
tcaaccttaactacc

SEQ ID NO: 151209 - DNA, 15 bp, Homo sapiens
ctcaaccttaactac

SEQ ID NO: 151210 - DNA, 15 bp, Homo sapiens
actcaaccttaacta

SEQ ID NO: 151211 - DNA, 15 bp, Homo sapiens
tactcaaccttaact

SEQ ID NO: 151212 - DNA, 15 bp, Homo sapiens
atactcaaccttaac

SEQ ID NO: 151213 - DNA, 15 bp, Homo sapiens
catactcaaccttaa

SEQ ID NO: 151214 - DNA, 15 bp, Homo sapiens
acatactcaacctta

SEQ ID NO: 151215 - DNA, 15 bp, Homo sapiens
cacatactcaacctt

SEQ ID NO: 151216 - DNA, 15 bp, Homo sapiens
ccacatactcaacct

SEQ ID NO: 151217 - DNA, 15 bp, Homo sapiens
accacatactcaacc

SEQ ID NO: 151218 - DNA, 15 bp, Homo sapiens
aaccacatactcaac

SEQ ID NO: 151219 - DNA, 15 bp, Homo sapiens
aaaccacatactcaa

SEQ ID NO: 151220 - DNA, 15 bp, Homo sapiens
aaaaccacatactca

SEQ ID NO: 151221 - DNA, 15 bp, Homo sapiens
aaaaaccacatactc

SEQ ID NO: 151222 - DNA, 15 bp, Homo sapiens
aaaaaaccacatact

SEQ ID NO: 151223 - DNA, 15 bp, Homo sapiens
taaaaaaccacatac

SEQ ID NO: 151224 - DNA, 15 bp, Homo sapiens
ctaaaaaaccacata

SEQ ID NO: 151225 - DNA, 15 bp, Homo sapiens
tctaaaaaaccacat

SEQ ID NO: 151226 - DNA, 15 bp, Homo sapiens
ttctaaaaaaccaca

SEQ ID NO: 151227 - DNA, 15 bp, Homo sapiens
cttctaaaaaaccac

SEQ ID NO: 151228 - DNA, 15 bp, Homo sapiens
tcttctaaaaaacca

SEQ ID NO: 151229 - DNA, 15 bp, Homo sapiens
gtcttctaaaaaacc

SEQ ID NO: 151230 - DNA, 15 bp, Homo sapiens
tgtcttctaaaaaac

SEQ ID NO: 151231 - DNA, 15 bp, Homo sapiens
gtgtcttctaaaaaa

SEQ ID NO: 151232 - DNA, 15 bp, Homo sapiens
agtgtcttctaaaaa

SEQ ID NO: 151233 - DNA, 15 bp, Homo sapiens
cagtgtcttctaaaa

SEQ ID NO: 151234 - DNA, 15 bp, Homo sapiens
tcagtgtcttctaaa

SEQ ID NO: 151235 - DNA, 15 bp, Homo sapiens
ttcagtgtcttctaa

SEQ ID NO: 151236 - DNA, 15 bp, Homo sapiens
attcagtgtcttcta

SEQ ID NO: 151237 - DNA, 15 bp, Homo sapiens
cattcagtgtcttct

SEQ ID NO: 151238 - DNA, 15 bp, Homo sapiens
ccattcagtgtcttc

SEQ ID NO: 151239 - DNA, 15 bp, Homo sapiens
tccattcagtgtctt

SEQ ID NO: 151240 - DNA, 15 bp, Homo sapiens
ctccattcagtgtct

SEQ ID NO: 151241 - DNA, 15 bp, Homo sapiens
actccattcagtgtc

SEQ ID NO: 151242 - DNA, 15 bp, Homo sapiens
cactccattcagtgt

SEQ ID NO: 151243 - DNA, 15 bp, Homo sapiens
ccactccattcagtg

SEQ ID NO: 151244 - DNA, 15 bp, Homo sapiens
accactccattcagt

SEQ ID NO: 151245 - DNA, 15 bp, Homo sapiens
caccactccattcag

SEQ ID NO: 151246 - DNA, 15 bp, Homo sapiens
acaccactccattca

SEQ ID NO: 151247 - DNA, 15 bp, Homo sapiens
tacaccactccattc

SEQ ID NO: 151248 - DNA, 15 bp, Homo sapiens
atacaccactccatt

SEQ ID NO: 151249 - DNA, 15 bp, Homo sapiens
aatacaccactccat

SEQ ID NO: 151250 - DNA, 15 bp, Homo sapiens
aaatacaccactcca

SEQ ID NO: 151251 - DNA, 15 bp, Homo sapiens
aaaatacaccactcc

SEQ ID NO: 151252 - DNA, 15 bp, Homo sapiens
gaaaatacaccactc

SEQ ID NO: 151253 - DNA, 15 bp, Homo sapiens
cgaaaatacaccact

SEQ ID NO: 151254 - DNA, 15 bp, Homo sapiens
tcgaaaatacaccac

SEQ ID NO: 151255 - DNA, 15 bp, Homo sapiens
gtcgaaaatacacca

SEQ ID NO: 151256 - DNA, 15 bp, Homo sapiens
ggtcgaaaatacacc

SEQ ID NO: 151257 - DNA, 15 bp, Homo sapiens
cggtcgaaaatacac

SEQ ID NO: 151258 - DNA, 15 bp, Homo sapiens
ccggtcgaaaataca

SEQ ID NO: 151259 - DNA, 15 bp, Homo sapiens
accggtcgaaaatac

SEQ ID NO: 151260 - DNA, 15 bp, Homo sapiens
aaccggtcgaaaata

SEQ ID NO: 151261 - DNA, 15 bp, Homo sapiens
caaccggtcgaaaat

SEQ ID NO: 151262 - DNA, 15 bp, Homo sapiens
tcaaccggtcgaaaa

SEQ ID NO: 151263 - DNA, 15 bp, Homo sapiens
ttcaaccggtcgaaa

SEQ ID NO: 151264 - DNA, 15 bp, Homo sapiens
attcaaccggtcgaa

SEQ ID NO: 151265 - DNA, 15 bp, Homo sapiens
aattcaaccggtcga

SEQ ID NO: 151266 - DNA, 15 bp, Homo sapiens
aaattcaaccggtcg

SEQ ID NO: 151267 - DNA, 15 bp, Homo sapiens
aaaattcaaccggtc

SEQ ID NO: 151268 - DNA, 15 bp, Homo sapiens
caaaattcaaccggt

SEQ ID NO: 151269 - DNA, 15 bp, Homo sapiens
acaaaattcaaccgg

SEQ ID NO: 151270 - DNA, 15 bp, Homo sapiens
tacaaaattcaaccg

SEQ ID NO: 151271 - DNA, 15 bp, Homo sapiens
atacaaaattcaacc

SEQ ID NO: 151272 - DNA, 15 bp, Homo sapiens
aatacaaaattcaac

SEQ ID NO: 151273 - DNA, 15 bp, Homo sapiens
aaatacaaaattcaa

SEQ ID NO: 151274 - DNA, 15 bp, Homo sapiens
aaaatacaaaattca

SEQ ID NO: 151275 - DNA, 15 bp, Homo sapiens
aaaaatacaaaattc

SEQ ID NO: 151276 - DNA, 15 bp, Homo sapiens
aaaaaatacaaaatt

SEQ ID NO: 151277 - DNA, 15 bp, Homo sapiens
taaaaaatacaaaat

SEQ ID NO: 151278 - DNA, 15 bp, Homo sapiens
agtaaaaaatacaaa

SEQ ID NO: 151279 - DNA, 15 bp, Homo sapiens
gagtaaaaaatacaa

SEQ ID NO: 151280 - DNA, 15 bp, Homo sapiens
agagtaaaaaataca

SEQ ID NO: 151281 - DNA, 15 bp, Homo sapiens
gagagtaaaaaatac

SEQ ID NO: 151282 - DNA, 15 bp, Homo sapiens
tgagagtaaaaaata

SEQ ID NO: 151283 - DNA, 15 bp, Homo sapiens
ttgagagtaaaaaat

SEQ ID NO: 151284 - DNA, 15 bp, Homo sapiens
tttgagagtaaaaaa

SEQ ID NO: 151285 - DNA, 15 bp, Homo sapiens
gtttgagagtaaaaa

SEQ ID NO: 151286 - DNA, 15 bp, Homo sapiens
tgtttgagagtaaaa

SEQ ID NO: 151287 - DNA, 15 bp, Homo sapiens
atgtttgagagtaaa

SEQ ID NO: 151288 - DNA, 15 bp, Homo sapiens
aatgtttgagagtaa

SEQ ID NO: 151289 - DNA, 15 bp, Homo sapiens
aaatgtttgagagta

SEQ ID NO: 151290 - DNA, 15 bp, Homo sapiens
gaaatgtttgagagt

SEQ ID NO: 151291 - DNA, 15 bp, Homo sapiens
ggaaatgtttgagag

SEQ ID NO: 151292 - DNA, 15 bp, Homo sapiens
gggaaatgtttgaga

SEQ ID NO: 151293 - DNA, 15 bp, Homo sapiens
ggggaaatgtttgag

SEQ ID NO: 151294 - DNA, 15 bp, Homo sapiens
tggggaaatgtttga

SEQ ID NO: 151295 - DNA, 15 bp, Homo sapiens
gtggggaaatgtttg

SEQ ID NO: 151296 - DNA, 15 bp, Homo sapiens
ggtggggaaatgttt

SEQ ID NO: 151297 - DNA, 15 bp, Homo sapiens
aggtggggaaatgtt

SEQ ID NO: 151298 - DNA, 15 bp, Homo sapiens
aaggtggggaaatgt

SEQ ID NO: 151299 - DNA, 15 bp, Homo sapiens
aaaggtggggaaatg

SEQ ID NO: 151300 - DNA, 15 bp, Homo sapiens
aaaaggtggggaaat

SEQ ID NO: 151301 - DNA, 15 bp, Homo sapiens
aaaaaggtggggaaa

SEQ ID NO: 151302 - DNA, 15 bp, Homo sapiens
aaaaaaggtggggaa

SEQ ID NO: 151303 - DNA, 15 bp, Homo sapiens
aaaaaaaggtgggga

SEQ ID NO: 151304 - DNA, 15 bp, Homo sapiens
gaaaaaaaggtgggg

SEQ ID NO: 151305 - DNA, 15 bp, Homo sapiens
tgaaaaaaaggtggg

SEQ ID NO: 151306 - DNA, 15 bp, Homo sapiens
gtgaaaaaaaggtgg

SEQ ID NO: 151307 - DNA, 15 bp, Homo sapiens
tgtgaaaaaaaggtg

SEQ ID NO: 151308 - DNA, 15 bp, Homo sapiens
ctgtgaaaaaaaggt

SEQ ID NO: 151309 - DNA, 15 bp, Homo sapiens
cctgtgaaaaaaagg

SEQ ID NO: 151310 - DNA, 15 bp, Homo sapiens
tcctgtgaaaaaaag

SEQ ID NO: 151311 - DNA, 15 bp, Homo sapiens
ctcctgtgaaaaaaa

SEQ ID NO: 151312 - DNA, 15 bp, Homo sapiens
tctcctgtgaaaaaa

SEQ ID NO: 151313 - DNA, 15 bp, Homo sapiens
ttctcctgtgaaaaa

SEQ ID NO: 151314 - DNA, 15 bp, Homo sapiens
gttctcctgtgaaaa

SEQ ID NO: 151315 - DNA, 15 bp, Homo sapiens
ggttctcctgtgaaa

SEQ ID NO: 151316 - DNA, 15 bp, Homo sapiens
gggttctcctgtgaa

SEQ ID NO: 151317 - DNA, 15 bp, Homo sapiens
agggttctcctgtga

SEQ ID NO: 151318 - DNA, 15 bp, Homo sapiens
cagggttctcctgtg

SEQ ID NO: 151319 - DNA, 15 bp, Homo sapiens
gcagggttctcctgt

SEQ ID NO: 151320 - DNA, 15 bp, Homo sapiens
agcagggttctcctg

SEQ ID NO: 151321 - DNA, 15 bp, Homo sapiens
gagcagggttctcct

SEQ ID NO: 151322 - DNA, 15 bp, Homo sapiens
agagcagggttctcc

SEQ ID NO: 151323 - DNA, 15 bp, Homo sapiens
gagagcagggttctc

SEQ ID NO: 151324 - DNA, 15 bp, Homo sapiens
ggagagcagggttct

SEQ ID NO: 151325 - DNA, 15 bp, Homo sapiens
aggagagcagggttc

SEQ ID NO: 151326 - DNA, 15 bp, Homo sapiens
aaggagagcagggtt

SEQ ID NO: 151327 - DNA, 15 bp, Homo sapiens
caaggagagcagggt

SEQ ID NO: 151328 - DNA, 15 bp, Homo sapiens
ccaaggagagcaggg

SEQ ID NO: 151329 - DNA, 15 bp, Homo sapiens
tccaaggagagcagg

SEQ ID NO: 151330 - DNA, 15 bp, Homo sapiens
gtccaaggagagcag

SEQ ID NO: 151331 - DNA, 15 bp, Homo sapiens
tgtccaaggagagca

SEQ ID NO: 151332 - DNA, 15 bp, Homo sapiens
ttgtccaaggagagc

SEQ ID NO: 151333 - DNA, 15 bp, Homo sapiens
attgtccaaggagag

SEQ ID NO: 151334 - DNA, 15 bp, Homo sapiens
aattgtccaaggaga

SEQ ID NO: 151335 - DNA, 15 bp, Homo sapiens
taattgtccaaggag

SEQ ID NO: 151336 - DNA, 15 bp, Homo sapiens
ttaattgtccaagga

SEQ ID NO: 151337 - DNA, 15 bp, Homo sapiens
tttaattgtccaagg

SEQ ID NO: 151338 - DNA, 15 bp, Homo sapiens
atttaattgtccaag

SEQ ID NO: 151339 - DNA, 15 bp, Homo sapiens
gatttaattgtccaa

SEQ ID NO: 151340 - DNA, 15 bp, Homo sapiens
ggatttaattgtcca

SEQ ID NO: 151341 - DNA, 15 bp, Homo sapiens
aggatttaattgtcc

SEQ ID NO: 151342 - DNA, 15 bp, Homo sapiens
caggatttaattgtc

SEQ ID NO: 151343 - DNA, 15 bp, Homo sapiens
tcaggatttaattgt

SEQ ID NO: 151344 - DNA, 15 bp, Homo sapiens
ttcaggatttaattg

SEQ ID NO: 151345 - DNA, 15 bp, Homo sapiens
cttcaggatttaatt

SEQ ID NO: 151346 - DNA, 15 bp, Homo sapiens
acttcaggatttaat

SEQ ID NO: 151347 - DNA, 15 bp, Homo sapiens
cacttcaggatttaa

SEQ ID NO: 151348 - DNA, 15 bp, Homo sapiens
tcacttcaggattta

SEQ ID NO: 151349 - DNA, 15 bp, Homo sapiens
atcacttcaggattt

SEQ ID NO: 151350 - DNA, 15 bp, Homo sapiens
gatcacttcaggatt

SEQ ID NO: 151351 - DNA, 15 bp, Homo sapiens
ggatcacttcaggat

SEQ ID NO: 151352 - DNA, 15 bp, Homo sapiens
tggatcacttcagga

SEQ ID NO: 151353 - DNA, 15 bp, Homo sapiens
ctggatcacttcagg

SEQ ID NO: 151354 - DNA, 15 bp, Homo sapiens
cctggatcacttcag

SEQ ID NO: 151355 - DNA, 15 bp, Homo sapiens
ccctggatcacttca

SEQ ID NO: 151356 - DNA, 15 bp, Homo sapiens
gccctggatcacttc

SEQ ID NO: 151357 - DNA, 15 bp, Homo sapiens
tgccctggatcactt

SEQ ID NO: 151358 - DNA, 15 bp, Homo sapiens
ttgccctggatcact

SEQ ID NO: 151359 - DNA, 15 bp, Homo sapiens
attgccctggatcac

SEQ ID NO: 151360 - DNA, 15 bp, Homo sapiens
cattgccctggatca

SEQ ID NO: 151361 - DNA, 15 bp, Homo sapiens
ccattgccctggatc

SEQ ID NO: 151362 - DNA, 15 bp, Homo sapiens
tccattgccctggat

SEQ ID NO: 151363 - DNA, 15 bp, Homo sapiens
ctccattgccctgga

SEQ ID NO: 151364 - DNA, 15 bp, Homo sapiens
tctccattgccctgg

SEQ ID NO: 151365 - DNA, 15 bp, Homo sapiens
atctccattgccctg

SEQ ID NO: 151366 - DNA, 15 bp, Homo sapiens
aatctccattgccct

SEQ ID NO: 151367 - DNA, 15 bp, Homo sapiens
aaatctccattgccc

SEQ ID NO: 151368 - DNA, 15 bp, Homo sapiens
taaatctccattgcc

SEQ ID NO: 151369 - DNA, 15 bp, Homo sapiens
gtaaatctccattgc

SEQ ID NO: 151370 - DNA, 15 bp, Homo sapiens
agtaaatctccattg

SEQ ID NO: 151371 - DNA, 15 bp, Homo sapiens
aagtaaatctccatt

SEQ ID NO: 151372 - DNA, 15 bp, Homo sapiens
aaagtaaatctccat

SEQ ID NO: 151373 - DNA, 15 bp, Homo sapiens
taaagtaaatctcca

SEQ ID NO: 151374 - DNA, 15 bp, Homo sapiens
ttaaagtaaatctcc

SEQ ID NO: 151375 - DNA, 15 bp, Homo sapiens
gttaaagtaaatctc

SEQ ID NO: 151376 - DNA, 15 bp, Homo sapiens
tgttaaagtaaatct

SEQ ID NO: 151377 - DNA, 15 bp, Homo sapiens
atgttaaagtaaatc

SEQ ID NO: 151378 - DNA, 15 bp, Homo sapiens
catgttaaagtaaat

SEQ ID NO: 151379 - DNA, 15 bp, Homo sapiens
tcatgttaaagtaaa

SEQ ID NO: 151380 - DNA, 15 bp, Homo sapiens
atcatgttaaagtaa

SEQ ID NO: 151381 - DNA, 15 bp, Homo sapiens
gatcatgttaaagta

SEQ ID NO: 151382 - DNA, 15 bp, Homo sapiens
agatcatgttaaagt

SEQ ID NO: 151383 - DNA, 15 bp, Homo sapiens
cagatcatgttaaag

SEQ ID NO: 151384 - DNA, 15 bp, Homo sapiens
tcagatcatgttaaa

SEQ ID NO: 151385 - DNA, 15 bp, Homo sapiens
atcagatcatgttaa

SEQ ID NO: 151386 - DNA, 15 bp, Homo sapiens
aatcagatcatgtta

SEQ ID NO: 151387 - DNA, 15 bp, Homo sapiens
caatcagatcatgtt

SEQ ID NO: 151388 - DNA, 15 bp, Homo sapiens
acaatcagatcatgt

SEQ ID NO: 151389 - DNA, 15 bp, Homo sapiens
aacaatcagatcatg

SEQ ID NO: 151390 - DNA, 15 bp, Homo sapiens
caacaatcagatcat

SEQ ID NO: 151391 - DNA, 15 bp, Homo sapiens
tcaacaatcagatca

SEQ ID NO: 151392 - DNA, 15 bp, Homo sapiens
ctcaacaatcagatc

SEQ ID NO: 151393 - DNA, 15 bp, Homo sapiens
tctcaacaatcagat

SEQ ID NO: 151394 - DNA, 15 bp, Homo sapiens
atctcaacaatcaga

SEQ ID NO: 151395 - DNA, 15 bp, Homo sapiens
catctcaacaatcag

SEQ ID NO: 151396 - DNA, 15 bp, Homo sapiens
acatctcaacaatca

SEQ ID NO: 151397 - DNA, 15 bp, Homo sapiens
cacatctcaacaatc

SEQ ID NO: 151398 - DNA, 15 bp, Homo sapiens
acacatctcaacaat

SEQ ID NO: 151399 - DNA, 15 bp, Homo sapiens
cacacatctcaacaa

SEQ ID NO: 151400 - DNA, 15 bp, Homo sapiens
acacacatctcaaca

SEQ ID NO: 151401 - DNA, 15 bp, Homo sapiens
tacacacatctcaac

SEQ ID NO: 151402 - DNA, 15 bp, Homo sapiens
atacacacatctcaa

SEQ ID NO: 151403 - DNA, 15 bp, Homo sapiens
aatacacacatctca

SEQ ID NO: 151404 - DNA, 15 bp, Homo sapiens
aaatacacacatctc

SEQ ID NO: 151405 - DNA, 15 bp, Homo sapiens
aaaatacacacatct

SEQ ID NO: 151406 - DNA, 15 bp, Homo sapiens
taaaatacacacatc

SEQ ID NO: 151407 - DNA, 15 bp, Homo sapiens
ttaaaatacacacat

SEQ ID NO: 151408 - DNA, 15 bp, Homo sapiens
cttaaaatacacaca

SEQ ID NO: 151409 - DNA, 15 bp, Homo sapiens
ccttaaaatacacac

SEQ ID NO: 151410 - DNA, 15 bp, Homo sapiens
accttaaaatacaca

SEQ ID NO: 151411 - DNA, 15 bp, Homo sapiens
gaccttaaaatacac

SEQ ID NO: 151412 - DNA, 15 bp, Homo sapiens
tgaccttaaaataca

SEQ ID NO: 151413 - DNA, 15 bp, Homo sapiens
ttgaccttaaaatac

SEQ ID NO: 151414 - DNA, 15 bp, Homo sapiens
gttgaccttaaaata

SEQ ID NO: 151415 - DNA, 15 bp, Homo sapiens
agttgaccttaaaat

SEQ ID NO: 151416 - DNA, 15 bp, Homo sapiens
gagttgaccttaaaa

SEQ ID NO: 151417 - DNA, 15 bp, Homo sapiens
agagttgaccttaaa

SEQ ID NO: 151418 - DNA, 15 bp, Homo sapiens
aagagttgaccttaa

SEQ ID NO: 151419 - DNA, 15 bp, Homo sapiens
caagagttgacctta

SEQ ID NO: 151420 - DNA, 15 bp, Homo sapiens
ccaagagttgacctt

SEQ ID NO: 151421 - DNA, 15 bp, Homo sapiens
tccaagagttgacct

SEQ ID NO: 151422 - DNA, 15 bp, Homo sapiens
atccaagagttgacc

SEQ ID NO: 151423 - DNA, 15 bp, Homo sapiens
aatccaagagttgac

SEQ ID NO: 151424 - DNA, 15 bp, Homo sapiens
gaatccaagagttga

SEQ ID NO: 151425 - DNA, 15 bp, Homo sapiens
ggaatccaagagttg

SEQ ID NO: 151426 - DNA, 15 bp, Homo sapiens
gggaatccaagagtt

SEQ ID NO: 151427 - DNA, 15 bp, Homo sapiens
agggaatccaagagt

SEQ ID NO: 151428 - DNA, 15 bp, Homo sapiens
gagggaatccaagag

SEQ ID NO: 151429 - DNA, 15 bp, Homo sapiens
tgagggaatccaaga

SEQ ID NO: 151430 - DNA, 15 bp, Homo sapiens
ctgagggaatccaag

SEQ ID NO: 151431 - DNA, 15 bp, Homo sapiens
actgagggaatccaa

SEQ ID NO: 151432 - DNA, 15 bp, Homo sapiens
aactgagggaatcca

SEQ ID NO: 151433 - DNA, 15 bp, Homo sapiens
aaactgagggaatcc

SEQ ID NO: 151434 - DNA, 15 bp, Homo sapiens
gaaactgagggaatc

SEQ ID NO: 151435 - DNA, 15 bp, Homo sapiens
agaaactgagggaat

SEQ ID NO: 151436 - DNA, 15 bp, Homo sapiens
gagaaactgagggaa

SEQ ID NO: 151437 - DNA, 15 bp, Homo sapiens
agagaaactgaggga

SEQ ID NO: 151438 - DNA, 15 bp, Homo sapiens
gagagaaactgaggg

SEQ ID NO: 151439 - DNA, 15 bp, Homo sapiens
tgagagaaactgagg

SEQ ID NO: 151440 - DNA, 15 bp, Homo sapiens
ttgagagaaactgag

SEQ ID NO: 151441 - DNA, 15 bp, Homo sapiens
attgagagaaactga

SEQ ID NO: 151442 - DNA, 15 bp, Homo sapiens
tattgagagaaactg

SEQ ID NO: 151443 - DNA, 15 bp, Homo sapiens
ttattgagagaaact

SEQ ID NO: 151444 - DNA, 15 bp, Homo sapiens
gttattgagagaaac

SEQ ID NO: 151445 - DNA, 15 bp, Homo sapiens
ggttattgagagaaa

SEQ ID NO: 151446 - DNA, 15 bp, Homo sapiens
tggttattgagagaa

SEQ ID NO: 151447 - DNA, 15 bp, Homo sapiens
ttggttattgagaga

SEQ ID NO: 151448 - DNA, 15 bp, Homo sapiens
gttggttattgagag

SEQ ID NO: 151449 - DNA, 15 bp, Homo sapiens
agttggttattgaga

SEQ ID NO: 151450 - DNA, 15 bp, Homo sapiens
gagttggttattgag

SEQ ID NO: 151451 - DNA, 15 bp, Homo sapiens
tgagttggttattga

SEQ ID NO: 151452 - DNA, 15 bp, Homo sapiens
atgagttggttattg

SEQ ID NO: 151453 - DNA, 15 bp, Homo sapiens
tatgagttggttatt

SEQ ID NO: 151454 - DNA, 15 bp, Homo sapiens
gtatgagttggttat

SEQ ID NO: 151455 - DNA, 15 bp, Homo sapiens
tgtatgagttggtta

SEQ ID NO: 151456 - DNA, 15 bp, Homo sapiens
atgtatgagttggtt

SEQ ID NO: 151457 - DNA, 15 bp, Homo sapiens
tatgtatgagttggt

SEQ ID NO: 151458 - DNA, 15 bp, Homo sapiens
ctatgtatgagttgg

SEQ ID NO: 151459 - DNA, 15 bp, Homo sapiens
tctatgtatgagttg

SEQ ID NO: 151460 - DNA, 15 bp, Homo sapiens
atctatgtatgagtt

SEQ ID NO: 151461 - DNA, 15 bp, Homo sapiens
aatctatgtatgagt

SEQ ID NO: 151462 - DNA, 15 bp, Homo sapiens
caatctatgtatgag

SEQ ID NO: 151463 - DNA, 15 bp, Homo sapiens
acaatctatgtatga

SEQ ID NO: 151464 - DNA, 15 bp, Homo sapiens
aacaatctatgtatg

SEQ ID NO: 151465 - DNA, 15 bp, Homo sapiens
aaacaatctatgtat

SEQ ID NO: 151466 - DNA, 15 bp, Homo sapiens
caaacaatctatgta

SEQ ID NO: 151467 - DNA, 15 bp, Homo sapiens
tcaaacaatctatgt

SEQ ID NO: 151468 - DNA, 15 bp, Homo sapiens
ttcaaacaatctatg

SEQ ID NO: 151469 - DNA, 15 bp, Homo sapiens
gttcaaacaatctat

SEQ ID NO: 151470 - DNA, 15 bp, Homo sapiens
ggttcaaacaatcta

SEQ ID NO: 151471 - DNA, 15 bp, Homo sapiens
tggttcaaacaatct

SEQ ID NO: 151472 - DNA, 15 bp, Homo sapiens
atggttcaaacaatc

SEQ ID NO: 151473 - DNA, 15 bp, Homo sapiens
catggttcaaacaat

SEQ ID NO: 151474 - DNA, 15 bp, Homo sapiens
ccatggttcaaacaa

SEQ ID NO: 151475 - DNA, 15 bp, Homo sapiens
tccatggttcaaaca

SEQ ID NO: 151476 - DNA, 15 bp, Homo sapiens
ctccatggttcaaac

SEQ ID NO: 151477 - DNA, 15 bp, Homo sapiens
gctccatggttcaaa

SEQ ID NO: 151478 - DNA, 15 bp, Homo sapiens
agctccatggttcaa

SEQ ID NO: 151479 - DNA, 15 bp, Homo sapiens
gagctccatggttca

SEQ ID NO: 151480 - DNA, 15 bp, Homo sapiens
tgagctccatggttc

SEQ ID NO: 151481 - DNA, 15 bp, Homo sapiens
ctgagctccatggtt

SEQ ID NO: 151482 - DNA, 15 bp, Homo sapiens
tctgagctccatggt

SEQ ID NO: 151483 - DNA, 15 bp, Homo sapiens
ctctgagctccatgg

SEQ ID NO: 151484 - DNA, 15 bp, Homo sapiens
actctgagctccatg

SEQ ID NO: 151485 - DNA, 15 bp, Homo sapiens
gactctgagctccat

SEQ ID NO: 151486 - DNA, 15 bp, Homo sapiens
tgactctgagctcca

SEQ ID NO: 151487 - DNA, 15 bp, Homo sapiens
atgactctgagctcc

SEQ ID NO: 151488 - DNA, 15 bp, Homo sapiens
catgactctgagctc

SEQ ID NO: 151489 - DNA, 15 bp, Homo sapiens
tcatgactctgagct

SEQ ID NO: 151490 - DNA, 15 bp, Homo sapiens
gtcatgactctgagc

SEQ ID NO: 151491 - DNA, 15 bp, Homo sapiens
ggtcatgactctgag

SEQ ID NO: 151492 - DNA, 15 bp, Homo sapiens
gggtcatgactctga

SEQ ID NO: 151493 - DNA, 15 bp, Homo sapiens
agggtcatgactctg

SEQ ID NO: 151494 - DNA, 15 bp, Homo sapiens
gagggtcatgactct

SEQ ID NO: 151495 - DNA, 15 bp, Homo sapiens
agagggtcatgactc

SEQ ID NO: 151496 - DNA, 15 bp, Homo sapiens
tagagggtcatgact

SEQ ID NO: 151497 - DNA, 15 bp, Homo sapiens
ctagagggtcatgac

SEQ ID NO: 151498 - DNA, 15 bp, Homo sapiens
actagagggtcatga

SEQ ID NO: 151499 - DNA, 15 bp, Homo sapiens
gactagagggtcatg

SEQ ID NO: 151500 - DNA, 15 bp, Homo sapiens
agactagagggtcat

SEQ ID NO: 151501 - DNA, 15 bp, Homo sapiens
cagactagagggtca

SEQ ID NO: 151502 - DNA, 15 bp, Homo sapiens
gcagactagagggtc

SEQ ID NO: 151503 - DNA, 15 bp, Homo sapiens
tgcagactagagggt

SEQ ID NO: 151504 - DNA, 15 bp, Homo sapiens
ttgcagactagaggg

SEQ ID NO: 151505 - DNA, 15 bp, Homo sapiens
cttgcagactagagg

SEQ ID NO: 151506 - DNA, 15 bp, Homo sapiens
acttgcagactagag

SEQ ID NO: 151507 - DNA, 15 bp, Homo sapiens
aacttgcagactaga

SEQ ID NO: 151508 - DNA, 15 bp, Homo sapiens
taacttgcagactag

SEQ ID NO: 151509 - DNA, 15 bp, Homo sapiens
ctaacttgcagacta

SEQ ID NO: 151510 - DNA, 15 bp, Homo sapiens
tctaacttgcagact

SEQ ID NO: 151511 - DNA, 15 bp, Homo sapiens
ttctaacttgcagac

SEQ ID NO: 151512 - DNA, 15 bp, Homo sapiens
attctaacttgcaga

SEQ ID NO: 151513 - DNA, 15 bp, Homo sapiens
aattctaacttgcag

SEQ ID NO: 151514 - DNA, 15 bp, Homo sapiens
gaattctaacttgca

SEQ ID NO: 151515 - DNA, 15 bp, Homo sapiens
ggaattctaacttgc

SEQ ID NO: 151516 - DNA, 15 bp, Homo sapiens
gggaattctaacttg

SEQ ID NO: 151517 - DNA, 15 bp, Homo sapiens
tgggaattctaactt

SEQ ID NO: 151518 - DNA, 15 bp, Homo sapiens
gtgggaattctaact

SEQ ID NO: 151519 - DNA, 15 bp, Homo sapiens
agtgggaattctaac

SEQ ID NO: 151520 - DNA, 15 bp, Homo sapiens
aagtgggaattctaa

SEQ ID NO: 151521 - DNA, 15 bp, Homo sapiens
caagtgggaattcta

SEQ ID NO: 151522 - DNA, 15 bp, Homo sapiens
tcaagtgggaattct

SEQ ID NO: 151523 - DNA, 15 bp, Homo sapiens
atcaagtgggaattc

SEQ ID NO: 151524 - DNA, 15 bp, Homo sapiens
gatcaagtgggaatt

SEQ ID NO: 151525 - DNA, 15 bp, Homo sapiens
tgatcaagtgggaat

SEQ ID NO: 151526 - DNA, 15 bp, Homo sapiens
atgatcaagtgggaa

SEQ ID NO: 151527 - DNA, 15 bp, Homo sapiens
tatgatcaagtggga

SEQ ID NO: 151528 - DNA, 15 bp, Homo sapiens
atatgatcaagtggg

SEQ ID NO: 151529 - DNA, 15 bp, Homo sapiens
catatgatcaagtgg

SEQ ID NO: 151530 - DNA, 15 bp, Homo sapiens
tcatatgatcaagtg

SEQ ID NO: 151531 - DNA, 15 bp, Homo sapiens
ctcatatgatcaagt

SEQ ID NO: 151532 - DNA, 15 bp, Homo sapiens
actcatatgatcaag

SEQ ID NO: 151533 - DNA, 15 bp, Homo sapiens
aactcatatgatcaa

SEQ ID NO: 151534 - DNA, 15 bp, Homo sapiens
caactcatatgatca

SEQ ID NO: 151535 - DNA, 15 bp, Homo sapiens
acaactcatatgatc

SEQ ID NO: 151536 - DNA, 15 bp, Homo sapiens
gacaactcatatgat

SEQ ID NO: 151537 - DNA, 15 bp, Homo sapiens
agacaactcatatga

SEQ ID NO: 151538 - DNA, 15 bp, Homo sapiens
gagacaactcatatg

SEQ ID NO: 151539 - DNA, 15 bp, Homo sapiens
agagacaactcatat

SEQ ID NO: 151540 - DNA, 15 bp, Homo sapiens
aagagacaactcata

SEQ ID NO: 151541 - DNA, 15 bp, Homo sapiens
gaagagacaactcat

SEQ ID NO: 151542 - DNA, 15 bp, Homo sapiens
agaagagacaactca

SEQ ID NO: 151543 - DNA, 15 bp, Homo sapiens
aagaagagacaactc

SEQ ID NO: 151544 - DNA, 15 bp, Homo sapiens
caagaagagacaact

SEQ ID NO: 151545 - DNA, 15 bp, Homo sapiens
ccaagaagagacaac

SEQ ID NO: 151546 - DNA, 15 bp, Homo sapiens
gccaagaagagacaa

SEQ ID NO: 151547 - DNA, 15 bp, Homo sapiens
agccaagaagagaca

SEQ ID NO: 151548 - DNA, 15 bp, Homo sapiens
aagccaagaagagac

SEQ ID NO: 151549 - DNA, 15 bp, Homo sapiens
gaagccaagaagaga

SEQ ID NO: 151550 - DNA, 15 bp, Homo sapiens
tgaagccaagaagag

SEQ ID NO: 151551 - DNA, 15 bp, Homo sapiens
atgaagccaagaaga

SEQ ID NO: 151552 - DNA, 15 bp, Homo sapiens
catgaagccaagaag

SEQ ID NO: 151553 - DNA, 15 bp, Homo sapiens
tcatgaagccaagaa

SEQ ID NO: 151554 - DNA, 15 bp, Homo sapiens
ctcatgaagccaaga

SEQ ID NO: 151555 - DNA, 15 bp, Homo sapiens
tctcatgaagccaag

SEQ ID NO: 151556 - DNA, 15 bp, Homo sapiens
ttctcatgaagccaa

SEQ ID NO: 151557 - DNA, 15 bp, Homo sapiens
tttctcatgaagcca

SEQ ID NO: 151558 - DNA, 15 bp, Homo sapiens
ctttctcatgaagcc

SEQ ID NO: 151559 - DNA, 15 bp, Homo sapiens
actttctcatgaagc

SEQ ID NO: 151560 - DNA, 15 bp, Homo sapiens
gactttctcatgaag

SEQ ID NO: 151561 - DNA, 15 bp, Homo sapiens
agactttctcatgaa

SEQ ID NO: 151562 - DNA, 15 bp, Homo sapiens
aagactttctcatga

SEQ ID NO: 151563 - DNA, 15 bp, Homo sapiens
caagactttctcatg

SEQ ID NO: 151564 - DNA, 15 bp, Homo sapiens
ccaagactttctcat

SEQ ID NO: 151565 - DNA, 15 bp, Homo sapiens
accaagactttctca

SEQ ID NO: 151566 - DNA, 15 bp, Homo sapiens
aaccaagactttctc

SEQ ID NO: 151567 - DNA, 15 bp, Homo sapiens
taaccaagactttct

SEQ ID NO: 151568 - DNA, 15 bp, Homo sapiens
ctaaccaagactttc

SEQ ID NO: 151569 - DNA, 15 bp, Homo sapiens
tctaaccaagacttt

SEQ ID NO: 151570 - DNA, 15 bp, Homo sapiens
atctaaccaagactt

SEQ ID NO: 151571 - DNA, 15 bp, Homo sapiens
aatctaaccaagact

SEQ ID NO: 151572 - DNA, 15 bp, Homo sapiens
taatctaaccaagac

SEQ ID NO: 151573 - DNA, 15 bp, Homo sapiens
ctaatctaaccaaga

SEQ ID NO: 151574 - DNA, 15 bp, Homo sapiens
actaatctaaccaag

SEQ ID NO: 151575 - DNA, 15 bp, Homo sapiens
tactaatctaaccaa

SEQ ID NO: 151576 - DNA, 15 bp, Homo sapiens
gtactaatctaacca

SEQ ID NO: 151577 - DNA, 15 bp, Homo sapiens
tgtactaatctaacc

SEQ ID NO: 151578 - DNA, 15 bp, Homo sapiens
ctgtactaatctaac

SEQ ID NO: 151579 - DNA, 15 bp, Homo sapiens
tctgtactaatctaa

SEQ ID NO: 151580 - DNA, 15 bp, Homo sapiens
ttctgtactaatcta

SEQ ID NO: 151581 - DNA, 15 bp, Homo sapiens
tttctgtactaatct

SEQ ID NO: 151582 - DNA, 15 bp, Homo sapiens
gtttctgtactaatc

SEQ ID NO: 151583 - DNA, 15 bp, Homo sapiens
agtttctgtactaat

SEQ ID NO: 151584 - DNA, 15 bp, Homo sapiens
cagtttctgtactaa

SEQ ID NO: 151585 - DNA, 15 bp, Homo sapiens
acagtttctgtacta

SEQ ID NO: 151586 - DNA, 15 bp, Homo sapiens
cacagtttctgtact

SEQ ID NO: 151587 - DNA, 15 bp, Homo sapiens
acacagtttctgtac

SEQ ID NO: 151588 - DNA, 15 bp, Homo sapiens
cacacagtttctgta

SEQ ID NO: 151589 - DNA, 15 bp, Homo sapiens
tcacacagtttctgt

SEQ ID NO: 151590 - DNA, 15 bp, Homo sapiens
ttcacacagtttctg

SEQ ID NO: 151591 - DNA, 15 bp, Homo sapiens
cttcacacagtttct

SEQ ID NO: 151592 - DNA, 15 bp, Homo sapiens
ccttcacacagtttc

SEQ ID NO: 151593 - DNA, 15 bp, Homo sapiens
accttcacacagttt

SEQ ID NO: 151594 - DNA, 15 bp, Homo sapiens
aaccttcacacagtt

SEQ ID NO: 151595 - DNA, 15 bp, Homo sapiens
caaccttcacacagt

SEQ ID NO: 151596 - DNA, 15 bp, Homo sapiens
tcaaccttcacacag

SEQ ID NO: 151597 - DNA, 15 bp, Homo sapiens
ctcaaccttcacaca

SEQ ID NO: 151598 - DNA, 15 bp, Homo sapiens
cctcaaccttcacac

SEQ ID NO: 151599 - DNA, 15 bp, Homo sapiens
acctcaaccttcaca

SEQ ID NO: 151600 - DNA, 15 bp, Homo sapiens
aacctcaaccttcac

SEQ ID NO: 151601 - DNA, 15 bp, Homo sapiens
aaacctcaaccttca

SEQ ID NO: 151602 - DNA, 15 bp, Homo sapiens
taaacctcaaccttc

SEQ ID NO: 151603 - DNA, 15 bp, Homo sapiens
ttaaacctcaacctt

SEQ ID NO: 151604 - DNA, 15 bp, Homo sapiens
attaaacctcaacct

SEQ ID NO: 151605 - DNA, 15 bp, Homo sapiens
cattaaacctcaacc

SEQ ID NO: 151606 - DNA, 15 bp, Homo sapiens
ccattaaacctcaac

SEQ ID NO: 151607 - DNA, 15 bp, Homo sapiens
tccattaaacctcaa

SEQ ID NO: 151608 - DNA, 15 bp, Homo sapiens
ctccattaaacctca

SEQ ID NO: 151609 - DNA, 15 bp, Homo sapiens
tctccattaaacctc

SEQ ID NO: 151610 - DNA, 15 bp, Homo sapiens
ttctccattaaacct

SEQ ID NO: 151611 - DNA, 15 bp, Homo sapiens
tttctccattaaacc

SEQ ID NO: 151612 - DNA, 15 bp, Homo sapiens
ttttctccattaaac

SEQ ID NO: 151613 - DNA, 15 bp, Homo sapiens
tttttctccattaaa

SEQ ID NO: 151614 - DNA, 15 bp, Homo sapiens
atttttctccattaa

SEQ ID NO: 151615 - DNA, 15 bp, Homo sapiens
catttttctccatta

SEQ ID NO: 151616 - DNA, 15 bp, Homo sapiens
ccatttttctccatt

SEQ ID NO: 151617 - DNA, 15 bp, Homo sapiens
gccatttttctccat

SEQ ID NO: 151618 - DNA, 15 bp, Homo sapiens
cgccatttttctcca

SEQ ID NO: 151619 - DNA, 15 bp, Homo sapiens
acgccatttttctcc

SEQ ID NO: 151620 - DNA, 15 bp, Homo sapiens
tacgccatttttctc

SEQ ID NO: 151621 - DNA, 15 bp, Homo sapiens
atacgccatttttct

SEQ ID NO: 151622 - DNA, 15 bp, Homo sapiens
catacgccatttttc

SEQ ID NO: 151623 - DNA, 15 bp, Homo sapiens
acatacgccattttt

SEQ ID NO: 151624 - DNA, 15 bp, Homo sapiens
tacatacgccatttt

SEQ ID NO: 151625 - DNA, 15 bp, Homo sapiens
ctacatacgccattt

SEQ ID NO: 151626 - DNA, 15 bp, Homo sapiens
tctacatacgccatt

SEQ ID NO: 151627 - DNA, 15 bp, Homo sapiens
atctacatacgccat

SEQ ID NO: 151628 - DNA, 15 bp, Homo sapiens
catctacatacgcca

SEQ ID NO: 151629 - DNA, 15 bp, Homo sapiens
ccatctacatacgcc

SEQ ID NO: 151630 - DNA, 15 bp, Homo sapiens
cccatctacatacgc

SEQ ID NO: 151631 - DNA, 15 bp, Homo sapiens
acccatctacatacg

SEQ ID NO: 151632 - DNA, 15 bp, Homo sapiens
aacccatctacatac

SEQ ID NO: 151633 - DNA, 15 bp, Homo sapiens
aaacccatctacata

SEQ ID NO: 151634 - DNA, 15 bp, Homo sapiens
caaacccatctacat

SEQ ID NO: 151635 - DNA, 15 bp, Homo sapiens
gcaaacccatctaca

SEQ ID NO: 151636 - DNA, 15 bp, Homo sapiens
ggcaaacccatctac

SEQ ID NO: 151637 - DNA, 15 bp, Homo sapiens
aggcaaacccatcta

SEQ ID NO: 151638 - DNA, 15 bp, Homo sapiens
gaggcaaacccatct

SEQ ID NO: 151639 - DNA, 15 bp, Homo sapiens
ggaggcaaacccatc

SEQ ID NO: 151640 - DNA, 15 bp, Homo sapiens
tggaggcaaacccat

SEQ ID NO: 151641 - DNA, 15 bp, Homo sapiens
atggaggcaaaccca

SEQ ID NO: 151642 - DNA, 15 bp, Homo sapiens
gatggaggcaaaccc

SEQ ID NO: 151643 - DNA, 15 bp, Homo sapiens
agatggaggcaaacc

SEQ ID NO: 151644 - DNA, 15 bp, Homo sapiens
tagatggaggcaaac

SEQ ID NO: 151645 - DNA, 15 bp, Homo sapiens
ttagatggaggcaaa

SEQ ID NO: 151646 - DNA, 15 bp, Homo sapiens
gttagatggaggcaa

SEQ ID NO: 151647 - DNA, 15 bp, Homo sapiens
ggttagatggaggca

SEQ ID NO: 151648 - DNA, 15 bp, Homo sapiens
gggttagatggaggc

SEQ ID NO: 151649 - DNA, 15 bp, Homo sapiens
agggttagatggagg

SEQ ID NO: 151650 - DNA, 15 bp, Homo sapiens
gagggttagatggag

SEQ ID NO: 151651 - DNA, 15 bp, Homo sapiens
agagggttagatgga

SEQ ID NO: 151652 - DNA, 15 bp, Homo sapiens
gagagggttagatgg

SEQ ID NO: 151653 - DNA, 15 bp, Homo sapiens
agagagggttagatg

SEQ ID NO: 151654 - DNA, 15 bp, Homo sapiens
tagagagggttagat

SEQ ID NO: 151655 - DNA, 15 bp, Homo sapiens
atagagagggttaga

SEQ ID NO: 151656 - DNA, 15 bp, Homo sapiens
catagagagggttag

SEQ ID NO: 151657 - DNA, 15 bp, Homo sapiens
ccatagagagggtta

SEQ ID NO: 151658 - DNA, 15 bp, Homo sapiens
tccatagagagggtt

SEQ ID NO: 151659 - DNA, 15 bp, Homo sapiens
atccatagagagggt

SEQ ID NO: 151660 - DNA, 15 bp, Homo sapiens
catccatagagaggg

SEQ ID NO: 151661 - DNA, 15 bp, Homo sapiens
gcatccatagagagg

SEQ ID NO: 151662 - DNA, 15 bp, Homo sapiens
agcatccatagagag

SEQ ID NO: 151663 - DNA, 15 bp, Homo sapiens
cagcatccatagaga

SEQ ID NO: 151664 - DNA, 15 bp, Homo sapiens
acagcatccatagag

SEQ ID NO: 151665 - DNA, 15 bp, Homo sapiens
tacagcatccataga

SEQ ID NO: 151666 - DNA, 15 bp, Homo sapiens
ctacagcatccatag

SEQ ID NO: 151667 - DNA, 15 bp, Homo sapiens
cctacagcatccata

SEQ ID NO: 151668 - DNA, 15 bp, Homo sapiens
acctacagcatccat

SEQ ID NO: 151669 - DNA, 15 bp, Homo sapiens
cacctacagcatcca

SEQ ID NO: 151670 - DNA, 15 bp, Homo sapiens
acacctacagcatcc

SEQ ID NO: 151671 - DNA, 15 bp, Homo sapiens
cacacctacagcatc

SEQ ID NO: 151672 - DNA, 15 bp, Homo sapiens
acacacctacagcat

SEQ ID NO: 151673 - DNA, 15 bp, Homo sapiens
aacacacctacagca

SEQ ID NO: 151674 - DNA, 15 bp, Homo sapiens
aaacacacctacagc

SEQ ID NO: 151675 - DNA, 15 bp, Homo sapiens
gaaacacacctacag

SEQ ID NO: 151676 - DNA, 15 bp, Homo sapiens
ggaaacacacctaca

SEQ ID NO: 151677 - DNA, 15 bp, Homo sapiens
aggaaacacacctac

SEQ ID NO: 151678 - DNA, 15 bp, Homo sapiens
caggaaacacaccta

SEQ ID NO: 151679 - DNA, 15 bp, Homo sapiens
ccaggaaacacacct

SEQ ID NO: 151680 - DNA, 15 bp, Homo sapiens
cccaggaaacacacc

SEQ ID NO: 151681 - DNA, 15 bp, Homo sapiens
tcccaggaaacacac

SEQ ID NO: 151682 - DNA, 15 bp, Homo sapiens
ctcccaggaaacaca

SEQ ID NO: 151683 - DNA, 15 bp, Homo sapiens
gctcccaggaaacac

SEQ ID NO: 151684 - DNA, 15 bp, Homo sapiens
agctcccaggaaaca

SEQ ID NO: 151685 - DNA, 15 bp, Homo sapiens
cagctcccaggaaac

SEQ ID NO: 151686 - DNA, 15 bp, Homo sapiens
acagctcccaggaaa

SEQ ID NO: 151687 - DNA, 15 bp, Homo sapiens
tacagctcccaggaa

SEQ ID NO: 151688 - DNA, 15 bp, Homo sapiens
atacagctcccagga

SEQ ID NO: 151689 - DNA, 15 bp, Homo sapiens
catacagctcccagg

SEQ ID NO: 151690 - DNA, 15 bp, Homo sapiens
ccatacagctcccag

SEQ ID NO: 151691 - DNA, 15 bp, Homo sapiens
tccatacagctccca

SEQ ID NO: 151692 - DNA, 15 bp, Homo sapiens
atccatacagctccc

SEQ ID NO: 151693 - DNA, 15 bp, Homo sapiens
tatccatacagctcc

SEQ ID NO: 151694 - DNA, 15 bp, Homo sapiens
gtatccatacagctc

SEQ ID NO: 151695 - DNA, 15 bp, Homo sapiens
ggtatccatacagct

SEQ ID NO: 151696 - DNA, 15 bp, Homo sapiens
gggtatccatacagc

SEQ ID NO: 151697 - DNA, 15 bp, Homo sapiens
tgggtatccatacag

SEQ ID NO: 151698 - DNA, 15 bp, Homo sapiens
gtgggtatccataca

SEQ ID NO: 151699 - DNA, 15 bp, Homo sapiens
tgtgggtatccatac

SEQ ID NO: 151700 - DNA, 15 bp, Homo sapiens
gtgtgggtatccata

SEQ ID NO: 151701 - DNA, 15 bp, Homo sapiens
tgtgtgggtatccat

SEQ ID NO: 151702 - DNA, 15 bp, Homo sapiens
ctgtgtgggtatcca

SEQ ID NO: 151703 - DNA, 15 bp, Homo sapiens
tctgtgtgggtatcc

SEQ ID NO: 151704 - DNA, 15 bp, Homo sapiens
gtctgtgtgggtatc

SEQ ID NO: 151705 - DNA, 15 bp, Homo sapiens
agtctgtgtgggtat

SEQ ID NO: 151706 - DNA, 15 bp, Homo sapiens
tagtctgtgtgggta

SEQ ID NO: 151707 - DNA, 15 bp, Homo sapiens
gtagtctgtgtgggt

SEQ ID NO: 151708 - DNA, 15 bp, Homo sapiens
agtagtctgtgtggg

SEQ ID NO: 151709 - DNA, 15 bp, Homo sapiens
aagtagtctgtgtgg

SEQ ID NO: 151710 - DNA, 15 bp, Homo sapiens
aaagtagtctgtgtg

SEQ ID NO: 151711 - DNA, 15 bp, Homo sapiens
gaaagtagtctgtgt

SEQ ID NO: 151712 - DNA, 15 bp, Homo sapiens
agaaagtagtctgtg

SEQ ID NO: 151713 - DNA, 15 bp, Homo sapiens
gagaaagtagtctgt

SEQ ID NO: 151714 - DNA, 15 bp, Homo sapiens
agagaaagtagtctg

SEQ ID NO: 151715 - DNA, 15 bp, Homo sapiens
tagagaaagtagtct

SEQ ID NO: 151716 - DNA, 15 bp, Homo sapiens
gtagagaaagtagtc

SEQ ID NO: 151717 - DNA, 15 bp, Homo sapiens
agtagagaaagtagt

SEQ ID NO: 151718 - DNA, 15 bp, Homo sapiens
gagtagagaaagtag

SEQ ID NO: 151719 - DNA, 15 bp, Homo sapiens
agagtagagaaagta

SEQ ID NO: 151720 - DNA, 15 bp, Homo sapiens
cagagtagagaaagt

SEQ ID NO: 151721 - DNA, 15 bp, Homo sapiens
gcagagtagagaaag

SEQ ID NO: 151722 - DNA, 15 bp, Homo sapiens
cgcagagtagagaaa

SEQ ID NO: 151723 - DNA, 15 bp, Homo sapiens
acgcagagtagagaa

SEQ ID NO: 151724 - DNA, 15 bp, Homo sapiens
aacgcagagtagaga

SEQ ID NO: 151725 - DNA, 15 bp, Homo sapiens
aaacgcagagtagag

SEQ ID NO: 151726 - DNA, 15 bp, Homo sapiens
caaacgcagagtaga

SEQ ID NO: 151727 - DNA, 15 bp, Homo sapiens
acaaacgcagagtag

SEQ ID NO: 151728 - DNA, 15 bp, Homo sapiens
aacaaacgcagagta

SEQ ID NO: 151729 - DNA, 15 bp, Homo sapiens
aaacaaacgcagagt

SEQ ID NO: 151730 - DNA, 15 bp, Homo sapiens
gaaacaaacgcagag

SEQ ID NO: 151731 - DNA, 15 bp, Homo sapiens
agaaacaaacgcaga

SEQ ID NO: 151732 - DNA, 15 bp, Homo sapiens
cagaaacaaacgcag

SEQ ID NO: 151733 - DNA, 15 bp, Homo sapiens
gcagaaacaaacgca

SEQ ID NO: 151734 - DNA, 15 bp, Homo sapiens
tgcagaaacaaacgc

SEQ ID NO: 151735 - DNA, 15 bp, Homo sapiens
gtgcagaaacaaacg

SEQ ID NO: 151736 - DNA, 15 bp, Homo sapiens
agtgcagaaacaaac

SEQ ID NO: 151737 - DNA, 15 bp, Homo sapiens
aagtgcagaaacaaa

SEQ ID NO: 151738 - DNA, 15 bp, Homo sapiens
gaagtgcagaaacaa

SEQ ID NO: 151739 - DNA, 15 bp, Homo sapiens
ggaagtgcagaaaca

SEQ ID NO: 151740 - DNA, 15 bp, Homo sapiens
aggaagtgcagaaac

SEQ ID NO: 151741 - DNA, 15 bp, Homo sapiens
taggaagtgcagaaa

SEQ ID NO: 151742 - DNA, 15 bp, Homo sapiens
ctaggaagtgcagaa

SEQ ID NO: 151743 - DNA, 15 bp, Homo sapiens
actaggaagtgcaga

SEQ ID NO: 151744 - DNA, 15 bp, Homo sapiens
gactaggaagtgcag

SEQ ID NO: 151745 - DNA, 15 bp, Homo sapiens
tgactaggaagtgca

SEQ ID NO: 151746 - DNA, 15 bp, Homo sapiens
ctgactaggaagtgc

SEQ ID NO: 151747 - DNA, 15 bp, Homo sapiens
cctgactaggaagtg

SEQ ID NO: 151748 - DNA, 15 bp, Homo sapiens
acctgactaggaagt

SEQ ID NO: 151749 - DNA, 15 bp, Homo sapiens
gacctgactaggaag

SEQ ID NO: 151750 - DNA, 15 bp, Homo sapiens
tgacctgactaggaa

SEQ ID NO: 151751 - DNA, 15 bp, Homo sapiens
ttgacctgactagga

SEQ ID NO: 151752 - DNA, 15 bp, Homo sapiens
cttgacctgactagg

SEQ ID NO: 151753 - DNA, 15 bp, Homo sapiens
tcttgacctgactag

SEQ ID NO: 151754 - DNA, 15 bp, Homo sapiens
atcttgacctgacta

SEQ ID NO: 151755 - DNA, 15 bp, Homo sapiens
aatcttgacctgact

SEQ ID NO: 151756 - DNA, 15 bp, Homo sapiens
taatcttgacctgac

SEQ ID NO: 151757 - DNA, 15 bp, Homo sapiens
gtaatcttgacctga

SEQ ID NO: 151758 - DNA, 15 bp, Homo sapiens
tgtaatcttgacctg

SEQ ID NO: 151759 - DNA, 15 bp, Homo sapiens
ctgtaatcttgacct

SEQ ID NO: 151760 - DNA, 15 bp, Homo sapiens
tctgtaatcttgacc

SEQ ID NO: 151761 - DNA, 15 bp, Homo sapiens
gtctgtaatcttgac

SEQ ID NO: 151762 - DNA, 15 bp, Homo sapiens
tgtctgtaatcttga

SEQ ID NO: 151763 - DNA, 15 bp, Homo sapiens
ttgtctgtaatcttg

SEQ ID NO: 151764 - DNA, 15 bp, Homo sapiens
tttgtctgtaatctt

SEQ ID NO: 151765 - DNA, 15 bp, Homo sapiens
ttttgtctgtaatct

SEQ ID NO: 151766 - DNA, 15 bp, Homo sapiens
cttttgtctgtaatc

SEQ ID NO: 151767 - DNA, 15 bp, Homo sapiens
acttttgtctgtaat

SEQ ID NO: 151768 - DNA, 15 bp, Homo sapiens
cacttttgtctgtaa

SEQ ID NO: 151769 - DNA, 15 bp, Homo sapiens
tcacttttgtctgta

SEQ ID NO: 151770 - DNA, 15 bp, Homo sapiens
ctcacttttgtctgt

SEQ ID NO: 151771 - DNA, 15 bp, Homo sapiens
tctcacttttgtctg

SEQ ID NO: 151772 - DNA, 15 bp, Homo sapiens
gtctcacttttgtct

SEQ ID NO: 151773 - DNA, 15 bp, Homo sapiens
cgtctcacttttgtc

SEQ ID NO: 151774 - DNA, 15 bp, Homo sapiens
ccgtctcacttttgt

SEQ ID NO: 151775 - DNA, 15 bp, Homo sapiens
cccgtctcacttttg

SEQ ID NO: 151776 - DNA, 15 bp, Homo sapiens
tcccgtctcactttt

SEQ ID NO: 151777 - DNA, 15 bp, Homo sapiens
atcccgtctcacttt

SEQ ID NO: 151778 - DNA, 15 bp, Homo sapiens
gatcccgtctcactt

SEQ ID NO: 151779 - DNA, 15 bp, Homo sapiens
tgatcccgtctcact

SEQ ID NO: 151780 - DNA, 15 bp, Homo sapiens
ttgatcccgtctcac

SEQ ID NO: 151781 - DNA, 15 bp, Homo sapiens
cttgatcccgtctca

SEQ ID NO: 151782 - DNA, 15 bp, Homo sapiens
ccttgatcccgtctc

SEQ ID NO: 151783 - DNA, 15 bp, Homo sapiens
tccttgatcccgtct

SEQ ID NO: 151784 - DNA, 15 bp, Homo sapiens
ctccttgatcccgtc

SEQ ID NO: 151785 - DNA, 15 bp, Homo sapiens
tctccttgatcccgt

SEQ ID NO: 151786 - DNA, 15 bp, Homo sapiens
ttctccttgatcccg

SEQ ID NO: 151787 - DNA, 15 bp, Homo sapiens
tttctccttgatccc

SEQ ID NO: 151788 - DNA, 15 bp, Homo sapiens
ttttctccttgatcc

SEQ ID NO: 151789 - DNA, 15 bp, Homo sapiens
gttttctccttgatc

SEQ ID NO: 151790 - DNA, 15 bp, Homo sapiens
tgttttctccttgat

SEQ ID NO: 151791 - DNA, 15 bp, Homo sapiens
gtgttttctccttga

SEQ ID NO: 151792 - DNA, 15 bp, Homo sapiens
ggtgttttctccttg

SEQ ID NO: 151793 - DNA, 15 bp, Homo sapiens
aggtgttttctcctt

SEQ ID NO: 151794 - DNA, 15 bp, Homo sapiens
caggtgttttctcct

SEQ ID NO: 151795 - DNA, 15 bp, Homo sapiens
gcaggtgttttctcc

SEQ ID NO: 151796 - DNA, 15 bp, Homo sapiens
tgcaggtgttttctc

SEQ ID NO: 151797 - DNA, 15 bp, Homo sapiens
gtgcaggtgttttct

SEQ ID NO: 151798 - DNA, 15 bp, Homo sapiens
ggtgcaggtgttttc

SEQ ID NO: 151799 - DNA, 15 bp, Homo sapiens
gggtgcaggtgtttt

SEQ ID NO: 151800 - DNA, 15 bp, Homo sapiens
ggggtgcaggtgttt

SEQ ID NO: 151801 - DNA, 15 bp, Homo sapiens
aggggtgcaggtgtt

SEQ ID NO: 151802 - DNA, 15 bp, Homo sapiens
caggggtgcaggtgt

SEQ ID NO: 151803 - DNA, 15 bp, Homo sapiens
gcaggggtgcaggtg

SEQ ID NO: 151804 - DNA, 15 bp, Homo sapiens
ggcaggggtgcaggt

SEQ ID NO: 151805 - DNA, 15 bp, Homo sapiens
aggcaggggtgcagg

SEQ ID NO: 151806 - DNA, 15 bp, Homo sapiens
caggcaggggtgcag

SEQ ID NO: 151807 - DNA, 15 bp, Homo sapiens
gcaggcaggggtgca

SEQ ID NO: 151808 - DNA, 15 bp, Homo sapiens
ggcaggcaggggtgc

SEQ ID NO: 151809 - DNA, 15 bp, Homo sapiens
tggcaggcaggggtg

SEQ ID NO: 151810 - DNA, 15 bp, Homo sapiens
gtggcaggcaggggt

SEQ ID NO: 151811 - DNA, 15 bp, Homo sapiens
agtggcaggcagggg

SEQ ID NO: 151812 - DNA, 15 bp, Homo sapiens
tagtggcaggcaggg

SEQ ID NO: 151813 - DNA, 15 bp, Homo sapiens
atagtggcaggcagg

SEQ ID NO: 151814 - DNA, 15 bp, Homo sapiens
gatagtggcaggcag

SEQ ID NO: 151815 - DNA, 15 bp, Homo sapiens
tgatagtggcaggca

SEQ ID NO: 151816 - DNA, 15 bp, Homo sapiens
ctgatagtggcaggc

SEQ ID NO: 151817 - DNA, 15 bp, Homo sapiens
tctgatagtggcagg

SEQ ID NO: 151818 - DNA, 15 bp, Homo sapiens
gtctgatagtggcag

SEQ ID NO: 151819 - DNA, 15 bp, Homo sapiens
tgtctgatagtggca

SEQ ID NO: 151820 - DNA, 15 bp, Homo sapiens
atgtctgatagtggc

SEQ ID NO: 151821 - DNA, 15 bp, Homo sapiens
catgtctgatagtgg

SEQ ID NO: 151822 - DNA, 15 bp, Homo sapiens
tcatgtctgatagtg

SEQ ID NO: 151823 - DNA, 15 bp, Homo sapiens
atcatgtctgatagt

SEQ ID NO: 151824 - DNA, 15 bp, Homo sapiens
aatcatgtctgatag

SEQ ID NO: 151825 - DNA, 15 bp, Homo sapiens
gaatcatgtctgata

SEQ ID NO: 151826 - DNA, 15 bp, Homo sapiens
ggaatcatgtctgat

SEQ ID NO: 151827 - DNA, 15 bp, Homo sapiens
aggaatcatgtctga

SEQ ID NO: 151828 - DNA, 15 bp, Homo sapiens
caggaatcatgtctg

SEQ ID NO: 151829 - DNA, 15 bp, Homo sapiens
acaggaatcatgtct

SEQ ID NO: 151830 - DNA, 15 bp, Homo sapiens
cacaggaatcatgtc

SEQ ID NO: 151831 - DNA, 15 bp, Homo sapiens
ccacaggaatcatgt

SEQ ID NO: 151832 - DNA, 15 bp, Homo sapiens
gccacaggaatcatg

SEQ ID NO: 151833 - DNA, 15 bp, Homo sapiens
agccacaggaatcat

SEQ ID NO: 151834 - DNA, 15 bp, Homo sapiens
aagccacaggaatca

SEQ ID NO: 151835 - DNA, 15 bp, Homo sapiens
gaagccacaggaatc

SEQ ID NO: 151836 - DNA, 15 bp, Homo sapiens
ggaagccacaggaat

SEQ ID NO: 151837 - DNA, 15 bp, Homo sapiens
tggaagccacaggaa

SEQ ID NO: 151838 - DNA, 15 bp, Homo sapiens
ttggaagccacagga

SEQ ID NO: 151839 - DNA, 15 bp, Homo sapiens
cttggaagccacagg

SEQ ID NO: 151840 - DNA, 15 bp, Homo sapiens
tcttggaagccacag

SEQ ID NO: 151841 - DNA, 15 bp, Homo sapiens
ctcttggaagccaca

SEQ ID NO: 151842 - DNA, 15 bp, Homo sapiens
gctcttggaagccac

SEQ ID NO: 151843 - DNA, 15 bp, Homo sapiens
tgctcttggaagcca

SEQ ID NO: 151844 - DNA, 15 bp, Homo sapiens
gtgctcttggaagcc

SEQ ID NO: 151845 - DNA, 15 bp, Homo sapiens
tgtgctcttggaagc

SEQ ID NO: 151846 - DNA, 15 bp, Homo sapiens
ttgtgctcttggaag

SEQ ID NO: 151847 - DNA, 15 bp, Homo sapiens
cttgtgctcttggaa

SEQ ID NO: 151848 - DNA, 15 bp, Homo sapiens
acttgtgctcttgga

SEQ ID NO: 151849 - DNA, 15 bp, Homo sapiens
cacttgtgctcttgg

SEQ ID NO: 151850 - DNA, 15 bp, Homo sapiens
gcacttgtgctcttg

SEQ ID NO: 151851 - DNA, 15 bp, Homo sapiens
ggcacttgtgctctt

SEQ ID NO: 151852 - DNA, 15 bp, Homo sapiens
tggcacttgtgctct

SEQ ID NO: 151853 - DNA, 15 bp, Homo sapiens
atggcacttgtgctc

SEQ ID NO: 151854 - DNA, 15 bp, Homo sapiens
aatggcacttgtgct

SEQ ID NO: 151855 - DNA, 15 bp, Homo sapiens
aaatggcacttgtgc

SEQ ID NO: 151856 - DNA, 15 bp, Homo sapiens
aaaatggcacttgtg

SEQ ID NO: 151857 - DNA, 15 bp, Homo sapiens
taaaatggcacttgt

SEQ ID NO: 151858 - DNA, 15 bp, Homo sapiens
ctaaaatggcacttg

SEQ ID NO: 151859 - DNA, 15 bp, Homo sapiens
tctaaaatggcactt

SEQ ID NO: 151860 - DNA, 15 bp, Homo sapiens
ttctaaaatggcact

SEQ ID NO: 151861 - DNA, 15 bp, Homo sapiens
tttctaaaatggcac

SEQ ID NO: 151862 - DNA, 15 bp, Homo sapiens
ctttctaaaatggca

SEQ ID NO: 151863 - DNA, 15 bp, Homo sapiens
gctttctaaaatggc

SEQ ID NO: 151864 - DNA, 15 bp, Homo sapiens
agctttctaaaatgg

SEQ ID NO: 151865 - DNA, 15 bp, Homo sapiens
gagctttctaaaatg

SEQ ID NO: 151866 - DNA, 15 bp, Homo sapiens
agagctttctaaaat

SEQ ID NO: 151867 - DNA, 15 bp, Homo sapiens
aagagctttctaaaa

SEQ ID NO: 151868 - DNA, 15 bp, Homo sapiens
caagagctttctaaa

SEQ ID NO: 151869 - DNA, 15 bp, Homo sapiens
ccaagagctttctaa

SEQ ID NO: 151870 - DNA, 15 bp, Homo sapiens
tccaagagctttcta

SEQ ID NO: 151871 - DNA, 15 bp, Homo sapiens
gtccaagagctttct

SEQ ID NO: 151872 - DNA, 15 bp, Homo sapiens
ggtccaagagctttc

SEQ ID NO: 151873 - DNA, 15 bp, Homo sapiens
aggtccaagagcttt

SEQ ID NO: 151874 - DNA, 15 bp, Homo sapiens
gaggtccaagagctt

SEQ ID NO: 151875 - DNA, 15 bp, Homo sapiens
agaggtccaagagct

SEQ ID NO: 151876 - DNA, 15 bp, Homo sapiens
cagaggtccaagagc

SEQ ID NO: 151877 - DNA, 15 bp, Homo sapiens
acagaggtccaagag

SEQ ID NO: 151878 - DNA, 15 bp, Homo sapiens
aacagaggtccaaga

SEQ ID NO: 151879 - DNA, 15 bp, Homo sapiens
aaacagaggtccaag

SEQ ID NO: 151880 - DNA, 15 bp, Homo sapiens
aaaacagaggtccaa

SEQ ID NO: 151881 - DNA, 15 bp, Homo sapiens
caaaacagaggtcca

SEQ ID NO: 151882 - DNA, 15 bp, Homo sapiens
gcaaaacagaggtcc

SEQ ID NO: 151883 - DNA, 15 bp, Homo sapiens
agcaaaacagaggtc

SEQ ID NO: 151884 - DNA, 15 bp, Homo sapiens
cagcaaaacagaggt

SEQ ID NO: 151885 - DNA, 15 bp, Homo sapiens
acagcaaaacagagg

SEQ ID NO: 151886 - DNA, 15 bp, Homo sapiens
tacagcaaaacagag

SEQ ID NO: 151887 - DNA, 15 bp, Homo sapiens
ctacagcaaaacaga

SEQ ID NO: 151888 - DNA, 15 bp, Homo sapiens
actacagcaaaacag

SEQ ID NO: 151889 - DNA, 15 bp, Homo sapiens
aactacagcaaaaca

SEQ ID NO: 151890 - DNA, 15 bp, Homo sapiens
gaactacagcaaaac

SEQ ID NO: 151891 - DNA, 15 bp, Homo sapiens
ggaactacagcaaaa

SEQ ID NO: 151892 - DNA, 15 bp, Homo sapiens
gggaactacagcaaa

SEQ ID NO: 151893 - DNA, 15 bp, Homo sapiens
ggggaactacagcaa

SEQ ID NO: 151894 - DNA, 15 bp, Homo sapiens
tggggaactacagca

SEQ ID NO: 151895 - DNA, 15 bp, Homo sapiens
ttggggaactacagc

SEQ ID NO: 151896 - DNA, 15 bp, Homo sapiens
cttggggaactacag

SEQ ID NO: 151897 - DNA, 15 bp, Homo sapiens
acttggggaactaca

SEQ ID NO: 151898 - DNA, 15 bp, Homo sapiens
aacttggggaactac

SEQ ID NO: 151899 - DNA, 15 bp, Homo sapiens
caacttggggaacta

SEQ ID NO: 151900 - DNA, 15 bp, Homo sapiens
tcaacttggggaact

SEQ ID NO: 151901 - DNA, 15 bp, Homo sapiens
atcaacttggggaac

SEQ ID NO: 151902 - DNA, 15 bp, Homo sapiens
tatcaacttggggaa

SEQ ID NO: 151903 - DNA, 15 bp, Homo sapiens
atatcaacttgggga

SEQ ID NO: 151904 - DNA, 15 bp, Homo sapiens
catatcaacttgggg

SEQ ID NO: 151905 - DNA, 15 bp, Homo sapiens
acatatcaacttggg

SEQ ID NO: 151906 - DNA, 15 bp, Homo sapiens
cacatatcaacttgg

SEQ ID NO: 151907 - DNA, 15 bp, Homo sapiens
acacatatcaacttg

SEQ ID NO: 151908 - DNA, 15 bp, Homo sapiens
aacacatatcaactt

SEQ ID NO: 151909 - DNA, 15 bp, Homo sapiens
caacacatatcaact

SEQ ID NO: 151910 - DNA, 15 bp, Homo sapiens
acaacacatatcaac

SEQ ID NO: 151911 - DNA, 15 bp, Homo sapiens
gacaacacatatcaa

SEQ ID NO: 151912 - DNA, 15 bp, Homo sapiens
tgacaacacatatca

SEQ ID NO: 151913 - DNA, 15 bp, Homo sapiens
ttgacaacacatatc

SEQ ID NO: 151914 - DNA, 15 bp, Homo sapiens
tttgacaacacatat

SEQ ID NO: 151915 - DNA, 15 bp, Homo sapiens
ttttgacaacacata

SEQ ID NO: 151916 - DNA, 15 bp, Homo sapiens
attttgacaacacat

SEQ ID NO: 151917 - DNA, 15 bp, Homo sapiens
aattttgacaacaca

SEQ ID NO: 151918 - DNA, 15 bp, Homo sapiens
taattttgacaacac

SEQ ID NO: 151919 - DNA, 15 bp, Homo sapiens
ataattttgacaaca

SEQ ID NO: 151920 - DNA, 15 bp, Homo sapiens
cataattttgacaac

SEQ ID NO: 151921 - DNA, 15 bp, Homo sapiens
acataattttgacaa

SEQ ID NO: 151922 - DNA, 15 bp, Homo sapiens
aacataattttgaca

SEQ ID NO: 151923 - DNA, 15 bp, Homo sapiens
aaacataattttgac

SEQ ID NO: 151924 - DNA, 15 bp, Homo sapiens
aaaacataattttga

SEQ ID NO: 151925 - DNA, 15 bp, Homo sapiens
aaaaacataattttg

SEQ ID NO: 151926 - DNA, 15 bp, Homo sapiens
taaaaacataatttt

SEQ ID NO: 151927 - DNA, 15 bp, Homo sapiens
ttaaaaacataattt

SEQ ID NO: 151928 - DNA, 15 bp, Homo sapiens
tttaaaaacataatt

SEQ ID NO: 151929 - DNA, 15 bp, Homo sapiens
ttttaaaaacataat

SEQ ID NO: 151930 - DNA, 15 bp, Homo sapiens
tttttaaaaacataa

SEQ ID NO: 151931 - DNA, 15 bp, Homo sapiens
ctttttaaaaacata

SEQ ID NO: 151932 - DNA, 15 bp, Homo sapiens
actttttaaaaacat

SEQ ID NO: 151933 - DNA, 15 bp, Homo sapiens
aactttttaaaaaca

SEQ ID NO: 151934 - DNA, 15 bp, Homo sapiens
taactttttaaaaac

SEQ ID NO: 151935 - DNA, 15 bp, Homo sapiens
ataactttttaaaaa

SEQ ID NO: 151936 - DNA, 15 bp, Homo sapiens
gataactttttaaaa

SEQ ID NO: 151937 - DNA, 15 bp, Homo sapiens
ggataactttttaaa

SEQ ID NO: 151938 - DNA, 15 bp, Homo sapiens
tggataactttttaa

SEQ ID NO: 151939 - DNA, 15 bp, Homo sapiens
ttggataacttttta

SEQ ID NO: 151940 - DNA, 15 bp, Homo sapiens
attggataacttttt

SEQ ID NO: 151941 - DNA, 15 bp, Homo sapiens
aattggataactttt

SEQ ID NO: 151942 - DNA, 15 bp, Homo sapiens
taattggataacttt

SEQ ID NO: 151943 - DNA, 15 bp, Homo sapiens
ttaattggataactt

SEQ ID NO: 151944 - DNA, 15 bp, Homo sapiens
gttaattggataact

SEQ ID NO: 151945 - DNA, 15 bp, Homo sapiens
agttaattggataac

SEQ ID NO: 151946 - DNA, 15 bp, Homo sapiens
tagttaattggataa

SEQ ID NO: 151947 - DNA, 15 bp, Homo sapiens
ttagttaattggata

SEQ ID NO: 151948 - DNA, 15 bp, Homo sapiens
gttagttaattggat

SEQ ID NO: 151949 - DNA, 15 bp, Homo sapiens
tgttagttaattgga

SEQ ID NO: 151950 - DNA, 15 bp, Homo sapiens
atgttagttaattgg

SEQ ID NO: 151951 - DNA, 15 bp, Homo sapiens
aatgttagttaattg

SEQ ID NO: 151952 - DNA, 15 bp, Homo sapiens
aaatgttagttaatt

SEQ ID NO: 151953 - DNA, 15 bp, Homo sapiens
aaaatgttagttaat

SEQ ID NO: 151954 - DNA, 15 bp, Homo sapiens
gaaaatgttagttaa

SEQ ID NO: 151955 - DNA, 15 bp, Homo sapiens
agaaaatgttagtta

SEQ ID NO: 151956 - DNA, 15 bp, Homo sapiens
aagaaaatgttagtt

SEQ ID NO: 151957 - DNA, 15 bp, Homo sapiens
taagaaaatgttagt

SEQ ID NO: 151958 - DNA, 15 bp, Homo sapiens
ttaagaaaatgttag

SEQ ID NO: 151959 - DNA, 15 bp, Homo sapiens
attaagaaaatgtta

SEQ ID NO: 151960 - DNA, 15 bp, Homo sapiens
gattaagaaaatgtt

SEQ ID NO: 151961 - DNA, 15 bp, Homo sapiens
tgattaagaaaatgt

SEQ ID NO: 151962 - DNA, 15 bp, Homo sapiens
ctgattaagaaaatg

SEQ ID NO: 151963 - DNA, 15 bp, Homo sapiens
tctgattaagaaaat

SEQ ID NO: 151964 - DNA, 15 bp, Homo sapiens
ttctgattaagaaaa

SEQ ID NO: 151965 - DNA, 15 bp, Homo sapiens
tttctgattaagaaa

SEQ ID NO: 151966 - DNA, 15 bp, Homo sapiens
ttttctgattaagaa

SEQ ID NO: 151967 - DNA, 15 bp, Homo sapiens
gttttctgattaaga

SEQ ID NO: 151968 - DNA, 15 bp, Homo sapiens
agttttctgattaag

SEQ ID NO: 151969 - DNA, 15 bp, Homo sapiens
gagttttctgattaa

SEQ ID NO: 151970 - DNA, 15 bp, Homo sapiens
tgagttttctgatta

SEQ ID NO: 151971 - DNA, 15 bp, Homo sapiens
atgagttttctgatt

SEQ ID NO: 151972 - DNA, 15 bp, Homo sapiens
catgagttttctgat

SEQ ID NO: 151973 - DNA, 15 bp, Homo sapiens
gcatgagttttctga

SEQ ID NO: 151974 - DNA, 15 bp, Homo sapiens
agcatgagttttctg

SEQ ID NO: 151975 - DNA, 15 bp, Homo sapiens
tagcatgagttttct

SEQ ID NO: 151976 - DNA, 15 bp, Homo sapiens
atagcatgagttttc

SEQ ID NO: 151977 - DNA, 15 bp, Homo sapiens
gatagcatgagtttt

SEQ ID NO: 151978 - DNA, 15 bp, Homo sapiens
tgatagcatgagttt

SEQ ID NO: 151979 - DNA, 15 bp, Homo sapiens
ttgatagcatgagtt

SEQ ID NO: 151980 - DNA, 15 bp, Homo sapiens
attgatagcatgagt

SEQ ID NO: 151981 - DNA, 15 bp, Homo sapiens
cattgatagcatgag

SEQ ID NO: 151982 - DNA, 15 bp, Homo sapiens
tcattgatagcatga

SEQ ID NO: 151983 - DNA, 15 bp, Homo sapiens
gtcattgatagcatg

SEQ ID NO: 151984 - DNA, 15 bp, Homo sapiens
agtcattgatagcat

SEQ ID NO: 151985 - DNA, 15 bp, Homo sapiens
aagtcattgatagca

SEQ ID NO: 151986 - DNA, 15 bp, Homo sapiens
caagtcattgatagc

SEQ ID NO: 151987 - DNA, 15 bp, Homo sapiens
ccaagtcattgatag

SEQ ID NO: 151988 - DNA, 15 bp, Homo sapiens
tccaagtcattgata

SEQ ID NO: 151989 - DNA, 15 bp, Homo sapiens
atccaagtcattgat

SEQ ID NO: 151990 - DNA, 15 bp, Homo sapiens
tatccaagtcattga

SEQ ID NO: 151991 - DNA, 15 bp, Homo sapiens
ttatccaagtcattg

SEQ ID NO: 151992 - DNA, 15 bp, Homo sapiens
tttatccaagtcatt

SEQ ID NO: 151993 - DNA, 15 bp, Homo sapiens
ctttatccaagtcat

SEQ ID NO: 151994 - DNA, 15 bp, Homo sapiens
actttatccaagtca

SEQ ID NO: 151995 - DNA, 15 bp, Homo sapiens
gactttatccaagtc

SEQ ID NO: 151996 - DNA, 15 bp, Homo sapiens
tgactttatccaagt

SEQ ID NO: 151997 - DNA, 15 bp, Homo sapiens
ttgactttatccaag

SEQ ID NO: 151998 - DNA, 15 bp, Homo sapiens
attgactttatccaa

SEQ ID NO: 151999 - DNA, 15 bp, Homo sapiens
tattgactttatcca

SEQ ID NO: 152000 - DNA, 15 bp, Homo sapiens
atattgactttatcc

SEQ ID NO: 152001 - DNA, 15 bp, Homo sapiens
tatattgactttatc

SEQ ID NO: 152002 - DNA, 15 bp, Homo sapiens
ttatattgactttat

SEQ ID NO: 152003 - DNA, 15 bp, Homo sapiens
attatattgacttta

SEQ ID NO: 152004 - DNA, 15 bp, Homo sapiens
aattatattgacttt

SEQ ID NO: 152005 - DNA, 15 bp, Homo sapiens
taattatattgactt

SEQ ID NO: 152006 - DNA, 15 bp, Homo sapiens
ctaattatattgact

SEQ ID NO: 152007 - DNA, 15 bp, Homo sapiens
gctaattatattgac

SEQ ID NO: 152008 - DNA, 15 bp, Homo sapiens
agctaattatattga

SEQ ID NO: 152009 - DNA, 15 bp, Homo sapiens
tagctaattatattg

SEQ ID NO: 152010 - DNA, 15 bp, Homo sapiens
ttagctaattatatt

SEQ ID NO: 152011 - DNA, 15 bp, Homo sapiens
tttagctaattatat

SEQ ID NO: 152012 - DNA, 15 bp, Homo sapiens
ttttagctaattata

SEQ ID NO: 152013 - DNA, 15 bp, Homo sapiens
tttttagctaattat

SEQ ID NO: 152014 - DNA, 15 bp, Homo sapiens
gtttttagctaatta

SEQ ID NO: 152015 - DNA, 15 bp, Homo sapiens
tgtttttagctaatt

SEQ ID NO: 152016 - DNA, 15 bp, Homo sapiens
ctgtttttagctaat

SEQ ID NO: 152017 - DNA, 15 bp, Homo sapiens
actgtttttagctaa

SEQ ID NO: 152018 - DNA, 15 bp, Homo sapiens
tactgtttttagcta

SEQ ID NO: 152019 - DNA, 15 bp, Homo sapiens
atactgtttttagct

SEQ ID NO: 152020 - DNA, 15 bp, Homo sapiens
tatactgtttttagc

SEQ ID NO: 152021 - DNA, 15 bp, Homo sapiens
ttatactgtttttag

SEQ ID NO: 152022 - DNA, 15 bp, Homo sapiens
attatactgttttta

SEQ ID NO: 152023 - DNA, 15 bp, Homo sapiens
aattatactgttttt

SEQ ID NO: 152024 - DNA, 15 bp, Homo sapiens
taattatactgtttt

SEQ ID NO: 152025 - DNA, 15 bp, Homo sapiens
ctaattatactgttt

SEQ ID NO: 152026 - DNA, 15 bp, Homo sapiens
tctaattatactgtt

SEQ ID NO: 152027 - DNA, 15 bp, Homo sapiens
atctaattatactgt

SEQ ID NO: 152028 - DNA, 15 bp, Homo sapiens
gatctaattatactg

SEQ ID NO: 152029 - DNA, 15 bp, Homo sapiens
agatctaattatact

SEQ ID NO: 152030 - DNA, 15 bp, Homo sapiens
cagatctaattatac

SEQ ID NO: 152031 - DNA, 15 bp, Homo sapiens
tcagatctaattata

SEQ ID NO: 152032 - DNA, 15 bp, Homo sapiens
atcagatctaattat

SEQ ID NO: 152033 - DNA, 15 bp, Homo sapiens
catcagatctaatta

SEQ ID NO: 152034 - DNA, 15 bp, Homo sapiens
gcatcagatctaatt

SEQ ID NO: 152035 - DNA, 15 bp, Homo sapiens
tgcatcagatctaat

SEQ ID NO: 152036 - DNA, 15 bp, Homo sapiens
ttgcatcagatctaa

SEQ ID NO: 152037 - DNA, 15 bp, Homo sapiens
attgcatcagatcta

SEQ ID NO: 152038 - DNA, 15 bp, Homo sapiens
cattgcatcagatct

SEQ ID NO: 152039 - DNA, 15 bp, Homo sapiens
gcattgcatcagatc

SEQ ID NO: 152040 - DNA, 15 bp, Homo sapiens
agcattgcatcagat

SEQ ID NO: 152041 - DNA, 15 bp, Homo sapiens
aagcattgcatcaga

SEQ ID NO: 152042 - DNA, 15 bp, Homo sapiens
aaagcattgcatcag

SEQ ID NO: 152043 - DNA, 15 bp, Homo sapiens
caaagcattgcatca

SEQ ID NO: 152044 - DNA, 15 bp, Homo sapiens
acaaagcattgcatc

SEQ ID NO: 152045 - DNA, 15 bp, Homo sapiens
gacaaagcattgcat

SEQ ID NO: 152046 - DNA, 15 bp, Homo sapiens
tgacaaagcattgca

SEQ ID NO: 152047 - DNA, 15 bp, Homo sapiens
gtgacaaagcattgc

SEQ ID NO: 152048 - DNA, 15 bp, Homo sapiens
agtgacaaagcattg

SEQ ID NO: 152049 - DNA, 15 bp, Homo sapiens
gagtgacaaagcatt

SEQ ID NO: 152050 - DNA, 15 bp, Homo sapiens
tgagtgacaaagcat

SEQ ID NO: 152051 - DNA, 15 bp, Homo sapiens
gtgagtgacaaagca

SEQ ID NO: 152052 - DNA, 15 bp, Homo sapiens
agtgagtgacaaagc

SEQ ID NO: 152053 - DNA, 15 bp, Homo sapiens
aagtgagtgacaaag

SEQ ID NO: 152054 - DNA, 15 bp, Homo sapiens
taagtgagtgacaaa

SEQ ID NO: 152055 - DNA, 15 bp, Homo sapiens
ttaagtgagtgacaa

SEQ ID NO: 152056 - DNA, 15 bp, Homo sapiens
tttaagtgagtgaca

SEQ ID NO: 152057 - DNA, 15 bp, Homo sapiens
ctttaagtgagtgac

SEQ ID NO: 152058 - DNA, 15 bp, Homo sapiens
tctttaagtgagtga

SEQ ID NO: 152059 - DNA, 15 bp, Homo sapiens
ttctttaagtgagtg

SEQ ID NO: 152060 - DNA, 15 bp, Homo sapiens
attctttaagtgagt

SEQ ID NO: 152061 - DNA, 15 bp, Homo sapiens
tattctttaagtgag

SEQ ID NO: 152062 - DNA, 15 bp, Homo sapiens
ttattctttaagtga

SEQ ID NO: 152063 - DNA, 15 bp, Homo sapiens
gttattctttaagtg

SEQ ID NO: 152064 - DNA, 15 bp, Homo sapiens
agttattctttaagt

SEQ ID NO: 152065 - DNA, 15 bp, Homo sapiens
tagttattctttaag

SEQ ID NO: 152066 - DNA, 15 bp, Homo sapiens
ttagttattctttaa

SEQ ID NO: 152067 - DNA, 15 bp, Homo sapiens
attagttattcttta

SEQ ID NO: 152068 - DNA, 15 bp, Homo sapiens
tattagttattcttt

SEQ ID NO: 152069 - DNA, 15 bp, Homo sapiens
gtattagttattctt

SEQ ID NO: 152070 - DNA, 15 bp, Homo sapiens
tgtattagttattct

SEQ ID NO: 152071 - DNA, 15 bp, Homo sapiens
atgtattagttattc

SEQ ID NO: 152072 - DNA, 15 bp, Homo sapiens
aatgtattagttatt

SEQ ID NO: 152073 - DNA, 15 bp, Homo sapiens
gaatgtattagttat

SEQ ID NO: 152074 - DNA, 15 bp, Homo sapiens
agaatgtattagtta

SEQ ID NO: 152075 - DNA, 15 bp, Homo sapiens
tagaatgtattagtt

SEQ ID NO: 152076 - DNA, 15 bp, Homo sapiens
atagaatgtattagt

SEQ ID NO: 152077 - DNA, 15 bp, Homo sapiens
tatagaatgtattag

SEQ ID NO: 152078 - DNA, 15 bp, Homo sapiens
ttatagaatgtatta

SEQ ID NO: 152079 - DNA, 15 bp, Homo sapiens
cttatagaatgtatt

SEQ ID NO: 152080 - DNA, 15 bp, Homo sapiens
ccttatagaatgtat

SEQ ID NO: 152081 - DNA, 15 bp, Homo sapiens
accttatagaatgta

SEQ ID NO: 152082 - DNA, 15 bp, Homo sapiens
taccttatagaatgt

SEQ ID NO: 152083 - DNA, 15 bp, Homo sapiens
ctaccttatagaatg

SEQ ID NO: 152084 - DNA, 15 bp, Homo sapiens
gctaccttatagaat

SEQ ID NO: 152085 - DNA, 15 bp, Homo sapiens
tgctaccttatagaa

SEQ ID NO: 152086 - DNA, 15 bp, Homo sapiens
atgctaccttataga

SEQ ID NO: 152087 - DNA, 15 bp, Homo sapiens
aatgctaccttatag

SEQ ID NO: 152088 - DNA, 15 bp, Homo sapiens
aaatgctaccttata

SEQ ID NO: 152089 - DNA, 15 bp, Homo sapiens
aaaatgctaccttat

SEQ ID NO: 152090 - DNA, 15 bp, Homo sapiens
taaaatgctacctta

SEQ ID NO: 152091 - DNA, 15 bp, Homo sapiens
ttaaaatgctacctt

SEQ ID NO: 152092 - DNA, 15 bp, Homo sapiens
tttaaaatgctacct

SEQ ID NO: 152093 - DNA, 15 bp, Homo sapiens
ttttaaaatgctacc

SEQ ID NO: 152094 - DNA, 15 bp, Homo sapiens
attttaaaatgctac

SEQ ID NO: 152095 - DNA, 15 bp, Homo sapiens
aattttaaaatgcta

SEQ ID NO: 152096 - DNA, 15 bp, Homo sapiens
gaattttaaaatgct

SEQ ID NO: 152097 - DNA, 15 bp, Homo sapiens
agaattttaaaatgc

SEQ ID NO: 152098 - DNA, 15 bp, Homo sapiens
aagaattttaaaatg

SEQ ID NO: 152099 - DNA, 15 bp, Homo sapiens
aaagaattttaaaat

SEQ ID NO: 152100 - DNA, 15 bp, Homo sapiens
taaaagaattttaaa

SEQ ID NO: 152101 - DNA, 15 bp, Homo sapiens
ataaaagaattttaa

SEQ ID NO: 152102 - DNA, 15 bp, Homo sapiens
tataaaagaatttta

SEQ ID NO: 152103 - DNA, 15 bp, Homo sapiens
ctataaaagaatttt

SEQ ID NO: 152104 - DNA, 15 bp, Homo sapiens
gctataaaagaattt

SEQ ID NO: 152105 - DNA, 15 bp, Homo sapiens
ggctataaaagaatt

SEQ ID NO: 152106 - DNA, 15 bp, Homo sapiens
tggctataaaagaat

SEQ ID NO: 152107 - DNA, 15 bp, Homo sapiens
ttggctataaaagaa

SEQ ID NO: 152108 - DNA, 15 bp, Homo sapiens
cttggctataaaaga

SEQ ID NO: 152109 - DNA, 15 bp, Homo sapiens
tcttggctataaaag

SEQ ID NO: 152110 - DNA, 15 bp, Homo sapiens
atcttggctataaaa

SEQ ID NO: 152111 - DNA, 15 bp, Homo sapiens
tatcttggctataaa

SEQ ID NO: 152112 - DNA, 15 bp, Homo sapiens
atatcttggctataa

SEQ ID NO: 152113 - DNA, 15 bp, Homo sapiens
gatatcttggctata

SEQ ID NO: 152114 - DNA, 15 bp, Homo sapiens
tgatatcttggctat

SEQ ID NO: 152115 - DNA, 15 bp, Homo sapiens
atgatatcttggcta

SEQ ID NO: 152116 - DNA, 15 bp, Homo sapiens
aatgatatcttggct

SEQ ID NO: 152117 - DNA, 15 bp, Homo sapiens
taatgatatcttggc

SEQ ID NO: 152118 - DNA, 15 bp, Homo sapiens
ataatgatatcttgg

SEQ ID NO: 152119 - DNA, 15 bp, Homo sapiens
gataatgatatcttg

SEQ ID NO: 152120 - DNA, 15 bp, Homo sapiens
tgataatgatatctt

SEQ ID NO: 152121 - DNA, 15 bp, Homo sapiens
atgataatgatatct

SEQ ID NO: 152122 - DNA, 15 bp, Homo sapiens
aatgataatgatatc

SEQ ID NO: 152123 - DNA, 15 bp, Homo sapiens
caatgataatgatat

SEQ ID NO: 152124 - DNA, 15 bp, Homo sapiens
ccaatgataatgata

SEQ ID NO: 152125 - DNA, 15 bp, Homo sapiens
accaatgataatgat

SEQ ID NO: 152126 - DNA, 15 bp, Homo sapiens
caccaatgataatga

SEQ ID NO: 152127 - DNA, 15 bp, Homo sapiens
acaccaatgataatg

SEQ ID NO: 152128 - DNA, 15 bp, Homo sapiens
tacaccaatgataat

SEQ ID NO: 152129 - DNA, 15 bp, Homo sapiens
atacaccaatgataa

SEQ ID NO: 152130 - DNA, 15 bp, Homo sapiens
catacaccaatgata

SEQ ID NO: 152131 - DNA, 15 bp, Homo sapiens
acatacaccaatgat

SEQ ID NO: 152132 - DNA, 15 bp, Homo sapiens
gacatacaccaatga

SEQ ID NO: 152133 - DNA, 15 bp, Homo sapiens
agacatacaccaatg

SEQ ID NO: 152134 - DNA, 15 bp, Homo sapiens
tagacatacaccaat

SEQ ID NO: 152135 - DNA, 15 bp, Homo sapiens
ctagacatacaccaa

SEQ ID NO: 152136 - DNA, 15 bp, Homo sapiens
tctagacatacacca

SEQ ID NO: 152137 - DNA, 15 bp, Homo sapiens
ttctagacatacacc

SEQ ID NO: 152138 - DNA, 15 bp, Homo sapiens
cttctagacatacac

SEQ ID NO: 152139 - DNA, 15 bp, Homo sapiens
acttctagacataca

SEQ ID NO: 152140 - DNA, 15 bp, Homo sapiens
cacttctagacatac

SEQ ID NO: 152141 - DNA, 15 bp, Homo sapiens
acacttctagacata

SEQ ID NO: 152142 - DNA, 15 bp, Homo sapiens
tacacttctagacat

SEQ ID NO: 152143 - DNA, 15 bp, Homo sapiens
ttacacttctagaca

SEQ ID NO: 152144 - DNA, 15 bp, Homo sapiens
attacacttctagac

SEQ ID NO: 152145 - DNA, 15 bp, Homo sapiens
tattacacttctaga

SEQ ID NO: 152146 - DNA, 15 bp, Homo sapiens
gtattacacttctag

SEQ ID NO: 152147 - DNA, 15 bp, Homo sapiens
agtattacacttcta

SEQ ID NO: 152148 - DNA, 15 bp, Homo sapiens
tagtattacacttct

SEQ ID NO: 152149 - DNA, 15 bp, Homo sapiens
ctagtattacacttc

SEQ ID NO: 152150 - DNA, 15 bp, Homo sapiens
actagtattacactt

SEQ ID NO: 152151 - DNA, 15 bp, Homo sapiens
tactagtattacact

SEQ ID NO: 152152 - DNA, 15 bp, Homo sapiens
gtactagtattacac

SEQ ID NO: 152153 - DNA, 15 bp, Homo sapiens
tgtactagtattaca

SEQ ID NO: 152154 - DNA, 15 bp, Homo sapiens
ttgtactagtattac

SEQ ID NO: 152155 - DNA, 15 bp, Homo sapiens
tttgtactagtatta

SEQ ID NO: 152156 - DNA, 15 bp, Homo sapiens
atttgtactagtatt

SEQ ID NO: 152157 - DNA, 15 bp, Homo sapiens
gatttgtactagtat

SEQ ID NO: 152158 - DNA, 15 bp, Homo sapiens
ggatttgtactagta

SEQ ID NO: 152159 - DNA, 15 bp, Homo sapiens
cggatttgtactagt

SEQ ID NO: 152160 - DNA, 15 bp, Homo sapiens
ccggatttgtactag

SEQ ID NO: 152161 - DNA, 15 bp, Homo sapiens
tccggatttgtacta

SEQ ID NO: 152162 - DNA, 15 bp, Homo sapiens
ttccggatttgtact

SEQ ID NO: 152163 - DNA, 15 bp, Homo sapiens
gttccggatttgtac

SEQ ID NO: 152164 - DNA, 15 bp, Homo sapiens
tgttccggatttgta

SEQ ID NO: 152165 - DNA, 15 bp, Homo sapiens
ttgttccggatttgt

SEQ ID NO: 152166 - DNA, 15 bp, Homo sapiens
tttgttccggatttg

SEQ ID NO: 152167 - DNA, 15 bp, Homo sapiens
atttgttccggattt

SEQ ID NO: 152168 - DNA, 15 bp, Homo sapiens
tatttgttccggatt

SEQ ID NO: 152169 - DNA, 15 bp, Homo sapiens
ctatttgttccggat

SEQ ID NO: 152170 - DNA, 15 bp, Homo sapiens
tctatttgttccgga

SEQ ID NO: 152171 - DNA, 15 bp, Homo sapiens
ttctatttgttccgg

SEQ ID NO: 152172 - DNA, 15 bp, Homo sapiens
cttctatttgttccg

SEQ ID NO: 152173 - DNA, 15 bp, Homo sapiens
ccttctatttgttcc

SEQ ID NO: 152174 - DNA, 15 bp, Homo sapiens
accttctatttgttc

SEQ ID NO: 152175 - DNA, 15 bp, Homo sapiens
gaccttctatttgtt

SEQ ID NO: 152176 - DNA, 15 bp, Homo sapiens
ggaccttctatttgt

SEQ ID NO: 152177 - DNA, 15 bp, Homo sapiens
aggaccttctatttg

SEQ ID NO: 152178 - DNA, 15 bp, Homo sapiens
aaggaccttctattt

SEQ ID NO: 152179 - DNA, 15 bp, Homo sapiens
gaaggaccttctatt

SEQ ID NO: 152180 - DNA, 15 bp, Homo sapiens
agaaggaccttctat

SEQ ID NO: 152181 - DNA, 15 bp, Homo sapiens
cagaaggaccttcta

SEQ ID NO: 152182 - DNA, 15 bp, Homo sapiens
tcagaaggaccttct

SEQ ID NO: 152183 - DNA, 15 bp, Homo sapiens
ctcagaaggaccttc

SEQ ID NO: 152184 - DNA, 15 bp, Homo sapiens
tctcagaaggacctt

SEQ ID NO: 152185 - DNA, 15 bp, Homo sapiens
atctcagaaggacct

SEQ ID NO: 152186 - DNA, 15 bp, Homo sapiens
catctcagaaggacc

SEQ ID NO: 152187 - DNA, 15 bp, Homo sapiens
ccatctcagaaggac

SEQ ID NO: 152188 - DNA, 15 bp, Homo sapiens
tccatctcagaagga

SEQ ID NO: 152189 - DNA, 15 bp, Homo sapiens
ctccatctcagaagg

SEQ ID NO: 152190 - DNA, 15 bp, Homo sapiens
actccatctcagaag

SEQ ID NO: 152191 - DNA, 15 bp, Homo sapiens
aactccatctcagaa

SEQ ID NO: 152192 - DNA, 15 bp, Homo sapiens
caactccatctcaga

SEQ ID NO: 152193 - DNA, 15 bp, Homo sapiens
tcaactccatctcag

SEQ ID NO: 152194 - DNA, 15 bp, Homo sapiens
ttcaactccatctca

SEQ ID NO: 152195 - DNA, 15 bp, Homo sapiens
cttcaactccatctc

SEQ ID NO: 152196 - DNA, 15 bp, Homo sapiens
acttcaactccatct

SEQ ID NO: 152197 - DNA, 15 bp, Homo sapiens
tacttcaactccatc

SEQ ID NO: 152198 - DNA, 15 bp, Homo sapiens
ctacttcaactccat

SEQ ID NO: 152199 - DNA, 15 bp, Homo sapiens
actacttcaactcca

SEQ ID NO: 152200 - DNA, 15 bp, Homo sapiens
tactacttcaactcc

SEQ ID NO: 152201 - DNA, 15 bp, Homo sapiens
atactacttcaactc

SEQ ID NO: 152202 - DNA, 15 bp, Homo sapiens
aatactacttcaact

SEQ ID NO: 152203 - DNA, 15 bp, Homo sapiens
taatactacttcaac

SEQ ID NO: 152204 - DNA, 15 bp, Homo sapiens
ttaatactacttcaa

SEQ ID NO: 152205 - DNA, 15 bp, Homo sapiens
cttaatactacttca

SEQ ID NO: 152206 - DNA, 15 bp, Homo sapiens
ccttaatactacttc

SEQ ID NO: 152207 - DNA, 15 bp, Homo sapiens
tccttaatactactt

SEQ ID NO: 152208 - DNA, 15 bp, Homo sapiens
atccttaatactact

SEQ ID NO: 152209 - DNA, 15 bp, Homo sapiens
tatccttaatactac

SEQ ID NO: 152210 - DNA, 15 bp, Homo sapiens
gtatccttaatacta

SEQ ID NO: 152211 - DNA, 15 bp, Homo sapiens
cgtatccttaatact

SEQ ID NO: 152212 - DNA, 15 bp, Homo sapiens
ccgtatccttaatac

SEQ ID NO: 152213 - DNA, 15 bp, Homo sapiens
tccgtatccttaata

SEQ ID NO: 152214 - DNA, 15 bp, Homo sapiens
atccgtatccttaat

SEQ ID NO: 152215 - DNA, 15 bp, Homo sapiens
tatccgtatccttaa

SEQ ID NO: 152216 - DNA, 15 bp, Homo sapiens
ttatccgtatcctta

SEQ ID NO: 152217 - DNA, 15 bp, Homo sapiens
tttatccgtatcctt

SEQ ID NO: 152218 - DNA, 15 bp, Homo sapiens
ttttatccgtatcct

SEQ ID NO: 152219 - DNA, 15 bp, Homo sapiens
cttttatccgtatcc

SEQ ID NO: 152220 - DNA, 15 bp, Homo sapiens
ccttttatccgtatc

SEQ ID NO: 152221 - DNA, 15 bp, Homo sapiens
accttttatccgtat

SEQ ID NO: 152222 - DNA, 15 bp, Homo sapiens
gaccttttatccgta

SEQ ID NO: 152223 - DNA, 15 bp, Homo sapiens
agaccttttatccgt

SEQ ID NO: 152224 - DNA, 15 bp, Homo sapiens
gagaccttttatccg

SEQ ID NO: 152225 - DNA, 15 bp, Homo sapiens
agagaccttttatcc

SEQ ID NO: 152226 - DNA, 15 bp, Homo sapiens
aagagaccttttatc

SEQ ID NO: 152227 - DNA, 15 bp, Homo sapiens
aaagagaccttttat

SEQ ID NO: 152228 - DNA, 15 bp, Homo sapiens
aaaagagacctttta

SEQ ID NO: 152229 - DNA, 15 bp, Homo sapiens
taaaagagacctttt

SEQ ID NO: 152230 - DNA, 15 bp, Homo sapiens
ataaaagagaccttt

SEQ ID NO: 152231 - DNA, 15 bp, Homo sapiens
aataaaagagacctt

SEQ ID NO: 152232 - DNA, 15 bp, Homo sapiens
aaataaaagagacct

SEQ ID NO: 152233 - DNA, 15 bp, Homo sapiens
caaataaaagagacc

SEQ ID NO: 152234 - DNA, 15 bp, Homo sapiens
acaaataaaagagac

SEQ ID NO: 152235 - DNA, 15 bp, Homo sapiens
tacaaataaaagaga

SEQ ID NO: 152236 - DNA, 15 bp, Homo sapiens
ctacaaataaaagag

SEQ ID NO: 152237 - DNA, 15 bp, Homo sapiens
tctacaaataaaaga

SEQ ID NO: 152238 - DNA, 15 bp, Homo sapiens
ctctacaaataaaag

SEQ ID NO: 152239 - DNA, 15 bp, Homo sapiens
actctacaaataaaa

SEQ ID NO: 152240 - DNA, 15 bp, Homo sapiens
tactctacaaataaa

SEQ ID NO: 152241 - DNA, 15 bp, Homo sapiens
atactctacaaataa

SEQ ID NO: 152242 - DNA, 15 bp, Homo sapiens
aatactctacaaata

SEQ ID NO: 152243 - DNA, 15 bp, Homo sapiens
taatactctacaaat

SEQ ID NO: 152244 - DNA, 15 bp, Homo sapiens
ataatactctacaaa

SEQ ID NO: 152245 - DNA, 15 bp, Homo sapiens
aataatactctacaa

SEQ ID NO: 152246 - DNA, 15 bp, Homo sapiens
aaataatactctaca

SEQ ID NO: 152247 - DNA, 15 bp, Homo sapiens
caaataatactctac

SEQ ID NO: 152248 - DNA, 15 bp, Homo sapiens
tcaaataatactcta

SEQ ID NO: 152249 - DNA, 15 bp, Homo sapiens
atcaaataatactct

SEQ ID NO: 152250 - DNA, 15 bp, Homo sapiens
tatcaaataatactc

SEQ ID NO: 152251 - DNA, 15 bp, Homo sapiens
ttatcaaataatact

SEQ ID NO: 152252 - DNA, 15 bp, Homo sapiens
attatcaaataatac

SEQ ID NO: 152253 - DNA, 15 bp, Homo sapiens
aattatcaaataata

SEQ ID NO: 152254 - DNA, 15 bp, Homo sapiens
caattatcaaataat

SEQ ID NO: 152255 - DNA, 15 bp, Homo sapiens
acaattatcaaataa

SEQ ID NO: 152256 - DNA, 15 bp, Homo sapiens
tacaattatcaaata

SEQ ID NO: 152257 - DNA, 15 bp, Homo sapiens
ttacaattatcaaat

SEQ ID NO: 152258 - DNA, 15 bp, Homo sapiens
gttacaattatcaaa

SEQ ID NO: 152259 - DNA, 15 bp, Homo sapiens
agttacaattatcaa

SEQ ID NO: 152260 - DNA, 15 bp, Homo sapiens
aagttacaattatca

SEQ ID NO: 152261 - DNA, 15 bp, Homo sapiens
taagttacaattatc

SEQ ID NO: 152262 - DNA, 15 bp, Homo sapiens
ttaagttacaattat

SEQ ID NO: 152263 - DNA, 15 bp, Homo sapiens
tttaagttacaatta

SEQ ID NO: 152264 - DNA, 15 bp, Homo sapiens
ctttaagttacaatt

SEQ ID NO: 152265 - DNA, 15 bp, Homo sapiens
cctttaagttacaat

SEQ ID NO: 152266 - DNA, 15 bp, Homo sapiens
ccctttaagttacaa

SEQ ID NO: 152267 - DNA, 15 bp, Homo sapiens
accctttaagttaca

SEQ ID NO: 152268 - DNA, 15 bp, Homo sapiens
aaccctttaagttac

SEQ ID NO: 152269 - DNA, 15 bp, Homo sapiens
caaccctttaagtta

SEQ ID NO: 152270 - DNA, 15 bp, Homo sapiens
tcaaccctttaagtt

SEQ ID NO: 152271 - DNA, 15 bp, Homo sapiens
atcaaccctttaagt

SEQ ID NO: 152272 - DNA, 15 bp, Homo sapiens
catcaaccctttaag

SEQ ID NO: 152273 - DNA, 15 bp, Homo sapiens
tcatcaaccctttaa

SEQ ID NO: 152274 - DNA, 15 bp, Homo sapiens
atcatcaacccttta

SEQ ID NO: 152275 - DNA, 15 bp, Homo sapiens
aatcatcaacccttt

SEQ ID NO: 152276 - DNA, 15 bp, Homo sapiens
aaatcatcaaccctt

SEQ ID NO: 152277 - DNA, 15 bp, Homo sapiens
caaatcatcaaccct

SEQ ID NO: 152278 - DNA, 15 bp, Homo sapiens
acaaatcatcaaccc

SEQ ID NO: 152279 - DNA, 15 bp, Homo sapiens
cacaaatcatcaacc

SEQ ID NO: 152280 - DNA, 15 bp, Homo sapiens
acacaaatcatcaac

SEQ ID NO: 152281 - DNA, 15 bp, Homo sapiens
aacacaaatcatcaa

SEQ ID NO: 152282 - DNA, 15 bp, Homo sapiens
aaacacaaatcatca

SEQ ID NO: 152283 - DNA, 15 bp, Homo sapiens
aaaacacaaatcatc

SEQ ID NO: 152284 - DNA, 15 bp, Homo sapiens
gaaaacacaaatcat

SEQ ID NO: 152285 - DNA, 15 bp, Homo sapiens
ggaaaacacaaatca

SEQ ID NO: 152286 - DNA, 15 bp, Homo sapiens
aggaaaacacaaatc

SEQ ID NO: 152287 - DNA, 15 bp, Homo sapiens
taggaaaacacaaat

SEQ ID NO: 152288 - DNA, 15 bp, Homo sapiens
ctaggaaaacacaaa

SEQ ID NO: 152289 - DNA, 15 bp, Homo sapiens
tctaggaaaacacaa

SEQ ID NO: 152290 - DNA, 15 bp, Homo sapiens
ctctaggaaaacaca

SEQ ID NO: 152291 - DNA, 15 bp, Homo sapiens
cctctaggaaaacac

SEQ ID NO: 152292 - DNA, 15 bp, Homo sapiens
gcctctaggaaaaca

SEQ ID NO: 152293 - DNA, 15 bp, Homo sapiens
tgcctctaggaaaac

SEQ ID NO: 152294 - DNA, 15 bp, Homo sapiens
ttgcctctaggaaaa

SEQ ID NO: 152295 - DNA, 15 bp, Homo sapiens
tttgcctctaggaaa

SEQ ID NO: 152296 - DNA, 15 bp, Homo sapiens
ctttgcctctaggaa

SEQ ID NO: 152297 - DNA, 15 bp, Homo sapiens
actttgcctctagga

SEQ ID NO: 152298 - DNA, 15 bp, Homo sapiens
aactttgcctctagg

SEQ ID NO: 152299 - DNA, 15 bp, Homo sapiens
aaactttgcctctag

SEQ ID NO: 152300 - DNA, 15 bp, Homo sapiens
taaactttgcctcta

SEQ ID NO: 152301 - DNA, 15 bp, Homo sapiens
ataaactttgcctct

SEQ ID NO: 152302 - DNA, 15 bp, Homo sapiens
aataaactttgcctc

SEQ ID NO: 152303 - DNA, 15 bp, Homo sapiens
taataaactttgcct

SEQ ID NO: 152304 - DNA, 15 bp, Homo sapiens
ttaataaactttgcc

SEQ ID NO: 152305 - DNA, 15 bp, Homo sapiens
tttaataaactttgc

SEQ ID NO: 152306 - DNA, 15 bp, Homo sapiens
atttaataaactttg

SEQ ID NO: 152307 - DNA, 15 bp, Homo sapiens
aatttaataaacttt

SEQ ID NO: 152308 - DNA, 15 bp, Homo sapiens
aaatttaataaactt

SEQ ID NO: 152309 - DNA, 15 bp, Homo sapiens
gaaatttaataaact

SEQ ID NO: 152310 - DNA, 15 bp, Homo sapiens
tgaaatttaataaac

SEQ ID NO: 152311 - DNA, 15 bp, Homo sapiens
ttgaaatttaataaa

SEQ ID NO: 152312 - DNA, 15 bp, Homo sapiens
cttgaaatttaataa

SEQ ID NO: 152313 - DNA, 15 bp, Homo sapiens
acttgaaatttaata

SEQ ID NO: 152314 - DNA, 15 bp, Homo sapiens
cacttgaaatttaat

SEQ ID NO: 152315 - DNA, 15 bp, Homo sapiens
ccacttgaaatttaa

SEQ ID NO: 152316 - DNA, 15 bp, Homo sapiens
tccacttgaaattta

SEQ ID NO: 152317 - DNA, 15 bp, Homo sapiens
ttccacttgaaattt

SEQ ID NO: 152318 - DNA, 15 bp, Homo sapiens
tttccacttgaaatt

SEQ ID NO: 152319 - DNA, 15 bp, Homo sapiens
atttccacttgaaat

SEQ ID NO: 152320 - DNA, 15 bp, Homo sapiens
aatttccacttgaaa

SEQ ID NO: 152321 - DNA, 15 bp, Homo sapiens
aaatttccacttgaa

SEQ ID NO: 152322 - DNA, 15 bp, Homo sapiens
gaaatttccacttga

SEQ ID NO: 152323 - DNA, 15 bp, Homo sapiens
ggaaatttccacttg

SEQ ID NO: 152324 - DNA, 15 bp, Homo sapiens
aggaaatttccactt

SEQ ID NO: 152325 - DNA, 15 bp, Homo sapiens
taggaaatttccact

SEQ ID NO: 152326 - DNA, 15 bp, Homo sapiens
ctaggaaatttccac

SEQ ID NO: 152327 - DNA, 15 bp, Homo sapiens
gctaggaaatttcca

SEQ ID NO: 152328 - DNA, 15 bp, Homo sapiens
agctaggaaatttcc

SEQ ID NO: 152329 - DNA, 15 bp, Homo sapiens
cagctaggaaatttc

SEQ ID NO: 152330 - DNA, 15 bp, Homo sapiens
acagctaggaaattt

SEQ ID NO: 152331 - DNA, 15 bp, Homo sapiens
tacagctaggaaatt

SEQ ID NO: 152332 - DNA, 15 bp, Homo sapiens
ctacagctaggaaat

SEQ ID NO: 152333 - DNA, 15 bp, Homo sapiens
cctacagctaggaaa

SEQ ID NO: 152334 - DNA, 15 bp, Homo sapiens
acctacagctaggaa

SEQ ID NO: 152335 - DNA, 15 bp, Homo sapiens
tacctacagctagga

SEQ ID NO: 152336 - DNA, 15 bp, Homo sapiens
gtacctacagctagg

SEQ ID NO: 152337 - DNA, 15 bp, Homo sapiens
agtacctacagctag

SEQ ID NO: 152338 - DNA, 15 bp, Homo sapiens
cagtacctacagcta

SEQ ID NO: 152339 - DNA, 15 bp, Homo sapiens
gcagtacctacagct

SEQ ID NO: 152340 - DNA, 15 bp, Homo sapiens
agcagtacctacagc

SEQ ID NO: 152341 - DNA, 15 bp, Homo sapiens
tagcagtacctacag

SEQ ID NO: 152342 - DNA, 15 bp, Homo sapiens
ctagcagtacctaca

SEQ ID NO: 152343 - DNA, 15 bp, Homo sapiens
tctagcagtacctac

SEQ ID NO: 152344 - DNA, 15 bp, Homo sapiens
atctagcagtaccta

SEQ ID NO: 152345 - DNA, 15 bp, Homo sapiens
aatctagcagtacct

SEQ ID NO: 152346 - DNA, 15 bp, Homo sapiens
aaatctagcagtacc

SEQ ID NO: 152347 - DNA, 15 bp, Homo sapiens
aaaatctagcagtac

SEQ ID NO: 152348 - DNA, 15 bp, Homo sapiens
taaaatctagcagta

SEQ ID NO: 152349 - DNA, 15 bp, Homo sapiens
ttaaaatctagcagt

SEQ ID NO: 152350 - DNA, 15 bp, Homo sapiens
tttaaaatctagcag

SEQ ID NO: 152351 - DNA, 15 bp, Homo sapiens
atttaaaatctagca

SEQ ID NO: 152352 - DNA, 15 bp, Homo sapiens
catttaaaatctagc

SEQ ID NO: 152353 - DNA, 15 bp, Homo sapiens
acatttaaaatctag

SEQ ID NO: 152354 - DNA, 15 bp, Homo sapiens
cacatttaaaatcta

SEQ ID NO: 152355 - DNA, 15 bp, Homo sapiens
gcacatttaaaatct

SEQ ID NO: 152356 - DNA, 15 bp, Homo sapiens
tgcacatttaaaatc

SEQ ID NO: 152357 - DNA, 15 bp, Homo sapiens
ctgcacatttaaaat

SEQ ID NO: 152358 - DNA, 15 bp, Homo sapiens
tctgcacatttaaaa

SEQ ID NO: 152359 - DNA, 15 bp, Homo sapiens
gtctgcacatttaaa

SEQ ID NO: 152360 - DNA, 15 bp, Homo sapiens
tgtctgcacatttaa

SEQ ID NO: 152361 - DNA, 15 bp, Homo sapiens
atgtctgcacattta

SEQ ID NO: 152362 - DNA, 15 bp, Homo sapiens
tatgtctgcacattt

SEQ ID NO: 152363 - DNA, 15 bp, Homo sapiens
ctatgtctgcacatt

SEQ ID NO: 152364 - DNA, 15 bp, Homo sapiens
gctatgtctgcacat

SEQ ID NO: 152365 - DNA, 15 bp, Homo sapiens
agctatgtctgcaca

SEQ ID NO: 152366 - DNA, 15 bp, Homo sapiens
gagctatgtctgcac

SEQ ID NO: 152367 - DNA, 15 bp, Homo sapiens
ggagctatgtctgca

SEQ ID NO: 152368 - DNA, 15 bp, Homo sapiens
aggagctatgtctgc

SEQ ID NO: 152369 - DNA, 15 bp, Homo sapiens
aaggagctatgtctg

SEQ ID NO: 152370 - DNA, 15 bp, Homo sapiens
gaaggagctatgtct

SEQ ID NO: 152371 - DNA, 15 bp, Homo sapiens
ggaaggagctatgtc

SEQ ID NO: 152372 - DNA, 15 bp, Homo sapiens
aggaaggagctatgt

SEQ ID NO: 152373 - DNA, 15 bp, Homo sapiens
gaggaaggagctatg

SEQ ID NO: 152374 - DNA, 15 bp, Homo sapiens
agaggaaggagctat

SEQ ID NO: 152375 - DNA, 15 bp, Homo sapiens
aagaggaaggagcta

SEQ ID NO: 152376 - DNA, 15 bp, Homo sapiens
taagaggaaggagct

SEQ ID NO: 152377 - DNA, 15 bp, Homo sapiens
gtaagaggaaggagc

SEQ ID NO: 152378 - DNA, 15 bp, Homo sapiens
agtaagaggaaggag

SEQ ID NO: 152379 - DNA, 15 bp, Homo sapiens
gagtaagaggaagga

SEQ ID NO: 152380 - DNA, 15 bp, Homo sapiens
agagtaagaggaagg

SEQ ID NO: 152381 - DNA, 15 bp, Homo sapiens
aagagtaagaggaag

SEQ ID NO: 152382 - DNA, 15 bp, Homo sapiens
taagagtaagaggaa

SEQ ID NO: 152383 - DNA, 15 bp, Homo sapiens
ttaagagtaagagga

SEQ ID NO: 152384 - DNA, 15 bp, Homo sapiens
gttaagagtaagagg

SEQ ID NO: 152385 - DNA, 15 bp, Homo sapiens
agttaagagtaagag

SEQ ID NO: 152386 - DNA, 15 bp, Homo sapiens
cagttaagagtaaga

SEQ ID NO: 152387 - DNA, 15 bp, Homo sapiens
acagttaagagtaag

SEQ ID NO: 152388 - DNA, 15 bp, Homo sapiens
cacagttaagagtaa

SEQ ID NO: 152389 - DNA, 15 bp, Homo sapiens
tcacagttaagagta

SEQ ID NO: 152390 - DNA, 15 bp, Homo sapiens
atcacagttaagagt

SEQ ID NO: 152391 - DNA, 15 bp, Homo sapiens
gatcacagttaagag

SEQ ID NO: 152392 - DNA, 15 bp, Homo sapiens
tgatcacagttaaga

SEQ ID NO: 152393 - DNA, 15 bp, Homo sapiens
gtgatcacagttaag

SEQ ID NO: 152394 - DNA, 15 bp, Homo sapiens
agtgatcacagttaa

SEQ ID NO: 152395 - DNA, 15 bp, Homo sapiens
tagtgatcacagtta

SEQ ID NO: 152396 - DNA, 15 bp, Homo sapiens
gtagtgatcacagtt

SEQ ID NO: 152397 - DNA, 15 bp, Homo sapiens
ggtagtgatcacagt

SEQ ID NO: 152398 - DNA, 15 bp, Homo sapiens
tggtagtgatcacag

SEQ ID NO: 152399 - DNA, 15 bp, Homo sapiens
ttggtagtgatcaca

SEQ ID NO: 152400 - DNA, 15 bp, Homo sapiens
gttggtagtgatcac

SEQ ID NO: 152401 - DNA, 15 bp, Homo sapiens
agttggtagtgatca

SEQ ID NO: 152402 - DNA, 15 bp, Homo sapiens
aagttggtagtgatc

SEQ ID NO: 152403 - DNA, 15 bp, Homo sapiens
gaagttggtagtgat

SEQ ID NO: 152404 - DNA, 15 bp, Homo sapiens
agaagttggtagtga

SEQ ID NO: 152405 - DNA, 15 bp, Homo sapiens
gagaagttggtagtg

SEQ ID NO: 152406 - DNA, 15 bp, Homo sapiens
agagaagttggtagt

SEQ ID NO: 152407 - DNA, 15 bp, Homo sapiens
aagagaagttggtag

SEQ ID NO: 152408 - DNA, 15 bp, Homo sapiens
taagagaagttggta

SEQ ID NO: 152409 - DNA, 15 bp, Homo sapiens
ctaagagaagttggt

SEQ ID NO: 152410 - DNA, 15 bp, Homo sapiens
actaagagaagttgg

SEQ ID NO: 152411 - DNA, 15 bp, Homo sapiens
tactaagagaagttg

SEQ ID NO: 152412 - DNA, 15 bp, Homo sapiens
atactaagagaagtt

SEQ ID NO: 152413 - DNA, 15 bp, Homo sapiens
tatactaagagaagt

SEQ ID NO: 152414 - DNA, 15 bp, Homo sapiens
atatactaagagaag

SEQ ID NO: 152415 - DNA, 15 bp, Homo sapiens
aatatactaagagaa

SEQ ID NO: 152416 - DNA, 15 bp, Homo sapiens
aaatatactaagaga

SEQ ID NO: 152417 - DNA, 15 bp, Homo sapiens
caaatatactaagag

SEQ ID NO: 152418 - DNA, 15 bp, Homo sapiens
ccaaatatactaaga

SEQ ID NO: 152419 - DNA, 15 bp, Homo sapiens
accaaatatactaag

SEQ ID NO: 152420 - DNA, 15 bp, Homo sapiens
taccaaatatactaa

SEQ ID NO: 152421 - DNA, 15 bp, Homo sapiens
ctaccaaatatacta

SEQ ID NO: 152422 - DNA, 15 bp, Homo sapiens
actaccaaatatact

SEQ ID NO: 152423 - DNA, 15 bp, Homo sapiens
aactaccaaatatac

SEQ ID NO: 152424 - DNA, 15 bp, Homo sapiens
aaactaccaaatata

SEQ ID NO: 152425 - DNA, 15 bp, Homo sapiens
taaactaccaaatat

SEQ ID NO: 152426 - DNA, 15 bp, Homo sapiens
ataaactaccaaata

SEQ ID NO: 152427 - DNA, 15 bp, Homo sapiens
aataaactaccaaat

SEQ ID NO: 152428 - DNA, 15 bp, Homo sapiens
aaataaactaccaaa

SEQ ID NO: 152429 - DNA, 15 bp, Homo sapiens
aaaataaactaccaa

SEQ ID NO: 152430 - DNA, 15 bp, Homo sapiens
aaaaataaactacca

SEQ ID NO: 152431 - DNA, 15 bp, Homo sapiens
taaaaataaactacc

SEQ ID NO: 152432 - DNA, 15 bp, Homo sapiens
ctaaaaataaactac

SEQ ID NO: 152433 - DNA, 15 bp, Homo sapiens
actaaaaataaacta

SEQ ID NO: 152434 - DNA, 15 bp, Homo sapiens
aactaaaaataaact

SEQ ID NO: 152435 - DNA, 15 bp, Homo sapiens
gaactaaaaataaac

SEQ ID NO: 152436 - DNA, 15 bp, Homo sapiens
agaactaaaaataaa

SEQ ID NO: 152437 - DNA, 15 bp, Homo sapiens
gagaactaaaaataa

SEQ ID NO: 152438 - DNA, 15 bp, Homo sapiens
agagaactaaaaata

SEQ ID NO: 152439 - DNA, 15 bp, Homo sapiens
tagagaactaaaaat

SEQ ID NO: 152440 - DNA, 15 bp, Homo sapiens
ttagagaactaaaaa

SEQ ID NO: 152441 - DNA, 15 bp, Homo sapiens
tttagagaactaaaa

SEQ ID NO: 152442 - DNA, 15 bp, Homo sapiens
ttttagagaactaaa

SEQ ID NO: 152443 - DNA, 15 bp, Homo sapiens
attttagagaactaa

SEQ ID NO: 152444 - DNA, 15 bp, Homo sapiens
tattttagagaacta

SEQ ID NO: 152445 - DNA, 15 bp, Homo sapiens
ttattttagagaact

SEQ ID NO: 152446 - DNA, 15 bp, Homo sapiens
cttattttagagaac

SEQ ID NO: 152447 - DNA, 15 bp, Homo sapiens
acttattttagagaa

SEQ ID NO: 152448 - DNA, 15 bp, Homo sapiens
tacttattttagaga

SEQ ID NO: 152449 - DNA, 15 bp, Homo sapiens
ttacttattttagag

SEQ ID NO: 152450 - DNA, 15 bp, Homo sapiens
attacttattttaga

SEQ ID NO: 152451 - DNA, 15 bp, Homo sapiens
aattacttattttag

SEQ ID NO: 152452 - DNA, 15 bp, Homo sapiens
taattacttatttta

SEQ ID NO: 152453 - DNA, 15 bp, Homo sapiens
ctaattacttatttt

SEQ ID NO: 152454 - DNA, 15 bp, Homo sapiens
actaattacttattt

SEQ ID NO: 152455 - DNA, 15 bp, Homo sapiens
tactaattacttatt

SEQ ID NO: 152456 - DNA, 15 bp, Homo sapiens
ctactaattacttat

SEQ ID NO: 152457 - DNA, 15 bp, Homo sapiens
tctactaattactta

SEQ ID NO: 152458 - DNA, 15 bp, Homo sapiens
ctctactaattactt

SEQ ID NO: 152459 - DNA, 15 bp, Homo sapiens
actctactaattact

SEQ ID NO: 152460 - DNA, 15 bp, Homo sapiens
aactctactaattac

SEQ ID NO: 152461 - DNA, 15 bp, Homo sapiens
gaactctactaatta

SEQ ID NO: 152462 - DNA, 15 bp, Homo sapiens
ggaactctactaatt

SEQ ID NO: 152463 - DNA, 15 bp, Homo sapiens
aggaactctactaat

SEQ ID NO: 152464 - DNA, 15 bp, Homo sapiens
taggaactctactaa

SEQ ID NO: 152465 - DNA, 15 bp, Homo sapiens
gtaggaactctacta

SEQ ID NO: 152466 - DNA, 15 bp, Homo sapiens
ggtaggaactctact

SEQ ID NO: 152467 - DNA, 15 bp, Homo sapiens
tggtaggaactctac

SEQ ID NO: 152468 - DNA, 15 bp, Homo sapiens
atggtaggaactcta

SEQ ID NO: 152469 - DNA, 15 bp, Homo sapiens
tatggtaggaactct

SEQ ID NO: 152470 - DNA, 15 bp, Homo sapiens
ctatggtaggaactc

SEQ ID NO: 152471 - DNA, 15 bp, Homo sapiens
tctatggtaggaact

SEQ ID NO: 152472 - DNA, 15 bp, Homo sapiens
ctctatggtaggaac

SEQ ID NO: 152473 - DNA, 15 bp, Homo sapiens
tctctatggtaggaa

SEQ ID NO: 152474 - DNA, 15 bp, Homo sapiens
atctctatggtagga

SEQ ID NO: 152475 - DNA, 15 bp, Homo sapiens
tatctctatggtagg

SEQ ID NO: 152476 - DNA, 15 bp, Homo sapiens
ttatctctatggtag

SEQ ID NO: 152477 - DNA, 15 bp, Homo sapiens
tttatctctatggta

SEQ ID NO: 152478 - DNA, 15 bp, Homo sapiens
ttttatctctatggt

SEQ ID NO: 152479 - DNA, 15 bp, Homo sapiens
cttttatctctatgg

SEQ ID NO: 152480 - DNA, 15 bp, Homo sapiens
tcttttatctctatg

SEQ ID NO: 152481 - DNA, 15 bp, Homo sapiens
ttcttttatctctat

SEQ ID NO: 152482 - DNA, 15 bp, Homo sapiens
attcttttatctcta

SEQ ID NO: 152483 - DNA, 15 bp, Homo sapiens
cattcttttatctct

SEQ ID NO: 152484 - DNA, 15 bp, Homo sapiens
acattcttttatctc

SEQ ID NO: 152485 - DNA, 15 bp, Homo sapiens
tacattcttttatct

SEQ ID NO: 152486 - DNA, 15 bp, Homo sapiens
ctacattcttttatc

SEQ ID NO: 152487 - DNA, 15 bp, Homo sapiens
tctacattcttttat

SEQ ID NO: 152488 - DNA, 15 bp, Homo sapiens
ttctacattctttta

SEQ ID NO: 152489 - DNA, 15 bp, Homo sapiens
tttctacattctttt

SEQ ID NO: 152490 - DNA, 15 bp, Homo sapiens
ttttctacattcttt

SEQ ID NO: 152491 - DNA, 15 bp, Homo sapiens
attttctacattctt

SEQ ID NO: 152492 - DNA, 15 bp, Homo sapiens
cattttctacattct

SEQ ID NO: 152493 - DNA, 15 bp, Homo sapiens
acattttctacattc

SEQ ID NO: 152494 - DNA, 15 bp, Homo sapiens
aacattttctacatt

SEQ ID NO: 152495 - DNA, 15 bp, Homo sapiens
taacattttctacat

SEQ ID NO: 152496 - DNA, 15 bp, Homo sapiens
ataacattttctaca

SEQ ID NO: 152497 - DNA, 15 bp, Homo sapiens
cataacattttctac

SEQ ID NO: 152498 - DNA, 15 bp, Homo sapiens
gcataacattttcta

SEQ ID NO: 152499 - DNA, 15 bp, Homo sapiens
ggcataacattttct

SEQ ID NO: 152500 - DNA, 15 bp, Homo sapiens
aggcataacattttc

SEQ ID NO: 152501 - DNA, 15 bp, Homo sapiens
aaggcataacatttt

SEQ ID NO: 152502 - DNA, 15 bp, Homo sapiens
caaggcataacattt

SEQ ID NO: 152503 - DNA, 15 bp, Homo sapiens
ccaaggcataacatt

SEQ ID NO: 152504 - DNA, 15 bp, Homo sapiens
accaaggcataacat

SEQ ID NO: 152505 - DNA, 15 bp, Homo sapiens
taccaaggcataaca

SEQ ID NO: 152506 - DNA, 15 bp, Homo sapiens
ctaccaaggcataac

SEQ ID NO: 152507 - DNA, 15 bp, Homo sapiens
gctaccaaggcataa

SEQ ID NO: 152508 - DNA, 15 bp, Homo sapiens
agctaccaaggcata

SEQ ID NO: 152509 - DNA, 15 bp, Homo sapiens
aagctaccaaggcat

SEQ ID NO: 152510 - DNA, 15 bp, Homo sapiens
aaagctaccaaggca

SEQ ID NO: 152511 - DNA, 15 bp, Homo sapiens
gaaagctaccaaggc

SEQ ID NO: 152512 - DNA, 15 bp, Homo sapiens
agaaagctaccaagg

SEQ ID NO: 152513 - DNA, 15 bp, Homo sapiens
gagaaagctaccaag

SEQ ID NO: 152514 - DNA, 15 bp, Homo sapiens
tgagaaagctaccaa

SEQ ID NO: 152515 - DNA, 15 bp, Homo sapiens
ctgagaaagctacca

SEQ ID NO: 152516 - DNA, 15 bp, Homo sapiens
actgagaaagctacc

SEQ ID NO: 152517 - DNA, 15 bp, Homo sapiens
aactgagaaagctac

SEQ ID NO: 152518 - DNA, 15 bp, Homo sapiens
aaactgagaaagcta

SEQ ID NO: 152519 - DNA, 15 bp, Homo sapiens
gaaactgagaaagct

SEQ ID NO: 152520 - DNA, 15 bp, Homo sapiens
tgaaactgagaaagc

SEQ ID NO: 152521 - DNA, 15 bp, Homo sapiens
gtgaaactgagaaag

SEQ ID NO: 152522 - DNA, 15 bp, Homo sapiens
tgtgaaactgagaaa

SEQ ID NO: 152523 - DNA, 15 bp, Homo sapiens
ttgtgaaactgagaa

SEQ ID NO: 152524 - DNA, 15 bp, Homo sapiens
tttgtgaaactgaga

SEQ ID NO: 152525 - DNA, 15 bp, Homo sapiens
ctttgtgaaactgag

SEQ ID NO: 152526 - DNA, 15 bp, Homo sapiens
gctttgtgaaactga

SEQ ID NO: 152527 - DNA, 15 bp, Homo sapiens
agctttgtgaaactg

SEQ ID NO: 152528 - DNA, 15 bp, Homo sapiens
aagctttgtgaaact

SEQ ID NO: 152529 - DNA, 15 bp, Homo sapiens
taagctttgtgaaac

SEQ ID NO: 152530 - DNA, 15 bp, Homo sapiens
ataagctttgtgaaa

SEQ ID NO: 152531 - DNA, 15 bp, Homo sapiens
aataagctttgtgaa

SEQ ID NO: 152532 - DNA, 15 bp, Homo sapiens
gaataagctttgtga

SEQ ID NO: 152533 - DNA, 15 bp, Homo sapiens
tgaataagctttgtg

SEQ ID NO: 152534 - DNA, 15 bp, Homo sapiens
atgaataagctttgt

SEQ ID NO: 152535 - DNA, 15 bp, Homo sapiens
aatgaataagctttg

SEQ ID NO: 152536 - DNA, 15 bp, Homo sapiens
aaatgaataagcttt

SEQ ID NO: 152537 - DNA, 15 bp, Homo sapiens
gaaatgaataagctt

SEQ ID NO: 152538 - DNA, 15 bp, Homo sapiens
agaaatgaataagct

SEQ ID NO: 152539 - DNA, 15 bp, Homo sapiens
cagaaatgaataagc

SEQ ID NO: 152540 - DNA, 15 bp, Homo sapiens
ccagaaatgaataag

SEQ ID NO: 152541 - DNA, 15 bp, Homo sapiens
cccagaaatgaataa

SEQ ID NO: 152542 - DNA, 15 bp, Homo sapiens
gcccagaaatgaata

SEQ ID NO: 152543 - DNA, 15 bp, Homo sapiens
cgcccagaaatgaat

SEQ ID NO: 152544 - DNA, 15 bp, Homo sapiens
tcgcccagaaatgaa

SEQ ID NO: 152545 - DNA, 15 bp, Homo sapiens
ctcgcccagaaatga

SEQ ID NO: 152546 - DNA, 15 bp, Homo sapiens
cctcgcccagaaatg

SEQ ID NO: 152547 - DNA, 15 bp, Homo sapiens
acctcgcccagaaat

SEQ ID NO: 152548 - DNA, 15 bp, Homo sapiens
tacctcgcccagaaa

SEQ ID NO: 152549 - DNA, 15 bp, Homo sapiens
ttacctcgcccagaa

SEQ ID NO: 152550 - DNA, 15 bp, Homo sapiens
tttacctcgcccaga

SEQ ID NO: 152551 - DNA, 15 bp, Homo sapiens
atttacctcgcccag

SEQ ID NO: 152552 - DNA, 15 bp, Homo sapiens
catttacctcgccca

SEQ ID NO: 152553 - DNA, 15 bp, Homo sapiens
tcatttacctcgccc

SEQ ID NO: 152554 - DNA, 15 bp, Homo sapiens
ctcatttacctcgcc

SEQ ID NO: 152555 - DNA, 15 bp, Homo sapiens
actcatttacctcgc

SEQ ID NO: 152556 - DNA, 15 bp, Homo sapiens
gactcatttacctcg

SEQ ID NO: 152557 - DNA, 15 bp, Homo sapiens
ggactcatttacctc

SEQ ID NO: 152558 - DNA, 15 bp, Homo sapiens
tggactcatttacct

SEQ ID NO: 152559 - DNA, 15 bp, Homo sapiens
ttggactcatttacc

SEQ ID NO: 152560 - DNA, 15 bp, Homo sapiens
tttggactcatttac

SEQ ID NO: 152561 - DNA, 15 bp, Homo sapiens
atttggactcattta

SEQ ID NO: 152562 - DNA, 15 bp, Homo sapiens
tatttggactcattt

SEQ ID NO: 152563 - DNA, 15 bp, Homo sapiens
ttatttggactcatt

SEQ ID NO: 152564 - DNA, 15 bp, Homo sapiens
attatttggactcat

SEQ ID NO: 152565 - DNA, 15 bp, Homo sapiens
aattatttggactca

SEQ ID NO: 152566 - DNA, 15 bp, Homo sapiens
caattatttggactc

SEQ ID NO: 152567 - DNA, 15 bp, Homo sapiens
tcaattatttggact

SEQ ID NO: 152568 - DNA, 15 bp, Homo sapiens
ttcaattatttggac

SEQ ID NO: 152569 - DNA, 15 bp, Homo sapiens
tttcaattatttgga

SEQ ID NO: 152570 - DNA, 15 bp, Homo sapiens
atttcaattatttgg

SEQ ID NO: 152571 - DNA, 15 bp, Homo sapiens
aatttcaattatttg

SEQ ID NO: 152572 - DNA, 15 bp, Homo sapiens
caatttcaattattt

SEQ ID NO: 152573 - DNA, 15 bp, Homo sapiens
ccaatttcaattatt

SEQ ID NO: 152574 - DNA, 15 bp, Homo sapiens
tccaatttcaattat

SEQ ID NO: 152575 - DNA, 15 bp, Homo sapiens
ttccaatttcaatta

SEQ ID NO: 152576 - DNA, 15 bp, Homo sapiens
tttccaatttcaatt

SEQ ID NO: 152577 - DNA, 15 bp, Homo sapiens
ctttccaatttcaat

SEQ ID NO: 152578 - DNA, 15 bp, Homo sapiens
cctttccaatttcaa

SEQ ID NO: 152579 - DNA, 15 bp, Homo sapiens
tcctttccaatttca

SEQ ID NO: 152580 - DNA, 15 bp, Homo sapiens
atcctttccaatttc

SEQ ID NO: 152581 - DNA, 15 bp, Homo sapiens
catcctttccaattt

SEQ ID NO: 152582 - DNA, 15 bp, Homo sapiens
acatcctttccaatt

SEQ ID NO: 152583 - DNA, 15 bp, Homo sapiens
cacatcctttccaat

SEQ ID NO: 152584 - DNA, 15 bp, Homo sapiens
tcacatcctttccaa

SEQ ID NO: 152585 - DNA, 15 bp, Homo sapiens
ttcacatcctttcca

SEQ ID NO: 152586 - DNA, 15 bp, Homo sapiens
cttcacatcctttcc

SEQ ID NO: 152587 - DNA, 15 bp, Homo sapiens
acttcacatcctttc

SEQ ID NO: 152588 - DNA, 15 bp, Homo sapiens
cacttcacatccttt

SEQ ID NO: 152589 - DNA, 15 bp, Homo sapiens
gcacttcacatcctt

SEQ ID NO: 152590 - DNA, 15 bp, Homo sapiens
tgcacttcacatcct

SEQ ID NO: 152591 - DNA, 15 bp, Homo sapiens
atgcacttcacatcc

SEQ ID NO: 152592 - DNA, 15 bp, Homo sapiens
gatgcacttcacatc

SEQ ID NO: 152593 - DNA, 15 bp, Homo sapiens
tgatgcacttcacat

SEQ ID NO: 152594 - DNA, 15 bp, Homo sapiens
ctgatgcacttcaca

SEQ ID NO: 152595 - DNA, 15 bp, Homo sapiens
tctgatgcacttcac

SEQ ID NO: 152596 - DNA, 15 bp, Homo sapiens
ctctgatgcacttca

SEQ ID NO: 152597 - DNA, 15 bp, Homo sapiens
cctctgatgcacttc

SEQ ID NO: 152598 - DNA, 15 bp, Homo sapiens
ccctctgatgcactt

SEQ ID NO: 152599 - DNA, 15 bp, Homo sapiens
accctctgatgcact

SEQ ID NO: 152600 - DNA, 15 bp, Homo sapiens
aaccctctgatgcac

SEQ ID NO: 152601 - DNA, 15 bp, Homo sapiens
caaccctctgatgca

SEQ ID NO: 152602 - DNA, 15 bp, Homo sapiens
gcaaccctctgatgc

SEQ ID NO: 152603 - DNA, 15 bp, Homo sapiens
agcaaccctctgatg

SEQ ID NO: 152604 - DNA, 15 bp, Homo sapiens
aagcaaccctctgat

SEQ ID NO: 152605 - DNA, 15 bp, Homo sapiens
aaagcaaccctctga

SEQ ID NO: 152606 - DNA, 15 bp, Homo sapiens
aaaagcaaccctctg

SEQ ID NO: 152607 - DNA, 15 bp, Homo sapiens
gaaaagcaaccctct

SEQ ID NO: 152608 - DNA, 15 bp, Homo sapiens
tgaaaagcaaccctc

SEQ ID NO: 152609 - DNA, 15 bp, Homo sapiens
atgaaaagcaaccct

SEQ ID NO: 152610 - DNA, 15 bp, Homo sapiens
aatgaaaagcaaccc

SEQ ID NO: 152611 - DNA, 15 bp, Homo sapiens
aaatgaaaagcaacc

SEQ ID NO: 152612 - DNA, 15 bp, Homo sapiens
aaaatgaaaagcaac

SEQ ID NO: 152613 - DNA, 15 bp, Homo sapiens
aaaaatgaaaagcaa

SEQ ID NO: 152614 - DNA, 15 bp, Homo sapiens
gaaaaatgaaaagca

SEQ ID NO: 152615 - DNA, 15 bp, Homo sapiens
tgaaaaatgaaaagc

SEQ ID NO: 152616 - DNA, 15 bp, Homo sapiens
atgaaaaatgaaaag

SEQ ID NO: 152617 - DNA, 15 bp, Homo sapiens
gatgaaaaatgaaaa

SEQ ID NO: 152618 - DNA, 15 bp, Homo sapiens
agatgaaaaatgaaa

SEQ ID NO: 152619 - DNA, 15 bp, Homo sapiens
aagatgaaaaatgaa

SEQ ID NO: 152620 - DNA, 15 bp, Homo sapiens
gaagatgaaaaatga

SEQ ID NO: 152621 - DNA, 15 bp, Homo sapiens
agaagatgaaaaatg

SEQ ID NO: 152622 - DNA, 15 bp, Homo sapiens
tagaagatgaaaaat

SEQ ID NO: 152623 - DNA, 15 bp, Homo sapiens
ctagaagatgaaaaa

SEQ ID NO: 152624 - DNA, 15 bp, Homo sapiens
actagaagatgaaaa

SEQ ID NO: 152625 - DNA, 15 bp, Homo sapiens
aactagaagatgaaa

SEQ ID NO: 152626 - DNA, 15 bp, Homo sapiens
aaactagaagatgaa

SEQ ID NO: 152627 - DNA, 15 bp, Homo sapiens
caaactagaagatga

SEQ ID NO: 152628 - DNA, 15 bp, Homo sapiens
acaaactagaagatg

SEQ ID NO: 152629 - DNA, 15 bp, Homo sapiens
aacaaactagaagat

SEQ ID NO: 152630 - DNA, 15 bp, Homo sapiens
gaacaaactagaaga

SEQ ID NO: 152631 - DNA, 15 bp, Homo sapiens
tgaacaaactagaag

SEQ ID NO: 152632 - DNA, 15 bp, Homo sapiens
ctgaacaaactagaa

SEQ ID NO: 152633 - DNA, 15 bp, Homo sapiens
actgaacaaactaga

SEQ ID NO: 152634 - DNA, 15 bp, Homo sapiens
aactgaacaaactag

SEQ ID NO: 152635 - DNA, 15 bp, Homo sapiens
gaactgaacaaacta

SEQ ID NO: 152636 - DNA, 15 bp, Homo sapiens
agaactgaacaaact

SEQ ID NO: 152637 - DNA, 15 bp, Homo sapiens
cagaactgaacaaac

SEQ ID NO: 152638 - DNA, 15 bp, Homo sapiens
acagaactgaacaaa

SEQ ID NO: 152639 - DNA, 15 bp, Homo sapiens
cacagaactgaacaa

SEQ ID NO: 152640 - DNA, 15 bp, Homo sapiens
ccacagaactgaaca

SEQ ID NO: 152641 - DNA, 15 bp, Homo sapiens
tccacagaactgaac

SEQ ID NO: 152642 - DNA, 15 bp, Homo sapiens
ttccacagaactgaa

SEQ ID NO: 152643 - DNA, 15 bp, Homo sapiens
gttccacagaactga

SEQ ID NO: 152644 - DNA, 15 bp, Homo sapiens
agttccacagaactg

SEQ ID NO: 152645 - DNA, 15 bp, Homo sapiens
gagttccacagaact

SEQ ID NO: 152646 - DNA, 15 bp, Homo sapiens
agagttccacagaac

SEQ ID NO: 152647 - DNA, 15 bp, Homo sapiens
tagagttccacagaa

SEQ ID NO: 152648 - DNA, 15 bp, Homo sapiens
ttagagttccacaga

SEQ ID NO: 152649 - DNA, 15 bp, Homo sapiens
tttagagttccacag

SEQ ID NO: 152650 - DNA, 15 bp, Homo sapiens
ttttagagttccaca

SEQ ID NO: 152651 - DNA, 15 bp, Homo sapiens
tttttagagttccac

SEQ ID NO: 152652 - DNA, 15 bp, Homo sapiens
ctttttagagttcca

SEQ ID NO: 152653 - DNA, 15 bp, Homo sapiens
tctttttagagttcc

SEQ ID NO: 152654 - DNA, 15 bp, Homo sapiens
atctttttagagttc

SEQ ID NO: 152655 - DNA, 15 bp, Homo sapiens
aatctttttagagtt

SEQ ID NO: 152656 - DNA, 15 bp, Homo sapiens
taatctttttagagt

SEQ ID NO: 152657 - DNA, 15 bp, Homo sapiens
ttaatctttttagag

SEQ ID NO: 152658 - DNA, 15 bp, Homo sapiens
attaatctttttaga

SEQ ID NO: 152659 - DNA, 15 bp, Homo sapiens
aattaatctttttag

SEQ ID NO: 152660 - DNA, 15 bp, Homo sapiens
aaattaatcttttta

SEQ ID NO: 152661 - DNA, 15 bp, Homo sapiens
taaattaatcttttt

SEQ ID NO: 152662 - DNA, 15 bp, Homo sapiens
ataaattaatctttt

SEQ ID NO: 152663 - DNA, 15 bp, Homo sapiens
tataaattaatcttt

SEQ ID NO: 152664 - DNA, 15 bp, Homo sapiens
ttataaattaatctt

SEQ ID NO: 152665 - DNA, 15 bp, Homo sapiens
gttataaattaatct

SEQ ID NO: 152666 - DNA, 15 bp, Homo sapiens
tgttataaattaatc

SEQ ID NO: 152667 - DNA, 15 bp, Homo sapiens
ttgttataaattaat

SEQ ID NO: 152668 - DNA, 15 bp, Homo sapiens
tttgttataaattaa

SEQ ID NO: 152669 - DNA, 15 bp, Homo sapiens
ctttgttataaatta

SEQ ID NO: 152670 - DNA, 15 bp, Homo sapiens
gctttgttataaatt

SEQ ID NO: 152671 - DNA, 15 bp, Homo sapiens
agctttgttataaat

SEQ ID NO: 152672 - DNA, 15 bp, Homo sapiens
gagctttgttataaa

SEQ ID NO: 152673 - DNA, 15 bp, Homo sapiens
tgagctttgttataa

SEQ ID NO: 152674 - DNA, 15 bp, Homo sapiens
gtgagctttgttata

SEQ ID NO: 152675 - DNA, 15 bp, Homo sapiens
agtgagctttgttat

SEQ ID NO: 152676 - DNA, 15 bp, Homo sapiens
aagtgagctttgtta

SEQ ID NO: 152677 - DNA, 15 bp, Homo sapiens
taagtgagctttgtt

SEQ ID NO: 152678 - DNA, 15 bp, Homo sapiens
ataagtgagctttgt

SEQ ID NO: 152679 - DNA, 15 bp, Homo sapiens
tataagtgagctttg

SEQ ID NO: 152680 - DNA, 15 bp, Homo sapiens
ttataagtgagcttt

SEQ ID NO: 152681 - DNA, 15 bp, Homo sapiens
tttataagtgagctt

SEQ ID NO: 152682 - DNA, 15 bp, Homo sapiens
ttttataagtgagct

SEQ ID NO: 152683 - DNA, 15 bp, Homo sapiens
cttttataagtgagc

SEQ ID NO: 152684 - DNA, 15 bp, Homo sapiens
gcttttataagtgag

SEQ ID NO: 152685 - DNA, 15 bp, Homo sapiens
tgcttttataagtga

SEQ ID NO: 152686 - DNA, 15 bp, Homo sapiens
ctgcttttataagtg

SEQ ID NO: 152687 - DNA, 15 bp, Homo sapiens
tctgcttttataagt

SEQ ID NO: 152688 - DNA, 15 bp, Homo sapiens
gtctgcttttataag

SEQ ID NO: 152689 - DNA, 15 bp, Homo sapiens
tgtctgcttttataa

SEQ ID NO: 152690 - DNA, 15 bp, Homo sapiens
ctgtctgcttttata

SEQ ID NO: 152691 - DNA, 15 bp, Homo sapiens
actgtctgcttttat

SEQ ID NO: 152692 - DNA, 15 bp, Homo sapiens
cactgtctgctttta

SEQ ID NO: 152693 - DNA, 15 bp, Homo sapiens
gcactgtctgctttt

SEQ ID NO: 152694 - DNA, 15 bp, Homo sapiens
ggcactgtctgcttt

SEQ ID NO: 152695 - DNA, 15 bp, Homo sapiens
aggcactgtctgctt

SEQ ID NO: 152696 - DNA, 15 bp, Homo sapiens
aaggcactgtctgct

SEQ ID NO: 152697 - DNA, 15 bp, Homo sapiens
aaaggcactgtctgc

SEQ ID NO: 152698 - DNA, 15 bp, Homo sapiens
aaaaggcactgtctg

SEQ ID NO: 152699 - DNA, 15 bp, Homo sapiens
taaaaggcactgtct

SEQ ID NO: 152700 - DNA, 15 bp, Homo sapiens
ctaaaaggcactgtc

SEQ ID NO: 152701 - DNA, 15 bp, Homo sapiens
actaaaaggcactgt

SEQ ID NO: 152702 - DNA, 15 bp, Homo sapiens
cactaaaaggcactg

SEQ ID NO: 152703 - DNA, 15 bp, Homo sapiens
gcactaaaaggcact

SEQ ID NO: 152704 - DNA, 15 bp, Homo sapiens
agcactaaaaggcac

SEQ ID NO: 152705 - DNA, 15 bp, Homo sapiens
aagcactaaaaggca

SEQ ID NO: 152706 - DNA, 15 bp, Homo sapiens
taagcactaaaaggc

SEQ ID NO: 152707 - DNA, 15 bp, Homo sapiens
ttaagcactaaaagg

SEQ ID NO: 152708 - DNA, 15 bp, Homo sapiens
attaagcactaaaag

SEQ ID NO: 152709 - DNA, 15 bp, Homo sapiens
tattaagcactaaaa

SEQ ID NO: 152710 - DNA, 15 bp, Homo sapiens
ttattaagcactaaa

SEQ ID NO: 152711 - DNA, 15 bp, Homo sapiens
tttattaagcactaa

SEQ ID NO: 152712 - DNA, 15 bp, Homo sapiens
atttattaagcacta

SEQ ID NO: 152713 - DNA, 15 bp, Homo sapiens
tatttattaagcact

SEQ ID NO: 152714 - DNA, 15 bp, Homo sapiens
ttatttattaagcac

SEQ ID NO: 152715 - DNA, 15 bp, Homo sapiens
attatttattaagca

SEQ ID NO: 152716 - DNA, 15 bp, Homo sapiens
tattatttattaagc

SEQ ID NO: 152717 - DNA, 15 bp, Homo sapiens
ctattatttattaag

SEQ ID NO: 152718 - DNA, 15 bp, Homo sapiens
cctattatttattaa

SEQ ID NO: 152719 - DNA, 15 bp, Homo sapiens
gcctattatttatta

SEQ ID NO: 152720 - DNA, 15 bp, Homo sapiens
agcctattatttatt

SEQ ID NO: 152721 - DNA, 15 bp, Homo sapiens
aagcctattatttat

SEQ ID NO: 152722 - DNA, 15 bp, Homo sapiens
taagcctattattta

SEQ ID NO: 152723 - DNA, 15 bp, Homo sapiens
ataagcctattattt

SEQ ID NO: 152724 - DNA, 15 bp, Homo sapiens
cataagcctattatt

SEQ ID NO: 152725 - DNA, 15 bp, Homo sapiens
acataagcctattat

SEQ ID NO: 152726 - DNA, 15 bp, Homo sapiens
cacataagcctatta

SEQ ID NO: 152727 - DNA, 15 bp, Homo sapiens
tcacataagcctatt

SEQ ID NO: 152728 - DNA, 15 bp, Homo sapiens
ttcacataagcctat

SEQ ID NO: 152729 - DNA, 15 bp, Homo sapiens
tttcacataagccta

SEQ ID NO: 152730 - DNA, 15 bp, Homo sapiens
ctttcacataagcct

SEQ ID NO: 152731 - DNA, 15 bp, Homo sapiens
actttcacataagcc

SEQ ID NO: 152732 - DNA, 15 bp, Homo sapiens
tactttcacataagc

SEQ ID NO: 152733 - DNA, 15 bp, Homo sapiens
atactttcacataag

SEQ ID NO: 152734 - DNA, 15 bp, Homo sapiens
catactttcacataa

SEQ ID NO: 152735 - DNA, 15 bp, Homo sapiens
ccatactttcacata

SEQ ID NO: 152736 - DNA, 15 bp, Homo sapiens
gccatactttcacat

SEQ ID NO: 152737 - DNA, 15 bp, Homo sapiens
agccatactttcaca

SEQ ID NO: 152738 - DNA, 15 bp, Homo sapiens
aagccatactttcac

SEQ ID NO: 152739 - DNA, 15 bp, Homo sapiens
gaagccatactttca

SEQ ID NO: 152740 - DNA, 15 bp, Homo sapiens
tgaagccatactttc

SEQ ID NO: 152741 - DNA, 15 bp, Homo sapiens
atgaagccatacttt

SEQ ID NO: 152742 - DNA, 15 bp, Homo sapiens
tatgaagccatactt

SEQ ID NO: 152743 - DNA, 15 bp, Homo sapiens
ttatgaagccatact

SEQ ID NO: 152744 - DNA, 15 bp, Homo sapiens
tttatgaagccatac

SEQ ID NO: 152745 - DNA, 15 bp, Homo sapiens
ctttatgaagccata

SEQ ID NO: 152746 - DNA, 15 bp, Homo sapiens
actttatgaagccat

SEQ ID NO: 152747 - DNA, 15 bp, Homo sapiens
aactttatgaagcca

SEQ ID NO: 152748 - DNA, 15 bp, Homo sapiens
taactttatgaagcc

SEQ ID NO: 152749 - DNA, 15 bp, Homo sapiens
ttaactttatgaagc

SEQ ID NO: 152750 - DNA, 15 bp, Homo sapiens
cttaactttatgaag

SEQ ID NO: 152751 - DNA, 15 bp, Homo sapiens
gcttaactttatgaa

SEQ ID NO: 152752 - DNA, 15 bp, Homo sapiens
tgcttaactttatga

SEQ ID NO: 152753 - DNA, 15 bp, Homo sapiens
ttgcttaactttatg

SEQ ID NO: 152754 - DNA, 15 bp, Homo sapiens
cttgcttaactttat

SEQ ID NO: 152755 - DNA, 15 bp, Homo sapiens
tcttgcttaacttta

SEQ ID NO: 152756 - DNA, 15 bp, Homo sapiens
ttcttgcttaacttt

SEQ ID NO: 152757 - DNA, 15 bp, Homo sapiens
attcttgcttaactt

SEQ ID NO: 152758 - DNA, 15 bp, Homo sapiens
aattcttgcttaact

SEQ ID NO: 152759 - DNA, 15 bp, Homo sapiens
aaattcttgcttaac

SEQ ID NO: 152760 - DNA, 15 bp, Homo sapiens
aaaattcttgcttaa

SEQ ID NO: 152761 - DNA, 15 bp, Homo sapiens
caaaattcttgctta

SEQ ID NO: 152762 - DNA, 15 bp, Homo sapiens
ccaaaattcttgctt

SEQ ID NO: 152763 - DNA, 15 bp, Homo sapiens
tccaaaattcttgct

SEQ ID NO: 152764 - DNA, 15 bp, Homo sapiens
ttccaaaattcttgc

SEQ ID NO: 152765 - DNA, 15 bp, Homo sapiens
tttccaaaattcttg

SEQ ID NO: 152766 - DNA, 15 bp, Homo sapiens
ttttccaaaattctt

SEQ ID NO: 152767 - DNA, 15 bp, Homo sapiens
tttttccaaaattct

SEQ ID NO: 152768 - DNA, 15 bp, Homo sapiens
gtttttccaaaattc

SEQ ID NO: 152769 - DNA, 15 bp, Homo sapiens
tgtttttccaaaatt

SEQ ID NO: 152770 - DNA, 15 bp, Homo sapiens
atgtttttccaaaat

SEQ ID NO: 152771 - DNA, 15 bp, Homo sapiens
gatgtttttccaaaa

SEQ ID NO: 152772 - DNA, 15 bp, Homo sapiens
tgatgtttttccaaa

SEQ ID NO: 152773 - DNA, 15 bp, Homo sapiens
ttgatgtttttccaa

SEQ ID NO: 152774 - DNA, 15 bp, Homo sapiens
tttgatgtttttcca

SEQ ID NO: 152775 - DNA, 15 bp, Homo sapiens
atttgatgtttttcc

SEQ ID NO: 152776 - DNA, 15 bp, Homo sapiens
catttgatgtttttc

SEQ ID NO: 152777 - DNA, 15 bp, Homo sapiens
ccatttgatgttttt

SEQ ID NO: 152778 - DNA, 15 bp, Homo sapiens
tccatttgatgtttt

SEQ ID NO: 152779 - DNA, 15 bp, Homo sapiens
ttccatttgatgttt

SEQ ID NO: 152780 - DNA, 15 bp, Homo sapiens
cttccatttgatgtt

SEQ ID NO: 152781 - DNA, 15 bp, Homo sapiens
tcttccatttgatgt

SEQ ID NO: 152782 - DNA, 15 bp, Homo sapiens
ttcttccatttgatg

SEQ ID NO: 152783 - DNA, 15 bp, Homo sapiens
cttcttccatttgat

SEQ ID NO: 152784 - DNA, 15 bp, Homo sapiens
tcttcttccatttga

SEQ ID NO: 152785 - DNA, 15 bp, Homo sapiens
atcttcttccatttg

SEQ ID NO: 152786 - DNA, 15 bp, Homo sapiens
catcttcttccattt

SEQ ID NO: 152787 - DNA, 15 bp, Homo sapiens
acatcttcttccatt

SEQ ID NO: 152788 - DNA, 15 bp, Homo sapiens
aacatcttcttccat

SEQ ID NO: 152789 - DNA, 15 bp, Homo sapiens
caacatcttcttcca

SEQ ID NO: 152790 - DNA, 15 bp, Homo sapiens
tcaacatcttcttcc

SEQ ID NO: 152791 - DNA, 15 bp, Homo sapiens
ttcaacatcttcttc

SEQ ID NO: 152792 - DNA, 15 bp, Homo sapiens
gttcaacatcttctt

SEQ ID NO: 152793 - DNA, 15 bp, Homo sapiens
agttcaacatcttct

SEQ ID NO: 152794 - DNA, 15 bp, Homo sapiens
cagttcaacatcttc

SEQ ID NO: 152795 - DNA, 15 bp, Homo sapiens
acagttcaacatctt

SEQ ID NO: 152796 - DNA, 15 bp, Homo sapiens
aacagttcaacatct

SEQ ID NO: 152797 - DNA, 15 bp, Homo sapiens
aaacagttcaacatc

SEQ ID NO: 152798 - DNA, 15 bp, Homo sapiens
caaacagttcaacat

SEQ ID NO: 152799 - DNA, 15 bp, Homo sapiens
gcaaacagttcaaca

SEQ ID NO: 152800 - DNA, 15 bp, Homo sapiens
tgcaaacagttcaac

SEQ ID NO: 152801 - DNA, 15 bp, Homo sapiens
gtgcaaacagttcaa

SEQ ID NO: 152802 - DNA, 15 bp, Homo sapiens
tgtgcaaacagttca

SEQ ID NO: 152803 - DNA, 15 bp, Homo sapiens
ttgtgcaaacagttc

SEQ ID NO: 152804 - DNA, 15 bp, Homo sapiens
attgtgcaaacagtt

SEQ ID NO: 152805 - DNA, 15 bp, Homo sapiens
tattgtgcaaacagt

SEQ ID NO: 152806 - DNA, 15 bp, Homo sapiens
ctattgtgcaaacag

SEQ ID NO: 152807 - DNA, 15 bp, Homo sapiens
tctattgtgcaaaca

SEQ ID NO: 152808 - DNA, 15 bp, Homo sapiens
gtctattgtgcaaac

SEQ ID NO: 152809 - DNA, 15 bp, Homo sapiens
tgtctattgtgcaaa

SEQ ID NO: 152810 - DNA, 15 bp, Homo sapiens
ttgtctattgtgcaa

SEQ ID NO: 152811 - DNA, 15 bp, Homo sapiens
gttgtctattgtgca

SEQ ID NO: 152812 - DNA, 15 bp, Homo sapiens
agttgtctattgtgc

SEQ ID NO: 152813 - DNA, 15 bp, Homo sapiens
tagttgtctattgtg

SEQ ID NO: 152814 - DNA, 15 bp, Homo sapiens
atagttgtctattgt

SEQ ID NO: 152815 - DNA, 15 bp, Homo sapiens
aatagttgtctattg

SEQ ID NO: 152816 - DNA, 15 bp, Homo sapiens
aaatagttgtctatt

SEQ ID NO: 152817 - DNA, 15 bp, Homo sapiens
aaaatagttgtctat

SEQ ID NO: 152818 - DNA, 15 bp, Homo sapiens
caaaatagttgtcta

SEQ ID NO: 152819 - DNA, 15 bp, Homo sapiens
acaaaatagttgtct

SEQ ID NO: 152820 - DNA, 15 bp, Homo sapiens
aacaaaatagttgtc

SEQ ID NO: 152821 - DNA, 15 bp, Homo sapiens
aaacaaaatagttgt

SEQ ID NO: 152822 - DNA, 15 bp, Homo sapiens
aaaacaaaatagttg

SEQ ID NO: 152823 - DNA, 15 bp, Homo sapiens
aaaaacaaaatagtt

SEQ ID NO: 152824 - DNA, 15 bp, Homo sapiens
taaaaacaaaatagt

SEQ ID NO: 152825 - DNA, 15 bp, Homo sapiens
ataaaaacaaaatag

SEQ ID NO: 152826 - DNA, 15 bp, Homo sapiens
aataaaaacaaaata

SEQ ID NO: 152827 - DNA, 15 bp, Homo sapiens
aaataaaaacaaaat

SEQ ID NO: 152828 - DNA, 15 bp, Homo sapiens
aaaataaaaacaaaa

SEQ ID NO: 152829 - DNA, 15 bp, Homo sapiens
taaaataaaaacaaa

SEQ ID NO: 152830 - DNA, 15 bp, Homo sapiens
ttaaaataaaaacaa

SEQ ID NO: 152831 - DNA, 15 bp, Homo sapiens
gttaaaataaaaaca

SEQ ID NO: 152832 - DNA, 15 bp, Homo sapiens
tgttaaaataaaaac

SEQ ID NO: 152833 - DNA, 15 bp, Homo sapiens
ctgttaaaataaaaa

SEQ ID NO: 152834 - DNA, 15 bp, Homo sapiens
tctgttaaaataaaa

SEQ ID NO: 152835 - DNA, 15 bp, Homo sapiens
ttctgttaaaataaa

SEQ ID NO: 152836 - DNA, 15 bp, Homo sapiens
attctgttaaaataa

SEQ ID NO: 152837 - DNA, 15 bp, Homo sapiens
aattctgttaaaata

SEQ ID NO: 152838 - DNA, 15 bp, Homo sapiens
caattctgttaaaat

SEQ ID NO: 152839 - DNA, 15 bp, Homo sapiens
tcaattctgttaaaa

SEQ ID NO: 152840 - DNA, 15 bp, Homo sapiens
ctcaattctgttaaa

SEQ ID NO: 152841 - DNA, 15 bp, Homo sapiens
tctcaattctgttaa

SEQ ID NO: 152842 - DNA, 15 bp, Homo sapiens
ctctcaattctgtta

SEQ ID NO: 152843 - DNA, 15 bp, Homo sapiens
tctctcaattctgtt

SEQ ID NO: 152844 - DNA, 15 bp, Homo sapiens
ttctctcaattctgt

SEQ ID NO: 152845 - DNA, 15 bp, Homo sapiens
tttctctcaattctg

SEQ ID NO: 152846 - DNA, 15 bp, Homo sapiens
ttttctctcaattct

SEQ ID NO: 152847 - DNA, 15 bp, Homo sapiens
tttttctctcaattc

SEQ ID NO: 152848 - DNA, 15 bp, Homo sapiens
atttttctctcaatt

SEQ ID NO: 152849 - DNA, 15 bp, Homo sapiens
catttttctctcaat

SEQ ID NO: 152850 - DNA, 15 bp, Homo sapiens
ccatttttctctcaa

SEQ ID NO: 152851 - DNA, 15 bp, Homo sapiens
gccatttttctctca

SEQ ID NO: 152852 - DNA, 15 bp, Homo sapiens
agccatttttctctc

SEQ ID NO: 152853 - DNA, 15 bp, Homo sapiens
cagccatttttctct

SEQ ID NO: 152854 - DNA, 15 bp, Homo sapiens
tcagccatttttctc

SEQ ID NO: 152855 - DNA, 15 bp, Homo sapiens
gtcagccatttttct

SEQ ID NO: 152856 - DNA, 15 bp, Homo sapiens
agtcagccatttttc

SEQ ID NO: 152857 - DNA, 15 bp, Homo sapiens
tagtcagccattttt

SEQ ID NO: 152858 - DNA, 15 bp, Homo sapiens
gtagtcagccatttt

SEQ ID NO: 152859 - DNA, 15 bp, Homo sapiens
tgtagtcagccattt

SEQ ID NO: 152860 - DNA, 15 bp, Homo sapiens
ttgtagtcagccatt

SEQ ID NO: 152861 - DNA, 15 bp, Homo sapiens
gttgtagtcagccat

SEQ ID NO: 152862 - DNA, 15 bp, Homo sapiens
tgttgtagtcagcca

SEQ ID NO: 152863 - DNA, 15 bp, Homo sapiens
ttgttgtagtcagcc

SEQ ID NO: 152864 - DNA, 15 bp, Homo sapiens
attgttgtagtcagc

SEQ ID NO: 152865 - DNA, 15 bp, Homo sapiens
tattgttgtagtcag

SEQ ID NO: 152866 - DNA, 15 bp, Homo sapiens
ctattgttgtagtca

SEQ ID NO: 152867 - DNA, 15 bp, Homo sapiens
tctattgttgtagtc

SEQ ID NO: 152868 - DNA, 15 bp, Homo sapiens
ttctattgttgtagt

SEQ ID NO: 152869 - DNA, 15 bp, Homo sapiens
attctattgttgtag

SEQ ID NO: 152870 - DNA, 15 bp, Homo sapiens
tattctattgttgta

SEQ ID NO: 152871 - DNA, 15 bp, Homo sapiens
ttattctattgttgt

SEQ ID NO: 152872 - DNA, 15 bp, Homo sapiens
gttattctattgttg

SEQ ID NO: 152873 - DNA, 15 bp, Homo sapiens
agttattctattgtt

SEQ ID NO: 152874 - DNA, 15 bp, Homo sapiens
cagttattctattgt

SEQ ID NO: 152875 - DNA, 15 bp, Homo sapiens
acagttattctattg

SEQ ID NO: 152876 - DNA, 15 bp, Homo sapiens
aacagttattctatt

SEQ ID NO: 152877 - DNA, 15 bp, Homo sapiens
taacagttattctat

SEQ ID NO: 152878 - DNA, 15 bp, Homo sapiens
ctaacagttattcta

SEQ ID NO: 152879 - DNA, 15 bp, Homo sapiens
gctaacagttattct

SEQ ID NO: 152880 - DNA, 15 bp, Homo sapiens
agctaacagttattc

SEQ ID NO: 152881 - DNA, 15 bp, Homo sapiens
cagctaacagttatt

SEQ ID NO: 152882 - DNA, 15 bp, Homo sapiens
acagctaacagttat

SEQ ID NO: 152883 - DNA, 15 bp, Homo sapiens
aacagctaacagtta

SEQ ID NO: 152884 - DNA, 15 bp, Homo sapiens
taacagctaacagtt

SEQ ID NO: 152885 - DNA, 15 bp, Homo sapiens
ataacagctaacagt

SEQ ID NO: 152886 - DNA, 15 bp, Homo sapiens
cataacagctaacag

SEQ ID NO: 152887 - DNA, 15 bp, Homo sapiens
tcataacagctaaca

SEQ ID NO: 152888 - DNA, 15 bp, Homo sapiens
atcataacagctaac

SEQ ID NO: 152889 - DNA, 15 bp, Homo sapiens
catcataacagctaa

SEQ ID NO: 152890 - DNA, 15 bp, Homo sapiens
ccatcataacagcta

SEQ ID NO: 152891 - DNA, 15 bp, Homo sapiens
cccatcataacagct

SEQ ID NO: 152892 - DNA, 15 bp, Homo sapiens
tcccatcataacagc

SEQ ID NO: 152893 - DNA, 15 bp, Homo sapiens
ttcccatcataacag

SEQ ID NO: 152894 - DNA, 15 bp, Homo sapiens
tttcccatcataaca

SEQ ID NO: 152895 - DNA, 15 bp, Homo sapiens
ttttcccatcataac

SEQ ID NO: 152896 - DNA, 15 bp, Homo sapiens
attttcccatcataa

SEQ ID NO: 152897 - DNA, 15 bp, Homo sapiens
tattttcccatcata

SEQ ID NO: 152898 - DNA, 15 bp, Homo sapiens
atattttcccatcat

SEQ ID NO: 152899 - DNA, 15 bp, Homo sapiens
gatattttcccatca

SEQ ID NO: 152900 - DNA, 15 bp, Homo sapiens
agatattttcccatc

SEQ ID NO: 152901 - DNA, 15 bp, Homo sapiens
aagatattttcccat

SEQ ID NO: 152902 - DNA, 15 bp, Homo sapiens
caagatattttccca

SEQ ID NO: 152903 - DNA, 15 bp, Homo sapiens
tcaagatattttccc

SEQ ID NO: 152904 - DNA, 15 bp, Homo sapiens
atcaagatattttcc

SEQ ID NO: 152905 - DNA, 15 bp, Homo sapiens
tatcaagatattttc

SEQ ID NO: 152906 - DNA, 15 bp, Homo sapiens
gtatcaagatatttt

SEQ ID NO: 152907 - DNA, 15 bp, Homo sapiens
agtatcaagatattt

SEQ ID NO: 152908 - DNA, 15 bp, Homo sapiens
cagtatcaagatatt

SEQ ID NO: 152909 - DNA, 15 bp, Homo sapiens
gcagtatcaagatat

SEQ ID NO: 152910 - DNA, 15 bp, Homo sapiens
agcagtatcaagata

SEQ ID NO: 152911 - DNA, 15 bp, Homo sapiens
tagcagtatcaagat

SEQ ID NO: 152912 - DNA, 15 bp, Homo sapiens
ctagcagtatcaaga

SEQ ID NO: 152913 - DNA, 15 bp, Homo sapiens
actagcagtatcaag

SEQ ID NO: 152914 - DNA, 15 bp, Homo sapiens
tactagcagtatcaa

SEQ ID NO: 152915 - DNA, 15 bp, Homo sapiens
gtactagcagtatca

SEQ ID NO: 152916 - DNA, 15 bp, Homo sapiens
tgtactagcagtatc

SEQ ID NO: 152917 - DNA, 15 bp, Homo sapiens
ctgtactagcagtat

SEQ ID NO: 152918 - DNA, 15 bp, Homo sapiens
actgtactagcagta

SEQ ID NO: 152919 - DNA, 15 bp, Homo sapiens
aactgtactagcagt

SEQ ID NO: 152920 - DNA, 15 bp, Homo sapiens
aaactgtactagcag

SEQ ID NO: 152921 - DNA, 15 bp, Homo sapiens
gaaactgtactagca

SEQ ID NO: 152922 - DNA, 15 bp, Homo sapiens
ggaaactgtactagc

SEQ ID NO: 152923 - DNA, 15 bp, Homo sapiens
aggaaactgtactag

SEQ ID NO: 152924 - DNA, 15 bp, Homo sapiens
aaggaaactgtacta

SEQ ID NO: 152925 - DNA, 15 bp, Homo sapiens
taaggaaactgtact

SEQ ID NO: 152926 - DNA, 15 bp, Homo sapiens
gtaaggaaactgtac

SEQ ID NO: 152927 - DNA, 15 bp, Homo sapiens
tgtaaggaaactgta

SEQ ID NO: 152928 - DNA, 15 bp, Homo sapiens
atgtaaggaaactgt

SEQ ID NO: 152929 - DNA, 15 bp, Homo sapiens
aatgtaaggaaactg

SEQ ID NO: 152930 - DNA, 15 bp, Homo sapiens
aaatgtaaggaaact

SEQ ID NO: 152931 - DNA, 15 bp, Homo sapiens
aaaatgtaaggaaac

SEQ ID NO: 152932 - DNA, 15 bp, Homo sapiens
aaaaatgtaaggaaa

SEQ ID NO: 152933 - DNA, 15 bp, Homo sapiens
taaaaatgtaaggaa

SEQ ID NO: 152934 - DNA, 15 bp, Homo sapiens
ctaaaaatgtaagga

SEQ ID NO: 152935 - DNA, 15 bp, Homo sapiens
actaaaaatgtaagg

SEQ ID NO: 152936 - DNA, 15 bp, Homo sapiens
tactaaaaatgtaag

SEQ ID NO: 152937 - DNA, 15 bp, Homo sapiens
atactaaaaatgtaa

SEQ ID NO: 152938 - DNA, 15 bp, Homo sapiens
aatactaaaaatgta

SEQ ID NO: 152939 - DNA, 15 bp, Homo sapiens
aaatactaaaaatgt

SEQ ID NO: 152940 - DNA, 15 bp, Homo sapiens
aaaatactaaaaatg

SEQ ID NO: 152941 - DNA, 15 bp, Homo sapiens
taaaatactaaaaat

SEQ ID NO: 152942 - DNA, 15 bp, Homo sapiens
ctaaaatactaaaaa

SEQ ID NO: 152943 - DNA, 15 bp, Homo sapiens
tctaaaatactaaaa

SEQ ID NO: 152944 - DNA, 15 bp, Homo sapiens
ctctaaaatactaaa

SEQ ID NO: 152945 - DNA, 15 bp, Homo sapiens
actctaaaatactaa

SEQ ID NO: 152946 - DNA, 15 bp, Homo sapiens
aactctaaaatacta

SEQ ID NO: 152947 - DNA, 15 bp, Homo sapiens
aaactctaaaatact

SEQ ID NO: 152948 - DNA, 15 bp, Homo sapiens
taaactctaaaatac

SEQ ID NO: 152949 - DNA, 15 bp, Homo sapiens
gtaaactctaaaata

SEQ ID NO: 152950 - DNA, 15 bp, Homo sapiens
tgtaaactctaaaat

SEQ ID NO: 152951 - DNA, 15 bp, Homo sapiens
ttgtaaactctaaaa

SEQ ID NO: 152952 - DNA, 15 bp, Homo sapiens
attgtaaactctaaa

SEQ ID NO: 152953 - DNA, 15 bp, Homo sapiens
cattgtaaactctaa

SEQ ID NO: 152954 - DNA, 15 bp, Homo sapiens
acattgtaaactcta

SEQ ID NO: 152955 - DNA, 15 bp, Homo sapiens
cacattgtaaactct

SEQ ID NO: 152956 - DNA, 15 bp, Homo sapiens
acacattgtaaactc

SEQ ID NO: 152957 - DNA, 15 bp, Homo sapiens
aacacattgtaaact

SEQ ID NO: 152958 - DNA, 15 bp, Homo sapiens
aaacacattgtaaac

SEQ ID NO: 152959 - DNA, 15 bp, Homo sapiens
aaaacacattgtaaa

SEQ ID NO: 152960 - DNA, 15 bp, Homo sapiens
gaaaacacattgtaa

SEQ ID NO: 152961 - DNA, 15 bp, Homo sapiens
agaaaacacattgta

SEQ ID NO: 152962 - DNA, 15 bp, Homo sapiens
gagaaaacacattgt

SEQ ID NO: 152963 - DNA, 15 bp, Homo sapiens
tgagaaaacacattg

SEQ ID NO: 152964 - DNA, 15 bp, Homo sapiens
atgagaaaacacatt

SEQ ID NO: 152965 - DNA, 15 bp, Homo sapiens
tatgagaaaacacat

SEQ ID NO: 152966 - DNA, 15 bp, Homo sapiens
atatgagaaaacaca

SEQ ID NO: 152967 - DNA, 15 bp, Homo sapiens
tatatgagaaaacac

SEQ ID NO: 152968 - DNA, 15 bp, Homo sapiens
atatatgagaaaaca

SEQ ID NO: 152969 - DNA, 15 bp, Homo sapiens
aatatatgagaaaac

SEQ ID NO: 152970 - DNA, 15 bp, Homo sapiens
taatatatgagaaaa

SEQ ID NO: 152971 - DNA, 15 bp, Homo sapiens
gtaatatatgagaaa

SEQ ID NO: 152972 - DNA, 15 bp, Homo sapiens
tgtaatatatgagaa

SEQ ID NO: 152973 - DNA, 15 bp, Homo sapiens
atgtaatatatgaga

SEQ ID NO: 152974 - DNA, 15 bp, Homo sapiens
gatgtaatatatgag

SEQ ID NO: 152975 - DNA, 15 bp, Homo sapiens
tgatgtaatatatga

SEQ ID NO: 152976 - DNA, 15 bp, Homo sapiens
atgatgtaatatatg

SEQ ID NO: 152977 - DNA, 15 bp, Homo sapiens
aatgatgtaatatat

SEQ ID NO: 152978 - DNA, 15 bp, Homo sapiens
taatgatgtaatata

SEQ ID NO: 152979 - DNA, 15 bp, Homo sapiens
ttaatgatgtaatat

SEQ ID NO: 152980 - DNA, 15 bp, Homo sapiens
attaatgatgtaata

SEQ ID NO: 152981 - DNA, 15 bp, Homo sapiens
tattaatgatgtaat

SEQ ID NO: 152982 - DNA, 15 bp, Homo sapiens
ttattaatgatgtaa

SEQ ID NO: 152983 - DNA, 15 bp, Homo sapiens
tttattaatgatgta

SEQ ID NO: 152984 - DNA, 15 bp, Homo sapiens
atttattaatgatgt

SEQ ID NO: 152985 - DNA, 15 bp, Homo sapiens
catttattaatgatg

SEQ ID NO: 152986 - DNA, 15 bp, Homo sapiens
acatttattaatgat

SEQ ID NO: 152987 - DNA, 15 bp, Homo sapiens
tacatttattaatga

SEQ ID NO: 152988 - DNA, 15 bp, Homo sapiens
ttacatttattaatg

SEQ ID NO: 152989 - DNA, 15 bp, Homo sapiens
attacatttattaat

SEQ ID NO: 152990 - DNA, 15 bp, Homo sapiens
tattacatttattaa

SEQ ID NO: 152991 - DNA, 15 bp, Homo sapiens
atattacatttatta

SEQ ID NO: 152992 - DNA, 15 bp, Homo sapiens
aatattacatttatt

SEQ ID NO: 152993 - DNA, 15 bp, Homo sapiens
taatattacatttat

SEQ ID NO: 152994 - DNA, 15 bp, Homo sapiens
ttaatattacattta

SEQ ID NO: 152995 - DNA, 15 bp, Homo sapiens
gttaatattacattt

SEQ ID NO: 152996 - DNA, 15 bp, Homo sapiens
tgttaatattacatt

SEQ ID NO: 152997 - DNA, 15 bp, Homo sapiens
ttgttaatattacat

SEQ ID NO: 152998 - DNA, 15 bp, Homo sapiens
attgttaatattaca

SEQ ID NO: 152999 - DNA, 15 bp, Homo sapiens
tattgttaatattac

SEQ ID NO: 153000 - DNA, 15 bp, Homo sapiens
atattgttaatatta

SEQ ID NO: 153001 - DNA, 15 bp, Homo sapiens
aatattgttaatatt

SEQ ID NO: 153002 - DNA, 15 bp, Homo sapiens
taatattgttaatat

SEQ ID NO: 153003 - DNA, 15 bp, Homo sapiens
ataatattgttaata

SEQ ID NO: 153004 - DNA, 15 bp, Homo sapiens
tataatattgttaat

SEQ ID NO: 153005 - DNA, 15 bp, Homo sapiens
atataatattgttaa

SEQ ID NO: 153006 - DNA, 15 bp, Homo sapiens
aatataatattgtta

SEQ ID NO: 153007 - DNA, 15 bp, Homo sapiens
taatataatattgtt

SEQ ID NO: 153008 - DNA, 15 bp, Homo sapiens
ataatataatattgt

SEQ ID NO: 153009 - DNA, 15 bp, Homo sapiens
gataatataatattg

SEQ ID NO: 153010 - DNA, 15 bp, Homo sapiens
agataatataatatt

SEQ ID NO: 153011 - DNA, 15 bp, Homo sapiens
aagataatataatat

SEQ ID NO: 153012 - DNA, 15 bp, Homo sapiens
caagataatataata

SEQ ID NO: 153013 - DNA, 15 bp, Homo sapiens
acaagataatataat

SEQ ID NO: 153014 - DNA, 15 bp, Homo sapiens
cacaagataatataa

SEQ ID NO: 153015 - DNA, 15 bp, Homo sapiens
acacaagataatata

SEQ ID NO: 153016 - DNA, 15 bp, Homo sapiens
gacacaagataatat

SEQ ID NO: 153017 - DNA, 15 bp, Homo sapiens
ggacacaagataata

SEQ ID NO: 153018 - DNA, 15 bp, Homo sapiens
aggacacaagataat

SEQ ID NO: 153019 - DNA, 15 bp, Homo sapiens
aaggacacaagataa

SEQ ID NO: 153020 - DNA, 15 bp, Homo sapiens
taaggacacaagata

SEQ ID NO: 153021 - DNA, 15 bp, Homo sapiens
ttaaggacacaagat

SEQ ID NO: 153022 - DNA, 15 bp, Homo sapiens
cttaaggacacaaga

SEQ ID NO: 153023 - DNA, 15 bp, Homo sapiens
tcttaaggacacaag

SEQ ID NO: 153024 - DNA, 15 bp, Homo sapiens
ctcttaaggacacaa

SEQ ID NO: 153025 - DNA, 15 bp, Homo sapiens
tctcttaaggacaca

SEQ ID NO: 153026 - DNA, 15 bp, Homo sapiens
atctcttaaggacac

SEQ ID NO: 153027 - DNA, 15 bp, Homo sapiens
tatctcttaaggaca

SEQ ID NO: 153028 - DNA, 15 bp, Homo sapiens
ctatctcttaaggac

SEQ ID NO: 153029 - DNA, 15 bp, Homo sapiens
tctatctcttaagga

SEQ ID NO: 153030 - DNA, 15 bp, Homo sapiens
atctatctcttaagg

SEQ ID NO: 153031 - DNA, 15 bp, Homo sapiens
tatctatctcttaag

SEQ ID NO: 153032 - DNA, 15 bp, Homo sapiens
ctatctatctcttaa

SEQ ID NO: 153033 - DNA, 15 bp, Homo sapiens
cctatctatctctta

SEQ ID NO: 153034 - DNA, 15 bp, Homo sapiens
tcctatctatctctt

SEQ ID NO: 153035 - DNA, 15 bp, Homo sapiens
ttcctatctatctct

SEQ ID NO: 153036 - DNA, 15 bp, Homo sapiens
tttcctatctatctc

SEQ ID NO: 153037 - DNA, 15 bp, Homo sapiens
ctttcctatctatct

SEQ ID NO: 153038 - DNA, 15 bp, Homo sapiens
tctttcctatctatc

SEQ ID NO: 153039 - DNA, 15 bp, Homo sapiens
ttctttcctatctat

SEQ ID NO: 153040 - DNA, 15 bp, Homo sapiens
tttctttcctatcta

SEQ ID NO: 153041 - DNA, 15 bp, Homo sapiens
atttctttcctatct

SEQ ID NO: 153042 - DNA, 15 bp, Homo sapiens
aatttctttcctatc

SEQ ID NO: 153043 - DNA, 15 bp, Homo sapiens
aaatttctttcctat

SEQ ID NO: 153044 - DNA, 15 bp, Homo sapiens
caaatttctttccta

SEQ ID NO: 153045 - DNA, 15 bp, Homo sapiens
acaaatttctttcct

SEQ ID NO: 153046 - DNA, 15 bp, Homo sapiens
aacaaatttctttcc

SEQ ID NO: 153047 - DNA, 15 bp, Homo sapiens
aaacaaatttctttc

SEQ ID NO: 153048 - DNA, 15 bp, Homo sapiens
aaaacaaatttcttt

SEQ ID NO: 153049 - DNA, 15 bp, Homo sapiens
caaaacaaatttctt

SEQ ID NO: 153050 - DNA, 15 bp, Homo sapiens
gcaaaacaaatttct

SEQ ID NO: 153051 - DNA, 15 bp, Homo sapiens
tgcaaaacaaatttc

SEQ ID NO: 153052 - DNA, 15 bp, Homo sapiens
cttgcaaaacaaatt

SEQ ID NO: 153053 - DNA, 15 bp, Homo sapiens
acttgcaaaacaaat

SEQ ID NO: 153054 - DNA, 15 bp, Homo sapiens
gacttgcaaaacaaa

SEQ ID NO: 153055 - DNA, 15 bp, Homo sapiens
tgacttgcaaaacaa

SEQ ID NO: 153056 - DNA, 15 bp, Homo sapiens
ctgacttgcaaaaca

SEQ ID NO: 153057 - DNA, 15 bp, Homo sapiens
gctgacttgcaaaac

SEQ ID NO: 153058 - DNA, 15 bp, Homo sapiens
tgctgacttgcaaaa

SEQ ID NO: 153059 - DNA, 15 bp, Homo sapiens
ttgctgacttgcaaa

SEQ ID NO: 153060 - DNA, 15 bp, Homo sapiens
cttgctgacttgcaa

SEQ ID NO: 153061 - DNA, 15 bp, Homo sapiens
acttgctgacttgca

SEQ ID NO: 153062 - DNA, 15 bp, Homo sapiens
cacttgctgacttgc

SEQ ID NO: 153063 - DNA, 15 bp, Homo sapiens
tcacttgctgacttg

SEQ ID NO: 153064 - DNA, 15 bp, Homo sapiens
ttcacttgctgactt

SEQ ID NO: 153065 - DNA, 15 bp, Homo sapiens
cttcacttgctgact

SEQ ID NO: 153066 - DNA, 15 bp, Homo sapiens
ccttcacttgctgac

SEQ ID NO: 153067 - DNA, 15 bp, Homo sapiens
tccttcacttgctga

SEQ ID NO: 153068 - DNA, 15 bp, Homo sapiens
ttccttcacttgctg

SEQ ID NO: 153069 - DNA, 15 bp, Homo sapiens
gttccttcacttgct

SEQ ID NO: 153070 - DNA, 15 bp, Homo sapiens
tgttccttcacttgc

SEQ ID NO: 153071 - DNA, 15 bp, Homo sapiens
atgttccttcacttg

SEQ ID NO: 153072 - DNA, 15 bp, Homo sapiens
catgttccttcactt

SEQ ID NO: 153073 - DNA, 15 bp, Homo sapiens
gcatgttccttcact

SEQ ID NO: 153074 - DNA, 15 bp, Homo sapiens
ggcatgttccttcac

SEQ ID NO: 153075 - DNA, 15 bp, Homo sapiens
tggcatgttccttca

SEQ ID NO: 153076 - DNA, 15 bp, Homo sapiens
ctggcatgttccttc

SEQ ID NO: 153077 - DNA, 15 bp, Homo sapiens
actggcatgttcctt

SEQ ID NO: 153078 - DNA, 15 bp, Homo sapiens
tactggcatgttcct

SEQ ID NO: 153079 - DNA, 15 bp, Homo sapiens
ctactggcatgttcc

SEQ ID NO: 153080 - DNA, 15 bp, Homo sapiens
actactggcatgttc

SEQ ID NO: 153081 - DNA, 15 bp, Homo sapiens
aactactggcatgtt

SEQ ID NO: 153082 - DNA, 15 bp, Homo sapiens
taactactggcatgt

SEQ ID NO: 153083 - DNA, 15 bp, Homo sapiens
ctaactactggcatg

SEQ ID NO: 153084 - DNA, 15 bp, Homo sapiens
actaactactggcat

SEQ ID NO: 153085 - DNA, 15 bp, Homo sapiens
aactaactactggca

SEQ ID NO: 153086 - DNA, 15 bp, Homo sapiens
caactaactactggc

SEQ ID NO: 153087 - DNA, 15 bp, Homo sapiens
gcaactaactactgg

SEQ ID NO: 153088 - DNA, 15 bp, Homo sapiens
agcaactaactactg

SEQ ID NO: 153089 - DNA, 15 bp, Homo sapiens
gagcaactaactact

SEQ ID NO: 153090 - DNA, 15 bp, Homo sapiens
tgagcaactaactac

SEQ ID NO: 153091 - DNA, 15 bp, Homo sapiens
ctgagcaactaacta

SEQ ID NO: 153092 - DNA, 15 bp, Homo sapiens
gctgagcaactaact

SEQ ID NO: 153093 - DNA, 15 bp, Homo sapiens
agctgagcaactaac

SEQ ID NO: 153094 - DNA, 15 bp, Homo sapiens
tagctgagcaactaa

SEQ ID NO: 153095 - DNA, 15 bp, Homo sapiens
ctagctgagcaacta

SEQ ID NO: 153096 - DNA, 15 bp, Homo sapiens
actagctgagcaact

SEQ ID NO: 153097 - DNA, 15 bp, Homo sapiens
tactagctgagcaac

SEQ ID NO: 153098 - DNA, 15 bp, Homo sapiens
atactagctgagcaa

SEQ ID NO: 153099 - DNA, 15 bp, Homo sapiens
catactagctgagca

SEQ ID NO: 153100 - DNA, 15 bp, Homo sapiens
gcatactagctgagc

SEQ ID NO: 153101 - DNA, 15 bp, Homo sapiens
cgcatactagctgag

SEQ ID NO: 153102 - DNA, 15 bp, Homo sapiens
ccgcatactagctga

SEQ ID NO: 153103 - DNA, 15 bp, Homo sapiens
accgcatactagctg

SEQ ID NO: 153104 - DNA, 15 bp, Homo sapiens
caccgcatactagct

SEQ ID NO: 153105 - DNA, 15 bp, Homo sapiens
gcaccgcatactagc

SEQ ID NO: 153106 - DNA, 15 bp, Homo sapiens
tgcaccgcatactag

SEQ ID NO: 153107 - DNA, 15 bp, Homo sapiens
ctgcaccgcatacta

SEQ ID NO: 153108 - DNA, 15 bp, Homo sapiens
gctgcaccgcatact

SEQ ID NO: 153109 - DNA, 15 bp, Homo sapiens
agctgcaccgcatac

SEQ ID NO: 153110 - DNA, 15 bp, Homo sapiens
aagctgcaccgcata

SEQ ID NO: 153111 - DNA, 15 bp, Homo sapiens
caagctgcaccgcat

SEQ ID NO: 153112 - DNA, 15 bp, Homo sapiens
acaagctgcaccgca

SEQ ID NO: 153113 - DNA, 15 bp, Homo sapiens
cacaagctgcaccgc

SEQ ID NO: 153114 - DNA, 15 bp, Homo sapiens
acacaagctgcaccg

SEQ ID NO: 153115 - DNA, 15 bp, Homo sapiens
aacacaagctgcacc

SEQ ID NO: 153116 - DNA, 15 bp, Homo sapiens
gaacacaagctgcac

SEQ ID NO: 153117 - DNA, 15 bp, Homo sapiens
tgaacacaagctgca

SEQ ID NO: 153118 - DNA, 15 bp, Homo sapiens
ttgaacacaagctgc

SEQ ID NO: 153119 - DNA, 15 bp, Homo sapiens
gttgaacacaagctg

SEQ ID NO: 153120 - DNA, 15 bp, Homo sapiens
tgttgaacacaagct

SEQ ID NO: 153121 - DNA, 15 bp, Homo sapiens
atgttgaacacaagc

SEQ ID NO: 153122 - DNA, 15 bp, Homo sapiens
tatgttgaacacaag

SEQ ID NO: 153123 - DNA, 15 bp, Homo sapiens
ctatgttgaacacaa

SEQ ID NO: 153124 - DNA, 15 bp, Homo sapiens
tctatgttgaacaca

SEQ ID NO: 153125 - DNA, 15 bp, Homo sapiens
atctatgttgaacac

SEQ ID NO: 153126 - DNA, 15 bp, Homo sapiens
aatctatgttgaaca

SEQ ID NO: 153127 - DNA, 15 bp, Homo sapiens
aaatctatgttgaac

SEQ ID NO: 153128 - DNA, 15 bp, Homo sapiens
aaaatctatgttgaa

SEQ ID NO: 153129 - DNA, 15 bp, Homo sapiens
gaaaatctatgttga

SEQ ID NO: 153130 - DNA, 15 bp, Homo sapiens
agaaaatctatgttg

SEQ ID NO: 153131 - DNA, 15 bp, Homo sapiens
cagaaaatctatgtt

SEQ ID NO: 153132 - DNA, 15 bp, Homo sapiens
gcagaaaatctatgt

SEQ ID NO: 153133 - DNA, 15 bp, Homo sapiens
agcagaaaatctatg

SEQ ID NO: 153134 - DNA, 15 bp, Homo sapiens
aagcagaaaatctat

SEQ ID NO: 153135 - DNA, 15 bp, Homo sapiens
gaagcagaaaatcta

SEQ ID NO: 153136 - DNA, 15 bp, Homo sapiens
tgaagcagaaaatct

SEQ ID NO: 153137 - DNA, 15 bp, Homo sapiens
ttgaagcagaaaatc

SEQ ID NO: 153138 - DNA, 15 bp, Homo sapiens
attgaagcagaaaat

SEQ ID NO: 153139 - DNA, 15 bp, Homo sapiens
tattgaagcagaaaa

SEQ ID NO: 153140 - DNA, 15 bp, Homo sapiens
ctattgaagcagaaa

SEQ ID NO: 153141 - DNA, 15 bp, Homo sapiens
gctattgaagcagaa

SEQ ID NO: 153142 - DNA, 15 bp, Homo sapiens
ggctattgaagcaga

SEQ ID NO: 153143 - DNA, 15 bp, Homo sapiens
tggctattgaagcag

SEQ ID NO: 153144 - DNA, 15 bp, Homo sapiens
ctggctattgaagca

SEQ ID NO: 153145 - DNA, 15 bp, Homo sapiens
actggctattgaagc

SEQ ID NO: 153146 - DNA, 15 bp, Homo sapiens
cactggctattgaag

SEQ ID NO: 153147 - DNA, 15 bp, Homo sapiens
acactggctattgaa

SEQ ID NO: 153148 - DNA, 15 bp, Homo sapiens
gacactggctattga

SEQ ID NO: 153149 - DNA, 15 bp, Homo sapiens
agacactggctattg

SEQ ID NO: 153150 - DNA, 15 bp, Homo sapiens
gagacactggctatt

SEQ ID NO: 153151 - DNA, 15 bp, Homo sapiens
agagacactggctat

SEQ ID NO: 153152 - DNA, 15 bp, Homo sapiens
gagagacactggcta

SEQ ID NO: 153153 - DNA, 15 bp, Homo sapiens
agagagacactggct

SEQ ID NO: 153154 - DNA, 15 bp, Homo sapiens
tagagagacactggc

SEQ ID NO: 153155 - DNA, 15 bp, Homo sapiens
gtagagagacactgg

SEQ ID NO: 153156 - DNA, 15 bp, Homo sapiens
ggtagagagacactg

SEQ ID NO: 153157 - DNA, 15 bp, Homo sapiens
aggtagagagacact

SEQ ID NO: 153158 - DNA, 15 bp, Homo sapiens
caggtagagagacac

SEQ ID NO: 153159 - DNA, 15 bp, Homo sapiens
acaggtagagagaca

SEQ ID NO: 153160 - DNA, 15 bp, Homo sapiens
tacaggtagagagac

SEQ ID NO: 153161 - DNA, 15 bp, Homo sapiens
ttacaggtagagaga

SEQ ID NO: 153162 - DNA, 15 bp, Homo sapiens
attacaggtagagag

SEQ ID NO: 153163 - DNA, 15 bp, Homo sapiens
aattacaggtagaga

SEQ ID NO: 153164 - DNA, 15 bp, Homo sapiens
aaattacaggtagag

SEQ ID NO: 153165 - DNA, 15 bp, Homo sapiens
aaaattacaggtaga

SEQ ID NO: 153166 - DNA, 15 bp, Homo sapiens
taaaattacaggtag

SEQ ID NO: 153167 - DNA, 15 bp, Homo sapiens
ctaaaattacaggta

SEQ ID NO: 153168 - DNA, 15 bp, Homo sapiens
tctaaaattacaggt

SEQ ID NO: 153169 - DNA, 15 bp, Homo sapiens
atctaaaattacagg

SEQ ID NO: 153170 - DNA, 15 bp, Homo sapiens
tatctaaaattacag

SEQ ID NO: 153171 - DNA, 15 bp, Homo sapiens
ctatctaaaattaca

SEQ ID NO: 153172 - DNA, 15 bp, Homo sapiens
tctatctaaaattac

SEQ ID NO: 153173 - DNA, 15 bp, Homo sapiens
ctctatctaaaatta

SEQ ID NO: 153174 - DNA, 15 bp, Homo sapiens
tctctatctaaaatt

SEQ ID NO: 153175 - DNA, 15 bp, Homo sapiens
ttctctatctaaaat

SEQ ID NO: 153176 - DNA, 15 bp, Homo sapiens
attctctatctaaaa

SEQ ID NO: 153177 - DNA, 15 bp, Homo sapiens
aattctctatctaaa

SEQ ID NO: 153178 - DNA, 15 bp, Homo sapiens
aaattctctatctaa

SEQ ID NO: 153179 - DNA, 15 bp, Homo sapiens
aaaattctctatcta

SEQ ID NO: 153180 - DNA, 15 bp, Homo sapiens
aaaaattctctatct

SEQ ID NO: 153181 - DNA, 15 bp, Homo sapiens
caaaaattctctatc

SEQ ID NO: 153182 - DNA, 15 bp, Homo sapiens
ccaaaaattctctat

SEQ ID NO: 153183 - DNA, 15 bp, Homo sapiens
tccaaaaattctcta

SEQ ID NO: 153184 - DNA, 15 bp, Homo sapiens
ttccaaaaattctct

SEQ ID NO: 153185 - DNA, 15 bp, Homo sapiens
attccaaaaattctc

SEQ ID NO: 153186 - DNA, 15 bp, Homo sapiens
aattccaaaaattct

SEQ ID NO: 153187 - DNA, 15 bp, Homo sapiens
taattccaaaaattc

SEQ ID NO: 153188 - DNA, 15 bp, Homo sapiens
ataattccaaaaatt

SEQ ID NO: 153189 - DNA, 15 bp, Homo sapiens
tataattccaaaaat

SEQ ID NO: 153190 - DNA, 15 bp, Homo sapiens
atataattccaaaaa

SEQ ID NO: 153191 - DNA, 15 bp, Homo sapiens
aatataattccaaaa

SEQ ID NO: 153192 - DNA, 15 bp, Homo sapiens
caatataattccaaa

SEQ ID NO: 153193 - DNA, 15 bp, Homo sapiens
ccaatataattccaa

SEQ ID NO: 153194 - DNA, 15 bp, Homo sapiens
cccaatataattcca

SEQ ID NO: 153195 - DNA, 15 bp, Homo sapiens
tcccaatataattcc

SEQ ID NO: 153196 - DNA, 15 bp, Homo sapiens
atcccaatataattc

SEQ ID NO: 153197 - DNA, 15 bp, Homo sapiens
tatcccaatataatt

SEQ ID NO: 153198 - DNA, 15 bp, Homo sapiens
ttatcccaatataat

SEQ ID NO: 153199 - DNA, 15 bp, Homo sapiens
tttatcccaatataa

SEQ ID NO: 153200 - DNA, 15 bp, Homo sapiens
ttttatcccaatata

SEQ ID NO: 153201 - DNA, 15 bp, Homo sapiens
attttatcccaatat

SEQ ID NO: 153202 - DNA, 15 bp, Homo sapiens
cattttatcccaata

SEQ ID NO: 153203 - DNA, 15 bp, Homo sapiens
ccattttatcccaat

SEQ ID NO: 153204 - DNA, 15 bp, Homo sapiens
cccattttatcccaa

SEQ ID NO: 153205 - DNA, 15 bp, Homo sapiens
acccattttatccca

SEQ ID NO: 153206 - DNA, 15 bp, Homo sapiens
gacccattttatccc

SEQ ID NO: 153207 - DNA, 15 bp, Homo sapiens
tgacccattttatcc

SEQ ID NO: 153208 - DNA, 15 bp, Homo sapiens
gtgacccattttatc

SEQ ID NO: 153209 - DNA, 15 bp, Homo sapiens
agtgacccattttat

SEQ ID NO: 153210 - DNA, 15 bp, Homo sapiens
gagtgacccatttta

SEQ ID NO: 153211 - DNA, 15 bp, Homo sapiens
tgagtgacccatttt

SEQ ID NO: 153212 - DNA, 15 bp, Homo sapiens
ctgagtgacccattt

SEQ ID NO: 153213 - DNA, 15 bp, Homo sapiens
actgagtgacccatt

SEQ ID NO: 153214 - DNA, 15 bp, Homo sapiens
tactgagtgacccat

SEQ ID NO: 153215 - DNA, 15 bp, Homo sapiens
atactgagtgaccca

SEQ ID NO: 153216 - DNA, 15 bp, Homo sapiens
tatactgagtgaccc

SEQ ID NO: 153217 - DNA, 15 bp, Homo sapiens
ctatactgagtgacc

SEQ ID NO: 153218 - DNA, 15 bp, Homo sapiens
tctatactgagtgac

SEQ ID NO: 153219 - DNA, 15 bp, Homo sapiens
ttctatactgagtga

SEQ ID NO: 153220 - DNA, 15 bp, Homo sapiens
cttctatactgagtg

SEQ ID NO: 153221 - DNA, 15 bp, Homo sapiens
tcttctatactgagt

SEQ ID NO: 153222 - DNA, 15 bp, Homo sapiens
atcttctatactgag

SEQ ID NO: 153223 - DNA, 15 bp, Homo sapiens
tatcttctatactga

SEQ ID NO: 153224 - DNA, 15 bp, Homo sapiens
atatcttctatactg

SEQ ID NO: 153225 - DNA, 15 bp, Homo sapiens
tatatcttctatact

SEQ ID NO: 153226 - DNA, 15 bp, Homo sapiens
ctatatcttctatac

SEQ ID NO: 153227 - DNA, 15 bp, Homo sapiens
tctatatcttctata

SEQ ID NO: 153228 - DNA, 15 bp, Homo sapiens
ttctatatcttctat

SEQ ID NO: 153229 - DNA, 15 bp, Homo sapiens
tttctatatcttcta

SEQ ID NO: 153230 - DNA, 15 bp, Homo sapiens
ctttctatatcttct

SEQ ID NO: 153231 - DNA, 15 bp, Homo sapiens
tctttctatatcttc

SEQ ID NO: 153232 - DNA, 15 bp, Homo sapiens
ctctttctatatctt

SEQ ID NO: 153233 - DNA, 15 bp, Homo sapiens
tctctttctatatct

SEQ ID NO: 153234 - DNA, 15 bp, Homo sapiens
ctctctttctatatc

SEQ ID NO: 153235 - DNA, 15 bp, Homo sapiens
tctctctttctatat

SEQ ID NO: 153236 - DNA, 15 bp, Homo sapiens
atctctctttctata

SEQ ID NO: 153237 - DNA, 15 bp, Homo sapiens
aatctctctttctat

SEQ ID NO: 153238 - DNA, 15 bp, Homo sapiens
taatctctctttcta

SEQ ID NO: 153239 - DNA, 15 bp, Homo sapiens
gtaatctctctttct

SEQ ID NO: 153240 - DNA, 15 bp, Homo sapiens
tgtaatctctctttc

SEQ ID NO: 153241 - DNA, 15 bp, Homo sapiens
atgtaatctctcttt

SEQ ID NO: 153242 - DNA, 15 bp, Homo sapiens
aatgtaatctctctt

SEQ ID NO: 153243 - DNA, 15 bp, Homo sapiens
taatgtaatctctct

SEQ ID NO: 153244 - DNA, 15 bp, Homo sapiens
ttaatgtaatctctc

SEQ ID NO: 153245 - DNA, 15 bp, Homo sapiens
gttaatgtaatctct

SEQ ID NO: 153246 - DNA, 15 bp, Homo sapiens
agttaatgtaatctc

SEQ ID NO: 153247 - DNA, 15 bp, Homo sapiens
tagttaatgtaatct

SEQ ID NO: 153248 - DNA, 15 bp, Homo sapiens
ttagttaatgtaatc

SEQ ID NO: 153249 - DNA, 15 bp, Homo sapiens
cttagttaatgtaat

SEQ ID NO: 153250 - DNA, 15 bp, Homo sapiens
acttagttaatgtaa

SEQ ID NO: 153251 - DNA, 15 bp, Homo sapiens
tacttagttaatgta

SEQ ID NO: 153252 - DNA, 15 bp, Homo sapiens
ttacttagttaatgt

SEQ ID NO: 153253 - DNA, 15 bp, Homo sapiens
attacttagttaatg

SEQ ID NO: 153254 - DNA, 15 bp, Homo sapiens
tattacttagttaat

SEQ ID NO: 153255 - DNA, 15 bp, Homo sapiens
ctattacttagttaa

SEQ ID NO: 153256 - DNA, 15 bp, Homo sapiens
tctattacttagtta

SEQ ID NO: 153257 - DNA, 15 bp, Homo sapiens
atctattacttagtt

SEQ ID NO: 153258 - DNA, 15 bp, Homo sapiens
tatctattacttagt

SEQ ID NO: 153259 - DNA, 15 bp, Homo sapiens
atatctattacttag

SEQ ID NO: 153260 - DNA, 15 bp, Homo sapiens
aatatctattactta

SEQ ID NO: 153261 - DNA, 15 bp, Homo sapiens
caatatctattactt

SEQ ID NO: 153262 - DNA, 15 bp, Homo sapiens
acaatatctattact

SEQ ID NO: 153263 - DNA, 15 bp, Homo sapiens
aacaatatctattac

SEQ ID NO: 153264 - DNA, 15 bp, Homo sapiens
aaacaatatctatta

SEQ ID NO: 153265 - DNA, 15 bp, Homo sapiens
aaaacaatatctatt

SEQ ID NO: 153266 - DNA, 15 bp, Homo sapiens
caaaacaatatctat

SEQ ID NO: 153267 - DNA, 15 bp, Homo sapiens
acaaaacaatatcta

SEQ ID NO: 153268 - DNA, 15 bp, Homo sapiens
aacaaaacaatatct

SEQ ID NO: 153269 - DNA, 15 bp, Homo sapiens
gaacaaaacaatatc

SEQ ID NO: 153270 - DNA, 15 bp, Homo sapiens
agaacaaaacaatat

SEQ ID NO: 153271 - DNA, 15 bp, Homo sapiens
cagaacaaaacaata

SEQ ID NO: 153272 - DNA, 15 bp, Homo sapiens
tcagaacaaaacaat

SEQ ID NO: 153273 - DNA, 15 bp, Homo sapiens
ttcagaacaaaacaa

SEQ ID NO: 153274 - DNA, 15 bp, Homo sapiens
attcagaacaaaaca

SEQ ID NO: 153275 - DNA, 15 bp, Homo sapiens
aattcagaacaaaac

SEQ ID NO: 153276 - DNA, 15 bp, Homo sapiens
aaataattcagaaca

SEQ ID NO: 153277 - DNA, 15 bp, Homo sapiens
gaaataattcagaac

SEQ ID NO: 153278 - DNA, 15 bp, Homo sapiens
ggaaataattcagaa

SEQ ID NO: 153279 - DNA, 15 bp, Homo sapiens
tggaaataattcaga

SEQ ID NO: 153280 - DNA, 15 bp, Homo sapiens
atggaaataattcag

SEQ ID NO: 153281 - DNA, 15 bp, Homo sapiens
tatggaaataattca

SEQ ID NO: 153282 - DNA, 15 bp, Homo sapiens
atatggaaataattc

SEQ ID NO: 153283 - DNA, 15 bp, Homo sapiens
gcatatggaaataat

SEQ ID NO: 153284 - DNA, 15 bp, Homo sapiens
tgcatatggaaataa

SEQ ID NO: 153285 - DNA, 15 bp, Homo sapiens
atgcatatggaaata

SEQ ID NO: 153286 - DNA, 15 bp, Homo sapiens
aatgcatatggaaat

SEQ ID NO: 153287 - DNA, 15 bp, Homo sapiens
aaatgcatatggaaa

SEQ ID NO: 153288 - DNA, 15 bp, Homo sapiens
gaaatgcatatggaa

SEQ ID NO: 153289 - DNA, 15 bp, Homo sapiens
ggaaatgcatatgga

SEQ ID NO: 153290 - DNA, 15 bp, Homo sapiens
aggaaatgcatatgg

SEQ ID NO: 153291 - DNA, 15 bp, Homo sapiens
aaggaaatgcatatg

SEQ ID NO: 153292 - DNA, 15 bp, Homo sapiens
caaggaaatgcatat

SEQ ID NO: 153293 - DNA, 15 bp, Homo sapiens
acaaggaaatgcata

SEQ ID NO: 153294 - DNA, 15 bp, Homo sapiens
gacaaggaaatgcat

SEQ ID NO: 153295 - DNA, 15 bp, Homo sapiens
agacaaggaaatgca

SEQ ID NO: 153296 - DNA, 15 bp, Homo sapiens
tagacaaggaaatgc

SEQ ID NO: 153297 - DNA, 15 bp, Homo sapiens
ttagacaaggaaatg

SEQ ID NO: 153298 - DNA, 15 bp, Homo sapiens
tttagacaaggaaat

SEQ ID NO: 153299 - DNA, 15 bp, Homo sapiens
ctttagacaaggaaa

SEQ ID NO: 153300 - DNA, 15 bp, Homo sapiens
tctttagacaaggaa

SEQ ID NO: 153301 - DNA, 15 bp, Homo sapiens
ttctttagacaagga

SEQ ID NO: 153302 - DNA, 15 bp, Homo sapiens
tttctttagacaagg

SEQ ID NO: 153303 - DNA, 15 bp, Homo sapiens
atttctttagacaag

SEQ ID NO: 153304 - DNA, 15 bp, Homo sapiens
aatttctttagacaa

SEQ ID NO: 153305 - DNA, 15 bp, Homo sapiens
aaatttctttagaca

SEQ ID NO: 153306 - DNA, 15 bp, Homo sapiens
gaaatttctttagac

SEQ ID NO: 153307 - DNA, 15 bp, Homo sapiens
tgaaatttctttaga

SEQ ID NO: 153308 - DNA, 15 bp, Homo sapiens
gtgaaatttctttag

SEQ ID NO: 153309 - DNA, 15 bp, Homo sapiens
ggtgaaatttcttta

SEQ ID NO: 153310 - DNA, 15 bp, Homo sapiens
aggtgaaatttcttt

SEQ ID NO: 153311 - DNA, 15 bp, Homo sapiens
caggtgaaatttctt

SEQ ID NO: 153312 - DNA, 15 bp, Homo sapiens
gcaggtgaaatttct

SEQ ID NO: 153313 - DNA, 15 bp, Homo sapiens
tgcaggtgaaatttc

SEQ ID NO: 153314 - DNA, 15 bp, Homo sapiens
ctgcaggtgaaattt

SEQ ID NO: 153315 - DNA, 15 bp, Homo sapiens
actgcaggtgaaatt

SEQ ID NO: 153316 - DNA, 15 bp, Homo sapiens
gactgcaggtgaaat

SEQ ID NO: 153317 - DNA, 15 bp, Homo sapiens
agactgcaggtgaaa

SEQ ID NO: 153318 - DNA, 15 bp, Homo sapiens
gagactgcaggtgaa

SEQ ID NO: 153319 - DNA, 15 bp, Homo sapiens
ggagactgcaggtga

SEQ ID NO: 153320 - DNA, 15 bp, Homo sapiens
aggagactgcaggtg

SEQ ID NO: 153321 - DNA, 15 bp, Homo sapiens
aaggagactgcaggt

SEQ ID NO: 153322 - DNA, 15 bp, Homo sapiens
aaaggagactgcagg

SEQ ID NO: 153323 - DNA, 15 bp, Homo sapiens
taaaggagactgcag

SEQ ID NO: 153324 - DNA, 15 bp, Homo sapiens
ttaaaggagactgca

SEQ ID NO: 153325 - DNA, 15 bp, Homo sapiens
tttaaaggagactgc

SEQ ID NO: 153326 - DNA, 15 bp, Homo sapiens
ttttaaaggagactg

SEQ ID NO: 153327 - DNA, 15 bp, Homo sapiens
gttttaaaggagact

SEQ ID NO: 153328 - DNA, 15 bp, Homo sapiens
tgttttaaaggagac

SEQ ID NO: 153329 - DNA, 15 bp, Homo sapiens
atgttttaaaggaga

SEQ ID NO: 153330 - DNA, 15 bp, Homo sapiens
catgttttaaaggag

SEQ ID NO: 153331 - DNA, 15 bp, Homo sapiens
tcatgttttaaagga

SEQ ID NO: 153332 - DNA, 15 bp, Homo sapiens
ctcatgttttaaagg

SEQ ID NO: 153333 - DNA, 15 bp, Homo sapiens
gctcatgttttaaag

SEQ ID NO: 153334 - DNA, 15 bp, Homo sapiens
agctcatgttttaaa

SEQ ID NO: 153335 - DNA, 15 bp, Homo sapiens
cagctcatgttttaa

SEQ ID NO: 153336 - DNA, 15 bp, Homo sapiens
ccagctcatgtttta

SEQ ID NO: 153337 - DNA, 15 bp, Homo sapiens
tccagctcatgtttt

SEQ ID NO: 153338 - DNA, 15 bp, Homo sapiens
ctccagctcatgttt

SEQ ID NO: 153339 - DNA, 15 bp, Homo sapiens
gctccagctcatgtt

SEQ ID NO: 153340 - DNA, 15 bp, Homo sapiens
tgctccagctcatgt

SEQ ID NO: 153341 - DNA, 15 bp, Homo sapiens
atgctccagctcatg

SEQ ID NO: 153342 - DNA, 15 bp, Homo sapiens
catgctccagctcat

SEQ ID NO: 153343 - DNA, 15 bp, Homo sapiens
tcatgctccagctca

SEQ ID NO: 153344 - DNA, 15 bp, Homo sapiens
ctcatgctccagctc

SEQ ID NO: 153345 - DNA, 15 bp, Homo sapiens
tctcatgctccagct

SEQ ID NO: 153346 - DNA, 15 bp, Homo sapiens
ttctcatgctccagc

SEQ ID NO: 153347 - DNA, 15 bp, Homo sapiens
gttctcatgctccag

SEQ ID NO: 153348 - DNA, 15 bp, Homo sapiens
tgttctcatgctcca

SEQ ID NO: 153349 - DNA, 15 bp, Homo sapiens
atgttctcatgctcc

SEQ ID NO: 153350 - DNA, 15 bp, Homo sapiens
aatgttctcatgctc

SEQ ID NO: 153351 - DNA, 15 bp, Homo sapiens
gaatgttctcatgct

SEQ ID NO: 153352 - DNA, 15 bp, Homo sapiens
ggaatgttctcatgc

SEQ ID NO: 153353 - DNA, 15 bp, Homo sapiens
tggaatgttctcatg

SEQ ID NO: 153354 - DNA, 15 bp, Homo sapiens
atggaatgttctcat

SEQ ID NO: 153355 - DNA, 15 bp, Homo sapiens
catggaatgttctca

SEQ ID NO: 153356 - DNA, 15 bp, Homo sapiens
acatggaatgttctc

SEQ ID NO: 153357 - DNA, 15 bp, Homo sapiens
aacatggaatgttct

SEQ ID NO: 153358 - DNA, 15 bp, Homo sapiens
gaacatggaatgttc

SEQ ID NO: 153359 - DNA, 15 bp, Homo sapiens
ggaacatggaatgtt

SEQ ID NO: 153360 - DNA, 15 bp, Homo sapiens
aggaacatggaatgt

SEQ ID NO: 153361 - DNA, 15 bp, Homo sapiens
aaggaacatggaatg

SEQ ID NO: 153362 - DNA, 15 bp, Homo sapiens
aaaggaacatggaat

SEQ ID NO: 153363 - DNA, 15 bp, Homo sapiens
taaaggaacatggaa

SEQ ID NO: 153364 - DNA, 15 bp, Homo sapiens
ttaaaggaacatgga

SEQ ID NO: 153365 - DNA, 15 bp, Homo sapiens
tttaaaggaacatgg

SEQ ID NO: 153366 - DNA, 15 bp, Homo sapiens
ttttaaaggaacatg

SEQ ID NO: 153367 - DNA, 15 bp, Homo sapiens
gttttaaaggaacat

SEQ ID NO: 153368 - DNA, 15 bp, Homo sapiens
tgttttaaaggaaca

SEQ ID NO: 153369 - DNA, 15 bp, Homo sapiens
atgttttaaaggaac

SEQ ID NO: 153370 - DNA, 15 bp, Homo sapiens
catgttttaaaggaa

SEQ ID NO: 153371 - DNA, 15 bp, Homo sapiens
ccatgttttaaagga

SEQ ID NO: 153372 - DNA, 15 bp, Homo sapiens
tccatgttttaaagg

SEQ ID NO: 153373 - DNA, 15 bp, Homo sapiens
ttccatgttttaaag

SEQ ID NO: 153374 - DNA, 15 bp, Homo sapiens
attccatgttttaaa

SEQ ID NO: 153375 - DNA, 15 bp, Homo sapiens
aattccatgttttaa

SEQ ID NO: 153376 - DNA, 15 bp, Homo sapiens
gaattccatgtttta

SEQ ID NO: 153377 - DNA, 15 bp, Homo sapiens
agaattccatgtttt

SEQ ID NO: 153378 - DNA, 15 bp, Homo sapiens
cagaattccatgttt

SEQ ID NO: 153379 - DNA, 15 bp, Homo sapiens
ccagaattccatgtt

SEQ ID NO: 153380 - DNA, 15 bp, Homo sapiens
tccagaattccatgt

SEQ ID NO: 153381 - DNA, 15 bp, Homo sapiens
ctccagaattccatg

SEQ ID NO: 153382 - DNA, 15 bp, Homo sapiens
tctccagaattccat

SEQ ID NO: 153383 - DNA, 15 bp, Homo sapiens
ttctccagaattcca

SEQ ID NO: 153384 - DNA, 15 bp, Homo sapiens
attctccagaattcc

SEQ ID NO: 153385 - DNA, 15 bp, Homo sapiens
cattctccagaattc

SEQ ID NO: 153386 - DNA, 15 bp, Homo sapiens
tcattctccagaatt

SEQ ID NO: 153387 - DNA, 15 bp, Homo sapiens
ctcattctccagaat

SEQ ID NO: 153388 - DNA, 15 bp, Homo sapiens
cctcattctccagaa

SEQ ID NO: 153389 - DNA, 15 bp, Homo sapiens
tcctcattctccaga

SEQ ID NO: 153390 - DNA, 15 bp, Homo sapiens
ctcctcattctccag

SEQ ID NO: 153391 - DNA, 15 bp, Homo sapiens
tctcctcattctcca

SEQ ID NO: 153392 - DNA, 15 bp, Homo sapiens
atctcctcattctcc

SEQ ID NO: 153393 - DNA, 15 bp, Homo sapiens
catctcctcattctc

SEQ ID NO: 153394 - DNA, 15 bp, Homo sapiens
acatctcctcattct

SEQ ID NO: 153395 - DNA, 15 bp, Homo sapiens
aacatctcctcattc

SEQ ID NO: 153396 - DNA, 15 bp, Homo sapiens
caacatctcctcatt

SEQ ID NO: 153397 - DNA, 15 bp, Homo sapiens
ccaacatctcctcat

SEQ ID NO: 153398 - DNA, 15 bp, Homo sapiens
tccaacatctcctca

SEQ ID NO: 153399 - DNA, 15 bp, Homo sapiens
ttccaacatctcctc

SEQ ID NO: 153400 - DNA, 15 bp, Homo sapiens
tttccaacatctcct

SEQ ID NO: 153401 - DNA, 15 bp, Homo sapiens
atttccaacatctcc

SEQ ID NO: 153402 - DNA, 15 bp, Homo sapiens
gatttccaacatctc

SEQ ID NO: 153403 - DNA, 15 bp, Homo sapiens
tgatttccaacatct

SEQ ID NO: 153404 - DNA, 15 bp, Homo sapiens
atgatttccaacatc

SEQ ID NO: 153405 - DNA, 15 bp, Homo sapiens
gatgatttccaacat

SEQ ID NO: 153406 - DNA, 15 bp, Homo sapiens
agatgatttccaaca

SEQ ID NO: 153407 - DNA, 15 bp, Homo sapiens
cagatgatttccaac

SEQ ID NO: 153408 - DNA, 15 bp, Homo sapiens
tcagatgatttccaa

SEQ ID NO: 153409 - DNA, 15 bp, Homo sapiens
atcagatgatttcca

SEQ ID NO: 153410 - DNA, 15 bp, Homo sapiens
aatcagatgatttcc

SEQ ID NO: 153411 - DNA, 15 bp, Homo sapiens
gaatcagatgatttc

SEQ ID NO: 153412 - DNA, 15 bp, Homo sapiens
tgaatcagatgattt

SEQ ID NO: 153413 - DNA, 15 bp, Homo sapiens
ttgaatcagatgatt

SEQ ID NO: 153414 - DNA, 15 bp, Homo sapiens
gttgaatcagatgat

SEQ ID NO: 153415 - DNA, 15 bp, Homo sapiens
ggttgaatcagatga

SEQ ID NO: 153416 - DNA, 15 bp, Homo sapiens
tggttgaatcagatg

SEQ ID NO: 153417 - DNA, 15 bp, Homo sapiens
atggttgaatcagat

SEQ ID NO: 153418 - DNA, 15 bp, Homo sapiens
aatggttgaatcaga

SEQ ID NO: 153419 - DNA, 15 bp, Homo sapiens
aaatggttgaatcag

SEQ ID NO: 153420 - DNA, 15 bp, Homo sapiens
gaaatggttgaatca

SEQ ID NO: 153421 - DNA, 15 bp, Homo sapiens
tgaaatggttgaatc

SEQ ID NO: 153422 - DNA, 15 bp, Homo sapiens
atgaaatggttgaat

SEQ ID NO: 153423 - DNA, 15 bp, Homo sapiens
aatgaaatggttgaa

SEQ ID NO: 153424 - DNA, 15 bp, Homo sapiens
aaatgaaatggttga

SEQ ID NO: 153425 - DNA, 15 bp, Homo sapiens
aaaatgaaatggttg

SEQ ID NO: 153426 - DNA, 15 bp, Homo sapiens
caaaatgaaatggtt

SEQ ID NO: 153427 - DNA, 15 bp, Homo sapiens
ccaaaatgaaatggt

SEQ ID NO: 153428 - DNA, 15 bp, Homo sapiens
tccaaaatgaaatgg

SEQ ID NO: 153429 - DNA, 15 bp, Homo sapiens
gtccaaaatgaaatg

SEQ ID NO: 153430 - DNA, 15 bp, Homo sapiens
tgtccaaaatgaaat

SEQ ID NO: 153431 - DNA, 15 bp, Homo sapiens
atgtccaaaatgaaa

SEQ ID NO: 153432 - DNA, 15 bp, Homo sapiens
tatgtccaaaatgaa

SEQ ID NO: 153433 - DNA, 15 bp, Homo sapiens
ttatgtccaaaatga

SEQ ID NO: 153434 - DNA, 15 bp, Homo sapiens
cttatgtccaaaatg

SEQ ID NO: 153435 - DNA, 15 bp, Homo sapiens
ccttatgtccaaaat

SEQ ID NO: 153436 - DNA, 15 bp, Homo sapiens
tccttatgtccaaaa

SEQ ID NO: 153437 - DNA, 15 bp, Homo sapiens
ttccttatgtccaaa

SEQ ID NO: 153438 - DNA, 15 bp, Homo sapiens
tttccttatgtccaa

SEQ ID NO: 153439 - DNA, 15 bp, Homo sapiens
gtttccttatgtcca

SEQ ID NO: 153440 - DNA, 15 bp, Homo sapiens
tgtttccttatgtcc

SEQ ID NO: 153441 - DNA, 15 bp, Homo sapiens
ctgtttccttatgtc

SEQ ID NO: 153442 - DNA, 15 bp, Homo sapiens
tctgtttccttatgt

SEQ ID NO: 153443 - DNA, 15 bp, Homo sapiens
ctctgtttccttatg

SEQ ID NO: 153444 - DNA, 15 bp, Homo sapiens
tctctgtttccttat

SEQ ID NO: 153445 - DNA, 15 bp, Homo sapiens
atctctgtttcctta

SEQ ID NO: 153446 - DNA, 15 bp, Homo sapiens
tatctctgtttcctt

SEQ ID NO: 153447 - DNA, 15 bp, Homo sapiens
ctatctctgtttcct

SEQ ID NO: 153448 - DNA, 15 bp, Homo sapiens
actatctctgtttcc

SEQ ID NO: 153449 - DNA, 15 bp, Homo sapiens
gactatctctgtttc

SEQ ID NO: 153450 - DNA, 15 bp, Homo sapiens
tagactatctctgtt

SEQ ID NO: 153451 - DNA, 15 bp, Homo sapiens
atagactatctctgt

SEQ ID NO: 153452 - DNA, 15 bp, Homo sapiens
tatagactatctctg

SEQ ID NO: 153453 - DNA, 15 bp, Homo sapiens
ttatagactatctct

SEQ ID NO: 153454 - DNA, 15 bp, Homo sapiens
attatagactatctc

SEQ ID NO: 153455 - DNA, 15 bp, Homo sapiens
cattatagactatct

SEQ ID NO: 153456 - DNA, 15 bp, Homo sapiens
ccattatagactatc

SEQ ID NO: 153457 - DNA, 15 bp, Homo sapiens
tccattatagactat

SEQ ID NO: 153458 - DNA, 15 bp, Homo sapiens
atccattatagacta

SEQ ID NO: 153459 - DNA, 15 bp, Homo sapiens
catccattatagact

SEQ ID NO: 153460 - DNA, 15 bp, Homo sapiens
acatccattatagac

SEQ ID NO: 153461 - DNA, 15 bp, Homo sapiens
aacatccattataga

SEQ ID NO: 153462 - DNA, 15 bp, Homo sapiens
aaacatccattatag

SEQ ID NO: 153463 - DNA, 15 bp, Homo sapiens
aaaacatccattata

SEQ ID NO: 153464 - DNA, 15 bp, Homo sapiens
taaaacatccattat

SEQ ID NO: 153465 - DNA, 15 bp, Homo sapiens
ataaaacatccatta

SEQ ID NO: 153466 - DNA, 15 bp, Homo sapiens
aataaaacatccatt

SEQ ID NO: 153467 - DNA, 15 bp, Homo sapiens
caataaaacatccat

SEQ ID NO: 153468 - DNA, 15 bp, Homo sapiens
gcaataaaacatcca

SEQ ID NO: 153469 - DNA, 15 bp, Homo sapiens
agcaataaaacatcc

SEQ ID NO: 153470 - DNA, 15 bp, Homo sapiens
cagcaataaaacatc

SEQ ID NO: 153471 - DNA, 15 bp, Homo sapiens
tcagcaataaaacat

SEQ ID NO: 153472 - DNA, 15 bp, Homo sapiens
gtcagcaataaaaca

SEQ ID NO: 153473 - DNA, 15 bp, Homo sapiens
tgtcagcaataaaac

SEQ ID NO: 153474 - DNA, 15 bp, Homo sapiens
ctgtcagcaataaaa

SEQ ID NO: 153475 - DNA, 15 bp, Homo sapiens
gctgtcagcaataaa

SEQ ID NO: 153476 - DNA, 15 bp, Homo sapiens
agctgtcagcaataa

SEQ ID NO: 153477 - DNA, 15 bp, Homo sapiens
aagctgtcagcaata

SEQ ID NO: 153478 - DNA, 15 bp, Homo sapiens
aaagctgtcagcaat

SEQ ID NO: 153479 - DNA, 15 bp, Homo sapiens
aaaagctgtcagcaa

SEQ ID NO: 153480 - DNA, 15 bp, Homo sapiens
aaaaagctgtcagca

SEQ ID NO: 153481 - DNA, 15 bp, Homo sapiens
aaaaaagctgtcagc

SEQ ID NO: 153482 - DNA, 15 bp, Homo sapiens
aaaaaaagctgtcag

SEQ ID NO: 153483 - DNA, 15 bp, Homo sapiens
aaaaaaaagctgtca

SEQ ID NO: 153484 - DNA, 15 bp, Homo sapiens
aaaaaaaaagctgtc

SEQ ID NO: 153485 - DNA, 15 bp, Homo sapiens
aaaaaaaaaagctgt

SEQ ID NO: 153486 - DNA, 15 bp, Homo sapiens
aaaaaaaaaaagctg

SEQ ID NO: 153487 - DNA, 15 bp, Homo sapiens
gaaaaaaaaaaagct

SEQ ID NO: 153488 - DNA, 15 bp, Homo sapiens
agaaaaaaaaaaagc

SEQ ID NO: 153489 - DNA, 15 bp, Homo sapiens
aagaaaaaaaaaaag

SEQ ID NO: 153490 - DNA, 15 bp, Homo sapiens
aaaaaaagaaaaaaa

SEQ ID NO: 153491 - DNA, 15 bp, Homo sapiens
caaaaaaagaaaaaa

SEQ ID NO: 153492 - DNA, 15 bp, Homo sapiens
tcaaaaaaagaaaaa

SEQ ID NO: 153493 - DNA, 15 bp, Homo sapiens
ctcaaaaaaagaaaa

SEQ ID NO: 153494 - DNA, 15 bp, Homo sapiens
tctcaaaaaaagaaa

SEQ ID NO: 153495 - DNA, 15 bp, Homo sapiens
gtctcaaaaaaagaa

SEQ ID NO: 153496 - DNA, 15 bp, Homo sapiens
tgtctcaaaaaaaga

SEQ ID NO: 153497 - DNA, 15 bp, Homo sapiens
ctgtctcaaaaaaag

SEQ ID NO: 153498 - DNA, 15 bp, Homo sapiens
gagaccctgtctcaa

SEQ ID NO: 153499 - DNA, 15 bp, Homo sapiens
agagaccctgtctca

SEQ ID NO: 153500 - DNA, 15 bp, Homo sapiens
cagagaccctgtctc

SEQ ID NO: 153501 - DNA, 15 bp, Homo sapiens
acagagaccctgtct

SEQ ID NO: 153502 - DNA, 15 bp, Homo sapiens
gacagagaccctgtc

SEQ ID NO: 153503 - DNA, 15 bp, Homo sapiens
tgacagagaccctgt

SEQ ID NO: 153504 - DNA, 15 bp, Homo sapiens
gtgacagagaccctg

SEQ ID NO: 153505 - DNA, 15 bp, Homo sapiens
tgtgacagagaccct

SEQ ID NO: 153506 - DNA, 15 bp, Homo sapiens
gtgtgacagagaccc

SEQ ID NO: 153507 - DNA, 15 bp, Homo sapiens
tgtgtgacagagacc

SEQ ID NO: 153508 - DNA, 15 bp, Homo sapiens
ctgtgtgacagagac

SEQ ID NO: 153509 - DNA, 15 bp, Homo sapiens
cctgtgtgacagaga

SEQ ID NO: 153510 - DNA, 15 bp, Homo sapiens
gcctgtgtgacagag

SEQ ID NO: 153511 - DNA, 15 bp, Homo sapiens
agcctgtgtgacaga

SEQ ID NO: 153512 - DNA, 15 bp, Homo sapiens
cagcctgtgtgacag

SEQ ID NO: 153513 - DNA, 15 bp, Homo sapiens
ccagcctgtgtgaca

SEQ ID NO: 153514 - DNA, 15 bp, Homo sapiens
tccagcctgtgtgac

SEQ ID NO: 153515 - DNA, 15 bp, Homo sapiens
ctccagcctgtgtga

SEQ ID NO: 153516 - DNA, 15 bp, Homo sapiens
actccagcctgtgtg

SEQ ID NO: 153517 - DNA, 15 bp, Homo sapiens
tactccagcctgtgt

SEQ ID NO: 153518 - DNA, 15 bp, Homo sapiens
gtactccagcctgtg

SEQ ID NO: 153519 - DNA, 15 bp, Homo sapiens
tgtactccagcctgt

SEQ ID NO: 153520 - DNA, 15 bp, Homo sapiens
ctgtactccagcctg

SEQ ID NO: 153521 - DNA, 15 bp, Homo sapiens
actgtactccagcct

SEQ ID NO: 153522 - DNA, 15 bp, Homo sapiens
cactgtactccagcc

SEQ ID NO: 153523 - DNA, 15 bp, Homo sapiens
ccactgtactccagc

SEQ ID NO: 153524 - DNA, 15 bp, Homo sapiens
accactgtactccag

SEQ ID NO: 153525 - DNA, 15 bp, Homo sapiens
caccactgtactcca

SEQ ID NO: 153526 - DNA, 15 bp, Homo sapiens
gcaccactgtactcc

SEQ ID NO: 153527 - DNA, 15 bp, Homo sapiens
agcaccactgtactc

SEQ ID NO: 153528 - DNA, 15 bp, Homo sapiens
tagcaccactgtact

SEQ ID NO: 153529 - DNA, 15 bp, Homo sapiens
atagcaccactgtac

SEQ ID NO: 153530 - DNA, 15 bp, Homo sapiens
gatagcaccactgta

SEQ ID NO: 153531 - DNA, 15 bp, Homo sapiens
tgatagcaccactgt

SEQ ID NO: 153532 - DNA, 15 bp, Homo sapiens
atgatagcaccactg

SEQ ID NO: 153533 - DNA, 15 bp, Homo sapiens
catgatagcaccact

SEQ ID NO: 153534 - DNA, 15 bp, Homo sapiens
ccatgatagcaccac

SEQ ID NO: 153535 - DNA, 15 bp, Homo sapiens
gccatgatagcacca

SEQ ID NO: 153536 - DNA, 15 bp, Homo sapiens
agccatgatagcacc

SEQ ID NO: 153537 - DNA, 15 bp, Homo sapiens
gagccatgatagcac

SEQ ID NO: 153538 - DNA, 15 bp, Homo sapiens
tgagccatgatagca

SEQ ID NO: 153539 - DNA, 15 bp, Homo sapiens
gtgagccatgatagc

SEQ ID NO: 153540 - DNA, 15 bp, Homo sapiens
agtgagccatgatag

SEQ ID NO: 153541 - DNA, 15 bp, Homo sapiens
cagtgagccatgata

SEQ ID NO: 153542 - DNA, 15 bp, Homo sapiens
gtcaaggctgcagtg

SEQ ID NO: 153543 - DNA, 15 bp, Homo sapiens
ggtcaaggctgcagt

SEQ ID NO: 153544 - DNA, 15 bp, Homo sapiens
aggtcaaggctgcag

SEQ ID NO: 153545 - DNA, 15 bp, Homo sapiens
gaggtcaaggctgca

SEQ ID NO: 153546 - DNA, 15 bp, Homo sapiens
ggaggtcaaggctgc

SEQ ID NO: 153547 - DNA, 15 bp, Homo sapiens
aggaggtcaaggctg

SEQ ID NO: 153548 - DNA, 15 bp, Homo sapiens
caggaggtcaaggct

SEQ ID NO: 153549 - DNA, 15 bp, Homo sapiens
ccaggaggtcaaggc

SEQ ID NO: 153550 - DNA, 15 bp, Homo sapiens
cccaggaggtcaagg

SEQ ID NO: 153551 - DNA, 15 bp, Homo sapiens
gcccaggaggtcaag

SEQ ID NO: 153552 - DNA, 15 bp, Homo sapiens
agcccaggaggtcaa

SEQ ID NO: 153553 - DNA, 15 bp, Homo sapiens
gagcccaggaggtca

SEQ ID NO: 153554 - DNA, 15 bp, Homo sapiens
tgagcccaggaggtc

SEQ ID NO: 153555 - DNA, 15 bp, Homo sapiens
ttgagcccaggaggt

SEQ ID NO: 153556 - DNA, 15 bp, Homo sapiens
cttgagcccaggagg

SEQ ID NO: 153557 - DNA, 15 bp, Homo sapiens
agcttgagcccagga

SEQ ID NO: 153558 - DNA, 15 bp, Homo sapiens
tagcttgagcccagg

SEQ ID NO: 153559 - DNA, 15 bp, Homo sapiens
atagcttgagcccag

SEQ ID NO: 153560 - DNA, 15 bp, Homo sapiens
gatagcttgagccca

SEQ ID NO: 153561 - DNA, 15 bp, Homo sapiens
ggatagcttgagccc

SEQ ID NO: 153562 - DNA, 15 bp, Homo sapiens
aggatagcttgagcc

SEQ ID NO: 153563 - DNA, 15 bp, Homo sapiens
gaggatagcttgagc

SEQ ID NO: 153564 - DNA, 15 bp, Homo sapiens
ggaggatagcttgag

SEQ ID NO: 153565 - DNA, 15 bp, Homo sapiens
gggaggatagcttga

SEQ ID NO: 153566 - DNA, 15 bp, Homo sapiens
cgggaggatagcttg

SEQ ID NO: 153567 - DNA, 15 bp, Homo sapiens
gcgggaggatagctt

SEQ ID NO: 153568 - DNA, 15 bp, Homo sapiens
ggcgggaggatagct

SEQ ID NO: 153569 - DNA, 15 bp, Homo sapiens
aggcgggaggatagc

SEQ ID NO: 153570 - DNA, 15 bp, Homo sapiens
gaggcgggaggatag

SEQ ID NO: 153571 - DNA, 15 bp, Homo sapiens
tgaggcgggaggata

SEQ ID NO: 153572 - DNA, 15 bp, Homo sapiens
ctgaggcgggaggat

SEQ ID NO: 153573 - DNA, 15 bp, Homo sapiens
gctgaggcgggagga

SEQ ID NO: 153574 - DNA, 15 bp, Homo sapiens
ggctgaggcgggagg

SEQ ID NO: 153575 - DNA, 15 bp, Homo sapiens
agaggctgaggcggg

SEQ ID NO: 153576 - DNA, 15 bp, Homo sapiens
gagaggctgaggcgg

SEQ ID NO: 153577 - DNA, 15 bp, Homo sapiens
cgagaggctgaggcg

SEQ ID NO: 153578 - DNA, 15 bp, Homo sapiens
tcgagaggctgaggc

SEQ ID NO: 153579 - DNA, 15 bp, Homo sapiens
ctcgagaggctgagg

SEQ ID NO: 153580 - DNA, 15 bp, Homo sapiens
actcgagaggctgag

SEQ ID NO: 153581 - DNA, 15 bp, Homo sapiens
tactcgagaggctga

SEQ ID NO: 153582 - DNA, 15 bp, Homo sapiens
ctactcgagaggctg

SEQ ID NO: 153583 - DNA, 15 bp, Homo sapiens
gctactcgagaggct

SEQ ID NO: 153584 - DNA, 15 bp, Homo sapiens
agctactcgagaggc

SEQ ID NO: 153585 - DNA, 15 bp, Homo sapiens
cagctactcgagagg

SEQ ID NO: 153586 - DNA, 15 bp, Homo sapiens
ccagctactcgagag

SEQ ID NO: 153587 - DNA, 15 bp, Homo sapiens
cccagctactcgaga

SEQ ID NO: 153588 - DNA, 15 bp, Homo sapiens
tcccagctactcgag

SEQ ID NO: 153589 - DNA, 15 bp, Homo sapiens
atcccagctactcga

SEQ ID NO: 153590 - DNA, 15 bp, Homo sapiens
gatcccagctactcg

SEQ ID NO: 153591 - DNA, 15 bp, Homo sapiens
gctgtgatcccagct

SEQ ID NO: 153592 - DNA, 15 bp, Homo sapiens
agctgtgatcccagc

SEQ ID NO: 153593 - DNA, 15 bp, Homo sapiens
tagctgtgatcccag

SEQ ID NO: 153594 - DNA, 15 bp, Homo sapiens
gtagctgtgatccca

SEQ ID NO: 153595 - DNA, 15 bp, Homo sapiens
agtagctgtgatccc

SEQ ID NO: 153596 - DNA, 15 bp, Homo sapiens
cagtagctgtgatcc

SEQ ID NO: 153597 - DNA, 15 bp, Homo sapiens
acagtagctgtgatc

SEQ ID NO: 153598 - DNA, 15 bp, Homo sapiens
cacagtagctgtgat

SEQ ID NO: 153599 - DNA, 15 bp, Homo sapiens
gcacagtagctgtga

SEQ ID NO: 153600 - DNA, 15 bp, Homo sapiens
tgcacagtagctgtg

SEQ ID NO: 153601 - DNA, 15 bp, Homo sapiens
atgcacagtagctgt

SEQ ID NO: 153602 - DNA, 15 bp, Homo sapiens
catgcacagtagctg

SEQ ID NO: 153603 - DNA, 15 bp, Homo sapiens
gcatgcacagtagct

SEQ ID NO: 153604 - DNA, 15 bp, Homo sapiens
ggcatgcacagtagc

SEQ ID NO: 153605 - DNA, 15 bp, Homo sapiens
tggcatgcacagtag

SEQ ID NO: 153606 - DNA, 15 bp, Homo sapiens
gtggcatgcacagta

SEQ ID NO: 153607 - DNA, 15 bp, Homo sapiens
ggtggcatgcacagt

SEQ ID NO: 153608 - DNA, 15 bp, Homo sapiens
tggtggcatgcacag

SEQ ID NO: 153609 - DNA, 15 bp, Homo sapiens
gtggtggcatgcaca

SEQ ID NO: 153610 - DNA, 15 bp, Homo sapiens
tgtggtggcatgcac

SEQ ID NO: 153611 - DNA, 15 bp, Homo sapiens
gtgtggtggcatgca

SEQ ID NO: 153612 - DNA, 15 bp, Homo sapiens
ggtgtggtggcatgc

SEQ ID NO: 153613 - DNA, 15 bp, Homo sapiens
cggtgtggtggcatg

SEQ ID NO: 153614 - DNA, 15 bp, Homo sapiens
ccggtgtggtggcat

SEQ ID NO: 153615 - DNA, 15 bp, Homo sapiens
cccggtgtggtggca

SEQ ID NO: 153616 - DNA, 15 bp, Homo sapiens
gcccggtgtggtggc

SEQ ID NO: 153617 - DNA, 15 bp, Homo sapiens
agcccggtgtggtgg

SEQ ID NO: 153618 - DNA, 15 bp, Homo sapiens
tagcccggtgtggtg

SEQ ID NO: 153619 - DNA, 15 bp, Homo sapiens
ttagcccggtgtggt

SEQ ID NO: 153620 - DNA, 15 bp, Homo sapiens
attagcccggtgtgg

SEQ ID NO: 153621 - DNA, 15 bp, Homo sapiens
aattagcccggtgtg

SEQ ID NO: 153622 - DNA, 15 bp, Homo sapiens
aaattagcccggtgt

SEQ ID NO: 153623 - DNA, 15 bp, Homo sapiens
aaaattagcccggtg

SEQ ID NO: 153624 - DNA, 15 bp, Homo sapiens
aaaaattagcccggt

SEQ ID NO: 153625 - DNA, 15 bp, Homo sapiens
aaaaaattagcccgg

SEQ ID NO: 153626 - DNA, 15 bp, Homo sapiens
aaaaaaattagcccg

SEQ ID NO: 153627 - DNA, 15 bp, Homo sapiens
caaaaaaattagccc

SEQ ID NO: 153628 - DNA, 15 bp, Homo sapiens
acaaaaaaattagcc

SEQ ID NO: 153629 - DNA, 15 bp, Homo sapiens
tacaaaaaaattagc

SEQ ID NO: 153630 - DNA, 15 bp, Homo sapiens
atacaaaaaaattag

SEQ ID NO: 153631 - DNA, 15 bp, Homo sapiens
aatacaaaaaaatta

SEQ ID NO: 153632 - DNA, 15 bp, Homo sapiens
aaatacaaaaaaatt

SEQ ID NO: 153633 - DNA, 15 bp, Homo sapiens
aaaatacaaaaaaat

SEQ ID NO: 153634 - DNA, 15 bp, Homo sapiens
caaaaaaaatacaaa

SEQ ID NO: 153635 - DNA, 15 bp, Homo sapiens
acaaaaaaaatacaa

SEQ ID NO: 153636 - DNA, 15 bp, Homo sapiens
cacaaaaaaaataca

SEQ ID NO: 153637 - DNA, 15 bp, Homo sapiens
ccacaaaaaaaatac

SEQ ID NO: 153638 - DNA, 15 bp, Homo sapiens
tccacaaaaaaaata

SEQ ID NO: 153639 - DNA, 15 bp, Homo sapiens
ctccacaaaaaaaat

SEQ ID NO: 153640 - DNA, 15 bp, Homo sapiens
tctccacaaaaaaaa

SEQ ID NO: 153641 - DNA, 15 bp, Homo sapiens
gtctccacaaaaaaa

SEQ ID NO: 153642 - DNA, 15 bp, Homo sapiens
tgtctccacaaaaaa

SEQ ID NO: 153643 - DNA, 15 bp, Homo sapiens
ctgtctccacaaaaa

SEQ ID NO: 153644 - DNA, 15 bp, Homo sapiens
cctgtctccacaaaa

SEQ ID NO: 153645 - DNA, 15 bp, Homo sapiens
ccctgtctccacaaa

SEQ ID NO: 153646 - DNA, 15 bp, Homo sapiens
gccctgtctccacaa

SEQ ID NO: 153647 - DNA, 15 bp, Homo sapiens
ggccctgtctccaca

SEQ ID NO: 153648 - DNA, 15 bp, Homo sapiens
aggccctgtctccac

SEQ ID NO: 153649 - DNA, 15 bp, Homo sapiens
gaggccctgtctcca

SEQ ID NO: 153650 - DNA, 15 bp, Homo sapiens
tgaggccctgtctcc

SEQ ID NO: 153651 - DNA, 15 bp, Homo sapiens
gtgaggccctgtctc

SEQ ID NO: 153652 - DNA, 15 bp, Homo sapiens
agtgaggccctgtct

SEQ ID NO: 153653 - DNA, 15 bp, Homo sapiens
tagtgaggccctgtc

SEQ ID NO: 153654 - DNA, 15 bp, Homo sapiens
atagtgaggccctgt

SEQ ID NO: 153655 - DNA, 15 bp, Homo sapiens
catagtgaggccctg

SEQ ID NO: 153656 - DNA, 15 bp, Homo sapiens
acatagtgaggccct

SEQ ID NO: 153657 - DNA, 15 bp, Homo sapiens
aacatagtgaggccc

SEQ ID NO: 153658 - DNA, 15 bp, Homo sapiens
cgcaacatagtgagg

SEQ ID NO: 153659 - DNA, 15 bp, Homo sapiens
gcgcaacatagtgag

SEQ ID NO: 153660 - DNA, 15 bp, Homo sapiens
ggcgcaacatagtga

SEQ ID NO: 153661 - DNA, 15 bp, Homo sapiens
cggcgcaacatagtg

SEQ ID NO: 153662 - DNA, 15 bp, Homo sapiens
ccggcgcaacatagt

SEQ ID NO: 153663 - DNA, 15 bp, Homo sapiens
gccggcgcaacatag

SEQ ID NO: 153664 - DNA, 15 bp, Homo sapiens
agccggcgcaacata

SEQ ID NO: 153665 - DNA, 15 bp, Homo sapiens
cagccggcgcaacat

SEQ ID NO: 153666 - DNA, 15 bp, Homo sapiens
ccagccggcgcaaca

SEQ ID NO: 153667 - DNA, 15 bp, Homo sapiens
accagccggcgcaac

SEQ ID NO: 153668 - DNA, 15 bp, Homo sapiens
gaccagccggcgcaa

SEQ ID NO: 153669 - DNA, 15 bp, Homo sapiens
agaccagccggcgca

SEQ ID NO: 153670 - DNA, 15 bp, Homo sapiens
gagaccagccggcgc

SEQ ID NO: 153671 - DNA, 15 bp, Homo sapiens
tgagaccagccggcg

SEQ ID NO: 153672 - DNA, 15 bp, Homo sapiens
ttgagaccagccggc

SEQ ID NO: 153673 - DNA, 15 bp, Homo sapiens
tttgagaccagccgg

SEQ ID NO: 153674 - DNA, 15 bp, Homo sapiens
gtttgagaccagccg

SEQ ID NO: 153675 - DNA, 15 bp, Homo sapiens
gcttgagctcaggag

SEQ ID NO: 153676 - DNA, 15 bp, Homo sapiens
tgcttgagctcagga

SEQ ID NO: 153677 - DNA, 15 bp, Homo sapiens
ttgcttgagctcagg

SEQ ID NO: 153678 - DNA, 15 bp, Homo sapiens
attgcttgagctcag

SEQ ID NO: 153679 - DNA, 15 bp, Homo sapiens
gattgcttgagctca

SEQ ID NO: 153680 - DNA, 15 bp, Homo sapiens
agattgcttgagctc

SEQ ID NO: 153681 - DNA, 15 bp, Homo sapiens
cagattgcttgagct

SEQ ID NO: 153682 - DNA, 15 bp, Homo sapiens
gcagattgcttgagc

SEQ ID NO: 153683 - DNA, 15 bp, Homo sapiens
ggcagattgcttgag

SEQ ID NO: 153684 - DNA, 15 bp, Homo sapiens
aggcagattgcttga

SEQ ID NO: 153685 - DNA, 15 bp, Homo sapiens
caggcagattgcttg

SEQ ID NO: 153686 - DNA, 15 bp, Homo sapiens
gcaggcagattgctt

SEQ ID NO: 153687 - DNA, 15 bp, Homo sapiens
ggcaggcagattgct

SEQ ID NO: 153688 - DNA, 15 bp, Homo sapiens
aggcaggcagattgc

SEQ ID NO: 153689 - DNA, 15 bp, Homo sapiens
gaggcaggcagattg

SEQ ID NO: 153690 - DNA, 15 bp, Homo sapiens
cgaggcaggcagatt

SEQ ID NO: 153691 - DNA, 15 bp, Homo sapiens
aaggccgaggcaggc

SEQ ID NO: 153692 - DNA, 15 bp, Homo sapiens
gaaggccgaggcagg

SEQ ID NO: 153693 - DNA, 15 bp, Homo sapiens
ggaaggccgaggcag

SEQ ID NO: 153694 - DNA, 15 bp, Homo sapiens
tggaaggccgaggca

SEQ ID NO: 153695 - DNA, 15 bp, Homo sapiens
ttggaaggccgaggc

SEQ ID NO: 153696 - DNA, 15 bp, Homo sapiens
tttggaaggccgagg

SEQ ID NO: 153697 - DNA, 15 bp, Homo sapiens
ctttggaaggccgag

SEQ ID NO: 153698 - DNA, 15 bp, Homo sapiens
actttggaaggccga

SEQ ID NO: 153699 - DNA, 15 bp, Homo sapiens
aactttggaaggccg

SEQ ID NO: 153700 - DNA, 15 bp, Homo sapiens
gaactttggaaggcc

SEQ ID NO: 153701 - DNA, 15 bp, Homo sapiens
ggaactttggaaggc

SEQ ID NO: 153702 - DNA, 15 bp, Homo sapiens
aggaactttggaagg

SEQ ID NO: 153703 - DNA, 15 bp, Homo sapiens
caggaactttggaag

SEQ ID NO: 153704 - DNA, 15 bp, Homo sapiens
tcaggaactttggaa

SEQ ID NO: 153705 - DNA, 15 bp, Homo sapiens
gtcaggaactttgga

SEQ ID NO: 153706 - DNA, 15 bp, Homo sapiens
tgtcaggaactttgg

SEQ ID NO: 153707 - DNA, 15 bp, Homo sapiens
ctgtcaggaactttg

SEQ ID NO: 153708 - DNA, 15 bp, Homo sapiens
actgtcaggaacttt

SEQ ID NO: 153709 - DNA, 15 bp, Homo sapiens
aactgtcaggaactt

SEQ ID NO: 153710 - DNA, 15 bp, Homo sapiens
aaactgtcaggaact

SEQ ID NO: 153711 - DNA, 15 bp, Homo sapiens
aaaactgtcaggaac

SEQ ID NO: 153712 - DNA, 15 bp, Homo sapiens
caaaactgtcaggaa

SEQ ID NO: 153713 - DNA, 15 bp, Homo sapiens
tcaaaactgtcagga

SEQ ID NO: 153714 - DNA, 15 bp, Homo sapiens
ctcaaaactgtcagg

SEQ ID NO: 153715 - DNA, 15 bp, Homo sapiens
gctcaaaactgtcag

SEQ ID NO: 153716 - DNA, 15 bp, Homo sapiens
tgctcaaaactgtca

SEQ ID NO: 153717 - DNA, 15 bp, Homo sapiens
ctgctcaaaactgtc

SEQ ID NO: 153718 - DNA, 15 bp, Homo sapiens
cctgctcaaaactgt

SEQ ID NO: 153719 - DNA, 15 bp, Homo sapiens
acctgctcaaaactg

SEQ ID NO: 153720 - DNA, 15 bp, Homo sapiens
cacctgctcaaaact

SEQ ID NO: 153721 - DNA, 15 bp, Homo sapiens
ccacctgctcaaaac

SEQ ID NO: 153722 - DNA, 15 bp, Homo sapiens
gccacctgctcaaaa

SEQ ID NO: 153723 - DNA, 15 bp, Homo sapiens
agccacctgctcaaa

SEQ ID NO: 153724 - DNA, 15 bp, Homo sapiens
tagccacctgctcaa

SEQ ID NO: 153725 - DNA, 15 bp, Homo sapiens
atagccacctgctca

SEQ ID NO: 153726 - DNA, 15 bp, Homo sapiens
catagccacctgctc

SEQ ID NO: 153727 - DNA, 15 bp, Homo sapiens
acatagccacctgct

SEQ ID NO: 153728 - DNA, 15 bp, Homo sapiens
tacatagccacctgc

SEQ ID NO: 153729 - DNA, 15 bp, Homo sapiens
gtacatagccacctg

SEQ ID NO: 153730 - DNA, 15 bp, Homo sapiens
agtacatagccacct

SEQ ID NO: 153731 - DNA, 15 bp, Homo sapiens
aagtacatagccacc

SEQ ID NO: 153732 - DNA, 15 bp, Homo sapiens
caagtacatagccac

SEQ ID NO: 153733 - DNA, 15 bp, Homo sapiens
acaagtacatagcca

SEQ ID NO: 153734 - DNA, 15 bp, Homo sapiens
aacaagtacatagcc

SEQ ID NO: 153735 - DNA, 15 bp, Homo sapiens
aaacaagtacatagc

SEQ ID NO: 153736 - DNA, 15 bp, Homo sapiens
aaaacaagtacatag

SEQ ID NO: 153737 - DNA, 15 bp, Homo sapiens
gaaaacaagtacata

SEQ ID NO: 153738 - DNA, 15 bp, Homo sapiens
ggaaaacaagtacat

SEQ ID NO: 153739 - DNA, 15 bp, Homo sapiens
aggaaaacaagtaca

SEQ ID NO: 153740 - DNA, 15 bp, Homo sapiens
taggaaaacaagtac

SEQ ID NO: 153741 - DNA, 15 bp, Homo sapiens
ctaggaaaacaagta

SEQ ID NO: 153742 - DNA, 15 bp, Homo sapiens
tctaggaaaacaagt

SEQ ID NO: 153743 - DNA, 15 bp, Homo sapiens
ttctaggaaaacaag

SEQ ID NO: 153744 - DNA, 15 bp, Homo sapiens
cttctaggaaaacaa

SEQ ID NO: 153745 - DNA, 15 bp, Homo sapiens
acttctaggaaaaca

SEQ ID NO: 153746 - DNA, 15 bp, Homo sapiens
aacttctaggaaaac

SEQ ID NO: 153747 - DNA, 15 bp, Homo sapiens
aaacttctaggaaaa

SEQ ID NO: 153748 - DNA, 15 bp, Homo sapiens
taaacttctaggaaa

SEQ ID NO: 153749 - DNA, 15 bp, Homo sapiens
ttaaacttctaggaa

SEQ ID NO: 153750 - DNA, 15 bp, Homo sapiens
tttaaacttctagga

SEQ ID NO: 153751 - DNA, 15 bp, Homo sapiens
ttttaaacttctagg

SEQ ID NO: 153752 - DNA, 15 bp, Homo sapiens
cttttaaacttctag

SEQ ID NO: 153753 - DNA, 15 bp, Homo sapiens
acttttaaacttcta

SEQ ID NO: 153754 - DNA, 15 bp, Homo sapiens
tacttttaaacttct

SEQ ID NO: 153755 - DNA, 15 bp, Homo sapiens
ttacttttaaacttc

SEQ ID NO: 153756 - DNA, 15 bp, Homo sapiens
cttacttttaaactt

SEQ ID NO: 153757 - DNA, 15 bp, Homo sapiens
ccttacttttaaact

SEQ ID NO: 153758 - DNA, 15 bp, Homo sapiens
tccttacttttaaac

SEQ ID NO: 153759 - DNA, 15 bp, Homo sapiens
ttccttacttttaaa

SEQ ID NO: 153760 - DNA, 15 bp, Homo sapiens
tttccttacttttaa

SEQ ID NO: 153761 - DNA, 15 bp, Homo sapiens
atttccttactttta

SEQ ID NO: 153762 - DNA, 15 bp, Homo sapiens
tatttccttactttt

SEQ ID NO: 153763 - DNA, 15 bp, Homo sapiens
atatttccttacttt

SEQ ID NO: 153764 - DNA, 15 bp, Homo sapiens
tatatttccttactt

SEQ ID NO: 153765 - DNA, 15 bp, Homo sapiens
atatatttccttact

SEQ ID NO: 153766 - DNA, 15 bp, Homo sapiens
aatatatttccttac

SEQ ID NO: 153767 - DNA, 15 bp, Homo sapiens
gaatatatttcctta

SEQ ID NO: 153768 - DNA, 15 bp, Homo sapiens
agaatatatttcctt

SEQ ID NO: 153769 - DNA, 15 bp, Homo sapiens
aagaatatatttcct

SEQ ID NO: 153770 - DNA, 15 bp, Homo sapiens
aaagaatatatttcc

SEQ ID NO: 153771 - DNA, 15 bp, Homo sapiens
aaaagaatatatttc

SEQ ID NO: 153772 - DNA, 15 bp, Homo sapiens
gaaaagaatatattt

SEQ ID NO: 153773 - DNA, 15 bp, Homo sapiens
tgaaaagaatatatt

SEQ ID NO: 153774 - DNA, 15 bp, Homo sapiens
ttgaaaagaatatat

SEQ ID NO: 153775 - DNA, 15 bp, Homo sapiens
tttgaaaagaatata

SEQ ID NO: 153776 - DNA, 15 bp, Homo sapiens
ttttgaaaagaatat

SEQ ID NO: 153777 - DNA, 15 bp, Homo sapiens
gttttgaaaagaata

SEQ ID NO: 153778 - DNA, 15 bp, Homo sapiens
agttttgaaaagaat

SEQ ID NO: 153779 - DNA, 15 bp, Homo sapiens
tagttttgaaaagaa

SEQ ID NO: 153780 - DNA, 15 bp, Homo sapiens
atagttttgaaaaga

SEQ ID NO: 153781 - DNA, 15 bp, Homo sapiens
aatagttttgaaaag

SEQ ID NO: 153782 - DNA, 15 bp, Homo sapiens
aaatagttttgaaaa

SEQ ID NO: 153783 - DNA, 15 bp, Homo sapiens
gaaatagttttgaaa

SEQ ID NO: 153784 - DNA, 15 bp, Homo sapiens
cgaaatagttttgaa

SEQ ID NO: 153785 - DNA, 15 bp, Homo sapiens
tcgaaatagttttga

SEQ ID NO: 153786 - DNA, 15 bp, Homo sapiens
atcgaaatagttttg

SEQ ID NO: 153787 - DNA, 15 bp, Homo sapiens
catcgaaatagtttt

SEQ ID NO: 153788 - DNA, 15 bp, Homo sapiens
acatcgaaatagttt

SEQ ID NO: 153789 - DNA, 15 bp, Homo sapiens
aacatcgaaatagtt

SEQ ID NO: 153790 - DNA, 15 bp, Homo sapiens
gaacatcgaaatagt

SEQ ID NO: 153791 - DNA, 15 bp, Homo sapiens
cgaacatcgaaatag

SEQ ID NO: 153792 - DNA, 15 bp, Homo sapiens
tcgaacatcgaaata

SEQ ID NO: 153793 - DNA, 15 bp, Homo sapiens
atcgaacatcgaaat

SEQ ID NO: 153794 - DNA, 15 bp, Homo sapiens
catcgaacatcgaaa

SEQ ID NO: 153795 - DNA, 15 bp, Homo sapiens
acatcgaacatcgaa

SEQ ID NO: 153796 - DNA, 15 bp, Homo sapiens
aacatcgaacatcga

SEQ ID NO: 153797 - DNA, 15 bp, Homo sapiens
gaacatcgaacatcg

SEQ ID NO: 153798 - DNA, 15 bp, Homo sapiens
tgaacatcgaacatc

SEQ ID NO: 153799 - DNA, 15 bp, Homo sapiens
ttgaacatcgaacat

SEQ ID NO: 153800 - DNA, 15 bp, Homo sapiens
cttgaacatcgaaca

SEQ ID NO: 153801 - DNA, 15 bp, Homo sapiens
acttgaacatcgaac

SEQ ID NO: 153802 - DNA, 15 bp, Homo sapiens
tacttgaacatcgaa

SEQ ID NO: 153803 - DNA, 15 bp, Homo sapiens
atacttgaacatcga

SEQ ID NO: 153804 - DNA, 15 bp, Homo sapiens
aatacttgaacatcg

SEQ ID NO: 153805 - DNA, 15 bp, Homo sapiens
caatacttgaacatc

SEQ ID NO: 153806 - DNA, 15 bp, Homo sapiens
ccaatacttgaacat

SEQ ID NO: 153807 - DNA, 15 bp, Homo sapiens
gccaatacttgaaca

SEQ ID NO: 153808 - DNA, 15 bp, Homo sapiens
agccaatacttgaac

SEQ ID NO: 153809 - DNA, 15 bp, Homo sapiens
tagccaatacttgaa

SEQ ID NO: 153810 - DNA, 15 bp, Homo sapiens
atagccaatacttga

SEQ ID NO: 153811 - DNA, 15 bp, Homo sapiens
tatagccaatacttg

SEQ ID NO: 153812 - DNA, 15 bp, Homo sapiens
atatagccaatactt

SEQ ID NO: 153813 - DNA, 15 bp, Homo sapiens
tatatagccaatact

SEQ ID NO: 153814 - DNA, 15 bp, Homo sapiens
ttatatagccaatac

SEQ ID NO: 153815 - DNA, 15 bp, Homo sapiens
attatatagccaata

SEQ ID NO: 153816 - DNA, 15 bp, Homo sapiens
cattatatagccaat

SEQ ID NO: 153817 - DNA, 15 bp, Homo sapiens
acattatatagccaa

SEQ ID NO: 153818 - DNA, 15 bp, Homo sapiens
aacattatatagcca

SEQ ID NO: 153819 - DNA, 15 bp, Homo sapiens
taacattatatagcc

SEQ ID NO: 153820 - DNA, 15 bp, Homo sapiens
ttaacattatatagc

SEQ ID NO: 153821 - DNA, 15 bp, Homo sapiens
cttaacattatatag

SEQ ID NO: 153822 - DNA, 15 bp, Homo sapiens
ccttaacattatata

SEQ ID NO: 153823 - DNA, 15 bp, Homo sapiens
tccttaacattatat

SEQ ID NO: 153824 - DNA, 15 bp, Homo sapiens
ttccttaacattata

SEQ ID NO: 153825 - DNA, 15 bp, Homo sapiens
tttccttaacattat

SEQ ID NO: 153826 - DNA, 15 bp, Homo sapiens
atttccttaacatta

SEQ ID NO: 153827 - DNA, 15 bp, Homo sapiens
tatttccttaacatt

SEQ ID NO: 153828 - DNA, 15 bp, Homo sapiens
ttatttccttaacat

SEQ ID NO: 153829 - DNA, 15 bp, Homo sapiens
tttatttccttaaca

SEQ ID NO: 153830 - DNA, 15 bp, Homo sapiens
ctttatttccttaac

SEQ ID NO: 153831 - DNA, 15 bp, Homo sapiens
tctttatttccttaa

SEQ ID NO: 153832 - DNA, 15 bp, Homo sapiens
atctttatttcctta

SEQ ID NO: 153833 - DNA, 15 bp, Homo sapiens
aatctttatttcctt

SEQ ID NO: 153834 - DNA, 15 bp, Homo sapiens
aaatctttatttcct

SEQ ID NO: 153835 - DNA, 15 bp, Homo sapiens
aaaatctttatttcc

SEQ ID NO: 153836 - DNA, 15 bp, Homo sapiens
aaaaatctttatttc

SEQ ID NO: 153837 - DNA, 15 bp, Homo sapiens
taaaaatctttattt

SEQ ID NO: 153838 - DNA, 15 bp, Homo sapiens
ttaaaaatctttatt

SEQ ID NO: 153839 - DNA, 15 bp, Homo sapiens
tttaaaaatctttat

SEQ ID NO: 153840 - DNA, 15 bp, Homo sapiens
ttttaaaaatcttta

SEQ ID NO: 153841 - DNA, 15 bp, Homo sapiens
tttttaaaaatcttt

SEQ ID NO: 153842 - DNA, 15 bp, Homo sapiens
atttttaaaaatctt

SEQ ID NO: 153843 - DNA, 15 bp, Homo sapiens
catttttaaaaatct

SEQ ID NO: 153844 - DNA, 15 bp, Homo sapiens
tcatttttaaaaatc

SEQ ID NO: 153845 - DNA, 15 bp, Homo sapiens
ctcatttttaaaaat

SEQ ID NO: 153846 - DNA, 15 bp, Homo sapiens
actcatttttaaaaa

SEQ ID NO: 153847 - DNA, 15 bp, Homo sapiens
aactcatttttaaaa

SEQ ID NO: 153848 - DNA, 15 bp, Homo sapiens
gaactcatttttaaa

SEQ ID NO: 153849 - DNA, 15 bp, Homo sapiens
tgaactcatttttaa

SEQ ID NO: 153850 - DNA, 15 bp, Homo sapiens
atgaactcattttta

SEQ ID NO: 153851 - DNA, 15 bp, Homo sapiens
aatgaactcattttt

SEQ ID NO: 153852 - DNA, 15 bp, Homo sapiens
aaatgaactcatttt

SEQ ID NO: 153853 - DNA, 15 bp, Homo sapiens
aaaatgaactcattt

SEQ ID NO: 153854 - DNA, 15 bp, Homo sapiens
caaaatgaactcatt

SEQ ID NO: 153855 - DNA, 15 bp, Homo sapiens
gcaaaatgaactcat

SEQ ID NO: 153856 - DNA, 15 bp, Homo sapiens
tgcaaaatgaactca

SEQ ID NO: 153857 - DNA, 15 bp, Homo sapiens
gtgcaaaatgaactc

SEQ ID NO: 153858 - DNA, 15 bp, Homo sapiens
agtgcaaaatgaact

SEQ ID NO: 153859 - DNA, 15 bp, Homo sapiens
aagtgcaaaatgaac

SEQ ID NO: 153860 - DNA, 15 bp, Homo sapiens
aaagtgcaaaatgaa

SEQ ID NO: 153861 - DNA, 15 bp, Homo sapiens
caaagtgcaaaatga

SEQ ID NO: 153862 - DNA, 15 bp, Homo sapiens
tcaaagtgcaaaatg

SEQ ID NO: 153863 - DNA, 15 bp, Homo sapiens
atcaaagtgcaaaat

SEQ ID NO: 153864 - DNA, 15 bp, Homo sapiens
tatcaaagtgcaaaa

SEQ ID NO: 153865 - DNA, 15 bp, Homo sapiens
ttatcaaagtgcaaa

SEQ ID NO: 153866 - DNA, 15 bp, Homo sapiens
cttatcaaagtgcaa

SEQ ID NO: 153867 - DNA, 15 bp, Homo sapiens
tcttatcaaagtgca

SEQ ID NO: 153868 - DNA, 15 bp, Homo sapiens
ttcttatcaaagtgc

SEQ ID NO: 153869 - DNA, 15 bp, Homo sapiens
tttcttatcaaagtg

SEQ ID NO: 153870 - DNA, 15 bp, Homo sapiens
ctttcttatcaaagt

SEQ ID NO: 153871 - DNA, 15 bp, Homo sapiens
tctttcttatcaaag

SEQ ID NO: 153872 - DNA, 15 bp, Homo sapiens
atctttcttatcaaa

SEQ ID NO: 153873 - DNA, 15 bp, Homo sapiens
catctttcttatcaa

SEQ ID NO: 153874 - DNA, 15 bp, Homo sapiens
ccatctttcttatca

SEQ ID NO: 153875 - DNA, 15 bp, Homo sapiens
tccatctttcttatc

SEQ ID NO: 153876 - DNA, 15 bp, Homo sapiens
atccatctttcttat

SEQ ID NO: 153877 - DNA, 15 bp, Homo sapiens
aatccatctttctta

SEQ ID NO: 153878 - DNA, 15 bp, Homo sapiens
caatccatctttctt

SEQ ID NO: 153879 - DNA, 15 bp, Homo sapiens
ccaatccatctttct

SEQ ID NO: 153880 - DNA, 15 bp, Homo sapiens
cccaatccatctttc

SEQ ID NO: 153881 - DNA, 15 bp, Homo sapiens
acccaatccatcttt

SEQ ID NO: 153882 - DNA, 15 bp, Homo sapiens
gacccaatccatctt

SEQ ID NO: 153883 - DNA, 15 bp, Homo sapiens
tgacccaatccatct

SEQ ID NO: 153884 - DNA, 15 bp, Homo sapiens
atgacccaatccatc

SEQ ID NO: 153885 - DNA, 15 bp, Homo sapiens
aatgacccaatccat

SEQ ID NO: 153886 - DNA, 15 bp, Homo sapiens
aaatgacccaatcca

SEQ ID NO: 153887 - DNA, 15 bp, Homo sapiens
gaaatgacccaatcc

SEQ ID NO: 153888 - DNA, 15 bp, Homo sapiens
ggaaatgacccaatc

SEQ ID NO: 153889 - DNA, 15 bp, Homo sapiens
tggaaatgacccaat

SEQ ID NO: 153890 - DNA, 15 bp, Homo sapiens
atggaaatgacccaa

SEQ ID NO: 153891 - DNA, 15 bp, Homo sapiens
gatggaaatgaccca

SEQ ID NO: 153892 - DNA, 15 bp, Homo sapiens
ggatggaaatgaccc

SEQ ID NO: 153893 - DNA, 15 bp, Homo sapiens
tggatggaaatgacc

SEQ ID NO: 153894 - DNA, 15 bp, Homo sapiens
atggatggaaatgac

SEQ ID NO: 153895 - DNA, 15 bp, Homo sapiens
tatggatggaaatga

SEQ ID NO: 153896 - DNA, 15 bp, Homo sapiens
atatggatggaaatg

SEQ ID NO: 153897 - DNA, 15 bp, Homo sapiens
aatatggatggaaat

SEQ ID NO: 153898 - DNA, 15 bp, Homo sapiens
taatatggatggaaa

SEQ ID NO: 153899 - DNA, 15 bp, Homo sapiens
ttaatatggatggaa

SEQ ID NO: 153900 - DNA, 15 bp, Homo sapiens
tttaatatggatgga

SEQ ID NO: 153901 - DNA, 15 bp, Homo sapiens
ttttaatatggatgg

SEQ ID NO: 153902 - DNA, 15 bp, Homo sapiens
attttaatatggatg

SEQ ID NO: 153903 - DNA, 15 bp, Homo sapiens
tattttaatatggat

SEQ ID NO: 153904 - DNA, 15 bp, Homo sapiens
ctattttaatatgga

SEQ ID NO: 153905 - DNA, 15 bp, Homo sapiens
actattttaatatgg

SEQ ID NO: 153906 - DNA, 15 bp, Homo sapiens
aactattttaatatg

SEQ ID NO: 153907 - DNA, 15 bp, Homo sapiens
caactattttaatat

SEQ ID NO: 153908 - DNA, 15 bp, Homo sapiens
ccaactattttaata

SEQ ID NO: 153909 - DNA, 15 bp, Homo sapiens
accaactattttaat

SEQ ID NO: 153910 - DNA, 15 bp, Homo sapiens
aaccaactattttaa

SEQ ID NO: 153911 - DNA, 15 bp, Homo sapiens
gaaccaactatttta

SEQ ID NO: 153912 - DNA, 15 bp, Homo sapiens
agaaccaactatttt

SEQ ID NO: 153913 - DNA, 15 bp, Homo sapiens
cagaaccaactattt

SEQ ID NO: 153914 - DNA, 15 bp, Homo sapiens
accagaaccaactat

SEQ ID NO: 153915 - DNA, 15 bp, Homo sapiens
aaccagaaccaacta

SEQ ID NO: 153916 - DNA, 15 bp, Homo sapiens
aaaccagaaccaact

SEQ ID NO: 153917 - DNA, 15 bp, Homo sapiens
aaaaccagaaccaac

SEQ ID NO: 153918 - DNA, 15 bp, Homo sapiens
aaaaaccagaaccaa

SEQ ID NO: 153919 - DNA, 15 bp, Homo sapiens
caaaaaccagaacca

SEQ ID NO: 153920 - DNA, 15 bp, Homo sapiens
tcaaaaaccagaacc

SEQ ID NO: 153921 - DNA, 15 bp, Homo sapiens
atcaaaaaccagaac

SEQ ID NO: 153922 - DNA, 15 bp, Homo sapiens
aatcaaaaaccagaa

SEQ ID NO: 153923 - DNA, 15 bp, Homo sapiens
aaatcaaaaaccaga

SEQ ID NO: 153924 - DNA, 15 bp, Homo sapiens
taaatcaaaaaccag

SEQ ID NO: 153925 - DNA, 15 bp, Homo sapiens
ataaatcaaaaacca

SEQ ID NO: 153926 - DNA, 15 bp, Homo sapiens
tataaatcaaaaacc

SEQ ID NO: 153927 - DNA, 15 bp, Homo sapiens
ttataaatcaaaaac

SEQ ID NO: 153928 - DNA, 15 bp, Homo sapiens
gttataaatcaaaaa

SEQ ID NO: 153929 - DNA, 15 bp, Homo sapiens
agttataaatcaaaa

SEQ ID NO: 153930 - DNA, 15 bp, Homo sapiens
aagttataaatcaaa

SEQ ID NO: 153931 - DNA, 15 bp, Homo sapiens
taagttataaatcaa

SEQ ID NO: 153932 - DNA, 15 bp, Homo sapiens
ttaagttataaatca

SEQ ID NO: 153933 - DNA, 15 bp, Homo sapiens
attaagttataaatc

SEQ ID NO: 153934 - DNA, 15 bp, Homo sapiens
aattaagttataaat

SEQ ID NO: 153935 - DNA, 15 bp, Homo sapiens
aaattaagttataaa

SEQ ID NO: 153936 - DNA, 15 bp, Homo sapiens
caaattaagttataa

SEQ ID NO: 153937 - DNA, 15 bp, Homo sapiens
ccaaattaagttata

SEQ ID NO: 153938 - DNA, 15 bp, Homo sapiens
accaaattaagttat

SEQ ID NO: 153939 - DNA, 15 bp, Homo sapiens
aaccaaattaagtta

SEQ ID NO: 153940 - DNA, 15 bp, Homo sapiens
aaaccaaattaagtt

SEQ ID NO: 153941 - DNA, 15 bp, Homo sapiens
caaaccaaattaagt

SEQ ID NO: 153942 - DNA, 15 bp, Homo sapiens
tcaaaccaaattaag

SEQ ID NO: 153943 - DNA, 15 bp, Homo sapiens
atcaaaccaaattaa

SEQ ID NO: 153944 - DNA, 15 bp, Homo sapiens
aatcaaaccaaatta

SEQ ID NO: 153945 - DNA, 15 bp, Homo sapiens
gaatcaaaccaaatt

SEQ ID NO: 153946 - DNA, 15 bp, Homo sapiens
agaatcaaaccaaat

SEQ ID NO: 153947 - DNA, 15 bp, Homo sapiens
aagaatcaaaccaaa

SEQ ID NO: 153948 - DNA, 15 bp, Homo sapiens
taagaatcaaaccaa

SEQ ID NO: 153949 - DNA, 15 bp, Homo sapiens
ttaagaatcaaacca

SEQ ID NO: 153950 - DNA, 15 bp, Homo sapiens
gttaagaatcaaacc

SEQ ID NO: 153951 - DNA, 15 bp, Homo sapiens
tgttaagaatcaaac

SEQ ID NO: 153952 - DNA, 15 bp, Homo sapiens
ctgttaagaatcaaa

SEQ ID NO: 153953 - DNA, 15 bp, Homo sapiens
actgttaagaatcaa

SEQ ID NO: 153954 - DNA, 15 bp, Homo sapiens
tactgttaagaatca

SEQ ID NO: 153955 - DNA, 15 bp, Homo sapiens
gtactgttaagaatc

SEQ ID NO: 153956 - DNA, 15 bp, Homo sapiens
tgtactgttaagaat

SEQ ID NO: 153957 - DNA, 15 bp, Homo sapiens
ttgtactgttaagaa

SEQ ID NO: 153958 - DNA, 15 bp, Homo sapiens
tttgtactgttaaga

SEQ ID NO: 153959 - DNA, 15 bp, Homo sapiens
gtttgtactgttaag

SEQ ID NO: 153960 - DNA, 15 bp, Homo sapiens
cgtttgtactgttaa

SEQ ID NO: 153961 - DNA, 15 bp, Homo sapiens
acgtttgtactgtta

SEQ ID NO: 153962 - DNA, 15 bp, Homo sapiens
aacgtttgtactgtt

SEQ ID NO: 153963 - DNA, 15 bp, Homo sapiens
taacgtttgtactgt

SEQ ID NO: 153964 - DNA, 15 bp, Homo sapiens
ttaacgtttgtactg

SEQ ID NO: 153965 - DNA, 15 bp, Homo sapiens
tttaacgtttgtact

SEQ ID NO: 153966 - DNA, 15 bp, Homo sapiens
atttaacgtttgtac

SEQ ID NO: 153967 - DNA, 15 bp, Homo sapiens
aatttaacgtttgta

SEQ ID NO: 153968 - DNA, 15 bp, Homo sapiens
taatttaacgtttgt

SEQ ID NO: 153969 - DNA, 15 bp, Homo sapiens
ataatttaacgtttg

SEQ ID NO: 153970 - DNA, 15 bp, Homo sapiens
cataatttaacgttt

SEQ ID NO: 153971 - DNA, 15 bp, Homo sapiens
acataatttaacgtt

SEQ ID NO: 153972 - DNA, 15 bp, Homo sapiens
cacataatttaacgt

SEQ ID NO: 153973 - DNA, 15 bp, Homo sapiens
acacataatttaacg

SEQ ID NO: 153974 - DNA, 15 bp, Homo sapiens
aacacataatttaac

SEQ ID NO: 153975 - DNA, 15 bp, Homo sapiens
gaacacataatttaa

SEQ ID NO: 153976 - DNA, 15 bp, Homo sapiens
tgaacacataattta

SEQ ID NO: 153977 - DNA, 15 bp, Homo sapiens
atgaacacataattt

SEQ ID NO: 153978 - DNA, 15 bp, Homo sapiens
aatgaacacataatt

SEQ ID NO: 153979 - DNA, 15 bp, Homo sapiens
caatgaacacataat

SEQ ID NO: 153980 - DNA, 15 bp, Homo sapiens
tcaatgaacacataa

SEQ ID NO: 153981 - DNA, 15 bp, Homo sapiens
ttcaatgaacacata

SEQ ID NO: 153982 - DNA, 15 bp, Homo sapiens
gttcaatgaacacat

SEQ ID NO: 153983 - DNA, 15 bp, Homo sapiens
ggttcaatgaacaca

SEQ ID NO: 153984 - DNA, 15 bp, Homo sapiens
gggttcaatgaacac

SEQ ID NO: 153985 - DNA, 15 bp, Homo sapiens
tgggttcaatgaaca

SEQ ID NO: 153986 - DNA, 15 bp, Homo sapiens
ctgggttcaatgaac

SEQ ID NO: 153987 - DNA, 15 bp, Homo sapiens
actgggttcaatgaa

SEQ ID NO: 153988 - DNA, 15 bp, Homo sapiens
aactgggttcaatga

SEQ ID NO: 153989 - DNA, 15 bp, Homo sapiens
gaactgggttcaatg

SEQ ID NO: 153990 - DNA, 15 bp, Homo sapiens
agaactgggttcaat

SEQ ID NO: 153991 - DNA, 15 bp, Homo sapiens
gagaactgggttcaa

SEQ ID NO: 153992 - DNA, 15 bp, Homo sapiens
ggagaactgggttca

SEQ ID NO: 153993 - DNA, 15 bp, Homo sapiens
tggagaactgggttc

SEQ ID NO: 153994 - DNA, 15 bp, Homo sapiens
atggagaactgggtt

SEQ ID NO: 153995 - DNA, 15 bp, Homo sapiens
tatggagaactgggt

SEQ ID NO: 153996 - DNA, 15 bp, Homo sapiens
gtatggagaactggg

SEQ ID NO: 153997 - DNA, 15 bp, Homo sapiens
ggtatggagaactgg

SEQ ID NO: 153998 - DNA, 15 bp, Homo sapiens
gggtatggagaactg

SEQ ID NO: 153999 - DNA, 15 bp, Homo sapiens
tgggtatggagaact

SEQ ID NO: 154000 - DNA, 15 bp, Homo sapiens
gtgggtatggagaac

SEQ ID NO: 154001 - DNA, 15 bp, Homo sapiens
tgtgggtatggagaa

SEQ ID NO: 154002 - DNA, 15 bp, Homo sapiens
atgtgggtatggaga

SEQ ID NO: 154003 - DNA, 15 bp, Homo sapiens
catgtgggtatggag

SEQ ID NO: 154004 - DNA, 15 bp, Homo sapiens
acatgtgggtatgga

SEQ ID NO: 154005 - DNA, 15 bp, Homo sapiens
tacatgtgggtatgg

SEQ ID NO: 154006 - DNA, 15 bp, Homo sapiens
ctacatgtgggtatg

SEQ ID NO: 154007 - DNA, 15 bp, Homo sapiens
actacatgtgggtat

SEQ ID NO: 154008 - DNA, 15 bp, Homo sapiens
aactacatgtgggta

SEQ ID NO: 154009 - DNA, 15 bp, Homo sapiens
aaactacatgtgggt

SEQ ID NO: 154010 - DNA, 15 bp, Homo sapiens
aaaactacatgtggg

SEQ ID NO: 154011 - DNA, 15 bp, Homo sapiens
aaaaactacatgtgg

SEQ ID NO: 154012 - DNA, 15 bp, Homo sapiens
aaaaaactacatgtg

SEQ ID NO: 154013 - DNA, 15 bp, Homo sapiens
taaaaaactacatgt

SEQ ID NO: 154014 - DNA, 15 bp, Homo sapiens
ataaaaaactacatg

SEQ ID NO: 154015 - DNA, 15 bp, Homo sapiens
gataaaaaactacat

SEQ ID NO: 154016 - DNA, 15 bp, Homo sapiens
tgataaaaaactaca

SEQ ID NO: 154017 - DNA, 15 bp, Homo sapiens
atgataaaaaactac

SEQ ID NO: 154018 - DNA, 15 bp, Homo sapiens
aatgataaaaaacta

SEQ ID NO: 154019 - DNA, 15 bp, Homo sapiens
taatgataaaaaact

SEQ ID NO: 154020 - DNA, 15 bp, Homo sapiens
ataatgataaaaaac

SEQ ID NO: 154021 - DNA, 15 bp, Homo sapiens
tataatgataaaaaa

SEQ ID NO: 154022 - DNA, 15 bp, Homo sapiens
aatataatgataaaa

SEQ ID NO: 154023 - DNA, 15 bp, Homo sapiens
aaatataatgataaa

SEQ ID NO: 154024 - DNA, 15 bp, Homo sapiens
taaatataatgataa

SEQ ID NO: 154025 - DNA, 15 bp, Homo sapiens
ttaaatataatgata

SEQ ID NO: 154026 - DNA, 15 bp, Homo sapiens
tttaaatataatgat

SEQ ID NO: 154027 - DNA, 15 bp, Homo sapiens
ttttaaatataatga

SEQ ID NO: 154028 - DNA, 15 bp, Homo sapiens
cttttaaatataatg

SEQ ID NO: 154029 - DNA, 15 bp, Homo sapiens
ccttttaaatataat

SEQ ID NO: 154030 - DNA, 15 bp, Homo sapiens
tccttttaaatataa

SEQ ID NO: 154031 - DNA, 15 bp, Homo sapiens
gtccttttaaatata

SEQ ID NO: 154032 - DNA, 15 bp, Homo sapiens
tgtccttttaaatat

SEQ ID NO: 154033 - DNA, 15 bp, Homo sapiens
atgtccttttaaata

SEQ ID NO: 154034 - DNA, 15 bp, Homo sapiens
tatgtccttttaaat

SEQ ID NO: 154035 - DNA, 15 bp, Homo sapiens
ttatgtccttttaaa

SEQ ID NO: 154036 - DNA, 15 bp, Homo sapiens
attatgtccttttaa

SEQ ID NO: 154037 - DNA, 15 bp, Homo sapiens
tattatgtcctttta

SEQ ID NO: 154038 - DNA, 15 bp, Homo sapiens
ctattatgtcctttt

SEQ ID NO: 154039 - DNA, 15 bp, Homo sapiens
gctattatgtccttt

SEQ ID NO: 154040 - DNA, 15 bp, Homo sapiens
agctattatgtcctt

SEQ ID NO: 154041 - DNA, 15 bp, Homo sapiens
gagctattatgtcct

SEQ ID NO: 154042 - DNA, 15 bp, Homo sapiens
ggagctattatgtcc

SEQ ID NO: 154043 - DNA, 15 bp, Homo sapiens
gggagctattatgtc

SEQ ID NO: 154044 - DNA, 15 bp, Homo sapiens
agggagctattatgt

SEQ ID NO: 154045 - DNA, 15 bp, Homo sapiens
tagggagctattatg

SEQ ID NO: 154046 - DNA, 15 bp, Homo sapiens
ttagggagctattat

SEQ ID NO: 154047 - DNA, 15 bp, Homo sapiens
cttagggagctatta

SEQ ID NO: 154048 - DNA, 15 bp, Homo sapiens
tcttagggagctatt

SEQ ID NO: 154049 - DNA, 15 bp, Homo sapiens
ttcttagggagctat

SEQ ID NO: 154050 - DNA, 15 bp, Homo sapiens
tttcttagggagcta

SEQ ID NO: 154051 - DNA, 15 bp, Homo sapiens
ctttcttagggagct

SEQ ID NO: 154052 - DNA, 15 bp, Homo sapiens
tctttcttagggagc

SEQ ID NO: 154053 - DNA, 15 bp, Homo sapiens
ttctttcttagggag

SEQ ID NO: 154054 - DNA, 15 bp, Homo sapiens
tttctttcttaggga

SEQ ID NO: 154055 - DNA, 15 bp, Homo sapiens
gtttctttcttaggg

SEQ ID NO: 154056 - DNA, 15 bp, Homo sapiens
agtttctttcttagg

SEQ ID NO: 154057 - DNA, 15 bp, Homo sapiens
cagtttctttcttag

SEQ ID NO: 154058 - DNA, 15 bp, Homo sapiens
tcagtttctttctta

SEQ ID NO: 154059 - DNA, 15 bp, Homo sapiens
ttcagtttctttctt

SEQ ID NO: 154060 - DNA, 15 bp, Homo sapiens
tttcagtttctttct

SEQ ID NO: 154061 - DNA, 15 bp, Homo sapiens
ctttcagtttctttc

SEQ ID NO: 154062 - DNA, 15 bp, Homo sapiens
cctttcagtttcttt

SEQ ID NO: 154063 - DNA, 15 bp, Homo sapiens
tcctttcagtttctt

SEQ ID NO: 154064 - DNA, 15 bp, Homo sapiens
ctcctttcagtttct

SEQ ID NO: 154065 - DNA, 15 bp, Homo sapiens
actcctttcagtttc

SEQ ID NO: 154066 - DNA, 15 bp, Homo sapiens
gactcctttcagttt

SEQ ID NO: 154067 - DNA, 15 bp, Homo sapiens
tgactcctttcagtt

SEQ ID NO: 154068 - DNA, 15 bp, Homo sapiens
ttgactcctttcagt

SEQ ID NO: 154069 - DNA, 15 bp, Homo sapiens
gttgactcctttcag

SEQ ID NO: 154070 - DNA, 15 bp, Homo sapiens
agttgactcctttca

SEQ ID NO: 154071 - DNA, 15 bp, Homo sapiens
tagttgactcctttc

SEQ ID NO: 154072 - DNA, 15 bp, Homo sapiens
ttagttgactccttt

SEQ ID NO: 154073 - DNA, 15 bp, Homo sapiens
gttagttgactcctt

SEQ ID NO: 154074 - DNA, 15 bp, Homo sapiens
agttagttgactcct

SEQ ID NO: 154075 - DNA, 15 bp, Homo sapiens
aagttagttgactcc

SEQ ID NO: 154076 - DNA, 15 bp, Homo sapiens
taagttagttgactc

SEQ ID NO: 154077 - DNA, 15 bp, Homo sapiens
ttaagttagttgact

SEQ ID NO: 154078 - DNA, 15 bp, Homo sapiens
gttaagttagttgac

SEQ ID NO: 154079 - DNA, 15 bp, Homo sapiens
tgttaagttagttga

SEQ ID NO: 154080 - DNA, 15 bp, Homo sapiens
ctgttaagttagttg

SEQ ID NO: 154081 - DNA, 15 bp, Homo sapiens
tctgttaagttagtt

SEQ ID NO: 154082 - DNA, 15 bp, Homo sapiens
gtctgttaagttagt

SEQ ID NO: 154083 - DNA, 15 bp, Homo sapiens
agtctgttaagttag

SEQ ID NO: 154084 - DNA, 15 bp, Homo sapiens
cagtctgttaagtta

SEQ ID NO: 154085 - DNA, 15 bp, Homo sapiens
tcagtctgttaagtt

SEQ ID NO: 154086 - DNA, 15 bp, Homo sapiens
ctcagtctgttaagt

SEQ ID NO: 154087 - DNA, 15 bp, Homo sapiens
actcagtctgttaag

SEQ ID NO: 154088 - DNA, 15 bp, Homo sapiens
aactcagtctgttaa

SEQ ID NO: 154089 - DNA, 15 bp, Homo sapiens
caactcagtctgtta

SEQ ID NO: 154090 - DNA, 15 bp, Homo sapiens
acaactcagtctgtt

SEQ ID NO: 154091 - DNA, 15 bp, Homo sapiens
aacaactcagtctgt

SEQ ID NO: 154092 - DNA, 15 bp, Homo sapiens
aaacaactcagtctg

SEQ ID NO: 154093 - DNA, 15 bp, Homo sapiens
taaacaactcagtct

SEQ ID NO: 154094 - DNA, 15 bp, Homo sapiens
ttaaacaactcagtc

SEQ ID NO: 154095 - DNA, 15 bp, Homo sapiens
tttaaacaactcagt

SEQ ID NO: 154096 - DNA, 15 bp, Homo sapiens
ttttaaacaactcag

SEQ ID NO: 154097 - DNA, 15 bp, Homo sapiens
attttaaacaactca

SEQ ID NO: 154098 - DNA, 15 bp, Homo sapiens
tattttaaacaactc

SEQ ID NO: 154099 - DNA, 15 bp, Homo sapiens
ttattttaaacaact

SEQ ID NO: 154100 - DNA, 15 bp, Homo sapiens
cttattttaaacaac

SEQ ID NO: 154101 - DNA, 15 bp, Homo sapiens
tcttattttaaacaa

SEQ ID NO: 154102 - DNA, 15 bp, Homo sapiens
ttcttattttaaaca

SEQ ID NO: 154103 - DNA, 15 bp, Homo sapiens
tttcttattttaaac

SEQ ID NO: 154104 - DNA, 15 bp, Homo sapiens
atttcttattttaaa

SEQ ID NO: 154105 - DNA, 15 bp, Homo sapiens
tatttcttattttaa

SEQ ID NO: 154106 - DNA, 15 bp, Homo sapiens
atatttcttatttta

SEQ ID NO: 154107 - DNA, 15 bp, Homo sapiens
catatttcttatttt

SEQ ID NO: 154108 - DNA, 15 bp, Homo sapiens
acatatttcttattt

SEQ ID NO: 154109 - DNA, 15 bp, Homo sapiens
tacatatttcttatt

SEQ ID NO: 154110 - DNA, 15 bp, Homo sapiens
atacatatttcttat

SEQ ID NO: 154111 - DNA, 15 bp, Homo sapiens
tatacatatttctta

SEQ ID NO: 154112 - DNA, 15 bp, Homo sapiens
atatacatatttctt

SEQ ID NO: 154113 - DNA, 15 bp, Homo sapiens
tatatacatatttct

SEQ ID NO: 154114 - DNA, 15 bp, Homo sapiens
atatatacatatttc

SEQ ID NO: 154115 - DNA, 15 bp, Homo sapiens
aatatatacatattt

SEQ ID NO: 154116 - DNA, 15 bp, Homo sapiens
aaatatatacatatt

SEQ ID NO: 154117 - DNA, 15 bp, Homo sapiens
taaaaatatatacat

SEQ ID NO: 154118 - DNA, 15 bp, Homo sapiens
ttaaaaatatataca

SEQ ID NO: 154119 - DNA, 15 bp, Homo sapiens
tttaaaaatatatac

SEQ ID NO: 154120 - DNA, 15 bp, Homo sapiens
ttttaaaaatatata

SEQ ID NO: 154121 - DNA, 15 bp, Homo sapiens
tttttaaaaatatat

SEQ ID NO: 154122 - DNA, 15 bp, Homo sapiens
ttttttaaaaatata

SEQ ID NO: 154123 - DNA, 15 bp, Homo sapiens
attttttaaaaatat

SEQ ID NO: 154124 - DNA, 15 bp, Homo sapiens
aattttttaaaaata

SEQ ID NO: 154125 - DNA, 15 bp, Homo sapiens
aaattttttaaaaat

SEQ ID NO: 154126 - DNA, 15 bp, Homo sapiens
taaattttttaaaaa

SEQ ID NO: 154127 - DNA, 15 bp, Homo sapiens
ttaaattttttaaaa

SEQ ID NO: 154128 - DNA, 15 bp, Homo sapiens
attaaattttttaaa

SEQ ID NO: 154129 - DNA, 15 bp, Homo sapiens
aattaaattttttaa

SEQ ID NO: 154130 - DNA, 15 bp, Homo sapiens
gaattaaatttttta

SEQ ID NO: 154131 - DNA, 15 bp, Homo sapiens
tgaattaaatttttt

SEQ ID NO: 154132 - DNA, 15 bp, Homo sapiens
ttgaattaaattttt

SEQ ID NO: 154133 - DNA, 15 bp, Homo sapiens
tttgaattaaatttt

SEQ ID NO: 154134 - DNA, 15 bp, Homo sapiens
ctttgaattaaattt

SEQ ID NO: 154135 - DNA, 15 bp, Homo sapiens
tctttgaattaaatt

SEQ ID NO: 154136 - DNA, 15 bp, Homo sapiens
ttctttgaattaaat

SEQ ID NO: 154137 - DNA, 15 bp, Homo sapiens
gttctttgaattaaa

SEQ ID NO: 154138 - DNA, 15 bp, Homo sapiens
tgttctttgaattaa

SEQ ID NO: 154139 - DNA, 15 bp, Homo sapiens
atgttctttgaatta

SEQ ID NO: 154140 - DNA, 15 bp, Homo sapiens
catgttctttgaatt

SEQ ID NO: 154141 - DNA, 15 bp, Homo sapiens
acatgttctttgaat

SEQ ID NO: 154142 - DNA, 15 bp, Homo sapiens
tacatgttctttgaa

SEQ ID NO: 154143 - DNA, 15 bp, Homo sapiens
atacatgttctttga

SEQ ID NO: 154144 - DNA, 15 bp, Homo sapiens
aatacatgttctttg

SEQ ID NO: 154145 - DNA, 15 bp, Homo sapiens
caatacatgttcttt

SEQ ID NO: 154146 - DNA, 15 bp, Homo sapiens
tcaatacatgttctt

SEQ ID NO: 154147 - DNA, 15 bp, Homo sapiens
ttcaatacatgttct

SEQ ID NO: 154148 - DNA, 15 bp, Homo sapiens
attcaatacatgttc

SEQ ID NO: 154149 - DNA, 15 bp, Homo sapiens
cattcaatacatgtt

SEQ ID NO: 154150 - DNA, 15 bp, Homo sapiens
ccattcaatacatgt

SEQ ID NO: 154151 - DNA, 15 bp, Homo sapiens
gccattcaatacatg

SEQ ID NO: 154152 - DNA, 15 bp, Homo sapiens
agccattcaatacat

SEQ ID NO: 154153 - DNA, 15 bp, Homo sapiens
cagccattcaataca

SEQ ID NO: 154154 - DNA, 15 bp, Homo sapiens
acagccattcaatac

SEQ ID NO: 154155 - DNA, 15 bp, Homo sapiens
gacagccattcaata

SEQ ID NO: 154156 - DNA, 15 bp, Homo sapiens
tgacagccattcaat

SEQ ID NO: 154157 - DNA, 15 bp, Homo sapiens
atgacagccattcaa

SEQ ID NO: 154158 - DNA, 15 bp, Homo sapiens
catgacagccattca

SEQ ID NO: 154159 - DNA, 15 bp, Homo sapiens
gcatgacagccattc

SEQ ID NO: 154160 - DNA, 15 bp, Homo sapiens
tgcatgacagccatt

SEQ ID NO: 154161 - DNA, 15 bp, Homo sapiens
atgcatgacagccat

SEQ ID NO: 154162 - DNA, 15 bp, Homo sapiens
gatgcatgacagcca

SEQ ID NO: 154163 - DNA, 15 bp, Homo sapiens
tgatgcatgacagcc

SEQ ID NO: 154164 - DNA, 15 bp, Homo sapiens
ctgatgcatgacagc

SEQ ID NO: 154165 - DNA, 15 bp, Homo sapiens
tctgatgcatgacag

SEQ ID NO: 154166 - DNA, 15 bp, Homo sapiens
ctctgatgcatgaca

SEQ ID NO: 154167 - DNA, 15 bp, Homo sapiens
tctctgatgcatgac

SEQ ID NO: 154168 - DNA, 15 bp, Homo sapiens
atctctgatgcatga

SEQ ID NO: 154169 - DNA, 15 bp, Homo sapiens
tatctctgatgcatg

SEQ ID NO: 154170 - DNA, 15 bp, Homo sapiens
atatctctgatgcat

SEQ ID NO: 154171 - DNA, 15 bp, Homo sapiens
catatctctgatgca

SEQ ID NO: 154172 - DNA, 15 bp, Homo sapiens
acatatctctgatgc

SEQ ID NO: 154173 - DNA, 15 bp, Homo sapiens
cacatatctctgatg

SEQ ID NO: 154174 - DNA, 15 bp, Homo sapiens
gcacatatctctgat

SEQ ID NO: 154175 - DNA, 15 bp, Homo sapiens
agcacatatctctga

SEQ ID NO: 154176 - DNA, 15 bp, Homo sapiens
tagcacatatctctg

SEQ ID NO: 154177 - DNA, 15 bp, Homo sapiens
ttagcacatatctct

SEQ ID NO: 154178 - DNA, 15 bp, Homo sapiens
cttagcacatatctc

SEQ ID NO: 154179 - DNA, 15 bp, Homo sapiens
gcttagcacatatct

SEQ ID NO: 154180 - DNA, 15 bp, Homo sapiens
tgcttagcacatatc

SEQ ID NO: 154181 - DNA, 15 bp, Homo sapiens
ctgcttagcacatat

SEQ ID NO: 154182 - DNA, 15 bp, Homo sapiens
gctgcttagcacata

SEQ ID NO: 154183 - DNA, 15 bp, Homo sapiens
tgctgcttagcacat

SEQ ID NO: 154184 - DNA, 15 bp, Homo sapiens
atgctgcttagcaca

SEQ ID NO: 154185 - DNA, 15 bp, Homo sapiens
tatgctgcttagcac

SEQ ID NO: 154186 - DNA, 15 bp, Homo sapiens
ttatgctgcttagca

SEQ ID NO: 154187 - DNA, 15 bp, Homo sapiens
tttatgctgcttagc

SEQ ID NO: 154188 - DNA, 15 bp, Homo sapiens
atttatgctgcttag

SEQ ID NO: 154189 - DNA, 15 bp, Homo sapiens
catttatgctgctta

SEQ ID NO: 154190 - DNA, 15 bp, Homo sapiens
acatttatgctgctt

SEQ ID NO: 154191 - DNA, 15 bp, Homo sapiens
tacatttatgctgct

SEQ ID NO: 154192 - DNA, 15 bp, Homo sapiens
ttacatttatgctgc

SEQ ID NO: 154193 - DNA, 15 bp, Homo sapiens
tttacatttatgctg

SEQ ID NO: 154194 - DNA, 15 bp, Homo sapiens
ttttacatttatgct

SEQ ID NO: 154195 - DNA, 15 bp, Homo sapiens
attttacatttatgc

SEQ ID NO: 154196 - DNA, 15 bp, Homo sapiens
cattttacatttatg

SEQ ID NO: 154197 - DNA, 15 bp, Homo sapiens
gcattttacatttat

SEQ ID NO: 154198 - DNA, 15 bp, Homo sapiens
tgcattttacattta

SEQ ID NO: 154199 - DNA, 15 bp, Homo sapiens
ctgcattttacattt

SEQ ID NO: 154200 - DNA, 15 bp, Homo sapiens
actgcattttacatt

SEQ ID NO: 154201 - DNA, 15 bp, Homo sapiens
cactgcattttacat

SEQ ID NO: 154202 - DNA, 15 bp, Homo sapiens
acactgcattttaca

SEQ ID NO: 154203 - DNA, 15 bp, Homo sapiens
aacactgcattttac

SEQ ID NO: 154204 - DNA, 15 bp, Homo sapiens
caacactgcatttta

SEQ ID NO: 154205 - DNA, 15 bp, Homo sapiens
gcaacactgcatttt

SEQ ID NO: 154206 - DNA, 15 bp, Homo sapiens
tgcaacactgcattt

SEQ ID NO: 154207 - DNA, 15 bp, Homo sapiens
atgcaacactgcatt

SEQ ID NO: 154208 - DNA, 15 bp, Homo sapiens
aatgcaacactgcat

SEQ ID NO: 154209 - DNA, 15 bp, Homo sapiens
aaatgcaacactgca

SEQ ID NO: 154210 - DNA, 15 bp, Homo sapiens
aaaatgcaacactgc

SEQ ID NO: 154211 - DNA, 15 bp, Homo sapiens
gaaaatgcaacactg

SEQ ID NO: 154212 - DNA, 15 bp, Homo sapiens
ggaaaatgcaacact

SEQ ID NO: 154213 - DNA, 15 bp, Homo sapiens
tggaaaatgcaacac

SEQ ID NO: 154214 - DNA, 15 bp, Homo sapiens
atggaaaatgcaaca

SEQ ID NO: 154215 - DNA, 15 bp, Homo sapiens
catggaaaatgcaac

SEQ ID NO: 154216 - DNA, 15 bp, Homo sapiens
ccatggaaaatgcaa

SEQ ID NO: 154217 - DNA, 15 bp, Homo sapiens
cccatggaaaatgca

SEQ ID NO: 154218 - DNA, 15 bp, Homo sapiens
tcccatggaaaatgc

SEQ ID NO: 154219 - DNA, 15 bp, Homo sapiens
ttcccatggaaaatg

SEQ ID NO: 154220 - DNA, 15 bp, Homo sapiens
tttcccatggaaaat

SEQ ID NO: 154221 - DNA, 15 bp, Homo sapiens
gtttcccatggaaaa

SEQ ID NO: 154222 - DNA, 15 bp, Homo sapiens
tgtttcccatggaaa

SEQ ID NO: 154223 - DNA, 15 bp, Homo sapiens
ttgtttcccatggaa

SEQ ID NO: 154224 - DNA, 15 bp, Homo sapiens
cttgtttcccatgga

SEQ ID NO: 154225 - DNA, 15 bp, Homo sapiens
ccttgtttcccatgg

SEQ ID NO: 154226 - DNA, 15 bp, Homo sapiens
tccttgtttcccatg

SEQ ID NO: 154227 - DNA, 15 bp, Homo sapiens
ttccttgtttcccat

SEQ ID NO: 154228 - DNA, 15 bp, Homo sapiens
cttccttgtttccca

SEQ ID NO: 154229 - DNA, 15 bp, Homo sapiens
acttccttgtttccc

SEQ ID NO: 154230 - DNA, 15 bp, Homo sapiens
tacttccttgtttcc

SEQ ID NO: 154231 - DNA, 15 bp, Homo sapiens
gtacttccttgtttc

SEQ ID NO: 154232 - DNA, 15 bp, Homo sapiens
tgtacttccttgttt

SEQ ID NO: 154233 - DNA, 15 bp, Homo sapiens
ttgtacttccttgtt

SEQ ID NO: 154234 - DNA, 15 bp, Homo sapiens
tttgtacttccttgt

SEQ ID NO: 154235 - DNA, 15 bp, Homo sapiens
atttgtacttccttg

SEQ ID NO: 154236 - DNA, 15 bp, Homo sapiens
tatttgtacttcctt

SEQ ID NO: 154237 - DNA, 15 bp, Homo sapiens
atatttgtacttcct

SEQ ID NO: 154238 - DNA, 15 bp, Homo sapiens
catatttgtacttcc

SEQ ID NO: 154239 - DNA, 15 bp, Homo sapiens
acatatttgtacttc

SEQ ID NO: 154240 - DNA, 15 bp, Homo sapiens
aacatatttgtactt

SEQ ID NO: 154241 - DNA, 15 bp, Homo sapiens
caacatatttgtact

SEQ ID NO: 154242 - DNA, 15 bp, Homo sapiens
acaacatatttgtac

SEQ ID NO: 154243 - DNA, 15 bp, Homo sapiens
aacaacatatttgta

SEQ ID NO: 154244 - DNA, 15 bp, Homo sapiens
gaacaacatatttgt

SEQ ID NO: 154245 - DNA, 15 bp, Homo sapiens
agaacaacatatttg

SEQ ID NO: 154246 - DNA, 15 bp, Homo sapiens
cagaacaacatattt

SEQ ID NO: 154247 - DNA, 15 bp, Homo sapiens
tcagaacaacatatt

SEQ ID NO: 154248 - DNA, 15 bp, Homo sapiens
ctcagaacaacatat

SEQ ID NO: 154249 - DNA, 15 bp, Homo sapiens
cctcagaacaacata

SEQ ID NO: 154250 - DNA, 15 bp, Homo sapiens
tcctcagaacaacat

SEQ ID NO: 154251 - DNA, 15 bp, Homo sapiens
ttcctcagaacaaca

SEQ ID NO: 154252 - DNA, 15 bp, Homo sapiens
attcctcagaacaac

SEQ ID NO: 154253 - DNA, 15 bp, Homo sapiens
aattcctcagaacaa

SEQ ID NO: 154254 - DNA, 15 bp, Homo sapiens
aaattcctcagaaca

SEQ ID NO: 154255 - DNA, 15 bp, Homo sapiens
aaaattcctcagaac

SEQ ID NO: 154256 - DNA, 15 bp, Homo sapiens
taaaattcctcagaa

SEQ ID NO: 154257 - DNA, 15 bp, Homo sapiens
ctaaaattcctcaga

SEQ ID NO: 154258 - DNA, 15 bp, Homo sapiens
actaaaattcctcag

SEQ ID NO: 154259 - DNA, 15 bp, Homo sapiens
gactaaaattcctca

SEQ ID NO: 154260 - DNA, 15 bp, Homo sapiens
cgactaaaattcctc

SEQ ID NO: 154261 - DNA, 15 bp, Homo sapiens
acgactaaaattcct

SEQ ID NO: 154262 - DNA, 15 bp, Homo sapiens
aacgactaaaattcc

SEQ ID NO: 154263 - DNA, 15 bp, Homo sapiens
gaacgactaaaattc

SEQ ID NO: 154264 - DNA, 15 bp, Homo sapiens
tgaacgactaaaatt

SEQ ID NO: 154265 - DNA, 15 bp, Homo sapiens
gtgaacgactaaaat

SEQ ID NO: 154266 - DNA, 15 bp, Homo sapiens
tgtgaacgactaaaa

SEQ ID NO: 154267 - DNA, 15 bp, Homo sapiens
gtgtgaacgactaaa

SEQ ID NO: 154268 - DNA, 15 bp, Homo sapiens
cgtgtgaacgactaa

SEQ ID NO: 154269 - DNA, 15 bp, Homo sapiens
tcgtgtgaacgacta

SEQ ID NO: 154270 - DNA, 15 bp, Homo sapiens
ctcgtgtgaacgact

SEQ ID NO: 154271 - DNA, 15 bp, Homo sapiens
actcgtgtgaacgac

SEQ ID NO: 154272 - DNA, 15 bp, Homo sapiens
gactcgtgtgaacga

SEQ ID NO: 154273 - DNA, 15 bp, Homo sapiens
agactcgtgtgaacg

SEQ ID NO: 154274 - DNA, 15 bp, Homo sapiens
tagactcgtgtgaac

SEQ ID NO: 154275 - DNA, 15 bp, Homo sapiens
ctagactcgtgtgaa

SEQ ID NO: 154276 - DNA, 15 bp, Homo sapiens
gctagactcgtgtga

SEQ ID NO: 154277 - DNA, 15 bp, Homo sapiens
cgctagactcgtgtg

SEQ ID NO: 154278 - DNA, 15 bp, Homo sapiens
acgctagactcgtgt

SEQ ID NO: 154279 - DNA, 15 bp, Homo sapiens
cacgctagactcgtg

SEQ ID NO: 154280 - DNA, 15 bp, Homo sapiens
tcacgctagactcgt

SEQ ID NO: 154281 - DNA, 15 bp, Homo sapiens
ctcacgctagactcg

SEQ ID NO: 154282 - DNA, 15 bp, Homo sapiens
tctcacgctagactc

SEQ ID NO: 154283 - DNA, 15 bp, Homo sapiens
gtctcacgctagact

SEQ ID NO: 154284 - DNA, 15 bp, Homo sapiens
agtctcacgctagac

SEQ ID NO: 154285 - DNA, 15 bp, Homo sapiens
tagtctcacgctaga

SEQ ID NO: 154286 - DNA, 15 bp, Homo sapiens
ttagtctcacgctag

SEQ ID NO: 154287 - DNA, 15 bp, Homo sapiens
tttagtctcacgcta

SEQ ID NO: 154288 - DNA, 15 bp, Homo sapiens
atttagtctcacgct

SEQ ID NO: 154289 - DNA, 15 bp, Homo sapiens
aatttagtctcacgc

SEQ ID NO: 154290 - DNA, 15 bp, Homo sapiens
gaatttagtctcacg

SEQ ID NO: 154291 - DNA, 15 bp, Homo sapiens
tgaatttagtctcac

SEQ ID NO: 154292 - DNA, 15 bp, Homo sapiens
ttgaatttagtctca

SEQ ID NO: 154293 - DNA, 15 bp, Homo sapiens
tttgaatttagtctc

SEQ ID NO: 154294 - DNA, 15 bp, Homo sapiens
gtttgaatttagtct

SEQ ID NO: 154295 - DNA, 15 bp, Homo sapiens
tgtttgaatttagtc

SEQ ID NO: 154296 - DNA, 15 bp, Homo sapiens
ctgtttgaatttagt

SEQ ID NO: 154297 - DNA, 15 bp, Homo sapiens
actgtttgaatttag

SEQ ID NO: 154298 - DNA, 15 bp, Homo sapiens
aactgtttgaattta

SEQ ID NO: 154299 - DNA, 15 bp, Homo sapiens
gaactgtttgaattt

SEQ ID NO: 154300 - DNA, 15 bp, Homo sapiens
agaactgtttgaatt

SEQ ID NO: 154301 - DNA, 15 bp, Homo sapiens
cagaactgtttgaat

SEQ ID NO: 154302 - DNA, 15 bp, Homo sapiens
ccagaactgtttgaa

SEQ ID NO: 154303 - DNA, 15 bp, Homo sapiens
gccagaactgtttga

SEQ ID NO: 154304 - DNA, 15 bp, Homo sapiens
agccagaactgtttg

SEQ ID NO: 154305 - DNA, 15 bp, Homo sapiens
aagccagaactgttt

SEQ ID NO: 154306 - DNA, 15 bp, Homo sapiens
aaagccagaactgtt

SEQ ID NO: 154307 - DNA, 15 bp, Homo sapiens
caaagccagaactgt

SEQ ID NO: 154308 - DNA, 15 bp, Homo sapiens
gcaaagccagaactg

SEQ ID NO: 154309 - DNA, 15 bp, Homo sapiens
ggcaaagccagaact

SEQ ID NO: 154310 - DNA, 15 bp, Homo sapiens
tggcaaagccagaac

SEQ ID NO: 154311 - DNA, 15 bp, Homo sapiens
gtggcaaagccagaa

SEQ ID NO: 154312 - DNA, 15 bp, Homo sapiens
agtggcaaagccaga

SEQ ID NO: 154313 - DNA, 15 bp, Homo sapiens
aagtggcaaagccag

SEQ ID NO: 154314 - DNA, 15 bp, Homo sapiens
taagtggcaaagcca

SEQ ID NO: 154315 - DNA, 15 bp, Homo sapiens
gtaagtggcaaagcc

SEQ ID NO: 154316 - DNA, 15 bp, Homo sapiens
ggtaagtggcaaagc

SEQ ID NO: 154317 - DNA, 15 bp, Homo sapiens
tggtaagtggcaaag

SEQ ID NO: 154318 - DNA, 15 bp, Homo sapiens
ctggtaagtggcaaa

SEQ ID NO: 154319 - DNA, 15 bp, Homo sapiens
actggtaagtggcaa

SEQ ID NO: 154320 - DNA, 15 bp, Homo sapiens
aactggtaagtggca

SEQ ID NO: 154321 - DNA, 15 bp, Homo sapiens
taactggtaagtggc

SEQ ID NO: 154322 - DNA, 15 bp, Homo sapiens
ataactggtaagtgg

SEQ ID NO: 154323 - DNA, 15 bp, Homo sapiens
cataactggtaagtg

SEQ ID NO: 154324 - DNA, 15 bp, Homo sapiens
acataactggtaagt

SEQ ID NO: 154325 - DNA, 15 bp, Homo sapiens
tacataactggtaag

SEQ ID NO: 154326 - DNA, 15 bp, Homo sapiens
ttacataactggtaa

SEQ ID NO: 154327 - DNA, 15 bp, Homo sapiens
gttacataactggta

SEQ ID NO: 154328 - DNA, 15 bp, Homo sapiens
ggttacataactggt

SEQ ID NO: 154329 - DNA, 15 bp, Homo sapiens
aggttacataactgg

SEQ ID NO: 154330 - DNA, 15 bp, Homo sapiens
aaggttacataactg

SEQ ID NO: 154331 - DNA, 15 bp, Homo sapiens
caaggttacataact

SEQ ID NO: 154332 - DNA, 15 bp, Homo sapiens
ccaaggttacataac

SEQ ID NO: 154333 - DNA, 15 bp, Homo sapiens
gccaaggttacataa

SEQ ID NO: 154334 - DNA, 15 bp, Homo sapiens
tgccaaggttacata

SEQ ID NO: 154335 - DNA, 15 bp, Homo sapiens
ttgccaaggttacat

SEQ ID NO: 154336 - DNA, 15 bp, Homo sapiens
tttgccaaggttaca

SEQ ID NO: 154337 - DNA, 15 bp, Homo sapiens
atttgccaaggttac

SEQ ID NO: 154338 - DNA, 15 bp, Homo sapiens
gatttgccaaggtta

SEQ ID NO: 154339 - DNA, 15 bp, Homo sapiens
ggatttgccaaggtt

SEQ ID NO: 154340 - DNA, 15 bp, Homo sapiens
aggatttgccaaggt

SEQ ID NO: 154341 - DNA, 15 bp, Homo sapiens
aaggatttgccaagg

SEQ ID NO: 154342 - DNA, 15 bp, Homo sapiens
gaaggatttgccaag

SEQ ID NO: 154343 - DNA, 15 bp, Homo sapiens
ggaaggatttgccaa

SEQ ID NO: 154344 - DNA, 15 bp, Homo sapiens
tggaaggatttgcca

SEQ ID NO: 154345 - DNA, 15 bp, Homo sapiens
gtggaaggatttgcc

SEQ ID NO: 154346 - DNA, 15 bp, Homo sapiens
tgtggaaggatttgc

SEQ ID NO: 154347 - DNA, 15 bp, Homo sapiens
atgtggaaggatttg

SEQ ID NO: 154348 - DNA, 15 bp, Homo sapiens
gatgtggaaggattt

SEQ ID NO: 154349 - DNA, 15 bp, Homo sapiens
agatgtggaaggatt

SEQ ID NO: 154350 - DNA, 15 bp, Homo sapiens
gagatgtggaaggat

SEQ ID NO: 154351 - DNA, 15 bp, Homo sapiens
agagatgtggaagga

SEQ ID NO: 154352 - DNA, 15 bp, Homo sapiens
cagagatgtggaagg

SEQ ID NO: 154353 - DNA, 15 bp, Homo sapiens
acagagatgtggaag

SEQ ID NO: 154354 - DNA, 15 bp, Homo sapiens
cacagagatgtggaa

SEQ ID NO: 154355 - DNA, 15 bp, Homo sapiens
acacagagatgtgga

SEQ ID NO: 154356 - DNA, 15 bp, Homo sapiens
aacacagagatgtgg

SEQ ID NO: 154357 - DNA, 15 bp, Homo sapiens
aaacacagagatgtg

SEQ ID NO: 154358 - DNA, 15 bp, Homo sapiens
gaaacacagagatgt

SEQ ID NO: 154359 - DNA, 15 bp, Homo sapiens
tgaaacacagagatg

SEQ ID NO: 154360 - DNA, 15 bp, Homo sapiens
ctgaaacacagagat

SEQ ID NO: 154361 - DNA, 15 bp, Homo sapiens
actgaaacacagaga

SEQ ID NO: 154362 - DNA, 15 bp, Homo sapiens
aactgaaacacagag

SEQ ID NO: 154363 - DNA, 15 bp, Homo sapiens
gaactgaaacacaga

SEQ ID NO: 154364 - DNA, 15 bp, Homo sapiens
ggaactgaaacacag

SEQ ID NO: 154365 - DNA, 15 bp, Homo sapiens
gggaactgaaacaca

SEQ ID NO: 154366 - DNA, 15 bp, Homo sapiens
agggaactgaaacac

SEQ ID NO: 154367 - DNA, 15 bp, Homo sapiens
aagggaactgaaaca

SEQ ID NO: 154368 - DNA, 15 bp, Homo sapiens
aaagggaactgaaac

SEQ ID NO: 154369 - DNA, 15 bp, Homo sapiens
aaaagggaactgaaa

SEQ ID NO: 154370 - DNA, 15 bp, Homo sapiens
gaaaagggaactgaa

SEQ ID NO: 154371 - DNA, 15 bp, Homo sapiens
tgaaaagggaactga

SEQ ID NO: 154372 - DNA, 15 bp, Homo sapiens
ctgaaaagggaactg

SEQ ID NO: 154373 - DNA, 15 bp, Homo sapiens
tctgaaaagggaact

SEQ ID NO: 154374 - DNA, 15 bp, Homo sapiens
ttctgaaaagggaac

SEQ ID NO: 154375 - DNA, 15 bp, Homo sapiens
cttctgaaaagggaa

SEQ ID NO: 154376 - DNA, 15 bp, Homo sapiens
tcttctgaaaaggga

SEQ ID NO: 154377 - DNA, 15 bp, Homo sapiens
atcttctgaaaaggg

SEQ ID NO: 154378 - DNA, 15 bp, Homo sapiens
tatcttctgaaaagg

SEQ ID NO: 154379 - DNA, 15 bp, Homo sapiens
ctatcttctgaaaag

SEQ ID NO: 154380 - DNA, 15 bp, Homo sapiens
cctatcttctgaaaa

SEQ ID NO: 154381 - DNA, 15 bp, Homo sapiens
ccctatcttctgaaa

SEQ ID NO: 154382 - DNA, 15 bp, Homo sapiens
accctatcttctgaa

SEQ ID NO: 154383 - DNA, 15 bp, Homo sapiens
aaccctatcttctga

SEQ ID NO: 154384 - DNA, 15 bp, Homo sapiens
caaccctatcttctg

SEQ ID NO: 154385 - DNA, 15 bp, Homo sapiens
ccaaccctatcttct

SEQ ID NO: 154386 - DNA, 15 bp, Homo sapiens
tccaaccctatcttc

SEQ ID NO: 154387 - DNA, 15 bp, Homo sapiens
ttccaaccctatctt

SEQ ID NO: 154388 - DNA, 15 bp, Homo sapiens
attccaaccctatct

SEQ ID NO: 154389 - DNA, 15 bp, Homo sapiens
aattccaaccctatc

SEQ ID NO: 154390 - DNA, 15 bp, Homo sapiens
taattccaaccctat

SEQ ID NO: 154391 - DNA, 15 bp, Homo sapiens
ctaattccaacccta

SEQ ID NO: 154392 - DNA, 15 bp, Homo sapiens
actaattccaaccct

SEQ ID NO: 154393 - DNA, 15 bp, Homo sapiens
gactaattccaaccc

SEQ ID NO: 154394 - DNA, 15 bp, Homo sapiens
agactaattccaacc

SEQ ID NO: 154395 - DNA, 15 bp, Homo sapiens
gagactaattccaac

SEQ ID NO: 154396 - DNA, 15 bp, Homo sapiens
agagactaattccaa

SEQ ID NO: 154397 - DNA, 15 bp, Homo sapiens
gagagactaattcca

SEQ ID NO: 154398 - DNA, 15 bp, Homo sapiens
agagagactaattcc

SEQ ID NO: 154399 - DNA, 15 bp, Homo sapiens
gagagagactaattc

SEQ ID NO: 154400 - DNA, 15 bp, Homo sapiens
agagagagactaatt

SEQ ID NO: 154401 - DNA, 15 bp, Homo sapiens
gagagagagactaat

SEQ ID NO: 154402 - DNA, 15 bp, Homo sapiens
agagagagagactaa

SEQ ID NO: 154403 - DNA, 15 bp, Homo sapiens
gagagagagagacta

SEQ ID NO: 154404 - DNA, 15 bp, Homo sapiens
agagagagagagact

SEQ ID NO: 154405 - DNA, 15 bp, Homo sapiens
tagattgagagagag

SEQ ID NO: 154406 - DNA, 15 bp, Homo sapiens
gtagattgagagaga

SEQ ID NO: 154407 - DNA, 15 bp, Homo sapiens
tgtagattgagagag

SEQ ID NO: 154408 - DNA, 15 bp, Homo sapiens
gtgtagattgagaga

SEQ ID NO: 154409 - DNA, 15 bp, Homo sapiens
tgtgtagattgagag

SEQ ID NO: 154410 - DNA, 15 bp, Homo sapiens
gtgtgtagattgaga

SEQ ID NO: 154411 - DNA, 15 bp, Homo sapiens
tgtgtgtagattgag

SEQ ID NO: 154412 - DNA, 15 bp, Homo sapiens
gtgtgtgtagattga

SEQ ID NO: 154413 - DNA, 15 bp, Homo sapiens
tgtgtgtgtagattg

SEQ ID NO: 154414 - DNA, 15 bp, Homo sapiens
gtgtgtgtgtagatt

SEQ ID NO: 154415 - DNA, 15 bp, Homo sapiens
tgtgtgtgtgtagat

SEQ ID NO: 154416 - DNA, 15 bp, Homo sapiens
gtgtgtgtgtgtaga

SEQ ID NO: 154417 - DNA, 15 bp, Homo sapiens
tgtgtgtgtgtgtag

SEQ ID NO: 154418 - DNA, 15 bp, Homo sapiens
atgtgcgtgtgtgtg

SEQ ID NO: 154419 - DNA, 15 bp, Homo sapiens
catgtgcgtgtgtgt

SEQ ID NO: 154420 - DNA, 15 bp, Homo sapiens
gcatgtgcgtgtgtg

SEQ ID NO: 154421 - DNA, 15 bp, Homo sapiens
tgcatgtgcgtgtgt

SEQ ID NO: 154422 - DNA, 15 bp, Homo sapiens
gtgcatgtgcgtgtg

SEQ ID NO: 154423 - DNA, 15 bp, Homo sapiens
tgtgcatgtgcgtgt

SEQ ID NO: 154424 - DNA, 15 bp, Homo sapiens
gtgtgcatgtgcgtg

SEQ ID NO: 154425 - DNA, 15 bp, Homo sapiens
tgtgtgcatgtgcgt

SEQ ID NO: 154426 - DNA, 15 bp, Homo sapiens
gtgtgtgcatgtgcg

SEQ ID NO: 154427 - DNA, 15 bp, Homo sapiens
tgtgtgtgcatgtgc

SEQ ID NO: 154428 - DNA, 15 bp, Homo sapiens
gtgtgtgtgcatgtg

SEQ ID NO: 154429 - DNA, 15 bp, Homo sapiens
tgtgtgtgtgcatgt

SEQ ID NO: 154430 - DNA, 15 bp, Homo sapiens
gtgtgtgtgtgcatg

SEQ ID NO: 154431 - DNA, 15 bp, Homo sapiens
tgtgtgtgtgtgcat

SEQ ID NO: 154432 - DNA, 15 bp, Homo sapiens
gtgtgtgtgtgtgca

SEQ ID NO: 154433 - DNA, 15 bp, Homo sapiens
tgtgtgtgtgtgtgc

SEQ ID NO: 154434 - DNA, 15 bp, Homo sapiens
tatgtgtgtgtgtgt

SEQ ID NO: 154435 - DNA, 15 bp, Homo sapiens
ttatgtgtgtgtgtg

SEQ ID NO: 154436 - DNA, 15 bp, Homo sapiens
cttatgtgtgtgtgt

SEQ ID NO: 154437 - DNA, 15 bp, Homo sapiens
ccttatgtgtgtgtg

SEQ ID NO: 154438 - DNA, 15 bp, Homo sapiens
accttatgtgtgtgt

SEQ ID NO: 154439 - DNA, 15 bp, Homo sapiens
aaccttatgtgtgtg

SEQ ID NO: 154440 - DNA, 15 bp, Homo sapiens
caaccttatgtgtgt

SEQ ID NO: 154441 - DNA, 15 bp, Homo sapiens
acaaccttatgtgtg

SEQ ID NO: 154442 - DNA, 15 bp, Homo sapiens
aacaaccttatgtgt

SEQ ID NO: 154443 - DNA, 15 bp, Homo sapiens
caacaaccttatgtg

SEQ ID NO: 154444 - DNA, 15 bp, Homo sapiens
acaacaaccttatgt

SEQ ID NO: 154445 - DNA, 15 bp, Homo sapiens
tacaacaaccttatg

SEQ ID NO: 154446 - DNA, 15 bp, Homo sapiens
ctacaacaaccttat

SEQ ID NO: 154447 - DNA, 15 bp, Homo sapiens
cctacaacaacctta

SEQ ID NO: 154448 - DNA, 15 bp, Homo sapiens
tcctacaacaacctt

SEQ ID NO: 154449 - DNA, 15 bp, Homo sapiens
ctcctacaacaacct

SEQ ID NO: 154450 - DNA, 15 bp, Homo sapiens
actcctacaacaacc

SEQ ID NO: 154451 - DNA, 15 bp, Homo sapiens
aactcctacaacaac

SEQ ID NO: 154452 - DNA, 15 bp, Homo sapiens
taactcctacaacaa

SEQ ID NO: 154453 - DNA, 15 bp, Homo sapiens
ttaactcctacaaca

SEQ ID NO: 154454 - DNA, 15 bp, Homo sapiens
tttaactcctacaac

SEQ ID NO: 154455 - DNA, 15 bp, Homo sapiens
atttaactcctacaa

SEQ ID NO: 154456 - DNA, 15 bp, Homo sapiens
tatttaactcctaca

SEQ ID NO: 154457 - DNA, 15 bp, Homo sapiens
ttatttaactcctac

SEQ ID NO: 154458 - DNA, 15 bp, Homo sapiens
cttatttaactccta

SEQ ID NO: 154459 - DNA, 15 bp, Homo sapiens
acttatttaactcct

SEQ ID NO: 154460 - DNA, 15 bp, Homo sapiens
aacttatttaactcc

SEQ ID NO: 154461 - DNA, 15 bp, Homo sapiens
taacttatttaactc

SEQ ID NO: 154462 - DNA, 15 bp, Homo sapiens
ttaacttatttaact

SEQ ID NO: 154463 - DNA, 15 bp, Homo sapiens
attaacttatttaac

SEQ ID NO: 154464 - DNA, 15 bp, Homo sapiens
tattaacttatttaa

SEQ ID NO: 154465 - DNA, 15 bp, Homo sapiens
atattaacttattta

SEQ ID NO: 154466 - DNA, 15 bp, Homo sapiens
aatattaacttattt

SEQ ID NO: 154467 - DNA, 15 bp, Homo sapiens
caatattaacttatt

SEQ ID NO: 154468 - DNA, 15 bp, Homo sapiens
tcaatattaacttat

SEQ ID NO: 154469 - DNA, 15 bp, Homo sapiens
atcaatattaactta

SEQ ID NO: 154470 - DNA, 15 bp, Homo sapiens
tatcaatattaactt

SEQ ID NO: 154471 - DNA, 15 bp, Homo sapiens
ttatcaatattaact

SEQ ID NO: 154472 - DNA, 15 bp, Homo sapiens
tttatcaatattaac

SEQ ID NO: 154473 - DNA, 15 bp, Homo sapiens
ttttatcaatattaa

SEQ ID NO: 154474 - DNA, 15 bp, Homo sapiens
attttatcaatatta

SEQ ID NO: 154475 - DNA, 15 bp, Homo sapiens
cattttatcaatatt

SEQ ID NO: 154476 - DNA, 15 bp, Homo sapiens
ccattttatcaatat

SEQ ID NO: 154477 - DNA, 15 bp, Homo sapiens
accattttatcaata

SEQ ID NO: 154478 - DNA, 15 bp, Homo sapiens
taccattttatcaat

SEQ ID NO: 154479 - DNA, 15 bp, Homo sapiens
ttaccattttatcaa

SEQ ID NO: 154480 - DNA, 15 bp, Homo sapiens
tttaccattttatca

SEQ ID NO: 154481 - DNA, 15 bp, Homo sapiens
ttttaccattttatc

SEQ ID NO: 154482 - DNA, 15 bp, Homo sapiens
tttttaccattttat

SEQ ID NO: 154483 - DNA, 15 bp, Homo sapiens
gtttttaccatttta

SEQ ID NO: 154484 - DNA, 15 bp, Homo sapiens
tgtttttaccatttt

SEQ ID NO: 154485 - DNA, 15 bp, Homo sapiens
ttgtttttaccattt

SEQ ID NO: 154486 - DNA, 15 bp, Homo sapiens
tttgtttttaccatt

SEQ ID NO: 154487 - DNA, 15 bp, Homo sapiens
ctttgtttttaccat

SEQ ID NO: 154488 - DNA, 15 bp, Homo sapiens
gctttgtttttacca

SEQ ID NO: 154489 - DNA, 15 bp, Homo sapiens
ggctttgtttttacc

SEQ ID NO: 154490 - DNA, 15 bp, Homo sapiens
aggctttgtttttac

SEQ ID NO: 154491 - DNA, 15 bp, Homo sapiens
caggctttgttttta

SEQ ID NO: 154492 - DNA, 15 bp, Homo sapiens
ccaggctttgttttt

SEQ ID NO: 154493 - DNA, 15 bp, Homo sapiens
gccaggctttgtttt

SEQ ID NO: 154494 - DNA, 15 bp, Homo sapiens
tgccaggctttgttt

SEQ ID NO: 154495 - DNA, 15 bp, Homo sapiens
gtgccaggctttgtt

SEQ ID NO: 154496 - DNA, 15 bp, Homo sapiens
ttcactacctatcaa

SEQ ID NO: 154497 - DNA, 15 bp, Homo sapiens
attcactacctatca

SEQ ID NO: 154498 - DNA, 15 bp, Homo sapiens
tattcactacctatc

SEQ ID NO: 154499 - DNA, 15 bp, Homo sapiens
ttattcactacctat

SEQ ID NO: 154500 - DNA, 15 bp, Homo sapiens
gttattcactaccta

SEQ ID NO: 154501 - DNA, 15 bp, Homo sapiens
ggttattcactacct

SEQ ID NO: 154502 - DNA, 15 bp, Homo sapiens
aggttattcactacc

SEQ ID NO: 154503 - DNA, 15 bp, Homo sapiens
caggttattcactac

SEQ ID NO: 154504 - DNA, 15 bp, Homo sapiens
tcaggttattcacta

SEQ ID NO: 154505 - DNA, 15 bp, Homo sapiens
ttcaggttattcact

SEQ ID NO: 154506 - DNA, 15 bp, Homo sapiens
attcaggttattcac

SEQ ID NO: 154507 - DNA, 15 bp, Homo sapiens
aattcaggttattca

SEQ ID NO: 154508 - DNA, 15 bp, Homo sapiens
taattcaggttattc

SEQ ID NO: 154509 - DNA, 15 bp, Homo sapiens
ttaattcaggttatt

SEQ ID NO: 154510 - DNA, 15 bp, Homo sapiens
attaattcaggttat

SEQ ID NO: 154511 - DNA, 15 bp, Homo sapiens
cattaattcaggtta

SEQ ID NO: 154512 - DNA, 15 bp, Homo sapiens
tcattaattcaggtt

SEQ ID NO: 154513 - DNA, 15 bp, Homo sapiens
gtcattaattcaggt

SEQ ID NO: 154514 - DNA, 15 bp, Homo sapiens
ggtcattaattcagg

SEQ ID NO: 154515 - DNA, 15 bp, Homo sapiens
tggtcattaattcag

SEQ ID NO: 154516 - DNA, 15 bp, Homo sapiens
atggtcattaattca

SEQ ID NO: 154517 - DNA, 15 bp, Homo sapiens
tatggtcattaattc

SEQ ID NO: 154518 - DNA, 15 bp, Homo sapiens
ttatggtcattaatt

SEQ ID NO: 154519 - DNA, 15 bp, Homo sapiens
attatggtcattaat

SEQ ID NO: 154520 - DNA, 15 bp, Homo sapiens
cattatggtcattaa

SEQ ID NO: 154521 - DNA, 15 bp, Homo sapiens
tcattatggtcatta

SEQ ID NO: 154522 - DNA, 15 bp, Homo sapiens
gtcattatggtcatt

SEQ ID NO: 154523 - DNA, 15 bp, Homo sapiens
agtcattatggtcat

SEQ ID NO: 154524 - DNA, 15 bp, Homo sapiens
cagtcattatggtca

SEQ ID NO: 154525 - DNA, 15 bp, Homo sapiens
tcagtcattatggtc

SEQ ID NO: 154526 - DNA, 15 bp, Homo sapiens
ctcagtcattatggt

SEQ ID NO: 154527 - DNA, 15 bp, Homo sapiens
actcagtcattatgg

SEQ ID NO: 154528 - DNA, 15 bp, Homo sapiens
cactcagtcattatg

SEQ ID NO: 154529 - DNA, 15 bp, Homo sapiens
gcactcagtcattat

SEQ ID NO: 154530 - DNA, 15 bp, Homo sapiens
agcactcagtcatta

SEQ ID NO: 154531 - DNA, 15 bp, Homo sapiens
cagcactcagtcatt

SEQ ID NO: 154532 - DNA, 15 bp, Homo sapiens
acagcactcagtcat

SEQ ID NO: 154533 - DNA, 15 bp, Homo sapiens
aacagcactcagtca

SEQ ID NO: 154534 - DNA, 15 bp, Homo sapiens
aaacagcactcagtc

SEQ ID NO: 154535 - DNA, 15 bp, Homo sapiens
aaaacagcactcagt

SEQ ID NO: 154536 - DNA, 15 bp, Homo sapiens
caaaacagcactcag

SEQ ID NO: 154537 - DNA, 15 bp, Homo sapiens
gcaaaacagcactca

SEQ ID NO: 154538 - DNA, 15 bp, Homo sapiens
tgcaaaacagcactc

SEQ ID NO: 154539 - DNA, 15 bp, Homo sapiens
atgcaaaacagcact

SEQ ID NO: 154540 - DNA, 15 bp, Homo sapiens
aatgcaaaacagcac

SEQ ID NO: 154541 - DNA, 15 bp, Homo sapiens
taatgcaaaacagca

SEQ ID NO: 154542 - DNA, 15 bp, Homo sapiens
ttaatgcaaaacagc

SEQ ID NO: 154543 - DNA, 15 bp, Homo sapiens
attaatgcaaaacag

SEQ ID NO: 154544 - DNA, 15 bp, Homo sapiens
aattaatgcaaaaca

SEQ ID NO: 154545 - DNA, 15 bp, Homo sapiens
gaattaatgcaaaac

SEQ ID NO: 154546 - DNA, 15 bp, Homo sapiens
agaattaatgcaaaa

SEQ ID NO: 154547 - DNA, 15 bp, Homo sapiens
aagaattaatgcaaa

SEQ ID NO: 154548 - DNA, 15 bp, Homo sapiens
caagaattaatgcaa

SEQ ID NO: 154549 - DNA, 15 bp, Homo sapiens
tcaagaattaatgca

SEQ ID NO: 154550 - DNA, 15 bp, Homo sapiens
ttcaagaattaatgc

SEQ ID NO: 154551 - DNA, 15 bp, Homo sapiens
tttcaagaattaatg

SEQ ID NO: 154552 - DNA, 15 bp, Homo sapiens
gtttcaagaattaat

SEQ ID NO: 154553 - DNA, 15 bp, Homo sapiens
tgtttcaagaattaa

SEQ ID NO: 154554 - DNA, 15 bp, Homo sapiens
ttgtttcaagaatta

SEQ ID NO: 154555 - DNA, 15 bp, Homo sapiens
tttgtttcaagaatt

SEQ ID NO: 154556 - DNA, 15 bp, Homo sapiens
ttttgtttcaagaat

SEQ ID NO: 154557 - DNA, 15 bp, Homo sapiens
gttttgtttcaagaa

SEQ ID NO: 154558 - DNA, 15 bp, Homo sapiens
ggttttgtttcaaga

SEQ ID NO: 154559 - DNA, 15 bp, Homo sapiens
aggttttgtttcaag

SEQ ID NO: 154560 - DNA, 15 bp, Homo sapiens
taggttttgtttcaa

SEQ ID NO: 154561 - DNA, 15 bp, Homo sapiens
ctaggttttgtttca

SEQ ID NO: 154562 - DNA, 15 bp, Homo sapiens
tctaggttttgtttc

SEQ ID NO: 154563 - DNA, 15 bp, Homo sapiens
atctaggttttgttt

SEQ ID NO: 154564 - DNA, 15 bp, Homo sapiens
aatctaggttttgtt

SEQ ID NO: 154565 - DNA, 15 bp, Homo sapiens
caatctaggttttgt

SEQ ID NO: 154566 - DNA, 15 bp, Homo sapiens
gcaatctaggttttg

SEQ ID NO: 154567 - DNA, 15 bp, Homo sapiens
agcaatctaggtttt

SEQ ID NO: 154568 - DNA, 15 bp, Homo sapiens
aagcaatctaggttt

SEQ ID NO: 154569 - DNA, 15 bp, Homo sapiens
gaagcaatctaggtt

SEQ ID NO: 154570 - DNA, 15 bp, Homo sapiens
tgaagcaatctaggt

SEQ ID NO: 154571 - DNA, 15 bp, Homo sapiens
atgaagcaatctagg

SEQ ID NO: 154572 - DNA, 15 bp, Homo sapiens
aatgaagcaatctag

SEQ ID NO: 154573 - DNA, 15 bp, Homo sapiens
taatgaagcaatcta

SEQ ID NO: 154574 - DNA, 15 bp, Homo sapiens
gtaatgaagcaatct

SEQ ID NO: 154575 - DNA, 15 bp, Homo sapiens
tgtaatgaagcaatc

SEQ ID NO: 154576 - DNA, 15 bp, Homo sapiens
atgtaatgaagcaat

SEQ ID NO: 154577 - DNA, 15 bp, Homo sapiens
catgtaatgaagcaa

SEQ ID NO: 154578 - DNA, 15 bp, Homo sapiens
ccatgtaatgaagca

SEQ ID NO: 154579 - DNA, 15 bp, Homo sapiens
gccatgtaatgaagc

SEQ ID NO: 154580 - DNA, 15 bp, Homo sapiens
ggccatgtaatgaag

SEQ ID NO: 154581 - DNA, 15 bp, Homo sapiens
aggccatgtaatgaa

SEQ ID NO: 154582 - DNA, 15 bp, Homo sapiens
caggccatgtaatga

SEQ ID NO: 154583 - DNA, 15 bp, Homo sapiens
acaggccatgtaatg

SEQ ID NO: 154584 - DNA, 15 bp, Homo sapiens
gacaggccatgtaat

SEQ ID NO: 154585 - DNA, 15 bp, Homo sapiens
agacaggccatgtaa

SEQ ID NO: 154586 - DNA, 15 bp, Homo sapiens
aagacaggccatgta

SEQ ID NO: 154587 - DNA, 15 bp, Homo sapiens
aaagacaggccatgt

SEQ ID NO: 154588 - DNA, 15 bp, Homo sapiens
caaagacaggccatg

SEQ ID NO: 154589 - DNA, 15 bp, Homo sapiens
acaaagacaggccat

SEQ ID NO: 154590 - DNA, 15 bp, Homo sapiens
cacaaagacaggcca

SEQ ID NO: 154591 - DNA, 15 bp, Homo sapiens
ccacaaagacaggcc

SEQ ID NO: 154592 - DNA, 15 bp, Homo sapiens
tccacaaagacaggc

SEQ ID NO: 154593 - DNA, 15 bp, Homo sapiens
ttccacaaagacagg

SEQ ID NO: 154594 - DNA, 15 bp, Homo sapiens
cttccacaaagacag

SEQ ID NO: 154595 - DNA, 15 bp, Homo sapiens
tcttccacaaagaca

SEQ ID NO: 154596 - DNA, 15 bp, Homo sapiens
atcttccacaaagac

SEQ ID NO: 154597 - DNA, 15 bp, Homo sapiens
gatcttccacaaaga

SEQ ID NO: 154598 - DNA, 15 bp, Homo sapiens
ggatcttccacaaag

SEQ ID NO: 154599 - DNA, 15 bp, Homo sapiens
aggatcttccacaaa

SEQ ID NO: 154600 - DNA, 15 bp, Homo sapiens
aaggatcttccacaa

SEQ ID NO: 154601 - DNA, 15 bp, Homo sapiens
taaggatcttccaca

SEQ ID NO: 154602 - DNA, 15 bp, Homo sapiens
ataaggatcttccac

SEQ ID NO: 154603 - DNA, 15 bp, Homo sapiens
tataaggatcttcca

SEQ ID NO: 154604 - DNA, 15 bp, Homo sapiens
gtataaggatcttcc

SEQ ID NO: 154605 - DNA, 15 bp, Homo sapiens
cgtataaggatcttc

SEQ ID NO: 154606 - DNA, 15 bp, Homo sapiens
ccgtataaggatctt

SEQ ID NO: 154607 - DNA, 15 bp, Homo sapiens
accgtataaggatct

SEQ ID NO: 154608 - DNA, 15 bp, Homo sapiens
caccgtataaggatc

SEQ ID NO: 154609 - DNA, 15 bp, Homo sapiens
acaccgtataaggat

SEQ ID NO: 154610 - DNA, 15 bp, Homo sapiens
cacaccgtataagga

SEQ ID NO: 154611 - DNA, 15 bp, Homo sapiens
ccacaccgtataagg

SEQ ID NO: 154612 - DNA, 15 bp, Homo sapiens
accacaccgtataag

SEQ ID NO: 154613 - DNA, 15 bp, Homo sapiens
caccacaccgtataa

SEQ ID NO: 154614 - DNA, 15 bp, Homo sapiens
ccaccacaccgtata

SEQ ID NO: 154615 - DNA, 15 bp, Homo sapiens
accaccacaccgtat

SEQ ID NO: 154616 - DNA, 15 bp, Homo sapiens
taccaccacaccgta

SEQ ID NO: 154617 - DNA, 15 bp, Homo sapiens
ttaccaccacaccgt

SEQ ID NO: 154618 - DNA, 15 bp, Homo sapiens
tttaccaccacaccg

SEQ ID NO: 154619 - DNA, 15 bp, Homo sapiens
ctttaccaccacacc

SEQ ID NO: 154620 - DNA, 15 bp, Homo sapiens
tctttaccaccacac

SEQ ID NO: 154621 - DNA, 15 bp, Homo sapiens
ttctttaccaccaca

SEQ ID NO: 154622 - DNA, 15 bp, Homo sapiens
tttctttaccaccac

SEQ ID NO: 154623 - DNA, 15 bp, Homo sapiens
ctttctttaccacca

SEQ ID NO: 154624 - DNA, 15 bp, Homo sapiens
cctttctttaccacc

SEQ ID NO: 154625 - DNA, 15 bp, Homo sapiens
ccctttctttaccac

SEQ ID NO: 154626 - DNA, 15 bp, Homo sapiens
cccctttctttacca

SEQ ID NO: 154627 - DNA, 15 bp, Homo sapiens
tcccctttctttacc

SEQ ID NO: 154628 - DNA, 15 bp, Homo sapiens
ttcccctttctttac

SEQ ID NO: 154629 - DNA, 15 bp, Homo sapiens
gttcccctttcttta

SEQ ID NO: 154630 - DNA, 15 bp, Homo sapiens
tgttcccctttcttt

SEQ ID NO: 154631 - DNA, 15 bp, Homo sapiens
atgttcccctttctt

SEQ ID NO: 154632 - DNA, 15 bp, Homo sapiens
aatgttcccctttct

SEQ ID NO: 154633 - DNA, 15 bp, Homo sapiens
aaatgttcccctttc

SEQ ID NO: 154634 - DNA, 15 bp, Homo sapiens
caaatgttccccttt

SEQ ID NO: 154635 - DNA, 15 bp, Homo sapiens
gcaaatgttcccctt

SEQ ID NO: 154636 - DNA, 15 bp, Homo sapiens
agcaaatgttcccct

SEQ ID NO: 154637 - DNA, 15 bp, Homo sapiens
gagcaaatgttcccc

SEQ ID NO: 154638 - DNA, 15 bp, Homo sapiens
agagcaaatgttccc

SEQ ID NO: 154639 - DNA, 15 bp, Homo sapiens
tagagcaaatgttcc

SEQ ID NO: 154640 - DNA, 15 bp, Homo sapiens
atagagcaaatgttc

SEQ ID NO: 154641 - DNA, 15 bp, Homo sapiens
aatagagcaaatgtt

SEQ ID NO: 154642 - DNA, 15 bp, Homo sapiens
aaatagagcaaatgt

SEQ ID NO: 154643 - DNA, 15 bp, Homo sapiens
aaaatagagcaaatg

SEQ ID NO: 154644 - DNA, 15 bp, Homo sapiens
caaaatagagcaaat

SEQ ID NO: 154645 - DNA, 15 bp, Homo sapiens
tcaaaatagagcaaa

SEQ ID NO: 154646 - DNA, 15 bp, Homo sapiens
ttcaaaatagagcaa

SEQ ID NO: 154647 - DNA, 15 bp, Homo sapiens
cttcaaaatagagca

SEQ ID NO: 154648 - DNA, 15 bp, Homo sapiens
acttcaaaatagagc

SEQ ID NO: 154649 - DNA, 15 bp, Homo sapiens
tacttcaaaatagag

SEQ ID NO: 154650 - DNA, 15 bp, Homo sapiens
ttacttcaaaataga

SEQ ID NO: 154651 - DNA, 15 bp, Homo sapiens
attacttcaaaatag

SEQ ID NO: 154652 - DNA, 15 bp, Homo sapiens
aattacttcaaaata

SEQ ID NO: 154653 - DNA, 15 bp, Homo sapiens
caattacttcaaaat

SEQ ID NO: 154654 - DNA, 15 bp, Homo sapiens
gcaattacttcaaaa

SEQ ID NO: 154655 - DNA, 15 bp, Homo sapiens
agcaattacttcaaa

SEQ ID NO: 154656 - DNA, 15 bp, Homo sapiens
aagcaattacttcaa

SEQ ID NO: 154657 - DNA, 15 bp, Homo sapiens
gaagcaattacttca

SEQ ID NO: 154658 - DNA, 15 bp, Homo sapiens
agaagcaattacttc

SEQ ID NO: 154659 - DNA, 15 bp, Homo sapiens
tagaagcaattactt

SEQ ID NO: 154660 - DNA, 15 bp, Homo sapiens
ttagaagcaattact

SEQ ID NO: 154661 - DNA, 15 bp, Homo sapiens
attagaagcaattac

SEQ ID NO: 154662 - DNA, 15 bp, Homo sapiens
cattagaagcaatta

SEQ ID NO: 154663 - DNA, 15 bp, Homo sapiens
ccattagaagcaatt

SEQ ID NO: 154664 - DNA, 15 bp, Homo sapiens
tccattagaagcaat

SEQ ID NO: 154665 - DNA, 15 bp, Homo sapiens
ttccattagaagcaa

SEQ ID NO: 154666 - DNA, 15 bp, Homo sapiens
cttccattagaagca

SEQ ID NO: 154667 - DNA, 15 bp, Homo sapiens
gcttccattagaagc

SEQ ID NO: 154668 - DNA, 15 bp, Homo sapiens
ggcttccattagaag

SEQ ID NO: 154669 - DNA, 15 bp, Homo sapiens
aggcttccattagaa

SEQ ID NO: 154670 - DNA, 15 bp, Homo sapiens
taggcttccattaga

SEQ ID NO: 154671 - DNA, 15 bp, Homo sapiens
ttaggcttccattag

SEQ ID NO: 154672 - DNA, 15 bp, Homo sapiens
attaggcttccatta

SEQ ID NO: 154673 - DNA, 15 bp, Homo sapiens
cattaggcttccatt

SEQ ID NO: 154674 - DNA, 15 bp, Homo sapiens
tcattaggcttccat

SEQ ID NO: 154675 - DNA, 15 bp, Homo sapiens
gtcattaggcttcca

SEQ ID NO: 154676 - DNA, 15 bp, Homo sapiens
ggtcattaggcttcc

SEQ ID NO: 154677 - DNA, 15 bp, Homo sapiens
aggtcattaggcttc

SEQ ID NO: 154678 - DNA, 15 bp, Homo sapiens
taggtcattaggctt

SEQ ID NO: 154679 - DNA, 15 bp, Homo sapiens
ataggtcattaggct

SEQ ID NO: 154680 - DNA, 15 bp, Homo sapiens
aataggtcattaggc

SEQ ID NO: 154681 - DNA, 15 bp, Homo sapiens
taataggtcattagg

SEQ ID NO: 154682 - DNA, 15 bp, Homo sapiens
ataataggtcattag

SEQ ID NO: 154683 - DNA, 15 bp, Homo sapiens
cataataggtcatta

SEQ ID NO: 154684 - DNA, 15 bp, Homo sapiens
gcataataggtcatt

SEQ ID NO: 154685 - DNA, 15 bp, Homo sapiens
agcataataggtcat

SEQ ID NO: 154686 - DNA, 15 bp, Homo sapiens
aagcataataggtca

SEQ ID NO: 154687 - DNA, 15 bp, Homo sapiens
taagcataataggtc

SEQ ID NO: 154688 - DNA, 15 bp, Homo sapiens
ataagcataataggt

SEQ ID NO: 154689 - DNA, 15 bp, Homo sapiens
aataagcataatagg

SEQ ID NO: 154690 - DNA, 15 bp, Homo sapiens
aaataagcataatag

SEQ ID NO: 154691 - DNA, 15 bp, Homo sapiens
gaaataagcataata

SEQ ID NO: 154692 - DNA, 15 bp, Homo sapiens
agaaataagcataat

SEQ ID NO: 154693 - DNA, 15 bp, Homo sapiens
tagaaataagcataa

SEQ ID NO: 154694 - DNA, 15 bp, Homo sapiens
ttagaaataagcata

SEQ ID NO: 154695 - DNA, 15 bp, Homo sapiens
tttagaaataagcat

SEQ ID NO: 154696 - DNA, 15 bp, Homo sapiens
ttttagaaataagca

SEQ ID NO: 154697 - DNA, 15 bp, Homo sapiens
cttttagaaataagc

SEQ ID NO: 154698 - DNA, 15 bp, Homo sapiens
gcttttagaaataag

SEQ ID NO: 154699 - DNA, 15 bp, Homo sapiens
agcttttagaaataa

SEQ ID NO: 154700 - DNA, 15 bp, Homo sapiens
cagcttttagaaata

SEQ ID NO: 154701 - DNA, 15 bp, Homo sapiens
tcagcttttagaaat

SEQ ID NO: 154702 - DNA, 15 bp, Homo sapiens
ctcagcttttagaaa

SEQ ID NO: 154703 - DNA, 15 bp, Homo sapiens
gctcagcttttagaa

SEQ ID NO: 154704 - DNA, 15 bp, Homo sapiens
tgctcagcttttaga

SEQ ID NO: 154705 - DNA, 15 bp, Homo sapiens
ctgctcagcttttag

SEQ ID NO: 154706 - DNA, 15 bp, Homo sapiens
actgctcagctttta

SEQ ID NO: 154707 - DNA, 15 bp, Homo sapiens
tactgctcagctttt

SEQ ID NO: 154708 - DNA, 15 bp, Homo sapiens
ttactgctcagcttt

SEQ ID NO: 154709 - DNA, 15 bp, Homo sapiens
cttactgctcagctt

SEQ ID NO: 154710 - DNA, 15 bp, Homo sapiens
gcttactgctcagct

SEQ ID NO: 154711 - DNA, 15 bp, Homo sapiens
agcttactgctcagc

SEQ ID NO: 154712 - DNA, 15 bp, Homo sapiens
aagcttactgctcag

SEQ ID NO: 154713 - DNA, 15 bp, Homo sapiens
caagcttactgctca

SEQ ID NO: 154714 - DNA, 15 bp, Homo sapiens
tcaagcttactgctc

SEQ ID NO: 154715 - DNA, 15 bp, Homo sapiens
atcaagcttactgct

SEQ ID NO: 154716 - DNA, 15 bp, Homo sapiens
tatcaagcttactgc

SEQ ID NO: 154717 - DNA, 15 bp, Homo sapiens
ctatcaagcttactg

SEQ ID NO: 154718 - DNA, 15 bp, Homo sapiens
cctatcaagcttact

SEQ ID NO: 154719 - DNA, 15 bp, Homo sapiens
tcctatcaagcttac

SEQ ID NO: 154720 - DNA, 15 bp, Homo sapiens
ttcctatcaagctta

SEQ ID NO: 154721 - DNA, 15 bp, Homo sapiens
cttcctatcaagctt

SEQ ID NO: 154722 - DNA, 15 bp, Homo sapiens
gcttcctatcaagct

SEQ ID NO: 154723 - DNA, 15 bp, Homo sapiens
agcttcctatcaagc

SEQ ID NO: 154724 - DNA, 15 bp, Homo sapiens
tagcttcctatcaag

SEQ ID NO: 154725 - DNA, 15 bp, Homo sapiens
ctagcttcctatcaa

SEQ ID NO: 154726 - DNA, 15 bp, Homo sapiens
tctagcttcctatca

SEQ ID NO: 154727 - DNA, 15 bp, Homo sapiens
ctctagcttcctatc

SEQ ID NO: 154728 - DNA, 15 bp, Homo sapiens
tctctagcttcctat

SEQ ID NO: 154729 - DNA, 15 bp, Homo sapiens
ttctctagcttccta

SEQ ID NO: 154730 - DNA, 15 bp, Homo sapiens
tttctctagcttcct

SEQ ID NO: 154731 - DNA, 15 bp, Homo sapiens
ctttctctagcttcc

SEQ ID NO: 154732 - DNA, 15 bp, Homo sapiens
tctttctctagcttc

SEQ ID NO: 154733 - DNA, 15 bp, Homo sapiens
atctttctctagctt

SEQ ID NO: 154734 - DNA, 15 bp, Homo sapiens
aatctttctctagct

SEQ ID NO: 154735 - DNA, 15 bp, Homo sapiens
caatctttctctagc

SEQ ID NO: 154736 - DNA, 15 bp, Homo sapiens
ccaatctttctctag

SEQ ID NO: 154737 - DNA, 15 bp, Homo sapiens
tccaatctttctcta

SEQ ID NO: 154738 - DNA, 15 bp, Homo sapiens
ctccaatctttctct

SEQ ID NO: 154739 - DNA, 15 bp, Homo sapiens
tctccaatctttctc

SEQ ID NO: 154740 - DNA, 15 bp, Homo sapiens
ttctccaatctttct

SEQ ID NO: 154741 - DNA, 15 bp, Homo sapiens
tttctccaatctttc

SEQ ID NO: 154742 - DNA, 15 bp, Homo sapiens
atttctccaatcttt

SEQ ID NO: 154743 - DNA, 15 bp, Homo sapiens
aatttctccaatctt

SEQ ID NO: 154744 - DNA, 15 bp, Homo sapiens
taatttctccaatct

SEQ ID NO: 154745 - DNA, 15 bp, Homo sapiens
ataatttctccaatc

SEQ ID NO: 154746 - DNA, 15 bp, Homo sapiens
cataatttctccaat

SEQ ID NO: 154747 - DNA, 15 bp, Homo sapiens
acataatttctccaa

SEQ ID NO: 154748 - DNA, 15 bp, Homo sapiens
gacataatttctcca

SEQ ID NO: 154749 - DNA, 15 bp, Homo sapiens
tgacataatttctcc

SEQ ID NO: 154750 - DNA, 15 bp, Homo sapiens
atgacataatttctc

SEQ ID NO: 154751 - DNA, 15 bp, Homo sapiens
tatgacataatttct

SEQ ID NO: 154752 - DNA, 15 bp, Homo sapiens
atatgacataatttc

SEQ ID NO: 154753 - DNA, 15 bp, Homo sapiens
tatatgacataattt

SEQ ID NO: 154754 - DNA, 15 bp, Homo sapiens
ttatatgacataatt

SEQ ID NO: 154755 - DNA, 15 bp, Homo sapiens
tttatatgacataat

SEQ ID NO: 154756 - DNA, 15 bp, Homo sapiens
gtttatatgacataa

SEQ ID NO: 154757 - DNA, 15 bp, Homo sapiens
ggtttatatgacata

SEQ ID NO: 154758 - DNA, 15 bp, Homo sapiens
tggtttatatgacat

SEQ ID NO: 154759 - DNA, 15 bp, Homo sapiens
ttggtttatatgaca

SEQ ID NO: 154760 - DNA, 15 bp, Homo sapiens
tttggtttatatgac

SEQ ID NO: 154761 - DNA, 15 bp, Homo sapiens
ttttggtttatatga

SEQ ID NO: 154762 - DNA, 15 bp, Homo sapiens
attttggtttatatg

SEQ ID NO: 154763 - DNA, 15 bp, Homo sapiens
aattttggtttatat

SEQ ID NO: 154764 - DNA, 15 bp, Homo sapiens
aaattttggtttata

SEQ ID NO: 154765 - DNA, 15 bp, Homo sapiens
gaaattttggtttat

SEQ ID NO: 154766 - DNA, 15 bp, Homo sapiens
tgaaattttggttta

SEQ ID NO: 154767 - DNA, 15 bp, Homo sapiens
ctgaaattttggttt

SEQ ID NO: 154768 - DNA, 15 bp, Homo sapiens
cctgaaattttggtt

SEQ ID NO: 154769 - DNA, 15 bp, Homo sapiens
tcctgaaattttggt

SEQ ID NO: 154770 - DNA, 15 bp, Homo sapiens
ttcctgaaattttgg

SEQ ID NO: 154771 - DNA, 15 bp, Homo sapiens
cttcctgaaattttg

SEQ ID NO: 154772 - DNA, 15 bp, Homo sapiens
acttcctgaaatttt

SEQ ID NO: 154773 - DNA, 15 bp, Homo sapiens
aacttcctgaaattt

SEQ ID NO: 154774 - DNA, 15 bp, Homo sapiens
caacttcctgaaatt

SEQ ID NO: 154775 - DNA, 15 bp, Homo sapiens
gcaacttcctgaaat

SEQ ID NO: 154776 - DNA, 15 bp, Homo sapiens
tgcaacttcctgaaa

SEQ ID NO: 154777 - DNA, 15 bp, Homo sapiens
atgcaacttcctgaa

SEQ ID NO: 154778 - DNA, 15 bp, Homo sapiens
catgcaacttcctga

SEQ ID NO: 154779 - DNA, 15 bp, Homo sapiens
acatgcaacttcctg

SEQ ID NO: 154780 - DNA, 15 bp, Homo sapiens
cacatgcaacttcct

SEQ ID NO: 154781 - DNA, 15 bp, Homo sapiens
ccacatgcaacttcc

SEQ ID NO: 154782 - DNA, 15 bp, Homo sapiens
accacatgcaacttc

SEQ ID NO: 154783 - DNA, 15 bp, Homo sapiens
aaccacatgcaactt

SEQ ID NO: 154784 - DNA, 15 bp, Homo sapiens
caaccacatgcaact

SEQ ID NO: 154785 - DNA, 15 bp, Homo sapiens
tcaaccacatgcaac

SEQ ID NO: 154786 - DNA, 15 bp, Homo sapiens
ctcaaccacatgcaa

SEQ ID NO: 154787 - DNA, 15 bp, Homo sapiens
tctcaaccacatgca

SEQ ID NO: 154788 - DNA, 15 bp, Homo sapiens
ttctcaaccacatgc

SEQ ID NO: 154789 - DNA, 15 bp, Homo sapiens
attctcaaccacatg

SEQ ID NO: 154790 - DNA, 15 bp, Homo sapiens
gattctcaaccacat

SEQ ID NO: 154791 - DNA, 15 bp, Homo sapiens
tgattctcaaccaca

SEQ ID NO: 154792 - DNA, 15 bp, Homo sapiens
ctgattctcaaccac

SEQ ID NO: 154793 - DNA, 15 bp, Homo sapiens
actgattctcaacca

SEQ ID NO: 154794 - DNA, 15 bp, Homo sapiens
tactgattctcaacc

SEQ ID NO: 154795 - DNA, 15 bp, Homo sapiens
gtactgattctcaac

SEQ ID NO: 154796 - DNA, 15 bp, Homo sapiens
ggtactgattctcaa

SEQ ID NO: 154797 - DNA, 15 bp, Homo sapiens
aggtactgattctca

SEQ ID NO: 154798 - DNA, 15 bp, Homo sapiens
gaggtactgattctc

SEQ ID NO: 154799 - DNA, 15 bp, Homo sapiens
tgaggtactgattct

SEQ ID NO: 154800 - DNA, 15 bp, Homo sapiens
atgaggtactgattc

SEQ ID NO: 154801 - DNA, 15 bp, Homo sapiens
aatgaggtactgatt

SEQ ID NO: 154802 - DNA, 15 bp, Homo sapiens
taatgaggtactgat

SEQ ID NO: 154803 - DNA, 15 bp, Homo sapiens
ctaatgaggtactga

SEQ ID NO: 154804 - DNA, 15 bp, Homo sapiens
tctaatgaggtactg

SEQ ID NO: 154805 - DNA, 15 bp, Homo sapiens
gtctaatgaggtact

SEQ ID NO: 154806 - DNA, 15 bp, Homo sapiens
tgtctaatgaggtac

SEQ ID NO: 154807 - DNA, 15 bp, Homo sapiens
ttgtctaatgaggta

SEQ ID NO: 154808 - DNA, 15 bp, Homo sapiens
gttgtctaatgaggt

SEQ ID NO: 154809 - DNA, 15 bp, Homo sapiens
agttgtctaatgagg

SEQ ID NO: 154810 - DNA, 15 bp, Homo sapiens
aagttgtctaatgag

SEQ ID NO: 154811 - DNA, 15 bp, Homo sapiens
taagttgtctaatga

SEQ ID NO: 154812 - DNA, 15 bp, Homo sapiens
ttaagttgtctaatg

SEQ ID NO: 154813 - DNA, 15 bp, Homo sapiens
attaagttgtctaat

SEQ ID NO: 154814 - DNA, 15 bp, Homo sapiens
tattaagttgtctaa

SEQ ID NO: 154815 - DNA, 15 bp, Homo sapiens
ttattaagttgtcta

SEQ ID NO: 154816 - DNA, 15 bp, Homo sapiens
attattaagttgtct

SEQ ID NO: 154817 - DNA, 15 bp, Homo sapiens
aattattaagttgtc

SEQ ID NO: 154818 - DNA, 15 bp, Homo sapiens
gaattattaagttgt

SEQ ID NO: 154819 - DNA, 15 bp, Homo sapiens
tgaattattaagttg

SEQ ID NO: 154820 - DNA, 15 bp, Homo sapiens
ttgaattattaagtt

SEQ ID NO: 154821 - DNA, 15 bp, Homo sapiens
attgaattattaagt

SEQ ID NO: 154822 - DNA, 15 bp, Homo sapiens
tattgaattattaag

SEQ ID NO: 154823 - DNA, 15 bp, Homo sapiens
ctattgaattattaa

SEQ ID NO: 154824 - DNA, 15 bp, Homo sapiens
actattgaattatta

SEQ ID NO: 154825 - DNA, 15 bp, Homo sapiens
aactattgaattatt

SEQ ID NO: 154826 - DNA, 15 bp, Homo sapiens
aaactattgaattat

SEQ ID NO: 154827 - DNA, 15 bp, Homo sapiens
taaactattgaatta

SEQ ID NO: 154828 - DNA, 15 bp, Homo sapiens
gtaaactattgaatt

SEQ ID NO: 154829 - DNA, 15 bp, Homo sapiens
agtaaactattgaat

SEQ ID NO: 154830 - DNA, 15 bp, Homo sapiens
aagtaaactattgaa

SEQ ID NO: 154831 - DNA, 15 bp, Homo sapiens
taagtaaactattga

SEQ ID NO: 154832 - DNA, 15 bp, Homo sapiens
ataagtaaactattg

SEQ ID NO: 154833 - DNA, 15 bp, Homo sapiens
cataagtaaactatt

SEQ ID NO: 154834 - DNA, 15 bp, Homo sapiens
gcataagtaaactat

SEQ ID NO: 154835 - DNA, 15 bp, Homo sapiens
ggcataagtaaacta

SEQ ID NO: 154836 - DNA, 15 bp, Homo sapiens
tggcataagtaaact

SEQ ID NO: 154837 - DNA, 15 bp, Homo sapiens
ttggcataagtaaac

SEQ ID NO: 154838 - DNA, 15 bp, Homo sapiens
tttggcataagtaaa

SEQ ID NO: 154839 - DNA, 15 bp, Homo sapiens
atttggcataagtaa

SEQ ID NO: 154840 - DNA, 15 bp, Homo sapiens
catttggcataagta

SEQ ID NO: 154841 - DNA, 15 bp, Homo sapiens
acatttggcataagt

SEQ ID NO: 154842 - DNA, 15 bp, Homo sapiens
gacatttggcataag

SEQ ID NO: 154843 - DNA, 15 bp, Homo sapiens
tgacatttggcataa

SEQ ID NO: 154844 - DNA, 15 bp, Homo sapiens
atgacatttggcata

SEQ ID NO: 154845 - DNA, 15 bp, Homo sapiens
gatgacatttggcat

SEQ ID NO: 154846 - DNA, 15 bp, Homo sapiens
ggatgacatttggca

SEQ ID NO: 154847 - DNA, 15 bp, Homo sapiens
aggatgacatttggc

SEQ ID NO: 154848 - DNA, 15 bp, Homo sapiens
aaggatgacatttgg

SEQ ID NO: 154849 - DNA, 15 bp, Homo sapiens
taaggatgacatttg

SEQ ID NO: 154850 - DNA, 15 bp, Homo sapiens
gtaaggatgacattt

SEQ ID NO: 154851 - DNA, 15 bp, Homo sapiens
agtaaggatgacatt

SEQ ID NO: 154852 - DNA, 15 bp, Homo sapiens
aagtaaggatgacat

SEQ ID NO: 154853 - DNA, 15 bp, Homo sapiens
aaagtaaggatgaca

SEQ ID NO: 154854 - DNA, 15 bp, Homo sapiens
taaagtaaggatgac

SEQ ID NO: 154855 - DNA, 15 bp, Homo sapiens
ttaaagtaaggatga

SEQ ID NO: 154856 - DNA, 15 bp, Homo sapiens
tttaaagtaaggatg

SEQ ID NO: 154857 - DNA, 15 bp, Homo sapiens
ttttaaagtaaggat

SEQ ID NO: 154858 - DNA, 15 bp, Homo sapiens
cttttaaagtaagga

SEQ ID NO: 154859 - DNA, 15 bp, Homo sapiens
gcttttaaagtaagg

SEQ ID NO: 154860 - DNA, 15 bp, Homo sapiens
agcttttaaagtaag

SEQ ID NO: 154861 - DNA, 15 bp, Homo sapiens
cagcttttaaagtaa

SEQ ID NO: 154862 - DNA, 15 bp, Homo sapiens
ccagcttttaaagta

SEQ ID NO: 154863 - DNA, 15 bp, Homo sapiens
tccagcttttaaagt

SEQ ID NO: 154864 - DNA, 15 bp, Homo sapiens
ctccagcttttaaag

SEQ ID NO: 154865 - DNA, 15 bp, Homo sapiens
actccagcttttaaa

SEQ ID NO: 154866 - DNA, 15 bp, Homo sapiens
cactccagcttttaa

SEQ ID NO: 154867 - DNA, 15 bp, Homo sapiens
tcactccagctttta

SEQ ID NO: 154868 - DNA, 15 bp, Homo sapiens
atcactccagctttt

SEQ ID NO: 154869 - DNA, 15 bp, Homo sapiens
aatcactccagcttt

SEQ ID NO: 154870 - DNA, 15 bp, Homo sapiens
aaatcactccagctt

SEQ ID NO: 154871 - DNA, 15 bp, Homo sapiens
gaaatcactccagct

SEQ ID NO: 154872 - DNA, 15 bp, Homo sapiens
agaaatcactccagc

SEQ ID NO: 154873 - DNA, 15 bp, Homo sapiens
tagaaatcactccag

SEQ ID NO: 154874 - DNA, 15 bp, Homo sapiens
ctagaaatcactcca

SEQ ID NO: 154875 - DNA, 15 bp, Homo sapiens
tctagaaatcactcc

SEQ ID NO: 154876 - DNA, 15 bp, Homo sapiens
ttctagaaatcactc

SEQ ID NO: 154877 - DNA, 15 bp, Homo sapiens
tttctagaaatcact

SEQ ID NO: 154878 - DNA, 15 bp, Homo sapiens
atttctagaaatcac

SEQ ID NO: 154879 - DNA, 15 bp, Homo sapiens
catttctagaaatca

SEQ ID NO: 154880 - DNA, 15 bp, Homo sapiens
acatttctagaaatc

SEQ ID NO: 154881 - DNA, 15 bp, Homo sapiens
cacatttctagaaat

SEQ ID NO: 154882 - DNA, 15 bp, Homo sapiens
acacatttctagaaa

SEQ ID NO: 154883 - DNA, 15 bp, Homo sapiens
gacacatttctagaa

SEQ ID NO: 154884 - DNA, 15 bp, Homo sapiens
ggacacatttctaga

SEQ ID NO: 154885 - DNA, 15 bp, Homo sapiens
tggacacatttctag

SEQ ID NO: 154886 - DNA, 15 bp, Homo sapiens
gtggacacatttcta

SEQ ID NO: 154887 - DNA, 15 bp, Homo sapiens
tgtggacacatttct

SEQ ID NO: 154888 - DNA, 15 bp, Homo sapiens
atgtggacacatttc

SEQ ID NO: 154889 - DNA, 15 bp, Homo sapiens
gatgtggacacattt

SEQ ID NO: 154890 - DNA, 15 bp, Homo sapiens
ggatgtggacacatt

SEQ ID NO: 154891 - DNA, 15 bp, Homo sapiens
aggatgtggacacat

SEQ ID NO: 154892 - DNA, 15 bp, Homo sapiens
aaggatgtggacaca

SEQ ID NO: 154893 - DNA, 15 bp, Homo sapiens
caaggatgtggacac

SEQ ID NO: 154894 - DNA, 15 bp, Homo sapiens
gcaaggatgtggaca

SEQ ID NO: 154895 - DNA, 15 bp, Homo sapiens
cgcaaggatgtggac

SEQ ID NO: 154896 - DNA, 15 bp, Homo sapiens
ccgcaaggatgtgga

SEQ ID NO: 154897 - DNA, 15 bp, Homo sapiens
cccgcaaggatgtgg

SEQ ID NO: 154898 - DNA, 15 bp, Homo sapiens
acccgcaaggatgtg

SEQ ID NO: 154899 - DNA, 15 bp, Homo sapiens
aacccgcaaggatgt

SEQ ID NO: 154900 - DNA, 15 bp, Homo sapiens
taacccgcaaggatg

SEQ ID NO: 154901 - DNA, 15 bp, Homo sapiens
ctaacccgcaaggat

SEQ ID NO: 154902 - DNA, 15 bp, Homo sapiens
cctaacccgcaagga

SEQ ID NO: 154903 - DNA, 15 bp, Homo sapiens
ccctaacccgcaagg

SEQ ID NO: 154904 - DNA, 15 bp, Homo sapiens
accctaacccgcaag

SEQ ID NO: 154905 - DNA, 15 bp, Homo sapiens
taccctaacccgcaa

SEQ ID NO: 154906 - DNA, 15 bp, Homo sapiens
gtaccctaacccgca

SEQ ID NO: 154907 - DNA, 15 bp, Homo sapiens
cgtaccctaacccgc

SEQ ID NO: 154908 - DNA, 15 bp, Homo sapiens
ccgtaccctaacccg

SEQ ID NO: 154909 - DNA, 15 bp, Homo sapiens
cccgtaccctaaccc

SEQ ID NO: 154910 - DNA, 15 bp, Homo sapiens
ccccgtaccctaacc

SEQ ID NO: 154911 - DNA, 15 bp, Homo sapiens
gccccgtaccctaac

SEQ ID NO: 154912 - DNA, 15 bp, Homo sapiens
tgccccgtaccctaa

SEQ ID NO: 154913 - DNA, 15 bp, Homo sapiens
ctgccccgtacccta

SEQ ID NO: 154914 - DNA, 15 bp, Homo sapiens
gctgccccgtaccct

SEQ ID NO: 154915 - DNA, 15 bp, Homo sapiens
agctgccccgtaccc

SEQ ID NO: 154916 - DNA, 15 bp, Homo sapiens
aagctgccccgtacc

SEQ ID NO: 154917 - DNA, 15 bp, Homo sapiens
gaagctgccccgtac

SEQ ID NO: 154918 - DNA, 15 bp, Homo sapiens
agaagctgccccgta

SEQ ID NO: 154919 - DNA, 15 bp, Homo sapiens
cagaagctgccccgt

SEQ ID NO: 154920 - DNA, 15 bp, Homo sapiens
ccagaagctgccccg

SEQ ID NO: 154921 - DNA, 15 bp, Homo sapiens
gccagaagctgcccc

SEQ ID NO: 154922 - DNA, 15 bp, Homo sapiens
ggccagaagctgccc

SEQ ID NO: 154923 - DNA, 15 bp, Homo sapiens
tggccagaagctgcc

SEQ ID NO: 154924 - DNA, 15 bp, Homo sapiens
ctggccagaagctgc

SEQ ID NO: 154925 - DNA, 15 bp, Homo sapiens
gctggccagaagctg

SEQ ID NO: 154926 - DNA, 15 bp, Homo sapiens
agctggccagaagct

SEQ ID NO: 154927 - DNA, 15 bp, Homo sapiens
cagctggccagaagc

SEQ ID NO: 154928 - DNA, 15 bp, Homo sapiens
acagctggccagaag

SEQ ID NO: 154929 - DNA, 15 bp, Homo sapiens
gacagctggccagaa

SEQ ID NO: 154930 - DNA, 15 bp, Homo sapiens
cgacagctggccaga

SEQ ID NO: 154931 - DNA, 15 bp, Homo sapiens
acgacagctggccag

SEQ ID NO: 154932 - DNA, 15 bp, Homo sapiens
gacgacagctggcca

SEQ ID NO: 154933 - DNA, 15 bp, Homo sapiens
ggacgacagctggcc

SEQ ID NO: 154934 - DNA, 15 bp, Homo sapiens
tggacgacagctggc

SEQ ID NO: 154935 - DNA, 15 bp, Homo sapiens
ctggacgacagctgg

SEQ ID NO: 154936 - DNA, 15 bp, Homo sapiens
cctggacgacagctg

SEQ ID NO: 154937 - DNA, 15 bp, Homo sapiens
acctggacgacagct

SEQ ID NO: 154938 - DNA, 15 bp, Homo sapiens
cacctggacgacagc

SEQ ID NO: 154939 - DNA, 15 bp, Homo sapiens
acacctggacgacag

SEQ ID NO: 154940 - DNA, 15 bp, Homo sapiens
gacacctggacgaca

SEQ ID NO: 154941 - DNA, 15 bp, Homo sapiens
agacacctggacgac

SEQ ID NO: 154942 - DNA, 15 bp, Homo sapiens
aagacacctggacga

SEQ ID NO: 154943 - DNA, 15 bp, Homo sapiens
taagacacctggacg

SEQ ID NO: 154944 - DNA, 15 bp, Homo sapiens
ataagacacctggac

SEQ ID NO: 154945 - DNA, 15 bp, Homo sapiens
cataagacacctgga

SEQ ID NO: 154946 - DNA, 15 bp, Homo sapiens
ccataagacacctgg

SEQ ID NO: 154947 - DNA, 15 bp, Homo sapiens
accataagacacctg

SEQ ID NO: 154948 - DNA, 15 bp, Homo sapiens
aaccataagacacct

SEQ ID NO: 154949 - DNA, 15 bp, Homo sapiens
aaaccataagacacc

SEQ ID NO: 154950 - DNA, 15 bp, Homo sapiens
aaaaccataagacac

SEQ ID NO: 154951 - DNA, 15 bp, Homo sapiens
aaaaaccataagaca

SEQ ID NO: 154952 - DNA, 15 bp, Homo sapiens
gaaaaaccataagac

SEQ ID NO: 154953 - DNA, 15 bp, Homo sapiens
ggaaaaaccataaga

SEQ ID NO: 154954 - DNA, 15 bp, Homo sapiens
cggaaaaaccataag

SEQ ID NO: 154955 - DNA, 15 bp, Homo sapiens
tcggaaaaaccataa

SEQ ID NO: 154956 - DNA, 15 bp, Homo sapiens
ctcggaaaaaccata

SEQ ID NO: 154957 - DNA, 15 bp, Homo sapiens
actcggaaaaaccat

SEQ ID NO: 154958 - DNA, 15 bp, Homo sapiens
aactcggaaaaacca

SEQ ID NO: 154959 - DNA, 15 bp, Homo sapiens
aaactcggaaaaacc

SEQ ID NO: 154960 - DNA, 15 bp, Homo sapiens
gaaactcggaaaaac

SEQ ID NO: 154961 - DNA, 15 bp, Homo sapiens
tgaaactcggaaaaa

SEQ ID NO: 154962 - DNA, 15 bp, Homo sapiens
atgaaactcggaaaa

SEQ ID NO: 154963 - DNA, 15 bp, Homo sapiens
tatgaaactcggaaa

SEQ ID NO: 154964 - DNA, 15 bp, Homo sapiens
atatgaaactcggaa

SEQ ID NO: 154965 - DNA, 15 bp, Homo sapiens
catatgaaactcgga

SEQ ID NO: 154966 - DNA, 15 bp, Homo sapiens
gcatatgaaactcgg

SEQ ID NO: 154967 - DNA, 15 bp, Homo sapiens
tgcatatgaaactcg

SEQ ID NO: 154968 - DNA, 15 bp, Homo sapiens
ctgcatatgaaactc

SEQ ID NO: 154969 - DNA, 15 bp, Homo sapiens
tctgcatatgaaact

SEQ ID NO: 154970 - DNA, 15 bp, Homo sapiens
atctgcatatgaaac

SEQ ID NO: 154971 - DNA, 15 bp, Homo sapiens
gatctgcatatgaaa

SEQ ID NO: 154972 - DNA, 15 bp, Homo sapiens
tgatctgcatatgaa

SEQ ID NO: 154973 - DNA, 15 bp, Homo sapiens
ttgatctgcatatga

SEQ ID NO: 154974 - DNA, 15 bp, Homo sapiens
tttgatctgcatatg

SEQ ID NO: 154975 - DNA, 15 bp, Homo sapiens
gtttgatctgcatat

SEQ ID NO: 154976 - DNA, 15 bp, Homo sapiens
tgtttgatctgcata

SEQ ID NO: 154977 - DNA, 15 bp, Homo sapiens
ctgtttgatctgcat

SEQ ID NO: 154978 - DNA, 15 bp, Homo sapiens
cctgtttgatctgca

SEQ ID NO: 154979 - DNA, 15 bp, Homo sapiens
ccctgtttgatctgc

SEQ ID NO: 154980 - DNA, 15 bp, Homo sapiens
gccctgtttgatctg

SEQ ID NO: 154981 - DNA, 15 bp, Homo sapiens
tgccctgtttgatct

SEQ ID NO: 154982 - DNA, 15 bp, Homo sapiens
ctgccctgtttgatc

SEQ ID NO: 154983 - DNA, 15 bp, Homo sapiens
actgccctgtttgat

SEQ ID NO: 154984 - DNA, 15 bp, Homo sapiens
cactgccctgtttga

SEQ ID NO: 154985 - DNA, 15 bp, Homo sapiens
tcactgccctgtttg

SEQ ID NO: 154986 - DNA, 15 bp, Homo sapiens
ctcactgccctgttt

SEQ ID NO: 154987 - DNA, 15 bp, Homo sapiens
tctcactgccctgtt

SEQ ID NO: 154988 - DNA, 15 bp, Homo sapiens
ctctcactgccctgt

SEQ ID NO: 154989 - DNA, 15 bp, Homo sapiens
actctcactgccctg

SEQ ID NO: 154990 - DNA, 15 bp, Homo sapiens
tactctcactgccct

SEQ ID NO: 154991 - DNA, 15 bp, Homo sapiens
ctactctcactgccc

SEQ ID NO: 154992 - DNA, 15 bp, Homo sapiens
tctactctcactgcc

SEQ ID NO: 154993 - DNA, 15 bp, Homo sapiens
ctctactctcactgc

SEQ ID NO: 154994 - DNA, 15 bp, Homo sapiens
actctactctcactg

SEQ ID NO: 154995 - DNA, 15 bp, Homo sapiens
aactctactctcact

SEQ ID NO: 154996 - DNA, 15 bp, Homo sapiens
aaactctactctcac

SEQ ID NO: 154997 - DNA, 15 bp, Homo sapiens
aaaactctactctca

SEQ ID NO: 154998 - DNA, 15 bp, Homo sapiens
gaaaactctactctc

SEQ ID NO: 154999 - DNA, 15 bp, Homo sapiens
ggaaaactctactct

SEQ ID NO: 155000 - DNA, 15 bp, Homo sapiens
aggaaaactctactc

SEQ ID NO: 155001 - DNA, 15 bp, Homo sapiens
caggaaaactctact

SEQ ID NO: 155002 - DNA, 15 bp, Homo sapiens
acaggaaaactctac

SEQ ID NO: 155003 - DNA, 15 bp, Homo sapiens
cacaggaaaactcta

SEQ ID NO: 155004 - DNA, 15 bp, Homo sapiens
ccacaggaaaactct

SEQ ID NO: 155005 - DNA, 15 bp, Homo sapiens
cccacaggaaaactc

SEQ ID NO: 155006 - DNA, 15 bp, Homo sapiens
acccacaggaaaact

SEQ ID NO: 155007 - DNA, 15 bp, Homo sapiens
tacccacaggaaaac

SEQ ID NO: 155008 - DNA, 15 bp, Homo sapiens
atacccacaggaaaa

SEQ ID NO: 155009 - DNA, 15 bp, Homo sapiens
aatacccacaggaaa

SEQ ID NO: 155010 - DNA, 15 bp, Homo sapiens
caatacccacaggaa

SEQ ID NO: 155011 - DNA, 15 bp, Homo sapiens
tcaatacccacagga

SEQ ID NO: 155012 - DNA, 15 bp, Homo sapiens
ttcaatacccacagg

SEQ ID NO: 155013 - DNA, 15 bp, Homo sapiens
tttcaatacccacag

SEQ ID NO: 155014 - DNA, 15 bp, Homo sapiens
atttcaatacccaca

SEQ ID NO: 155015 - DNA, 15 bp, Homo sapiens
catttcaatacccac

SEQ ID NO: 155016 - DNA, 15 bp, Homo sapiens
ccatttcaataccca

SEQ ID NO: 155017 - DNA, 15 bp, Homo sapiens
accatttcaataccc

SEQ ID NO: 155018 - DNA, 15 bp, Homo sapiens
taccatttcaatacc

SEQ ID NO: 155019 - DNA, 15 bp, Homo sapiens
ttaccatttcaatac

SEQ ID NO: 155020 - DNA, 15 bp, Homo sapiens
gttaccatttcaata

SEQ ID NO: 155021 - DNA, 15 bp, Homo sapiens
tgttaccatttcaat

SEQ ID NO: 155022 - DNA, 15 bp, Homo sapiens
atgttaccatttcaa

SEQ ID NO: 155023 - DNA, 15 bp, Homo sapiens
aatgttaccatttca

SEQ ID NO: 155024 - DNA, 15 bp, Homo sapiens
aaatgttaccatttc

SEQ ID NO: 155025 - DNA, 15 bp, Homo sapiens
taaatgttaccattt

SEQ ID NO: 155026 - DNA, 15 bp, Homo sapiens
ttaaatgttaccatt

SEQ ID NO: 155027 - DNA, 15 bp, Homo sapiens
attaaatgttaccat

SEQ ID NO: 155028 - DNA, 15 bp, Homo sapiens
tattaaatgttacca

SEQ ID NO: 155029 - DNA, 15 bp, Homo sapiens
ttattaaatgttacc

SEQ ID NO: 155030 - DNA, 15 bp, Homo sapiens
gttattaaatgttac

SEQ ID NO: 155031 - DNA, 15 bp, Homo sapiens
ggttattaaatgtta

SEQ ID NO: 155032 - DNA, 15 bp, Homo sapiens
aggttattaaatgtt

SEQ ID NO: 155033 - DNA, 15 bp, Homo sapiens
taggttattaaatgt

SEQ ID NO: 155034 - DNA, 15 bp, Homo sapiens
ataggttattaaatg

SEQ ID NO: 155035 - DNA, 15 bp, Homo sapiens
cataggttattaaat

SEQ ID NO: 155036 - DNA, 15 bp, Homo sapiens
ccataggttattaaa

SEQ ID NO: 155037 - DNA, 15 bp, Homo sapiens
accataggttattaa

SEQ ID NO: 155038 - DNA, 15 bp, Homo sapiens
caccataggttatta

SEQ ID NO: 155039 - DNA, 15 bp, Homo sapiens
tcaccataggttatt

SEQ ID NO: 155040 - DNA, 15 bp, Homo sapiens
gtcaccataggttat

SEQ ID NO: 155041 - DNA, 15 bp, Homo sapiens
agtcaccataggtta

SEQ ID NO: 155042 - DNA, 15 bp, Homo sapiens
aagtcaccataggtt

SEQ ID NO: 155043 - DNA, 15 bp, Homo sapiens
aaagtcaccataggt

SEQ ID NO: 155044 - DNA, 15 bp, Homo sapiens
caaagtcaccatagg

SEQ ID NO: 155045 - DNA, 15 bp, Homo sapiens
ccaaagtcaccatag

SEQ ID NO: 155046 - DNA, 15 bp, Homo sapiens
tccaaagtcaccata

SEQ ID NO: 155047 - DNA, 15 bp, Homo sapiens
atccaaagtcaccat

SEQ ID NO: 155048 - DNA, 15 bp, Homo sapiens
tatccaaagtcacca

SEQ ID NO: 155049 - DNA, 15 bp, Homo sapiens
atatccaaagtcacc

SEQ ID NO: 155050 - DNA, 15 bp, Homo sapiens
aatatccaaagtcac

SEQ ID NO: 155051 - DNA, 15 bp, Homo sapiens
gaatatccaaagtca

SEQ ID NO: 155052 - DNA, 15 bp, Homo sapiens
agaatatccaaagtc

SEQ ID NO: 155053 - DNA, 15 bp, Homo sapiens
gagaatatccaaagt

SEQ ID NO: 155054 - DNA, 15 bp, Homo sapiens
tgagaatatccaaag

SEQ ID NO: 155055 - DNA, 15 bp, Homo sapiens
ttgagaatatccaaa

SEQ ID NO: 155056 - DNA, 15 bp, Homo sapiens
cttgagaatatccaa

SEQ ID NO: 155057 - DNA, 15 bp, Homo sapiens
acttgagaatatcca

SEQ ID NO: 155058 - DNA, 15 bp, Homo sapiens
aacttgagaatatcc

SEQ ID NO: 155059 - DNA, 15 bp, Homo sapiens
aaacttgagaatatc

SEQ ID NO: 155060 - DNA, 15 bp, Homo sapiens
taaacttgagaatat

SEQ ID NO: 155061 - DNA, 15 bp, Homo sapiens
ctaaacttgagaata

SEQ ID NO: 155062 - DNA, 15 bp, Homo sapiens
gctaaacttgagaat

SEQ ID NO: 155063 - DNA, 15 bp, Homo sapiens
agctaaacttgagaa

SEQ ID NO: 155064 - DNA, 15 bp, Homo sapiens
aagctaaacttgaga

SEQ ID NO: 155065 - DNA, 15 bp, Homo sapiens
gaagctaaacttgag

SEQ ID NO: 155066 - DNA, 15 bp, Homo sapiens
ggaagctaaacttga

SEQ ID NO: 155067 - DNA, 15 bp, Homo sapiens
aggaagctaaacttg

SEQ ID NO: 155068 - DNA, 15 bp, Homo sapiens
caggaagctaaactt

SEQ ID NO: 155069 - DNA, 15 bp, Homo sapiens
tcaggaagctaaact

SEQ ID NO: 155070 - DNA, 15 bp, Homo sapiens
atcaggaagctaaac

SEQ ID NO: 155071 - DNA, 15 bp, Homo sapiens
aatcaggaagctaaa

SEQ ID NO: 155072 - DNA, 15 bp, Homo sapiens
aaatcaggaagctaa

SEQ ID NO: 155073 - DNA, 15 bp, Homo sapiens
aaaatcaggaagcta

SEQ ID NO: 155074 - DNA, 15 bp, Homo sapiens
aaaaatcaggaagct

SEQ ID NO: 155075 - DNA, 15 bp, Homo sapiens
aaaaaatcaggaagc

SEQ ID NO: 155076 - DNA, 15 bp, Homo sapiens
gaaaaaatcaggaag

SEQ ID NO: 155077 - DNA, 15 bp, Homo sapiens
tgaaaaaatcaggaa

SEQ ID NO: 155078 - DNA, 15 bp, Homo sapiens
ttgaaaaaatcagga

SEQ ID NO: 155079 - DNA, 15 bp, Homo sapiens
cttgaaaaaatcagg

SEQ ID NO: 155080 - DNA, 15 bp, Homo sapiens
tcttgaaaaaatcag

SEQ ID NO: 155081 - DNA, 15 bp, Homo sapiens
atcttgaaaaaatca

SEQ ID NO: 155082 - DNA, 15 bp, Homo sapiens
gatcttgaaaaaatc

SEQ ID NO: 155083 - DNA, 15 bp, Homo sapiens
tgatcttgaaaaaat

SEQ ID NO: 155084 - DNA, 15 bp, Homo sapiens
ctgatcttgaaaaaa

SEQ ID NO: 155085 - DNA, 15 bp, Homo sapiens
cctgatcttgaaaaa

SEQ ID NO: 155086 - DNA, 15 bp, Homo sapiens
tcctgatcttgaaaa

SEQ ID NO: 155087 - DNA, 15 bp, Homo sapiens
ctcctgatcttgaaa

SEQ ID NO: 155088 - DNA, 15 bp, Homo sapiens
tctcctgatcttgaa

SEQ ID NO: 155089 - DNA, 15 bp, Homo sapiens
gtctcctgatcttga

SEQ ID NO: 155090 - DNA, 15 bp, Homo sapiens
tgtctcctgatcttg

SEQ ID NO: 155091 - DNA, 15 bp, Homo sapiens
ctgtctcctgatctt

SEQ ID NO: 155092 - DNA, 15 bp, Homo sapiens
tctgtctcctgatct

SEQ ID NO: 155093 - DNA, 15 bp, Homo sapiens
ttctgtctcctgatc

SEQ ID NO: 155094 - DNA, 15 bp, Homo sapiens
cttctgtctcctgat

SEQ ID NO: 155095 - DNA, 15 bp, Homo sapiens
gcttctgtctcctga

SEQ ID NO: 155096 - DNA, 15 bp, Homo sapiens
agcttctgtctcctg

SEQ ID NO: 155097 - DNA, 15 bp, Homo sapiens
aagcttctgtctcct

SEQ ID NO: 155098 - DNA, 15 bp, Homo sapiens
taagcttctgtctcc

SEQ ID NO: 155099 - DNA, 15 bp, Homo sapiens
ttaagcttctgtctc

SEQ ID NO: 155100 - DNA, 15 bp, Homo sapiens
tttaagcttctgtct

SEQ ID NO: 155101 - DNA, 15 bp, Homo sapiens
ttttaagcttctgtc

SEQ ID NO: 155102 - DNA, 15 bp, Homo sapiens
cttttaagcttctgt

SEQ ID NO: 155103 - DNA, 15 bp, Homo sapiens
tcttttaagcttctg

SEQ ID NO: 155104 - DNA, 15 bp, Homo sapiens
ctcttttaagcttct

SEQ ID NO: 155105 - DNA, 15 bp, Homo sapiens
actcttttaagcttc

SEQ ID NO: 155106 - DNA, 15 bp, Homo sapiens
aactcttttaagctt

SEQ ID NO: 155107 - DNA, 15 bp, Homo sapiens
taactcttttaagct

SEQ ID NO: 155108 - DNA, 15 bp, Homo sapiens
ttaactcttttaagc

SEQ ID NO: 155109 - DNA, 15 bp, Homo sapiens
attaactcttttaag

SEQ ID NO: 155110 - DNA, 15 bp, Homo sapiens
gattaactcttttaa

SEQ ID NO: 155111 - DNA, 15 bp, Homo sapiens
ggattaactctttta

SEQ ID NO: 155112 - DNA, 15 bp, Homo sapiens
aggattaactctttt

SEQ ID NO: 155113 - DNA, 15 bp, Homo sapiens
taggattaactcttt

SEQ ID NO: 155114 - DNA, 15 bp, Homo sapiens
ataggattaactctt

SEQ ID NO: 155115 - DNA, 15 bp, Homo sapiens
tataggattaactct

SEQ ID NO: 155116 - DNA, 15 bp, Homo sapiens
ctataggattaactc

SEQ ID NO: 155117 - DNA, 15 bp, Homo sapiens
cctataggattaact

SEQ ID NO: 155118 - DNA, 15 bp, Homo sapiens
tcctataggattaac

SEQ ID NO: 155119 - DNA, 15 bp, Homo sapiens
attaatcctatagga

SEQ ID NO: 155120 - DNA, 15 bp, Homo sapiens
aattaatcctatagg

SEQ ID NO: 155121 - DNA, 15 bp, Homo sapiens
taattaatcctatag

SEQ ID NO: 155122 - DNA, 15 bp, Homo sapiens
ctaattaatcctata

SEQ ID NO: 155123 - DNA, 15 bp, Homo sapiens
actaattaatcctat

SEQ ID NO: 155124 - DNA, 15 bp, Homo sapiens
tactaattaatccta

SEQ ID NO: 155125 - DNA, 15 bp, Homo sapiens
ctactaattaatcct

SEQ ID NO: 155126 - DNA, 15 bp, Homo sapiens
actactaattaatcc

SEQ ID NO: 155127 - DNA, 15 bp, Homo sapiens
cactactaattaatc

SEQ ID NO: 155128 - DNA, 15 bp, Homo sapiens
ccactactaattaat

SEQ ID NO: 155129 - DNA, 15 bp, Homo sapiens
gccactactaattaa

SEQ ID NO: 155130 - DNA, 15 bp, Homo sapiens
tgccactactaatta

SEQ ID NO: 155131 - DNA, 15 bp, Homo sapiens
ttgccactactaatt

SEQ ID NO: 155132 - DNA, 15 bp, Homo sapiens
attgccactactaat

SEQ ID NO: 155133 - DNA, 15 bp, Homo sapiens
cattgccactactaa

SEQ ID NO: 155134 - DNA, 15 bp, Homo sapiens
tcattgccactacta

SEQ ID NO: 155135 - DNA, 15 bp, Homo sapiens
gtcattgccactact

SEQ ID NO: 155136 - DNA, 15 bp, Homo sapiens
ggtcattgccactac

SEQ ID NO: 155137 - DNA, 15 bp, Homo sapiens
tggtcattgccacta

SEQ ID NO: 155138 - DNA, 15 bp, Homo sapiens
ttggtcattgccact

SEQ ID NO: 155139 - DNA, 15 bp, Homo sapiens
tttggtcattgccac

SEQ ID NO: 155140 - DNA, 15 bp, Homo sapiens
gtttggtcattgcca

SEQ ID NO: 155141 - DNA, 15 bp, Homo sapiens
agtttggtcattgcc

SEQ ID NO: 155142 - DNA, 15 bp, Homo sapiens
cagtttggtcattgc

SEQ ID NO: 155143 - DNA, 15 bp, Homo sapiens
gcagtttggtcattg

SEQ ID NO: 155144 - DNA, 15 bp, Homo sapiens
cgcagtttggtcatt

SEQ ID NO: 155145 - DNA, 15 bp, Homo sapiens
tcgcagtttggtcat

SEQ ID NO: 155146 - DNA, 15 bp, Homo sapiens
atcgcagtttggtca

SEQ ID NO: 155147 - DNA, 15 bp, Homo sapiens
catcgcagtttggtc

SEQ ID NO: 155148 - DNA, 15 bp, Homo sapiens
tcatcgcagtttggt

SEQ ID NO: 155149 - DNA, 15 bp, Homo sapiens
atcatcgcagtttgg

SEQ ID NO: 155150 - DNA, 15 bp, Homo sapiens
tatcatcgcagtttg

SEQ ID NO: 155151 - DNA, 15 bp, Homo sapiens
atatcatcgcagttt

SEQ ID NO: 155152 - DNA, 15 bp, Homo sapiens
catatcatcgcagtt

SEQ ID NO: 155153 - DNA, 15 bp, Homo sapiens
ccatatcatcgcagt

SEQ ID NO: 155154 - DNA, 15 bp, Homo sapiens
tccatatcatcgcag

SEQ ID NO: 155155 - DNA, 15 bp, Homo sapiens
atccatatcatcgca

SEQ ID NO: 155156 - DNA, 15 bp, Homo sapiens
tatccatatcatcgc

SEQ ID NO: 155157 - DNA, 15 bp, Homo sapiens
atatccatatcatcg

SEQ ID NO: 155158 - DNA, 15 bp, Homo sapiens
tatatccatatcatc

SEQ ID NO: 155159 - DNA, 15 bp, Homo sapiens
atatatccatatcat

SEQ ID NO: 155160 - DNA, 15 bp, Homo sapiens
aatatatccatatca

SEQ ID NO: 155161 - DNA, 15 bp, Homo sapiens
gaatatatccatatc

SEQ ID NO: 155162 - DNA, 15 bp, Homo sapiens
ggaatatatccatat

SEQ ID NO: 155163 - DNA, 15 bp, Homo sapiens
tggaatatatccata

SEQ ID NO: 155164 - DNA, 15 bp, Homo sapiens
atggaatatatccat

SEQ ID NO: 155165 - DNA, 15 bp, Homo sapiens
aatggaatatatcca

SEQ ID NO: 155166 - DNA, 15 bp, Homo sapiens
aaatggaatatatcc

SEQ ID NO: 155167 - DNA, 15 bp, Homo sapiens
aaaatggaatatatc

SEQ ID NO: 155168 - DNA, 15 bp, Homo sapiens
aaaaatggaatatat

SEQ ID NO: 155169 - DNA, 15 bp, Homo sapiens
caaaaatggaatata

SEQ ID NO: 155170 - DNA, 15 bp, Homo sapiens
ccaaaaatggaatat

SEQ ID NO: 155171 - DNA, 15 bp, Homo sapiens
cccaaaaatggaata

SEQ ID NO: 155172 - DNA, 15 bp, Homo sapiens
acccaaaaatggaat

SEQ ID NO: 155173 - DNA, 15 bp, Homo sapiens
aacccaaaaatggaa

SEQ ID NO: 155174 - DNA, 15 bp, Homo sapiens
aaacccaaaaatgga

SEQ ID NO: 155175 - DNA, 15 bp, Homo sapiens
gaaacccaaaaatgg

SEQ ID NO: 155176 - DNA, 15 bp, Homo sapiens
tgaaacccaaaaatg

SEQ ID NO: 155177 - DNA, 15 bp, Homo sapiens
atgaaacccaaaaat

SEQ ID NO: 155178 - DNA, 15 bp, Homo sapiens
catgaaacccaaaaa

SEQ ID NO: 155179 - DNA, 15 bp, Homo sapiens
ccatgaaacccaaaa

SEQ ID NO: 155180 - DNA, 15 bp, Homo sapiens
cccatgaaacccaaa

SEQ ID NO: 155181 - DNA, 15 bp, Homo sapiens
tcccatgaaacccaa

SEQ ID NO: 155182 - DNA, 15 bp, Homo sapiens
gtcccatgaaaccca

SEQ ID NO: 155183 - DNA, 15 bp, Homo sapiens
agtcccatgaaaccc

SEQ ID NO: 155184 - DNA, 15 bp, Homo sapiens
cagtcccatgaaacc

SEQ ID NO: 155185 - DNA, 15 bp, Homo sapiens
acagtcccatgaaac

SEQ ID NO: 155186 - DNA, 15 bp, Homo sapiens
tacagtcccatgaaa

SEQ ID NO: 155187 - DNA, 15 bp, Homo sapiens
gtacagtcccatgaa

SEQ ID NO: 155188 - DNA, 15 bp, Homo sapiens
agtacagtcccatga

SEQ ID NO: 155189 - DNA, 15 bp, Homo sapiens
tagtacagtcccatg

SEQ ID NO: 155190 - DNA, 15 bp, Homo sapiens
gtagtacagtcccat

SEQ ID NO: 155191 - DNA, 15 bp, Homo sapiens
ggtagtacagtccca

SEQ ID NO: 155192 - DNA, 15 bp, Homo sapiens
tggtagtacagtccc

SEQ ID NO: 155193 - DNA, 15 bp, Homo sapiens
ttggtagtacagtcc

SEQ ID NO: 155194 - DNA, 15 bp, Homo sapiens
tttggtagtacagtc

SEQ ID NO: 155195 - DNA, 15 bp, Homo sapiens
ctttggtagtacagt

SEQ ID NO: 155196 - DNA, 15 bp, Homo sapiens
actttggtagtacag

SEQ ID NO: 155197 - DNA, 15 bp, Homo sapiens
cactttggtagtaca

SEQ ID NO: 155198 - DNA, 15 bp, Homo sapiens
acactttggtagtac

SEQ ID NO: 155199 - DNA, 15 bp, Homo sapiens
tacactttggtagta

SEQ ID NO: 155200 - DNA, 15 bp, Homo sapiens
atacactttggtagt

SEQ ID NO: 155201 - DNA, 15 bp, Homo sapiens
aatacactttggtag

SEQ ID NO: 155202 - DNA, 15 bp, Homo sapiens
aaatacactttggta

SEQ ID NO: 155203 - DNA, 15 bp, Homo sapiens
aaaatacactttggt

SEQ ID NO: 155204 - DNA, 15 bp, Homo sapiens
taaaatacactttgg

SEQ ID NO: 155205 - DNA, 15 bp, Homo sapiens
ataaaatacactttg

SEQ ID NO: 155206 - DNA, 15 bp, Homo sapiens
tataaaatacacttt

SEQ ID NO: 155207 - DNA, 15 bp, Homo sapiens
atataaaatacactt

SEQ ID NO: 155208 - DNA, 15 bp, Homo sapiens
catataaaatacact

SEQ ID NO: 155209 - DNA, 15 bp, Homo sapiens
acatataaaatacac

SEQ ID NO: 155210 - DNA, 15 bp, Homo sapiens
aacatataaaataca

SEQ ID NO: 155211 - DNA, 15 bp, Homo sapiens
aaacatataaaatac

SEQ ID NO: 155212 - DNA, 15 bp, Homo sapiens
gaaacatataaaata

SEQ ID NO: 155213 - DNA, 15 bp, Homo sapiens
agaaacatataaaat

SEQ ID NO: 155214 - DNA, 15 bp, Homo sapiens
tagaaacatataaaa

SEQ ID NO: 155215 - DNA, 15 bp, Homo sapiens
ttagaaacatataaa

SEQ ID NO: 155216 - DNA, 15 bp, Homo sapiens
attagaaacatataa

SEQ ID NO: 155217 - DNA, 15 bp, Homo sapiens
aattagaaacatata

SEQ ID NO: 155218 - DNA, 15 bp, Homo sapiens
aaattagaaacatat

SEQ ID NO: 155219 - DNA, 15 bp, Homo sapiens
caaattagaaacata

SEQ ID NO: 155220 - DNA, 15 bp, Homo sapiens
ccaaattagaaacat

SEQ ID NO: 155221 - DNA, 15 bp, Homo sapiens
tccaaattagaaaca

SEQ ID NO: 155222 - DNA, 15 bp, Homo sapiens
gtccaaattagaaac

SEQ ID NO: 155223 - DNA, 15 bp, Homo sapiens
agtccaaattagaaa

SEQ ID NO: 155224 - DNA, 15 bp, Homo sapiens
tagtccaaattagaa

SEQ ID NO: 155225 - DNA, 15 bp, Homo sapiens
atagtccaaattaga

SEQ ID NO: 155226 - DNA, 15 bp, Homo sapiens
aatagtccaaattag

SEQ ID NO: 155227 - DNA, 15 bp, Homo sapiens
caatagtccaaatta

SEQ ID NO: 155228 - DNA, 15 bp, Homo sapiens
tcaatagtccaaatt

SEQ ID NO: 155229 - DNA, 15 bp, Homo sapiens
gtcaatagtccaaat

SEQ ID NO: 155230 - DNA, 15 bp, Homo sapiens
tgtcaatagtccaaa

SEQ ID NO: 155231 - DNA, 15 bp, Homo sapiens
atgtcaatagtccaa

SEQ ID NO: 155232 - DNA, 15 bp, Homo sapiens
gatgtcaatagtcca

SEQ ID NO: 155233 - DNA, 15 bp, Homo sapiens
tgatgtcaatagtcc

SEQ ID NO: 155234 - DNA, 15 bp, Homo sapiens
ttgatgtcaatagtc

SEQ ID NO: 155235 - DNA, 15 bp, Homo sapiens
tttgatgtcaatagt

SEQ ID NO: 155236 - DNA, 15 bp, Homo sapiens
atttgatgtcaatag

SEQ ID NO: 155237 - DNA, 15 bp, Homo sapiens
catttgatgtcaata

SEQ ID NO: 155238 - DNA, 15 bp, Homo sapiens
tcatttgatgtcaat

SEQ ID NO: 155239 - DNA, 15 bp, Homo sapiens
ttcatttgatgtcaa

SEQ ID NO: 155240 - DNA, 15 bp, Homo sapiens
attcatttgatgtca

SEQ ID NO: 155241 - DNA, 15 bp, Homo sapiens
gattcatttgatgtc

SEQ ID NO: 155242 - DNA, 15 bp, Homo sapiens
tgattcatttgatgt

SEQ ID NO: 155243 - DNA, 15 bp, Homo sapiens
ttgattcatttgatg

SEQ ID NO: 155244 - DNA, 15 bp, Homo sapiens
tttgattcatttgat

SEQ ID NO: 155245 - DNA, 15 bp, Homo sapiens
atttgattcatttga

SEQ ID NO: 155246 - DNA, 15 bp, Homo sapiens
tatttgattcatttg

SEQ ID NO: 155247 - DNA, 15 bp, Homo sapiens
ctatttgattcattt

SEQ ID NO: 155248 - DNA, 15 bp, Homo sapiens
actatttgattcatt

SEQ ID NO: 155249 - DNA, 15 bp, Homo sapiens
aactatttgattcat

SEQ ID NO: 155250 - DNA, 15 bp, Homo sapiens
caactatttgattca

SEQ ID NO: 155251 - DNA, 15 bp, Homo sapiens
ccaactatttgattc

SEQ ID NO: 155252 - DNA, 15 bp, Homo sapiens
tccaactatttgatt

SEQ ID NO: 155253 - DNA, 15 bp, Homo sapiens
ctccaactatttgat

SEQ ID NO: 155254 - DNA, 15 bp, Homo sapiens
actccaactatttga

SEQ ID NO: 155255 - DNA, 15 bp, Homo sapiens
tactccaactatttg

SEQ ID NO: 155256 - DNA, 15 bp, Homo sapiens
ttactccaactattt

SEQ ID NO: 155257 - DNA, 15 bp, Homo sapiens
tttactccaactatt

SEQ ID NO: 155258 - DNA, 15 bp, Homo sapiens
atttactccaactat

SEQ ID NO: 155259 - DNA, 15 bp, Homo sapiens
catttactccaacta

SEQ ID NO: 155260 - DNA, 15 bp, Homo sapiens
tcatttactccaact

SEQ ID NO: 155261 - DNA, 15 bp, Homo sapiens
atcatttactccaac

SEQ ID NO: 155262 - DNA, 15 bp, Homo sapiens
aatcatttactccaa

SEQ ID NO: 155263 - DNA, 15 bp, Homo sapiens
aaatcatttactcca

SEQ ID NO: 155264 - DNA, 15 bp, Homo sapiens
taaatcatttactcc

SEQ ID NO: 155265 - DNA, 15 bp, Homo sapiens
gtaaatcatttactc

SEQ ID NO: 155266 - DNA, 15 bp, Homo sapiens
agtaaatcatttact

SEQ ID NO: 155267 - DNA, 15 bp, Homo sapiens
aagtaaatcatttac

SEQ ID NO: 155268 - DNA, 15 bp, Homo sapiens
caagtaaatcattta

SEQ ID NO: 155269 - DNA, 15 bp, Homo sapiens
tcaagtaaatcattt

SEQ ID NO: 155270 - DNA, 15 bp, Homo sapiens
ttcaagtaaatcatt

SEQ ID NO: 155271 - DNA, 15 bp, Homo sapiens
cttcaagtaaatcat

SEQ ID NO: 155272 - DNA, 15 bp, Homo sapiens
ccttcaagtaaatca

SEQ ID NO: 155273 - DNA, 15 bp, Homo sapiens
accttcaagtaaatc

SEQ ID NO: 155274 - DNA, 15 bp, Homo sapiens
caccttcaagtaaat

SEQ ID NO: 155275 - DNA, 15 bp, Homo sapiens
ccaccttcaagtaaa

SEQ ID NO: 155276 - DNA, 15 bp, Homo sapiens
accaccttcaagtaa

SEQ ID NO: 155277 - DNA, 15 bp, Homo sapiens
aaccaccttcaagta

SEQ ID NO: 155278 - DNA, 15 bp, Homo sapiens
gaaccaccttcaagt

SEQ ID NO: 155279 - DNA, 15 bp, Homo sapiens
ggaaccaccttcaag

SEQ ID NO: 155280 - DNA, 15 bp, Homo sapiens
tggaaccaccttcaa

SEQ ID NO: 155281 - DNA, 15 bp, Homo sapiens
ttggaaccaccttca

SEQ ID NO: 155282 - DNA, 15 bp, Homo sapiens
tttggaaccaccttc

SEQ ID NO: 155283 - DNA, 15 bp, Homo sapiens
ttttggaaccacctt

SEQ ID NO: 155284 - DNA, 15 bp, Homo sapiens
tttttggaaccacct

SEQ ID NO: 155285 - DNA, 15 bp, Homo sapiens
atttttggaaccacc

SEQ ID NO: 155286 - DNA, 15 bp, Homo sapiens
aatttttggaaccac

SEQ ID NO: 155287 - DNA, 15 bp, Homo sapiens
taatttttggaacca

SEQ ID NO: 155288 - DNA, 15 bp, Homo sapiens
ttaatttttggaacc

SEQ ID NO: 155289 - DNA, 15 bp, Homo sapiens
attaatttttggaac

SEQ ID NO: 155290 - DNA, 15 bp, Homo sapiens
aattaatttttggaa

SEQ ID NO: 155291 - DNA, 15 bp, Homo sapiens
taattaatttttgga

SEQ ID NO: 155292 - DNA, 15 bp, Homo sapiens
ttaattaatttttgg

SEQ ID NO: 155293 - DNA, 15 bp, Homo sapiens
attaattaatttttg

SEQ ID NO: 155294 - DNA, 15 bp, Homo sapiens
cattaattaattttt

SEQ ID NO: 155295 - DNA, 15 bp, Homo sapiens
tcattaattaatttt

SEQ ID NO: 155296 - DNA, 15 bp, Homo sapiens
ttcattaattaattt

SEQ ID NO: 155297 - DNA, 15 bp, Homo sapiens
tttcattaattaatt

SEQ ID NO: 155298 - DNA, 15 bp, Homo sapiens
atttcattaattaat

SEQ ID NO: 155299 - DNA, 15 bp, Homo sapiens
catttcattaattaa

SEQ ID NO: 155300 - DNA, 15 bp, Homo sapiens
acatttcattaatta

SEQ ID NO: 155301 - DNA, 15 bp, Homo sapiens
tacatttcattaatt

SEQ ID NO: 155302 - DNA, 15 bp, Homo sapiens
atacatttcattaat

SEQ ID NO: 155303 - DNA, 15 bp, Homo sapiens
gatacatttcattaa

SEQ ID NO: 155304 - DNA, 15 bp, Homo sapiens
agatacatttcatta

SEQ ID NO: 155305 - DNA, 15 bp, Homo sapiens
gagatacatttcatt

SEQ ID NO: 155306 - DNA, 15 bp, Homo sapiens
agagatacatttcat

SEQ ID NO: 155307 - DNA, 15 bp, Homo sapiens
aagagatacatttca

SEQ ID NO: 155308 - DNA, 15 bp, Homo sapiens
aaagagatacatttc

SEQ ID NO: 155309 - DNA, 15 bp, Homo sapiens
taaagagatacattt

SEQ ID NO: 155310 - DNA, 15 bp, Homo sapiens
ctaaagagatacatt

SEQ ID NO: 155311 - DNA, 15 bp, Homo sapiens
tctaaagagatacat

SEQ ID NO: 155312 - DNA, 15 bp, Homo sapiens
atctaaagagataca

SEQ ID NO: 155313 - DNA, 15 bp, Homo sapiens
tatctaaagagatac

SEQ ID NO: 155314 - DNA, 15 bp, Homo sapiens
ttatctaaagagata

SEQ ID NO: 155315 - DNA, 15 bp, Homo sapiens
tttatctaaagagat

SEQ ID NO: 155316 - DNA, 15 bp, Homo sapiens
ttttatctaaagaga

SEQ ID NO: 155317 - DNA, 15 bp, Homo sapiens
gttttatctaaagag

SEQ ID NO: 155318 - DNA, 15 bp, Homo sapiens
tgttttatctaaaga

SEQ ID NO: 155319 - DNA, 15 bp, Homo sapiens
gtgttttatctaaag

SEQ ID NO: 155320 - DNA, 15 bp, Homo sapiens
tgtgttttatctaaa

SEQ ID NO: 155321 - DNA, 15 bp, Homo sapiens
atgtgttttatctaa

SEQ ID NO: 155322 - DNA, 15 bp, Homo sapiens
tatgtgttttatcta

SEQ ID NO: 155323 - DNA, 15 bp, Homo sapiens
atatgtgttttatct

SEQ ID NO: 155324 - DNA, 15 bp, Homo sapiens
catatgtgttttatc

SEQ ID NO: 155325 - DNA, 15 bp, Homo sapiens
ccatatgtgttttat

SEQ ID NO: 155326 - DNA, 15 bp, Homo sapiens
accatatgtgtttta

SEQ ID NO: 155327 - DNA, 15 bp, Homo sapiens
taccatatgtgtttt

SEQ ID NO: 155328 - DNA, 15 bp, Homo sapiens
ttaccatatgtgttt

SEQ ID NO: 155329 - DNA, 15 bp, Homo sapiens
gttaccatatgtgtt

SEQ ID NO: 155330 - DNA, 15 bp, Homo sapiens
tgttaccatatgtgt

SEQ ID NO: 155331 - DNA, 15 bp, Homo sapiens
atgttaccatatgtg

SEQ ID NO: 155332 - DNA, 15 bp, Homo sapiens
gatgttaccatatgt

SEQ ID NO: 155333 - DNA, 15 bp, Homo sapiens
agatgttaccatatg

SEQ ID NO: 155334 - DNA, 15 bp, Homo sapiens
aagatgttaccatat

SEQ ID NO: 155335 - DNA, 15 bp, Homo sapiens
taagatgttaccata

SEQ ID NO: 155336 - DNA, 15 bp, Homo sapiens
ttaagatgttaccat

SEQ ID NO: 155337 - DNA, 15 bp, Homo sapiens
gttaagatgttacca

SEQ ID NO: 155338 - DNA, 15 bp, Homo sapiens
tgttaagatgttacc

SEQ ID NO: 155339 - DNA, 15 bp, Homo sapiens
ctgttaagatgttac

SEQ ID NO: 155340 - DNA, 15 bp, Homo sapiens
gctgttaagatgtta

SEQ ID NO: 155341 - DNA, 15 bp, Homo sapiens
agctgttaagatgtt

SEQ ID NO: 155342 - DNA, 15 bp, Homo sapiens
cagctgttaagatgt

SEQ ID NO: 155343 - DNA, 15 bp, Homo sapiens
acagctgttaagatg

SEQ ID NO: 155344 - DNA, 15 bp, Homo sapiens
aacagctgttaagat

SEQ ID NO: 155345 - DNA, 15 bp, Homo sapiens
caacagctgttaaga

SEQ ID NO: 155346 - DNA, 15 bp, Homo sapiens
tcaacagctgttaag

SEQ ID NO: 155347 - DNA, 15 bp, Homo sapiens
ctcaacagctgttaa

SEQ ID NO: 155348 - DNA, 15 bp, Homo sapiens
actcaacagctgtta

SEQ ID NO: 155349 - DNA, 15 bp, Homo sapiens
gactcaacagctgtt

SEQ ID NO: 155350 - DNA, 15 bp, Homo sapiens
agactcaacagctgt

SEQ ID NO: 155351 - DNA, 15 bp, Homo sapiens
cagactcaacagctg

SEQ ID NO: 155352 - DNA, 15 bp, Homo sapiens
ccagactcaacagct

SEQ ID NO: 155353 - DNA, 15 bp, Homo sapiens
accagactcaacagc

SEQ ID NO: 155354 - DNA, 15 bp, Homo sapiens
aaccagactcaacag

SEQ ID NO: 155355 - DNA, 15 bp, Homo sapiens
caaccagactcaaca

SEQ ID NO: 155356 - DNA, 15 bp, Homo sapiens
acaaccagactcaac

SEQ ID NO: 155357 - DNA, 15 bp, Homo sapiens
gacaaccagactcaa

SEQ ID NO: 155358 - DNA, 15 bp, Homo sapiens
tgacaaccagactca

SEQ ID NO: 155359 - DNA, 15 bp, Homo sapiens
ctgacaaccagactc

SEQ ID NO: 155360 - DNA, 15 bp, Homo sapiens
actgacaaccagact

SEQ ID NO: 155361 - DNA, 15 bp, Homo sapiens
tactgacaaccagac

SEQ ID NO: 155362 - DNA, 15 bp, Homo sapiens
atactgacaaccaga

SEQ ID NO: 155363 - DNA, 15 bp, Homo sapiens
tatactgacaaccag

SEQ ID NO: 155364 - DNA, 15 bp, Homo sapiens
atatactgacaacca

SEQ ID NO: 155365 - DNA, 15 bp, Homo sapiens
catatactgacaacc

SEQ ID NO: 155366 - DNA, 15 bp, Homo sapiens
ccatatactgacaac

SEQ ID NO: 155367 - DNA, 15 bp, Homo sapiens
cccatatactgacaa

SEQ ID NO: 155368 - DNA, 15 bp, Homo sapiens
acccatatactgaca

SEQ ID NO: 155369 - DNA, 15 bp, Homo sapiens
tacccatatactgac

SEQ ID NO: 155370 - DNA, 15 bp, Homo sapiens
atacccatatactga

SEQ ID NO: 155371 - DNA, 15 bp, Homo sapiens
aatacccatatactg

SEQ ID NO: 155372 - DNA, 15 bp, Homo sapiens
aaatacccatatact

SEQ ID NO: 155373 - DNA, 15 bp, Homo sapiens
taaatacccatatac

SEQ ID NO: 155374 - DNA, 15 bp, Homo sapiens
ataaatacccatata

SEQ ID NO: 155375 - DNA, 15 bp, Homo sapiens
aataaatacccatat

SEQ ID NO: 155376 - DNA, 15 bp, Homo sapiens
aaataaatacccata

SEQ ID NO: 155377 - DNA, 15 bp, Homo sapiens
aaaataaatacccat

SEQ ID NO: 155378 - DNA, 15 bp, Homo sapiens
taaaataaataccca

SEQ ID NO: 155379 - DNA, 15 bp, Homo sapiens
gtaaaataaataccc

SEQ ID NO: 155380 - DNA, 15 bp, Homo sapiens
agtaaaataaatacc

SEQ ID NO: 155381 - DNA, 15 bp, Homo sapiens
gagtaaaataaatac

SEQ ID NO: 155382 - DNA, 15 bp, Homo sapiens
agagtaaaataaata

SEQ ID NO: 155383 - DNA, 15 bp, Homo sapiens
aagagtaaaataaat

SEQ ID NO: 155384 - DNA, 15 bp, Homo sapiens
aaagagtaaaataaa

SEQ ID NO: 155385 - DNA, 15 bp, Homo sapiens
aaaagagtaaaataa

SEQ ID NO: 155386 - DNA, 15 bp, Homo sapiens
aaaaagagtaaaata

SEQ ID NO: 155387 - DNA, 15 bp, Homo sapiens
aaaaaagagtaaaat

SEQ ID NO: 155388 - DNA, 15 bp, Homo sapiens
gaaaaaagagtaaaa

SEQ ID NO: 155389 - DNA, 15 bp, Homo sapiens
tgaaaaaagagtaaa

SEQ ID NO: 155390 - DNA, 15 bp, Homo sapiens
ttgaaaaaagagtaa

SEQ ID NO: 155391 - DNA, 15 bp, Homo sapiens
attgaaaaaagagta

SEQ ID NO: 155392 - DNA, 15 bp, Homo sapiens
aattgaaaaaagagt

SEQ ID NO: 155393 - DNA, 15 bp, Homo sapiens
taattgaaaaaagag

SEQ ID NO: 155394 - DNA, 15 bp, Homo sapiens
ataattgaaaaaaga

SEQ ID NO: 155395 - DNA, 15 bp, Homo sapiens
aataattgaaaaaag

SEQ ID NO: 155396 - DNA, 15 bp, Homo sapiens
gaataattgaaaaaa

SEQ ID NO: 155397 - DNA, 15 bp, Homo sapiens
agaataattgaaaaa

SEQ ID NO: 155398 - DNA, 15 bp, Homo sapiens
cagaataattgaaaa

SEQ ID NO: 155399 - DNA, 15 bp, Homo sapiens
acagaataattgaaa

SEQ ID NO: 155400 - DNA, 15 bp, Homo sapiens
tacagaataattgaa

SEQ ID NO: 155401 - DNA, 15 bp, Homo sapiens
atacagaataattga

SEQ ID NO: 155402 - DNA, 15 bp, Homo sapiens
catacagaataattg

SEQ ID NO: 155403 - DNA, 15 bp, Homo sapiens
gcatacagaataatt

SEQ ID NO: 155404 - DNA, 15 bp, Homo sapiens
agcatacagaataat

SEQ ID NO: 155405 - DNA, 15 bp, Homo sapiens
aagcatacagaataa

SEQ ID NO: 155406 - DNA, 15 bp, Homo sapiens
caagcatacagaata

SEQ ID NO: 155407 - DNA, 15 bp, Homo sapiens
tcaagcatacagaat

SEQ ID NO: 155408 - DNA, 15 bp, Homo sapiens
ttcaagcatacagaa

SEQ ID NO: 155409 - DNA, 15 bp, Homo sapiens
attcaagcatacaga

SEQ ID NO: 155410 - DNA, 15 bp, Homo sapiens
tattcaagcatacag

SEQ ID NO: 155411 - DNA, 15 bp, Homo sapiens
atattcaagcataca

SEQ ID NO: 155412 - DNA, 15 bp, Homo sapiens
aatattcaagcatac

SEQ ID NO: 155413 - DNA, 15 bp, Homo sapiens
aaatattcaagcata

SEQ ID NO: 155414 - DNA, 15 bp, Homo sapiens
aaaatattcaagcat

SEQ ID NO: 155415 - DNA, 15 bp, Homo sapiens
aaaaatattcaagca

SEQ ID NO: 155416 - DNA, 15 bp, Homo sapiens
taaaaatattcaagc

SEQ ID NO: 155417 - DNA, 15 bp, Homo sapiens
ataaaaatattcaag

SEQ ID NO: 155418 - DNA, 15 bp, Homo sapiens
cataaaaatattcaa

SEQ ID NO: 155419 - DNA, 15 bp, Homo sapiens
tcataaaaatattca

SEQ ID NO: 155420 - DNA, 15 bp, Homo sapiens
atcataaaaatattc

SEQ ID NO: 155421 - DNA, 15 bp, Homo sapiens
tatcataaaaatatt

SEQ ID NO: 155422 - DNA, 15 bp, Homo sapiens
ttatcataaaaatat

SEQ ID NO: 155423 - DNA, 15 bp, Homo sapiens
tttatcataaaaata

SEQ ID NO: 155424 - DNA, 15 bp, Homo sapiens
ttttatcataaaaat

SEQ ID NO: 155425 - DNA, 15 bp, Homo sapiens
attttatcataaaaa

SEQ ID NO: 155426 - DNA, 15 bp, Homo sapiens
cattttatcataaaa

SEQ ID NO: 155427 - DNA, 15 bp, Homo sapiens
acattttatcataaa

SEQ ID NO: 155428 - DNA, 15 bp, Homo sapiens
gacattttatcataa

SEQ ID NO: 155429 - DNA, 15 bp, Homo sapiens
agacattttatcata

SEQ ID NO: 155430 - DNA, 15 bp, Homo sapiens
aagacattttatcat

SEQ ID NO: 155431 - DNA, 15 bp, Homo sapiens
taagacattttatca

SEQ ID NO: 155432 - DNA, 15 bp, Homo sapiens
ataagacattttatc

SEQ ID NO: 155433 - DNA, 15 bp, Homo sapiens
tataagacattttat

SEQ ID NO: 155434 - DNA, 15 bp, Homo sapiens
ctataagacatttta

SEQ ID NO: 155435 - DNA, 15 bp, Homo sapiens
cctataagacatttt

SEQ ID NO: 155436 - DNA, 15 bp, Homo sapiens
acctataagacattt

SEQ ID NO: 155437 - DNA, 15 bp, Homo sapiens
tacctataagacatt

SEQ ID NO: 155438 - DNA, 15 bp, Homo sapiens
ttacctataagacat

SEQ ID NO: 155439 - DNA, 15 bp, Homo sapiens
gttacctataagaca

SEQ ID NO: 155440 - DNA, 15 bp, Homo sapiens
tgttacctataagac

SEQ ID NO: 155441 - DNA, 15 bp, Homo sapiens
ttgttacctataaga

SEQ ID NO: 155442 - DNA, 15 bp, Homo sapiens
gttgttacctataag

SEQ ID NO: 155443 - DNA, 15 bp, Homo sapiens
tgttgttacctataa

SEQ ID NO: 155444 - DNA, 15 bp, Homo sapiens
ttgttgttacctata

SEQ ID NO: 155445 - DNA, 15 bp, Homo sapiens
gttgttgttacctat

SEQ ID NO: 155446 - DNA, 15 bp, Homo sapiens
ggttgttgttaccta

SEQ ID NO: 155447 - DNA, 15 bp, Homo sapiens
gggttgttgttacct

SEQ ID NO: 155448 - DNA, 15 bp, Homo sapiens
agggttgttgttacc

SEQ ID NO: 155449 - DNA, 15 bp, Homo sapiens
tagggttgttgttac

SEQ ID NO: 155450 - DNA, 15 bp, Homo sapiens
atagggttgttgtta

SEQ ID NO: 155451 - DNA, 15 bp, Homo sapiens
aatagggttgttgtt

SEQ ID NO: 155452 - DNA, 15 bp, Homo sapiens
gaatagggttgttgt

SEQ ID NO: 155453 - DNA, 15 bp, Homo sapiens
agaatagggttgttg

SEQ ID NO: 155454 - DNA, 15 bp, Homo sapiens
tagaatagggttgtt

SEQ ID NO: 155455 - DNA, 15 bp, Homo sapiens
ttagaatagggttgt

SEQ ID NO: 155456 - DNA, 15 bp, Homo sapiens
attagaatagggttg

SEQ ID NO: 155457 - DNA, 15 bp, Homo sapiens
tattagaatagggtt

SEQ ID NO: 155458 - DNA, 15 bp, Homo sapiens
ttattagaatagggt

SEQ ID NO: 155459 - DNA, 15 bp, Homo sapiens
tttattagaataggg

SEQ ID NO: 155460 - DNA, 15 bp, Homo sapiens
ttttattagaatagg

SEQ ID NO: 155461 - DNA, 15 bp, Homo sapiens
cttttattagaatag

SEQ ID NO: 155462 - DNA, 15 bp, Homo sapiens
gcttttattagaata

SEQ ID NO: 155463 - DNA, 15 bp, Homo sapiens
agcttttattagaat

SEQ ID NO: 155464 - DNA, 15 bp, Homo sapiens
aagcttttattagaa

SEQ ID NO: 155465 - DNA, 15 bp, Homo sapiens
caagcttttattaga

SEQ ID NO: 155466 - DNA, 15 bp, Homo sapiens
acaagcttttattag

SEQ ID NO: 155467 - DNA, 15 bp, Homo sapiens
gacaagcttttatta

SEQ ID NO: 155468 - DNA, 15 bp, Homo sapiens
tgacaagcttttatt

SEQ ID NO: 155469 - DNA, 15 bp, Homo sapiens
ctgacaagcttttat

SEQ ID NO: 155470 - DNA, 15 bp, Homo sapiens
tctgacaagctttta

SEQ ID NO: 155471 - DNA, 15 bp, Homo sapiens
atctgacaagctttt

SEQ ID NO: 155472 - DNA, 15 bp, Homo sapiens
aatctgacaagcttt

SEQ ID NO: 155473 - DNA, 15 bp, Homo sapiens
taatctgacaagctt

SEQ ID NO: 155474 - DNA, 15 bp, Homo sapiens
gtaatctgacaagct

SEQ ID NO: 155475 - DNA, 15 bp, Homo sapiens
agtaatctgacaagc

SEQ ID NO: 155476 - DNA, 15 bp, Homo sapiens
aagtaatctgacaag

SEQ ID NO: 155477 - DNA, 15 bp, Homo sapiens
caagtaatctgacaa

SEQ ID NO: 155478 - DNA, 15 bp, Homo sapiens
tcaagtaatctgaca

SEQ ID NO: 155479 - DNA, 15 bp, Homo sapiens
ctcaagtaatctgac

SEQ ID NO: 155480 - DNA, 15 bp, Homo sapiens
gctcaagtaatctga

SEQ ID NO: 155481 - DNA, 15 bp, Homo sapiens
ggctcaagtaatctg

SEQ ID NO: 155482 - DNA, 15 bp, Homo sapiens
gggctcaagtaatct

SEQ ID NO: 155483 - DNA, 15 bp, Homo sapiens
agggctcaagtaatc

SEQ ID NO: 155484 - DNA, 15 bp, Homo sapiens
aagggctcaagtaat

SEQ ID NO: 155485 - DNA, 15 bp, Homo sapiens
caagggctcaagtaa

SEQ ID NO: 155486 - DNA, 15 bp, Homo sapiens
gcaagggctcaagta

SEQ ID NO: 155487 - DNA, 15 bp, Homo sapiens
tgcaagggctcaagt

SEQ ID NO: 155488 - DNA, 15 bp, Homo sapiens
atgcaagggctcaag

SEQ ID NO: 155489 - DNA, 15 bp, Homo sapiens
tatgcaagggctcaa

SEQ ID NO: 155490 - DNA, 15 bp, Homo sapiens
gtatgcaagggctca

SEQ ID NO: 155491 - DNA, 15 bp, Homo sapiens
agtatgcaagggctc

SEQ ID NO: 155492 - DNA, 15 bp, Homo sapiens
aagtatgcaagggct

SEQ ID NO: 155493 - DNA, 15 bp, Homo sapiens
aaagtatgcaagggc

SEQ ID NO: 155494 - DNA, 15 bp, Homo sapiens
taaagtatgcaaggg

SEQ ID NO: 155495 - DNA, 15 bp, Homo sapiens
gtaaagtatgcaagg

SEQ ID NO: 155496 - DNA, 15 bp, Homo sapiens
agtaaagtatgcaag

SEQ ID NO: 155497 - DNA, 15 bp, Homo sapiens
cagtaaagtatgcaa

SEQ ID NO: 155498 - DNA, 15 bp, Homo sapiens
acagtaaagtatgca

SEQ ID NO: 155499 - DNA, 15 bp, Homo sapiens
aacagtaaagtatgc

SEQ ID NO: 155500 - DNA, 15 bp, Homo sapiens
caacagtaaagtatg

SEQ ID NO: 155501 - DNA, 15 bp, Homo sapiens
tcaacagtaaagtat

SEQ ID NO: 155502 - DNA, 15 bp, Homo sapiens
ctcaacagtaaagta

SEQ ID NO: 155503 - DNA, 15 bp, Homo sapiens
gctcaacagtaaagt

SEQ ID NO: 155504 - DNA, 15 bp, Homo sapiens
tgctcaacagtaaag

SEQ ID NO: 155505 - DNA, 15 bp, Homo sapiens
atgctcaacagtaaa

SEQ ID NO: 155506 - DNA, 15 bp, Homo sapiens
gatgctcaacagtaa

SEQ ID NO: 155507 - DNA, 15 bp, Homo sapiens
tgatgctcaacagta

SEQ ID NO: 155508 - DNA, 15 bp, Homo sapiens
atgatgctcaacagt

SEQ ID NO: 155509 - DNA, 15 bp, Homo sapiens
tatgatgctcaacag

SEQ ID NO: 155510 - DNA, 15 bp, Homo sapiens
ttatgatgctcaaca

SEQ ID NO: 155511 - DNA, 15 bp, Homo sapiens
tttatgatgctcaac

SEQ ID NO: 155512 - DNA, 15 bp, Homo sapiens
ttttatgatgctcaa

SEQ ID NO: 155513 - DNA, 15 bp, Homo sapiens
cttttatgatgctca

SEQ ID NO: 155514 - DNA, 15 bp, Homo sapiens
tcttttatgatgctc

SEQ ID NO: 155515 - DNA, 15 bp, Homo sapiens
ttcttttatgatgct

SEQ ID NO: 155516 - DNA, 15 bp, Homo sapiens
gttcttttatgatgc

SEQ ID NO: 155517 - DNA, 15 bp, Homo sapiens
agttcttttatgatg

SEQ ID NO: 155518 - DNA, 15 bp, Homo sapiens
aagttcttttatgat

SEQ ID NO: 155519 - DNA, 15 bp, Homo sapiens
caagttcttttatga

SEQ ID NO: 155520 - DNA, 15 bp, Homo sapiens
tcaagttcttttatg

SEQ ID NO: 155521 - DNA, 15 bp, Homo sapiens
ttcaagttcttttat

SEQ ID NO: 155522 - DNA, 15 bp, Homo sapiens
tttcaagttctttta

SEQ ID NO: 155523 - DNA, 15 bp, Homo sapiens
atttcaagttctttt

SEQ ID NO: 155524 - DNA, 15 bp, Homo sapiens
catttcaagttcttt

SEQ ID NO: 155525 - DNA, 15 bp, Homo sapiens
gcatttcaagttctt

SEQ ID NO: 155526 - DNA, 15 bp, Homo sapiens
agcatttcaagttct

SEQ ID NO: 155527 - DNA, 15 bp, Homo sapiens
aagcatttcaagttc

SEQ ID NO: 155528 - DNA, 15 bp, Homo sapiens
aaagcatttcaagtt

SEQ ID NO: 155529 - DNA, 15 bp, Homo sapiens
aaaagcatttcaagt

SEQ ID NO: 155530 - DNA, 15 bp, Homo sapiens
caaaagcatttcaag

SEQ ID NO: 155531 - DNA, 15 bp, Homo sapiens
acaaaagcatttcaa

SEQ ID NO: 155532 - DNA, 15 bp, Homo sapiens
aaacaaaagcatttc

SEQ ID NO: 155533 - DNA, 15 bp, Homo sapiens
aaaacaaaagcattt

SEQ ID NO: 155534 - DNA, 15 bp, Homo sapiens
aaaaacaaaagcatt

SEQ ID NO: 155535 - DNA, 15 bp, Homo sapiens
caaaaacaaaagcat

SEQ ID NO: 155536 - DNA, 15 bp, Homo sapiens
ccaaaaacaaaagca

SEQ ID NO: 155537 - DNA, 15 bp, Homo sapiens
tccaaaaacaaaagc

SEQ ID NO: 155538 - DNA, 15 bp, Homo sapiens
atccaaaaacaaaag

SEQ ID NO: 155539 - DNA, 15 bp, Homo sapiens
aatccaaaaacaaaa

SEQ ID NO: 155540 - DNA, 15 bp, Homo sapiens
gaatccaaaaacaaa

SEQ ID NO: 155541 - DNA, 15 bp, Homo sapiens
agaatccaaaaacaa

SEQ ID NO: 155542 - DNA, 15 bp, Homo sapiens
aagaatccaaaaaca

SEQ ID NO: 155543 - DNA, 15 bp, Homo sapiens
gaagaatccaaaaac

SEQ ID NO: 155544 - DNA, 15 bp, Homo sapiens
tgaagaatccaaaaa

SEQ ID NO: 155545 - DNA, 15 bp, Homo sapiens
atgaagaatccaaaa

SEQ ID NO: 155546 - DNA, 15 bp, Homo sapiens
catgaagaatccaaa

SEQ ID NO: 155547 - DNA, 15 bp, Homo sapiens
acatgaagaatccaa

SEQ ID NO: 155548 - DNA, 15 bp, Homo sapiens
aacatgaagaatcca

SEQ ID NO: 155549 - DNA, 15 bp, Homo sapiens
aaacatgaagaatcc

SEQ ID NO: 155550 - DNA, 15 bp, Homo sapiens
gaaacatgaagaatc

SEQ ID NO: 155551 - DNA, 15 bp, Homo sapiens
tgaaacatgaagaat

SEQ ID NO: 155552 - DNA, 15 bp, Homo sapiens
ttgaaacatgaagaa

SEQ ID NO: 155553 - DNA, 15 bp, Homo sapiens
gttgaaacatgaaga

SEQ ID NO: 155554 - DNA, 15 bp, Homo sapiens
agttgaaacatgaag

SEQ ID NO: 155555 - DNA, 15 bp, Homo sapiens
aagttgaaacatgaa

SEQ ID NO: 155556 - DNA, 15 bp, Homo sapiens
gaagttgaaacatga

SEQ ID NO: 155557 - DNA, 15 bp, Homo sapiens
tgaagttgaaacatg

SEQ ID NO: 155558 - DNA, 15 bp, Homo sapiens
ctgaagttgaaacat

SEQ ID NO: 155559 - DNA, 15 bp, Homo sapiens
tctgaagttgaaaca

SEQ ID NO: 155560 - DNA, 15 bp, Homo sapiens
atctgaagttgaaac

SEQ ID NO: 155561 - DNA, 15 bp, Homo sapiens
catctgaagttgaaa

SEQ ID NO: 155562 - DNA, 15 bp, Homo sapiens
ccatctgaagttgaa

SEQ ID NO: 155563 - DNA, 15 bp, Homo sapiens
accatctgaagttga

SEQ ID NO: 155564 - DNA, 15 bp, Homo sapiens
caccatctgaagttg

SEQ ID NO: 155565 - DNA, 15 bp, Homo sapiens
tcaccatctgaagtt

SEQ ID NO: 155566 - DNA, 15 bp, Homo sapiens
gtcaccatctgaagt

SEQ ID NO: 155567 - DNA, 15 bp, Homo sapiens
tgtcaccatctgaag

SEQ ID NO: 155568 - DNA, 15 bp, Homo sapiens
ttgtcaccatctgaa

SEQ ID NO: 155569 - DNA, 15 bp, Homo sapiens
cttgtcaccatctga

SEQ ID NO: 155570 - DNA, 15 bp, Homo sapiens
acttgtcaccatctg

SEQ ID NO: 155571 - DNA, 15 bp, Homo sapiens
cacttgtcaccatct

SEQ ID NO: 155572 - DNA, 15 bp, Homo sapiens
gcacttgtcaccatc

SEQ ID NO: 155573 - DNA, 15 bp, Homo sapiens
tgcacttgtcaccat

SEQ ID NO: 155574 - DNA, 15 bp, Homo sapiens
ttgcacttgtcacca

SEQ ID NO: 155575 - DNA, 15 bp, Homo sapiens
tttgcacttgtcacc

SEQ ID NO: 155576 - DNA, 15 bp, Homo sapiens
ttttgcacttgtcac

SEQ ID NO: 155577 - DNA, 15 bp, Homo sapiens
attttgcacttgtca

SEQ ID NO: 155578 - DNA, 15 bp, Homo sapiens
cattttgcacttgtc

SEQ ID NO: 155579 - DNA, 15 bp, Homo sapiens
ccattttgcacttgt

SEQ ID NO: 155580 - DNA, 15 bp, Homo sapiens
gccattttgcacttg

SEQ ID NO: 155581 - DNA, 15 bp, Homo sapiens
agccattttgcactt

SEQ ID NO: 155582 - DNA, 15 bp, Homo sapiens
aagccattttgcact

SEQ ID NO: 155583 - DNA, 15 bp, Homo sapiens
taagccattttgcac

SEQ ID NO: 155584 - DNA, 15 bp, Homo sapiens
ttaagccattttgca

SEQ ID NO: 155585 - DNA, 15 bp, Homo sapiens
tttaagccattttgc

SEQ ID NO: 155586 - DNA, 15 bp, Homo sapiens
ttttaagccattttg

SEQ ID NO: 155587 - DNA, 15 bp, Homo sapiens
cttttaagccatttt

SEQ ID NO: 155588 - DNA, 15 bp, Homo sapiens
acttttaagccattt

SEQ ID NO: 155589 - DNA, 15 bp, Homo sapiens
cacttttaagccatt

SEQ ID NO: 155590 - DNA, 15 bp, Homo sapiens
gcacttttaagccat

SEQ ID NO: 155591 - DNA, 15 bp, Homo sapiens
ggcacttttaagcca

SEQ ID NO: 155592 - DNA, 15 bp, Homo sapiens
aggcacttttaagcc

SEQ ID NO: 155593 - DNA, 15 bp, Homo sapiens
aaggcacttttaagc

SEQ ID NO: 155594 - DNA, 15 bp, Homo sapiens
caaggcacttttaag

SEQ ID NO: 155595 - DNA, 15 bp, Homo sapiens
ccaaggcacttttaa

SEQ ID NO: 155596 - DNA, 15 bp, Homo sapiens
gccaaggcactttta

SEQ ID NO: 155597 - DNA, 15 bp, Homo sapiens
agccaaggcactttt

SEQ ID NO: 155598 - DNA, 15 bp, Homo sapiens
tagccaaggcacttt

SEQ ID NO: 155599 - DNA, 15 bp, Homo sapiens
ctagccaaggcactt

SEQ ID NO: 155600 - DNA, 15 bp, Homo sapiens
cctagccaaggcact

SEQ ID NO: 155601 - DNA, 15 bp, Homo sapiens
gcctagccaaggcac

SEQ ID NO: 155602 - DNA, 15 bp, Homo sapiens
tgcctagccaaggca

SEQ ID NO: 155603 - DNA, 15 bp, Homo sapiens
gtgcctagccaaggc

SEQ ID NO: 155604 - DNA, 15 bp, Homo sapiens
tgtgcctagccaagg

SEQ ID NO: 155605 - DNA, 15 bp, Homo sapiens
ctgtgcctagccaag

SEQ ID NO: 155606 - DNA, 15 bp, Homo sapiens
tgtgagccactgtgc

SEQ ID NO: 155607 - DNA, 15 bp, Homo sapiens
gtgtgagccactgtg

SEQ ID NO: 155608 - DNA, 15 bp, Homo sapiens
ggtgtgagccactgt

SEQ ID NO: 155609 - DNA, 15 bp, Homo sapiens
tgatctgtccacctt

SEQ ID NO: 155610 - DNA, 15 bp, Homo sapiens
atgatctgtccacct

SEQ ID NO: 155611 - DNA, 15 bp, Homo sapiens
catgatctgtccacc

SEQ ID NO: 155612 - DNA, 15 bp, Homo sapiens
tcatgatctgtccac

SEQ ID NO: 155613 - DNA, 15 bp, Homo sapiens
ctcatgatctgtcca

SEQ ID NO: 155614 - DNA, 15 bp, Homo sapiens
cctcatgatctgtcc

SEQ ID NO: 155615 - DNA, 15 bp, Homo sapiens
acctcatgatctgtc

SEQ ID NO: 155616 - DNA, 15 bp, Homo sapiens
gacctcatgatctgt

SEQ ID NO: 155617 - DNA, 15 bp, Homo sapiens
tgacctcatgatctg

SEQ ID NO: 155618 - DNA, 15 bp, Homo sapiens
ctgacctcatgatct

SEQ ID NO: 155619 - DNA, 15 bp, Homo sapiens
caatctcctgacctc

SEQ ID NO: 155620 - DNA, 15 bp, Homo sapiens
tcaatctcctgacct

SEQ ID NO: 155621 - DNA, 15 bp, Homo sapiens
ctcaatctcctgacc

SEQ ID NO: 155622 - DNA, 15 bp, Homo sapiens
tctcaatctcctgac

SEQ ID NO: 155623 - DNA, 15 bp, Homo sapiens
gtctcaatctcctga

SEQ ID NO: 155624 - DNA, 15 bp, Homo sapiens
agtctcaatctcctg

SEQ ID NO: 155625 - DNA, 15 bp, Homo sapiens
tagtctcaatctcct

SEQ ID NO: 155626 - DNA, 15 bp, Homo sapiens
atagtctcaatctcc

SEQ ID NO: 155627 - DNA, 15 bp, Homo sapiens
gatagtctcaatctc

SEQ ID NO: 155628 - DNA, 15 bp, Homo sapiens
ggatagtctcaatct

SEQ ID NO: 155629 - DNA, 15 bp, Homo sapiens
aggatagtctcaatc

SEQ ID NO: 155630 - DNA, 15 bp, Homo sapiens
caggatagtctcaat

SEQ ID NO: 155631 - DNA, 15 bp, Homo sapiens
ccaggatagtctcaa

SEQ ID NO: 155632 - DNA, 15 bp, Homo sapiens
gccaggatagtctca

SEQ ID NO: 155633 - DNA, 15 bp, Homo sapiens
agccaggatagtctc

SEQ ID NO: 155634 - DNA, 15 bp, Homo sapiens
tagccaggatagtct

SEQ ID NO: 155635 - DNA, 15 bp, Homo sapiens
ttagccaggatagtc

SEQ ID NO: 155636 - DNA, 15 bp, Homo sapiens
gttagccaggatagt

SEQ ID NO: 155637 - DNA, 15 bp, Homo sapiens
tgttagccaggatag

SEQ ID NO: 155638 - DNA, 15 bp, Homo sapiens
atgttagccaggata

SEQ ID NO: 155639 - DNA, 15 bp, Homo sapiens
aaggtttcaccatgt

SEQ ID NO: 155640 - DNA, 15 bp, Homo sapiens
caaggtttcaccatg

SEQ ID NO: 155641 - DNA, 15 bp, Homo sapiens
acaaggtttcaccat

SEQ ID NO: 155642 - DNA, 15 bp, Homo sapiens
gacaaggtttcacca

SEQ ID NO: 155643 - DNA, 15 bp, Homo sapiens
agacaaggtttcacc

SEQ ID NO: 155644 - DNA, 15 bp, Homo sapiens
gagacaaggtttcac

SEQ ID NO: 155645 - DNA, 15 bp, Homo sapiens
cagtagagacaaggt

SEQ ID NO: 155646 - DNA, 15 bp, Homo sapiens
tcagtagagacaagg

SEQ ID NO: 155647 - DNA, 15 bp, Homo sapiens
ttcagtagagacaag

SEQ ID NO: 155648 - DNA, 15 bp, Homo sapiens
tttcagtagagacaa

SEQ ID NO: 155649 - DNA, 15 bp, Homo sapiens
ctttcagtagagaca

SEQ ID NO: 155650 - DNA, 15 bp, Homo sapiens
actttcagtagagac

SEQ ID NO: 155651 - DNA, 15 bp, Homo sapiens
cactttcagtagaga

SEQ ID NO: 155652 - DNA, 15 bp, Homo sapiens
gcactttcagtagag

SEQ ID NO: 155653 - DNA, 15 bp, Homo sapiens
tgcactttcagtaga

SEQ ID NO: 155654 - DNA, 15 bp, Homo sapiens
ttgcactttcagtag

SEQ ID NO: 155655 - DNA, 15 bp, Homo sapiens
tttgcactttcagta

SEQ ID NO: 155656 - DNA, 15 bp, Homo sapiens
ttttgcactttcagt

SEQ ID NO: 155657 - DNA, 15 bp, Homo sapiens
tttttgcactttcag

SEQ ID NO: 155658 - DNA, 15 bp, Homo sapiens
ttttttgcactttca

SEQ ID NO: 155659 - DNA, 15 bp, Homo sapiens
attttttgcactttc

SEQ ID NO: 155660 - DNA, 15 bp, Homo sapiens
aattttttgcacttt

SEQ ID NO: 155661 - DNA, 15 bp, Homo sapiens
taattttttgcactt

SEQ ID NO: 155662 - DNA, 15 bp, Homo sapiens
ctaattttttgcact

SEQ ID NO: 155663 - DNA, 15 bp, Homo sapiens
gctaattttttgcac

SEQ ID NO: 155664 - DNA, 15 bp, Homo sapiens
cggctaattttttgc

SEQ ID NO: 155665 - DNA, 15 bp, Homo sapiens
tccggctaatttttt

SEQ ID NO: 155666 - DNA, 15 bp, Homo sapiens
atccggctaattttt

SEQ ID NO: 155667 - DNA, 15 bp, Homo sapiens
catccggctaatttt

SEQ ID NO: 155668 - DNA, 15 bp, Homo sapiens
acatccggctaattt

SEQ ID NO: 155669 - DNA, 15 bp, Homo sapiens
cacatccggctaatt

SEQ ID NO: 155670 - DNA, 15 bp, Homo sapiens
ccacatccggctaat

SEQ ID NO: 155671 - DNA, 15 bp, Homo sapiens
accacatccggctaa

SEQ ID NO: 155672 - DNA, 15 bp, Homo sapiens
caccacatccggcta

SEQ ID NO: 155673 - DNA, 15 bp, Homo sapiens
ccaccacatccggct

SEQ ID NO: 155674 - DNA, 15 bp, Homo sapiens
gccaccacatccggc

SEQ ID NO: 155675 - DNA, 15 bp, Homo sapiens
tgccaccacatccgg

SEQ ID NO: 155676 - DNA, 15 bp, Homo sapiens
gtgccaccacatccg

SEQ ID NO: 155677 - DNA, 15 bp, Homo sapiens
tgtgccaccacatcc

SEQ ID NO: 155678 - DNA, 15 bp, Homo sapiens
atgtgccaccacatc

SEQ ID NO: 155679 - DNA, 15 bp, Homo sapiens
catgtgccaccacat

SEQ ID NO: 155680 - DNA, 15 bp, Homo sapiens
gcatgtgccaccaca

SEQ ID NO: 155681 - DNA, 15 bp, Homo sapiens
ggcatgtgccaccac

SEQ ID NO: 155682 - DNA, 15 bp, Homo sapiens
ctacaggcatgtgcc

SEQ ID NO: 155683 - DNA, 15 bp, Homo sapiens
actacaggcatgtgc

SEQ ID NO: 155684 - DNA, 15 bp, Homo sapiens
gactacaggcatgtg

SEQ ID NO: 155685 - DNA, 15 bp, Homo sapiens
ggactacaggcatgt

SEQ ID NO: 155686 - DNA, 15 bp, Homo sapiens
ccccagtagctggga

SEQ ID NO: 155687 - DNA, 15 bp, Homo sapiens
tccccagtagctggg

SEQ ID NO: 155688 - DNA, 15 bp, Homo sapiens
ctccccagtagctgg

SEQ ID NO: 155689 - DNA, 15 bp, Homo sapiens
tcgcctcccaggttc

SEQ ID NO: 155690 - DNA, 15 bp, Homo sapiens
ttcgcctcccaggtt

SEQ ID NO: 155691 - DNA, 15 bp, Homo sapiens
cttcgcctcccaggt

SEQ ID NO: 155692 - DNA, 15 bp, Homo sapiens
ccttcgcctcccagg

SEQ ID NO: 155693 - DNA, 15 bp, Homo sapiens
accttcgcctcccag

SEQ ID NO: 155694 - DNA, 15 bp, Homo sapiens
aaccttcgcctccca

SEQ ID NO: 155695 - DNA, 15 bp, Homo sapiens
caaccttcgcctccc

SEQ ID NO: 155696 - DNA, 15 bp, Homo sapiens
gcaaccttcgcctcc

SEQ ID NO: 155697 - DNA, 15 bp, Homo sapiens
tgcaaccttcgcctc

SEQ ID NO: 155698 - DNA, 15 bp, Homo sapiens
ctgcaaccttcgcct

SEQ ID NO: 155699 - DNA, 15 bp, Homo sapiens
actgcaaccttcgcc

SEQ ID NO: 155700 - DNA, 15 bp, Homo sapiens
cactgcaaccttcgc

SEQ ID NO: 155701 - DNA, 15 bp, Homo sapiens
tcactgcaaccttcg

SEQ ID NO: 155702 - DNA, 15 bp, Homo sapiens
ttcactgcaaccttc

SEQ ID NO: 155703 - DNA, 15 bp, Homo sapiens
gttcactgcaacctt

SEQ ID NO: 155704 - DNA, 15 bp, Homo sapiens
ggttcactgcaacct

SEQ ID NO: 155705 - DNA, 15 bp, Homo sapiens
cggttcactgcaacc

SEQ ID NO: 155706 - DNA, 15 bp, Homo sapiens
tcggttcactgcaac

SEQ ID NO: 155707 - DNA, 15 bp, Homo sapiens
ctcggttcactgcaa

SEQ ID NO: 155708 - DNA, 15 bp, Homo sapiens
tctcggttcactgca

SEQ ID NO: 155709 - DNA, 15 bp, Homo sapiens
atctcggttcactgc

SEQ ID NO: 155710 - DNA, 15 bp, Homo sapiens
aatctcggttcactg

SEQ ID NO: 155711 - DNA, 15 bp, Homo sapiens
caatctcggttcact

SEQ ID NO: 155712 - DNA, 15 bp, Homo sapiens
acaatctcggttcac

SEQ ID NO: 155713 - DNA, 15 bp, Homo sapiens
tacaatctcggttca

SEQ ID NO: 155714 - DNA, 15 bp, Homo sapiens
gtacaatctcggttc

SEQ ID NO: 155715 - DNA, 15 bp, Homo sapiens
ggtacaatctcggtt

SEQ ID NO: 155716 - DNA, 15 bp, Homo sapiens
tggtacaatctcggt

SEQ ID NO: 155717 - DNA, 15 bp, Homo sapiens
gtggtacaatctcgg

SEQ ID NO: 155718 - DNA, 15 bp, Homo sapiens
agtggtacaatctcg

SEQ ID NO: 155719 - DNA, 15 bp, Homo sapiens
cagtggtacaatctc

SEQ ID NO: 155720 - DNA, 15 bp, Homo sapiens
gcagtggtacaatct

SEQ ID NO: 155721 - DNA, 15 bp, Homo sapiens
tgcagtggtacaatc

SEQ ID NO: 155722 - DNA, 15 bp, Homo sapiens
gtgcagtggtacaat

SEQ ID NO: 155723 - DNA, 15 bp, Homo sapiens
agtgcagtggtacaa

SEQ ID NO: 155724 - DNA, 15 bp, Homo sapiens
gagtgcagtggtaca

SEQ ID NO: 155725 - DNA, 15 bp, Homo sapiens
cagtctcactctgtt

SEQ ID NO: 155726 - DNA, 15 bp, Homo sapiens
acagtctcactctgt

SEQ ID NO: 155727 - DNA, 15 bp, Homo sapiens
gacagtctcactctg

SEQ ID NO: 155728 - DNA, 15 bp, Homo sapiens
agacagtctcactct

SEQ ID NO: 155729 - DNA, 15 bp, Homo sapiens
gagacagtctcactc

SEQ ID NO: 155730 - DNA, 15 bp, Homo sapiens
tgagacagtctcact

SEQ ID NO: 155731 - DNA, 15 bp, Homo sapiens
ttgagacagtctcac

SEQ ID NO: 155732 - DNA, 15 bp, Homo sapiens
tttgagacagtctca

SEQ ID NO: 155733 - DNA, 15 bp, Homo sapiens
ttttgagacagtctc

SEQ ID NO: 155734 - DNA, 15 bp, Homo sapiens
tttttgagacagtct

SEQ ID NO: 155735 - DNA, 15 bp, Homo sapiens
ttttttgagacagtc

SEQ ID NO: 155736 - DNA, 15 bp, Homo sapiens
tttttttgagacagt

SEQ ID NO: 155737 - DNA, 15 bp, Homo sapiens
cactttttttttttt

SEQ ID NO: 155738 - DNA, 15 bp, Homo sapiens
gcacttttttttttt

SEQ ID NO: 155739 - DNA, 15 bp, Homo sapiens
ggcactttttttttt

SEQ ID NO: 155740 - DNA, 15 bp, Homo sapiens
aggcacttttttttt

SEQ ID NO: 155741 - DNA, 15 bp, Homo sapiens
aaggcactttttttt

SEQ ID NO: 155742 - DNA, 15 bp, Homo sapiens
taaggcacttttttt

SEQ ID NO: 155743 - DNA, 15 bp, Homo sapiens
ttaaggcactttttt

SEQ ID NO: 155744 - DNA, 15 bp, Homo sapiens
gttaaggcacttttt

SEQ ID NO: 155745 - DNA, 15 bp, Homo sapiens
agttaaggcactttt

SEQ ID NO: 155746 - DNA, 15 bp, Homo sapiens
aagttaaggcacttt

SEQ ID NO: 155747 - DNA, 15 bp, Homo sapiens
taagttaaggcactt

SEQ ID NO: 155748 - DNA, 15 bp, Homo sapiens
gtaagttaaggcact

SEQ ID NO: 155749 - DNA, 15 bp, Homo sapiens
ggtaagttaaggcac

SEQ ID NO: 155750 - DNA, 15 bp, Homo sapiens
aggtaagttaaggca

SEQ ID NO: 155751 - DNA, 15 bp, Homo sapiens
caggtaagttaaggc

SEQ ID NO: 155752 - DNA, 15 bp, Homo sapiens
ccaggtaagttaagg

SEQ ID NO: 155753 - DNA, 15 bp, Homo sapiens
gccaggtaagttaag

SEQ ID NO: 155754 - DNA, 15 bp, Homo sapiens
tgccaggtaagttaa

SEQ ID NO: 155755 - DNA, 15 bp, Homo sapiens
ttgccaggtaagtta

SEQ ID NO: 155756 - DNA, 15 bp, Homo sapiens
attgccaggtaagtt

SEQ ID NO: 155757 - DNA, 15 bp, Homo sapiens
tattgccaggtaagt

SEQ ID NO: 155758 - DNA, 15 bp, Homo sapiens
ttattgccaggtaag

SEQ ID NO: 155759 - DNA, 15 bp, Homo sapiens
tttattgccaggtaa

SEQ ID NO: 155760 - DNA, 15 bp, Homo sapiens
gtttattgccaggta

SEQ ID NO: 155761 - DNA, 15 bp, Homo sapiens
tgtttattgccaggt

SEQ ID NO: 155762 - DNA, 15 bp, Homo sapiens
atgtttattgccagg

SEQ ID NO: 155763 - DNA, 15 bp, Homo sapiens
aatgtttattgccag

SEQ ID NO: 155764 - DNA, 15 bp, Homo sapiens
aaatgtttattgcca

SEQ ID NO: 155765 - DNA, 15 bp, Homo sapiens
taaatgtttattgcc

SEQ ID NO: 155766 - DNA, 15 bp, Homo sapiens
ataaatgtttattgc

SEQ ID NO: 155767 - DNA, 15 bp, Homo sapiens
aataaatgtttattg

SEQ ID NO: 155768 - DNA, 15 bp, Homo sapiens
caataaatgtttatt

SEQ ID NO: 155769 - DNA, 15 bp, Homo sapiens
tcaataaatgtttat

SEQ ID NO: 155770 - DNA, 15 bp, Homo sapiens
ctcaataaatgttta

SEQ ID NO: 155771 - DNA, 15 bp, Homo sapiens
actcaataaatgttt

SEQ ID NO: 155772 - DNA, 15 bp, Homo sapiens
gactcaataaatgtt

SEQ ID NO: 155773 - DNA, 15 bp, Homo sapiens
agactcaataaatgt

SEQ ID NO: 155774 - DNA, 15 bp, Homo sapiens
cagactcaataaatg

SEQ ID NO: 155775 - DNA, 15 bp, Homo sapiens
gcagactcaataaat

SEQ ID NO: 155776 - DNA, 15 bp, Homo sapiens
tgcagactcaataaa

SEQ ID NO: 155777 - DNA, 15 bp, Homo sapiens
ctgcagactcaataa

SEQ ID NO: 155778 - DNA, 15 bp, Homo sapiens
gctgcagactcaata

SEQ ID NO: 155779 - DNA, 15 bp, Homo sapiens
agctgcagactcaat

SEQ ID NO: 155780 - DNA, 15 bp, Homo sapiens
aagctgcagactcaa

SEQ ID NO: 155781 - DNA, 15 bp, Homo sapiens
aaagctgcagactca

SEQ ID NO: 155782 - DNA, 15 bp, Homo sapiens
gaaagctgcagactc

SEQ ID NO: 155783 - DNA, 15 bp, Homo sapiens
tgaaagctgcagact

SEQ ID NO: 155784 - DNA, 15 bp, Homo sapiens
atgaaagctgcagac

SEQ ID NO: 155785 - DNA, 15 bp, Homo sapiens
aatgaaagctgcaga

SEQ ID NO: 155786 - DNA, 15 bp, Homo sapiens
gaatgaaagctgcag

SEQ ID NO: 155787 - DNA, 15 bp, Homo sapiens
tgaatgaaagctgca

SEQ ID NO: 155788 - DNA, 15 bp, Homo sapiens
atgaatgaaagctgc

SEQ ID NO: 155789 - DNA, 15 bp, Homo sapiens
aatgaatgaaagctg

SEQ ID NO: 155790 - DNA, 15 bp, Homo sapiens
aaatgaatgaaagct

SEQ ID NO: 155791 - DNA, 15 bp, Homo sapiens
taaatgaatgaaagc

SEQ ID NO: 155792 - DNA, 15 bp, Homo sapiens
ctaaatgaatgaaag

SEQ ID NO: 155793 - DNA, 15 bp, Homo sapiens
gctaaatgaatgaaa

SEQ ID NO: 155794 - DNA, 15 bp, Homo sapiens
agctaaatgaatgaa

SEQ ID NO: 155795 - DNA, 15 bp, Homo sapiens
gagctaaatgaatga

SEQ ID NO: 155796 - DNA, 15 bp, Homo sapiens
tgagctaaatgaatg

SEQ ID NO: 155797 - DNA, 15 bp, Homo sapiens
atgagctaaatgaat

SEQ ID NO: 155798 - DNA, 15 bp, Homo sapiens
aatgagctaaatgaa

SEQ ID NO: 155799 - DNA, 15 bp, Homo sapiens
aaatgagctaaatga

SEQ ID NO: 155800 - DNA, 15 bp, Homo sapiens
taaatgagctaaatg

SEQ ID NO: 155801 - DNA, 15 bp, Homo sapiens
gtaaatgagctaaat

SEQ ID NO: 155802 - DNA, 15 bp, Homo sapiens
tgtaaatgagctaaa

SEQ ID NO: 155803 - DNA, 15 bp, Homo sapiens
atgtaaatgagctaa

SEQ ID NO: 155804 - DNA, 15 bp, Homo sapiens
aatgtaaatgagcta

SEQ ID NO: 155805 - DNA, 15 bp, Homo sapiens
aaatgtaaatgagct

SEQ ID NO: 155806 - DNA, 15 bp, Homo sapiens
taaatgtaaatgagc

SEQ ID NO: 155807 - DNA, 15 bp, Homo sapiens
ttaaatgtaaatgag

SEQ ID NO: 155808 - DNA, 15 bp, Homo sapiens
gttaaatgtaaatga

SEQ ID NO: 155809 - DNA, 15 bp, Homo sapiens
agttaaatgtaaatg

SEQ ID NO: 155810 - DNA, 15 bp, Homo sapiens
cagttaaatgtaaat

SEQ ID NO: 155811 - DNA, 15 bp, Homo sapiens
tcagttaaatgtaaa

SEQ ID NO: 155812 - DNA, 15 bp, Homo sapiens
ttcagttaaatgtaa

SEQ ID NO: 155813 - DNA, 15 bp, Homo sapiens
tttcagttaaatgta

SEQ ID NO: 155814 - DNA, 15 bp, Homo sapiens
gtttcagttaaatgt

SEQ ID NO: 155815 - DNA, 15 bp, Homo sapiens
tgtttcagttaaatg

SEQ ID NO: 155816 - DNA, 15 bp, Homo sapiens
gtgtttcagttaaat

SEQ ID NO: 155817 - DNA, 15 bp, Homo sapiens
tgtgtttcagttaaa

SEQ ID NO: 155818 - DNA, 15 bp, Homo sapiens
atgtgtttcagttaa

SEQ ID NO: 155819 - DNA, 15 bp, Homo sapiens
aatgtgtttcagtta

SEQ ID NO: 155820 - DNA, 15 bp, Homo sapiens
aaatgtgtttcagtt

SEQ ID NO: 155821 - DNA, 15 bp, Homo sapiens
taaatgtgtttcagt

SEQ ID NO: 155822 - DNA, 15 bp, Homo sapiens
ttaaatgtgtttcag

SEQ ID NO: 155823 - DNA, 15 bp, Homo sapiens
tttaaatgtgtttca

SEQ ID NO: 155824 - DNA, 15 bp, Homo sapiens
ttttaaatgtgtttc

SEQ ID NO: 155825 - DNA, 15 bp, Homo sapiens
tttttaaatgtgttt

SEQ ID NO: 155826 - DNA, 15 bp, Homo sapiens
atttttaaatgtgtt

SEQ ID NO: 155827 - DNA, 15 bp, Homo sapiens
aatttttaaatgtgt

SEQ ID NO: 155828 - DNA, 15 bp, Homo sapiens
gaatttttaaatgtg

SEQ ID NO: 155829 - DNA, 15 bp, Homo sapiens
tgaatttttaaatgt

SEQ ID NO: 155830 - DNA, 15 bp, Homo sapiens
atgaatttttaaatg

SEQ ID NO: 155831 - DNA, 15 bp, Homo sapiens
aatgaatttttaaat

SEQ ID NO: 155832 - DNA, 15 bp, Homo sapiens
aaatgaatttttaaa

SEQ ID NO: 155833 - DNA, 15 bp, Homo sapiens
aaaatgaatttttaa

SEQ ID NO: 155834 - DNA, 15 bp, Homo sapiens
aaaaatgaattttta

SEQ ID NO: 155835 - DNA, 15 bp, Homo sapiens
aaaaaatgaattttt

SEQ ID NO: 155836 - DNA, 15 bp, Homo sapiens
gaaaaaatgaatttt

SEQ ID NO: 155837 - DNA, 15 bp, Homo sapiens
ggaaaaaatgaattt

SEQ ID NO: 155838 - DNA, 15 bp, Homo sapiens
aggaaaaaatgaatt

SEQ ID NO: 155839 - DNA, 15 bp, Homo sapiens
aaggaaaaaatgaat

SEQ ID NO: 155840 - DNA, 15 bp, Homo sapiens
aaaggaaaaaatgaa

SEQ ID NO: 155841 - DNA, 15 bp, Homo sapiens
aaaaggaaaaaatga

SEQ ID NO: 155842 - DNA, 15 bp, Homo sapiens
caaaaggaaaaaatg

SEQ ID NO: 155843 - DNA, 15 bp, Homo sapiens
gcaaaaggaaaaaat

SEQ ID NO: 155844 - DNA, 15 bp, Homo sapiens
tgcaaaaggaaaaaa

SEQ ID NO: 155845 - DNA, 15 bp, Homo sapiens
ttgcaaaaggaaaaa

SEQ ID NO: 155846 - DNA, 15 bp, Homo sapiens
tttgcaaaaggaaaa

SEQ ID NO: 155847 - DNA, 15 bp, Homo sapiens
ttttgcaaaaggaaa

SEQ ID NO: 155848 - DNA, 15 bp, Homo sapiens
cttttgcaaaaggaa

SEQ ID NO: 155849 - DNA, 15 bp, Homo sapiens
gcttttgcaaaagga

SEQ ID NO: 155850 - DNA, 15 bp, Homo sapiens
agcttttgcaaaagg

SEQ ID NO: 155851 - DNA, 15 bp, Homo sapiens
tagcttttgcaaaag

SEQ ID NO: 155852 - DNA, 15 bp, Homo sapiens
ctagcttttgcaaaa

SEQ ID NO: 155853 - DNA, 15 bp, Homo sapiens
cctagcttttgcaaa

SEQ ID NO: 155854 - DNA, 15 bp, Homo sapiens
gcctagcttttgcaa

SEQ ID NO: 155855 - DNA, 15 bp, Homo sapiens
tgcctagcttttgca

SEQ ID NO: 155856 - DNA, 15 bp, Homo sapiens
atgcctagcttttgc

SEQ ID NO: 155857 - DNA, 15 bp, Homo sapiens
catgcctagcttttg

SEQ ID NO: 155858 - DNA, 15 bp, Homo sapiens
gcatgcctagctttt

SEQ ID NO: 155859 - DNA, 15 bp, Homo sapiens
ggcatgcctagcttt

SEQ ID NO: 155860 - DNA, 15 bp, Homo sapiens
aggcatgcctagctt

SEQ ID NO: 155861 - DNA, 15 bp, Homo sapiens
taggcatgcctagct

SEQ ID NO: 155862 - DNA, 15 bp, Homo sapiens
gtaggcatgcctagc

SEQ ID NO: 155863 - DNA, 15 bp, Homo sapiens
agtaggcatgcctag

SEQ ID NO: 155864 - DNA, 15 bp, Homo sapiens
tagtaggcatgccta

SEQ ID NO: 155865 - DNA, 15 bp, Homo sapiens
atagtaggcatgcct

SEQ ID NO: 155866 - DNA, 15 bp, Homo sapiens
tatagtaggcatgcc

SEQ ID NO: 155867 - DNA, 15 bp, Homo sapiens
ttatagtaggcatgc

SEQ ID NO: 155868 - DNA, 15 bp, Homo sapiens
tttatagtaggcatg

SEQ ID NO: 155869 - DNA, 15 bp, Homo sapiens
ttttatagtaggcat

SEQ ID NO: 155870 - DNA, 15 bp, Homo sapiens
cttttatagtaggca

SEQ ID NO: 155871 - DNA, 15 bp, Homo sapiens
acttttatagtaggc

SEQ ID NO: 155872 - DNA, 15 bp, Homo sapiens
aacttttatagtagg

SEQ ID NO: 155873 - DNA, 15 bp, Homo sapiens
aaacttttatagtag

SEQ ID NO: 155874 - DNA, 15 bp, Homo sapiens
caaacttttatagta

SEQ ID NO: 155875 - DNA, 15 bp, Homo sapiens
gcaaacttttatagt

SEQ ID NO: 155876 - DNA, 15 bp, Homo sapiens
tgcaaacttttatag

SEQ ID NO: 155877 - DNA, 15 bp, Homo sapiens
ttgcaaacttttata

SEQ ID NO: 155878 - DNA, 15 bp, Homo sapiens
gttgcaaacttttat

SEQ ID NO: 155879 - DNA, 15 bp, Homo sapiens
agttgcaaactttta

SEQ ID NO: 155880 - DNA, 15 bp, Homo sapiens
aagttgcaaactttt

SEQ ID NO: 155881 - DNA, 15 bp, Homo sapiens
aaagttgcaaacttt

SEQ ID NO: 155882 - DNA, 15 bp, Homo sapiens
aaaagttgcaaactt

SEQ ID NO: 155883 - DNA, 15 bp, Homo sapiens
gaaaagttgcaaact

SEQ ID NO: 155884 - DNA, 15 bp, Homo sapiens
tgaaaagttgcaaac

SEQ ID NO: 155885 - DNA, 15 bp, Homo sapiens
ttgaaaagttgcaaa

SEQ ID NO: 155886 - DNA, 15 bp, Homo sapiens
tttgaaaagttgcaa

SEQ ID NO: 155887 - DNA, 15 bp, Homo sapiens
ctttgaaaagttgca

SEQ ID NO: 155888 - DNA, 15 bp, Homo sapiens
gctttgaaaagttgc

SEQ ID NO: 155889 - DNA, 15 bp, Homo sapiens
tgctttgaaaagttg

SEQ ID NO: 155890 - DNA, 15 bp, Homo sapiens
atgctttgaaaagtt

SEQ ID NO: 155891 - DNA, 15 bp, Homo sapiens
catgctttgaaaagt

SEQ ID NO: 155892 - DNA, 15 bp, Homo sapiens
tcatgctttgaaaag

SEQ ID NO: 155893 - DNA, 15 bp, Homo sapiens
ttcatgctttgaaaa

SEQ ID NO: 155894 - DNA, 15 bp, Homo sapiens
tttcatgctttgaaa

SEQ ID NO: 155895 - DNA, 15 bp, Homo sapiens
atttcatgctttgaa

SEQ ID NO: 155896 - DNA, 15 bp, Homo sapiens
tatttcatgctttga

SEQ ID NO: 155897 - DNA, 15 bp, Homo sapiens
atatttcatgctttg

SEQ ID NO: 155898 - DNA, 15 bp, Homo sapiens
catatttcatgcttt

SEQ ID NO: 155899 - DNA, 15 bp, Homo sapiens
acatatttcatgctt

SEQ ID NO: 155900 - DNA, 15 bp, Homo sapiens
tacatatttcatgct

SEQ ID NO: 155901 - DNA, 15 bp, Homo sapiens
ctacatatttcatgc

SEQ ID NO: 155902 - DNA, 15 bp, Homo sapiens
tctacatatttcatg

SEQ ID NO: 155903 - DNA, 15 bp, Homo sapiens
ctctacatatttcat

SEQ ID NO: 155904 - DNA, 15 bp, Homo sapiens
actctacatatttca

SEQ ID NO: 155905 - DNA, 15 bp, Homo sapiens
aactctacatatttc

SEQ ID NO: 155906 - DNA, 15 bp, Homo sapiens
caactctacatattt

SEQ ID NO: 155907 - DNA, 15 bp, Homo sapiens
tcaactctacatatt

SEQ ID NO: 155908 - DNA, 15 bp, Homo sapiens
atcaactctacatat

SEQ ID NO: 155909 - DNA, 15 bp, Homo sapiens
tatcaactctacata

SEQ ID NO: 155910 - DNA, 15 bp, Homo sapiens
gtatcaactctacat

SEQ ID NO: 155911 - DNA, 15 bp, Homo sapiens
ggtatcaactctaca

SEQ ID NO: 155912 - DNA, 15 bp, Homo sapiens
gggtatcaactctac

SEQ ID NO: 155913 - DNA, 15 bp, Homo sapiens
agggtatcaactcta

SEQ ID NO: 155914 - DNA, 15 bp, Homo sapiens
gagggtatcaactct

SEQ ID NO: 155915 - DNA, 15 bp, Homo sapiens
tgagggtatcaactc

SEQ ID NO: 155916 - DNA, 15 bp, Homo sapiens
atgagggtatcaact

SEQ ID NO: 155917 - DNA, 15 bp, Homo sapiens
aatgagggtatcaac

SEQ ID NO: 155918 - DNA, 15 bp, Homo sapiens
aaatgagggtatcaa

SEQ ID NO: 155919 - DNA, 15 bp, Homo sapiens
taaatgagggtatca

SEQ ID NO: 155920 - DNA, 15 bp, Homo sapiens
ataaatgagggtatc

SEQ ID NO: 155921 - DNA, 15 bp, Homo sapiens
aataaatgagggtat

SEQ ID NO: 155922 - DNA, 15 bp, Homo sapiens
taataaatgagggta

SEQ ID NO: 155923 - DNA, 15 bp, Homo sapiens
ataataaatgagggt

SEQ ID NO: 155924 - DNA, 15 bp, Homo sapiens
tataataaatgaggg

SEQ ID NO: 155925 - DNA, 15 bp, Homo sapiens
atataataaatgagg

SEQ ID NO: 155926 - DNA, 15 bp, Homo sapiens
aatataataaatgag

SEQ ID NO: 155927 - DNA, 15 bp, Homo sapiens
aaatataataaatga

SEQ ID NO: 155928 - DNA, 15 bp, Homo sapiens
aaaatataataaatg

SEQ ID NO: 155929 - DNA, 15 bp, Homo sapiens
taaaatataataaat

SEQ ID NO: 155930 - DNA, 15 bp, Homo sapiens
gtaaaatataataaa

SEQ ID NO: 155931 - DNA, 15 bp, Homo sapiens
agtaaaatataataa

SEQ ID NO: 155932 - DNA, 15 bp, Homo sapiens
tagtaaaatataata

SEQ ID NO: 155933 - DNA, 15 bp, Homo sapiens
ttagtaaaatataat

SEQ ID NO: 155934 - DNA, 15 bp, Homo sapiens
attagtaaaatataa

SEQ ID NO: 155935 - DNA, 15 bp, Homo sapiens
aattagtaaaatata

SEQ ID NO: 155936 - DNA, 15 bp, Homo sapiens
gaattagtaaaatat

SEQ ID NO: 155937 - DNA, 15 bp, Homo sapiens
ggaattagtaaaata

SEQ ID NO: 155938 - DNA, 15 bp, Homo sapiens
aggaattagtaaaat

SEQ ID NO: 155939 - DNA, 15 bp, Homo sapiens
caggaattagtaaaa

SEQ ID NO: 155940 - DNA, 15 bp, Homo sapiens
acaggaattagtaaa

SEQ ID NO: 155941 - DNA, 15 bp, Homo sapiens
tacaggaattagtaa

SEQ ID NO: 155942 - DNA, 15 bp, Homo sapiens
ctacaggaattagta

SEQ ID NO: 155943 - DNA, 15 bp, Homo sapiens
tctacaggaattagt

SEQ ID NO: 155944 - DNA, 15 bp, Homo sapiens
ctctacaggaattag

SEQ ID NO: 155945 - DNA, 15 bp, Homo sapiens
tctctacaggaatta

SEQ ID NO: 155946 - DNA, 15 bp, Homo sapiens
atctctacaggaatt

SEQ ID NO: 155947 - DNA, 15 bp, Homo sapiens
catctctacaggaat

SEQ ID NO: 155948 - DNA, 15 bp, Homo sapiens
tcatctctacaggaa

SEQ ID NO: 155949 - DNA, 15 bp, Homo sapiens
ctcatctctacagga

SEQ ID NO: 155950 - DNA, 15 bp, Homo sapiens
gctcatctctacagg

SEQ ID NO: 155951 - DNA, 15 bp, Homo sapiens
tgctcatctctacag

SEQ ID NO: 155952 - DNA, 15 bp, Homo sapiens
ttgctcatctctaca

SEQ ID NO: 155953 - DNA, 15 bp, Homo sapiens
gttgctcatctctac

SEQ ID NO: 155954 - DNA, 15 bp, Homo sapiens
tgttgctcatctcta

SEQ ID NO: 155955 - DNA, 15 bp, Homo sapiens
ttgttgctcatctct

SEQ ID NO: 155956 - DNA, 15 bp, Homo sapiens
tttgttgctcatctc

SEQ ID NO: 155957 - DNA, 15 bp, Homo sapiens
ttttgttgctcatct

SEQ ID NO: 155958 - DNA, 15 bp, Homo sapiens
attttgttgctcatc

SEQ ID NO: 155959 - DNA, 15 bp, Homo sapiens
aattttgttgctcat

SEQ ID NO: 155960 - DNA, 15 bp, Homo sapiens
caattttgttgctca

SEQ ID NO: 155961 - DNA, 15 bp, Homo sapiens
acaattttgttgctc

SEQ ID NO: 155962 - DNA, 15 bp, Homo sapiens
gacaattttgttgct

SEQ ID NO: 155963 - DNA, 15 bp, Homo sapiens
ggacaattttgttgc

SEQ ID NO: 155964 - DNA, 15 bp, Homo sapiens
aggacaattttgttg

SEQ ID NO: 155965 - DNA, 15 bp, Homo sapiens
aaggacaattttgtt

SEQ ID NO: 155966 - DNA, 15 bp, Homo sapiens
aaaggacaattttgt

SEQ ID NO: 155967 - DNA, 15 bp, Homo sapiens
taaaggacaattttg

SEQ ID NO: 155968 - DNA, 15 bp, Homo sapiens
ataaaggacaatttt

SEQ ID NO: 155969 - DNA, 15 bp, Homo sapiens
cataaaggacaattt

SEQ ID NO: 155970 - DNA, 15 bp, Homo sapiens
tcataaaggacaatt

SEQ ID NO: 155971 - DNA, 15 bp, Homo sapiens
ttcataaaggacaat

SEQ ID NO: 155972 - DNA, 15 bp, Homo sapiens
tttcataaaggacaa

SEQ ID NO: 155973 - DNA, 15 bp, Homo sapiens
ctttcataaaggaca

SEQ ID NO: 155974 - DNA, 15 bp, Homo sapiens
gctttcataaaggac

SEQ ID NO: 155975 - DNA, 15 bp, Homo sapiens
agctttcataaagga

SEQ ID NO: 155976 - DNA, 15 bp, Homo sapiens
cagctttcataaagg

SEQ ID NO: 155977 - DNA, 15 bp, Homo sapiens
acagctttcataaag

SEQ ID NO: 155978 - DNA, 15 bp, Homo sapiens
gacagctttcataaa

SEQ ID NO: 155979 - DNA, 15 bp, Homo sapiens
tgacagctttcataa

SEQ ID NO: 155980 - DNA, 15 bp, Homo sapiens
atgacagctttcata

SEQ ID NO: 155981 - DNA, 15 bp, Homo sapiens
aatgacagctttcat

SEQ ID NO: 155982 - DNA, 15 bp, Homo sapiens
gaatgacagctttca

SEQ ID NO: 155983 - DNA, 15 bp, Homo sapiens
agaatgacagctttc

SEQ ID NO: 155984 - DNA, 15 bp, Homo sapiens
gagaatgacagcttt

SEQ ID NO: 155985 - DNA, 15 bp, Homo sapiens
agagaatgacagctt

SEQ ID NO: 155986 - DNA, 15 bp, Homo sapiens
tagagaatgacagct

SEQ ID NO: 155987 - DNA, 15 bp, Homo sapiens
ttagagaatgacagc

SEQ ID NO: 155988 - DNA, 15 bp, Homo sapiens
tttagagaatgacag

SEQ ID NO: 155989 - DNA, 15 bp, Homo sapiens
ttttagagaatgaca

SEQ ID NO: 155990 - DNA, 15 bp, Homo sapiens
attttagagaatgac

SEQ ID NO: 155991 - DNA, 15 bp, Homo sapiens
aattttagagaatga

SEQ ID NO: 155992 - DNA, 15 bp, Homo sapiens
gaattttagagaatg

SEQ ID NO: 155993 - DNA, 15 bp, Homo sapiens
cgaattttagagaat

SEQ ID NO: 155994 - DNA, 15 bp, Homo sapiens
tcgaattttagagaa

SEQ ID NO: 155995 - DNA, 15 bp, Homo sapiens
atcgaattttagaga

SEQ ID NO: 155996 - DNA, 15 bp, Homo sapiens
tatcgaattttagag

SEQ ID NO: 155997 - DNA, 15 bp, Homo sapiens
atatcgaattttaga

SEQ ID NO: 155998 - DNA, 15 bp, Homo sapiens
tatatcgaattttag

SEQ ID NO: 155999 - DNA, 15 bp, Homo sapiens
ctatatcgaatttta

SEQ ID NO: 156000 - DNA, 15 bp, Homo sapiens
actatatcgaatttt

SEQ ID NO: 156001 - DNA, 15 bp, Homo sapiens
tactatatcgaattt

SEQ ID NO: 156002 - DNA, 15 bp, Homo sapiens
ctactatatcgaatt

SEQ ID NO: 156003 - DNA, 15 bp, Homo sapiens
cctactatatcgaat

SEQ ID NO: 156004 - DNA, 15 bp, Homo sapiens
tcctactatatcgaa

SEQ ID NO: 156005 - DNA, 15 bp, Homo sapiens
ttcctactatatcga

SEQ ID NO: 156006 - DNA, 15 bp, Homo sapiens
tttcctactatatcg

SEQ ID NO: 156007 - DNA, 15 bp, Homo sapiens
ctttcctactatatc

SEQ ID NO: 156008 - DNA, 15 bp, Homo sapiens
actttcctactatat

SEQ ID NO: 156009 - DNA, 15 bp, Homo sapiens
aactttcctactata

SEQ ID NO: 156010 - DNA, 15 bp, Homo sapiens
caactttcctactat

SEQ ID NO: 156011 - DNA, 15 bp, Homo sapiens
ccaactttcctacta

SEQ ID NO: 156012 - DNA, 15 bp, Homo sapiens
accaactttcctact

SEQ ID NO: 156013 - DNA, 15 bp, Homo sapiens
caccaactttcctac

SEQ ID NO: 156014 - DNA, 15 bp, Homo sapiens
acaccaactttccta

SEQ ID NO: 156015 - DNA, 15 bp, Homo sapiens
cacaccaactttcct

SEQ ID NO: 156016 - DNA, 15 bp, Homo sapiens
acacaccaactttcc

SEQ ID NO: 156017 - DNA, 15 bp, Homo sapiens
tacacaccaactttc

SEQ ID NO: 156018 - DNA, 15 bp, Homo sapiens
ttacacaccaacttt

SEQ ID NO: 156019 - DNA, 15 bp, Homo sapiens
gttacacaccaactt

SEQ ID NO: 156020 - DNA, 15 bp, Homo sapiens
ggttacacaccaact

SEQ ID NO: 156021 - DNA, 15 bp, Homo sapiens
aggttacacaccaac

SEQ ID NO: 156022 - DNA, 15 bp, Homo sapiens
aaggttacacaccaa

SEQ ID NO: 156023 - DNA, 15 bp, Homo sapiens
taaggttacacacca

SEQ ID NO: 156024 - DNA, 15 bp, Homo sapiens
ataaggttacacacc

SEQ ID NO: 156025 - DNA, 15 bp, Homo sapiens
aataaggttacacac

SEQ ID NO: 156026 - DNA, 15 bp, Homo sapiens
aaataaggttacaca

SEQ ID NO: 156027 - DNA, 15 bp, Homo sapiens
taaataaggttacac

SEQ ID NO: 156028 - DNA, 15 bp, Homo sapiens
ttaaataaggttaca

SEQ ID NO: 156029 - DNA, 15 bp, Homo sapiens
gttaaataaggttac

SEQ ID NO: 156030 - DNA, 15 bp, Homo sapiens
tgttaaataaggtta

SEQ ID NO: 156031 - DNA, 15 bp, Homo sapiens
ttgttaaataaggtt

SEQ ID NO: 156032 - DNA, 15 bp, Homo sapiens
cttgttaaataaggt

SEQ ID NO: 156033 - DNA, 15 bp, Homo sapiens
ccttgttaaataagg

SEQ ID NO: 156034 - DNA, 15 bp, Homo sapiens
gccttgttaaataag

SEQ ID NO: 156035 - DNA, 15 bp, Homo sapiens
agccttgttaaataa

SEQ ID NO: 156036 - DNA, 15 bp, Homo sapiens
aagccttgttaaata

SEQ ID NO: 156037 - DNA, 15 bp, Homo sapiens
caagccttgttaaat

SEQ ID NO: 156038 - DNA, 15 bp, Homo sapiens
gcaagccttgttaaa

SEQ ID NO: 156039 - DNA, 15 bp, Homo sapiens
tgcaagccttgttaa

SEQ ID NO: 156040 - DNA, 15 bp, Homo sapiens
ttgcaagccttgtta

SEQ ID NO: 156041 - DNA, 15 bp, Homo sapiens
gttgcaagccttgtt

SEQ ID NO: 156042 - DNA, 15 bp, Homo sapiens
agttgcaagccttgt

SEQ ID NO: 156043 - DNA, 15 bp, Homo sapiens
cagttgcaagccttg

SEQ ID NO: 156044 - DNA, 15 bp, Homo sapiens
tcagttgcaagcctt

SEQ ID NO: 156045 - DNA, 15 bp, Homo sapiens
atcagttgcaagcct

SEQ ID NO: 156046 - DNA, 15 bp, Homo sapiens
tatcagttgcaagcc

SEQ ID NO: 156047 - DNA, 15 bp, Homo sapiens
ttatcagttgcaagc

SEQ ID NO: 156048 - DNA, 15 bp, Homo sapiens
gttatcagttgcaag

SEQ ID NO: 156049 - DNA, 15 bp, Homo sapiens
agttatcagttgcaa

SEQ ID NO: 156050 - DNA, 15 bp, Homo sapiens
aagttatcagttgca

SEQ ID NO: 156051 - DNA, 15 bp, Homo sapiens
aaagttatcagttgc

SEQ ID NO: 156052 - DNA, 15 bp, Homo sapiens
aaaagttatcagttg

SEQ ID NO: 156053 - DNA, 15 bp, Homo sapiens
caaaagttatcagtt

SEQ ID NO: 156054 - DNA, 15 bp, Homo sapiens
acaaaagttatcagt

SEQ ID NO: 156055 - DNA, 15 bp, Homo sapiens
aacaaaagttatcag

SEQ ID NO: 156056 - DNA, 15 bp, Homo sapiens
caacaaaagttatca

SEQ ID NO: 156057 - DNA, 15 bp, Homo sapiens
tcaacaaaagttatc

SEQ ID NO: 156058 - DNA, 15 bp, Homo sapiens
ctcaacaaaagttat

SEQ ID NO: 156059 - DNA, 15 bp, Homo sapiens
tctcaacaaaagtta

SEQ ID NO: 156060 - DNA, 15 bp, Homo sapiens
gtctcaacaaaagtt

SEQ ID NO: 156061 - DNA, 15 bp, Homo sapiens
tgtctcaacaaaagt

SEQ ID NO: 156062 - DNA, 15 bp, Homo sapiens
ctgtctcaacaaaag

SEQ ID NO: 156063 - DNA, 15 bp, Homo sapiens
cctgtctcaacaaaa

SEQ ID NO: 156064 - DNA, 15 bp, Homo sapiens
gcctgtctcaacaaa

SEQ ID NO: 156065 - DNA, 15 bp, Homo sapiens
tgcctgtctcaacaa

SEQ ID NO: 156066 - DNA, 15 bp, Homo sapiens
atgcctgtctcaaca

SEQ ID NO: 156067 - DNA, 15 bp, Homo sapiens
catgcctgtctcaac

SEQ ID NO: 156068 - DNA, 15 bp, Homo sapiens
ccatgcctgtctcaa

SEQ ID NO: 156069 - DNA, 15 bp, Homo sapiens
cccatgcctgtctca

SEQ ID NO: 156070 - DNA, 15 bp, Homo sapiens
ccccatgcctgtctc

SEQ ID NO: 156071 - DNA, 15 bp, Homo sapiens
cccccatgcctgtct

SEQ ID NO: 156072 - DNA, 15 bp, Homo sapiens
gcccccatgcctgtc

SEQ ID NO: 156073 - DNA, 15 bp, Homo sapiens
ggcccccatgcctgt

SEQ ID NO: 156074 - DNA, 15 bp, Homo sapiens
gggcccccatgcctg

SEQ ID NO: 156075 - DNA, 15 bp, Homo sapiens
agggcccccatgcct

SEQ ID NO: 156076 - DNA, 15 bp, Homo sapiens
aagggcccccatgcc

SEQ ID NO: 156077 - DNA, 15 bp, Homo sapiens
gaagggcccccatgc

SEQ ID NO: 156078 - DNA, 15 bp, Homo sapiens
agaagggcccccatg

SEQ ID NO: 156079 - DNA, 15 bp, Homo sapiens
aagaagggcccccat

SEQ ID NO: 156080 - DNA, 15 bp, Homo sapiens
aaagaagggccccca

SEQ ID NO: 156081 - DNA, 15 bp, Homo sapiens
aaaagaagggccccc

SEQ ID NO: 156082 - DNA, 15 bp, Homo sapiens
caaaagaagggcccc

SEQ ID NO: 156083 - DNA, 15 bp, Homo sapiens
ccaaaagaagggccc

SEQ ID NO: 156084 - DNA, 15 bp, Homo sapiens
accaaaagaagggcc

SEQ ID NO: 156085 - DNA, 15 bp, Homo sapiens
caccaaaagaagggc

SEQ ID NO: 156086 - DNA, 15 bp, Homo sapiens
acaccaaaagaaggg

SEQ ID NO: 156087 - DNA, 15 bp, Homo sapiens
aacaccaaaagaagg

SEQ ID NO: 156088 - DNA, 15 bp, Homo sapiens
caacaccaaaagaag

SEQ ID NO: 156089 - DNA, 15 bp, Homo sapiens
tcaacaccaaaagaa

SEQ ID NO: 156090 - DNA, 15 bp, Homo sapiens
gtcaacaccaaaaga

SEQ ID NO: 156091 - DNA, 15 bp, Homo sapiens
tgtcaacaccaaaag

SEQ ID NO: 156092 - DNA, 15 bp, Homo sapiens
atgtcaacaccaaaa

SEQ ID NO: 156093 - DNA, 15 bp, Homo sapiens
tatgtcaacaccaaa

SEQ ID NO: 156094 - DNA, 15 bp, Homo sapiens
ttatgtcaacaccaa

SEQ ID NO: 156095 - DNA, 15 bp, Homo sapiens
attatgtcaacacca

SEQ ID NO: 156096 - DNA, 15 bp, Homo sapiens
tattatgtcaacacc

SEQ ID NO: 156097 - DNA, 15 bp, Homo sapiens
atattatgtcaacac

SEQ ID NO: 156098 - DNA, 15 bp, Homo sapiens
gatattatgtcaaca

SEQ ID NO: 156099 - DNA, 15 bp, Homo sapiens
agatattatgtcaac

SEQ ID NO: 156100 - DNA, 15 bp, Homo sapiens
aagatattatgtcaa

SEQ ID NO: 156101 - DNA, 15 bp, Homo sapiens
aaagatattatgtca

SEQ ID NO: 156102 - DNA, 15 bp, Homo sapiens
aaaagatattatgtc

SEQ ID NO: 156103 - DNA, 15 bp, Homo sapiens
aaaaagatattatgt

SEQ ID NO: 156104 - DNA, 15 bp, Homo sapiens
caaaaagatattatg

SEQ ID NO: 156105 - DNA, 15 bp, Homo sapiens
acaaaaagatattat

SEQ ID NO: 156106 - DNA, 15 bp, Homo sapiens
gacaaaaagatatta

SEQ ID NO: 156107 - DNA, 15 bp, Homo sapiens
agacaaaaagatatt

SEQ ID NO: 156108 - DNA, 15 bp, Homo sapiens
aagacaaaaagatat

SEQ ID NO: 156109 - DNA, 15 bp, Homo sapiens
aaagacaaaaagata

SEQ ID NO: 156110 - DNA, 15 bp, Homo sapiens
gaaagacaaaaagat

SEQ ID NO: 156111 - DNA, 15 bp, Homo sapiens
agaaagacaaaaaga

SEQ ID NO: 156112 - DNA, 15 bp, Homo sapiens
aagaaagacaaaaag

SEQ ID NO: 156113 - DNA, 15 bp, Homo sapiens
taagaaagacaaaaa

SEQ ID NO: 156114 - DNA, 15 bp, Homo sapiens
ataagaaagacaaaa

SEQ ID NO: 156115 - DNA, 15 bp, Homo sapiens
aataagaaagacaaa

SEQ ID NO: 156116 - DNA, 15 bp, Homo sapiens
gaataagaaagacaa

SEQ ID NO: 156117 - DNA, 15 bp, Homo sapiens
tgaataagaaagaca

SEQ ID NO: 156118 - DNA, 15 bp, Homo sapiens
atgaataagaaagac

SEQ ID NO: 156119 - DNA, 15 bp, Homo sapiens
gatgaataagaaaga

SEQ ID NO: 156120 - DNA, 15 bp, Homo sapiens
tgatgaataagaaag

SEQ ID NO: 156121 - DNA, 15 bp, Homo sapiens
ttgatgaataagaaa

SEQ ID NO: 156122 - DNA, 15 bp, Homo sapiens
cttgatgaataagaa

SEQ ID NO: 156123 - DNA, 15 bp, Homo sapiens
ccttgatgaataaga

SEQ ID NO: 156124 - DNA, 15 bp, Homo sapiens
accttgatgaataag

SEQ ID NO: 156125 - DNA, 15 bp, Homo sapiens
aaccttgatgaataa

SEQ ID NO: 156126 - DNA, 15 bp, Homo sapiens
taaccttgatgaata

SEQ ID NO: 156127 - DNA, 15 bp, Homo sapiens
ctaaccttgatgaat

SEQ ID NO: 156128 - DNA, 15 bp, Homo sapiens
actaaccttgatgaa

SEQ ID NO: 156129 - DNA, 15 bp, Homo sapiens
tactaaccttgatga

SEQ ID NO: 156130 - DNA, 15 bp, Homo sapiens
ctactaaccttgatg

SEQ ID NO: 156131 - DNA, 15 bp, Homo sapiens
tctactaaccttgat

SEQ ID NO: 156132 - DNA, 15 bp, Homo sapiens
ttctactaaccttga

SEQ ID NO: 156133 - DNA, 15 bp, Homo sapiens
tttctactaaccttg

SEQ ID NO: 156134 - DNA, 15 bp, Homo sapiens
ctttctactaacctt

SEQ ID NO: 156135 - DNA, 15 bp, Homo sapiens
actttctactaacct

SEQ ID NO: 156136 - DNA, 15 bp, Homo sapiens
aactttctactaacc

SEQ ID NO: 156137 - DNA, 15 bp, Homo sapiens
caactttctactaac

SEQ ID NO: 156138 - DNA, 15 bp, Homo sapiens
acaactttctactaa

SEQ ID NO: 156139 - DNA, 15 bp, Homo sapiens
gacaactttctacta

SEQ ID NO: 156140 - DNA, 15 bp, Homo sapiens
tgacaactttctact

SEQ ID NO: 156141 - DNA, 15 bp, Homo sapiens
ttgacaactttctac

SEQ ID NO: 156142 - DNA, 15 bp, Homo sapiens
cttgacaactttcta

SEQ ID NO: 156143 - DNA, 15 bp, Homo sapiens
acttgacaactttct

SEQ ID NO: 156144 - DNA, 15 bp, Homo sapiens
aacttgacaactttc

SEQ ID NO: 156145 - DNA, 15 bp, Homo sapiens
aaacttgacaacttt

SEQ ID NO: 156146 - DNA, 15 bp, Homo sapiens
gaaacttgacaactt

SEQ ID NO: 156147 - DNA, 15 bp, Homo sapiens
agaaacttgacaact

SEQ ID NO: 156148 - DNA, 15 bp, Homo sapiens
tagaaacttgacaac

SEQ ID NO: 156149 - DNA, 15 bp, Homo sapiens
atagaaacttgacaa

SEQ ID NO: 156150 - DNA, 15 bp, Homo sapiens
aatagaaacttgaca

SEQ ID NO: 156151 - DNA, 15 bp, Homo sapiens
gaatagaaacttgac

SEQ ID NO: 156152 - DNA, 15 bp, Homo sapiens
agaatagaaacttga

SEQ ID NO: 156153 - DNA, 15 bp, Homo sapiens
aagaatagaaacttg

SEQ ID NO: 156154 - DNA, 15 bp, Homo sapiens
taagaatagaaactt

SEQ ID NO: 156155 - DNA, 15 bp, Homo sapiens
ttaagaatagaaact

SEQ ID NO: 156156 - DNA, 15 bp, Homo sapiens
cttaagaatagaaac

SEQ ID NO: 156157 - DNA, 15 bp, Homo sapiens
gcttaagaatagaaa

SEQ ID NO: 156158 - DNA, 15 bp, Homo sapiens
agcttaagaatagaa

SEQ ID NO: 156159 - DNA, 15 bp, Homo sapiens
gagcttaagaataga

SEQ ID NO: 156160 - DNA, 15 bp, Homo sapiens
agagcttaagaatag

SEQ ID NO: 156161 - DNA, 15 bp, Homo sapiens
tagagcttaagaata

SEQ ID NO: 156162 - DNA, 15 bp, Homo sapiens
ctagagcttaagaat

SEQ ID NO: 156163 - DNA, 15 bp, Homo sapiens
tctagagcttaagaa

SEQ ID NO: 156164 - DNA, 15 bp, Homo sapiens
ttctagagcttaaga

SEQ ID NO: 156165 - DNA, 15 bp, Homo sapiens
gttctagagcttaag

SEQ ID NO: 156166 - DNA, 15 bp, Homo sapiens
agttctagagcttaa

SEQ ID NO: 156167 - DNA, 15 bp, Homo sapiens
tagttctagagctta

SEQ ID NO: 156168 - DNA, 15 bp, Homo sapiens
atagttctagagctt

SEQ ID NO: 156169 - DNA, 15 bp, Homo sapiens
gatagttctagagct

SEQ ID NO: 156170 - DNA, 15 bp, Homo sapiens
ggatagttctagagc

SEQ ID NO: 156171 - DNA, 15 bp, Homo sapiens
aggatagttctagag

SEQ ID NO: 156172 - DNA, 15 bp, Homo sapiens
caggatagttctaga

SEQ ID NO: 156173 - DNA, 15 bp, Homo sapiens
ccaggatagttctag

SEQ ID NO: 156174 - DNA, 15 bp, Homo sapiens
accaggatagttcta

SEQ ID NO: 156175 - DNA, 15 bp, Homo sapiens
gaccaggatagttct

SEQ ID NO: 156176 - DNA, 15 bp, Homo sapiens
agaccaggatagttc

SEQ ID NO: 156177 - DNA, 15 bp, Homo sapiens
aagaccaggatagtt

SEQ ID NO: 156178 - DNA, 15 bp, Homo sapiens
aaagaccaggatagt

SEQ ID NO: 156179 - DNA, 15 bp, Homo sapiens
taaagaccaggatag

SEQ ID NO: 156180 - DNA, 15 bp, Homo sapiens
ataaagaccaggata

SEQ ID NO: 156181 - DNA, 15 bp, Homo sapiens
gataaagaccaggat

SEQ ID NO: 156182 - DNA, 15 bp, Homo sapiens
agataaagaccagga

SEQ ID NO: 156183 - DNA, 15 bp, Homo sapiens
tagataaagaccagg

SEQ ID NO: 156184 - DNA, 15 bp, Homo sapiens
atagataaagaccag

SEQ ID NO: 156185 - DNA, 15 bp, Homo sapiens
catagataaagacca

SEQ ID NO: 156186 - DNA, 15 bp, Homo sapiens
tcatagataaagacc

SEQ ID NO: 156187 - DNA, 15 bp, Homo sapiens
ttcatagataaagac

SEQ ID NO: 156188 - DNA, 15 bp, Homo sapiens
tttcatagataaaga

SEQ ID NO: 156189 - DNA, 15 bp, Homo sapiens
ctttcatagataaag

SEQ ID NO: 156190 - DNA, 15 bp, Homo sapiens
tctttcatagataaa

SEQ ID NO: 156191 - DNA, 15 bp, Homo sapiens
ttctttcatagataa

SEQ ID NO: 156192 - DNA, 15 bp, Homo sapiens
cttctttcatagata

SEQ ID NO: 156193 - DNA, 15 bp, Homo sapiens
gcttctttcatagat

SEQ ID NO: 156194 - DNA, 15 bp, Homo sapiens
tgcttctttcataga

SEQ ID NO: 156195 - DNA, 15 bp, Homo sapiens
atgcttctttcatag

SEQ ID NO: 156196 - DNA, 15 bp, Homo sapiens
tatgcttctttcata

SEQ ID NO: 156197 - DNA, 15 bp, Homo sapiens
ttatgcttctttcat

SEQ ID NO: 156198 - DNA, 15 bp, Homo sapiens
tttatgcttctttca

SEQ ID NO: 156199 - DNA, 15 bp, Homo sapiens
gtttatgcttctttc

SEQ ID NO: 156200 - DNA, 15 bp, Homo sapiens
agtttatgcttcttt

SEQ ID NO: 156201 - DNA, 15 bp, Homo sapiens
aagtttatgcttctt

SEQ ID NO: 156202 - DNA, 15 bp, Homo sapiens
aaagtttatgcttct

SEQ ID NO: 156203 - DNA, 15 bp, Homo sapiens
caaagtttatgcttc

SEQ ID NO: 156204 - DNA, 15 bp, Homo sapiens
acaaagtttatgctt

SEQ ID NO: 156205 - DNA, 15 bp, Homo sapiens
gacaaagtttatgct

SEQ ID NO: 156206 - DNA, 15 bp, Homo sapiens
tgacaaagtttatgc

SEQ ID NO: 156207 - DNA, 15 bp, Homo sapiens
ttgacaaagtttatg

SEQ ID NO: 156208 - DNA, 15 bp, Homo sapiens
tttgacaaagtttat

SEQ ID NO: 156209 - DNA, 15 bp, Homo sapiens
ctttgacaaagttta

SEQ ID NO: 156210 - DNA, 15 bp, Homo sapiens
cctttgacaaagttt

SEQ ID NO: 156211 - DNA, 15 bp, Homo sapiens
tcctttgacaaagtt

SEQ ID NO: 156212 - DNA, 15 bp, Homo sapiens
ttcctttgacaaagt

SEQ ID NO: 156213 - DNA, 15 bp, Homo sapiens
attcctttgacaaag

SEQ ID NO: 156214 - DNA, 15 bp, Homo sapiens
cattcctttgacaaa

SEQ ID NO: 156215 - DNA, 15 bp, Homo sapiens
tcattcctttgacaa

SEQ ID NO: 156216 - DNA, 15 bp, Homo sapiens
atcattcctttgaca

SEQ ID NO: 156217 - DNA, 15 bp, Homo sapiens
aatcattcctttgac

SEQ ID NO: 156218 - DNA, 15 bp, Homo sapiens
aaatcattcctttga

SEQ ID NO: 156219 - DNA, 15 bp, Homo sapiens
taaatcattcctttg

SEQ ID NO: 156220 - DNA, 15 bp, Homo sapiens
gtaaatcattccttt

SEQ ID NO: 156221 - DNA, 15 bp, Homo sapiens
agtaaatcattcctt

SEQ ID NO: 156222 - DNA, 15 bp, Homo sapiens
gagtaaatcattcct

SEQ ID NO: 156223 - DNA, 15 bp, Homo sapiens
tgagtaaatcattcc

SEQ ID NO: 156224 - DNA, 15 bp, Homo sapiens
atgagtaaatcattc

SEQ ID NO: 156225 - DNA, 15 bp, Homo sapiens
tatgagtaaatcatt

SEQ ID NO: 156226 - DNA, 15 bp, Homo sapiens
ttatgagtaaatcat

SEQ ID NO: 156227 - DNA, 15 bp, Homo sapiens
attatgagtaaatca

SEQ ID NO: 156228 - DNA, 15 bp, Homo sapiens
tattatgagtaaatc

SEQ ID NO: 156229 - DNA, 15 bp, Homo sapiens
ttattatgagtaaat

SEQ ID NO: 156230 - DNA, 15 bp, Homo sapiens
cttattatgagtaaa

SEQ ID NO: 156231 - DNA, 15 bp, Homo sapiens
acttattatgagtaa

SEQ ID NO: 156232 - DNA, 15 bp, Homo sapiens
gacttattatgagta

SEQ ID NO: 156233 - DNA, 15 bp, Homo sapiens
tgacttattatgagt

SEQ ID NO: 156234 - DNA, 15 bp, Homo sapiens
ttgacttattatgag

SEQ ID NO: 156235 - DNA, 15 bp, Homo sapiens
attgacttattatga

SEQ ID NO: 156236 - DNA, 15 bp, Homo sapiens
cattgacttattatg

SEQ ID NO: 156237 - DNA, 15 bp, Homo sapiens
acattgacttattat

SEQ ID NO: 156238 - DNA, 15 bp, Homo sapiens
cacattgacttatta

SEQ ID NO: 156239 - DNA, 15 bp, Homo sapiens
tcacattgacttatt

SEQ ID NO: 156240 - DNA, 15 bp, Homo sapiens
ttcacattgacttat

SEQ ID NO: 156241 - DNA, 15 bp, Homo sapiens
cttcacattgactta

SEQ ID NO: 156242 - DNA, 15 bp, Homo sapiens
gcttcacattgactt

SEQ ID NO: 156243 - DNA, 15 bp, Homo sapiens
ggcttcacattgact

SEQ ID NO: 156244 - DNA, 15 bp, Homo sapiens
gggcttcacattgac

SEQ ID NO: 156245 - DNA, 15 bp, Homo sapiens
tgggcttcacattga

SEQ ID NO: 156246 - DNA, 15 bp, Homo sapiens
atgggcttcacattg

SEQ ID NO: 156247 - DNA, 15 bp, Homo sapiens
aatgggcttcacatt

SEQ ID NO: 156248 - DNA, 15 bp, Homo sapiens
gaatgggcttcacat

SEQ ID NO: 156249 - DNA, 15 bp, Homo sapiens
tgaatgggcttcaca

SEQ ID NO: 156250 - DNA, 15 bp, Homo sapiens
atgaatgggcttcac

SEQ ID NO: 156251 - DNA, 15 bp, Homo sapiens
tatgaatgggcttca

SEQ ID NO: 156252 - DNA, 15 bp, Homo sapiens
ttatgaatgggcttc

SEQ ID NO: 156253 - DNA, 15 bp, Homo sapiens
gttatgaatgggctt

SEQ ID NO: 156254 - DNA, 15 bp, Homo sapiens
agttatgaatgggct

SEQ ID NO: 156255 - DNA, 15 bp, Homo sapiens
tagttatgaatgggc

SEQ ID NO: 156256 - DNA, 15 bp, Homo sapiens
atagttatgaatggg

SEQ ID NO: 156257 - DNA, 15 bp, Homo sapiens
tatagttatgaatgg

SEQ ID NO: 156258 - DNA, 15 bp, Homo sapiens
gtatagttatgaatg

SEQ ID NO: 156259 - DNA, 15 bp, Homo sapiens
ggtatagttatgaat

SEQ ID NO: 156260 - DNA, 15 bp, Homo sapiens
aggtatagttatgaa

SEQ ID NO: 156261 - DNA, 15 bp, Homo sapiens
aaggtatagttatga

SEQ ID NO: 156262 - DNA, 15 bp, Homo sapiens
aaaggtatagttatg

SEQ ID NO: 156263 - DNA, 15 bp, Homo sapiens
aaaaggtatagttat

SEQ ID NO: 156264 - DNA, 15 bp, Homo sapiens
aaaaaggtatagtta

SEQ ID NO: 156265 - DNA, 15 bp, Homo sapiens
caaaaaggtatagtt

SEQ ID NO: 156266 - DNA, 15 bp, Homo sapiens
acaaaaaggtatagt

SEQ ID NO: 156267 - DNA, 15 bp, Homo sapiens
aacaaaaaggtatag

SEQ ID NO: 156268 - DNA, 15 bp, Homo sapiens
aaacaaaaaggtata

SEQ ID NO: 156269 - DNA, 15 bp, Homo sapiens
aaaacaaaaaggtat

SEQ ID NO: 156270 - DNA, 15 bp, Homo sapiens
caaaacaaaaaggta

SEQ ID NO: 156271 - DNA, 15 bp, Homo sapiens
gcaaaacaaaaaggt

SEQ ID NO: 156272 - DNA, 15 bp, Homo sapiens
agcaaaacaaaaagg

SEQ ID NO: 156273 - DNA, 15 bp, Homo sapiens
aagcaaaacaaaaag

SEQ ID NO: 156274 - DNA, 15 bp, Homo sapiens
aaaagcaaaacaaaa

SEQ ID NO: 156275 - DNA, 15 bp, Homo sapiens
gaaaagcaaaacaaa

SEQ ID NO: 156276 - DNA, 15 bp, Homo sapiens
agaaaagcaaaacaa

SEQ ID NO: 156277 - DNA, 15 bp, Homo sapiens
gagaaaagcaaaaca

SEQ ID NO: 156278 - DNA, 15 bp, Homo sapiens
tgagaaaagcaaaac

SEQ ID NO: 156279 - DNA, 15 bp, Homo sapiens
atgagaaaagcaaaa

SEQ ID NO: 156280 - DNA, 15 bp, Homo sapiens
aatgagaaaagcaaa

SEQ ID NO: 156281 - DNA, 15 bp, Homo sapiens
aaatgagaaaagcaa

SEQ ID NO: 156282 - DNA, 15 bp, Homo sapiens
gaaatgagaaaagca

SEQ ID NO: 156283 - DNA, 15 bp, Homo sapiens
agaaatgagaaaagc

SEQ ID NO: 156284 - DNA, 15 bp, Homo sapiens
gagaaatgagaaaag

SEQ ID NO: 156285 - DNA, 15 bp, Homo sapiens
cagagaaatgagaaa

SEQ ID NO: 156286 - DNA, 15 bp, Homo sapiens
tcagagaaatgagaa

SEQ ID NO: 156287 - DNA, 15 bp, Homo sapiens
ctcagagaaatgaga

SEQ ID NO: 156288 - DNA, 15 bp, Homo sapiens
actcagagaaatgag

SEQ ID NO: 156289 - DNA, 15 bp, Homo sapiens
gactcagagaaatga

SEQ ID NO: 156290 - DNA, 15 bp, Homo sapiens
tgactcagagaaatg

SEQ ID NO: 156291 - DNA, 15 bp, Homo sapiens
atgactcagagaaat

SEQ ID NO: 156292 - DNA, 15 bp, Homo sapiens
aatgactcagagaaa

SEQ ID NO: 156293 - DNA, 15 bp, Homo sapiens
taatgactcagagaa

SEQ ID NO: 156294 - DNA, 15 bp, Homo sapiens
gtaatgactcagaga

SEQ ID NO: 156295 - DNA, 15 bp, Homo sapiens
agtaatgactcagag

SEQ ID NO: 156296 - DNA, 15 bp, Homo sapiens
aagtaatgactcaga

SEQ ID NO: 156297 - DNA, 15 bp, Homo sapiens
taagtaatgactcag

SEQ ID NO: 156298 - DNA, 15 bp, Homo sapiens
ttaagtaatgactca

SEQ ID NO: 156299 - DNA, 15 bp, Homo sapiens
tttaagtaatgactc

SEQ ID NO: 156300 - DNA, 15 bp, Homo sapiens
ctttaagtaatgact

SEQ ID NO: 156301 - DNA, 15 bp, Homo sapiens
gctttaagtaatgac

SEQ ID NO: 156302 - DNA, 15 bp, Homo sapiens
agctttaagtaatga

SEQ ID NO: 156303 - DNA, 15 bp, Homo sapiens
cagctttaagtaatg

SEQ ID NO: 156304 - DNA, 15 bp, Homo sapiens
ccagctttaagtaat

SEQ ID NO: 156305 - DNA, 15 bp, Homo sapiens
accagctttaagtaa

SEQ ID NO: 156306 - DNA, 15 bp, Homo sapiens
caccagctttaagta

SEQ ID NO: 156307 - DNA, 15 bp, Homo sapiens
gcaccagctttaagt

SEQ ID NO: 156308 - DNA, 15 bp, Homo sapiens
agcaccagctttaag

SEQ ID NO: 156309 - DNA, 15 bp, Homo sapiens
aagcaccagctttaa

SEQ ID NO: 156310 - DNA, 15 bp, Homo sapiens
aaagcaccagcttta

SEQ ID NO: 156311 - DNA, 15 bp, Homo sapiens
taaagcaccagcttt

SEQ ID NO: 156312 - DNA, 15 bp, Homo sapiens
ataaagcaccagctt

SEQ ID NO: 156313 - DNA, 15 bp, Homo sapiens
tataaagcaccagct

SEQ ID NO: 156314 - DNA, 15 bp, Homo sapiens
ttataaagcaccagc

SEQ ID NO: 156315 - DNA, 15 bp, Homo sapiens
attataaagcaccag

SEQ ID NO: 156316 - DNA, 15 bp, Homo sapiens
aattataaagcacca

SEQ ID NO: 156317 - DNA, 15 bp, Homo sapiens
aaattataaagcacc

SEQ ID NO: 156318 - DNA, 15 bp, Homo sapiens
caaattataaagcac

SEQ ID NO: 156319 - DNA, 15 bp, Homo sapiens
tcaaattataaagca

SEQ ID NO: 156320 - DNA, 15 bp, Homo sapiens
gtcaaattataaagc

SEQ ID NO: 156321 - DNA, 15 bp, Homo sapiens
agtcaaattataaag

SEQ ID NO: 156322 - DNA, 15 bp, Homo sapiens
aagtcaaattataaa

SEQ ID NO: 156323 - DNA, 15 bp, Homo sapiens
taagtcaaattataa

SEQ ID NO: 156324 - DNA, 15 bp, Homo sapiens
ttaagtcaaattata

SEQ ID NO: 156325 - DNA, 15 bp, Homo sapiens
attaagtcaaattat

SEQ ID NO: 156326 - DNA, 15 bp, Homo sapiens
gattaagtcaaatta

SEQ ID NO: 156327 - DNA, 15 bp, Homo sapiens
tgattaagtcaaatt

SEQ ID NO: 156328 - DNA, 15 bp, Homo sapiens
gtgattaagtcaaat

SEQ ID NO: 156329 - DNA, 15 bp, Homo sapiens
tgtgattaagtcaaa

SEQ ID NO: 156330 - DNA, 15 bp, Homo sapiens
atgtgattaagtcaa

SEQ ID NO: 156331 - DNA, 15 bp, Homo sapiens
tatgtgattaagtca

SEQ ID NO: 156332 - DNA, 15 bp, Homo sapiens
atatgtgattaagtc

SEQ ID NO: 156333 - DNA, 15 bp, Homo sapiens
catatgtgattaagt

SEQ ID NO: 156334 - DNA, 15 bp, Homo sapiens
ccatatgtgattaag

SEQ ID NO: 156335 - DNA, 15 bp, Homo sapiens
accatatgtgattaa

SEQ ID NO: 156336 - DNA, 15 bp, Homo sapiens
caccatatgtgatta

SEQ ID NO: 156337 - DNA, 15 bp, Homo sapiens
acaccatatgtgatt

SEQ ID NO: 156338 - DNA, 15 bp, Homo sapiens
cacaccatatgtgat

SEQ ID NO: 156339 - DNA, 15 bp, Homo sapiens
tcacaccatatgtga

SEQ ID NO: 156340 - DNA, 15 bp, Homo sapiens
atcacaccatatgtg

SEQ ID NO: 156341 - DNA, 15 bp, Homo sapiens
aatcacaccatatgt

SEQ ID NO: 156342 - DNA, 15 bp, Homo sapiens
gaatcacaccatatg

SEQ ID NO: 156343 - DNA, 15 bp, Homo sapiens
agaatcacaccatat

SEQ ID NO: 156344 - DNA, 15 bp, Homo sapiens
aagaatcacaccata

SEQ ID NO: 156345 - DNA, 15 bp, Homo sapiens
aaagaatcacaccat

SEQ ID NO: 156346 - DNA, 15 bp, Homo sapiens
aaaagaatcacacca

SEQ ID NO: 156347 - DNA, 15 bp, Homo sapiens
taaaagaatcacacc

SEQ ID NO: 156348 - DNA, 15 bp, Homo sapiens
ctaaaagaatcacac

SEQ ID NO: 156349 - DNA, 15 bp, Homo sapiens
gctaaaagaatcaca

SEQ ID NO: 156350 - DNA, 15 bp, Homo sapiens
tgctaaaagaatcac

SEQ ID NO: 156351 - DNA, 15 bp, Homo sapiens
gtgctaaaagaatca

SEQ ID NO: 156352 - DNA, 15 bp, Homo sapiens
tgtgctaaaagaatc

SEQ ID NO: 156353 - DNA, 15 bp, Homo sapiens
gtgtgctaaaagaat

SEQ ID NO: 156354 - DNA, 15 bp, Homo sapiens
tgtgtgctaaaagaa

SEQ ID NO: 156355 - DNA, 15 bp, Homo sapiens
atgtgtgctaaaaga

SEQ ID NO: 156356 - DNA, 15 bp, Homo sapiens
tatgtgtgctaaaag

SEQ ID NO: 156357 - DNA, 15 bp, Homo sapiens
gtatgtgtgctaaaa

SEQ ID NO: 156358 - DNA, 15 bp, Homo sapiens
agtatgtgtgctaaa

SEQ ID NO: 156359 - DNA, 15 bp, Homo sapiens
cagtatgtgtgctaa

SEQ ID NO: 156360 - DNA, 15 bp, Homo sapiens
acagtatgtgtgcta

SEQ ID NO: 156361 - DNA, 15 bp, Homo sapiens
aacagtatgtgtgct

SEQ ID NO: 156362 - DNA, 15 bp, Homo sapiens
caacagtatgtgtgc

SEQ ID NO: 156363 - DNA, 15 bp, Homo sapiens
acaacagtatgtgtg

SEQ ID NO: 156364 - DNA, 15 bp, Homo sapiens
aacaacagtatgtgt

SEQ ID NO: 156365 - DNA, 15 bp, Homo sapiens
aaacaacagtatgtg

SEQ ID NO: 156366 - DNA, 15 bp, Homo sapiens
aaaacaacagtatgt

SEQ ID NO: 156367 - DNA, 15 bp, Homo sapiens
aaaaacaacagtatg

SEQ ID NO: 156368 - DNA, 15 bp, Homo sapiens
taaaaacaacagtat

SEQ ID NO: 156369 - DNA, 15 bp, Homo sapiens
ttaaaaacaacagta

SEQ ID NO: 156370 - DNA, 15 bp, Homo sapiens
tttaaaaacaacagt

SEQ ID NO: 156371 - DNA, 15 bp, Homo sapiens
atttaaaaacaacag

SEQ ID NO: 156372 - DNA, 15 bp, Homo sapiens
gatttaaaaacaaca

SEQ ID NO: 156373 - DNA, 15 bp, Homo sapiens
tgatttaaaaacaac

SEQ ID NO: 156374 - DNA, 15 bp, Homo sapiens
atgatttaaaaacaa

SEQ ID NO: 156375 - DNA, 15 bp, Homo sapiens
aatgatttaaaaaca

SEQ ID NO: 156376 - DNA, 15 bp, Homo sapiens
taatgatttaaaaac

SEQ ID NO: 156377 - DNA, 15 bp, Homo sapiens
gtaatgatttaaaaa

SEQ ID NO: 156378 - DNA, 15 bp, Homo sapiens
tgtaatgatttaaaa

SEQ ID NO: 156379 - DNA, 15 bp, Homo sapiens
atgtaatgatttaaa

SEQ ID NO: 156380 - DNA, 15 bp, Homo sapiens
aatgtaatgatttaa

SEQ ID NO: 156381 - DNA, 15 bp, Homo sapiens
aaatgtaatgattta

SEQ ID NO: 156382 - DNA, 15 bp, Homo sapiens
aaaatgtaatgattt

SEQ ID NO: 156383 - DNA, 15 bp, Homo sapiens
taaaatgtaatgatt

SEQ ID NO: 156384 - DNA, 15 bp, Homo sapiens
ttaaaatgtaatgat

SEQ ID NO: 156385 - DNA, 15 bp, Homo sapiens
tttaaaatgtaatga

SEQ ID NO: 156386 - DNA, 15 bp, Homo sapiens
gtttaaaatgtaatg

SEQ ID NO: 156387 - DNA, 15 bp, Homo sapiens
agtttaaaatgtaat

SEQ ID NO: 156388 - DNA, 15 bp, Homo sapiens
aagtttaaaatgtaa

SEQ ID NO: 156389 - DNA, 15 bp, Homo sapiens
gaagtttaaaatgta

SEQ ID NO: 156390 - DNA, 15 bp, Homo sapiens
agaagtttaaaatgt

SEQ ID NO: 156391 - DNA, 15 bp, Homo sapiens
aagaagtttaaaatg

SEQ ID NO: 156392 - DNA, 15 bp, Homo sapiens
aaagaagtttaaaat

SEQ ID NO: 156393 - DNA, 15 bp, Homo sapiens
taaagaagtttaaaa

SEQ ID NO: 156394 - DNA, 15 bp, Homo sapiens
ataaagaagtttaaa

SEQ ID NO: 156395 - DNA, 15 bp, Homo sapiens
tataaagaagtttaa

SEQ ID NO: 156396 - DNA, 15 bp, Homo sapiens
atataaagaagttta

SEQ ID NO: 156397 - DNA, 15 bp, Homo sapiens
gatataaagaagttt

SEQ ID NO: 156398 - DNA, 15 bp, Homo sapiens
agatataaagaagtt

SEQ ID NO: 156399 - DNA, 15 bp, Homo sapiens
tagatataaagaagt

SEQ ID NO: 156400 - DNA, 15 bp, Homo sapiens
ctagatataaagaag

SEQ ID NO: 156401 - DNA, 15 bp, Homo sapiens
tctagatataaagaa

SEQ ID NO: 156402 - DNA, 15 bp, Homo sapiens
ttctagatataaaga

SEQ ID NO: 156403 - DNA, 15 bp, Homo sapiens
attctagatataaag

SEQ ID NO: 156404 - DNA, 15 bp, Homo sapiens
aattctagatataaa

SEQ ID NO: 156405 - DNA, 15 bp, Homo sapiens
aaattctagatataa

SEQ ID NO: 156406 - DNA, 15 bp, Homo sapiens
aaaattctagatata

SEQ ID NO: 156407 - DNA, 15 bp, Homo sapiens
aaaaattctagatat

SEQ ID NO: 156408 - DNA, 15 bp, Homo sapiens
taaaaattctagata

SEQ ID NO: 156409 - DNA, 15 bp, Homo sapiens
gtaaaaattctagat

SEQ ID NO: 156410 - DNA, 15 bp, Homo sapiens
tgtaaaaattctaga

SEQ ID NO: 156411 - DNA, 15 bp, Homo sapiens
gtgtaaaaattctag

SEQ ID NO: 156412 - DNA, 15 bp, Homo sapiens
agtgtaaaaattcta

SEQ ID NO: 156413 - DNA, 15 bp, Homo sapiens
cagtgtaaaaattct

SEQ ID NO: 156414 - DNA, 15 bp, Homo sapiens
gcagtgtaaaaattc

SEQ ID NO: 156415 - DNA, 15 bp, Homo sapiens
ggcagtgtaaaaatt

SEQ ID NO: 156416 - DNA, 15 bp, Homo sapiens
tggcagtgtaaaaat

SEQ ID NO: 156417 - DNA, 15 bp, Homo sapiens
ctggcagtgtaaaaa

SEQ ID NO: 156418 - DNA, 15 bp, Homo sapiens
tctggcagtgtaaaa

SEQ ID NO: 156419 - DNA, 15 bp, Homo sapiens
atctggcagtgtaaa

SEQ ID NO: 156420 - DNA, 15 bp, Homo sapiens
tatctggcagtgtaa

SEQ ID NO: 156421 - DNA, 15 bp, Homo sapiens
ttatctggcagtgta

SEQ ID NO: 156422 - DNA, 15 bp, Homo sapiens
gttatctggcagtgt

SEQ ID NO: 156423 - DNA, 15 bp, Homo sapiens
ggttatctggcagtg

SEQ ID NO: 156424 - DNA, 15 bp, Homo sapiens
aggttatctggcagt

SEQ ID NO: 156425 - DNA, 15 bp, Homo sapiens
caggttatctggcag

SEQ ID NO: 156426 - DNA, 15 bp, Homo sapiens
tcaggttatctggca

SEQ ID NO: 156427 - DNA, 15 bp, Homo sapiens
ttcaggttatctggc

SEQ ID NO: 156428 - DNA, 15 bp, Homo sapiens
attcaggttatctgg

SEQ ID NO: 156429 - DNA, 15 bp, Homo sapiens
aattcaggttatctg

SEQ ID NO: 156430 - DNA, 15 bp, Homo sapiens
aaattcaggttatct

SEQ ID NO: 156431 - DNA, 15 bp, Homo sapiens
aaaattcaggttatc

SEQ ID NO: 156432 - DNA, 15 bp, Homo sapiens
gaaaattcaggttat

SEQ ID NO: 156433 - DNA, 15 bp, Homo sapiens
ggaaaattcaggtta

SEQ ID NO: 156434 - DNA, 15 bp, Homo sapiens
gggaaaattcaggtt

SEQ ID NO: 156435 - DNA, 15 bp, Homo sapiens
ggggaaaattcaggt

SEQ ID NO: 156436 - DNA, 15 bp, Homo sapiens
aggggaaaattcagg

SEQ ID NO: 156437 - DNA, 15 bp, Homo sapiens
caggggaaaattcag

SEQ ID NO: 156438 - DNA, 15 bp, Homo sapiens
gcaggggaaaattca

SEQ ID NO: 156439 - DNA, 15 bp, Homo sapiens
agcaggggaaaattc

SEQ ID NO: 156440 - DNA, 15 bp, Homo sapiens
aagcaggggaaaatt

SEQ ID NO: 156441 - DNA, 15 bp, Homo sapiens
taagcaggggaaaat

SEQ ID NO: 156442 - DNA, 15 bp, Homo sapiens
ataagcaggggaaaa

SEQ ID NO: 156443 - DNA, 15 bp, Homo sapiens
gataagcaggggaaa

SEQ ID NO: 156444 - DNA, 15 bp, Homo sapiens
agataagcaggggaa

SEQ ID NO: 156445 - DNA, 15 bp, Homo sapiens
cagataagcagggga

SEQ ID NO: 156446 - DNA, 15 bp, Homo sapiens
ccagataagcagggg

SEQ ID NO: 156447 - DNA, 15 bp, Homo sapiens
accagataagcaggg

SEQ ID NO: 156448 - DNA, 15 bp, Homo sapiens
caccagataagcagg

SEQ ID NO: 156449 - DNA, 15 bp, Homo sapiens
tcaccagataagcag

SEQ ID NO: 156450 - DNA, 15 bp, Homo sapiens
ttcaccagataagca

SEQ ID NO: 156451 - DNA, 15 bp, Homo sapiens
tttcaccagataagc

SEQ ID NO: 156452 - DNA, 15 bp, Homo sapiens
ctttcaccagataag

SEQ ID NO: 156453 - DNA, 15 bp, Homo sapiens
tctttcaccagataa

SEQ ID NO: 156454 - DNA, 15 bp, Homo sapiens
ttctttcaccagata

SEQ ID NO: 156455 - DNA, 15 bp, Homo sapiens
attctttcaccagat

SEQ ID NO: 156456 - DNA, 15 bp, Homo sapiens
cattctttcaccaga

SEQ ID NO: 156457 - DNA, 15 bp, Homo sapiens
tcattctttcaccag

SEQ ID NO: 156458 - DNA, 15 bp, Homo sapiens
atcattctttcacca

SEQ ID NO: 156459 - DNA, 15 bp, Homo sapiens
tatcattctttcacc

SEQ ID NO: 156460 - DNA, 15 bp, Homo sapiens
ctatcattctttcac

SEQ ID NO: 156461 - DNA, 15 bp, Homo sapiens
tcctatcattctttc

SEQ ID NO: 156462 - DNA, 15 bp, Homo sapiens
ttcctatcattcttt

SEQ ID NO: 156463 - DNA, 15 bp, Homo sapiens
attcctatcattctt

SEQ ID NO: 156464 - DNA, 15 bp, Homo sapiens
aattcctatcattct

SEQ ID NO: 156465 - DNA, 15 bp, Homo sapiens
taattcctatcattc

SEQ ID NO: 156466 - DNA, 15 bp, Homo sapiens
gtaattcctatcatt

SEQ ID NO: 156467 - DNA, 15 bp, Homo sapiens
tgtaattcctatcat

SEQ ID NO: 156468 - DNA, 15 bp, Homo sapiens
ttgtaattcctatca

SEQ ID NO: 156469 - DNA, 15 bp, Homo sapiens
attgtaattcctatc

SEQ ID NO: 156470 - DNA, 15 bp, Homo sapiens
cattgtaattcctat

SEQ ID NO: 156471 - DNA, 15 bp, Homo sapiens
acattgtaattccta

SEQ ID NO: 156472 - DNA, 15 bp, Homo sapiens
aacattgtaattcct

SEQ ID NO: 156473 - DNA, 15 bp, Homo sapiens
aaacattgtaattcc

SEQ ID NO: 156474 - DNA, 15 bp, Homo sapiens
caaacattgtaattc

SEQ ID NO: 156475 - DNA, 15 bp, Homo sapiens
tcaaacattgtaatt

SEQ ID NO: 156476 - DNA, 15 bp, Homo sapiens
ttcaaacattgtaat

SEQ ID NO: 156477 - DNA, 15 bp, Homo sapiens
tttcaaacattgtaa

SEQ ID NO: 156478 - DNA, 15 bp, Homo sapiens
gtttcaaacattgta

SEQ ID NO: 156479 - DNA, 15 bp, Homo sapiens
tgtttcaaacattgt

SEQ ID NO: 156480 - DNA, 15 bp, Homo sapiens
atgtttcaaacattg

SEQ ID NO: 156481 - DNA, 15 bp, Homo sapiens
tatgtttcaaacatt

SEQ ID NO: 156482 - DNA, 15 bp, Homo sapiens
ctatgtttcaaacat

SEQ ID NO: 156483 - DNA, 15 bp, Homo sapiens
cctatgtttcaaaca

SEQ ID NO: 156484 - DNA, 15 bp, Homo sapiens
ccctatgtttcaaac

SEQ ID NO: 156485 - DNA, 15 bp, Homo sapiens
accctatgtttcaaa

SEQ ID NO: 156486 - DNA, 15 bp, Homo sapiens
aaccctatgtttcaa

SEQ ID NO: 156487 - DNA, 15 bp, Homo sapiens
caaccctatgtttca

SEQ ID NO: 156488 - DNA, 15 bp, Homo sapiens
acaaccctatgtttc

SEQ ID NO: 156489 - DNA, 15 bp, Homo sapiens
aacaaccctatgttt

SEQ ID NO: 156490 - DNA, 15 bp, Homo sapiens
gaacaaccctatgtt

SEQ ID NO: 156491 - DNA, 15 bp, Homo sapiens
ggaacaaccctatgt

SEQ ID NO: 156492 - DNA, 15 bp, Homo sapiens
aggaacaaccctatg

SEQ ID NO: 156493 - DNA, 15 bp, Homo sapiens
aaggaacaaccctat

SEQ ID NO: 156494 - DNA, 15 bp, Homo sapiens
taaggaacaacccta

SEQ ID NO: 156495 - DNA, 15 bp, Homo sapiens
ataaggaacaaccct

SEQ ID NO: 156496 - DNA, 15 bp, Homo sapiens
aataaggaacaaccc

SEQ ID NO: 156497 - DNA, 15 bp, Homo sapiens
aaataaggaacaacc

SEQ ID NO: 156498 - DNA, 15 bp, Homo sapiens
taaataaggaacaac

SEQ ID NO: 156499 - DNA, 15 bp, Homo sapiens
gtaaataaggaacaa

SEQ ID NO: 156500 - DNA, 15 bp, Homo sapiens
agtaaataaggaaca

SEQ ID NO: 156501 - DNA, 15 bp, Homo sapiens
cagtaaataaggaac

SEQ ID NO: 156502 - DNA, 15 bp, Homo sapiens
tcagtaaataaggaa

SEQ ID NO: 156503 - DNA, 15 bp, Homo sapiens
ttcagtaaataagga

SEQ ID NO: 156504 - DNA, 15 bp, Homo sapiens
tttcagtaaataagg

SEQ ID NO: 156505 - DNA, 15 bp, Homo sapiens
ttttcagtaaataag

SEQ ID NO: 156506 - DNA, 15 bp, Homo sapiens
attttcagtaaataa

SEQ ID NO: 156507 - DNA, 15 bp, Homo sapiens
aattttcagtaaata

SEQ ID NO: 156508 - DNA, 15 bp, Homo sapiens
taattttcagtaaat

SEQ ID NO: 156509 - DNA, 15 bp, Homo sapiens
ataattttcagtaaa

SEQ ID NO: 156510 - DNA, 15 bp, Homo sapiens
tataattttcagtaa

SEQ ID NO: 156511 - DNA, 15 bp, Homo sapiens
atataattttcagta

SEQ ID NO: 156512 - DNA, 15 bp, Homo sapiens
catataattttcagt

SEQ ID NO: 156513 - DNA, 15 bp, Homo sapiens
ccatataattttcag

SEQ ID NO: 156514 - DNA, 15 bp, Homo sapiens
tccatataattttca

SEQ ID NO: 156515 - DNA, 15 bp, Homo sapiens
ttccatataattttc

SEQ ID NO: 156516 - DNA, 15 bp, Homo sapiens
gttccatataatttt

SEQ ID NO: 156517 - DNA, 15 bp, Homo sapiens
tgttccatataattt

SEQ ID NO: 156518 - DNA, 15 bp, Homo sapiens
ttgttccatataatt

SEQ ID NO: 156519 - DNA, 15 bp, Homo sapiens
gttgttccatataat

SEQ ID NO: 156520 - DNA, 15 bp, Homo sapiens
tgttgttccatataa

SEQ ID NO: 156521 - DNA, 15 bp, Homo sapiens
atgttgttccatata

SEQ ID NO: 156522 - DNA, 15 bp, Homo sapiens
tatgttgttccatat

SEQ ID NO: 156523 - DNA, 15 bp, Homo sapiens
atatgttgttccata

SEQ ID NO: 156524 - DNA, 15 bp, Homo sapiens
tatatgttgttccat

SEQ ID NO: 156525 - DNA, 15 bp, Homo sapiens
atatatgttgttcca

SEQ ID NO: 156526 - DNA, 15 bp, Homo sapiens
gatatatgttgttcc

SEQ ID NO: 156527 - DNA, 15 bp, Homo sapiens
tgatatatgttgttc

SEQ ID NO: 156528 - DNA, 15 bp, Homo sapiens
atgatatatgttgtt

SEQ ID NO: 156529 - DNA, 15 bp, Homo sapiens
aatgatatatgttgt

SEQ ID NO: 156530 - DNA, 15 bp, Homo sapiens
gaatgatatatgttg

SEQ ID NO: 156531 - DNA, 15 bp, Homo sapiens
agaatgatatatgtt

SEQ ID NO: 156532 - DNA, 15 bp, Homo sapiens
cagaatgatatatgt

SEQ ID NO: 156533 - DNA, 15 bp, Homo sapiens
ccagaatgatatatg

SEQ ID NO: 156534 - DNA, 15 bp, Homo sapiens
gccagaatgatatat

SEQ ID NO: 156535 - DNA, 15 bp, Homo sapiens
agccagaatgatata

SEQ ID NO: 156536 - DNA, 15 bp, Homo sapiens
aagccagaatgatat

SEQ ID NO: 156537 - DNA, 15 bp, Homo sapiens
gaagccagaatgata

SEQ ID NO: 156538 - DNA, 15 bp, Homo sapiens
ggaagccagaatgat

SEQ ID NO: 156539 - DNA, 15 bp, Homo sapiens
tggaagccagaatga

SEQ ID NO: 156540 - DNA, 15 bp, Homo sapiens
ttggaagccagaatg

SEQ ID NO: 156541 - DNA, 15 bp, Homo sapiens
cttggaagccagaat

SEQ ID NO: 156542 - DNA, 15 bp, Homo sapiens
ccttggaagccagaa

SEQ ID NO: 156543 - DNA, 15 bp, Homo sapiens
tccttggaagccaga

SEQ ID NO: 156544 - DNA, 15 bp, Homo sapiens
atccttggaagccag

SEQ ID NO: 156545 - DNA, 15 bp, Homo sapiens
catccttggaagcca

SEQ ID NO: 156546 - DNA, 15 bp, Homo sapiens
tcatccttggaagcc

SEQ ID NO: 156547 - DNA, 15 bp, Homo sapiens
ttcatccttggaagc

SEQ ID NO: 156548 - DNA, 15 bp, Homo sapiens
attcatccttggaag

SEQ ID NO: 156549 - DNA, 15 bp, Homo sapiens
gattcatccttggaa

SEQ ID NO: 156550 - DNA, 15 bp, Homo sapiens
agattcatccttgga

SEQ ID NO: 156551 - DNA, 15 bp, Homo sapiens
cagattcatccttgg

SEQ ID NO: 156552 - DNA, 15 bp, Homo sapiens
acagattcatccttg

SEQ ID NO: 156553 - DNA, 15 bp, Homo sapiens
cacagattcatcctt

SEQ ID NO: 156554 - DNA, 15 bp, Homo sapiens
tcacagattcatcct

SEQ ID NO: 156555 - DNA, 15 bp, Homo sapiens
ttcacagattcatcc

SEQ ID NO: 156556 - DNA, 15 bp, Homo sapiens
gttcacagattcatc

SEQ ID NO: 156557 - DNA, 15 bp, Homo sapiens
cgttcacagattcat

SEQ ID NO: 156558 - DNA, 15 bp, Homo sapiens
tcgttcacagattca

SEQ ID NO: 156559 - DNA, 15 bp, Homo sapiens
ttcgttcacagattc

SEQ ID NO: 156560 - DNA, 15 bp, Homo sapiens
tttcgttcacagatt

SEQ ID NO: 156561 - DNA, 15 bp, Homo sapiens
ttttcgttcacagat

SEQ ID NO: 156562 - DNA, 15 bp, Homo sapiens
cttttcgttcacaga

SEQ ID NO: 156563 - DNA, 15 bp, Homo sapiens
tcttttcgttcacag

SEQ ID NO: 156564 - DNA, 15 bp, Homo sapiens
ctcttttcgttcaca

SEQ ID NO: 156565 - DNA, 15 bp, Homo sapiens
actcttttcgttcac

SEQ ID NO: 156566 - DNA, 15 bp, Homo sapiens
gactcttttcgttca

SEQ ID NO: 156567 - DNA, 15 bp, Homo sapiens
tgactcttttcgttc

SEQ ID NO: 156568 - DNA, 15 bp, Homo sapiens
ttgactcttttcgtt

SEQ ID NO: 156569 - DNA, 15 bp, Homo sapiens
tttgactcttttcgt

SEQ ID NO: 156570 - DNA, 15 bp, Homo sapiens
gtttgactcttttcg

SEQ ID NO: 156571 - DNA, 15 bp, Homo sapiens
agtttgactcttttc

SEQ ID NO: 156572 - DNA, 15 bp, Homo sapiens
gagtttgactctttt

SEQ ID NO: 156573 - DNA, 15 bp, Homo sapiens
agagtttgactcttt

SEQ ID NO: 156574 - DNA, 15 bp, Homo sapiens
cagagtttgactctt

SEQ ID NO: 156575 - DNA, 15 bp, Homo sapiens
acagagtttgactct

SEQ ID NO: 156576 - DNA, 15 bp, Homo sapiens
tacagagtttgactc

SEQ ID NO: 156577 - DNA, 15 bp, Homo sapiens
ttacagagtttgact

SEQ ID NO: 156578 - DNA, 15 bp, Homo sapiens
attacagagtttgac

SEQ ID NO: 156579 - DNA, 15 bp, Homo sapiens
tattacagagtttga

SEQ ID NO: 156580 - DNA, 15 bp, Homo sapiens
atattacagagtttg

SEQ ID NO: 156581 - DNA, 15 bp, Homo sapiens
aatattacagagttt

SEQ ID NO: 156582 - DNA, 15 bp, Homo sapiens
aaatattacagagtt

SEQ ID NO: 156583 - DNA, 15 bp, Homo sapiens
caaatattacagagt

SEQ ID NO: 156584 - DNA, 15 bp, Homo sapiens
tcaaatattacagag

SEQ ID NO: 156585 - DNA, 15 bp, Homo sapiens
ttcaaatattacaga

SEQ ID NO: 156586 - DNA, 15 bp, Homo sapiens
cttcaaatattacag

SEQ ID NO: 156587 - DNA, 15 bp, Homo sapiens
tcttcaaatattaca

SEQ ID NO: 156588 - DNA, 15 bp, Homo sapiens
ctcttcaaatattac

SEQ ID NO: 156589 - DNA, 15 bp, Homo sapiens
tctcttcaaatatta

SEQ ID NO: 156590 - DNA, 15 bp, Homo sapiens
atctcttcaaatatt

SEQ ID NO: 156591 - DNA, 15 bp, Homo sapiens
aatctcttcaaatat

SEQ ID NO: 156592 - DNA, 15 bp, Homo sapiens
aaatctcttcaaata

SEQ ID NO: 156593 - DNA, 15 bp, Homo sapiens
taaatctcttcaaat

SEQ ID NO: 156594 - DNA, 15 bp, Homo sapiens
ataaatctcttcaaa

SEQ ID NO: 156595 - DNA, 15 bp, Homo sapiens
aataaatctcttcaa

SEQ ID NO: 156596 - DNA, 15 bp, Homo sapiens
gaataaatctcttca

SEQ ID NO: 156597 - DNA, 15 bp, Homo sapiens
ggaataaatctcttc

SEQ ID NO: 156598 - DNA, 15 bp, Homo sapiens
tggaataaatctctt

SEQ ID NO: 156599 - DNA, 15 bp, Homo sapiens
ttggaataaatctct

SEQ ID NO: 156600 - DNA, 15 bp, Homo sapiens
cttggaataaatctc

SEQ ID NO: 156601 - DNA, 15 bp, Homo sapiens
gcttggaataaatct

SEQ ID NO: 156602 - DNA, 15 bp, Homo sapiens
ggcttggaataaatc

SEQ ID NO: 156603 - DNA, 15 bp, Homo sapiens
tggcttggaataaat

SEQ ID NO: 156604 - DNA, 15 bp, Homo sapiens
ttggcttggaataaa

SEQ ID NO: 156605 - DNA, 15 bp, Homo sapiens
tttggcttggaataa

SEQ ID NO: 156606 - DNA, 15 bp, Homo sapiens
atttggcttggaata

SEQ ID NO: 156607 - DNA, 15 bp, Homo sapiens
tatttggcttggaat

SEQ ID NO: 156608 - DNA, 15 bp, Homo sapiens
atatttggcttggaa

SEQ ID NO: 156609 - DNA, 15 bp, Homo sapiens
catatttggcttgga

SEQ ID NO: 156610 - DNA, 15 bp, Homo sapiens
tcatatttggcttgg

SEQ ID NO: 156611 - DNA, 15 bp, Homo sapiens
ctcatatttggcttg

SEQ ID NO: 156612 - DNA, 15 bp, Homo sapiens
actcatatttggctt

SEQ ID NO: 156613 - DNA, 15 bp, Homo sapiens
cactcatatttggct

SEQ ID NO: 156614 - DNA, 15 bp, Homo sapiens
tcactcatatttggc

SEQ ID NO: 156615 - DNA, 15 bp, Homo sapiens
gtcactcatatttgg

SEQ ID NO: 156616 - DNA, 15 bp, Homo sapiens
ggtcactcatatttg

SEQ ID NO: 156617 - DNA, 15 bp, Homo sapiens
tggtcactcatattt

SEQ ID NO: 156618 - DNA, 15 bp, Homo sapiens
atggtcactcatatt

SEQ ID NO: 156619 - DNA, 15 bp, Homo sapiens
catggtcactcatat

SEQ ID NO: 156620 - DNA, 15 bp, Homo sapiens
ccatggtcactcata

SEQ ID NO: 156621 - DNA, 15 bp, Homo sapiens
gccatggtcactcat

SEQ ID NO: 156622 - DNA, 15 bp, Homo sapiens
ggccatggtcactca

SEQ ID NO: 156623 - DNA, 15 bp, Homo sapiens
gggccatggtcactc

SEQ ID NO: 156624 - DNA, 15 bp, Homo sapiens
tgggccatggtcact

SEQ ID NO: 156625 - DNA, 15 bp, Homo sapiens
atgggccatggtcac

SEQ ID NO: 156626 - DNA, 15 bp, Homo sapiens
catgggccatggtca

SEQ ID NO: 156627 - DNA, 15 bp, Homo sapiens
tcatgggccatggtc

SEQ ID NO: 156628 - DNA, 15 bp, Homo sapiens
gtcatgggccatggt

SEQ ID NO: 156629 - DNA, 15 bp, Homo sapiens
tgtcatgggccatgg

SEQ ID NO: 156630 - DNA, 15 bp, Homo sapiens
gtgtcatgggccatg

SEQ ID NO: 156631 - DNA, 15 bp, Homo sapiens
tgtgtcatgggccat

SEQ ID NO: 156632 - DNA, 15 bp, Homo sapiens
ctgtgtcatgggcca

SEQ ID NO: 156633 - DNA, 15 bp, Homo sapiens
gctgtgtcatgggcc

SEQ ID NO: 156634 - DNA, 15 bp, Homo sapiens
ggctgtgtcatgggc

SEQ ID NO: 156635 - DNA, 15 bp, Homo sapiens
gggctgtgtcatggg

SEQ ID NO: 156636 - DNA, 15 bp, Homo sapiens
ggggctgtgtcatgg

SEQ ID NO: 156637 - DNA, 15 bp, Homo sapiens
tggggctgtgtcatg

SEQ ID NO: 156638 - DNA, 15 bp, Homo sapiens
ctggggctgtgtcat

SEQ ID NO: 156639 - DNA, 15 bp, Homo sapiens
cctggggctgtgtca

SEQ ID NO: 156640 - DNA, 15 bp, Homo sapiens
tcctggggctgtgtc

SEQ ID NO: 156641 - DNA, 15 bp, Homo sapiens
ctcctggggctgtgt

SEQ ID NO: 156642 - DNA, 15 bp, Homo sapiens
tctcctggggctgtg

SEQ ID NO: 156643 - DNA, 15 bp, Homo sapiens
atctcctggggctgt

SEQ ID NO: 156644 - DNA, 15 bp, Homo sapiens
gatctcctggggctg

SEQ ID NO: 156645 - DNA, 15 bp, Homo sapiens
ggatctcctggggct

SEQ ID NO: 156646 - DNA, 15 bp, Homo sapiens
aggatctcctggggc

SEQ ID NO: 156647 - DNA, 15 bp, Homo sapiens
caggatctcctgggg

SEQ ID NO: 156648 - DNA, 15 bp, Homo sapiens
tcaggatctcctggg

SEQ ID NO: 156649 - DNA, 15 bp, Homo sapiens
atcaggatctcctgg

SEQ ID NO: 156650 - DNA, 15 bp, Homo sapiens
tatcaggatctcctg

SEQ ID NO: 156651 - DNA, 15 bp, Homo sapiens
ttatcaggatctcct

SEQ ID NO: 156652 - DNA, 15 bp, Homo sapiens
gttatcaggatctcc

SEQ ID NO: 156653 - DNA, 15 bp, Homo sapiens
tgttatcaggatctc

SEQ ID NO: 156654 - DNA, 15 bp, Homo sapiens
atgttatcaggatct

SEQ ID NO: 156655 - DNA, 15 bp, Homo sapiens
catgttatcaggatc

SEQ ID NO: 156656 - DNA, 15 bp, Homo sapiens
acatgttatcaggat

SEQ ID NO: 156657 - DNA, 15 bp, Homo sapiens
cacatgttatcagga

SEQ ID NO: 156658 - DNA, 15 bp, Homo sapiens
gcacatgttatcagg

SEQ ID NO: 156659 - DNA, 15 bp, Homo sapiens
ggcacatgttatcag

SEQ ID NO: 156660 - DNA, 15 bp, Homo sapiens
gggcacatgttatca

SEQ ID NO: 156661 - DNA, 15 bp, Homo sapiens
tgggcacatgttatc

SEQ ID NO: 156662 - DNA, 15 bp, Homo sapiens
ctgggcacatgttat

SEQ ID NO: 156663 - DNA, 15 bp, Homo sapiens
cctgggcacatgtta

SEQ ID NO: 156664 - DNA, 15 bp, Homo sapiens
ccctgggcacatgtt

SEQ ID NO: 156665 - DNA, 15 bp, Homo sapiens
accctgggcacatgt

SEQ ID NO: 156666 - DNA, 15 bp, Homo sapiens
caccctgggcacatg

SEQ ID NO: 156667 - DNA, 15 bp, Homo sapiens
tcaccctgggcacat

SEQ ID NO: 156668 - DNA, 15 bp, Homo sapiens
atcaccctgggcaca

SEQ ID NO: 156669 - DNA, 15 bp, Homo sapiens
gatcaccctgggcac

SEQ ID NO: 156670 - DNA, 15 bp, Homo sapiens
tgatcaccctgggca

SEQ ID NO: 156671 - DNA, 15 bp, Homo sapiens
ctgatcaccctgggc

SEQ ID NO: 156672 - DNA, 15 bp, Homo sapiens
cctgatcaccctggg

SEQ ID NO: 156673 - DNA, 15 bp, Homo sapiens
ccctgatcaccctgg

SEQ ID NO: 156674 - DNA, 15 bp, Homo sapiens
accctgatcaccctg

SEQ ID NO: 156675 - DNA, 15 bp, Homo sapiens
caccctgatcaccct

SEQ ID NO: 156676 - DNA, 15 bp, Homo sapiens
acaccctgatcaccc

SEQ ID NO: 156677 - DNA, 15 bp, Homo sapiens
tacaccctgatcacc

SEQ ID NO: 156678 - DNA, 15 bp, Homo sapiens
ctacaccctgatcac

SEQ ID NO: 156679 - DNA, 15 bp, Homo sapiens
gctacaccctgatca

SEQ ID NO: 156680 - DNA, 15 bp, Homo sapiens
tgctacaccctgatc

SEQ ID NO: 156681 - DNA, 15 bp, Homo sapiens
atgctacaccctgat

SEQ ID NO: 156682 - DNA, 15 bp, Homo sapiens
catgctacaccctga

SEQ ID NO: 156683 - DNA, 15 bp, Homo sapiens
ccatgctacaccctg

SEQ ID NO: 156684 - DNA, 15 bp, Homo sapiens
accatgctacaccct

SEQ ID NO: 156685 - DNA, 15 bp, Homo sapiens
aaccatgctacaccc

SEQ ID NO: 156686 - DNA, 15 bp, Homo sapiens
aaaccatgctacacc

SEQ ID NO: 156687 - DNA, 15 bp, Homo sapiens
aaaaccatgctacac

SEQ ID NO: 156688 - DNA, 15 bp, Homo sapiens
taaaaccatgctaca

SEQ ID NO: 156689 - DNA, 15 bp, Homo sapiens
ataaaaccatgctac

SEQ ID NO: 156690 - DNA, 15 bp, Homo sapiens
tataaaaccatgcta

SEQ ID NO: 156691 - DNA, 15 bp, Homo sapiens
gtataaaaccatgct

SEQ ID NO: 156692 - DNA, 15 bp, Homo sapiens
tgtataaaaccatgc

SEQ ID NO: 156693 - DNA, 15 bp, Homo sapiens
atgtataaaaccatg

SEQ ID NO: 156694 - DNA, 15 bp, Homo sapiens
aatgtataaaaccat

SEQ ID NO: 156695 - DNA, 15 bp, Homo sapiens
ttctccctaaaatgt

SEQ ID NO: 156696 - DNA, 15 bp, Homo sapiens
tttctccctaaaatg

SEQ ID NO: 156697 - DNA, 15 bp, Homo sapiens
ttttctccctaaaat

SEQ ID NO: 156698 - DNA, 15 bp, Homo sapiens
attttctccctaaaa

SEQ ID NO: 156699 - DNA, 15 bp, Homo sapiens
tattttctccctaaa

SEQ ID NO: 156700 - DNA, 15 bp, Homo sapiens
ctattttctccctaa

SEQ ID NO: 156701 - DNA, 15 bp, Homo sapiens
tctattttctcccta

SEQ ID NO: 156702 - DNA, 15 bp, Homo sapiens
gtctattttctccct

SEQ ID NO: 156703 - DNA, 15 bp, Homo sapiens
cgtctattttctccc

SEQ ID NO: 156704 - DNA, 15 bp, Homo sapiens
acgtctattttctcc

SEQ ID NO: 156705 - DNA, 15 bp, Homo sapiens
gacgtctattttctc

SEQ ID NO: 156706 - DNA, 15 bp, Homo sapiens
ggacgtctattttct

SEQ ID NO: 156707 - DNA, 15 bp, Homo sapiens
tggacgtctattttc

SEQ ID NO: 156708 - DNA, 15 bp, Homo sapiens
atggacgtctatttt

SEQ ID NO: 156709 - DNA, 15 bp, Homo sapiens
gatggacgtctattt

SEQ ID NO: 156710 - DNA, 15 bp, Homo sapiens
tgatggacgtctatt

SEQ ID NO: 156711 - DNA, 15 bp, Homo sapiens
ttgatggacgtctat

SEQ ID NO: 156712 - DNA, 15 bp, Homo sapiens
attgatggacgtcta

SEQ ID NO: 156713 - DNA, 15 bp, Homo sapiens
tattgatggacgtct

SEQ ID NO: 156714 - DNA, 15 bp, Homo sapiens
gtattgatggacgtc

SEQ ID NO: 156715 - DNA, 15 bp, Homo sapiens
cgtattgatggacgt

SEQ ID NO: 156716 - DNA, 15 bp, Homo sapiens
acgtattgatggacg

SEQ ID NO: 156717 - DNA, 15 bp, Homo sapiens
cacgtattgatggac

SEQ ID NO: 156718 - DNA, 15 bp, Homo sapiens
acacgtattgatgga

SEQ ID NO: 156719 - DNA, 15 bp, Homo sapiens
tacacgtattgatgg

SEQ ID NO: 156720 - DNA, 15 bp, Homo sapiens
ttacacgtattgatg

SEQ ID NO: 156721 - DNA, 15 bp, Homo sapiens
cttacacgtattgat

SEQ ID NO: 156722 - DNA, 15 bp, Homo sapiens
tcttacacgtattga

SEQ ID NO: 156723 - DNA, 15 bp, Homo sapiens
atcttacacgtattg

SEQ ID NO: 156724 - DNA, 15 bp, Homo sapiens
catcttacacgtatt

SEQ ID NO: 156725 - DNA, 15 bp, Homo sapiens
acatcttacacgtat

SEQ ID NO: 156726 - DNA, 15 bp, Homo sapiens
tacatcttacacgta

SEQ ID NO: 156727 - DNA, 15 bp, Homo sapiens
gtacatcttacacgt

SEQ ID NO: 156728 - DNA, 15 bp, Homo sapiens
tgtacatcttacacg

SEQ ID NO: 156729 - DNA, 15 bp, Homo sapiens
atgtacatcttacac

SEQ ID NO: 156730 - DNA, 15 bp, Homo sapiens
aatgtacatcttaca

SEQ ID NO: 156731 - DNA, 15 bp, Homo sapiens
caatgtacatcttac

SEQ ID NO: 156732 - DNA, 15 bp, Homo sapiens
ccaatgtacatctta

SEQ ID NO: 156733 - DNA, 15 bp, Homo sapiens
accaatgtacatctt

SEQ ID NO: 156734 - DNA, 15 bp, Homo sapiens
aaccaatgtacatct

SEQ ID NO: 156735 - DNA, 15 bp, Homo sapiens
aaaccaatgtacatc

SEQ ID NO: 156736 - DNA, 15 bp, Homo sapiens
caaaccaatgtacat

SEQ ID NO: 156737 - DNA, 15 bp, Homo sapiens
ccaaaccaatgtaca

SEQ ID NO: 156738 - DNA, 15 bp, Homo sapiens
accaaaccaatgtac

SEQ ID NO: 156739 - DNA, 15 bp, Homo sapiens
gaccaaaccaatgta

SEQ ID NO: 156740 - DNA, 15 bp, Homo sapiens
ggaccaaaccaatgt

SEQ ID NO: 156741 - DNA, 15 bp, Homo sapiens
tggaccaaaccaatg

SEQ ID NO: 156742 - DNA, 15 bp, Homo sapiens
ttggaccaaaccaat

SEQ ID NO: 156743 - DNA, 15 bp, Homo sapiens
tttggaccaaaccaa

SEQ ID NO: 156744 - DNA, 15 bp, Homo sapiens
ttttggaccaaacca

SEQ ID NO: 156745 - DNA, 15 bp, Homo sapiens
tttttggaccaaacc

SEQ ID NO: 156746 - DNA, 15 bp, Homo sapiens
ctttttggaccaaac

SEQ ID NO: 156747 - DNA, 15 bp, Homo sapiens
cctttttggaccaaa

SEQ ID NO: 156748 - DNA, 15 bp, Homo sapiens
gcctttttggaccaa

SEQ ID NO: 156749 - DNA, 15 bp, Homo sapiens
cgcctttttggacca

SEQ ID NO: 156750 - DNA, 15 bp, Homo sapiens
ccgcctttttggacc

SEQ ID NO: 156751 - DNA, 15 bp, Homo sapiens
cccgcctttttggac

SEQ ID NO: 156752 - DNA, 15 bp, Homo sapiens
tcccgcctttttgga

SEQ ID NO: 156753 - DNA, 15 bp, Homo sapiens
gtcccgcctttttgg

SEQ ID NO: 156754 - DNA, 15 bp, Homo sapiens
tgtcccgcctttttg

SEQ ID NO: 156755 - DNA, 15 bp, Homo sapiens
ttgtcccgccttttt

SEQ ID NO: 156756 - DNA, 15 bp, Homo sapiens
gttgtcccgcctttt

SEQ ID NO: 156757 - DNA, 15 bp, Homo sapiens
agttgtcccgccttt

SEQ ID NO: 156758 - DNA, 15 bp, Homo sapiens
aagttgtcccgcctt

SEQ ID NO: 156759 - DNA, 15 bp, Homo sapiens
caagttgtcccgcct

SEQ ID NO: 156760 - DNA, 15 bp, Homo sapiens
tcaagttgtcccgcc

SEQ ID NO: 156761 - DNA, 15 bp, Homo sapiens
ttcaagttgtcccgc

SEQ ID NO: 156762 - DNA, 15 bp, Homo sapiens
cttcaagttgtcccg

SEQ ID NO: 156763 - DNA, 15 bp, Homo sapiens
acttcaagttgtccc

SEQ ID NO: 156764 - DNA, 15 bp, Homo sapiens
cacttcaagttgtcc

SEQ ID NO: 156765 - DNA, 15 bp, Homo sapiens
ccacttcaagttgtc

SEQ ID NO: 156766 - DNA, 15 bp, Homo sapiens
gccacttcaagttgt

SEQ ID NO: 156767 - DNA, 15 bp, Homo sapiens
agccacttcaagttg

SEQ ID NO: 156768 - DNA, 15 bp, Homo sapiens
aagccacttcaagtt

SEQ ID NO: 156769 - DNA, 15 bp, Homo sapiens
gaagccacttcaagt

SEQ ID NO: 156770 - DNA, 15 bp, Homo sapiens
ggaagccacttcaag

SEQ ID NO: 156771 - DNA, 15 bp, Homo sapiens
tggaagccacttcaa

SEQ ID NO: 156772 - DNA, 15 bp, Homo sapiens
atggaagccacttca

SEQ ID NO: 156773 - DNA, 15 bp, Homo sapiens
catggaagccacttc

SEQ ID NO: 156774 - DNA, 15 bp, Homo sapiens
acatggaagccactt

SEQ ID NO: 156775 - DNA, 15 bp, Homo sapiens
gacatggaagccact

SEQ ID NO: 156776 - DNA, 15 bp, Homo sapiens
cgacatggaagccac

SEQ ID NO: 156777 - DNA, 15 bp, Homo sapiens
acgacatggaagcca

SEQ ID NO: 156778 - DNA, 15 bp, Homo sapiens
tacgacatggaagcc

SEQ ID NO: 156779 - DNA, 15 bp, Homo sapiens
ctacgacatggaagc

SEQ ID NO: 156780 - DNA, 15 bp, Homo sapiens
cctacgacatggaag

SEQ ID NO: 156781 - DNA, 15 bp, Homo sapiens
tcctacgacatggaa

SEQ ID NO: 156782 - DNA, 15 bp, Homo sapiens
ctcctacgacatgga

SEQ ID NO: 156783 - DNA, 15 bp, Homo sapiens
cctcctacgacatgg

SEQ ID NO: 156784 - DNA, 15 bp, Homo sapiens
tcctcctacgacatg

SEQ ID NO: 156785 - DNA, 15 bp, Homo sapiens
atcctcctacgacat

SEQ ID NO: 156786 - DNA, 15 bp, Homo sapiens
aatcctcctacgaca

SEQ ID NO: 156787 - DNA, 15 bp, Homo sapiens
gaatcctcctacgac

SEQ ID NO: 156788 - DNA, 15 bp, Homo sapiens
tgaatcctcctacga

SEQ ID NO: 156789 - DNA, 15 bp, Homo sapiens
ttgaatcctcctacg

SEQ ID NO: 156790 - DNA, 15 bp, Homo sapiens
tttgaatcctcctac

SEQ ID NO: 156791 - DNA, 15 bp, Homo sapiens
ctttgaatcctccta

SEQ ID NO: 156792 - DNA, 15 bp, Homo sapiens
tctttgaatcctcct

SEQ ID NO: 156793 - DNA, 15 bp, Homo sapiens
atctttgaatcctcc

SEQ ID NO: 156794 - DNA, 15 bp, Homo sapiens
aatctttgaatcctc

SEQ ID NO: 156795 - DNA, 15 bp, Homo sapiens
aaatctttgaatcct

SEQ ID NO: 156796 - DNA, 15 bp, Homo sapiens
aaaatctttgaatcc

SEQ ID NO: 156797 - DNA, 15 bp, Homo sapiens
gaaaatctttgaatc

SEQ ID NO: 156798 - DNA, 15 bp, Homo sapiens
agaaaatctttgaat

SEQ ID NO: 156799 - DNA, 15 bp, Homo sapiens
cagaaaatctttgaa

SEQ ID NO: 156800 - DNA, 15 bp, Homo sapiens
tcagaaaatctttga

SEQ ID NO: 156801 - DNA, 15 bp, Homo sapiens
atcagaaaatctttg

SEQ ID NO: 156802 - DNA, 15 bp, Homo sapiens
aatcagaaaatcttt

SEQ ID NO: 156803 - DNA, 15 bp, Homo sapiens
caatcagaaaatctt

SEQ ID NO: 156804 - DNA, 15 bp, Homo sapiens
ccaatcagaaaatct

SEQ ID NO: 156805 - DNA, 15 bp, Homo sapiens
gccaatcagaaaatc

SEQ ID NO: 156806 - DNA, 15 bp, Homo sapiens
tgccaatcagaaaat

SEQ ID NO: 156807 - DNA, 15 bp, Homo sapiens
ctgccaatcagaaaa

SEQ ID NO: 156808 - DNA, 15 bp, Homo sapiens
actgccaatcagaaa

SEQ ID NO: 156809 - DNA, 15 bp, Homo sapiens
aactgccaatcagaa

SEQ ID NO: 156810 - DNA, 15 bp, Homo sapiens
caactgccaatcaga

SEQ ID NO: 156811 - DNA, 15 bp, Homo sapiens
ccaactgccaatcag

SEQ ID NO: 156812 - DNA, 15 bp, Homo sapiens
accaactgccaatca

SEQ ID NO: 156813 - DNA, 15 bp, Homo sapiens
aaccaactgccaatc

SEQ ID NO: 156814 - DNA, 15 bp, Homo sapiens
caaccaactgccaat

SEQ ID NO: 156815 - DNA, 15 bp, Homo sapiens
tcaaccaactgccaa

SEQ ID NO: 156816 - DNA, 15 bp, Homo sapiens
ttcaaccaactgcca

SEQ ID NO: 156817 - DNA, 15 bp, Homo sapiens
tttcaaccaactgcc

SEQ ID NO: 156818 - DNA, 15 bp, Homo sapiens
ctttcaaccaactgc

SEQ ID NO: 156819 - DNA, 15 bp, Homo sapiens
tctttcaaccaactg

SEQ ID NO: 156820 - DNA, 15 bp, Homo sapiens
ctctttcaaccaact

SEQ ID NO: 156821 - DNA, 15 bp, Homo sapiens
actctttcaaccaac

SEQ ID NO: 156822 - DNA, 15 bp, Homo sapiens
aactctttcaaccaa

SEQ ID NO: 156823 - DNA, 15 bp, Homo sapiens
gaactctttcaacca

SEQ ID NO: 156824 - DNA, 15 bp, Homo sapiens
tgaactctttcaacc

SEQ ID NO: 156825 - DNA, 15 bp, Homo sapiens
atgaactctttcaac

SEQ ID NO: 156826 - DNA, 15 bp, Homo sapiens
gatgaactctttcaa

SEQ ID NO: 156827 - DNA, 15 bp, Homo sapiens
agatgaactctttca

SEQ ID NO: 156828 - DNA, 15 bp, Homo sapiens
tagatgaactctttc

SEQ ID NO: 156829 - DNA, 15 bp, Homo sapiens
ttagatgaactcttt

SEQ ID NO: 156830 - DNA, 15 bp, Homo sapiens
tttagatgaactctt

SEQ ID NO: 156831 - DNA, 15 bp, Homo sapiens
ctttagatgaactct

SEQ ID NO: 156832 - DNA, 15 bp, Homo sapiens
tctttagatgaactc

SEQ ID NO: 156833 - DNA, 15 bp, Homo sapiens
gtctttagatgaact

SEQ ID NO: 156834 - DNA, 15 bp, Homo sapiens
ggtctttagatgaac

SEQ ID NO: 156835 - DNA, 15 bp, Homo sapiens
aggtctttagatgaa

SEQ ID NO: 156836 - DNA, 15 bp, Homo sapiens
caggtctttagatga

SEQ ID NO: 156837 - DNA, 15 bp, Homo sapiens
ccaggtctttagatg

SEQ ID NO: 156838 - DNA, 15 bp, Homo sapiens
tccaggtctttagat

SEQ ID NO: 156839 - DNA, 15 bp, Homo sapiens
ttccaggtctttaga

SEQ ID NO: 156840 - DNA, 15 bp, Homo sapiens
attccaggtctttag

SEQ ID NO: 156841 - DNA, 15 bp, Homo sapiens
gattccaggtcttta

SEQ ID NO: 156842 - DNA, 15 bp, Homo sapiens
tgattccaggtcttt

SEQ ID NO: 156843 - DNA, 15 bp, Homo sapiens
ttgattccaggtctt

SEQ ID NO: 156844 - DNA, 15 bp, Homo sapiens
attgattccaggtct

SEQ ID NO: 156845 - DNA, 15 bp, Homo sapiens
gattgattccaggtc

SEQ ID NO: 156846 - DNA, 15 bp, Homo sapiens
cgattgattccaggt

SEQ ID NO: 156847 - DNA, 15 bp, Homo sapiens
tcgattgattccagg

SEQ ID NO: 156848 - DNA, 15 bp, Homo sapiens
ttcgattgattccag

SEQ ID NO: 156849 - DNA, 15 bp, Homo sapiens
cttcgattgattcca

SEQ ID NO: 156850 - DNA, 15 bp, Homo sapiens
ccttcgattgattcc

SEQ ID NO: 156851 - DNA, 15 bp, Homo sapiens
cccttcgattgattc

SEQ ID NO: 156852 - DNA, 15 bp, Homo sapiens
tcccttcgattgatt

SEQ ID NO: 156853 - DNA, 15 bp, Homo sapiens
ctcccttcgattgat

SEQ ID NO: 156854 - DNA, 15 bp, Homo sapiens
actcccttcgattga

SEQ ID NO: 156855 - DNA, 15 bp, Homo sapiens
cactcccttcgattg

SEQ ID NO: 156856 - DNA, 15 bp, Homo sapiens
acactcccttcgatt

SEQ ID NO: 156857 - DNA, 15 bp, Homo sapiens
gacactcccttcgat

SEQ ID NO: 156858 - DNA, 15 bp, Homo sapiens
agacactcccttcga

SEQ ID NO: 156859 - DNA, 15 bp, Homo sapiens
cagacactcccttcg

SEQ ID NO: 156860 - DNA, 15 bp, Homo sapiens
ccagacactcccttc

SEQ ID NO: 156861 - DNA, 15 bp, Homo sapiens
cccagacactccctt

SEQ ID NO: 156862 - DNA, 15 bp, Homo sapiens
acccagacactccct

SEQ ID NO: 156863 - DNA, 15 bp, Homo sapiens
aacccagacactccc

SEQ ID NO: 156864 - DNA, 15 bp, Homo sapiens
taacccagacactcc

SEQ ID NO: 156865 - DNA, 15 bp, Homo sapiens
ttaacccagacactc

SEQ ID NO: 156866 - DNA, 15 bp, Homo sapiens
cttaacccagacact

SEQ ID NO: 156867 - DNA, 15 bp, Homo sapiens
tcttaacccagacac

SEQ ID NO: 156868 - DNA, 15 bp, Homo sapiens
atcttaacccagaca

SEQ ID NO: 156869 - DNA, 15 bp, Homo sapiens
tatcttaacccagac

SEQ ID NO: 156870 - DNA, 15 bp, Homo sapiens
ttatcttaacccaga

SEQ ID NO: 156871 - DNA, 15 bp, Homo sapiens
cttatcttaacccag

SEQ ID NO: 156872 - DNA, 15 bp, Homo sapiens
ccttatcttaaccca

SEQ ID NO: 156873 - DNA, 15 bp, Homo sapiens
cccttatcttaaccc

SEQ ID NO: 156874 - DNA, 15 bp, Homo sapiens
ccccttatcttaacc

SEQ ID NO: 156875 - DNA, 15 bp, Homo sapiens
accccttatcttaac

SEQ ID NO: 156876 - DNA, 15 bp, Homo sapiens
aaccccttatcttaa

SEQ ID NO: 156877 - DNA, 15 bp, Homo sapiens
caaccccttatctta

SEQ ID NO: 156878 - DNA, 15 bp, Homo sapiens
gcaaccccttatctt

SEQ ID NO: 156879 - DNA, 15 bp, Homo sapiens
tgcaaccccttatct

SEQ ID NO: 156880 - DNA, 15 bp, Homo sapiens
ctgcaaccccttatc

SEQ ID NO: 156881 - DNA, 15 bp, Homo sapiens
tctgcaaccccttat

SEQ ID NO: 156882 - DNA, 15 bp, Homo sapiens
ctctgcaacccctta

SEQ ID NO: 156883 - DNA, 15 bp, Homo sapiens
tctctgcaacccctt

SEQ ID NO: 156884 - DNA, 15 bp, Homo sapiens
gtctctgcaacccct

SEQ ID NO: 156885 - DNA, 15 bp, Homo sapiens
ggtctctgcaacccc

SEQ ID NO: 156886 - DNA, 15 bp, Homo sapiens
tggtctctgcaaccc

SEQ ID NO: 156887 - DNA, 15 bp, Homo sapiens
ttggtctctgcaacc

SEQ ID NO: 156888 - DNA, 15 bp, Homo sapiens
cttggtctctgcaac

SEQ ID NO: 156889 - DNA, 15 bp, Homo sapiens
ccttggtctctgcaa

SEQ ID NO: 156890 - DNA, 15 bp, Homo sapiens
accttggtctctgca

SEQ ID NO: 156891 - DNA, 15 bp, Homo sapiens
aaccttggtctctgc

SEQ ID NO: 156892 - DNA, 15 bp, Homo sapiens
gaaccttggtctctg

SEQ ID NO: 156893 - DNA, 15 bp, Homo sapiens
agaaccttggtctct

SEQ ID NO: 156894 - DNA, 15 bp, Homo sapiens
aagaaccttggtctc

SEQ ID NO: 156895 - DNA, 15 bp, Homo sapiens
taagaaccttggtct

SEQ ID NO: 156896 - DNA, 15 bp, Homo sapiens
ataagaaccttggtc

SEQ ID NO: 156897 - DNA, 15 bp, Homo sapiens
aataagaaccttggt

SEQ ID NO: 156898 - DNA, 15 bp, Homo sapiens
taataagaaccttgg

SEQ ID NO: 156899 - DNA, 15 bp, Homo sapiens
ataataagaaccttg

SEQ ID NO: 156900 - DNA, 15 bp, Homo sapiens
aataataagaacctt

SEQ ID NO: 156901 - DNA, 15 bp, Homo sapiens
caataataagaacct

SEQ ID NO: 156902 - DNA, 15 bp, Homo sapiens
gcaataataagaacc

SEQ ID NO: 156903 - DNA, 15 bp, Homo sapiens
tgcaataataagaac

SEQ ID NO: 156904 - DNA, 15 bp, Homo sapiens
ctgcaataataagaa

SEQ ID NO: 156905 - DNA, 15 bp, Homo sapiens
tctgcaataataaga

SEQ ID NO: 156906 - DNA, 15 bp, Homo sapiens
atctgcaataataag

SEQ ID NO: 156907 - DNA, 15 bp, Homo sapiens
catctgcaataataa

SEQ ID NO: 156908 - DNA, 15 bp, Homo sapiens
tcatctgcaataata

SEQ ID NO: 156909 - DNA, 15 bp, Homo sapiens
ttcatctgcaataat

SEQ ID NO: 156910 - DNA, 15 bp, Homo sapiens
cttcatctgcaataa

SEQ ID NO: 156911 - DNA, 15 bp, Homo sapiens
gcttcatctgcaata

SEQ ID NO: 156912 - DNA, 15 bp, Homo sapiens
ggcttcatctgcaat

SEQ ID NO: 156913 - DNA, 15 bp, Homo sapiens
aggcttcatctgcaa

SEQ ID NO: 156914 - DNA, 15 bp, Homo sapiens
gaggcttcatctgca

SEQ ID NO: 156915 - DNA, 15 bp, Homo sapiens
agaggcttcatctgc

SEQ ID NO: 156916 - DNA, 15 bp, Homo sapiens
tagaggcttcatctg

SEQ ID NO: 156917 - DNA, 15 bp, Homo sapiens
ctagaggcttcatct

SEQ ID NO: 156918 - DNA, 15 bp, Homo sapiens
actagaggcttcatc

SEQ ID NO: 156919 - DNA, 15 bp, Homo sapiens
aactagaggcttcat

SEQ ID NO: 156920 - DNA, 15 bp, Homo sapiens
taactagaggcttca

SEQ ID NO: 156921 - DNA, 15 bp, Homo sapiens
ctaactagaggcttc

SEQ ID NO: 156922 - DNA, 15 bp, Homo sapiens
gctaactagaggctt

SEQ ID NO: 156923 - DNA, 15 bp, Homo sapiens
tgctaactagaggct

SEQ ID NO: 156924 - DNA, 15 bp, Homo sapiens
ctgctaactagaggc

SEQ ID NO: 156925 - DNA, 15 bp, Homo sapiens
cctgctaactagagg

SEQ ID NO: 156926 - DNA, 15 bp, Homo sapiens
gcctgctaactagag

SEQ ID NO: 156927 - DNA, 15 bp, Homo sapiens
agcctgctaactaga

SEQ ID NO: 156928 - DNA, 15 bp, Homo sapiens
aagcctgctaactag

SEQ ID NO: 156929 - DNA, 15 bp, Homo sapiens
gaagcctgctaacta

SEQ ID NO: 156930 - DNA, 15 bp, Homo sapiens
tgaagcctgctaact

SEQ ID NO: 156931 - DNA, 15 bp, Homo sapiens
ctgaagcctgctaac

SEQ ID NO: 156932 - DNA, 15 bp, Homo sapiens
tctgaagcctgctaa

SEQ ID NO: 156933 - DNA, 15 bp, Homo sapiens
ctctgaagcctgcta

SEQ ID NO: 156934 - DNA, 15 bp, Homo sapiens
tctctgaagcctgct

SEQ ID NO: 156935 - DNA, 15 bp, Homo sapiens
ctctctgaagcctgc

SEQ ID NO: 156936 - DNA, 15 bp, Homo sapiens
tctctctgaagcctg

SEQ ID NO: 156937 - DNA, 15 bp, Homo sapiens
ttctctctgaagcct

SEQ ID NO: 156938 - DNA, 15 bp, Homo sapiens
attctctctgaagcc

SEQ ID NO: 156939 - DNA, 15 bp, Homo sapiens
tattctctctgaagc

SEQ ID NO: 156940 - DNA, 15 bp, Homo sapiens
ctattctctctgaag

SEQ ID NO: 156941 - DNA, 15 bp, Homo sapiens
tctattctctctgaa

SEQ ID NO: 156942 - DNA, 15 bp, Homo sapiens
atctattctctctga

SEQ ID NO: 156943 - DNA, 15 bp, Homo sapiens
aatctattctctctg

SEQ ID NO: 156944 - DNA, 15 bp, Homo sapiens
caatctattctctct

SEQ ID NO: 156945 - DNA, 15 bp, Homo sapiens
acaatctattctctc

SEQ ID NO: 156946 - DNA, 15 bp, Homo sapiens
tacaatctattctct

SEQ ID NO: 156947 - DNA, 15 bp, Homo sapiens
ttacaatctattctc

SEQ ID NO: 156948 - DNA, 15 bp, Homo sapiens
tttacaatctattct

SEQ ID NO: 156949 - DNA, 15 bp, Homo sapiens
atttacaatctattc

SEQ ID NO: 156950 - DNA, 15 bp, Homo sapiens
catttacaatctatt

SEQ ID NO: 156951 - DNA, 15 bp, Homo sapiens
acatttacaatctat

SEQ ID NO: 156952 - DNA, 15 bp, Homo sapiens
aacatttacaatcta

SEQ ID NO: 156953 - DNA, 15 bp, Homo sapiens
aaacatttacaatct

SEQ ID NO: 156954 - DNA, 15 bp, Homo sapiens
gaaacatttacaatc

SEQ ID NO: 156955 - DNA, 15 bp, Homo sapiens
agaaacatttacaat

SEQ ID NO: 156956 - DNA, 15 bp, Homo sapiens
aagaaacatttacaa

SEQ ID NO: 156957 - DNA, 15 bp, Homo sapiens
taagaaacatttaca

SEQ ID NO: 156958 - DNA, 15 bp, Homo sapiens
ataagaaacatttac

SEQ ID NO: 156959 - DNA, 15 bp, Homo sapiens
gataagaaacattta

SEQ ID NO: 156960 - DNA, 15 bp, Homo sapiens
tgataagaaacattt

SEQ ID NO: 156961 - DNA, 15 bp, Homo sapiens
ctgataagaaacatt

SEQ ID NO: 156962 - DNA, 15 bp, Homo sapiens
tctgataagaaacat

SEQ ID NO: 156963 - DNA, 15 bp, Homo sapiens
gtctgataagaaaca

SEQ ID NO: 156964 - DNA, 15 bp, Homo sapiens
tgtctgataagaaac

SEQ ID NO: 156965 - DNA, 15 bp, Homo sapiens
atgtctgataagaaa

SEQ ID NO: 156966 - DNA, 15 bp, Homo sapiens
tatgtctgataagaa

SEQ ID NO: 156967 - DNA, 15 bp, Homo sapiens
ttatgtctgataaga

SEQ ID NO: 156968 - DNA, 15 bp, Homo sapiens
tttatgtctgataag

SEQ ID NO: 156969 - DNA, 15 bp, Homo sapiens
ttttatgtctgataa

SEQ ID NO: 156970 - DNA, 15 bp, Homo sapiens
tttttatgtctgata

SEQ ID NO: 156971 - DNA, 15 bp, Homo sapiens
gtttttatgtctgat

SEQ ID NO: 156972 - DNA, 15 bp, Homo sapiens
cgtttttatgtctga

SEQ ID NO: 156973 - DNA, 15 bp, Homo sapiens
acgtttttatgtctg

SEQ ID NO: 156974 - DNA, 15 bp, Homo sapiens
tacgtttttatgtct

SEQ ID NO: 156975 - DNA, 15 bp, Homo sapiens
gtacgtttttatgtc

SEQ ID NO: 156976 - DNA, 15 bp, Homo sapiens
ggtacgtttttatgt

SEQ ID NO: 156977 - DNA, 15 bp, Homo sapiens
tggtacgtttttatg

SEQ ID NO: 156978 - DNA, 15 bp, Homo sapiens
ctggtacgtttttat

SEQ ID NO: 156979 - DNA, 15 bp, Homo sapiens
tctggtacgttttta

SEQ ID NO: 156980 - DNA, 15 bp, Homo sapiens
gtctggtacgttttt

SEQ ID NO: 156981 - DNA, 15 bp, Homo sapiens
agtctggtacgtttt

SEQ ID NO: 156982 - DNA, 15 bp, Homo sapiens
gagtctggtacgttt

SEQ ID NO: 156983 - DNA, 15 bp, Homo sapiens
agagtctggtacgtt

SEQ ID NO: 156984 - DNA, 15 bp, Homo sapiens
aagagtctggtacgt

SEQ ID NO: 156985 - DNA, 15 bp, Homo sapiens
taagagtctggtacg

SEQ ID NO: 156986 - DNA, 15 bp, Homo sapiens
ttaagagtctggtac

SEQ ID NO: 156987 - DNA, 15 bp, Homo sapiens
attaagagtctggta

SEQ ID NO: 156988 - DNA, 15 bp, Homo sapiens
aattaagagtctggt

SEQ ID NO: 156989 - DNA, 15 bp, Homo sapiens
taattaagagtctgg

SEQ ID NO: 156990 - DNA, 15 bp, Homo sapiens
ttaattaagagtctg

SEQ ID NO: 156991 - DNA, 15 bp, Homo sapiens
attaattaagagtct

SEQ ID NO: 156992 - DNA, 15 bp, Homo sapiens
aattaattaagagtc

SEQ ID NO: 156993 - DNA, 15 bp, Homo sapiens
gaattaattaagagt

SEQ ID NO: 156994 - DNA, 15 bp, Homo sapiens
agaattaattaagag

SEQ ID NO: 156995 - DNA, 15 bp, Homo sapiens
gagaattaattaaga

SEQ ID NO: 156996 - DNA, 15 bp, Homo sapiens
agagaattaattaag

SEQ ID NO: 156997 - DNA, 15 bp, Homo sapiens
gagagaattaattaa

SEQ ID NO: 156998 - DNA, 15 bp, Homo sapiens
ggagagaattaatta

SEQ ID NO: 156999 - DNA, 15 bp, Homo sapiens
aggagagaattaatt

SEQ ID NO: 157000 - DNA, 15 bp, Homo sapiens
caggagagaattaat

SEQ ID NO: 157001 - DNA, 15 bp, Homo sapiens
ccaggagagaattaa

SEQ ID NO: 157002 - DNA, 15 bp, Homo sapiens
tccaggagagaatta

SEQ ID NO: 157003 - DNA, 15 bp, Homo sapiens
atccaggagagaatt

SEQ ID NO: 157004 - DNA, 15 bp, Homo sapiens
tatccaggagagaat

SEQ ID NO: 157005 - DNA, 15 bp, Homo sapiens
ctatccaggagagaa

SEQ ID NO: 157006 - DNA, 15 bp, Homo sapiens
cctatccaggagaga

SEQ ID NO: 157007 - DNA, 15 bp, Homo sapiens
ccctatccaggagag

SEQ ID NO: 157008 - DNA, 15 bp, Homo sapiens
tccctatccaggaga

SEQ ID NO: 157009 - DNA, 15 bp, Homo sapiens
ttccctatccaggag

SEQ ID NO: 157010 - DNA, 15 bp, Homo sapiens
tttccctatccagga

SEQ ID NO: 157011 - DNA, 15 bp, Homo sapiens
ttttccctatccagg

SEQ ID NO: 157012 - DNA, 15 bp, Homo sapiens
tttttccctatccag

SEQ ID NO: 157013 - DNA, 15 bp, Homo sapiens
ctttttccctatcca

SEQ ID NO: 157014 - DNA, 15 bp, Homo sapiens
tctttttccctatcc

SEQ ID NO: 157015 - DNA, 15 bp, Homo sapiens
gtctttttccctatc

SEQ ID NO: 157016 - DNA, 15 bp, Homo sapiens
ggtctttttccctat

SEQ ID NO: 157017 - DNA, 15 bp, Homo sapiens
aggtctttttcccta

SEQ ID NO: 157018 - DNA, 15 bp, Homo sapiens
caggtctttttccct

SEQ ID NO: 157019 - DNA, 15 bp, Homo sapiens
ccaggtctttttccc

SEQ ID NO: 157020 - DNA, 15 bp, Homo sapiens
tccaggtctttttcc

SEQ ID NO: 157021 - DNA, 15 bp, Homo sapiens
ttccaggtctttttc

SEQ ID NO: 157022 - DNA, 15 bp, Homo sapiens
tttccaggtcttttt

SEQ ID NO: 157023 - DNA, 15 bp, Homo sapiens
ctttccaggtctttt

SEQ ID NO: 157024 - DNA, 15 bp, Homo sapiens
cctttccaggtcttt

SEQ ID NO: 157025 - DNA, 15 bp, Homo sapiens
ccctttccaggtctt

SEQ ID NO: 157026 - DNA, 15 bp, Homo sapiens
tccctttccaggtct

SEQ ID NO: 157027 - DNA, 15 bp, Homo sapiens
ttccctttccaggtc

SEQ ID NO: 157028 - DNA, 15 bp, Homo sapiens
cttccctttccaggt

SEQ ID NO: 157029 - DNA, 15 bp, Homo sapiens
ccttccctttccagg

SEQ ID NO: 157030 - DNA, 15 bp, Homo sapiens
cccttccctttccag

SEQ ID NO: 157031 - DNA, 15 bp, Homo sapiens
ccccttccctttcca

SEQ ID NO: 157032 - DNA, 15 bp, Homo sapiens
tccccttccctttcc

SEQ ID NO: 157033 - DNA, 15 bp, Homo sapiens
atccccttccctttc

SEQ ID NO: 157034 - DNA, 15 bp, Homo sapiens
aatccccttcccttt

SEQ ID NO: 157035 - DNA, 15 bp, Homo sapiens
gaatccccttccctt

SEQ ID NO: 157036 - DNA, 15 bp, Homo sapiens
agaatccccttccct

SEQ ID NO: 157037 - DNA, 15 bp, Homo sapiens
gagaatccccttccc

SEQ ID NO: 157038 - DNA, 15 bp, Homo sapiens
agagaatccccttcc

SEQ ID NO: 157039 - DNA, 15 bp, Homo sapiens
tagagaatccccttc

SEQ ID NO: 157040 - DNA, 15 bp, Homo sapiens
atagagaatcccctt

SEQ ID NO: 157041 - DNA, 15 bp, Homo sapiens
catagagaatcccct

SEQ ID NO: 157042 - DNA, 15 bp, Homo sapiens
ccatagagaatcccc

SEQ ID NO: 157043 - DNA, 15 bp, Homo sapiens
tccatagagaatccc

SEQ ID NO: 157044 - DNA, 15 bp, Homo sapiens
ttccatagagaatcc

SEQ ID NO: 157045 - DNA, 15 bp, Homo sapiens
attccatagagaatc

SEQ ID NO: 157046 - DNA, 15 bp, Homo sapiens
cattccatagagaat

SEQ ID NO: 157047 - DNA, 15 bp, Homo sapiens
acattccatagagaa

SEQ ID NO: 157048 - DNA, 15 bp, Homo sapiens
tacattccatagaga

SEQ ID NO: 157049 - DNA, 15 bp, Homo sapiens
ctacattccatagag

SEQ ID NO: 157050 - DNA, 15 bp, Homo sapiens
tctacattccataga

SEQ ID NO: 157051 - DNA, 15 bp, Homo sapiens
atctacattccatag

SEQ ID NO: 157052 - DNA, 15 bp, Homo sapiens
aatctacattccata

SEQ ID NO: 157053 - DNA, 15 bp, Homo sapiens
aaatctacattccat

SEQ ID NO: 157054 - DNA, 15 bp, Homo sapiens
aaaatctacattcca

SEQ ID NO: 157055 - DNA, 15 bp, Homo sapiens
gaaaatctacattcc

SEQ ID NO: 157056 - DNA, 15 bp, Homo sapiens
ggaaaatctacattc

SEQ ID NO: 157057 - DNA, 15 bp, Homo sapiens
gggaaaatctacatt

SEQ ID NO: 157058 - DNA, 15 bp, Homo sapiens
ggggaaaatctacat

SEQ ID NO: 157059 - DNA, 15 bp, Homo sapiens
tggggaaaatctaca

SEQ ID NO: 157060 - DNA, 15 bp, Homo sapiens
ctggggaaaatctac

SEQ ID NO: 157061 - DNA, 15 bp, Homo sapiens
tctggggaaaatcta

SEQ ID NO: 157062 - DNA, 15 bp, Homo sapiens
ttctggggaaaatct

SEQ ID NO: 157063 - DNA, 15 bp, Homo sapiens
cttctggggaaaatc

SEQ ID NO: 157064 - DNA, 15 bp, Homo sapiens
tcttctggggaaaat

SEQ ID NO: 157065 - DNA, 15 bp, Homo sapiens
ctcttctggggaaaa

SEQ ID NO: 157066 - DNA, 15 bp, Homo sapiens
tctcttctggggaaa

SEQ ID NO: 157067 - DNA, 15 bp, Homo sapiens
gtctcttctggggaa

SEQ ID NO: 157068 - DNA, 15 bp, Homo sapiens
tgtctcttctgggga

SEQ ID NO: 157069 - DNA, 15 bp, Homo sapiens
ctgtctcttctgggg

SEQ ID NO: 157070 - DNA, 15 bp, Homo sapiens
gctgtctcttctggg

SEQ ID NO: 157071 - DNA, 15 bp, Homo sapiens
agctgtctcttctgg

SEQ ID NO: 157072 - DNA, 15 bp, Homo sapiens
aagctgtctcttctg

SEQ ID NO: 157073 - DNA, 15 bp, Homo sapiens
aaagctgtctcttct

SEQ ID NO: 157074 - DNA, 15 bp, Homo sapiens
caaagctgtctcttc

SEQ ID NO: 157075 - DNA, 15 bp, Homo sapiens
gcaaagctgtctctt

SEQ ID NO: 157076 - DNA, 15 bp, Homo sapiens
tgcaaagctgtctct

SEQ ID NO: 157077 - DNA, 15 bp, Homo sapiens
ctgcaaagctgtctc

SEQ ID NO: 157078 - DNA, 15 bp, Homo sapiens
cctgcaaagctgtct

SEQ ID NO: 157079 - DNA, 15 bp, Homo sapiens
ccctgcaaagctgtc

SEQ ID NO: 157080 - DNA, 15 bp, Homo sapiens
cccctgcaaagctgt

SEQ ID NO: 157081 - DNA, 15 bp, Homo sapiens
acccctgcaaagctg

SEQ ID NO: 157082 - DNA, 15 bp, Homo sapiens
tacccctgcaaagct

SEQ ID NO: 157083 - DNA, 15 bp, Homo sapiens
atacccctgcaaagc

SEQ ID NO: 157084 - DNA, 15 bp, Homo sapiens
aatacccctgcaaag

SEQ ID NO: 157085 - DNA, 15 bp, Homo sapiens
aaatacccctgcaaa

SEQ ID NO: 157086 - DNA, 15 bp, Homo sapiens
gaaatacccctgcaa

SEQ ID NO: 157087 - DNA, 15 bp, Homo sapiens
tgaaatacccctgca

SEQ ID NO: 157088 - DNA, 15 bp, Homo sapiens
ttgaaatacccctgc

SEQ ID NO: 157089 - DNA, 15 bp, Homo sapiens
tttgaaatacccctg

SEQ ID NO: 157090 - DNA, 15 bp, Homo sapiens
ttttgaaatacccct

SEQ ID NO: 157091 - DNA, 15 bp, Homo sapiens
attttgaaatacccc

SEQ ID NO: 157092 - DNA, 15 bp, Homo sapiens
tattttgaaataccc

SEQ ID NO: 157093 - DNA, 15 bp, Homo sapiens
atattttgaaatacc

SEQ ID NO: 157094 - DNA, 15 bp, Homo sapiens
catattttgaaatac

SEQ ID NO: 157095 - DNA, 15 bp, Homo sapiens
acatattttgaaata

SEQ ID NO: 157096 - DNA, 15 bp, Homo sapiens
gacatattttgaaat

SEQ ID NO: 157097 - DNA, 15 bp, Homo sapiens
tgacatattttgaaa

SEQ ID NO: 157098 - DNA, 15 bp, Homo sapiens
ttgacatattttgaa

SEQ ID NO: 157099 - DNA, 15 bp, Homo sapiens
tttgacatattttga

SEQ ID NO: 157100 - DNA, 15 bp, Homo sapiens
ctttgacatattttg

SEQ ID NO: 157101 - DNA, 15 bp, Homo sapiens
tctttgacatatttt

SEQ ID NO: 157102 - DNA, 15 bp, Homo sapiens
ttctttgacatattt

SEQ ID NO: 157103 - DNA, 15 bp, Homo sapiens
tttctttgacatatt

SEQ ID NO: 157104 - DNA, 15 bp, Homo sapiens
atttctttgacatat

SEQ ID NO: 157105 - DNA, 15 bp, Homo sapiens
tatttctttgacata

SEQ ID NO: 157106 - DNA, 15 bp, Homo sapiens
atatttctttgacat

SEQ ID NO: 157107 - DNA, 15 bp, Homo sapiens
tatatttctttgaca

SEQ ID NO: 157108 - DNA, 15 bp, Homo sapiens
atatatttctttgac

SEQ ID NO: 157109 - DNA, 15 bp, Homo sapiens
aatatatttctttga

SEQ ID NO: 157110 - DNA, 15 bp, Homo sapiens
aaatatatttctttg

SEQ ID NO: 157111 - DNA, 15 bp, Homo sapiens
aaaatatatttcttt

SEQ ID NO: 157112 - DNA, 15 bp, Homo sapiens
caaaatatatttctt

SEQ ID NO: 157113 - DNA, 15 bp, Homo sapiens
ccaaaatatatttct

SEQ ID NO: 157114 - DNA, 15 bp, Homo sapiens
cccaaaatatatttc

SEQ ID NO: 157115 - DNA, 15 bp, Homo sapiens
ccccaaaatatattt

SEQ ID NO: 157116 - DNA, 15 bp, Homo sapiens
accccaaaatatatt

SEQ ID NO: 157117 - DNA, 15 bp, Homo sapiens
taccccaaaatatat

SEQ ID NO: 157118 - DNA, 15 bp, Homo sapiens
ttaccccaaaatata

SEQ ID NO: 157119 - DNA, 15 bp, Homo sapiens
tttaccccaaaatat

SEQ ID NO: 157120 - DNA, 15 bp, Homo sapiens
ttttaccccaaaata

SEQ ID NO: 157121 - DNA, 15 bp, Homo sapiens
attttaccccaaaat

SEQ ID NO: 157122 - DNA, 15 bp, Homo sapiens
tattttaccccaaaa

SEQ ID NO: 157123 - DNA, 15 bp, Homo sapiens
gtattttaccccaaa

SEQ ID NO: 157124 - DNA, 15 bp, Homo sapiens
agtattttaccccaa

SEQ ID NO: 157125 - DNA, 15 bp, Homo sapiens
aagtattttacccca

SEQ ID NO: 157126 - DNA, 15 bp, Homo sapiens
taagtattttacccc

SEQ ID NO: 157127 - DNA, 15 bp, Homo sapiens
gtaagtattttaccc

SEQ ID NO: 157128 - DNA, 15 bp, Homo sapiens
tgtaagtattttacc

SEQ ID NO: 157129 - DNA, 15 bp, Homo sapiens
atgtaagtattttac

SEQ ID NO: 157130 - DNA, 15 bp, Homo sapiens
aatgtaagtatttta

SEQ ID NO: 157131 - DNA, 15 bp, Homo sapiens
aaatgtaagtatttt

SEQ ID NO: 157132 - DNA, 15 bp, Homo sapiens
gaaatgtaagtattt

SEQ ID NO: 157133 - DNA, 15 bp, Homo sapiens
agaaatgtaagtatt

SEQ ID NO: 157134 - DNA, 15 bp, Homo sapiens
aagaaatgtaagtat

SEQ ID NO: 157135 - DNA, 15 bp, Homo sapiens
aaagaaatgtaagta

SEQ ID NO: 157136 - DNA, 15 bp, Homo sapiens
gaaagaaatgtaagt

SEQ ID NO: 157137 - DNA, 15 bp, Homo sapiens
tgaaagaaatgtaag

SEQ ID NO: 157138 - DNA, 15 bp, Homo sapiens
ctgaaagaaatgtaa

SEQ ID NO: 157139 - DNA, 15 bp, Homo sapiens
cctgaaagaaatgta

SEQ ID NO: 157140 - DNA, 15 bp, Homo sapiens
ccctgaaagaaatgt

SEQ ID NO: 157141 - DNA, 15 bp, Homo sapiens
gccctgaaagaaatg

SEQ ID NO: 157142 - DNA, 15 bp, Homo sapiens
ggccctgaaagaaat

SEQ ID NO: 157143 - DNA, 15 bp, Homo sapiens
aggccctgaaagaaa

SEQ ID NO: 157144 - DNA, 15 bp, Homo sapiens
caggccctgaaagaa

SEQ ID NO: 157145 - DNA, 15 bp, Homo sapiens
gcaggccctgaaaga

SEQ ID NO: 157146 - DNA, 15 bp, Homo sapiens
agcaggccctgaaag

SEQ ID NO: 157147 - DNA, 15 bp, Homo sapiens
tagcaggccctgaaa

SEQ ID NO: 157148 - DNA, 15 bp, Homo sapiens
atagcaggccctgaa

SEQ ID NO: 157149 - DNA, 15 bp, Homo sapiens
gatagcaggccctga

SEQ ID NO: 157150 - DNA, 15 bp, Homo sapiens
agatagcaggccctg

SEQ ID NO: 157151 - DNA, 15 bp, Homo sapiens
cagatagcaggccct

SEQ ID NO: 157152 - DNA, 15 bp, Homo sapiens
acagatagcaggccc

SEQ ID NO: 157153 - DNA, 15 bp, Homo sapiens
gacagatagcaggcc

SEQ ID NO: 157154 - DNA, 15 bp, Homo sapiens
tgacagatagcaggc

SEQ ID NO: 157155 - DNA, 15 bp, Homo sapiens
atgacagatagcagg

SEQ ID NO: 157156 - DNA, 15 bp, Homo sapiens
catgacagatagcag

SEQ ID NO: 157157 - DNA, 15 bp, Homo sapiens
acatgacagatagca

SEQ ID NO: 157158 - DNA, 15 bp, Homo sapiens
aacatgacagatagc

SEQ ID NO: 157159 - DNA, 15 bp, Homo sapiens
caacatgacagatag

SEQ ID NO: 157160 - DNA, 15 bp, Homo sapiens
tcaacatgacagata

SEQ ID NO: 157161 - DNA, 15 bp, Homo sapiens
atcaacatgacagat

SEQ ID NO: 157162 - DNA, 15 bp, Homo sapiens
tatcaacatgacaga

SEQ ID NO: 157163 - DNA, 15 bp, Homo sapiens
atatcaacatgacag

SEQ ID NO: 157164 - DNA, 15 bp, Homo sapiens
gatatcaacatgaca

SEQ ID NO: 157165 - DNA, 15 bp, Homo sapiens
agatatcaacatgac

SEQ ID NO: 157166 - DNA, 15 bp, Homo sapiens
aagatatcaacatga

SEQ ID NO: 157167 - DNA, 15 bp, Homo sapiens
caagatatcaacatg

SEQ ID NO: 157168 - DNA, 15 bp, Homo sapiens
acaagatatcaacat

SEQ ID NO: 157169 - DNA, 15 bp, Homo sapiens
aacaagatatcaaca

SEQ ID NO: 157170 - DNA, 15 bp, Homo sapiens
taacaagatatcaac

SEQ ID NO: 157171 - DNA, 15 bp, Homo sapiens
gtaacaagatatcaa

SEQ ID NO: 157172 - DNA, 15 bp, Homo sapiens
agtaacaagatatca

SEQ ID NO: 157173 - DNA, 15 bp, Homo sapiens
tagtaacaagatatc

SEQ ID NO: 157174 - DNA, 15 bp, Homo sapiens
ctagtaacaagatat

SEQ ID NO: 157175 - DNA, 15 bp, Homo sapiens
tctagtaacaagata

SEQ ID NO: 157176 - DNA, 15 bp, Homo sapiens
ctctagtaacaagat

SEQ ID NO: 157177 - DNA, 15 bp, Homo sapiens
tctctagtaacaaga

SEQ ID NO: 157178 - DNA, 15 bp, Homo sapiens
ctctctagtaacaag

SEQ ID NO: 157179 - DNA, 15 bp, Homo sapiens
tctctctagtaacaa

SEQ ID NO: 157180 - DNA, 15 bp, Homo sapiens
ctctctctagtaaca

SEQ ID NO: 157181 - DNA, 15 bp, Homo sapiens
actctctctagtaac

SEQ ID NO: 157182 - DNA, 15 bp, Homo sapiens
gactctctctagtaa

SEQ ID NO: 157183 - DNA, 15 bp, Homo sapiens
agactctctctagta

SEQ ID NO: 157184 - DNA, 15 bp, Homo sapiens
cagactctctctagt

SEQ ID NO: 157185 - DNA, 15 bp, Homo sapiens
acagactctctctag

SEQ ID NO: 157186 - DNA, 15 bp, Homo sapiens
aacagactctctcta

SEQ ID NO: 157187 - DNA, 15 bp, Homo sapiens
aaacagactctctct

SEQ ID NO: 157188 - DNA, 15 bp, Homo sapiens
aaaacagactctctc

SEQ ID NO: 157189 - DNA, 15 bp, Homo sapiens
caaaacagactctct

SEQ ID NO: 157190 - DNA, 15 bp, Homo sapiens
acaaaacagactctc

SEQ ID NO: 157191 - DNA, 15 bp, Homo sapiens
gacaaaacagactct

SEQ ID NO: 157192 - DNA, 15 bp, Homo sapiens
tgacaaaacagactc

SEQ ID NO: 157193 - DNA, 15 bp, Homo sapiens
ttgacaaaacagact

SEQ ID NO: 157194 - DNA, 15 bp, Homo sapiens
attgacaaaacagac

SEQ ID NO: 157195 - DNA, 15 bp, Homo sapiens
gattgacaaaacaga

SEQ ID NO: 157196 - DNA, 15 bp, Homo sapiens
tgattgacaaaacag

SEQ ID NO: 157197 - DNA, 15 bp, Homo sapiens
atgattgacaaaaca

SEQ ID NO: 157198 - DNA, 15 bp, Homo sapiens
tatgattgacaaaac

SEQ ID NO: 157199 - DNA, 15 bp, Homo sapiens
ttatgattgacaaaa

SEQ ID NO: 157200 - DNA, 15 bp, Homo sapiens
cttatgattgacaaa

SEQ ID NO: 157201 - DNA, 15 bp, Homo sapiens
ccttatgattgacaa

SEQ ID NO: 157202 - DNA, 15 bp, Homo sapiens
accttatgattgaca

SEQ ID NO: 157203 - DNA, 15 bp, Homo sapiens
gaccttatgattgac

SEQ ID NO: 157204 - DNA, 15 bp, Homo sapiens
cgaccttatgattga

SEQ ID NO: 157205 - DNA, 15 bp, Homo sapiens
gcgaccttatgattg

SEQ ID NO: 157206 - DNA, 15 bp, Homo sapiens
agcgaccttatgatt

SEQ ID NO: 157207 - DNA, 15 bp, Homo sapiens
cagcgaccttatgat

SEQ ID NO: 157208 - DNA, 15 bp, Homo sapiens
acagcgaccttatga

SEQ ID NO: 157209 - DNA, 15 bp, Homo sapiens
tacagcgaccttatg

SEQ ID NO: 157210 - DNA, 15 bp, Homo sapiens
atacagcgaccttat

SEQ ID NO: 157211 - DNA, 15 bp, Homo sapiens
aatacagcgacctta

SEQ ID NO: 157212 - DNA, 15 bp, Homo sapiens
taatacagcgacctt

SEQ ID NO: 157213 - DNA, 15 bp, Homo sapiens
ttaatacagcgacct

SEQ ID NO: 157214 - DNA, 15 bp, Homo sapiens
attaatacagcgacc

SEQ ID NO: 157215 - DNA, 15 bp, Homo sapiens
cattaatacagcgac

SEQ ID NO: 157216 - DNA, 15 bp, Homo sapiens
acattaatacagcga

SEQ ID NO: 157217 - DNA, 15 bp, Homo sapiens
aacattaatacagcg

SEQ ID NO: 157218 - DNA, 15 bp, Homo sapiens
taacattaatacagc

SEQ ID NO: 157219 - DNA, 15 bp, Homo sapiens
ttaacattaatacag

SEQ ID NO: 157220 - DNA, 15 bp, Homo sapiens
attaacattaataca

SEQ ID NO: 157221 - DNA, 15 bp, Homo sapiens
cattaacattaatac

SEQ ID NO: 157222 - DNA, 15 bp, Homo sapiens
gcattaacattaata

SEQ ID NO: 157223 - DNA, 15 bp, Homo sapiens
agcattaacattaat

SEQ ID NO: 157224 - DNA, 15 bp, Homo sapiens
tagcattaacattaa

SEQ ID NO: 157225 - DNA, 15 bp, Homo sapiens
ctagcattaacatta

SEQ ID NO: 157226 - DNA, 15 bp, Homo sapiens
actagcattaacatt

SEQ ID NO: 157227 - DNA, 15 bp, Homo sapiens
gactagcattaacat

SEQ ID NO: 157228 - DNA, 15 bp, Homo sapiens
tgactagcattaaca

SEQ ID NO: 157229 - DNA, 15 bp, Homo sapiens
ctgactagcattaac

SEQ ID NO: 157230 - DNA, 15 bp, Homo sapiens
gctgactagcattaa

SEQ ID NO: 157231 - DNA, 15 bp, Homo sapiens
agctgactagcatta

SEQ ID NO: 157232 - DNA, 15 bp, Homo sapiens
cagctgactagcatt

SEQ ID NO: 157233 - DNA, 15 bp, Homo sapiens
acagctgactagcat

SEQ ID NO: 157234 - DNA, 15 bp, Homo sapiens
cacagctgactagca

SEQ ID NO: 157235 - DNA, 15 bp, Homo sapiens
gcacagctgactagc

SEQ ID NO: 157236 - DNA, 15 bp, Homo sapiens
ggcacagctgactag

SEQ ID NO: 157237 - DNA, 15 bp, Homo sapiens
aggcacagctgacta

SEQ ID NO: 157238 - DNA, 15 bp, Homo sapiens
caggcacagctgact

SEQ ID NO: 157239 - DNA, 15 bp, Homo sapiens
tcaggcacagctgac

SEQ ID NO: 157240 - DNA, 15 bp, Homo sapiens
ttcaggcacagctga

SEQ ID NO: 157241 - DNA, 15 bp, Homo sapiens
attcaggcacagctg

SEQ ID NO: 157242 - DNA, 15 bp, Homo sapiens
aattcaggcacagct

SEQ ID NO: 157243 - DNA, 15 bp, Homo sapiens
gaattcaggcacagc

SEQ ID NO: 157244 - DNA, 15 bp, Homo sapiens
ggaattcaggcacag

SEQ ID NO: 157245 - DNA, 15 bp, Homo sapiens
tggaattcaggcaca

SEQ ID NO: 157246 - DNA, 15 bp, Homo sapiens
ttggaattcaggcac

SEQ ID NO: 157247 - DNA, 15 bp, Homo sapiens
tttggaattcaggca

SEQ ID NO: 157248 - DNA, 15 bp, Homo sapiens
ctttggaattcaggc

SEQ ID NO: 157249 - DNA, 15 bp, Homo sapiens
tctttggaattcagg

SEQ ID NO: 157250 - DNA, 15 bp, Homo sapiens
ctctttggaattcag

SEQ ID NO: 157251 - DNA, 15 bp, Homo sapiens
tctctttggaattca

SEQ ID NO: 157252 - DNA, 15 bp, Homo sapiens
ctctctttggaattc

SEQ ID NO: 157253 - DNA, 15 bp, Homo sapiens
cctctctttggaatt

SEQ ID NO: 157254 - DNA, 15 bp, Homo sapiens
tcctctctttggaat

SEQ ID NO: 157255 - DNA, 15 bp, Homo sapiens
ttcctctctttggaa

SEQ ID NO: 157256 - DNA, 15 bp, Homo sapiens
cttcctctctttgga

SEQ ID NO: 157257 - DNA, 15 bp, Homo sapiens
acttcctctctttgg

SEQ ID NO: 157258 - DNA, 15 bp, Homo sapiens
aacttcctctctttg

SEQ ID NO: 157259 - DNA, 15 bp, Homo sapiens
taacttcctctcttt

SEQ ID NO: 157260 - DNA, 15 bp, Homo sapiens
ataacttcctctctt

SEQ ID NO: 157261 - DNA, 15 bp, Homo sapiens
tataacttcctctct

SEQ ID NO: 157262 - DNA, 15 bp, Homo sapiens
ttataacttcctctc

SEQ ID NO: 157263 - DNA, 15 bp, Homo sapiens
attataacttcctct

SEQ ID NO: 157264 - DNA, 15 bp, Homo sapiens
cattataacttcctc

SEQ ID NO: 157265 - DNA, 15 bp, Homo sapiens
tcattataacttcct

SEQ ID NO: 157266 - DNA, 15 bp, Homo sapiens
ctcattataacttcc

SEQ ID NO: 157267 - DNA, 15 bp, Homo sapiens
cctcattataacttc

SEQ ID NO: 157268 - DNA, 15 bp, Homo sapiens
gcctcattataactt

SEQ ID NO: 157269 - DNA, 15 bp, Homo sapiens
tgcctcattataact

SEQ ID NO: 157270 - DNA, 15 bp, Homo sapiens
atgcctcattataac

SEQ ID NO: 157271 - DNA, 15 bp, Homo sapiens
catgcctcattataa

SEQ ID NO: 157272 - DNA, 15 bp, Homo sapiens
acatgcctcattata

SEQ ID NO: 157273 - DNA, 15 bp, Homo sapiens
gacatgcctcattat

SEQ ID NO: 157274 - DNA, 15 bp, Homo sapiens
ggacatgcctcatta

SEQ ID NO: 157275 - DNA, 15 bp, Homo sapiens
tggacatgcctcatt

SEQ ID NO: 157276 - DNA, 15 bp, Homo sapiens
ttggacatgcctcat

SEQ ID NO: 157277 - DNA, 15 bp, Homo sapiens
gttggacatgcctca

SEQ ID NO: 157278 - DNA, 15 bp, Homo sapiens
ggttggacatgcctc

SEQ ID NO: 157279 - DNA, 15 bp, Homo sapiens
tggttggacatgcct

SEQ ID NO: 157280 - DNA, 15 bp, Homo sapiens
gtggttggacatgcc

SEQ ID NO: 157281 - DNA, 15 bp, Homo sapiens
ggtggttggacatgc

SEQ ID NO: 157282 - DNA, 15 bp, Homo sapiens
gggtggttggacatg

SEQ ID NO: 157283 - DNA, 15 bp, Homo sapiens
tgggtggttggacat

SEQ ID NO: 157284 - DNA, 15 bp, Homo sapiens
atgggtggttggaca

SEQ ID NO: 157285 - DNA, 15 bp, Homo sapiens
aatgggtggttggac

SEQ ID NO: 157286 - DNA, 15 bp, Homo sapiens
gaatgggtggttgga

SEQ ID NO: 157287 - DNA, 15 bp, Homo sapiens
ggaatgggtggttgg

SEQ ID NO: 157288 - DNA, 15 bp, Homo sapiens
gggaatgggtggttg

SEQ ID NO: 157289 - DNA, 15 bp, Homo sapiens
tgggaatgggtggtt

SEQ ID NO: 157290 - DNA, 15 bp, Homo sapiens
atgggaatgggtggt

SEQ ID NO: 157291 - DNA, 15 bp, Homo sapiens
gatgggaatgggtgg

SEQ ID NO: 157292 - DNA, 15 bp, Homo sapiens
tgatgggaatgggtg

SEQ ID NO: 157293 - DNA, 15 bp, Homo sapiens
gtgatgggaatgggt

SEQ ID NO: 157294 - DNA, 15 bp, Homo sapiens
cgtgatgggaatggg

SEQ ID NO: 157295 - DNA, 15 bp, Homo sapiens
ccgtgatgggaatgg

SEQ ID NO: 157296 - DNA, 15 bp, Homo sapiens
gccgtgatgggaatg

SEQ ID NO: 157297 - DNA, 15 bp, Homo sapiens
ggccgtgatgggaat

SEQ ID NO: 157298 - DNA, 15 bp, Homo sapiens
aggccgtgatgggaa

SEQ ID NO: 157299 - DNA, 15 bp, Homo sapiens
caggccgtgatggga

SEQ ID NO: 157300 - DNA, 15 bp, Homo sapiens
tcaggccgtgatggg

SEQ ID NO: 157301 - DNA, 15 bp, Homo sapiens
ttcaggccgtgatgg

SEQ ID NO: 157302 - DNA, 15 bp, Homo sapiens
gttcaggccgtgatg

SEQ ID NO: 157303 - DNA, 15 bp, Homo sapiens
agttcaggccgtgat

SEQ ID NO: 157304 - DNA, 15 bp, Homo sapiens
tagttcaggccgtga

SEQ ID NO: 157305 - DNA, 15 bp, Homo sapiens
ctagttcaggccgtg

SEQ ID NO: 157306 - DNA, 15 bp, Homo sapiens
actagttcaggccgt

SEQ ID NO: 157307 - DNA, 15 bp, Homo sapiens
cactagttcaggccg

SEQ ID NO: 157308 - DNA, 15 bp, Homo sapiens
acactagttcaggcc

SEQ ID NO: 157309 - DNA, 15 bp, Homo sapiens
aacactagttcaggc

SEQ ID NO: 157310 - DNA, 15 bp, Homo sapiens
aaacactagttcagg

SEQ ID NO: 157311 - DNA, 15 bp, Homo sapiens
gaaacactagttcag

SEQ ID NO: 157312 - DNA, 15 bp, Homo sapiens
tgaaacactagttca

SEQ ID NO: 157313 - DNA, 15 bp, Homo sapiens
ctgaaacactagttc

SEQ ID NO: 157314 - DNA, 15 bp, Homo sapiens
cctgaaacactagtt

SEQ ID NO: 157315 - DNA, 15 bp, Homo sapiens
acctgaaacactagt

SEQ ID NO: 157316 - DNA, 15 bp, Homo sapiens
aacctgaaacactag

SEQ ID NO: 157317 - DNA, 15 bp, Homo sapiens
aaacctgaaacacta

SEQ ID NO: 157318 - DNA, 15 bp, Homo sapiens
taaacctgaaacact

SEQ ID NO: 157319 - DNA, 15 bp, Homo sapiens
gtaaacctgaaacac

SEQ ID NO: 157320 - DNA, 15 bp, Homo sapiens
agtaaacctgaaaca

SEQ ID NO: 157321 - DNA, 15 bp, Homo sapiens
aagtaaacctgaaac

SEQ ID NO: 157322 - DNA, 15 bp, Homo sapiens
aaagtaaacctgaaa

SEQ ID NO: 157323 - DNA, 15 bp, Homo sapiens
taaagtaaacctgaa

SEQ ID NO: 157324 - DNA, 15 bp, Homo sapiens
ctaaagtaaacctga

SEQ ID NO: 157325 - DNA, 15 bp, Homo sapiens
tctaaagtaaacctg

SEQ ID NO: 157326 - DNA, 15 bp, Homo sapiens
ttctaaagtaaacct

SEQ ID NO: 157327 - DNA, 15 bp, Homo sapiens
attctaaagtaaacc

SEQ ID NO: 157328 - DNA, 15 bp, Homo sapiens
cattctaaagtaaac

SEQ ID NO: 157329 - DNA, 15 bp, Homo sapiens
gcattctaaagtaaa

SEQ ID NO: 157330 - DNA, 15 bp, Homo sapiens
ggcattctaaagtaa

SEQ ID NO: 157331 - DNA, 15 bp, Homo sapiens
gggcattctaaagta

SEQ ID NO: 157332 - DNA, 15 bp, Homo sapiens
agggcattctaaagt

SEQ ID NO: 157333 - DNA, 15 bp, Homo sapiens
aagggcattctaaag

SEQ ID NO: 157334 - DNA, 15 bp, Homo sapiens
caagggcattctaaa

SEQ ID NO: 157335 - DNA, 15 bp, Homo sapiens
ccaagggcattctaa

SEQ ID NO: 157336 - DNA, 15 bp, Homo sapiens
gccaagggcattcta

SEQ ID NO: 157337 - DNA, 15 bp, Homo sapiens
ggccaagggcattct

SEQ ID NO: 157338 - DNA, 15 bp, Homo sapiens
gggccaagggcattc

SEQ ID NO: 157339 - DNA, 15 bp, Homo sapiens
tgggccaagggcatt

SEQ ID NO: 157340 - DNA, 15 bp, Homo sapiens
ctgggccaagggcat

SEQ ID NO: 157341 - DNA, 15 bp, Homo sapiens
tctgggccaagggca

SEQ ID NO: 157342 - DNA, 15 bp, Homo sapiens
ctctgggccaagggc

SEQ ID NO: 157343 - DNA, 15 bp, Homo sapiens
cctctgggccaaggg

SEQ ID NO: 157344 - DNA, 15 bp, Homo sapiens
tcctctgggccaagg

SEQ ID NO: 157345 - DNA, 15 bp, Homo sapiens
ctcctctgggccaag

SEQ ID NO: 157346 - DNA, 15 bp, Homo sapiens
cctcctctgggccaa

SEQ ID NO: 157347 - DNA, 15 bp, Homo sapiens
ccctcctctgggcca

SEQ ID NO: 157348 - DNA, 15 bp, Homo sapiens
tccctcctctgggcc

SEQ ID NO: 157349 - DNA, 15 bp, Homo sapiens
atccctcctctgggc

SEQ ID NO: 157350 - DNA, 15 bp, Homo sapiens
gatccctcctctggg

SEQ ID NO: 157351 - DNA, 15 bp, Homo sapiens
ggatccctcctctgg

SEQ ID NO: 157352 - DNA, 15 bp, Homo sapiens
tggatccctcctctg

SEQ ID NO: 157353 - DNA, 15 bp, Homo sapiens
atggatccctcctct

SEQ ID NO: 157354 - DNA, 15 bp, Homo sapiens
aatggatccctcctc

SEQ ID NO: 157355 - DNA, 15 bp, Homo sapiens
gaatggatccctcct

SEQ ID NO: 157356 - DNA, 15 bp, Homo sapiens
tgaatggatccctcc

SEQ ID NO: 157357 - DNA, 15 bp, Homo sapiens
ctgaatggatccctc

SEQ ID NO: 157358 - DNA, 15 bp, Homo sapiens
actgaatggatccct

SEQ ID NO: 157359 - DNA, 15 bp, Homo sapiens
aactgaatggatccc

SEQ ID NO: 157360 - DNA, 15 bp, Homo sapiens
caactgaatggatcc

SEQ ID NO: 157361 - DNA, 15 bp, Homo sapiens
ccaactgaatggatc

SEQ ID NO: 157362 - DNA, 15 bp, Homo sapiens
accaactgaatggat

SEQ ID NO: 157363 - DNA, 15 bp, Homo sapiens
aaccaactgaatgga

SEQ ID NO: 157364 - DNA, 15 bp, Homo sapiens
caaccaactgaatgg

SEQ ID NO: 157365 - DNA, 15 bp, Homo sapiens
ccaaccaactgaatg

SEQ ID NO: 157366 - DNA, 15 bp, Homo sapiens
cccaaccaactgaat

SEQ ID NO: 157367 - DNA, 15 bp, Homo sapiens
ccccaaccaactgaa

SEQ ID NO: 157368 - DNA, 15 bp, Homo sapiens
cccccaaccaactga

SEQ ID NO: 157369 - DNA, 15 bp, Homo sapiens
gcccccaaccaactg

SEQ ID NO: 157370 - DNA, 15 bp, Homo sapiens
ggcccccaaccaact

SEQ ID NO: 157371 - DNA, 15 bp, Homo sapiens
tggcccccaaccaac

SEQ ID NO: 157372 - DNA, 15 bp, Homo sapiens
atggcccccaaccaa

SEQ ID NO: 157373 - DNA, 15 bp, Homo sapiens
tatggcccccaacca

SEQ ID NO: 157374 - DNA, 15 bp, Homo sapiens
ctatggcccccaacc

SEQ ID NO: 157375 - DNA, 15 bp, Homo sapiens
tctatggcccccaac

SEQ ID NO: 157376 - DNA, 15 bp, Homo sapiens
ttctatggcccccaa

SEQ ID NO: 157377 - DNA, 15 bp, Homo sapiens
attctatggccccca

SEQ ID NO: 157378 - DNA, 15 bp, Homo sapiens
aattctatggccccc

SEQ ID NO: 157379 - DNA, 15 bp, Homo sapiens
aaattctatggcccc

SEQ ID NO: 157380 - DNA, 15 bp, Homo sapiens
aaaattctatggccc

SEQ ID NO: 157381 - DNA, 15 bp, Homo sapiens
taaaattctatggcc

SEQ ID NO: 157382 - DNA, 15 bp, Homo sapiens
gtaaaattctatggc

SEQ ID NO: 157383 - DNA, 15 bp, Homo sapiens
agtaaaattctatgg

SEQ ID NO: 157384 - DNA, 15 bp, Homo sapiens
aagtaaaattctatg

SEQ ID NO: 157385 - DNA, 15 bp, Homo sapiens
aaagtaaaattctat

SEQ ID NO: 157386 - DNA, 15 bp, Homo sapiens
aaaagtaaaattcta

SEQ ID NO: 157387 - DNA, 15 bp, Homo sapiens
caaaagtaaaattct

SEQ ID NO: 157388 - DNA, 15 bp, Homo sapiens
ccaaaagtaaaattc

SEQ ID NO: 157389 - DNA, 15 bp, Homo sapiens
accaaaagtaaaatt

SEQ ID NO: 157390 - DNA, 15 bp, Homo sapiens
aaccaaaagtaaaat

SEQ ID NO: 157391 - DNA, 15 bp, Homo sapiens
aaaccaaaagtaaaa

SEQ ID NO: 157392 - DNA, 15 bp, Homo sapiens
gaaaccaaaagtaaa

SEQ ID NO: 157393 - DNA, 15 bp, Homo sapiens
ggaaaccaaaagtaa

SEQ ID NO: 157394 - DNA, 15 bp, Homo sapiens
tggaaaccaaaagta

SEQ ID NO: 157395 - DNA, 15 bp, Homo sapiens
ttggaaaccaaaagt

SEQ ID NO: 157396 - DNA, 15 bp, Homo sapiens
tttggaaaccaaaag

SEQ ID NO: 157397 - DNA, 15 bp, Homo sapiens
atttggaaaccaaaa

SEQ ID NO: 157398 - DNA, 15 bp, Homo sapiens
gatttggaaaccaaa

SEQ ID NO: 157399 - DNA, 15 bp, Homo sapiens
tgatttggaaaccaa

SEQ ID NO: 157400 - DNA, 15 bp, Homo sapiens
ctgatttggaaacca

SEQ ID NO: 157401 - DNA, 15 bp, Homo sapiens
tctgatttggaaacc

SEQ ID NO: 157402 - DNA, 15 bp, Homo sapiens
ttctgatttggaaac

SEQ ID NO: 157403 - DNA, 15 bp, Homo sapiens
attctgatttggaaa

SEQ ID NO: 157404 - DNA, 15 bp, Homo sapiens
cattctgatttggaa

SEQ ID NO: 157405 - DNA, 15 bp, Homo sapiens
tcattctgatttgga

SEQ ID NO: 157406 - DNA, 15 bp, Homo sapiens
ttcattctgatttgg

SEQ ID NO: 157407 - DNA, 15 bp, Homo sapiens
attcattctgatttg

SEQ ID NO: 157408 - DNA, 15 bp, Homo sapiens
tattcattctgattt

SEQ ID NO: 157409 - DNA, 15 bp, Homo sapiens
atattcattctgatt

SEQ ID NO: 157410 - DNA, 15 bp, Homo sapiens
aatattcattctgat

SEQ ID NO: 157411 - DNA, 15 bp, Homo sapiens
caatattcattctga

SEQ ID NO: 157412 - DNA, 15 bp, Homo sapiens
gcaatattcattctg

SEQ ID NO: 157413 - DNA, 15 bp, Homo sapiens
agcaatattcattct

SEQ ID NO: 157414 - DNA, 15 bp, Homo sapiens
tagcaatattcattc

SEQ ID NO: 157415 - DNA, 15 bp, Homo sapiens
ctagcaatattcatt

SEQ ID NO: 157416 - DNA, 15 bp, Homo sapiens
tctagcaatattcat

SEQ ID NO: 157417 - DNA, 15 bp, Homo sapiens
gtctagcaatattca

SEQ ID NO: 157418 - DNA, 15 bp, Homo sapiens
agtctagcaatattc

SEQ ID NO: 157419 - DNA, 15 bp, Homo sapiens
tagtctagcaatatt

SEQ ID NO: 157420 - DNA, 15 bp, Homo sapiens
ctagtctagcaatat

SEQ ID NO: 157421 - DNA, 15 bp, Homo sapiens
tctagtctagcaata

SEQ ID NO: 157422 - DNA, 15 bp, Homo sapiens
ttctagtctagcaat

SEQ ID NO: 157423 - DNA, 15 bp, Homo sapiens
tttctagtctagcaa

SEQ ID NO: 157424 - DNA, 15 bp, Homo sapiens
atttctagtctagca

SEQ ID NO: 157425 - DNA, 15 bp, Homo sapiens
tatttctagtctagc

SEQ ID NO: 157426 - DNA, 15 bp, Homo sapiens
ttatttctagtctag

SEQ ID NO: 157427 - DNA, 15 bp, Homo sapiens
gttatttctagtcta

SEQ ID NO: 157428 - DNA, 15 bp, Homo sapiens
agttatttctagtct

SEQ ID NO: 157429 - DNA, 15 bp, Homo sapiens
gagttatttctagtc

SEQ ID NO: 157430 - DNA, 15 bp, Homo sapiens
tgagttatttctagt

SEQ ID NO: 157431 - DNA, 15 bp, Homo sapiens
ttgagttatttctag

SEQ ID NO: 157432 - DNA, 15 bp, Homo sapiens
tttgagttatttcta

SEQ ID NO: 157433 - DNA, 15 bp, Homo sapiens
ctttgagttatttct

SEQ ID NO: 157434 - DNA, 15 bp, Homo sapiens
cctttgagttatttc

SEQ ID NO: 157435 - DNA, 15 bp, Homo sapiens
acctttgagttattt

SEQ ID NO: 157436 - DNA, 15 bp, Homo sapiens
aacctttgagttatt

SEQ ID NO: 157437 - DNA, 15 bp, Homo sapiens
caacctttgagttat

SEQ ID NO: 157438 - DNA, 15 bp, Homo sapiens
acaacctttgagtta

SEQ ID NO: 157439 - DNA, 15 bp, Homo sapiens
aacaacctttgagtt

SEQ ID NO: 157440 - DNA, 15 bp, Homo sapiens
caacaacctttgagt

SEQ ID NO: 157441 - DNA, 15 bp, Homo sapiens
ccaacaacctttgag

SEQ ID NO: 157442 - DNA, 15 bp, Homo sapiens
tccaacaacctttga

SEQ ID NO: 157443 - DNA, 15 bp, Homo sapiens
ctccaacaacctttg

SEQ ID NO: 157444 - DNA, 15 bp, Homo sapiens
tctccaacaaccttt

SEQ ID NO: 157445 - DNA, 15 bp, Homo sapiens
ttctccaacaacctt

SEQ ID NO: 157446 - DNA, 15 bp, Homo sapiens
attctccaacaacct

SEQ ID NO: 157447 - DNA, 15 bp, Homo sapiens
aattctccaacaacc

SEQ ID NO: 157448 - DNA, 15 bp, Homo sapiens
aaattctccaacaac

SEQ ID NO: 157449 - DNA, 15 bp, Homo sapiens
aaaattctccaacaa

SEQ ID NO: 157450 - DNA, 15 bp, Homo sapiens
taaaattctccaaca

SEQ ID NO: 157451 - DNA, 15 bp, Homo sapiens
ttaaaattctccaac

SEQ ID NO: 157452 - DNA, 15 bp, Homo sapiens
tttaaaattctccaa

SEQ ID NO: 157453 - DNA, 15 bp, Homo sapiens
ttttaaaattctcca

SEQ ID NO: 157454 - DNA, 15 bp, Homo sapiens
attttaaaattctcc

SEQ ID NO: 157455 - DNA, 15 bp, Homo sapiens
cattttaaaattctc

SEQ ID NO: 157456 - DNA, 15 bp, Homo sapiens
acattttaaaattct

SEQ ID NO: 157457 - DNA, 15 bp, Homo sapiens
tacattttaaaattc

SEQ ID NO: 157458 - DNA, 15 bp, Homo sapiens
atacattttaaaatt

SEQ ID NO: 157459 - DNA, 15 bp, Homo sapiens
aatacattttaaaat

SEQ ID NO: 157460 - DNA, 15 bp, Homo sapiens
aaatacattttaaaa

SEQ ID NO: 157461 - DNA, 15 bp, Homo sapiens
taaatacattttaaa

SEQ ID NO: 157462 - DNA, 15 bp, Homo sapiens
ataaatacattttaa

SEQ ID NO: 157463 - DNA, 15 bp, Homo sapiens
aataaatacatttta

SEQ ID NO: 157464 - DNA, 15 bp, Homo sapiens
aaataaatacatttt

SEQ ID NO: 157465 - DNA, 15 bp, Homo sapiens
taaataaatacattt

SEQ ID NO: 157466 - DNA, 15 bp, Homo sapiens
ataaataaatacatt

SEQ ID NO: 157467 - DNA, 15 bp, Homo sapiens
aataaataaatacat

SEQ ID NO: 157468 - DNA, 15 bp, Homo sapiens
taaataaataaatac

SEQ ID NO: 157469 - DNA, 15 bp, Homo sapiens
tcataaataaataaa

SEQ ID NO: 157470 - DNA, 15 bp, Homo sapiens
gtcataaataaataa

SEQ ID NO: 157471 - DNA, 15 bp, Homo sapiens
tgtcataaataaata

SEQ ID NO: 157472 - DNA, 15 bp, Homo sapiens
atgtcataaataaat

SEQ ID NO: 157473 - DNA, 15 bp, Homo sapiens
gatgtcataaataaa

SEQ ID NO: 157474 - DNA, 15 bp, Homo sapiens
agatgtcataaataa

SEQ ID NO: 157475 - DNA, 15 bp, Homo sapiens
tagatgtcataaata

SEQ ID NO: 157476 - DNA, 15 bp, Homo sapiens
ctagatgtcataaat

SEQ ID NO: 157477 - DNA, 15 bp, Homo sapiens
actagatgtcataaa

SEQ ID NO: 157478 - DNA, 15 bp, Homo sapiens
aactagatgtcataa

SEQ ID NO: 157479 - DNA, 15 bp, Homo sapiens
aaactagatgtcata

SEQ ID NO: 157480 - DNA, 15 bp, Homo sapiens
caaactagatgtcat

SEQ ID NO: 157481 - DNA, 15 bp, Homo sapiens
acaaactagatgtca

SEQ ID NO: 157482 - DNA, 15 bp, Homo sapiens
cacaaactagatgtc

SEQ ID NO: 157483 - DNA, 15 bp, Homo sapiens
gcacaaactagatgt

SEQ ID NO: 157484 - DNA, 15 bp, Homo sapiens
agcacaaactagatg

SEQ ID NO: 157485 - DNA, 15 bp, Homo sapiens
gagcacaaactagat

SEQ ID NO: 157486 - DNA, 15 bp, Homo sapiens
agagcacaaactaga

SEQ ID NO: 157487 - DNA, 15 bp, Homo sapiens
aagagcacaaactag

SEQ ID NO: 157488 - DNA, 15 bp, Homo sapiens
caagagcacaaacta

SEQ ID NO: 157489 - DNA, 15 bp, Homo sapiens
tcaagagcacaaact

SEQ ID NO: 157490 - DNA, 15 bp, Homo sapiens
atcaagagcacaaac

SEQ ID NO: 157491 - DNA, 15 bp, Homo sapiens
aatcaagagcacaaa

SEQ ID NO: 157492 - DNA, 15 bp, Homo sapiens
taatcaagagcacaa

SEQ ID NO: 157493 - DNA, 15 bp, Homo sapiens
ttaatcaagagcaca

SEQ ID NO: 157494 - DNA, 15 bp, Homo sapiens
attaatcaagagcac

SEQ ID NO: 157495 - DNA, 15 bp, Homo sapiens
aattaatcaagagca

SEQ ID NO: 157496 - DNA, 15 bp, Homo sapiens
caattaatcaagagc

SEQ ID NO: 157497 - DNA, 15 bp, Homo sapiens
gcaattaatcaagag

SEQ ID NO: 157498 - DNA, 15 bp, Homo sapiens
agcaattaatcaaga

SEQ ID NO: 157499 - DNA, 15 bp, Homo sapiens
gagcaattaatcaag

SEQ ID NO: 157500 - DNA, 15 bp, Homo sapiens
agagcaattaatcaa

SEQ ID NO: 157501 - DNA, 15 bp, Homo sapiens
aagagcaattaatca

SEQ ID NO: 157502 - DNA, 15 bp, Homo sapiens
caagagcaattaatc

SEQ ID NO: 157503 - DNA, 15 bp, Homo sapiens
tcaagagcaattaat

SEQ ID NO: 157504 - DNA, 15 bp, Homo sapiens
atcaagagcaattaa

SEQ ID NO: 157505 - DNA, 15 bp, Homo sapiens
aatcaagagcaatta

SEQ ID NO: 157506 - DNA, 15 bp, Homo sapiens
taatcaagagcaatt

SEQ ID NO: 157507 - DNA, 15 bp, Homo sapiens
ttaatcaagagcaat

SEQ ID NO: 157508 - DNA, 15 bp, Homo sapiens
gttaatcaagagcaa

SEQ ID NO: 157509 - DNA, 15 bp, Homo sapiens
ggttaatcaagagca

SEQ ID NO: 157510 - DNA, 15 bp, Homo sapiens
aggttaatcaagagc

SEQ ID NO: 157511 - DNA, 15 bp, Homo sapiens
gaggttaatcaagag

SEQ ID NO: 157512 - DNA, 15 bp, Homo sapiens
ggaggttaatcaaga

SEQ ID NO: 157513 - DNA, 15 bp, Homo sapiens
gggaggttaatcaag

SEQ ID NO: 157514 - DNA, 15 bp, Homo sapiens
agggaggttaatcaa

SEQ ID NO: 157515 - DNA, 15 bp, Homo sapiens
gagggaggttaatca

SEQ ID NO: 157516 - DNA, 15 bp, Homo sapiens
cgagggaggttaatc

SEQ ID NO: 157517 - DNA, 15 bp, Homo sapiens
acgagggaggttaat

SEQ ID NO: 157518 - DNA, 15 bp, Homo sapiens
gacgagggaggttaa

SEQ ID NO: 157519 - DNA, 15 bp, Homo sapiens
agacgagggaggtta

SEQ ID NO: 157520 - DNA, 15 bp, Homo sapiens
aagacgagggaggtt

SEQ ID NO: 157521 - DNA, 15 bp, Homo sapiens
aaagacgagggaggt

SEQ ID NO: 157522 - DNA, 15 bp, Homo sapiens
taaagacgagggagg

SEQ ID NO: 157523 - DNA, 15 bp, Homo sapiens
ttaaagacgagggag

SEQ ID NO: 157524 - DNA, 15 bp, Homo sapiens
tttaaagacgaggga

SEQ ID NO: 157525 - DNA, 15 bp, Homo sapiens
atttaaagacgaggg

SEQ ID NO: 157526 - DNA, 15 bp, Homo sapiens
aatttaaagacgagg

SEQ ID NO: 157527 - DNA, 15 bp, Homo sapiens
taatttaaagacgag

SEQ ID NO: 157528 - DNA, 15 bp, Homo sapiens
ttaatttaaagacga

SEQ ID NO: 157529 - DNA, 15 bp, Homo sapiens
tttaatttaaagacg

SEQ ID NO: 157530 - DNA, 15 bp, Homo sapiens
atttaatttaaagac

SEQ ID NO: 157531 - DNA, 15 bp, Homo sapiens
gatttaatttaaaga

SEQ ID NO: 157532 - DNA, 15 bp, Homo sapiens
tgatttaatttaaag

SEQ ID NO: 157533 - DNA, 15 bp, Homo sapiens
ttgatttaatttaaa

SEQ ID NO: 157534 - DNA, 15 bp, Homo sapiens
tttgatttaatttaa

SEQ ID NO: 157535 - DNA, 15 bp, Homo sapiens
ttttgatttaattta

SEQ ID NO: 157536 - DNA, 15 bp, Homo sapiens
attttgatttaattt

SEQ ID NO: 157537 - DNA, 15 bp, Homo sapiens
aattttgatttaatt

SEQ ID NO: 157538 - DNA, 15 bp, Homo sapiens
taattttgatttaat

SEQ ID NO: 157539 - DNA, 15 bp, Homo sapiens
ctaattttgatttaa

SEQ ID NO: 157540 - DNA, 15 bp, Homo sapiens
gctaattttgattta

SEQ ID NO: 157541 - DNA, 15 bp, Homo sapiens
tgctaattttgattt

SEQ ID NO: 157542 - DNA, 15 bp, Homo sapiens
ttgctaattttgatt

SEQ ID NO: 157543 - DNA, 15 bp, Homo sapiens
tttgctaattttgat

SEQ ID NO: 157544 - DNA, 15 bp, Homo sapiens
atttgctaattttga

SEQ ID NO: 157545 - DNA, 15 bp, Homo sapiens
tatttgctaattttg

SEQ ID NO: 157546 - DNA, 15 bp, Homo sapiens
atatttgctaatttt

SEQ ID NO: 157547 - DNA, 15 bp, Homo sapiens
aatatttgctaattt

SEQ ID NO: 157548 - DNA, 15 bp, Homo sapiens
aaatatttgctaatt

SEQ ID NO: 157549 - DNA, 15 bp, Homo sapiens
taaatatttgctaat

SEQ ID NO: 157550 - DNA, 15 bp, Homo sapiens
ataaatatttgctaa

SEQ ID NO: 157551 - DNA, 15 bp, Homo sapiens
aataaatatttgcta

SEQ ID NO: 157552 - DNA, 15 bp, Homo sapiens
caataaatatttgct

SEQ ID NO: 157553 - DNA, 15 bp, Homo sapiens
gcaataaatatttgc

SEQ ID NO: 157554 - DNA, 15 bp, Homo sapiens
cgcaataaatatttg

SEQ ID NO: 157555 - DNA, 15 bp, Homo sapiens
ccgcaataaatattt

SEQ ID NO: 157556 - DNA, 15 bp, Homo sapiens
accgcaataaatatt

SEQ ID NO: 157557 - DNA, 15 bp, Homo sapiens
gaccgcaataaatat

SEQ ID NO: 157558 - DNA, 15 bp, Homo sapiens
agaccgcaataaata

SEQ ID NO: 157559 - DNA, 15 bp, Homo sapiens
tagaccgcaataaat

SEQ ID NO: 157560 - DNA, 15 bp, Homo sapiens
ctagaccgcaataaa

SEQ ID NO: 157561 - DNA, 15 bp, Homo sapiens
cctagaccgcaataa

SEQ ID NO: 157562 - DNA, 15 bp, Homo sapiens
tcctagaccgcaata

SEQ ID NO: 157563 - DNA, 15 bp, Homo sapiens
ctcctagaccgcaat

SEQ ID NO: 157564 - DNA, 15 bp, Homo sapiens
tctcctagaccgcaa

SEQ ID NO: 157565 - DNA, 15 bp, Homo sapiens
ttctcctagaccgca

SEQ ID NO: 157566 - DNA, 15 bp, Homo sapiens
tttctcctagaccgc

SEQ ID NO: 157567 - DNA, 15 bp, Homo sapiens
atttctcctagaccg

SEQ ID NO: 157568 - DNA, 15 bp, Homo sapiens
gatttctcctagacc

SEQ ID NO: 157569 - DNA, 15 bp, Homo sapiens
agatttctcctagac

SEQ ID NO: 157570 - DNA, 15 bp, Homo sapiens
gagatttctcctaga

SEQ ID NO: 157571 - DNA, 15 bp, Homo sapiens
tgagatttctcctag

SEQ ID NO: 157572 - DNA, 15 bp, Homo sapiens
atgagatttctccta

SEQ ID NO: 157573 - DNA, 15 bp, Homo sapiens
aatgagatttctcct

SEQ ID NO: 157574 - DNA, 15 bp, Homo sapiens
aaatgagatttctcc

SEQ ID NO: 157575 - DNA, 15 bp, Homo sapiens
taaatgagatttctc

SEQ ID NO: 157576 - DNA, 15 bp, Homo sapiens
ttaaatgagatttct

SEQ ID NO: 157577 - DNA, 15 bp, Homo sapiens
cttaaatgagatttc

SEQ ID NO: 157578 - DNA, 15 bp, Homo sapiens
ccttaaatgagattt

SEQ ID NO: 157579 - DNA, 15 bp, Homo sapiens
gccttaaatgagatt

SEQ ID NO: 157580 - DNA, 15 bp, Homo sapiens
tgccttaaatgagat

SEQ ID NO: 157581 - DNA, 15 bp, Homo sapiens
gtgccttaaatgaga

SEQ ID NO: 157582 - DNA, 15 bp, Homo sapiens
tgtgccttaaatgag

SEQ ID NO: 157583 - DNA, 15 bp, Homo sapiens
ttgtgccttaaatga

SEQ ID NO: 157584 - DNA, 15 bp, Homo sapiens
tttgtgccttaaatg

SEQ ID NO: 157585 - DNA, 15 bp, Homo sapiens
ctttgtgccttaaat

SEQ ID NO: 157586 - DNA, 15 bp, Homo sapiens
gctttgtgccttaaa

SEQ ID NO: 157587 - DNA, 15 bp, Homo sapiens
tgctttgtgccttaa

SEQ ID NO: 157588 - DNA, 15 bp, Homo sapiens
gtgctttgtgcctta

SEQ ID NO: 157589 - DNA, 15 bp, Homo sapiens
agtgctttgtgcctt

SEQ ID NO: 157590 - DNA, 15 bp, Homo sapiens
cagtgctttgtgcct

SEQ ID NO: 157591 - DNA, 15 bp, Homo sapiens
acagtgctttgtgcc

SEQ ID NO: 157592 - DNA, 15 bp, Homo sapiens
cacagtgctttgtgc

SEQ ID NO: 157593 - DNA, 15 bp, Homo sapiens
acacagtgctttgtg

SEQ ID NO: 157594 - DNA, 15 bp, Homo sapiens
tacacagtgctttgt

SEQ ID NO: 157595 - DNA, 15 bp, Homo sapiens
ttacacagtgctttg

SEQ ID NO: 157596 - DNA, 15 bp, Homo sapiens
tttacacagtgcttt

SEQ ID NO: 157597 - DNA, 15 bp, Homo sapiens
ctttacacagtgctt

SEQ ID NO: 157598 - DNA, 15 bp, Homo sapiens
gctttacacagtgct

SEQ ID NO: 157599 - DNA, 15 bp, Homo sapiens
tgctttacacagtgc

SEQ ID NO: 157600 - DNA, 15 bp, Homo sapiens
ctgctttacacagtg

SEQ ID NO: 157601 - DNA, 15 bp, Homo sapiens
actgctttacacagt

SEQ ID NO: 157602 - DNA, 15 bp, Homo sapiens
tactgctttacacag

SEQ ID NO: 157603 - DNA, 15 bp, Homo sapiens
ctactgctttacaca

SEQ ID NO: 157604 - DNA, 15 bp, Homo sapiens
tctactgctttacac

SEQ ID NO: 157605 - DNA, 15 bp, Homo sapiens
ttctactgctttaca

SEQ ID NO: 157606 - DNA, 15 bp, Homo sapiens
attctactgctttac

SEQ ID NO: 157607 - DNA, 15 bp, Homo sapiens
cattctactgcttta

SEQ ID NO: 157608 - DNA, 15 bp, Homo sapiens
acattctactgcttt

SEQ ID NO: 157609 - DNA, 15 bp, Homo sapiens
aacattctactgctt

SEQ ID NO: 157610 - DNA, 15 bp, Homo sapiens
aaacattctactgct

SEQ ID NO: 157611 - DNA, 15 bp, Homo sapiens
aaaacattctactgc

SEQ ID NO: 157612 - DNA, 15 bp, Homo sapiens
gaaaacattctactg

SEQ ID NO: 157613 - DNA, 15 bp, Homo sapiens
agaaaacattctact

SEQ ID NO: 157614 - DNA, 15 bp, Homo sapiens
aagaaaacattctac

SEQ ID NO: 157615 - DNA, 15 bp, Homo sapiens
aaagaaaacattcta

SEQ ID NO: 157616 - DNA, 15 bp, Homo sapiens
taaagaaaacattct

SEQ ID NO: 157617 - DNA, 15 bp, Homo sapiens
gtaaagaaaacattc

SEQ ID NO: 157618 - DNA, 15 bp, Homo sapiens
agtaaagaaaacatt

SEQ ID NO: 157619 - DNA, 15 bp, Homo sapiens
tagtaaagaaaacat

SEQ ID NO: 157620 - DNA, 15 bp, Homo sapiens
ttagtaaagaaaaca

SEQ ID NO: 157621 - DNA, 15 bp, Homo sapiens
attagtaaagaaaac

SEQ ID NO: 157622 - DNA, 15 bp, Homo sapiens
tattagtaaagaaaa

SEQ ID NO: 157623 - DNA, 15 bp, Homo sapiens
ttattagtaaagaaa

SEQ ID NO: 157624 - DNA, 15 bp, Homo sapiens
tttattagtaaagaa

SEQ ID NO: 157625 - DNA, 15 bp, Homo sapiens
ctttattagtaaaga

SEQ ID NO: 157626 - DNA, 15 bp, Homo sapiens
cctttattagtaaag

SEQ ID NO: 157627 - DNA, 15 bp, Homo sapiens
tcctttattagtaaa

SEQ ID NO: 157628 - DNA, 15 bp, Homo sapiens
gtcctttattagtaa

SEQ ID NO: 157629 - DNA, 15 bp, Homo sapiens
tgtcctttattagta

SEQ ID NO: 157630 - DNA, 15 bp, Homo sapiens
ctgtcctttattagt

SEQ ID NO: 157631 - DNA, 15 bp, Homo sapiens
tctgtcctttattag

SEQ ID NO: 157632 - DNA, 15 bp, Homo sapiens
ttctgtcctttatta

SEQ ID NO: 157633 - DNA, 15 bp, Homo sapiens
tttctgtcctttatt

SEQ ID NO: 157634 - DNA, 15 bp, Homo sapiens
atttctgtcctttat

SEQ ID NO: 157635 - DNA, 15 bp, Homo sapiens
aatttctgtccttta

SEQ ID NO: 157636 - DNA, 15 bp, Homo sapiens
caatttctgtccttt

SEQ ID NO: 157637 - DNA, 15 bp, Homo sapiens
tcaatttctgtcctt

SEQ ID NO: 157638 - DNA, 15 bp, Homo sapiens
ttcaatttctgtcct

SEQ ID NO: 157639 - DNA, 15 bp, Homo sapiens
cttcaatttctgtcc

SEQ ID NO: 157640 - DNA, 15 bp, Homo sapiens
tcttcaatttctgtc

SEQ ID NO: 157641 - DNA, 15 bp, Homo sapiens
gtcttcaatttctgt

SEQ ID NO: 157642 - DNA, 15 bp, Homo sapiens
ggtcttcaatttctg

SEQ ID NO: 157643 - DNA, 15 bp, Homo sapiens
tggtcttcaatttct

SEQ ID NO: 157644 - DNA, 15 bp, Homo sapiens
ctggtcttcaatttc

SEQ ID NO: 157645 - DNA, 15 bp, Homo sapiens
cctggtcttcaattt

SEQ ID NO: 157646 - DNA, 15 bp, Homo sapiens
tcctggtcttcaatt

SEQ ID NO: 157647 - DNA, 15 bp, Homo sapiens
ttcctggtcttcaat

SEQ ID NO: 157648 - DNA, 15 bp, Homo sapiens
attcctggtcttcaa

SEQ ID NO: 157649 - DNA, 15 bp, Homo sapiens
aattcctggtcttca

SEQ ID NO: 157650 - DNA, 15 bp, Homo sapiens
taattcctggtcttc

SEQ ID NO: 157651 - DNA, 15 bp, Homo sapiens
ttaattcctggtctt

SEQ ID NO: 157652 - DNA, 15 bp, Homo sapiens
gttaattcctggtct

SEQ ID NO: 157653 - DNA, 15 bp, Homo sapiens
ggttaattcctggtc

SEQ ID NO: 157654 - DNA, 15 bp, Homo sapiens
tggttaattcctggt

SEQ ID NO: 157655 - DNA, 15 bp, Homo sapiens
ctggttaattcctgg

SEQ ID NO: 157656 - DNA, 15 bp, Homo sapiens
gctggttaattcctg

SEQ ID NO: 157657 - DNA, 15 bp, Homo sapiens
ggctggttaattcct

SEQ ID NO: 157658 - DNA, 15 bp, Homo sapiens
gggctggttaattcc

SEQ ID NO: 157659 - DNA, 15 bp, Homo sapiens
tgggctggttaattc

SEQ ID NO: 157660 - DNA, 15 bp, Homo sapiens
atgggctggttaatt

SEQ ID NO: 157661 - DNA, 15 bp, Homo sapiens
catgggctggttaat

SEQ ID NO: 157662 - DNA, 15 bp, Homo sapiens
acatgggctggttaa

SEQ ID NO: 157663 - DNA, 15 bp, Homo sapiens
tacatgggctggtta

SEQ ID NO: 157664 - DNA, 15 bp, Homo sapiens
atacatgggctggtt

SEQ ID NO: 157665 - DNA, 15 bp, Homo sapiens
aatacatgggctggt

SEQ ID NO: 157666 - DNA, 15 bp, Homo sapiens
aaatacatgggctgg

SEQ ID NO: 157667 - DNA, 15 bp, Homo sapiens
gaaatacatgggctg

SEQ ID NO: 157668 - DNA, 15 bp, Homo sapiens
ggaaatacatgggct

SEQ ID NO: 157669 - DNA, 15 bp, Homo sapiens
aggaaatacatgggc

SEQ ID NO: 157670 - DNA, 15 bp, Homo sapiens
caggaaatacatggg

SEQ ID NO: 157671 - DNA, 15 bp, Homo sapiens
tcaggaaatacatgg

SEQ ID NO: 157672 - DNA, 15 bp, Homo sapiens
atcaggaaatacatg

SEQ ID NO: 157673 - DNA, 15 bp, Homo sapiens
tatcaggaaatacat

SEQ ID NO: 157674 - DNA, 15 bp, Homo sapiens
atatcaggaaataca

SEQ ID NO: 157675 - DNA, 15 bp, Homo sapiens
tatatcaggaaatac

SEQ ID NO: 157676 - DNA, 15 bp, Homo sapiens
atatatcaggaaata

SEQ ID NO: 157677 - DNA, 15 bp, Homo sapiens
tatatatcaggaaat

SEQ ID NO: 157678 - DNA, 15 bp, Homo sapiens
gtatatatcaggaaa

SEQ ID NO: 157679 - DNA, 15 bp, Homo sapiens
ggtatatatcaggaa

SEQ ID NO: 157680 - DNA, 15 bp, Homo sapiens
aggtatatatcagga

SEQ ID NO: 157681 - DNA, 15 bp, Homo sapiens
caggtatatatcagg

SEQ ID NO: 157682 - DNA, 15 bp, Homo sapiens
tcaggtatatatcag

SEQ ID NO: 157683 - DNA, 15 bp, Homo sapiens
atcaggtatatatca

SEQ ID NO: 157684 - DNA, 15 bp, Homo sapiens
aatcaggtatatatc

SEQ ID NO: 157685 - DNA, 15 bp, Homo sapiens
aaatcaggtatatat

SEQ ID NO: 157686 - DNA, 15 bp, Homo sapiens
taaatcaggtatata

SEQ ID NO: 157687 - DNA, 15 bp, Homo sapiens
ctaaatcaggtatat

SEQ ID NO: 157688 - DNA, 15 bp, Homo sapiens
actaaatcaggtata

SEQ ID NO: 157689 - DNA, 15 bp, Homo sapiens
tactaaatcaggtat

SEQ ID NO: 157690 - DNA, 15 bp, Homo sapiens
gtactaaatcaggta

SEQ ID NO: 157691 - DNA, 15 bp, Homo sapiens
tgtactaaatcaggt

SEQ ID NO: 157692 - DNA, 15 bp, Homo sapiens
ctgtactaaatcagg

SEQ ID NO: 157693 - DNA, 15 bp, Homo sapiens
cctgtactaaatcag

SEQ ID NO: 157694 - DNA, 15 bp, Homo sapiens
acctgtactaaatca

SEQ ID NO: 157695 - DNA, 15 bp, Homo sapiens
cacctgtactaaatc

SEQ ID NO: 157696 - DNA, 15 bp, Homo sapiens
acacctgtactaaat

SEQ ID NO: 157697 - DNA, 15 bp, Homo sapiens
tacacctgtactaaa

SEQ ID NO: 157698 - DNA, 15 bp, Homo sapiens
atacacctgtactaa

SEQ ID NO: 157699 - DNA, 15 bp, Homo sapiens
aatacacctgtacta

SEQ ID NO: 157700 - DNA, 15 bp, Homo sapiens
aaatacacctgtact

SEQ ID NO: 157701 - DNA, 15 bp, Homo sapiens
caaatacacctgtac

SEQ ID NO: 157702 - DNA, 15 bp, Homo sapiens
ccaaatacacctgta

SEQ ID NO: 157703 - DNA, 15 bp, Homo sapiens
cccaaatacacctgt

SEQ ID NO: 157704 - DNA, 15 bp, Homo sapiens
ccccaaatacacctg

SEQ ID NO: 157705 - DNA, 15 bp, Homo sapiens
tccccaaatacacct

SEQ ID NO: 157706 - DNA, 15 bp, Homo sapiens
ttccccaaatacacc

SEQ ID NO: 157707 - DNA, 15 bp, Homo sapiens
tttccccaaatacac

SEQ ID NO: 157708 - DNA, 15 bp, Homo sapiens
atttccccaaataca

SEQ ID NO: 157709 - DNA, 15 bp, Homo sapiens
catttccccaaatac

SEQ ID NO: 157710 - DNA, 15 bp, Homo sapiens
ccatttccccaaata

SEQ ID NO: 157711 - DNA, 15 bp, Homo sapiens
cccatttccccaaat

SEQ ID NO: 157712 - DNA, 15 bp, Homo sapiens
ccccatttccccaaa

SEQ ID NO: 157713 - DNA, 15 bp, Homo sapiens
accccatttccccaa

SEQ ID NO: 157714 - DNA, 15 bp, Homo sapiens
caccccatttcccca

SEQ ID NO: 157715 - DNA, 15 bp, Homo sapiens
ccaccccatttcccc

SEQ ID NO: 157716 - DNA, 15 bp, Homo sapiens
accaccccatttccc

SEQ ID NO: 157717 - DNA, 15 bp, Homo sapiens
aaccaccccatttcc

SEQ ID NO: 157718 - DNA, 15 bp, Homo sapiens
caaccaccccatttc

SEQ ID NO: 157719 - DNA, 15 bp, Homo sapiens
ccaaccaccccattt

SEQ ID NO: 157720 - DNA, 15 bp, Homo sapiens
accaaccaccccatt

SEQ ID NO: 157721 - DNA, 15 bp, Homo sapiens
aaccaaccaccccat

SEQ ID NO: 157722 - DNA, 15 bp, Homo sapiens
taaccaaccacccca

SEQ ID NO: 157723 - DNA, 15 bp, Homo sapiens
ctaaccaaccacccc

SEQ ID NO: 157724 - DNA, 15 bp, Homo sapiens
cctaaccaaccaccc

SEQ ID NO: 157725 - DNA, 15 bp, Homo sapiens
ccctaaccaaccacc

SEQ ID NO: 157726 - DNA, 15 bp, Homo sapiens
gccctaaccaaccac

SEQ ID NO: 157727 - DNA, 15 bp, Homo sapiens
agccctaaccaacca

SEQ ID NO: 157728 - DNA, 15 bp, Homo sapiens
cagccctaaccaacc

SEQ ID NO: 157729 - DNA, 15 bp, Homo sapiens
ccagccctaaccaac

SEQ ID NO: 157730 - DNA, 15 bp, Homo sapiens
tccagccctaaccaa

SEQ ID NO: 157731 - DNA, 15 bp, Homo sapiens
ttccagccctaacca

SEQ ID NO: 157732 - DNA, 15 bp, Homo sapiens
cttccagccctaacc

SEQ ID NO: 157733 - DNA, 15 bp, Homo sapiens
tcttccagccctaac

SEQ ID NO: 157734 - DNA, 15 bp, Homo sapiens
ttcttccagccctaa

SEQ ID NO: 157735 - DNA, 15 bp, Homo sapiens
tttcttccagcccta

SEQ ID NO: 157736 - DNA, 15 bp, Homo sapiens
ctttcttccagccct

SEQ ID NO: 157737 - DNA, 15 bp, Homo sapiens
actttcttccagccc

SEQ ID NO: 157738 - DNA, 15 bp, Homo sapiens
cactttcttccagcc

SEQ ID NO: 157739 - DNA, 15 bp, Homo sapiens
tcactttcttccagc

SEQ ID NO: 157740 - DNA, 15 bp, Homo sapiens
ctcactttcttccag

SEQ ID NO: 157741 - DNA, 15 bp, Homo sapiens
cctcactttcttcca

SEQ ID NO: 157742 - DNA, 15 bp, Homo sapiens
tcctcactttcttcc

SEQ ID NO: 157743 - DNA, 15 bp, Homo sapiens
ttcctcactttcttc

SEQ ID NO: 157744 - DNA, 15 bp, Homo sapiens
cttcctcactttctt

SEQ ID NO: 157745 - DNA, 15 bp, Homo sapiens
tcttcctcactttct

SEQ ID NO: 157746 - DNA, 15 bp, Homo sapiens
ctcttcctcactttc

SEQ ID NO: 157747 - DNA, 15 bp, Homo sapiens
actcttcctcacttt

SEQ ID NO: 157748 - DNA, 15 bp, Homo sapiens
tactcttcctcactt

SEQ ID NO: 157749 - DNA, 15 bp, Homo sapiens
gtactcttcctcact

SEQ ID NO: 157750 - DNA, 15 bp, Homo sapiens
agtactcttcctcac

SEQ ID NO: 157751 - DNA, 15 bp, Homo sapiens
gagtactcttcctca

SEQ ID NO: 157752 - DNA, 15 bp, Homo sapiens
tgagtactcttcctc

SEQ ID NO: 157753 - DNA, 15 bp, Homo sapiens
ttgagtactcttcct

SEQ ID NO: 157754 - DNA, 15 bp, Homo sapiens
attgagtactcttcc

SEQ ID NO: 157755 - DNA, 15 bp, Homo sapiens
aattgagtactcttc

SEQ ID NO: 157756 - DNA, 15 bp, Homo sapiens
taattgagtactctt

SEQ ID NO: 157757 - DNA, 15 bp, Homo sapiens
ttaattgagtactct

SEQ ID NO: 157758 - DNA, 15 bp, Homo sapiens
cttaattgagtactc

SEQ ID NO: 157759 - DNA, 15 bp, Homo sapiens
acttaattgagtact

SEQ ID NO: 157760 - DNA, 15 bp, Homo sapiens
tacttaattgagtac

SEQ ID NO: 157761 - DNA, 15 bp, Homo sapiens
ctacttaattgagta

SEQ ID NO: 157762 - DNA, 15 bp, Homo sapiens
actacttaattgagt

SEQ ID NO: 157763 - DNA, 15 bp, Homo sapiens
aactacttaattgag

SEQ ID NO: 157764 - DNA, 15 bp, Homo sapiens
gaactacttaattga

SEQ ID NO: 157765 - DNA, 15 bp, Homo sapiens
agaactacttaattg

SEQ ID NO: 157766 - DNA, 15 bp, Homo sapiens
gagaactacttaatt

SEQ ID NO: 157767 - DNA, 15 bp, Homo sapiens
agagaactacttaat

SEQ ID NO: 157768 - DNA, 15 bp, Homo sapiens
aagagaactacttaa

SEQ ID NO: 157769 - DNA, 15 bp, Homo sapiens
caagagaactactta

SEQ ID NO: 157770 - DNA, 15 bp, Homo sapiens
tcaagagaactactt

SEQ ID NO: 157771 - DNA, 15 bp, Homo sapiens
atcaagagaactact

SEQ ID NO: 157772 - DNA, 15 bp, Homo sapiens
tatcaagagaactac

SEQ ID NO: 157773 - DNA, 15 bp, Homo sapiens
atatcaagagaacta

SEQ ID NO: 157774 - DNA, 15 bp, Homo sapiens
aatatcaagagaact

SEQ ID NO: 157775 - DNA, 15 bp, Homo sapiens
taatatcaagagaac

SEQ ID NO: 157776 - DNA, 15 bp, Homo sapiens
ataatatcaagagaa

SEQ ID NO: 157777 - DNA, 15 bp, Homo sapiens
aataatatcaagaga

SEQ ID NO: 157778 - DNA, 15 bp, Homo sapiens
aaataatatcaagag

SEQ ID NO: 157779 - DNA, 15 bp, Homo sapiens
aaaataatatcaaga

SEQ ID NO: 157780 - DNA, 15 bp, Homo sapiens
taaaataatatcaag

SEQ ID NO: 157781 - DNA, 15 bp, Homo sapiens
ataaaataatatcaa

SEQ ID NO: 157782 - DNA, 15 bp, Homo sapiens
tataaaataatatca

SEQ ID NO: 157783 - DNA, 15 bp, Homo sapiens
atataaaataatatc

SEQ ID NO: 157784 - DNA, 15 bp, Homo sapiens
caatataaaataata

SEQ ID NO: 157785 - DNA, 15 bp, Homo sapiens
tcaatataaaataat

SEQ ID NO: 157786 - DNA, 15 bp, Homo sapiens
ttcaatataaaataa

SEQ ID NO: 157787 - DNA, 15 bp, Homo sapiens
tttcaatataaaata

SEQ ID NO: 157788 - DNA, 15 bp, Homo sapiens
ttttcaatataaaat

SEQ ID NO: 157789 - DNA, 15 bp, Homo sapiens
tttttcaatataaaa

SEQ ID NO: 157790 - DNA, 15 bp, Homo sapiens
ttttttcaatataaa

SEQ ID NO: 157791 - DNA, 15 bp, Homo sapiens
attttttcaatataa

SEQ ID NO: 157792 - DNA, 15 bp, Homo sapiens
gattttttcaatata

SEQ ID NO: 157793 - DNA, 15 bp, Homo sapiens
agattttttcaatat

SEQ ID NO: 157794 - DNA, 15 bp, Homo sapiens
aagattttttcaata

SEQ ID NO: 157795 - DNA, 15 bp, Homo sapiens
aaagattttttcaat

SEQ ID NO: 157796 - DNA, 15 bp, Homo sapiens
taaagattttttcaa

SEQ ID NO: 157797 - DNA, 15 bp, Homo sapiens
ttaaagattttttca

SEQ ID NO: 157798 - DNA, 15 bp, Homo sapiens
cttaaagattttttc

SEQ ID NO: 157799 - DNA, 15 bp, Homo sapiens
tcttaaagatttttt

SEQ ID NO: 157800 - DNA, 15 bp, Homo sapiens
ctcttaaagattttt

SEQ ID NO: 157801 - DNA, 15 bp, Homo sapiens
cctcttaaagatttt

SEQ ID NO: 157802 - DNA, 15 bp, Homo sapiens
acctcttaaagattt

SEQ ID NO: 157803 - DNA, 15 bp, Homo sapiens
aacctcttaaagatt

SEQ ID NO: 157804 - DNA, 15 bp, Homo sapiens
taacctcttaaagat

SEQ ID NO: 157805 - DNA, 15 bp, Homo sapiens
ttaacctcttaaaga

SEQ ID NO: 157806 - DNA, 15 bp, Homo sapiens
tttaacctcttaaag

SEQ ID NO: 157807 - DNA, 15 bp, Homo sapiens
gtttaacctcttaaa

SEQ ID NO: 157808 - DNA, 15 bp, Homo sapiens
tgtttaacctcttaa

SEQ ID NO: 157809 - DNA, 15 bp, Homo sapiens
ttgtttaacctctta

SEQ ID NO: 157810 - DNA, 15 bp, Homo sapiens
tttgtttaacctctt

SEQ ID NO: 157811 - DNA, 15 bp, Homo sapiens
atttgtttaacctct

SEQ ID NO: 157812 - DNA, 15 bp, Homo sapiens
tatttgtttaacctc

SEQ ID NO: 157813 - DNA, 15 bp, Homo sapiens
ttatttgtttaacct

SEQ ID NO: 157814 - DNA, 15 bp, Homo sapiens
attatttgtttaacc

SEQ ID NO: 157815 - DNA, 15 bp, Homo sapiens
aattatttgtttaac

SEQ ID NO: 157816 - DNA, 15 bp, Homo sapiens
taattatttgtttaa

SEQ ID NO: 157817 - DNA, 15 bp, Homo sapiens
ttaattatttgttta

SEQ ID NO: 157818 - DNA, 15 bp, Homo sapiens
cttaattatttgttt

SEQ ID NO: 157819 - DNA, 15 bp, Homo sapiens
ccttaattatttgtt

SEQ ID NO: 157820 - DNA, 15 bp, Homo sapiens
accttaattatttgt

SEQ ID NO: 157821 - DNA, 15 bp, Homo sapiens
taccttaattatttg

SEQ ID NO: 157822 - DNA, 15 bp, Homo sapiens
ttaccttaattattt

SEQ ID NO: 157823 - DNA, 15 bp, Homo sapiens
attaccttaattatt

SEQ ID NO: 157824 - DNA, 15 bp, Homo sapiens
aattaccttaattat

SEQ ID NO: 157825 - DNA, 15 bp, Homo sapiens
taattaccttaatta

SEQ ID NO: 157826 - DNA, 15 bp, Homo sapiens
ttaattaccttaatt

SEQ ID NO: 157827 - DNA, 15 bp, Homo sapiens
gttaattaccttaat

SEQ ID NO: 157828 - DNA, 15 bp, Homo sapiens
cgttaattaccttaa

SEQ ID NO: 157829 - DNA, 15 bp, Homo sapiens
tcgttaattacctta

SEQ ID NO: 157830 - DNA, 15 bp, Homo sapiens
ttcgttaattacctt

SEQ ID NO: 157831 - DNA, 15 bp, Homo sapiens
cttcgttaattacct

SEQ ID NO: 157832 - DNA, 15 bp, Homo sapiens
gcttcgttaattacc

SEQ ID NO: 157833 - DNA, 15 bp, Homo sapiens
tgcttcgttaattac

SEQ ID NO: 157834 - DNA, 15 bp, Homo sapiens
ctgcttcgttaatta

SEQ ID NO: 157835 - DNA, 15 bp, Homo sapiens
actgcttcgttaatt

SEQ ID NO: 157836 - DNA, 15 bp, Homo sapiens
cactgcttcgttaat

SEQ ID NO: 157837 - DNA, 15 bp, Homo sapiens
tcactgcttcgttaa

SEQ ID NO: 157838 - DNA, 15 bp, Homo sapiens
ctcactgcttcgtta

SEQ ID NO: 157839 - DNA, 15 bp, Homo sapiens
cctcactgcttcgtt

SEQ ID NO: 157840 - DNA, 15 bp, Homo sapiens
ccctcactgcttcgt

SEQ ID NO: 157841 - DNA, 15 bp, Homo sapiens
tccctcactgcttcg

SEQ ID NO: 157842 - DNA, 15 bp, Homo sapiens
gtccctcactgcttc

SEQ ID NO: 157843 - DNA, 15 bp, Homo sapiens
tgtccctcactgctt

SEQ ID NO: 157844 - DNA, 15 bp, Homo sapiens
gtgtccctcactgct

SEQ ID NO: 157845 - DNA, 15 bp, Homo sapiens
tgtgtccctcactgc

SEQ ID NO: 157846 - DNA, 15 bp, Homo sapiens
gtgtgtccctcactg

SEQ ID NO: 157847 - DNA, 15 bp, Homo sapiens
agtgtgtccctcact

SEQ ID NO: 157848 - DNA, 15 bp, Homo sapiens
cagtgtgtccctcac

SEQ ID NO: 157849 - DNA, 15 bp, Homo sapiens
ccagtgtgtccctca

SEQ ID NO: 157850 - DNA, 15 bp, Homo sapiens
cccagtgtgtccctc

SEQ ID NO: 157851 - DNA, 15 bp, Homo sapiens
acccagtgtgtccct

SEQ ID NO: 157852 - DNA, 15 bp, Homo sapiens
aacccagtgtgtccc

SEQ ID NO: 157853 - DNA, 15 bp, Homo sapiens
caacccagtgtgtcc

SEQ ID NO: 157854 - DNA, 15 bp, Homo sapiens
ccaacccagtgtgtc

SEQ ID NO: 157855 - DNA, 15 bp, Homo sapiens
tccaacccagtgtgt

SEQ ID NO: 157856 - DNA, 15 bp, Homo sapiens
ctccaacccagtgtg

SEQ ID NO: 157857 - DNA, 15 bp, Homo sapiens
cctccaacccagtgt

SEQ ID NO: 157858 - DNA, 15 bp, Homo sapiens
gcctccaacccagtg

SEQ ID NO: 157859 - DNA, 15 bp, Homo sapiens
cgcctccaacccagt

SEQ ID NO: 157860 - DNA, 15 bp, Homo sapiens
ccgcctccaacccag

SEQ ID NO: 157861 - DNA, 15 bp, Homo sapiens
cccgcctccaaccca

SEQ ID NO: 157862 - DNA, 15 bp, Homo sapiens
tcccgcctccaaccc

SEQ ID NO: 157863 - DNA, 15 bp, Homo sapiens
ctcccgcctccaacc

SEQ ID NO: 157864 - DNA, 15 bp, Homo sapiens
cctcccgcctccaac

SEQ ID NO: 157865 - DNA, 15 bp, Homo sapiens
acctcccgcctccaa

SEQ ID NO: 157866 - DNA, 15 bp, Homo sapiens
aacctcccgcctcca

SEQ ID NO: 157867 - DNA, 15 bp, Homo sapiens
taacctcccgcctcc

SEQ ID NO: 157868 - DNA, 15 bp, Homo sapiens
ataacctcccgcctc

SEQ ID NO: 157869 - DNA, 15 bp, Homo sapiens
aataacctcccgcct

SEQ ID NO: 157870 - DNA, 15 bp, Homo sapiens
taataacctcccgcc

SEQ ID NO: 157871 - DNA, 15 bp, Homo sapiens
ataataacctcccgc

SEQ ID NO: 157872 - DNA, 15 bp, Homo sapiens
aataataacctcccg

SEQ ID NO: 157873 - DNA, 15 bp, Homo sapiens
gaataataacctccc

SEQ ID NO: 157874 - DNA, 15 bp, Homo sapiens
agaataataacctcc

SEQ ID NO: 157875 - DNA, 15 bp, Homo sapiens
cagaataataacctc

SEQ ID NO: 157876 - DNA, 15 bp, Homo sapiens
ccagaataataacct

SEQ ID NO: 157877 - DNA, 15 bp, Homo sapiens
tccagaataataacc

SEQ ID NO: 157878 - DNA, 15 bp, Homo sapiens
gtccagaataataac

SEQ ID NO: 157879 - DNA, 15 bp, Homo sapiens
tgtccagaataataa

SEQ ID NO: 157880 - DNA, 15 bp, Homo sapiens
atgtccagaataata

SEQ ID NO: 157881 - DNA, 15 bp, Homo sapiens
tatgtccagaataat

SEQ ID NO: 157882 - DNA, 15 bp, Homo sapiens
gtatgtccagaataa

SEQ ID NO: 157883 - DNA, 15 bp, Homo sapiens
ggtatgtccagaata

SEQ ID NO: 157884 - DNA, 15 bp, Homo sapiens
aggtatgtccagaat

SEQ ID NO: 157885 - DNA, 15 bp, Homo sapiens
aaggtatgtccagaa

SEQ ID NO: 157886 - DNA, 15 bp, Homo sapiens
aaaggtatgtccaga

SEQ ID NO: 157887 - DNA, 15 bp, Homo sapiens
taaaggtatgtccag

SEQ ID NO: 157888 - DNA, 15 bp, Homo sapiens
ttaaaggtatgtcca

SEQ ID NO: 157889 - DNA, 15 bp, Homo sapiens
gttaaaggtatgtcc

SEQ ID NO: 157890 - DNA, 15 bp, Homo sapiens
agttaaaggtatgtc

SEQ ID NO: 157891 - DNA, 15 bp, Homo sapiens
cagttaaaggtatgt

SEQ ID NO: 157892 - DNA, 15 bp, Homo sapiens
acagttaaaggtatg

SEQ ID NO: 157893 - DNA, 15 bp, Homo sapiens
cacagttaaaggtat

SEQ ID NO: 157894 - DNA, 15 bp, Homo sapiens
tcacagttaaaggta

SEQ ID NO: 157895 - DNA, 15 bp, Homo sapiens
ctcacagttaaaggt

SEQ ID NO: 157896 - DNA, 15 bp, Homo sapiens
cctcacagttaaagg

SEQ ID NO: 157897 - DNA, 15 bp, Homo sapiens
tcctcacagttaaag

SEQ ID NO: 157898 - DNA, 15 bp, Homo sapiens
ctcctcacagttaaa

SEQ ID NO: 157899 - DNA, 15 bp, Homo sapiens
actcctcacagttaa

SEQ ID NO: 157900 - DNA, 15 bp, Homo sapiens
cactcctcacagtta

SEQ ID NO: 157901 - DNA, 15 bp, Homo sapiens
tcactcctcacagtt

SEQ ID NO: 157902 - DNA, 15 bp, Homo sapiens
ttcactcctcacagt

SEQ ID NO: 157903 - DNA, 15 bp, Homo sapiens
tttcactcctcacag

SEQ ID NO: 157904 - DNA, 15 bp, Homo sapiens
atttcactcctcaca

SEQ ID NO: 157905 - DNA, 15 bp, Homo sapiens
catttcactcctcac

SEQ ID NO: 157906 - DNA, 15 bp, Homo sapiens
ccatttcactcctca

SEQ ID NO: 157907 - DNA, 15 bp, Homo sapiens
tccatttcactcctc

SEQ ID NO: 157908 - DNA, 15 bp, Homo sapiens
atccatttcactcct

SEQ ID NO: 157909 - DNA, 15 bp, Homo sapiens
tatccatttcactcc

SEQ ID NO: 157910 - DNA, 15 bp, Homo sapiens
atatccatttcactc

SEQ ID NO: 157911 - DNA, 15 bp, Homo sapiens
catatccatttcact

SEQ ID NO: 157912 - DNA, 15 bp, Homo sapiens
acatatccatttcac

SEQ ID NO: 157913 - DNA, 15 bp, Homo sapiens
gacatatccatttca

SEQ ID NO: 157914 - DNA, 15 bp, Homo sapiens
tgacatatccatttc

SEQ ID NO: 157915 - DNA, 15 bp, Homo sapiens
ttgacatatccattt

SEQ ID NO: 157916 - DNA, 15 bp, Homo sapiens
gttgacatatccatt

SEQ ID NO: 157917 - DNA, 15 bp, Homo sapiens
agttgacatatccat

SEQ ID NO: 157918 - DNA, 15 bp, Homo sapiens
tagttgacatatcca

SEQ ID NO: 157919 - DNA, 15 bp, Homo sapiens
atagttgacatatcc

SEQ ID NO: 157920 - DNA, 15 bp, Homo sapiens
catagttgacatatc

SEQ ID NO: 157921 - DNA, 15 bp, Homo sapiens
gcatagttgacatat

SEQ ID NO: 157922 - DNA, 15 bp, Homo sapiens
agcatagttgacata

SEQ ID NO: 157923 - DNA, 15 bp, Homo sapiens
cagcatagttgacat

SEQ ID NO: 157924 - DNA, 15 bp, Homo sapiens
tcagcatagttgaca

SEQ ID NO: 157925 - DNA, 15 bp, Homo sapiens
ttcagcatagttgac

SEQ ID NO: 157926 - DNA, 15 bp, Homo sapiens
tttcagcatagttga

SEQ ID NO: 157927 - DNA, 15 bp, Homo sapiens
gtttcagcatagttg

SEQ ID NO: 157928 - DNA, 15 bp, Homo sapiens
agtttcagcatagtt

SEQ ID NO: 157929 - DNA, 15 bp, Homo sapiens
aagtttcagcatagt

SEQ ID NO: 157930 - DNA, 15 bp, Homo sapiens
caagtttcagcatag

SEQ ID NO: 157931 - DNA, 15 bp, Homo sapiens
acaagtttcagcata

SEQ ID NO: 157932 - DNA, 15 bp, Homo sapiens
aacaagtttcagcat

SEQ ID NO: 157933 - DNA, 15 bp, Homo sapiens
aaacaagtttcagca

SEQ ID NO: 157934 - DNA, 15 bp, Homo sapiens
aaaacaagtttcagc

SEQ ID NO: 157935 - DNA, 15 bp, Homo sapiens
aaaaacaagtttcag

SEQ ID NO: 157936 - DNA, 15 bp, Homo sapiens
aaaaaacaagtttca

SEQ ID NO: 157937 - DNA, 15 bp, Homo sapiens
aaaaaaacaagtttc

SEQ ID NO: 157938 - DNA, 15 bp, Homo sapiens
aaaaaaaacaagttt

SEQ ID NO: 157939 - DNA, 15 bp, Homo sapiens
taaaaaaaacaagtt

SEQ ID NO: 157940 - DNA, 15 bp, Homo sapiens
ttaaaaaaaacaagt

SEQ ID NO: 157941 - DNA, 15 bp, Homo sapiens
tttaaaaaaaacaag

SEQ ID NO: 157942 - DNA, 15 bp, Homo sapiens
atttaaaaaaaacaa

SEQ ID NO: 157943 - DNA, 15 bp, Homo sapiens
gatttaaaaaaaaca

SEQ ID NO: 157944 - DNA, 15 bp, Homo sapiens
agatttaaaaaaaac

SEQ ID NO: 157945 - DNA, 15 bp, Homo sapiens
gagatttaaaaaaaa

SEQ ID NO: 157946 - DNA, 15 bp, Homo sapiens
agagatttaaaaaaa

SEQ ID NO: 157947 - DNA, 15 bp, Homo sapiens
tagagatttaaaaaa

SEQ ID NO: 157948 - DNA, 15 bp, Homo sapiens
ttagagatttaaaaa

SEQ ID NO: 157949 - DNA, 15 bp, Homo sapiens
cttagagatttaaaa

SEQ ID NO: 157950 - DNA, 15 bp, Homo sapiens
acttagagatttaaa

SEQ ID NO: 157951 - DNA, 15 bp, Homo sapiens
aacttagagatttaa

SEQ ID NO: 157952 - DNA, 15 bp, Homo sapiens
caacttagagattta

SEQ ID NO: 157953 - DNA, 15 bp, Homo sapiens
tcaacttagagattt

SEQ ID NO: 157954 - DNA, 15 bp, Homo sapiens
atcaacttagagatt

SEQ ID NO: 157955 - DNA, 15 bp, Homo sapiens
aatcaacttagagat

SEQ ID NO: 157956 - DNA, 15 bp, Homo sapiens
aaatcaacttagaga

SEQ ID NO: 157957 - DNA, 15 bp, Homo sapiens
aaaatcaacttagag

SEQ ID NO: 157958 - DNA, 15 bp, Homo sapiens
caaaatcaacttaga

SEQ ID NO: 157959 - DNA, 15 bp, Homo sapiens
acaaaatcaacttag

SEQ ID NO: 157960 - DNA, 15 bp, Homo sapiens
tacaaaatcaactta

SEQ ID NO: 157961 - DNA, 15 bp, Homo sapiens
ttacaaaatcaactt

SEQ ID NO: 157962 - DNA, 15 bp, Homo sapiens
cttacaaaatcaact

SEQ ID NO: 157963 - DNA, 15 bp, Homo sapiens
ccttacaaaatcaac

SEQ ID NO: 157964 - DNA, 15 bp, Homo sapiens
accttacaaaatcaa

SEQ ID NO: 157965 - DNA, 15 bp, Homo sapiens
taccttacaaaatca

SEQ ID NO: 157966 - DNA, 15 bp, Homo sapiens
ataccttacaaaatc

SEQ ID NO: 157967 - DNA, 15 bp, Homo sapiens
tataccttacaaaat

SEQ ID NO: 157968 - DNA, 15 bp, Homo sapiens
ttataccttacaaaa

SEQ ID NO: 157969 - DNA, 15 bp, Homo sapiens
tttataccttacaaa

SEQ ID NO: 157970 - DNA, 15 bp, Homo sapiens
ttttataccttacaa

SEQ ID NO: 157971 - DNA, 15 bp, Homo sapiens
tttttataccttaca

SEQ ID NO: 157972 - DNA, 15 bp, Homo sapiens
ttttttataccttac

SEQ ID NO: 157973 - DNA, 15 bp, Homo sapiens
attttttatacctta

SEQ ID NO: 157974 - DNA, 15 bp, Homo sapiens
cattttttatacctt

SEQ ID NO: 157975 - DNA, 15 bp, Homo sapiens
acattttttatacct

SEQ ID NO: 157976 - DNA, 15 bp, Homo sapiens
aacattttttatacc

SEQ ID NO: 157977 - DNA, 15 bp, Homo sapiens
aaacattttttatac

SEQ ID NO: 157978 - DNA, 15 bp, Homo sapiens
aaaacattttttata

SEQ ID NO: 157979 - DNA, 15 bp, Homo sapiens
aaaaacattttttat

SEQ ID NO: 157980 - DNA, 15 bp, Homo sapiens
aaaaaacatttttta

SEQ ID NO: 157981 - DNA, 15 bp, Homo sapiens
taaaaaacatttttt

SEQ ID NO: 157982 - DNA, 15 bp, Homo sapiens
ctaaaaaacattttt

SEQ ID NO: 157983 - DNA, 15 bp, Homo sapiens
tctaaaaaacatttt

SEQ ID NO: 157984 - DNA, 15 bp, Homo sapiens
ttctaaaaaacattt

SEQ ID NO: 157985 - DNA, 15 bp, Homo sapiens
tttctaaaaaacatt

SEQ ID NO: 157986 - DNA, 15 bp, Homo sapiens
ttttctaaaaaacat

SEQ ID NO: 157987 - DNA, 15 bp, Homo sapiens
tttttctaaaaaaca

SEQ ID NO: 157988 - DNA, 15 bp, Homo sapiens
gtttttctaaaaaac

SEQ ID NO: 157989 - DNA, 15 bp, Homo sapiens
ggtttttctaaaaaa

SEQ ID NO: 157990 - DNA, 15 bp, Homo sapiens
aggtttttctaaaaa

SEQ ID NO: 157991 - DNA, 15 bp, Homo sapiens
gaggtttttctaaaa

SEQ ID NO: 157992 - DNA, 15 bp, Homo sapiens
agaggtttttctaaa

SEQ ID NO: 157993 - DNA, 15 bp, Homo sapiens
cagaggtttttctaa

SEQ ID NO: 157994 - DNA, 15 bp, Homo sapiens
tcagaggtttttcta

SEQ ID NO: 157995 - DNA, 15 bp, Homo sapiens
ttcagaggtttttct

SEQ ID NO: 157996 - DNA, 15 bp, Homo sapiens
attcagaggtttttc

SEQ ID NO: 157997 - DNA, 15 bp, Homo sapiens
cattcagaggttttt

SEQ ID NO: 157998 - DNA, 15 bp, Homo sapiens
acattcagaggtttt

SEQ ID NO: 157999 - DNA, 15 bp, Homo sapiens
gacattcagaggttt

SEQ ID NO: 158000 - DNA, 15 bp, Homo sapiens
tgacattcagaggtt

SEQ ID NO: 158001 - DNA, 15 bp, Homo sapiens
ttgacattcagaggt

SEQ ID NO: 158002 - DNA, 15 bp, Homo sapiens
tttgacattcagagg

SEQ ID NO: 158003 - DNA, 15 bp, Homo sapiens
ctttgacattcagag

SEQ ID NO: 158004 - DNA, 15 bp, Homo sapiens
tctttgacattcaga

SEQ ID NO: 158005 - DNA, 15 bp, Homo sapiens
ttctttgacattcag

SEQ ID NO: 158006 - DNA, 15 bp, Homo sapiens
cttctttgacattca

SEQ ID NO: 158007 - DNA, 15 bp, Homo sapiens
acttctttgacattc

SEQ ID NO: 158008 - DNA, 15 bp, Homo sapiens
tacttctttgacatt

SEQ ID NO: 158009 - DNA, 15 bp, Homo sapiens
atacttctttgacat

SEQ ID NO: 158010 - DNA, 15 bp, Homo sapiens
tatacttctttgaca

SEQ ID NO: 158011 - DNA, 15 bp, Homo sapiens
ttatacttctttgac

SEQ ID NO: 158012 - DNA, 15 bp, Homo sapiens
attatacttctttga

SEQ ID NO: 158013 - DNA, 15 bp, Homo sapiens
cattatacttctttg

SEQ ID NO: 158014 - DNA, 15 bp, Homo sapiens
tcattatacttcttt

SEQ ID NO: 158015 - DNA, 15 bp, Homo sapiens
gtcattatacttctt

SEQ ID NO: 158016 - DNA, 15 bp, Homo sapiens
tgtcattatacttct

SEQ ID NO: 158017 - DNA, 15 bp, Homo sapiens
ctgtcattatacttc

SEQ ID NO: 158018 - DNA, 15 bp, Homo sapiens
gctgtcattatactt

SEQ ID NO: 158019 - DNA, 15 bp, Homo sapiens
agctgtcattatact

SEQ ID NO: 158020 - DNA, 15 bp, Homo sapiens
aagctgtcattatac

SEQ ID NO: 158021 - DNA, 15 bp, Homo sapiens
caagctgtcattata

SEQ ID NO: 158022 - DNA, 15 bp, Homo sapiens
tcaagctgtcattat

SEQ ID NO: 158023 - DNA, 15 bp, Homo sapiens
ttcaagctgtcatta

SEQ ID NO: 158024 - DNA, 15 bp, Homo sapiens
attcaagctgtcatt

SEQ ID NO: 158025 - DNA, 15 bp, Homo sapiens
tattcaagctgtcat

SEQ ID NO: 158026 - DNA, 15 bp, Homo sapiens
atattcaagctgtca

SEQ ID NO: 158027 - DNA, 15 bp, Homo sapiens
catattcaagctgtc

SEQ ID NO: 158028 - DNA, 15 bp, Homo sapiens
gcatattcaagctgt

SEQ ID NO: 158029 - DNA, 15 bp, Homo sapiens
tgcatattcaagctg

SEQ ID NO: 158030 - DNA, 15 bp, Homo sapiens
atgcatattcaagct

SEQ ID NO: 158031 - DNA, 15 bp, Homo sapiens
tatgcatattcaagc

SEQ ID NO: 158032 - DNA, 15 bp, Homo sapiens
atatgcatattcaag

SEQ ID NO: 158033 - DNA, 15 bp, Homo sapiens
tatatgcatattcaa

SEQ ID NO: 158034 - DNA, 15 bp, Homo sapiens
gtatatgcatattca

SEQ ID NO: 158035 - DNA, 15 bp, Homo sapiens
tgtatatgcatattc

SEQ ID NO: 158036 - DNA, 15 bp, Homo sapiens
ctgtatatgcatatt

SEQ ID NO: 158037 - DNA, 15 bp, Homo sapiens
gctgtatatgcatat

SEQ ID NO: 158038 - DNA, 15 bp, Homo sapiens
tgctgtatatgcata

SEQ ID NO: 158039 - DNA, 15 bp, Homo sapiens
ttgctgtatatgcat

SEQ ID NO: 158040 - DNA, 15 bp, Homo sapiens
tttgctgtatatgca

SEQ ID NO: 158041 - DNA, 15 bp, Homo sapiens
atttgctgtatatgc

SEQ ID NO: 158042 - DNA, 15 bp, Homo sapiens
gatttgctgtatatg

SEQ ID NO: 158043 - DNA, 15 bp, Homo sapiens
tgatttgctgtatat

SEQ ID NO: 158044 - DNA, 15 bp, Homo sapiens
gtgatttgctgtata

SEQ ID NO: 158045 - DNA, 15 bp, Homo sapiens
agtgatttgctgtat

SEQ ID NO: 158046 - DNA, 15 bp, Homo sapiens
aagtgatttgctgta

SEQ ID NO: 158047 - DNA, 15 bp, Homo sapiens
taagtgatttgctgt

SEQ ID NO: 158048 - DNA, 15 bp, Homo sapiens
ataagtgatttgctg

SEQ ID NO: 158049 - DNA, 15 bp, Homo sapiens
tataagtgatttgct

SEQ ID NO: 158050 - DNA, 15 bp, Homo sapiens
ttataagtgatttgc

SEQ ID NO: 158051 - DNA, 15 bp, Homo sapiens
attataagtgatttg

SEQ ID NO: 158052 - DNA, 15 bp, Homo sapiens
aattataagtgattt

SEQ ID NO: 158053 - DNA, 15 bp, Homo sapiens
aaattataagtgatt

SEQ ID NO: 158054 - DNA, 15 bp, Homo sapiens
aaaattataagtgat

SEQ ID NO: 158055 - DNA, 15 bp, Homo sapiens
caaaattataagtga

SEQ ID NO: 158056 - DNA, 15 bp, Homo sapiens
acaaaattataagtg

SEQ ID NO: 158057 - DNA, 15 bp, Homo sapiens
aacaaaattataagt

SEQ ID NO: 158058 - DNA, 15 bp, Homo sapiens
aaacaaaattataag

SEQ ID NO: 158059 - DNA, 15 bp, Homo sapiens
caaacaaaattataa

SEQ ID NO: 158060 - DNA, 15 bp, Homo sapiens
ccaaacaaaattata

SEQ ID NO: 158061 - DNA, 15 bp, Homo sapiens
gccaaacaaaattat

SEQ ID NO: 158062 - DNA, 15 bp, Homo sapiens
tgccaaacaaaatta

SEQ ID NO: 158063 - DNA, 15 bp, Homo sapiens
ttgccaaacaaaatt

SEQ ID NO: 158064 - DNA, 15 bp, Homo sapiens
tttgccaaacaaaat

SEQ ID NO: 158065 - DNA, 15 bp, Homo sapiens
atttgccaaacaaaa

SEQ ID NO: 158066 - DNA, 15 bp, Homo sapiens
catttgccaaacaaa

SEQ ID NO: 158067 - DNA, 15 bp, Homo sapiens
tcatttgccaaacaa

SEQ ID NO: 158068 - DNA, 15 bp, Homo sapiens
ttcatttgccaaaca

SEQ ID NO: 158069 - DNA, 15 bp, Homo sapiens
tttcatttgccaaac

SEQ ID NO: 158070 - DNA, 15 bp, Homo sapiens
ttttcatttgccaaa

SEQ ID NO: 158071 - DNA, 15 bp, Homo sapiens
attttcatttgccaa

SEQ ID NO: 158072 - DNA, 15 bp, Homo sapiens
tattttcatttgcca

SEQ ID NO: 158073 - DNA, 15 bp, Homo sapiens
ctattttcatttgcc

SEQ ID NO: 158074 - DNA, 15 bp, Homo sapiens
tctattttcatttgc

SEQ ID NO: 158075 - DNA, 15 bp, Homo sapiens
atctattttcatttg

SEQ ID NO: 158076 - DNA, 15 bp, Homo sapiens
aatctattttcattt

SEQ ID NO: 158077 - DNA, 15 bp, Homo sapiens
aaatctattttcatt

SEQ ID NO: 158078 - DNA, 15 bp, Homo sapiens
gaaatctattttcat

SEQ ID NO: 158079 - DNA, 15 bp, Homo sapiens
tgaaatctattttca

SEQ ID NO: 158080 - DNA, 15 bp, Homo sapiens
atgaaatctattttc

SEQ ID NO: 158081 - DNA, 15 bp, Homo sapiens
aatgaaatctatttt

SEQ ID NO: 158082 - DNA, 15 bp, Homo sapiens
taatgaaatctattt

SEQ ID NO: 158083 - DNA, 15 bp, Homo sapiens
ctaatgaaatctatt

SEQ ID NO: 158084 - DNA, 15 bp, Homo sapiens
gctaatgaaatctat

SEQ ID NO: 158085 - DNA, 15 bp, Homo sapiens
agctaatgaaatcta

SEQ ID NO: 158086 - DNA, 15 bp, Homo sapiens
aagctaatgaaatct

SEQ ID NO: 158087 - DNA, 15 bp, Homo sapiens
aaagctaatgaaatc

SEQ ID NO: 158088 - DNA, 15 bp, Homo sapiens
taaagctaatgaaat

SEQ ID NO: 158089 - DNA, 15 bp, Homo sapiens
ttaaagctaatgaaa

SEQ ID NO: 158090 - DNA, 15 bp, Homo sapiens
tttaaagctaatgaa

SEQ ID NO: 158091 - DNA, 15 bp, Homo sapiens
ttttaaagctaatga

SEQ ID NO: 158092 - DNA, 15 bp, Homo sapiens
attttaaagctaatg

SEQ ID NO: 158093 - DNA, 15 bp, Homo sapiens
tattttaaagctaat

SEQ ID NO: 158094 - DNA, 15 bp, Homo sapiens
ctattttaaagctaa

SEQ ID NO: 158095 - DNA, 15 bp, Homo sapiens
gctattttaaagcta

SEQ ID NO: 158096 - DNA, 15 bp, Homo sapiens
tgctattttaaagct

SEQ ID NO: 158097 - DNA, 15 bp, Homo sapiens
atgctattttaaagc

SEQ ID NO: 158098 - DNA, 15 bp, Homo sapiens
aatgctattttaaag

SEQ ID NO: 158099 - DNA, 15 bp, Homo sapiens
aaatgctattttaaa

SEQ ID NO: 158100 - DNA, 15 bp, Homo sapiens
taaatgctattttaa

SEQ ID NO: 158101 - DNA, 15 bp, Homo sapiens
gtaaatgctatttta

SEQ ID NO: 158102 - DNA, 15 bp, Homo sapiens
tgtaaatgctatttt

SEQ ID NO: 158103 - DNA, 15 bp, Homo sapiens
gtgtaaatgctattt

SEQ ID NO: 158104 - DNA, 15 bp, Homo sapiens
agtgtaaatgctatt

SEQ ID NO: 158105 - DNA, 15 bp, Homo sapiens
aagtgtaaatgctat

SEQ ID NO: 158106 - DNA, 15 bp, Homo sapiens
aaagtgtaaatgcta

SEQ ID NO: 158107 - DNA, 15 bp, Homo sapiens
aaaagtgtaaatgct

SEQ ID NO: 158108 - DNA, 15 bp, Homo sapiens
taaaagtgtaaatgc

SEQ ID NO: 158109 - DNA, 15 bp, Homo sapiens
gtaaaagtgtaaatg

SEQ ID NO: 158110 - DNA, 15 bp, Homo sapiens
agtaaaagtgtaaat

SEQ ID NO: 158111 - DNA, 15 bp, Homo sapiens
gagtaaaagtgtaaa

SEQ ID NO: 158112 - DNA, 15 bp, Homo sapiens
agagtaaaagtgtaa

SEQ ID NO: 158113 - DNA, 15 bp, Homo sapiens
aagagtaaaagtgta

SEQ ID NO: 158114 - DNA, 15 bp, Homo sapiens
caagagtaaaagtgt

SEQ ID NO: 158115 - DNA, 15 bp, Homo sapiens
ccaagagtaaaagtg

SEQ ID NO: 158116 - DNA, 15 bp, Homo sapiens
tccaagagtaaaagt

SEQ ID NO: 158117 - DNA, 15 bp, Homo sapiens
atccaagagtaaaag

SEQ ID NO: 158118 - DNA, 15 bp, Homo sapiens
tatccaagagtaaaa

SEQ ID NO: 158119 - DNA, 15 bp, Homo sapiens
atatccaagagtaaa

SEQ ID NO: 158120 - DNA, 15 bp, Homo sapiens
tatatccaagagtaa

SEQ ID NO: 158121 - DNA, 15 bp, Homo sapiens
atatatccaagagta

SEQ ID NO: 158122 - DNA, 15 bp, Homo sapiens
aatatatccaagagt

SEQ ID NO: 158123 - DNA, 15 bp, Homo sapiens
taatatatccaagag

SEQ ID NO: 158124 - DNA, 15 bp, Homo sapiens
ttaatatatccaaga

SEQ ID NO: 158125 - DNA, 15 bp, Homo sapiens
tttaatatatccaag

SEQ ID NO: 158126 - DNA, 15 bp, Homo sapiens
ttttaatatatccaa

SEQ ID NO: 158127 - DNA, 15 bp, Homo sapiens
tttttaatatatcca

SEQ ID NO: 158128 - DNA, 15 bp, Homo sapiens
ctttttaatatatcc

SEQ ID NO: 158129 - DNA, 15 bp, Homo sapiens
tctttttaatatatc

SEQ ID NO: 158130 - DNA, 15 bp, Homo sapiens
ttctttttaatatat

SEQ ID NO: 158131 - DNA, 15 bp, Homo sapiens
tttctttttaatata

SEQ ID NO: 158132 - DNA, 15 bp, Homo sapiens
ctttctttttaatat

SEQ ID NO: 158133 - DNA, 15 bp, Homo sapiens
actttctttttaata

SEQ ID NO: 158134 - DNA, 15 bp, Homo sapiens
cactttctttttaat

SEQ ID NO: 158135 - DNA, 15 bp, Homo sapiens
gcactttctttttaa

SEQ ID NO: 158136 - DNA, 15 bp, Homo sapiens
tgcactttcttttta

SEQ ID NO: 158137 - DNA, 15 bp, Homo sapiens
gtgcactttcttttt

SEQ ID NO: 158138 - DNA, 15 bp, Homo sapiens
tgtgcactttctttt

SEQ ID NO: 158139 - DNA, 15 bp, Homo sapiens
atgtgcactttcttt

SEQ ID NO: 158140 - DNA, 15 bp, Homo sapiens
aatgtgcactttctt

SEQ ID NO: 158141 - DNA, 15 bp, Homo sapiens
aaatgtgcactttct

SEQ ID NO: 158142 - DNA, 15 bp, Homo sapiens
aaaatgtgcactttc

SEQ ID NO: 158143 - DNA, 15 bp, Homo sapiens
caaaatgtgcacttt

SEQ ID NO: 158144 - DNA, 15 bp, Homo sapiens
acaaaatgtgcactt

SEQ ID NO: 158145 - DNA, 15 bp, Homo sapiens
tacaaaatgtgcact

SEQ ID NO: 158146 - DNA, 15 bp, Homo sapiens
ttacaaaatgtgcac

SEQ ID NO: 158147 - DNA, 15 bp, Homo sapiens
tttacaaaatgtgca

SEQ ID NO: 158148 - DNA, 15 bp, Homo sapiens
ttttacaaaatgtgc

SEQ ID NO: 158149 - DNA, 15 bp, Homo sapiens
attttacaaaatgtg

SEQ ID NO: 158150 - DNA, 15 bp, Homo sapiens
cattttacaaaatgt

SEQ ID NO: 158151 - DNA, 15 bp, Homo sapiens
tacattttacaaaat

SEQ ID NO: 158152 - DNA, 15 bp, Homo sapiens
ctacattttacaaaa

SEQ ID NO: 158153 - DNA, 15 bp, Homo sapiens
actacattttacaaa

SEQ ID NO: 158154 - DNA, 15 bp, Homo sapiens
tactacattttacaa

SEQ ID NO: 158155 - DNA, 15 bp, Homo sapiens
ctactacattttaca

SEQ ID NO: 158156 - DNA, 15 bp, Homo sapiens
tctactacattttac

SEQ ID NO: 158157 - DNA, 15 bp, Homo sapiens
ttctactacatttta

SEQ ID NO: 158158 - DNA, 15 bp, Homo sapiens
tttctactacatttt

SEQ ID NO: 158159 - DNA, 15 bp, Homo sapiens
ctttctactacattt

SEQ ID NO: 158160 - DNA, 15 bp, Homo sapiens
cctttctactacatt

SEQ ID NO: 158161 - DNA, 15 bp, Homo sapiens
tcctttctactacat

SEQ ID NO: 158162 - DNA, 15 bp, Homo sapiens
ttcctttctactaca

SEQ ID NO: 158163 - DNA, 15 bp, Homo sapiens
cttcctttctactac

SEQ ID NO: 158164 - DNA, 15 bp, Homo sapiens
ccttcctttctacta

SEQ ID NO: 158165 - DNA, 15 bp, Homo sapiens
tccttcctttctact

SEQ ID NO: 158166 - DNA, 15 bp, Homo sapiens
ttccttcctttctac

SEQ ID NO: 158167 - DNA, 15 bp, Homo sapiens
cttccttcctttcta

SEQ ID NO: 158168 - DNA, 15 bp, Homo sapiens
tcttccttcctttct

SEQ ID NO: 158169 - DNA, 15 bp, Homo sapiens
ttcttccttcctttc

SEQ ID NO: 158170 - DNA, 15 bp, Homo sapiens
cttcttccttccttt

SEQ ID NO: 158171 - DNA, 15 bp, Homo sapiens
tcttcttccttcctt

SEQ ID NO: 158172 - DNA, 15 bp, Homo sapiens
ttcttcttccttcct

SEQ ID NO: 158173 - DNA, 15 bp, Homo sapiens
tttcttcttccttcc

SEQ ID NO: 158174 - DNA, 15 bp, Homo sapiens
ttttcttcttccttc

SEQ ID NO: 158175 - DNA, 15 bp, Homo sapiens
attttcttcttcctt

SEQ ID NO: 158176 - DNA, 15 bp, Homo sapiens
tattttcttcttcct

SEQ ID NO: 158177 - DNA, 15 bp, Homo sapiens
ttattttcttcttcc

SEQ ID NO: 158178 - DNA, 15 bp, Homo sapiens
tttattttcttcttc

SEQ ID NO: 158179 - DNA, 15 bp, Homo sapiens
ttttattttcttctt

SEQ ID NO: 158180 - DNA, 15 bp, Homo sapiens
gttttattttcttct

SEQ ID NO: 158181 - DNA, 15 bp, Homo sapiens
agttttattttcttc

SEQ ID NO: 158182 - DNA, 15 bp, Homo sapiens
aagttttattttctt

SEQ ID NO: 158183 - DNA, 15 bp, Homo sapiens
taagttttattttct

SEQ ID NO: 158184 - DNA, 15 bp, Homo sapiens
gtaagttttattttc

SEQ ID NO: 158185 - DNA, 15 bp, Homo sapiens
ggtaagttttatttt

SEQ ID NO: 158186 - DNA, 15 bp, Homo sapiens
tggtaagttttattt

SEQ ID NO: 158187 - DNA, 15 bp, Homo sapiens
ctggtaagttttatt

SEQ ID NO: 158188 - DNA, 15 bp, Homo sapiens
actggtaagttttat

SEQ ID NO: 158189 - DNA, 15 bp, Homo sapiens
aactggtaagtttta

SEQ ID NO: 158190 - DNA, 15 bp, Homo sapiens
taactggtaagtttt

SEQ ID NO: 158191 - DNA, 15 bp, Homo sapiens
ttaactggtaagttt

SEQ ID NO: 158192 - DNA, 15 bp, Homo sapiens
gttaactggtaagtt

SEQ ID NO: 158193 - DNA, 15 bp, Homo sapiens
ggttaactggtaagt

SEQ ID NO: 158194 - DNA, 15 bp, Homo sapiens
tggttaactggtaag

SEQ ID NO: 158195 - DNA, 15 bp, Homo sapiens
atggttaactggtaa

SEQ ID NO: 158196 - DNA, 15 bp, Homo sapiens
tatggttaactggta

SEQ ID NO: 158197 - DNA, 15 bp, Homo sapiens
gtatggttaactggt

SEQ ID NO: 158198 - DNA, 15 bp, Homo sapiens
agtatggttaactgg

SEQ ID NO: 158199 - DNA, 15 bp, Homo sapiens
tagtatggttaactg

SEQ ID NO: 158200 - DNA, 15 bp, Homo sapiens
atagtatggttaact

SEQ ID NO: 158201 - DNA, 15 bp, Homo sapiens
aatagtatggttaac

SEQ ID NO: 158202 - DNA, 15 bp, Homo sapiens
gaatagtatggttaa

SEQ ID NO: 158203 - DNA, 15 bp, Homo sapiens
tgaatagtatggtta

SEQ ID NO: 158204 - DNA, 15 bp, Homo sapiens
ctgaatagtatggtt

SEQ ID NO: 158205 - DNA, 15 bp, Homo sapiens
tctgaatagtatggt

SEQ ID NO: 158206 - DNA, 15 bp, Homo sapiens
ttctgaatagtatgg

SEQ ID NO: 158207 - DNA, 15 bp, Homo sapiens
cttctgaatagtatg

SEQ ID NO: 158208 - DNA, 15 bp, Homo sapiens
ccttctgaatagtat

SEQ ID NO: 158209 - DNA, 15 bp, Homo sapiens
cccttctgaatagta

SEQ ID NO: 158210 - DNA, 15 bp, Homo sapiens
tcccttctgaatagt

SEQ ID NO: 158211 - DNA, 15 bp, Homo sapiens
ttcccttctgaatag

SEQ ID NO: 158212 - DNA, 15 bp, Homo sapiens
attcccttctgaata

SEQ ID NO: 158213 - DNA, 15 bp, Homo sapiens
tattcccttctgaat

SEQ ID NO: 158214 - DNA, 15 bp, Homo sapiens
atattcccttctgaa

SEQ ID NO: 158215 - DNA, 15 bp, Homo sapiens
aatattcccttctga

SEQ ID NO: 158216 - DNA, 15 bp, Homo sapiens
taatattcccttctg

SEQ ID NO: 158217 - DNA, 15 bp, Homo sapiens
ataatattcccttct

SEQ ID NO: 158218 - DNA, 15 bp, Homo sapiens
aataatattcccttc

SEQ ID NO: 158219 - DNA, 15 bp, Homo sapiens
taataatattccctt

SEQ ID NO: 158220 - DNA, 15 bp, Homo sapiens
ttaataatattccct

SEQ ID NO: 158221 - DNA, 15 bp, Homo sapiens
attaataatattccc

SEQ ID NO: 158222 - DNA, 15 bp, Homo sapiens
cattaataatattcc

SEQ ID NO: 158223 - DNA, 15 bp, Homo sapiens
acattaataatattc

SEQ ID NO: 158224 - DNA, 15 bp, Homo sapiens
gacattaataatatt

SEQ ID NO: 158225 - DNA, 15 bp, Homo sapiens
agacattaataatat

SEQ ID NO: 158226 - DNA, 15 bp, Homo sapiens
aagacattaataata

SEQ ID NO: 158227 - DNA, 15 bp, Homo sapiens
taagacattaataat

SEQ ID NO: 158228 - DNA, 15 bp, Homo sapiens
gtaagacattaataa

SEQ ID NO: 158229 - DNA, 15 bp, Homo sapiens
agtaagacattaata

SEQ ID NO: 158230 - DNA, 15 bp, Homo sapiens
aagtaagacattaat

SEQ ID NO: 158231 - DNA, 15 bp, Homo sapiens
aaagtaagacattaa

SEQ ID NO: 158232 - DNA, 15 bp, Homo sapiens
gaaagtaagacatta

SEQ ID NO: 158233 - DNA, 15 bp, Homo sapiens
tgaaagtaagacatt

SEQ ID NO: 158234 - DNA, 15 bp, Homo sapiens
atgaaagtaagacat

SEQ ID NO: 158235 - DNA, 15 bp, Homo sapiens
aatgaaagtaagaca

SEQ ID NO: 158236 - DNA, 15 bp, Homo sapiens
aaatgaaagtaagac

SEQ ID NO: 158237 - DNA, 15 bp, Homo sapiens
gaaatgaaagtaaga

SEQ ID NO: 158238 - DNA, 15 bp, Homo sapiens
tgaaatgaaagtaag

SEQ ID NO: 158239 - DNA, 15 bp, Homo sapiens
gtgaaatgaaagtaa

SEQ ID NO: 158240 - DNA, 15 bp, Homo sapiens
agtgaaatgaaagta

SEQ ID NO: 158241 - DNA, 15 bp, Homo sapiens
gagtgaaatgaaagt

SEQ ID NO: 158242 - DNA, 15 bp, Homo sapiens
agagtgaaatgaaag

SEQ ID NO: 158243 - DNA, 15 bp, Homo sapiens
aagagtgaaatgaaa

SEQ ID NO: 158244 - DNA, 15 bp, Homo sapiens
gaagagtgaaatgaa

SEQ ID NO: 158245 - DNA, 15 bp, Homo sapiens
agaagagtgaaatga

SEQ ID NO: 158246 - DNA, 15 bp, Homo sapiens
aagaagagtgaaatg

SEQ ID NO: 158247 - DNA, 15 bp, Homo sapiens
aaagaagagtgaaat

SEQ ID NO: 158248 - DNA, 15 bp, Homo sapiens
aaaagaagagtgaaa

SEQ ID NO: 158249 - DNA, 15 bp, Homo sapiens
gaaaagaagagtgaa

SEQ ID NO: 158250 - DNA, 15 bp, Homo sapiens
agaaaagaagagtga

SEQ ID NO: 158251 - DNA, 15 bp, Homo sapiens
cagaaaagaagagtg

SEQ ID NO: 158252 - DNA, 15 bp, Homo sapiens
acagaaaagaagagt

SEQ ID NO: 158253 - DNA, 15 bp, Homo sapiens
cacagaaaagaagag

SEQ ID NO: 158254 - DNA, 15 bp, Homo sapiens
acacagaaaagaaga

SEQ ID NO: 158255 - DNA, 15 bp, Homo sapiens
cacacagaaaagaag

SEQ ID NO: 158256 - DNA, 15 bp, Homo sapiens
acacacagaaaagaa

SEQ ID NO: 158257 - DNA, 15 bp, Homo sapiens
tacacacagaaaaga

SEQ ID NO: 158258 - DNA, 15 bp, Homo sapiens
gtacacacagaaaag

SEQ ID NO: 158259 - DNA, 15 bp, Homo sapiens
tgtacacacagaaaa

SEQ ID NO: 158260 - DNA, 15 bp, Homo sapiens
gtgtacacacagaaa

SEQ ID NO: 158261 - DNA, 15 bp, Homo sapiens
tgtgtacacacagaa

SEQ ID NO: 158262 - DNA, 15 bp, Homo sapiens
ctgtgtacacacaga

SEQ ID NO: 158263 - DNA, 15 bp, Homo sapiens
cctgtgtacacacag

SEQ ID NO: 158264 - DNA, 15 bp, Homo sapiens
gcctgtgtacacaca

SEQ ID NO: 158265 - DNA, 15 bp, Homo sapiens
tgcctgtgtacacac

SEQ ID NO: 158266 - DNA, 15 bp, Homo sapiens
atgcctgtgtacaca

SEQ ID NO: 158267 - DNA, 15 bp, Homo sapiens
tatgcctgtgtacac

SEQ ID NO: 158268 - DNA, 15 bp, Homo sapiens
gtatgcctgtgtaca

SEQ ID NO: 158269 - DNA, 15 bp, Homo sapiens
ggtatgcctgtgtac

SEQ ID NO: 158270 - DNA, 15 bp, Homo sapiens
gggtatgcctgtgta

SEQ ID NO: 158271 - DNA, 15 bp, Homo sapiens
ggggtatgcctgtgt

SEQ ID NO: 158272 - DNA, 15 bp, Homo sapiens
gggggtatgcctgtg

SEQ ID NO: 158273 - DNA, 15 bp, Homo sapiens
tgggggtatgcctgt

SEQ ID NO: 158274 - DNA, 15 bp, Homo sapiens
atgggggtatgcctg

SEQ ID NO: 158275 - DNA, 15 bp, Homo sapiens
gatgggggtatgcct

SEQ ID NO: 158276 - DNA, 15 bp, Homo sapiens
agatgggggtatgcc

SEQ ID NO: 158277 - DNA, 15 bp, Homo sapiens
aagatgggggtatgc

SEQ ID NO: 158278 - DNA, 15 bp, Homo sapiens
taagatgggggtatg

SEQ ID NO: 158279 - DNA, 15 bp, Homo sapiens
ataagatgggggtat

SEQ ID NO: 158280 - DNA, 15 bp, Homo sapiens
gataagatgggggta

SEQ ID NO: 158281 - DNA, 15 bp, Homo sapiens
tgataagatgggggt

SEQ ID NO: 158282 - DNA, 15 bp, Homo sapiens
gtgataagatggggg

SEQ ID NO: 158283 - DNA, 15 bp, Homo sapiens
tgtgataagatgggg

SEQ ID NO: 158284 - DNA, 15 bp, Homo sapiens
gtgtgataagatggg

SEQ ID NO: 158285 - DNA, 15 bp, Homo sapiens
tgtgtgataagatgg

SEQ ID NO: 158286 - DNA, 15 bp, Homo sapiens
atgtgtgataagatg

SEQ ID NO: 158287 - DNA, 15 bp, Homo sapiens
tatgtgtgataagat

SEQ ID NO: 158288 - DNA, 15 bp, Homo sapiens
ctatgtgtgataaga

SEQ ID NO: 158289 - DNA, 15 bp, Homo sapiens
agctatgtgtgataa

SEQ ID NO: 158290 - DNA, 15 bp, Homo sapiens
aagctatgtgtgata

SEQ ID NO: 158291 - DNA, 15 bp, Homo sapiens
aaagctatgtgtgat

SEQ ID NO: 158292 - DNA, 15 bp, Homo sapiens
taaagctatgtgtga

SEQ ID NO: 158293 - DNA, 15 bp, Homo sapiens
gtaaagctatgtgtg

SEQ ID NO: 158294 - DNA, 15 bp, Homo sapiens
agtaaagctatgtgt

SEQ ID NO: 158295 - DNA, 15 bp, Homo sapiens
cagtaaagctatgtg

SEQ ID NO: 158296 - DNA, 15 bp, Homo sapiens
acagtaaagctatgt

SEQ ID NO: 158297 - DNA, 15 bp, Homo sapiens
cacagtaaagctatg

SEQ ID NO: 158298 - DNA, 15 bp, Homo sapiens
gcacagtaaagctat

SEQ ID NO: 158299 - DNA, 15 bp, Homo sapiens
agcacagtaaagcta

SEQ ID NO: 158300 - DNA, 15 bp, Homo sapiens
aagcacagtaaagct

SEQ ID NO: 158301 - DNA, 15 bp, Homo sapiens
aaagcacagtaaagc

SEQ ID NO: 158302 - DNA, 15 bp, Homo sapiens
gaaagcacagtaaag

SEQ ID NO: 158303 - DNA, 15 bp, Homo sapiens
ggaaagcacagtaaa

SEQ ID NO: 158304 - DNA, 15 bp, Homo sapiens
tggaaagcacagtaa

SEQ ID NO: 158305 - DNA, 15 bp, Homo sapiens
ctggaaagcacagta

SEQ ID NO: 158306 - DNA, 15 bp, Homo sapiens
gctggaaagcacagt

SEQ ID NO: 158307 - DNA, 15 bp, Homo sapiens
agctggaaagcacag

SEQ ID NO: 158308 - DNA, 15 bp, Homo sapiens
cagctggaaagcaca

SEQ ID NO: 158309 - DNA, 15 bp, Homo sapiens
acagctggaaagcac

SEQ ID NO: 158310 - DNA, 15 bp, Homo sapiens
tacagctggaaagca

SEQ ID NO: 158311 - DNA, 15 bp, Homo sapiens
ctacagctggaaagc

SEQ ID NO: 158312 - DNA, 15 bp, Homo sapiens
gctacagctggaaag

SEQ ID NO: 158313 - DNA, 15 bp, Homo sapiens
tgctacagctggaaa

SEQ ID NO: 158314 - DNA, 15 bp, Homo sapiens
atgctacagctggaa

SEQ ID NO: 158315 - DNA, 15 bp, Homo sapiens
aatgctacagctgga

SEQ ID NO: 158316 - DNA, 15 bp, Homo sapiens
aaatgctacagctgg

SEQ ID NO: 158317 - DNA, 15 bp, Homo sapiens
aaaatgctacagctg

SEQ ID NO: 158318 - DNA, 15 bp, Homo sapiens
aaaaatgctacagct

SEQ ID NO: 158319 - DNA, 15 bp, Homo sapiens
taaaaatgctacagc

SEQ ID NO: 158320 - DNA, 15 bp, Homo sapiens
gtaaaaatgctacag

SEQ ID NO: 158321 - DNA, 15 bp, Homo sapiens
tgtaaaaatgctaca

SEQ ID NO: 158322 - DNA, 15 bp, Homo sapiens
ttgtaaaaatgctac

SEQ ID NO: 158323 - DNA, 15 bp, Homo sapiens
tttgtaaaaatgcta

SEQ ID NO: 158324 - DNA, 15 bp, Homo sapiens
atttgtaaaaatgct

SEQ ID NO: 158325 - DNA, 15 bp, Homo sapiens
aatttgtaaaaatgc

SEQ ID NO: 158326 - DNA, 15 bp, Homo sapiens
caatttgtaaaaatg

SEQ ID NO: 158327 - DNA, 15 bp, Homo sapiens
tcaatttgtaaaaat

SEQ ID NO: 158328 - DNA, 15 bp, Homo sapiens
ttcaatttgtaaaaa

SEQ ID NO: 158329 - DNA, 15 bp, Homo sapiens
tttcaatttgtaaaa

SEQ ID NO: 158330 - DNA, 15 bp, Homo sapiens
ctttcaatttgtaaa

SEQ ID NO: 158331 - DNA, 15 bp, Homo sapiens
actttcaatttgtaa

SEQ ID NO: 158332 - DNA, 15 bp, Homo sapiens
aactttcaatttgta

SEQ ID NO: 158333 - DNA, 15 bp, Homo sapiens
aaactttcaatttgt

SEQ ID NO: 158334 - DNA, 15 bp, Homo sapiens
caaactttcaatttg

SEQ ID NO: 158335 - DNA, 15 bp, Homo sapiens
acaaactttcaattt

SEQ ID NO: 158336 - DNA, 15 bp, Homo sapiens
cacaaactttcaatt

SEQ ID NO: 158337 - DNA, 15 bp, Homo sapiens
ccacaaactttcaat

SEQ ID NO: 158338 - DNA, 15 bp, Homo sapiens
gccacaaactttcaa

SEQ ID NO: 158339 - DNA, 15 bp, Homo sapiens
tgccacaaactttca

SEQ ID NO: 158340 - DNA, 15 bp, Homo sapiens
ttgccacaaactttc

SEQ ID NO: 158341 - DNA, 15 bp, Homo sapiens
gttgccacaaacttt

SEQ ID NO: 158342 - DNA, 15 bp, Homo sapiens
ggttgccacaaactt

SEQ ID NO: 158343 - DNA, 15 bp, Homo sapiens
gggttgccacaaact

SEQ ID NO: 158344 - DNA, 15 bp, Homo sapiens
agggttgccacaaac

SEQ ID NO: 158345 - DNA, 15 bp, Homo sapiens
gagggttgccacaaa

SEQ ID NO: 158346 - DNA, 15 bp, Homo sapiens
agagggttgccacaa

SEQ ID NO: 158347 - DNA, 15 bp, Homo sapiens
cagagggttgccaca

SEQ ID NO: 158348 - DNA, 15 bp, Homo sapiens
acagagggttgccac

SEQ ID NO: 158349 - DNA, 15 bp, Homo sapiens
cacagagggttgcca

SEQ ID NO: 158350 - DNA, 15 bp, Homo sapiens
tcacagagggttgcc

SEQ ID NO: 158351 - DNA, 15 bp, Homo sapiens
ttcacagagggttgc

SEQ ID NO: 158352 - DNA, 15 bp, Homo sapiens
tttcacagagggttg

SEQ ID NO: 158353 - DNA, 15 bp, Homo sapiens
gtttcacagagggtt

SEQ ID NO: 158354 - DNA, 15 bp, Homo sapiens
tgtttcacagagggt

SEQ ID NO: 158355 - DNA, 15 bp, Homo sapiens
ttgtttcacagaggg

SEQ ID NO: 158356 - DNA, 15 bp, Homo sapiens
ggtcttatatttaag

SEQ ID NO: 158357 - DNA, 15 bp, Homo sapiens
aggtcttatatttaa

SEQ ID NO: 158358 - DNA, 15 bp, Homo sapiens
caggtcttatattta

SEQ ID NO: 158359 - DNA, 15 bp, Homo sapiens
tcaggtcttatattt

SEQ ID NO: 158360 - DNA, 15 bp, Homo sapiens
ttcaggtcttatatt

SEQ ID NO: 158361 - DNA, 15 bp, Homo sapiens
tttcaggtcttatat

SEQ ID NO: 158362 - DNA, 15 bp, Homo sapiens
gtttcaggtcttata

SEQ ID NO: 158363 - DNA, 15 bp, Homo sapiens
agtttcaggtcttat

SEQ ID NO: 158364 - DNA, 15 bp, Homo sapiens
cagtttcaggtctta

SEQ ID NO: 158365 - DNA, 15 bp, Homo sapiens
acagtttcaggtctt

SEQ ID NO: 158366 - DNA, 15 bp, Homo sapiens
tacagtttcaggtct

SEQ ID NO: 158367 - DNA, 15 bp, Homo sapiens
ttacagtttcaggtc

SEQ ID NO: 158368 - DNA, 15 bp, Homo sapiens
tttacagtttcaggt

SEQ ID NO: 158369 - DNA, 15 bp, Homo sapiens
ttttacagtttcagg

SEQ ID NO: 158370 - DNA, 15 bp, Homo sapiens
attttacagtttcag

SEQ ID NO: 158371 - DNA, 15 bp, Homo sapiens
aattttacagtttca

SEQ ID NO: 158372 - DNA, 15 bp, Homo sapiens
gaattttacagtttc

SEQ ID NO: 158373 - DNA, 15 bp, Homo sapiens
ggaattttacagttt

SEQ ID NO: 158374 - DNA, 15 bp, Homo sapiens
aggaattttacagtt

SEQ ID NO: 158375 - DNA, 15 bp, Homo sapiens
taggaattttacagt

SEQ ID NO: 158376 - DNA, 15 bp, Homo sapiens
ctaggaattttacag

SEQ ID NO: 158377 - DNA, 15 bp, Homo sapiens
tctaggaattttaca

SEQ ID NO: 158378 - DNA, 15 bp, Homo sapiens
ttctaggaattttac

SEQ ID NO: 158379 - DNA, 15 bp, Homo sapiens
cttctaggaatttta

SEQ ID NO: 158380 - DNA, 15 bp, Homo sapiens
tcttctaggaatttt

SEQ ID NO: 158381 - DNA, 15 bp, Homo sapiens
ttcttctaggaattt

SEQ ID NO: 158382 - DNA, 15 bp, Homo sapiens
tttcttctaggaatt

SEQ ID NO: 158383 - DNA, 15 bp, Homo sapiens
ttttcttctaggaat

SEQ ID NO: 158384 - DNA, 15 bp, Homo sapiens
gttttcttctaggaa

SEQ ID NO: 158385 - DNA, 15 bp, Homo sapiens
tgttttcttctagga

SEQ ID NO: 158386 - DNA, 15 bp, Homo sapiens
atgttttcttctagg

SEQ ID NO: 158387 - DNA, 15 bp, Homo sapiens
catgttttcttctag

SEQ ID NO: 158388 - DNA, 15 bp, Homo sapiens
ccatgttttcttcta

SEQ ID NO: 158389 - DNA, 15 bp, Homo sapiens
cccatgttttcttct

SEQ ID NO: 158390 - DNA, 15 bp, Homo sapiens
ccccatgttttcttc

SEQ ID NO: 158391 - DNA, 15 bp, Homo sapiens
tccccatgttttctt

SEQ ID NO: 158392 - DNA, 15 bp, Homo sapiens
ttccccatgttttct

SEQ ID NO: 158393 - DNA, 15 bp, Homo sapiens
tttccccatgttttc

SEQ ID NO: 158394 - DNA, 15 bp, Homo sapiens
ttttccccatgtttt

SEQ ID NO: 158395 - DNA, 15 bp, Homo sapiens
tttttccccatgttt

SEQ ID NO: 158396 - DNA, 15 bp, Homo sapiens
ctttttccccatgtt

SEQ ID NO: 158397 - DNA, 15 bp, Homo sapiens
actttttccccatgt

SEQ ID NO: 158398 - DNA, 15 bp, Homo sapiens
aactttttccccatg

SEQ ID NO: 158399 - DNA, 15 bp, Homo sapiens
aaactttttccccat

SEQ ID NO: 158400 - DNA, 15 bp, Homo sapiens
gaaactttttcccca

SEQ ID NO: 158401 - DNA, 15 bp, Homo sapiens
ggaaactttttcccc

SEQ ID NO: 158402 - DNA, 15 bp, Homo sapiens
aggaaactttttccc

SEQ ID NO: 158403 - DNA, 15 bp, Homo sapiens
caggaaactttttcc

SEQ ID NO: 158404 - DNA, 15 bp, Homo sapiens
tcaggaaactttttc

SEQ ID NO: 158405 - DNA, 15 bp, Homo sapiens
gtcaggaaacttttt

SEQ ID NO: 158406 - DNA, 15 bp, Homo sapiens
tgtcaggaaactttt

SEQ ID NO: 158407 - DNA, 15 bp, Homo sapiens
atgtcaggaaacttt

SEQ ID NO: 158408 - DNA, 15 bp, Homo sapiens
aatgtcaggaaactt

SEQ ID NO: 158409 - DNA, 15 bp, Homo sapiens
caatgtcaggaaact

SEQ ID NO: 158410 - DNA, 15 bp, Homo sapiens
ccaatgtcaggaaac

SEQ ID NO: 158411 - DNA, 15 bp, Homo sapiens
accaatgtcaggaaa

SEQ ID NO: 158412 - DNA, 15 bp, Homo sapiens
aaccaatgtcaggaa

SEQ ID NO: 158413 - DNA, 15 bp, Homo sapiens
taaccaatgtcagga

SEQ ID NO: 158414 - DNA, 15 bp, Homo sapiens
ttaaccaatgtcagg

SEQ ID NO: 158415 - DNA, 15 bp, Homo sapiens
cttaaccaatgtcag

SEQ ID NO: 158416 - DNA, 15 bp, Homo sapiens
ccttaaccaatgtca

SEQ ID NO: 158417 - DNA, 15 bp, Homo sapiens
gccttaaccaatgtc

SEQ ID NO: 158418 - DNA, 15 bp, Homo sapiens
tgccttaaccaatgt

SEQ ID NO: 158419 - DNA, 15 bp, Homo sapiens
ttgccttaaccaatg

SEQ ID NO: 158420 - DNA, 15 bp, Homo sapiens
attgccttaaccaat

SEQ ID NO: 158421 - DNA, 15 bp, Homo sapiens
cattgccttaaccaa

SEQ ID NO: 158422 - DNA, 15 bp, Homo sapiens
tcattgccttaacca

SEQ ID NO: 158423 - DNA, 15 bp, Homo sapiens
atcattgccttaacc

SEQ ID NO: 158424 - DNA, 15 bp, Homo sapiens
aatcattgccttaac

SEQ ID NO: 158425 - DNA, 15 bp, Homo sapiens
aaatcattgccttaa

SEQ ID NO: 158426 - DNA, 15 bp, Homo sapiens
aaaatcattgcctta

SEQ ID NO: 158427 - DNA, 15 bp, Homo sapiens
aaaaatcattgcctt

SEQ ID NO: 158428 - DNA, 15 bp, Homo sapiens
aaaaaatcattgcct

SEQ ID NO: 158429 - DNA, 15 bp, Homo sapiens
aaaaaaatcattgcc

SEQ ID NO: 158430 - DNA, 15 bp, Homo sapiens
taaaaaaatcattgc

SEQ ID NO: 158431 - DNA, 15 bp, Homo sapiens
ttaaaaaaatcattg

SEQ ID NO: 158432 - DNA, 15 bp, Homo sapiens
attaaaaaaatcatt

SEQ ID NO: 158433 - DNA, 15 bp, Homo sapiens
tattaaaaaaatcat

SEQ ID NO: 158434 - DNA, 15 bp, Homo sapiens
atattaaaaaaatca

SEQ ID NO: 158435 - DNA, 15 bp, Homo sapiens
catattaaaaaaatc

SEQ ID NO: 158436 - DNA, 15 bp, Homo sapiens
ccatattaaaaaaat

SEQ ID NO: 158437 - DNA, 15 bp, Homo sapiens
gccatattaaaaaaa

SEQ ID NO: 158438 - DNA, 15 bp, Homo sapiens
ggccatattaaaaaa

SEQ ID NO: 158439 - DNA, 15 bp, Homo sapiens
cggccatattaaaaa

SEQ ID NO: 158440 - DNA, 15 bp, Homo sapiens
acggccatattaaaa

SEQ ID NO: 158441 - DNA, 15 bp, Homo sapiens
aacggccatattaaa

SEQ ID NO: 158442 - DNA, 15 bp, Homo sapiens
gaacggccatattaa

SEQ ID NO: 158443 - DNA, 15 bp, Homo sapiens
tgaacggccatatta

SEQ ID NO: 158444 - DNA, 15 bp, Homo sapiens
gtgaacggccatatt

SEQ ID NO: 158445 - DNA, 15 bp, Homo sapiens
ggtgaacggccatat

SEQ ID NO: 158446 - DNA, 15 bp, Homo sapiens
tggtgaacggccata

SEQ ID NO: 158447 - DNA, 15 bp, Homo sapiens
ctggtgaacggccat

SEQ ID NO: 158448 - DNA, 15 bp, Homo sapiens
gctggtgaacggcca

SEQ ID NO: 158449 - DNA, 15 bp, Homo sapiens
tgctggtgaacggcc

SEQ ID NO: 158450 - DNA, 15 bp, Homo sapiens
ttgctggtgaacggc

SEQ ID NO: 158451 - DNA, 15 bp, Homo sapiens
tttgctggtgaacgg

SEQ ID NO: 158452 - DNA, 15 bp, Homo sapiens
ttttgctggtgaacg

SEQ ID NO: 158453 - DNA, 15 bp, Homo sapiens
tttttgctggtgaac

SEQ ID NO: 158454 - DNA, 15 bp, Homo sapiens
atttttgctggtgaa

SEQ ID NO: 158455 - DNA, 15 bp, Homo sapiens
tatttttgctggtga

SEQ ID NO: 158456 - DNA, 15 bp, Homo sapiens
ctatttttgctggtg

SEQ ID NO: 158457 - DNA, 15 bp, Homo sapiens
cctatttttgctggt

SEQ ID NO: 158458 - DNA, 15 bp, Homo sapiens
gcctatttttgctgg

SEQ ID NO: 158459 - DNA, 15 bp, Homo sapiens
tgcctatttttgctg

SEQ ID NO: 158460 - DNA, 15 bp, Homo sapiens
ttgcctatttttgct

SEQ ID NO: 158461 - DNA, 15 bp, Homo sapiens
tttgcctatttttgc

SEQ ID NO: 158462 - DNA, 15 bp, Homo sapiens
atttgcctatttttg

SEQ ID NO: 158463 - DNA, 15 bp, Homo sapiens
catttgcctattttt

SEQ ID NO: 158464 - DNA, 15 bp, Homo sapiens
ccatttgcctatttt

SEQ ID NO: 158465 - DNA, 15 bp, Homo sapiens
cccatttgcctattt

SEQ ID NO: 158466 - DNA, 15 bp, Homo sapiens
tcccatttgcctatt

SEQ ID NO: 158467 - DNA, 15 bp, Homo sapiens
atcccatttgcctat

SEQ ID NO: 158468 - DNA, 15 bp, Homo sapiens
aatcccatttgccta

SEQ ID NO: 158469 - DNA, 15 bp, Homo sapiens
caatcccatttgcct

SEQ ID NO: 158470 - DNA, 15 bp, Homo sapiens
tcaatcccatttgcc

SEQ ID NO: 158471 - DNA, 15 bp, Homo sapiens
ttcaatcccatttgc

SEQ ID NO: 158472 - DNA, 15 bp, Homo sapiens
attcaatcccatttg

SEQ ID NO: 158473 - DNA, 15 bp, Homo sapiens
gattcaatcccattt

SEQ ID NO: 158474 - DNA, 15 bp, Homo sapiens
tgattcaatcccatt

SEQ ID NO: 158475 - DNA, 15 bp, Homo sapiens
ttgattcaatcccat

SEQ ID NO: 158476 - DNA, 15 bp, Homo sapiens
tttgattcaatccca

SEQ ID NO: 158477 - DNA, 15 bp, Homo sapiens
gtttgattcaatccc

SEQ ID NO: 158478 - DNA, 15 bp, Homo sapiens
agtttgattcaatcc

SEQ ID NO: 158479 - DNA, 15 bp, Homo sapiens
tagtttgattcaatc

SEQ ID NO: 158480 - DNA, 15 bp, Homo sapiens
ttagtttgattcaat

SEQ ID NO: 158481 - DNA, 15 bp, Homo sapiens
tttagtttgattcaa

SEQ ID NO: 158482 - DNA, 15 bp, Homo sapiens
ttttagtttgattca

SEQ ID NO: 158483 - DNA, 15 bp, Homo sapiens
tttttagtttgattc

SEQ ID NO: 158484 - DNA, 15 bp, Homo sapiens
ctttttagtttgatt

SEQ ID NO: 158485 - DNA, 15 bp, Homo sapiens
gctttttagtttgat

SEQ ID NO: 158486 - DNA, 15 bp, Homo sapiens
agctttttagtttga

SEQ ID NO: 158487 - DNA, 15 bp, Homo sapiens
aagctttttagtttg

SEQ ID NO: 158488 - DNA, 15 bp, Homo sapiens
gaagctttttagttt

SEQ ID NO: 158489 - DNA, 15 bp, Homo sapiens
agaagctttttagtt

SEQ ID NO: 158490 - DNA, 15 bp, Homo sapiens
cagaagctttttagt

SEQ ID NO: 158491 - DNA, 15 bp, Homo sapiens
gcagaagctttttag

SEQ ID NO: 158492 - DNA, 15 bp, Homo sapiens
tgcagaagcttttta

SEQ ID NO: 158493 - DNA, 15 bp, Homo sapiens
gtgcagaagcttttt

SEQ ID NO: 158494 - DNA, 15 bp, Homo sapiens
tgtgcagaagctttt

SEQ ID NO: 158495 - DNA, 15 bp, Homo sapiens
ctgtgcagaagcttt

SEQ ID NO: 158496 - DNA, 15 bp, Homo sapiens
gctgtgcagaagctt

SEQ ID NO: 158497 - DNA, 15 bp, Homo sapiens
tgctgtgcagaagct

SEQ ID NO: 158498 - DNA, 15 bp, Homo sapiens
ctttgctgtgcagaa

SEQ ID NO: 158499 - DNA, 15 bp, Homo sapiens
cctttgctgtgcaga

SEQ ID NO: 158500 - DNA, 15 bp, Homo sapiens
gcctttgctgtgcag

SEQ ID NO: 158501 - DNA, 15 bp, Homo sapiens
tgcctttgctgtgca

SEQ ID NO: 158502 - DNA, 15 bp, Homo sapiens
ctgcctttgctgtgc

SEQ ID NO: 158503 - DNA, 15 bp, Homo sapiens
gctgcctttgctgtg

SEQ ID NO: 158504 - DNA, 15 bp, Homo sapiens
tgctgcctttgctgt

SEQ ID NO: 158505 - DNA, 15 bp, Homo sapiens
ttgctgcctttgctg

SEQ ID NO: 158506 - DNA, 15 bp, Homo sapiens
attgctgcctttgct

SEQ ID NO: 158507 - DNA, 15 bp, Homo sapiens
gattgctgcctttgc

SEQ ID NO: 158508 - DNA, 15 bp, Homo sapiens
tgattgctgcctttg

SEQ ID NO: 158509 - DNA, 15 bp, Homo sapiens
ttgattgctgccttt

SEQ ID NO: 158510 - DNA, 15 bp, Homo sapiens
tttgattgctgcctt

SEQ ID NO: 158511 - DNA, 15 bp, Homo sapiens
ctttgattgctgcct

SEQ ID NO: 158512 - DNA, 15 bp, Homo sapiens
actttgattgctgcc

SEQ ID NO: 158513 - DNA, 15 bp, Homo sapiens
cactttgattgctgc

SEQ ID NO: 158514 - DNA, 15 bp, Homo sapiens
ccactttgattgctg

SEQ ID NO: 158515 - DNA, 15 bp, Homo sapiens
tccactttgattgct

SEQ ID NO: 158516 - DNA, 15 bp, Homo sapiens
ctccactttgattgc

SEQ ID NO: 158517 - DNA, 15 bp, Homo sapiens
tctccactttgattg

SEQ ID NO: 158518 - DNA, 15 bp, Homo sapiens
ctctccactttgatt

SEQ ID NO: 158519 - DNA, 15 bp, Homo sapiens
tctctccactttgat

SEQ ID NO: 158520 - DNA, 15 bp, Homo sapiens
atctctccactttga

SEQ ID NO: 158521 - DNA, 15 bp, Homo sapiens
tatctctccactttg

SEQ ID NO: 158522 - DNA, 15 bp, Homo sapiens
ttatctctccacttt

SEQ ID NO: 158523 - DNA, 15 bp, Homo sapiens
gttatctctccactt

SEQ ID NO: 158524 - DNA, 15 bp, Homo sapiens
ggttatctctccact

SEQ ID NO: 158525 - DNA, 15 bp, Homo sapiens
aggttatctctccac

SEQ ID NO: 158526 - DNA, 15 bp, Homo sapiens
taggttatctctcca

SEQ ID NO: 158527 - DNA, 15 bp, Homo sapiens
gtaggttatctctcc

SEQ ID NO: 158528 - DNA, 15 bp, Homo sapiens
tgtaggttatctctc

SEQ ID NO: 158529 - DNA, 15 bp, Homo sapiens
ctgtaggttatctct

SEQ ID NO: 158530 - DNA, 15 bp, Homo sapiens
tctgtaggttatctc

SEQ ID NO: 158531 - DNA, 15 bp, Homo sapiens
ttctgtaggttatct

SEQ ID NO: 158532 - DNA, 15 bp, Homo sapiens
cttctgtaggttatc

SEQ ID NO: 158533 - DNA, 15 bp, Homo sapiens
ccttctgtaggttat

SEQ ID NO: 158534 - DNA, 15 bp, Homo sapiens
cccttctgtaggtta

SEQ ID NO: 158535 - DNA, 15 bp, Homo sapiens
ccccttctgtaggtt

SEQ ID NO: 158536 - DNA, 15 bp, Homo sapiens
tccccttctgtaggt

SEQ ID NO: 158537 - DNA, 15 bp, Homo sapiens
ctccccttctgtagg

SEQ ID NO: 158538 - DNA, 15 bp, Homo sapiens
tctccccttctgtag

SEQ ID NO: 158539 - DNA, 15 bp, Homo sapiens
ctctccccttctgta

SEQ ID NO: 158540 - DNA, 15 bp, Homo sapiens
tctctccccttctgt

SEQ ID NO: 158541 - DNA, 15 bp, Homo sapiens
ttctctccccttctg

SEQ ID NO: 158542 - DNA, 15 bp, Homo sapiens
attctctccccttct

SEQ ID NO: 158543 - DNA, 15 bp, Homo sapiens
tattctctccccttc

SEQ ID NO: 158544 - DNA, 15 bp, Homo sapiens
atattctctcccctt

SEQ ID NO: 158545 - DNA, 15 bp, Homo sapiens
aatattctctcccct

SEQ ID NO: 158546 - DNA, 15 bp, Homo sapiens
aaatattctctcccc

SEQ ID NO: 158547 - DNA, 15 bp, Homo sapiens
caaatattctctccc

SEQ ID NO: 158548 - DNA, 15 bp, Homo sapiens
gcaaatattctctcc

SEQ ID NO: 158549 - DNA, 15 bp, Homo sapiens
tgcaaatattctctc

SEQ ID NO: 158550 - DNA, 15 bp, Homo sapiens
ttgcaaatattctct

SEQ ID NO: 158551 - DNA, 15 bp, Homo sapiens
tttgcaaatattctc

SEQ ID NO: 158552 - DNA, 15 bp, Homo sapiens
gtttgcaaatattct

SEQ ID NO: 158553 - DNA, 15 bp, Homo sapiens
ggtttgcaaatattc

SEQ ID NO: 158554 - DNA, 15 bp, Homo sapiens
cggtttgcaaatatt

SEQ ID NO: 158555 - DNA, 15 bp, Homo sapiens
acggtttgcaaatat

SEQ ID NO: 158556 - DNA, 15 bp, Homo sapiens
tacggtttgcaaata

SEQ ID NO: 158557 - DNA, 15 bp, Homo sapiens
gtacggtttgcaaat

SEQ ID NO: 158558 - DNA, 15 bp, Homo sapiens
tgtacggtttgcaaa

SEQ ID NO: 158559 - DNA, 15 bp, Homo sapiens
atgtacggtttgcaa

SEQ ID NO: 158560 - DNA, 15 bp, Homo sapiens
gatgtacggtttgca

SEQ ID NO: 158561 - DNA, 15 bp, Homo sapiens
agatgtacggtttgc

SEQ ID NO: 158562 - DNA, 15 bp, Homo sapiens
cagatgtacggtttg

SEQ ID NO: 158563 - DNA, 15 bp, Homo sapiens
tcagatgtacggttt

SEQ ID NO: 158564 - DNA, 15 bp, Homo sapiens
atcagatgtacggtt

SEQ ID NO: 158565 - DNA, 15 bp, Homo sapiens
tatcagatgtacggt

SEQ ID NO: 158566 - DNA, 15 bp, Homo sapiens
ttatcagatgtacgg

SEQ ID NO: 158567 - DNA, 15 bp, Homo sapiens
cttatcagatgtacg

SEQ ID NO: 158568 - DNA, 15 bp, Homo sapiens
ccttatcagatgtac

SEQ ID NO: 158569 - DNA, 15 bp, Homo sapiens
cccttatcagatgta

SEQ ID NO: 158570 - DNA, 15 bp, Homo sapiens
ccccttatcagatgt

SEQ ID NO: 158571 - DNA, 15 bp, Homo sapiens
accccttatcagatg

SEQ ID NO: 158572 - DNA, 15 bp, Homo sapiens
aaccccttatcagat

SEQ ID NO: 158573 - DNA, 15 bp, Homo sapiens
taaccccttatcaga

SEQ ID NO: 158574 - DNA, 15 bp, Homo sapiens
ttaaccccttatcag

SEQ ID NO: 158575 - DNA, 15 bp, Homo sapiens
gttaaccccttatca

SEQ ID NO: 158576 - DNA, 15 bp, Homo sapiens
tgttaaccccttatc

SEQ ID NO: 158577 - DNA, 15 bp, Homo sapiens
ctgttaaccccttat

SEQ ID NO: 158578 - DNA, 15 bp, Homo sapiens
gctgttaacccctta

SEQ ID NO: 158579 - DNA, 15 bp, Homo sapiens
ggctgttaacccctt

SEQ ID NO: 158580 - DNA, 15 bp, Homo sapiens
tggctgttaacccct

SEQ ID NO: 158581 - DNA, 15 bp, Homo sapiens
ttggctgttaacccc

SEQ ID NO: 158582 - DNA, 15 bp, Homo sapiens
attggctgttaaccc

SEQ ID NO: 158583 - DNA, 15 bp, Homo sapiens
tattggctgttaacc

SEQ ID NO: 158584 - DNA, 15 bp, Homo sapiens
atattggctgttaac

SEQ ID NO: 158585 - DNA, 15 bp, Homo sapiens
tatattggctgttaa

SEQ ID NO: 158586 - DNA, 15 bp, Homo sapiens
atatattggctgtta

SEQ ID NO: 158587 - DNA, 15 bp, Homo sapiens
tatatattggctgtt

SEQ ID NO: 158588 - DNA, 15 bp, Homo sapiens
atatatattggctgt

SEQ ID NO: 158589 - DNA, 15 bp, Homo sapiens
tatatatattggctg

SEQ ID NO: 158590 - DNA, 15 bp, Homo sapiens
ttatatatattggct

SEQ ID NO: 158591 - DNA, 15 bp, Homo sapiens
cttatatatattggc

SEQ ID NO: 158592 - DNA, 15 bp, Homo sapiens
gcttatatatattgg

SEQ ID NO: 158593 - DNA, 15 bp, Homo sapiens
tgcttatatatattg

SEQ ID NO: 158594 - DNA, 15 bp, Homo sapiens
gtgcttatatatatt

SEQ ID NO: 158595 - DNA, 15 bp, Homo sapiens
agtgcttatatatat

SEQ ID NO: 158596 - DNA, 15 bp, Homo sapiens
gagtgcttatatata

SEQ ID NO: 158597 - DNA, 15 bp, Homo sapiens
tgagtgcttatatat

SEQ ID NO: 158598 - DNA, 15 bp, Homo sapiens
ttgagtgcttatata

SEQ ID NO: 158599 - DNA, 15 bp, Homo sapiens
gttgagtgcttatat

SEQ ID NO: 158600 - DNA, 15 bp, Homo sapiens
agttgagtgcttata

SEQ ID NO: 158601 - DNA, 15 bp, Homo sapiens
gagttgagtgcttat

SEQ ID NO: 158602 - DNA, 15 bp, Homo sapiens
tgagttgagtgctta

SEQ ID NO: 158603 - DNA, 15 bp, Homo sapiens
ctgagttgagtgctt

SEQ ID NO: 158604 - DNA, 15 bp, Homo sapiens
gctgagttgagtgct

SEQ ID NO: 158605 - DNA, 15 bp, Homo sapiens
tgctgagttgagtgc

SEQ ID NO: 158606 - DNA, 15 bp, Homo sapiens
ttgctgagttgagtg

SEQ ID NO: 158607 - DNA, 15 bp, Homo sapiens
cttgctgagttgagt

SEQ ID NO: 158608 - DNA, 15 bp, Homo sapiens
tcttgctgagttgag

SEQ ID NO: 158609 - DNA, 15 bp, Homo sapiens
ttcttgctgagttga

SEQ ID NO: 158610 - DNA, 15 bp, Homo sapiens
tttcttgctgagttg

SEQ ID NO: 158611 - DNA, 15 bp, Homo sapiens
ttttcttgctgagtt

SEQ ID NO: 158612 - DNA, 15 bp, Homo sapiens
gttttcttgctgagt

SEQ ID NO: 158613 - DNA, 15 bp, Homo sapiens
tgttttcttgctgag

SEQ ID NO: 158614 - DNA, 15 bp, Homo sapiens
ttgttttcttgctga

SEQ ID NO: 158615 - DNA, 15 bp, Homo sapiens
tttgttttcttgctg

SEQ ID NO: 158616 - DNA, 15 bp, Homo sapiens
atttgttttcttgct

SEQ ID NO: 158617 - DNA, 15 bp, Homo sapiens
tatttgttttcttgc

SEQ ID NO: 158618 - DNA, 15 bp, Homo sapiens
ttatttgttttcttg

SEQ ID NO: 158619 - DNA, 15 bp, Homo sapiens
tttatttgttttctt

SEQ ID NO: 158620 - DNA, 15 bp, Homo sapiens
gtttatttgttttct

SEQ ID NO: 158621 - DNA, 15 bp, Homo sapiens
agtttatttgttttc

SEQ ID NO: 158622 - DNA, 15 bp, Homo sapiens
cagtttatttgtttt

SEQ ID NO: 158623 - DNA, 15 bp, Homo sapiens
tcagtttatttgttt

SEQ ID NO: 158624 - DNA, 15 bp, Homo sapiens
atcagtttatttgtt

SEQ ID NO: 158625 - DNA, 15 bp, Homo sapiens
aatcagtttatttgt

SEQ ID NO: 158626 - DNA, 15 bp, Homo sapiens
aaatcagtttatttg

SEQ ID NO: 158627 - DNA, 15 bp, Homo sapiens
taaatcagtttattt

SEQ ID NO: 158628 - DNA, 15 bp, Homo sapiens
ttaaatcagtttatt

SEQ ID NO: 158629 - DNA, 15 bp, Homo sapiens
tttaaatcagtttat

SEQ ID NO: 158630 - DNA, 15 bp, Homo sapiens
ttttaaatcagttta

SEQ ID NO: 158631 - DNA, 15 bp, Homo sapiens
tttttaaatcagttt

SEQ ID NO: 158632 - DNA, 15 bp, Homo sapiens
atttttaaatcagtt

SEQ ID NO: 158633 - DNA, 15 bp, Homo sapiens
aatttttaaatcagt

SEQ ID NO: 158634 - DNA, 15 bp, Homo sapiens
caatttttaaatcag

SEQ ID NO: 158635 - DNA, 15 bp, Homo sapiens
tcaatttttaaatca

SEQ ID NO: 158636 - DNA, 15 bp, Homo sapiens
gtcaatttttaaatc

SEQ ID NO: 158637 - DNA, 15 bp, Homo sapiens
tgtcaatttttaaat

SEQ ID NO: 158638 - DNA, 15 bp, Homo sapiens
ttgtcaatttttaaa

SEQ ID NO: 158639 - DNA, 15 bp, Homo sapiens
tttgtcaatttttaa

SEQ ID NO: 158640 - DNA, 15 bp, Homo sapiens
ctttgtcaattttta

SEQ ID NO: 158641 - DNA, 15 bp, Homo sapiens
actttgtcaattttt

SEQ ID NO: 158642 - DNA, 15 bp, Homo sapiens
tactttgtcaatttt

SEQ ID NO: 158643 - DNA, 15 bp, Homo sapiens
gtactttgtcaattt

SEQ ID NO: 158644 - DNA, 15 bp, Homo sapiens
ggtactttgtcaatt

SEQ ID NO: 158645 - DNA, 15 bp, Homo sapiens
aggtactttgtcaat

SEQ ID NO: 158646 - DNA, 15 bp, Homo sapiens
caggtactttgtcaa

SEQ ID NO: 158647 - DNA, 15 bp, Homo sapiens
tcaggtactttgtca

SEQ ID NO: 158648 - DNA, 15 bp, Homo sapiens
ttcaggtactttgtc

SEQ ID NO: 158649 - DNA, 15 bp, Homo sapiens
gttcaggtactttgt

SEQ ID NO: 158650 - DNA, 15 bp, Homo sapiens
tgttcaggtactttg

SEQ ID NO: 158651 - DNA, 15 bp, Homo sapiens
ctgttcaggtacttt

SEQ ID NO: 158652 - DNA, 15 bp, Homo sapiens
tctgttcaggtactt

SEQ ID NO: 158653 - DNA, 15 bp, Homo sapiens
gtctgttcaggtact

SEQ ID NO: 158654 - DNA, 15 bp, Homo sapiens
tgtctgttcaggtac

SEQ ID NO: 158655 - DNA, 15 bp, Homo sapiens
atgtctgttcaggta

SEQ ID NO: 158656 - DNA, 15 bp, Homo sapiens
aatgtctgttcaggt

SEQ ID NO: 158657 - DNA, 15 bp, Homo sapiens
aaatgtctgttcagg

SEQ ID NO: 158658 - DNA, 15 bp, Homo sapiens
gaaatgtctgttcag

SEQ ID NO: 158659 - DNA, 15 bp, Homo sapiens
ggaaatgtctgttca

SEQ ID NO: 158660 - DNA, 15 bp, Homo sapiens
gggaaatgtctgttc

SEQ ID NO: 158661 - DNA, 15 bp, Homo sapiens
tgggaaatgtctgtt

SEQ ID NO: 158662 - DNA, 15 bp, Homo sapiens
ttgggaaatgtctgt

SEQ ID NO: 158663 - DNA, 15 bp, Homo sapiens
tttgggaaatgtctg

SEQ ID NO: 158664 - DNA, 15 bp, Homo sapiens
ttttgggaaatgtct

SEQ ID NO: 158665 - DNA, 15 bp, Homo sapiens
cttttgggaaatgtc

SEQ ID NO: 158666 - DNA, 15 bp, Homo sapiens
acttttgggaaatgt

SEQ ID NO: 158667 - DNA, 15 bp, Homo sapiens
tacttttgggaaatg

SEQ ID NO: 158668 - DNA, 15 bp, Homo sapiens
ctacttttgggaaat

SEQ ID NO: 158669 - DNA, 15 bp, Homo sapiens
tctacttttgggaaa

SEQ ID NO: 158670 - DNA, 15 bp, Homo sapiens
atctacttttgggaa

SEQ ID NO: 158671 - DNA, 15 bp, Homo sapiens
tatctacttttggga

SEQ ID NO: 158672 - DNA, 15 bp, Homo sapiens
gtatctacttttggg

SEQ ID NO: 158673 - DNA, 15 bp, Homo sapiens
tgtatctacttttgg

SEQ ID NO: 158674 - DNA, 15 bp, Homo sapiens
ctgtatctacttttg

SEQ ID NO: 158675 - DNA, 15 bp, Homo sapiens
tctgtatctactttt

SEQ ID NO: 158676 - DNA, 15 bp, Homo sapiens
ttctgtatctacttt

SEQ ID NO: 158677 - DNA, 15 bp, Homo sapiens
tttctgtatctactt

SEQ ID NO: 158678 - DNA, 15 bp, Homo sapiens
atttctgtatctact

SEQ ID NO: 158679 - DNA, 15 bp, Homo sapiens
catttctgtatctac

SEQ ID NO: 158680 - DNA, 15 bp, Homo sapiens
tcatttctgtatcta

SEQ ID NO: 158681 - DNA, 15 bp, Homo sapiens
atcatttctgtatct

SEQ ID NO: 158682 - DNA, 15 bp, Homo sapiens
gatcatttctgtatc

SEQ ID NO: 158683 - DNA, 15 bp, Homo sapiens
tgatcatttctgtat

SEQ ID NO: 158684 - DNA, 15 bp, Homo sapiens
atgatcatttctgta

SEQ ID NO: 158685 - DNA, 15 bp, Homo sapiens
gatgatcatttctgt

SEQ ID NO: 158686 - DNA, 15 bp, Homo sapiens
tgatgatcatttctg

SEQ ID NO: 158687 - DNA, 15 bp, Homo sapiens
ctgatgatcatttct

SEQ ID NO: 158688 - DNA, 15 bp, Homo sapiens
cctgatgatcatttc

SEQ ID NO: 158689 - DNA, 15 bp, Homo sapiens
acctgatgatcattt

SEQ ID NO: 158690 - DNA, 15 bp, Homo sapiens
tacctgatgatcatt

SEQ ID NO: 158691 - DNA, 15 bp, Homo sapiens
gtacctgatgatcat

SEQ ID NO: 158692 - DNA, 15 bp, Homo sapiens
tgtacctgatgatca

SEQ ID NO: 158693 - DNA, 15 bp, Homo sapiens
ctgtacctgatgatc

SEQ ID NO: 158694 - DNA, 15 bp, Homo sapiens
cctgtacctgatgat

SEQ ID NO: 158695 - DNA, 15 bp, Homo sapiens
tcctgtacctgatga

SEQ ID NO: 158696 - DNA, 15 bp, Homo sapiens
ttcctgtacctgatg

SEQ ID NO: 158697 - DNA, 15 bp, Homo sapiens
tttcctgtacctgat

SEQ ID NO: 158698 - DNA, 15 bp, Homo sapiens
ttttcctgtacctga

SEQ ID NO: 158699 - DNA, 15 bp, Homo sapiens
tttttcctgtacctg

SEQ ID NO: 158700 - DNA, 15 bp, Homo sapiens
ttttttcctgtacct

SEQ ID NO: 158701 - DNA, 15 bp, Homo sapiens
attttttcctgtacc

SEQ ID NO: 158702 - DNA, 15 bp, Homo sapiens
cattttttcctgtac

SEQ ID NO: 158703 - DNA, 15 bp, Homo sapiens
gcattttttcctgta

SEQ ID NO: 158704 - DNA, 15 bp, Homo sapiens
agcattttttcctgt

SEQ ID NO: 158705 - DNA, 15 bp, Homo sapiens
aagcattttttcctg

SEQ ID NO: 158706 - DNA, 15 bp, Homo sapiens
taagcattttttcct

SEQ ID NO: 158707 - DNA, 15 bp, Homo sapiens
ctaagcattttttcc

SEQ ID NO: 158708 - DNA, 15 bp, Homo sapiens
gctaagcattttttc

SEQ ID NO: 158709 - DNA, 15 bp, Homo sapiens
tgctaagcatttttt

SEQ ID NO: 158710 - DNA, 15 bp, Homo sapiens
atgctaagcattttt

SEQ ID NO: 158711 - DNA, 15 bp, Homo sapiens
gatgctaagcatttt

SEQ ID NO: 158712 - DNA, 15 bp, Homo sapiens
tgatgctaagcattt

SEQ ID NO: 158713 - DNA, 15 bp, Homo sapiens
gtgatgctaagcatt

SEQ ID NO: 158714 - DNA, 15 bp, Homo sapiens
agtgatgctaagcat

SEQ ID NO: 158715 - DNA, 15 bp, Homo sapiens
tagtgatgctaagca

SEQ ID NO: 158716 - DNA, 15 bp, Homo sapiens
ttagtgatgctaagc

SEQ ID NO: 158717 - DNA, 15 bp, Homo sapiens
attagtgatgctaag

SEQ ID NO: 158718 - DNA, 15 bp, Homo sapiens
aattagtgatgctaa

SEQ ID NO: 158719 - DNA, 15 bp, Homo sapiens
taattagtgatgcta

SEQ ID NO: 158720 - DNA, 15 bp, Homo sapiens
gtaattagtgatgct

SEQ ID NO: 158721 - DNA, 15 bp, Homo sapiens
agtaattagtgatgc

SEQ ID NO: 158722 - DNA, 15 bp, Homo sapiens
aagtaattagtgatg

SEQ ID NO: 158723 - DNA, 15 bp, Homo sapiens
caagtaattagtgat

SEQ ID NO: 158724 - DNA, 15 bp, Homo sapiens
ccaagtaattagtga

SEQ ID NO: 158725 - DNA, 15 bp, Homo sapiens
cccaagtaattagtg

SEQ ID NO: 158726 - DNA, 15 bp, Homo sapiens
tcccaagtaattagt

SEQ ID NO: 158727 - DNA, 15 bp, Homo sapiens
ttcccaagtaattag

SEQ ID NO: 158728 - DNA, 15 bp, Homo sapiens
tttcccaagtaatta

SEQ ID NO: 158729 - DNA, 15 bp, Homo sapiens
atttcccaagtaatt

SEQ ID NO: 158730 - DNA, 15 bp, Homo sapiens
catttcccaagtaat

SEQ ID NO: 158731 - DNA, 15 bp, Homo sapiens
gcatttcccaagtaa

SEQ ID NO: 158732 - DNA, 15 bp, Homo sapiens
tgcatttcccaagta

SEQ ID NO: 158733 - DNA, 15 bp, Homo sapiens
ttgcatttcccaagt

SEQ ID NO: 158734 - DNA, 15 bp, Homo sapiens
tttgcatttcccaag

SEQ ID NO: 158735 - DNA, 15 bp, Homo sapiens
ctttgcatttcccaa

SEQ ID NO: 158736 - DNA, 15 bp, Homo sapiens
gctttgcatttccca

SEQ ID NO: 158737 - DNA, 15 bp, Homo sapiens
tgctttgcatttccc

SEQ ID NO: 158738 - DNA, 15 bp, Homo sapiens
ttgctttgcatttcc

SEQ ID NO: 158739 - DNA, 15 bp, Homo sapiens
tttgctttgcatttc

SEQ ID NO: 158740 - DNA, 15 bp, Homo sapiens
gttttgctttgcatt

SEQ ID NO: 158741 - DNA, 15 bp, Homo sapiens
ggttttgctttgcat

SEQ ID NO: 158742 - DNA, 15 bp, Homo sapiens
tggttttgctttgca

SEQ ID NO: 158743 - DNA, 15 bp, Homo sapiens
gtggttttgctttgc

SEQ ID NO: 158744 - DNA, 15 bp, Homo sapiens
tgtggttttgctttg

SEQ ID NO: 158745 - DNA, 15 bp, Homo sapiens
ttgtggttttgcttt

SEQ ID NO: 158746 - DNA, 15 bp, Homo sapiens
attgtggttttgctt

SEQ ID NO: 158747 - DNA, 15 bp, Homo sapiens
cattgtggttttgct

SEQ ID NO: 158748 - DNA, 15 bp, Homo sapiens
tcattgtggttttgc

SEQ ID NO: 158749 - DNA, 15 bp, Homo sapiens
ctcattgtggttttg

SEQ ID NO: 158750 - DNA, 15 bp, Homo sapiens
tctcattgtggtttt

SEQ ID NO: 158751 - DNA, 15 bp, Homo sapiens
atctcattgtggttt

SEQ ID NO: 158752 - DNA, 15 bp, Homo sapiens
tatctcattgtggtt

SEQ ID NO: 158753 - DNA, 15 bp, Homo sapiens
atatctcattgtggt

SEQ ID NO: 158754 - DNA, 15 bp, Homo sapiens
aatatctcattgtgg

SEQ ID NO: 158755 - DNA, 15 bp, Homo sapiens
taatatctcattgtg

SEQ ID NO: 158756 - DNA, 15 bp, Homo sapiens
gtaatatctcattgt

SEQ ID NO: 158757 - DNA, 15 bp, Homo sapiens
ggtaatatctcattg

SEQ ID NO: 158758 - DNA, 15 bp, Homo sapiens
aggtaatatctcatt

SEQ ID NO: 158759 - DNA, 15 bp, Homo sapiens
gaggtaatatctcat

SEQ ID NO: 158760 - DNA, 15 bp, Homo sapiens
tgaggtaatatctca

SEQ ID NO: 158761 - DNA, 15 bp, Homo sapiens
gtgaggtaatatctc

SEQ ID NO: 158762 - DNA, 15 bp, Homo sapiens
ggtgaggtaatatct

SEQ ID NO: 158763 - DNA, 15 bp, Homo sapiens
gggtgaggtaatatc

SEQ ID NO: 158764 - DNA, 15 bp, Homo sapiens
ggggtgaggtaatat

SEQ ID NO: 158765 - DNA, 15 bp, Homo sapiens
tggggtgaggtaata

SEQ ID NO: 158766 - DNA, 15 bp, Homo sapiens
ctggggtgaggtaat

SEQ ID NO: 158767 - DNA, 15 bp, Homo sapiens
actggggtgaggtaa

SEQ ID NO: 158768 - DNA, 15 bp, Homo sapiens
aactggggtgaggta

SEQ ID NO: 158769 - DNA, 15 bp, Homo sapiens
taactggggtgaggt

SEQ ID NO: 158770 - DNA, 15 bp, Homo sapiens
ctaactggggtgagg

SEQ ID NO: 158771 - DNA, 15 bp, Homo sapiens
tctaactggggtgag

SEQ ID NO: 158772 - DNA, 15 bp, Homo sapiens
ttctaactggggtga

SEQ ID NO: 158773 - DNA, 15 bp, Homo sapiens
attctaactggggtg

SEQ ID NO: 158774 - DNA, 15 bp, Homo sapiens
cattctaactggggt

SEQ ID NO: 158775 - DNA, 15 bp, Homo sapiens
ccattctaactgggg

SEQ ID NO: 158776 - DNA, 15 bp, Homo sapiens
gccattctaactggg

SEQ ID NO: 158777 - DNA, 15 bp, Homo sapiens
agccattctaactgg

SEQ ID NO: 158778 - DNA, 15 bp, Homo sapiens
cagccattctaactg

SEQ ID NO: 158779 - DNA, 15 bp, Homo sapiens
acagccattctaact

SEQ ID NO: 158780 - DNA, 15 bp, Homo sapiens
aacagccattctaac

SEQ ID NO: 158781 - DNA, 15 bp, Homo sapiens
caacagccattctaa

SEQ ID NO: 158782 - DNA, 15 bp, Homo sapiens
acaacagccattcta

SEQ ID NO: 158783 - DNA, 15 bp, Homo sapiens
gacaacagccattct

SEQ ID NO: 158784 - DNA, 15 bp, Homo sapiens
tgacaacagccattc

SEQ ID NO: 158785 - DNA, 15 bp, Homo sapiens
ttgacaacagccatt

SEQ ID NO: 158786 - DNA, 15 bp, Homo sapiens
tttgacaacagccat

SEQ ID NO: 158787 - DNA, 15 bp, Homo sapiens
ttttgacaacagcca

SEQ ID NO: 158788 - DNA, 15 bp, Homo sapiens
tttttgacaacagcc

SEQ ID NO: 158789 - DNA, 15 bp, Homo sapiens
gtttttgacaacagc

SEQ ID NO: 158790 - DNA, 15 bp, Homo sapiens
tgtttttgacaacag

SEQ ID NO: 158791 - DNA, 15 bp, Homo sapiens
atgtttttgacaaca

SEQ ID NO: 158792 - DNA, 15 bp, Homo sapiens
catgtttttgacaac

SEQ ID NO: 158793 - DNA, 15 bp, Homo sapiens
tcatgtttttgacaa

SEQ ID NO: 158794 - DNA, 15 bp, Homo sapiens
ttcatgtttttgaca

SEQ ID NO: 158795 - DNA, 15 bp, Homo sapiens
tttcatgtttttgac

SEQ ID NO: 158796 - DNA, 15 bp, Homo sapiens
ctttcatgtttttga

SEQ ID NO: 158797 - DNA, 15 bp, Homo sapiens
tctttcatgtttttg

SEQ ID NO: 158798 - DNA, 15 bp, Homo sapiens
atctttcatgttttt

SEQ ID NO: 158799 - DNA, 15 bp, Homo sapiens
tatctttcatgtttt

SEQ ID NO: 158800 - DNA, 15 bp, Homo sapiens
ttatctttcatgttt

SEQ ID NO: 158801 - DNA, 15 bp, Homo sapiens
gttatctttcatgtt

SEQ ID NO: 158802 - DNA, 15 bp, Homo sapiens
agttatctttcatgt

SEQ ID NO: 158803 - DNA, 15 bp, Homo sapiens
cagttatctttcatg

SEQ ID NO: 158804 - DNA, 15 bp, Homo sapiens
ccagttatctttcat

SEQ ID NO: 158805 - DNA, 15 bp, Homo sapiens
accagttatctttca

SEQ ID NO: 158806 - DNA, 15 bp, Homo sapiens
caccagttatctttc

SEQ ID NO: 158807 - DNA, 15 bp, Homo sapiens
acaccagttatcttt

SEQ ID NO: 158808 - DNA, 15 bp, Homo sapiens
aacaccagttatctt

SEQ ID NO: 158809 - DNA, 15 bp, Homo sapiens
caacaccagttatct

SEQ ID NO: 158810 - DNA, 15 bp, Homo sapiens
ccaacaccagttatc

SEQ ID NO: 158811 - DNA, 15 bp, Homo sapiens
tccaacaccagttat

SEQ ID NO: 158812 - DNA, 15 bp, Homo sapiens
ctccaacaccagtta

SEQ ID NO: 158813 - DNA, 15 bp, Homo sapiens
tctccaacaccagtt

SEQ ID NO: 158814 - DNA, 15 bp, Homo sapiens
ttctccaacaccagt

SEQ ID NO: 158815 - DNA, 15 bp, Homo sapiens
cttctccaacaccag

SEQ ID NO: 158816 - DNA, 15 bp, Homo sapiens
tcttctccaacacca

SEQ ID NO: 158817 - DNA, 15 bp, Homo sapiens
atcttctccaacacc

SEQ ID NO: 158818 - DNA, 15 bp, Homo sapiens
tatcttctccaacac

SEQ ID NO: 158819 - DNA, 15 bp, Homo sapiens
gtatcttctccaaca

SEQ ID NO: 158820 - DNA, 15 bp, Homo sapiens
tgtatcttctccaac

SEQ ID NO: 158821 - DNA, 15 bp, Homo sapiens
ctgtatcttctccaa

SEQ ID NO: 158822 - DNA, 15 bp, Homo sapiens
tctgtatcttctcca

SEQ ID NO: 158823 - DNA, 15 bp, Homo sapiens
ctctgtatcttctcc

SEQ ID NO: 158824 - DNA, 15 bp, Homo sapiens
tctctgtatcttctc

SEQ ID NO: 158825 - DNA, 15 bp, Homo sapiens
ttctctgtatcttct

SEQ ID NO: 158826 - DNA, 15 bp, Homo sapiens
tttctctgtatcttc

SEQ ID NO: 158827 - DNA, 15 bp, Homo sapiens
ttttctctgtatctt

SEQ ID NO: 158828 - DNA, 15 bp, Homo sapiens
cttttctctgtatct

SEQ ID NO: 158829 - DNA, 15 bp, Homo sapiens
ccttttctctgtatc

SEQ ID NO: 158830 - DNA, 15 bp, Homo sapiens
tccttttctctgtat

SEQ ID NO: 158831 - DNA, 15 bp, Homo sapiens
ttccttttctctgta

SEQ ID NO: 158832 - DNA, 15 bp, Homo sapiens
tttccttttctctgt

SEQ ID NO: 158833 - DNA, 15 bp, Homo sapiens
ttttccttttctctg

SEQ ID NO: 158834 - DNA, 15 bp, Homo sapiens
cttttccttttctct

SEQ ID NO: 158835 - DNA, 15 bp, Homo sapiens
tcttttccttttctc

SEQ ID NO: 158836 - DNA, 15 bp, Homo sapiens
ttcttttccttttct

SEQ ID NO: 158837 - DNA, 15 bp, Homo sapiens
gttcttttccttttc

SEQ ID NO: 158838 - DNA, 15 bp, Homo sapiens
agttcttttcctttt

SEQ ID NO: 158839 - DNA, 15 bp, Homo sapiens
gagttcttttccttt

SEQ ID NO: 158840 - DNA, 15 bp, Homo sapiens
tgagttcttttcctt

SEQ ID NO: 158841 - DNA, 15 bp, Homo sapiens
atgagttcttttcct

SEQ ID NO: 158842 - DNA, 15 bp, Homo sapiens
tatgagttcttttcc

SEQ ID NO: 158843 - DNA, 15 bp, Homo sapiens
atatgagttcttttc

SEQ ID NO: 158844 - DNA, 15 bp, Homo sapiens
tatatgagttctttt

SEQ ID NO: 158845 - DNA, 15 bp, Homo sapiens
atatatgagttcttt

SEQ ID NO: 158846 - DNA, 15 bp, Homo sapiens
aatatatgagttctt

SEQ ID NO: 158847 - DNA, 15 bp, Homo sapiens
caatatatgagttct

SEQ ID NO: 158848 - DNA, 15 bp, Homo sapiens
acaatatatgagttc

SEQ ID NO: 158849 - DNA, 15 bp, Homo sapiens
cacaatatatgagtt

SEQ ID NO: 158850 - DNA, 15 bp, Homo sapiens
tcacaatatatgagt

SEQ ID NO: 158851 - DNA, 15 bp, Homo sapiens
ctcacaatatatgag

SEQ ID NO: 158852 - DNA, 15 bp, Homo sapiens
actcacaatatatga

SEQ ID NO: 158853 - DNA, 15 bp, Homo sapiens
cactcacaatatatg

SEQ ID NO: 158854 - DNA, 15 bp, Homo sapiens
ccactcacaatatat

SEQ ID NO: 158855 - DNA, 15 bp, Homo sapiens
cccactcacaatata

SEQ ID NO: 158856 - DNA, 15 bp, Homo sapiens
tcccactcacaatat

SEQ ID NO: 158857 - DNA, 15 bp, Homo sapiens
ttcccactcacaata

SEQ ID NO: 158858 - DNA, 15 bp, Homo sapiens
attcccactcacaat

SEQ ID NO: 158859 - DNA, 15 bp, Homo sapiens
cattcccactcacaa

SEQ ID NO: 158860 - DNA, 15 bp, Homo sapiens
acattcccactcaca

SEQ ID NO: 158861 - DNA, 15 bp, Homo sapiens
tacattcccactcac

SEQ ID NO: 158862 - DNA, 15 bp, Homo sapiens
ttacattcccactca

SEQ ID NO: 158863 - DNA, 15 bp, Homo sapiens
tttacattcccactc

SEQ ID NO: 158864 - DNA, 15 bp, Homo sapiens
atttacattcccact

SEQ ID NO: 158865 - DNA, 15 bp, Homo sapiens
aatttacattcccac

SEQ ID NO: 158866 - DNA, 15 bp, Homo sapiens
taatttacattccca

SEQ ID NO: 158867 - DNA, 15 bp, Homo sapiens
ctaatttacattccc

SEQ ID NO: 158868 - DNA, 15 bp, Homo sapiens
actaatttacattcc

SEQ ID NO: 158869 - DNA, 15 bp, Homo sapiens
tactaatttacattc

SEQ ID NO: 158870 - DNA, 15 bp, Homo sapiens
atactaatttacatt

SEQ ID NO: 158871 - DNA, 15 bp, Homo sapiens
tatactaatttacat

SEQ ID NO: 158872 - DNA, 15 bp, Homo sapiens
ctatactaatttaca

SEQ ID NO: 158873 - DNA, 15 bp, Homo sapiens
gctatactaatttac

SEQ ID NO: 158874 - DNA, 15 bp, Homo sapiens
ggctatactaattta

SEQ ID NO: 158875 - DNA, 15 bp, Homo sapiens
tggctatactaattt

SEQ ID NO: 158876 - DNA, 15 bp, Homo sapiens
atggctatactaatt

SEQ ID NO: 158877 - DNA, 15 bp, Homo sapiens
aatggctatactaat

SEQ ID NO: 158878 - DNA, 15 bp, Homo sapiens
taatggctatactaa

SEQ ID NO: 158879 - DNA, 15 bp, Homo sapiens
ataatggctatacta

SEQ ID NO: 158880 - DNA, 15 bp, Homo sapiens
cataatggctatact

SEQ ID NO: 158881 - DNA, 15 bp, Homo sapiens
acataatggctatac

SEQ ID NO: 158882 - DNA, 15 bp, Homo sapiens
tacataatggctata

SEQ ID NO: 158883 - DNA, 15 bp, Homo sapiens
ttacataatggctat

SEQ ID NO: 158884 - DNA, 15 bp, Homo sapiens
tttacataatggcta

SEQ ID NO: 158885 - DNA, 15 bp, Homo sapiens
ttttacataatggct

SEQ ID NO: 158886 - DNA, 15 bp, Homo sapiens
attttacataatggc

SEQ ID NO: 158887 - DNA, 15 bp, Homo sapiens
cattttacataatgg

SEQ ID NO: 158888 - DNA, 15 bp, Homo sapiens
ccattttacataatg

SEQ ID NO: 158889 - DNA, 15 bp, Homo sapiens
accattttacataat

SEQ ID NO: 158890 - DNA, 15 bp, Homo sapiens
taccattttacataa

SEQ ID NO: 158891 - DNA, 15 bp, Homo sapiens
ataccattttacata

SEQ ID NO: 158892 - DNA, 15 bp, Homo sapiens
cataccattttacat

SEQ ID NO: 158893 - DNA, 15 bp, Homo sapiens
tcataccattttaca

SEQ ID NO: 158894 - DNA, 15 bp, Homo sapiens
ttcataccattttac

SEQ ID NO: 158895 - DNA, 15 bp, Homo sapiens
cttcataccatttta

SEQ ID NO: 158896 - DNA, 15 bp, Homo sapiens
ccttcataccatttt

SEQ ID NO: 158897 - DNA, 15 bp, Homo sapiens
accttcataccattt

SEQ ID NO: 158898 - DNA, 15 bp, Homo sapiens
aaccttcataccatt

SEQ ID NO: 158899 - DNA, 15 bp, Homo sapiens
gaaccttcataccat

SEQ ID NO: 158900 - DNA, 15 bp, Homo sapiens
agaaccttcatacca

SEQ ID NO: 158901 - DNA, 15 bp, Homo sapiens
aagaaccttcatacc

SEQ ID NO: 158902 - DNA, 15 bp, Homo sapiens
taagaaccttcatac

SEQ ID NO: 158903 - DNA, 15 bp, Homo sapiens
ttaagaaccttcata

SEQ ID NO: 158904 - DNA, 15 bp, Homo sapiens
tttaagaaccttcat

SEQ ID NO: 158905 - DNA, 15 bp, Homo sapiens
ttttaagaaccttca

SEQ ID NO: 158906 - DNA, 15 bp, Homo sapiens
tttttaagaaccttc

SEQ ID NO: 158907 - DNA, 15 bp, Homo sapiens
ctttttaagaacctt

SEQ ID NO: 158908 - DNA, 15 bp, Homo sapiens
cctttttaagaacct

SEQ ID NO: 158909 - DNA, 15 bp, Homo sapiens
acctttttaagaacc

SEQ ID NO: 158910 - DNA, 15 bp, Homo sapiens
tacctttttaagaac

SEQ ID NO: 158911 - DNA, 15 bp, Homo sapiens
ttacctttttaagaa

SEQ ID NO: 158912 - DNA, 15 bp, Homo sapiens
tttacctttttaaga

SEQ ID NO: 158913 - DNA, 15 bp, Homo sapiens
ttttacctttttaag

SEQ ID NO: 158914 - DNA, 15 bp, Homo sapiens
tttttacctttttaa

SEQ ID NO: 158915 - DNA, 15 bp, Homo sapiens
atttttaccttttta

SEQ ID NO: 158916 - DNA, 15 bp, Homo sapiens
tatttttaccttttt

SEQ ID NO: 158917 - DNA, 15 bp, Homo sapiens
ctatttttacctttt

SEQ ID NO: 158918 - DNA, 15 bp, Homo sapiens
tctatttttaccttt

SEQ ID NO: 158919 - DNA, 15 bp, Homo sapiens
ttctatttttacctt

SEQ ID NO: 158920 - DNA, 15 bp, Homo sapiens
tttctatttttacct

SEQ ID NO: 158921 - DNA, 15 bp, Homo sapiens
atttctatttttacc

SEQ ID NO: 158922 - DNA, 15 bp, Homo sapiens
tatttctatttttac

SEQ ID NO: 158923 - DNA, 15 bp, Homo sapiens
gtatttctattttta

SEQ ID NO: 158924 - DNA, 15 bp, Homo sapiens
tgtatttctattttt

SEQ ID NO: 158925 - DNA, 15 bp, Homo sapiens
atgtatttctatttt

SEQ ID NO: 158926 - DNA, 15 bp, Homo sapiens
tatgtatttctattt

SEQ ID NO: 158927 - DNA, 15 bp, Homo sapiens
gtatgtatttctatt

SEQ ID NO: 158928 - DNA, 15 bp, Homo sapiens
tgtatgtatttctat

SEQ ID NO: 158929 - DNA, 15 bp, Homo sapiens
ttgtatgtatttcta

SEQ ID NO: 158930 - DNA, 15 bp, Homo sapiens
gttgtatgtatttct

SEQ ID NO: 158931 - DNA, 15 bp, Homo sapiens
ggttgtatgtatttc

SEQ ID NO: 158932 - DNA, 15 bp, Homo sapiens
tggttgtatgtattt

SEQ ID NO: 158933 - DNA, 15 bp, Homo sapiens
ttggttgtatgtatt

SEQ ID NO: 158934 - DNA, 15 bp, Homo sapiens
cttggttgtatgtat

SEQ ID NO: 158935 - DNA, 15 bp, Homo sapiens
acttggttgtatgta

SEQ ID NO: 158936 - DNA, 15 bp, Homo sapiens
tacttggttgtatgt

SEQ ID NO: 158937 - DNA, 15 bp, Homo sapiens
ttacttggttgtatg

SEQ ID NO: 158938 - DNA, 15 bp, Homo sapiens
attacttggttgtat

SEQ ID NO: 158939 - DNA, 15 bp, Homo sapiens
gattacttggttgta

SEQ ID NO: 158940 - DNA, 15 bp, Homo sapiens
ggattacttggttgt

SEQ ID NO: 158941 - DNA, 15 bp, Homo sapiens
gggattacttggttg

SEQ ID NO: 158942 - DNA, 15 bp, Homo sapiens
tgggattacttggtt

SEQ ID NO: 158943 - DNA, 15 bp, Homo sapiens
gtgggattacttggt

SEQ ID NO: 158944 - DNA, 15 bp, Homo sapiens
agtgggattacttgg

SEQ ID NO: 158945 - DNA, 15 bp, Homo sapiens
aagtgggattacttg

SEQ ID NO: 158946 - DNA, 15 bp, Homo sapiens
gaagtgggattactt

SEQ ID NO: 158947 - DNA, 15 bp, Homo sapiens
gacccagaagtggga

SEQ ID NO: 158948 - DNA, 15 bp, Homo sapiens
agacccagaagtggg

SEQ ID NO: 158949 - DNA, 15 bp, Homo sapiens
aagacccagaagtgg

SEQ ID NO: 158950 - DNA, 15 bp, Homo sapiens
aaagacccagaagtg

SEQ ID NO: 158951 - DNA, 15 bp, Homo sapiens
taaagacccagaagt

SEQ ID NO: 158952 - DNA, 15 bp, Homo sapiens
ataaagacccagaag

SEQ ID NO: 158953 - DNA, 15 bp, Homo sapiens
tataaagacccagaa

SEQ ID NO: 158954 - DNA, 15 bp, Homo sapiens
atataaagacccaga

SEQ ID NO: 158955 - DNA, 15 bp, Homo sapiens
gatataaagacccag

SEQ ID NO: 158956 - DNA, 15 bp, Homo sapiens
ggatataaagaccca

SEQ ID NO: 158957 - DNA, 15 bp, Homo sapiens
tggatataaagaccc

SEQ ID NO: 158958 - DNA, 15 bp, Homo sapiens
ttggatataaagacc

SEQ ID NO: 158959 - DNA, 15 bp, Homo sapiens
tttggatataaagac

SEQ ID NO: 158960 - DNA, 15 bp, Homo sapiens
ctttggatataaaga

SEQ ID NO: 158961 - DNA, 15 bp, Homo sapiens
tctttggatataaag

SEQ ID NO: 158962 - DNA, 15 bp, Homo sapiens
ttctttggatataaa

SEQ ID NO: 158963 - DNA, 15 bp, Homo sapiens
tttctttggatataa

SEQ ID NO: 158964 - DNA, 15 bp, Homo sapiens
gtttctttggatata

SEQ ID NO: 158965 - DNA, 15 bp, Homo sapiens
agtttctttggatat

SEQ ID NO: 158966 - DNA, 15 bp, Homo sapiens
cagtttctttggata

SEQ ID NO: 158967 - DNA, 15 bp, Homo sapiens
gcagtttctttggat

SEQ ID NO: 158968 - DNA, 15 bp, Homo sapiens
tgcagtttctttgga

SEQ ID NO: 158969 - DNA, 15 bp, Homo sapiens
ttgcagtttctttgg

SEQ ID NO: 158970 - DNA, 15 bp, Homo sapiens
attgcagtttctttg

SEQ ID NO: 158971 - DNA, 15 bp, Homo sapiens
gattgcagtttcttt

SEQ ID NO: 158972 - DNA, 15 bp, Homo sapiens
tgattgcagtttctt

SEQ ID NO: 158973 - DNA, 15 bp, Homo sapiens
ctgattgcagtttct

SEQ ID NO: 158974 - DNA, 15 bp, Homo sapiens
actgattgcagtttc

SEQ ID NO: 158975 - DNA, 15 bp, Homo sapiens
cactgattgcagttt

SEQ ID NO: 158976 - DNA, 15 bp, Homo sapiens
acactgattgcagtt

SEQ ID NO: 158977 - DNA, 15 bp, Homo sapiens
aacactgattgcagt

SEQ ID NO: 158978 - DNA, 15 bp, Homo sapiens
taacactgattgcag

SEQ ID NO: 158979 - DNA, 15 bp, Homo sapiens
ttaacactgattgca

SEQ ID NO: 158980 - DNA, 15 bp, Homo sapiens
tttaacactgattgc

SEQ ID NO: 158981 - DNA, 15 bp, Homo sapiens
ctttaacactgattg

SEQ ID NO: 158982 - DNA, 15 bp, Homo sapiens
cctttaacactgatt

SEQ ID NO: 158983 - DNA, 15 bp, Homo sapiens
ccctttaacactgat

SEQ ID NO: 158984 - DNA, 15 bp, Homo sapiens
tccctttaacactga

SEQ ID NO: 158985 - DNA, 15 bp, Homo sapiens
atccctttaacactg

SEQ ID NO: 158986 - DNA, 15 bp, Homo sapiens
tatccctttaacact

SEQ ID NO: 158987 - DNA, 15 bp, Homo sapiens
atatccctttaacac

SEQ ID NO: 158988 - DNA, 15 bp, Homo sapiens
aatatccctttaaca

SEQ ID NO: 158989 - DNA, 15 bp, Homo sapiens
aaatatccctttaac

SEQ ID NO: 158990 - DNA, 15 bp, Homo sapiens
caaatatccctttaa

SEQ ID NO: 158991 - DNA, 15 bp, Homo sapiens
gcaaatatcccttta

SEQ ID NO: 158992 - DNA, 15 bp, Homo sapiens
tgcaaatatcccttt

SEQ ID NO: 158993 - DNA, 15 bp, Homo sapiens
gtgcaaatatccctt

SEQ ID NO: 158994 - DNA, 15 bp, Homo sapiens
agtgcaaatatccct

SEQ ID NO: 158995 - DNA, 15 bp, Homo sapiens
gagtgcaaatatccc

SEQ ID NO: 158996 - DNA, 15 bp, Homo sapiens
agagtgcaaatatcc

SEQ ID NO: 158997 - DNA, 15 bp, Homo sapiens
gagagtgcaaatatc

SEQ ID NO: 158998 - DNA, 15 bp, Homo sapiens
tgagagtgcaaatat

SEQ ID NO: 158999 - DNA, 15 bp, Homo sapiens
gtgagagtgcaaata

SEQ ID NO: 159000 - DNA, 15 bp, Homo sapiens
cgtgagagtgcaaat

SEQ ID NO: 159001 - DNA, 15 bp, Homo sapiens
acgtgagagtgcaaa

SEQ ID NO: 159002 - DNA, 15 bp, Homo sapiens
aacgtgagagtgcaa

SEQ ID NO: 159003 - DNA, 15 bp, Homo sapiens
gaacgtgagagtgca

SEQ ID NO: 159004 - DNA, 15 bp, Homo sapiens
tgaacgtgagagtgc

SEQ ID NO: 159005 - DNA, 15 bp, Homo sapiens
atgaacgtgagagtg

SEQ ID NO: 159006 - DNA, 15 bp, Homo sapiens
aatgaacgtgagagt

SEQ ID NO: 159007 - DNA, 15 bp, Homo sapiens
caatgaacgtgagag

SEQ ID NO: 159008 - DNA, 15 bp, Homo sapiens
acaatgaacgtgaga

SEQ ID NO: 159009 - DNA, 15 bp, Homo sapiens
tacaatgaacgtgag

SEQ ID NO: 159010 - DNA, 15 bp, Homo sapiens
ctacaatgaacgtga

SEQ ID NO: 159011 - DNA, 15 bp, Homo sapiens
gctacaatgaacgtg

SEQ ID NO: 159012 - DNA, 15 bp, Homo sapiens
tgctacaatgaacgt

SEQ ID NO: 159013 - DNA, 15 bp, Homo sapiens
atgctacaatgaacg

SEQ ID NO: 159014 - DNA, 15 bp, Homo sapiens
aatgctacaatgaac

SEQ ID NO: 159015 - DNA, 15 bp, Homo sapiens
taatgctacaatgaa

SEQ ID NO: 159016 - DNA, 15 bp, Homo sapiens
ataatgctacaatga

SEQ ID NO: 159017 - DNA, 15 bp, Homo sapiens
aataatgctacaatg

SEQ ID NO: 159018 - DNA, 15 bp, Homo sapiens
gaataatgctacaat

SEQ ID NO: 159019 - DNA, 15 bp, Homo sapiens
tgaataatgctacaa

SEQ ID NO: 159020 - DNA, 15 bp, Homo sapiens
attgtgaataatgct

SEQ ID NO: 159021 - DNA, 15 bp, Homo sapiens
tattgtgaataatgc

SEQ ID NO: 159022 - DNA, 15 bp, Homo sapiens
ctattgtgaataatg

SEQ ID NO: 159023 - DNA, 15 bp, Homo sapiens
gctattgtgaataat

SEQ ID NO: 159024 - DNA, 15 bp, Homo sapiens
ggctattgtgaataa

SEQ ID NO: 159025 - DNA, 15 bp, Homo sapiens
tggctattgtgaata

SEQ ID NO: 159026 - DNA, 15 bp, Homo sapiens
ttggctattgtgaat

SEQ ID NO: 159027 - DNA, 15 bp, Homo sapiens
cttggctattgtgaa

SEQ ID NO: 159028 - DNA, 15 bp, Homo sapiens
tcttggctattgtga

SEQ ID NO: 159029 - DNA, 15 bp, Homo sapiens
tttccatatcttggc

SEQ ID NO: 159030 - DNA, 15 bp, Homo sapiens
gtttccatatcttgg

SEQ ID NO: 159031 - DNA, 15 bp, Homo sapiens
tgtttccatatcttg

SEQ ID NO: 159032 - DNA, 15 bp, Homo sapiens
ttgtttccatatctt

SEQ ID NO: 159033 - DNA, 15 bp, Homo sapiens
gttgtttccatatct

SEQ ID NO: 159034 - DNA, 15 bp, Homo sapiens
tgttgtttccatatc

SEQ ID NO: 159035 - DNA, 15 bp, Homo sapiens
ttgttgtttccatat

SEQ ID NO: 159036 - DNA, 15 bp, Homo sapiens
gttgttgtttccata

SEQ ID NO: 159037 - DNA, 15 bp, Homo sapiens
tgttgttgtttccat

SEQ ID NO: 159038 - DNA, 15 bp, Homo sapiens
ttgttgttgtttcca

SEQ ID NO: 159039 - DNA, 15 bp, Homo sapiens
tttgttgttgtttcc

SEQ ID NO: 159040 - DNA, 15 bp, Homo sapiens
ttttgttgttgtttc

SEQ ID NO: 159041 - DNA, 15 bp, Homo sapiens
gttttgttgttgttt

SEQ ID NO: 159042 - DNA, 15 bp, Homo sapiens
tgttttgttgttgtt

SEQ ID NO: 159043 - DNA, 15 bp, Homo sapiens
atgttttgttgttgt

SEQ ID NO: 159044 - DNA, 15 bp, Homo sapiens
gatgttttgttgttg

SEQ ID NO: 159045 - DNA, 15 bp, Homo sapiens
ggatgttttgttgtt

SEQ ID NO: 159046 - DNA, 15 bp, Homo sapiens
tggatgttttgttgt

SEQ ID NO: 159047 - DNA, 15 bp, Homo sapiens
atggatgttttgttg

SEQ ID NO: 159048 - DNA, 15 bp, Homo sapiens
aatggatgttttgtt

SEQ ID NO: 159049 - DNA, 15 bp, Homo sapiens
taatggatgttttgt

SEQ ID NO: 159050 - DNA, 15 bp, Homo sapiens
ttaatggatgttttg

SEQ ID NO: 159051 - DNA, 15 bp, Homo sapiens
gttaatggatgtttt

SEQ ID NO: 159052 - DNA, 15 bp, Homo sapiens
tgttaatggatgttt

SEQ ID NO: 159053 - DNA, 15 bp, Homo sapiens
ctgttaatggatgtt

SEQ ID NO: 159054 - DNA, 15 bp, Homo sapiens
tctgttaatggatgt

SEQ ID NO: 159055 - DNA, 15 bp, Homo sapiens
atctgttaatggatg

SEQ ID NO: 159056 - DNA, 15 bp, Homo sapiens
catctgttaatggat

SEQ ID NO: 159057 - DNA, 15 bp, Homo sapiens
tcatctgttaatgga

SEQ ID NO: 159058 - DNA, 15 bp, Homo sapiens
ttcatctgttaatgg

SEQ ID NO: 159059 - DNA, 15 bp, Homo sapiens
attcatctgttaatg

SEQ ID NO: 159060 - DNA, 15 bp, Homo sapiens
cattcatctgttaat

SEQ ID NO: 159061 - DNA, 15 bp, Homo sapiens
ccattcatctgttaa

SEQ ID NO: 159062 - DNA, 15 bp, Homo sapiens
tccattcatctgtta

SEQ ID NO: 159063 - DNA, 15 bp, Homo sapiens
atccattcatctgtt

SEQ ID NO: 159064 - DNA, 15 bp, Homo sapiens
ctttatccattcatc

SEQ ID NO: 159065 - DNA, 15 bp, Homo sapiens
tctttatccattcat

SEQ ID NO: 159066 - DNA, 15 bp, Homo sapiens
ttctttatccattca

SEQ ID NO: 159067 - DNA, 15 bp, Homo sapiens
tttctttatccattc

SEQ ID NO: 159068 - DNA, 15 bp, Homo sapiens
ttttctttatccatt

SEQ ID NO: 159069 - DNA, 15 bp, Homo sapiens
cattttctttatcca

SEQ ID NO: 159070 - DNA, 15 bp, Homo sapiens
acattttctttatcc

SEQ ID NO: 159071 - DNA, 15 bp, Homo sapiens
cacattttctttatc

SEQ ID NO: 159072 - DNA, 15 bp, Homo sapiens
ccacattttctttat

SEQ ID NO: 159073 - DNA, 15 bp, Homo sapiens
ataccacattttctt

SEQ ID NO: 159074 - DNA, 15 bp, Homo sapiens
tataccacattttct

SEQ ID NO: 159075 - DNA, 15 bp, Homo sapiens
atataccacattttc

SEQ ID NO: 159076 - DNA, 15 bp, Homo sapiens
gatataccacatttt

SEQ ID NO: 159077 - DNA, 15 bp, Homo sapiens
agatataccacattt

SEQ ID NO: 159078 - DNA, 15 bp, Homo sapiens
gagatataccacatt

SEQ ID NO: 159079 - DNA, 15 bp, Homo sapiens
ggagatataccacat

SEQ ID NO: 159080 - DNA, 15 bp, Homo sapiens
tggagatataccaca

SEQ ID NO: 159081 - DNA, 15 bp, Homo sapiens
atggagatataccac

SEQ ID NO: 159082 - DNA, 15 bp, Homo sapiens
tatggagatatacca

SEQ ID NO: 159083 - DNA, 15 bp, Homo sapiens
ttatggagatatacc

SEQ ID NO: 159084 - DNA, 15 bp, Homo sapiens
attatggagatatac

SEQ ID NO: 159085 - DNA, 15 bp, Homo sapiens
cattatggagatata

SEQ ID NO: 159086 - DNA, 15 bp, Homo sapiens
ccattatggagatat

SEQ ID NO: 159087 - DNA, 15 bp, Homo sapiens
accattatggagata

SEQ ID NO: 159088 - DNA, 15 bp, Homo sapiens
taccattatggagat

SEQ ID NO: 159089 - DNA, 15 bp, Homo sapiens
ataccattatggaga

SEQ ID NO: 159090 - DNA, 15 bp, Homo sapiens
tataccattatggag

SEQ ID NO: 159091 - DNA, 15 bp, Homo sapiens
gtataccattatgga

SEQ ID NO: 159092 - DNA, 15 bp, Homo sapiens
agtataccattatgg

SEQ ID NO: 159093 - DNA, 15 bp, Homo sapiens
tagtataccattatg

SEQ ID NO: 159094 - DNA, 15 bp, Homo sapiens
atagtataccattat

SEQ ID NO: 159095 - DNA, 15 bp, Homo sapiens
aatagtataccatta

SEQ ID NO: 159096 - DNA, 15 bp, Homo sapiens
gaatagtataccatt

SEQ ID NO: 159097 - DNA, 15 bp, Homo sapiens
tgaatagtataccat

SEQ ID NO: 159098 - DNA, 15 bp, Homo sapiens
atgaatagtatacca

SEQ ID NO: 159099 - DNA, 15 bp, Homo sapiens
gatgaatagtatacc

SEQ ID NO: 159100 - DNA, 15 bp, Homo sapiens
ggatgaatagtatac

SEQ ID NO: 159101 - DNA, 15 bp, Homo sapiens
aggatgaatagtata

SEQ ID NO: 159102 - DNA, 15 bp, Homo sapiens
aaggatgaatagtat

SEQ ID NO: 159103 - DNA, 15 bp, Homo sapiens
aaaggatgaatagta

SEQ ID NO: 159104 - DNA, 15 bp, Homo sapiens
taaaggatgaatagt

SEQ ID NO: 159105 - DNA, 15 bp, Homo sapiens
gtaaaggatgaatag

SEQ ID NO: 159106 - DNA, 15 bp, Homo sapiens
tgtaaaggatgaata

SEQ ID NO: 159107 - DNA, 15 bp, Homo sapiens
ttgtaaaggatgaat

SEQ ID NO: 159108 - DNA, 15 bp, Homo sapiens
tttgtaaaggatgaa

SEQ ID NO: 159109 - DNA, 15 bp, Homo sapiens
atttgtaaaggatga

SEQ ID NO: 159110 - DNA, 15 bp, Homo sapiens
catttgtaaaggatg

SEQ ID NO: 159111 - DNA, 15 bp, Homo sapiens
ccatttgtaaaggat

SEQ ID NO: 159112 - DNA, 15 bp, Homo sapiens
accatttgtaaagga

SEQ ID NO: 159113 - DNA, 15 bp, Homo sapiens
caccatttgtaaagg

SEQ ID NO: 159114 - DNA, 15 bp, Homo sapiens
acaccatttgtaaag

SEQ ID NO: 159115 - DNA, 15 bp, Homo sapiens
tacaccatttgtaaa

SEQ ID NO: 159116 - DNA, 15 bp, Homo sapiens
ttacaccatttgtaa

SEQ ID NO: 159117 - DNA, 15 bp, Homo sapiens
tttacaccatttgta

SEQ ID NO: 159118 - DNA, 15 bp, Homo sapiens
atttacaccatttgt

SEQ ID NO: 159119 - DNA, 15 bp, Homo sapiens
gatttacaccatttg

SEQ ID NO: 159120 - DNA, 15 bp, Homo sapiens
ggatttacaccattt

SEQ ID NO: 159121 - DNA, 15 bp, Homo sapiens
aggatttacaccatt

SEQ ID NO: 159122 - DNA, 15 bp, Homo sapiens
caggatttacaccat

SEQ ID NO: 159123 - DNA, 15 bp, Homo sapiens
acaggatttacacca

SEQ ID NO: 159124 - DNA, 15 bp, Homo sapiens
gacaggatttacacc

SEQ ID NO: 159125 - DNA, 15 bp, Homo sapiens
tgacaggatttacac

SEQ ID NO: 159126 - DNA, 15 bp, Homo sapiens
atgacaggatttaca

SEQ ID NO: 159127 - DNA, 15 bp, Homo sapiens
aatgacaggatttac

SEQ ID NO: 159128 - DNA, 15 bp, Homo sapiens
aaatgacaggattta

SEQ ID NO: 159129 - DNA, 15 bp, Homo sapiens
caaatgacaggattt

SEQ ID NO: 159130 - DNA, 15 bp, Homo sapiens
acaaatgacaggatt

SEQ ID NO: 159131 - DNA, 15 bp, Homo sapiens
cacaaatgacaggat

SEQ ID NO: 159132 - DNA, 15 bp, Homo sapiens
tcacaaatgacagga

SEQ ID NO: 159133 - DNA, 15 bp, Homo sapiens
atcacaaatgacagg

SEQ ID NO: 159134 - DNA, 15 bp, Homo sapiens
tatcacaaatgacag

SEQ ID NO: 159135 - DNA, 15 bp, Homo sapiens
ctatcacaaatgaca

SEQ ID NO: 159136 - DNA, 15 bp, Homo sapiens
gctatcacaaatgac

SEQ ID NO: 159137 - DNA, 15 bp, Homo sapiens
tgctatcacaaatga

SEQ ID NO: 159138 - DNA, 15 bp, Homo sapiens
atgctatcacaaatg

SEQ ID NO: 159139 - DNA, 15 bp, Homo sapiens
tatgctatcacaaat

SEQ ID NO: 159140 - DNA, 15 bp, Homo sapiens
ttatgctatcacaaa

SEQ ID NO: 159141 - DNA, 15 bp, Homo sapiens
tttatgctatcacaa

SEQ ID NO: 159142 - DNA, 15 bp, Homo sapiens
atttatgctatcaca

SEQ ID NO: 159143 - DNA, 15 bp, Homo sapiens
catttatgctatcac

SEQ ID NO: 159144 - DNA, 15 bp, Homo sapiens
tcatttatgctatca

SEQ ID NO: 159145 - DNA, 15 bp, Homo sapiens
ctcatttatgctatc

SEQ ID NO: 159146 - DNA, 15 bp, Homo sapiens
gctcatttatgctat

SEQ ID NO: 159147 - DNA, 15 bp, Homo sapiens
ggctcatttatgcta

SEQ ID NO: 159148 - DNA, 15 bp, Homo sapiens
aggctcatttatgct

SEQ ID NO: 159149 - DNA, 15 bp, Homo sapiens
caggctcatttatgc

SEQ ID NO: 159150 - DNA, 15 bp, Homo sapiens
ccaggctcatttatg

SEQ ID NO: 159151 - DNA, 15 bp, Homo sapiens
tccaggctcatttat

SEQ ID NO: 159152 - DNA, 15 bp, Homo sapiens
ttccaggctcattta

SEQ ID NO: 159153 - DNA, 15 bp, Homo sapiens
cttccaggctcattt

SEQ ID NO: 159154 - DNA, 15 bp, Homo sapiens
acttccaggctcatt

SEQ ID NO: 159155 - DNA, 15 bp, Homo sapiens
gacttccaggctcat

SEQ ID NO: 159156 - DNA, 15 bp, Homo sapiens
tgacttccaggctca

SEQ ID NO: 159157 - DNA, 15 bp, Homo sapiens
atgacttccaggctc

SEQ ID NO: 159158 - DNA, 15 bp, Homo sapiens
aatgacttccaggct

SEQ ID NO: 159159 - DNA, 15 bp, Homo sapiens
taatgacttccaggc

SEQ ID NO: 159160 - DNA, 15 bp, Homo sapiens
ataatgacttccagg

SEQ ID NO: 159161 - DNA, 15 bp, Homo sapiens
cataatgacttccag

SEQ ID NO: 159162 - DNA, 15 bp, Homo sapiens
acataatgacttcca

SEQ ID NO: 159163 - DNA, 15 bp, Homo sapiens
tacataatgacttcc

SEQ ID NO: 159164 - DNA, 15 bp, Homo sapiens
ttacataatgacttc

SEQ ID NO: 159165 - DNA, 15 bp, Homo sapiens
tttacataatgactt

SEQ ID NO: 159166 - DNA, 15 bp, Homo sapiens
ctttacataatgact

SEQ ID NO: 159167 - DNA, 15 bp, Homo sapiens
tctttacataatgac

SEQ ID NO: 159168 - DNA, 15 bp, Homo sapiens
ctctttacataatga

SEQ ID NO: 159169 - DNA, 15 bp, Homo sapiens
tctctttacataatg

SEQ ID NO: 159170 - DNA, 15 bp, Homo sapiens
atctctttacataat

SEQ ID NO: 159171 - DNA, 15 bp, Homo sapiens
aatctctttacataa

SEQ ID NO: 159172 - DNA, 15 bp, Homo sapiens
taatctctttacata

SEQ ID NO: 159173 - DNA, 15 bp, Homo sapiens
ttaatctctttacat

SEQ ID NO: 159174 - DNA, 15 bp, Homo sapiens
tttaatctctttaca

SEQ ID NO: 159175 - DNA, 15 bp, Homo sapiens
ctttaatctctttac

SEQ ID NO: 159176 - DNA, 15 bp, Homo sapiens
actttaatctcttta

SEQ ID NO: 159177 - DNA, 15 bp, Homo sapiens
gactttaatctcttt

SEQ ID NO: 159178 - DNA, 15 bp, Homo sapiens
ggactttaatctctt

SEQ ID NO: 159179 - DNA, 15 bp, Homo sapiens
aggactttaatctct

SEQ ID NO: 159180 - DNA, 15 bp, Homo sapiens
aaggactttaatctc

SEQ ID NO: 159181 - DNA, 15 bp, Homo sapiens
aaaggactttaatct

SEQ ID NO: 159182 - DNA, 15 bp, Homo sapiens
caaaggactttaatc

SEQ ID NO: 159183 - DNA, 15 bp, Homo sapiens
acaaaggactttaat

SEQ ID NO: 159184 - DNA, 15 bp, Homo sapiens
tacaaaggactttaa

SEQ ID NO: 159185 - DNA, 15 bp, Homo sapiens
ttacaaaggacttta

SEQ ID NO: 159186 - DNA, 15 bp, Homo sapiens
tttacaaaggacttt

SEQ ID NO: 159187 - DNA, 15 bp, Homo sapiens
ctttacaaaggactt

SEQ ID NO: 159188 - DNA, 15 bp, Homo sapiens
tctttacaaaggact

SEQ ID NO: 159189 - DNA, 15 bp, Homo sapiens
ttctttacaaaggac

SEQ ID NO: 159190 - DNA, 15 bp, Homo sapiens
attctttacaaagga

SEQ ID NO: 159191 - DNA, 15 bp, Homo sapiens
cattctttacaaagg

SEQ ID NO: 159192 - DNA, 15 bp, Homo sapiens
tcattctttacaaag

SEQ ID NO: 159193 - DNA, 15 bp, Homo sapiens
atcattctttacaaa

SEQ ID NO: 159194 - DNA, 15 bp, Homo sapiens
tatcattctttacaa

SEQ ID NO: 159195 - DNA, 15 bp, Homo sapiens
ttatcattctttaca

SEQ ID NO: 159196 - DNA, 15 bp, Homo sapiens
tttatcattctttac

SEQ ID NO: 159197 - DNA, 15 bp, Homo sapiens
atttatcattcttta

SEQ ID NO: 159198 - DNA, 15 bp, Homo sapiens
tatttatcattcttt

SEQ ID NO: 159199 - DNA, 15 bp, Homo sapiens
gtatttatcattctt

SEQ ID NO: 159200 - DNA, 15 bp, Homo sapiens
agtatttatcattct

SEQ ID NO: 159201 - DNA, 15 bp, Homo sapiens
cagtatttatcattc

SEQ ID NO: 159202 - DNA, 15 bp, Homo sapiens
gcagtatttatcatt

SEQ ID NO: 159203 - DNA, 15 bp, Homo sapiens
ggcagtatttatcat

SEQ ID NO: 159204 - DNA, 15 bp, Homo sapiens
aggcagtatttatca

SEQ ID NO: 159205 - DNA, 15 bp, Homo sapiens
caggcagtatttatc

SEQ ID NO: 159206 - DNA, 15 bp, Homo sapiens
tcaggcagtatttat

SEQ ID NO: 159207 - DNA, 15 bp, Homo sapiens
atcaggcagtattta

SEQ ID NO: 159208 - DNA, 15 bp, Homo sapiens
tatcaggcagtattt

SEQ ID NO: 159209 - DNA, 15 bp, Homo sapiens
atatcaggcagtatt

SEQ ID NO: 159210 - DNA, 15 bp, Homo sapiens
gatatcaggcagtat

SEQ ID NO: 159211 - DNA, 15 bp, Homo sapiens
tgatatcaggcagta

SEQ ID NO: 159212 - DNA, 15 bp, Homo sapiens
gtgatatcaggcagt

SEQ ID NO: 159213 - DNA, 15 bp, Homo sapiens
agtgatatcaggcag

SEQ ID NO: 159214 - DNA, 15 bp, Homo sapiens
aagtgatatcaggca

SEQ ID NO: 159215 - DNA, 15 bp, Homo sapiens
taagtgatatcaggc

SEQ ID NO: 159216 - DNA, 15 bp, Homo sapiens
ataagtgatatcagg

SEQ ID NO: 159217 - DNA, 15 bp, Homo sapiens
gataagtgatatcag

SEQ ID NO: 159218 - DNA, 15 bp, Homo sapiens
agataagtgatatca

SEQ ID NO: 159219 - DNA, 15 bp, Homo sapiens
tagataagtgatatc

SEQ ID NO: 159220 - DNA, 15 bp, Homo sapiens
atagataagtgatat

SEQ ID NO: 159221 - DNA, 15 bp, Homo sapiens
catagataagtgata

SEQ ID NO: 159222 - DNA, 15 bp, Homo sapiens
ccatagataagtgat

SEQ ID NO: 159223 - DNA, 15 bp, Homo sapiens
tccatagataagtga

SEQ ID NO: 159224 - DNA, 15 bp, Homo sapiens
ttccatagataagtg

SEQ ID NO: 159225 - DNA, 15 bp, Homo sapiens
attccatagataagt

SEQ ID NO: 159226 - DNA, 15 bp, Homo sapiens
gattccatagataag

SEQ ID NO: 159227 - DNA, 15 bp, Homo sapiens
agattccatagataa

SEQ ID NO: 159228 - DNA, 15 bp, Homo sapiens
tagattccatagata

SEQ ID NO: 159229 - DNA, 15 bp, Homo sapiens
ttagattccatagat

SEQ ID NO: 159230 - DNA, 15 bp, Homo sapiens
attagattccataga

SEQ ID NO: 159231 - DNA, 15 bp, Homo sapiens
tattagattccatag

SEQ ID NO: 159232 - DNA, 15 bp, Homo sapiens
gtattagattccata

SEQ ID NO: 159233 - DNA, 15 bp, Homo sapiens
tgtattagattccat

SEQ ID NO: 159234 - DNA, 15 bp, Homo sapiens
atgtattagattcca

SEQ ID NO: 159235 - DNA, 15 bp, Homo sapiens
aatgtattagattcc

SEQ ID NO: 159236 - DNA, 15 bp, Homo sapiens
aaatgtattagattc

SEQ ID NO: 159237 - DNA, 15 bp, Homo sapiens
caaatgtattagatt

SEQ ID NO: 159238 - DNA, 15 bp, Homo sapiens
tcaaatgtattagat

SEQ ID NO: 159239 - DNA, 15 bp, Homo sapiens
ttcaaatgtattaga

SEQ ID NO: 159240 - DNA, 15 bp, Homo sapiens
attcaaatgtattag

SEQ ID NO: 159241 - DNA, 15 bp, Homo sapiens
aattcaaatgtatta

SEQ ID NO: 159242 - DNA, 15 bp, Homo sapiens
taattcaaatgtatt

SEQ ID NO: 159243 - DNA, 15 bp, Homo sapiens
ttaattcaaatgtat

SEQ ID NO: 159244 - DNA, 15 bp, Homo sapiens
attaattcaaatgta

SEQ ID NO: 159245 - DNA, 15 bp, Homo sapiens
tattaattcaaatgt

SEQ ID NO: 159246 - DNA, 15 bp, Homo sapiens
ctattaattcaaatg

SEQ ID NO: 159247 - DNA, 15 bp, Homo sapiens
tctattaattcaaat

SEQ ID NO: 159248 - DNA, 15 bp, Homo sapiens
ttctattaattcaaa

SEQ ID NO: 159249 - DNA, 15 bp, Homo sapiens
cttctattaattcaa

SEQ ID NO: 159250 - DNA, 15 bp, Homo sapiens
acttctattaattca

SEQ ID NO: 159251 - DNA, 15 bp, Homo sapiens
tacttctattaattc

SEQ ID NO: 159252 - DNA, 15 bp, Homo sapiens
ctacttctattaatt

SEQ ID NO: 159253 - DNA, 15 bp, Homo sapiens
tctacttctattaat

SEQ ID NO: 159254 - DNA, 15 bp, Homo sapiens
gtctacttctattaa

SEQ ID NO: 159255 - DNA, 15 bp, Homo sapiens
tgtctacttctatta

SEQ ID NO: 159256 - DNA, 15 bp, Homo sapiens
ctgtctacttctatt

SEQ ID NO: 159257 - DNA, 15 bp, Homo sapiens
actgtctacttctat

SEQ ID NO: 159258 - DNA, 15 bp, Homo sapiens
tactgtctacttcta

SEQ ID NO: 159259 - DNA, 15 bp, Homo sapiens
ctactgtctacttct

SEQ ID NO: 159260 - DNA, 15 bp, Homo sapiens
tctactgtctacttc

SEQ ID NO: 159261 - DNA, 15 bp, Homo sapiens
ttctactgtctactt

SEQ ID NO: 159262 - DNA, 15 bp, Homo sapiens
gttctactgtctact

SEQ ID NO: 159263 - DNA, 15 bp, Homo sapiens
agttctactgtctac

SEQ ID NO: 159264 - DNA, 15 bp, Homo sapiens
tagttctactgtcta

SEQ ID NO: 159265 - DNA, 15 bp, Homo sapiens
atagttctactgtct

SEQ ID NO: 159266 - DNA, 15 bp, Homo sapiens
catagttctactgtc

SEQ ID NO: 159267 - DNA, 15 bp, Homo sapiens
ccatagttctactgt

SEQ ID NO: 159268 - DNA, 15 bp, Homo sapiens
accatagttctactg

SEQ ID NO: 159269 - DNA, 15 bp, Homo sapiens
aaccatagttctact

SEQ ID NO: 159270 - DNA, 15 bp, Homo sapiens
taaccatagttctac

SEQ ID NO: 159271 - DNA, 15 bp, Homo sapiens
ataaccatagttcta

SEQ ID NO: 159272 - DNA, 15 bp, Homo sapiens
gataaccatagttct

SEQ ID NO: 159273 - DNA, 15 bp, Homo sapiens
tgataaccatagttc

SEQ ID NO: 159274 - DNA, 15 bp, Homo sapiens
ctgataaccatagtt

SEQ ID NO: 159275 - DNA, 15 bp, Homo sapiens
tctgataaccatagt

SEQ ID NO: 159276 - DNA, 15 bp, Homo sapiens
ttctgataaccatag

SEQ ID NO: 159277 - DNA, 15 bp, Homo sapiens
cttctgataaccata

SEQ ID NO: 159278 - DNA, 15 bp, Homo sapiens
gcttctgataaccat

SEQ ID NO: 159279 - DNA, 15 bp, Homo sapiens
agcttctgataacca

SEQ ID NO: 159280 - DNA, 15 bp, Homo sapiens
aagcttctgataacc

SEQ ID NO: 159281 - DNA, 15 bp, Homo sapiens
caagcttctgataac

SEQ ID NO: 159282 - DNA, 15 bp, Homo sapiens
ccaagcttctgataa

SEQ ID NO: 159283 - DNA, 15 bp, Homo sapiens
accaagcttctgata

SEQ ID NO: 159284 - DNA, 15 bp, Homo sapiens
caccaagcttctgat

SEQ ID NO: 159285 - DNA, 15 bp, Homo sapiens
ccaccaagcttctga

SEQ ID NO: 159286 - DNA, 15 bp, Homo sapiens
cccaccaagcttctg

SEQ ID NO: 159287 - DNA, 15 bp, Homo sapiens
acccaccaagcttct

SEQ ID NO: 159288 - DNA, 15 bp, Homo sapiens
cacccaccaagcttc

SEQ ID NO: 159289 - DNA, 15 bp, Homo sapiens
tcacccaccaagctt

SEQ ID NO: 159290 - DNA, 15 bp, Homo sapiens
ctcacccaccaagct

SEQ ID NO: 159291 - DNA, 15 bp, Homo sapiens
cctcacccaccaagc

SEQ ID NO: 159292 - DNA, 15 bp, Homo sapiens
ccctcacccaccaag

SEQ ID NO: 159293 - DNA, 15 bp, Homo sapiens
tccctcacccaccaa

SEQ ID NO: 159294 - DNA, 15 bp, Homo sapiens
ctccctcacccacca

SEQ ID NO: 159295 - DNA, 15 bp, Homo sapiens
cctccctcacccacc

SEQ ID NO: 159296 - DNA, 15 bp, Homo sapiens
ccctccctcacccac

SEQ ID NO: 159297 - DNA, 15 bp, Homo sapiens
tccctccctcaccca

SEQ ID NO: 159298 - DNA, 15 bp, Homo sapiens
ctccctccctcaccc

SEQ ID NO: 159299 - DNA, 15 bp, Homo sapiens
tctccctccctcacc

SEQ ID NO: 159300 - DNA, 15 bp, Homo sapiens
ctctccctccctcac

SEQ ID NO: 159301 - DNA, 15 bp, Homo sapiens
tctctccctccctca

SEQ ID NO: 159302 - DNA, 15 bp, Homo sapiens
ttctctccctccctc

SEQ ID NO: 159303 - DNA, 15 bp, Homo sapiens
cttctctccctccct

SEQ ID NO: 159304 - DNA, 15 bp, Homo sapiens
ccttctctccctccc

SEQ ID NO: 159305 - DNA, 15 bp, Homo sapiens
tccttctctccctcc

SEQ ID NO: 159306 - DNA, 15 bp, Homo sapiens
cttccttctctccct

SEQ ID NO: 159307 - DNA, 15 bp, Homo sapiens
ccttccttctctccc

SEQ ID NO: 159308 - DNA, 15 bp, Homo sapiens
cccttccttctctcc

SEQ ID NO: 159309 - DNA, 15 bp, Homo sapiens
ccccttccttctctc

SEQ ID NO: 159310 - DNA, 15 bp, Homo sapiens
tccccttccttctct

SEQ ID NO: 159311 - DNA, 15 bp, Homo sapiens
ttccccttccttctc

SEQ ID NO: 159312 - DNA, 15 bp, Homo sapiens
tttccccttccttct

SEQ ID NO: 159313 - DNA, 15 bp, Homo sapiens
atttccccttccttc

SEQ ID NO: 159314 - DNA, 15 bp, Homo sapiens
aatttccccttcctt

SEQ ID NO: 159315 - DNA, 15 bp, Homo sapiens
caatttccccttcct

SEQ ID NO: 159316 - DNA, 15 bp, Homo sapiens
acaatttccccttcc

SEQ ID NO: 159317 - DNA, 15 bp, Homo sapiens
aacaatttccccttc

SEQ ID NO: 159318 - DNA, 15 bp, Homo sapiens
caacaatttcccctt

SEQ ID NO: 159319 - DNA, 15 bp, Homo sapiens
tcaacaatttcccct

SEQ ID NO: 159320 - DNA, 15 bp, Homo sapiens
atcaacaatttcccc

SEQ ID NO: 159321 - DNA, 15 bp, Homo sapiens
gatcaacaatttccc

SEQ ID NO: 159322 - DNA, 15 bp, Homo sapiens
tgatcaacaatttcc

SEQ ID NO: 159323 - DNA, 15 bp, Homo sapiens
ttgatcaacaatttc

SEQ ID NO: 159324 - DNA, 15 bp, Homo sapiens
tttgatcaacaattt

SEQ ID NO: 159325 - DNA, 15 bp, Homo sapiens
ctttgatcaacaatt

SEQ ID NO: 159326 - DNA, 15 bp, Homo sapiens
cctttgatcaacaat

SEQ ID NO: 159327 - DNA, 15 bp, Homo sapiens
gcctttgatcaacaa

SEQ ID NO: 159328 - DNA, 15 bp, Homo sapiens
agcctttgatcaaca

SEQ ID NO: 159329 - DNA, 15 bp, Homo sapiens
tagcctttgatcaac

SEQ ID NO: 159330 - DNA, 15 bp, Homo sapiens
gtagcctttgatcaa

SEQ ID NO: 159331 - DNA, 15 bp, Homo sapiens
tgtagcctttgatca

SEQ ID NO: 159332 - DNA, 15 bp, Homo sapiens
ttgtagcctttgatc

SEQ ID NO: 159333 - DNA, 15 bp, Homo sapiens
tttgtagcctttgat

SEQ ID NO: 159334 - DNA, 15 bp, Homo sapiens
ctttgtagcctttga

SEQ ID NO: 159335 - DNA, 15 bp, Homo sapiens
actttgtagcctttg

SEQ ID NO: 159336 - DNA, 15 bp, Homo sapiens
aactttgtagccttt

SEQ ID NO: 159337 - DNA, 15 bp, Homo sapiens
aaactttgtagcctt

SEQ ID NO: 159338 - DNA, 15 bp, Homo sapiens
gaaactttgtagcct

SEQ ID NO: 159339 - DNA, 15 bp, Homo sapiens
tgaaactttgtagcc

SEQ ID NO: 159340 - DNA, 15 bp, Homo sapiens
ctgaaactttgtagc

SEQ ID NO: 159341 - DNA, 15 bp, Homo sapiens
tctgaaactttgtag

SEQ ID NO: 159342 - DNA, 15 bp, Homo sapiens
atctgaaactttgta

SEQ ID NO: 159343 - DNA, 15 bp, Homo sapiens
tatctgaaactttgt

SEQ ID NO: 159344 - DNA, 15 bp, Homo sapiens
ctatctgaaactttg

SEQ ID NO: 159345 - DNA, 15 bp, Homo sapiens
tctatctgaaacttt

SEQ ID NO: 159346 - DNA, 15 bp, Homo sapiens
atctatctgaaactt

SEQ ID NO: 159347 - DNA, 15 bp, Homo sapiens
tatctatctgaaact

SEQ ID NO: 159348 - DNA, 15 bp, Homo sapiens
ttatctatctgaaac

SEQ ID NO: 159349 - DNA, 15 bp, Homo sapiens
cttatctatctgaaa

SEQ ID NO: 159350 - DNA, 15 bp, Homo sapiens
tcttatctatctgaa

SEQ ID NO: 159351 - DNA, 15 bp, Homo sapiens
ctcttatctatctga

SEQ ID NO: 159352 - DNA, 15 bp, Homo sapiens
cctcttatctatctg

SEQ ID NO: 159353 - DNA, 15 bp, Homo sapiens
tcctcttatctatct

SEQ ID NO: 159354 - DNA, 15 bp, Homo sapiens
atcctcttatctatc

SEQ ID NO: 159355 - DNA, 15 bp, Homo sapiens
aatcctcttatctat

SEQ ID NO: 159356 - DNA, 15 bp, Homo sapiens
aaatcctcttatcta

SEQ ID NO: 159357 - DNA, 15 bp, Homo sapiens
taaatcctcttatct

SEQ ID NO: 159358 - DNA, 15 bp, Homo sapiens
ataaatcctcttatc

SEQ ID NO: 159359 - DNA, 15 bp, Homo sapiens
cataaatcctcttat

SEQ ID NO: 159360 - DNA, 15 bp, Homo sapiens
ccataaatcctctta

SEQ ID NO: 159361 - DNA, 15 bp, Homo sapiens
gccataaatcctctt

SEQ ID NO: 159362 - DNA, 15 bp, Homo sapiens
tgccataaatcctct

SEQ ID NO: 159363 - DNA, 15 bp, Homo sapiens
ttgccataaatcctc

SEQ ID NO: 159364 - DNA, 15 bp, Homo sapiens
tttgccataaatcct

SEQ ID NO: 159365 - DNA, 15 bp, Homo sapiens
gtttgccataaatcc

SEQ ID NO: 159366 - DNA, 15 bp, Homo sapiens
ggtttgccataaatc

SEQ ID NO: 159367 - DNA, 15 bp, Homo sapiens
tggtttgccataaat

SEQ ID NO: 159368 - DNA, 15 bp, Homo sapiens
ttggtttgccataaa

SEQ ID NO: 159369 - DNA, 15 bp, Homo sapiens
cttggtttgccataa

SEQ ID NO: 159370 - DNA, 15 bp, Homo sapiens
ccttggtttgccata

SEQ ID NO: 159371 - DNA, 15 bp, Homo sapiens
tccttggtttgccat

SEQ ID NO: 159372 - DNA, 15 bp, Homo sapiens
ctccttggtttgcca

SEQ ID NO: 159373 - DNA, 15 bp, Homo sapiens
tctccttggtttgcc

SEQ ID NO: 159374 - DNA, 15 bp, Homo sapiens
ctctccttggtttgc

SEQ ID NO: 159375 - DNA, 15 bp, Homo sapiens
tctctccttggtttg

SEQ ID NO: 159376 - DNA, 15 bp, Homo sapiens
gtctctccttggttt

SEQ ID NO: 159377 - DNA, 15 bp, Homo sapiens
tgtctctccttggtt

SEQ ID NO: 159378 - DNA, 15 bp, Homo sapiens
atgtctctccttggt

SEQ ID NO: 159379 - DNA, 15 bp, Homo sapiens
catgtctctccttgg

SEQ ID NO: 159380 - DNA, 15 bp, Homo sapiens
tcatgtctctccttg

SEQ ID NO: 159381 - DNA, 15 bp, Homo sapiens
ttcatgtctctcctt

SEQ ID NO: 159382 - DNA, 15 bp, Homo sapiens
attcatgtctctcct

SEQ ID NO: 159383 - DNA, 15 bp, Homo sapiens
cattcatgtctctcc

SEQ ID NO: 159384 - DNA, 15 bp, Homo sapiens
tcattcatgtctctc

SEQ ID NO: 159385 - DNA, 15 bp, Homo sapiens
ttcattcatgtctct

SEQ ID NO: 159386 - DNA, 15 bp, Homo sapiens
tttcattcatgtctc

SEQ ID NO: 159387 - DNA, 15 bp, Homo sapiens
ttttcattcatgtct

SEQ ID NO: 159388 - DNA, 15 bp, Homo sapiens
cttttcattcatgtc

SEQ ID NO: 159389 - DNA, 15 bp, Homo sapiens
tcttttcattcatgt

SEQ ID NO: 159390 - DNA, 15 bp, Homo sapiens
ctcttttcattcatg

SEQ ID NO: 159391 - DNA, 15 bp, Homo sapiens
actcttttcattcat

SEQ ID NO: 159392 - DNA, 15 bp, Homo sapiens
cactcttttcattca

SEQ ID NO: 159393 - DNA, 15 bp, Homo sapiens
ccactcttttcattc

SEQ ID NO: 159394 - DNA, 15 bp, Homo sapiens
gccactcttttcatt

SEQ ID NO: 159395 - DNA, 15 bp, Homo sapiens
agccactcttttcat

SEQ ID NO: 159396 - DNA, 15 bp, Homo sapiens
tagccactcttttca

SEQ ID NO: 159397 - DNA, 15 bp, Homo sapiens
gtagccactcttttc

SEQ ID NO: 159398 - DNA, 15 bp, Homo sapiens
ggtagccactctttt

SEQ ID NO: 159399 - DNA, 15 bp, Homo sapiens
tggtagccactcttt

SEQ ID NO: 159400 - DNA, 15 bp, Homo sapiens
ttggtagccactctt

SEQ ID NO: 159401 - DNA, 15 bp, Homo sapiens
gttggtagccactct

SEQ ID NO: 159402 - DNA, 15 bp, Homo sapiens
ggttggtagccactc

SEQ ID NO: 159403 - DNA, 15 bp, Homo sapiens
tggttggtagccact

SEQ ID NO: 159404 - DNA, 15 bp, Homo sapiens
ttggttggtagccac

SEQ ID NO: 159405 - DNA, 15 bp, Homo sapiens
tttggttggtagcca

SEQ ID NO: 159406 - DNA, 15 bp, Homo sapiens
atttggttggtagcc

SEQ ID NO: 159407 - DNA, 15 bp, Homo sapiens
gatttggttggtagc

SEQ ID NO: 159408 - DNA, 15 bp, Homo sapiens
tgatttggttggtag

SEQ ID NO: 159409 - DNA, 15 bp, Homo sapiens
ttgatttggttggta

SEQ ID NO: 159410 - DNA, 15 bp, Homo sapiens
gttgatttggttggt

SEQ ID NO: 159411 - DNA, 15 bp, Homo sapiens
tgttgatttggttgg

SEQ ID NO: 159412 - DNA, 15 bp, Homo sapiens
ttgttgatttggttg

SEQ ID NO: 159413 - DNA, 15 bp, Homo sapiens
attgttgatttggtt

SEQ ID NO: 159414 - DNA, 15 bp, Homo sapiens
tattgttgatttggt

SEQ ID NO: 159415 - DNA, 15 bp, Homo sapiens
ttattgttgatttgg

SEQ ID NO: 159416 - DNA, 15 bp, Homo sapiens
attattgttgatttg

SEQ ID NO: 159417 - DNA, 15 bp, Homo sapiens
cattattgttgattt

SEQ ID NO: 159418 - DNA, 15 bp, Homo sapiens
acattattgttgatt

SEQ ID NO: 159419 - DNA, 15 bp, Homo sapiens
cacattattgttgat

SEQ ID NO: 159420 - DNA, 15 bp, Homo sapiens
acacattattgttga

SEQ ID NO: 159421 - DNA, 15 bp, Homo sapiens
aacacattattgttg

SEQ ID NO: 159422 - DNA, 15 bp, Homo sapiens
taacacattattgtt

SEQ ID NO: 159423 - DNA, 15 bp, Homo sapiens
ataacacattattgt

SEQ ID NO: 159424 - DNA, 15 bp, Homo sapiens
cataacacattattg

SEQ ID NO: 159425 - DNA, 15 bp, Homo sapiens
acataacacattatt

SEQ ID NO: 159426 - DNA, 15 bp, Homo sapiens
tacataacacattat

SEQ ID NO: 159427 - DNA, 15 bp, Homo sapiens
atacataacacatta

SEQ ID NO: 159428 - DNA, 15 bp, Homo sapiens
aatacataacacatt

SEQ ID NO: 159429 - DNA, 15 bp, Homo sapiens
aaatacataacacat

SEQ ID NO: 159430 - DNA, 15 bp, Homo sapiens
gaaatacataacaca

SEQ ID NO: 159431 - DNA, 15 bp, Homo sapiens
tgaaatacataacac

SEQ ID NO: 159432 - DNA, 15 bp, Homo sapiens
ttgaaatacataaca

SEQ ID NO: 159433 - DNA, 15 bp, Homo sapiens
tttgaaatacataac

SEQ ID NO: 159434 - DNA, 15 bp, Homo sapiens
ttttgaaatacataa

SEQ ID NO: 159435 - DNA, 15 bp, Homo sapiens
attttgaaatacata

SEQ ID NO: 159436 - DNA, 15 bp, Homo sapiens
aattttgaaatacat

SEQ ID NO: 159437 - DNA, 15 bp, Homo sapiens
aaattttgaaataca

SEQ ID NO: 159438 - DNA, 15 bp, Homo sapiens
gaaattttgaaatac

SEQ ID NO: 159439 - DNA, 15 bp, Homo sapiens
agaaattttgaaata

SEQ ID NO: 159440 - DNA, 15 bp, Homo sapiens
tagaaattttgaaat

SEQ ID NO: 159441 - DNA, 15 bp, Homo sapiens
ttagaaattttgaaa

SEQ ID NO: 159442 - DNA, 15 bp, Homo sapiens
cttagaaattttgaa

SEQ ID NO: 159443 - DNA, 15 bp, Homo sapiens
tcttagaaattttga

SEQ ID NO: 159444 - DNA, 15 bp, Homo sapiens
ctcttagaaattttg

SEQ ID NO: 159445 - DNA, 15 bp, Homo sapiens
tctcttagaaatttt

SEQ ID NO: 159446 - DNA, 15 bp, Homo sapiens
ttctcttagaaattt

SEQ ID NO: 159447 - DNA, 15 bp, Homo sapiens
attctcttagaaatt

SEQ ID NO: 159448 - DNA, 15 bp, Homo sapiens
tattctcttagaaat

SEQ ID NO: 159449 - DNA, 15 bp, Homo sapiens
ttattctcttagaaa

SEQ ID NO: 159450 - DNA, 15 bp, Homo sapiens
tttattctcttagaa

SEQ ID NO: 159451 - DNA, 15 bp, Homo sapiens
atttattctcttaga

SEQ ID NO: 159452 - DNA, 15 bp, Homo sapiens
aatttattctcttag

SEQ ID NO: 159453 - DNA, 15 bp, Homo sapiens
aaatttattctctta

SEQ ID NO: 159454 - DNA, 15 bp, Homo sapiens
caaatttattctctt

SEQ ID NO: 159455 - DNA, 15 bp, Homo sapiens
tcaaatttattctct

SEQ ID NO: 159456 - DNA, 15 bp, Homo sapiens
ctcaaatttattctc

SEQ ID NO: 159457 - DNA, 15 bp, Homo sapiens
tctcaaatttattct

SEQ ID NO: 159458 - DNA, 15 bp, Homo sapiens
atctcaaatttattc

SEQ ID NO: 159459 - DNA, 15 bp, Homo sapiens
catctcaaatttatt

SEQ ID NO: 159460 - DNA, 15 bp, Homo sapiens
acatctcaaatttat

SEQ ID NO: 159461 - DNA, 15 bp, Homo sapiens
gacatctcaaattta

SEQ ID NO: 159462 - DNA, 15 bp, Homo sapiens
agacatctcaaattt

SEQ ID NO: 159463 - DNA, 15 bp, Homo sapiens
aagacatctcaaatt

SEQ ID NO: 159464 - DNA, 15 bp, Homo sapiens
taagacatctcaaat

SEQ ID NO: 159465 - DNA, 15 bp, Homo sapiens
ataagacatctcaaa

SEQ ID NO: 159466 - DNA, 15 bp, Homo sapiens
gataagacatctcaa

SEQ ID NO: 159467 - DNA, 15 bp, Homo sapiens
tgataagacatctca

SEQ ID NO: 159468 - DNA, 15 bp, Homo sapiens
ttgataagacatctc

SEQ ID NO: 159469 - DNA, 15 bp, Homo sapiens
cttgataagacatct

SEQ ID NO: 159470 - DNA, 15 bp, Homo sapiens
tcttgataagacatc

SEQ ID NO: 159471 - DNA, 15 bp, Homo sapiens
ttcttgataagacat

SEQ ID NO: 159472 - DNA, 15 bp, Homo sapiens
tttcttgataagaca

SEQ ID NO: 159473 - DNA, 15 bp, Homo sapiens
atttcttgataagac

SEQ ID NO: 159474 - DNA, 15 bp, Homo sapiens
catttcttgataaga

SEQ ID NO: 159475 - DNA, 15 bp, Homo sapiens
tcatttcttgataag

SEQ ID NO: 159476 - DNA, 15 bp, Homo sapiens
gtcatttcttgataa

SEQ ID NO: 159477 - DNA, 15 bp, Homo sapiens
tgtcatttcttgata

SEQ ID NO: 159478 - DNA, 15 bp, Homo sapiens
ctgtcatttcttgat

SEQ ID NO: 159479 - DNA, 15 bp, Homo sapiens
cctgtcatttcttga

SEQ ID NO: 159480 - DNA, 15 bp, Homo sapiens
acctgtcatttcttg

SEQ ID NO: 159481 - DNA, 15 bp, Homo sapiens
tacctgtcatttctt

SEQ ID NO: 159482 - DNA, 15 bp, Homo sapiens
ttacctgtcatttct

SEQ ID NO: 159483 - DNA, 15 bp, Homo sapiens
cttacctgtcatttc

SEQ ID NO: 159484 - DNA, 15 bp, Homo sapiens
gcttacctgtcattt

SEQ ID NO: 159485 - DNA, 15 bp, Homo sapiens
tgcttacctgtcatt

SEQ ID NO: 159486 - DNA, 15 bp, Homo sapiens
ttgcttacctgtcat

SEQ ID NO: 159487 - DNA, 15 bp, Homo sapiens
cttgcttacctgtca

SEQ ID NO: 159488 - DNA, 15 bp, Homo sapiens
ccttgcttacctgtc

SEQ ID NO: 159489 - DNA, 15 bp, Homo sapiens
tccttgcttacctgt

SEQ ID NO: 159490 - DNA, 15 bp, Homo sapiens
ctccttgcttacctg

SEQ ID NO: 159491 - DNA, 15 bp, Homo sapiens
tctccttgcttacct

SEQ ID NO: 159492 - DNA, 15 bp, Homo sapiens
atctccttgcttacc

SEQ ID NO: 159493 - DNA, 15 bp, Homo sapiens
catctccttgcttac

SEQ ID NO: 159494 - DNA, 15 bp, Homo sapiens
tcatctccttgctta

SEQ ID NO: 159495 - DNA, 15 bp, Homo sapiens
ttcatctccttgctt

SEQ ID NO: 159496 - DNA, 15 bp, Homo sapiens
attcatctccttgct

SEQ ID NO: 159497 - DNA, 15 bp, Homo sapiens
gattcatctccttgc

SEQ ID NO: 159498 - DNA, 15 bp, Homo sapiens
cgattcatctccttg

SEQ ID NO: 159499 - DNA, 15 bp, Homo sapiens
ccgattcatctcctt

SEQ ID NO: 159500 - DNA, 15 bp, Homo sapiens
accgattcatctcct

SEQ ID NO: 159501 - DNA, 15 bp, Homo sapiens
aaccgattcatctcc

SEQ ID NO: 159502 - DNA, 15 bp, Homo sapiens
taaccgattcatctc

SEQ ID NO: 159503 - DNA, 15 bp, Homo sapiens
ttaaccgattcatct

SEQ ID NO: 159504 - DNA, 15 bp, Homo sapiens
attaaccgattcatc

SEQ ID NO: 159505 - DNA, 15 bp, Homo sapiens
aattaaccgattcat

SEQ ID NO: 159506 - DNA, 15 bp, Homo sapiens
taattaaccgattca

SEQ ID NO: 159507 - DNA, 15 bp, Homo sapiens
ctaattaaccgattc

SEQ ID NO: 159508 - DNA, 15 bp, Homo sapiens
actaattaaccgatt

SEQ ID NO: 159509 - DNA, 15 bp, Homo sapiens
aactaattaaccgat

SEQ ID NO: 159510 - DNA, 15 bp, Homo sapiens
aaactaattaaccga

SEQ ID NO: 159511 - DNA, 15 bp, Homo sapiens
caaactaattaaccg

SEQ ID NO: 159512 - DNA, 15 bp, Homo sapiens
tcaaactaattaacc

SEQ ID NO: 159513 - DNA, 15 bp, Homo sapiens
atcaaactaattaac

SEQ ID NO: 159514 - DNA, 15 bp, Homo sapiens
aatcaaactaattaa

SEQ ID NO: 159515 - DNA, 15 bp, Homo sapiens
caatcaaactaatta

SEQ ID NO: 159516 - DNA, 15 bp, Homo sapiens
tcaatcaaactaatt

SEQ ID NO: 159517 - DNA, 15 bp, Homo sapiens
atcaatcaaactaat

SEQ ID NO: 159518 - DNA, 15 bp, Homo sapiens
gatcaatcaaactaa

SEQ ID NO: 159519 - DNA, 15 bp, Homo sapiens
tgatcaatcaaacta

SEQ ID NO: 159520 - DNA, 15 bp, Homo sapiens
atgatcaatcaaact

SEQ ID NO: 159521 - DNA, 15 bp, Homo sapiens
catgatcaatcaaac

SEQ ID NO: 159522 - DNA, 15 bp, Homo sapiens
gcatgatcaatcaaa

SEQ ID NO: 159523 - DNA, 15 bp, Homo sapiens
ggcatgatcaatcaa

SEQ ID NO: 159524 - DNA, 15 bp, Homo sapiens
cggcatgatcaatca

SEQ ID NO: 159525 - DNA, 15 bp, Homo sapiens
acggcatgatcaatc

SEQ ID NO: 159526 - DNA, 15 bp, Homo sapiens
cacggcatgatcaat

SEQ ID NO: 159527 - DNA, 15 bp, Homo sapiens
acacggcatgatcaa

SEQ ID NO: 159528 - DNA, 15 bp, Homo sapiens
aacacggcatgatca

SEQ ID NO: 159529 - DNA, 15 bp, Homo sapiens
caacacggcatgatc

SEQ ID NO: 159530 - DNA, 15 bp, Homo sapiens
acaacacggcatgat

SEQ ID NO: 159531 - DNA, 15 bp, Homo sapiens
tacaacacggcatga

SEQ ID NO: 159532 - DNA, 15 bp, Homo sapiens
atacaacacggcatg

SEQ ID NO: 159533 - DNA, 15 bp, Homo sapiens
gatacaacacggcat

SEQ ID NO: 159534 - DNA, 15 bp, Homo sapiens
ggatacaacacggca

SEQ ID NO: 159535 - DNA, 15 bp, Homo sapiens
tggatacaacacggc

SEQ ID NO: 159536 - DNA, 15 bp, Homo sapiens
atggatacaacacgg

SEQ ID NO: 159537 - DNA, 15 bp, Homo sapiens
catggatacaacacg

SEQ ID NO: 159538 - DNA, 15 bp, Homo sapiens
acatggatacaacac

SEQ ID NO: 159539 - DNA, 15 bp, Homo sapiens
tacatggatacaaca

SEQ ID NO: 159540 - DNA, 15 bp, Homo sapiens
atacatggatacaac

SEQ ID NO: 159541 - DNA, 15 bp, Homo sapiens
gatacatggatacaa

SEQ ID NO: 159542 - DNA, 15 bp, Homo sapiens
tgatacatggataca

SEQ ID NO: 159543 - DNA, 15 bp, Homo sapiens
gtgatacatggatac

SEQ ID NO: 159544 - DNA, 15 bp, Homo sapiens
tgtgatacatggata

SEQ ID NO: 159545 - DNA, 15 bp, Homo sapiens
atgtgatacatggat

SEQ ID NO: 159546 - DNA, 15 bp, Homo sapiens
aatgtgatacatgga

SEQ ID NO: 159547 - DNA, 15 bp, Homo sapiens
caatgtgatacatgg

SEQ ID NO: 159548 - DNA, 15 bp, Homo sapiens
acaatgtgatacatg

SEQ ID NO: 159549 - DNA, 15 bp, Homo sapiens
tacaatgtgatacat

SEQ ID NO: 159550 - DNA, 15 bp, Homo sapiens
atacaatgtgataca

SEQ ID NO: 159551 - DNA, 15 bp, Homo sapiens
gatacaatgtgatac

SEQ ID NO: 159552 - DNA, 15 bp, Homo sapiens
ggatacaatgtgata

SEQ ID NO: 159553 - DNA, 15 bp, Homo sapiens
gggatacaatgtgat

SEQ ID NO: 159554 - DNA, 15 bp, Homo sapiens
tgggatacaatgtga

SEQ ID NO: 159555 - DNA, 15 bp, Homo sapiens
atgggatacaatgtg

SEQ ID NO: 159556 - DNA, 15 bp, Homo sapiens
tatgggatacaatgt

SEQ ID NO: 159557 - DNA, 15 bp, Homo sapiens
ttatgggatacaatg

SEQ ID NO: 159558 - DNA, 15 bp, Homo sapiens
tttatgggatacaat

SEQ ID NO: 159559 - DNA, 15 bp, Homo sapiens
atttatgggatacaa

SEQ ID NO: 159560 - DNA, 15 bp, Homo sapiens
catttatgggataca

SEQ ID NO: 159561 - DNA, 15 bp, Homo sapiens
acatttatgggatac

SEQ ID NO: 159562 - DNA, 15 bp, Homo sapiens
cacatttatgggata

SEQ ID NO: 159563 - DNA, 15 bp, Homo sapiens
acacatttatgggat

SEQ ID NO: 159564 - DNA, 15 bp, Homo sapiens
tacacatttatggga

SEQ ID NO: 159565 - DNA, 15 bp, Homo sapiens
gtacacatttatggg

SEQ ID NO: 159566 - DNA, 15 bp, Homo sapiens
ggtacacatttatgg

SEQ ID NO: 159567 - DNA, 15 bp, Homo sapiens
tggtacacatttatg

SEQ ID NO: 159568 - DNA, 15 bp, Homo sapiens
gtggtacacatttat

SEQ ID NO: 159569 - DNA, 15 bp, Homo sapiens
agtggtacacattta

SEQ ID NO: 159570 - DNA, 15 bp, Homo sapiens
tagtggtacacattt

SEQ ID NO: 159571 - DNA, 15 bp, Homo sapiens
atagtggtacacatt

SEQ ID NO: 159572 - DNA, 15 bp, Homo sapiens
catagtggtacacat

SEQ ID NO: 159573 - DNA, 15 bp, Homo sapiens
ccatagtggtacaca

SEQ ID NO: 159574 - DNA, 15 bp, Homo sapiens
accatagtggtacac

SEQ ID NO: 159575 - DNA, 15 bp, Homo sapiens
aaccatagtggtaca

SEQ ID NO: 159576 - DNA, 15 bp, Homo sapiens
aaaccatagtggtac

SEQ ID NO: 159577 - DNA, 15 bp, Homo sapiens
aaaaccatagtggta

SEQ ID NO: 159578 - DNA, 15 bp, Homo sapiens
aaaaaccatagtggt

SEQ ID NO: 159579 - DNA, 15 bp, Homo sapiens
gaaaaaccatagtgg

SEQ ID NO: 159580 - DNA, 15 bp, Homo sapiens
tgaaaaaccatagtg

SEQ ID NO: 159581 - DNA, 15 bp, Homo sapiens
ttgaaaaaccatagt

SEQ ID NO: 159582 - DNA, 15 bp, Homo sapiens
attgaaaaaccatag

SEQ ID NO: 159583 - DNA, 15 bp, Homo sapiens
aattgaaaaaccata

SEQ ID NO: 159584 - DNA, 15 bp, Homo sapiens
taattgaaaaaccat

SEQ ID NO: 159585 - DNA, 15 bp, Homo sapiens
gtaattgaaaaacca

SEQ ID NO: 159586 - DNA, 15 bp, Homo sapiens
tgtaattgaaaaacc

SEQ ID NO: 159587 - DNA, 15 bp, Homo sapiens
ttgtaattgaaaaac

SEQ ID NO: 159588 - DNA, 15 bp, Homo sapiens
tttgtaattgaaaaa

SEQ ID NO: 159589 - DNA, 15 bp, Homo sapiens
ttttgtaattgaaaa

SEQ ID NO: 159590 - DNA, 15 bp, Homo sapiens
gttttgtaattgaaa

SEQ ID NO: 159591 - DNA, 15 bp, Homo sapiens
tgttttgtaattgaa

SEQ ID NO: 159592 - DNA, 15 bp, Homo sapiens
ttgttttgtaattga

SEQ ID NO: 159593 - DNA, 15 bp, Homo sapiens
tttgttttgtaattg

SEQ ID NO: 159594 - DNA, 15 bp, Homo sapiens
ttttgttttgtaatt

SEQ ID NO: 159595 - DNA, 15 bp, Homo sapiens
tttttgttttgtaat

SEQ ID NO: 159596 - DNA, 15 bp, Homo sapiens
gtttttgttttgtaa

SEQ ID NO: 159597 - DNA, 15 bp, Homo sapiens
tgtttttgttttgta

SEQ ID NO: 159598 - DNA, 15 bp, Homo sapiens
ttgtttttgttttgt

SEQ ID NO: 159599 - DNA, 15 bp, Homo sapiens
tttgtttttgttttg

SEQ ID NO: 159600 - DNA, 15 bp, Homo sapiens
gtgtttttgtttttg

SEQ ID NO: 159601 - DNA, 15 bp, Homo sapiens
agtgtttttgttttt

SEQ ID NO: 159602 - DNA, 15 bp, Homo sapiens
tagtgtttttgtttt

SEQ ID NO: 159603 - DNA, 15 bp, Homo sapiens
ttagtgtttttgttt

SEQ ID NO: 159604 - DNA, 15 bp, Homo sapiens
tttagtgtttttgtt

SEQ ID NO: 159605 - DNA, 15 bp, Homo sapiens
atttagtgtttttgt

SEQ ID NO: 159606 - DNA, 15 bp, Homo sapiens
catttagtgtttttg

SEQ ID NO: 159607 - DNA, 15 bp, Homo sapiens
gcatttagtgttttt

SEQ ID NO: 159608 - DNA, 15 bp, Homo sapiens
tgcatttagtgtttt

SEQ ID NO: 159609 - DNA, 15 bp, Homo sapiens
atgcatttagtgttt

SEQ ID NO: 159610 - DNA, 15 bp, Homo sapiens
catgcatttagtgtt

SEQ ID NO: 159611 - DNA, 15 bp, Homo sapiens
acatgcatttagtgt

SEQ ID NO: 159612 - DNA, 15 bp, Homo sapiens
aacatgcatttagtg

SEQ ID NO: 159613 - DNA, 15 bp, Homo sapiens
caacatgcatttagt

SEQ ID NO: 159614 - DNA, 15 bp, Homo sapiens
acaacatgcatttag

SEQ ID NO: 159615 - DNA, 15 bp, Homo sapiens
tacaacatgcattta

SEQ ID NO: 159616 - DNA, 15 bp, Homo sapiens
atacaacatgcattt

SEQ ID NO: 159617 - DNA, 15 bp, Homo sapiens
catacaacatgcatt

SEQ ID NO: 159618 - DNA, 15 bp, Homo sapiens
tcatacaacatgcat

SEQ ID NO: 159619 - DNA, 15 bp, Homo sapiens
atcatacaacatgca

SEQ ID NO: 159620 - DNA, 15 bp, Homo sapiens
aatcatacaacatgc

SEQ ID NO: 159621 - DNA, 15 bp, Homo sapiens
aaatcatacaacatg

SEQ ID NO: 159622 - DNA, 15 bp, Homo sapiens
gaaatcatacaacat

SEQ ID NO: 159623 - DNA, 15 bp, Homo sapiens
tgaaatcatacaaca

SEQ ID NO: 159624 - DNA, 15 bp, Homo sapiens
atgaaatcatacaac

SEQ ID NO: 159625 - DNA, 15 bp, Homo sapiens
aatgaaatcatacaa

SEQ ID NO: 159626 - DNA, 15 bp, Homo sapiens
gaatgaaatcataca

SEQ ID NO: 159627 - DNA, 15 bp, Homo sapiens
tgaatgaaatcatac

SEQ ID NO: 159628 - DNA, 15 bp, Homo sapiens
atgaatgaaatcata

SEQ ID NO: 159629 - DNA, 15 bp, Homo sapiens
tatgaatgaaatcat

SEQ ID NO: 159630 - DNA, 15 bp, Homo sapiens
atatgaatgaaatca

SEQ ID NO: 159631 - DNA, 15 bp, Homo sapiens
gatatgaatgaaatc

SEQ ID NO: 159632 - DNA, 15 bp, Homo sapiens
tgatatgaatgaaat

SEQ ID NO: 159633 - DNA, 15 bp, Homo sapiens
gtgatatgaatgaaa

SEQ ID NO: 159634 - DNA, 15 bp, Homo sapiens
tgtgatatgaatgaa

SEQ ID NO: 159635 - DNA, 15 bp, Homo sapiens
atgtgatatgaatga

SEQ ID NO: 159636 - DNA, 15 bp, Homo sapiens
aatgtgatatgaatg

SEQ ID NO: 159637 - DNA, 15 bp, Homo sapiens
aaatgtgatatgaat

SEQ ID NO: 159638 - DNA, 15 bp, Homo sapiens
aaaatgtgatatgaa

SEQ ID NO: 159639 - DNA, 15 bp, Homo sapiens
taaaatgtgatatga

SEQ ID NO: 159640 - DNA, 15 bp, Homo sapiens
ctaaaatgtgatatg

SEQ ID NO: 159641 - DNA, 15 bp, Homo sapiens
tctaaaatgtgatat

SEQ ID NO: 159642 - DNA, 15 bp, Homo sapiens
ttctaaaatgtgata

SEQ ID NO: 159643 - DNA, 15 bp, Homo sapiens
tttctaaaatgtgat

SEQ ID NO: 159644 - DNA, 15 bp, Homo sapiens
ctttctaaaatgtga

SEQ ID NO: 159645 - DNA, 15 bp, Homo sapiens
cctttctaaaatgtg

SEQ ID NO: 159646 - DNA, 15 bp, Homo sapiens
gcctttctaaaatgt

SEQ ID NO: 159647 - DNA, 15 bp, Homo sapiens
tgcctttctaaaatg

SEQ ID NO: 159648 - DNA, 15 bp, Homo sapiens
ttgcctttctaaaat

SEQ ID NO: 159649 - DNA, 15 bp, Homo sapiens
tttgcctttctaaaa

SEQ ID NO: 159650 - DNA, 15 bp, Homo sapiens
ttttgcctttctaaa

SEQ ID NO: 159651 - DNA, 15 bp, Homo sapiens
attttgcctttctaa

SEQ ID NO: 159652 - DNA, 15 bp, Homo sapiens
aattttgcctttcta

SEQ ID NO: 159653 - DNA, 15 bp, Homo sapiens
taattttgcctttct

SEQ ID NO: 159654 - DNA, 15 bp, Homo sapiens
ataattttgcctttc

SEQ ID NO: 159655 - DNA, 15 bp, Homo sapiens
cataattttgccttt

SEQ ID NO: 159656 - DNA, 15 bp, Homo sapiens
ccataattttgcctt

SEQ ID NO: 159657 - DNA, 15 bp, Homo sapiens
accataattttgcct

SEQ ID NO: 159658 - DNA, 15 bp, Homo sapiens
aaccataattttgcc

SEQ ID NO: 159659 - DNA, 15 bp, Homo sapiens
taaccataattttgc

SEQ ID NO: 159660 - DNA, 15 bp, Homo sapiens
ataaccataattttg

SEQ ID NO: 159661 - DNA, 15 bp, Homo sapiens
cataaccataatttt

SEQ ID NO: 159662 - DNA, 15 bp, Homo sapiens
ccataaccataattt

SEQ ID NO: 159663 - DNA, 15 bp, Homo sapiens
tccataaccataatt

SEQ ID NO: 159664 - DNA, 15 bp, Homo sapiens
ttccataaccataat

SEQ ID NO: 159665 - DNA, 15 bp, Homo sapiens
tttccataaccataa

SEQ ID NO: 159666 - DNA, 15 bp, Homo sapiens
ctttccataaccata

SEQ ID NO: 159667 - DNA, 15 bp, Homo sapiens
gctttccataaccat

SEQ ID NO: 159668 - DNA, 15 bp, Homo sapiens
tgctttccataacca

SEQ ID NO: 159669 - DNA, 15 bp, Homo sapiens
ctgctttccataacc

SEQ ID NO: 159670 - DNA, 15 bp, Homo sapiens
actgctttccataac

SEQ ID NO: 159671 - DNA, 15 bp, Homo sapiens
aactgctttccataa

SEQ ID NO: 159672 - DNA, 15 bp, Homo sapiens
gaactgctttccata

SEQ ID NO: 159673 - DNA, 15 bp, Homo sapiens
tgaactgctttccat

SEQ ID NO: 159674 - DNA, 15 bp, Homo sapiens
ttgaactgctttcca

SEQ ID NO: 159675 - DNA, 15 bp, Homo sapiens
attgaactgctttcc

SEQ ID NO: 159676 - DNA, 15 bp, Homo sapiens
aattgaactgctttc

SEQ ID NO: 159677 - DNA, 15 bp, Homo sapiens
caattgaactgcttt

SEQ ID NO: 159678 - DNA, 15 bp, Homo sapiens
acaattgaactgctt

SEQ ID NO: 159679 - DNA, 15 bp, Homo sapiens
aacaattgaactgct

SEQ ID NO: 159680 - DNA, 15 bp, Homo sapiens
caacaattgaactgc

SEQ ID NO: 159681 - DNA, 15 bp, Homo sapiens
tcaacaattgaactg

SEQ ID NO: 159682 - DNA, 15 bp, Homo sapiens
gtcaacaattgaact

SEQ ID NO: 159683 - DNA, 15 bp, Homo sapiens
tgtcaacaattgaac

SEQ ID NO: 159684 - DNA, 15 bp, Homo sapiens
ctgtcaacaattgaa

SEQ ID NO: 159685 - DNA, 15 bp, Homo sapiens
cctgtcaacaattga

SEQ ID NO: 159686 - DNA, 15 bp, Homo sapiens
ccctgtcaacaattg

SEQ ID NO: 159687 - DNA, 15 bp, Homo sapiens
cccctgtcaacaatt

SEQ ID NO: 159688 - DNA, 15 bp, Homo sapiens
gcccctgtcaacaat

SEQ ID NO: 159689 - DNA, 15 bp, Homo sapiens
agcccctgtcaacaa

SEQ ID NO: 159690 - DNA, 15 bp, Homo sapiens
aagcccctgtcaaca

SEQ ID NO: 159691 - DNA, 15 bp, Homo sapiens
caagcccctgtcaac

SEQ ID NO: 159692 - DNA, 15 bp, Homo sapiens
tcaagcccctgtcaa

SEQ ID NO: 159693 - DNA, 15 bp, Homo sapiens
ctcaagcccctgtca

SEQ ID NO: 159694 - DNA, 15 bp, Homo sapiens
tctcaagcccctgtc

SEQ ID NO: 159695 - DNA, 15 bp, Homo sapiens
ttctcaagcccctgt

SEQ ID NO: 159696 - DNA, 15 bp, Homo sapiens
attctcaagcccctg

SEQ ID NO: 159697 - DNA, 15 bp, Homo sapiens
aattctcaagcccct

SEQ ID NO: 159698 - DNA, 15 bp, Homo sapiens
caattctcaagcccc

SEQ ID NO: 159699 - DNA, 15 bp, Homo sapiens
tcaattctcaagccc

SEQ ID NO: 159700 - DNA, 15 bp, Homo sapiens
gtcaattctcaagcc

SEQ ID NO: 159701 - DNA, 15 bp, Homo sapiens
agtcaattctcaagc

SEQ ID NO: 159702 - DNA, 15 bp, Homo sapiens
tagtcaattctcaag

SEQ ID NO: 159703 - DNA, 15 bp, Homo sapiens
gtagtcaattctcaa

SEQ ID NO: 159704 - DNA, 15 bp, Homo sapiens
tgtagtcaattctca

SEQ ID NO: 159705 - DNA, 15 bp, Homo sapiens
ttgtagtcaattctc

SEQ ID NO: 159706 - DNA, 15 bp, Homo sapiens
tttgtagtcaattct

SEQ ID NO: 159707 - DNA, 15 bp, Homo sapiens
ctttgtagtcaattc

SEQ ID NO: 159708 - DNA, 15 bp, Homo sapiens
cctttgtagtcaatt

SEQ ID NO: 159709 - DNA, 15 bp, Homo sapiens
ccctttgtagtcaat

SEQ ID NO: 159710 - DNA, 15 bp, Homo sapiens
tccctttgtagtcaa

SEQ ID NO: 159711 - DNA, 15 bp, Homo sapiens
gtccctttgtagtca

SEQ ID NO: 159712 - DNA, 15 bp, Homo sapiens
tgtccctttgtagtc

SEQ ID NO: 159713 - DNA, 15 bp, Homo sapiens
atgtccctttgtagt

SEQ ID NO: 159714 - DNA, 15 bp, Homo sapiens
catgtccctttgtag

SEQ ID NO: 159715 - DNA, 15 bp, Homo sapiens
tcatgtccctttgta

SEQ ID NO: 159716 - DNA, 15 bp, Homo sapiens
ttcatgtccctttgt

SEQ ID NO: 159717 - DNA, 15 bp, Homo sapiens
tttcatgtccctttg

SEQ ID NO: 159718 - DNA, 15 bp, Homo sapiens
ctttcatgtcccttt

SEQ ID NO: 159719 - DNA, 15 bp, Homo sapiens
cctttcatgtccctt

SEQ ID NO: 159720 - DNA, 15 bp, Homo sapiens
tcctttcatgtccct

SEQ ID NO: 159721 - DNA, 15 bp, Homo sapiens
gtcctttcatgtccc

SEQ ID NO: 159722 - DNA, 15 bp, Homo sapiens
agtcctttcatgtcc

SEQ ID NO: 159723 - DNA, 15 bp, Homo sapiens
aagtcctttcatgtc

SEQ ID NO: 159724 - DNA, 15 bp, Homo sapiens
aaagtcctttcatgt

SEQ ID NO: 159725 - DNA, 15 bp, Homo sapiens
gaaagtcctttcatg

SEQ ID NO: 159726 - DNA, 15 bp, Homo sapiens
agaaagtcctttcat

SEQ ID NO: 159727 - DNA, 15 bp, Homo sapiens
tagaaagtcctttca

SEQ ID NO: 159728 - DNA, 15 bp, Homo sapiens
ctagaaagtcctttc

SEQ ID NO: 159729 - DNA, 15 bp, Homo sapiens
tctagaaagtccttt

SEQ ID NO: 159730 - DNA, 15 bp, Homo sapiens
ctctagaaagtcctt

SEQ ID NO: 159731 - DNA, 15 bp, Homo sapiens
actctagaaagtcct

SEQ ID NO: 159732 - DNA, 15 bp, Homo sapiens
cactctagaaagtcc

SEQ ID NO: 159733 - DNA, 15 bp, Homo sapiens
acactctagaaagtc

SEQ ID NO: 159734 - DNA, 15 bp, Homo sapiens
aacactctagaaagt

SEQ ID NO: 159735 - DNA, 15 bp, Homo sapiens
taacactctagaaag

SEQ ID NO: 159736 - DNA, 15 bp, Homo sapiens
ttaacactctagaaa

SEQ ID NO: 159737 - DNA, 15 bp, Homo sapiens
tttaacactctagaa

SEQ ID NO: 159738 - DNA, 15 bp, Homo sapiens
ttttaacactctaga

SEQ ID NO: 159739 - DNA, 15 bp, Homo sapiens
tttttaacactctag

SEQ ID NO: 159740 - DNA, 15 bp, Homo sapiens
atttttaacactcta

SEQ ID NO: 159741 - DNA, 15 bp, Homo sapiens
catttttaacactct

SEQ ID NO: 159742 - DNA, 15 bp, Homo sapiens
tcatttttaacactc

SEQ ID NO: 159743 - DNA, 15 bp, Homo sapiens
gtcatttttaacact

SEQ ID NO: 159744 - DNA, 15 bp, Homo sapiens
ggtcatttttaacac

SEQ ID NO: 159745 - DNA, 15 bp, Homo sapiens
aggtcatttttaaca

SEQ ID NO: 159746 - DNA, 15 bp, Homo sapiens
taggtcatttttaac

SEQ ID NO: 159747 - DNA, 15 bp, Homo sapiens
ataggtcatttttaa

SEQ ID NO: 159748 - DNA, 15 bp, Homo sapiens
tataggtcattttta

SEQ ID NO: 159749 - DNA, 15 bp, Homo sapiens
atataggtcattttt

SEQ ID NO: 159750 - DNA, 15 bp, Homo sapiens
catataggtcatttt

SEQ ID NO: 159751 - DNA, 15 bp, Homo sapiens
gcatataggtcattt

SEQ ID NO: 159752 - DNA, 15 bp, Homo sapiens
agcatataggtcatt

SEQ ID NO: 159753 - DNA, 15 bp, Homo sapiens
cagcatataggtcat

SEQ ID NO: 159754 - DNA, 15 bp, Homo sapiens
tcagcatataggtca

SEQ ID NO: 159755 - DNA, 15 bp, Homo sapiens
atcagcatataggtc

SEQ ID NO: 159756 - DNA, 15 bp, Homo sapiens
aatcagcatataggt

SEQ ID NO: 159757 - DNA, 15 bp, Homo sapiens
caatcagcatatagg

SEQ ID NO: 159758 - DNA, 15 bp, Homo sapiens
acaatcagcatatag

SEQ ID NO: 159759 - DNA, 15 bp, Homo sapiens
cacaatcagcatata

SEQ ID NO: 159760 - DNA, 15 bp, Homo sapiens
ccacaatcagcatat

SEQ ID NO: 159761 - DNA, 15 bp, Homo sapiens
accacaatcagcata

SEQ ID NO: 159762 - DNA, 15 bp, Homo sapiens
caccacaatcagcat

SEQ ID NO: 159763 - DNA, 15 bp, Homo sapiens
ccaccacaatcagca

SEQ ID NO: 159764 - DNA, 15 bp, Homo sapiens
accaccacaatcagc

SEQ ID NO: 159765 - DNA, 15 bp, Homo sapiens
caccaccacaatcag

SEQ ID NO: 159766 - DNA, 15 bp, Homo sapiens
ccaccaccacaatca

SEQ ID NO: 159767 - DNA, 15 bp, Homo sapiens
accaccaccacaatc

SEQ ID NO: 159768 - DNA, 15 bp, Homo sapiens
gaccaccaccacaat

SEQ ID NO: 159769 - DNA, 15 bp, Homo sapiens
ggaccaccaccacaa

SEQ ID NO: 159770 - DNA, 15 bp, Homo sapiens
gggaccaccaccaca

SEQ ID NO: 159771 - DNA, 15 bp, Homo sapiens
cgggaccaccaccac

SEQ ID NO: 159772 - DNA, 15 bp, Homo sapiens
gcgggaccaccacca

SEQ ID NO: 159773 - DNA, 15 bp, Homo sapiens
agcgggaccaccacc

SEQ ID NO: 159774 - DNA, 15 bp, Homo sapiens
tagcgggaccaccac

SEQ ID NO: 159775 - DNA, 15 bp, Homo sapiens
gtagcgggaccacca

SEQ ID NO: 159776 - DNA, 15 bp, Homo sapiens
agtagcgggaccacc

SEQ ID NO: 159777 - DNA, 15 bp, Homo sapiens
cagtagcgggaccac

SEQ ID NO: 159778 - DNA, 15 bp, Homo sapiens
acagtagcgggacca

SEQ ID NO: 159779 - DNA, 15 bp, Homo sapiens
tacagtagcgggacc

SEQ ID NO: 159780 - DNA, 15 bp, Homo sapiens
atacagtagcgggac

SEQ ID NO: 159781 - DNA, 15 bp, Homo sapiens
tatacagtagcggga

SEQ ID NO: 159782 - DNA, 15 bp, Homo sapiens
gtatacagtagcggg

SEQ ID NO: 159783 - DNA, 15 bp, Homo sapiens
tgtatacagtagcgg

SEQ ID NO: 159784 - DNA, 15 bp, Homo sapiens
atgtatacagtagcg

SEQ ID NO: 159785 - DNA, 15 bp, Homo sapiens
aatgtatacagtagc

SEQ ID NO: 159786 - DNA, 15 bp, Homo sapiens
aaatgtatacagtag

SEQ ID NO: 159787 - DNA, 15 bp, Homo sapiens
caaatgtatacagta

SEQ ID NO: 159788 - DNA, 15 bp, Homo sapiens
gcaaatgtatacagt

SEQ ID NO: 159789 - DNA, 15 bp, Homo sapiens
ggcaaatgtatacag

SEQ ID NO: 159790 - DNA, 15 bp, Homo sapiens
tggcaaatgtataca

SEQ ID NO: 159791 - DNA, 15 bp, Homo sapiens
gtggcaaatgtatac

SEQ ID NO: 159792 - DNA, 15 bp, Homo sapiens
cgtggcaaatgtata

SEQ ID NO: 159793 - DNA, 15 bp, Homo sapiens
tcgtggcaaatgtat

SEQ ID NO: 159794 - DNA, 15 bp, Homo sapiens
gtcgtggcaaatgta

SEQ ID NO: 159795 - DNA, 15 bp, Homo sapiens
agtcgtggcaaatgt

SEQ ID NO: 159796 - DNA, 15 bp, Homo sapiens
gagtcgtggcaaatg

SEQ ID NO: 159797 - DNA, 15 bp, Homo sapiens
tgagtcgtggcaaat

SEQ ID NO: 159798 - DNA, 15 bp, Homo sapiens
atgagtcgtggcaaa

SEQ ID NO: 159799 - DNA, 15 bp, Homo sapiens
gatgagtcgtggcaa

SEQ ID NO: 159800 - DNA, 15 bp, Homo sapiens
tgatgagtcgtggca

SEQ ID NO: 159801 - DNA, 15 bp, Homo sapiens
ctgatgagtcgtggc

SEQ ID NO: 159802 - DNA, 15 bp, Homo sapiens
tctgatgagtcgtgg

SEQ ID NO: 159803 - DNA, 15 bp, Homo sapiens
atctgatgagtcgtg

SEQ ID NO: 159804 - DNA, 15 bp, Homo sapiens
aatctgatgagtcgt

SEQ ID NO: 159805 - DNA, 15 bp, Homo sapiens
caatctgatgagtcg

SEQ ID NO: 159806 - DNA, 15 bp, Homo sapiens
acaatctgatgagtc

SEQ ID NO: 159807 - DNA, 15 bp, Homo sapiens
cacaatctgatgagt

SEQ ID NO: 159808 - DNA, 15 bp, Homo sapiens
acacaatctgatgag

SEQ ID NO: 159809 - DNA, 15 bp, Homo sapiens
tacacaatctgatga

SEQ ID NO: 159810 - DNA, 15 bp, Homo sapiens
gtacacaatctgatg

SEQ ID NO: 159811 - DNA, 15 bp, Homo sapiens
agtacacaatctgat

SEQ ID NO: 159812 - DNA, 15 bp, Homo sapiens
aagtacacaatctga

SEQ ID NO: 159813 - DNA, 15 bp, Homo sapiens
taagtacacaatctg

SEQ ID NO: 159814 - DNA, 15 bp, Homo sapiens
ttaagtacacaatct

SEQ ID NO: 159815 - DNA, 15 bp, Homo sapiens
tttaagtacacaatc

SEQ ID NO: 159816 - DNA, 15 bp, Homo sapiens
ttttaagtacacaat

SEQ ID NO: 159817 - DNA, 15 bp, Homo sapiens
attttaagtacacaa

SEQ ID NO: 159818 - DNA, 15 bp, Homo sapiens
aattttaagtacaca

SEQ ID NO: 159819 - DNA, 15 bp, Homo sapiens
aaattttaagtacac

SEQ ID NO: 159820 - DNA, 15 bp, Homo sapiens
aaaattttaagtaca

SEQ ID NO: 159821 - DNA, 15 bp, Homo sapiens
taaaattttaagtac

SEQ ID NO: 159822 - DNA, 15 bp, Homo sapiens
ataaaattttaagta

SEQ ID NO: 159823 - DNA, 15 bp, Homo sapiens
aataaaattttaagt

SEQ ID NO: 159824 - DNA, 15 bp, Homo sapiens
aaataaaattttaag

SEQ ID NO: 159825 - DNA, 15 bp, Homo sapiens
aaaataaaattttaa

SEQ ID NO: 159826 - DNA, 15 bp, Homo sapiens
taaaataaaatttta

SEQ ID NO: 159827 - DNA, 15 bp, Homo sapiens
ttaaaataaaatttt

SEQ ID NO: 159828 - DNA, 15 bp, Homo sapiens
tttaaaataaaattt

SEQ ID NO: 159829 - DNA, 15 bp, Homo sapiens
atttaaaataaaatt

SEQ ID NO: 159830 - DNA, 15 bp, Homo sapiens
aatttaaaataaaat

SEQ ID NO: 159831 - DNA, 15 bp, Homo sapiens
taatttaaaataaaa

SEQ ID NO: 159832 - DNA, 15 bp, Homo sapiens
ttaatttaaaataaa

SEQ ID NO: 159833 - DNA, 15 bp, Homo sapiens
attaatttaaaataa

SEQ ID NO: 159834 - DNA, 15 bp, Homo sapiens
aattaatttaaaata

SEQ ID NO: 159835 - DNA, 15 bp, Homo sapiens
taattaatttaaaat

SEQ ID NO: 159836 - DNA, 15 bp, Homo sapiens
ataattaatttaaaa

SEQ ID NO: 159837 - DNA, 15 bp, Homo sapiens
tataattaatttaaa

SEQ ID NO: 159838 - DNA, 15 bp, Homo sapiens
gtataattaatttaa

SEQ ID NO: 159839 - DNA, 15 bp, Homo sapiens
agtataattaattta

SEQ ID NO: 159840 - DNA, 15 bp, Homo sapiens
aagtataattaattt

SEQ ID NO: 159841 - DNA, 15 bp, Homo sapiens
gaagtataattaatt

SEQ ID NO: 159842 - DNA, 15 bp, Homo sapiens
tgaagtataattaat

SEQ ID NO: 159843 - DNA, 15 bp, Homo sapiens
ttgaagtataattaa

SEQ ID NO: 159844 - DNA, 15 bp, Homo sapiens
attgaagtataatta

SEQ ID NO: 159845 - DNA, 15 bp, Homo sapiens
tattgaagtataatt

SEQ ID NO: 159846 - DNA, 15 bp, Homo sapiens
ttattgaagtataat

SEQ ID NO: 159847 - DNA, 15 bp, Homo sapiens
tttattgaagtataa

SEQ ID NO: 159848 - DNA, 15 bp, Homo sapiens
ctttattgaagtata

SEQ ID NO: 159849 - DNA, 15 bp, Homo sapiens
gctttattgaagtat

SEQ ID NO: 159850 - DNA, 15 bp, Homo sapiens
agctttattgaagta

SEQ ID NO: 159851 - DNA, 15 bp, Homo sapiens
cagctttattgaagt

SEQ ID NO: 159852 - DNA, 15 bp, Homo sapiens
tcagctttattgaag

SEQ ID NO: 159853 - DNA, 15 bp, Homo sapiens
gtcagctttattgaa

SEQ ID NO: 159854 - DNA, 15 bp, Homo sapiens
tgtcagctttattga

SEQ ID NO: 159855 - DNA, 15 bp, Homo sapiens
ttgtcagctttattg

SEQ ID NO: 159856 - DNA, 15 bp, Homo sapiens
cttgtcagctttatt

SEQ ID NO: 159857 - DNA, 15 bp, Homo sapiens
tcttgtcagctttat

SEQ ID NO: 159858 - DNA, 15 bp, Homo sapiens
ttcttgtcagcttta

SEQ ID NO: 159859 - DNA, 15 bp, Homo sapiens
tttcttgtcagcttt

SEQ ID NO: 159860 - DNA, 15 bp, Homo sapiens
gtttcttgtcagctt

SEQ ID NO: 159861 - DNA, 15 bp, Homo sapiens
ggtttcttgtcagct

SEQ ID NO: 159862 - DNA, 15 bp, Homo sapiens
gggtttcttgtcagc

SEQ ID NO: 159863 - DNA, 15 bp, Homo sapiens
ggggtttcttgtcag

SEQ ID NO: 159864 - DNA, 15 bp, Homo sapiens
aggggtttcttgtca

SEQ ID NO: 159865 - DNA, 15 bp, Homo sapiens
gaggggtttcttgtc

SEQ ID NO: 159866 - DNA, 15 bp, Homo sapiens
ggaggggtttcttgt

SEQ ID NO: 159867 - DNA, 15 bp, Homo sapiens
gggaggggtttcttg

SEQ ID NO: 159868 - DNA, 15 bp, Homo sapiens
ggggaggggtttctt

SEQ ID NO: 159869 - DNA, 15 bp, Homo sapiens
tggggaggggtttct

SEQ ID NO: 159870 - DNA, 15 bp, Homo sapiens
ttggggaggggtttc

SEQ ID NO: 159871 - DNA, 15 bp, Homo sapiens
tttggggaggggttt

SEQ ID NO: 159872 - DNA, 15 bp, Homo sapiens
ctttggggaggggtt

SEQ ID NO: 159873 - DNA, 15 bp, Homo sapiens
tctttggggaggggt

SEQ ID NO: 159874 - DNA, 15 bp, Homo sapiens
ttctttggggagggg

SEQ ID NO: 159875 - DNA, 15 bp, Homo sapiens
tttctttggggaggg

SEQ ID NO: 159876 - DNA, 15 bp, Homo sapiens
ttttctttggggagg

SEQ ID NO: 159877 - DNA, 15 bp, Homo sapiens
gttttctttggggag

SEQ ID NO: 159878 - DNA, 15 bp, Homo sapiens
agttttctttgggga

SEQ ID NO: 159879 - DNA, 15 bp, Homo sapiens
cagttttctttgggg

SEQ ID NO: 159880 - DNA, 15 bp, Homo sapiens
tcagttttctttggg

SEQ ID NO: 159881 - DNA, 15 bp, Homo sapiens
ctcagttttctttgg

SEQ ID NO: 159882 - DNA, 15 bp, Homo sapiens
cctcagttttctttg

SEQ ID NO: 159883 - DNA, 15 bp, Homo sapiens
tcctcagttttcttt

SEQ ID NO: 159884 - DNA, 15 bp, Homo sapiens
ttcctcagttttctt

SEQ ID NO: 159885 - DNA, 15 bp, Homo sapiens
cttcctcagttttct

SEQ ID NO: 159886 - DNA, 15 bp, Homo sapiens
ccttcctcagttttc

SEQ ID NO: 159887 - DNA, 15 bp, Homo sapiens
tccttcctcagtttt

SEQ ID NO: 159888 - DNA, 15 bp, Homo sapiens
ttccttcctcagttt

SEQ ID NO: 159889 - DNA, 15 bp, Homo sapiens
gttccttcctcagtt

SEQ ID NO: 159890 - DNA, 15 bp, Homo sapiens
agttccttcctcagt

SEQ ID NO: 159891 - DNA, 15 bp, Homo sapiens
aagttccttcctcag

SEQ ID NO: 159892 - DNA, 15 bp, Homo sapiens
taagttccttcctca

SEQ ID NO: 159893 - DNA, 15 bp, Homo sapiens
ataagttccttcctc

SEQ ID NO: 159894 - DNA, 15 bp, Homo sapiens
tataagttccttcct

SEQ ID NO: 159895 - DNA, 15 bp, Homo sapiens
ttataagttccttcc

SEQ ID NO: 159896 - DNA, 15 bp, Homo sapiens
tttataagttccttc

SEQ ID NO: 159897 - DNA, 15 bp, Homo sapiens
ttttataagttcctt

SEQ ID NO: 159898 - DNA, 15 bp, Homo sapiens
tttttataagttcct

SEQ ID NO: 159899 - DNA, 15 bp, Homo sapiens
ttttttataagttcc

SEQ ID NO: 159900 - DNA, 15 bp, Homo sapiens
attttttataagttc

SEQ ID NO: 159901 - DNA, 15 bp, Homo sapiens
tattttttataagtt

SEQ ID NO: 159902 - DNA, 15 bp, Homo sapiens
ctattttttataagt

SEQ ID NO: 159903 - DNA, 15 bp, Homo sapiens
actattttttataag

SEQ ID NO: 159904 - DNA, 15 bp, Homo sapiens
cactattttttataa

SEQ ID NO: 159905 - DNA, 15 bp, Homo sapiens
tcactattttttata

SEQ ID NO: 159906 - DNA, 15 bp, Homo sapiens
atcactattttttat

SEQ ID NO: 159907 - DNA, 15 bp, Homo sapiens
tatcactatttttta

SEQ ID NO: 159908 - DNA, 15 bp, Homo sapiens
atatcactatttttt

SEQ ID NO: 159909 - DNA, 15 bp, Homo sapiens
catatcactattttt

SEQ ID NO: 159910 - DNA, 15 bp, Homo sapiens
tcatatcactatttt

SEQ ID NO: 159911 - DNA, 15 bp, Homo sapiens
atcatatcactattt

SEQ ID NO: 159912 - DNA, 15 bp, Homo sapiens
aatcatatcactatt

SEQ ID NO: 159913 - DNA, 15 bp, Homo sapiens
gaatcatatcactat

SEQ ID NO: 159914 - DNA, 15 bp, Homo sapiens
agaatcatatcacta

SEQ ID NO: 159915 - DNA, 15 bp, Homo sapiens
gagaatcatatcact

SEQ ID NO: 159916 - DNA, 15 bp, Homo sapiens
agagaatcatatcac

SEQ ID NO: 159917 - DNA, 15 bp, Homo sapiens
aagagaatcatatca

SEQ ID NO: 159918 - DNA, 15 bp, Homo sapiens
caagagaatcatatc

SEQ ID NO: 159919 - DNA, 15 bp, Homo sapiens
acaagagaatcatat

SEQ ID NO: 159920 - DNA, 15 bp, Homo sapiens
tacaagagaatcata

SEQ ID NO: 159921 - DNA, 15 bp, Homo sapiens
atacaagagaatcat

SEQ ID NO: 159922 - DNA, 15 bp, Homo sapiens
aatacaagagaatca

SEQ ID NO: 159923 - DNA, 15 bp, Homo sapiens
aaatacaagagaatc

SEQ ID NO: 159924 - DNA, 15 bp, Homo sapiens
aaaatacaagagaat

SEQ ID NO: 159925 - DNA, 15 bp, Homo sapiens
caaaatacaagagaa

SEQ ID NO: 159926 - DNA, 15 bp, Homo sapiens
acaaaatacaagaga

SEQ ID NO: 159927 - DNA, 15 bp, Homo sapiens
tacaaaatacaagag

SEQ ID NO: 159928 - DNA, 15 bp, Homo sapiens
ttacaaaatacaaga

SEQ ID NO: 159929 - DNA, 15 bp, Homo sapiens
tttacaaaatacaag

SEQ ID NO: 159930 - DNA, 15 bp, Homo sapiens
ttttacaaaatacaa

SEQ ID NO: 159931 - DNA, 15 bp, Homo sapiens
attttacaaaataca
